United States Patent 7,888,497 (BIOINFORMATICALLY DETECTABLE GROUP OF NOVEL REGULATORY OLIGONUCLEOTIDES AND USES THEREOF) - sequence listing, part 49

SEQ ID NO: 2053022 - DNA, 20 bp, Homo sapiens
cggtggctcaggcctataac

SEQ ID NO: 2053023 - DNA, 15 bp, Homo sapiens
cggtgggacagcccc

SEQ ID NO: 2053024 - DNA, 18 bp, Homo sapiens
cggtgggacagccccagg

SEQ ID NO: 2053025 - DNA, 14 bp, Homo sapiens
cggtggtgccagag

SEQ ID NO: 2053026 - DNA, 15 bp, Homo sapiens
cggttgcttcacctt

SEQ ID NO: 2053027 - DNA, 13 bp, Homo sapiens
cggtttctgagca

SEQ ID NO: 2053028 - DNA, 23 bp, Homo sapiens
cggtttggtttgttgtaaataaa

SEQ ID NO: 2053029 - DNA, 23 bp, Homo sapiens
cggttttcagctattagcaactg

SEQ ID NO: 2053030 - DNA, 20 bp, Homo sapiens
cgtaaatacacaacacacac

SEQ ID NO: 2053031 - DNA, 19 bp, Homo sapiens
cgtaagatggcttatttgt

SEQ ID NO: 2053032 - DNA, 19 bp, Homo sapiens
cgtaatgattatatgacaa

SEQ ID NO: 2053033 - DNA, 13 bp, Homo sapiens
cgtaatgcttaga

SEQ ID NO: 2053034 - DNA, 16 bp, Homo sapiens
cgtaattaaaagaatt

SEQ ID NO: 2053035 - DNA, 17 bp, Homo sapiens
cgtacccccgtggtctt

SEQ ID NO: 2053036 - DNA, 20 bp, Homo sapiens
cgtaggcagcctctctgcta

SEQ ID NO: 2053037 - DNA, 13 bp, Homo sapiens
cgtatcatttcta

SEQ ID NO: 2053038 - DNA, 23 bp, Homo sapiens
cgtatctttaaaaagcagtcctc

SEQ ID NO: 2053039 - DNA, 15 bp, Homo sapiens
cgtattggtccagct

SEQ ID NO: 2053040 - DNA, 12 bp, Homo sapiens
cgtattttaaaa

SEQ ID NO: 2053041 - DNA, 21 bp, Homo sapiens
cgtcaaaacagattgtttgca

SEQ ID NO: 2053042 - DNA, 17 bp, Homo sapiens
cgtcaacgtgcatttta

SEQ ID NO: 2053043 - DNA, 12 bp, Homo sapiens
cgtcacctcaga

SEQ ID NO: 2053044 - DNA, 22 bp, Homo sapiens
cgtcaggagagacgcagccctg

SEQ ID NO: 2053045 - DNA, 20 bp, Homo sapiens
cgtcatcggaggctgggccc

SEQ ID NO: 2053046 - DNA, 15 bp, Homo sapiens
cgtcatctgcggggc

SEQ ID NO: 2053047 - DNA, 15 bp, Homo sapiens
cgtcatgttcctcaa

SEQ ID NO: 2053048 - DNA, 22 bp, Homo sapiens
cgtccacaggggcaggcctggg

SEQ ID NO: 2053049 - DNA, 14 bp, Homo sapiens
cgtccacccaggct

SEQ ID NO: 2053050 - DNA, 15 bp, Homo sapiens
cgtccacccaggctg

SEQ ID NO: 2053051 - DNA, 19 bp, Homo sapiens
cgtccaggagcctgtgcct

SEQ ID NO: 2053052 - DNA, 16 bp, Homo sapiens
cgtccatggcaccagc

SEQ ID NO: 2053053 - DNA, 19 bp, Homo sapiens
cgtccatggcaccagcccc

SEQ ID NO: 2053054 - DNA, 16 bp, Homo sapiens
cgtcccccagaacctc

SEQ ID NO: 2053055 - DNA, 14 bp, Homo sapiens
cgtcccccagccct

SEQ ID NO: 2053056 - DNA, 19 bp, Homo sapiens
cgtcccccagccctcaggc

SEQ ID NO: 2053057 - DNA, 14 bp, Homo sapiens
cgtcccctgcctca

SEQ ID NO: 2053058 - DNA, 16 bp, Homo sapiens
cgtccctagcagtgaa

SEQ ID NO: 2053059 - DNA, 16 bp, Homo sapiens
cgtcctccccctgcca

SEQ ID NO: 2053060 - DNA, 12 bp, Homo sapiens
cgtcctgcagag

SEQ ID NO: 2053061 - DNA, 15 bp, Homo sapiens
cgtcctgcagaggac

SEQ ID NO: 2053062 - DNA, 21 bp, Homo sapiens
cgtcctgcagaggaccacagt

SEQ ID NO: 2053063 - DNA, 12 bp, Homo sapiens
cgtcctgctggc

SEQ ID NO: 2053064 - DNA, 12 bp, Homo sapiens
cgtcctgtccca

SEQ ID NO: 2053065 - DNA, 15 bp, Homo sapiens
cgtccttactcctgt

SEQ ID NO: 2053066 - DNA, 20 bp, Homo sapiens
cgtcgctggacaacccagaa

SEQ ID NO: 2053067 - DNA, 16 bp, Homo sapiens
cgtctatcaccaggat

SEQ ID NO: 2053068 - DNA, 20 bp, Homo sapiens
cgtctgacaggcaatgctgg

SEQ ID NO: 2053069 - DNA, 15 bp, Homo sapiens
cgtctgccaggccca

SEQ ID NO: 2053070 - DNA, 16 bp, Homo sapiens
cgtctgccaggcccat

SEQ ID NO: 2053071 - DNA, 15 bp, Homo sapiens
cgtctgcctggaaat

SEQ ID NO: 2053072 - DNA, 22 bp, Homo sapiens
cgtctgcctggaaattctggaa

SEQ ID NO: 2053073 - DNA, 23 bp, Homo sapiens
cgtctggggttcagcccctcctc

SEQ ID NO: 2053074 - DNA, 12 bp, Homo sapiens
cgtcttctctcc

SEQ ID NO: 2053075 - DNA, 22 bp, Homo sapiens
cgtcttgggtcgccctaccctc

SEQ ID NO: 2053076 - DNA, 13 bp, Homo sapiens
cgtctttggagga

SEQ ID NO: 2053077 - DNA, 21 bp, Homo sapiens
cgtctttggaggaacagctcc

SEQ ID NO: 2053078 - DNA, 17 bp, Homo sapiens
cgtgaaaccccgtctct

SEQ ID NO: 2053079 - DNA, 14 bp, Homo sapiens
cgtgaactgcgtgc

SEQ ID NO: 2053080 - DNA, 22 bp, Homo sapiens
cgtgaagcagtgcctcgaggca

SEQ ID NO: 2053081 - DNA, 22 bp, Homo sapiens
cgtgaatatcgagaactgccat

SEQ ID NO: 2053082 - DNA, 17 bp, Homo sapiens
cgtgaatgcttacctgt

SEQ ID NO: 2053083 - DNA, 14 bp, Homo sapiens
cgtgaatgtctcag

SEQ ID NO: 2053084 - DNA, 14 bp, Homo sapiens
cgtgacaacacttg

SEQ ID NO: 2053085 - DNA, 14 bp, Homo sapiens
cgtgacccttcagg

SEQ ID NO: 2053086 - DNA, 16 bp, Homo sapiens
cgtgacccttcagggc

SEQ ID NO: 2053087 - DNA, 19 bp, Homo sapiens
cgtgacccttcagggccag

SEQ ID NO: 2053088 - DNA, 16 bp, Homo sapiens
cgtgactcacccaagc

SEQ ID NO: 2053089 - DNA, 13 bp, Homo sapiens
cgtgactgcccca

SEQ ID NO: 2053090 - DNA, 17 bp, Homo sapiens
cgtgagagaatctgcct

SEQ ID NO: 2053091 - DNA, 20 bp, Homo sapiens
cgtgagccactgcaccgggc

SEQ ID NO: 2053092 - DNA, 21 bp, Homo sapiens
cgtgagccaggtaatgaggga

SEQ ID NO: 2053093 - DNA, 23 bp, Homo sapiens
cgtgatttggaagagaggcacct

SEQ ID NO: 2053094 - DNA, 15 bp, Homo sapiens
cgtgcaaggggctca

SEQ ID NO: 2053095 - DNA, 19 bp, Homo sapiens
cgtgcacacaccagagccc

SEQ ID NO: 2053096 - DNA, 22 bp, Homo sapiens
cgtgcacacaccagagcccacc

SEQ ID NO: 2053097 - DNA, 22 bp, Homo sapiens
cgtgcaccaccatgccaggcta

SEQ ID NO: 2053098 - DNA, 15 bp, Homo sapiens
cgtgcacctgtactc

SEQ ID NO: 2053099 - DNA, 21 bp, Homo sapiens
cgtgccaagtccaggtcctgg

SEQ ID NO: 2053100 - DNA, 16 bp, Homo sapiens
cgtgccagctctagtt

SEQ ID NO: 2053101 - DNA, 21 bp, Homo sapiens
cgtgccgggagaggactctgc

SEQ ID NO: 2053102 - DNA, 23 bp, Homo sapiens
cgtgcctttctctggctccagaa

SEQ ID NO: 2053103 - DNA, 17 bp, Homo sapiens
cgtgcgtgttagtgtgt

SEQ ID NO: 2053104 - DNA, 19 bp, Homo sapiens
cgtgcgtgttagtgtgtgt

SEQ ID NO: 2053105 - DNA, 14 bp, Homo sapiens
cgtgctaaattttc

SEQ ID NO: 2053106 - DNA, 18 bp, Homo sapiens
cgtgctcttctgttctca

SEQ ID NO: 2053107 - DNA, 18 bp, Homo sapiens
cgtgcttagcctcctgac

SEQ ID NO: 2053108 - DNA, 20 bp, Homo sapiens
cgtgcttagcctcctgacct

SEQ ID NO: 2053109 - DNA, 17 bp, Homo sapiens
cgtggacacctgccctg

SEQ ID NO: 2053110 - DNA, 14 bp, Homo sapiens
cgtggaccacccgc

SEQ ID NO: 2053111 - DNA, 15 bp, Homo sapiens
cgtggaccttcctgc

SEQ ID NO: 2053112 - DNA, 18 bp, Homo sapiens
cgtggagagctaggagca

SEQ ID NO: 2053113 - DNA, 18 bp, Homo sapiens
cgtggagcagaatcagta

SEQ ID NO: 2053114 - DNA, 14 bp, Homo sapiens
ctagatctcctgta

SEQ ID NO: 2053115 - DNA, 20 bp, Homo sapiens
ctagattctacatattcttt

SEQ ID NO: 2053116 - DNA, 24 bp, Homo sapiens
ctagattgagagaagagacaaaca

SEQ ID NO: 2053117 - DNA, 14 bp, Homo sapiens
ctagcaactgttgg

SEQ ID NO: 2053118 - DNA, 16 bp, Homo sapiens
ctagcacttggagcca

SEQ ID NO: 2053119 - DNA, 19 bp, Homo sapiens
ctagcagctgcagtcaaca

SEQ ID NO: 2053120 - DNA, 17 bp, Homo sapiens
ctagcaggcacaggaca

SEQ ID NO: 2053121 - DNA, 17 bp, Homo sapiens
ctagcagtgaactattt

SEQ ID NO: 2053122 - DNA, 16 bp, Homo sapiens
ctagcatctcatgagt

SEQ ID NO: 2053123 - DNA, 13 bp, Homo sapiens
ctagccacctccc

SEQ ID NO: 2053124 - DNA, 12 bp, Homo sapiens
ctagccaggagt

SEQ ID NO: 2053125 - DNA, 13 bp, Homo sapiens
ctagcccagtgct

SEQ ID NO: 2053126 - DNA, 13 bp, Homo sapiens
ctagccctctcac

SEQ ID NO: 2053127 - DNA, 19 bp, Homo sapiens
ctagccctctcacatttat

SEQ ID NO: 2053128 - DNA, 14 bp, Homo sapiens
ctagccgacctcag

SEQ ID NO: 2053129 - DNA, 19 bp, Homo sapiens
ctagccgacctcagccttc

SEQ ID NO: 2053130 - DNA, 20 bp, Homo sapiens
ctagccgacctcagccttcc

SEQ ID NO: 2053131 - DNA, 15 bp, Homo sapiens
ctagcctgggccaga

SEQ ID NO: 2053132 - DNA, 21 bp, Homo sapiens
ctagcctgtgattaacttgct

SEQ ID NO: 2053133 - DNA, 21 bp, Homo sapiens
ctagccttagaagtcacacag

SEQ ID NO: 2053134 - DNA, 22 bp, Homo sapiens
ctagccttagaagtcacacagt

SEQ ID NO: 2053135 - DNA, 23 bp, Homo sapiens
ctagccttagaagtcacacagta

SEQ ID NO: 2053136 - DNA, 12 bp, Homo sapiens
ctagcgctgccg

SEQ ID NO: 2053137 - DNA, 21 bp, Homo sapiens
ctagctagaaatatgatttta

SEQ ID NO: 2053138 - DNA, 19 bp, Homo sapiens
ctagctagaagtgggccag

SEQ ID NO: 2053139 - DNA, 13 bp, Homo sapiens
ctagctggcagga

SEQ ID NO: 2053140 - DNA, 23 bp, Homo sapiens
ctagctgggcaaacccttctctt

SEQ ID NO: 2053141 - DNA, 13 bp, Homo sapiens
ctagcttcatgcc

SEQ ID NO: 2053142 - DNA, 17 bp, Homo sapiens
ctagcttcatgcctcag

SEQ ID NO: 2053143 - DNA, 18 bp, Homo sapiens
ctagcttcatgcctcagt

SEQ ID NO: 2053144 - DNA, 12 bp, Homo sapiens
ctaggaaagcag

SEQ ID NO: 2053145 - DNA, 16 bp, Homo sapiens
ctaggaatgaaatcct

SEQ ID NO: 2053146 - DNA, 15 bp, Homo sapiens
ctaggaattcccagc

SEQ ID NO: 2053147 - DNA, 23 bp, Homo sapiens
ctaggacctcaggcggggaggag

SEQ ID NO: 2053148 - DNA, 12 bp, Homo sapiens
ctaggacctcat

SEQ ID NO: 2053149 - DNA, 13 bp, Homo sapiens
ctaggacctcata

SEQ ID NO: 2053150 - DNA, 12 bp, Homo sapiens
ctaggactctga

SEQ ID NO: 2053151 - DNA, 14 bp, Homo sapiens
ctaggactctgagg

SEQ ID NO: 2053152 - DNA, 18 bp, Homo sapiens
ctaggactgaggagtggg

SEQ ID NO: 2053153 - DNA, 16 bp, Homo sapiens
ctaggagaccaaggcg

SEQ ID NO: 2053154 - DNA, 20 bp, Homo sapiens
ctaggagagactgaaagcag

SEQ ID NO: 2053155 - DNA, 13 bp, Homo sapiens
ctaggagcaaagc

SEQ ID NO: 2053156 - DNA, 18 bp, Homo sapiens
ctaggagcaaagcctgtt

SEQ ID NO: 2053157 - DNA, 16 bp, Homo sapiens
ctaggagctgggagga

SEQ ID NO: 2053158 - DNA, 19 bp, Homo sapiens
ctaggagctgggaggaaaa

SEQ ID NO: 2053159 - DNA, 17 bp, Homo sapiens
ctaggagctgtctccag

SEQ ID NO: 2053160 - DNA, 16 bp, Homo sapiens
ctaggaggaaaaagaa

SEQ ID NO: 2053161 - DNA, 17 bp, Homo sapiens
ctaggaggaaaaagaaa

SEQ ID NO: 2053162 - DNA, 15 bp, Homo sapiens
ctaggaggccttctc

SEQ ID NO: 2053163 - DNA, 20 bp, Homo sapiens
ctaggaggttccggtgtctg

SEQ ID NO: 2053164 - DNA, 19 bp, Homo sapiens
ctaggagtcaactggctgg

SEQ ID NO: 2053165 - DNA, 23 bp, Homo sapiens
ctaggagttgagtacagtgagga

SEQ ID NO: 2053166 - DNA, 13 bp, Homo sapiens
ctaggatttcatg

SEQ ID NO: 2053167 - DNA, 14 bp, Homo sapiens
ctaggcatcccagg

SEQ ID NO: 2053168 - DNA, 19 bp, Homo sapiens
ctaggcatcccaggggacc

SEQ ID NO: 2053169 - DNA, 20 bp, Homo sapiens
ctaggccaaatgcacaagct

SEQ ID NO: 2053170 - DNA, 19 bp, Homo sapiens
ctaggccacaccatctcct

SEQ ID NO: 2053171 - DNA, 14 bp, Homo sapiens
ctaggccactcctc

SEQ ID NO: 2053172 - DNA, 15 bp, Homo sapiens
ctaggccactcctcc

SEQ ID NO: 2053173 - DNA, 13 bp, Homo sapiens
ctaggccccagag

SEQ ID NO: 2053174 - DNA, 15 bp, Homo sapiens
ctaggcctggccaga

SEQ ID NO: 2053175 - DNA, 17 bp, Homo sapiens
ctaggcgagtgccagga

SEQ ID NO: 2053176 - DNA, 16 bp, Homo sapiens
ctagggagtggtcttt

SEQ ID NO: 2053177 - DNA, 23 bp, Homo sapiens
ctaggggccgagggaaatgctgt

SEQ ID NO: 2053178 - DNA, 16 bp, Homo sapiens
ctaggggtcaggctcc

SEQ ID NO: 2053179 - DNA, 18 bp, Homo sapiens
ctaggggtcaggctccat

SEQ ID NO: 2053180 - DNA, 24 bp, Homo sapiens
ctaggtgacagagtgagactctgt

SEQ ID NO: 2053181 - DNA, 19 bp, Homo sapiens
ctagtaatgggccaattaa

SEQ ID NO: 2053182 - DNA, 22 bp, Homo sapiens
ctagtaatgggccaattaaaat

SEQ ID NO: 2053183 - DNA, 21 bp, Homo sapiens
ctagtaccctatagagagggg

SEQ ID NO: 2053184 - DNA, 19 bp, Homo sapiens
ctagtactctctgctctag

SEQ ID NO: 2053185 - DNA, 22 bp, Homo sapiens
ctagtacttgggagacctgtaa

SEQ ID NO: 2053186 - DNA, 18 bp, Homo sapiens
ctagtattgtccatatca

SEQ ID NO: 2053187 - DNA, 18 bp, Homo sapiens
ctagtcagagagagtgtt

SEQ ID NO: 2053188 - DNA, 20 bp, Homo sapiens
ctagtcatagaaatacctca

SEQ ID NO: 2053189 - DNA, 13 bp, Homo sapiens
ctagtcttgcttt

SEQ ID NO: 2053190 - DNA, 18 bp, Homo sapiens
ctagtcttgctttgctgt

SEQ ID NO: 2053191 - DNA, 19 bp, Homo sapiens
ctagtgaaagaggcagctt

SEQ ID NO: 2053192 - DNA, 13 bp, Homo sapiens
ctagtgaagatgt

SEQ ID NO: 2053193 - DNA, 17 bp, Homo sapiens
ctagtgacccacatgcc

SEQ ID NO: 2053194 - DNA, 18 bp, Homo sapiens
ctagtgacccacatgcca

SEQ ID NO: 2053195 - DNA, 19 bp, Homo sapiens
ctagtgacccacatgccat

SEQ ID NO: 2053196 - DNA, 14 bp, Homo sapiens
ctagtgacttcctg

SEQ ID NO: 2053197 - DNA, 14 bp, Homo sapiens
ctagtgatttcatt

SEQ ID NO: 2053198 - DNA, 19 bp, Homo sapiens
ctagtgccctccacagccg

SEQ ID NO: 2053199 - DNA, 23 bp, Homo sapiens
ctagtgccctccacagccgcagc

SEQ ID NO: 2053200 - DNA, 19 bp, Homo sapiens
ctagtgctattctgtgttg

SEQ ID NO: 2053201 - DNA, 16 bp, Homo sapiens
ctagtggcttcctccg

SEQ ID NO: 2053202 - DNA, 18 bp, Homo sapiens
ctagtggcttcctccgtc

SEQ ID NO: 2053203 - DNA, 19 bp, Homo sapiens
ctagtggggtctccctctc

SEQ ID NO: 2053204 - DNA, 20 bp, Homo sapiens
ctagtggggtctccctctcc

SEQ ID NO: 2053205 - DNA, 22 bp, Homo sapiens
ctagtggggtctccctctcctg

SEQ ID NO: 2053206 - DNA, 22 bp, Homo sapiens
ctagtgtaacactgcaagaagt

SEQ ID NO: 2053207 - DNA, 16 bp, Homo sapiens
ctagtgtgagtggcag

SEQ ID NO: 2053208 - DNA, 17 bp, Homo sapiens
ctagttagcaggaaata

SEQ ID NO: 2053209 - DNA, 20 bp, Homo sapiens
ctagttagctgctttaaatc

SEQ ID NO: 2053210 - DNA, 18 bp, Homo sapiens
ctagttctcaatcactgc

SEQ ID NO: 2053211 - DNA, 23 bp, Homo sapiens
ctagttctcaatcactgctcccc

SEQ ID NO: 2053212 - DNA, 21 bp, Homo sapiens
ctagtttcagtaaataatgaa

SEQ ID NO: 2053213 - DNA, 22 bp, Homo sapiens
ctagtttcagtaaataatgaaa

SEQ ID NO: 2053214 - DNA, 13 bp, Homo sapiens
ctagtttccagtg

SEQ ID NO: 2053215 - DNA, 17 bp, Homo sapiens
ctagtttctttctgtta

SEQ ID NO: 2053216 - DNA, 22 bp, Homo sapiens
ctagtttgacctcacagtgacc

SEQ ID NO: 2053217 - DNA, 16 bp, Homo sapiens
ctagttttctcctccc

SEQ ID NO: 2053218 - DNA, 19 bp, Homo sapiens
ctagttttctcctcccagg

SEQ ID NO: 2053219 - DNA, 12 bp, Homo sapiens
ctataaaatgcc

SEQ ID NO: 2053220 - DNA, 12 bp, Homo sapiens
ctataaacatta

SEQ ID NO: 2053221 - DNA, 15 bp, Homo sapiens
ctataaactactgta

SEQ ID NO: 2053222 - DNA, 23 bp, Homo sapiens
ctataaatggtgtttttttaata

SEQ ID NO: 2053223 - DNA, 18 bp, Homo sapiens
ctataaccccagctccct

SEQ ID NO: 2053224 - DNA, 23 bp, Homo sapiens
ctataactgtcatctagcccctt

SEQ ID NO: 2053225 - DNA, 22 bp, Homo sapiens
ctataagcaagaaggcaaaaat

SEQ ID NO: 2053226 - DNA, 17 bp, Homo sapiens
ctataatggaaacattt

SEQ ID NO: 2053227 - DNA, 15 bp, Homo sapiens
ctatacaactggaca

SEQ ID NO: 2053228 - DNA, 16 bp, Homo sapiens
ctcaggaggctgaggg

SEQ ID NO: 2053229 - DNA, 13 bp, Homo sapiens
ctcaggcaagccc

SEQ ID NO: 2053230 - DNA, 16 bp, Homo sapiens
ctcaggcaagcccctc

SEQ ID NO: 2053231 - DNA, 14 bp, Homo sapiens
ctcaggcagacaag

SEQ ID NO: 2053232 - DNA, 22 bp, Homo sapiens
ctcaggcagacaagagctgctg

SEQ ID NO: 2053233 - DNA, 20 bp, Homo sapiens
ctcaggcagaggatgttctg

SEQ ID NO: 2053234 - DNA, 19 bp, Homo sapiens
ctcaggccaacaagccaac

SEQ ID NO: 2053235 - DNA, 18 bp, Homo sapiens
ctcaggccaggtgcagtg

SEQ ID NO: 2053236 - DNA, 16 bp, Homo sapiens
ctcaggccagtgccag

SEQ ID NO: 2053237 - DNA, 20 bp, Homo sapiens
ctcaggccagtgccaggaca

SEQ ID NO: 2053238 - DNA, 20 bp, Homo sapiens
ctcaggcccccacctggctc

SEQ ID NO: 2053239 - DNA, 14 bp, Homo sapiens
ctcaggcccggcat

SEQ ID NO: 2053240 - DNA, 16 bp, Homo sapiens
ctcaggcggggaggag

SEQ ID NO: 2053241 - DNA, 13 bp, Homo sapiens
ctcaggctgagcc

SEQ ID NO: 2053242 - DNA, 14 bp, Homo sapiens
ctcaggctgagccc

SEQ ID NO: 2053243 - DNA, 16 bp, Homo sapiens
ctcaggctgagcccag

SEQ ID NO: 2053244 - DNA, 17 bp, Homo sapiens
ctcaggctgagcccagc

SEQ ID NO: 2053245 - DNA, 21 bp, Homo sapiens
ctcaggctgagcccagccacc

SEQ ID NO: 2053246 - DNA, 20 bp, Homo sapiens
ctcagggacagagacacctg

SEQ ID NO: 2053247 - DNA, 22 bp, Homo sapiens
ctcagggacagagacacctgca

SEQ ID NO: 2053248 - DNA, 18 bp, Homo sapiens
ctcagggccccagcacta

SEQ ID NO: 2053249 - DNA, 21 bp, Homo sapiens
ctcaggggcctcaggggagcc

SEQ ID NO: 2053250 - DNA, 14 bp, Homo sapiens
ctcaggggtggaga

SEQ ID NO: 2053251 - DNA, 17 bp, Homo sapiens
ctcaggtagtactggga

SEQ ID NO: 2053252 - DNA, 16 bp, Homo sapiens
ctcaggtgactggagc

SEQ ID NO: 2053253 - DNA, 18 bp, Homo sapiens
ctcaggtgatccacccac

SEQ ID NO: 2053254 - DNA, 17 bp, Homo sapiens
ctcaggtgccactccct

SEQ ID NO: 2053255 - DNA, 23 bp, Homo sapiens
ctcaggtgccactccctgagctt

SEQ ID NO: 2053256 - DNA, 15 bp, Homo sapiens
ctcaggtgtccctgc

SEQ ID NO: 2053257 - DNA, 18 bp, Homo sapiens
ctcaggtgtccctgcact

SEQ ID NO: 2053258 - DNA, 21 bp, Homo sapiens
ctcaggttcctaagacttcag

SEQ ID NO: 2053259 - DNA, 16 bp, Homo sapiens
ctcaggttctttccat

SEQ ID NO: 2053260 - DNA, 14 bp, Homo sapiens
ctcaggttgtctga

SEQ ID NO: 2053261 - DNA, 22 bp, Homo sapiens
ctcaggttgtctgaagtcactg

SEQ ID NO: 2053262 - DNA, 20 bp, Homo sapiens
ctcagtaagtatctggagga

SEQ ID NO: 2053263 - DNA, 21 bp, Homo sapiens
ctcagtaagtatctggaggaa

SEQ ID NO: 2053264 - DNA, 20 bp, Homo sapiens
ctcagtcagttcccggagca

SEQ ID NO: 2053265 - DNA, 14 bp, Homo sapiens
ctcagtccagatgc

SEQ ID NO: 2053266 - DNA, 15 bp, Homo sapiens
ctcagtccagatgcc

SEQ ID NO: 2053267 - DNA, 21 bp, Homo sapiens
ctcagtcccccaccacactga

SEQ ID NO: 2053268 - DNA, 13 bp, Homo sapiens
ctcagtcctggaa

SEQ ID NO: 2053269 - DNA, 15 bp, Homo sapiens
ctcagtctcaggagc

SEQ ID NO: 2053270 - DNA, 22 bp, Homo sapiens
ctcagtgatacgtacagccaaa

SEQ ID NO: 2053271 - DNA, 20 bp, Homo sapiens
ctcagtgctcggcagtcata

SEQ ID NO: 2053272 - DNA, 21 bp, Homo sapiens
ctcagtgctctcctaccccac

SEQ ID NO: 2053273 - DNA, 22 bp, Homo sapiens
ctcagtgggacaaaccagagca

SEQ ID NO: 2053274 - DNA, 20 bp, Homo sapiens
ctcagttaaaatgtctgttt

SEQ ID NO: 2053275 - DNA, 14 bp, Homo sapiens
ctcagtttccccat

SEQ ID NO: 2053276 - DNA, 13 bp, Homo sapiens
ctcagtttgtcag

SEQ ID NO: 2053277 - DNA, 17 bp, Homo sapiens
ctcagtttttcggtggg

SEQ ID NO: 2053278 - DNA, 20 bp, Homo sapiens
ctcagtttttcggtgggaca

SEQ ID NO: 2053279 - DNA, 22 bp, Homo sapiens
ctcataacatctttgaaaagaa

SEQ ID NO: 2053280 - DNA, 15 bp, Homo sapiens
ctcataccatctgct

SEQ ID NO: 2053281 - DNA, 20 bp, Homo sapiens
ctcatagtatggtggctggg

SEQ ID NO: 2053282 - DNA, 23 bp, Homo sapiens
ctcatagtatggtggctgggttg

SEQ ID NO: 2053283 - DNA, 19 bp, Homo sapiens
ctcatatatatctatctta

SEQ ID NO: 2053284 - DNA, 14 bp, Homo sapiens
ctcatatcttcctc

SEQ ID NO: 2053285 - DNA, 17 bp, Homo sapiens
ctcatatcttcctcatc

SEQ ID NO: 2053286 - DNA, 17 bp, Homo sapiens
ctcatatgtagccctca

SEQ ID NO: 2053287 - DNA, 15 bp, Homo sapiens
ctcatatttaaagac

SEQ ID NO: 2053288 - DNA, 13 bp, Homo sapiens
ctcatattttgta

SEQ ID NO: 2053289 - DNA, 15 bp, Homo sapiens
ctcatcaacaaagaa

SEQ ID NO: 2053290 - DNA, 18 bp, Homo sapiens
ctcatcaacaaagaaata

SEQ ID NO: 2053291 - DNA, 15 bp, Homo sapiens
ctcatcacccagtcc

SEQ ID NO: 2053292 - DNA, 16 bp, Homo sapiens
ctcatcacccagtcct

SEQ ID NO: 2053293 - DNA, 17 bp, Homo sapiens
ctcatcacccagtcctg

SEQ ID NO: 2053294 - DNA, 18 bp, Homo sapiens
ctcatcacccagtcctgg

SEQ ID NO: 2053295 - DNA, 15 bp, Homo sapiens
ctcatcataaaataa

SEQ ID NO: 2053296 - DNA, 13 bp, Homo sapiens
ctcatcatattgt

SEQ ID NO: 2053297 - DNA, 22 bp, Homo sapiens
ctcatcatattgtatgtaagta

SEQ ID NO: 2053298 - DNA, 22 bp, Homo sapiens
ctcatccagggtgttacaaggc

SEQ ID NO: 2053299 - DNA, 17 bp, Homo sapiens
ctcatccctcggaagcc

SEQ ID NO: 2053300 - DNA, 15 bp, Homo sapiens
ctcatccgaggcagg

SEQ ID NO: 2053301 - DNA, 12 bp, Homo sapiens
ctcatcctcctt

SEQ ID NO: 2053302 - DNA, 16 bp, Homo sapiens
ctcatcctccttcttc

SEQ ID NO: 2053303 - DNA, 18 bp, Homo sapiens
ctcatcctgtgtggggag

SEQ ID NO: 2053304 - DNA, 17 bp, Homo sapiens
ctcatcgccagacaact

SEQ ID NO: 2053305 - DNA, 11 bp, Homo sapiens
ctcatctcagt

SEQ ID NO: 2053306 - DNA, 12 bp, Homo sapiens
ctcatctgtcac

SEQ ID NO: 2053307 - DNA, 14 bp, Homo sapiens
ctcatctgtcacca

SEQ ID NO: 2053308 - DNA, 13 bp, Homo sapiens
ctcatgacagcca

SEQ ID NO: 2053309 - DNA, 21 bp, Homo sapiens
ctcatgagtctacctgagcat

SEQ ID NO: 2053310 - DNA, 12 bp, Homo sapiens
ctcatgccacac

SEQ ID NO: 2053311 - DNA, 15 bp, Homo sapiens
ctcatgcctgcctga

SEQ ID NO: 2053312 - DNA, 21 bp, Homo sapiens
ctcatggcgtaatgggcctgc

SEQ ID NO: 2053313 - DNA, 15 bp, Homo sapiens
ctcatgggtacccag

SEQ ID NO: 2053314 - DNA, 18 bp, Homo sapiens
ctcatgttgttcccacac

SEQ ID NO: 2053315 - DNA, 21 bp, Homo sapiens
ctcatgttgttcccacacaca

SEQ ID NO: 2053316 - DNA, 14 bp, Homo sapiens
ctcattacccaggt

SEQ ID NO: 2053317 - DNA, 12 bp, Homo sapiens
ctcattagactg

SEQ ID NO: 2053318 - DNA, 14 bp, Homo sapiens
ctcattagactgga

SEQ ID NO: 2053319 - DNA, 14 bp, Homo sapiens
ctcattcccctcgt

SEQ ID NO: 2053320 - DNA, 13 bp, Homo sapiens
ctcattcttctgt

SEQ ID NO: 2053321 - DNA, 14 bp, Homo sapiens
ctcattcttctgta

SEQ ID NO: 2053322 - DNA, 23 bp, Homo sapiens
ctcattcttctgtacgtctgaca

SEQ ID NO: 2053323 - DNA, 12 bp, Homo sapiens
ctcattgtagag

SEQ ID NO: 2053324 - DNA, 19 bp, Homo sapiens
ctcattgtctcagtgctgg

SEQ ID NO: 2053325 - DNA, 16 bp, Homo sapiens
ctcatttaagggaaaa

SEQ ID NO: 2053326 - DNA, 18 bp, Homo sapiens
ctcatttgtcacacactt

SEQ ID NO: 2053327 - DNA, 17 bp, Homo sapiens
ctcattttaggcctcct

SEQ ID NO: 2053328 - DNA, 22 bp, Homo sapiens
ctcatttttttttttgtttctg

SEQ ID NO: 2053329 - DNA, 23 bp, Homo sapiens
ctcatttttttttttgtttctga

SEQ ID NO: 2053330 - DNA, 15 bp, Homo sapiens
ctccaaactcctgcc

SEQ ID NO: 2053331 - DNA, 13 bp, Homo sapiens
ctccaaagaaatg

SEQ ID NO: 2053332 - DNA, 16 bp, Homo sapiens
ctccaaaggggctgct

SEQ ID NO: 2053333 - DNA, 20 bp, Homo sapiens
ctccaaaggggctgctgggg

SEQ ID NO: 2053334 - DNA, 23 bp, Homo sapiens
ctccaaatattattcaagtgcct

SEQ ID NO: 2053335 - DNA, 15 bp, Homo sapiens
ctccaaatgagatct

SEQ ID NO: 2053336 - DNA, 20 bp, Homo sapiens
ctccaacagcttgaccagac

SEQ ID NO: 2053337 - DNA, 17 bp, Homo sapiens
ctccaacgttaaaagac

SEQ ID NO: 2053338 - DNA, 18 bp, Homo sapiens
ctccaactggattataaa

SEQ ID NO: 2053339 - DNA, 13 bp, Homo sapiens
ctccaagcttcaa

SEQ ID NO: 2053340 - DNA, 12 bp, Homo sapiens
ctccaaggacca

SEQ ID NO: 2053341 - DNA, 14 bp, Homo sapiens
ctccaatcctttcc

SEQ ID NO: 2053342 - DNA, 15 bp, Homo sapiens
ctccaattccacagt

SEQ ID NO: 2053343 - DNA, 14 bp, Homo sapiens
ctccctggcatgtc

SEQ ID NO: 2053344 - DNA, 12 bp, Homo sapiens
ctccctggcctc

SEQ ID NO: 2053345 - DNA, 23 bp, Homo sapiens
ctccctggggatatgcaaccctt

SEQ ID NO: 2053346 - DNA, 20 bp, Homo sapiens
ctccctgtagctctgcctcc

SEQ ID NO: 2053347 - DNA, 22 bp, Homo sapiens
ctccctgtgggggtggccatcc

SEQ ID NO: 2053348 - DNA, 12 bp, Homo sapiens
ctcccttcaacc

SEQ ID NO: 2053349 - DNA, 18 bp, Homo sapiens
ctcccttcaaccattccc

SEQ ID NO: 2053350 - DNA, 19 bp, Homo sapiens
ctcccttcaaccattcccc

SEQ ID NO: 2053351 - DNA, 21 bp, Homo sapiens
ctcccttcaaccattccccat

SEQ ID NO: 2053352 - DNA, 14 bp, Homo sapiens
ctcccttcctggcc

SEQ ID NO: 2053353 - DNA, 14 bp, Homo sapiens
ctcccttcttccct

SEQ ID NO: 2053354 - DNA, 14 bp, Homo sapiens
ctccctttctggga

SEQ ID NO: 2053355 - DNA, 16 bp, Homo sapiens
ctccgactgctaggga

SEQ ID NO: 2053356 - DNA, 18 bp, Homo sapiens
ctccgcacttggaaaggt

SEQ ID NO: 2053357 - DNA, 13 bp, Homo sapiens
ctccgctaagacc

SEQ ID NO: 2053358 - DNA, 20 bp, Homo sapiens
ctccgctaagacctccccac

SEQ ID NO: 2053359 - DNA, 18 bp, Homo sapiens
ctccgctgggaggaacct

SEQ ID NO: 2053360 - DNA, 21 bp, Homo sapiens
ctccgctttctacccagcgag

SEQ ID NO: 2053361 - DNA, 22 bp, Homo sapiens
ctccgctttctacccagcgagc

SEQ ID NO: 2053362 - DNA, 22 bp, Homo sapiens
ctccggcctgatgacagagcga

SEQ ID NO: 2053363 - DNA, 23 bp, Homo sapiens
ctccgggaccattgacctcagct

SEQ ID NO: 2053364 - DNA, 17 bp, Homo sapiens
ctccggggtctgtgctg

SEQ ID NO: 2053365 - DNA, 18 bp, Homo sapiens
ctccggggtctgtgctgt

SEQ ID NO: 2053366 - DNA, 15 bp, Homo sapiens
ctccgggtgtggcct

SEQ ID NO: 2053367 - DNA, 17 bp, Homo sapiens
ctccgggtgtggcctca

SEQ ID NO: 2053368 - DNA, 19 bp, Homo sapiens
ctccgggtgtggcctcagc

SEQ ID NO: 2053369 - DNA, 20 bp, Homo sapiens
ctccggtaaaacaccggaga

SEQ ID NO: 2053370 - DNA, 22 bp, Homo sapiens
ctccgtcatctgcggggcttct

SEQ ID NO: 2053371 - DNA, 14 bp, Homo sapiens
ctccgtccacccag

SEQ ID NO: 2053372 - DNA, 15 bp, Homo sapiens
ctccgtccacccagg

SEQ ID NO: 2053373 - DNA, 16 bp, Homo sapiens
ctccgtccacccaggc

SEQ ID NO: 2053374 - DNA, 18 bp, Homo sapiens
ctccgtccacccaggctg

SEQ ID NO: 2053375 - DNA, 19 bp, Homo sapiens
ctccgtccaggagcctggc

SEQ ID NO: 2053376 - DNA, 13 bp, Homo sapiens
ctccgtggagcag

SEQ ID NO: 2053377 - DNA, 20 bp, Homo sapiens
ctcctaaacccccgctccag

SEQ ID NO: 2053378 - DNA, 17 bp, Homo sapiens
ctcctaagcagctggga

SEQ ID NO: 2053379 - DNA, 19 bp, Homo sapiens
ctcctaagcagctgggact

SEQ ID NO: 2053380 - DNA, 13 bp, Homo sapiens
ctcctacctcagc

SEQ ID NO: 2053381 - DNA, 18 bp, Homo sapiens
ctcctacctcagcctaga

SEQ ID NO: 2053382 - DNA, 16 bp, Homo sapiens
ctcctacctgctgctg

SEQ ID NO: 2053383 - DNA, 14 bp, Homo sapiens
ctcctactttacac

SEQ ID NO: 2053384 - DNA, 15 bp, Homo sapiens
ctcctactttacact

SEQ ID NO: 2053385 - DNA, 13 bp, Homo sapiens
ctcctagaggtgg

SEQ ID NO: 2053386 - DNA, 20 bp, Homo sapiens
ctcctagaggtgggcagctg

SEQ ID NO: 2053387 - DNA, 22 bp, Homo sapiens
ctcctagaggtgggcagctggg

SEQ ID NO: 2053388 - DNA, 22 bp, Homo sapiens
ctcctatcagaagtttctcagc

SEQ ID NO: 2053389 - DNA, 14 bp, Homo sapiens
ctcctatccttgga

SEQ ID NO: 2053390 - DNA, 15 bp, Homo sapiens
ctcctatcttctcca

SEQ ID NO: 2053391 - DNA, 22 bp, Homo sapiens
ctcctattctcttaatttttct

SEQ ID NO: 2053392 - DNA, 13 bp, Homo sapiens
ctcctattttaat

SEQ ID NO: 2053393 - DNA, 17 bp, Homo sapiens
ctcctcacccccagctt

SEQ ID NO: 2053394 - DNA, 21 bp, Homo sapiens
ctcctcacccccagctttgct

SEQ ID NO: 2053395 - DNA, 15 bp, Homo sapiens
ctcctcactgcccca

SEQ ID NO: 2053396 - DNA, 19 bp, Homo sapiens
ctcctcactgccccaccag

SEQ ID NO: 2053397 - DNA, 18 bp, Homo sapiens
ctcctccaaaggaagtct

SEQ ID NO: 2053398 - DNA, 16 bp, Homo sapiens
ctcctccacagtgctg

SEQ ID NO: 2053399 - DNA, 12 bp, Homo sapiens
ctcctccactca

SEQ ID NO: 2053400 - DNA, 16 bp, Homo sapiens
ctcctccactccacct

SEQ ID NO: 2053401 - DNA, 17 bp, Homo sapiens
ctcctccactccacctc

SEQ ID NO: 2053402 - DNA, 21 bp, Homo sapiens
ctcctccaggcacgtcccgga

SEQ ID NO: 2053403 - DNA, 14 bp, Homo sapiens
ctcctcccatggcc

SEQ ID NO: 2053404 - DNA, 16 bp, Homo sapiens
ctcctcccccaccttc

SEQ ID NO: 2053405 - DNA, 14 bp, Homo sapiens
ctcctccccttcct

SEQ ID NO: 2053406 - DNA, 14 bp, Homo sapiens
ctcctcccggtgcc

SEQ ID NO: 2053407 - DNA, 14 bp, Homo sapiens
ctcctccttgcctg

SEQ ID NO: 2053408 - DNA, 18 bp, Homo sapiens
ctcctcggccccctccat

SEQ ID NO: 2053409 - DNA, 20 bp, Homo sapiens
ctcctcggccccctccatcg

SEQ ID NO: 2053410 - DNA, 11 bp, Homo sapiens
ctcctctccag

SEQ ID NO: 2053411 - DNA, 12 bp, Homo sapiens
ctcctctccagg

SEQ ID NO: 2053412 - DNA, 15 bp, Homo sapiens
ctcctctccccagca

SEQ ID NO: 2053413 - DNA, 16 bp, Homo sapiens
ctcctctccttgggct

SEQ ID NO: 2053414 - DNA, 17 bp, Homo sapiens
ctcctctccttgggctc

SEQ ID NO: 2053415 - DNA, 15 bp, Homo sapiens
ctcctctctgccacc

SEQ ID NO: 2053416 - DNA, 14 bp, Homo sapiens
ctcctctgctgctc

SEQ ID NO: 2053417 - DNA, 13 bp, Homo sapiens
ctcctctgcttgc

SEQ ID NO: 2053418 - DNA, 12 bp, Homo sapiens
ctcctctgtcca

SEQ ID NO: 2053419 - DNA, 15 bp, Homo sapiens
ctcctctgtccaggg

SEQ ID NO: 2053420 - DNA, 18 bp, Homo sapiens
ctcctctgtccagggccc

SEQ ID NO: 2053421 - DNA, 13 bp, Homo sapiens
ctcctctgtctct

SEQ ID NO: 2053422 - DNA, 15 bp, Homo sapiens
ctcctctgtctctgc

SEQ ID NO: 2053423 - DNA, 18 bp, Homo sapiens
ctcctcttgccactgcct

SEQ ID NO: 2053424 - DNA, 19 bp, Homo sapiens
ctcctcttgccactgcctc

SEQ ID NO: 2053425 - DNA, 19 bp, Homo sapiens
ctcctgaagcctctgccct

SEQ ID NO: 2053426 - DNA, 16 bp, Homo sapiens
ctcctgacctgaggct

SEQ ID NO: 2053427 - DNA, 14 bp, Homo sapiens
ctcctgatggccaa

SEQ ID NO: 2053428 - DNA, 19 bp, Homo sapiens
ctcctgatggccaagagca

SEQ ID NO: 2053429 - DNA, 19 bp, Homo sapiens
ctcctgatttctctgaaca

SEQ ID NO: 2053430 - DNA, 15 bp, Homo sapiens
ctcctgattttgtag

SEQ ID NO: 2053431 - DNA, 16 bp, Homo sapiens
ctcctgccactgacct

SEQ ID NO: 2053432 - DNA, 18 bp, Homo sapiens
ctcctgccactgacctca

SEQ ID NO: 2053433 - DNA, 19 bp, Homo sapiens
ctcctgccactgacctcac

SEQ ID NO: 2053434 - DNA, 12 bp, Homo sapiens
ctcctgcccagg

SEQ ID NO: 2053435 - DNA, 17 bp, Homo sapiens
ctcctgcccaggagagc

SEQ ID NO: 2053436 - DNA, 20 bp, Homo sapiens
ctcctgcccaggagagccag

SEQ ID NO: 2053437 - DNA, 13 bp, Homo sapiens
ctcctgcctacat

SEQ ID NO: 2053438 - DNA, 19 bp, Homo sapiens
ctcctgcctacattccctg

SEQ ID NO: 2053439 - DNA, 21 bp, Homo sapiens
ctcctgcctacattccctggc

SEQ ID NO: 2053440 - DNA, 14 bp, Homo sapiens
ctcctgcctactca

SEQ ID NO: 2053441 - DNA, 12 bp, Homo sapiens
ctcctgcctcag

SEQ ID NO: 2053442 - DNA, 15 bp, Homo sapiens
ctcctgcctcagcct

SEQ ID NO: 2053443 - DNA, 22 bp, Homo sapiens
ctcctgcctcgaactggctgca

SEQ ID NO: 2053444 - DNA, 14 bp, Homo sapiens
ctcctgcctgtagc

SEQ ID NO: 2053445 - DNA, 15 bp, Homo sapiens
ctcctgcctgtagca

SEQ ID NO: 2053446 - DNA, 23 bp, Homo sapiens
ctcctgcgggagtagttggaaag

SEQ ID NO: 2053447 - DNA, 23 bp, Homo sapiens
ctcctgctgaaacacctcccagg

SEQ ID NO: 2053448 - DNA, 18 bp, Homo sapiens
ctcctgctgcctaataaa

SEQ ID NO: 2053449 - DNA, 11 bp, Homo sapiens
ctcctgctgtg

SEQ ID NO: 2053450 - DNA, 18 bp, Homo sapiens
ctcctggaaaggctcagt

SEQ ID NO: 2053451 - DNA, 19 bp, Homo sapiens
ctcctggagcatcccaggc

SEQ ID NO: 2053452 - DNA, 12 bp, Homo sapiens
ctcctggccaga

SEQ ID NO: 2053453 - DNA, 23 bp, Homo sapiens
ctcctggccagacgctgccgctg

SEQ ID NO: 2053454 - DNA, 18 bp, Homo sapiens
ctcctggctgccaggcgt

SEQ ID NO: 2053455 - DNA, 14 bp, Homo sapiens
ctcctggcttccca

SEQ ID NO: 2053456 - DNA, 23 bp, Homo sapiens
ctcctggcttcccatccccagcg

SEQ ID NO: 2053457 - DNA, 22 bp, Homo sapiens
ctcctgggaccatggacacatt

SEQ ID NO: 2053458 - DNA, 19 bp, Homo sapiens
ctctctgcagccagcccag

SEQ ID NO: 2053459 - DNA, 20 bp, Homo sapiens
ctctctgcctatttattggg

SEQ ID NO: 2053460 - DNA, 12 bp, Homo sapiens
ctctctgctcta

SEQ ID NO: 2053461 - DNA, 17 bp, Homo sapiens
ctctctggggccctggg

SEQ ID NO: 2053462 - DNA, 20 bp, Homo sapiens
ctctctggggccctgggcct

SEQ ID NO: 2053463 - DNA, 15 bp, Homo sapiens
ctctctgtataaaca

SEQ ID NO: 2053464 - DNA, 11 bp, Homo sapiens
ctctcttcagc

SEQ ID NO: 2053465 - DNA, 24 bp, Homo sapiens
ctctcttccagaagatgccctcca

SEQ ID NO: 2053466 - DNA, 13 bp, Homo sapiens
ctctcttgccttt

SEQ ID NO: 2053467 - DNA, 18 bp, Homo sapiens
ctctcttgctttgttctt

SEQ ID NO: 2053468 - DNA, 16 bp, Homo sapiens
ctctctttctccctca

SEQ ID NO: 2053469 - DNA, 17 bp, Homo sapiens
ctctgaaatttcccaca

SEQ ID NO: 2053470 - DNA, 21 bp, Homo sapiens
ctctgaacaaacactgaatca

SEQ ID NO: 2053471 - DNA, 18 bp, Homo sapiens
ctctgaataccaagtgtg

SEQ ID NO: 2053472 - DNA, 22 bp, Homo sapiens
ctctgaataccaagtgtgttgg

SEQ ID NO: 2053473 - DNA, 18 bp, Homo sapiens
ctctgaatattttgtaat

SEQ ID NO: 2053474 - DNA, 17 bp, Homo sapiens
ctctgacaagggctgac

SEQ ID NO: 2053475 - DNA, 19 bp, Homo sapiens
ctctgacacacagctctgt

SEQ ID NO: 2053476 - DNA, 16 bp, Homo sapiens
ctctgaccaacaggct

SEQ ID NO: 2053477 - DNA, 13 bp, Homo sapiens
ctctgacctgcag

SEQ ID NO: 2053478 - DNA, 15 bp, Homo sapiens
ctctgacctgcaggc

SEQ ID NO: 2053479 - DNA, 13 bp, Homo sapiens
ctctgagaacaga

SEQ ID NO: 2053480 - DNA, 18 bp, Homo sapiens
ctctgagaattccaagga

SEQ ID NO: 2053481 - DNA, 15 bp, Homo sapiens
ctctgagaggccctg

SEQ ID NO: 2053482 - DNA, 16 bp, Homo sapiens
ctctgagaggccctgg

SEQ ID NO: 2053483 - DNA, 13 bp, Homo sapiens
ctctgagatgtgt

SEQ ID NO: 2053484 - DNA, 12 bp, Homo sapiens
ctctgagcccag

SEQ ID NO: 2053485 - DNA, 13 bp, Homo sapiens
ctctgagcccagg

SEQ ID NO: 2053486 - DNA, 14 bp, Homo sapiens
ctctgagcccaggc

SEQ ID NO: 2053487 - DNA, 16 bp, Homo sapiens
ctctgagcccaggccg

SEQ ID NO: 2053488 - DNA, 12 bp, Homo sapiens
ctctgaggacac

SEQ ID NO: 2053489 - DNA, 10 bp, Homo sapiens
ctctgaggcg

SEQ ID NO: 2053490 - DNA, 12 bp, Homo sapiens
ctctgaggcgcc

SEQ ID NO: 2053491 - DNA, 21 bp, Homo sapiens
ctctgaggcgccccaacccgt

SEQ ID NO: 2053492 - DNA, 23 bp, Homo sapiens
ctctgaggcgccccaacccgtgg

SEQ ID NO: 2053493 - DNA, 19 bp, Homo sapiens
ctctgaggctctttctggg

SEQ ID NO: 2053494 - DNA, 15 bp, Homo sapiens
ctctgaggcttccag

SEQ ID NO: 2053495 - DNA, 16 bp, Homo sapiens
ctctgaggcttccaga

SEQ ID NO: 2053496 - DNA, 19 bp, Homo sapiens
ctctgaggcttccagagag

SEQ ID NO: 2053497 - DNA, 13 bp, Homo sapiens
ctctgatatggga

SEQ ID NO: 2053498 - DNA, 14 bp, Homo sapiens
ctctgatatgggac

SEQ ID NO: 2053499 - DNA, 15 bp, Homo sapiens
ctctgatatgggact

SEQ ID NO: 2053500 - DNA, 17 bp, Homo sapiens
ctctgatatgggactga

SEQ ID NO: 2053501 - DNA, 23 bp, Homo sapiens
ctctgatgagagagtgctgagaa

SEQ ID NO: 2053502 - DNA, 14 bp, Homo sapiens
ctctgattatcagg

SEQ ID NO: 2053503 - DNA, 20 bp, Homo sapiens
ctctgattatcaggtactgg

SEQ ID NO: 2053504 - DNA, 18 bp, Homo sapiens
ctctgcaatgggcactgg

SEQ ID NO: 2053505 - DNA, 23 bp, Homo sapiens
ctctgcaatgggcactgggatga

SEQ ID NO: 2053506 - DNA, 16 bp, Homo sapiens
ctctgcacatgtcttg

SEQ ID NO: 2053507 - DNA, 14 bp, Homo sapiens
ctctgcactccatg

SEQ ID NO: 2053508 - DNA, 17 bp, Homo sapiens
ctctgcactccatggcc

SEQ ID NO: 2053509 - DNA, 21 bp, Homo sapiens
ctctgcactccatggccaccc

SEQ ID NO: 2053510 - DNA, 22 bp, Homo sapiens
ctctgcactccatggccacccc

SEQ ID NO: 2053511 - DNA, 15 bp, Homo sapiens
ctctgcagccagccc

SEQ ID NO: 2053512 - DNA, 14 bp, Homo sapiens
ctctgcaggcacct

SEQ ID NO: 2053513 - DNA, 15 bp, Homo sapiens
ctctgcaggcacctt

SEQ ID NO: 2053514 - DNA, 13 bp, Homo sapiens
ctctgccacctcc

SEQ ID NO: 2053515 - DNA, 18 bp, Homo sapiens
ctctgccacctcccctat

SEQ ID NO: 2053516 - DNA, 16 bp, Homo sapiens
ctctgccatgcccaga

SEQ ID NO: 2053517 - DNA, 19 bp, Homo sapiens
ctctgccccaagcagccag

SEQ ID NO: 2053518 - DNA, 21 bp, Homo sapiens
ctctgccccaagcagccagcc

SEQ ID NO: 2053519 - DNA, 22 bp, Homo sapiens
ctctgccccaagcagccagcca

SEQ ID NO: 2053520 - DNA, 15 bp, Homo sapiens
ctctgccccaagccc

SEQ ID NO: 2053521 - DNA, 13 bp, Homo sapiens
ctctgccccaagg

SEQ ID NO: 2053522 - DNA, 19 bp, Homo sapiens
ctctgccccaaggggccca

SEQ ID NO: 2053523 - DNA, 15 bp, Homo sapiens
ctctgccccagaggc

SEQ ID NO: 2053524 - DNA, 12 bp, Homo sapiens
ctctgccccagc

SEQ ID NO: 2053525 - DNA, 13 bp, Homo sapiens
ctctgccccagct

SEQ ID NO: 2053526 - DNA, 17 bp, Homo sapiens
ctctgccccagctctgg

SEQ ID NO: 2053527 - DNA, 21 bp, Homo sapiens
ctctgccccagctctggcttc

SEQ ID NO: 2053528 - DNA, 20 bp, Homo sapiens
ctctgcccccagcctctgtc

SEQ ID NO: 2053529 - DNA, 21 bp, Homo sapiens
ctctgccccttgggcatccac

SEQ ID NO: 2053530 - DNA, 15 bp, Homo sapiens
ctctgccctccctgg

SEQ ID NO: 2053531 - DNA, 19 bp, Homo sapiens
ctctgccctccctggcctc

SEQ ID NO: 2053532 - DNA, 17 bp, Homo sapiens
ctctgcctatttattgg

SEQ ID NO: 2053533 - DNA, 19 bp, Homo sapiens
ctctgcctatttattgggg

SEQ ID NO: 2053534 - DNA, 14 bp, Homo sapiens
ctctgcctccctct

SEQ ID NO: 2053535 - DNA, 16 bp, Homo sapiens
ctctgcctcctcttca

SEQ ID NO: 2053536 - DNA, 10 bp, Homo sapiens
ctctgcctga

SEQ ID NO: 2053537 - DNA, 21 bp, Homo sapiens
ctctgcctgaagtcacacagt

SEQ ID NO: 2053538 - DNA, 23 bp, Homo sapiens
ctctgcctggaggatccctccat

SEQ ID NO: 2053539 - DNA, 19 bp, Homo sapiens
ctctgcgtcccccagccct

SEQ ID NO: 2053540 - DNA, 23 bp, Homo sapiens
ctctgctatatgccttaagccaa

SEQ ID NO: 2053541 - DNA, 21 bp, Homo sapiens
ctctgctcctctccccagcaa

SEQ ID NO: 2053542 - DNA, 12 bp, Homo sapiens
ctctgctctagc

SEQ ID NO: 2053543 - DNA, 19 bp, Homo sapiens
ctctgctctagccaggagt

SEQ ID NO: 2053544 - DNA, 23 bp, Homo sapiens
ctctgctctagccaggagtctgt

SEQ ID NO: 2053545 - DNA, 14 bp, Homo sapiens
ctctgctcttgcct

SEQ ID NO: 2053546 - DNA, 16 bp, Homo sapiens
ctctgctcttgcctgc

SEQ ID NO: 2053547 - DNA, 14 bp, Homo sapiens
ctctgctgaaggtt

SEQ ID NO: 2053548 - DNA, 20 bp, Homo sapiens
ctctgctgacagacacaggc

SEQ ID NO: 2053549 - DNA, 22 bp, Homo sapiens
ctctgctgacagacacaggccc

SEQ ID NO: 2053550 - DNA, 15 bp, Homo sapiens
ctctgctgccatggc

SEQ ID NO: 2053551 - DNA, 22 bp, Homo sapiens
ctctgcttactaatgtgcccca

SEQ ID NO: 2053552 - DNA, 19 bp, Homo sapiens
ctctggaaaatgtgaccca

SEQ ID NO: 2053553 - DNA, 16 bp, Homo sapiens
ctctggaagcccccca

SEQ ID NO: 2053554 - DNA, 17 bp, Homo sapiens
ctctggaagccccccac

SEQ ID NO: 2053555 - DNA, 19 bp, Homo sapiens
ctctggaagccccccacct

SEQ ID NO: 2053556 - DNA, 15 bp, Homo sapiens
ctctggaagcctgga

SEQ ID NO: 2053557 - DNA, 14 bp, Homo sapiens
ctctggacaggcat

SEQ ID NO: 2053558 - DNA, 22 bp, Homo sapiens
ctctggacaggcatgttctctg

SEQ ID NO: 2053559 - DNA, 14 bp, Homo sapiens
ctctggaccagcct

SEQ ID NO: 2053560 - DNA, 23 bp, Homo sapiens
ctctggacctcaggttcctaaga

SEQ ID NO: 2053561 - DNA, 21 bp, Homo sapiens
ctctggatcctgctgtggcct

SEQ ID NO: 2053562 - DNA, 20 bp, Homo sapiens
ctctggatggcaccagaggc

SEQ ID NO: 2053563 - DNA, 13 bp, Homo sapiens
ctctggcacccag

SEQ ID NO: 2053564 - DNA, 21 bp, Homo sapiens
ctctggcactccagaacaaac

SEQ ID NO: 2053565 - DNA, 14 bp, Homo sapiens
ctctggcagccaca

SEQ ID NO: 2053566 - DNA, 15 bp, Homo sapiens
ctctggcagccacac

SEQ ID NO: 2053567 - DNA, 16 bp, Homo sapiens
ctctggcagccacact

SEQ ID NO: 2053568 - DNA, 17 bp, Homo sapiens
ctctggcagccacactt

SEQ ID NO: 2053569 - DNA, 22 bp, Homo sapiens
ctctggcagccacacttctcag

SEQ ID NO: 2053570 - DNA, 16 bp, Homo sapiens
ctctggccaggcatgg

SEQ ID NO: 2053571 - DNA, 16 bp, Homo sapiens
ctctggccttttccta

SEQ ID NO: 2053572 - DNA, 15 bp, Homo sapiens
ctctggcggcttcct

SEQ ID NO: 2053573 - DNA, 18 bp, Homo sapiens
ctgaccctccgctgcaga

SEQ ID NO: 2053574 - DNA, 14 bp, Homo sapiens
ctgaccctggagcg

SEQ ID NO: 2053575 - DNA, 20 bp, Homo sapiens
ctgaccctggagcggctctc

SEQ ID NO: 2053576 - DNA, 21 bp, Homo sapiens
ctgacctcaccggcatgctgg

SEQ ID NO: 2053577 - DNA, 12 bp, Homo sapiens
ctgacctcccag

SEQ ID NO: 2053578 - DNA, 23 bp, Homo sapiens
ctgacctcccagccctatggatg

SEQ ID NO: 2053579 - DNA, 21 bp, Homo sapiens
ctgacctccctctaatttatc

SEQ ID NO: 2053580 - DNA, 13 bp, Homo sapiens
ctgacctgaggct

SEQ ID NO: 2053581 - DNA, 19 bp, Homo sapiens
ctgacctgatcacctctgg

SEQ ID NO: 2053582 - DNA, 20 bp, Homo sapiens
ctgacctgatcacctctggc

SEQ ID NO: 2053583 - DNA, 21 bp, Homo sapiens
ctgacctgatcacctctggct

SEQ ID NO: 2053584 - DNA, 22 bp, Homo sapiens
ctgacctgatcacctctggctt

SEQ ID NO: 2053585 - DNA, 18 bp, Homo sapiens
ctgacctttgtcatcttt

SEQ ID NO: 2053586 - DNA, 14 bp, Homo sapiens
ctgacgccctgcgt

SEQ ID NO: 2053587 - DNA, 21 bp, Homo sapiens
ctgacgccctgcgttggagcc

SEQ ID NO: 2053588 - DNA, 16 bp, Homo sapiens
ctgacggaagccaact

SEQ ID NO: 2053589 - DNA, 16 bp, Homo sapiens
ctgactcacaagaaga

SEQ ID NO: 2053590 - DNA, 15 bp, Homo sapiens
ctgactccctgtggg

SEQ ID NO: 2053591 - DNA, 19 bp, Homo sapiens
ctgactcctctaagccact

SEQ ID NO: 2053592 - DNA, 15 bp, Homo sapiens
ctgactccttagaga

SEQ ID NO: 2053593 - DNA, 13 bp, Homo sapiens
ctgactctctgtg

SEQ ID NO: 2053594 - DNA, 16 bp, Homo sapiens
ctgactctctgtgacc

SEQ ID NO: 2053595 - DNA, 18 bp, Homo sapiens
ctgactctctgtgacctg

SEQ ID NO: 2053596 - DNA, 14 bp, Homo sapiens
ctgactcttgcctt

SEQ ID NO: 2053597 - DNA, 19 bp, Homo sapiens
ctgactgacacaggccagc

SEQ ID NO: 2053598 - DNA, 21 bp, Homo sapiens
ctgactgacacaggccagccc

SEQ ID NO: 2053599 - DNA, 22 bp, Homo sapiens
ctgactgacacaggccagcccc

SEQ ID NO: 2053600 - DNA, 16 bp, Homo sapiens
ctgacttctaagtaaa

SEQ ID NO: 2053601 - DNA, 13 bp, Homo sapiens
ctgacttgcagag

SEQ ID NO: 2053602 - DNA, 20 bp, Homo sapiens
ctgacttggggagatggagt

SEQ ID NO: 2053603 - DNA, 21 bp, Homo sapiens
ctgactttgttgccttatctt

SEQ ID NO: 2053604 - DNA, 21 bp, Homo sapiens
ctgagaaaagctttgaaccct

SEQ ID NO: 2053605 - DNA, 19 bp, Homo sapiens
ctgagaaacccaccagcct

SEQ ID NO: 2053606 - DNA, 19 bp, Homo sapiens
ctgagaaagactattcaaa

SEQ ID NO: 2053607 - DNA, 12 bp, Homo sapiens
ctgagaacctgg

SEQ ID NO: 2053608 - DNA, 13 bp, Homo sapiens
ctgagaacctggc

SEQ ID NO: 2053609 - DNA, 18 bp, Homo sapiens
ctgagaacctggccttca

SEQ ID NO: 2053610 - DNA, 19 bp, Homo sapiens
ctgagaacctggccttcag

SEQ ID NO: 2053611 - DNA, 20 bp, Homo sapiens
ctgagaacctggccttcagt

SEQ ID NO: 2053612 - DNA, 15 bp, Homo sapiens
ctgagaagaagctga

SEQ ID NO: 2053613 - DNA, 19 bp, Homo sapiens
ctgagaagaagctgaggat

SEQ ID NO: 2053614 - DNA, 21 bp, Homo sapiens
ctgagaaggcgaggagagtgg

SEQ ID NO: 2053615 - DNA, 23 bp, Homo sapiens
ctgagaaggtttggtccagcctg

SEQ ID NO: 2053616 - DNA, 22 bp, Homo sapiens
ctgagaccatttaacatgcaac

SEQ ID NO: 2053617 - DNA, 20 bp, Homo sapiens
ctgagacctgacaagcactg

SEQ ID NO: 2053618 - DNA, 14 bp, Homo sapiens
ctgagacggcagag

SEQ ID NO: 2053619 - DNA, 13 bp, Homo sapiens
ctgagactccaga

SEQ ID NO: 2053620 - DNA, 17 bp, Homo sapiens
ctgagactctcttagga

SEQ ID NO: 2053621 - DNA, 16 bp, Homo sapiens
ctgagactgctaagta

SEQ ID NO: 2053622 - DNA, 17 bp, Homo sapiens
ctgagagacccaaggag

SEQ ID NO: 2053623 - DNA, 14 bp, Homo sapiens
ctgagagcagatgg

SEQ ID NO: 2053624 - DNA, 16 bp, Homo sapiens
ctgagagccctgctgt

SEQ ID NO: 2053625 - DNA, 19 bp, Homo sapiens
ctgagagccctgctgtggg

SEQ ID NO: 2053626 - DNA, 21 bp, Homo sapiens
ctgagagccctgctgtgggag

SEQ ID NO: 2053627 - DNA, 14 bp, Homo sapiens
ctgagagctcacag

SEQ ID NO: 2053628 - DNA, 15 bp, Homo sapiens
ctgagaggaagatga

SEQ ID NO: 2053629 - DNA, 19 bp, Homo sapiens
ctgagaggaagatgaagag

SEQ ID NO: 2053630 - DNA, 20 bp, Homo sapiens
ctgagaggaagatgaagaga

SEQ ID NO: 2053631 - DNA, 19 bp, Homo sapiens
ctgagagtctgaaagacag

SEQ ID NO: 2053632 - DNA, 22 bp, Homo sapiens
ctgagagttggctcaggcagac

SEQ ID NO: 2053633 - DNA, 19 bp, Homo sapiens
ctgagatctccctccaggg

SEQ ID NO: 2053634 - DNA, 20 bp, Homo sapiens
ctgagatgtgaacacatcag

SEQ ID NO: 2053635 - DNA, 15 bp, Homo sapiens
ctgagattgcgccac

SEQ ID NO: 2053636 - DNA, 23 bp, Homo sapiens
ctgagcaacagagtgagaccctg

SEQ ID NO: 2053637 - DNA, 15 bp, Homo sapiens
ctgagcaagagctgg

SEQ ID NO: 2053638 - DNA, 15 bp, Homo sapiens
ctgagcaagatcttg

SEQ ID NO: 2053639 - DNA, 21 bp, Homo sapiens
ctgagcaagatcttgtctcca

SEQ ID NO: 2053640 - DNA, 18 bp, Homo sapiens
ctgagcaccccctcattc

SEQ ID NO: 2053641 - DNA, 15 bp, Homo sapiens
ctgagcaccctctcc

SEQ ID NO: 2053642 - DNA, 13 bp, Homo sapiens
ctgagcacctgct

SEQ ID NO: 2053643 - DNA, 14 bp, Homo sapiens
ctgagcactgccag

SEQ ID NO: 2053644 - DNA, 18 bp, Homo sapiens
ctgagcactgccaggagg

SEQ ID NO: 2053645 - DNA, 19 bp, Homo sapiens
ctgagcactgccaggaggg

SEQ ID NO: 2053646 - DNA, 16 bp, Homo sapiens
ctgagcaggattttaa

SEQ ID NO: 2053647 - DNA, 20 bp, Homo sapiens
ctgagcaggcccgacagaga

SEQ ID NO: 2053648 - DNA, 22 bp, Homo sapiens
ctgagcaggcccgacagagaga

SEQ ID NO: 2053649 - DNA, 12 bp, Homo sapiens
ctgagcagggcc

SEQ ID NO: 2053650 - DNA, 16 bp, Homo sapiens
ctgagcagggccgggg

SEQ ID NO: 2053651 - DNA, 15 bp, Homo sapiens
ctgagcattcaggca

SEQ ID NO: 2053652 - DNA, 16 bp, Homo sapiens
ctgagcattcaggcag

SEQ ID NO: 2053653 - DNA, 22 bp, Homo sapiens
ctgagcattcaggcagcactga

SEQ ID NO: 2053654 - DNA, 21 bp, Homo sapiens
ctgagccaaacacactgtaaa

SEQ ID NO: 2053655 - DNA, 19 bp, Homo sapiens
ctgagcccagccacctccc

SEQ ID NO: 2053656 - DNA, 13 bp, Homo sapiens
ctgagcccaggag

SEQ ID NO: 2053657 - DNA, 12 bp, Homo sapiens
ctgagcccaggg

SEQ ID NO: 2053658 - DNA, 14 bp, Homo sapiens
ctgagcccagggag

SEQ ID NO: 2053659 - DNA, 16 bp, Homo sapiens
ctgagcccagggaggc

SEQ ID NO: 2053660 - DNA, 14 bp, Homo sapiens
ctgagccctggcag

SEQ ID NO: 2053661 - DNA, 16 bp, Homo sapiens
ctgagcctagctacct

SEQ ID NO: 2053662 - DNA, 14 bp, Homo sapiens
ctgagcctcttttc

SEQ ID NO: 2053663 - DNA, 22 bp, Homo sapiens
ctgagcctcttttcaattattt

SEQ ID NO: 2053664 - DNA, 19 bp, Homo sapiens
ctgagcctgacctttctga

SEQ ID NO: 2053665 - DNA, 14 bp, Homo sapiens
ctgagcctgccgag

SEQ ID NO: 2053666 - DNA, 15 bp, Homo sapiens
ctgagcctgccgagc

SEQ ID NO: 2053667 - DNA, 15 bp, Homo sapiens
ctgagccttgtaatt

SEQ ID NO: 2053668 - DNA, 21 bp, Homo sapiens
ctgagccttgtaattctaaat

SEQ ID NO: 2053669 - DNA, 16 bp, Homo sapiens
ctgagccttttcttat

SEQ ID NO: 2053670 - DNA, 14 bp, Homo sapiens
ctgagctcacaagg

SEQ ID NO: 2053671 - DNA, 12 bp, Homo sapiens
ctgagctcaggc

SEQ ID NO: 2053672 - DNA, 16 bp, Homo sapiens
ctgagctcaggctgag

SEQ ID NO: 2053673 - DNA, 17 bp, Homo sapiens
ctgagctcaggctgagc

SEQ ID NO: 2053674 - DNA, 20 bp, Homo sapiens
ctgagctcggtggacccagg

SEQ ID NO: 2053675 - DNA, 12 bp, Homo sapiens
ctgagctggccc

SEQ ID NO: 2053676 - DNA, 14 bp, Homo sapiens
ctgagctgggcacc

SEQ ID NO: 2053677 - DNA, 12 bp, Homo sapiens
ctgagctgggct

SEQ ID NO: 2053678 - DNA, 16 bp, Homo sapiens
ctgagctggggcctgg

SEQ ID NO: 2053679 - DNA, 22 bp, Homo sapiens
ctgagcttagccttgtgccctg

SEQ ID NO: 2053680 - DNA, 16 bp, Homo sapiens
ctgagcttctctgtga

SEQ ID NO: 2053681 - DNA, 17 bp, Homo sapiens
ctgagcttggccctatt

SEQ ID NO: 2053682 - DNA, 17 bp, Homo sapiens
ctgagctttggggacag

SEQ ID NO: 2053683 - DNA, 18 bp, Homo sapiens
ctgagcttttcatggaag

SEQ ID NO: 2053684 - DNA, 19 bp, Homo sapiens
ctgagcttttcatggaagt

SEQ ID NO: 2053685 - DNA, 20 bp, Homo sapiens
ctgaggacactaaccacgct

SEQ ID NO: 2053686 - DNA, 23 bp, Homo sapiens
ctgaggacatggagagagactca

SEQ ID NO: 2053687 - DNA, 20 bp, Homo sapiens
ctgaggactccctccatgtg

SEQ ID NO: 2053688 - DNA, 16 bp, Homo sapiens
ctgccctccctggcct

SEQ ID NO: 2053689 - DNA, 22 bp, Homo sapiens
ctgccctctctcagttattcag

SEQ ID NO: 2053690 - DNA, 15 bp, Homo sapiens
ctgccctgccacctg

SEQ ID NO: 2053691 - DNA, 18 bp, Homo sapiens
ctgccctgccacctgtct

SEQ ID NO: 2053692 - DNA, 20 bp, Homo sapiens
ctgccctgccacctgtctgt

SEQ ID NO: 2053693 - DNA, 16 bp, Homo sapiens
ctgccctgccactttg

SEQ ID NO: 2053694 - DNA, 11 bp, Homo sapiens
ctgccctgccc

SEQ ID NO: 2053695 - DNA, 14 bp, Homo sapiens
ctgccctgccctgc

SEQ ID NO: 2053696 - DNA, 15 bp, Homo sapiens
ctgccctgcctccct

SEQ ID NO: 2053697 - DNA, 21 bp, Homo sapiens
ctgccctgcctccctttctgg

SEQ ID NO: 2053698 - DNA, 14 bp, Homo sapiens
ctgccctgcctgcc

SEQ ID NO: 2053699 - DNA, 16 bp, Homo sapiens
ctgccctggagggagg

SEQ ID NO: 2053700 - DNA, 14 bp, Homo sapiens
ctgccctggtgctg

SEQ ID NO: 2053701 - DNA, 16 bp, Homo sapiens
ctgccctggtgctgcc

SEQ ID NO: 2053702 - DNA, 21 bp, Homo sapiens
ctgccctggtgctgccacact

SEQ ID NO: 2053703 - DNA, 21 bp, Homo sapiens
ctgccctgttgtgtatagatg

SEQ ID NO: 2053704 - DNA, 17 bp, Homo sapiens
ctgcccttcgctgccag

SEQ ID NO: 2053705 - DNA, 18 bp, Homo sapiens
ctgcccttcgctgccagg

SEQ ID NO: 2053706 - DNA, 19 bp, Homo sapiens
ctgcccttcgctgccagga

SEQ ID NO: 2053707 - DNA, 22 bp, Homo sapiens
ctgcccttcgctgccaggacac

SEQ ID NO: 2053708 - DNA, 20 bp, Homo sapiens
ctgcccttgtttggggcagg

SEQ ID NO: 2053709 - DNA, 15 bp, Homo sapiens
ctgccgacctcgtcc

SEQ ID NO: 2053710 - DNA, 19 bp, Homo sapiens
ctgccgacctcgtcctccc

SEQ ID NO: 2053711 - DNA, 14 bp, Homo sapiens
ctgccgagcaaccg

SEQ ID NO: 2053712 - DNA, 17 bp, Homo sapiens
ctgccgcaacagttttt

SEQ ID NO: 2053713 - DNA, 15 bp, Homo sapiens
ctgccgcaaggccct

SEQ ID NO: 2053714 - DNA, 17 bp, Homo sapiens
ctgccgcaaggccctgt

SEQ ID NO: 2053715 - DNA, 21 bp, Homo sapiens
ctgccgcaaggccctgtccca

SEQ ID NO: 2053716 - DNA, 14 bp, Homo sapiens
ctgccgcaccccag

SEQ ID NO: 2053717 - DNA, 15 bp, Homo sapiens
ctgccgcaccccaga

SEQ ID NO: 2053718 - DNA, 16 bp, Homo sapiens
ctgccgcaccccagag

SEQ ID NO: 2053719 - DNA, 14 bp, Homo sapiens
ctgccgctgcacca

SEQ ID NO: 2053720 - DNA, 20 bp, Homo sapiens
ctgccgggttctagtctcct

SEQ ID NO: 2053721 - DNA, 21 bp, Homo sapiens
ctgccgggttctagtctcctt

SEQ ID NO: 2053722 - DNA, 14 bp, Homo sapiens
ctgcctaagtggct

SEQ ID NO: 2053723 - DNA, 15 bp, Homo sapiens
ctgcctaagtggctg

SEQ ID NO: 2053724 - DNA, 16 bp, Homo sapiens
ctgcctaagtggctgc

SEQ ID NO: 2053725 - DNA, 20 bp, Homo sapiens
ctgcctaagtggctgctgac

SEQ ID NO: 2053726 - DNA, 19 bp, Homo sapiens
ctgcctacattccctggcc

SEQ ID NO: 2053727 - DNA, 22 bp, Homo sapiens
ctgcctacattccctggcctgg

SEQ ID NO: 2053728 - DNA, 15 bp, Homo sapiens
ctgcctatccatcct

SEQ ID NO: 2053729 - DNA, 17 bp, Homo sapiens
ctgcctatccatcctgc

SEQ ID NO: 2053730 - DNA, 18 bp, Homo sapiens
ctgcctatccatcctgcg

SEQ ID NO: 2053731 - DNA, 15 bp, Homo sapiens
ctgcctcagcctccc

SEQ ID NO: 2053732 - DNA, 14 bp, Homo sapiens
ctgcctcagctgct

SEQ ID NO: 2053733 - DNA, 22 bp, Homo sapiens
ctgcctcagctgctcgcacaga

SEQ ID NO: 2053734 - DNA, 21 bp, Homo sapiens
ctgcctcatgaccctcctgtc

SEQ ID NO: 2053735 - DNA, 23 bp, Homo sapiens
ctgcctcatgaccctcctgtcca

SEQ ID NO: 2053736 - DNA, 22 bp, Homo sapiens
ctgcctccagaatggtctttct

SEQ ID NO: 2053737 - DNA, 18 bp, Homo sapiens
ctgcctccattctgacca

SEQ ID NO: 2053738 - DNA, 21 bp, Homo sapiens
ctgcctcccagccctgccagg

SEQ ID NO: 2053739 - DNA, 22 bp, Homo sapiens
ctgcctcccagccctgccagga

SEQ ID NO: 2053740 - DNA, 12 bp, Homo sapiens
ctgcctccctag

SEQ ID NO: 2053741 - DNA, 23 bp, Homo sapiens
ctgcctccctctccatatctcct

SEQ ID NO: 2053742 - DNA, 14 bp, Homo sapiens
ctgcctcgaactgg

SEQ ID NO: 2053743 - DNA, 15 bp, Homo sapiens
ctgcctcgaactggc

SEQ ID NO: 2053744 - DNA, 18 bp, Homo sapiens
ctgcctcgaactggctgc

SEQ ID NO: 2053745 - DNA, 15 bp, Homo sapiens
ctgcctctactggga

SEQ ID NO: 2053746 - DNA, 18 bp, Homo sapiens
ctgcctctactgggaagg

SEQ ID NO: 2053747 - DNA, 21 bp, Homo sapiens
ctgcctctcacacacatagat

SEQ ID NO: 2053748 - DNA, 20 bp, Homo sapiens
ctgcctctctgctccagaga

SEQ ID NO: 2053749 - DNA, 22 bp, Homo sapiens
ctgcctctctgctccagagaga

SEQ ID NO: 2053750 - DNA, 17 bp, Homo sapiens
ctgcctctgacacacag

SEQ ID NO: 2053751 - DNA, 21 bp, Homo sapiens
ctgcctctgacacacagctct

SEQ ID NO: 2053752 - DNA, 12 bp, Homo sapiens
ctgcctcttcct

SEQ ID NO: 2053753 - DNA, 13 bp, Homo sapiens
ctgcctgagccca

SEQ ID NO: 2053754 - DNA, 14 bp, Homo sapiens
ctgcctgagcccag

SEQ ID NO: 2053755 - DNA, 17 bp, Homo sapiens
ctgcctgataccctgct

SEQ ID NO: 2053756 - DNA, 18 bp, Homo sapiens
ctgcctgataccctgctt

SEQ ID NO: 2053757 - DNA, 21 bp, Homo sapiens
ctgcctgcagtactttacctc

SEQ ID NO: 2053758 - DNA, 16 bp, Homo sapiens
ctgcctgcccaggccc

SEQ ID NO: 2053759 - DNA, 22 bp, Homo sapiens
ctgcctgcccaggcccctgcca

SEQ ID NO: 2053760 - DNA, 13 bp, Homo sapiens
ctgcctgcttggg

SEQ ID NO: 2053761 - DNA, 22 bp, Homo sapiens
ctgcctggaaattctggaactg

SEQ ID NO: 2053762 - DNA, 12 bp, Homo sapiens
ctgcctggagga

SEQ ID NO: 2053763 - DNA, 19 bp, Homo sapiens
ctgcctggaggacctgagc

SEQ ID NO: 2053764 - DNA, 23 bp, Homo sapiens
ctgcctggaggacctgagcctgc

SEQ ID NO: 2053765 - DNA, 22 bp, Homo sapiens
ctgcctggaggatccctccatc

SEQ ID NO: 2053766 - DNA, 12 bp, Homo sapiens
ctgcctggcctg

SEQ ID NO: 2053767 - DNA, 19 bp, Homo sapiens
ctgcctgggcctgtgcagc

SEQ ID NO: 2053768 - DNA, 21 bp, Homo sapiens
ctgcctgggcctgtgcagcag

SEQ ID NO: 2053769 - DNA, 22 bp, Homo sapiens
ctgcctgggcctgtgcagcagc

SEQ ID NO: 2053770 - DNA, 19 bp, Homo sapiens
ctgcctgtagttaggaaat

SEQ ID NO: 2053771 - DNA, 18 bp, Homo sapiens
ctgcctgtgcatgacctg

SEQ ID NO: 2053772 - DNA, 19 bp, Homo sapiens
ctgcctgtgcatgacctga

SEQ ID NO: 2053773 - DNA, 13 bp, Homo sapiens
ctgcctgtggcct

SEQ ID NO: 2053774 - DNA, 24 bp, Homo sapiens
ctgccttcttcggggaactcctgg

SEQ ID NO: 2053775 - DNA, 17 bp, Homo sapiens
ctgccttgatgaagccc

SEQ ID NO: 2053776 - DNA, 19 bp, Homo sapiens
ctgccttgatgaagcctgt

SEQ ID NO: 2053777 - DNA, 22 bp, Homo sapiens
ctgccttgatgaagcctgtgcc

SEQ ID NO: 2053778 - DNA, 13 bp, Homo sapiens
ctgccttgccatg

SEQ ID NO: 2053779 - DNA, 20 bp, Homo sapiens
ctgcctttgaaattccccca

SEQ ID NO: 2053780 - DNA, 13 bp, Homo sapiens
ctgcctttggaag

SEQ ID NO: 2053781 - DNA, 18 bp, Homo sapiens
ctgcctttggaagaaaca

SEQ ID NO: 2053782 - DNA, 21 bp, Homo sapiens
ctgccttttttaacactagaa

SEQ ID NO: 2053783 - DNA, 21 bp, Homo sapiens
ctgccttttttcacagcccgg

SEQ ID NO: 2053784 - DNA, 18 bp, Homo sapiens
ctgcgaaggggccctggt

SEQ ID NO: 2053785 - DNA, 16 bp, Homo sapiens
ctgcgagcatttccct

SEQ ID NO: 2053786 - DNA, 17 bp, Homo sapiens
ctgcgagcatttccctc

SEQ ID NO: 2053787 - DNA, 20 bp, Homo sapiens
ctgcgagcatttccctcccg

SEQ ID NO: 2053788 - DNA, 21 bp, Homo sapiens
ctgcgagcatttccctcccgg

SEQ ID NO: 2053789 - DNA, 14 bp, Homo sapiens
ctgcgatcttcaga

SEQ ID NO: 2053790 - DNA, 20 bp, Homo sapiens
ctgcggaatgaaccacatct

SEQ ID NO: 2053791 - DNA, 18 bp, Homo sapiens
ctgcggagaccctgagtc

SEQ ID NO: 2053792 - DNA, 15 bp, Homo sapiens
ctgcggccgggctgc

SEQ ID NO: 2053793 - DNA, 15 bp, Homo sapiens
ctgcggggcttctgg

SEQ ID NO: 2053794 - DNA, 15 bp, Homo sapiens
ctgcgggtctgaagg

SEQ ID NO: 2053795 - DNA, 16 bp, Homo sapiens
ctgcggtccacccagg

SEQ ID NO: 2053796 - DNA, 20 bp, Homo sapiens
ctgcgtcagaccagtactgg

SEQ ID NO: 2053797 - DNA, 21 bp, Homo sapiens
ctgcgtcagaccagtactggg

SEQ ID NO: 2053798 - DNA, 14 bp, Homo sapiens
ctgcgtcccccagc

SEQ ID NO: 2053799 - DNA, 19 bp, Homo sapiens
ctgcgtcccccagccctca

SEQ ID NO: 2053800 - DNA, 22 bp, Homo sapiens
ctgcgtcccccagccctcaggc

SEQ ID NO: 2053801 - DNA, 19 bp, Homo sapiens
ctgcgtcgaactgtcctgg

SEQ ID NO: 2053802 - DNA, 20 bp, Homo sapiens
ctggaggactagaacctgga

SEQ ID NO: 2053803 - DNA, 21 bp, Homo sapiens
ctggaggactagaacctggag

SEQ ID NO: 2053804 - DNA, 19 bp, Homo sapiens
ctggaggatccctccatcc

SEQ ID NO: 2053805 - DNA, 14 bp, Homo sapiens
ctggaggcagacag

SEQ ID NO: 2053806 - DNA, 12 bp, Homo sapiens
ctggaggcaggg

SEQ ID NO: 2053807 - DNA, 15 bp, Homo sapiens
ctggaggcagggcct

SEQ ID NO: 2053808 - DNA, 22 bp, Homo sapiens
ctggagggaatgaacctggagg

SEQ ID NO: 2053809 - DNA, 22 bp, Homo sapiens
ctggagggctagaacctggcag

SEQ ID NO: 2053810 - DNA, 19 bp, Homo sapiens
ctggagggctggaatctgg

SEQ ID NO: 2053811 - DNA, 20 bp, Homo sapiens
ctggagggctggaatctgga

SEQ ID NO: 2053812 - DNA, 21 bp, Homo sapiens
ctggaggggctagaacctaga

SEQ ID NO: 2053813 - DNA, 20 bp, Homo sapiens
ctggagggtgagaggaaggg

SEQ ID NO: 2053814 - DNA, 19 bp, Homo sapiens
ctggaggtcacattcagga

SEQ ID NO: 2053815 - DNA, 12 bp, Homo sapiens
ctggagtgcagg

SEQ ID NO: 2053816 - DNA, 16 bp, Homo sapiens
ctggagtgcagggagg

SEQ ID NO: 2053817 - DNA, 15 bp, Homo sapiens
ctggagtgcagtgag

SEQ ID NO: 2053818 - DNA, 14 bp, Homo sapiens
ctggagtgcagtgg

SEQ ID NO: 2053819 - DNA, 13 bp, Homo sapiens
ctggagtgcagtt

SEQ ID NO: 2053820 - DNA, 17 bp, Homo sapiens
ctggagtgcgctcttgg

SEQ ID NO: 2053821 - DNA, 16 bp, Homo sapiens
ctggagttacattaat

SEQ ID NO: 2053822 - DNA, 18 bp, Homo sapiens
ctggatacagaatgaatc

SEQ ID NO: 2053823 - DNA, 20 bp, Homo sapiens
ctggatatgttgttaaacac

SEQ ID NO: 2053824 - DNA, 15 bp, Homo sapiens
ctggatcagaacagg

SEQ ID NO: 2053825 - DNA, 18 bp, Homo sapiens
ctggatcagcgtggcctt

SEQ ID NO: 2053826 - DNA, 19 bp, Homo sapiens
ctggatcctgctgtggcct

SEQ ID NO: 2053827 - DNA, 20 bp, Homo sapiens
ctggatctgggaccctttcc

SEQ ID NO: 2053828 - DNA, 13 bp, Homo sapiens
ctggatgaagatt

SEQ ID NO: 2053829 - DNA, 21 bp, Homo sapiens
ctggatggaggaaaaccaagc

SEQ ID NO: 2053830 - DNA, 15 bp, Homo sapiens
ctggatgggcattgg

SEQ ID NO: 2053831 - DNA, 21 bp, Homo sapiens
ctggatgtcccctgtcccacc

SEQ ID NO: 2053832 - DNA, 22 bp, Homo sapiens
ctggatgtcccctgtcccacca

SEQ ID NO: 2053833 - DNA, 19 bp, Homo sapiens
ctggatgtgcccacaggga

SEQ ID NO: 2053834 - DNA, 19 bp, Homo sapiens
ctggattaatgttttgtac

SEQ ID NO: 2053835 - DNA, 22 bp, Homo sapiens
ctggatttttacaaataaagat

SEQ ID NO: 2053836 - DNA, 18 bp, Homo sapiens
ctggcaaaggtggctctc

SEQ ID NO: 2053837 - DNA, 16 bp, Homo sapiens
ctggcaagcagggaaa

SEQ ID NO: 2053838 - DNA, 21 bp, Homo sapiens
ctggcacacagtaggtgctca

SEQ ID NO: 2053839 - DNA, 17 bp, Homo sapiens
ctggcacagggcagtgg

SEQ ID NO: 2053840 - DNA, 16 bp, Homo sapiens
ctggcacccggcccct

SEQ ID NO: 2053841 - DNA, 21 bp, Homo sapiens
ctggcacttggagacttgtat

SEQ ID NO: 2053842 - DNA, 13 bp, Homo sapiens
ctggcagagaagg

SEQ ID NO: 2053843 - DNA, 16 bp, Homo sapiens
ctggcagagaaggctt

SEQ ID NO: 2053844 - DNA, 17 bp, Homo sapiens
ctggcagccgtgccttc

SEQ ID NO: 2053845 - DNA, 18 bp, Homo sapiens
ctggcagccgtgccttca

SEQ ID NO: 2053846 - DNA, 20 bp, Homo sapiens
ctggcagccgtgccttcagc

SEQ ID NO: 2053847 - DNA, 21 bp, Homo sapiens
ctggcagccgtgccttcagct

SEQ ID NO: 2053848 - DNA, 12 bp, Homo sapiens
ctggcagctgag

SEQ ID NO: 2053849 - DNA, 23 bp, Homo sapiens
ctggcaggacacatcccggcctc

SEQ ID NO: 2053850 - DNA, 20 bp, Homo sapiens
ctggcaggatgaccctgcga

SEQ ID NO: 2053851 - DNA, 12 bp, Homo sapiens
ctggcaggtgca

SEQ ID NO: 2053852 - DNA, 14 bp, Homo sapiens
ctggcaggtgcaga

SEQ ID NO: 2053853 - DNA, 23 bp, Homo sapiens
ctggcaggtgcagatgggctgtt

SEQ ID NO: 2053854 - DNA, 22 bp, Homo sapiens
ctggcagtttatatttaactct

SEQ ID NO: 2053855 - DNA, 17 bp, Homo sapiens
ctggcatgacactctag

SEQ ID NO: 2053856 - DNA, 14 bp, Homo sapiens
ctggcatgtcagag

SEQ ID NO: 2053857 - DNA, 17 bp, Homo sapiens
ctggcatgtcagagcca

SEQ ID NO: 2053858 - DNA, 16 bp, Homo sapiens
ctggcattaattatta

SEQ ID NO: 2053859 - DNA, 17 bp, Homo sapiens
ctggcattaattattaa

SEQ ID NO: 2053860 - DNA, 16 bp, Homo sapiens
ctggcattacagctgg

SEQ ID NO: 2053861 - DNA, 20 bp, Homo sapiens
ctggcattggtctgctgacc

SEQ ID NO: 2053862 - DNA, 22 bp, Homo sapiens
ctggccaagctgaggtgcccag

SEQ ID NO: 2053863 - DNA, 13 bp, Homo sapiens
ctggccagacgct

SEQ ID NO: 2053864 - DNA, 14 bp, Homo sapiens
ctggccagagaggg

SEQ ID NO: 2053865 - DNA, 20 bp, Homo sapiens
ctggccagagagggcccagc

SEQ ID NO: 2053866 - DNA, 16 bp, Homo sapiens
ctggccagatgcacca

SEQ ID NO: 2053867 - DNA, 19 bp, Homo sapiens
ctggccagatgcaccagcc

SEQ ID NO: 2053868 - DNA, 20 bp, Homo sapiens
ctggccagatgcaccagccc

SEQ ID NO: 2053869 - DNA, 21 bp, Homo sapiens
ctggccagatgcaccagccct

SEQ ID NO: 2053870 - DNA, 14 bp, Homo sapiens
ctggccagcaccct

SEQ ID NO: 2053871 - DNA, 16 bp, Homo sapiens
ctggccagcaccctct

SEQ ID NO: 2053872 - DNA, 21 bp, Homo sapiens
ctggccagcaccctctcctgg

SEQ ID NO: 2053873 - DNA, 23 bp, Homo sapiens
ctggccagcaccctctcctgggg

SEQ ID NO: 2053874 - DNA, 15 bp, Homo sapiens
ctggccaggggtcct

SEQ ID NO: 2053875 - DNA, 18 bp, Homo sapiens
ctggccagtcctagagct

SEQ ID NO: 2053876 - DNA, 13 bp, Homo sapiens
ctggccatcccca

SEQ ID NO: 2053877 - DNA, 16 bp, Homo sapiens
ctggcccagggtaggg

SEQ ID NO: 2053878 - DNA, 19 bp, Homo sapiens
ctggccccatgtctctcag

SEQ ID NO: 2053879 - DNA, 17 bp, Homo sapiens
ctggcccccctccaggc

SEQ ID NO: 2053880 - DNA, 20 bp, Homo sapiens
ctggccccgggctctggcca

SEQ ID NO: 2053881 - DNA, 19 bp, Homo sapiens
ctggcccgcccctcgctgc

SEQ ID NO: 2053882 - DNA, 23 bp, Homo sapiens
ctggcccgcccctcgctgctgct

SEQ ID NO: 2053883 - DNA, 18 bp, Homo sapiens
ctggcccgtcatgttcct

SEQ ID NO: 2053884 - DNA, 12 bp, Homo sapiens
ctggccctgcct

SEQ ID NO: 2053885 - DNA, 19 bp, Homo sapiens
ctggccggctccagtttcc

SEQ ID NO: 2053886 - DNA, 19 bp, Homo sapiens
ctggccggggcccctcacc

SEQ ID NO: 2053887 - DNA, 22 bp, Homo sapiens
ctggcctcaagtgattctcctg

SEQ ID NO: 2053888 - DNA, 22 bp, Homo sapiens
ctggcctcacgcccagcctcct

SEQ ID NO: 2053889 - DNA, 18 bp, Homo sapiens
ctggcctcactggctggg

SEQ ID NO: 2053890 - DNA, 20 bp, Homo sapiens
ctggcctcactggctggggc

SEQ ID NO: 2053891 - DNA, 20 bp, Homo sapiens
ctggcctcagcaggaacctg

SEQ ID NO: 2053892 - DNA, 18 bp, Homo sapiens
ctggcctcccaataaagc

SEQ ID NO: 2053893 - DNA, 23 bp, Homo sapiens
ctggcctcccaataaagctggac

SEQ ID NO: 2053894 - DNA, 16 bp, Homo sapiens
ctggcctcctgcctct

SEQ ID NO: 2053895 - DNA, 21 bp, Homo sapiens
ctggcctctagaacacccact

SEQ ID NO: 2053896 - DNA, 22 bp, Homo sapiens
ctggcctctagaacacccactg

SEQ ID NO: 2053897 - DNA, 12 bp, Homo sapiens
ctggcctgctgg

SEQ ID NO: 2053898 - DNA, 15 bp, Homo sapiens
ctggcctgctgggaa

SEQ ID NO: 2053899 - DNA, 17 bp, Homo sapiens
ctggcctgctgggaacc

SEQ ID NO: 2053900 - DNA, 14 bp, Homo sapiens
ctggcctggatctc

SEQ ID NO: 2053901 - DNA, 14 bp, Homo sapiens
ctggcctggcacac

SEQ ID NO: 2053902 - DNA, 13 bp, Homo sapiens
ctggcctggctcc

SEQ ID NO: 2053903 - DNA, 17 bp, Homo sapiens
ctggcctggctccccac

SEQ ID NO: 2053904 - DNA, 19 bp, Homo sapiens
ctggcctggctccccacga

SEQ ID NO: 2053905 - DNA, 19 bp, Homo sapiens
ctggcctgtggcaggccta

SEQ ID NO: 2053906 - DNA, 21 bp, Homo sapiens
ctggccttgtcaggacccagg

SEQ ID NO: 2053907 - DNA, 16 bp, Homo sapiens
ctggcggcgcagaggg

SEQ ID NO: 2053908 - DNA, 20 bp, Homo sapiens
ctggcggctactcagcagcc

SEQ ID NO: 2053909 - DNA, 13 bp, Homo sapiens
ctggcggcttcct

SEQ ID NO: 2053910 - DNA, 20 bp, Homo sapiens
ctggcggcttcctgtccact

SEQ ID NO: 2053911 - DNA, 20 bp, Homo sapiens
ctggctctcccatttcctga

SEQ ID NO: 2053912 - DNA, 15 bp, Homo sapiens
ctggctgaaaatcac

SEQ ID NO: 2053913 - DNA, 22 bp, Homo sapiens
ctggctgaccccaaagagcctg

SEQ ID NO: 2053914 - DNA, 12 bp, Homo sapiens
ctggctgagggc

SEQ ID NO: 2053915 - DNA, 22 bp, Homo sapiens
ctggctgagtggaatgcaggga

SEQ ID NO: 2053916 - DNA, 21 bp, Homo sapiens
ctggttgttgcaccatctgct

SEQ ID NO: 2053917 - DNA, 14 bp, Homo sapiens
ctggtttaatgttt

SEQ ID NO: 2053918 - DNA, 21 bp, Homo sapiens
ctggtttagtgttctgtattt

SEQ ID NO: 2053919 - DNA, 23 bp, Homo sapiens
ctggtttcatttctactgtgact

SEQ ID NO: 2053920 - DNA, 23 bp, Homo sapiens
ctggtttctcagaatccaaagat

SEQ ID NO: 2053921 - DNA, 13 bp, Homo sapiens
ctggttttaacaa

SEQ ID NO: 2053922 - DNA, 18 bp, Homo sapiens
ctgtaaacccctgggtaa

SEQ ID NO: 2053923 - DNA, 19 bp, Homo sapiens
ctgtaaactcaaaacttaa

SEQ ID NO: 2053924 - DNA, 13 bp, Homo sapiens
ctgtaaatacaaa

SEQ ID NO: 2053925 - DNA, 21 bp, Homo sapiens
ctgtaaatacaaaataaaatt

SEQ ID NO: 2053926 - DNA, 19 bp, Homo sapiens
ctgtaaatagttttaaata

SEQ ID NO: 2053927 - DNA, 20 bp, Homo sapiens
ctgtaaatagttttaaatat

SEQ ID NO: 2053928 - DNA, 15 bp, Homo sapiens
ctgtaaatatccaca

SEQ ID NO: 2053929 - DNA, 16 bp, Homo sapiens
ctgtaaatatgtttgt

SEQ ID NO: 2053930 - DNA, 21 bp, Homo sapiens
ctgtaaatatgtttgtgcctt

SEQ ID NO: 2053931 - DNA, 18 bp, Homo sapiens
ctgtaaatcacttgtaaa

SEQ ID NO: 2053932 - DNA, 21 bp, Homo sapiens
ctgtaaatcacttgtaaataa

SEQ ID NO: 2053933 - DNA, 23 bp, Homo sapiens
ctgtaaatcacttgtaaataaat

SEQ ID NO: 2053934 - DNA, 16 bp, Homo sapiens
ctgtaacaagccagat

SEQ ID NO: 2053935 - DNA, 15 bp, Homo sapiens
ctgtaacacagctga

SEQ ID NO: 2053936 - DNA, 21 bp, Homo sapiens
ctgtaagactcattccctaga

SEQ ID NO: 2053937 - DNA, 17 bp, Homo sapiens
ctgtaaggaactggaac

SEQ ID NO: 2053938 - DNA, 19 bp, Homo sapiens
ctgtaatcatataataaat

SEQ ID NO: 2053939 - DNA, 14 bp, Homo sapiens
ctgtaatcccagca

SEQ ID NO: 2053940 - DNA, 16 bp, Homo sapiens
ctgtaatcccagcact

SEQ ID NO: 2053941 - DNA, 20 bp, Homo sapiens
ctgtaatcccagcatgctga

SEQ ID NO: 2053942 - DNA, 14 bp, Homo sapiens
ctgtaatcccagct

SEQ ID NO: 2053943 - DNA, 20 bp, Homo sapiens
ctgtaatcccagctacacct

SEQ ID NO: 2053944 - DNA, 19 bp, Homo sapiens
ctgtaatgagaacttcaat

SEQ ID NO: 2053945 - DNA, 22 bp, Homo sapiens
ctgtaatgagaacttcaatcac

SEQ ID NO: 2053946 - DNA, 18 bp, Homo sapiens
ctgtaattaagtaaacca

SEQ ID NO: 2053947 - DNA, 19 bp, Homo sapiens
ctgtaattaagtaaaccaa

SEQ ID NO: 2053948 - DNA, 15 bp, Homo sapiens
ctgtaattaagtgca

SEQ ID NO: 2053949 - DNA, 16 bp, Homo sapiens
ctgtaattaagtgcaa

SEQ ID NO: 2053950 - DNA, 18 bp, Homo sapiens
ctgtaattaagtgcaatt

SEQ ID NO: 2053951 - DNA, 17 bp, Homo sapiens
ctgtaattaatattcct

SEQ ID NO: 2053952 - DNA, 19 bp, Homo sapiens
ctgtaattttgtttgtaat

SEQ ID NO: 2053953 - DNA, 20 bp, Homo sapiens
ctgtaattttgtttgtaatc

SEQ ID NO: 2053954 - DNA, 21 bp, Homo sapiens
ctgtaattttgtttgtaatcc

SEQ ID NO: 2053955 - DNA, 13 bp, Homo sapiens
ctgtacaaaaaca

SEQ ID NO: 2053956 - DNA, 14 bp, Homo sapiens
ctgtacaaaaacaa

SEQ ID NO: 2053957 - DNA, 16 bp, Homo sapiens
ctgtacaaaaacaaaa

SEQ ID NO: 2053958 - DNA, 16 bp, Homo sapiens
ctgtacaatatttaaa

SEQ ID NO: 2053959 - DNA, 21 bp, Homo sapiens
ctgtacaatatttaaaattta

SEQ ID NO: 2053960 - DNA, 17 bp, Homo sapiens
ctgtacacgtgtcctgt

SEQ ID NO: 2053961 - DNA, 15 bp, Homo sapiens
ctgtacactgcacga

SEQ ID NO: 2053962 - DNA, 22 bp, Homo sapiens
ctgtacatatatatgccttatg

SEQ ID NO: 2053963 - DNA, 15 bp, Homo sapiens
ctgtaccaagcccct

SEQ ID NO: 2053964 - DNA, 13 bp, Homo sapiens
ctgtacccttcca

SEQ ID NO: 2053965 - DNA, 19 bp, Homo sapiens
ctgtacgtctgacaggcaa

SEQ ID NO: 2053966 - DNA, 15 bp, Homo sapiens
ctgtactcagagcag

SEQ ID NO: 2053967 - DNA, 15 bp, Homo sapiens
ctgtactcctcccag

SEQ ID NO: 2053968 - DNA, 21 bp, Homo sapiens
ctgtactcctcccaggcgccc

SEQ ID NO: 2053969 - DNA, 14 bp, Homo sapiens
ctgtactgcctgct

SEQ ID NO: 2053970 - DNA, 19 bp, Homo sapiens
ctgtactgcctgcttgggg

SEQ ID NO: 2053971 - DNA, 20 bp, Homo sapiens
ctgtactgggttatttttgt

SEQ ID NO: 2053972 - DNA, 13 bp, Homo sapiens
ctgtacttaataa

SEQ ID NO: 2053973 - DNA, 22 bp, Homo sapiens
ctgtagaaagaatgtgttgcct

SEQ ID NO: 2053974 - DNA, 19 bp, Homo sapiens
ctgtagagttggaactgca

SEQ ID NO: 2053975 - DNA, 12 bp, Homo sapiens
ctgtagcatctt

SEQ ID NO: 2053976 - DNA, 20 bp, Homo sapiens
ctgtagcatcttctggagtc

SEQ ID NO: 2053977 - DNA, 17 bp, Homo sapiens
ctgtagcattacagtgg

SEQ ID NO: 2053978 - DNA, 14 bp, Homo sapiens
ctgtagccatggct

SEQ ID NO: 2053979 - DNA, 20 bp, Homo sapiens
ctgtagccatggctcaggca

SEQ ID NO: 2053980 - DNA, 21 bp, Homo sapiens
ctgtagccatggctcaggcaa

SEQ ID NO: 2053981 - DNA, 23 bp, Homo sapiens
ctgtagccatggctcaggcaagc

SEQ ID NO: 2053982 - DNA, 20 bp, Homo sapiens
ctgtagccccagtgacagct

SEQ ID NO: 2053983 - DNA, 22 bp, Homo sapiens
ctgtagctgatgaaactcctga

SEQ ID NO: 2053984 - DNA, 18 bp, Homo sapiens
ctgtagcttgttccctgt

SEQ ID NO: 2053985 - DNA, 14 bp, Homo sapiens
ctgtagggctggac

SEQ ID NO: 2053986 - DNA, 15 bp, Homo sapiens
ctgtagggctggacc

SEQ ID NO: 2053987 - DNA, 16 bp, Homo sapiens
ctgtagggctggacct

SEQ ID NO: 2053988 - DNA, 22 bp, Homo sapiens
ctgtaggttgcttaaaagggac

SEQ ID NO: 2053989 - DNA, 19 bp, Homo sapiens
ctgtagtagccctttctgt

SEQ ID NO: 2053990 - DNA, 15 bp, Homo sapiens
ctgtagtcccagcca

SEQ ID NO: 2053991 - DNA, 13 bp, Homo sapiens
ctgtagtgagaaa

SEQ ID NO: 2053992 - DNA, 17 bp, Homo sapiens
ctgtagtgagaaactga

SEQ ID NO: 2053993 - DNA, 18 bp, Homo sapiens
ctgtagttaggaaataaa

SEQ ID NO: 2053994 - DNA, 21 bp, Homo sapiens
ctgtagttaggaaataaaacc

SEQ ID NO: 2053995 - DNA, 19 bp, Homo sapiens
ctgtataaacattaaatgt

SEQ ID NO: 2053996 - DNA, 19 bp, Homo sapiens
ctgtataatctatttacat

SEQ ID NO: 2053997 - DNA, 20 bp, Homo sapiens
ctgtataatttaacagtgcc

SEQ ID NO: 2053998 - DNA, 16 bp, Homo sapiens
ctgtatagacagcact

SEQ ID NO: 2053999 - DNA, 23 bp, Homo sapiens
ctgtatagattataaaattattt

SEQ ID NO: 2054000 - DNA, 15 bp, Homo sapiens
ctgtatagtactggc

SEQ ID NO: 2054001 - DNA, 20 bp, Homo sapiens
ctgtatataatactaaagtg

SEQ ID NO: 2054002 - DNA, 23 bp, Homo sapiens
ctgtatatacaataacataattt

SEQ ID NO: 2054003 - DNA, 15 bp, Homo sapiens
ctgtatatgttgtaa

SEQ ID NO: 2054004 - DNA, 16 bp, Homo sapiens
ctgtatattatggtgt

SEQ ID NO: 2054005 - DNA, 20 bp, Homo sapiens
ctgtatattatggtgtaatg

SEQ ID NO: 2054006 - DNA, 22 bp, Homo sapiens
ctgtatattatggtgtaatgca

SEQ ID NO: 2054007 - DNA, 14 bp, Homo sapiens
ctgtatcccatgag

SEQ ID NO: 2054008 - DNA, 20 bp, Homo sapiens
ctgtatcccatgagcctcag

SEQ ID NO: 2054009 - DNA, 18 bp, Homo sapiens
ctgtatcggagacagtga

SEQ ID NO: 2054010 - DNA, 20 bp, Homo sapiens
ctgtatctacttagccagat

SEQ ID NO: 2054011 - DNA, 15 bp, Homo sapiens
ctgtatctgtaatta

SEQ ID NO: 2054012 - DNA, 20 bp, Homo sapiens
ctgtatctgtaattaatatt

SEQ ID NO: 2054013 - DNA, 18 bp, Homo sapiens
ctgtatgtgtctttatca

SEQ ID NO: 2054014 - DNA, 20 bp, Homo sapiens
ctgtatgtttgatcacacag

SEQ ID NO: 2054015 - DNA, 14 bp, Homo sapiens
ctgtatttgtatct

SEQ ID NO: 2054016 - DNA, 17 bp, Homo sapiens
ctgtatttgttcccaag

SEQ ID NO: 2054017 - DNA, 10 bp, Homo sapiens
ctgtattttc

SEQ ID NO: 2054018 - DNA, 19 bp, Homo sapiens
ctgtcaatttccctgactc

SEQ ID NO: 2054019 - DNA, 16 bp, Homo sapiens
ctgtcaccctccacct

SEQ ID NO: 2054020 - DNA, 13 bp, Homo sapiens
ctgtcagagctgt

SEQ ID NO: 2054021 - DNA, 20 bp, Homo sapiens
ctgtcagagctgttggcctc

SEQ ID NO: 2054022 - DNA, 24 bp, Homo sapiens
ctgtcagagctgttggcctcgcct

SEQ ID NO: 2054023 - DNA, 18 bp, Homo sapiens
ctgtcagccagccgccct

SEQ ID NO: 2054024 - DNA, 23 bp, Homo sapiens
ctgtcagccagccgccctgggct

SEQ ID NO: 2054025 - DNA, 17 bp, Homo sapiens
ctgtcagcgcaggttta

SEQ ID NO: 2054026 - DNA, 21 bp, Homo sapiens
ctgtcagctcccctcggagaa

SEQ ID NO: 2054027 - DNA, 15 bp, Homo sapiens
ctgtcatcactccct

SEQ ID NO: 2054028 - DNA, 16 bp, Homo sapiens
ctgtcatcactccctg

SEQ ID NO: 2054029 - DNA, 20 bp, Homo sapiens
ctgtcatcactccctggatg

SEQ ID NO: 2054030 - DNA, 12 bp, Homo sapiens
cttaataaattc

SEQ ID NO: 2054031 - DNA, 13 bp, Homo sapiens
cttaataggcttt

SEQ ID NO: 2054032 - DNA, 17 bp, Homo sapiens
cttaatagtatttatga

SEQ ID NO: 2054033 - DNA, 15 bp, Homo sapiens
cttaatattattggg

SEQ ID NO: 2054034 - DNA, 22 bp, Homo sapiens
cttaatcaagaatattcaaatg

SEQ ID NO: 2054035 - DNA, 21 bp, Homo sapiens
cttaatcagatagatattcct

SEQ ID NO: 2054036 - DNA, 20 bp, Homo sapiens
cttaatcaggtcctcagaga

SEQ ID NO: 2054037 - DNA, 17 bp, Homo sapiens
cttaatgctttcctccc

SEQ ID NO: 2054038 - DNA, 16 bp, Homo sapiens
cttaatgtttattcct

SEQ ID NO: 2054039 - DNA, 23 bp, Homo sapiens
cttaatgtttattcctgataata

SEQ ID NO: 2054040 - DNA, 17 bp, Homo sapiens
cttaattaaaagaatat

SEQ ID NO: 2054041 - DNA, 19 bp, Homo sapiens
cttaattaaaagaatattt

SEQ ID NO: 2054042 - DNA, 16 bp, Homo sapiens
cttacacttggagccc

SEQ ID NO: 2054043 - DNA, 16 bp, Homo sapiens
cttacataatttttta

SEQ ID NO: 2054044 - DNA, 18 bp, Homo sapiens
cttacatgcattactgca

SEQ ID NO: 2054045 - DNA, 12 bp, Homo sapiens
cttacattccta

SEQ ID NO: 2054046 - DNA, 14 bp, Homo sapiens
cttacatttttaca

SEQ ID NO: 2054047 - DNA, 19 bp, Homo sapiens
cttaccaactttctgtaaa

SEQ ID NO: 2054048 - DNA, 20 bp, Homo sapiens
cttaccacgttactgcatac

SEQ ID NO: 2054049 - DNA, 20 bp, Homo sapiens
cttaccaggcaccaaaagaa

SEQ ID NO: 2054050 - DNA, 22 bp, Homo sapiens
cttacccaaactgttcaagaaa

SEQ ID NO: 2054051 - DNA, 23 bp, Homo sapiens
cttacccggagaaggccgctgcc

SEQ ID NO: 2054052 - DNA, 18 bp, Homo sapiens
cttacctaaacagatata

SEQ ID NO: 2054053 - DNA, 19 bp, Homo sapiens
cttacctaaacagatataa

SEQ ID NO: 2054054 - DNA, 15 bp, Homo sapiens
cttacctcccctgcc

SEQ ID NO: 2054055 - DNA, 23 bp, Homo sapiens
cttacctcccctgccagggctcg

SEQ ID NO: 2054056 - DNA, 17 bp, Homo sapiens
cttacctcctgcccagg

SEQ ID NO: 2054057 - DNA, 16 bp, Homo sapiens
cttacctgacacaaga

SEQ ID NO: 2054058 - DNA, 21 bp, Homo sapiens
cttaccttcaataaagtatct

SEQ ID NO: 2054059 - DNA, 13 bp, Homo sapiens
cttacctttacat

SEQ ID NO: 2054060 - DNA, 12 bp, Homo sapiens
cttacgctctct

SEQ ID NO: 2054061 - DNA, 22 bp, Homo sapiens
cttactaaacattttgttattg

SEQ ID NO: 2054062 - DNA, 18 bp, Homo sapiens
cttactatgatctcagga

SEQ ID NO: 2054063 - DNA, 20 bp, Homo sapiens
cttactatgatctcaggagc

SEQ ID NO: 2054064 - DNA, 16 bp, Homo sapiens
cttactattggtaata

SEQ ID NO: 2054065 - DNA, 15 bp, Homo sapiens
cttactcacctctct

SEQ ID NO: 2054066 - DNA, 19 bp, Homo sapiens
cttactcacctctctctaa

SEQ ID NO: 2054067 - DNA, 17 bp, Homo sapiens
cttactctgagcccagg

SEQ ID NO: 2054068 - DNA, 13 bp, Homo sapiens
cttactgcagaat

SEQ ID NO: 2054069 - DNA, 23 bp, Homo sapiens
cttacttaaacccagctcccttc

SEQ ID NO: 2054070 - DNA, 14 bp, Homo sapiens
cttacttggaactg

SEQ ID NO: 2054071 - DNA, 20 bp, Homo sapiens
cttagaagtcacacagtatt

SEQ ID NO: 2054072 - DNA, 18 bp, Homo sapiens
cttagaagtggaccagga

SEQ ID NO: 2054073 - DNA, 23 bp, Homo sapiens
cttagaagtggaccaggacagga

SEQ ID NO: 2054074 - DNA, 17 bp, Homo sapiens
cttagacctcagcctgt

SEQ ID NO: 2054075 - DNA, 18 bp, Homo sapiens
cttagacctcagcctgtg

SEQ ID NO: 2054076 - DNA, 19 bp, Homo sapiens
cttagacttcgactcagga

SEQ ID NO: 2054077 - DNA, 22 bp, Homo sapiens
cttagagattgccccagagccc

SEQ ID NO: 2054078 - DNA, 17 bp, Homo sapiens
cttagatagatggtact

SEQ ID NO: 2054079 - DNA, 16 bp, Homo sapiens
cttagcacttctttcc

SEQ ID NO: 2054080 - DNA, 21 bp, Homo sapiens
cttagcagggaaacagctaat

SEQ ID NO: 2054081 - DNA, 21 bp, Homo sapiens
cttagcatgcctccaaaaatt

SEQ ID NO: 2054082 - DNA, 18 bp, Homo sapiens
cttagcccaagaggtctg

SEQ ID NO: 2054083 - DNA, 21 bp, Homo sapiens
cttagcccaagaggtctgagc

SEQ ID NO: 2054084 - DNA, 22 bp, Homo sapiens
cttagcccaagaggtctgagcc

SEQ ID NO: 2054085 - DNA, 23 bp, Homo sapiens
cttagcccaagaggtctgagccc

SEQ ID NO: 2054086 - DNA, 15 bp, Homo sapiens
cttagcctggagcac

SEQ ID NO: 2054087 - DNA, 11 bp, Homo sapiens
cttagccttgt

SEQ ID NO: 2054088 - DNA, 19 bp, Homo sapiens
cttagccttgtgccctgcc

SEQ ID NO: 2054089 - DNA, 23 bp, Homo sapiens
cttagccttgtgccctgccccca

SEQ ID NO: 2054090 - DNA, 14 bp, Homo sapiens
cttagctgtctgct

SEQ ID NO: 2054091 - DNA, 17 bp, Homo sapiens
cttagcttagacctcag

SEQ ID NO: 2054092 - DNA, 22 bp, Homo sapiens
cttagcttagacctcagcctgt

SEQ ID NO: 2054093 - DNA, 14 bp, Homo sapiens
cttagctttccaca

SEQ ID NO: 2054094 - DNA, 18 bp, Homo sapiens
cttaggaaaatgcttctg

SEQ ID NO: 2054095 - DNA, 22 bp, Homo sapiens
cttaggcattatttaatgtttg

SEQ ID NO: 2054096 - DNA, 20 bp, Homo sapiens
cttaggtaaaaatataagaa

SEQ ID NO: 2054097 - DNA, 14 bp, Homo sapiens
cttaggtgccaggc

SEQ ID NO: 2054098 - DNA, 15 bp, Homo sapiens
cttaggtgccaggct

SEQ ID NO: 2054099 - DNA, 18 bp, Homo sapiens
cttaggtgccaggctgta

SEQ ID NO: 2054100 - DNA, 19 bp, Homo sapiens
cttagtatctcatcaacaa

SEQ ID NO: 2054101 - DNA, 20 bp, Homo sapiens
cttagtgcggacaagtttta

SEQ ID NO: 2054102 - DNA, 22 bp, Homo sapiens
cttagtggcttttttcctcctg

SEQ ID NO: 2054103 - DNA, 17 bp, Homo sapiens
cttagttaagtcatcca

SEQ ID NO: 2054104 - DNA, 14 bp, Homo sapiens
cttataaatgtgta

SEQ ID NO: 2054105 - DNA, 16 bp, Homo sapiens
cttatagaatatttat

SEQ ID NO: 2054106 - DNA, 21 bp, Homo sapiens
cttatatagcagcaaaaatat

SEQ ID NO: 2054107 - DNA, 20 bp, Homo sapiens
cttatcatgctgtctttaca

SEQ ID NO: 2054108 - DNA, 16 bp, Homo sapiens
cttatcccttcttttt

SEQ ID NO: 2054109 - DNA, 20 bp, Homo sapiens
cttatcttgaaaagaatcta

SEQ ID NO: 2054110 - DNA, 15 bp, Homo sapiens
cttatgtaattattt

SEQ ID NO: 2054111 - DNA, 13 bp, Homo sapiens
cttatgtattatt

SEQ ID NO: 2054112 - DNA, 17 bp, Homo sapiens
cttatgtattattttct

SEQ ID NO: 2054113 - DNA, 18 bp, Homo sapiens
cttatgtctctacatggt

SEQ ID NO: 2054114 - DNA, 11 bp, Homo sapiens
cttattagaac

SEQ ID NO: 2054115 - DNA, 22 bp, Homo sapiens
cttattcatgctttctcctttt

SEQ ID NO: 2054116 - DNA, 19 bp, Homo sapiens
cttattcccaactgctctg

SEQ ID NO: 2054117 - DNA, 20 bp, Homo sapiens
cttattcccaactgctctgc

SEQ ID NO: 2054118 - DNA, 15 bp, Homo sapiens
cttattgtccccact

SEQ ID NO: 2054119 - DNA, 13 bp, Homo sapiens
cttatttatatat

SEQ ID NO: 2054120 - DNA, 14 bp, Homo sapiens
cttatttatatatg

SEQ ID NO: 2054121 - DNA, 22 bp, Homo sapiens
cttatttatattcagagatgta

SEQ ID NO: 2054122 - DNA, 13 bp, Homo sapiens
cttatttattatt

SEQ ID NO: 2054123 - DNA, 17 bp, Homo sapiens
cttatttccctcatctt

SEQ ID NO: 2054124 - DNA, 11 bp, Homo sapiens
cttatttctgt

SEQ ID NO: 2054125 - DNA, 12 bp, Homo sapiens
cttatttgagtg

SEQ ID NO: 2054126 - DNA, 15 bp, Homo sapiens
cttatttgcaataaa

SEQ ID NO: 2054127 - DNA, 14 bp, Homo sapiens
cttatttgtataat

SEQ ID NO: 2054128 - DNA, 23 bp, Homo sapiens
cttattttaaaattttatctctt

SEQ ID NO: 2054129 - DNA, 18 bp, Homo sapiens
cttattttcaagaaactg

SEQ ID NO: 2054130 - DNA, 19 bp, Homo sapiens
cttattttcaagaaactga

SEQ ID NO: 2054131 - DNA, 13 bp, Homo sapiens
cttattttgtaat

SEQ ID NO: 2054132 - DNA, 14 bp, Homo sapiens
cttattttgtaata

SEQ ID NO: 2054133 - DNA, 21 bp, Homo sapiens
cttattttgtaataaactctc

SEQ ID NO: 2054134 - DNA, 23 bp, Homo sapiens
cttattttgtaataaactctcta

SEQ ID NO: 2054135 - DNA, 16 bp, Homo sapiens
cttcaaagcttgaaga

SEQ ID NO: 2054136 - DNA, 18 bp, Homo sapiens
cttcaaagcttgaagatc

SEQ ID NO: 2054137 - DNA, 19 bp, Homo sapiens
cttcaaatatagagatatt

SEQ ID NO: 2054138 - DNA, 16 bp, Homo sapiens
cttcaaccctcagcct

SEQ ID NO: 2054139 - DNA, 23 bp, Homo sapiens
cttcaactgaccagcctccatgc

SEQ ID NO: 2054140 - DNA, 14 bp, Homo sapiens
cttcaagctgtccc

SEQ ID NO: 2054141 - DNA, 15 bp, Homo sapiens
cttcaagctgtcccc

SEQ ID NO: 2054142 - DNA, 17 bp, Homo sapiens
cttcaaggtgtaaaata

SEQ ID NO: 2054143 - DNA, 20 bp, Homo sapiens
cttcaaggtgtaaaatatct

SEQ ID NO: 2054144 - DNA, 15 bp, Homo sapiens
cttgagggttgggct

SEQ ID NO: 2054145 - DNA, 18 bp, Homo sapiens
cttgatgaagcctgtgcc

SEQ ID NO: 2054146 - DNA, 19 bp, Homo sapiens
cttgatgaagcctgtgcca

SEQ ID NO: 2054147 - DNA, 23 bp, Homo sapiens
cttgatgaagcctgtgccacctg

SEQ ID NO: 2054148 - DNA, 19 bp, Homo sapiens
cttgattttagccttctct

SEQ ID NO: 2054149 - DNA, 15 bp, Homo sapiens
cttgcaagaggaggt

SEQ ID NO: 2054150 - DNA, 16 bp, Homo sapiens
cttgcacaagcttgta

SEQ ID NO: 2054151 - DNA, 20 bp, Homo sapiens
cttgcacaagcttgtatata

SEQ ID NO: 2054152 - DNA, 14 bp, Homo sapiens
cttgcacatctctg

SEQ ID NO: 2054153 - DNA, 20 bp, Homo sapiens
cttgcagactctacagaggc

SEQ ID NO: 2054154 - DNA, 21 bp, Homo sapiens
cttgcagactctacagaggcc

SEQ ID NO: 2054155 - DNA, 15 bp, Homo sapiens
cttgcagtcatcaga

SEQ ID NO: 2054156 - DNA, 13 bp, Homo sapiens
cttgcattagaaa

SEQ ID NO: 2054157 - DNA, 17 bp, Homo sapiens
cttgccaaattccatgt

SEQ ID NO: 2054158 - DNA, 18 bp, Homo sapiens
cttgccaagctttcttct

SEQ ID NO: 2054159 - DNA, 21 bp, Homo sapiens
cttgccacatctgtgtctctg

SEQ ID NO: 2054160 - DNA, 13 bp, Homo sapiens
cttgcccagagat

SEQ ID NO: 2054161 - DNA, 21 bp, Homo sapiens
cttgcccagagatgcctccac

SEQ ID NO: 2054162 - DNA, 22 bp, Homo sapiens
cttgcccagagatgcctccacc

SEQ ID NO: 2054163 - DNA, 13 bp, Homo sapiens
cttgcccagggct

SEQ ID NO: 2054164 - DNA, 23 bp, Homo sapiens
cttgcccagggctcagcctggtg

SEQ ID NO: 2054165 - DNA, 22 bp, Homo sapiens
cttgcccccatccctcggaccc

SEQ ID NO: 2054166 - DNA, 19 bp, Homo sapiens
cttgcccctccagagacag

SEQ ID NO: 2054167 - DNA, 18 bp, Homo sapiens
cttgcccggattctggga

SEQ ID NO: 2054168 - DNA, 20 bp, Homo sapiens
cttgcccggattctgggagg

SEQ ID NO: 2054169 - DNA, 15 bp, Homo sapiens
cttgccctgacctcc

SEQ ID NO: 2054170 - DNA, 22 bp, Homo sapiens
cttgccctgttaaaagatgaaa

SEQ ID NO: 2054171 - DNA, 18 bp, Homo sapiens
cttgcctaggccaaatgc

SEQ ID NO: 2054172 - DNA, 13 bp, Homo sapiens
cttgcctcatttt

SEQ ID NO: 2054173 - DNA, 19 bp, Homo sapiens
cttgcctgaggctcaagag

SEQ ID NO: 2054174 - DNA, 24 bp, Homo sapiens
cttgcctgaggctcaagaggccca

SEQ ID NO: 2054175 - DNA, 21 bp, Homo sapiens
cttgcctgcacccttcctcct

SEQ ID NO: 2054176 - DNA, 16 bp, Homo sapiens
cttgcctgccagggcc

SEQ ID NO: 2054177 - DNA, 17 bp, Homo sapiens
cttgcctgccagggccc

SEQ ID NO: 2054178 - DNA, 20 bp, Homo sapiens
cttgccttcttcacccagct

SEQ ID NO: 2054179 - DNA, 14 bp, Homo sapiens
cttgcgtcctgcag

SEQ ID NO: 2054180 - DNA, 22 bp, Homo sapiens
cttgctcaccaagctgttccac

SEQ ID NO: 2054181 - DNA, 16 bp, Homo sapiens
cttgctcaggtgcaag

SEQ ID NO: 2054182 - DNA, 15 bp, Homo sapiens
cttgctcagtgcctc

SEQ ID NO: 2054183 - DNA, 19 bp, Homo sapiens
cttgctcagtgcctcctgg

SEQ ID NO: 2054184 - DNA, 17 bp, Homo sapiens
cttgctccagggtcttg

SEQ ID NO: 2054185 - DNA, 15 bp, Homo sapiens
cttgctcctccttct

SEQ ID NO: 2054186 - DNA, 12 bp, Homo sapiens
cttgctctgctg

SEQ ID NO: 2054187 - DNA, 18 bp, Homo sapiens
cttgctgacatggctttg

SEQ ID NO: 2054188 - DNA, 13 bp, Homo sapiens
cttgctggaagac

SEQ ID NO: 2054189 - DNA, 17 bp, Homo sapiens
cttgctggacggggact

SEQ ID NO: 2054190 - DNA, 21 bp, Homo sapiens
cttgctggacggggactgggg

SEQ ID NO: 2054191 - DNA, 22 bp, Homo sapiens
cttgctggacggggactgggga

SEQ ID NO: 2054192 - DNA, 14 bp, Homo sapiens
cttgctgtcctagg

SEQ ID NO: 2054193 - DNA, 16 bp, Homo sapiens
cttgctgtcctaggcc

SEQ ID NO: 2054194 - DNA, 22 bp, Homo sapiens
cttgcttagtatggttctcaga

SEQ ID NO: 2054195 - DNA, 19 bp, Homo sapiens
cttgcttctaaatgcccag

SEQ ID NO: 2054196 - DNA, 11 bp, Homo sapiens
cttgcttctgc

SEQ ID NO: 2054197 - DNA, 12 bp, Homo sapiens
cttgcttctgca

SEQ ID NO: 2054198 - DNA, 21 bp, Homo sapiens
cttgcttctgcagcaactccc

SEQ ID NO: 2054199 - DNA, 22 bp, Homo sapiens
cttgcttctgcagcaactccca

SEQ ID NO: 2054200 - DNA, 23 bp, Homo sapiens
cttgcttctgcagcaactcccac

SEQ ID NO: 2054201 - DNA, 19 bp, Homo sapiens
cttgcttgccgagcctaat

SEQ ID NO: 2054202 - DNA, 15 bp, Homo sapiens
cttgctttgctgtct

SEQ ID NO: 2054203 - DNA, 13 bp, Homo sapiens
cttgctttttcaa

SEQ ID NO: 2054204 - DNA, 17 bp, Homo sapiens
cttggaaaaagaaagaa

SEQ ID NO: 2054205 - DNA, 19 bp, Homo sapiens
cttggaaagttcagccaga

SEQ ID NO: 2054206 - DNA, 15 bp, Homo sapiens
cttggaactgaaggg

SEQ ID NO: 2054207 - DNA, 13 bp, Homo sapiens
cttggaagagctc

SEQ ID NO: 2054208 - DNA, 17 bp, Homo sapiens
cttggaagtgtgtggaa

SEQ ID NO: 2054209 - DNA, 12 bp, Homo sapiens
cttggacctctg

SEQ ID NO: 2054210 - DNA, 15 bp, Homo sapiens
cttggacctctgctc

SEQ ID NO: 2054211 - DNA, 14 bp, Homo sapiens
cttggactattata

SEQ ID NO: 2054212 - DNA, 13 bp, Homo sapiens
cttggactcctcc

SEQ ID NO: 2054213 - DNA, 16 bp, Homo sapiens
cttggactcctcccac

SEQ ID NO: 2054214 - DNA, 18 bp, Homo sapiens
cttggactcctcccacaa

SEQ ID NO: 2054215 - DNA, 18 bp, Homo sapiens
cttggacttcctggggcc

SEQ ID NO: 2054216 - DNA, 23 bp, Homo sapiens
cttggacttcctggggccccgct

SEQ ID NO: 2054217 - DNA, 15 bp, Homo sapiens
cttggagagacacag

SEQ ID NO: 2054218 - DNA, 13 bp, Homo sapiens
cttggagagcagc

SEQ ID NO: 2054219 - DNA, 14 bp, Homo sapiens
cttggagagcagct

SEQ ID NO: 2054220 - DNA, 16 bp, Homo sapiens
cttggagagcagctgg

SEQ ID NO: 2054221 - DNA, 20 bp, Homo sapiens
cttggagagcagctggctct

SEQ ID NO: 2054222 - DNA, 16 bp, Homo sapiens
cttggagcctgaacat

SEQ ID NO: 2054223 - DNA, 15 bp, Homo sapiens
cttggaggacagtgg

SEQ ID NO: 2054224 - DNA, 23 bp, Homo sapiens
cttggagggatggagaggcggcc

SEQ ID NO: 2054225 - DNA, 20 bp, Homo sapiens
cttggcaacagaagcagttg

SEQ ID NO: 2054226 - DNA, 23 bp, Homo sapiens
cttggcagcttaacattgacttc

SEQ ID NO: 2054227 - DNA, 19 bp, Homo sapiens
cttggcagtattccatggg

SEQ ID NO: 2054228 - DNA, 19 bp, Homo sapiens
cttggcatcacagggcaga

SEQ ID NO: 2054229 - DNA, 20 bp, Homo sapiens
cttggcatcacagggcagag

SEQ ID NO: 2054230 - DNA, 17 bp, Homo sapiens
cttggccgactcaggga

SEQ ID NO: 2054231 - DNA, 19 bp, Homo sapiens
cttggcctcccaaggtgct

SEQ ID NO: 2054232 - DNA, 14 bp, Homo sapiens
cttggctgcaggga

SEQ ID NO: 2054233 - DNA, 16 bp, Homo sapiens
cttggctgcagggagt

SEQ ID NO: 2054234 - DNA, 12 bp, Homo sapiens
cttggctgtgag

SEQ ID NO: 2054235 - DNA, 17 bp, Homo sapiens
cttggcttttgcttggc

SEQ ID NO: 2054236 - DNA, 21 bp, Homo sapiens
cttggcttttgcttggcagag

SEQ ID NO: 2054237 - DNA, 10 bp, Homo sapiens
cttgggaatg

SEQ ID NO: 2054238 - DNA, 18 bp, Homo sapiens
cttgggaatggatcctgg

SEQ ID NO: 2054239 - DNA, 20 bp, Homo sapiens
cttgggaggctgaggcagga

SEQ ID NO: 2054240 - DNA, 18 bp, Homo sapiens
cttgggcacccccagcct

SEQ ID NO: 2054241 - DNA, 19 bp, Homo sapiens
cttgggcacccccagcctg

SEQ ID NO: 2054242 - DNA, 20 bp, Homo sapiens
cttgggcacccccagcctgg

SEQ ID NO: 2054243 - DNA, 17 bp, Homo sapiens
cttgggcatccacccag

SEQ ID NO: 2054244 - DNA, 20 bp, Homo sapiens
cttgggcatccacccagtgc

SEQ ID NO: 2054245 - DNA, 13 bp, Homo sapiens
cttgggccctgca

SEQ ID NO: 2054246 - DNA, 17 bp, Homo sapiens
cttgggccctgcacaga

SEQ ID NO: 2054247 - DNA, 21 bp, Homo sapiens
cttgggcctccccccagcccc

SEQ ID NO: 2054248 - DNA, 13 bp, Homo sapiens
cttgggctactgg

SEQ ID NO: 2054249 - DNA, 18 bp, Homo sapiens
cttgggctactggcagct

SEQ ID NO: 2054250 - DNA, 21 bp, Homo sapiens
cttgggctactggcagctcct

SEQ ID NO: 2054251 - DNA, 15 bp, Homo sapiens
cttgggctcctggct

SEQ ID NO: 2054252 - DNA, 16 bp, Homo sapiens
cttgggctcctggctg

SEQ ID NO: 2054253 - DNA, 10 bp, Homo sapiens
cttggggagc

SEQ ID NO: 2054254 - DNA, 14 bp, Homo sapiens
cttggggagcagag

SEQ ID NO: 2054255 - DNA, 17 bp, Homo sapiens
cttggggagcaggtctc

SEQ ID NO: 2054256 - DNA, 21 bp, Homo sapiens
cttggggagcaggtctctggc

SEQ ID NO: 2054257 - DNA, 21 bp, Homo sapiens
cttggggattcttccatctga

SEQ ID NO: 2054258 - DNA, 13 bp, Homo sapiens
cttggggcacagt

SEQ ID NO: 2054259 - DNA, 12 bp, Homo sapiens
gaccatcctggc

SEQ ID NO: 2054260 - DNA, 14 bp, Homo sapiens
gaccatcctggccc

SEQ ID NO: 2054261 - DNA, 18 bp, Homo sapiens
gaccatcctggcccctcc

SEQ ID NO: 2054262 - DNA, 19 bp, Homo sapiens
gaccatcctggcccctcca

SEQ ID NO: 2054263 - DNA, 21 bp, Homo sapiens
gaccatcctggcccctccaga

SEQ ID NO: 2054264 - DNA, 14 bp, Homo sapiens
gaccattgacctca

SEQ ID NO: 2054265 - DNA, 14 bp, Homo sapiens
gaccattgtcttcc

SEQ ID NO: 2054266 - DNA, 16 bp, Homo sapiens
gaccattgtcttccaa

SEQ ID NO: 2054267 - DNA, 18 bp, Homo sapiens
gaccattgtcttccaacc

SEQ ID NO: 2054268 - DNA, 19 bp, Homo sapiens
gaccattgtcttccaaccc

SEQ ID NO: 2054269 - DNA, 20 bp, Homo sapiens
gaccattgtcttccaacccc

SEQ ID NO: 2054270 - DNA, 23 bp, Homo sapiens
gaccattgtcttccaaccccagc

SEQ ID NO: 2054271 - DNA, 17 bp, Homo sapiens
gaccatttaacatgcaa

SEQ ID NO: 2054272 - DNA, 16 bp, Homo sapiens
gacccaagaggtgggg

SEQ ID NO: 2054273 - DNA, 17 bp, Homo sapiens
gacccaagaggtgggga

SEQ ID NO: 2054274 - DNA, 17 bp, Homo sapiens
gacccaatgctcctgga

SEQ ID NO: 2054275 - DNA, 20 bp, Homo sapiens
gacccacccatcttcctgct

SEQ ID NO: 2054276 - DNA, 18 bp, Homo sapiens
gacccagagtggagtctg

SEQ ID NO: 2054277 - DNA, 15 bp, Homo sapiens
gacccagatcctcac

SEQ ID NO: 2054278 - DNA, 16 bp, Homo sapiens
gacccagcaggaagcc

SEQ ID NO: 2054279 - DNA, 22 bp, Homo sapiens
gacccagcaggaagccaggctg

SEQ ID NO: 2054280 - DNA, 20 bp, Homo sapiens
gacccagctactctgtccag

SEQ ID NO: 2054281 - DNA, 21 bp, Homo sapiens
gacccagctactctgtccagg

SEQ ID NO: 2054282 - DNA, 11 bp, Homo sapiens
gacccaggccc

SEQ ID NO: 2054283 - DNA, 15 bp, Homo sapiens
gacccaggccctcca

SEQ ID NO: 2054284 - DNA, 13 bp, Homo sapiens
gacccaggtggct

SEQ ID NO: 2054285 - DNA, 16 bp, Homo sapiens
gacccagtccctgggg

SEQ ID NO: 2054286 - DNA, 22 bp, Homo sapiens
gacccagtgagattacagagga

SEQ ID NO: 2054287 - DNA, 23 bp, Homo sapiens
gacccagtgagattacagaggaa

SEQ ID NO: 2054288 - DNA, 21 bp, Homo sapiens
gaccccaaagagcctggagaa

SEQ ID NO: 2054289 - DNA, 19 bp, Homo sapiens
gaccccagggcacaggagc

SEQ ID NO: 2054290 - DNA, 21 bp, Homo sapiens
gaccccagggcacaggagcta

SEQ ID NO: 2054291 - DNA, 23 bp, Homo sapiens
gaccccgcctcccagccccaggg

SEQ ID NO: 2054292 - DNA, 18 bp, Homo sapiens
gaccccgggcgtggacca

SEQ ID NO: 2054293 - DNA, 13 bp, Homo sapiens
gacccctccatgt

SEQ ID NO: 2054294 - DNA, 23 bp, Homo sapiens
gacccctcccttgctcagtgcct

SEQ ID NO: 2054295 - DNA, 22 bp, Homo sapiens
gacccctggaccaccagcccca

SEQ ID NO: 2054296 - DNA, 16 bp, Homo sapiens
gaccccttcctttcct

SEQ ID NO: 2054297 - DNA, 17 bp, Homo sapiens
gaccccttcctttcctc

SEQ ID NO: 2054298 - DNA, 13 bp, Homo sapiens
gacccctttcccc

SEQ ID NO: 2054299 - DNA, 16 bp, Homo sapiens
gacccctttcccccac

SEQ ID NO: 2054300 - DNA, 16 bp, Homo sapiens
gacccgctctggacca

SEQ ID NO: 2054301 - DNA, 14 bp, Homo sapiens
gaccctacaggaga

SEQ ID NO: 2054302 - DNA, 14 bp, Homo sapiens
gaccctaccccacc

SEQ ID NO: 2054303 - DNA, 19 bp, Homo sapiens
gaccctcactgctggggag

SEQ ID NO: 2054304 - DNA, 14 bp, Homo sapiens
gaccctccctacct

SEQ ID NO: 2054305 - DNA, 18 bp, Homo sapiens
gaccctcctccactccac

SEQ ID NO: 2054306 - DNA, 23 bp, Homo sapiens
gaccctcctccactccacctcca

SEQ ID NO: 2054307 - DNA, 22 bp, Homo sapiens
gaccctcctcctcccccagagg

SEQ ID NO: 2054308 - DNA, 14 bp, Homo sapiens
gaccctcgcagcag

SEQ ID NO: 2054309 - DNA, 15 bp, Homo sapiens
gaccctcgcagcagg

SEQ ID NO: 2054310 - DNA, 16 bp, Homo sapiens
gaccctcgcagcaggt

SEQ ID NO: 2054311 - DNA, 20 bp, Homo sapiens
gaccctctgaatggtccagg

SEQ ID NO: 2054312 - DNA, 21 bp, Homo sapiens
gaccctgcccatacccctgcc

SEQ ID NO: 2054313 - DNA, 15 bp, Homo sapiens
gaccctgcctgagcc

SEQ ID NO: 2054314 - DNA, 20 bp, Homo sapiens
gaccctgcgaaggggccctg

SEQ ID NO: 2054315 - DNA, 22 bp, Homo sapiens
gaccctgcgaaggggccctggt

SEQ ID NO: 2054316 - DNA, 20 bp, Homo sapiens
gaccctggaattcagcaccc

SEQ ID NO: 2054317 - DNA, 21 bp, Homo sapiens
gaccctggaattcagcaccct

SEQ ID NO: 2054318 - DNA, 12 bp, Homo sapiens
gaccctgtctct

SEQ ID NO: 2054319 - DNA, 16 bp, Homo sapiens
gaccctgttttccaca

SEQ ID NO: 2054320 - DNA, 17 bp, Homo sapiens
gaccctgttttccacac

SEQ ID NO: 2054321 - DNA, 18 bp, Homo sapiens
gaccctgttttccacacc

SEQ ID NO: 2054322 - DNA, 15 bp, Homo sapiens
gacccttcagggcca

SEQ ID NO: 2054323 - DNA, 21 bp, Homo sapiens
gaccctttccttccttccctg

SEQ ID NO: 2054324 - DNA, 22 bp, Homo sapiens
gaccctttccttccttccctgg

SEQ ID NO: 2054325 - DNA, 16 bp, Homo sapiens
gaccgcgtagagagcc

SEQ ID NO: 2054326 - DNA, 20 bp, Homo sapiens
gaccgctacaccactctggc

SEQ ID NO: 2054327 - DNA, 18 bp, Homo sapiens
gaccgcttcacccctgca

SEQ ID NO: 2054328 - DNA, 17 bp, Homo sapiens
gaccgcttcccagaggc

SEQ ID NO: 2054329 - DNA, 14 bp, Homo sapiens
gaccgggggccaga

SEQ ID NO: 2054330 - DNA, 15 bp, Homo sapiens
gaccggtacagaaag

SEQ ID NO: 2054331 - DNA, 21 bp, Homo sapiens
gaccgtgatttggaagagagg

SEQ ID NO: 2054332 - DNA, 23 bp, Homo sapiens
gaccgtgatttggaagagaggca

SEQ ID NO: 2054333 - DNA, 17 bp, Homo sapiens
gaccgtggccctgccct

SEQ ID NO: 2054334 - DNA, 12 bp, Homo sapiens
gacctaaatgac

SEQ ID NO: 2054335 - DNA, 16 bp, Homo sapiens
gacctaaatgacctca

SEQ ID NO: 2054336 - DNA, 21 bp, Homo sapiens
gacctaacctaagcaaaacca

SEQ ID NO: 2054337 - DNA, 20 bp, Homo sapiens
gacctactaaaaatataaaa

SEQ ID NO: 2054338 - DNA, 14 bp, Homo sapiens
gacctagacctggg

SEQ ID NO: 2054339 - DNA, 21 bp, Homo sapiens
gacctatgtcctaaggacaca

SEQ ID NO: 2054340 - DNA, 21 bp, Homo sapiens
gacctcacagtgacccttccc

SEQ ID NO: 2054341 - DNA, 11 bp, Homo sapiens
gacctcagcca

SEQ ID NO: 2054342 - DNA, 20 bp, Homo sapiens
gacctcagccttccccttgc

SEQ ID NO: 2054343 - DNA, 16 bp, Homo sapiens
gacctcagctgcacat

SEQ ID NO: 2054344 - DNA, 17 bp, Homo sapiens
gacctcagctgcacatt

SEQ ID NO: 2054345 - DNA, 21 bp, Homo sapiens
gacctcagctgcacattcctg

SEQ ID NO: 2054346 - DNA, 21 bp, Homo sapiens
gacctcagttttatcattttc

SEQ ID NO: 2054347 - DNA, 20 bp, Homo sapiens
gacctcatatcttcctcatc

SEQ ID NO: 2054348 - DNA, 16 bp, Homo sapiens
gacctccagctttcct

SEQ ID NO: 2054349 - DNA, 16 bp, Homo sapiens
gacctccggggagagc

SEQ ID NO: 2054350 - DNA, 17 bp, Homo sapiens
gacctcctaacaagtag

SEQ ID NO: 2054351 - DNA, 13 bp, Homo sapiens
gacctcgtcctcc

SEQ ID NO: 2054352 - DNA, 15 bp, Homo sapiens
gacctcgtcctcccc

SEQ ID NO: 2054353 - DNA, 18 bp, Homo sapiens
gacctcgtcctccccctg

SEQ ID NO: 2054354 - DNA, 22 bp, Homo sapiens
gacctcgtcctccccctgccag

SEQ ID NO: 2054355 - DNA, 16 bp, Homo sapiens
gacctcgtttgggagt

SEQ ID NO: 2054356 - DNA, 17 bp, Homo sapiens
gacctcgtttgggagtg

SEQ ID NO: 2054357 - DNA, 16 bp, Homo sapiens
gacctctgctctgagg

SEQ ID NO: 2054358 - DNA, 12 bp, Homo sapiens
gacctgaagaat

SEQ ID NO: 2054359 - DNA, 17 bp, Homo sapiens
gacctgaccggcacctg

SEQ ID NO: 2054360 - DNA, 11 bp, Homo sapiens
gacctgagcct

SEQ ID NO: 2054361 - DNA, 14 bp, Homo sapiens
gacctgaggctcct

SEQ ID NO: 2054362 - DNA, 20 bp, Homo sapiens
gacctgaggctcctgtgcta

SEQ ID NO: 2054363 - DNA, 17 bp, Homo sapiens
gacctgagtcggcccca

SEQ ID NO: 2054364 - DNA, 21 bp, Homo sapiens
gacctgagtcggccccacatg

SEQ ID NO: 2054365 - DNA, 15 bp, Homo sapiens
gacctgatcacctct

SEQ ID NO: 2054366 - DNA, 23 bp, Homo sapiens
gacctgatcattacatggctgtg

SEQ ID NO: 2054367 - DNA, 20 bp, Homo sapiens
gacctgcctctcacacacat

SEQ ID NO: 2054368 - DNA, 20 bp, Homo sapiens
gacctgcggctgctgtgtgc

SEQ ID NO: 2054369 - DNA, 14 bp, Homo sapiens
gacctgctgagctc

SEQ ID NO: 2054370 - DNA, 20 bp, Homo sapiens
gacctgggccaaaagggcag

SEQ ID NO: 2054371 - DNA, 21 bp, Homo sapiens
gacctgggccaaaagggcagc

SEQ ID NO: 2054372 - DNA, 18 bp, Homo sapiens
gacctgttagatgtgaca

SEQ ID NO: 2054373 - DNA, 18 bp, Homo sapiens
gagatgtttttaaaagtt

SEQ ID NO: 2054374 - DNA, 13 bp, Homo sapiens
gagattaatttgt

SEQ ID NO: 2054375 - DNA, 14 bp, Homo sapiens
gagatttcaacata

SEQ ID NO: 2054376 - DNA, 14 bp, Homo sapiens
gagatttgccagca

SEQ ID NO: 2054377 - DNA, 15 bp, Homo sapiens
gagatttgccagcac

SEQ ID NO: 2054378 - DNA, 18 bp, Homo sapiens
gagatttgccagcacagg

SEQ ID NO: 2054379 - DNA, 22 bp, Homo sapiens
gagatttgccagcacaggggcc

SEQ ID NO: 2054380 - DNA, 17 bp, Homo sapiens
gagatttgtatttatat

SEQ ID NO: 2054381 - DNA, 21 bp, Homo sapiens
gagatttgtatttatattaga

SEQ ID NO: 2054382 - DNA, 12 bp, Homo sapiens
gagattttcctt

SEQ ID NO: 2054383 - DNA, 16 bp, Homo sapiens
gagattttcttggcag

SEQ ID NO: 2054384 - DNA, 18 bp, Homo sapiens
gagattttgtcgggacag

SEQ ID NO: 2054385 - DNA, 14 bp, Homo sapiens
gagcaaatgtttct

SEQ ID NO: 2054386 - DNA, 16 bp, Homo sapiens
gagcaaatgtttctgc

SEQ ID NO: 2054387 - DNA, 19 bp, Homo sapiens
gagcaaatgtttctgcagt

SEQ ID NO: 2054388 - DNA, 16 bp, Homo sapiens
gagcaacccctgtacc

SEQ ID NO: 2054389 - DNA, 20 bp, Homo sapiens
gagcaaccgtggcccttcct

SEQ ID NO: 2054390 - DNA, 13 bp, Homo sapiens
gagcaactctcca

SEQ ID NO: 2054391 - DNA, 15 bp, Homo sapiens
gagcaactctccact

SEQ ID NO: 2054392 - DNA, 16 bp, Homo sapiens
gagcaactctccactc

SEQ ID NO: 2054393 - DNA, 14 bp, Homo sapiens
gagcaagagctggc

SEQ ID NO: 2054394 - DNA, 16 bp, Homo sapiens
gagcaattcatttcac

SEQ ID NO: 2054395 - DNA, 13 bp, Homo sapiens
gagcaatttgcac

SEQ ID NO: 2054396 - DNA, 22 bp, Homo sapiens
gagcacacaggtacagcaacag

SEQ ID NO: 2054397 - DNA, 18 bp, Homo sapiens
gagcacacggccctgccc

SEQ ID NO: 2054398 - DNA, 23 bp, Homo sapiens
gagcacacggccctgccccatcc

SEQ ID NO: 2054399 - DNA, 12 bp, Homo sapiens
gagcacagccct

SEQ ID NO: 2054400 - DNA, 14 bp, Homo sapiens
gagcacagccctgg

SEQ ID NO: 2054401 - DNA, 15 bp, Homo sapiens
gagcacagccctggg

SEQ ID NO: 2054402 - DNA, 13 bp, Homo sapiens
gagcacaggcagc

SEQ ID NO: 2054403 - DNA, 12 bp, Homo sapiens
gagcaccccctc

SEQ ID NO: 2054404 - DNA, 18 bp, Homo sapiens
gagcaccccctcattccc

SEQ ID NO: 2054405 - DNA, 13 bp, Homo sapiens
gagcaccctctcc

SEQ ID NO: 2054406 - DNA, 20 bp, Homo sapiens
gagcacctgaaccccatggg

SEQ ID NO: 2054407 - DNA, 15 bp, Homo sapiens
gagcactaaggtgtg

SEQ ID NO: 2054408 - DNA, 16 bp, Homo sapiens
gagcactgccaggagg

SEQ ID NO: 2054409 - DNA, 17 bp, Homo sapiens
gagcactgccaggaggg

SEQ ID NO: 2054410 - DNA, 18 bp, Homo sapiens
gagcactgccaggaggga

SEQ ID NO: 2054411 - DNA, 19 bp, Homo sapiens
gagcactgccaggagggac

SEQ ID NO: 2054412 - DNA, 23 bp, Homo sapiens
gagcactggccagagagggccca

SEQ ID NO: 2054413 - DNA, 13 bp, Homo sapiens
gagcactgggttg

SEQ ID NO: 2054414 - DNA, 17 bp, Homo sapiens
gagcactgggttgactt

SEQ ID NO: 2054415 - DNA, 20 bp, Homo sapiens
gagcacttgcgtcctgcaga

SEQ ID NO: 2054416 - DNA, 19 bp, Homo sapiens
gagcagaaagccagggtcc

SEQ ID NO: 2054417 - DNA, 12 bp, Homo sapiens
gagcagaaataa

SEQ ID NO: 2054418 - DNA, 13 bp, Homo sapiens
gagcagaaataaa

SEQ ID NO: 2054419 - DNA, 12 bp, Homo sapiens
gagcagacagag

SEQ ID NO: 2054420 - DNA, 14 bp, Homo sapiens
gagcagacagagaa

SEQ ID NO: 2054421 - DNA, 15 bp, Homo sapiens
gagcagacagagaaa

SEQ ID NO: 2054422 - DNA, 15 bp, Homo sapiens
gagcagacaggagga

SEQ ID NO: 2054423 - DNA, 19 bp, Homo sapiens
gagcagaggagtccagggc

SEQ ID NO: 2054424 - DNA, 15 bp, Homo sapiens
gagcagcctgatggc

SEQ ID NO: 2054425 - DNA, 16 bp, Homo sapiens
gagcagctgagcaggg

SEQ ID NO: 2054426 - DNA, 17 bp, Homo sapiens
gagcagctgagcagggc

SEQ ID NO: 2054427 - DNA, 11 bp, Homo sapiens
gagcagctggc

SEQ ID NO: 2054428 - DNA, 16 bp, Homo sapiens
gagcagctggctctcc

SEQ ID NO: 2054429 - DNA, 13 bp, Homo sapiens
gagcaggaacaga

SEQ ID NO: 2054430 - DNA, 14 bp, Homo sapiens
gagcaggaacagag

SEQ ID NO: 2054431 - DNA, 18 bp, Homo sapiens
gagcaggaacagagactc

SEQ ID NO: 2054432 - DNA, 19 bp, Homo sapiens
gagcaggaacagagactct

SEQ ID NO: 2054433 - DNA, 15 bp, Homo sapiens
gagcaggccacgctc

SEQ ID NO: 2054434 - DNA, 12 bp, Homo sapiens
gagcaggcccga

SEQ ID NO: 2054435 - DNA, 17 bp, Homo sapiens
gagcaggcccgacagag

SEQ ID NO: 2054436 - DNA, 19 bp, Homo sapiens
gagcaggcccgacagagag

SEQ ID NO: 2054437 - DNA, 22 bp, Homo sapiens
gagcaggcccgacagagagatg

SEQ ID NO: 2054438 - DNA, 16 bp, Homo sapiens
gagcaggctcagactc

SEQ ID NO: 2054439 - DNA, 14 bp, Homo sapiens
gagcagggctcagc

SEQ ID NO: 2054440 - DNA, 16 bp, Homo sapiens
gagcaggggtctgagc

SEQ ID NO: 2054441 - DNA, 16 bp, Homo sapiens
gagcagggtgctgtgg

SEQ ID NO: 2054442 - DNA, 17 bp, Homo sapiens
gagcaggtctctggcag

SEQ ID NO: 2054443 - DNA, 20 bp, Homo sapiens
gagcaggtctctggcagaga

SEQ ID NO: 2054444 - DNA, 21 bp, Homo sapiens
gagcagtggccgcaagcgcag

SEQ ID NO: 2054445 - DNA, 19 bp, Homo sapiens
gagcatcatgcctctgagg

SEQ ID NO: 2054446 - DNA, 20 bp, Homo sapiens
gagcatcatgcctctgaggc

SEQ ID NO: 2054447 - DNA, 18 bp, Homo sapiens
gagcatctcttgaggcca

SEQ ID NO: 2054448 - DNA, 23 bp, Homo sapiens
gagcatctcttgaggccaggagt

SEQ ID NO: 2054449 - DNA, 17 bp, Homo sapiens
gagcatgcacagctgct

SEQ ID NO: 2054450 - DNA, 19 bp, Homo sapiens
gagcatgcacagctgcttg

SEQ ID NO: 2054451 - DNA, 17 bp, Homo sapiens
gagcattacgtgagcca

SEQ ID NO: 2054452 - DNA, 23 bp, Homo sapiens
gagccaaacacactgtaaatatc

SEQ ID NO: 2054453 - DNA, 19 bp, Homo sapiens
gagccaatttaaagaaaac

SEQ ID NO: 2054454 - DNA, 19 bp, Homo sapiens
gagccacagaccacctgct

SEQ ID NO: 2054455 - DNA, 20 bp, Homo sapiens
gagccaccagggcactgtct

SEQ ID NO: 2054456 - DNA, 22 bp, Homo sapiens
gagccaccagggcactgtctgc

SEQ ID NO: 2054457 - DNA, 18 bp, Homo sapiens
gagccactgcaccgggcc

SEQ ID NO: 2054458 - DNA, 20 bp, Homo sapiens
gagccactgcaccgggccac

SEQ ID NO: 2054459 - DNA, 22 bp, Homo sapiens
gagccactgcaccgggccacag

SEQ ID NO: 2054460 - DNA, 21 bp, Homo sapiens
gagccagaacctggagggcta

SEQ ID NO: 2054461 - DNA, 14 bp, Homo sapiens
gagccagccctccc

SEQ ID NO: 2054462 - DNA, 15 bp, Homo sapiens
gagccagcctgctcc

SEQ ID NO: 2054463 - DNA, 19 bp, Homo sapiens
gagccaggctctgcctgga

SEQ ID NO: 2054464 - DNA, 15 bp, Homo sapiens
gagccatgggcctgg

SEQ ID NO: 2054465 - DNA, 17 bp, Homo sapiens
gagccatgggcctgggc

SEQ ID NO: 2054466 - DNA, 18 bp, Homo sapiens
gagccatgggcctgggcc

SEQ ID NO: 2054467 - DNA, 16 bp, Homo sapiens
gagcccaagtgccatc

SEQ ID NO: 2054468 - DNA, 19 bp, Homo sapiens
gagcccaagtgccatccca

SEQ ID NO: 2054469 - DNA, 17 bp, Homo sapiens
gagcccagagggccaag

SEQ ID NO: 2054470 - DNA, 14 bp, Homo sapiens
gagcccagctacat

SEQ ID NO: 2054471 - DNA, 18 bp, Homo sapiens
gagcccagctacattcct

SEQ ID NO: 2054472 - DNA, 21 bp, Homo sapiens
gagcccagctacattcctcag

SEQ ID NO: 2054473 - DNA, 11 bp, Homo sapiens
gagcccaggga

SEQ ID NO: 2054474 - DNA, 17 bp, Homo sapiens
gagcccagggaggccga

SEQ ID NO: 2054475 - DNA, 20 bp, Homo sapiens
gagcccagggaggccgaagc

SEQ ID NO: 2054476 - DNA, 14 bp, Homo sapiens
gagccccacacgga

SEQ ID NO: 2054477 - DNA, 16 bp, Homo sapiens
gagccccaggcctctg

SEQ ID NO: 2054478 - DNA, 12 bp, Homo sapiens
gagcccccaagc

SEQ ID NO: 2054479 - DNA, 18 bp, Homo sapiens
gagcccccaagcctctgc

SEQ ID NO: 2054480 - DNA, 14 bp, Homo sapiens
gagccccgaggcct

SEQ ID NO: 2054481 - DNA, 16 bp, Homo sapiens
gagcccctccctgcta

SEQ ID NO: 2054482 - DNA, 14 bp, Homo sapiens
gagcccctggtcct

SEQ ID NO: 2054483 - DNA, 20 bp, Homo sapiens
gagcccctggtcctgagggt

SEQ ID NO: 2054484 - DNA, 13 bp, Homo sapiens
gagccctgagctc

SEQ ID NO: 2054485 - DNA, 14 bp, Homo sapiens
gagccctgagctca

SEQ ID NO: 2054486 - DNA, 18 bp, Homo sapiens
gagccctgagctcaggct

SEQ ID NO: 2054487 - DNA, 22 bp, Homo sapiens
gagccctgagctcaggctgagc

SEQ ID NO: 2054488 - DNA, 16 bp, Homo sapiens
gagccctgctgtggga

SEQ ID NO: 2054489 - DNA, 21 bp, Homo sapiens
gaggtgtcaccctgcagagct

SEQ ID NO: 2054490 - DNA, 22 bp, Homo sapiens
gaggtgtcaccctgcagagcta

SEQ ID NO: 2054491 - DNA, 14 bp, Homo sapiens
gaggtgtcccaagc

SEQ ID NO: 2054492 - DNA, 21 bp, Homo sapiens
gaggttaaaatataaattaag

SEQ ID NO: 2054493 - DNA, 14 bp, Homo sapiens
gaggttaaggtggg

SEQ ID NO: 2054494 - DNA, 13 bp, Homo sapiens
gaggttatctgcc

SEQ ID NO: 2054495 - DNA, 15 bp, Homo sapiens
gaggttatctgcctg

SEQ ID NO: 2054496 - DNA, 23 bp, Homo sapiens
gaggttatctgcctggcctggct

SEQ ID NO: 2054497 - DNA, 16 bp, Homo sapiens
gaggttctggggagga

SEQ ID NO: 2054498 - DNA, 19 bp, Homo sapiens
gaggttctggggaggaagg

SEQ ID NO: 2054499 - DNA, 13 bp, Homo sapiens
gaggttgcaggga

SEQ ID NO: 2054500 - DNA, 14 bp, Homo sapiens
gaggttgtggatgc

SEQ ID NO: 2054501 - DNA, 21 bp, Homo sapiens
gagtaccaaatccacaagcca

SEQ ID NO: 2054502 - DNA, 15 bp, Homo sapiens
gagtacctcaaagga

SEQ ID NO: 2054503 - DNA, 17 bp, Homo sapiens
gagtagaaagacagagc

SEQ ID NO: 2054504 - DNA, 15 bp, Homo sapiens
gagtagctgagagga

SEQ ID NO: 2054505 - DNA, 17 bp, Homo sapiens
gagtagctgagaggaag

SEQ ID NO: 2054506 - DNA, 20 bp, Homo sapiens
gagtagctgagaggaagatg

SEQ ID NO: 2054507 - DNA, 15 bp, Homo sapiens
gagtagctgagctca

SEQ ID NO: 2054508 - DNA, 15 bp, Homo sapiens
gagtagtgcatttaa

SEQ ID NO: 2054509 - DNA, 17 bp, Homo sapiens
gagtagtttttcagcta

SEQ ID NO: 2054510 - DNA, 18 bp, Homo sapiens
gagtatacaatatataaa

SEQ ID NO: 2054511 - DNA, 15 bp, Homo sapiens
gagtatatatgtaca

SEQ ID NO: 2054512 - DNA, 17 bp, Homo sapiens
gagtattaagaatgcag

SEQ ID NO: 2054513 - DNA, 15 bp, Homo sapiens
gagtcaaaagcctgg

SEQ ID NO: 2054514 - DNA, 15 bp, Homo sapiens
gagtcaccaagccca

SEQ ID NO: 2054515 - DNA, 16 bp, Homo sapiens
gagtcaccaagcccag

SEQ ID NO: 2054516 - DNA, 20 bp, Homo sapiens
gagtcacccatgaagacagg

SEQ ID NO: 2054517 - DNA, 12 bp, Homo sapiens
gagtcacctcct

SEQ ID NO: 2054518 - DNA, 15 bp, Homo sapiens
gagtcacctgcaagc

SEQ ID NO: 2054519 - DNA, 22 bp, Homo sapiens
gagtcacctgcaagccccaggg

SEQ ID NO: 2054520 - DNA, 11 bp, Homo sapiens
gagtcagcctt

SEQ ID NO: 2054521 - DNA, 17 bp, Homo sapiens
gagtcaggacctccggg

SEQ ID NO: 2054522 - DNA, 16 bp, Homo sapiens
gagtcatgatctccct

SEQ ID NO: 2054523 - DNA, 18 bp, Homo sapiens
gagtcatgatctccctgc

SEQ ID NO: 2054524 - DNA, 19 bp, Homo sapiens
gagtcatgatctccctgcc

SEQ ID NO: 2054525 - DNA, 14 bp, Homo sapiens
gagtcattgttaca

SEQ ID NO: 2054526 - DNA, 15 bp, Homo sapiens
gagtccagggcggga

SEQ ID NO: 2054527 - DNA, 20 bp, Homo sapiens
gagtccagggcgggagtggg

SEQ ID NO: 2054528 - DNA, 14 bp, Homo sapiens
gagtcccaaggaaa

SEQ ID NO: 2054529 - DNA, 20 bp, Homo sapiens
gagtcccaccttggctgcag

SEQ ID NO: 2054530 - DNA, 22 bp, Homo sapiens
gagtcccctactcccctgatcc

SEQ ID NO: 2054531 - DNA, 15 bp, Homo sapiens
gagtcctgtctctgc

SEQ ID NO: 2054532 - DNA, 20 bp, Homo sapiens
gagtcctgtctctgcctgcg

SEQ ID NO: 2054533 - DNA, 15 bp, Homo sapiens
gagtcgaggacaggg

SEQ ID NO: 2054534 - DNA, 20 bp, Homo sapiens
gagtctaggaatgcttttat

SEQ ID NO: 2054535 - DNA, 21 bp, Homo sapiens
gagtctcattctgttgcccag

SEQ ID NO: 2054536 - DNA, 15 bp, Homo sapiens
gagtctcctctctga

SEQ ID NO: 2054537 - DNA, 16 bp, Homo sapiens
gagtctcctctctgag

SEQ ID NO: 2054538 - DNA, 20 bp, Homo sapiens
gagtctcctctctgagactg

SEQ ID NO: 2054539 - DNA, 12 bp, Homo sapiens
gagtctcctgtg

SEQ ID NO: 2054540 - DNA, 13 bp, Homo sapiens
gagtctgaggtcc

SEQ ID NO: 2054541 - DNA, 17 bp, Homo sapiens
gagtctgaggtcctgag

SEQ ID NO: 2054542 - DNA, 18 bp, Homo sapiens
gagtctgaggtcctgagc

SEQ ID NO: 2054543 - DNA, 23 bp, Homo sapiens
gagtctgaggtcctgagcactgc

SEQ ID NO: 2054544 - DNA, 14 bp, Homo sapiens
gagtctgagtctga

SEQ ID NO: 2054545 - DNA, 19 bp, Homo sapiens
gagtctgcataaacttcat

SEQ ID NO: 2054546 - DNA, 21 bp, Homo sapiens
gagtctgcataaacttcatct

SEQ ID NO: 2054547 - DNA, 23 bp, Homo sapiens
gagtctgggcaatgaaaccaaag

SEQ ID NO: 2054548 - DNA, 16 bp, Homo sapiens
gagtcttggcctgcct

SEQ ID NO: 2054549 - DNA, 15 bp, Homo sapiens
gagtgaatagctttc

SEQ ID NO: 2054550 - DNA, 22 bp, Homo sapiens
gagtgacacccaagagggctgc

SEQ ID NO: 2054551 - DNA, 14 bp, Homo sapiens
gagtgacagaggca

SEQ ID NO: 2054552 - DNA, 18 bp, Homo sapiens
gagtgacgggagcctcct

SEQ ID NO: 2054553 - DNA, 15 bp, Homo sapiens
gagtgacggtcccac

SEQ ID NO: 2054554 - DNA, 17 bp, Homo sapiens
gagtgactccaagaaca

SEQ ID NO: 2054555 - DNA, 15 bp, Homo sapiens
gagtgactcggtgta

SEQ ID NO: 2054556 - DNA, 23 bp, Homo sapiens
gagtgactcggtgtaaaaccatg

SEQ ID NO: 2054557 - DNA, 23 bp, Homo sapiens
gagtgagaataattgtgtacaaa

SEQ ID NO: 2054558 - DNA, 18 bp, Homo sapiens
gagtgagactctgtctca

SEQ ID NO: 2054559 - DNA, 19 bp, Homo sapiens
gagtgaggcttccaggctc

SEQ ID NO: 2054560 - DNA, 17 bp, Homo sapiens
gagtgcaggcctgctca

SEQ ID NO: 2054561 - DNA, 13 bp, Homo sapiens
gagtgcagtgagc

SEQ ID NO: 2054562 - DNA, 14 bp, Homo sapiens
gagtgccaggactc

SEQ ID NO: 2054563 - DNA, 20 bp, Homo sapiens
gagtgccaggactccccagg

SEQ ID NO: 2054564 - DNA, 14 bp, Homo sapiens
gagtggaatgcagg

SEQ ID NO: 2054565 - DNA, 16 bp, Homo sapiens
gagtggaatgcaggga

SEQ ID NO: 2054566 - DNA, 18 bp, Homo sapiens
gagtggaggaggcctggg

SEQ ID NO: 2054567 - DNA, 12 bp, Homo sapiens
gagtggagtctg

SEQ ID NO: 2054568 - DNA, 17 bp, Homo sapiens
gagtggatctccaagga

SEQ ID NO: 2054569 - DNA, 19 bp, Homo sapiens
gagtggatggatggacaga

SEQ ID NO: 2054570 - DNA, 12 bp, Homo sapiens
gagtggcagcca

SEQ ID NO: 2054571 - DNA, 19 bp, Homo sapiens
gagtggcagccatgcctca

SEQ ID NO: 2054572 - DNA, 24 bp, Homo sapiens
gagtggcagccatgcctcatgcca

SEQ ID NO: 2054573 - DNA, 21 bp, Homo sapiens
gagtggcagctgtcccctctc

SEQ ID NO: 2054574 - DNA, 23 bp, Homo sapiens
gagtggcccctcacctgggcctt

SEQ ID NO: 2054575 - DNA, 15 bp, Homo sapiens
gagtggctcctcccg

SEQ ID NO: 2054576 - DNA, 23 bp, Homo sapiens
gagtggcttgtgattctgggatg

SEQ ID NO: 2054577 - DNA, 16 bp, Homo sapiens
gagtgggctgcctggg

SEQ ID NO: 2054578 - DNA, 21 bp, Homo sapiens
gagtgggggctgtgccgtgaa

SEQ ID NO: 2054579 - DNA, 11 bp, Homo sapiens
gagtgtagtga

SEQ ID NO: 2054580 - DNA, 18 bp, Homo sapiens
gagtgtgggaagggagag

SEQ ID NO: 2054581 - DNA, 23 bp, Homo sapiens
gagtgtgggtgatcagaaggctg

SEQ ID NO: 2054582 - DNA, 17 bp, Homo sapiens
gagtgtgtttgtcaccg

SEQ ID NO: 2054583 - DNA, 21 bp, Homo sapiens
gagtgttcattttagtgactg

SEQ ID NO: 2054584 - DNA, 19 bp, Homo sapiens
gagtgttctgtgggcttgg

SEQ ID NO: 2054585 - DNA, 17 bp, Homo sapiens
gagttatagtttgcttt

SEQ ID NO: 2054586 - DNA, 16 bp, Homo sapiens
gagttattcaaatgaa

SEQ ID NO: 2054587 - DNA, 17 bp, Homo sapiens
gagttattcaaatgaag

SEQ ID NO: 2054588 - DNA, 18 bp, Homo sapiens
gagttcaagcctgtggga

SEQ ID NO: 2054589 - DNA, 20 bp, Homo sapiens
gagttcataccctgttacca

SEQ ID NO: 2054590 - DNA, 17 bp, Homo sapiens
gagttccatgaagacca

SEQ ID NO: 2054591 - DNA, 21 bp, Homo sapiens
gagttccttgatctgtatata

SEQ ID NO: 2054592 - DNA, 19 bp, Homo sapiens
gagttcgagaccagcccag

SEQ ID NO: 2054593 - DNA, 20 bp, Homo sapiens
gagttcgagaccagcctggc

SEQ ID NO: 2054594 - DNA, 15 bp, Homo sapiens
gagttcttgtgccat

SEQ ID NO: 2054595 - DNA, 16 bp, Homo sapiens
gagttgccagggaaga

SEQ ID NO: 2054596 - DNA, 14 bp, Homo sapiens
gagttgctcactca

SEQ ID NO: 2054597 - DNA, 14 bp, Homo sapiens
gagttgcttttcta

SEQ ID NO: 2054598 - DNA, 23 bp, Homo sapiens
gagttgtgagcactctactgcaa

SEQ ID NO: 2054599 - DNA, 20 bp, Homo sapiens
gagtttaactttgggcccag

SEQ ID NO: 2054600 - DNA, 21 bp, Homo sapiens
gagtttaactttgggcccaga

SEQ ID NO: 2054601 - DNA, 22 bp, Homo sapiens
gagtttgagacaagccctggca

SEQ ID NO: 2054602 - DNA, 15 bp, Homo sapiens
gagtttgtgtgtctt

SEQ ID NO: 2054603 - DNA, 15 bp, Homo sapiens
gatttacgctcattg

SEQ ID NO: 2054604 - DNA, 15 bp, Homo sapiens
gatttagaactgtat

SEQ ID NO: 2054605 - DNA, 18 bp, Homo sapiens
gatttatatgtgtaattt

SEQ ID NO: 2054606 - DNA, 20 bp, Homo sapiens
gatttatatgtgtaattttt

SEQ ID NO: 2054607 - DNA, 12 bp, Homo sapiens
gatttatttaaa

SEQ ID NO: 2054608 - DNA, 18 bp, Homo sapiens
gatttatttaaaatagca

SEQ ID NO: 2054609 - DNA, 19 bp, Homo sapiens
gatttcaagaaaaaataaa

SEQ ID NO: 2054610 - DNA, 22 bp, Homo sapiens
gatttcaagaaaaaataaatgg

SEQ ID NO: 2054611 - DNA, 20 bp, Homo sapiens
gatttcaggatactctgtca

SEQ ID NO: 2054612 - DNA, 16 bp, Homo sapiens
gatttcatgctatctc

SEQ ID NO: 2054613 - DNA, 20 bp, Homo sapiens
gatttcatgctatctctgtg

SEQ ID NO: 2054614 - DNA, 21 bp, Homo sapiens
gatttcatttcaactgtttgc

SEQ ID NO: 2054615 - DNA, 20 bp, Homo sapiens
gatttccaagtaatataatg

SEQ ID NO: 2054616 - DNA, 12 bp, Homo sapiens
gatttccaggcc

SEQ ID NO: 2054617 - DNA, 13 bp, Homo sapiens
gatttccaggccc

SEQ ID NO: 2054618 - DNA, 14 bp, Homo sapiens
gatttccaggcccc

SEQ ID NO: 2054619 - DNA, 14 bp, Homo sapiens
gatttcctatttta

SEQ ID NO: 2054620 - DNA, 16 bp, Homo sapiens
gatttcctattttaaa

SEQ ID NO: 2054621 - DNA, 13 bp, Homo sapiens
gatttctcctgac

SEQ ID NO: 2054622 - DNA, 10 bp, Homo sapiens
gatttctctg

SEQ ID NO: 2054623 - DNA, 11 bp, Homo sapiens
gatttctctga

SEQ ID NO: 2054624 - DNA, 14 bp, Homo sapiens
gatttctctgaaca

SEQ ID NO: 2054625 - DNA, 16 bp, Homo sapiens
gatttcttttaaagaa

SEQ ID NO: 2054626 - DNA, 13 bp, Homo sapiens
gatttgacccact

SEQ ID NO: 2054627 - DNA, 14 bp, Homo sapiens
gatttgagaaattt

SEQ ID NO: 2054628 - DNA, 15 bp, Homo sapiens
gatttgccagcacag

SEQ ID NO: 2054629 - DNA, 17 bp, Homo sapiens
gatttgccagcacaggg

SEQ ID NO: 2054630 - DNA, 20 bp, Homo sapiens
gatttgccagcacaggggcc

SEQ ID NO: 2054631 - DNA, 18 bp, Homo sapiens
gatttgctatcaaaataa

SEQ ID NO: 2054632 - DNA, 21 bp, Homo sapiens
gatttggaagagaggcacctg

SEQ ID NO: 2054633 - DNA, 17 bp, Homo sapiens
gatttgtatttatatta

SEQ ID NO: 2054634 - DNA, 20 bp, Homo sapiens
gatttgtatttatattagag

SEQ ID NO: 2054635 - DNA, 20 bp, Homo sapiens
gattttaacaaaagcaagac

SEQ ID NO: 2054636 - DNA, 13 bp, Homo sapiens
gattttaattttg

SEQ ID NO: 2054637 - DNA, 13 bp, Homo sapiens
gattttatacata

SEQ ID NO: 2054638 - DNA, 15 bp, Homo sapiens
gattttatacatagt

SEQ ID NO: 2054639 - DNA, 20 bp, Homo sapiens
gattttctgctactttgctg

SEQ ID NO: 2054640 - DNA, 14 bp, Homo sapiens
gattttgagtatct

SEQ ID NO: 2054641 - DNA, 13 bp, Homo sapiens
gattttgcctgtg

SEQ ID NO: 2054642 - DNA, 21 bp, Homo sapiens
gattttggtattacactgtat

SEQ ID NO: 2054643 - DNA, 16 bp, Homo sapiens
gattttgtacagaatt

SEQ ID NO: 2054644 - DNA, 17 bp, Homo sapiens
gattttgtacagaattt

SEQ ID NO: 2054645 - DNA, 12 bp, Homo sapiens
gattttgtagtt

SEQ ID NO: 2054646 - DNA, 20 bp, Homo sapiens
gattttgtgttttttcgttc

SEQ ID NO: 2054647 - DNA, 15 bp, Homo sapiens
gattttttaaaagaa

SEQ ID NO: 2054648 - DNA, 16 bp, Homo sapiens
gattttttaaaagaaa

SEQ ID NO: 2054649 - DNA, 17 bp, Homo sapiens
gattttttaaaagaaat

SEQ ID NO: 2054650 - DNA, 16 bp, Homo sapiens
gattttttaataattt

SEQ ID NO: 2054651 - DNA, 19 bp, Homo sapiens
gattttttaataatttaga

SEQ ID NO: 2054652 - DNA, 20 bp, Homo sapiens
gattttttacagctgcctgc

SEQ ID NO: 2054653 - DNA, 15 bp, Homo sapiens
gcaaaaaagaaaacc

SEQ ID NO: 2054654 - DNA, 17 bp, Homo sapiens
gcaaaaaagaaaacctt

SEQ ID NO: 2054655 - DNA, 18 bp, Homo sapiens
gcaaaagaagtaaaagct

SEQ ID NO: 2054656 - DNA, 22 bp, Homo sapiens
gcaaaagtggggctaaatgaag

SEQ ID NO: 2054657 - DNA, 18 bp, Homo sapiens
gcaaaataaatgttttta

SEQ ID NO: 2054658 - DNA, 20 bp, Homo sapiens
gcaaaataattttaaacaaa

SEQ ID NO: 2054659 - DNA, 14 bp, Homo sapiens
gcaaacactgtgta

SEQ ID NO: 2054660 - DNA, 20 bp, Homo sapiens
gcaaacatttcttaaaatgt

SEQ ID NO: 2054661 - DNA, 14 bp, Homo sapiens
gcaaaccaggactc

SEQ ID NO: 2054662 - DNA, 18 bp, Homo sapiens
gcaaaccatttcaaatgg

SEQ ID NO: 2054663 - DNA, 16 bp, Homo sapiens
gcaaacccttctcttc

SEQ ID NO: 2054664 - DNA, 19 bp, Homo sapiens
gcaaacccttctcttctcc

SEQ ID NO: 2054665 - DNA, 17 bp, Homo sapiens
gcaaactcactgctcaa

SEQ ID NO: 2054666 - DNA, 17 bp, Homo sapiens
gcaaagaactgccccat

SEQ ID NO: 2054667 - DNA, 21 bp, Homo sapiens
gcaaagcaccagcttctccag

SEQ ID NO: 2054668 - DNA, 19 bp, Homo sapiens
gcaaagcctgttcatggca

SEQ ID NO: 2054669 - DNA, 21 bp, Homo sapiens
gcaaagcctgttcatggcaga

SEQ ID NO: 2054670 - DNA, 19 bp, Homo sapiens
gcaaagggctgaaagccat

SEQ ID NO: 2054671 - DNA, 18 bp, Homo sapiens
gcaaaggtggctctccag

SEQ ID NO: 2054672 - DNA, 13 bp, Homo sapiens
gcaaagttatatt

SEQ ID NO: 2054673 - DNA, 23 bp, Homo sapiens
gcaaagttccctacttcctgtga

SEQ ID NO: 2054674 - DNA, 14 bp, Homo sapiens
gcaaatactccaag

SEQ ID NO: 2054675 - DNA, 11 bp, Homo sapiens
gcaaatataaa

SEQ ID NO: 2054676 - DNA, 14 bp, Homo sapiens
gcaaatataaaact

SEQ ID NO: 2054677 - DNA, 19 bp, Homo sapiens
gcaaatataagctgggaaa

SEQ ID NO: 2054678 - DNA, 18 bp, Homo sapiens
gcaaatattagcaaagaa

SEQ ID NO: 2054679 - DNA, 18 bp, Homo sapiens
gcaaatgcaacaaaatat

SEQ ID NO: 2054680 - DNA, 23 bp, Homo sapiens
gcaaatgtagtatggcctgtgtc

SEQ ID NO: 2054681 - DNA, 15 bp, Homo sapiens
gcaaatgtggctcct

SEQ ID NO: 2054682 - DNA, 12 bp, Homo sapiens
gcaaattagtaa

SEQ ID NO: 2054683 - DNA, 22 bp, Homo sapiens
gcaaatttcaaaagacatgttg

SEQ ID NO: 2054684 - DNA, 18 bp, Homo sapiens
gcaacaagagcaaaatga

SEQ ID NO: 2054685 - DNA, 19 bp, Homo sapiens
gcaacacaagctggaagca

SEQ ID NO: 2054686 - DNA, 17 bp, Homo sapiens
gcaacagaaaaatggag

SEQ ID NO: 2054687 - DNA, 18 bp, Homo sapiens
gcaacaggaatctcagag

SEQ ID NO: 2054688 - DNA, 20 bp, Homo sapiens
gcaacaggttttataatttt

SEQ ID NO: 2054689 - DNA, 16 bp, Homo sapiens
gcaacagtagcaggga

SEQ ID NO: 2054690 - DNA, 13 bp, Homo sapiens
gcaaccacacacc

SEQ ID NO: 2054691 - DNA, 14 bp, Homo sapiens
gcaacccccagcct

SEQ ID NO: 2054692 - DNA, 15 bp, Homo sapiens
gcaacccccagcctg

SEQ ID NO: 2054693 - DNA, 16 bp, Homo sapiens
gcaacccccagcctgc

SEQ ID NO: 2054694 - DNA, 22 bp, Homo sapiens
gcaacccttagagattgcccca

SEQ ID NO: 2054695 - DNA, 19 bp, Homo sapiens
gcaacctccacctcctgag

SEQ ID NO: 2054696 - DNA, 12 bp, Homo sapiens
gcaacctcccaa

SEQ ID NO: 2054697 - DNA, 20 bp, Homo sapiens
gcaacctgttcttcctacca

SEQ ID NO: 2054698 - DNA, 17 bp, Homo sapiens
gcaaccttcattttaca

SEQ ID NO: 2054699 - DNA, 18 bp, Homo sapiens
gcaaccttcattttacat

SEQ ID NO: 2054700 - DNA, 16 bp, Homo sapiens
gcaactcggagagggc

SEQ ID NO: 2054701 - DNA, 19 bp, Homo sapiens
gcaactcggagagggctgc

SEQ ID NO: 2054702 - DNA, 15 bp, Homo sapiens
gcaactgaggcagac

SEQ ID NO: 2054703 - DNA, 21 bp, Homo sapiens
gcaactgaggcagacagcagc

SEQ ID NO: 2054704 - DNA, 14 bp, Homo sapiens
gcaacttgcttcta

SEQ ID NO: 2054705 - DNA, 18 bp, Homo sapiens
gcaagaacctaaagtagc

SEQ ID NO: 2054706 - DNA, 14 bp, Homo sapiens
gcaagaagaatata

SEQ ID NO: 2054707 - DNA, 20 bp, Homo sapiens
gcaagaaggcaaaaatagtt

SEQ ID NO: 2054708 - DNA, 21 bp, Homo sapiens
gcaagaaggcaaaaatagttt

SEQ ID NO: 2054709 - DNA, 23 bp, Homo sapiens
gcaagaaggcaaaaatagtttgg

SEQ ID NO: 2054710 - DNA, 15 bp, Homo sapiens
gcaagacctgttggt

SEQ ID NO: 2054711 - DNA, 17 bp, Homo sapiens
gcaagacgtcctggaat

SEQ ID NO: 2054712 - DNA, 22 bp, Homo sapiens
gcaagacttctctttgcctcaa

SEQ ID NO: 2054713 - DNA, 15 bp, Homo sapiens
gcaagagaaaataaa

SEQ ID NO: 2054714 - DNA, 15 bp, Homo sapiens
gcaagagacagagcc

SEQ ID NO: 2054715 - DNA, 21 bp, Homo sapiens
gcaagagacagagcccccaag

SEQ ID NO: 2054716 - DNA, 20 bp, Homo sapiens
gcaagagactctggcctcca

SEQ ID NO: 2054717 - DNA, 16 bp, Homo sapiens
gcaagatatttatata

SEQ ID NO: 2054718 - DNA, 21 bp, Homo sapiens
gcagcagctgggacccctccc

SEQ ID NO: 2054719 - DNA, 23 bp, Homo sapiens
gcagcagcttttaatacagggta

SEQ ID NO: 2054720 - DNA, 17 bp, Homo sapiens
gcagcaggaggctagca

SEQ ID NO: 2054721 - DNA, 21 bp, Homo sapiens
gcagcaggtgcaagagacaga

SEQ ID NO: 2054722 - DNA, 20 bp, Homo sapiens
gcagcaggtggcagaatggg

SEQ ID NO: 2054723 - DNA, 21 bp, Homo sapiens
gcagcagtgagtctcttcaga

SEQ ID NO: 2054724 - DNA, 21 bp, Homo sapiens
gcagcagttccatgaagacac

SEQ ID NO: 2054725 - DNA, 21 bp, Homo sapiens
gcagcatcttcaaacatgtac

SEQ ID NO: 2054726 - DNA, 15 bp, Homo sapiens
gcagcattcagcaca

SEQ ID NO: 2054727 - DNA, 21 bp, Homo sapiens
gcagccaaacccatgaggcaa

SEQ ID NO: 2054728 - DNA, 19 bp, Homo sapiens
gcagccacacttctcagga

SEQ ID NO: 2054729 - DNA, 15 bp, Homo sapiens
gcagccaccctgagg

SEQ ID NO: 2054730 - DNA, 12 bp, Homo sapiens
gcagccagccag

SEQ ID NO: 2054731 - DNA, 17 bp, Homo sapiens
gcagccagccagtcttg

SEQ ID NO: 2054732 - DNA, 20 bp, Homo sapiens
gcagccagccagtcttgcct

SEQ ID NO: 2054733 - DNA, 16 bp, Homo sapiens
gcagccagcccagccc

SEQ ID NO: 2054734 - DNA, 17 bp, Homo sapiens
gcagccagcccagccca

SEQ ID NO: 2054735 - DNA, 16 bp, Homo sapiens
gcagccagccctgcct

SEQ ID NO: 2054736 - DNA, 18 bp, Homo sapiens
gcagccagccctgcctgg

SEQ ID NO: 2054737 - DNA, 18 bp, Homo sapiens
gcagccagctctcagcca

SEQ ID NO: 2054738 - DNA, 19 bp, Homo sapiens
gcagccaggggctgctcat

SEQ ID NO: 2054739 - DNA, 14 bp, Homo sapiens
gcagccatgcctca

SEQ ID NO: 2054740 - DNA, 16 bp, Homo sapiens
gcagcccagcttcctg

SEQ ID NO: 2054741 - DNA, 22 bp, Homo sapiens
gcagcccatggcctctggccag

SEQ ID NO: 2054742 - DNA, 16 bp, Homo sapiens
gcagccccccagcact

SEQ ID NO: 2054743 - DNA, 21 bp, Homo sapiens
gcagcccgaagcccagtttcc

SEQ ID NO: 2054744 - DNA, 18 bp, Homo sapiens
gcagccctcctcaccccg

SEQ ID NO: 2054745 - DNA, 18 bp, Homo sapiens
gcagccctgggggccagc

SEQ ID NO: 2054746 - DNA, 14 bp, Homo sapiens
gcagccgccgggca

SEQ ID NO: 2054747 - DNA, 16 bp, Homo sapiens
gcagccgccgggcagg

SEQ ID NO: 2054748 - DNA, 16 bp, Homo sapiens
gcagccgctaggagag

SEQ ID NO: 2054749 - DNA, 17 bp, Homo sapiens
gcagccgctaggagaga

SEQ ID NO: 2054750 - DNA, 15 bp, Homo sapiens
gcagccgtgccttca

SEQ ID NO: 2054751 - DNA, 17 bp, Homo sapiens
gcagccgtgccttcagc

SEQ ID NO: 2054752 - DNA, 20 bp, Homo sapiens
gcagcctcaacctcctgggc

SEQ ID NO: 2054753 - DNA, 21 bp, Homo sapiens
gcagcctcaacctcctgggct

SEQ ID NO: 2054754 - DNA, 15 bp, Homo sapiens
gcagcctccagagcc

SEQ ID NO: 2054755 - DNA, 21 bp, Homo sapiens
gcagcctccagagccagcctg

SEQ ID NO: 2054756 - DNA, 14 bp, Homo sapiens
gcagcctccctctg

SEQ ID NO: 2054757 - DNA, 22 bp, Homo sapiens
gcagcctccctctgacctgcag

SEQ ID NO: 2054758 - DNA, 14 bp, Homo sapiens
gcagcctcctcctg

SEQ ID NO: 2054759 - DNA, 18 bp, Homo sapiens
gcagcctcctgggcagtc

SEQ ID NO: 2054760 - DNA, 17 bp, Homo sapiens
gcagcctgatggccaag

SEQ ID NO: 2054761 - DNA, 19 bp, Homo sapiens
gcagcctgatggccaaggg

SEQ ID NO: 2054762 - DNA, 23 bp, Homo sapiens
gcagcctgatggccaagggggtg

SEQ ID NO: 2054763 - DNA, 18 bp, Homo sapiens
gcagcctggcggggcagg

SEQ ID NO: 2054764 - DNA, 19 bp, Homo sapiens
gcagcctggcggggcagga

SEQ ID NO: 2054765 - DNA, 20 bp, Homo sapiens
gcagcctggcggggcaggag

SEQ ID NO: 2054766 - DNA, 21 bp, Homo sapiens
gcagcctggcggggcaggagg

SEQ ID NO: 2054767 - DNA, 15 bp, Homo sapiens
gcagccttggcaaac

SEQ ID NO: 2054768 - DNA, 15 bp, Homo sapiens
gcagcctttctgtgg

SEQ ID NO: 2054769 - DNA, 17 bp, Homo sapiens
gcagctagactggagtg

SEQ ID NO: 2054770 - DNA, 21 bp, Homo sapiens
gcagctatgcgcaatgtggca

SEQ ID NO: 2054771 - DNA, 17 bp, Homo sapiens
gcagctcagcctccccc

SEQ ID NO: 2054772 - DNA, 22 bp, Homo sapiens
gcagctccaacagcttgaccag

SEQ ID NO: 2054773 - DNA, 17 bp, Homo sapiens
gcagctcctctccttgg

SEQ ID NO: 2054774 - DNA, 19 bp, Homo sapiens
gcagctcttcccctttcct

SEQ ID NO: 2054775 - DNA, 15 bp, Homo sapiens
gcagctgagagccct

SEQ ID NO: 2054776 - DNA, 21 bp, Homo sapiens
gcagctgagagccctgctgtg

SEQ ID NO: 2054777 - DNA, 23 bp, Homo sapiens
gcagctgagagccctgctgtggg

SEQ ID NO: 2054778 - DNA, 17 bp, Homo sapiens
gcagctgagcagggccg

SEQ ID NO: 2054779 - DNA, 19 bp, Homo sapiens
gcagctgagcagggccggg

SEQ ID NO: 2054780 - DNA, 20 bp, Homo sapiens
gcagctgcgggtctgaagga

SEQ ID NO: 2054781 - DNA, 19 bp, Homo sapiens
gcagctgcggtccacccag

SEQ ID NO: 2054782 - DNA, 18 bp, Homo sapiens
gcagctgctcttagtgcc

SEQ ID NO: 2054783 - DNA, 13 bp, Homo sapiens
gcagctgcttttg

SEQ ID NO: 2054784 - DNA, 13 bp, Homo sapiens
gcagctggctctc

SEQ ID NO: 2054785 - DNA, 19 bp, Homo sapiens
gcagctgggacccctccca

SEQ ID NO: 2054786 - DNA, 18 bp, Homo sapiens
gcagctgggccccatgct

SEQ ID NO: 2054787 - DNA, 21 bp, Homo sapiens
gcagctgggccccatgctctg

SEQ ID NO: 2054788 - DNA, 14 bp, Homo sapiens
gcagctgggccggc

SEQ ID NO: 2054789 - DNA, 12 bp, Homo sapiens
gcagctgtcatg

SEQ ID NO: 2054790 - DNA, 20 bp, Homo sapiens
gcagctgtcccctctccctg

SEQ ID NO: 2054791 - DNA, 21 bp, Homo sapiens
gcagctgtcccctctccctgg

SEQ ID NO: 2054792 - DNA, 15 bp, Homo sapiens
gcagctgtttctgga

SEQ ID NO: 2054793 - DNA, 14 bp, Homo sapiens
gcagcttgtagcca

SEQ ID NO: 2054794 - DNA, 15 bp, Homo sapiens
gcagcttgtagccag

SEQ ID NO: 2054795 - DNA, 17 bp, Homo sapiens
gcagcttgtagccagcc

SEQ ID NO: 2054796 - DNA, 18 bp, Homo sapiens
gcagcttgtagccagccg

SEQ ID NO: 2054797 - DNA, 21 bp, Homo sapiens
gcagcttgtagccagccgggg

SEQ ID NO: 2054798 - DNA, 15 bp, Homo sapiens
gcaggaactcccagc

SEQ ID NO: 2054799 - DNA, 13 bp, Homo sapiens
gcaggaagagaga

SEQ ID NO: 2054800 - DNA, 22 bp, Homo sapiens
gcaggaagagagagagagaggt

SEQ ID NO: 2054801 - DNA, 16 bp, Homo sapiens
gcaggaagtctctccc

SEQ ID NO: 2054802 - DNA, 17 bp, Homo sapiens
gcaggaatgtgtggcag

SEQ ID NO: 2054803 - DNA, 17 bp, Homo sapiens
gcaggacacatcccggc

SEQ ID NO: 2054804 - DNA, 17 bp, Homo sapiens
gcaggaccgatgccagc

SEQ ID NO: 2054805 - DNA, 22 bp, Homo sapiens
gcaggagaatcacttgcactcc

SEQ ID NO: 2054806 - DNA, 15 bp, Homo sapiens
gcaggagcaggaaca

SEQ ID NO: 2054807 - DNA, 23 bp, Homo sapiens
gcaggaggattgcttgagcccag

SEQ ID NO: 2054808 - DNA, 17 bp, Homo sapiens
gcaggaggcctggcctt

SEQ ID NO: 2054809 - DNA, 21 bp, Homo sapiens
gcaggagtagctgagctcaca

SEQ ID NO: 2054810 - DNA, 17 bp, Homo sapiens
gcaggatccgctgccac

SEQ ID NO: 2054811 - DNA, 18 bp, Homo sapiens
gcaggatccgctgccacc

SEQ ID NO: 2054812 - DNA, 23 bp, Homo sapiens
gcaggcaaagtgagactgacacc

SEQ ID NO: 2054813 - DNA, 17 bp, Homo sapiens
gcaggcacacagcagcc

SEQ ID NO: 2054814 - DNA, 18 bp, Homo sapiens
gcaggcacacagcagccc

SEQ ID NO: 2054815 - DNA, 15 bp, Homo sapiens
gcaggcacatggagg

SEQ ID NO: 2054816 - DNA, 20 bp, Homo sapiens
gcaggcacctagcaattcca

SEQ ID NO: 2054817 - DNA, 15 bp, Homo sapiens
gcaggcaccttagtg

SEQ ID NO: 2054818 - DNA, 18 bp, Homo sapiens
gcaggcagagcggggagg

SEQ ID NO: 2054819 - DNA, 24 bp, Homo sapiens
gcaggcagagcggggaggtgcctg

SEQ ID NO: 2054820 - DNA, 14 bp, Homo sapiens
gcaggcagggctct

SEQ ID NO: 2054821 - DNA, 24 bp, Homo sapiens
gcaggccaagagcagaggcagcga

SEQ ID NO: 2054822 - DNA, 15 bp, Homo sapiens
gcaggcccagcagac

SEQ ID NO: 2054823 - DNA, 13 bp, Homo sapiens
gcaggcccgacag

SEQ ID NO: 2054824 - DNA, 23 bp, Homo sapiens
gcaggcccgacagagagatgaag

SEQ ID NO: 2054825 - DNA, 17 bp, Homo sapiens
gcaggccgaggcaggtg

SEQ ID NO: 2054826 - DNA, 14 bp, Homo sapiens
gcaggcctaggacc

SEQ ID NO: 2054827 - DNA, 19 bp, Homo sapiens
gcaggcctaggacctcagg

SEQ ID NO: 2054828 - DNA, 15 bp, Homo sapiens
gcaggctaccccttc

SEQ ID NO: 2054829 - DNA, 16 bp, Homo sapiens
gcaggctccccctgcc

SEQ ID NO: 2054830 - DNA, 16 bp, Homo sapiens
gcaggctctgggctca

SEQ ID NO: 2054831 - DNA, 18 bp, Homo sapiens
gcaggctctgggctcagg

SEQ ID NO: 2054832 - DNA, 18 bp, Homo sapiens
gccaaggtgggctgagcc

SEQ ID NO: 2054833 - DNA, 23 bp, Homo sapiens
gccaaggtgtttccatttctcaa

SEQ ID NO: 2054834 - DNA, 15 bp, Homo sapiens
gccaagtccaggtcc

SEQ ID NO: 2054835 - DNA, 17 bp, Homo sapiens
gccaagtccaggtcctg

SEQ ID NO: 2054836 - DNA, 18 bp, Homo sapiens
gccaagtccaggtcctgg

SEQ ID NO: 2054837 - DNA, 21 bp, Homo sapiens
gccaagtccaggtcctggtgg

SEQ ID NO: 2054838 - DNA, 14 bp, Homo sapiens
gccaagttatattg

SEQ ID NO: 2054839 - DNA, 19 bp, Homo sapiens
gccaatgaggtctgaaatg

SEQ ID NO: 2054840 - DNA, 19 bp, Homo sapiens
gccaatgcacctaaagaaa

SEQ ID NO: 2054841 - DNA, 21 bp, Homo sapiens
gccaattaaaatatatataaa

SEQ ID NO: 2054842 - DNA, 22 bp, Homo sapiens
gccacaaatcaaagcaagggct

SEQ ID NO: 2054843 - DNA, 21 bp, Homo sapiens
gccacaaccctgttttatact

SEQ ID NO: 2054844 - DNA, 14 bp, Homo sapiens
gccacaagaaattt

SEQ ID NO: 2054845 - DNA, 18 bp, Homo sapiens
gccacaatgcctctccca

SEQ ID NO: 2054846 - DNA, 20 bp, Homo sapiens
gccacacagagcctgcctca

SEQ ID NO: 2054847 - DNA, 22 bp, Homo sapiens
gccacacccggctccccctgct

SEQ ID NO: 2054848 - DNA, 16 bp, Homo sapiens
gccacaccctccccat

SEQ ID NO: 2054849 - DNA, 17 bp, Homo sapiens
gccacaccctccccatt

SEQ ID NO: 2054850 - DNA, 18 bp, Homo sapiens
gccacactattaccatga

SEQ ID NO: 2054851 - DNA, 21 bp, Homo sapiens
gccacactattaccatgagaa

SEQ ID NO: 2054852 - DNA, 15 bp, Homo sapiens
gccacactcagtccc

SEQ ID NO: 2054853 - DNA, 19 bp, Homo sapiens
gccacactcagtcccccac

SEQ ID NO: 2054854 - DNA, 14 bp, Homo sapiens
gccacagaagccag

SEQ ID NO: 2054855 - DNA, 18 bp, Homo sapiens
gccacagaagccaggagc

SEQ ID NO: 2054856 - DNA, 17 bp, Homo sapiens
gccacagaccacctgct

SEQ ID NO: 2054857 - DNA, 12 bp, Homo sapiens
gccacagagaag

SEQ ID NO: 2054858 - DNA, 13 bp, Homo sapiens
gccacagccccac

SEQ ID NO: 2054859 - DNA, 15 bp, Homo sapiens
gccacagccccacag

SEQ ID NO: 2054860 - DNA, 16 bp, Homo sapiens
gccacagccccacagc

SEQ ID NO: 2054861 - DNA, 18 bp, Homo sapiens
gccacagccccacagcac

SEQ ID NO: 2054862 - DNA, 14 bp, Homo sapiens
gccaccaataaaaa

SEQ ID NO: 2054863 - DNA, 22 bp, Homo sapiens
gccaccaccccataatctcatt

SEQ ID NO: 2054864 - DNA, 16 bp, Homo sapiens
gccaccacgtctgcca

SEQ ID NO: 2054865 - DNA, 16 bp, Homo sapiens
gccaccactagagctg

SEQ ID NO: 2054866 - DNA, 19 bp, Homo sapiens
gccaccagggcactgtctg

SEQ ID NO: 2054867 - DNA, 17 bp, Homo sapiens
gccaccatcctgcagcc

SEQ ID NO: 2054868 - DNA, 15 bp, Homo sapiens
gccaccatcctgctg

SEQ ID NO: 2054869 - DNA, 16 bp, Homo sapiens
gccacccaacagcacc

SEQ ID NO: 2054870 - DNA, 20 bp, Homo sapiens
gccacccgtaggcagcctct

SEQ ID NO: 2054871 - DNA, 21 bp, Homo sapiens
gccacccgttctgctggcctg

SEQ ID NO: 2054872 - DNA, 18 bp, Homo sapiens
gccaccctccttcccgcc

SEQ ID NO: 2054873 - DNA, 16 bp, Homo sapiens
gccaccctctccatgc

SEQ ID NO: 2054874 - DNA, 13 bp, Homo sapiens
gccaccctgagga

SEQ ID NO: 2054875 - DNA, 19 bp, Homo sapiens
gccaccctgaggagtctga

SEQ ID NO: 2054876 - DNA, 22 bp, Homo sapiens
gccaccctgaggagtctgaggt

SEQ ID NO: 2054877 - DNA, 23 bp, Homo sapiens
gccaccctgaggagtctgaggtc

SEQ ID NO: 2054878 - DNA, 23 bp, Homo sapiens
gccaccctggcccgcccctcgct

SEQ ID NO: 2054879 - DNA, 19 bp, Homo sapiens
gccaccctggggagaaagt

SEQ ID NO: 2054880 - DNA, 16 bp, Homo sapiens
gccaccgccagaggac

SEQ ID NO: 2054881 - DNA, 21 bp, Homo sapiens
gccaccgccagaggacaagga

SEQ ID NO: 2054882 - DNA, 15 bp, Homo sapiens
gccaccgctgccttt

SEQ ID NO: 2054883 - DNA, 15 bp, Homo sapiens
gccacctcccaagga

SEQ ID NO: 2054884 - DNA, 16 bp, Homo sapiens
gccacctcccaaggac

SEQ ID NO: 2054885 - DNA, 23 bp, Homo sapiens
gccacctcccaaggactttccag

SEQ ID NO: 2054886 - DNA, 13 bp, Homo sapiens
gccacctcccacc

SEQ ID NO: 2054887 - DNA, 14 bp, Homo sapiens
gccacctcccaccc

SEQ ID NO: 2054888 - DNA, 15 bp, Homo sapiens
gccacctcccacccc

SEQ ID NO: 2054889 - DNA, 17 bp, Homo sapiens
gccacctcccaccccac

SEQ ID NO: 2054890 - DNA, 22 bp, Homo sapiens
gccacctcccctatccacccag

SEQ ID NO: 2054891 - DNA, 14 bp, Homo sapiens
gccaccttccagtg

SEQ ID NO: 2054892 - DNA, 18 bp, Homo sapiens
gccacgctgtcctctcga

SEQ ID NO: 2054893 - DNA, 15 bp, Homo sapiens
gccacggccaccctc

SEQ ID NO: 2054894 - DNA, 19 bp, Homo sapiens
gccacggccaggccagagg

SEQ ID NO: 2054895 - DNA, 16 bp, Homo sapiens
gccacggggaggggga

SEQ ID NO: 2054896 - DNA, 15 bp, Homo sapiens
gccacgttaagtcca

SEQ ID NO: 2054897 - DNA, 16 bp, Homo sapiens
gccacgttccttactg

SEQ ID NO: 2054898 - DNA, 23 bp, Homo sapiens
gccactaccttctgacctcccca

SEQ ID NO: 2054899 - DNA, 15 bp, Homo sapiens
gccactacctttgtc

SEQ ID NO: 2054900 - DNA, 16 bp, Homo sapiens
gccactacctttgtcc

SEQ ID NO: 2054901 - DNA, 20 bp, Homo sapiens
gccactcatattctgggctc

SEQ ID NO: 2054902 - DNA, 12 bp, Homo sapiens
gccactcatttc

SEQ ID NO: 2054903 - DNA, 19 bp, Homo sapiens
gccactccagacccctggc

SEQ ID NO: 2054904 - DNA, 22 bp, Homo sapiens
gccactccagacccctggcttt

SEQ ID NO: 2054905 - DNA, 13 bp, Homo sapiens
gccactccctgag

SEQ ID NO: 2054906 - DNA, 14 bp, Homo sapiens
gccactccctgagc

SEQ ID NO: 2054907 - DNA, 15 bp, Homo sapiens
gccactccctgagct

SEQ ID NO: 2054908 - DNA, 13 bp, Homo sapiens
gccactcctgtcc

SEQ ID NO: 2054909 - DNA, 18 bp, Homo sapiens
gccactcctgtcccgcct

SEQ ID NO: 2054910 - DNA, 22 bp, Homo sapiens
gccactcctgtcccgccttcct

SEQ ID NO: 2054911 - DNA, 15 bp, Homo sapiens
gccactctcccctcc

SEQ ID NO: 2054912 - DNA, 17 bp, Homo sapiens
gccactctcccctccct

SEQ ID NO: 2054913 - DNA, 23 bp, Homo sapiens
gccactctcccctccctcttcct

SEQ ID NO: 2054914 - DNA, 13 bp, Homo sapiens
gccactcttccaa

SEQ ID NO: 2054915 - DNA, 19 bp, Homo sapiens
gccactgcaccgggccaca

SEQ ID NO: 2054916 - DNA, 22 bp, Homo sapiens
gccactgcaccgggccacagag

SEQ ID NO: 2054917 - DNA, 12 bp, Homo sapiens
gccactgcactc

SEQ ID NO: 2054918 - DNA, 19 bp, Homo sapiens
gccactgcactccagcctg

SEQ ID NO: 2054919 - DNA, 15 bp, Homo sapiens
gccactgcactccgg

SEQ ID NO: 2054920 - DNA, 15 bp, Homo sapiens
gccactgccaggcac

SEQ ID NO: 2054921 - DNA, 19 bp, Homo sapiens
gccactgccaggcacctgg

SEQ ID NO: 2054922 - DNA, 21 bp, Homo sapiens
gccactgccaggcacctggcc

SEQ ID NO: 2054923 - DNA, 16 bp, Homo sapiens
gccactgcctcttcct

SEQ ID NO: 2054924 - DNA, 23 bp, Homo sapiens
gccactggtgttaagatatattt

SEQ ID NO: 2054925 - DNA, 12 bp, Homo sapiens
gccactgtggcc

SEQ ID NO: 2054926 - DNA, 16 bp, Homo sapiens
gccactgtggccagag

SEQ ID NO: 2054927 - DNA, 19 bp, Homo sapiens
gccacttaccttcaataaa

SEQ ID NO: 2054928 - DNA, 22 bp, Homo sapiens
gccacttcttaaaggcctggaa

SEQ ID NO: 2054929 - DNA, 16 bp, Homo sapiens
gccacttgacattcct

SEQ ID NO: 2054930 - DNA, 16 bp, Homo sapiens
gccacttggtttttgg

SEQ ID NO: 2054931 - DNA, 22 bp, Homo sapiens
gccactttaagagagaaatctg

SEQ ID NO: 2054932 - DNA, 15 bp, Homo sapiens
gccactttggcttct

SEQ ID NO: 2054933 - DNA, 23 bp, Homo sapiens
gccactttggtacatggccagtg

SEQ ID NO: 2054934 - DNA, 23 bp, Homo sapiens
gccagaaactccttttgctgtct

SEQ ID NO: 2054935 - DNA, 16 bp, Homo sapiens
gccagaacagtttgta

SEQ ID NO: 2054936 - DNA, 18 bp, Homo sapiens
gccagaacagtttgtaca

SEQ ID NO: 2054937 - DNA, 19 bp, Homo sapiens
gccagaagcctctgcctcc

SEQ ID NO: 2054938 - DNA, 15 bp, Homo sapiens
gccagaaggagggca

SEQ ID NO: 2054939 - DNA, 16 bp, Homo sapiens
gccagaaggagggcag

SEQ ID NO: 2054940 - DNA, 18 bp, Homo sapiens
gccagaaggagggcagag

SEQ ID NO: 2054941 - DNA, 22 bp, Homo sapiens
gccagaaggagggcagagccat

SEQ ID NO: 2054942 - DNA, 23 bp, Homo sapiens
gccagaaggagggcagagccatg

SEQ ID NO: 2054943 - DNA, 21 bp, Homo sapiens
gccagaaggggcacgcctgcc

SEQ ID NO: 2054944 - DNA, 23 bp, Homo sapiens
gccagaaggggcacgcctgccca

SEQ ID NO: 2054945 - DNA, 12 bp, Homo sapiens
gccagacacatg

SEQ ID NO: 2054946 - DNA, 13 bp, Homo sapiens
gcccctcagccct

SEQ ID NO: 2054947 - DNA, 14 bp, Homo sapiens
gcccctcagccctt

SEQ ID NO: 2054948 - DNA, 15 bp, Homo sapiens
gcccctcagcccttg

SEQ ID NO: 2054949 - DNA, 21 bp, Homo sapiens
gcccctcatgtgtgctgtgct

SEQ ID NO: 2054950 - DNA, 17 bp, Homo sapiens
gcccctccacgcctcct

SEQ ID NO: 2054951 - DNA, 22 bp, Homo sapiens
gcccctccagagacaggaaaga

SEQ ID NO: 2054952 - DNA, 22 bp, Homo sapiens
gcccctccctcctctggcccag

SEQ ID NO: 2054953 - DNA, 15 bp, Homo sapiens
gcccctccctctgcc

SEQ ID NO: 2054954 - DNA, 21 bp, Homo sapiens
gcccctccctctgccccaagc

SEQ ID NO: 2054955 - DNA, 15 bp, Homo sapiens
gcccctcccttcaac

SEQ ID NO: 2054956 - DNA, 14 bp, Homo sapiens
gcccctcctcccct

SEQ ID NO: 2054957 - DNA, 16 bp, Homo sapiens
gcccctcctccccttc

SEQ ID NO: 2054958 - DNA, 20 bp, Homo sapiens
gcccctcctccccttcctgc

SEQ ID NO: 2054959 - DNA, 14 bp, Homo sapiens
gcccctcctctgcc

SEQ ID NO: 2054960 - DNA, 17 bp, Homo sapiens
gcccctcctctgccacc

SEQ ID NO: 2054961 - DNA, 22 bp, Homo sapiens
gcccctcctctgccacctcccc

SEQ ID NO: 2054962 - DNA, 16 bp, Homo sapiens
gcccctcgctgctgct

SEQ ID NO: 2054963 - DNA, 15 bp, Homo sapiens
gcccctgaggactgg

SEQ ID NO: 2054964 - DNA, 18 bp, Homo sapiens
gcccctgaggactggaga

SEQ ID NO: 2054965 - DNA, 13 bp, Homo sapiens
gcccctgcagttg

SEQ ID NO: 2054966 - DNA, 14 bp, Homo sapiens
gcccctgcatcccc

SEQ ID NO: 2054967 - DNA, 13 bp, Homo sapiens
gcccctgccaccc

SEQ ID NO: 2054968 - DNA, 15 bp, Homo sapiens
gcccctgccaccctg

SEQ ID NO: 2054969 - DNA, 16 bp, Homo sapiens
gcccctgcccccaaag

SEQ ID NO: 2054970 - DNA, 16 bp, Homo sapiens
gcccctgctggttcag

SEQ ID NO: 2054971 - DNA, 19 bp, Homo sapiens
gcccctggacaagcagagg

SEQ ID NO: 2054972 - DNA, 17 bp, Homo sapiens
gcccctggtaagcagag

SEQ ID NO: 2054973 - DNA, 18 bp, Homo sapiens
gcccctgtaggttgctta

SEQ ID NO: 2054974 - DNA, 18 bp, Homo sapiens
gcccctgttcccccgctg

SEQ ID NO: 2054975 - DNA, 16 bp, Homo sapiens
gccccttaagggttga

SEQ ID NO: 2054976 - DNA, 18 bp, Homo sapiens
gccccttaagggttgaag

SEQ ID NO: 2054977 - DNA, 14 bp, Homo sapiens
gccccttccccaag

SEQ ID NO: 2054978 - DNA, 16 bp, Homo sapiens
gccccttccccatctc

SEQ ID NO: 2054979 - DNA, 20 bp, Homo sapiens
gccccttccccatctccatt

SEQ ID NO: 2054980 - DNA, 14 bp, Homo sapiens
gccccttggccctc

SEQ ID NO: 2054981 - DNA, 23 bp, Homo sapiens
gccccttgggcatccacccagtg

SEQ ID NO: 2054982 - DNA, 17 bp, Homo sapiens
gccccttgtcctctccc

SEQ ID NO: 2054983 - DNA, 18 bp, Homo sapiens
gccccttgtcctctcccg

SEQ ID NO: 2054984 - DNA, 17 bp, Homo sapiens
gcccgaaagctgagacc

SEQ ID NO: 2054985 - DNA, 19 bp, Homo sapiens
gcccgaccccatctcattc

SEQ ID NO: 2054986 - DNA, 13 bp, Homo sapiens
gcccgagcagctg

SEQ ID NO: 2054987 - DNA, 14 bp, Homo sapiens
gcccgagcagctga

SEQ ID NO: 2054988 - DNA, 16 bp, Homo sapiens
gcccgagcagctgagc

SEQ ID NO: 2054989 - DNA, 17 bp, Homo sapiens
gcccgagggcctgacag

SEQ ID NO: 2054990 - DNA, 13 bp, Homo sapiens
gcccgcagagccc

SEQ ID NO: 2054991 - DNA, 17 bp, Homo sapiens
gcccgccagcctcagtg

SEQ ID NO: 2054992 - DNA, 15 bp, Homo sapiens
gcccgctttgcctgc

SEQ ID NO: 2054993 - DNA, 16 bp, Homo sapiens
gcccgctttgcctgct

SEQ ID NO: 2054994 - DNA, 19 bp, Homo sapiens
gcccggagtaatcaggcag

SEQ ID NO: 2054995 - DNA, 20 bp, Homo sapiens
gcccggagtaatcaggcagc

SEQ ID NO: 2054996 - DNA, 15 bp, Homo sapiens
gcccggattctggga

SEQ ID NO: 2054997 - DNA, 15 bp, Homo sapiens
gcccggccagggcct

SEQ ID NO: 2054998 - DNA, 16 bp, Homo sapiens
gcccggccagggcctg

SEQ ID NO: 2054999 - DNA, 18 bp, Homo sapiens
gcccggcctgctcccagc

SEQ ID NO: 2055000 - DNA, 14 bp, Homo sapiens
gcccggctccaggc

SEQ ID NO: 2055001 - DNA, 17 bp, Homo sapiens
gcccggctccaggctcc

SEQ ID NO: 2055002 - DNA, 18 bp, Homo sapiens
gcccggctccaggctcct

SEQ ID NO: 2055003 - DNA, 18 bp, Homo sapiens
gcccggtttggggctgcg

SEQ ID NO: 2055004 - DNA, 16 bp, Homo sapiens
gcccgtcttcagccta

SEQ ID NO: 2055005 - DNA, 13 bp, Homo sapiens
gcccgtgaagcag

SEQ ID NO: 2055006 - DNA, 14 bp, Homo sapiens
gcccgtgaagcagt

SEQ ID NO: 2055007 - DNA, 18 bp, Homo sapiens
gcccgtgaagcagtgcct

SEQ ID NO: 2055008 - DNA, 21 bp, Homo sapiens
gcccgtgaagcagtgcctcga

SEQ ID NO: 2055009 - DNA, 12 bp, Homo sapiens
gcccgtgcagta

SEQ ID NO: 2055010 - DNA, 15 bp, Homo sapiens
gcccgtgtcctgcct

SEQ ID NO: 2055011 - DNA, 16 bp, Homo sapiens
gccctaacgggggtgc

SEQ ID NO: 2055012 - DNA, 21 bp, Homo sapiens
gccctaagtgttgaagaagag

SEQ ID NO: 2055013 - DNA, 20 bp, Homo sapiens
gccctacatcttcagctccc

SEQ ID NO: 2055014 - DNA, 15 bp, Homo sapiens
gccctaccctcactc

SEQ ID NO: 2055015 - DNA, 19 bp, Homo sapiens
gccctagagcacactgtag

SEQ ID NO: 2055016 - DNA, 19 bp, Homo sapiens
gccctagcgctctcttcca

SEQ ID NO: 2055017 - DNA, 13 bp, Homo sapiens
gccctatggatgt

SEQ ID NO: 2055018 - DNA, 14 bp, Homo sapiens
gccctatggatgtg

SEQ ID NO: 2055019 - DNA, 19 bp, Homo sapiens
gccctcaaacttgactcta

SEQ ID NO: 2055020 - DNA, 14 bp, Homo sapiens
gccctcaggccagt

SEQ ID NO: 2055021 - DNA, 15 bp, Homo sapiens
gccctcaggccagtg

SEQ ID NO: 2055022 - DNA, 16 bp, Homo sapiens
gccctcaggccagtgc

SEQ ID NO: 2055023 - DNA, 20 bp, Homo sapiens
gccctcatgataatctgggc

SEQ ID NO: 2055024 - DNA, 16 bp, Homo sapiens
gccctccatgggctag

SEQ ID NO: 2055025 - DNA, 22 bp, Homo sapiens
gccctcccatgttgcatgccta

SEQ ID NO: 2055026 - DNA, 23 bp, Homo sapiens
gccctcccatgttgcatgcctat

SEQ ID NO: 2055027 - DNA, 19 bp, Homo sapiens
gccctccctccccagctcc

SEQ ID NO: 2055028 - DNA, 17 bp, Homo sapiens
gccctccctggcatgtc

SEQ ID NO: 2055029 - DNA, 16 bp, Homo sapiens
gccctccctgtcctcc

SEQ ID NO: 2055030 - DNA, 21 bp, Homo sapiens
gccctccgagccgcgccaacg

SEQ ID NO: 2055031 - DNA, 14 bp, Homo sapiens
gccctcctcacccc

SEQ ID NO: 2055032 - DNA, 11 bp, Homo sapiens
gccctctctca

SEQ ID NO: 2055033 - DNA, 13 bp, Homo sapiens
gccctctctcagt

SEQ ID NO: 2055034 - DNA, 21 bp, Homo sapiens
gccctctgcgtcccccagccc

SEQ ID NO: 2055035 - DNA, 22 bp, Homo sapiens
gccctctgcgtcccccagccct

SEQ ID NO: 2055036 - DNA, 16 bp, Homo sapiens
gccctgacctcccagc

SEQ ID NO: 2055037 - DNA, 19 bp, Homo sapiens
gccctgacctcccagccct

SEQ ID NO: 2055038 - DNA, 12 bp, Homo sapiens
gccctgagctca

SEQ ID NO: 2055039 - DNA, 13 bp, Homo sapiens
gccctgagctcag

SEQ ID NO: 2055040 - DNA, 15 bp, Homo sapiens
gccctgagctcaggc

SEQ ID NO: 2055041 - DNA, 19 bp, Homo sapiens
gccctgagctcaggctgag

SEQ ID NO: 2055042 - DNA, 23 bp, Homo sapiens
gccctgagctcaggctgagccca

SEQ ID NO: 2055043 - DNA, 16 bp, Homo sapiens
gccctgcacctgtgca

SEQ ID NO: 2055044 - DNA, 17 bp, Homo sapiens
gccctgcacctgtgcag

SEQ ID NO: 2055045 - DNA, 17 bp, Homo sapiens
gccctgcagaccctgcc

SEQ ID NO: 2055046 - DNA, 19 bp, Homo sapiens
gccctgcagaccctgccct

SEQ ID NO: 2055047 - DNA, 13 bp, Homo sapiens
gccctgccacctg

SEQ ID NO: 2055048 - DNA, 14 bp, Homo sapiens
gccctgccacctgt

SEQ ID NO: 2055049 - DNA, 16 bp, Homo sapiens
gccctgccacctgtct

SEQ ID NO: 2055050 - DNA, 17 bp, Homo sapiens
gccctgccacctgtctg

SEQ ID NO: 2055051 - DNA, 12 bp, Homo sapiens
gccctgccagga

SEQ ID NO: 2055052 - DNA, 13 bp, Homo sapiens
gccctgccaggag

SEQ ID NO: 2055053 - DNA, 12 bp, Homo sapiens
gccctgccatta

SEQ ID NO: 2055054 - DNA, 21 bp, Homo sapiens
gccctgccccatcctgggcct

SEQ ID NO: 2055055 - DNA, 22 bp, Homo sapiens
gccctgcccccatctccccagg

SEQ ID NO: 2055056 - DNA, 12 bp, Homo sapiens
gccctgcccctg

SEQ ID NO: 2055057 - DNA, 18 bp, Homo sapiens
gccctgcccctgccccaa

SEQ ID NO: 2055058 - DNA, 13 bp, Homo sapiens
gccctgccctgcc

SEQ ID NO: 2055059 - DNA, 12 bp, Homo sapiens
gccctgcctgcc

SEQ ID NO: 2055060 - DNA, 15 bp, Homo sapiens
gccctgcctgcccac

SEQ ID NO: 2055061 - DNA, 16 bp, Homo sapiens
gccctgcctggaggac

SEQ ID NO: 2055062 - DNA, 13 bp, Homo sapiens
gcctggagaagct

SEQ ID NO: 2055063 - DNA, 15 bp, Homo sapiens
gcctggagaggggcc

SEQ ID NO: 2055064 - DNA, 14 bp, Homo sapiens
gcctggagatgact

SEQ ID NO: 2055065 - DNA, 13 bp, Homo sapiens
gcctggaggacct

SEQ ID NO: 2055066 - DNA, 14 bp, Homo sapiens
gcctggaggacctg

SEQ ID NO: 2055067 - DNA, 18 bp, Homo sapiens
gcctggaggacctgagcc

SEQ ID NO: 2055068 - DNA, 21 bp, Homo sapiens
gcctggaggacctgagcctgc

SEQ ID NO: 2055069 - DNA, 21 bp, Homo sapiens
gcctggaggatccctccatcc

SEQ ID NO: 2055070 - DNA, 17 bp, Homo sapiens
gcctggagggatgccac

SEQ ID NO: 2055071 - DNA, 18 bp, Homo sapiens
gcctggcaacagagcaag

SEQ ID NO: 2055072 - DNA, 18 bp, Homo sapiens
gcctggcaagtgggtgaa

SEQ ID NO: 2055073 - DNA, 13 bp, Homo sapiens
gcctggcacagga

SEQ ID NO: 2055074 - DNA, 16 bp, Homo sapiens
gcctggcacaggactg

SEQ ID NO: 2055075 - DNA, 18 bp, Homo sapiens
gcctggcacagggcagtg

SEQ ID NO: 2055076 - DNA, 19 bp, Homo sapiens
gcctggcccatagaaacat

SEQ ID NO: 2055077 - DNA, 14 bp, Homo sapiens
gcctggcctgagct

SEQ ID NO: 2055078 - DNA, 15 bp, Homo sapiens
gcctggcctgagctg

SEQ ID NO: 2055079 - DNA, 16 bp, Homo sapiens
gcctggcctgagctgg

SEQ ID NO: 2055080 - DNA, 22 bp, Homo sapiens
gcctggcctgagctggggccac

SEQ ID NO: 2055081 - DNA, 12 bp, Homo sapiens
gcctggcctggc

SEQ ID NO: 2055082 - DNA, 18 bp, Homo sapiens
gcctggcggggcaggagg

SEQ ID NO: 2055083 - DNA, 23 bp, Homo sapiens
gcctggcggggcaggaggcctgg

SEQ ID NO: 2055084 - DNA, 13 bp, Homo sapiens
gcctggctctcct

SEQ ID NO: 2055085 - DNA, 20 bp, Homo sapiens
gcctggctggctgagggcag

SEQ ID NO: 2055086 - DNA, 12 bp, Homo sapiens
gcctggctgtgg

SEQ ID NO: 2055087 - DNA, 20 bp, Homo sapiens
gcctggctgtggaggcctga

SEQ ID NO: 2055088 - DNA, 15 bp, Homo sapiens
gcctggcttctggag

SEQ ID NO: 2055089 - DNA, 17 bp, Homo sapiens
gcctggcttgctccagg

SEQ ID NO: 2055090 - DNA, 18 bp, Homo sapiens
gcctgggaaatttctact

SEQ ID NO: 2055091 - DNA, 15 bp, Homo sapiens
gcctgggactcccag

SEQ ID NO: 2055092 - DNA, 18 bp, Homo sapiens
gcctgggactcccagtga

SEQ ID NO: 2055093 - DNA, 13 bp, Homo sapiens
gcctgggcagcat

SEQ ID NO: 2055094 - DNA, 14 bp, Homo sapiens
gcctgggccagaga

SEQ ID NO: 2055095 - DNA, 13 bp, Homo sapiens
gcctgggcccagg

SEQ ID NO: 2055096 - DNA, 18 bp, Homo sapiens
gcctgggcccaggctctg

SEQ ID NO: 2055097 - DNA, 13 bp, Homo sapiens
gcctgggcctgct

SEQ ID NO: 2055098 - DNA, 22 bp, Homo sapiens
gcctgggcctgcttttccagga

SEQ ID NO: 2055099 - DNA, 13 bp, Homo sapiens
gcctgggcctgtg

SEQ ID NO: 2055100 - DNA, 16 bp, Homo sapiens
gcctgggcctgtgcag

SEQ ID NO: 2055101 - DNA, 23 bp, Homo sapiens
gcctggggattgggagggacagg

SEQ ID NO: 2055102 - DNA, 23 bp, Homo sapiens
gcctggggctcctttctccagcc

SEQ ID NO: 2055103 - DNA, 20 bp, Homo sapiens
gcctggggctctaacgcctg

SEQ ID NO: 2055104 - DNA, 22 bp, Homo sapiens
gcctgggggcagggagaggagt

SEQ ID NO: 2055105 - DNA, 14 bp, Homo sapiens
gcctgggggcagtg

SEQ ID NO: 2055106 - DNA, 20 bp, Homo sapiens
gcctgggggcagtgactggc

SEQ ID NO: 2055107 - DNA, 21 bp, Homo sapiens
gcctgggggcagtgactggca

SEQ ID NO: 2055108 - DNA, 22 bp, Homo sapiens
gcctgggggcagtgactggcag

SEQ ID NO: 2055109 - DNA, 16 bp, Homo sapiens
gcctgggggcctggct

SEQ ID NO: 2055110 - DNA, 18 bp, Homo sapiens
gcctggggtgacccggca

SEQ ID NO: 2055111 - DNA, 22 bp, Homo sapiens
gcctggggtgacccggcacccc

SEQ ID NO: 2055112 - DNA, 20 bp, Homo sapiens
gcctgggtgacagagcaaga

SEQ ID NO: 2055113 - DNA, 23 bp, Homo sapiens
gcctgggtggcagagtgagactc

SEQ ID NO: 2055114 - DNA, 19 bp, Homo sapiens
gcctgggtggggctgctcc

SEQ ID NO: 2055115 - DNA, 15 bp, Homo sapiens
gcctgggttttctaa

SEQ ID NO: 2055116 - DNA, 19 bp, Homo sapiens
gcctgggttttctaactgt

SEQ ID NO: 2055117 - DNA, 20 bp, Homo sapiens
gcctgggttttctaactgta

SEQ ID NO: 2055118 - DNA, 21 bp, Homo sapiens
gcctggtagaattgggaagct

SEQ ID NO: 2055119 - DNA, 13 bp, Homo sapiens
gcctggtggcagc

SEQ ID NO: 2055120 - DNA, 15 bp, Homo sapiens
gcctggtgggaccag

SEQ ID NO: 2055121 - DNA, 18 bp, Homo sapiens
gcctggtgtgaggctggg

SEQ ID NO: 2055122 - DNA, 15 bp, Homo sapiens
gcctgtaatcccagc

SEQ ID NO: 2055123 - DNA, 19 bp, Homo sapiens
gcctgtaatcccagcactt

SEQ ID NO: 2055124 - DNA, 17 bp, Homo sapiens
gcctgtaatcccagcag

SEQ ID NO: 2055125 - DNA, 13 bp, Homo sapiens
gcctgtactgcct

SEQ ID NO: 2055126 - DNA, 14 bp, Homo sapiens
gcctgtactgcctg

SEQ ID NO: 2055127 - DNA, 14 bp, Homo sapiens
gcctgtagcagtga

SEQ ID NO: 2055128 - DNA, 19 bp, Homo sapiens
gcctgtagtcccagccact

SEQ ID NO: 2055129 - DNA, 17 bp, Homo sapiens
gcctgtagttaggaaat

SEQ ID NO: 2055130 - DNA, 16 bp, Homo sapiens
gcctgtatagacagca

SEQ ID NO: 2055131 - DNA, 12 bp, Homo sapiens
gcctgtcctgcc

SEQ ID NO: 2055132 - DNA, 16 bp, Homo sapiens
gcctgtcctggtacag

SEQ ID NO: 2055133 - DNA, 12 bp, Homo sapiens
gcctgtctcaag

SEQ ID NO: 2055134 - DNA, 14 bp, Homo sapiens
gcctgtgaacccag

SEQ ID NO: 2055135 - DNA, 17 bp, Homo sapiens
gcctgtgaacccaggac

SEQ ID NO: 2055136 - DNA, 15 bp, Homo sapiens
gcctgtgattaactt

SEQ ID NO: 2055137 - DNA, 20 bp, Homo sapiens
gcctgtgattaacttgctta

SEQ ID NO: 2055138 - DNA, 13 bp, Homo sapiens
gcctgtgcagcag

SEQ ID NO: 2055139 - DNA, 19 bp, Homo sapiens
gcctgtgcatgtatgtctt

SEQ ID NO: 2055140 - DNA, 14 bp, Homo sapiens
gcctgtgccacctg

SEQ ID NO: 2055141 - DNA, 15 bp, Homo sapiens
gcctgtgccacctgc

SEQ ID NO: 2055142 - DNA, 15 bp, Homo sapiens
gcctgtgctaaagaa

SEQ ID NO: 2055143 - DNA, 14 bp, Homo sapiens
gcctgtgctgcccg

SEQ ID NO: 2055144 - DNA, 21 bp, Homo sapiens
gcctgtggcagaaaagaggag

SEQ ID NO: 2055145 - DNA, 22 bp, Homo sapiens
gcctgtggcagaaaagaggaga

SEQ ID NO: 2055146 - DNA, 13 bp, Homo sapiens
gcctgtggcaggc

SEQ ID NO: 2055147 - DNA, 16 bp, Homo sapiens
gcctgtggcggtgcct

SEQ ID NO: 2055148 - DNA, 16 bp, Homo sapiens
gcctgtgggaagagaa

SEQ ID NO: 2055149 - DNA, 18 bp, Homo sapiens
gcctgtgggaagagaagg

SEQ ID NO: 2055150 - DNA, 20 bp, Homo sapiens
gcctgtgtagctgtgacctg

SEQ ID NO: 2055151 - DNA, 21 bp, Homo sapiens
gcctgtgtagctgtgacctgc

SEQ ID NO: 2055152 - DNA, 13 bp, Homo sapiens
gcctgtgtccagc

SEQ ID NO: 2055153 - DNA, 15 bp, Homo sapiens
gcctgtgtccagcag

SEQ ID NO: 2055154 - DNA, 22 bp, Homo sapiens
gcctgtgtccagcagctgcggg

SEQ ID NO: 2055155 - DNA, 20 bp, Homo sapiens
gcctgtgtgagcatctctgt

SEQ ID NO: 2055156 - DNA, 14 bp, Homo sapiens
gcctgttcagctcc

SEQ ID NO: 2055157 - DNA, 15 bp, Homo sapiens
gcctgttcagctcca

SEQ ID NO: 2055158 - DNA, 17 bp, Homo sapiens
gcctgttcagctccagc

SEQ ID NO: 2055159 - DNA, 19 bp, Homo sapiens
gcctgttgttcccatctgc

SEQ ID NO: 2055160 - DNA, 18 bp, Homo sapiens
gccttacctcccctgcca

SEQ ID NO: 2055161 - DNA, 22 bp, Homo sapiens
gccttacctcccctgccagggc

SEQ ID NO: 2055162 - DNA, 12 bp, Homo sapiens
gccttacctcct

SEQ ID NO: 2055163 - DNA, 17 bp, Homo sapiens
gccttacctcctgccca

SEQ ID NO: 2055164 - DNA, 22 bp, Homo sapiens
gccttacctcctgcccaggaga

SEQ ID NO: 2055165 - DNA, 17 bp, Homo sapiens
gccttactcacctctct

SEQ ID NO: 2055166 - DNA, 17 bp, Homo sapiens
gccttagaagtcacaca

SEQ ID NO: 2055167 - DNA, 16 bp, Homo sapiens
gccttagcacttcttt

SEQ ID NO: 2055168 - DNA, 22 bp, Homo sapiens
gccttatgtaattattttcttt

SEQ ID NO: 2055169 - DNA, 16 bp, Homo sapiens
gccttcagctctacag

SEQ ID NO: 2055170 - DNA, 21 bp, Homo sapiens
gccttccataattatgacagt

SEQ ID NO: 2055171 - DNA, 18 bp, Homo sapiens
gccttccccttgcccagg

SEQ ID NO: 2055172 - DNA, 16 bp, Homo sapiens
gccttccccttttgcc

SEQ ID NO: 2055173 - DNA, 18 bp, Homo sapiens
gccttccccttttgcctg

SEQ ID NO: 2055174 - DNA, 19 bp, Homo sapiens
gccttccctccccacagtc

SEQ ID NO: 2055175 - DNA, 15 bp, Homo sapiens
gccttcctcatcccc

SEQ ID NO: 2055176 - DNA, 16 bp, Homo sapiens
gccttcctcatcccct

SEQ ID NO: 2055177 - DNA, 13 bp, Homo sapiens
gctactctgtgcc

SEQ ID NO: 2055178 - DNA, 14 bp, Homo sapiens
gctactctgtgcca

SEQ ID NO: 2055179 - DNA, 20 bp, Homo sapiens
gctactctgtgccagagcct

SEQ ID NO: 2055180 - DNA, 17 bp, Homo sapiens
gctactgatttttgtga

SEQ ID NO: 2055181 - DNA, 18 bp, Homo sapiens
gctactgcagctttacat

SEQ ID NO: 2055182 - DNA, 15 bp, Homo sapiens
gctactgtcagctcc

SEQ ID NO: 2055183 - DNA, 19 bp, Homo sapiens
gctactgtcctacccaccc

SEQ ID NO: 2055184 - DNA, 20 bp, Homo sapiens
gctactgtcctacccaccct

SEQ ID NO: 2055185 - DNA, 18 bp, Homo sapiens
gctacttcggggctggga

SEQ ID NO: 2055186 - DNA, 16 bp, Homo sapiens
gctactttgctgctat

SEQ ID NO: 2055187 - DNA, 23 bp, Homo sapiens
gctactttgctgctatggttttc

SEQ ID NO: 2055188 - DNA, 18 bp, Homo sapiens
gctagaaatatgatttta

SEQ ID NO: 2055189 - DNA, 19 bp, Homo sapiens
gctagaaccaagaagggct

SEQ ID NO: 2055190 - DNA, 20 bp, Homo sapiens
gctagaaccaagaagggcta

SEQ ID NO: 2055191 - DNA, 19 bp, Homo sapiens
gctagaacctagaagggct

SEQ ID NO: 2055192 - DNA, 19 bp, Homo sapiens
gctagaacctggagggctg

SEQ ID NO: 2055193 - DNA, 14 bp, Homo sapiens
gctagaagctggag

SEQ ID NO: 2055194 - DNA, 13 bp, Homo sapiens
gctagaaggccac

SEQ ID NO: 2055195 - DNA, 15 bp, Homo sapiens
gctagaaggccacat

SEQ ID NO: 2055196 - DNA, 23 bp, Homo sapiens
gctagatatcacttactcagtta

SEQ ID NO: 2055197 - DNA, 15 bp, Homo sapiens
gctagcgctgccgca

SEQ ID NO: 2055198 - DNA, 21 bp, Homo sapiens
gctagcgctgccgcaccccag

SEQ ID NO: 2055199 - DNA, 13 bp, Homo sapiens
gctagctgtagaa

SEQ ID NO: 2055200 - DNA, 13 bp, Homo sapiens
gctaggaatgaaa

SEQ ID NO: 2055201 - DNA, 18 bp, Homo sapiens
gctaggactgaggagtgg

SEQ ID NO: 2055202 - DNA, 14 bp, Homo sapiens
gctaggcctggcca

SEQ ID NO: 2055203 - DNA, 17 bp, Homo sapiens
gctaggcctggccagat

SEQ ID NO: 2055204 - DNA, 23 bp, Homo sapiens
gctaggcctggccagatgcacca

SEQ ID NO: 2055205 - DNA, 19 bp, Homo sapiens
gctaggcgagtgccaggac

SEQ ID NO: 2055206 - DNA, 21 bp, Homo sapiens
gctaggcgagtgccaggactc

SEQ ID NO: 2055207 - DNA, 16 bp, Homo sapiens
gctaggggctggtcct

SEQ ID NO: 2055208 - DNA, 18 bp, Homo sapiens
gctaggggctggtccttc

SEQ ID NO: 2055209 - DNA, 20 bp, Homo sapiens
gctagtaccctatagagagg

SEQ ID NO: 2055210 - DNA, 21 bp, Homo sapiens
gctagtaccctatagagaggg

SEQ ID NO: 2055211 - DNA, 19 bp, Homo sapiens
gctagtactggggagaaat

SEQ ID NO: 2055212 - DNA, 14 bp, Homo sapiens
gctagtcagagaga

SEQ ID NO: 2055213 - DNA, 16 bp, Homo sapiens
gctagtgtgagtggca

SEQ ID NO: 2055214 - DNA, 19 bp, Homo sapiens
gctagtgtgagtggcagcc

SEQ ID NO: 2055215 - DNA, 21 bp, Homo sapiens
gctagttgggcttcctcatag

SEQ ID NO: 2055216 - DNA, 21 bp, Homo sapiens
gctataggtgctacaaaaaca

SEQ ID NO: 2055217 - DNA, 11 bp, Homo sapiens
gctatatatat

SEQ ID NO: 2055218 - DNA, 13 bp, Homo sapiens
gctatatatataa

SEQ ID NO: 2055219 - DNA, 16 bp, Homo sapiens
gctatatatataaata

SEQ ID NO: 2055220 - DNA, 22 bp, Homo sapiens
gctatattttcatgacttttcc

SEQ ID NO: 2055221 - DNA, 23 bp, Homo sapiens
gctatcaaaataaattgaaatat

SEQ ID NO: 2055222 - DNA, 13 bp, Homo sapiens
gctatcacacagt

SEQ ID NO: 2055223 - DNA, 16 bp, Homo sapiens
gctatcctagagaggc

SEQ ID NO: 2055224 - DNA, 18 bp, Homo sapiens
gctatcctagagaggctg

SEQ ID NO: 2055225 - DNA, 13 bp, Homo sapiens
gctatctctgtgt

SEQ ID NO: 2055226 - DNA, 20 bp, Homo sapiens
gctatctctgtgtgcacaaa

SEQ ID NO: 2055227 - DNA, 16 bp, Homo sapiens
gctatctgtcatctct

SEQ ID NO: 2055228 - DNA, 11 bp, Homo sapiens
gctatgccttg

SEQ ID NO: 2055229 - DNA, 18 bp, Homo sapiens
gctatgcgcaatgtggca

SEQ ID NO: 2055230 - DNA, 19 bp, Homo sapiens
gctatgcgcaatgtggcat

SEQ ID NO: 2055231 - DNA, 16 bp, Homo sapiens
gctatggccccagggt

SEQ ID NO: 2055232 - DNA, 21 bp, Homo sapiens
gctattattttcactgtagaa

SEQ ID NO: 2055233 - DNA, 15 bp, Homo sapiens
gctattctgtgttga

SEQ ID NO: 2055234 - DNA, 16 bp, Homo sapiens
gctattgacaagtcat

SEQ ID NO: 2055235 - DNA, 15 bp, Homo sapiens
gctattgcactccag

SEQ ID NO: 2055236 - DNA, 18 bp, Homo sapiens
gctattgcactccagtct

SEQ ID NO: 2055237 - DNA, 17 bp, Homo sapiens
gctattgcatgtaaaat

SEQ ID NO: 2055238 - DNA, 20 bp, Homo sapiens
gctattgcatgtaaaatgca

SEQ ID NO: 2055239 - DNA, 22 bp, Homo sapiens
gctattgcatgtaaaatgcagt

SEQ ID NO: 2055240 - DNA, 18 bp, Homo sapiens
gctattgttgtgggcttt

SEQ ID NO: 2055241 - DNA, 22 bp, Homo sapiens
gctattgttgtgggctttctcc

SEQ ID NO: 2055242 - DNA, 19 bp, Homo sapiens
gctatttctggcctcagca

SEQ ID NO: 2055243 - DNA, 20 bp, Homo sapiens
gctatttctggcctcagcag

SEQ ID NO: 2055244 - DNA, 17 bp, Homo sapiens
gctattttatttgtatt

SEQ ID NO: 2055245 - DNA, 14 bp, Homo sapiens
gctcaaatcattta

SEQ ID NO: 2055246 - DNA, 20 bp, Homo sapiens
gctcaaatcatttaagaagg

SEQ ID NO: 2055247 - DNA, 16 bp, Homo sapiens
gctcaagaggcccagg

SEQ ID NO: 2055248 - DNA, 17 bp, Homo sapiens
gctcaagaggcccaggg

SEQ ID NO: 2055249 - DNA, 18 bp, Homo sapiens
gctcaagaggcccaggga

SEQ ID NO: 2055250 - DNA, 20 bp, Homo sapiens
gctcaagaggcccagggagc

SEQ ID NO: 2055251 - DNA, 14 bp, Homo sapiens
gctcaagatgacag

SEQ ID NO: 2055252 - DNA, 18 bp, Homo sapiens
gctcaagtcctcttttct

SEQ ID NO: 2055253 - DNA, 20 bp, Homo sapiens
gctcaagtcttccctgatca

SEQ ID NO: 2055254 - DNA, 14 bp, Homo sapiens
gctcacaactgttt

SEQ ID NO: 2055255 - DNA, 18 bp, Homo sapiens
gctcacaagcccaggctg

SEQ ID NO: 2055256 - DNA, 21 bp, Homo sapiens
gctcacaaggcagcaaggccc

SEQ ID NO: 2055257 - DNA, 22 bp, Homo sapiens
gctcacagaacccttggagcca

SEQ ID NO: 2055258 - DNA, 20 bp, Homo sapiens
gctcacagtacaatgtttca

SEQ ID NO: 2055259 - DNA, 13 bp, Homo sapiens
gctcacagttcct

SEQ ID NO: 2055260 - DNA, 15 bp, Homo sapiens
gctcacagttcctcg

SEQ ID NO: 2055261 - DNA, 16 bp, Homo sapiens
gctcacagttcctcgc

SEQ ID NO: 2055262 - DNA, 23 bp, Homo sapiens
gctcacagttcctcgccctgggt

SEQ ID NO: 2055263 - DNA, 22 bp, Homo sapiens
gctcacgcctataatcccagca

SEQ ID NO: 2055264 - DNA, 21 bp, Homo sapiens
gctcacgcctatgatcccagc

SEQ ID NO: 2055265 - DNA, 22 bp, Homo sapiens
gctcacgcctatgatcccagca

SEQ ID NO: 2055266 - DNA, 18 bp, Homo sapiens
gctcacgctcccccgcag

SEQ ID NO: 2055267 - DNA, 22 bp, Homo sapiens
gctcacgctcccccgcagtccc

SEQ ID NO: 2055268 - DNA, 23 bp, Homo sapiens
gctcacgctcccccgcagtcccc

SEQ ID NO: 2055269 - DNA, 13 bp, Homo sapiens
gctcactccctgg

SEQ ID NO: 2055270 - DNA, 14 bp, Homo sapiens
gctcactccctggg

SEQ ID NO: 2055271 - DNA, 18 bp, Homo sapiens
gctcagaagtttcttctt

SEQ ID NO: 2055272 - DNA, 13 bp, Homo sapiens
gctcagactctgg

SEQ ID NO: 2055273 - DNA, 17 bp, Homo sapiens
gctcagacttgccaggc

SEQ ID NO: 2055274 - DNA, 17 bp, Homo sapiens
gctcagagatgaaacta

SEQ ID NO: 2055275 - DNA, 15 bp, Homo sapiens
gctcagaggcccagg

SEQ ID NO: 2055276 - DNA, 12 bp, Homo sapiens
gctcagccctcc

SEQ ID NO: 2055277 - DNA, 15 bp, Homo sapiens
gctcagccctccctg

SEQ ID NO: 2055278 - DNA, 17 bp, Homo sapiens
gctcagccctccctgcc

SEQ ID NO: 2055279 - DNA, 19 bp, Homo sapiens
gctcagccctccctgcccc

SEQ ID NO: 2055280 - DNA, 21 bp, Homo sapiens
gctcagccctccctgcccctc

SEQ ID NO: 2055281 - DNA, 16 bp, Homo sapiens
gctcagccctgactgg

SEQ ID NO: 2055282 - DNA, 19 bp, Homo sapiens
gctcagccctgactggtgc

SEQ ID NO: 2055283 - DNA, 20 bp, Homo sapiens
gctcagccctgactggtgct

SEQ ID NO: 2055284 - DNA, 18 bp, Homo sapiens
gctcagcccttcctagaa

SEQ ID NO: 2055285 - DNA, 19 bp, Homo sapiens
gctcagcctccccctgctg

SEQ ID NO: 2055286 - DNA, 20 bp, Homo sapiens
gctcagcctccccctgctgc

SEQ ID NO: 2055287 - DNA, 23 bp, Homo sapiens
gctcagcctccccctgctgctca

SEQ ID NO: 2055288 - DNA, 11 bp, Homo sapiens
gctcagcctgg

SEQ ID NO: 2055289 - DNA, 18 bp, Homo sapiens
gctcagcctggtgggcct

SEQ ID NO: 2055290 - DNA, 16 bp, Homo sapiens
gctcagcggggacagc

SEQ ID NO: 2055291 - DNA, 14 bp, Homo sapiens
gctgaagttctgag

SEQ ID NO: 2055292 - DNA, 22 bp, Homo sapiens
gctgaattattttgttgtgatt

SEQ ID NO: 2055293 - DNA, 19 bp, Homo sapiens
gctgacacctaccatgctg

SEQ ID NO: 2055294 - DNA, 20 bp, Homo sapiens
gctgacacctaccatgctgc

SEQ ID NO: 2055295 - DNA, 13 bp, Homo sapiens
gctgacagacaca

SEQ ID NO: 2055296 - DNA, 15 bp, Homo sapiens
gctgacagacacagg

SEQ ID NO: 2055297 - DNA, 20 bp, Homo sapiens
gctgacagacacaggcccgg

SEQ ID NO: 2055298 - DNA, 12 bp, Homo sapiens
gctgacaggatg

SEQ ID NO: 2055299 - DNA, 19 bp, Homo sapiens
gctgacaggatgtggcact

SEQ ID NO: 2055300 - DNA, 23 bp, Homo sapiens
gctgacatggctttgctttgtgt

SEQ ID NO: 2055301 - DNA, 18 bp, Homo sapiens
gctgaccccaaagagcct

SEQ ID NO: 2055302 - DNA, 16 bp, Homo sapiens
gctgacctctggtggc

SEQ ID NO: 2055303 - DNA, 15 bp, Homo sapiens
gctgacctgcctctc

SEQ ID NO: 2055304 - DNA, 22 bp, Homo sapiens
gctgacctgcctctcacacaca

SEQ ID NO: 2055305 - DNA, 23 bp, Homo sapiens
gctgacctgcctctcacacacat

SEQ ID NO: 2055306 - DNA, 14 bp, Homo sapiens
gctgacctgttttt

SEQ ID NO: 2055307 - DNA, 18 bp, Homo sapiens
gctgactgatgttgaggg

SEQ ID NO: 2055308 - DNA, 20 bp, Homo sapiens
gctgactgatgttgagggaa

SEQ ID NO: 2055309 - DNA, 16 bp, Homo sapiens
gctgagaacctggcct

SEQ ID NO: 2055310 - DNA, 20 bp, Homo sapiens
gctgagaagaagctgaggat

SEQ ID NO: 2055311 - DNA, 14 bp, Homo sapiens
gctgagagacccaa

SEQ ID NO: 2055312 - DNA, 17 bp, Homo sapiens
gctgagagccctgctgt

SEQ ID NO: 2055313 - DNA, 12 bp, Homo sapiens
gctgagaggaag

SEQ ID NO: 2055314 - DNA, 23 bp, Homo sapiens
gctgagaggaagatgaagagaag

SEQ ID NO: 2055315 - DNA, 21 bp, Homo sapiens
gctgagagtctgaaagacaga

SEQ ID NO: 2055316 - DNA, 22 bp, Homo sapiens
gctgagattgcgccactgcact

SEQ ID NO: 2055317 - DNA, 16 bp, Homo sapiens
gctgagcaccctctcc

SEQ ID NO: 2055318 - DNA, 23 bp, Homo sapiens
gctgagcaggcccgacagagaga

SEQ ID NO: 2055319 - DNA, 16 bp, Homo sapiens
gctgagcagggccggg

SEQ ID NO: 2055320 - DNA, 15 bp, Homo sapiens
gctgagccactcgca

SEQ ID NO: 2055321 - DNA, 11 bp, Homo sapiens
gctgagccctg

SEQ ID NO: 2055322 - DNA, 12 bp, Homo sapiens
gctgagccctgg

SEQ ID NO: 2055323 - DNA, 13 bp, Homo sapiens
gctgagccctggc

SEQ ID NO: 2055324 - DNA, 15 bp, Homo sapiens
gctgagccctggcag

SEQ ID NO: 2055325 - DNA, 16 bp, Homo sapiens
gctgagccctggcagg

SEQ ID NO: 2055326 - DNA, 20 bp, Homo sapiens
gctgagctcacaaggcagca

SEQ ID NO: 2055327 - DNA, 15 bp, Homo sapiens
gctgagctctgagag

SEQ ID NO: 2055328 - DNA, 20 bp, Homo sapiens
gctgagctctgagaggccct

SEQ ID NO: 2055329 - DNA, 21 bp, Homo sapiens
gctgagctctgagaggccctg

SEQ ID NO: 2055330 - DNA, 22 bp, Homo sapiens
gctgagctctgagaggccctgg

SEQ ID NO: 2055331 - DNA, 14 bp, Homo sapiens
gctgaggactccct

SEQ ID NO: 2055332 - DNA, 17 bp, Homo sapiens
gctgaggatcctcacag

SEQ ID NO: 2055333 - DNA, 23 bp, Homo sapiens
gctgaggatcctcacaggagcag

SEQ ID NO: 2055334 - DNA, 15 bp, Homo sapiens
gctgaggatgacaga

SEQ ID NO: 2055335 - DNA, 16 bp, Homo sapiens
gctgaggatgacagag

SEQ ID NO: 2055336 - DNA, 15 bp, Homo sapiens
gctgaggcagaagaa

SEQ ID NO: 2055337 - DNA, 15 bp, Homo sapiens
gctgaggcaggagga

SEQ ID NO: 2055338 - DNA, 21 bp, Homo sapiens
gctgaggggggccgtgcccag

SEQ ID NO: 2055339 - DNA, 15 bp, Homo sapiens
gctgaggtgcccagg

SEQ ID NO: 2055340 - DNA, 21 bp, Homo sapiens
gctgaggtgtcttaagccttt

SEQ ID NO: 2055341 - DNA, 15 bp, Homo sapiens
gctgagtcacctcct

SEQ ID NO: 2055342 - DNA, 21 bp, Homo sapiens
gctgagtcatgatctccctgc

SEQ ID NO: 2055343 - DNA, 16 bp, Homo sapiens
gctgagtgagccacag

SEQ ID NO: 2055344 - DNA, 22 bp, Homo sapiens
gctgagttacttgtctgaggcc

SEQ ID NO: 2055345 - DNA, 23 bp, Homo sapiens
gctgagttacttgtctgaggcct

SEQ ID NO: 2055346 - DNA, 19 bp, Homo sapiens
gctgataattttaaattct

SEQ ID NO: 2055347 - DNA, 17 bp, Homo sapiens
gctgatgaaactcctga

SEQ ID NO: 2055348 - DNA, 22 bp, Homo sapiens
gctgatgaaactcctgattttg

SEQ ID NO: 2055349 - DNA, 23 bp, Homo sapiens
gctgatgaaactcctgattttgt

SEQ ID NO: 2055350 - DNA, 15 bp, Homo sapiens
gctgatttccaggcc

SEQ ID NO: 2055351 - DNA, 19 bp, Homo sapiens
gctgatttccaggcccctg

SEQ ID NO: 2055352 - DNA, 13 bp, Homo sapiens
gctgcaaagtgca

SEQ ID NO: 2055353 - DNA, 14 bp, Homo sapiens
gctgcacattcctg

SEQ ID NO: 2055354 - DNA, 17 bp, Homo sapiens
gctgcacattcctggcc

SEQ ID NO: 2055355 - DNA, 18 bp, Homo sapiens
gctgcacattcctggccc

SEQ ID NO: 2055356 - DNA, 20 bp, Homo sapiens
gctgcacattcctggccccg

SEQ ID NO: 2055357 - DNA, 16 bp, Homo sapiens
gctgcaccagagtgaa

SEQ ID NO: 2055358 - DNA, 19 bp, Homo sapiens
gctgcaccatcacacatgc

SEQ ID NO: 2055359 - DNA, 22 bp, Homo sapiens
gctgcacctgccagcctggctt

SEQ ID NO: 2055360 - DNA, 15 bp, Homo sapiens
gctgcactgcagtga

SEQ ID NO: 2055361 - DNA, 17 bp, Homo sapiens
gctgcagaaggccaaga

SEQ ID NO: 2055362 - DNA, 14 bp, Homo sapiens
gctgcagctgggcc

SEQ ID NO: 2055363 - DNA, 22 bp, Homo sapiens
gctgcagctgggccccatgctc

SEQ ID NO: 2055364 - DNA, 13 bp, Homo sapiens
gctgcagcttcct

SEQ ID NO: 2055365 - DNA, 14 bp, Homo sapiens
gctgcagcttcctg

SEQ ID NO: 2055366 - DNA, 15 bp, Homo sapiens
gctgcaggaatcaaa

SEQ ID NO: 2055367 - DNA, 21 bp, Homo sapiens
gctgcaggtacttcctcctga

SEQ ID NO: 2055368 - DNA, 22 bp, Homo sapiens
gctgcaggtacttcctcctgat

SEQ ID NO: 2055369 - DNA, 22 bp, Homo sapiens
gctgcagtcaacagttcaaaga

SEQ ID NO: 2055370 - DNA, 15 bp, Homo sapiens
gctgcatctactcag

SEQ ID NO: 2055371 - DNA, 18 bp, Homo sapiens
gctgcatgcctggtcttt

SEQ ID NO: 2055372 - DNA, 16 bp, Homo sapiens
gctgccaccacgtctg

SEQ ID NO: 2055373 - DNA, 19 bp, Homo sapiens
gctgccactaacctgtaga

SEQ ID NO: 2055374 - DNA, 15 bp, Homo sapiens
gctgccagccgggca

SEQ ID NO: 2055375 - DNA, 13 bp, Homo sapiens
gctgccaggacac

SEQ ID NO: 2055376 - DNA, 14 bp, Homo sapiens
gctgccaggacacc

SEQ ID NO: 2055377 - DNA, 17 bp, Homo sapiens
gctgccaggacacctgc

SEQ ID NO: 2055378 - DNA, 18 bp, Homo sapiens
gctgccaggacacctgcc

SEQ ID NO: 2055379 - DNA, 19 bp, Homo sapiens
gctgccaggacacctgccc

SEQ ID NO: 2055380 - DNA, 20 bp, Homo sapiens
gctgccaggacacctgcccc

SEQ ID NO: 2055381 - DNA, 22 bp, Homo sapiens
gctgccaggacacctgccccag

SEQ ID NO: 2055382 - DNA, 10 bp, Homo sapiens
gctgccaggc

SEQ ID NO: 2055383 - DNA, 12 bp, Homo sapiens
gctgccatccag

SEQ ID NO: 2055384 - DNA, 14 bp, Homo sapiens
gctgccatgccact

SEQ ID NO: 2055385 - DNA, 17 bp, Homo sapiens
gctgccatgccactgcc

SEQ ID NO: 2055386 - DNA, 15 bp, Homo sapiens
gctgcccccacctct

SEQ ID NO: 2055387 - DNA, 20 bp, Homo sapiens
gctgccccgcttccccacag

SEQ ID NO: 2055388 - DNA, 23 bp, Homo sapiens
gctgccccgcttccccacagaac

SEQ ID NO: 2055389 - DNA, 19 bp, Homo sapiens
gctgccccgttccctgtca

SEQ ID NO: 2055390 - DNA, 20 bp, Homo sapiens
gctgccccgttccctgtcag

SEQ ID NO: 2055391 - DNA, 22 bp, Homo sapiens
gctgccccgttccctgtcagag

SEQ ID NO: 2055392 - DNA, 13 bp, Homo sapiens
gctgcccctgcag

SEQ ID NO: 2055393 - DNA, 16 bp, Homo sapiens
gctgcccgtcttcagc

SEQ ID NO: 2055394 - DNA, 19 bp, Homo sapiens
gctgcccgtcttcagccta

SEQ ID NO: 2055395 - DNA, 13 bp, Homo sapiens
gctgccctggtgc

SEQ ID NO: 2055396 - DNA, 16 bp, Homo sapiens
gctgccgaccagagcc

SEQ ID NO: 2055397 - DNA, 18 bp, Homo sapiens
gctgccgcaaggccctgt

SEQ ID NO: 2055398 - DNA, 22 bp, Homo sapiens
gctgccgcaccccagagtgtgg

SEQ ID NO: 2055399 - DNA, 18 bp, Homo sapiens
gctgccgcctcccagcct

SEQ ID NO: 2055400 - DNA, 16 bp, Homo sapiens
gctgccgctgcaccac

SEQ ID NO: 2055401 - DNA, 17 bp, Homo sapiens
gctgccgctgcaccacg

SEQ ID NO: 2055402 - DNA, 17 bp, Homo sapiens
gctgccgctgccgctgc

SEQ ID NO: 2055403 - DNA, 17 bp, Homo sapiens
gctgccgggccaggcgc

SEQ ID NO: 2055404 - DNA, 16 bp, Homo sapiens
gctgcctaagtggctg

SEQ ID NO: 2055405 - DNA, 14 bp, Homo sapiens
gctggtcccactca

SEQ ID NO: 2055406 - DNA, 19 bp, Homo sapiens
gctggtcccactcagtcca

SEQ ID NO: 2055407 - DNA, 20 bp, Homo sapiens
gctggtcccactcagtccat

SEQ ID NO: 2055408 - DNA, 19 bp, Homo sapiens
gctggtcgtgaactcctga

SEQ ID NO: 2055409 - DNA, 12 bp, Homo sapiens
gctggtggacca

SEQ ID NO: 2055410 - DNA, 15 bp, Homo sapiens
gctggttcagggttg

SEQ ID NO: 2055411 - DNA, 18 bp, Homo sapiens
gctgtaactcagacattc

SEQ ID NO: 2055412 - DNA, 15 bp, Homo sapiens
gctgtaactgctgag

SEQ ID NO: 2055413 - DNA, 17 bp, Homo sapiens
gctgtaactgctgagcc

SEQ ID NO: 2055414 - DNA, 19 bp, Homo sapiens
gctgtaagcattctgagct

SEQ ID NO: 2055415 - DNA, 16 bp, Homo sapiens
gctgtacactgcacga

SEQ ID NO: 2055416 - DNA, 14 bp, Homo sapiens
gctgtacccttcca

SEQ ID NO: 2055417 - DNA, 15 bp, Homo sapiens
gctgtacccttccac

SEQ ID NO: 2055418 - DNA, 16 bp, Homo sapiens
gctgtactcagagcag

SEQ ID NO: 2055419 - DNA, 19 bp, Homo sapiens
gctgtagccatggctcagg

SEQ ID NO: 2055420 - DNA, 20 bp, Homo sapiens
gctgtagccatggctcaggc

SEQ ID NO: 2055421 - DNA, 13 bp, Homo sapiens
gctgtaggtgtgc

SEQ ID NO: 2055422 - DNA, 18 bp, Homo sapiens
gctgtatatatatatgtg

SEQ ID NO: 2055423 - DNA, 19 bp, Homo sapiens
gctgtatatatatatgtgt

SEQ ID NO: 2055424 - DNA, 23 bp, Homo sapiens
gctgtatcccatgagcctcagca

SEQ ID NO: 2055425 - DNA, 20 bp, Homo sapiens
gctgtcacttagggataaca

SEQ ID NO: 2055426 - DNA, 18 bp, Homo sapiens
gctgtcataagaatgaat

SEQ ID NO: 2055427 - DNA, 15 bp, Homo sapiens
gctgtcattgtccat

SEQ ID NO: 2055428 - DNA, 14 bp, Homo sapiens
gctgtcccctctcc

SEQ ID NO: 2055429 - DNA, 16 bp, Homo sapiens
gctgtcccctctgtca

SEQ ID NO: 2055430 - DNA, 14 bp, Homo sapiens
gctgtcctaggcca

SEQ ID NO: 2055431 - DNA, 16 bp, Homo sapiens
gctgtcctaggccaca

SEQ ID NO: 2055432 - DNA, 17 bp, Homo sapiens
gctgtcctctcgagccc

SEQ ID NO: 2055433 - DNA, 20 bp, Homo sapiens
gctgtcctctcgagcccaga

SEQ ID NO: 2055434 - DNA, 15 bp, Homo sapiens
gctgtcctctgaagg

SEQ ID NO: 2055435 - DNA, 17 bp, Homo sapiens
gctgtcctgctgtgtga

SEQ ID NO: 2055436 - DNA, 14 bp, Homo sapiens
gctgtctccaggat

SEQ ID NO: 2055437 - DNA, 18 bp, Homo sapiens
gctgtctccataatgcca

SEQ ID NO: 2055438 - DNA, 13 bp, Homo sapiens
gctgtctctgtcc

SEQ ID NO: 2055439 - DNA, 18 bp, Homo sapiens
gctgtgaacatggactct

SEQ ID NO: 2055440 - DNA, 19 bp, Homo sapiens
gctgtgaactcagagcccc

SEQ ID NO: 2055441 - DNA, 20 bp, Homo sapiens
gctgtgaactcagagcccct

SEQ ID NO: 2055442 - DNA, 23 bp, Homo sapiens
gctgtgacctgctgagctctgag

SEQ ID NO: 2055443 - DNA, 20 bp, Homo sapiens
gctgtgagcccctggtcctg

SEQ ID NO: 2055444 - DNA, 22 bp, Homo sapiens
gctgtgatttttgttgattaaa

SEQ ID NO: 2055445 - DNA, 15 bp, Homo sapiens
gctgtgcctctgcct

SEQ ID NO: 2055446 - DNA, 12 bp, Homo sapiens
gctgtgcctgct

SEQ ID NO: 2055447 - DNA, 17 bp, Homo sapiens
gctgtgcctgctagagc

SEQ ID NO: 2055448 - DNA, 18 bp, Homo sapiens
gctgtgcctgctagagca

SEQ ID NO: 2055449 - DNA, 19 bp, Homo sapiens
gctgtgctctcaccagctg

SEQ ID NO: 2055450 - DNA, 21 bp, Homo sapiens
gctgtgctctggacaggcatg

SEQ ID NO: 2055451 - DNA, 14 bp, Homo sapiens
gctgtgctgtgtct

SEQ ID NO: 2055452 - DNA, 12 bp, Homo sapiens
gctgtggaggcc

SEQ ID NO: 2055453 - DNA, 13 bp, Homo sapiens
gctgtggaggcct

SEQ ID NO: 2055454 - DNA, 22 bp, Homo sapiens
gctgtggaggcctgatgctgcc

SEQ ID NO: 2055455 - DNA, 12 bp, Homo sapiens
gctgtggcctca

SEQ ID NO: 2055456 - DNA, 13 bp, Homo sapiens
gctgtggcctcac

SEQ ID NO: 2055457 - DNA, 14 bp, Homo sapiens
gctgtggcctcact

SEQ ID NO: 2055458 - DNA, 20 bp, Homo sapiens
gctgtggcctcacttccctg

SEQ ID NO: 2055459 - DNA, 12 bp, Homo sapiens
gctgtggctcct

SEQ ID NO: 2055460 - DNA, 13 bp, Homo sapiens
gctgtggctcctg

SEQ ID NO: 2055461 - DNA, 15 bp, Homo sapiens
gctgtggctcctgcc

SEQ ID NO: 2055462 - DNA, 13 bp, Homo sapiens
gctgtgggcagca

SEQ ID NO: 2055463 - DNA, 15 bp, Homo sapiens
gctgtgggcagcacc

SEQ ID NO: 2055464 - DNA, 18 bp, Homo sapiens
gctgtggggcatagaact

SEQ ID NO: 2055465 - DNA, 22 bp, Homo sapiens
gctgtgggggaggtccctgcca

SEQ ID NO: 2055466 - DNA, 20 bp, Homo sapiens
gctgtggtggctgtctctgt

SEQ ID NO: 2055467 - DNA, 20 bp, Homo sapiens
gctgtggtggggagaggcat

SEQ ID NO: 2055468 - DNA, 18 bp, Homo sapiens
gctgtgtagctctgtcca

SEQ ID NO: 2055469 - DNA, 19 bp, Homo sapiens
gctgtgtccttgcacctgc

SEQ ID NO: 2055470 - DNA, 18 bp, Homo sapiens
gctgttatttctattttt

SEQ ID NO: 2055471 - DNA, 20 bp, Homo sapiens
gctgttcacccacagggcta

SEQ ID NO: 2055472 - DNA, 17 bp, Homo sapiens
gctgttccacttctcta

SEQ ID NO: 2055473 - DNA, 15 bp, Homo sapiens
gctgttctggagctg

SEQ ID NO: 2055474 - DNA, 20 bp, Homo sapiens
gctgttctggagctgctgtt

SEQ ID NO: 2055475 - DNA, 15 bp, Homo sapiens
gctgttgccatagcc

SEQ ID NO: 2055476 - DNA, 16 bp, Homo sapiens
gctgttgccatagccc

SEQ ID NO: 2055477 - DNA, 12 bp, Homo sapiens
gctgttggcctc

SEQ ID NO: 2055478 - DNA, 14 bp, Homo sapiens
gctgttggcctcgc

SEQ ID NO: 2055479 - DNA, 16 bp, Homo sapiens
gctgttggcctcgcct

SEQ ID NO: 2055480 - DNA, 20 bp, Homo sapiens
gctgttggctgggggcctca

SEQ ID NO: 2055481 - DNA, 23 bp, Homo sapiens
gctgttgttccttcacatttaag

SEQ ID NO: 2055482 - DNA, 17 bp, Homo sapiens
gctgtttatttattcac

SEQ ID NO: 2055483 - DNA, 14 bp, Homo sapiens
gctgtttctggaaa

SEQ ID NO: 2055484 - DNA, 23 bp, Homo sapiens
gctgtttctttttttatgactgt

SEQ ID NO: 2055485 - DNA, 20 bp, Homo sapiens
gctgtttgagatgtgatgct

SEQ ID NO: 2055486 - DNA, 20 bp, Homo sapiens
gctgtttgtttgacaaagaa

SEQ ID NO: 2055487 - DNA, 16 bp, Homo sapiens
gcttaaaatatgtatg

SEQ ID NO: 2055488 - DNA, 17 bp, Homo sapiens
gcttaatgtttattcct

SEQ ID NO: 2055489 - DNA, 16 bp, Homo sapiens
gcttacagtgactgtc

SEQ ID NO: 2055490 - DNA, 18 bp, Homo sapiens
gcttacatttttacaata

SEQ ID NO: 2055491 - DNA, 12 bp, Homo sapiens
gcttacctgaca

SEQ ID NO: 2055492 - DNA, 14 bp, Homo sapiens
gcttacctgacaca

SEQ ID NO: 2055493 - DNA, 13 bp, Homo sapiens
gcttagacctcag

SEQ ID NO: 2055494 - DNA, 18 bp, Homo sapiens
gcttagacctcagcctgt

SEQ ID NO: 2055495 - DNA, 21 bp, Homo sapiens
gcttagacttcgactcaggat

SEQ ID NO: 2055496 - DNA, 22 bp, Homo sapiens
gcttagcctcctgacctgaggc

SEQ ID NO: 2055497 - DNA, 12 bp, Homo sapiens
gcttagccttgt

SEQ ID NO: 2055498 - DNA, 20 bp, Homo sapiens
gcttagccttgtgccctgcc

SEQ ID NO: 2055499 - DNA, 13 bp, Homo sapiens
gcttagctgaaac

SEQ ID NO: 2055500 - DNA, 12 bp, Homo sapiens
gcttaggatgtt

SEQ ID NO: 2055501 - DNA, 19 bp, Homo sapiens
gcttaggctgcttattgga

SEQ ID NO: 2055502 - DNA, 22 bp, Homo sapiens
gcttagtatctcatcaacaaag

SEQ ID NO: 2055503 - DNA, 15 bp, Homo sapiens
gcttataaatgtgta

SEQ ID NO: 2055504 - DNA, 18 bp, Homo sapiens
gcttatgacatcacttgt

SEQ ID NO: 2055505 - DNA, 23 bp, Homo sapiens
gcttatgacatcacttgtacaaa

SEQ ID NO: 2055506 - DNA, 14 bp, Homo sapiens
gcttatggccaggg

SEQ ID NO: 2055507 - DNA, 20 bp, Homo sapiens
gcttattcatctgtttttct

SEQ ID NO: 2055508 - DNA, 22 bp, Homo sapiens
gcttatttatattcagagatgt

SEQ ID NO: 2055509 - DNA, 14 bp, Homo sapiens
gcttatttccctca

SEQ ID NO: 2055510 - DNA, 18 bp, Homo sapiens
gcttcaaccctcagcctt

SEQ ID NO: 2055511 - DNA, 22 bp, Homo sapiens
gcttcaagtgatatatgtattt

SEQ ID NO: 2055512 - DNA, 15 bp, Homo sapiens
gcttcacccctgcac

SEQ ID NO: 2055513 - DNA, 22 bp, Homo sapiens
gcttcaccctgaatggttccat

SEQ ID NO: 2055514 - DNA, 15 bp, Homo sapiens
gcttcagagcctagc

SEQ ID NO: 2055515 - DNA, 23 bp, Homo sapiens
gcttcagagcctagccacctccc

SEQ ID NO: 2055516 - DNA, 17 bp, Homo sapiens
gcttcagcatatttata

SEQ ID NO: 2055517 - DNA, 17 bp, Homo sapiens
gcttcagcctccccacc

SEQ ID NO: 2055518 - DNA, 20 bp, Homo sapiens
gcttcagggtatcccagacc

SEQ ID NO: 2055519 - DNA, 17 bp, Homo sapiens
gcttcagtggcagctgc

SEQ ID NO: 2055520 - DNA, 21 bp, Homo sapiens
ggacaccccttatccaggact

SEQ ID NO: 2055521 - DNA, 22 bp, Homo sapiens
ggacacctgccccagcgcggct

SEQ ID NO: 2055522 - DNA, 17 bp, Homo sapiens
ggacacctgccctgccc

SEQ ID NO: 2055523 - DNA, 17 bp, Homo sapiens
ggacacctggccgcctc

SEQ ID NO: 2055524 - DNA, 22 bp, Homo sapiens
ggacacggggcagtggcaacct

SEQ ID NO: 2055525 - DNA, 14 bp, Homo sapiens
ggacagaagaaggc

SEQ ID NO: 2055526 - DNA, 15 bp, Homo sapiens
ggacagacctggaca

SEQ ID NO: 2055527 - DNA, 20 bp, Homo sapiens
ggacagagacacctgcacct

SEQ ID NO: 2055528 - DNA, 21 bp, Homo sapiens
ggacagagacacctgcacctc

SEQ ID NO: 2055529 - DNA, 12 bp, Homo sapiens
ggacagagatgg

SEQ ID NO: 2055530 - DNA, 15 bp, Homo sapiens
ggacagagatggagg

SEQ ID NO: 2055531 - DNA, 21 bp, Homo sapiens
ggacagcagaagggggagacc

SEQ ID NO: 2055532 - DNA, 21 bp, Homo sapiens
ggacagccacggccaggccag

SEQ ID NO: 2055533 - DNA, 12 bp, Homo sapiens
ggacagccccag

SEQ ID NO: 2055534 - DNA, 15 bp, Homo sapiens
ggacagccccagggc

SEQ ID NO: 2055535 - DNA, 16 bp, Homo sapiens
ggacagccgcctggag

SEQ ID NO: 2055536 - DNA, 11 bp, Homo sapiens
ggacagctcct

SEQ ID NO: 2055537 - DNA, 15 bp, Homo sapiens
ggacagctccttctg

SEQ ID NO: 2055538 - DNA, 17 bp, Homo sapiens
ggacagctccttctgtc

SEQ ID NO: 2055539 - DNA, 14 bp, Homo sapiens
ggacagctggctgc

SEQ ID NO: 2055540 - DNA, 17 bp, Homo sapiens
ggacagctggctgctga

SEQ ID NO: 2055541 - DNA, 21 bp, Homo sapiens
ggacagctggctgctgacagg

SEQ ID NO: 2055542 - DNA, 11 bp, Homo sapiens
ggacagctgtg

SEQ ID NO: 2055543 - DNA, 12 bp, Homo sapiens
ggacagctgtgc

SEQ ID NO: 2055544 - DNA, 15 bp, Homo sapiens
ggacagctgtgcctc

SEQ ID NO: 2055545 - DNA, 20 bp, Homo sapiens
ggacagctgtgcctcgctcc

SEQ ID NO: 2055546 - DNA, 12 bp, Homo sapiens
ggacagcttgtg

SEQ ID NO: 2055547 - DNA, 22 bp, Homo sapiens
ggacagcttgtggcaagtgaat

SEQ ID NO: 2055548 - DNA, 23 bp, Homo sapiens
ggacaggaggggcccacaatgga

SEQ ID NO: 2055549 - DNA, 23 bp, Homo sapiens
ggacaggcatgttctctgaggac

SEQ ID NO: 2055550 - DNA, 17 bp, Homo sapiens
ggacagggaggtgaccc

SEQ ID NO: 2055551 - DNA, 15 bp, Homo sapiens
ggacagggcatggcc

SEQ ID NO: 2055552 - DNA, 17 bp, Homo sapiens
ggacagtattctcagtg

SEQ ID NO: 2055553 - DNA, 20 bp, Homo sapiens
ggacagtattctcagtgctc

SEQ ID NO: 2055554 - DNA, 19 bp, Homo sapiens
ggacagtcctgggagaacc

SEQ ID NO: 2055555 - DNA, 14 bp, Homo sapiens
ggacagtgcttcag

SEQ ID NO: 2055556 - DNA, 20 bp, Homo sapiens
ggacagtgcttcagcctgag

SEQ ID NO: 2055557 - DNA, 21 bp, Homo sapiens
ggacagtgcttcagcctgagg

SEQ ID NO: 2055558 - DNA, 22 bp, Homo sapiens
ggacagttgcttttcagcatgg

SEQ ID NO: 2055559 - DNA, 14 bp, Homo sapiens
ggacagttggcaga

SEQ ID NO: 2055560 - DNA, 17 bp, Homo sapiens
ggacatcacagcagaat

SEQ ID NO: 2055561 - DNA, 20 bp, Homo sapiens
ggacatgatttagggaagca

SEQ ID NO: 2055562 - DNA, 21 bp, Homo sapiens
ggacatgatttagggaagcag

SEQ ID NO: 2055563 - DNA, 16 bp, Homo sapiens
ggacatggagagagac

SEQ ID NO: 2055564 - DNA, 19 bp, Homo sapiens
ggacatggagagagactca

SEQ ID NO: 2055565 - DNA, 22 bp, Homo sapiens
ggacatggggcatagaaactga

SEQ ID NO: 2055566 - DNA, 23 bp, Homo sapiens
ggacatgtgctattgaactgagc

SEQ ID NO: 2055567 - DNA, 19 bp, Homo sapiens
ggaccaaattgcttctagg

SEQ ID NO: 2055568 - DNA, 17 bp, Homo sapiens
ggaccaaccctgtttcc

SEQ ID NO: 2055569 - DNA, 14 bp, Homo sapiens
ggaccaactggctt

SEQ ID NO: 2055570 - DNA, 16 bp, Homo sapiens
ggaccaactggcttct

SEQ ID NO: 2055571 - DNA, 11 bp, Homo sapiens
ggaccaagaat

SEQ ID NO: 2055572 - DNA, 16 bp, Homo sapiens
ggaccaagatgggcac

SEQ ID NO: 2055573 - DNA, 21 bp, Homo sapiens
ggaccacacctccctgaacca

SEQ ID NO: 2055574 - DNA, 21 bp, Homo sapiens
ggaccacactttgagaacctg

SEQ ID NO: 2055575 - DNA, 17 bp, Homo sapiens
ggaccaggacaggacca

SEQ ID NO: 2055576 - DNA, 18 bp, Homo sapiens
ggaccagtcccagagcag

SEQ ID NO: 2055577 - DNA, 16 bp, Homo sapiens
ggaccatgaagagact

SEQ ID NO: 2055578 - DNA, 24 bp, Homo sapiens
ggaccattgacctcagctgcacat

SEQ ID NO: 2055579 - DNA, 23 bp, Homo sapiens
ggacccagctactctgtccaggc

SEQ ID NO: 2055580 - DNA, 12 bp, Homo sapiens
ggacccaggccc

SEQ ID NO: 2055581 - DNA, 13 bp, Homo sapiens
ggacccaggccct

SEQ ID NO: 2055582 - DNA, 13 bp, Homo sapiens
ggacccaggccgc

SEQ ID NO: 2055583 - DNA, 14 bp, Homo sapiens
ggacccagggatga

SEQ ID NO: 2055584 - DNA, 19 bp, Homo sapiens
ggacccatagatcttctga

SEQ ID NO: 2055585 - DNA, 18 bp, Homo sapiens
ggaccccagctagggctg

SEQ ID NO: 2055586 - DNA, 23 bp, Homo sapiens
ggaccccgcctcccagccccagg

SEQ ID NO: 2055587 - DNA, 13 bp, Homo sapiens
ggacccctcccaa

SEQ ID NO: 2055588 - DNA, 17 bp, Homo sapiens
ggacccctcccttgctc

SEQ ID NO: 2055589 - DNA, 14 bp, Homo sapiens
ggaccctcgcagca

SEQ ID NO: 2055590 - DNA, 12 bp, Homo sapiens
ggaccctgccca

SEQ ID NO: 2055591 - DNA, 16 bp, Homo sapiens
ggaccctttccttcct

SEQ ID NO: 2055592 - DNA, 19 bp, Homo sapiens
ggaccgcttcccagaggcc

SEQ ID NO: 2055593 - DNA, 15 bp, Homo sapiens
ggaccgggctggggt

SEQ ID NO: 2055594 - DNA, 19 bp, Homo sapiens
ggaccgggtgggcctggcc

SEQ ID NO: 2055595 - DNA, 20 bp, Homo sapiens
ggaccgtggccctgccctct

SEQ ID NO: 2055596 - DNA, 17 bp, Homo sapiens
ggacctatgtcctaagg

SEQ ID NO: 2055597 - DNA, 12 bp, Homo sapiens
ggacctcaggcg

SEQ ID NO: 2055598 - DNA, 13 bp, Homo sapiens
ggacctctgctct

SEQ ID NO: 2055599 - DNA, 14 bp, Homo sapiens
ggacctctgctctg

SEQ ID NO: 2055600 - DNA, 16 bp, Homo sapiens
ggacctctgctctgag

SEQ ID NO: 2055601 - DNA, 17 bp, Homo sapiens
ggacctctgctctgagg

SEQ ID NO: 2055602 - DNA, 21 bp, Homo sapiens
ggacctgaagggtgacatccc

SEQ ID NO: 2055603 - DNA, 12 bp, Homo sapiens
ggacctgagcct

SEQ ID NO: 2055604 - DNA, 15 bp, Homo sapiens
ggacctgagcctgcc

SEQ ID NO: 2055605 - DNA, 16 bp, Homo sapiens
ggacctgagcctgccg

SEQ ID NO: 2055606 - DNA, 19 bp, Homo sapiens
ggacctgagcctgccgagc

SEQ ID NO: 2055607 - DNA, 17 bp, Homo sapiens
ggacctgagtctgctat

SEQ ID NO: 2055608 - DNA, 16 bp, Homo sapiens
ggacctgttttcttca

SEQ ID NO: 2055609 - DNA, 15 bp, Homo sapiens
ggaccttgaactggg

SEQ ID NO: 2055610 - DNA, 17 bp, Homo sapiens
ggacctttcagctgtga

SEQ ID NO: 2055611 - DNA, 13 bp, Homo sapiens
ggacgaacagggg

SEQ ID NO: 2055612 - DNA, 13 bp, Homo sapiens
ggacgcgggctgt

SEQ ID NO: 2055613 - DNA, 17 bp, Homo sapiens
ggacgttgcctggccct

SEQ ID NO: 2055614 - DNA, 14 bp, Homo sapiens
ggacgttggttctg

SEQ ID NO: 2055615 - DNA, 21 bp, Homo sapiens
ggactaacactcagaagcctg

SEQ ID NO: 2055616 - DNA, 21 bp, Homo sapiens
ggactacgttaagggaaggaa

SEQ ID NO: 2055617 - DNA, 22 bp, Homo sapiens
ggactagaaaaacttgggtctc

SEQ ID NO: 2055618 - DNA, 14 bp, Homo sapiens
ggactattataatt

SEQ ID NO: 2055619 - DNA, 15 bp, Homo sapiens
ggactcaatgcactg

SEQ ID NO: 2055620 - DNA, 18 bp, Homo sapiens
ggactcaatgcactgaca

SEQ ID NO: 2055621 - DNA, 22 bp, Homo sapiens
ggactcaatgcactgacattgt

SEQ ID NO: 2055622 - DNA, 22 bp, Homo sapiens
ggactcattttaaaaaatggaa

SEQ ID NO: 2055623 - DNA, 14 bp, Homo sapiens
ggactccccaggcc

SEQ ID NO: 2055624 - DNA, 12 bp, Homo sapiens
ggactcctccca

SEQ ID NO: 2055625 - DNA, 17 bp, Homo sapiens
ggactctaagctggagc

SEQ ID NO: 2055626 - DNA, 15 bp, Homo sapiens
ggactctgcacatga

SEQ ID NO: 2055627 - DNA, 18 bp, Homo sapiens
ggactctgccccttctgt

SEQ ID NO: 2055628 - DNA, 11 bp, Homo sapiens
ggactctgcct

SEQ ID NO: 2055629 - DNA, 22 bp, Homo sapiens
ggactgacaagaagctcccaga

SEQ ID NO: 2055630 - DNA, 22 bp, Homo sapiens
ggactgcaagcagggctctgcc

SEQ ID NO: 2055631 - DNA, 14 bp, Homo sapiens
ggactggaaccagg

SEQ ID NO: 2055632 - DNA, 11 bp, Homo sapiens
ggactgggagg

SEQ ID NO: 2055633 - DNA, 12 bp, Homo sapiens
ggactgggaggt

SEQ ID NO: 2055634 - DNA, 17 bp, Homo sapiens
ggactggggatgtggga

SEQ ID NO: 2055635 - DNA, 19 bp, Homo sapiens
ggcacacagcagcccccca

SEQ ID NO: 2055636 - DNA, 18 bp, Homo sapiens
ggcacaccactgccctgc

SEQ ID NO: 2055637 - DNA, 18 bp, Homo sapiens
ggcacaccgggcactcag

SEQ ID NO: 2055638 - DNA, 17 bp, Homo sapiens
ggcacacgcctgtaatc

SEQ ID NO: 2055639 - DNA, 22 bp, Homo sapiens
ggcacaggactgattctgggat

SEQ ID NO: 2055640 - DNA, 17 bp, Homo sapiens
ggcacaggagctacctg

SEQ ID NO: 2055641 - DNA, 21 bp, Homo sapiens
ggcacaggcaggaagagagag

SEQ ID NO: 2055642 - DNA, 18 bp, Homo sapiens
ggcacaggtgtaaatata

SEQ ID NO: 2055643 - DNA, 13 bp, Homo sapiens
ggcaccagaatgc

SEQ ID NO: 2055644 - DNA, 22 bp, Homo sapiens
ggcaccagaggctgcagaaggc

SEQ ID NO: 2055645 - DNA, 14 bp, Homo sapiens
ggcaccagccccct

SEQ ID NO: 2055646 - DNA, 13 bp, Homo sapiens
ggcaccagctctg

SEQ ID NO: 2055647 - DNA, 22 bp, Homo sapiens
ggcaccagctctgtggcctgtg

SEQ ID NO: 2055648 - DNA, 23 bp, Homo sapiens
ggcacccaccatcatgtctggct

SEQ ID NO: 2055649 - DNA, 14 bp, Homo sapiens
ggcacccccagcct

SEQ ID NO: 2055650 - DNA, 18 bp, Homo sapiens
ggcacccccagcctgggc

SEQ ID NO: 2055651 - DNA, 19 bp, Homo sapiens
ggcacccccagcctgggcc

SEQ ID NO: 2055652 - DNA, 16 bp, Homo sapiens
ggcaccccctgcagct

SEQ ID NO: 2055653 - DNA, 19 bp, Homo sapiens
ggcaccccctgcagcttgt

SEQ ID NO: 2055654 - DNA, 19 bp, Homo sapiens
ggcaccccctggagagaag

SEQ ID NO: 2055655 - DNA, 20 bp, Homo sapiens
ggcacccttctttcctcttc

SEQ ID NO: 2055656 - DNA, 22 bp, Homo sapiens
ggcacccttctttcctcttccc

SEQ ID NO: 2055657 - DNA, 14 bp, Homo sapiens
ggcaccggcgctgc

SEQ ID NO: 2055658 - DNA, 22 bp, Homo sapiens
ggcacctatagtcccagctact

SEQ ID NO: 2055659 - DNA, 17 bp, Homo sapiens
ggcacctcagacaatcc

SEQ ID NO: 2055660 - DNA, 23 bp, Homo sapiens
ggcacctcctacgtcaaacatga

SEQ ID NO: 2055661 - DNA, 13 bp, Homo sapiens
ggcacctcctgag

SEQ ID NO: 2055662 - DNA, 14 bp, Homo sapiens
ggcacctcctgaga

SEQ ID NO: 2055663 - DNA, 12 bp, Homo sapiens
ggcacctgccac

SEQ ID NO: 2055664 - DNA, 17 bp, Homo sapiens
ggcacctgccaccgcca

SEQ ID NO: 2055665 - DNA, 15 bp, Homo sapiens
ggcacctggcctgct

SEQ ID NO: 2055666 - DNA, 16 bp, Homo sapiens
ggcacctggcctgctg

SEQ ID NO: 2055667 - DNA, 19 bp, Homo sapiens
ggcacctggcctgctggga

SEQ ID NO: 2055668 - DNA, 18 bp, Homo sapiens
ggcacgcctgcccagcct

SEQ ID NO: 2055669 - DNA, 18 bp, Homo sapiens
ggcactcagaagacactg

SEQ ID NO: 2055670 - DNA, 17 bp, Homo sapiens
ggcactgagatatttat

SEQ ID NO: 2055671 - DNA, 17 bp, Homo sapiens
ggcactgcttgaggagg

SEQ ID NO: 2055672 - DNA, 20 bp, Homo sapiens
ggcactgcttgaggaggggc

SEQ ID NO: 2055673 - DNA, 20 bp, Homo sapiens
ggcactgggatgagccgctg

SEQ ID NO: 2055674 - DNA, 13 bp, Homo sapiens
ggcactggtggca

SEQ ID NO: 2055675 - DNA, 17 bp, Homo sapiens
ggcacttagcccaagag

SEQ ID NO: 2055676 - DNA, 22 bp, Homo sapiens
ggcacttagcccaagaggtctg

SEQ ID NO: 2055677 - DNA, 21 bp, Homo sapiens
ggcagaaaagaggagaccctg

SEQ ID NO: 2055678 - DNA, 18 bp, Homo sapiens
ggcagacaagagctgctg

SEQ ID NO: 2055679 - DNA, 15 bp, Homo sapiens
ggcagacagcagctc

SEQ ID NO: 2055680 - DNA, 20 bp, Homo sapiens
ggcagacagcagctcaggca

SEQ ID NO: 2055681 - DNA, 17 bp, Homo sapiens
ggcagagaaagaagaga

SEQ ID NO: 2055682 - DNA, 18 bp, Homo sapiens
ggcagagaaagaagagac

SEQ ID NO: 2055683 - DNA, 21 bp, Homo sapiens
ggcagagaaagaagagacagg

SEQ ID NO: 2055684 - DNA, 18 bp, Homo sapiens
ggcagagaaggcttcctc

SEQ ID NO: 2055685 - DNA, 13 bp, Homo sapiens
ggcagagccatgg

SEQ ID NO: 2055686 - DNA, 19 bp, Homo sapiens
ggcagagccatgggcctgg

SEQ ID NO: 2055687 - DNA, 23 bp, Homo sapiens
ggcagagccatgggcctgggcct

SEQ ID NO: 2055688 - DNA, 19 bp, Homo sapiens
ggcagaggctggaggcagg

SEQ ID NO: 2055689 - DNA, 20 bp, Homo sapiens
ggcagagggaatgttccctg

SEQ ID NO: 2055690 - DNA, 18 bp, Homo sapiens
ggcagagtgggctgcctg

SEQ ID NO: 2055691 - DNA, 16 bp, Homo sapiens
ggcagcaaagtgtcag

SEQ ID NO: 2055692 - DNA, 13 bp, Homo sapiens
ggcagcaaggccc

SEQ ID NO: 2055693 - DNA, 18 bp, Homo sapiens
ggcagcaaggcccgagca

SEQ ID NO: 2055694 - DNA, 15 bp, Homo sapiens
ggcagcaccctcccc

SEQ ID NO: 2055695 - DNA, 19 bp, Homo sapiens
ggcagcaccctcccccgca

SEQ ID NO: 2055696 - DNA, 14 bp, Homo sapiens
ggcagcactcagtg

SEQ ID NO: 2055697 - DNA, 11 bp, Homo sapiens
ggcagcagcca

SEQ ID NO: 2055698 - DNA, 15 bp, Homo sapiens
ggcagcagccagccc

SEQ ID NO: 2055699 - DNA, 21 bp, Homo sapiens
ggcagcagccagccctgcctg

SEQ ID NO: 2055700 - DNA, 23 bp, Homo sapiens
ggcagcagccagccctgcctgga

SEQ ID NO: 2055701 - DNA, 21 bp, Homo sapiens
ggcagcagttccatgaagaca

SEQ ID NO: 2055702 - DNA, 19 bp, Homo sapiens
ggcagcatagcaagacaca

SEQ ID NO: 2055703 - DNA, 20 bp, Homo sapiens
ggcagccacacttctcagga

SEQ ID NO: 2055704 - DNA, 11 bp, Homo sapiens
ggcagccatgc

SEQ ID NO: 2055705 - DNA, 14 bp, Homo sapiens
ggcagccatgcctc

SEQ ID NO: 2055706 - DNA, 16 bp, Homo sapiens
ggcagccatgcctcat

SEQ ID NO: 2055707 - DNA, 14 bp, Homo sapiens
ggcagcccagcctc

SEQ ID NO: 2055708 - DNA, 13 bp, Homo sapiens
ggcagccctgtag

SEQ ID NO: 2055709 - DNA, 21 bp, Homo sapiens
ggcagccgtgccttcagctct

SEQ ID NO: 2055710 - DNA, 13 bp, Homo sapiens
ggcagcctccaga

SEQ ID NO: 2055711 - DNA, 18 bp, Homo sapiens
ggcagcctccagagccag

SEQ ID NO: 2055712 - DNA, 19 bp, Homo sapiens
ggcagcgggatctcgtatc

SEQ ID NO: 2055713 - DNA, 15 bp, Homo sapiens
ggcagctagactgga

SEQ ID NO: 2055714 - DNA, 18 bp, Homo sapiens
ggcagctagactggagtg

SEQ ID NO: 2055715 - DNA, 16 bp, Homo sapiens
ggcagctccaacagct

SEQ ID NO: 2055716 - DNA, 16 bp, Homo sapiens
ggcagctcctctcctt

SEQ ID NO: 2055717 - DNA, 18 bp, Homo sapiens
ggcagctcctctccttgg

SEQ ID NO: 2055718 - DNA, 19 bp, Homo sapiens
ggcagctcctctccttggg

SEQ ID NO: 2055719 - DNA, 16 bp, Homo sapiens
ggcagctcctctgtct

SEQ ID NO: 2055720 - DNA, 18 bp, Homo sapiens
ggcagctcctctgtctcg

SEQ ID NO: 2055721 - DNA, 21 bp, Homo sapiens
ggcagctgaactattggaggg

SEQ ID NO: 2055722 - DNA, 10 bp, Homo sapiens
ggcagctgga

SEQ ID NO: 2055723 - DNA, 11 bp, Homo sapiens
ggcagctgggc

SEQ ID NO: 2055724 - DNA, 13 bp, Homo sapiens
ggcagctgggccc

SEQ ID NO: 2055725 - DNA, 18 bp, Homo sapiens
ggcagctgggccccacct

SEQ ID NO: 2055726 - DNA, 21 bp, Homo sapiens
ggcagctgggccccacctact

SEQ ID NO: 2055727 - DNA, 23 bp, Homo sapiens
ggcagctggtctttattcctccc

SEQ ID NO: 2055728 - DNA, 13 bp, Homo sapiens
ggcagctgtagct

SEQ ID NO: 2055729 - DNA, 16 bp, Homo sapiens
ggcaggacacatcccg

SEQ ID NO: 2055730 - DNA, 14 bp, Homo sapiens
ggcaggaccaggac

SEQ ID NO: 2055731 - DNA, 19 bp, Homo sapiens
ggcaggagaatcaataaaa

SEQ ID NO: 2055732 - DNA, 16 bp, Homo sapiens
ggcaggagcaggaaca

SEQ ID NO: 2055733 - DNA, 16 bp, Homo sapiens
ggcaggaggcctggcc

SEQ ID NO: 2055734 - DNA, 16 bp, Homo sapiens
ggcaggagtggcagct

SEQ ID NO: 2055735 - DNA, 15 bp, Homo sapiens
ggcaggatgaccctg

SEQ ID NO: 2055736 - DNA, 17 bp, Homo sapiens
ggcaggcacacagcagc

SEQ ID NO: 2055737 - DNA, 18 bp, Homo sapiens
ggcaggcacacagcagcc

SEQ ID NO: 2055738 - DNA, 22 bp, Homo sapiens
ggcaggcacacagcagcccccc

SEQ ID NO: 2055739 - DNA, 13 bp, Homo sapiens
ggcaggcagggct

SEQ ID NO: 2055740 - DNA, 23 bp, Homo sapiens
ggcaggcagggctctcctggctt

SEQ ID NO: 2055741 - DNA, 20 bp, Homo sapiens
ggcaggcctaggacctcagg

SEQ ID NO: 2055742 - DNA, 14 bp, Homo sapiens
ggcaggctccccct

SEQ ID NO: 2055743 - DNA, 14 bp, Homo sapiens
ggcagggaaactgg

SEQ ID NO: 2055744 - DNA, 18 bp, Homo sapiens
ggcagggaaaggctctga

SEQ ID NO: 2055745 - DNA, 13 bp, Homo sapiens
ggcagggagggga

SEQ ID NO: 2055746 - DNA, 23 bp, Homo sapiens
ggcagggcaaatgacatgcactg

SEQ ID NO: 2055747 - DNA, 15 bp, Homo sapiens
ggcagggcagaggga

SEQ ID NO: 2055748 - DNA, 17 bp, Homo sapiens
ggcagggctctcctggc

SEQ ID NO: 2055749 - DNA, 13 bp, Homo sapiens
ggcagggctggga

SEQ ID NO: 2055750 - DNA, 20 bp, Homo sapiens
ggctgacacctaccatgctg

SEQ ID NO: 2055751 - DNA, 22 bp, Homo sapiens
ggctgacacctaccatgctgct

SEQ ID NO: 2055752 - DNA, 17 bp, Homo sapiens
ggctgacccagtccctg

SEQ ID NO: 2055753 - DNA, 18 bp, Homo sapiens
ggctgaccccaaagagcc

SEQ ID NO: 2055754 - DNA, 22 bp, Homo sapiens
ggctgaccccaaagagcctgga

SEQ ID NO: 2055755 - DNA, 23 bp, Homo sapiens
ggctgacctgcctctcacacaca

SEQ ID NO: 2055756 - DNA, 21 bp, Homo sapiens
ggctgagactgcgggatggtc

SEQ ID NO: 2055757 - DNA, 14 bp, Homo sapiens
ggctgagccctggc

SEQ ID NO: 2055758 - DNA, 17 bp, Homo sapiens
ggctgaggcagaagaat

SEQ ID NO: 2055759 - DNA, 23 bp, Homo sapiens
ggctgagtcatgatctccctgcc

SEQ ID NO: 2055760 - DNA, 19 bp, Homo sapiens
ggctgagtggaatgcaggg

SEQ ID NO: 2055761 - DNA, 20 bp, Homo sapiens
ggctgagtggaatgcaggga

SEQ ID NO: 2055762 - DNA, 23 bp, Homo sapiens
ggctgcaaagggtatcaggtgct

SEQ ID NO: 2055763 - DNA, 18 bp, Homo sapiens
ggctgcaagggccagagt

SEQ ID NO: 2055764 - DNA, 22 bp, Homo sapiens
ggctgcagtgacgtgcacctgt

SEQ ID NO: 2055765 - DNA, 19 bp, Homo sapiens
ggctgcatgctctggaagc

SEQ ID NO: 2055766 - DNA, 21 bp, Homo sapiens
ggctgccactaacctgtagaa

SEQ ID NO: 2055767 - DNA, 10 bp, Homo sapiens
ggctgccagg

SEQ ID NO: 2055768 - DNA, 22 bp, Homo sapiens
ggctgccccgggtccccagctc

SEQ ID NO: 2055769 - DNA, 23 bp, Homo sapiens
ggctgccccgggtccccagctcc

SEQ ID NO: 2055770 - DNA, 12 bp, Homo sapiens
ggctgccctgcc

SEQ ID NO: 2055771 - DNA, 19 bp, Homo sapiens
ggctgcccttcgctgccag

SEQ ID NO: 2055772 - DNA, 16 bp, Homo sapiens
ggctgcctgccgccca

SEQ ID NO: 2055773 - DNA, 22 bp, Homo sapiens
ggctgcctggggattgggaggg

SEQ ID NO: 2055774 - DNA, 16 bp, Homo sapiens
ggctgccttagaacct

SEQ ID NO: 2055775 - DNA, 15 bp, Homo sapiens
ggctgctacccagaa

SEQ ID NO: 2055776 - DNA, 16 bp, Homo sapiens
ggctgctcatcaccca

SEQ ID NO: 2055777 - DNA, 18 bp, Homo sapiens
ggctgctcatcacccagt

SEQ ID NO: 2055778 - DNA, 19 bp, Homo sapiens
ggctgctcctccagggcca

SEQ ID NO: 2055779 - DNA, 22 bp, Homo sapiens
ggctgctggggcatgtgtgcct

SEQ ID NO: 2055780 - DNA, 24 bp, Homo sapiens
ggctgctggggcatgtgtgcctgt

SEQ ID NO: 2055781 - DNA, 19 bp, Homo sapiens
ggctgctgtgtagctctgt

SEQ ID NO: 2055782 - DNA, 22 bp, Homo sapiens
ggctgctgtgtagctctgtcca

SEQ ID NO: 2055783 - DNA, 15 bp, Homo sapiens
ggctgctgtgtgcct

SEQ ID NO: 2055784 - DNA, 16 bp, Homo sapiens
ggctggaatctggaga

SEQ ID NO: 2055785 - DNA, 20 bp, Homo sapiens
ggctggaatctggagagcta

SEQ ID NO: 2055786 - DNA, 16 bp, Homo sapiens
ggctggacctatgtcc

SEQ ID NO: 2055787 - DNA, 22 bp, Homo sapiens
ggctggacctatgtcctaagga

SEQ ID NO: 2055788 - DNA, 15 bp, Homo sapiens
ggctggaggcagggc

SEQ ID NO: 2055789 - DNA, 14 bp, Homo sapiens
ggctggagtgcgct

SEQ ID NO: 2055790 - DNA, 20 bp, Homo sapiens
ggctggagttcagtggtgtg

SEQ ID NO: 2055791 - DNA, 15 bp, Homo sapiens
ggctggatgtggtgg

SEQ ID NO: 2055792 - DNA, 16 bp, Homo sapiens
ggctggcaagcaggga

SEQ ID NO: 2055793 - DNA, 20 bp, Homo sapiens
ggctggcgtgcagtggtgcg

SEQ ID NO: 2055794 - DNA, 12 bp, Homo sapiens
ggctggctgagg

SEQ ID NO: 2055795 - DNA, 14 bp, Homo sapiens
ggctggctgagggc

SEQ ID NO: 2055796 - DNA, 14 bp, Homo sapiens
ggctggctgcagtg

SEQ ID NO: 2055797 - DNA, 15 bp, Homo sapiens
ggctggctgcagtga

SEQ ID NO: 2055798 - DNA, 18 bp, Homo sapiens
ggctgggcacctctagtg

SEQ ID NO: 2055799 - DNA, 18 bp, Homo sapiens
ggctgggccagcctcagc

SEQ ID NO: 2055800 - DNA, 22 bp, Homo sapiens
ggctgggcccacagagatgcat

SEQ ID NO: 2055801 - DNA, 11 bp, Homo sapiens
ggctgggcttc

SEQ ID NO: 2055802 - DNA, 14 bp, Homo sapiens
ggctggggccagtg

SEQ ID NO: 2055803 - DNA, 21 bp, Homo sapiens
ggctgggggcgggggagccaa

SEQ ID NO: 2055804 - DNA, 22 bp, Homo sapiens
ggctgggggcgggggagccaac

SEQ ID NO: 2055805 - DNA, 23 bp, Homo sapiens
ggctgggttcattccccggccct

SEQ ID NO: 2055806 - DNA, 14 bp, Homo sapiens
ggctgggttggagg

SEQ ID NO: 2055807 - DNA, 23 bp, Homo sapiens
ggctggtcgtgaactcctgagct

SEQ ID NO: 2055808 - DNA, 22 bp, Homo sapiens
ggctggtctccctccagctgga

SEQ ID NO: 2055809 - DNA, 18 bp, Homo sapiens
ggctgtaaacagctctgt

SEQ ID NO: 2055810 - DNA, 22 bp, Homo sapiens
ggctgtaaactataaactactg

SEQ ID NO: 2055811 - DNA, 22 bp, Homo sapiens
ggctgtatcccatgagcctcag

SEQ ID NO: 2055812 - DNA, 15 bp, Homo sapiens
ggctgtcaggacacc

SEQ ID NO: 2055813 - DNA, 13 bp, Homo sapiens
ggctgtctgtcac

SEQ ID NO: 2055814 - DNA, 13 bp, Homo sapiens
ggctgtgcctctg

SEQ ID NO: 2055815 - DNA, 16 bp, Homo sapiens
ggctgtggaggcctga

SEQ ID NO: 2055816 - DNA, 22 bp, Homo sapiens
ggctgtggaggcctgatgctgc

SEQ ID NO: 2055817 - DNA, 13 bp, Homo sapiens
ggctgttctgcac

SEQ ID NO: 2055818 - DNA, 15 bp, Homo sapiens
ggctgttctgcactg

SEQ ID NO: 2055819 - DNA, 17 bp, Homo sapiens
ggctgttggacagctgc

SEQ ID NO: 2055820 - DNA, 18 bp, Homo sapiens
ggctgttggacagctgct

SEQ ID NO: 2055821 - DNA, 21 bp, Homo sapiens
ggctgttggacagctgcttgt

SEQ ID NO: 2055822 - DNA, 14 bp, Homo sapiens
ggctgttggctggg

SEQ ID NO: 2055823 - DNA, 20 bp, Homo sapiens
ggctgttggctgggggcctc

SEQ ID NO: 2055824 - DNA, 21 bp, Homo sapiens
ggcttagacttcgactcagga

SEQ ID NO: 2055825 - DNA, 16 bp, Homo sapiens
ggcttagtaatagatc

SEQ ID NO: 2055826 - DNA, 22 bp, Homo sapiens
ggcttataaatgtgtattctgg

SEQ ID NO: 2055827 - DNA, 20 bp, Homo sapiens
ggcttcagcatatttatagc

SEQ ID NO: 2055828 - DNA, 15 bp, Homo sapiens
ggcttcagtggcagc

SEQ ID NO: 2055829 - DNA, 21 bp, Homo sapiens
ggcttccagaaaaccccagca

SEQ ID NO: 2055830 - DNA, 13 bp, Homo sapiens
ggcttccagagag

SEQ ID NO: 2055831 - DNA, 20 bp, Homo sapiens
ggcttccagagagtcctctg

SEQ ID NO: 2055832 - DNA, 17 bp, Homo sapiens
ggcttccaggctcttcc

SEQ ID NO: 2055833 - DNA, 21 bp, Homo sapiens
ggcttccaggtatctccagga

SEQ ID NO: 2055834 - DNA, 18 bp, Homo sapiens
ggcttcccatccccagcg

SEQ ID NO: 2055835 - DNA, 19 bp, Homo sapiens
ggcttcctccgtccaccca

SEQ ID NO: 2055836 - DNA, 20 bp, Homo sapiens
ggcttcctccgtccacccag

SEQ ID NO: 2055837 - DNA, 22 bp, Homo sapiens
ggcttcctccgtccacccaggc

SEQ ID NO: 2055838 - DNA, 16 bp, Homo sapiens
ggcttcctgactgaca

SEQ ID NO: 2055839 - DNA, 13 bp, Homo sapiens
ggcttcctgtcca

SEQ ID NO: 2055840 - DNA, 15 bp, Homo sapiens
ggcttctcctgaccc

SEQ ID NO: 2055841 - DNA, 16 bp, Homo sapiens
ggcttctcctgaccca

SEQ ID NO: 2055842 - DNA, 14 bp, Homo sapiens
ggcttctcctgtga

SEQ ID NO: 2055843 - DNA, 18 bp, Homo sapiens
ggcttctggagcccttgg

SEQ ID NO: 2055844 - DNA, 14 bp, Homo sapiens
ggcttgactggatg

SEQ ID NO: 2055845 - DNA, 14 bp, Homo sapiens
ggcttgcatgccaa

SEQ ID NO: 2055846 - DNA, 16 bp, Homo sapiens
ggcttgctccagggtc

SEQ ID NO: 2055847 - DNA, 22 bp, Homo sapiens
ggcttgctccagggtcttgggc

SEQ ID NO: 2055848 - DNA, 17 bp, Homo sapiens
ggcttggacttcctggg

SEQ ID NO: 2055849 - DNA, 13 bp, Homo sapiens
ggcttggccgcca

SEQ ID NO: 2055850 - DNA, 15 bp, Homo sapiens
ggcttgggccctgca

SEQ ID NO: 2055851 - DNA, 18 bp, Homo sapiens
ggcttgggccctgcacag

SEQ ID NO: 2055852 - DNA, 14 bp, Homo sapiens
ggcttggggagcag

SEQ ID NO: 2055853 - DNA, 15 bp, Homo sapiens
ggctttatgctgtgt

SEQ ID NO: 2055854 - DNA, 18 bp, Homo sapiens
ggctttcaattgtatttt

SEQ ID NO: 2055855 - DNA, 24 bp, Homo sapiens
ggctttctccggggtctgtgctgt

SEQ ID NO: 2055856 - DNA, 12 bp, Homo sapiens
ggctttctggag

SEQ ID NO: 2055857 - DNA, 22 bp, Homo sapiens
ggctttgccatgggcctgctgc

SEQ ID NO: 2055858 - DNA, 20 bp, Homo sapiens
ggctttggcagaccatctcc

SEQ ID NO: 2055859 - DNA, 13 bp, Homo sapiens
ggctttgtcctgg

SEQ ID NO: 2055860 - DNA, 15 bp, Homo sapiens
ggcttttcactgctg

SEQ ID NO: 2055861 - DNA, 20 bp, Homo sapiens
ggcttttcgcttgcttctgc

SEQ ID NO: 2055862 - DNA, 21 bp, Homo sapiens
gggaaaaaagttttgatgaaa

SEQ ID NO: 2055863 - DNA, 13 bp, Homo sapiens
gggaaacagggag

SEQ ID NO: 2055864 - DNA, 19 bp, Homo sapiens
gggcttgggccctgcacag

SEQ ID NO: 2055865 - DNA, 24 bp, Homo sapiens
gggcttgttgtttttaagtcctgt

SEQ ID NO: 2055866 - DNA, 14 bp, Homo sapiens
gggctttctggaga

SEQ ID NO: 2055867 - DNA, 15 bp, Homo sapiens
gggctttctggagag

SEQ ID NO: 2055868 - DNA, 14 bp, Homo sapiens
gggctttgcaggct

SEQ ID NO: 2055869 - DNA, 16 bp, Homo sapiens
gggctttgcaggctct

SEQ ID NO: 2055870 - DNA, 22 bp, Homo sapiens
ggggaagcaagacgtcctggaa

SEQ ID NO: 2055871 - DNA, 13 bp, Homo sapiens
ggggaagggccag

SEQ ID NO: 2055872 - DNA, 23 bp, Homo sapiens
ggggaagggccagtctgggctgc

SEQ ID NO: 2055873 - DNA, 20 bp, Homo sapiens
ggggacagctccttctgtcc

SEQ ID NO: 2055874 - DNA, 15 bp, Homo sapiens
ggggacaggtcctca

SEQ ID NO: 2055875 - DNA, 19 bp, Homo sapiens
ggggacttacatgattcat

SEQ ID NO: 2055876 - DNA, 11 bp, Homo sapiens
ggggagaaagt

SEQ ID NO: 2055877 - DNA, 19 bp, Homo sapiens
ggggagaacttacattgtg

SEQ ID NO: 2055878 - DNA, 16 bp, Homo sapiens
ggggagaagggccagc

SEQ ID NO: 2055879 - DNA, 12 bp, Homo sapiens
ggggagacctgg

SEQ ID NO: 2055880 - DNA, 19 bp, Homo sapiens
ggggagacggtgttgcaga

SEQ ID NO: 2055881 - DNA, 16 bp, Homo sapiens
ggggagcaggtctctg

SEQ ID NO: 2055882 - DNA, 20 bp, Homo sapiens
ggggagcaggtctctggcag

SEQ ID NO: 2055883 - DNA, 23 bp, Homo sapiens
ggggagcaggtctctggcagaga

SEQ ID NO: 2055884 - DNA, 17 bp, Homo sapiens
ggggaggaggagctgcc

SEQ ID NO: 2055885 - DNA, 19 bp, Homo sapiens
ggggaggatcactggagcc

SEQ ID NO: 2055886 - DNA, 18 bp, Homo sapiens
ggggagggctgcctgaaa

SEQ ID NO: 2055887 - DNA, 15 bp, Homo sapiens
ggggaggggcctagg

SEQ ID NO: 2055888 - DNA, 21 bp, Homo sapiens
ggggatctgcattccccgctg

SEQ ID NO: 2055889 - DNA, 23 bp, Homo sapiens
ggggatctgcattccccgctgcc

SEQ ID NO: 2055890 - DNA, 21 bp, Homo sapiens
ggggatgactagaggcaggga

SEQ ID NO: 2055891 - DNA, 14 bp, Homo sapiens
ggggatgggccagg

SEQ ID NO: 2055892 - DNA, 14 bp, Homo sapiens
ggggatgtgggagg

SEQ ID NO: 2055893 - DNA, 18 bp, Homo sapiens
ggggatgtgggagggagc

SEQ ID NO: 2055894 - DNA, 15 bp, Homo sapiens
ggggcaaggtctcct

SEQ ID NO: 2055895 - DNA, 16 bp, Homo sapiens
ggggcaatggggagag

SEQ ID NO: 2055896 - DNA, 16 bp, Homo sapiens
ggggcacaccactgcc

SEQ ID NO: 2055897 - DNA, 20 bp, Homo sapiens
ggggcacaccactgccctgc

SEQ ID NO: 2055898 - DNA, 21 bp, Homo sapiens
ggggcacaccactgccctgcc

SEQ ID NO: 2055899 - DNA, 14 bp, Homo sapiens
ggggcacctgccac

SEQ ID NO: 2055900 - DNA, 17 bp, Homo sapiens
ggggcagaacagccgct

SEQ ID NO: 2055901 - DNA, 19 bp, Homo sapiens
ggggcagccgctaggagag

SEQ ID NO: 2055902 - DNA, 14 bp, Homo sapiens
ggggcaggaggcct

SEQ ID NO: 2055903 - DNA, 15 bp, Homo sapiens
ggggcaggaggcctg

SEQ ID NO: 2055904 - DNA, 18 bp, Homo sapiens
ggggcaggaggcctggcc

SEQ ID NO: 2055905 - DNA, 19 bp, Homo sapiens
ggggcaggaggcctggcct

SEQ ID NO: 2055906 - DNA, 17 bp, Homo sapiens
ggggcaggagtagctga

SEQ ID NO: 2055907 - DNA, 21 bp, Homo sapiens
ggggcaggagtagctgagctc

SEQ ID NO: 2055908 - DNA, 12 bp, Homo sapiens
ggggcaggcctg

SEQ ID NO: 2055909 - DNA, 16 bp, Homo sapiens
ggggcaggcctgggac

SEQ ID NO: 2055910 - DNA, 15 bp, Homo sapiens
ggggcatagaaactg

SEQ ID NO: 2055911 - DNA, 16 bp, Homo sapiens
ggggcatgctggggca

SEQ ID NO: 2055912 - DNA, 17 bp, Homo sapiens
ggggcatggttccttcc

SEQ ID NO: 2055913 - DNA, 18 bp, Homo sapiens
ggggcatggttccttccc

SEQ ID NO: 2055914 - DNA, 20 bp, Homo sapiens
ggggcatgtgtgcctgtggc

SEQ ID NO: 2055915 - DNA, 23 bp, Homo sapiens
ggggccaggcaggggtgggagag

SEQ ID NO: 2055916 - DNA, 18 bp, Homo sapiens
ggggccccagatctgcct

SEQ ID NO: 2055917 - DNA, 21 bp, Homo sapiens
ggggccccagatctgcctggg

SEQ ID NO: 2055918 - DNA, 14 bp, Homo sapiens
ggggccctgggcct

SEQ ID NO: 2055919 - DNA, 21 bp, Homo sapiens
ggggccctggtccttccaggc

SEQ ID NO: 2055920 - DNA, 19 bp, Homo sapiens
ggggcccttggggcctggc

SEQ ID NO: 2055921 - DNA, 21 bp, Homo sapiens
ggggcccttggggcctggctt

SEQ ID NO: 2055922 - DNA, 14 bp, Homo sapiens
ggggccgctggccc

SEQ ID NO: 2055923 - DNA, 16 bp, Homo sapiens
ggggccgctggcccag

SEQ ID NO: 2055924 - DNA, 19 bp, Homo sapiens
ggggccgctggcccagggt

SEQ ID NO: 2055925 - DNA, 15 bp, Homo sapiens
ggggcctcagtgcca

SEQ ID NO: 2055926 - DNA, 11 bp, Homo sapiens
ggggcctggca

SEQ ID NO: 2055927 - DNA, 13 bp, Homo sapiens
ggggcctggcttg

SEQ ID NO: 2055928 - DNA, 15 bp, Homo sapiens
ggggcctgtactgcc

SEQ ID NO: 2055929 - DNA, 17 bp, Homo sapiens
ggggcctgtactgcctg

SEQ ID NO: 2055930 - DNA, 19 bp, Homo sapiens
ggggcctgtactgcctgct

SEQ ID NO: 2055931 - DNA, 17 bp, Homo sapiens
ggggcgacccctcagtg

SEQ ID NO: 2055932 - DNA, 20 bp, Homo sapiens
ggggcgacccctcagtgctc

SEQ ID NO: 2055933 - DNA, 20 bp, Homo sapiens
ggggcgatcaagtccagagc

SEQ ID NO: 2055934 - DNA, 12 bp, Homo sapiens
ggggcgctcagg

SEQ ID NO: 2055935 - DNA, 22 bp, Homo sapiens
ggggcgctcaggacccaggccc

SEQ ID NO: 2055936 - DNA, 14 bp, Homo sapiens
ggggcggggcagga

SEQ ID NO: 2055937 - DNA, 14 bp, Homo sapiens
ggggctagaaccta

SEQ ID NO: 2055938 - DNA, 16 bp, Homo sapiens
ggggctatgccttgtc

SEQ ID NO: 2055939 - DNA, 15 bp, Homo sapiens
ggggctcagcaaggt

SEQ ID NO: 2055940 - DNA, 14 bp, Homo sapiens
ggggctccatggag

SEQ ID NO: 2055941 - DNA, 12 bp, Homo sapiens
ggggctcctgga

SEQ ID NO: 2055942 - DNA, 21 bp, Homo sapiens
ggggctcctggaaaggctcag

SEQ ID NO: 2055943 - DNA, 15 bp, Homo sapiens
ggggctcgccccacc

SEQ ID NO: 2055944 - DNA, 18 bp, Homo sapiens
ggggctcgtggccttccc

SEQ ID NO: 2055945 - DNA, 18 bp, Homo sapiens
ggggctctaacgcctgag

SEQ ID NO: 2055946 - DNA, 20 bp, Homo sapiens
ggggctctaacgcctgagcc

SEQ ID NO: 2055947 - DNA, 12 bp, Homo sapiens
ggggctctggga

SEQ ID NO: 2055948 - DNA, 15 bp, Homo sapiens
ggggctgctcctcca

SEQ ID NO: 2055949 - DNA, 16 bp, Homo sapiens
ggggctgctcctccag

SEQ ID NO: 2055950 - DNA, 18 bp, Homo sapiens
ggggcttctgggtggctc

SEQ ID NO: 2055951 - DNA, 22 bp, Homo sapiens
ggggcttctgggtggctcctgc

SEQ ID NO: 2055952 - DNA, 21 bp, Homo sapiens
gggggacttacatgattcatt

SEQ ID NO: 2055953 - DNA, 13 bp, Homo sapiens
gggggccagacac

SEQ ID NO: 2055954 - DNA, 14 bp, Homo sapiens
gggggccagacaca

SEQ ID NO: 2055955 - DNA, 18 bp, Homo sapiens
gggggccgggcaggtcct

SEQ ID NO: 2055956 - DNA, 20 bp, Homo sapiens
gggggccgggcaggtcctgc

SEQ ID NO: 2055957 - DNA, 12 bp, Homo sapiens
gggggcctcagt

SEQ ID NO: 2055958 - DNA, 18 bp, Homo sapiens
gggggcctcagtgccact

SEQ ID NO: 2055959 - DNA, 15 bp, Homo sapiens
gggggcggcctatga

SEQ ID NO: 2055960 - DNA, 12 bp, Homo sapiens
gggggctctcca

SEQ ID NO: 2055961 - DNA, 18 bp, Homo sapiens
gggggtgatgagggcagc

SEQ ID NO: 2055962 - DNA, 18 bp, Homo sapiens
gggggtttttactccagt

SEQ ID NO: 2055963 - DNA, 15 bp, Homo sapiens
ggggtaagccagagc

SEQ ID NO: 2055964 - DNA, 18 bp, Homo sapiens
ggggtaagccagagcctg

SEQ ID NO: 2055965 - DNA, 19 bp, Homo sapiens
ggggtaagccagagcctgg

SEQ ID NO: 2055966 - DNA, 15 bp, Homo sapiens
ggggtcaggctccat

SEQ ID NO: 2055967 - DNA, 18 bp, Homo sapiens
ggggtcgtggagagctag

SEQ ID NO: 2055968 - DNA, 19 bp, Homo sapiens
ggggtcgtggagagctagg

SEQ ID NO: 2055969 - DNA, 19 bp, Homo sapiens
ggggtctccctctcctgcc

SEQ ID NO: 2055970 - DNA, 14 bp, Homo sapiens
ggggtctgtgctgt

SEQ ID NO: 2055971 - DNA, 17 bp, Homo sapiens
ggggtgatgagggcagc

SEQ ID NO: 2055972 - DNA, 23 bp, Homo sapiens
ggggtgatgagggcagcagccag

SEQ ID NO: 2055973 - DNA, 18 bp, Homo sapiens
ggggtgatttcagagagg

SEQ ID NO: 2055974 - DNA, 13 bp, Homo sapiens
ggggtgcacagga

SEQ ID NO: 2055975 - DNA, 14 bp, Homo sapiens
ggggtgcacaggag

SEQ ID NO: 2055976 - DNA, 14 bp, Homo sapiens
ggggtggggcagga

SEQ ID NO: 2055977 - DNA, 22 bp, Homo sapiens
ggggttctttcttcctctgctg

SEQ ID NO: 2055978 - DNA, 23 bp, Homo sapiens
ggggttgcgggggagctggaaat

SEQ ID NO: 2055979 - DNA, 17 bp, Homo sapiens
gtaagctgctctattgt

SEQ ID NO: 2055980 - DNA, 18 bp, Homo sapiens
gtaagggaaactgccagc

SEQ ID NO: 2055981 - DNA, 21 bp, Homo sapiens
gtaagggtctgttgtaaatga

SEQ ID NO: 2055982 - DNA, 24 bp, Homo sapiens
gtaagggtctgttgtaaatgacca

SEQ ID NO: 2055983 - DNA, 20 bp, Homo sapiens
gtaaggtaatttctgtgtat

SEQ ID NO: 2055984 - DNA, 13 bp, Homo sapiens
gtaagtaattatc

SEQ ID NO: 2055985 - DNA, 19 bp, Homo sapiens
gtaagtttatgtctaaaga

SEQ ID NO: 2055986 - DNA, 19 bp, Homo sapiens
gtaataaaacccagcatgt

SEQ ID NO: 2055987 - DNA, 11 bp, Homo sapiens
gtaataaactc

SEQ ID NO: 2055988 - DNA, 15 bp, Homo sapiens
gtaatagaaaactga

SEQ ID NO: 2055989 - DNA, 15 bp, Homo sapiens
gtaatatgtctgcca

SEQ ID NO: 2055990 - DNA, 22 bp, Homo sapiens
gtaatcagcattattcttcaga

SEQ ID NO: 2055991 - DNA, 12 bp, Homo sapiens
gtaatcccagca

SEQ ID NO: 2055992 - DNA, 16 bp, Homo sapiens
gtaatcccagcacttt

SEQ ID NO: 2055993 - DNA, 14 bp, Homo sapiens
gtaatcccagctac

SEQ ID NO: 2055994 - DNA, 21 bp, Homo sapiens
gtaatcccagctactcaggag

SEQ ID NO: 2055995 - DNA, 16 bp, Homo sapiens
gtaatcccagctactt

SEQ ID NO: 2055996 - DNA, 20 bp, Homo sapiens
gtaatcctattaaaacacag

SEQ ID NO: 2055997 - DNA, 18 bp, Homo sapiens
gtaatcgttatgtgtgta

SEQ ID NO: 2055998 - DNA, 15 bp, Homo sapiens
gtaatgagaacttca

SEQ ID NO: 2055999 - DNA, 22 bp, Homo sapiens
gtaatgcacaatttagaaaaca

SEQ ID NO: 2056000 - DNA, 21 bp, Homo sapiens
gtaatgggccaattaaaatat

SEQ ID NO: 2056001 - DNA, 14 bp, Homo sapiens
gtaatgggcctgcc

SEQ ID NO: 2056002 - DNA, 19 bp, Homo sapiens
gtaatgtatcttatttata

SEQ ID NO: 2056003 - DNA, 20 bp, Homo sapiens
gtaatgtatcttatttatat

SEQ ID NO: 2056004 - DNA, 16 bp, Homo sapiens
gtaattgaataaagtt

SEQ ID NO: 2056005 - DNA, 15 bp, Homo sapiens
gtaattgcttacatt

SEQ ID NO: 2056006 - DNA, 17 bp, Homo sapiens
gtaattgcttacatttt

SEQ ID NO: 2056007 - DNA, 19 bp, Homo sapiens
gtaattggtgacaatgtca

SEQ ID NO: 2056008 - DNA, 15 bp, Homo sapiens
gtaatttataaaatt

SEQ ID NO: 2056009 - DNA, 20 bp, Homo sapiens
gtaatttctgtgtattttga

SEQ ID NO: 2056010 - DNA, 16 bp, Homo sapiens
gtaatttgaggacaac

SEQ ID NO: 2056011 - DNA, 13 bp, Homo sapiens
gtaatttgtatct

SEQ ID NO: 2056012 - DNA, 16 bp, Homo sapiens
gtaattttgtgaaaga

SEQ ID NO: 2056013 - DNA, 17 bp, Homo sapiens
gtaattttttaaatgaa

SEQ ID NO: 2056014 - DNA, 20 bp, Homo sapiens
gtaattttttaaatgaaaat

SEQ ID NO: 2056015 - DNA, 22 bp, Homo sapiens
gtacaaaagtaccatagaacag

SEQ ID NO: 2056016 - DNA, 20 bp, Homo sapiens
gtacaaagatatgctaagca

SEQ ID NO: 2056017 - DNA, 18 bp, Homo sapiens
gtacaaagtagagaagta

SEQ ID NO: 2056018 - DNA, 21 bp, Homo sapiens
gtacaaatattcctgtttctg

SEQ ID NO: 2056019 - DNA, 19 bp, Homo sapiens
gtacaaattgttcatgtta

SEQ ID NO: 2056020 - DNA, 16 bp, Homo sapiens
gtacaagttttgtata

SEQ ID NO: 2056021 - DNA, 14 bp, Homo sapiens
gtacaatgtttcag

SEQ ID NO: 2056022 - DNA, 16 bp, Homo sapiens
gtacacagcaccagaa

SEQ ID NO: 2056023 - DNA, 18 bp, Homo sapiens
gtacacagcaccagaatg

SEQ ID NO: 2056024 - DNA, 20 bp, Homo sapiens
gtacacagctctagacactg

SEQ ID NO: 2056025 - DNA, 14 bp, Homo sapiens
gtacacgtgtcctg

SEQ ID NO: 2056026 - DNA, 22 bp, Homo sapiens
gtacagaatttttaatgacttt

SEQ ID NO: 2056027 - DNA, 19 bp, Homo sapiens
gtacagacgtctcaagact

SEQ ID NO: 2056028 - DNA, 19 bp, Homo sapiens
gtacagcatgcatcacgga

SEQ ID NO: 2056029 - DNA, 18 bp, Homo sapiens
gtacagctgtttaagatg

SEQ ID NO: 2056030 - DNA, 17 bp, Homo sapiens
gtacagtggagaaatat

SEQ ID NO: 2056031 - DNA, 16 bp, Homo sapiens
gtacagtgtgtaaagt

SEQ ID NO: 2056032 - DNA, 14 bp, Homo sapiens
gtacagttatctaa

SEQ ID NO: 2056033 - DNA, 14 bp, Homo sapiens
gtacagttcagttc

SEQ ID NO: 2056034 - DNA, 16 bp, Homo sapiens
gtacagttcagttcct

SEQ ID NO: 2056035 - DNA, 22 bp, Homo sapiens
gtacagttcagttcctctttgc

SEQ ID NO: 2056036 - DNA, 23 bp, Homo sapiens
gtacagttcagttcctctttgca

SEQ ID NO: 2056037 - DNA, 18 bp, Homo sapiens
gtacatagttatttattt

SEQ ID NO: 2056038 - DNA, 19 bp, Homo sapiens
gtacatgtgtagcctgtgc

SEQ ID NO: 2056039 - DNA, 23 bp, Homo sapiens
gtacattcctgatactgggtaca

SEQ ID NO: 2056040 - DNA, 16 bp, Homo sapiens
gtacatttccctgtgc

SEQ ID NO: 2056041 - DNA, 13 bp, Homo sapiens
gtaccagccagga

SEQ ID NO: 2056042 - DNA, 18 bp, Homo sapiens
gtaccagctcactccctg

SEQ ID NO: 2056043 - DNA, 17 bp, Homo sapiens
gtaccatacacattgga

SEQ ID NO: 2056044 - DNA, 23 bp, Homo sapiens
gtaccatctgtcttgccagccag

SEQ ID NO: 2056045 - DNA, 19 bp, Homo sapiens
gtacccaccgggccactcc

SEQ ID NO: 2056046 - DNA, 14 bp, Homo sapiens
gtacccactgctct

SEQ ID NO: 2056047 - DNA, 22 bp, Homo sapiens
gtacccccgtggtctttgaata

SEQ ID NO: 2056048 - DNA, 23 bp, Homo sapiens
gtacccccgtggtctttgaataa

SEQ ID NO: 2056049 - DNA, 20 bp, Homo sapiens
gtacccttccacctcctaga

SEQ ID NO: 2056050 - DNA, 23 bp, Homo sapiens
gtaccgccttgcacactcagaag

SEQ ID NO: 2056051 - DNA, 23 bp, Homo sapiens
gtacctatggctgcctgcatcta

SEQ ID NO: 2056052 - DNA, 18 bp, Homo sapiens
gtacctatgtgacagaca

SEQ ID NO: 2056053 - DNA, 15 bp, Homo sapiens
gtacctcagtttctc

SEQ ID NO: 2056054 - DNA, 21 bp, Homo sapiens
gtacctgtagtgagaaactga

SEQ ID NO: 2056055 - DNA, 13 bp, Homo sapiens
gtacctttgtcac

SEQ ID NO: 2056056 - DNA, 15 bp, Homo sapiens
gtacgtctgacaggc

SEQ ID NO: 2056057 - DNA, 17 bp, Homo sapiens
gtacgtttttgcattat

SEQ ID NO: 2056058 - DNA, 15 bp, Homo sapiens
gtactactagatgtc

SEQ ID NO: 2056059 - DNA, 21 bp, Homo sapiens
gtactactagatgtctttagg

SEQ ID NO: 2056060 - DNA, 20 bp, Homo sapiens
gtactactgctgcaaagtgc

SEQ ID NO: 2056061 - DNA, 19 bp, Homo sapiens
gtactatggctgtattttt

SEQ ID NO: 2056062 - DNA, 20 bp, Homo sapiens
gtactattgtttaaaaacag

SEQ ID NO: 2056063 - DNA, 17 bp, Homo sapiens
gtactcagagcagagca

SEQ ID NO: 2056064 - DNA, 23 bp, Homo sapiens
gtactcaggaggctgaggggagg

SEQ ID NO: 2056065 - DNA, 21 bp, Homo sapiens
gtactcctgcaaaattttata

SEQ ID NO: 2056066 - DNA, 17 bp, Homo sapiens
gtactctacgccaaagt

SEQ ID NO: 2056067 - DNA, 21 bp, Homo sapiens
gtactctctgctctagccagg

SEQ ID NO: 2056068 - DNA, 22 bp, Homo sapiens
gtactctctgctctagccagga

SEQ ID NO: 2056069 - DNA, 23 bp, Homo sapiens
gtactctttatttctagcagagt

SEQ ID NO: 2056070 - DNA, 16 bp, Homo sapiens
gtactgagccttgtaa

SEQ ID NO: 2056071 - DNA, 16 bp, Homo sapiens
gtactggcatggtacg

SEQ ID NO: 2056072 - DNA, 23 bp, Homo sapiens
gtactgggaatggaaggctttgc

SEQ ID NO: 2056073 - DNA, 23 bp, Homo sapiens
gtactgggttatttttgtccctg

SEQ ID NO: 2056074 - DNA, 23 bp, Homo sapiens
gtactgtgtacagaattctgcta

SEQ ID NO: 2056075 - DNA, 14 bp, Homo sapiens
gtacttaactgtgt

SEQ ID NO: 2056076 - DNA, 23 bp, Homo sapiens
gtacttacccggagaaggccgct

SEQ ID NO: 2056077 - DNA, 12 bp, Homo sapiens
gtacttctaaga

SEQ ID NO: 2056078 - DNA, 13 bp, Homo sapiens
gtacttctaagag

SEQ ID NO: 2056079 - DNA, 16 bp, Homo sapiens
gtacttctccaccctg

SEQ ID NO: 2056080 - DNA, 17 bp, Homo sapiens
gtacttctccaccctgc

SEQ ID NO: 2056081 - DNA, 16 bp, Homo sapiens
gtacttgtggacacag

SEQ ID NO: 2056082 - DNA, 20 bp, Homo sapiens
gtacttgtggacacagctct

SEQ ID NO: 2056083 - DNA, 18 bp, Homo sapiens
gtagaaagacagagctgg

SEQ ID NO: 2056084 - DNA, 21 bp, Homo sapiens
gtagaaagacagagctgggat

SEQ ID NO: 2056085 - DNA, 22 bp, Homo sapiens
gtagaagatggactctgaaaaa

SEQ ID NO: 2056086 - DNA, 11 bp, Homo sapiens
gtagaagccag

SEQ ID NO: 2056087 - DNA, 17 bp, Homo sapiens
gtagaataaatgaagaa

SEQ ID NO: 2056088 - DNA, 16 bp, Homo sapiens
gtagaattatatctaa

SEQ ID NO: 2056089 - DNA, 15 bp, Homo sapiens
gtagacatatattta

SEQ ID NO: 2056090 - DNA, 15 bp, Homo sapiens
gtagaccaaaataaa

SEQ ID NO: 2056091 - DNA, 16 bp, Homo sapiens
gtagactatatacatg

SEQ ID NO: 2056092 - DNA, 21 bp, Homo sapiens
gtagactcctgcttcttcaag

SEQ ID NO: 2056093 - DNA, 14 bp, Homo sapiens
gtccagaggctgca

SEQ ID NO: 2056094 - DNA, 16 bp, Homo sapiens
gtccagatgccttcct

SEQ ID NO: 2056095 - DNA, 20 bp, Homo sapiens
gtccagatgccttcctgtct

SEQ ID NO: 2056096 - DNA, 14 bp, Homo sapiens
gtccagcagctgcg

SEQ ID NO: 2056097 - DNA, 19 bp, Homo sapiens
gtccagcaggtagtgggtg

SEQ ID NO: 2056098 - DNA, 14 bp, Homo sapiens
gtccagccagctcc

SEQ ID NO: 2056099 - DNA, 17 bp, Homo sapiens
gtccagcttgctcttca

SEQ ID NO: 2056100 - DNA, 19 bp, Homo sapiens
gtccaggaaggcagctgct

SEQ ID NO: 2056101 - DNA, 21 bp, Homo sapiens
gtccaggaaggcagctgctct

SEQ ID NO: 2056102 - DNA, 21 bp, Homo sapiens
gtccaggccactgtggccaga

SEQ ID NO: 2056103 - DNA, 22 bp, Homo sapiens
gtccaggccactgtggccagag

SEQ ID NO: 2056104 - DNA, 14 bp, Homo sapiens
gtccagggccctga

SEQ ID NO: 2056105 - DNA, 20 bp, Homo sapiens
gtccagggccctgagctcgg

SEQ ID NO: 2056106 - DNA, 17 bp, Homo sapiens
gtccagggcgggagtgg

SEQ ID NO: 2056107 - DNA, 16 bp, Homo sapiens
gtccaggtcctggtgg

SEQ ID NO: 2056108 - DNA, 21 bp, Homo sapiens
gtccaggtcctggtggggcag

SEQ ID NO: 2056109 - DNA, 17 bp, Homo sapiens
gtccagtgacctgctgg

SEQ ID NO: 2056110 - DNA, 24 bp, Homo sapiens
gtccagtgggaggtgagaccacct

SEQ ID NO: 2056111 - DNA, 12 bp, Homo sapiens
gtccataaagta

SEQ ID NO: 2056112 - DNA, 16 bp, Homo sapiens
gtccatatcagacctc

SEQ ID NO: 2056113 - DNA, 17 bp, Homo sapiens
gtccatatcagacctct

SEQ ID NO: 2056114 - DNA, 15 bp, Homo sapiens
gtccatgcctacaga

SEQ ID NO: 2056115 - DNA, 18 bp, Homo sapiens
gtccatgcctacagataa

SEQ ID NO: 2056116 - DNA, 20 bp, Homo sapiens
gtccatgcctacagataatt

SEQ ID NO: 2056117 - DNA, 13 bp, Homo sapiens
gtccatggcacca

SEQ ID NO: 2056118 - DNA, 15 bp, Homo sapiens
gtccatggcaccagc

SEQ ID NO: 2056119 - DNA, 18 bp, Homo sapiens
gtccatggcaccagcccc

SEQ ID NO: 2056120 - DNA, 19 bp, Homo sapiens
gtccatggcaccagccccc

SEQ ID NO: 2056121 - DNA, 19 bp, Homo sapiens
gtccatgtggttcttcaaa

SEQ ID NO: 2056122 - DNA, 13 bp, Homo sapiens
gtcccaagcagcc

SEQ ID NO: 2056123 - DNA, 16 bp, Homo sapiens
gtcccaaggaaagccc

SEQ ID NO: 2056124 - DNA, 13 bp, Homo sapiens
gtcccaaggagct

SEQ ID NO: 2056125 - DNA, 16 bp, Homo sapiens
gtcccaaggagctgat

SEQ ID NO: 2056126 - DNA, 23 bp, Homo sapiens
gtcccaaggagctgatttccagg

SEQ ID NO: 2056127 - DNA, 21 bp, Homo sapiens
gtcccaagtagtagtgtcttc

SEQ ID NO: 2056128 - DNA, 18 bp, Homo sapiens
gtcccacatccctgggcc

SEQ ID NO: 2056129 - DNA, 19 bp, Homo sapiens
gtcccacatccctgggcct

SEQ ID NO: 2056130 - DNA, 23 bp, Homo sapiens
gtcccacatccctgggcctgctg

SEQ ID NO: 2056131 - DNA, 20 bp, Homo sapiens
gtcccaccaactctgcactc

SEQ ID NO: 2056132 - DNA, 19 bp, Homo sapiens
gtcccaccgggagcctccc

SEQ ID NO: 2056133 - DNA, 15 bp, Homo sapiens
gtcccaccttggctg

SEQ ID NO: 2056134 - DNA, 17 bp, Homo sapiens
gtcccaccttggctgca

SEQ ID NO: 2056135 - DNA, 22 bp, Homo sapiens
gtcccacgaatttgctggggaa

SEQ ID NO: 2056136 - DNA, 22 bp, Homo sapiens
gtcccagagcttattggccact

SEQ ID NO: 2056137 - DNA, 23 bp, Homo sapiens
gtcccagaggttatctgcctggc

SEQ ID NO: 2056138 - DNA, 20 bp, Homo sapiens
gtcccagcagaagagggagg

SEQ ID NO: 2056139 - DNA, 22 bp, Homo sapiens
gtcccagctactcagaagcctg

SEQ ID NO: 2056140 - DNA, 24 bp, Homo sapiens
gtcccagggaagaggaatcgcccc

SEQ ID NO: 2056141 - DNA, 12 bp, Homo sapiens
gtccccagctcc

SEQ ID NO: 2056142 - DNA, 13 bp, Homo sapiens
gtccccagctccc

SEQ ID NO: 2056143 - DNA, 16 bp, Homo sapiens
gtccccagctccccag

SEQ ID NO: 2056144 - DNA, 18 bp, Homo sapiens
gtccccagctccccagga

SEQ ID NO: 2056145 - DNA, 18 bp, Homo sapiens
gtccccagtttgcagaaa

SEQ ID NO: 2056146 - DNA, 12 bp, Homo sapiens
gtccccatcagc

SEQ ID NO: 2056147 - DNA, 19 bp, Homo sapiens
gtccccatcatcccagctg

SEQ ID NO: 2056148 - DNA, 15 bp, Homo sapiens
gtcccccagaacctc

SEQ ID NO: 2056149 - DNA, 15 bp, Homo sapiens
gtcccccagccctca

SEQ ID NO: 2056150 - DNA, 16 bp, Homo sapiens
gtcccccagccctcag

SEQ ID NO: 2056151 - DNA, 21 bp, Homo sapiens
gtcccccagccctcaggccag

SEQ ID NO: 2056152 - DNA, 15 bp, Homo sapiens
gtcccccccagtgca

SEQ ID NO: 2056153 - DNA, 21 bp, Homo sapiens
gtccccccccaacctttccct

SEQ ID NO: 2056154 - DNA, 22 bp, Homo sapiens
gtccccctggggcttctcctga

SEQ ID NO: 2056155 - DNA, 14 bp, Homo sapiens
gtccccgggagcac

SEQ ID NO: 2056156 - DNA, 21 bp, Homo sapiens
gtccccgtcccccagaacctc

SEQ ID NO: 2056157 - DNA, 13 bp, Homo sapiens
gtcccctcactct

SEQ ID NO: 2056158 - DNA, 17 bp, Homo sapiens
gtcccctcactctgtca

SEQ ID NO: 2056159 - DNA, 21 bp, Homo sapiens
gtcccgccttcctcctccaca

SEQ ID NO: 2056160 - DNA, 22 bp, Homo sapiens
gtcccgccttcctcctccacag

SEQ ID NO: 2056161 - DNA, 17 bp, Homo sapiens
gtcccggttcaccttgc

SEQ ID NO: 2056162 - DNA, 13 bp, Homo sapiens
gtcccgtggaggg

SEQ ID NO: 2056163 - DNA, 20 bp, Homo sapiens
gtccctacccactctttgct

SEQ ID NO: 2056164 - DNA, 18 bp, Homo sapiens
gtccctcactgccttcca

SEQ ID NO: 2056165 - DNA, 19 bp, Homo sapiens
gtccctcggagctgccagc

SEQ ID NO: 2056166 - DNA, 17 bp, Homo sapiens
gtccctgactctctgtg

SEQ ID NO: 2056167 - DNA, 18 bp, Homo sapiens
gtccctgactctctgtga

SEQ ID NO: 2056168 - DNA, 18 bp, Homo sapiens
gtccctgccacactcagt

SEQ ID NO: 2056169 - DNA, 15 bp, Homo sapiens
gtccctgccagtgtt

SEQ ID NO: 2056170 - DNA, 18 bp, Homo sapiens
gtccctgccccagcaaga

SEQ ID NO: 2056171 - DNA, 10 bp, Homo sapiens
gtccctgctc

SEQ ID NO: 2056172 - DNA, 12 bp, Homo sapiens
gtccctgctcct

SEQ ID NO: 2056173 - DNA, 13 bp, Homo sapiens
gtccctgctcctc

SEQ ID NO: 2056174 - DNA, 15 bp, Homo sapiens
gtccctgctcctccc

SEQ ID NO: 2056175 - DNA, 22 bp, Homo sapiens
gtccctgggggaagccctggat

SEQ ID NO: 2056176 - DNA, 12 bp, Homo sapiens
gtccctggtccc

SEQ ID NO: 2056177 - DNA, 15 bp, Homo sapiens
gtccctggtccctcg

SEQ ID NO: 2056178 - DNA, 16 bp, Homo sapiens
gtccctggtccctcgt

SEQ ID NO: 2056179 - DNA, 19 bp, Homo sapiens
gtccctggtccctcgtcca

SEQ ID NO: 2056180 - DNA, 19 bp, Homo sapiens
gtccctgttctcagctccg

SEQ ID NO: 2056181 - DNA, 18 bp, Homo sapiens
gtcccttgagacctcagc

SEQ ID NO: 2056182 - DNA, 19 bp, Homo sapiens
gtcccttgagacctcagcc

SEQ ID NO: 2056183 - DNA, 20 bp, Homo sapiens
gtcccttggaaagttcagcc

SEQ ID NO: 2056184 - DNA, 13 bp, Homo sapiens
gtccgcaccagct

SEQ ID NO: 2056185 - DNA, 14 bp, Homo sapiens
gtccgcaccagctg

SEQ ID NO: 2056186 - DNA, 12 bp, Homo sapiens
gtccgcctctgc

SEQ ID NO: 2056187 - DNA, 21 bp, Homo sapiens
gtccgcctctgcccgcagagc

SEQ ID NO: 2056188 - DNA, 24 bp, Homo sapiens
gtccggtgtccttttcactacacc

SEQ ID NO: 2056189 - DNA, 19 bp, Homo sapiens
gtcctaaggacacactaat

SEQ ID NO: 2056190 - DNA, 20 bp, Homo sapiens
gtcctacagcctcagaggca

SEQ ID NO: 2056191 - DNA, 15 bp, Homo sapiens
gtcctacccaccctc

SEQ ID NO: 2056192 - DNA, 12 bp, Homo sapiens
gtcctactctgt

SEQ ID NO: 2056193 - DNA, 14 bp, Homo sapiens
gtcctagagctcct

SEQ ID NO: 2056194 - DNA, 17 bp, Homo sapiens
gtcctagagctcctgtc

SEQ ID NO: 2056195 - DNA, 22 bp, Homo sapiens
gtcctaggccacaccatctcct

SEQ ID NO: 2056196 - DNA, 22 bp, Homo sapiens
gtcctaggggccgagggaaatg

SEQ ID NO: 2056197 - DNA, 19 bp, Homo sapiens
gtcctcaaaataaggggca

SEQ ID NO: 2056198 - DNA, 16 bp, Homo sapiens
gtcctcacagcctctc

SEQ ID NO: 2056199 - DNA, 17 bp, Homo sapiens
gtcctcacagcctctcc

SEQ ID NO: 2056200 - DNA, 18 bp, Homo sapiens
gtcctcacagcctctccc

SEQ ID NO: 2056201 - DNA, 23 bp, Homo sapiens
gtcctccagcttcccctcgctgt

SEQ ID NO: 2056202 - DNA, 21 bp, Homo sapiens
gtcctccatttcaactccaga

SEQ ID NO: 2056203 - DNA, 19 bp, Homo sapiens
gtcctcccatcccctggac

SEQ ID NO: 2056204 - DNA, 21 bp, Homo sapiens
gtcctcccatcccctggactg

SEQ ID NO: 2056205 - DNA, 15 bp, Homo sapiens
gtcctccccctgcca

SEQ ID NO: 2056206 - DNA, 16 bp, Homo sapiens
gtcctccccctgccag

SEQ ID NO: 2056207 - DNA, 22 bp, Homo sapiens
gtgatggttcccctgttcactc

SEQ ID NO: 2056208 - DNA, 23 bp, Homo sapiens
gtgatggttcccctgttcactct

SEQ ID NO: 2056209 - DNA, 15 bp, Homo sapiens
gtgatgtgagttgca

SEQ ID NO: 2056210 - DNA, 21 bp, Homo sapiens
gtgatgtgcaaggaaaataat

SEQ ID NO: 2056211 - DNA, 15 bp, Homo sapiens
gtgatgtttttatga

SEQ ID NO: 2056212 - DNA, 19 bp, Homo sapiens
gtgattatttgttatttgt

SEQ ID NO: 2056213 - DNA, 13 bp, Homo sapiens
gtgattccttcaa

SEQ ID NO: 2056214 - DNA, 17 bp, Homo sapiens
gtgattctcctgcctca

SEQ ID NO: 2056215 - DNA, 16 bp, Homo sapiens
gtgattgacacacagc

SEQ ID NO: 2056216 - DNA, 18 bp, Homo sapiens
gtgattgacacacagcac

SEQ ID NO: 2056217 - DNA, 21 bp, Homo sapiens
gtgatttagaactgtatgtca

SEQ ID NO: 2056218 - DNA, 16 bp, Homo sapiens
gtgattttgtacagaa

SEQ ID NO: 2056219 - DNA, 12 bp, Homo sapiens
gtgcaagagaca

SEQ ID NO: 2056220 - DNA, 17 bp, Homo sapiens
gtgcaagagacagagcc

SEQ ID NO: 2056221 - DNA, 13 bp, Homo sapiens
gtgcaatgtaaat

SEQ ID NO: 2056222 - DNA, 22 bp, Homo sapiens
gtgcaatgtaaatattttaaag

SEQ ID NO: 2056223 - DNA, 16 bp, Homo sapiens
gtgcaatttcccctct

SEQ ID NO: 2056224 - DNA, 14 bp, Homo sapiens
gtgcacacaccaga

SEQ ID NO: 2056225 - DNA, 21 bp, Homo sapiens
gtgcacacaccagagcccacc

SEQ ID NO: 2056226 - DNA, 18 bp, Homo sapiens
gtgcacagcgcgggcgga

SEQ ID NO: 2056227 - DNA, 12 bp, Homo sapiens
gtgcacaggagg

SEQ ID NO: 2056228 - DNA, 20 bp, Homo sapiens
gtgcacatatgggtgctggc

SEQ ID NO: 2056229 - DNA, 18 bp, Homo sapiens
gtgcacatgtgtctgtgt

SEQ ID NO: 2056230 - DNA, 22 bp, Homo sapiens
gtgcaccaccatgccaggctaa

SEQ ID NO: 2056231 - DNA, 13 bp, Homo sapiens
gtgcacccactca

SEQ ID NO: 2056232 - DNA, 16 bp, Homo sapiens
gtgcacccctccccat

SEQ ID NO: 2056233 - DNA, 18 bp, Homo sapiens
gtgcacctgtactcagga

SEQ ID NO: 2056234 - DNA, 20 bp, Homo sapiens
gtgcaccttacattcctaga

SEQ ID NO: 2056235 - DNA, 13 bp, Homo sapiens
gtgcacggcagct

SEQ ID NO: 2056236 - DNA, 15 bp, Homo sapiens
gtgcacggcagcttg

SEQ ID NO: 2056237 - DNA, 15 bp, Homo sapiens
gtgcacggccagctg

SEQ ID NO: 2056238 - DNA, 13 bp, Homo sapiens
gtgcactggcccc

SEQ ID NO: 2056239 - DNA, 16 bp, Homo sapiens
gtgcactggccccacc

SEQ ID NO: 2056240 - DNA, 24 bp, Homo sapiens
gtgcagccccgccctctgcgtccc

SEQ ID NO: 2056241 - DNA, 15 bp, Homo sapiens
gtgcagcttctgtcc

SEQ ID NO: 2056242 - DNA, 15 bp, Homo sapiens
gtgcagtcccgtgga

SEQ ID NO: 2056243 - DNA, 17 bp, Homo sapiens
gtgcagtgatacatgta

SEQ ID NO: 2056244 - DNA, 19 bp, Homo sapiens
gtgcagttgacagcaggtg

SEQ ID NO: 2056245 - DNA, 19 bp, Homo sapiens
gtgcatccacgcacacatg

SEQ ID NO: 2056246 - DNA, 20 bp, Homo sapiens
gtgcatccacgcacacatgg

SEQ ID NO: 2056247 - DNA, 13 bp, Homo sapiens
gtgcatgctctct

SEQ ID NO: 2056248 - DNA, 16 bp, Homo sapiens
gtgcatgctctctgca

SEQ ID NO: 2056249 - DNA, 21 bp, Homo sapiens
gtgcatgctctctgcagccag

SEQ ID NO: 2056250 - DNA, 19 bp, Homo sapiens
gtgcatggcttggggagca

SEQ ID NO: 2056251 - DNA, 21 bp, Homo sapiens
gtgcatggcttggggagcaga

SEQ ID NO: 2056252 - DNA, 16 bp, Homo sapiens
gtgcatgtatgtcttg

SEQ ID NO: 2056253 - DNA, 21 bp, Homo sapiens
gtgcatgtatgtgcacatgtg

SEQ ID NO: 2056254 - DNA, 14 bp, Homo sapiens
gtgcatgtatgtgt

SEQ ID NO: 2056255 - DNA, 22 bp, Homo sapiens
gtgcatgtatgtgtgtgtgtat

SEQ ID NO: 2056256 - DNA, 19 bp, Homo sapiens
gtgcatgtgagcacatgcg

SEQ ID NO: 2056257 - DNA, 14 bp, Homo sapiens
gtgcatgtgtgtat

SEQ ID NO: 2056258 - DNA, 21 bp, Homo sapiens
gtgcatgttgccatgaggcct

SEQ ID NO: 2056259 - DNA, 22 bp, Homo sapiens
gtgcatgttgccatgaggcctt

SEQ ID NO: 2056260 - DNA, 14 bp, Homo sapiens
gtgcattctccagc

SEQ ID NO: 2056261 - DNA, 23 bp, Homo sapiens
gtgcatttgtgagccaaagagaa

SEQ ID NO: 2056262 - DNA, 22 bp, Homo sapiens
gtgccaaactaccgttcccaaa

SEQ ID NO: 2056263 - DNA, 16 bp, Homo sapiens
gtgccaaggttgtcct

SEQ ID NO: 2056264 - DNA, 18 bp, Homo sapiens
gtgccaagtccaggtcct

SEQ ID NO: 2056265 - DNA, 19 bp, Homo sapiens
gtgccaagtccaggtcctg

SEQ ID NO: 2056266 - DNA, 21 bp, Homo sapiens
gtgccaagtccaggtcctggt

SEQ ID NO: 2056267 - DNA, 17 bp, Homo sapiens
gtgccaatatgtattgt

SEQ ID NO: 2056268 - DNA, 17 bp, Homo sapiens
gtgccaccaataaaaat

SEQ ID NO: 2056269 - DNA, 20 bp, Homo sapiens
gtgccacccgtaggcagcct

SEQ ID NO: 2056270 - DNA, 12 bp, Homo sapiens
gtgccacctgca

SEQ ID NO: 2056271 - DNA, 13 bp, Homo sapiens
gtgccactccctg

SEQ ID NO: 2056272 - DNA, 18 bp, Homo sapiens
gtgccactccctgagctt

SEQ ID NO: 2056273 - DNA, 13 bp, Homo sapiens
gtgccagagcctg

SEQ ID NO: 2056274 - DNA, 14 bp, Homo sapiens
gtgccagagcctgg

SEQ ID NO: 2056275 - DNA, 17 bp, Homo sapiens
gtgccagagcctggggc

SEQ ID NO: 2056276 - DNA, 15 bp, Homo sapiens
gtgccagctctagtt

SEQ ID NO: 2056277 - DNA, 13 bp, Homo sapiens
gtgccaggacagc

SEQ ID NO: 2056278 - DNA, 16 bp, Homo sapiens
gtgccaggacagctgg

SEQ ID NO: 2056279 - DNA, 17 bp, Homo sapiens
gtgccaggacagctggc

SEQ ID NO: 2056280 - DNA, 18 bp, Homo sapiens
gtgccaggactccccagg

SEQ ID NO: 2056281 - DNA, 13 bp, Homo sapiens
gtgccaggcccgg

SEQ ID NO: 2056282 - DNA, 20 bp, Homo sapiens
gtgccaggcccggggctggc

SEQ ID NO: 2056283 - DNA, 17 bp, Homo sapiens
gtgccaggctgtaagca

SEQ ID NO: 2056284 - DNA, 14 bp, Homo sapiens
gtgccatcccacat

SEQ ID NO: 2056285 - DNA, 14 bp, Homo sapiens
gtgccatgtgccag

SEQ ID NO: 2056286 - DNA, 16 bp, Homo sapiens
gtgccatgtgccaggt

SEQ ID NO: 2056287 - DNA, 14 bp, Homo sapiens
gtgccattcccagc

SEQ ID NO: 2056288 - DNA, 23 bp, Homo sapiens
gtgcccaagaatagatgctgact

SEQ ID NO: 2056289 - DNA, 13 bp, Homo sapiens
gtgcccacaggga

SEQ ID NO: 2056290 - DNA, 15 bp, Homo sapiens
gtgcccacatcccag

SEQ ID NO: 2056291 - DNA, 14 bp, Homo sapiens
gtgcccagctaatt

SEQ ID NO: 2056292 - DNA, 13 bp, Homo sapiens
gtgcccaggagaa

SEQ ID NO: 2056293 - DNA, 16 bp, Homo sapiens
gtgcccccacccagtc

SEQ ID NO: 2056294 - DNA, 13 bp, Homo sapiens
gtgccccccttgc

SEQ ID NO: 2056295 - DNA, 16 bp, Homo sapiens
gtgccccgcctccccg

SEQ ID NO: 2056296 - DNA, 17 bp, Homo sapiens
gtgccccgcctccccga

SEQ ID NO: 2056297 - DNA, 19 bp, Homo sapiens
gtgcccctcagagaggcat

SEQ ID NO: 2056298 - DNA, 12 bp, Homo sapiens
gtgcccctgtaa

SEQ ID NO: 2056299 - DNA, 14 bp, Homo sapiens
gtgcccgccctgcc

SEQ ID NO: 2056300 - DNA, 23 bp, Homo sapiens
gtgcccgccctgcccctgcccca

SEQ ID NO: 2056301 - DNA, 20 bp, Homo sapiens
gtgccctccacagccgcagc

SEQ ID NO: 2056302 - DNA, 17 bp, Homo sapiens
gtgccctgacccctgca

SEQ ID NO: 2056303 - DNA, 18 bp, Homo sapiens
gtgccctgacccctgcac

SEQ ID NO: 2056304 - DNA, 22 bp, Homo sapiens
gtgccctgcccccatctcccca

SEQ ID NO: 2056305 - DNA, 12 bp, Homo sapiens
gtgcccttgggg

SEQ ID NO: 2056306 - DNA, 13 bp, Homo sapiens
gtgccgcctgtgc

SEQ ID NO: 2056307 - DNA, 15 bp, Homo sapiens
gtgccgcctgtgccc

SEQ ID NO: 2056308 - DNA, 20 bp, Homo sapiens
gtgccgggagaggactctgc

SEQ ID NO: 2056309 - DNA, 22 bp, Homo sapiens
gtgccgtgaactgcgtgccagt

SEQ ID NO: 2056310 - DNA, 18 bp, Homo sapiens
gtgccgttactctccaac

SEQ ID NO: 2056311 - DNA, 22 bp, Homo sapiens
gtgccgttactctccaacctgg

SEQ ID NO: 2056312 - DNA, 19 bp, Homo sapiens
gtgcctagttcctgtggcc

SEQ ID NO: 2056313 - DNA, 16 bp, Homo sapiens
gtgcctcagagcaggc

SEQ ID NO: 2056314 - DNA, 14 bp, Homo sapiens
gtgcctgagctggg

SEQ ID NO: 2056315 - DNA, 22 bp, Homo sapiens
gtgcctgctagagcaacccctg

SEQ ID NO: 2056316 - DNA, 19 bp, Homo sapiens
gtgcctggcctggcacaca

SEQ ID NO: 2056317 - DNA, 18 bp, Homo sapiens
gtgcctggcgcccctgcc

SEQ ID NO: 2056318 - DNA, 23 bp, Homo sapiens
gtgcctgggtggggctgctcctc

SEQ ID NO: 2056319 - DNA, 16 bp, Homo sapiens
gtgcctgtgaggcagg

SEQ ID NO: 2056320 - DNA, 14 bp, Homo sapiens
gtgcctgtggcaga

SEQ ID NO: 2056321 - DNA, 11 bp, Homo sapiens
gtgccttcatt

SEQ ID NO: 2056322 - DNA, 21 bp, Homo sapiens
gtggcattggggggccgggca

SEQ ID NO: 2056323 - DNA, 11 bp, Homo sapiens
gtggccagagc

SEQ ID NO: 2056324 - DNA, 13 bp, Homo sapiens
gtggccagagctg

SEQ ID NO: 2056325 - DNA, 14 bp, Homo sapiens
gtggccagagctgg

SEQ ID NO: 2056326 - DNA, 18 bp, Homo sapiens
gtggccagagctggaagg

SEQ ID NO: 2056327 - DNA, 22 bp, Homo sapiens
gtggccagagctggaaggcagg

SEQ ID NO: 2056328 - DNA, 17 bp, Homo sapiens
gtggccagagctgggag

SEQ ID NO: 2056329 - DNA, 14 bp, Homo sapiens
gtggccatccctgg

SEQ ID NO: 2056330 - DNA, 18 bp, Homo sapiens
gtggccatccctgggccc

SEQ ID NO: 2056331 - DNA, 21 bp, Homo sapiens
gtggccatccctgggcccctc

SEQ ID NO: 2056332 - DNA, 22 bp, Homo sapiens
gtggccatccctgggcccctcc

SEQ ID NO: 2056333 - DNA, 14 bp, Homo sapiens
gtggccccaggtgc

SEQ ID NO: 2056334 - DNA, 20 bp, Homo sapiens
gtggccccctgtgccagctc

SEQ ID NO: 2056335 - DNA, 18 bp, Homo sapiens
gtggccctgccctctcct

SEQ ID NO: 2056336 - DNA, 23 bp, Homo sapiens
gtggccctgccctctccttcctt

SEQ ID NO: 2056337 - DNA, 13 bp, Homo sapiens
gtggccctggcct

SEQ ID NO: 2056338 - DNA, 16 bp, Homo sapiens
gtggccctggcctgct

SEQ ID NO: 2056339 - DNA, 17 bp, Homo sapiens
gtggccctggcctgctg

SEQ ID NO: 2056340 - DNA, 21 bp, Homo sapiens
gtggcccttcctggacagctg

SEQ ID NO: 2056341 - DNA, 19 bp, Homo sapiens
gtggccgcaagcgcaggga

SEQ ID NO: 2056342 - DNA, 20 bp, Homo sapiens
gtggccgcaagcgcagggag

SEQ ID NO: 2056343 - DNA, 16 bp, Homo sapiens
gtggcctcacttccct

SEQ ID NO: 2056344 - DNA, 20 bp, Homo sapiens
gtggcctcacttccctggga

SEQ ID NO: 2056345 - DNA, 21 bp, Homo sapiens
gtggcctcacttccctgggaa

SEQ ID NO: 2056346 - DNA, 14 bp, Homo sapiens
gtggcctcagccct

SEQ ID NO: 2056347 - DNA, 17 bp, Homo sapiens
gtggcctcagccctcag

SEQ ID NO: 2056348 - DNA, 18 bp, Homo sapiens
gtggcctcagccctcaga

SEQ ID NO: 2056349 - DNA, 22 bp, Homo sapiens
gtggcctcgggacacctgccct

SEQ ID NO: 2056350 - DNA, 20 bp, Homo sapiens
gtggcctgcggccgggctgc

SEQ ID NO: 2056351 - DNA, 15 bp, Homo sapiens
gtggcctgtgtccag

SEQ ID NO: 2056352 - DNA, 22 bp, Homo sapiens
gtggccttccccttttgcctgg

SEQ ID NO: 2056353 - DNA, 23 bp, Homo sapiens
gtggccttgcccgccagcctcag

SEQ ID NO: 2056354 - DNA, 20 bp, Homo sapiens
gtggcgactctatagactct

SEQ ID NO: 2056355 - DNA, 13 bp, Homo sapiens
gtggcgagaggag

SEQ ID NO: 2056356 - DNA, 14 bp, Homo sapiens
gtggcggtgcctgg

SEQ ID NO: 2056357 - DNA, 17 bp, Homo sapiens
gtggctactctgtgcca

SEQ ID NO: 2056358 - DNA, 21 bp, Homo sapiens
gtggctactctgtgccagagc

SEQ ID NO: 2056359 - DNA, 22 bp, Homo sapiens
gtggctactctgtgccagagcc

SEQ ID NO: 2056360 - DNA, 23 bp, Homo sapiens
gtggctcacgcctgtaatcccag

SEQ ID NO: 2056361 - DNA, 20 bp, Homo sapiens
gtggctcctcccggtgccca

SEQ ID NO: 2056362 - DNA, 14 bp, Homo sapiens
gtggctcctgccac

SEQ ID NO: 2056363 - DNA, 13 bp, Homo sapiens
gtggctctccagt

SEQ ID NO: 2056364 - DNA, 17 bp, Homo sapiens
gtggctgacccagtccc

SEQ ID NO: 2056365 - DNA, 17 bp, Homo sapiens
gtggctgctagcacttg

SEQ ID NO: 2056366 - DNA, 14 bp, Homo sapiens
gtggctgtctctgt

SEQ ID NO: 2056367 - DNA, 22 bp, Homo sapiens
gtggcttacaaattctacagca

SEQ ID NO: 2056368 - DNA, 18 bp, Homo sapiens
gtggcttcccatgtcttt

SEQ ID NO: 2056369 - DNA, 21 bp, Homo sapiens
gtggcttcccgctcagccctc

SEQ ID NO: 2056370 - DNA, 20 bp, Homo sapiens
gtggcttgtgattctgggat

SEQ ID NO: 2056371 - DNA, 17 bp, Homo sapiens
gtgggaaccctccccaa

SEQ ID NO: 2056372 - DNA, 17 bp, Homo sapiens
gtgggaagcgtctgtcc

SEQ ID NO: 2056373 - DNA, 13 bp, Homo sapiens
gtgggaagggaga

SEQ ID NO: 2056374 - DNA, 17 bp, Homo sapiens
gtgggaagtgaagcccc

SEQ ID NO: 2056375 - DNA, 20 bp, Homo sapiens
gtgggacaaaccagagcaga

SEQ ID NO: 2056376 - DNA, 17 bp, Homo sapiens
gtgggacagaggagcaa

SEQ ID NO: 2056377 - DNA, 14 bp, Homo sapiens
gtgggagacaagga

SEQ ID NO: 2056378 - DNA, 12 bp, Homo sapiens
gtgggagagaca

SEQ ID NO: 2056379 - DNA, 13 bp, Homo sapiens
gtgggagagccca

SEQ ID NO: 2056380 - DNA, 14 bp, Homo sapiens
gtgggagagcccag

SEQ ID NO: 2056381 - DNA, 15 bp, Homo sapiens
gtgggagagcccagc

SEQ ID NO: 2056382 - DNA, 11 bp, Homo sapiens
gtgggagcctc

SEQ ID NO: 2056383 - DNA, 12 bp, Homo sapiens
gtgggagcctcg

SEQ ID NO: 2056384 - DNA, 18 bp, Homo sapiens
gtgggagctgcctgttca

SEQ ID NO: 2056385 - DNA, 20 bp, Homo sapiens
gtgggagggtaccagcagaa

SEQ ID NO: 2056386 - DNA, 17 bp, Homo sapiens
gtgggatggaggagaag

SEQ ID NO: 2056387 - DNA, 16 bp, Homo sapiens
gtgggcagcaccctcc

SEQ ID NO: 2056388 - DNA, 12 bp, Homo sapiens
gtgggcagctgg

SEQ ID NO: 2056389 - DNA, 14 bp, Homo sapiens
gtgggcagggctgg

SEQ ID NO: 2056390 - DNA, 14 bp, Homo sapiens
gtgggccaggacag

SEQ ID NO: 2056391 - DNA, 13 bp, Homo sapiens
gtgggccaggagc

SEQ ID NO: 2056392 - DNA, 23 bp, Homo sapiens
gtgggcccataatagttagccct

SEQ ID NO: 2056393 - DNA, 15 bp, Homo sapiens
gtgggcctcctctgt

SEQ ID NO: 2056394 - DNA, 14 bp, Homo sapiens
gtgggcctggcctg

SEQ ID NO: 2056395 - DNA, 15 bp, Homo sapiens
gtgggcctggcctga

SEQ ID NO: 2056396 - DNA, 18 bp, Homo sapiens
gtgggcctggcctgagct

SEQ ID NO: 2056397 - DNA, 19 bp, Homo sapiens
gtgggcctggcctgagctg

SEQ ID NO: 2056398 - DNA, 14 bp, Homo sapiens
gtgggctaattaaa

SEQ ID NO: 2056399 - DNA, 15 bp, Homo sapiens
gtgggctagttgggc

SEQ ID NO: 2056400 - DNA, 13 bp, Homo sapiens
gtgggctgagccc

SEQ ID NO: 2056401 - DNA, 17 bp, Homo sapiens
gtgggctgcctggggat

SEQ ID NO: 2056402 - DNA, 14 bp, Homo sapiens
gtgggcttggcctt

SEQ ID NO: 2056403 - DNA, 21 bp, Homo sapiens
gtgggctttctccggggtctg

SEQ ID NO: 2056404 - DNA, 13 bp, Homo sapiens
gtggggagacctg

SEQ ID NO: 2056405 - DNA, 15 bp, Homo sapiens
gtggggaggcagctc

SEQ ID NO: 2056406 - DNA, 17 bp, Homo sapiens
gtggggcagcttgaggg

SEQ ID NO: 2056407 - DNA, 12 bp, Homo sapiens
gtggggctgctc

SEQ ID NO: 2056408 - DNA, 18 bp, Homo sapiens
gtggggctgctcctccag

SEQ ID NO: 2056409 - DNA, 22 bp, Homo sapiens
gtgggggcagagggcagaggct

SEQ ID NO: 2056410 - DNA, 18 bp, Homo sapiens
gtgggggccgctggccca

SEQ ID NO: 2056411 - DNA, 12 bp, Homo sapiens
gtgggggtggcc

SEQ ID NO: 2056412 - DNA, 12 bp, Homo sapiens
gtgggtccagga

SEQ ID NO: 2056413 - DNA, 14 bp, Homo sapiens
gtgggtctggggag

SEQ ID NO: 2056414 - DNA, 24 bp, Homo sapiens
gtgggtctgtaagaccttggtagg

SEQ ID NO: 2056415 - DNA, 18 bp, Homo sapiens
gtgggtgatcagaaggct

SEQ ID NO: 2056416 - DNA, 17 bp, Homo sapiens
gtgggtggcacctcctg

SEQ ID NO: 2056417 - DNA, 19 bp, Homo sapiens
gtggtagaaccacttggct

SEQ ID NO: 2056418 - DNA, 14 bp, Homo sapiens
gtggtagaagccag

SEQ ID NO: 2056419 - DNA, 19 bp, Homo sapiens
gtggtatatttgtgtatgt

SEQ ID NO: 2056420 - DNA, 19 bp, Homo sapiens
gtggtatgatcacggctca

SEQ ID NO: 2056421 - DNA, 16 bp, Homo sapiens
gtggtcattaagcatt

SEQ ID NO: 2056422 - DNA, 12 bp, Homo sapiens
gtggtccagctc

SEQ ID NO: 2056423 - DNA, 13 bp, Homo sapiens
gtggtccagctct

SEQ ID NO: 2056424 - DNA, 11 bp, Homo sapiens
gtggtctttga

SEQ ID NO: 2056425 - DNA, 17 bp, Homo sapiens
gtggtctttgaataaag

SEQ ID NO: 2056426 - DNA, 20 bp, Homo sapiens
gtggtgaaggaccctggctc

SEQ ID NO: 2056427 - DNA, 14 bp, Homo sapiens
gtggtgacaggccc

SEQ ID NO: 2056428 - DNA, 19 bp, Homo sapiens
gtggtgatcaattaaatgt

SEQ ID NO: 2056429 - DNA, 13 bp, Homo sapiens
gtggtgccagagg

SEQ ID NO: 2056430 - DNA, 16 bp, Homo sapiens
gtggtggaggaggagg

SEQ ID NO: 2056431 - DNA, 20 bp, Homo sapiens
gtggtggatctgtccaagga

SEQ ID NO: 2056432 - DNA, 15 bp, Homo sapiens
gtggtggctgtctct

SEQ ID NO: 2056433 - DNA, 18 bp, Homo sapiens
gtggtggctgtctctgtc

SEQ ID NO: 2056434 - DNA, 14 bp, Homo sapiens
gtggtgggaatcag

SEQ ID NO: 2056435 - DNA, 16 bp, Homo sapiens
gtggtgggtgcctgta

SEQ ID NO: 2056436 - DNA, 22 bp, Homo sapiens
gtggtgggttctttggaaggag

SEQ ID NO: 2056437 - DNA, 12 bp, Homo sapiens
gtggtgtaattt

SEQ ID NO: 2056438 - DNA, 15 bp, Homo sapiens
gtttgtctgtcttca

SEQ ID NO: 2056439 - DNA, 22 bp, Homo sapiens
gtttgtgagcatgggtgtgccc

SEQ ID NO: 2056440 - DNA, 22 bp, Homo sapiens
gtttgtgccttaaaaggagaga

SEQ ID NO: 2056441 - DNA, 14 bp, Homo sapiens
gtttgtgtgcatga

SEQ ID NO: 2056442 - DNA, 15 bp, Homo sapiens
gtttgtgtggatacc

SEQ ID NO: 2056443 - DNA, 23 bp, Homo sapiens
gtttgttctccgggtgtggcctc

SEQ ID NO: 2056444 - DNA, 20 bp, Homo sapiens
gtttgtttctccccctgggc

SEQ ID NO: 2056445 - DNA, 13 bp, Homo sapiens
gtttgttttacaa

SEQ ID NO: 2056446 - DNA, 19 bp, Homo sapiens
gttttaaacatagaaagtt

SEQ ID NO: 2056447 - DNA, 22 bp, Homo sapiens
gttttaacaatttcctttatat

SEQ ID NO: 2056448 - DNA, 16 bp, Homo sapiens
gttttaagaggcaggg

SEQ ID NO: 2056449 - DNA, 23 bp, Homo sapiens
gttttaagattgtaattcagaaa

SEQ ID NO: 2056450 - DNA, 22 bp, Homo sapiens
gttttacaaatttaattttgca

SEQ ID NO: 2056451 - DNA, 22 bp, Homo sapiens
gttttacaaatttttcctgcaa

SEQ ID NO: 2056452 - DNA, 13 bp, Homo sapiens
gttttagaatgat

SEQ ID NO: 2056453 - DNA, 20 bp, Homo sapiens
gttttagctccttgactcct

SEQ ID NO: 2056454 - DNA, 14 bp, Homo sapiens
gttttatcatgaca

SEQ ID NO: 2056455 - DNA, 21 bp, Homo sapiens
gttttattttttattgttttc

SEQ ID NO: 2056456 - DNA, 12 bp, Homo sapiens
gttttcactctt

SEQ ID NO: 2056457 - DNA, 17 bp, Homo sapiens
gttttcagactcagact

SEQ ID NO: 2056458 - DNA, 19 bp, Homo sapiens
gttttcataacttgctgaa

SEQ ID NO: 2056459 - DNA, 15 bp, Homo sapiens
gttttcatcctggcc

SEQ ID NO: 2056460 - DNA, 16 bp, Homo sapiens
gttttcatgagctgag

SEQ ID NO: 2056461 - DNA, 16 bp, Homo sapiens
gttttccaccctggaa

SEQ ID NO: 2056462 - DNA, 14 bp, Homo sapiens
gttttccactgtgc

SEQ ID NO: 2056463 - DNA, 19 bp, Homo sapiens
gttttcctttgtcatcatt

SEQ ID NO: 2056464 - DNA, 14 bp, Homo sapiens
gttttctaactgta

SEQ ID NO: 2056465 - DNA, 18 bp, Homo sapiens
gttttctaactgtaaatc

SEQ ID NO: 2056466 - DNA, 21 bp, Homo sapiens
gttttctcctcccaggaactg

SEQ ID NO: 2056467 - DNA, 20 bp, Homo sapiens
gttttcttcccatcactgga

SEQ ID NO: 2056468 - DNA, 15 bp, Homo sapiens
gttttctttgtaaag

SEQ ID NO: 2056469 - DNA, 16 bp, Homo sapiens
gttttctttgtaaagg

SEQ ID NO: 2056470 - DNA, 18 bp, Homo sapiens
gttttctttgtaaaggtc

SEQ ID NO: 2056471 - DNA, 14 bp, Homo sapiens
gttttgaaagaaaa

SEQ ID NO: 2056472 - DNA, 13 bp, Homo sapiens
gttttgaaatgct

SEQ ID NO: 2056473 - DNA, 17 bp, Homo sapiens
gttttgaactaataaaa

SEQ ID NO: 2056474 - DNA, 16 bp, Homo sapiens
gttttgacggatgatt

SEQ ID NO: 2056475 - DNA, 14 bp, Homo sapiens
gttttgatatgagt

SEQ ID NO: 2056476 - DNA, 20 bp, Homo sapiens
gttttgatttatatgtgtaa

SEQ ID NO: 2056477 - DNA, 20 bp, Homo sapiens
gttttgccatgttggccagg

SEQ ID NO: 2056478 - DNA, 16 bp, Homo sapiens
gttttgctgtttcctt

SEQ ID NO: 2056479 - DNA, 18 bp, Homo sapiens
gttttggtgcctgcctct

SEQ ID NO: 2056480 - DNA, 19 bp, Homo sapiens
gttttgtataaataataaa

SEQ ID NO: 2056481 - DNA, 21 bp, Homo sapiens
gttttgtataaataataaaga

SEQ ID NO: 2056482 - DNA, 16 bp, Homo sapiens
gttttgtatatgatct

SEQ ID NO: 2056483 - DNA, 21 bp, Homo sapiens
gttttgtcctttgagaaagaa

SEQ ID NO: 2056484 - DNA, 15 bp, Homo sapiens
gtttttaaaagtttc

SEQ ID NO: 2056485 - DNA, 18 bp, Homo sapiens
gtttttaaaagtttcaat

SEQ ID NO: 2056486 - DNA, 15 bp, Homo sapiens
gtttttaactcaata

SEQ ID NO: 2056487 - DNA, 16 bp, Homo sapiens
gtttttaagtcctgta

SEQ ID NO: 2056488 - DNA, 11 bp, Homo sapiens
gtttttagttt

SEQ ID NO: 2056489 - DNA, 19 bp, Homo sapiens
gtttttccttgtatttaaa

SEQ ID NO: 2056490 - DNA, 17 bp, Homo sapiens
gtttttcggtgggacag

SEQ ID NO: 2056491 - DNA, 21 bp, Homo sapiens
gtttttgtagtattggggccc

SEQ ID NO: 2056492 - DNA, 12 bp, Homo sapiens
gttttttgaaaa

SEQ ID NO: 2056493 - DNA, 13 bp, Homo sapiens
gttttttgcctaa

SEQ ID NO: 2056494 - DNA, 19 bp, Homo sapiens
gtttttttgtatagtaaag

SEQ ID NO: 2056495 - DNA, 20 bp, Homo sapiens
taaaaaaataagaagaatgc

SEQ ID NO: 2056496 - DNA, 18 bp, Homo sapiens
taaaaaaatacagtaaag

SEQ ID NO: 2056497 - DNA, 13 bp, Homo sapiens
taaaaaacatttg

SEQ ID NO: 2056498 - DNA, 19 bp, Homo sapiens
taaaaaagcttaaaacttt

SEQ ID NO: 2056499 - DNA, 15 bp, Homo sapiens
taaaaaatgaaaata

SEQ ID NO: 2056500 - DNA, 13 bp, Homo sapiens
taaaaacaggaaa

SEQ ID NO: 2056501 - DNA, 14 bp, Homo sapiens
taaaaacaggaaaa

SEQ ID NO: 2056502 - DNA, 16 bp, Homo sapiens
taaaaacatgagaaat

SEQ ID NO: 2056503 - DNA, 20 bp, Homo sapiens
taaaaactagaggtgagaaa

SEQ ID NO: 2056504 - DNA, 17 bp, Homo sapiens
taaaaacttcagaaaaa

SEQ ID NO: 2056505 - DNA, 23 bp, Homo sapiens
taaaaagaggatgatttcagaag

SEQ ID NO: 2056506 - DNA, 15 bp, Homo sapiens
taaaaagttgcacat

SEQ ID NO: 2056507 - DNA, 18 bp, Homo sapiens
taaaaagtttgccctgga

SEQ ID NO: 2056508 - DNA, 15 bp, Homo sapiens
taaaaataaaatgat

SEQ ID NO: 2056509 - DNA, 19 bp, Homo sapiens
taaaaataaaatgatgtat

SEQ ID NO: 2056510 - DNA, 18 bp, Homo sapiens
taaaaatataagaacttg

SEQ ID NO: 2056511 - DNA, 16 bp, Homo sapiens
taaaaatattttctga

SEQ ID NO: 2056512 - DNA, 18 bp, Homo sapiens
taaaaatgaaattattta

SEQ ID NO: 2056513 - DNA, 14 bp, Homo sapiens
taaaacacagcttt

SEQ ID NO: 2056514 - DNA, 13 bp, Homo sapiens
taaaaccacagca

SEQ ID NO: 2056515 - DNA, 21 bp, Homo sapiens
taaaaccatgcagcttcatca

SEQ ID NO: 2056516 - DNA, 22 bp, Homo sapiens
taaaaccatgcagcttcatcaa

SEQ ID NO: 2056517 - DNA, 19 bp, Homo sapiens
taaaaccatgtagttttaa

SEQ ID NO: 2056518 - DNA, 23 bp, Homo sapiens
taaaacctagaacttcaaaatgt

SEQ ID NO: 2056519 - DNA, 12 bp, Homo sapiens
taaaactaaata

SEQ ID NO: 2056520 - DNA, 20 bp, Homo sapiens
taaaactaaatatatgtctg

SEQ ID NO: 2056521 - DNA, 18 bp, Homo sapiens
taaaactatggttcccaa

SEQ ID NO: 2056522 - DNA, 18 bp, Homo sapiens
taaaactcagttaaaatg

SEQ ID NO: 2056523 - DNA, 15 bp, Homo sapiens
taaaactttgaagtt

SEQ ID NO: 2056524 - DNA, 14 bp, Homo sapiens
taaaagaaactttc

SEQ ID NO: 2056525 - DNA, 23 bp, Homo sapiens
taaaagaaagttaggttataaga

SEQ ID NO: 2056526 - DNA, 13 bp, Homo sapiens
taaaagaatattt

SEQ ID NO: 2056527 - DNA, 14 bp, Homo sapiens
taaaagaatttaaa

SEQ ID NO: 2056528 - DNA, 12 bp, Homo sapiens
taaaagacagtg

SEQ ID NO: 2056529 - DNA, 20 bp, Homo sapiens
taaaagattcactaaagcag

SEQ ID NO: 2056530 - DNA, 16 bp, Homo sapiens
taaaagcaaaaaagaa

SEQ ID NO: 2056531 - DNA, 22 bp, Homo sapiens
taaaagcaaaaaagaaaacctt

SEQ ID NO: 2056532 - DNA, 23 bp, Homo sapiens
taaaagcaaaaaagaaaaccttt

SEQ ID NO: 2056533 - DNA, 17 bp, Homo sapiens
taaaagcataaatgcaa

SEQ ID NO: 2056534 - DNA, 19 bp, Homo sapiens
taaaaggagagaagaaagt

SEQ ID NO: 2056535 - DNA, 12 bp, Homo sapiens
taaaaggagcca

SEQ ID NO: 2056536 - DNA, 22 bp, Homo sapiens
taaaaggtattaaattgatgtt

SEQ ID NO: 2056537 - DNA, 13 bp, Homo sapiens
taaaaggtattga

SEQ ID NO: 2056538 - DNA, 22 bp, Homo sapiens
taaaaggtattgagccattttt

SEQ ID NO: 2056539 - DNA, 12 bp, Homo sapiens
taaaagtaaaca

SEQ ID NO: 2056540 - DNA, 14 bp, Homo sapiens
taaaagtaaacatt

SEQ ID NO: 2056541 - DNA, 16 bp, Homo sapiens
taaaagtactgaagac

SEQ ID NO: 2056542 - DNA, 15 bp, Homo sapiens
taaaagttgtgattc

SEQ ID NO: 2056543 - DNA, 15 bp, Homo sapiens
taaaagtttcaatgt

SEQ ID NO: 2056544 - DNA, 15 bp, Homo sapiens
taaaataaaaaccag

SEQ ID NO: 2056545 - DNA, 20 bp, Homo sapiens
taaaataaaaaccagaatca

SEQ ID NO: 2056546 - DNA, 21 bp, Homo sapiens
taaaataactagtgttgcttg

SEQ ID NO: 2056547 - DNA, 18 bp, Homo sapiens
taaaatacggtacctggc

SEQ ID NO: 2056548 - DNA, 22 bp, Homo sapiens
taaaatactctagcctgggcca

SEQ ID NO: 2056549 - DNA, 14 bp, Homo sapiens
taaaatagcttgta

SEQ ID NO: 2056550 - DNA, 16 bp, Homo sapiens
taaaatagtattgaaa

SEQ ID NO: 2056551 - DNA, 19 bp, Homo sapiens
taaaatataaattaagact

SEQ ID NO: 2056552 - DNA, 14 bp, Homo sapiens
taaaatatacaaac

SEQ ID NO: 2056553 - DNA, 16 bp, Homo sapiens
taaagtttatttcatg

SEQ ID NO: 2056554 - DNA, 21 bp, Homo sapiens
taaataaagtatcatgcattc

SEQ ID NO: 2056555 - DNA, 15 bp, Homo sapiens
taaataaatatttta

SEQ ID NO: 2056556 - DNA, 13 bp, Homo sapiens
taaataaatgcca

SEQ ID NO: 2056557 - DNA, 19 bp, Homo sapiens
taaataaatgccaacatac

SEQ ID NO: 2056558 - DNA, 20 bp, Homo sapiens
taaataaattgtttgaccat

SEQ ID NO: 2056559 - DNA, 12 bp, Homo sapiens
taaataatgaaa

SEQ ID NO: 2056560 - DNA, 13 bp, Homo sapiens
taaataatgaaaa

SEQ ID NO: 2056561 - DNA, 14 bp, Homo sapiens
taaatacagacact

SEQ ID NO: 2056562 - DNA, 15 bp, Homo sapiens
taaatacagacacta

SEQ ID NO: 2056563 - DNA, 16 bp, Homo sapiens
taaatacagacactaa

SEQ ID NO: 2056564 - DNA, 18 bp, Homo sapiens
taaatacagacactaagt

SEQ ID NO: 2056565 - DNA, 17 bp, Homo sapiens
taaatacatgtgtggat

SEQ ID NO: 2056566 - DNA, 13 bp, Homo sapiens
taaatactgtaca

SEQ ID NO: 2056567 - DNA, 14 bp, Homo sapiens
taaatagagttcca

SEQ ID NO: 2056568 - DNA, 16 bp, Homo sapiens
taaatagcatctgctc

SEQ ID NO: 2056569 - DNA, 13 bp, Homo sapiens
taaatagtatttc

SEQ ID NO: 2056570 - DNA, 18 bp, Homo sapiens
taaatagttcagtataaa

SEQ ID NO: 2056571 - DNA, 13 bp, Homo sapiens
taaatagttctat

SEQ ID NO: 2056572 - DNA, 15 bp, Homo sapiens
taaatagttttaaat

SEQ ID NO: 2056573 - DNA, 21 bp, Homo sapiens
taaatataattgggattttaa

SEQ ID NO: 2056574 - DNA, 14 bp, Homo sapiens
taaatatgactcct

SEQ ID NO: 2056575 - DNA, 17 bp, Homo sapiens
taaatatttacatatga

SEQ ID NO: 2056576 - DNA, 16 bp, Homo sapiens
taaatatttatgctta

SEQ ID NO: 2056577 - DNA, 13 bp, Homo sapiens
taaatatttcatg

SEQ ID NO: 2056578 - DNA, 22 bp, Homo sapiens
taaatatttcatgattcacaac

SEQ ID NO: 2056579 - DNA, 22 bp, Homo sapiens
taaatatttggtctctatttca

SEQ ID NO: 2056580 - DNA, 17 bp, Homo sapiens
taaatattttaaagaat

SEQ ID NO: 2056581 - DNA, 18 bp, Homo sapiens
taaatattttaaagaatt

SEQ ID NO: 2056582 - DNA, 16 bp, Homo sapiens
taaatcaaaagctgct

SEQ ID NO: 2056583 - DNA, 17 bp, Homo sapiens
taaatcaaaagctgctt

SEQ ID NO: 2056584 - DNA, 14 bp, Homo sapiens
taaatcacttgtaa

SEQ ID NO: 2056585 - DNA, 22 bp, Homo sapiens
taaatccacagccaacaaacat

SEQ ID NO: 2056586 - DNA, 15 bp, Homo sapiens
taaatcccattcata

SEQ ID NO: 2056587 - DNA, 23 bp, Homo sapiens
taaatcccattcataactttcat

SEQ ID NO: 2056588 - DNA, 12 bp, Homo sapiens
taaatcctccag

SEQ ID NO: 2056589 - DNA, 19 bp, Homo sapiens
taaatccttgggagtcatt

SEQ ID NO: 2056590 - DNA, 23 bp, Homo sapiens
taaatccttgggagtcattacca

SEQ ID NO: 2056591 - DNA, 14 bp, Homo sapiens
taaatctctaatat

SEQ ID NO: 2056592 - DNA, 15 bp, Homo sapiens
taaatctctaatatg

SEQ ID NO: 2056593 - DNA, 18 bp, Homo sapiens
taaatctctaatatggca

SEQ ID NO: 2056594 - DNA, 23 bp, Homo sapiens
taaatctgagatctccctccagg

SEQ ID NO: 2056595 - DNA, 12 bp, Homo sapiens
taaatcttcctt

SEQ ID NO: 2056596 - DNA, 14 bp, Homo sapiens
taaatcttccttgt

SEQ ID NO: 2056597 - DNA, 18 bp, Homo sapiens
taaatcttccttgtgagg

SEQ ID NO: 2056598 - DNA, 19 bp, Homo sapiens
taaatcttttataggattt

SEQ ID NO: 2056599 - DNA, 23 bp, Homo sapiens
taaatcttttataggatttattt

SEQ ID NO: 2056600 - DNA, 20 bp, Homo sapiens
taaatgaaaatgtaactttt

SEQ ID NO: 2056601 - DNA, 16 bp, Homo sapiens
taaatgaatcttactc

SEQ ID NO: 2056602 - DNA, 15 bp, Homo sapiens
taaatgacctcagca

SEQ ID NO: 2056603 - DNA, 18 bp, Homo sapiens
taaatgcaatatgtatta

SEQ ID NO: 2056604 - DNA, 16 bp, Homo sapiens
taaatgcatgatttta

SEQ ID NO: 2056605 - DNA, 23 bp, Homo sapiens
taaatgcatgattttatacatag

SEQ ID NO: 2056606 - DNA, 18 bp, Homo sapiens
taaatgccaactggtcac

SEQ ID NO: 2056607 - DNA, 15 bp, Homo sapiens
taaatgccctctctg

SEQ ID NO: 2056608 - DNA, 14 bp, Homo sapiens
taaatgcctaataa

SEQ ID NO: 2056609 - DNA, 14 bp, Homo sapiens
taaatgctgaatga

SEQ ID NO: 2056610 - DNA, 21 bp, Homo sapiens
taaatgctttgtgtgattgaa

SEQ ID NO: 2056611 - DNA, 11 bp, Homo sapiens
taaatggaaat

SEQ ID NO: 2056612 - DNA, 15 bp, Homo sapiens
taaatggagcttgta

SEQ ID NO: 2056613 - DNA, 17 bp, Homo sapiens
taaatggggctcacaaa

SEQ ID NO: 2056614 - DNA, 21 bp, Homo sapiens
taaatggttgtctgggtcaat

SEQ ID NO: 2056615 - DNA, 12 bp, Homo sapiens
taaatgtatata

SEQ ID NO: 2056616 - DNA, 17 bp, Homo sapiens
taaatgtatatacacat

SEQ ID NO: 2056617 - DNA, 12 bp, Homo sapiens
taaatgtctgtt

SEQ ID NO: 2056618 - DNA, 20 bp, Homo sapiens
taaatgtgtggtgctaactg

SEQ ID NO: 2056619 - DNA, 22 bp, Homo sapiens
taaatgtgtggtgctaactgta

SEQ ID NO: 2056620 - DNA, 16 bp, Homo sapiens
taaatgttcaaactgt

SEQ ID NO: 2056621 - DNA, 12 bp, Homo sapiens
taaatgtttaaa

SEQ ID NO: 2056622 - DNA, 21 bp, Homo sapiens
taaatgttttacaagaattgt

SEQ ID NO: 2056623 - DNA, 20 bp, Homo sapiens
taaatgtttttattaacaat

SEQ ID NO: 2056624 - DNA, 13 bp, Homo sapiens
taaattaagacat

SEQ ID NO: 2056625 - DNA, 15 bp, Homo sapiens
taaattaagacatgc

SEQ ID NO: 2056626 - DNA, 22 bp, Homo sapiens
taaattaggaggctcaacaata

SEQ ID NO: 2056627 - DNA, 21 bp, Homo sapiens
taaattatgtttgtactagtt

SEQ ID NO: 2056628 - DNA, 16 bp, Homo sapiens
taaattcaaaccattt

SEQ ID NO: 2056629 - DNA, 17 bp, Homo sapiens
taaattcacaatagaaa

SEQ ID NO: 2056630 - DNA, 22 bp, Homo sapiens
taaattctctctcttgcaggaa

SEQ ID NO: 2056631 - DNA, 12 bp, Homo sapiens
taaattctggaa

SEQ ID NO: 2056632 - DNA, 16 bp, Homo sapiens
taaattctggaaatgt

SEQ ID NO: 2056633 - DNA, 21 bp, Homo sapiens
taaattctttatttctgtcat

SEQ ID NO: 2056634 - DNA, 16 bp, Homo sapiens
taaattgatgttgctg

SEQ ID NO: 2056635 - DNA, 15 bp, Homo sapiens
taaattgctccttga

SEQ ID NO: 2056636 - DNA, 19 bp, Homo sapiens
taaattgtatacattttgt

SEQ ID NO: 2056637 - DNA, 23 bp, Homo sapiens
taaattgtttggcttcctcctga

SEQ ID NO: 2056638 - DNA, 15 bp, Homo sapiens
taaatttatttcaaa

SEQ ID NO: 2056639 - DNA, 17 bp, Homo sapiens
taaatttatttcaaaaa

SEQ ID NO: 2056640 - DNA, 15 bp, Homo sapiens
taaatttattttctt

SEQ ID NO: 2056641 - DNA, 22 bp, Homo sapiens
taaattttagagcataccagta

SEQ ID NO: 2056642 - DNA, 15 bp, Homo sapiens
taaattttgaatgtt

SEQ ID NO: 2056643 - DNA, 17 bp, Homo sapiens
taaattttgtatgaaaa

SEQ ID NO: 2056644 - DNA, 14 bp, Homo sapiens
taaatttttgtcat

SEQ ID NO: 2056645 - DNA, 18 bp, Homo sapiens
taaatttttgtcatttta

SEQ ID NO: 2056646 - DNA, 13 bp, Homo sapiens
taacaaacaaaat

SEQ ID NO: 2056647 - DNA, 20 bp, Homo sapiens
taacaaactacatgtaatcc

SEQ ID NO: 2056648 - DNA, 9 bp, Homo sapiens
taacaacaa

SEQ ID NO: 2056649 - DNA, 17 bp, Homo sapiens
taacaactaatcaagag

SEQ ID NO: 2056650 - DNA, 15 bp, Homo sapiens
taacaagaaaatcaa

SEQ ID NO: 2056651 - DNA, 13 bp, Homo sapiens
taacaagccaccc

SEQ ID NO: 2056652 - DNA, 15 bp, Homo sapiens
taacaagccagattt

SEQ ID NO: 2056653 - DNA, 18 bp, Homo sapiens
taacaattttaatgctat

SEQ ID NO: 2056654 - DNA, 18 bp, Homo sapiens
taacacaagtcctgtgaa

SEQ ID NO: 2056655 - DNA, 14 bp, Homo sapiens
taacactacttaaa

SEQ ID NO: 2056656 - DNA, 19 bp, Homo sapiens
taacactcagaagcctggg

SEQ ID NO: 2056657 - DNA, 13 bp, Homo sapiens
taacagaaccaga

SEQ ID NO: 2056658 - DNA, 15 bp, Homo sapiens
taacagaaccagagg

SEQ ID NO: 2056659 - DNA, 17 bp, Homo sapiens
taacagaaccagagggt

SEQ ID NO: 2056660 - DNA, 17 bp, Homo sapiens
taacagatacagctcgg

SEQ ID NO: 2056661 - DNA, 14 bp, Homo sapiens
taacaggcttctgg

SEQ ID NO: 2056662 - DNA, 19 bp, Homo sapiens
taacagggaaggcaggcag

SEQ ID NO: 2056663 - DNA, 22 bp, Homo sapiens
taacagggaaggcaggcagggc

SEQ ID NO: 2056664 - DNA, 14 bp, Homo sapiens
taacaggtaaccac

SEQ ID NO: 2056665 - DNA, 13 bp, Homo sapiens
taacaggtctcct

SEQ ID NO: 2056666 - DNA, 15 bp, Homo sapiens
taacaggtctcctct

SEQ ID NO: 2056667 - DNA, 19 bp, Homo sapiens
taacagtatttgtacaaat

SEQ ID NO: 2056668 - DNA, 15 bp, Homo sapiens
taacagtcatttaaa

SEQ ID NO: 2056669 - DNA, 12 bp, Homo sapiens
taattttctacc

SEQ ID NO: 2056670 - DNA, 23 bp, Homo sapiens
taattttcttcatgcaatgacat

SEQ ID NO: 2056671 - DNA, 19 bp, Homo sapiens
taattttgtagtagttgat

SEQ ID NO: 2056672 - DNA, 13 bp, Homo sapiens
taatttttgcaat

SEQ ID NO: 2056673 - DNA, 16 bp, Homo sapiens
taattttttaaatgaa

SEQ ID NO: 2056674 - DNA, 19 bp, Homo sapiens
taattttttaaatgaaaat

SEQ ID NO: 2056675 - DNA, 17 bp, Homo sapiens
taattttttattcaagt

SEQ ID NO: 2056676 - DNA, 16 bp, Homo sapiens
taatttttttcaatat

SEQ ID NO: 2056677 - DNA, 16 bp, Homo sapiens
taattttttttaatgt

SEQ ID NO: 2056678 - DNA, 12 bp, Homo sapiens
tacaaaaacaaa

SEQ ID NO: 2056679 - DNA, 13 bp, Homo sapiens
tacaaaaacaaaa

SEQ ID NO: 2056680 - DNA, 21 bp, Homo sapiens
tacaaaaaccaaaaagttaaa

SEQ ID NO: 2056681 - DNA, 13 bp, Homo sapiens
tacaaaaatagta

SEQ ID NO: 2056682 - DNA, 15 bp, Homo sapiens
tacaaaagtaccata

SEQ ID NO: 2056683 - DNA, 17 bp, Homo sapiens
tacaaacatgtggttaa

SEQ ID NO: 2056684 - DNA, 19 bp, Homo sapiens
tacaaactcccacttgtca

SEQ ID NO: 2056685 - DNA, 17 bp, Homo sapiens
tacaaagtagagaagta

SEQ ID NO: 2056686 - DNA, 18 bp, Homo sapiens
tacaaagtagagaagtat

SEQ ID NO: 2056687 - DNA, 19 bp, Homo sapiens
tacaaatactcttaggaag

SEQ ID NO: 2056688 - DNA, 16 bp, Homo sapiens
tacaaatatatttaat

SEQ ID NO: 2056689 - DNA, 20 bp, Homo sapiens
tacaaattttcttttgaaag

SEQ ID NO: 2056690 - DNA, 17 bp, Homo sapiens
tacaaatttttcctgca

SEQ ID NO: 2056691 - DNA, 18 bp, Homo sapiens
tacaaatttttcctgcaa

SEQ ID NO: 2056692 - DNA, 14 bp, Homo sapiens
tacaacaagaacaa

SEQ ID NO: 2056693 - DNA, 18 bp, Homo sapiens
tacaacaagaacaacaac

SEQ ID NO: 2056694 - DNA, 22 bp, Homo sapiens
tacaacaagagtttatttccaa

SEQ ID NO: 2056695 - DNA, 15 bp, Homo sapiens
tacaacacaaagaga

SEQ ID NO: 2056696 - DNA, 15 bp, Homo sapiens
tacaagcatatttga

SEQ ID NO: 2056697 - DNA, 18 bp, Homo sapiens
tacaagcatatttgagaa

SEQ ID NO: 2056698 - DNA, 16 bp, Homo sapiens
tacaaggatcagaatg

SEQ ID NO: 2056699 - DNA, 15 bp, Homo sapiens
tacaagtttataagc

SEQ ID NO: 2056700 - DNA, 13 bp, Homo sapiens
tacaagttttgta

SEQ ID NO: 2056701 - DNA, 15 bp, Homo sapiens
tacaagttttgtata

SEQ ID NO: 2056702 - DNA, 16 bp, Homo sapiens
tacaataaatgctgaa

SEQ ID NO: 2056703 - DNA, 19 bp, Homo sapiens
tacaataattaatgtgtgt

SEQ ID NO: 2056704 - DNA, 20 bp, Homo sapiens
tacaataattaatgtgtgtc

SEQ ID NO: 2056705 - DNA, 13 bp, Homo sapiens
tacaatatataaa

SEQ ID NO: 2056706 - DNA, 17 bp, Homo sapiens
tacaatatataaaaata

SEQ ID NO: 2056707 - DNA, 15 bp, Homo sapiens
tacaatgcagaattt

SEQ ID NO: 2056708 - DNA, 14 bp, Homo sapiens
tacaatgtttcaga

SEQ ID NO: 2056709 - DNA, 20 bp, Homo sapiens
tacaattgaacttaaataaa

SEQ ID NO: 2056710 - DNA, 14 bp, Homo sapiens
tacacaagtaaaca

SEQ ID NO: 2056711 - DNA, 15 bp, Homo sapiens
tacacaagtaaacat

SEQ ID NO: 2056712 - DNA, 13 bp, Homo sapiens
tacacacaaaaat

SEQ ID NO: 2056713 - DNA, 15 bp, Homo sapiens
tacacacacagatgt

SEQ ID NO: 2056714 - DNA, 14 bp, Homo sapiens
tacacacatataca

SEQ ID NO: 2056715 - DNA, 17 bp, Homo sapiens
tacacacatatacatat

SEQ ID NO: 2056716 - DNA, 20 bp, Homo sapiens
tacacacatatacatatata

SEQ ID NO: 2056717 - DNA, 18 bp, Homo sapiens
tacacaccttatatttac

SEQ ID NO: 2056718 - DNA, 15 bp, Homo sapiens
tacacagtaaaaact

SEQ ID NO: 2056719 - DNA, 16 bp, Homo sapiens
tacacagtaaaaactt

SEQ ID NO: 2056720 - DNA, 22 bp, Homo sapiens
tacacagtgggaactctgacaa

SEQ ID NO: 2056721 - DNA, 11 bp, Homo sapiens
tacacagttgc

SEQ ID NO: 2056722 - DNA, 13 bp, Homo sapiens
tacacatacatac

SEQ ID NO: 2056723 - DNA, 21 bp, Homo sapiens
tacacatatacctataatgtg

SEQ ID NO: 2056724 - DNA, 15 bp, Homo sapiens
tacacatatatgtat

SEQ ID NO: 2056725 - DNA, 17 bp, Homo sapiens
tacacatatatgtatat

SEQ ID NO: 2056726 - DNA, 21 bp, Homo sapiens
tacacatgtatctatgcattt

SEQ ID NO: 2056727 - DNA, 14 bp, Homo sapiens
tacaccactctggc

SEQ ID NO: 2056728 - DNA, 19 bp, Homo sapiens
tacaccactctggcagcca

SEQ ID NO: 2056729 - DNA, 15 bp, Homo sapiens
tacaccgggcctgga

SEQ ID NO: 2056730 - DNA, 17 bp, Homo sapiens
tacaccgggcctggaga

SEQ ID NO: 2056731 - DNA, 14 bp, Homo sapiens
tacacctatgtcat

SEQ ID NO: 2056732 - DNA, 21 bp, Homo sapiens
tacacctatgtcatttcattt

SEQ ID NO: 2056733 - DNA, 13 bp, Homo sapiens
tacacctccctcc

SEQ ID NO: 2056734 - DNA, 15 bp, Homo sapiens
tacacctgaggctga

SEQ ID NO: 2056735 - DNA, 23 bp, Homo sapiens
tacacctgaggctgaggcaggag

SEQ ID NO: 2056736 - DNA, 16 bp, Homo sapiens
tacactacaagtttat

SEQ ID NO: 2056737 - DNA, 16 bp, Homo sapiens
tacactccagcctgag

SEQ ID NO: 2056738 - DNA, 17 bp, Homo sapiens
tacactccagcctgagc

SEQ ID NO: 2056739 - DNA, 21 bp, Homo sapiens
tacactctctgtacaaaaaca

SEQ ID NO: 2056740 - DNA, 13 bp, Homo sapiens
tacactcttatag

SEQ ID NO: 2056741 - DNA, 20 bp, Homo sapiens
tacactgaagttaacagaga

SEQ ID NO: 2056742 - DNA, 16 bp, Homo sapiens
tacactgtatttgtat

SEQ ID NO: 2056743 - DNA, 11 bp, Homo sapiens
tacactgtgta

SEQ ID NO: 2056744 - DNA, 23 bp, Homo sapiens
tacactttggccaagcaagaggt

SEQ ID NO: 2056745 - DNA, 11 bp, Homo sapiens
tacagacacta

SEQ ID NO: 2056746 - DNA, 14 bp, Homo sapiens
tacagacactaagt

SEQ ID NO: 2056747 - DNA, 17 bp, Homo sapiens
tacagacgtatgcttat

SEQ ID NO: 2056748 - DNA, 18 bp, Homo sapiens
tacagacgtatgcttatt

SEQ ID NO: 2056749 - DNA, 18 bp, Homo sapiens
tacagagaaattctgtgg

SEQ ID NO: 2056750 - DNA, 16 bp, Homo sapiens
tacagagaatctgaag

SEQ ID NO: 2056751 - DNA, 18 bp, Homo sapiens
tacagaggccatgggcct

SEQ ID NO: 2056752 - DNA, 16 bp, Homo sapiens
tacagagtggcccctc

SEQ ID NO: 2056753 - DNA, 13 bp, Homo sapiens
tacagataattta

SEQ ID NO: 2056754 - DNA, 21 bp, Homo sapiens
tacagataatttattttgtat

SEQ ID NO: 2056755 - DNA, 19 bp, Homo sapiens
tacagatagtcaaaccata

SEQ ID NO: 2056756 - DNA, 21 bp, Homo sapiens
tacagcaacaggaatctcaga

SEQ ID NO: 2056757 - DNA, 21 bp, Homo sapiens
tacagcagggtcttgctgtaa

SEQ ID NO: 2056758 - DNA, 15 bp, Homo sapiens
tacagcctcagaaac

SEQ ID NO: 2056759 - DNA, 16 bp, Homo sapiens
tacagcgagaggcaga

SEQ ID NO: 2056760 - DNA, 18 bp, Homo sapiens
tacagctaatcagcattc

SEQ ID NO: 2056761 - DNA, 14 bp, Homo sapiens
tacagctcttggca

SEQ ID NO: 2056762 - DNA, 21 bp, Homo sapiens
tacagctcttggcattttcct

SEQ ID NO: 2056763 - DNA, 14 bp, Homo sapiens
tacagctgcctgca

SEQ ID NO: 2056764 - DNA, 20 bp, Homo sapiens
tacagctttacacacacaga

SEQ ID NO: 2056765 - DNA, 21 bp, Homo sapiens
tacagctttacacacacagat

SEQ ID NO: 2056766 - DNA, 18 bp, Homo sapiens
tacaggaaaagctgctga

SEQ ID NO: 2056767 - DNA, 20 bp, Homo sapiens
tacaggcaaaacacgcaagg

SEQ ID NO: 2056768 - DNA, 13 bp, Homo sapiens
tacaggcaattcc

SEQ ID NO: 2056769 - DNA, 16 bp, Homo sapiens
tacaggcacccaccat

SEQ ID NO: 2056770 - DNA, 22 bp, Homo sapiens
tacagggtagcaggtaccactg

SEQ ID NO: 2056771 - DNA, 13 bp, Homo sapiens
tacagtaaagttt

SEQ ID NO: 2056772 - DNA, 17 bp, Homo sapiens
tacagtaaagtttaaaa

SEQ ID NO: 2056773 - DNA, 20 bp, Homo sapiens
tacagtaaagtttaaaaaat

SEQ ID NO: 2056774 - DNA, 16 bp, Homo sapiens
tacagtaaataaattg

SEQ ID NO: 2056775 - DNA, 21 bp, Homo sapiens
tacagtaaataaattgtttga

SEQ ID NO: 2056776 - DNA, 14 bp, Homo sapiens
tacagtcaatttta

SEQ ID NO: 2056777 - DNA, 14 bp, Homo sapiens
tacagtctaaagct

SEQ ID NO: 2056778 - DNA, 12 bp, Homo sapiens
tacagtgagcca

SEQ ID NO: 2056779 - DNA, 23 bp, Homo sapiens
tacagtgcatccttgaactgtca

SEQ ID NO: 2056780 - DNA, 16 bp, Homo sapiens
tacagtggagaaatat

SEQ ID NO: 2056781 - DNA, 19 bp, Homo sapiens
tacagttatctaagttaat

SEQ ID NO: 2056782 - DNA, 20 bp, Homo sapiens
tacagttatgcatcctgtat

SEQ ID NO: 2056783 - DNA, 20 bp, Homo sapiens
tacagttgttttttgaaaac

SEQ ID NO: 2056784 - DNA, 13 bp, Homo sapiens
tacataaaggtgg

SEQ ID NO: 2056785 - DNA, 20 bp, Homo sapiens
tagaagtggaccaggacagg

SEQ ID NO: 2056786 - DNA, 16 bp, Homo sapiens
tagaagtgggccagga

SEQ ID NO: 2056787 - DNA, 20 bp, Homo sapiens
tagaagtgggccaggacagg

SEQ ID NO: 2056788 - DNA, 22 bp, Homo sapiens
tagaagtgttttaatttctaca

SEQ ID NO: 2056789 - DNA, 14 bp, Homo sapiens
tagaataaaattgt

SEQ ID NO: 2056790 - DNA, 15 bp, Homo sapiens
tagaataaaattgta

SEQ ID NO: 2056791 - DNA, 19 bp, Homo sapiens
tagaataaaattgtaaaat

SEQ ID NO: 2056792 - DNA, 15 bp, Homo sapiens
tagaataaagaaaaa

SEQ ID NO: 2056793 - DNA, 16 bp, Homo sapiens
tagaataaagaaaaac

SEQ ID NO: 2056794 - DNA, 18 bp, Homo sapiens
tagaatataattatcgga

SEQ ID NO: 2056795 - DNA, 12 bp, Homo sapiens
tagaatatttat

SEQ ID NO: 2056796 - DNA, 15 bp, Homo sapiens
tagaatatttattac

SEQ ID NO: 2056797 - DNA, 12 bp, Homo sapiens
tagaatgacagt

SEQ ID NO: 2056798 - DNA, 22 bp, Homo sapiens
tagaatgcacaccaaaaaaata

SEQ ID NO: 2056799 - DNA, 23 bp, Homo sapiens
tagaatggcagctggaatttaag

SEQ ID NO: 2056800 - DNA, 17 bp, Homo sapiens
tagaatgtaaagcttgt

SEQ ID NO: 2056801 - DNA, 21 bp, Homo sapiens
tagaatgttactttggaatga

SEQ ID NO: 2056802 - DNA, 14 bp, Homo sapiens
tagaattatatcta

SEQ ID NO: 2056803 - DNA, 15 bp, Homo sapiens
tagaattatatctaa

SEQ ID NO: 2056804 - DNA, 19 bp, Homo sapiens
tagaattatatctaattta

SEQ ID NO: 2056805 - DNA, 21 bp, Homo sapiens
tagaattatatctaatttata

SEQ ID NO: 2056806 - DNA, 23 bp, Homo sapiens
tagaatttattcaattcctctgg

SEQ ID NO: 2056807 - DNA, 16 bp, Homo sapiens
tagaatttgtattttg

SEQ ID NO: 2056808 - DNA, 16 bp, Homo sapiens
tagaattttaagtgct

SEQ ID NO: 2056809 - DNA, 12 bp, Homo sapiens
tagaattttaga

SEQ ID NO: 2056810 - DNA, 18 bp, Homo sapiens
tagacacccattttcaca

SEQ ID NO: 2056811 - DNA, 15 bp, Homo sapiens
tagacagaagaaaca

SEQ ID NO: 2056812 - DNA, 16 bp, Homo sapiens
tagacagtgctgccct

SEQ ID NO: 2056813 - DNA, 18 bp, Homo sapiens
tagacagtgctgccctgc

SEQ ID NO: 2056814 - DNA, 14 bp, Homo sapiens
tagaccaaaataaa

SEQ ID NO: 2056815 - DNA, 13 bp, Homo sapiens
tagacctcagcct

SEQ ID NO: 2056816 - DNA, 21 bp, Homo sapiens
tagacctcagcctgtgctgcc

SEQ ID NO: 2056817 - DNA, 22 bp, Homo sapiens
tagacctcagcctgtgctgccc

SEQ ID NO: 2056818 - DNA, 24 bp, Homo sapiens
tagactaattaaaatctggaaatc

SEQ ID NO: 2056819 - DNA, 14 bp, Homo sapiens
tagactgaagagac

SEQ ID NO: 2056820 - DNA, 14 bp, Homo sapiens
tagactggacagct

SEQ ID NO: 2056821 - DNA, 21 bp, Homo sapiens
tagactggagtgaggcttcca

SEQ ID NO: 2056822 - DNA, 22 bp, Homo sapiens
tagacttcaagcatggctattt

SEQ ID NO: 2056823 - DNA, 20 bp, Homo sapiens
tagacttcgactcaggatcc

SEQ ID NO: 2056824 - DNA, 22 bp, Homo sapiens
tagagaaggacccggaggggcc

SEQ ID NO: 2056825 - DNA, 19 bp, Homo sapiens
tagagacggggtttcacca

SEQ ID NO: 2056826 - DNA, 17 bp, Homo sapiens
tagagagcagaaataaa

SEQ ID NO: 2056827 - DNA, 13 bp, Homo sapiens
tagagagggggct

SEQ ID NO: 2056828 - DNA, 15 bp, Homo sapiens
tagagagggggctct

SEQ ID NO: 2056829 - DNA, 19 bp, Homo sapiens
tagagatatgcagaaggaa

SEQ ID NO: 2056830 - DNA, 20 bp, Homo sapiens
tagagatatgcagaaggaag

SEQ ID NO: 2056831 - DNA, 12 bp, Homo sapiens
tagagatgtgtg

SEQ ID NO: 2056832 - DNA, 20 bp, Homo sapiens
tagagattaatttgtgtaga

SEQ ID NO: 2056833 - DNA, 20 bp, Homo sapiens
tagagattgccccagagccc

SEQ ID NO: 2056834 - DNA, 17 bp, Homo sapiens
tagagattttcttggca

SEQ ID NO: 2056835 - DNA, 12 bp, Homo sapiens
tagagctcctgt

SEQ ID NO: 2056836 - DNA, 15 bp, Homo sapiens
tagagctcctgtccc

SEQ ID NO: 2056837 - DNA, 12 bp, Homo sapiens
tagagctgggaa

SEQ ID NO: 2056838 - DNA, 17 bp, Homo sapiens
tagagctttcaagtaca

SEQ ID NO: 2056839 - DNA, 23 bp, Homo sapiens
tagagctttctttcacaaaaaag

SEQ ID NO: 2056840 - DNA, 21 bp, Homo sapiens
tagaggcatgaacacacatgg

SEQ ID NO: 2056841 - DNA, 17 bp, Homo sapiens
tagaggcttccttcatt

SEQ ID NO: 2056842 - DNA, 18 bp, Homo sapiens
tagaggcttccttcattt

SEQ ID NO: 2056843 - DNA, 19 bp, Homo sapiens
tagaggcttccttcatttc

SEQ ID NO: 2056844 - DNA, 18 bp, Homo sapiens
tagaggtgggcagctggg

SEQ ID NO: 2056845 - DNA, 19 bp, Homo sapiens
tagaggtgggcagctgggc

SEQ ID NO: 2056846 - DNA, 19 bp, Homo sapiens
tagaggttttgttgtttta

SEQ ID NO: 2056847 - DNA, 22 bp, Homo sapiens
tagagtgcccttaaaataatga

SEQ ID NO: 2056848 - DNA, 18 bp, Homo sapiens
tagagtggcccagaattg

SEQ ID NO: 2056849 - DNA, 16 bp, Homo sapiens
tagataggtaaatacc

SEQ ID NO: 2056850 - DNA, 13 bp, Homo sapiens
tagatagtgcttt

SEQ ID NO: 2056851 - DNA, 22 bp, Homo sapiens
tagatagttaaaagactgcagc

SEQ ID NO: 2056852 - DNA, 14 bp, Homo sapiens
tagatattattcat

SEQ ID NO: 2056853 - DNA, 18 bp, Homo sapiens
tagatccacacacagagg

SEQ ID NO: 2056854 - DNA, 21 bp, Homo sapiens
tagatccatttggacaaaatg

SEQ ID NO: 2056855 - DNA, 22 bp, Homo sapiens
tagatccatttggacaaaatgg

SEQ ID NO: 2056856 - DNA, 17 bp, Homo sapiens
tagatcgcttgagccca

SEQ ID NO: 2056857 - DNA, 19 bp, Homo sapiens
tagatcgcttgagcccagg

SEQ ID NO: 2056858 - DNA, 23 bp, Homo sapiens
tagatctcctatttttcagaatg

SEQ ID NO: 2056859 - DNA, 21 bp, Homo sapiens
tagatctgatggtgagctggg

SEQ ID NO: 2056860 - DNA, 14 bp, Homo sapiens
tagatcttctgaaa

SEQ ID NO: 2056861 - DNA, 15 bp, Homo sapiens
tagatgaactcaact

SEQ ID NO: 2056862 - DNA, 14 bp, Homo sapiens
tagatgctgactgt

SEQ ID NO: 2056863 - DNA, 23 bp, Homo sapiens
tagatgctgactgtactcctccc

SEQ ID NO: 2056864 - DNA, 13 bp, Homo sapiens
tagatggaccagt

SEQ ID NO: 2056865 - DNA, 16 bp, Homo sapiens
tagatgttttacaaat

SEQ ID NO: 2056866 - DNA, 17 bp, Homo sapiens
tagattaatggcactga

SEQ ID NO: 2056867 - DNA, 21 bp, Homo sapiens
tagattaccccctcattgttt

SEQ ID NO: 2056868 - DNA, 16 bp, Homo sapiens
tagattagctctggac

SEQ ID NO: 2056869 - DNA, 15 bp, Homo sapiens
tagattctccaaatg

SEQ ID NO: 2056870 - DNA, 17 bp, Homo sapiens
tagattttatgaaaaac

SEQ ID NO: 2056871 - DNA, 13 bp, Homo sapiens
tagattttctgct

SEQ ID NO: 2056872 - DNA, 14 bp, Homo sapiens
tagcaaagaattga

SEQ ID NO: 2056873 - DNA, 19 bp, Homo sapiens
tagcaaagatatctcatct

SEQ ID NO: 2056874 - DNA, 19 bp, Homo sapiens
tagcaaagcttaaatgcct

SEQ ID NO: 2056875 - DNA, 17 bp, Homo sapiens
tagcaagacacatccct

SEQ ID NO: 2056876 - DNA, 18 bp, Homo sapiens
tagcaagttctagagaag

SEQ ID NO: 2056877 - DNA, 16 bp, Homo sapiens
tagcaattccatcacc

SEQ ID NO: 2056878 - DNA, 16 bp, Homo sapiens
tagcacttgacctttt

SEQ ID NO: 2056879 - DNA, 15 bp, Homo sapiens
tagcagacagtgttt

SEQ ID NO: 2056880 - DNA, 15 bp, Homo sapiens
tagcagagtcattgt

SEQ ID NO: 2056881 - DNA, 14 bp, Homo sapiens
tagcagattttaat

SEQ ID NO: 2056882 - DNA, 11 bp, Homo sapiens
tagcagctgca

SEQ ID NO: 2056883 - DNA, 15 bp, Homo sapiens
tagcaggaaatagtg

SEQ ID NO: 2056884 - DNA, 22 bp, Homo sapiens
tagcaggactgaattgtcccca

SEQ ID NO: 2056885 - DNA, 11 bp, Homo sapiens
tagcagggaaa

SEQ ID NO: 2056886 - DNA, 15 bp, Homo sapiens
tagcaggtggtcctg

SEQ ID NO: 2056887 - DNA, 22 bp, Homo sapiens
tagcaggtggtcctgagacctg

SEQ ID NO: 2056888 - DNA, 23 bp, Homo sapiens
tagcaggtggtcctgagacctga

SEQ ID NO: 2056889 - DNA, 15 bp, Homo sapiens
tagcatacatttata

SEQ ID NO: 2056890 - DNA, 21 bp, Homo sapiens
tagcatacatttataatgttt

SEQ ID NO: 2056891 - DNA, 12 bp, Homo sapiens
tagcatatcaat

SEQ ID NO: 2056892 - DNA, 15 bp, Homo sapiens
tagcatctgctcttc

SEQ ID NO: 2056893 - DNA, 13 bp, Homo sapiens
tagcatcttctgg

SEQ ID NO: 2056894 - DNA, 23 bp, Homo sapiens
tagcatcttctggagtctccagt

SEQ ID NO: 2056895 - DNA, 22 bp, Homo sapiens
tagcatttagtccaatgtcttt

SEQ ID NO: 2056896 - DNA, 16 bp, Homo sapiens
tagcatttcttgatgt

SEQ ID NO: 2056897 - DNA, 16 bp, Homo sapiens
tagccaactcctcctt

SEQ ID NO: 2056898 - DNA, 21 bp, Homo sapiens
tagccaaggtgggctgagccc

SEQ ID NO: 2056899 - DNA, 23 bp, Homo sapiens
tagccaaggtgggctgagccctg

SEQ ID NO: 2056900 - DNA, 22 bp, Homo sapiens
tatagctattactgtctggttt

SEQ ID NO: 2056901 - DNA, 13 bp, Homo sapiens
tatagctattttt

SEQ ID NO: 2056902 - DNA, 19 bp, Homo sapiens
tataggatttatttaaaat

SEQ ID NO: 2056903 - DNA, 14 bp, Homo sapiens
tataggctggagaa

SEQ ID NO: 2056904 - DNA, 16 bp, Homo sapiens
tataggtgctacaaaa

SEQ ID NO: 2056905 - DNA, 20 bp, Homo sapiens
tataggttactcataaggca

SEQ ID NO: 2056906 - DNA, 16 bp, Homo sapiens
tatagtaatgcactct

SEQ ID NO: 2056907 - DNA, 17 bp, Homo sapiens
tatagtagtcaattagt

SEQ ID NO: 2056908 - DNA, 18 bp, Homo sapiens
tatagtagtcaattagta

SEQ ID NO: 2056909 - DNA, 19 bp, Homo sapiens
tatagtagtcaattagtac

SEQ ID NO: 2056910 - DNA, 22 bp, Homo sapiens
tatagtatgatttttacaataa

SEQ ID NO: 2056911 - DNA, 22 bp, Homo sapiens
tatagtcatttattttaaaaaa

SEQ ID NO: 2056912 - DNA, 21 bp, Homo sapiens
tatagtgtaaaataagaatga

SEQ ID NO: 2056913 - DNA, 19 bp, Homo sapiens
tatagtttattgacaataa

SEQ ID NO: 2056914 - DNA, 22 bp, Homo sapiens
tatagtttcagatatatatcat

SEQ ID NO: 2056915 - DNA, 20 bp, Homo sapiens
tatagtttgctttgcttttt

SEQ ID NO: 2056916 - DNA, 18 bp, Homo sapiens
tatagtttttatattaat

SEQ ID NO: 2056917 - DNA, 14 bp, Homo sapiens
tatataaaaatata

SEQ ID NO: 2056918 - DNA, 18 bp, Homo sapiens
tatataaaaatatatata

SEQ ID NO: 2056919 - DNA, 21 bp, Homo sapiens
tatataaaaatatatatagtg

SEQ ID NO: 2056920 - DNA, 14 bp, Homo sapiens
tatataagacaaga

SEQ ID NO: 2056921 - DNA, 21 bp, Homo sapiens
tatataatggtttactgctgt

SEQ ID NO: 2056922 - DNA, 16 bp, Homo sapiens
tatatacaataacata

SEQ ID NO: 2056923 - DNA, 12 bp, Homo sapiens
tatatacacata

SEQ ID NO: 2056924 - DNA, 13 bp, Homo sapiens
tatatacacatat

SEQ ID NO: 2056925 - DNA, 14 bp, Homo sapiens
tatatacacatata

SEQ ID NO: 2056926 - DNA, 16 bp, Homo sapiens
tatatacatatgtaga

SEQ ID NO: 2056927 - DNA, 19 bp, Homo sapiens
tatatacatattataaata

SEQ ID NO: 2056928 - DNA, 16 bp, Homo sapiens
tatatacatgtatagt

SEQ ID NO: 2056929 - DNA, 13 bp, Homo sapiens
tatatacatgtgt

SEQ ID NO: 2056930 - DNA, 16 bp, Homo sapiens
tatatacatgtgtgta

SEQ ID NO: 2056931 - DNA, 18 bp, Homo sapiens
tatatacatgtgtgtata

SEQ ID NO: 2056932 - DNA, 17 bp, Homo sapiens
tatataggttgtgcaaa

SEQ ID NO: 2056933 - DNA, 11 bp, Homo sapiens
tatatagtata

SEQ ID NO: 2056934 - DNA, 14 bp, Homo sapiens
tatatagtatattt

SEQ ID NO: 2056935 - DNA, 12 bp, Homo sapiens
tatatataaata

SEQ ID NO: 2056936 - DNA, 13 bp, Homo sapiens
tatatataaatat

SEQ ID NO: 2056937 - DNA, 13 bp, Homo sapiens
tatatatacacat

SEQ ID NO: 2056938 - DNA, 15 bp, Homo sapiens
tatatatacacatac

SEQ ID NO: 2056939 - DNA, 14 bp, Homo sapiens
tatatatacataca

SEQ ID NO: 2056940 - DNA, 22 bp, Homo sapiens
tatatatacatacacttgtata

SEQ ID NO: 2056941 - DNA, 13 bp, Homo sapiens
tatatatacatat

SEQ ID NO: 2056942 - DNA, 16 bp, Homo sapiens
tatatatacatatgta

SEQ ID NO: 2056943 - DNA, 14 bp, Homo sapiens
tatatatacatgta

SEQ ID NO: 2056944 - DNA, 14 bp, Homo sapiens
tatatatataaata

SEQ ID NO: 2056945 - DNA, 16 bp, Homo sapiens
tatatatatacacata

SEQ ID NO: 2056946 - DNA, 14 bp, Homo sapiens
tatatatatagtaa

SEQ ID NO: 2056947 - DNA, 14 bp, Homo sapiens
tatatatatgtgtg

SEQ ID NO: 2056948 - DNA, 12 bp, Homo sapiens
tatatatcataa

SEQ ID NO: 2056949 - DNA, 22 bp, Homo sapiens
tatatatcatattggtattcac

SEQ ID NO: 2056950 - DNA, 21 bp, Homo sapiens
tatatatctgcttcagtggag

SEQ ID NO: 2056951 - DNA, 18 bp, Homo sapiens
tatatatgccttatgtaa

SEQ ID NO: 2056952 - DNA, 14 bp, Homo sapiens
tatatatggcatat

SEQ ID NO: 2056953 - DNA, 17 bp, Homo sapiens
tatatatgtacagttat

SEQ ID NO: 2056954 - DNA, 22 bp, Homo sapiens
tatatatgtgtatatatacata

SEQ ID NO: 2056955 - DNA, 21 bp, Homo sapiens
tatatattctacacatatatg

SEQ ID NO: 2056956 - DNA, 13 bp, Homo sapiens
tatatatttataa

SEQ ID NO: 2056957 - DNA, 15 bp, Homo sapiens
tatatatttataact

SEQ ID NO: 2056958 - DNA, 20 bp, Homo sapiens
tatatatttgaatatcatta

SEQ ID NO: 2056959 - DNA, 22 bp, Homo sapiens
tatatatttgattgtaaaaaca

SEQ ID NO: 2056960 - DNA, 20 bp, Homo sapiens
tatatatttttggttgtcaa

SEQ ID NO: 2056961 - DNA, 17 bp, Homo sapiens
tatatcaaggatgttct

SEQ ID NO: 2056962 - DNA, 18 bp, Homo sapiens
tatatcaatgtaacaaaa

SEQ ID NO: 2056963 - DNA, 20 bp, Homo sapiens
tatatcatgctttaaagtgt

SEQ ID NO: 2056964 - DNA, 14 bp, Homo sapiens
tatatcccagaaat

SEQ ID NO: 2056965 - DNA, 12 bp, Homo sapiens
tatatctaattt

SEQ ID NO: 2056966 - DNA, 13 bp, Homo sapiens
tatatctaattta

SEQ ID NO: 2056967 - DNA, 14 bp, Homo sapiens
tatatctaatttat

SEQ ID NO: 2056968 - DNA, 19 bp, Homo sapiens
tatatctaatttatacaaa

SEQ ID NO: 2056969 - DNA, 15 bp, Homo sapiens
tatatctgataaaat

SEQ ID NO: 2056970 - DNA, 18 bp, Homo sapiens
tatatctgataaaattgt

SEQ ID NO: 2056971 - DNA, 21 bp, Homo sapiens
tatatctgataaaattgtgat

SEQ ID NO: 2056972 - DNA, 21 bp, Homo sapiens
tatatctggatttttacaaat

SEQ ID NO: 2056973 - DNA, 14 bp, Homo sapiens
tatatctgtggtct

SEQ ID NO: 2056974 - DNA, 18 bp, Homo sapiens
tatatctgtggtcttcaa

SEQ ID NO: 2056975 - DNA, 16 bp, Homo sapiens
tatatgagagaatcac

SEQ ID NO: 2056976 - DNA, 19 bp, Homo sapiens
tatatgagagaatcacaca

SEQ ID NO: 2056977 - DNA, 19 bp, Homo sapiens
tatatgaggacttgtgtct

SEQ ID NO: 2056978 - DNA, 17 bp, Homo sapiens
tatatgatttttatcca

SEQ ID NO: 2056979 - DNA, 15 bp, Homo sapiens
tatatgccttatgta

SEQ ID NO: 2056980 - DNA, 13 bp, Homo sapiens
tatatgtatatct

SEQ ID NO: 2056981 - DNA, 19 bp, Homo sapiens
tatatgtatatctatatct

SEQ ID NO: 2056982 - DNA, 18 bp, Homo sapiens
tatatgtatatgtatata

SEQ ID NO: 2056983 - DNA, 12 bp, Homo sapiens
tatatgtattta

SEQ ID NO: 2056984 - DNA, 13 bp, Homo sapiens
tatatgtgtgtgt

SEQ ID NO: 2056985 - DNA, 14 bp, Homo sapiens
tatatgttgtaata

SEQ ID NO: 2056986 - DNA, 13 bp, Homo sapiens
tatattacctcaa

SEQ ID NO: 2056987 - DNA, 19 bp, Homo sapiens
tatattacctcaaattcct

SEQ ID NO: 2056988 - DNA, 17 bp, Homo sapiens
tatattataataatgtt

SEQ ID NO: 2056989 - DNA, 19 bp, Homo sapiens
tatattatggtgtaatgca

SEQ ID NO: 2056990 - DNA, 22 bp, Homo sapiens
tatattatggtgtaatgcacaa

SEQ ID NO: 2056991 - DNA, 23 bp, Homo sapiens
tatattcagagatgtaccatgtt

SEQ ID NO: 2056992 - DNA, 18 bp, Homo sapiens
tatattccaccattcaca

SEQ ID NO: 2056993 - DNA, 15 bp, Homo sapiens
tatattctggaaaaa

SEQ ID NO: 2056994 - DNA, 22 bp, Homo sapiens
tatattctggaaaaaaaatata

SEQ ID NO: 2056995 - DNA, 13 bp, Homo sapiens
tatattctttaaa

SEQ ID NO: 2056996 - DNA, 14 bp, Homo sapiens
tatattgaaaagat

SEQ ID NO: 2056997 - DNA, 13 bp, Homo sapiens
tatattgaatata

SEQ ID NO: 2056998 - DNA, 19 bp, Homo sapiens
tatattggtaacatccttt

SEQ ID NO: 2056999 - DNA, 14 bp, Homo sapiens
tatattgtatattc

SEQ ID NO: 2057000 - DNA, 17 bp, Homo sapiens
tatattgtatattctgg

SEQ ID NO: 2057001 - DNA, 15 bp, Homo sapiens
tatattgtattaagg

SEQ ID NO: 2057002 - DNA, 19 bp, Homo sapiens
tatattgtcagatattttt

SEQ ID NO: 2057003 - DNA, 21 bp, Homo sapiens
tatattgtcctcccctatttt

SEQ ID NO: 2057004 - DNA, 22 bp, Homo sapiens
tatattgtcctcccctatttta

SEQ ID NO: 2057005 - DNA, 21 bp, Homo sapiens
tatatttaatacctttggaaa

SEQ ID NO: 2057006 - DNA, 13 bp, Homo sapiens
tatatttaattgt

SEQ ID NO: 2057007 - DNA, 12 bp, Homo sapiens
tatatttatact

SEQ ID NO: 2057008 - DNA, 14 bp, Homo sapiens
tatatttatactct

SEQ ID NO: 2057009 - DNA, 17 bp, Homo sapiens
tatatttgaatatcatt

SEQ ID NO: 2057010 - DNA, 16 bp, Homo sapiens
tatatttggaaagaga

SEQ ID NO: 2057011 - DNA, 16 bp, Homo sapiens
tatatttgtgtatgtg

SEQ ID NO: 2057012 - DNA, 18 bp, Homo sapiens
tatatttgtgtatgtgta

SEQ ID NO: 2057013 - DNA, 14 bp, Homo sapiens
tatattttaatttg

SEQ ID NO: 2057014 - DNA, 17 bp, Homo sapiens
tatattttatgatttaa

SEQ ID NO: 2057015 - DNA, 23 bp, Homo sapiens
tatattttcatgacttttccatg

SEQ ID NO: 2057016 - DNA, 14 bp, Homo sapiens
tattgtacctctct

SEQ ID NO: 2057017 - DNA, 15 bp, Homo sapiens
tattgtagcatttct

SEQ ID NO: 2057018 - DNA, 16 bp, Homo sapiens
tattgtataaactatc

SEQ ID NO: 2057019 - DNA, 21 bp, Homo sapiens
tattgtataaactatcagttt

SEQ ID NO: 2057020 - DNA, 12 bp, Homo sapiens
tattgtatgtaa

SEQ ID NO: 2057021 - DNA, 12 bp, Homo sapiens
tattgtattaag

SEQ ID NO: 2057022 - DNA, 16 bp, Homo sapiens
tattgtcagatatttt

SEQ ID NO: 2057023 - DNA, 21 bp, Homo sapiens
tattgtgatctatcaatagtc

SEQ ID NO: 2057024 - DNA, 17 bp, Homo sapiens
tattgtgccaagcgaaa

SEQ ID NO: 2057025 - DNA, 17 bp, Homo sapiens
tattgtgtgttatttaa

SEQ ID NO: 2057026 - DNA, 16 bp, Homo sapiens
tattgtttaaaatcat

SEQ ID NO: 2057027 - DNA, 20 bp, Homo sapiens
tattgtttaaaatcatttct

SEQ ID NO: 2057028 - DNA, 20 bp, Homo sapiens
tattgtttctttaagaaagt

SEQ ID NO: 2057029 - DNA, 17 bp, Homo sapiens
tattgttttatgttcta

SEQ ID NO: 2057030 - DNA, 18 bp, Homo sapiens
tattgttttatgttctag

SEQ ID NO: 2057031 - DNA, 18 bp, Homo sapiens
tatttaaaaaataaaaaa

SEQ ID NO: 2057032 - DNA, 15 bp, Homo sapiens
tatttaaaatagcaa

SEQ ID NO: 2057033 - DNA, 23 bp, Homo sapiens
tatttaaaatagcaaaagaagaa

SEQ ID NO: 2057034 - DNA, 19 bp, Homo sapiens
tatttaaactgttctgtgt

SEQ ID NO: 2057035 - DNA, 14 bp, Homo sapiens
tatttaaatgttga

SEQ ID NO: 2057036 - DNA, 21 bp, Homo sapiens
tatttaacttgagggtaataa

SEQ ID NO: 2057037 - DNA, 17 bp, Homo sapiens
tatttaagataattata

SEQ ID NO: 2057038 - DNA, 20 bp, Homo sapiens
tatttaagatagttttgcca

SEQ ID NO: 2057039 - DNA, 13 bp, Homo sapiens
tatttaagccttt

SEQ ID NO: 2057040 - DNA, 17 bp, Homo sapiens
tatttaagtatatagta

SEQ ID NO: 2057041 - DNA, 19 bp, Homo sapiens
tatttaagtatatagtata

SEQ ID NO: 2057042 - DNA, 22 bp, Homo sapiens
tatttaagtttgttgctgtcaa

SEQ ID NO: 2057043 - DNA, 18 bp, Homo sapiens
tatttaatagcaaagaat

SEQ ID NO: 2057044 - DNA, 19 bp, Homo sapiens
tatttaattgtgtcatatt

SEQ ID NO: 2057045 - DNA, 17 bp, Homo sapiens
tatttaatttttacatg

SEQ ID NO: 2057046 - DNA, 16 bp, Homo sapiens
tatttaatttttgcaa

SEQ ID NO: 2057047 - DNA, 14 bp, Homo sapiens
tatttacatatgaa

SEQ ID NO: 2057048 - DNA, 16 bp, Homo sapiens
tatttacatatgaaat

SEQ ID NO: 2057049 - DNA, 14 bp, Homo sapiens
tatttactaaaaga

SEQ ID NO: 2057050 - DNA, 15 bp, Homo sapiens
tatttactaaaagaa

SEQ ID NO: 2057051 - DNA, 22 bp, Homo sapiens
tatttactgagcttctctgtga

SEQ ID NO: 2057052 - DNA, 16 bp, Homo sapiens
tatttacttgtagaaa

SEQ ID NO: 2057053 - DNA, 13 bp, Homo sapiens
tatttagaatata

SEQ ID NO: 2057054 - DNA, 16 bp, Homo sapiens
tatttagaccctgttt

SEQ ID NO: 2057055 - DNA, 20 bp, Homo sapiens
tatttagttatagtttcaga

SEQ ID NO: 2057056 - DNA, 16 bp, Homo sapiens
tatttataaatatatt

SEQ ID NO: 2057057 - DNA, 20 bp, Homo sapiens
tatttataactcatcataaa

SEQ ID NO: 2057058 - DNA, 15 bp, Homo sapiens
tatttatactctaga

SEQ ID NO: 2057059 - DNA, 23 bp, Homo sapiens
tatttatactctagaacatgcac

SEQ ID NO: 2057060 - DNA, 18 bp, Homo sapiens
tatttatagcaatccatg

SEQ ID NO: 2057061 - DNA, 14 bp, Homo sapiens
tatttatatatatt

SEQ ID NO: 2057062 - DNA, 23 bp, Homo sapiens
tatttatatatgtatttataaat

SEQ ID NO: 2057063 - DNA, 12 bp, Homo sapiens
tatttatcttta

SEQ ID NO: 2057064 - DNA, 20 bp, Homo sapiens
tatttatgaaaaccatatga

SEQ ID NO: 2057065 - DNA, 20 bp, Homo sapiens
tatttatgcctctgtattta

SEQ ID NO: 2057066 - DNA, 13 bp, Homo sapiens
tatttatggctta

SEQ ID NO: 2057067 - DNA, 16 bp, Homo sapiens
tatttattacctctga

SEQ ID NO: 2057068 - DNA, 16 bp, Homo sapiens
tatttattagctgtaa

SEQ ID NO: 2057069 - DNA, 19 bp, Homo sapiens
tatttattcactgtaagtt

SEQ ID NO: 2057070 - DNA, 21 bp, Homo sapiens
tatttattcagcttcatttgt

SEQ ID NO: 2057071 - DNA, 15 bp, Homo sapiens
tatttattcattcag

SEQ ID NO: 2057072 - DNA, 21 bp, Homo sapiens
tatttattgaagaaacagata

SEQ ID NO: 2057073 - DNA, 14 bp, Homo sapiens
tatttattggggtg

SEQ ID NO: 2057074 - DNA, 12 bp, Homo sapiens
tatttatttaat

SEQ ID NO: 2057075 - DNA, 12 bp, Homo sapiens
tatttcaaatga

SEQ ID NO: 2057076 - DNA, 20 bp, Homo sapiens
tatttcaaatgaacacgtgc

SEQ ID NO: 2057077 - DNA, 20 bp, Homo sapiens
tatttcataaacaacttaat

SEQ ID NO: 2057078 - DNA, 17 bp, Homo sapiens
tatttcatacaaaactg

SEQ ID NO: 2057079 - DNA, 12 bp, Homo sapiens
tatttcatttct

SEQ ID NO: 2057080 - DNA, 11 bp, Homo sapiens
tatttcctgct

SEQ ID NO: 2057081 - DNA, 17 bp, Homo sapiens
tatttctagcagagtga

SEQ ID NO: 2057082 - DNA, 19 bp, Homo sapiens
tatttctcaacaaagcaca

SEQ ID NO: 2057083 - DNA, 17 bp, Homo sapiens
tatttctggcctcagca

SEQ ID NO: 2057084 - DNA, 18 bp, Homo sapiens
tatttctttgtgataaca

SEQ ID NO: 2057085 - DNA, 22 bp, Homo sapiens
tatttctttgtgataacaaaga

SEQ ID NO: 2057086 - DNA, 13 bp, Homo sapiens
tatttgccattca

SEQ ID NO: 2057087 - DNA, 15 bp, Homo sapiens
tatttgcttatttat

SEQ ID NO: 2057088 - DNA, 16 bp, Homo sapiens
tatttgcttatttata

SEQ ID NO: 2057089 - DNA, 12 bp, Homo sapiens
tatttgtatctc

SEQ ID NO: 2057090 - DNA, 22 bp, Homo sapiens
tatttgtatctctgaagcatgt

SEQ ID NO: 2057091 - DNA, 16 bp, Homo sapiens
tatttgtatgtactgt

SEQ ID NO: 2057092 - DNA, 13 bp, Homo sapiens
tatttgtattccc

SEQ ID NO: 2057093 - DNA, 20 bp, Homo sapiens
tatttgttaatggtttgaat

SEQ ID NO: 2057094 - DNA, 13 bp, Homo sapiens
tatttgttttcat

SEQ ID NO: 2057095 - DNA, 19 bp, Homo sapiens
tattttaaaaaatgaaaat

SEQ ID NO: 2057096 - DNA, 17 bp, Homo sapiens
tattttaaaaccatgca

SEQ ID NO: 2057097 - DNA, 19 bp, Homo sapiens
tattttaaaaccatgcagc

SEQ ID NO: 2057098 - DNA, 14 bp, Homo sapiens
tattttaaacaaaa

SEQ ID NO: 2057099 - DNA, 19 bp, Homo sapiens
tattttaaacaaaatagaa

SEQ ID NO: 2057100 - DNA, 12 bp, Homo sapiens
tattttaaagaa

SEQ ID NO: 2057101 - DNA, 14 bp, Homo sapiens
tattttaaagaatt

SEQ ID NO: 2057102 - DNA, 17 bp, Homo sapiens
tattttaagacgtgaat

SEQ ID NO: 2057103 - DNA, 16 bp, Homo sapiens
tattttaatattttgt

SEQ ID NO: 2057104 - DNA, 17 bp, Homo sapiens
tattttaggagacagtc

SEQ ID NO: 2057105 - DNA, 18 bp, Homo sapiens
tattttaggcagggattt

SEQ ID NO: 2057106 - DNA, 14 bp, Homo sapiens
tattttatatgaga

SEQ ID NO: 2057107 - DNA, 15 bp, Homo sapiens
tattttatgtatata

SEQ ID NO: 2057108 - DNA, 13 bp, Homo sapiens
tattttattccct

SEQ ID NO: 2057109 - DNA, 21 bp, Homo sapiens
tattttcatgacttttccatg

SEQ ID NO: 2057110 - DNA, 17 bp, Homo sapiens
tattttcattacaatgg

SEQ ID NO: 2057111 - DNA, 13 bp, Homo sapiens
tattttcgtgcat

SEQ ID NO: 2057112 - DNA, 19 bp, Homo sapiens
tattttcgtgcatttgtga

SEQ ID NO: 2057113 - DNA, 20 bp, Homo sapiens
tattttcgtgcatttgtgag

SEQ ID NO: 2057114 - DNA, 13 bp, Homo sapiens
tattttcttggat

SEQ ID NO: 2057115 - DNA, 18 bp, Homo sapiens
tattttgacataaagttg

SEQ ID NO: 2057116 - DNA, 13 bp, Homo sapiens
tattttgtaaact

SEQ ID NO: 2057117 - DNA, 13 bp, Homo sapiens
tattttgtaataa

SEQ ID NO: 2057118 - DNA, 18 bp, Homo sapiens
tattttgtaataaactct

SEQ ID NO: 2057119 - DNA, 21 bp, Homo sapiens
tattttgtaataaactctcta

SEQ ID NO: 2057120 - DNA, 21 bp, Homo sapiens
tatttttatatttagttatag

SEQ ID NO: 2057121 - DNA, 19 bp, Homo sapiens
tatttttcaaccagcattt

SEQ ID NO: 2057122 - DNA, 14 bp, Homo sapiens
tatttttcatattg

SEQ ID NO: 2057123 - DNA, 14 bp, Homo sapiens
tatttttgtccctg

SEQ ID NO: 2057124 - DNA, 13 bp, Homo sapiens
tattttttaagta

SEQ ID NO: 2057125 - DNA, 21 bp, Homo sapiens
tattttttaagtatttatata

SEQ ID NO: 2057126 - DNA, 12 bp, Homo sapiens
tattttttaatt

SEQ ID NO: 2057127 - DNA, 15 bp, Homo sapiens
tattttttatttcca

SEQ ID NO: 2057128 - DNA, 18 bp, Homo sapiens
tattttttatttccacat

SEQ ID NO: 2057129 - DNA, 14 bp, Homo sapiens
tattttttctacac

SEQ ID NO: 2057130 - DNA, 20 bp, Homo sapiens
tcaaaaaaagggcaataaat

SEQ ID NO: 2057131 - DNA, 23 bp, Homo sapiens
tcaaaaagtctacgctctccttt

SEQ ID NO: 2057132 - DNA, 15 bp, Homo sapiens
tcacaggcaggtcca

SEQ ID NO: 2057133 - DNA, 16 bp, Homo sapiens
tcacaggcaggtccag

SEQ ID NO: 2057134 - DNA, 15 bp, Homo sapiens
tcacagggcagagcc

SEQ ID NO: 2057135 - DNA, 18 bp, Homo sapiens
tcacagggcagagccggg

SEQ ID NO: 2057136 - DNA, 16 bp, Homo sapiens
tcacagggccccagaa

SEQ ID NO: 2057137 - DNA, 15 bp, Homo sapiens
tcacaggggcggggc

SEQ ID NO: 2057138 - DNA, 21 bp, Homo sapiens
tcacaggtgtggtgtaattta

SEQ ID NO: 2057139 - DNA, 17 bp, Homo sapiens
tcacagtacaatgtttc

SEQ ID NO: 2057140 - DNA, 21 bp, Homo sapiens
tcacagtctctttaatcttca

SEQ ID NO: 2057141 - DNA, 17 bp, Homo sapiens
tcacagtgacccttccc

SEQ ID NO: 2057142 - DNA, 18 bp, Homo sapiens
tcacagtgacccttccca

SEQ ID NO: 2057143 - DNA, 14 bp, Homo sapiens
tcacagtgtttgca

SEQ ID NO: 2057144 - DNA, 18 bp, Homo sapiens
tcacagtgtttgcaatgg

SEQ ID NO: 2057145 - DNA, 22 bp, Homo sapiens
tcacagttaccctaaactctct

SEQ ID NO: 2057146 - DNA, 13 bp, Homo sapiens
tcacagttcctcg

SEQ ID NO: 2057147 - DNA, 14 bp, Homo sapiens
tcacagttcctcgc

SEQ ID NO: 2057148 - DNA, 22 bp, Homo sapiens
tcacagttggctggatgaaatt

SEQ ID NO: 2057149 - DNA, 17 bp, Homo sapiens
tcacataatgaatgcta

SEQ ID NO: 2057150 - DNA, 17 bp, Homo sapiens
tcacatagctacccaaa

SEQ ID NO: 2057151 - DNA, 21 bp, Homo sapiens
tcacatataaaagttaaacta

SEQ ID NO: 2057152 - DNA, 20 bp, Homo sapiens
tcacatatacaaaagcaaga

SEQ ID NO: 2057153 - DNA, 19 bp, Homo sapiens
tcacatcaagcatgcaata

SEQ ID NO: 2057154 - DNA, 14 bp, Homo sapiens
tcacatcttatgct

SEQ ID NO: 2057155 - DNA, 16 bp, Homo sapiens
tcacatggcctatgca

SEQ ID NO: 2057156 - DNA, 21 bp, Homo sapiens
tcacatggcctatgcacatat

SEQ ID NO: 2057157 - DNA, 19 bp, Homo sapiens
tcacattaatatttgctga

SEQ ID NO: 2057158 - DNA, 20 bp, Homo sapiens
tcacattaatatttgctgac

SEQ ID NO: 2057159 - DNA, 16 bp, Homo sapiens
tcacattaatggtcta

SEQ ID NO: 2057160 - DNA, 17 bp, Homo sapiens
tcacatttattctgctc

SEQ ID NO: 2057161 - DNA, 18 bp, Homo sapiens
tcacatttgatgtacatg

SEQ ID NO: 2057162 - DNA, 19 bp, Homo sapiens
tcacatttgatgtacatgt

SEQ ID NO: 2057163 - DNA, 17 bp, Homo sapiens
tcacattttgcctttct

SEQ ID NO: 2057164 - DNA, 19 bp, Homo sapiens
tcacatttttacttggtgt

SEQ ID NO: 2057165 - DNA, 19 bp, Homo sapiens
tcaccaaatgatgccactt

SEQ ID NO: 2057166 - DNA, 12 bp, Homo sapiens
tcaccaagctca

SEQ ID NO: 2057167 - DNA, 20 bp, Homo sapiens
tcaccaagctcacagttcct

SEQ ID NO: 2057168 - DNA, 20 bp, Homo sapiens
tcaccaataacttcagagaa

SEQ ID NO: 2057169 - DNA, 22 bp, Homo sapiens
tcaccaataacttcagagaagt

SEQ ID NO: 2057170 - DNA, 23 bp, Homo sapiens
tcaccaatgtacccaccgggcca

SEQ ID NO: 2057171 - DNA, 23 bp, Homo sapiens
tcaccacaccaaacctctcttat

SEQ ID NO: 2057172 - DNA, 15 bp, Homo sapiens
tcaccaccttcccag

SEQ ID NO: 2057173 - DNA, 15 bp, Homo sapiens
tcaccactccattcc

SEQ ID NO: 2057174 - DNA, 21 bp, Homo sapiens
tcaccagcaacatctcgagcc

SEQ ID NO: 2057175 - DNA, 16 bp, Homo sapiens
tcaccagccccagtgc

SEQ ID NO: 2057176 - DNA, 17 bp, Homo sapiens
tcaccagctatctgtca

SEQ ID NO: 2057177 - DNA, 19 bp, Homo sapiens
tcaccagctatctgtcatc

SEQ ID NO: 2057178 - DNA, 20 bp, Homo sapiens
tcaccagctgccaaaatcgt

SEQ ID NO: 2057179 - DNA, 22 bp, Homo sapiens
tcaccaggaatgttaaagtcag

SEQ ID NO: 2057180 - DNA, 17 bp, Homo sapiens
tcaccagtgtcccctcc

SEQ ID NO: 2057181 - DNA, 20 bp, Homo sapiens
tcaccagtgtcccctccact

SEQ ID NO: 2057182 - DNA, 21 bp, Homo sapiens
tcaccagtgtcccctccactg

SEQ ID NO: 2057183 - DNA, 14 bp, Homo sapiens
tcacccacagggct

SEQ ID NO: 2057184 - DNA, 23 bp, Homo sapiens
tcacccaggctctggagccagag

SEQ ID NO: 2057185 - DNA, 14 bp, Homo sapiens
tcaccccccactca

SEQ ID NO: 2057186 - DNA, 20 bp, Homo sapiens
tcaccccctcccacccccag

SEQ ID NO: 2057187 - DNA, 20 bp, Homo sapiens
tcaccctcataccatctgct

SEQ ID NO: 2057188 - DNA, 14 bp, Homo sapiens
tcaccctccacctc

SEQ ID NO: 2057189 - DNA, 12 bp, Homo sapiens
tcaccctggccc

SEQ ID NO: 2057190 - DNA, 21 bp, Homo sapiens
tcaccgagacggctggacctg

SEQ ID NO: 2057191 - DNA, 23 bp, Homo sapiens
tcaccgagagtagccgagagcct

SEQ ID NO: 2057192 - DNA, 14 bp, Homo sapiens
tcaccggagctttc

SEQ ID NO: 2057193 - DNA, 14 bp, Homo sapiens
tcaccggcatgctg

SEQ ID NO: 2057194 - DNA, 16 bp, Homo sapiens
tcaccggcatgctggc

SEQ ID NO: 2057195 - DNA, 18 bp, Homo sapiens
tcaccggcatgctggcct

SEQ ID NO: 2057196 - DNA, 21 bp, Homo sapiens
tcaccggcatgctggcctgtg

SEQ ID NO: 2057197 - DNA, 16 bp, Homo sapiens
tcaccgggatgaacct

SEQ ID NO: 2057198 - DNA, 17 bp, Homo sapiens
tcaccgtggaccttcct

SEQ ID NO: 2057199 - DNA, 20 bp, Homo sapiens
tcacctcctccactcactcc

SEQ ID NO: 2057200 - DNA, 13 bp, Homo sapiens
tcacctctgcctc

SEQ ID NO: 2057201 - DNA, 13 bp, Homo sapiens
tcacctctggctt

SEQ ID NO: 2057202 - DNA, 17 bp, Homo sapiens
tcacctgaggtcgggag

SEQ ID NO: 2057203 - DNA, 13 bp, Homo sapiens
tcacctgcaagcc

SEQ ID NO: 2057204 - DNA, 14 bp, Homo sapiens
tcacctgcaagccc

SEQ ID NO: 2057205 - DNA, 19 bp, Homo sapiens
tcacctggaagcatttgtt

SEQ ID NO: 2057206 - DNA, 13 bp, Homo sapiens
tcacctgggcctt

SEQ ID NO: 2057207 - DNA, 14 bp, Homo sapiens
tcaccttatgtatt

SEQ ID NO: 2057208 - DNA, 16 bp, Homo sapiens
tcaccttatgtattat

SEQ ID NO: 2057209 - DNA, 18 bp, Homo sapiens
tcaccttcaccttcatcc

SEQ ID NO: 2057210 - DNA, 20 bp, Homo sapiens
tcaccttggagcctgaacat

SEQ ID NO: 2057211 - DNA, 23 bp, Homo sapiens
tcacgatgaaattgaacctggtt

SEQ ID NO: 2057212 - DNA, 14 bp, Homo sapiens
tcacgccactgcac

SEQ ID NO: 2057213 - DNA, 16 bp, Homo sapiens
tcacgcccagcctcct

SEQ ID NO: 2057214 - DNA, 23 bp, Homo sapiens
tcacgcccagcctcctcccacca

SEQ ID NO: 2057215 - DNA, 19 bp, Homo sapiens
tcacgcctgtaatcccagc

SEQ ID NO: 2057216 - DNA, 20 bp, Homo sapiens
tcacgcctgtaatcccagca

SEQ ID NO: 2057217 - DNA, 15 bp, Homo sapiens
tcacgctctggacat

SEQ ID NO: 2057218 - DNA, 13 bp, Homo sapiens
tcacggctcactg

SEQ ID NO: 2057219 - DNA, 17 bp, Homo sapiens
tcactaaatcttttata

SEQ ID NO: 2057220 - DNA, 22 bp, Homo sapiens
tcactacgggggggagaaggaa

SEQ ID NO: 2057221 - DNA, 19 bp, Homo sapiens
tcactactcacagtctctt

SEQ ID NO: 2057222 - DNA, 21 bp, Homo sapiens
tcactataaccatcagttact

SEQ ID NO: 2057223 - DNA, 15 bp, Homo sapiens
tcactatgacactga

SEQ ID NO: 2057224 - DNA, 13 bp, Homo sapiens
tcactatgatttt

SEQ ID NO: 2057225 - DNA, 24 bp, Homo sapiens
tcactatgctatttctggcctcag

SEQ ID NO: 2057226 - DNA, 22 bp, Homo sapiens
tcactatggtatgctggccagc

SEQ ID NO: 2057227 - DNA, 17 bp, Homo sapiens
tcactatgttgcccagg

SEQ ID NO: 2057228 - DNA, 21 bp, Homo sapiens
tcactatgttgcccaggcagg

SEQ ID NO: 2057229 - DNA, 19 bp, Homo sapiens
tcactatgttgcccaggct

SEQ ID NO: 2057230 - DNA, 17 bp, Homo sapiens
tcactattcctaggagg

SEQ ID NO: 2057231 - DNA, 23 bp, Homo sapiens
tcactcaaaaaggtgtgtcaaag

SEQ ID NO: 2057232 - DNA, 16 bp, Homo sapiens
tcactcactgtcaatg

SEQ ID NO: 2057233 - DNA, 15 bp, Homo sapiens
tcactccaccaccca

SEQ ID NO: 2057234 - DNA, 19 bp, Homo sapiens
tcactcccagaccacctcc

SEQ ID NO: 2057235 - DNA, 18 bp, Homo sapiens
tcactcccataagctaag

SEQ ID NO: 2057236 - DNA, 17 bp, Homo sapiens
tcactccggtgtgcctg

SEQ ID NO: 2057237 - DNA, 15 bp, Homo sapiens
tcactcctacctggt

SEQ ID NO: 2057238 - DNA, 14 bp, Homo sapiens
tcactctggcctca

SEQ ID NO: 2057239 - DNA, 13 bp, Homo sapiens
tcactctgtcagc

SEQ ID NO: 2057240 - DNA, 16 bp, Homo sapiens
tcactctgtcgcccag

SEQ ID NO: 2057241 - DNA, 23 bp, Homo sapiens
tcactcttattgcccacgctgga

SEQ ID NO: 2057242 - DNA, 17 bp, Homo sapiens
tcactgattgggtgcca

SEQ ID NO: 2057243 - DNA, 23 bp, Homo sapiens
tcactgattgggtgccatgtgga

SEQ ID NO: 2057244 - DNA, 24 bp, Homo sapiens
tcactgattgggtgccatgtggag

SEQ ID NO: 2057245 - DNA, 15 bp, Homo sapiens
tcactgcacaagata

SEQ ID NO: 2057246 - DNA, 22 bp, Homo sapiens
tcagggcgacctgcacgcactg

SEQ ID NO: 2057247 - DNA, 21 bp, Homo sapiens
tcagggctggaaaagtcacac

SEQ ID NO: 2057248 - DNA, 23 bp, Homo sapiens
tcagggctggagtgcgctcttgg

SEQ ID NO: 2057249 - DNA, 22 bp, Homo sapiens
tcagggggcctttaaagactta

SEQ ID NO: 2057250 - DNA, 23 bp, Homo sapiens
tcaggggtcgtcaccacctctcc

SEQ ID NO: 2057251 - DNA, 18 bp, Homo sapiens
tcagggtgggccactctc

SEQ ID NO: 2057252 - DNA, 20 bp, Homo sapiens
tcagggtgggccactctccc

SEQ ID NO: 2057253 - DNA, 16 bp, Homo sapiens
tcagggttggcccctg

SEQ ID NO: 2057254 - DNA, 23 bp, Homo sapiens
tcagggttggcccctgcccggct

SEQ ID NO: 2057255 - DNA, 22 bp, Homo sapiens
tcaggtaacaggcagatacagg

SEQ ID NO: 2057256 - DNA, 13 bp, Homo sapiens
tcaggtaggccct

SEQ ID NO: 2057257 - DNA, 13 bp, Homo sapiens
tcaggtcaataac

SEQ ID NO: 2057258 - DNA, 19 bp, Homo sapiens
tcaggtctcccacgtggga

SEQ ID NO: 2057259 - DNA, 21 bp, Homo sapiens
tcaggtctcccacgtgggaga

SEQ ID NO: 2057260 - DNA, 16 bp, Homo sapiens
tcaggtgactggagcc

SEQ ID NO: 2057261 - DNA, 23 bp, Homo sapiens
tcaggtgatccacccacctcagc

SEQ ID NO: 2057262 - DNA, 14 bp, Homo sapiens
tcaggtgctgccat

SEQ ID NO: 2057263 - DNA, 15 bp, Homo sapiens
tcaggtgctgccatc

SEQ ID NO: 2057264 - DNA, 18 bp, Homo sapiens
tcaggtgcttttgatgtg

SEQ ID NO: 2057265 - DNA, 21 bp, Homo sapiens
tcaggtgcttttgatgtgaaa

SEQ ID NO: 2057266 - DNA, 17 bp, Homo sapiens
tcaggtggggcagcttg

SEQ ID NO: 2057267 - DNA, 20 bp, Homo sapiens
tcagtaatttagaaatcatt

SEQ ID NO: 2057268 - DNA, 19 bp, Homo sapiens
tcagtaggtccaagggcca

SEQ ID NO: 2057269 - DNA, 20 bp, Homo sapiens
tcagtagtttgagaccagcc

SEQ ID NO: 2057270 - DNA, 19 bp, Homo sapiens
tcagtatagcattgaacat

SEQ ID NO: 2057271 - DNA, 16 bp, Homo sapiens
tcagtatgctgtttta

SEQ ID NO: 2057272 - DNA, 19 bp, Homo sapiens
tcagtattttggagaaatt

SEQ ID NO: 2057273 - DNA, 22 bp, Homo sapiens
tcagtattttggagaaattatt

SEQ ID NO: 2057274 - DNA, 14 bp, Homo sapiens
tcagtcatattctt

SEQ ID NO: 2057275 - DNA, 15 bp, Homo sapiens
tcagtccatagcaga

SEQ ID NO: 2057276 - DNA, 21 bp, Homo sapiens
tcagtcccccaccacactgaa

SEQ ID NO: 2057277 - DNA, 16 bp, Homo sapiens
tcagtccgcctggccg

SEQ ID NO: 2057278 - DNA, 12 bp, Homo sapiens
tcagtcctggaa

SEQ ID NO: 2057279 - DNA, 20 bp, Homo sapiens
tcagtcctggtctgctcagg

SEQ ID NO: 2057280 - DNA, 19 bp, Homo sapiens
tcagtctcagaatgtcatt

SEQ ID NO: 2057281 - DNA, 12 bp, Homo sapiens
tcagtctctctc

SEQ ID NO: 2057282 - DNA, 21 bp, Homo sapiens
tcagtctgattcccaagctct

SEQ ID NO: 2057283 - DNA, 22 bp, Homo sapiens
tcagtctgattcccaagctctg

SEQ ID NO: 2057284 - DNA, 14 bp, Homo sapiens
tcagtctgggtgtc

SEQ ID NO: 2057285 - DNA, 11 bp, Homo sapiens
tcagtgacaga

SEQ ID NO: 2057286 - DNA, 21 bp, Homo sapiens
tcagtgcagtgatacatgtac

SEQ ID NO: 2057287 - DNA, 21 bp, Homo sapiens
tcagtgccacttgacattcct

SEQ ID NO: 2057288 - DNA, 22 bp, Homo sapiens
tcagtgcccaccaacatcccat

SEQ ID NO: 2057289 - DNA, 17 bp, Homo sapiens
tcagtgctcggcagtca

SEQ ID NO: 2057290 - DNA, 15 bp, Homo sapiens
tcagtgctgtggcct

SEQ ID NO: 2057291 - DNA, 22 bp, Homo sapiens
tcagtgctgtggcctgggcaag

SEQ ID NO: 2057292 - DNA, 12 bp, Homo sapiens
tcagtggcagct

SEQ ID NO: 2057293 - DNA, 14 bp, Homo sapiens
tcagtggcagctgc

SEQ ID NO: 2057294 - DNA, 15 bp, Homo sapiens
tcagtgggaacgtga

SEQ ID NO: 2057295 - DNA, 19 bp, Homo sapiens
tcagtgggaacgtgactgc

SEQ ID NO: 2057296 - DNA, 22 bp, Homo sapiens
tcagtgggaacgtgactgcccc

SEQ ID NO: 2057297 - DNA, 12 bp, Homo sapiens
tcagtgggagaa

SEQ ID NO: 2057298 - DNA, 14 bp, Homo sapiens
tcagtgggagaaaa

SEQ ID NO: 2057299 - DNA, 21 bp, Homo sapiens
tcagtgtagttaaagggcaga

SEQ ID NO: 2057300 - DNA, 14 bp, Homo sapiens
tcagttactcagcc

SEQ ID NO: 2057301 - DNA, 18 bp, Homo sapiens
tcagttactcagccctgg

SEQ ID NO: 2057302 - DNA, 15 bp, Homo sapiens
tcagttacttacctg

SEQ ID NO: 2057303 - DNA, 17 bp, Homo sapiens
tcagttcaacctggtgg

SEQ ID NO: 2057304 - DNA, 14 bp, Homo sapiens
tcagttcccggagc

SEQ ID NO: 2057305 - DNA, 21 bp, Homo sapiens
tcagttcccggagcacagccc

SEQ ID NO: 2057306 - DNA, 23 bp, Homo sapiens
tcagttcccggagcacagccctg

SEQ ID NO: 2057307 - DNA, 18 bp, Homo sapiens
tcagttgataaaaggaaa

SEQ ID NO: 2057308 - DNA, 14 bp, Homo sapiens
tcagttggctgact

SEQ ID NO: 2057309 - DNA, 23 bp, Homo sapiens
tcagtttccccattgacttgcac

SEQ ID NO: 2057310 - DNA, 15 bp, Homo sapiens
tcagtttgtttactt

SEQ ID NO: 2057311 - DNA, 16 bp, Homo sapiens
tcagttttatcatttt

SEQ ID NO: 2057312 - DNA, 19 bp, Homo sapiens
tcagttttatcattttcaa

SEQ ID NO: 2057313 - DNA, 13 bp, Homo sapiens
tcataaacagcat

SEQ ID NO: 2057314 - DNA, 14 bp, Homo sapiens
tcataaacagcatt

SEQ ID NO: 2057315 - DNA, 22 bp, Homo sapiens
tcataaactgagcctcttttca

SEQ ID NO: 2057316 - DNA, 13 bp, Homo sapiens
tcataaagtatgc

SEQ ID NO: 2057317 - DNA, 12 bp, Homo sapiens
tcataacaatgt

SEQ ID NO: 2057318 - DNA, 13 bp, Homo sapiens
tcataacaatgta

SEQ ID NO: 2057319 - DNA, 20 bp, Homo sapiens
tcataacatctttgaaaaga

SEQ ID NO: 2057320 - DNA, 14 bp, Homo sapiens
tcataacttgctga

SEQ ID NO: 2057321 - DNA, 23 bp, Homo sapiens
tcataagttggaccagaggaagc

SEQ ID NO: 2057322 - DNA, 16 bp, Homo sapiens
tcataattagaacaat

SEQ ID NO: 2057323 - DNA, 18 bp, Homo sapiens
tcataattagaacaatag

SEQ ID NO: 2057324 - DNA, 19 bp, Homo sapiens
tcataattagaacaatagc

SEQ ID NO: 2057325 - DNA, 15 bp, Homo sapiens
tcataattttcaaga

SEQ ID NO: 2057326 - DNA, 20 bp, Homo sapiens
tcataattttcaagagaaga

SEQ ID NO: 2057327 - DNA, 15 bp, Homo sapiens
tcataccacaataaa

SEQ ID NO: 2057328 - DNA, 18 bp, Homo sapiens
tcatacctatcatcttaa

SEQ ID NO: 2057329 - DNA, 22 bp, Homo sapiens
tcatactaccggctacatcaaa

SEQ ID NO: 2057330 - DNA, 20 bp, Homo sapiens
tcatagaaatacctcattcg

SEQ ID NO: 2057331 - DNA, 13 bp, Homo sapiens
tcatagaaatgta

SEQ ID NO: 2057332 - DNA, 22 bp, Homo sapiens
tcatagaaatgtaacttttgta

SEQ ID NO: 2057333 - DNA, 19 bp, Homo sapiens
tcataggcggtcatgtgtg

SEQ ID NO: 2057334 - DNA, 18 bp, Homo sapiens
tcatagtatggtggctgg

SEQ ID NO: 2057335 - DNA, 18 bp, Homo sapiens
tcatataaagtatcatca

SEQ ID NO: 2057336 - DNA, 15 bp, Homo sapiens
tcatataataaatgt

SEQ ID NO: 2057337 - DNA, 14 bp, Homo sapiens
tcatatatatctat

SEQ ID NO: 2057338 - DNA, 13 bp, Homo sapiens
tcatatattcatg

SEQ ID NO: 2057339 - DNA, 15 bp, Homo sapiens
tcatatattcatgta

SEQ ID NO: 2057340 - DNA, 16 bp, Homo sapiens
tcatatattcatgtaa

SEQ ID NO: 2057341 - DNA, 15 bp, Homo sapiens
tcatatcctttgccc

SEQ ID NO: 2057342 - DNA, 18 bp, Homo sapiens
tcatatcttcctcatcag

SEQ ID NO: 2057343 - DNA, 15 bp, Homo sapiens
tcatatgaatgttct

SEQ ID NO: 2057344 - DNA, 18 bp, Homo sapiens
tcatatgacatgccaccc

SEQ ID NO: 2057345 - DNA, 20 bp, Homo sapiens
tcatatgacatgccaccctc

SEQ ID NO: 2057346 - DNA, 21 bp, Homo sapiens
tcatatgtaccatgtacatga

SEQ ID NO: 2057347 - DNA, 13 bp, Homo sapiens
tcatattgtatgt

SEQ ID NO: 2057348 - DNA, 22 bp, Homo sapiens
tcatattgtgccaatatgtatt

SEQ ID NO: 2057349 - DNA, 23 bp, Homo sapiens
tcatattttgtatatatctgctt

SEQ ID NO: 2057350 - DNA, 16 bp, Homo sapiens
tcatcaacaaagaaat

SEQ ID NO: 2057351 - DNA, 18 bp, Homo sapiens
tcatcaacaaagaaatat

SEQ ID NO: 2057352 - DNA, 21 bp, Homo sapiens
tcatcaatttaaaatcattca

SEQ ID NO: 2057353 - DNA, 16 bp, Homo sapiens
tcatcaatttttatac

SEQ ID NO: 2057354 - DNA, 17 bp, Homo sapiens
tcatcaatttttataca

SEQ ID NO: 2057355 - DNA, 18 bp, Homo sapiens
tcatcaatttttatacat

SEQ ID NO: 2057356 - DNA, 12 bp, Homo sapiens
tcatcacccagt

SEQ ID NO: 2057357 - DNA, 15 bp, Homo sapiens
tcatcacccagtcct

SEQ ID NO: 2057358 - DNA, 17 bp, Homo sapiens
tcatcacccagtcctgg

SEQ ID NO: 2057359 - DNA, 20 bp, Homo sapiens
tcatcacccagtcctggcca

SEQ ID NO: 2057360 - DNA, 14 bp, Homo sapiens
tccacgcctcctgg

SEQ ID NO: 2057361 - DNA, 20 bp, Homo sapiens
tccacgcctcctggccagac

SEQ ID NO: 2057362 - DNA, 22 bp, Homo sapiens
tccacggtcagatttgctgttc

SEQ ID NO: 2057363 - DNA, 13 bp, Homo sapiens
tccacggtgcgtg

SEQ ID NO: 2057364 - DNA, 16 bp, Homo sapiens
tccacggtgcgtggct

SEQ ID NO: 2057365 - DNA, 22 bp, Homo sapiens
tccacggtgcgtggctgtggca

SEQ ID NO: 2057366 - DNA, 18 bp, Homo sapiens
tccactactgtgtagact

SEQ ID NO: 2057367 - DNA, 16 bp, Homo sapiens
tccactcactccagcc

SEQ ID NO: 2057368 - DNA, 23 bp, Homo sapiens
tccactccatatttatttaaaca

SEQ ID NO: 2057369 - DNA, 16 bp, Homo sapiens
tccactcccccacctg

SEQ ID NO: 2057370 - DNA, 21 bp, Homo sapiens
tccactctcggggcccttggg

SEQ ID NO: 2057371 - DNA, 13 bp, Homo sapiens
tccactgaggatg

SEQ ID NO: 2057372 - DNA, 20 bp, Homo sapiens
tccactgaggatgtgagcct

SEQ ID NO: 2057373 - DNA, 16 bp, Homo sapiens
tccactgccaaaacaa

SEQ ID NO: 2057374 - DNA, 22 bp, Homo sapiens
tccactgccttcgatacaccgg

SEQ ID NO: 2057375 - DNA, 17 bp, Homo sapiens
tccactggacttgagct

SEQ ID NO: 2057376 - DNA, 21 bp, Homo sapiens
tccactgtgccatgtgccagg

SEQ ID NO: 2057377 - DNA, 12 bp, Homo sapiens
tccactgtgcta

SEQ ID NO: 2057378 - DNA, 20 bp, Homo sapiens
tccactttgttggaaagcag

SEQ ID NO: 2057379 - DNA, 18 bp, Homo sapiens
tccagaaaatataaatgc

SEQ ID NO: 2057380 - DNA, 17 bp, Homo sapiens
tccagaaaatgtgtcag

SEQ ID NO: 2057381 - DNA, 20 bp, Homo sapiens
tccagaacaaacctctatat

SEQ ID NO: 2057382 - DNA, 23 bp, Homo sapiens
tccagaactgaggtcactgggtt

SEQ ID NO: 2057383 - DNA, 16 bp, Homo sapiens
tccagaagaatattca

SEQ ID NO: 2057384 - DNA, 21 bp, Homo sapiens
tccagaagaatattcaggact

SEQ ID NO: 2057385 - DNA, 18 bp, Homo sapiens
tccagaagatgccctcca

SEQ ID NO: 2057386 - DNA, 18 bp, Homo sapiens
tccagaataagtgctgtt

SEQ ID NO: 2057387 - DNA, 24 bp, Homo sapiens
tccagaatccacaaagccgtgcct

SEQ ID NO: 2057388 - DNA, 22 bp, Homo sapiens
tccagaattatgaggcattgag

SEQ ID NO: 2057389 - DNA, 20 bp, Homo sapiens
tccagacatacgaaacacaa

SEQ ID NO: 2057390 - DNA, 12 bp, Homo sapiens
tccagaccacct

SEQ ID NO: 2057391 - DNA, 13 bp, Homo sapiens
tccagaccacctg

SEQ ID NO: 2057392 - DNA, 14 bp, Homo sapiens
tccagaccacctgc

SEQ ID NO: 2057393 - DNA, 16 bp, Homo sapiens
tccagaccacctgcca

SEQ ID NO: 2057394 - DNA, 18 bp, Homo sapiens
tccagaccacctgccagc

SEQ ID NO: 2057395 - DNA, 22 bp, Homo sapiens
tccagaccacctgccagccatc

SEQ ID NO: 2057396 - DNA, 15 bp, Homo sapiens
tccagaccattgtct

SEQ ID NO: 2057397 - DNA, 17 bp, Homo sapiens
tccagaccattgtcttc

SEQ ID NO: 2057398 - DNA, 18 bp, Homo sapiens
tccagaccattgtcttcc

SEQ ID NO: 2057399 - DNA, 20 bp, Homo sapiens
tccagaccattgtcttccaa

SEQ ID NO: 2057400 - DNA, 22 bp, Homo sapiens
tccagaccattgtcttccaacc

SEQ ID NO: 2057401 - DNA, 13 bp, Homo sapiens
tccagacccctgg

SEQ ID NO: 2057402 - DNA, 18 bp, Homo sapiens
tccagacccctggctttt

SEQ ID NO: 2057403 - DNA, 16 bp, Homo sapiens
tccagaccctgcctga

SEQ ID NO: 2057404 - DNA, 19 bp, Homo sapiens
tccagaccctgcctgagcc

SEQ ID NO: 2057405 - DNA, 20 bp, Homo sapiens
tccagaccctgcctgagccc

SEQ ID NO: 2057406 - DNA, 15 bp, Homo sapiens
tccagacctgaagaa

SEQ ID NO: 2057407 - DNA, 23 bp, Homo sapiens
tccagactgcttccaattttctg

SEQ ID NO: 2057408 - DNA, 17 bp, Homo sapiens
tccagagacaggaaaga

SEQ ID NO: 2057409 - DNA, 18 bp, Homo sapiens
tccagagacaggaaagaa

SEQ ID NO: 2057410 - DNA, 19 bp, Homo sapiens
tccagagagaggatgcaga

SEQ ID NO: 2057411 - DNA, 21 bp, Homo sapiens
tccagagagaggatgcagagg

SEQ ID NO: 2057412 - DNA, 15 bp, Homo sapiens
tccagagccagcctg

SEQ ID NO: 2057413 - DNA, 19 bp, Homo sapiens
tccagagccagcctgggac

SEQ ID NO: 2057414 - DNA, 20 bp, Homo sapiens
tccagagccagcctgggact

SEQ ID NO: 2057415 - DNA, 18 bp, Homo sapiens
tccagagcctaagaaaat

SEQ ID NO: 2057416 - DNA, 20 bp, Homo sapiens
tccagagcctaagaaaatca

SEQ ID NO: 2057417 - DNA, 22 bp, Homo sapiens
tccagagtctgagcccccggct

SEQ ID NO: 2057418 - DNA, 11 bp, Homo sapiens
tccagatctgc

SEQ ID NO: 2057419 - DNA, 12 bp, Homo sapiens
tccagatctgca

SEQ ID NO: 2057420 - DNA, 13 bp, Homo sapiens
tccagattcttcc

SEQ ID NO: 2057421 - DNA, 12 bp, Homo sapiens
tccagcagctgc

SEQ ID NO: 2057422 - DNA, 14 bp, Homo sapiens
tccagcatccagcc

SEQ ID NO: 2057423 - DNA, 17 bp, Homo sapiens
tccagcatccagcctgt

SEQ ID NO: 2057424 - DNA, 13 bp, Homo sapiens
tccagcatcctgc

SEQ ID NO: 2057425 - DNA, 22 bp, Homo sapiens
tccagcatttgccattcctgga

SEQ ID NO: 2057426 - DNA, 10 bp, Homo sapiens
tccagccagc

SEQ ID NO: 2057427 - DNA, 13 bp, Homo sapiens
tccagccagcgcc

SEQ ID NO: 2057428 - DNA, 14 bp, Homo sapiens
tccagccagcgcct

SEQ ID NO: 2057429 - DNA, 22 bp, Homo sapiens
tccagccagcgcctccctccac

SEQ ID NO: 2057430 - DNA, 22 bp, Homo sapiens
tccagccagctcctgggcagct

SEQ ID NO: 2057431 - DNA, 21 bp, Homo sapiens
tccagccatcaagagactgag

SEQ ID NO: 2057432 - DNA, 12 bp, Homo sapiens
tccagcccacac

SEQ ID NO: 2057433 - DNA, 14 bp, Homo sapiens
tccagcccacaccc

SEQ ID NO: 2057434 - DNA, 17 bp, Homo sapiens
tccagcccacacccctc

SEQ ID NO: 2057435 - DNA, 18 bp, Homo sapiens
tccagccctgtcccctga

SEQ ID NO: 2057436 - DNA, 16 bp, Homo sapiens
tccagcctctcccggc

SEQ ID NO: 2057437 - DNA, 20 bp, Homo sapiens
tccagcctgggcaacagagc

SEQ ID NO: 2057438 - DNA, 20 bp, Homo sapiens
tccagcctggtttagcctgg

SEQ ID NO: 2057439 - DNA, 14 bp, Homo sapiens
tccagcctgtgtgt

SEQ ID NO: 2057440 - DNA, 17 bp, Homo sapiens
tccagcgcctgccctcc

SEQ ID NO: 2057441 - DNA, 21 bp, Homo sapiens
tccagcgcctgccctccctgg

SEQ ID NO: 2057442 - DNA, 21 bp, Homo sapiens
tccagctatttttatttgttt

SEQ ID NO: 2057443 - DNA, 18 bp, Homo sapiens
tccagctcaccagcccca

SEQ ID NO: 2057444 - DNA, 10 bp, Homo sapiens
tccagctcca

SEQ ID NO: 2057445 - DNA, 14 bp, Homo sapiens
tccagctgcctggg

SEQ ID NO: 2057446 - DNA, 20 bp, Homo sapiens
tccagctggaattgctgctc

SEQ ID NO: 2057447 - DNA, 24 bp, Homo sapiens
tccagctggaattgctgctctctg

SEQ ID NO: 2057448 - DNA, 16 bp, Homo sapiens
tccaggaaaactgttt

SEQ ID NO: 2057449 - DNA, 19 bp, Homo sapiens
tccaggaaggcagctgctc

SEQ ID NO: 2057450 - DNA, 23 bp, Homo sapiens
tccaggaaggcagctgctcttag

SEQ ID NO: 2057451 - DNA, 15 bp, Homo sapiens
tccaggacatgatac

SEQ ID NO: 2057452 - DNA, 19 bp, Homo sapiens
tccaggagcacacggccct

SEQ ID NO: 2057453 - DNA, 14 bp, Homo sapiens
tccaggagcctggc

SEQ ID NO: 2057454 - DNA, 15 bp, Homo sapiens
tccaggagcctgtgc

SEQ ID NO: 2057455 - DNA, 14 bp, Homo sapiens
tccaggatcctgca

SEQ ID NO: 2057456 - DNA, 15 bp, Homo sapiens
tccaggatcctgcag

SEQ ID NO: 2057457 - DNA, 16 bp, Homo sapiens
tccaggatcctgcagg

SEQ ID NO: 2057458 - DNA, 17 bp, Homo sapiens
tccaggatcctgcagga

SEQ ID NO: 2057459 - DNA, 19 bp, Homo sapiens
tccaggatcctgcaggaac

SEQ ID NO: 2057460 - DNA, 15 bp, Homo sapiens
tccaggattccaaag

SEQ ID NO: 2057461 - DNA, 16 bp, Homo sapiens
tccaggattccaaagt

SEQ ID NO: 2057462 - DNA, 22 bp, Homo sapiens
tccaggcagagacaataaaaca

SEQ ID NO: 2057463 - DNA, 17 bp, Homo sapiens
tccaggcatgctggcct

SEQ ID NO: 2057464 - DNA, 22 bp, Homo sapiens
tccaggccactgtggccagagc

SEQ ID NO: 2057465 - DNA, 17 bp, Homo sapiens
tccaggcccctgaggac

SEQ ID NO: 2057466 - DNA, 18 bp, Homo sapiens
tccaggcccctgaggact

SEQ ID NO: 2057467 - DNA, 20 bp, Homo sapiens
tccaggcccctgaggactgg

SEQ ID NO: 2057468 - DNA, 21 bp, Homo sapiens
tccaggcccctgaggactgga

SEQ ID NO: 2057469 - DNA, 19 bp, Homo sapiens
tccaggctcttcctggacc

SEQ ID NO: 2057470 - DNA, 22 bp, Homo sapiens
tccaggctcttcctggacctga

SEQ ID NO: 2057471 - DNA, 15 bp, Homo sapiens
tccaggctgtttctt

SEQ ID NO: 2057472 - DNA, 13 bp, Homo sapiens
tccagggcagcct

SEQ ID NO: 2057473 - DNA, 14 bp, Homo sapiens
tccagggcagcctc

SEQ ID NO: 2057474 - DNA, 20 bp, Homo sapiens
tccctgggggaagccctgga

SEQ ID NO: 2057475 - DNA, 21 bp, Homo sapiens
tccctggtaataagtactgtg

SEQ ID NO: 2057476 - DNA, 13 bp, Homo sapiens
tccctggtccctt

SEQ ID NO: 2057477 - DNA, 14 bp, Homo sapiens
tccctggtcccttg

SEQ ID NO: 2057478 - DNA, 19 bp, Homo sapiens
tccctggtcccttggagac

SEQ ID NO: 2057479 - DNA, 13 bp, Homo sapiens
tccctggtgcaga

SEQ ID NO: 2057480 - DNA, 16 bp, Homo sapiens
tccctgtagctctgcc

SEQ ID NO: 2057481 - DNA, 18 bp, Homo sapiens
tccctgtagctctgcctc

SEQ ID NO: 2057482 - DNA, 14 bp, Homo sapiens
tccctgtcaccaag

SEQ ID NO: 2057483 - DNA, 15 bp, Homo sapiens
tccctgtcagaggct

SEQ ID NO: 2057484 - DNA, 21 bp, Homo sapiens
tccctgtgggggtggccatcc

SEQ ID NO: 2057485 - DNA, 18 bp, Homo sapiens
tccctgttctcagctccg

SEQ ID NO: 2057486 - DNA, 15 bp, Homo sapiens
tccctgtttaatatt

SEQ ID NO: 2057487 - DNA, 15 bp, Homo sapiens
tcccttcccctgcct

SEQ ID NO: 2057488 - DNA, 16 bp, Homo sapiens
tcccttcccctgcctg

SEQ ID NO: 2057489 - DNA, 17 bp, Homo sapiens
tcccttcccctgcctgg

SEQ ID NO: 2057490 - DNA, 15 bp, Homo sapiens
tcccttcctggcctc

SEQ ID NO: 2057491 - DNA, 14 bp, Homo sapiens
tcccttctatgcag

SEQ ID NO: 2057492 - DNA, 17 bp, Homo sapiens
tcccttctttttcttct

SEQ ID NO: 2057493 - DNA, 16 bp, Homo sapiens
tcccttgagacctcag

SEQ ID NO: 2057494 - DNA, 19 bp, Homo sapiens
tcccttgagacctcagcca

SEQ ID NO: 2057495 - DNA, 19 bp, Homo sapiens
tcccttggaaagttcagcc

SEQ ID NO: 2057496 - DNA, 21 bp, Homo sapiens
tcccttggaaagttcagccag

SEQ ID NO: 2057497 - DNA, 22 bp, Homo sapiens
tccctttcccatccataaggtg

SEQ ID NO: 2057498 - DNA, 21 bp, Homo sapiens
tccctttcccatgatccagaa

SEQ ID NO: 2057499 - DNA, 13 bp, Homo sapiens
tccctttctcttc

SEQ ID NO: 2057500 - DNA, 20 bp, Homo sapiens
tcccttttgcataagattaa

SEQ ID NO: 2057501 - DNA, 21 bp, Homo sapiens
tccgaaagggacttggaagct

SEQ ID NO: 2057502 - DNA, 15 bp, Homo sapiens
tccgatgacagtgct

SEQ ID NO: 2057503 - DNA, 20 bp, Homo sapiens
tccgcaccagctgctctgcc

SEQ ID NO: 2057504 - DNA, 13 bp, Homo sapiens
tccgcacttggaa

SEQ ID NO: 2057505 - DNA, 19 bp, Homo sapiens
tccgcaggctatttgttca

SEQ ID NO: 2057506 - DNA, 16 bp, Homo sapiens
tccgccacgaggagct

SEQ ID NO: 2057507 - DNA, 14 bp, Homo sapiens
tccgccccagacac

SEQ ID NO: 2057508 - DNA, 21 bp, Homo sapiens
tccgcctggccggctccagtt

SEQ ID NO: 2057509 - DNA, 17 bp, Homo sapiens
tccgccttcactccggt

SEQ ID NO: 2057510 - DNA, 20 bp, Homo sapiens
tccgctaagacctccccacc

SEQ ID NO: 2057511 - DNA, 22 bp, Homo sapiens
tccgctaagacctccccacccc

SEQ ID NO: 2057512 - DNA, 23 bp, Homo sapiens
tccgctgccaccacgtctgccag

SEQ ID NO: 2057513 - DNA, 16 bp, Homo sapiens
tccgctttcatgaaca

SEQ ID NO: 2057514 - DNA, 20 bp, Homo sapiens
tccgctttctacccagcgag

SEQ ID NO: 2057515 - DNA, 21 bp, Homo sapiens
tccggaggggttgcgggggag

SEQ ID NO: 2057516 - DNA, 15 bp, Homo sapiens
tccgggacgcttcca

SEQ ID NO: 2057517 - DNA, 16 bp, Homo sapiens
tccgggacgcttccag

SEQ ID NO: 2057518 - DNA, 17 bp, Homo sapiens
tccgggacgcttccaga

SEQ ID NO: 2057519 - DNA, 24 bp, Homo sapiens
tccgggatccccagcctactgcct

SEQ ID NO: 2057520 - DNA, 14 bp, Homo sapiens
tccggggtctgtgc

SEQ ID NO: 2057521 - DNA, 20 bp, Homo sapiens
tccggggtctgtgctgtgcc

SEQ ID NO: 2057522 - DNA, 16 bp, Homo sapiens
tccgggtgccattccc

SEQ ID NO: 2057523 - DNA, 19 bp, Homo sapiens
tccgggtgtggcctcagcc

SEQ ID NO: 2057524 - DNA, 13 bp, Homo sapiens
tccgtaaaaatga

SEQ ID NO: 2057525 - DNA, 14 bp, Homo sapiens
tccgtagttccctg

SEQ ID NO: 2057526 - DNA, 16 bp, Homo sapiens
tccgtcaaaacagatt

SEQ ID NO: 2057527 - DNA, 23 bp, Homo sapiens
tccgtcaaaacagattgtttgca

SEQ ID NO: 2057528 - DNA, 13 bp, Homo sapiens
tccgtccacccag

SEQ ID NO: 2057529 - DNA, 15 bp, Homo sapiens
tccgtccacccaggc

SEQ ID NO: 2057530 - DNA, 16 bp, Homo sapiens
tccgtcccaaacagag

SEQ ID NO: 2057531 - DNA, 16 bp, Homo sapiens
tccgtttatgggcctt

SEQ ID NO: 2057532 - DNA, 18 bp, Homo sapiens
tccgtttatgggccttgc

SEQ ID NO: 2057533 - DNA, 15 bp, Homo sapiens
tcctaaatttcagta

SEQ ID NO: 2057534 - DNA, 14 bp, Homo sapiens
tcctaactgagaat

SEQ ID NO: 2057535 - DNA, 17 bp, Homo sapiens
tcctaagcagctgggac

SEQ ID NO: 2057536 - DNA, 13 bp, Homo sapiens
tcctaagcctgtt

SEQ ID NO: 2057537 - DNA, 18 bp, Homo sapiens
tcctaaggacacactaat

SEQ ID NO: 2057538 - DNA, 22 bp, Homo sapiens
tcctaagtgggaagtgaagccc

SEQ ID NO: 2057539 - DNA, 17 bp, Homo sapiens
tcctacacccttggact

SEQ ID NO: 2057540 - DNA, 20 bp, Homo sapiens
tcctacacccttggacttga

SEQ ID NO: 2057541 - DNA, 22 bp, Homo sapiens
tcctacagaaatactgctctga

SEQ ID NO: 2057542 - DNA, 23 bp, Homo sapiens
tcctacagaaatactgctctgaa

SEQ ID NO: 2057543 - DNA, 14 bp, Homo sapiens
tcctacagcctcag

SEQ ID NO: 2057544 - DNA, 17 bp, Homo sapiens
tcctaccaatgcatgca

SEQ ID NO: 2057545 - DNA, 21 bp, Homo sapiens
tcctaccaatgcatgcagcca

SEQ ID NO: 2057546 - DNA, 15 bp, Homo sapiens
tcctacccaaccact

SEQ ID NO: 2057547 - DNA, 12 bp, Homo sapiens
tcctacctcagc

SEQ ID NO: 2057548 - DNA, 16 bp, Homo sapiens
tcctacctcagcctag

SEQ ID NO: 2057549 - DNA, 15 bp, Homo sapiens
tcctacctgctgctg

SEQ ID NO: 2057550 - DNA, 16 bp, Homo sapiens
tcctacctgctgctgc

SEQ ID NO: 2057551 - DNA, 18 bp, Homo sapiens
tcctacctgctgctgcta

SEQ ID NO: 2057552 - DNA, 20 bp, Homo sapiens
tcctacctgctgctgctatt

SEQ ID NO: 2057553 - DNA, 19 bp, Homo sapiens
tcctactactttgtgtttt

SEQ ID NO: 2057554 - DNA, 19 bp, Homo sapiens
tcctagaaccaagcttcag

SEQ ID NO: 2057555 - DNA, 20 bp, Homo sapiens
tcctagaaccaagcttcaga

SEQ ID NO: 2057556 - DNA, 21 bp, Homo sapiens
tcctagaaccaagcttcagag

SEQ ID NO: 2057557 - DNA, 19 bp, Homo sapiens
tcctagagagcagaaataa

SEQ ID NO: 2057558 - DNA, 21 bp, Homo sapiens
tcctagagagcagaaataaaa

SEQ ID NO: 2057559 - DNA, 16 bp, Homo sapiens
tcctagagctcctgtc

SEQ ID NO: 2057560 - DNA, 21 bp, Homo sapiens
tcctagagctcctgtccctac

SEQ ID NO: 2057561 - DNA, 14 bp, Homo sapiens
tcctagaggacctg

SEQ ID NO: 2057562 - DNA, 16 bp, Homo sapiens
tcctagtttgacctca

SEQ ID NO: 2057563 - DNA, 14 bp, Homo sapiens
tcctataaggagag

SEQ ID NO: 2057564 - DNA, 19 bp, Homo sapiens
tcctataccatatgtctgc

SEQ ID NO: 2057565 - DNA, 18 bp, Homo sapiens
tcctatatagtttattga

SEQ ID NO: 2057566 - DNA, 20 bp, Homo sapiens
tcctatcaagccagtacgtg

SEQ ID NO: 2057567 - DNA, 12 bp, Homo sapiens
tcctatgtgtga

SEQ ID NO: 2057568 - DNA, 20 bp, Homo sapiens
tcctattaaaacacagcttt

SEQ ID NO: 2057569 - DNA, 14 bp, Homo sapiens
tcctattctcacca

SEQ ID NO: 2057570 - DNA, 16 bp, Homo sapiens
tcctattctcaccagg

SEQ ID NO: 2057571 - DNA, 21 bp, Homo sapiens
tcctattgtgcaatgtaaata

SEQ ID NO: 2057572 - DNA, 15 bp, Homo sapiens
tcctatttcttatag

SEQ ID NO: 2057573 - DNA, 16 bp, Homo sapiens
tcctatttgcactgta

SEQ ID NO: 2057574 - DNA, 20 bp, Homo sapiens
tcctattttaaaaccatgca

SEQ ID NO: 2057575 - DNA, 15 bp, Homo sapiens
tcctatttttcagaa

SEQ ID NO: 2057576 - DNA, 15 bp, Homo sapiens
tcctcacagcctctc

SEQ ID NO: 2057577 - DNA, 18 bp, Homo sapiens
tcctcacagcctctccct

SEQ ID NO: 2057578 - DNA, 21 bp, Homo sapiens
tcctcacaggagcagacagag

SEQ ID NO: 2057579 - DNA, 12 bp, Homo sapiens
tcctcacatagc

SEQ ID NO: 2057580 - DNA, 18 bp, Homo sapiens
tcctcaccaataacttca

SEQ ID NO: 2057581 - DNA, 12 bp, Homo sapiens
tcctcactgccc

SEQ ID NO: 2057582 - DNA, 19 bp, Homo sapiens
tcctcactgccccaccagc

SEQ ID NO: 2057583 - DNA, 22 bp, Homo sapiens
tcctcactgccccaccagccac

SEQ ID NO: 2057584 - DNA, 11 bp, Homo sapiens
tcctcagactg

SEQ ID NO: 2057585 - DNA, 15 bp, Homo sapiens
tcctcagctgccaag

SEQ ID NO: 2057586 - DNA, 16 bp, Homo sapiens
tcctcagggacagaga

SEQ ID NO: 2057587 - DNA, 22 bp, Homo sapiens
tcctcagggacagagacacctg

SEQ ID NO: 2057588 - DNA, 21 bp, Homo sapiens
tcctcaggggtggagaagtgt

SEQ ID NO: 2057589 - DNA, 10 bp, Homo sapiens
tccttcctgc

SEQ ID NO: 2057590 - DNA, 14 bp, Homo sapiens
tccttcctgcccca

SEQ ID NO: 2057591 - DNA, 16 bp, Homo sapiens
tccttcctgtgccctg

SEQ ID NO: 2057592 - DNA, 18 bp, Homo sapiens
tccttcgtgtctctccca

SEQ ID NO: 2057593 - DNA, 14 bp, Homo sapiens
tccttctgcaccca

SEQ ID NO: 2057594 - DNA, 21 bp, Homo sapiens
tccttctgcttctccctggct

SEQ ID NO: 2057595 - DNA, 20 bp, Homo sapiens
tccttctttctcttccctcc

SEQ ID NO: 2057596 - DNA, 16 bp, Homo sapiens
tccttgaaaaaaagtt

SEQ ID NO: 2057597 - DNA, 23 bp, Homo sapiens
tccttgaaaaaaagttgctttgt

SEQ ID NO: 2057598 - DNA, 22 bp, Homo sapiens
tccttgattttagccttctctg

SEQ ID NO: 2057599 - DNA, 23 bp, Homo sapiens
tccttgattttagccttctctgt

SEQ ID NO: 2057600 - DNA, 15 bp, Homo sapiens
tccttgcacccctca

SEQ ID NO: 2057601 - DNA, 20 bp, Homo sapiens
tccttgcacccctcactctg

SEQ ID NO: 2057602 - DNA, 17 bp, Homo sapiens
tccttgcacctgcatcc

SEQ ID NO: 2057603 - DNA, 12 bp, Homo sapiens
tccttgcctggt

SEQ ID NO: 2057604 - DNA, 19 bp, Homo sapiens
tccttgctgtcctaggcca

SEQ ID NO: 2057605 - DNA, 15 bp, Homo sapiens
tccttgctttgctgt

SEQ ID NO: 2057606 - DNA, 14 bp, Homo sapiens
tccttggagagcag

SEQ ID NO: 2057607 - DNA, 19 bp, Homo sapiens
tccttggagagcagctggc

SEQ ID NO: 2057608 - DNA, 20 bp, Homo sapiens
tccttggagagcagctggct

SEQ ID NO: 2057609 - DNA, 16 bp, Homo sapiens
tccttggaggacagtg

SEQ ID NO: 2057610 - DNA, 21 bp, Homo sapiens
tccttggcaggctgatttcta

SEQ ID NO: 2057611 - DNA, 23 bp, Homo sapiens
tccttggcaggctgatttctagg

SEQ ID NO: 2057612 - DNA, 14 bp, Homo sapiens
tccttgggctcctg

SEQ ID NO: 2057613 - DNA, 17 bp, Homo sapiens
tccttgggctcctggct

SEQ ID NO: 2057614 - DNA, 19 bp, Homo sapiens
tccttgggctcctggctgc

SEQ ID NO: 2057615 - DNA, 22 bp, Homo sapiens
tccttgggctcctggctgccag

SEQ ID NO: 2057616 - DNA, 15 bp, Homo sapiens
tccttggtctgctgg

SEQ ID NO: 2057617 - DNA, 21 bp, Homo sapiens
tccttggtgtgaccctctgaa

SEQ ID NO: 2057618 - DNA, 15 bp, Homo sapiens
tccttgtcaccagca

SEQ ID NO: 2057619 - DNA, 22 bp, Homo sapiens
tccttgtcaccagcaacatctc

SEQ ID NO: 2057620 - DNA, 14 bp, Homo sapiens
tccttgtctctcat

SEQ ID NO: 2057621 - DNA, 22 bp, Homo sapiens
tcctttacctaccaccttccct

SEQ ID NO: 2057622 - DNA, 14 bp, Homo sapiens
tcctttaggcagcc

SEQ ID NO: 2057623 - DNA, 17 bp, Homo sapiens
tcctttaggcagcctgc

SEQ ID NO: 2057624 - DNA, 20 bp, Homo sapiens
tcctttcacaaccttctgtg

SEQ ID NO: 2057625 - DNA, 22 bp, Homo sapiens
tcctttcagggaatttcaggaa

SEQ ID NO: 2057626 - DNA, 23 bp, Homo sapiens
tcctttcagggaatttcaggaac

SEQ ID NO: 2057627 - DNA, 12 bp, Homo sapiens
tcctttcctctg

SEQ ID NO: 2057628 - DNA, 17 bp, Homo sapiens
tcctttctccagccagc

SEQ ID NO: 2057629 - DNA, 15 bp, Homo sapiens
tcctttgagaaagaa

SEQ ID NO: 2057630 - DNA, 17 bp, Homo sapiens
tcctttgagaaagaaat

SEQ ID NO: 2057631 - DNA, 18 bp, Homo sapiens
tcctttgagaatgtgatt

SEQ ID NO: 2057632 - DNA, 19 bp, Homo sapiens
tcctttgagaatgtgattc

SEQ ID NO: 2057633 - DNA, 14 bp, Homo sapiens
tcctttgagggcag

SEQ ID NO: 2057634 - DNA, 17 bp, Homo sapiens
tcctttgcactgagggc

SEQ ID NO: 2057635 - DNA, 20 bp, Homo sapiens
tcctttgcactgagggccac

SEQ ID NO: 2057636 - DNA, 20 bp, Homo sapiens
tcctttgccccctgtgccct

SEQ ID NO: 2057637 - DNA, 19 bp, Homo sapiens
tcctttgttattatcctgc

SEQ ID NO: 2057638 - DNA, 19 bp, Homo sapiens
tccttttaaaacacttcca

SEQ ID NO: 2057639 - DNA, 12 bp, Homo sapiens
tccttttatgtt

SEQ ID NO: 2057640 - DNA, 14 bp, Homo sapiens
tccttttattctgt

SEQ ID NO: 2057641 - DNA, 14 bp, Homo sapiens
tccttttgatgggg

SEQ ID NO: 2057642 - DNA, 19 bp, Homo sapiens
tccttttgcaacaagacaa

SEQ ID NO: 2057643 - DNA, 13 bp, Homo sapiens
tccttttgctgtc

SEQ ID NO: 2057644 - DNA, 20 bp, Homo sapiens
tccttttgtccccagggccc

SEQ ID NO: 2057645 - DNA, 19 bp, Homo sapiens
tcgaaaattcatttcacat

SEQ ID NO: 2057646 - DNA, 21 bp, Homo sapiens
tcgaaaattcatttcacatta

SEQ ID NO: 2057647 - DNA, 20 bp, Homo sapiens
tcgaaatgaatttatctgaa

SEQ ID NO: 2057648 - DNA, 12 bp, Homo sapiens
tcgaaccaaggc

SEQ ID NO: 2057649 - DNA, 18 bp, Homo sapiens
tcgaaccaaggcagcctc

SEQ ID NO: 2057650 - DNA, 22 bp, Homo sapiens
tcgaaccaaggcagcctccaga

SEQ ID NO: 2057651 - DNA, 15 bp, Homo sapiens
tcgaagatatacaaa

SEQ ID NO: 2057652 - DNA, 16 bp, Homo sapiens
tcgaagcccttccagt

SEQ ID NO: 2057653 - DNA, 17 bp, Homo sapiens
tcgaatgaaattaactg

SEQ ID NO: 2057654 - DNA, 15 bp, Homo sapiens
tcgacctcactgtca

SEQ ID NO: 2057655 - DNA, 18 bp, Homo sapiens
tcgactttatacagaact

SEQ ID NO: 2057656 - DNA, 18 bp, Homo sapiens
tcgagaccaacctgacca

SEQ ID NO: 2057657 - DNA, 15 bp, Homo sapiens
tcgagaccagcccag

SEQ ID NO: 2057658 - DNA, 17 bp, Homo sapiens
tcgagaccagcctggcc

SEQ ID NO: 2057659 - DNA, 18 bp, Homo sapiens
tcgagaccatcctggccc

SEQ ID NO: 2057660 - DNA, 21 bp, Homo sapiens
tcgagaccatcctggcccctc

SEQ ID NO: 2057661 - DNA, 23 bp, Homo sapiens
tcgagaccatcctggcccctcca

SEQ ID NO: 2057662 - DNA, 16 bp, Homo sapiens
tcgagcccagatggaa

SEQ ID NO: 2057663 - DNA, 14 bp, Homo sapiens
tcgagccccctgga

SEQ ID NO: 2057664 - DNA, 16 bp, Homo sapiens
tcgagcgccctgcaga

SEQ ID NO: 2057665 - DNA, 16 bp, Homo sapiens
tcgaggctgcagtcag

SEQ ID NO: 2057666 - DNA, 14 bp, Homo sapiens
tcgaggtgtcaccc

SEQ ID NO: 2057667 - DNA, 13 bp, Homo sapiens
tcgagtttacttc

SEQ ID NO: 2057668 - DNA, 18 bp, Homo sapiens
tcgagtttacttcatgag

SEQ ID NO: 2057669 - DNA, 21 bp, Homo sapiens
tcgatctgtactgtaattttg

SEQ ID NO: 2057670 - DNA, 12 bp, Homo sapiens
tcgattagactg

SEQ ID NO: 2057671 - DNA, 17 bp, Homo sapiens
tcgcaccttttatacca

SEQ ID NO: 2057672 - DNA, 12 bp, Homo sapiens
tcgcagccaccc

SEQ ID NO: 2057673 - DNA, 16 bp, Homo sapiens
tcgcagccaccctgag

SEQ ID NO: 2057674 - DNA, 20 bp, Homo sapiens
tcgcagccaccctgaggagt

SEQ ID NO: 2057675 - DNA, 21 bp, Homo sapiens
tcgcagccaccctgaggagtc

SEQ ID NO: 2057676 - DNA, 23 bp, Homo sapiens
tcgcagccaccctgaggagtctg

SEQ ID NO: 2057677 - DNA, 12 bp, Homo sapiens
tcgcagcctggc

SEQ ID NO: 2057678 - DNA, 19 bp, Homo sapiens
tcgcaggatccgctgccac

SEQ ID NO: 2057679 - DNA, 17 bp, Homo sapiens
tcgcagtgatagttgac

SEQ ID NO: 2057680 - DNA, 23 bp, Homo sapiens
tcgcccacaagccttactcacct

SEQ ID NO: 2057681 - DNA, 11 bp, Homo sapiens
tcgcccaggag

SEQ ID NO: 2057682 - DNA, 14 bp, Homo sapiens
tcgcccagtctgga

SEQ ID NO: 2057683 - DNA, 23 bp, Homo sapiens
tcgcccagtctggaatgcagtgg

SEQ ID NO: 2057684 - DNA, 11 bp, Homo sapiens
tcgccccaccc

SEQ ID NO: 2057685 - DNA, 14 bp, Homo sapiens
tcgccccacccagg

SEQ ID NO: 2057686 - DNA, 15 bp, Homo sapiens
tcgccccagatcacc

SEQ ID NO: 2057687 - DNA, 18 bp, Homo sapiens
tcgccccagatcaccagc

SEQ ID NO: 2057688 - DNA, 20 bp, Homo sapiens
tcgccccagatcaccagccc

SEQ ID NO: 2057689 - DNA, 12 bp, Homo sapiens
tcgccctaccct

SEQ ID NO: 2057690 - DNA, 16 bp, Homo sapiens
tcgcctaggcctgtga

SEQ ID NO: 2057691 - DNA, 15 bp, Homo sapiens
tcgcctgagcccagg

SEQ ID NO: 2057692 - DNA, 20 bp, Homo sapiens
tcgcctgcccccagcactcc

SEQ ID NO: 2057693 - DNA, 21 bp, Homo sapiens
tcgcctgggcccaggctctgg

SEQ ID NO: 2057694 - DNA, 12 bp, Homo sapiens
tcgcctgtggga

SEQ ID NO: 2057695 - DNA, 18 bp, Homo sapiens
tcgctccccactctgctc

SEQ ID NO: 2057696 - DNA, 19 bp, Homo sapiens
tcgctccctgtagctctgc

SEQ ID NO: 2057697 - DNA, 13 bp, Homo sapiens
tcgctcctgtgtc

SEQ ID NO: 2057698 - DNA, 21 bp, Homo sapiens
tcgctctgctggcctggccgg

SEQ ID NO: 2057699 - DNA, 14 bp, Homo sapiens
tcgctcttgggagt

SEQ ID NO: 2057700 - DNA, 10 bp, Homo sapiens
tcgctgccag

SEQ ID NO: 2057701 - DNA, 11 bp, Homo sapiens
tcgctgccagg

SEQ ID NO: 2057702 - DNA, 13 bp, Homo sapiens
tcgctgccaggac

SEQ ID NO: 2057703 - DNA, 17 bp, Homo sapiens
tcgctgccaggacacct

SEQ ID NO: 2057704 - DNA, 17 bp, Homo sapiens
tctcactcctacctggt

SEQ ID NO: 2057705 - DNA, 18 bp, Homo sapiens
tctcactcctacctggta

SEQ ID NO: 2057706 - DNA, 12 bp, Homo sapiens
tctcactctgtc

SEQ ID NO: 2057707 - DNA, 14 bp, Homo sapiens
tctcactgcccagt

SEQ ID NO: 2057708 - DNA, 14 bp, Homo sapiens
tctcactgttgccc

SEQ ID NO: 2057709 - DNA, 20 bp, Homo sapiens
tctcactgttgcccaggctg

SEQ ID NO: 2057710 - DNA, 14 bp, Homo sapiens
tctcacttatacca

SEQ ID NO: 2057711 - DNA, 15 bp, Homo sapiens
tctcagaacagctga

SEQ ID NO: 2057712 - DNA, 16 bp, Homo sapiens
tctcagaacagctgaa

SEQ ID NO: 2057713 - DNA, 19 bp, Homo sapiens
tctcagaaggtattccttt

SEQ ID NO: 2057714 - DNA, 18 bp, Homo sapiens
tctcagaatgtcattttg

SEQ ID NO: 2057715 - DNA, 14 bp, Homo sapiens
tctcagagacaggt

SEQ ID NO: 2057716 - DNA, 16 bp, Homo sapiens
tctcagatcttgacag

SEQ ID NO: 2057717 - DNA, 22 bp, Homo sapiens
tctcagccccgggcctgcctct

SEQ ID NO: 2057718 - DNA, 13 bp, Homo sapiens
tctcagcctccca

SEQ ID NO: 2057719 - DNA, 14 bp, Homo sapiens
tctcagcctcccaa

SEQ ID NO: 2057720 - DNA, 19 bp, Homo sapiens
tctcagcctcccaacccca

SEQ ID NO: 2057721 - DNA, 11 bp, Homo sapiens
tctcagcttca

SEQ ID NO: 2057722 - DNA, 15 bp, Homo sapiens
tctcaggacacaggc

SEQ ID NO: 2057723 - DNA, 16 bp, Homo sapiens
tctcaggacacaggcc

SEQ ID NO: 2057724 - DNA, 21 bp, Homo sapiens
tctcaggacacaggcctgtgt

SEQ ID NO: 2057725 - DNA, 18 bp, Homo sapiens
tctcaggagcacaggcag

SEQ ID NO: 2057726 - DNA, 15 bp, Homo sapiens
tctcaggagcatggg

SEQ ID NO: 2057727 - DNA, 19 bp, Homo sapiens
tctcaggaggcgcagcccg

SEQ ID NO: 2057728 - DNA, 20 bp, Homo sapiens
tctcaggatcaagaaagtgt

SEQ ID NO: 2057729 - DNA, 15 bp, Homo sapiens
tctcaggtccctgca

SEQ ID NO: 2057730 - DNA, 15 bp, Homo sapiens
tctcaggtgccactc

SEQ ID NO: 2057731 - DNA, 17 bp, Homo sapiens
tctcaggtgccactccc

SEQ ID NO: 2057732 - DNA, 18 bp, Homo sapiens
tctcaggtgccactccct

SEQ ID NO: 2057733 - DNA, 20 bp, Homo sapiens
tctcaggtgccactccctga

SEQ ID NO: 2057734 - DNA, 22 bp, Homo sapiens
tctcaggtgccactccctgagc

SEQ ID NO: 2057735 - DNA, 18 bp, Homo sapiens
tctcagtcggtgtgtaat

SEQ ID NO: 2057736 - DNA, 14 bp, Homo sapiens
tctcagtgctctcc

SEQ ID NO: 2057737 - DNA, 23 bp, Homo sapiens
tctcagtgggacaaaccagagca

SEQ ID NO: 2057738 - DNA, 19 bp, Homo sapiens
tctcagttattcagattga

SEQ ID NO: 2057739 - DNA, 15 bp, Homo sapiens
tctcatacctctgac

SEQ ID NO: 2057740 - DNA, 16 bp, Homo sapiens
tctcataggaaaagta

SEQ ID NO: 2057741 - DNA, 19 bp, Homo sapiens
tctcataggaaaagtacat

SEQ ID NO: 2057742 - DNA, 21 bp, Homo sapiens
tctcataggaaaagtacattt

SEQ ID NO: 2057743 - DNA, 18 bp, Homo sapiens
tctcatatgtagccctca

SEQ ID NO: 2057744 - DNA, 21 bp, Homo sapiens
tctcatcagtgtcctcttgct

SEQ ID NO: 2057745 - DNA, 21 bp, Homo sapiens
tctcatctactcattgtctca

SEQ ID NO: 2057746 - DNA, 19 bp, Homo sapiens
tctcatggaaactggccag

SEQ ID NO: 2057747 - DNA, 16 bp, Homo sapiens
tctcatgtctcagcct

SEQ ID NO: 2057748 - DNA, 18 bp, Homo sapiens
tctcatgtgatcctttta

SEQ ID NO: 2057749 - DNA, 19 bp, Homo sapiens
tctcattccaacagtgagt

SEQ ID NO: 2057750 - DNA, 16 bp, Homo sapiens
tctcattccccaggtg

SEQ ID NO: 2057751 - DNA, 16 bp, Homo sapiens
tctcattctctttctt

SEQ ID NO: 2057752 - DNA, 16 bp, Homo sapiens
tctcatttgtcacaca

SEQ ID NO: 2057753 - DNA, 20 bp, Homo sapiens
tctcattttttaaaaaagct

SEQ ID NO: 2057754 - DNA, 17 bp, Homo sapiens
tctccaaaggggctgct

SEQ ID NO: 2057755 - DNA, 12 bp, Homo sapiens
tctccaaatgag

SEQ ID NO: 2057756 - DNA, 17 bp, Homo sapiens
tctccaacaagttgcct

SEQ ID NO: 2057757 - DNA, 16 bp, Homo sapiens
tctccaaggaccaggt

SEQ ID NO: 2057758 - DNA, 13 bp, Homo sapiens
tctccaattgtaa

SEQ ID NO: 2057759 - DNA, 21 bp, Homo sapiens
tctccaccaactggagcactg

SEQ ID NO: 2057760 - DNA, 18 bp, Homo sapiens
tctccaccctgagcctga

SEQ ID NO: 2057761 - DNA, 13 bp, Homo sapiens
tctccaccctgct

SEQ ID NO: 2057762 - DNA, 15 bp, Homo sapiens
tctccacctcagcct

SEQ ID NO: 2057763 - DNA, 16 bp, Homo sapiens
tctccacctcagcctt

SEQ ID NO: 2057764 - DNA, 17 bp, Homo sapiens
tctccacctcagccttg

SEQ ID NO: 2057765 - DNA, 18 bp, Homo sapiens
tctccacctcagccttgg

SEQ ID NO: 2057766 - DNA, 21 bp, Homo sapiens
tctccactaaatgagctcctg

SEQ ID NO: 2057767 - DNA, 22 bp, Homo sapiens
tctccactaaatgagctcctgc

SEQ ID NO: 2057768 - DNA, 12 bp, Homo sapiens
tctccactccat

SEQ ID NO: 2057769 - DNA, 18 bp, Homo sapiens
tctccactgctctcagcc

SEQ ID NO: 2057770 - DNA, 19 bp, Homo sapiens
tctccactgctctcagcct

SEQ ID NO: 2057771 - DNA, 12 bp, Homo sapiens
tctccagcccac

SEQ ID NO: 2057772 - DNA, 16 bp, Homo sapiens
tctccagcccacaccc

SEQ ID NO: 2057773 - DNA, 19 bp, Homo sapiens
tctccaggatggtgcagga

SEQ ID NO: 2057774 - DNA, 19 bp, Homo sapiens
tctccaggattgaagagca

SEQ ID NO: 2057775 - DNA, 19 bp, Homo sapiens
tctccaggcaccatctccc

SEQ ID NO: 2057776 - DNA, 23 bp, Homo sapiens
tctccaggcacccttctttcctc

SEQ ID NO: 2057777 - DNA, 11 bp, Homo sapiens
tctccaggctg

SEQ ID NO: 2057778 - DNA, 24 bp, Homo sapiens
tctccagggctgcccctgtaggtt

SEQ ID NO: 2057779 - DNA, 18 bp, Homo sapiens
tctccagtggttgctgtt

SEQ ID NO: 2057780 - DNA, 13 bp, Homo sapiens
tctccataatgcc

SEQ ID NO: 2057781 - DNA, 17 bp, Homo sapiens
tctccataatgccactg

SEQ ID NO: 2057782 - DNA, 15 bp, Homo sapiens
tctccatatgttaca

SEQ ID NO: 2057783 - DNA, 17 bp, Homo sapiens
tctccatctggcagggt

SEQ ID NO: 2057784 - DNA, 22 bp, Homo sapiens
tctccatgtagaataaatgaag

SEQ ID NO: 2057785 - DNA, 21 bp, Homo sapiens
tctccatttcacacaggtcct

SEQ ID NO: 2057786 - DNA, 22 bp, Homo sapiens
tctccatttcacacaggtcctg

SEQ ID NO: 2057787 - DNA, 15 bp, Homo sapiens
tctcccacgtgggag

SEQ ID NO: 2057788 - DNA, 16 bp, Homo sapiens
tctcccacgtgggaga

SEQ ID NO: 2057789 - DNA, 13 bp, Homo sapiens
tctcccaggcccc

SEQ ID NO: 2057790 - DNA, 20 bp, Homo sapiens
tctccccaggcctccagcct

SEQ ID NO: 2057791 - DNA, 19 bp, Homo sapiens
tctcccccgacactgctgc

SEQ ID NO: 2057792 - DNA, 12 bp, Homo sapiens
tctccccctggg

SEQ ID NO: 2057793 - DNA, 13 bp, Homo sapiens
tctccccctgggc

SEQ ID NO: 2057794 - DNA, 20 bp, Homo sapiens
tctccccctgggctctgccc

SEQ ID NO: 2057795 - DNA, 13 bp, Homo sapiens
tctcccctccctc

SEQ ID NO: 2057796 - DNA, 22 bp, Homo sapiens
tctcccctccctcttccttccc

SEQ ID NO: 2057797 - DNA, 17 bp, Homo sapiens
tctcccctctgccctgt

SEQ ID NO: 2057798 - DNA, 18 bp, Homo sapiens
tctcccctctgccctgta

SEQ ID NO: 2057799 - DNA, 15 bp, Homo sapiens
tctcccctgccctgc

SEQ ID NO: 2057800 - DNA, 15 bp, Homo sapiens
tctccctaaaataaa

SEQ ID NO: 2057801 - DNA, 12 bp, Homo sapiens
tctccctccagc

SEQ ID NO: 2057802 - DNA, 15 bp, Homo sapiens
tctccctctcctgcc

SEQ ID NO: 2057803 - DNA, 16 bp, Homo sapiens
tctccctctcctgcct

SEQ ID NO: 2057804 - DNA, 18 bp, Homo sapiens
tctccctctcctgcctac

SEQ ID NO: 2057805 - DNA, 14 bp, Homo sapiens
tctccctctggccc

SEQ ID NO: 2057806 - DNA, 17 bp, Homo sapiens
tctccctctggccctgc

SEQ ID NO: 2057807 - DNA, 12 bp, Homo sapiens
tctccctgccgc

SEQ ID NO: 2057808 - DNA, 13 bp, Homo sapiens
tctccctgccgcc

SEQ ID NO: 2057809 - DNA, 15 bp, Homo sapiens
tctccctgccgcctc

SEQ ID NO: 2057810 - DNA, 17 bp, Homo sapiens
tctccgactgctaggga

SEQ ID NO: 2057811 - DNA, 15 bp, Homo sapiens
tctccggggtctgtg

SEQ ID NO: 2057812 - DNA, 16 bp, Homo sapiens
tctccggggtctgtgc

SEQ ID NO: 2057813 - DNA, 20 bp, Homo sapiens
tctccggggtctgtgctgtg

SEQ ID NO: 2057814 - DNA, 22 bp, Homo sapiens
tctccggggtctgtgctgtgcc

SEQ ID NO: 2057815 - DNA, 18 bp, Homo sapiens
tctccgggtgtggcctca

SEQ ID NO: 2057816 - DNA, 23 bp, Homo sapiens
tctccgggtgtggcctcagccct

SEQ ID NO: 2057817 - DNA, 19 bp, Homo sapiens
tctcctaccccacctcatg

SEQ ID NO: 2057818 - DNA, 23 bp, Homo sapiens
tctcctaccccacctcatgcctg

SEQ ID NO: 2057819 - DNA, 22 bp, Homo sapiens
tctgggaggctggtctccctcc

SEQ ID NO: 2057820 - DNA, 13 bp, Homo sapiens
tctgggaggtctc

SEQ ID NO: 2057821 - DNA, 14 bp, Homo sapiens
tctgggatggaccc

SEQ ID NO: 2057822 - DNA, 22 bp, Homo sapiens
tctgggatgtagaacttcaaga

SEQ ID NO: 2057823 - DNA, 23 bp, Homo sapiens
tctgggatgtagaacttcaagaa

SEQ ID NO: 2057824 - DNA, 23 bp, Homo sapiens
tctgggcagtaaatccacagcca

SEQ ID NO: 2057825 - DNA, 12 bp, Homo sapiens
tctgggctcagg

SEQ ID NO: 2057826 - DNA, 18 bp, Homo sapiens
tctgggctcagggctgga

SEQ ID NO: 2057827 - DNA, 17 bp, Homo sapiens
tctggggaccctgtaga

SEQ ID NO: 2057828 - DNA, 20 bp, Homo sapiens
tctggggacctggtttgaat

SEQ ID NO: 2057829 - DNA, 15 bp, Homo sapiens
tctggggcagggtta

SEQ ID NO: 2057830 - DNA, 15 bp, Homo sapiens
tctggggccctgggc

SEQ ID NO: 2057831 - DNA, 16 bp, Homo sapiens
tctggggccctgggcc

SEQ ID NO: 2057832 - DNA, 18 bp, Homo sapiens
tctggggccctgggcctc

SEQ ID NO: 2057833 - DNA, 15 bp, Homo sapiens
tctggggctctggga

SEQ ID NO: 2057834 - DNA, 16 bp, Homo sapiens
tctggggctctgggat

SEQ ID NO: 2057835 - DNA, 21 bp, Homo sapiens
tctggggttcagcccctcctc

SEQ ID NO: 2057836 - DNA, 13 bp, Homo sapiens
tctgggtggctcc

SEQ ID NO: 2057837 - DNA, 14 bp, Homo sapiens
tctgggtggctcct

SEQ ID NO: 2057838 - DNA, 15 bp, Homo sapiens
tctgggtggctcctg

SEQ ID NO: 2057839 - DNA, 16 bp, Homo sapiens
tctgggtggctcctgc

SEQ ID NO: 2057840 - DNA, 18 bp, Homo sapiens
tctgggtggctcctgcca

SEQ ID NO: 2057841 - DNA, 16 bp, Homo sapiens
tctgggttcactgcaa

SEQ ID NO: 2057842 - DNA, 13 bp, Homo sapiens
tctgggtttggat

SEQ ID NO: 2057843 - DNA, 21 bp, Homo sapiens
tctggtcaggcccactgcaga

SEQ ID NO: 2057844 - DNA, 17 bp, Homo sapiens
tctggtgcctatttatt

SEQ ID NO: 2057845 - DNA, 21 bp, Homo sapiens
tctggtggccgatcggggcac

SEQ ID NO: 2057846 - DNA, 16 bp, Homo sapiens
tctggtgtagctcctc

SEQ ID NO: 2057847 - DNA, 18 bp, Homo sapiens
tctggtgtagctcctctg

SEQ ID NO: 2057848 - DNA, 15 bp, Homo sapiens
tctggtgttctgagt

SEQ ID NO: 2057849 - DNA, 12 bp, Homo sapiens
tctggttgcttc

SEQ ID NO: 2057850 - DNA, 15 bp, Homo sapiens
tctggttttaacaat

SEQ ID NO: 2057851 - DNA, 18 bp, Homo sapiens
tctgtaaactcaaaactt

SEQ ID NO: 2057852 - DNA, 14 bp, Homo sapiens
tctgtaaggaactg

SEQ ID NO: 2057853 - DNA, 18 bp, Homo sapiens
tctgtaaggaactggaac

SEQ ID NO: 2057854 - DNA, 17 bp, Homo sapiens
tctgtacacgtgtcctg

SEQ ID NO: 2057855 - DNA, 17 bp, Homo sapiens
tctgtacgtctgacagg

SEQ ID NO: 2057856 - DNA, 18 bp, Homo sapiens
tctgtacgtctgacaggc

SEQ ID NO: 2057857 - DNA, 17 bp, Homo sapiens
tctgtagggctggacct

SEQ ID NO: 2057858 - DNA, 23 bp, Homo sapiens
tctgtataaaatgcaaaataaat

SEQ ID NO: 2057859 - DNA, 23 bp, Homo sapiens
tctgtataaacattaaatgtctt

SEQ ID NO: 2057860 - DNA, 14 bp, Homo sapiens
tctgtatactgtgg

SEQ ID NO: 2057861 - DNA, 17 bp, Homo sapiens
tctgtatatacatttca

SEQ ID NO: 2057862 - DNA, 21 bp, Homo sapiens
tctgtatcggagacagtgatc

SEQ ID NO: 2057863 - DNA, 18 bp, Homo sapiens
tctgtatttaatggtttt

SEQ ID NO: 2057864 - DNA, 14 bp, Homo sapiens
tctgtcaatgaaaa

SEQ ID NO: 2057865 - DNA, 19 bp, Homo sapiens
tctgtcaccaattggttaa

SEQ ID NO: 2057866 - DNA, 18 bp, Homo sapiens
tctgtcagatgggaagac

SEQ ID NO: 2057867 - DNA, 21 bp, Homo sapiens
tctgtcagcgcaggtttagtt

SEQ ID NO: 2057868 - DNA, 20 bp, Homo sapiens
tctgtcatcactccctggat

SEQ ID NO: 2057869 - DNA, 11 bp, Homo sapiens
tctgtcatcca

SEQ ID NO: 2057870 - DNA, 20 bp, Homo sapiens
tctgtcatttgagcagggct

SEQ ID NO: 2057871 - DNA, 13 bp, Homo sapiens
tctgtccaaggaa

SEQ ID NO: 2057872 - DNA, 13 bp, Homo sapiens
tctgtccaaggca

SEQ ID NO: 2057873 - DNA, 12 bp, Homo sapiens
tctgtccactct

SEQ ID NO: 2057874 - DNA, 19 bp, Homo sapiens
tctgtccagaggctgcaag

SEQ ID NO: 2057875 - DNA, 17 bp, Homo sapiens
tctgtccaggccactgt

SEQ ID NO: 2057876 - DNA, 20 bp, Homo sapiens
tctgtcccggttcaccttgc

SEQ ID NO: 2057877 - DNA, 14 bp, Homo sapiens
tctgtccctcactg

SEQ ID NO: 2057878 - DNA, 21 bp, Homo sapiens
tctgtccctcactgccttcca

SEQ ID NO: 2057879 - DNA, 12 bp, Homo sapiens
tctgtccctctt

SEQ ID NO: 2057880 - DNA, 15 bp, Homo sapiens
tctgtccctctttgc

SEQ ID NO: 2057881 - DNA, 17 bp, Homo sapiens
tctgtccctctttgcct

SEQ ID NO: 2057882 - DNA, 18 bp, Homo sapiens
tctgtccctctttgcctg

SEQ ID NO: 2057883 - DNA, 20 bp, Homo sapiens
tctgtccgtttactccaagg

SEQ ID NO: 2057884 - DNA, 21 bp, Homo sapiens
tctgtccttttggcactgaga

SEQ ID NO: 2057885 - DNA, 17 bp, Homo sapiens
tctgtcgcccagtctgg

SEQ ID NO: 2057886 - DNA, 22 bp, Homo sapiens
tctgtctctgctcttgcctgca

SEQ ID NO: 2057887 - DNA, 16 bp, Homo sapiens
tctgtctgtcccaaag

SEQ ID NO: 2057888 - DNA, 18 bp, Homo sapiens
tctgtctgtctgtcccaa

SEQ ID NO: 2057889 - DNA, 15 bp, Homo sapiens
tctgtcttcacaaca

SEQ ID NO: 2057890 - DNA, 13 bp, Homo sapiens
tctgtctttgtgg

SEQ ID NO: 2057891 - DNA, 22 bp, Homo sapiens
tctgtgaaatcagaagtgcaaa

SEQ ID NO: 2057892 - DNA, 15 bp, Homo sapiens
tctgtgaagaatgaa

SEQ ID NO: 2057893 - DNA, 20 bp, Homo sapiens
tctgtgaagaatgaagtgga

SEQ ID NO: 2057894 - DNA, 13 bp, Homo sapiens
tctgtgaattaaa

SEQ ID NO: 2057895 - DNA, 22 bp, Homo sapiens
tctgtgaattaaaaaagctcaa

SEQ ID NO: 2057896 - DNA, 20 bp, Homo sapiens
tctgtgaggaaagcacacag

SEQ ID NO: 2057897 - DNA, 16 bp, Homo sapiens
tctgtgaggtgctgat

SEQ ID NO: 2057898 - DNA, 20 bp, Homo sapiens
tctgtgcagatgagcagtca

SEQ ID NO: 2057899 - DNA, 17 bp, Homo sapiens
tctgtgccagagcctgg

SEQ ID NO: 2057900 - DNA, 22 bp, Homo sapiens
tctgtgccagagcctggggctc

SEQ ID NO: 2057901 - DNA, 15 bp, Homo sapiens
tctgtgcccctgtaa

SEQ ID NO: 2057902 - DNA, 22 bp, Homo sapiens
tctgtgcccctgtaaatagttt

SEQ ID NO: 2057903 - DNA, 15 bp, Homo sapiens
tctgtgctgccctgc

SEQ ID NO: 2057904 - DNA, 14 bp, Homo sapiens
tctgtgctgtgcct

SEQ ID NO: 2057905 - DNA, 15 bp, Homo sapiens
tctgtgctgtgcctg

SEQ ID NO: 2057906 - DNA, 17 bp, Homo sapiens
tctgtgctgtgcctgct

SEQ ID NO: 2057907 - DNA, 16 bp, Homo sapiens
tctgtggaaatgacag

SEQ ID NO: 2057908 - DNA, 21 bp, Homo sapiens
tctgtggagagtgagaataat

SEQ ID NO: 2057909 - DNA, 19 bp, Homo sapiens
tctgtgggcttggccttgt

SEQ ID NO: 2057910 - DNA, 20 bp, Homo sapiens
tctgtgggcttggccttgtg

SEQ ID NO: 2057911 - DNA, 14 bp, Homo sapiens
tctgtgtccaatta

SEQ ID NO: 2057912 - DNA, 14 bp, Homo sapiens
tctgtgtgcacaaa

SEQ ID NO: 2057913 - DNA, 21 bp, Homo sapiens
tctgtgtgcacaaatatttat

SEQ ID NO: 2057914 - DNA, 23 bp, Homo sapiens
tctgtgtgtgtccccctatgctc

SEQ ID NO: 2057915 - DNA, 13 bp, Homo sapiens
tctgtgttgaaca

SEQ ID NO: 2057916 - DNA, 16 bp, Homo sapiens
tctgttaaaatcagga

SEQ ID NO: 2057917 - DNA, 19 bp, Homo sapiens
tctgttcacttttcctccc

SEQ ID NO: 2057918 - DNA, 13 bp, Homo sapiens
tctgttctgttga

SEQ ID NO: 2057919 - DNA, 14 bp, Homo sapiens
tctgttgagtgcaa

SEQ ID NO: 2057920 - DNA, 23 bp, Homo sapiens
tctgttgatcccacttcactgtg

SEQ ID NO: 2057921 - DNA, 20 bp, Homo sapiens
tctgttgcccaggctggcct

SEQ ID NO: 2057922 - DNA, 21 bp, Homo sapiens
tctgttgcccaggctggcctg

SEQ ID NO: 2057923 - DNA, 18 bp, Homo sapiens
tctgttggccagtgtgac

SEQ ID NO: 2057924 - DNA, 22 bp, Homo sapiens
tctgtttctattctctcctcag

SEQ ID NO: 2057925 - DNA, 16 bp, Homo sapiens
tctgtttttaaaaatc

SEQ ID NO: 2057926 - DNA, 18 bp, Homo sapiens
tctgtttttctaactggg

SEQ ID NO: 2057927 - DNA, 14 bp, Homo sapiens
tcttaaaataactt

SEQ ID NO: 2057928 - DNA, 15 bp, Homo sapiens
tcttaaaataactta

SEQ ID NO: 2057929 - DNA, 21 bp, Homo sapiens
tcttaaaataacttatatcat

SEQ ID NO: 2057930 - DNA, 13 bp, Homo sapiens
tcttaaaatgttt

SEQ ID NO: 2057931 - DNA, 19 bp, Homo sapiens
tcttaaagctgcctgtagt

SEQ ID NO: 2057932 - DNA, 23 bp, Homo sapiens
tcttaaagctgcctgtagttagg

SEQ ID NO: 2057933 - DNA, 15 bp, Homo sapiens
tcttaaaggcctgga

SEQ ID NO: 2057934 - DNA, 23 bp, Homo sapiens
tgaagaggggaggggcctaggga

SEQ ID NO: 2057935 - DNA, 16 bp, Homo sapiens
tgaagagtgagagggc

SEQ ID NO: 2057936 - DNA, 18 bp, Homo sapiens
tgaagagtgagagggcat

SEQ ID NO: 2057937 - DNA, 24 bp, Homo sapiens
tgaagagtttaactttgggcccag

SEQ ID NO: 2057938 - DNA, 11 bp, Homo sapiens
tgaagatctca

SEQ ID NO: 2057939 - DNA, 17 bp, Homo sapiens
tgaagatctcagataaa

SEQ ID NO: 2057940 - DNA, 17 bp, Homo sapiens
tgaagcaaagcaccagc

SEQ ID NO: 2057941 - DNA, 20 bp, Homo sapiens
tgaagcaaatcgaatgaaat

SEQ ID NO: 2057942 - DNA, 23 bp, Homo sapiens
tgaagcagtgcctcgaggcaccg

SEQ ID NO: 2057943 - DNA, 17 bp, Homo sapiens
tgaagcagttgtgtcag

SEQ ID NO: 2057944 - DNA, 14 bp, Homo sapiens
tgaagcatgtttca

SEQ ID NO: 2057945 - DNA, 19 bp, Homo sapiens
tgaagcatgtttcatgttt

SEQ ID NO: 2057946 - DNA, 16 bp, Homo sapiens
tgaagccactgaagct

SEQ ID NO: 2057947 - DNA, 19 bp, Homo sapiens
tgaagccactgaagctggg

SEQ ID NO: 2057948 - DNA, 20 bp, Homo sapiens
tgaagccactgaagctggga

SEQ ID NO: 2057949 - DNA, 19 bp, Homo sapiens
tgaagcccaataaacctct

SEQ ID NO: 2057950 - DNA, 18 bp, Homo sapiens
tgaagccccttgtcctct

SEQ ID NO: 2057951 - DNA, 16 bp, Homo sapiens
tgaagcctatttattt

SEQ ID NO: 2057952 - DNA, 19 bp, Homo sapiens
tgaagcctctgccctgcct

SEQ ID NO: 2057953 - DNA, 21 bp, Homo sapiens
tgaagcctctgccctgcctcc

SEQ ID NO: 2057954 - DNA, 23 bp, Homo sapiens
tgaagcctgctaaatgaagagac

SEQ ID NO: 2057955 - DNA, 16 bp, Homo sapiens
tgaagcctgtgccacc

SEQ ID NO: 2057956 - DNA, 18 bp, Homo sapiens
tgaagcctgtgccacctg

SEQ ID NO: 2057957 - DNA, 19 bp, Homo sapiens
tgaagcctgtgccacctgc

SEQ ID NO: 2057958 - DNA, 19 bp, Homo sapiens
tgaagcctttttttagtaa

SEQ ID NO: 2057959 - DNA, 15 bp, Homo sapiens
tgaagctaagattta

SEQ ID NO: 2057960 - DNA, 13 bp, Homo sapiens
tgaagctgacagc

SEQ ID NO: 2057961 - DNA, 20 bp, Homo sapiens
tgaagctggaagcactgctg

SEQ ID NO: 2057962 - DNA, 13 bp, Homo sapiens
tgaagctttacca

SEQ ID NO: 2057963 - DNA, 12 bp, Homo sapiens
tgaaggaacagt

SEQ ID NO: 2057964 - DNA, 17 bp, Homo sapiens
tgaaggaatagccagag

SEQ ID NO: 2057965 - DNA, 20 bp, Homo sapiens
tgaaggacattgcggacagc

SEQ ID NO: 2057966 - DNA, 17 bp, Homo sapiens
tgaaggaccctggctct

SEQ ID NO: 2057967 - DNA, 23 bp, Homo sapiens
tgaaggaccctggctcttctctc

SEQ ID NO: 2057968 - DNA, 13 bp, Homo sapiens
tgaaggagaaaat

SEQ ID NO: 2057969 - DNA, 23 bp, Homo sapiens
tgaaggagaaaatgcattatgtg

SEQ ID NO: 2057970 - DNA, 16 bp, Homo sapiens
tgaaggagagcccttc

SEQ ID NO: 2057971 - DNA, 18 bp, Homo sapiens
tgaaggagccacgtgaat

SEQ ID NO: 2057972 - DNA, 13 bp, Homo sapiens
tgaaggaggtgag

SEQ ID NO: 2057973 - DNA, 17 bp, Homo sapiens
tgaaggaggtgagggat

SEQ ID NO: 2057974 - DNA, 19 bp, Homo sapiens
tgaaggcagtctgaaccct

SEQ ID NO: 2057975 - DNA, 22 bp, Homo sapiens
tgaaggcccaggtcaacatcta

SEQ ID NO: 2057976 - DNA, 22 bp, Homo sapiens
tgaaggcgtgcaaggggctcag

SEQ ID NO: 2057977 - DNA, 14 bp, Homo sapiens
tgaaggctgtacac

SEQ ID NO: 2057978 - DNA, 18 bp, Homo sapiens
tgaagggaaaggatattt

SEQ ID NO: 2057979 - DNA, 15 bp, Homo sapiens
tgaagggcaggtgct

SEQ ID NO: 2057980 - DNA, 19 bp, Homo sapiens
tgaagggcaggtgcttcag

SEQ ID NO: 2057981 - DNA, 19 bp, Homo sapiens
tgaaggggcacaccactgc

SEQ ID NO: 2057982 - DNA, 22 bp, Homo sapiens
tgaaggggcacaccactgccct

SEQ ID NO: 2057983 - DNA, 18 bp, Homo sapiens
tgaagggtgacatcccag

SEQ ID NO: 2057984 - DNA, 22 bp, Homo sapiens
tgaaggtcactcttcctgcaag

SEQ ID NO: 2057985 - DNA, 15 bp, Homo sapiens
tgaaggttaggattt

SEQ ID NO: 2057986 - DNA, 20 bp, Homo sapiens
tgaaggttaggatttaacag

SEQ ID NO: 2057987 - DNA, 22 bp, Homo sapiens
tgaagtaaccttataggttact

SEQ ID NO: 2057988 - DNA, 17 bp, Homo sapiens
tgaagtaagttctgaaa

SEQ ID NO: 2057989 - DNA, 15 bp, Homo sapiens
tgaagtagtttgtat

SEQ ID NO: 2057990 - DNA, 13 bp, Homo sapiens
tgaagtcacacag

SEQ ID NO: 2057991 - DNA, 21 bp, Homo sapiens
tgaagtgaaggagaaaggagc

SEQ ID NO: 2057992 - DNA, 16 bp, Homo sapiens
tgaagttcatggtgat

SEQ ID NO: 2057993 - DNA, 14 bp, Homo sapiens
tgaagttctgagcc

SEQ ID NO: 2057994 - DNA, 18 bp, Homo sapiens
tgaagtttgaacttcata

SEQ ID NO: 2057995 - DNA, 20 bp, Homo sapiens
tgaataaaaaacatttgtac

SEQ ID NO: 2057996 - DNA, 13 bp, Homo sapiens
tgaataaacttca

SEQ ID NO: 2057997 - DNA, 16 bp, Homo sapiens
tgaataaacttcagca

SEQ ID NO: 2057998 - DNA, 18 bp, Homo sapiens
tgaataaacttcagcacc

SEQ ID NO: 2057999 - DNA, 19 bp, Homo sapiens
tgaataaacttcagcacca

SEQ ID NO: 2058000 - DNA, 18 bp, Homo sapiens
tgaataaagcctgctttt

SEQ ID NO: 2058001 - DNA, 14 bp, Homo sapiens
tgaataaagtctga

SEQ ID NO: 2058002 - DNA, 20 bp, Homo sapiens
tgaataaagtctgagtgggc

SEQ ID NO: 2058003 - DNA, 22 bp, Homo sapiens
tgaataaagtctgagtgggcgg

SEQ ID NO: 2058004 - DNA, 22 bp, Homo sapiens
tgaataaagttagtgtgttgtc

SEQ ID NO: 2058005 - DNA, 17 bp, Homo sapiens
tgaataaagttgaagct

SEQ ID NO: 2058006 - DNA, 16 bp, Homo sapiens
tgaataaataaatgta

SEQ ID NO: 2058007 - DNA, 15 bp, Homo sapiens
tgaataaccacttaa

SEQ ID NO: 2058008 - DNA, 14 bp, Homo sapiens
tgaataagtattct

SEQ ID NO: 2058009 - DNA, 19 bp, Homo sapiens
tgaatacagggcatgcatt

SEQ ID NO: 2058010 - DNA, 15 bp, Homo sapiens
tgaatacccccagag

SEQ ID NO: 2058011 - DNA, 13 bp, Homo sapiens
tgaatactaaatg

SEQ ID NO: 2058012 - DNA, 14 bp, Homo sapiens
tgaatactctcaca

SEQ ID NO: 2058013 - DNA, 17 bp, Homo sapiens
tgaatagtctgtgtgca

SEQ ID NO: 2058014 - DNA, 16 bp, Homo sapiens
tgaatataaacactat

SEQ ID NO: 2058015 - DNA, 16 bp, Homo sapiens
tgaatatatggtctgt

SEQ ID NO: 2058016 - DNA, 19 bp, Homo sapiens
tgaatatttcaaaataaac

SEQ ID NO: 2058017 - DNA, 19 bp, Homo sapiens
tgaatattttcattaaaag

SEQ ID NO: 2058018 - DNA, 13 bp, Homo sapiens
tgaatcaaagaca

SEQ ID NO: 2058019 - DNA, 14 bp, Homo sapiens
tgaatcatgttaat

SEQ ID NO: 2058020 - DNA, 15 bp, Homo sapiens
tgaatcctaagggct

SEQ ID NO: 2058021 - DNA, 14 bp, Homo sapiens
tgaatcctctctct

SEQ ID NO: 2058022 - DNA, 16 bp, Homo sapiens
tgaatcctctctctgt

SEQ ID NO: 2058023 - DNA, 21 bp, Homo sapiens
tgaatcctctctctgtgttac

SEQ ID NO: 2058024 - DNA, 23 bp, Homo sapiens
tgaatctgattggacattttctt

SEQ ID NO: 2058025 - DNA, 18 bp, Homo sapiens
tgaatctgttactgaaat

SEQ ID NO: 2058026 - DNA, 21 bp, Homo sapiens
tgaatctgttactgaaatgag

SEQ ID NO: 2058027 - DNA, 13 bp, Homo sapiens
tgaatctttgtgc

SEQ ID NO: 2058028 - DNA, 15 bp, Homo sapiens
tgaatgatctctctg

SEQ ID NO: 2058029 - DNA, 18 bp, Homo sapiens
tgaatgatctctctgaat

SEQ ID NO: 2058030 - DNA, 14 bp, Homo sapiens
tgaatgatgtttta

SEQ ID NO: 2058031 - DNA, 15 bp, Homo sapiens
tgaatgctattgaaa

SEQ ID NO: 2058032 - DNA, 12 bp, Homo sapiens
tgaatgcttttt

SEQ ID NO: 2058033 - DNA, 21 bp, Homo sapiens
tgaatggcctgccttgaagcc

SEQ ID NO: 2058034 - DNA, 14 bp, Homo sapiens
tgaatggtcttctg

SEQ ID NO: 2058035 - DNA, 21 bp, Homo sapiens
tgaatggttccatgcctgagg

SEQ ID NO: 2058036 - DNA, 16 bp, Homo sapiens
tgaatgtcattcacaa

SEQ ID NO: 2058037 - DNA, 18 bp, Homo sapiens
tgaatgtctcagcgaggt

SEQ ID NO: 2058038 - DNA, 14 bp, Homo sapiens
tgaatgtgcatttc

SEQ ID NO: 2058039 - DNA, 16 bp, Homo sapiens
tgaatgtgcatttctt

SEQ ID NO: 2058040 - DNA, 16 bp, Homo sapiens
tgaatgtgttgatttg

SEQ ID NO: 2058041 - DNA, 15 bp, Homo sapiens
tgaatgttatttgtt

SEQ ID NO: 2058042 - DNA, 18 bp, Homo sapiens
tgaatgttcttggttccc

SEQ ID NO: 2058043 - DNA, 22 bp, Homo sapiens
tgaatgtttacactctttgtaa

SEQ ID NO: 2058044 - DNA, 18 bp, Homo sapiens
tgaatgtttatgttctca

SEQ ID NO: 2058045 - DNA, 21 bp, Homo sapiens
tgaatgtttccaacctggagt

SEQ ID NO: 2058046 - DNA, 13 bp, Homo sapiens
tgaattcccaggt

SEQ ID NO: 2058047 - DNA, 22 bp, Homo sapiens
tgaattgcctgcagagagaagc

SEQ ID NO: 2058048 - DNA, 20 bp, Homo sapiens
tgaatttagtgagatttacc

SEQ ID NO: 2058049 - DNA, 21 bp, Homo sapiens
tgagtcagtctctctctccct

SEQ ID NO: 2058050 - DNA, 20 bp, Homo sapiens
tgagtcatgatctccctgcc

SEQ ID NO: 2058051 - DNA, 16 bp, Homo sapiens
tgagtccctccatgca

SEQ ID NO: 2058052 - DNA, 18 bp, Homo sapiens
tgagtcctgtctctgcct

SEQ ID NO: 2058053 - DNA, 23 bp, Homo sapiens
tgagtcggccccacatgggaacc

SEQ ID NO: 2058054 - DNA, 15 bp, Homo sapiens
tgagtctcctctctg

SEQ ID NO: 2058055 - DNA, 18 bp, Homo sapiens
tgagtctcctctctgaga

SEQ ID NO: 2058056 - DNA, 17 bp, Homo sapiens
tgagtctgcataaactt

SEQ ID NO: 2058057 - DNA, 20 bp, Homo sapiens
tgagtctgcataaacttcat

SEQ ID NO: 2058058 - DNA, 21 bp, Homo sapiens
tgagtctttaacatcttgaac

SEQ ID NO: 2058059 - DNA, 23 bp, Homo sapiens
tgagtgagccacagaccacctgc

SEQ ID NO: 2058060 - DNA, 23 bp, Homo sapiens
tgagtgattgacacacagcactc

SEQ ID NO: 2058061 - DNA, 14 bp, Homo sapiens
tgagtggatggatg

SEQ ID NO: 2058062 - DNA, 15 bp, Homo sapiens
tgagtggatggatgg

SEQ ID NO: 2058063 - DNA, 18 bp, Homo sapiens
tgagtggatggatggaca

SEQ ID NO: 2058064 - DNA, 19 bp, Homo sapiens
tgagtggatggatggacag

SEQ ID NO: 2058065 - DNA, 21 bp, Homo sapiens
tgagtggatggatggacagaa

SEQ ID NO: 2058066 - DNA, 13 bp, Homo sapiens
tgagtggcagcca

SEQ ID NO: 2058067 - DNA, 20 bp, Homo sapiens
tgagtggcttgtgattctgg

SEQ ID NO: 2058068 - DNA, 12 bp, Homo sapiens
tgagtgttcatt

SEQ ID NO: 2058069 - DNA, 14 bp, Homo sapiens
tgagtgttcatttt

SEQ ID NO: 2058070 - DNA, 23 bp, Homo sapiens
tgagtgttcattttagtgactgt

SEQ ID NO: 2058071 - DNA, 22 bp, Homo sapiens
tgagtgtttttactacagttgt

SEQ ID NO: 2058072 - DNA, 18 bp, Homo sapiens
tgagttacttgtctgagg

SEQ ID NO: 2058073 - DNA, 20 bp, Homo sapiens
tgagttacttgtctgaggcc

SEQ ID NO: 2058074 - DNA, 17 bp, Homo sapiens
tgagttcataccctgtt

SEQ ID NO: 2058075 - DNA, 21 bp, Homo sapiens
tgagttccttataagaattaa

SEQ ID NO: 2058076 - DNA, 13 bp, Homo sapiens
tgagttggacaca

SEQ ID NO: 2058077 - DNA, 24 bp, Homo sapiens
tgagttgttttggtgcctgcctct

SEQ ID NO: 2058078 - DNA, 18 bp, Homo sapiens
tgagtttcattctcctgc

SEQ ID NO: 2058079 - DNA, 22 bp, Homo sapiens
tgagttttcaaagatcccgtga

SEQ ID NO: 2058080 - DNA, 18 bp, Homo sapiens
tgagtttttatggggctg

SEQ ID NO: 2058081 - DNA, 15 bp, Homo sapiens
tgataaacacagagg

SEQ ID NO: 2058082 - DNA, 11 bp, Homo sapiens
tgataaatatt

SEQ ID NO: 2058083 - DNA, 13 bp, Homo sapiens
tgataaatattta

SEQ ID NO: 2058084 - DNA, 18 bp, Homo sapiens
tgataacaacctggagac

SEQ ID NO: 2058085 - DNA, 16 bp, Homo sapiens
tgataaggatcagaac

SEQ ID NO: 2058086 - DNA, 13 bp, Homo sapiens
tgataagtggaaa

SEQ ID NO: 2058087 - DNA, 22 bp, Homo sapiens
tgataatcaattattacattta

SEQ ID NO: 2058088 - DNA, 23 bp, Homo sapiens
tgataatctgggcatctcgtgcc

SEQ ID NO: 2058089 - DNA, 15 bp, Homo sapiens
tgataatgaacagaa

SEQ ID NO: 2058090 - DNA, 14 bp, Homo sapiens
tgataattttaaat

SEQ ID NO: 2058091 - DNA, 19 bp, Homo sapiens
tgatacaaaatgctgaggt

SEQ ID NO: 2058092 - DNA, 18 bp, Homo sapiens
tgatacccatagcttcca

SEQ ID NO: 2058093 - DNA, 21 bp, Homo sapiens
tgatacccatagcttccatga

SEQ ID NO: 2058094 - DNA, 19 bp, Homo sapiens
tgataccctgcttggtcaa

SEQ ID NO: 2058095 - DNA, 24 bp, Homo sapiens
tgataccctgcttggtcaaatccc

SEQ ID NO: 2058096 - DNA, 17 bp, Homo sapiens
tgatactaaaagttctt

SEQ ID NO: 2058097 - DNA, 14 bp, Homo sapiens
tgatactgatgcca

SEQ ID NO: 2058098 - DNA, 15 bp, Homo sapiens
tgatacttcaggtgc

SEQ ID NO: 2058099 - DNA, 18 bp, Homo sapiens
tgatacttcaggtgcttt

SEQ ID NO: 2058100 - DNA, 21 bp, Homo sapiens
tgatacttttgacaacaaatt

SEQ ID NO: 2058101 - DNA, 18 bp, Homo sapiens
tgatagctaacattttaa

SEQ ID NO: 2058102 - DNA, 21 bp, Homo sapiens
tgatagctaacattttaaata

SEQ ID NO: 2058103 - DNA, 18 bp, Homo sapiens
tgataggaaaagaaggct

SEQ ID NO: 2058104 - DNA, 22 bp, Homo sapiens
tgatatacttttttcttattta

SEQ ID NO: 2058105 - DNA, 14 bp, Homo sapiens
tgatatattttcca

SEQ ID NO: 2058106 - DNA, 13 bp, Homo sapiens
tgatatcacctct

SEQ ID NO: 2058107 - DNA, 20 bp, Homo sapiens
tgatatccagtaagcacatg

SEQ ID NO: 2058108 - DNA, 12 bp, Homo sapiens
tgatatccctga

SEQ ID NO: 2058109 - DNA, 14 bp, Homo sapiens
tgatatccttctag

SEQ ID NO: 2058110 - DNA, 12 bp, Homo sapiens
tgatatgaaaaa

SEQ ID NO: 2058111 - DNA, 15 bp, Homo sapiens
tgatatgaaaaatat

SEQ ID NO: 2058112 - DNA, 19 bp, Homo sapiens
tgatatgaaaaatatgata

SEQ ID NO: 2058113 - DNA, 15 bp, Homo sapiens
tgatatgagtataca

SEQ ID NO: 2058114 - DNA, 18 bp, Homo sapiens
tgatatgagtatacaata

SEQ ID NO: 2058115 - DNA, 21 bp, Homo sapiens
tgatatgtaaacataattctt

SEQ ID NO: 2058116 - DNA, 16 bp, Homo sapiens
tgatattaaaggagtt

SEQ ID NO: 2058117 - DNA, 20 bp, Homo sapiens
tgatattttgtctcctacct

SEQ ID NO: 2058118 - DNA, 12 bp, Homo sapiens
tgatcaaaaata

SEQ ID NO: 2058119 - DNA, 14 bp, Homo sapiens
tgatcaaaaataaa

SEQ ID NO: 2058120 - DNA, 22 bp, Homo sapiens
tgatcaaattcatttttttcac

SEQ ID NO: 2058121 - DNA, 14 bp, Homo sapiens
tgatcaatgaaatg

SEQ ID NO: 2058122 - DNA, 13 bp, Homo sapiens
tgatcacacagcc

SEQ ID NO: 2058123 - DNA, 12 bp, Homo sapiens
tgatcacactct

SEQ ID NO: 2058124 - DNA, 16 bp, Homo sapiens
tgatcacagtgacttt

SEQ ID NO: 2058125 - DNA, 22 bp, Homo sapiens
tgatcacagtggcgagaggaga

SEQ ID NO: 2058126 - DNA, 15 bp, Homo sapiens
tgatcacggctcact

SEQ ID NO: 2058127 - DNA, 18 bp, Homo sapiens
tgatcacggctcactgca

SEQ ID NO: 2058128 - DNA, 19 bp, Homo sapiens
tgatcacggctcactgcag

SEQ ID NO: 2058129 - DNA, 21 bp, Homo sapiens
tgatcacggctcactgcagcc

SEQ ID NO: 2058130 - DNA, 21 bp, Homo sapiens
tgatcactttgttaaaaatat

SEQ ID NO: 2058131 - DNA, 18 bp, Homo sapiens
tgatcagtatgctgtttt

SEQ ID NO: 2058132 - DNA, 23 bp, Homo sapiens
tgatcagtatgctgttttaataa

SEQ ID NO: 2058133 - DNA, 19 bp, Homo sapiens
tgatcataggtatttcaaa

SEQ ID NO: 2058134 - DNA, 13 bp, Homo sapiens
tgatcatggtcag

SEQ ID NO: 2058135 - DNA, 14 bp, Homo sapiens
tgatcatggtcagc

SEQ ID NO: 2058136 - DNA, 17 bp, Homo sapiens
tgatccacccacctcag

SEQ ID NO: 2058137 - DNA, 19 bp, Homo sapiens
tgatccacccacctcagcc

SEQ ID NO: 2058138 - DNA, 23 bp, Homo sapiens
tgatccacttcttaatgctttcc

SEQ ID NO: 2058139 - DNA, 12 bp, Homo sapiens
tgatcccagcac

SEQ ID NO: 2058140 - DNA, 15 bp, Homo sapiens
tgatcctcccacctc

SEQ ID NO: 2058141 - DNA, 19 bp, Homo sapiens
tgatcctcccacctcagcc

SEQ ID NO: 2058142 - DNA, 15 bp, Homo sapiens
tgatcgagccactgc

SEQ ID NO: 2058143 - DNA, 19 bp, Homo sapiens
tgatctccatatgttacac

SEQ ID NO: 2058144 - DNA, 14 bp, Homo sapiens
tgatctccctgccg

SEQ ID NO: 2058145 - DNA, 22 bp, Homo sapiens
tgatctgtatatacaataacat

SEQ ID NO: 2058146 - DNA, 15 bp, Homo sapiens
tgatctgtatttaat

SEQ ID NO: 2058147 - DNA, 15 bp, Homo sapiens
tgatctgtcccctct

SEQ ID NO: 2058148 - DNA, 17 bp, Homo sapiens
tgatctttaaaatacac

SEQ ID NO: 2058149 - DNA, 14 bp, Homo sapiens
tgatgaaaataata

SEQ ID NO: 2058150 - DNA, 16 bp, Homo sapiens
tgatgaaattcttgaa

SEQ ID NO: 2058151 - DNA, 13 bp, Homo sapiens
tgatgaactttct

SEQ ID NO: 2058152 - DNA, 15 bp, Homo sapiens
tgatgaagcctgtgc

SEQ ID NO: 2058153 - DNA, 23 bp, Homo sapiens
tgatgacaaacccaggagtttgt

SEQ ID NO: 2058154 - DNA, 14 bp, Homo sapiens
tgatgacagacact

SEQ ID NO: 2058155 - DNA, 14 bp, Homo sapiens
tgatgaccaagaat

SEQ ID NO: 2058156 - DNA, 15 bp, Homo sapiens
tgatgaccaatctct

SEQ ID NO: 2058157 - DNA, 15 bp, Homo sapiens
tgatgagctcctctt

SEQ ID NO: 2058158 - DNA, 18 bp, Homo sapiens
tgatgaggcctcttggac

SEQ ID NO: 2058159 - DNA, 22 bp, Homo sapiens
tgatgaggcctcttggacctct

SEQ ID NO: 2058160 - DNA, 15 bp, Homo sapiens
tgatgagggcagcag

SEQ ID NO: 2058161 - DNA, 19 bp, Homo sapiens
tgatgagggcagcagccag

SEQ ID NO: 2058162 - DNA, 22 bp, Homo sapiens
tgatgagggcagcagccagccc

SEQ ID NO: 2058163 - DNA, 16 bp, Homo sapiens
tgcatgtatgtgtgtg

SEQ ID NO: 2058164 - DNA, 17 bp, Homo sapiens
tgcatgtgagcacatgc

SEQ ID NO: 2058165 - DNA, 18 bp, Homo sapiens
tgcatgtgagcacatgcg

SEQ ID NO: 2058166 - DNA, 14 bp, Homo sapiens
tgcatgtgtgtata

SEQ ID NO: 2058167 - DNA, 15 bp, Homo sapiens
tgcatgtgtgtataa

SEQ ID NO: 2058168 - DNA, 22 bp, Homo sapiens
tgcatgttaggaaaatttcaca

SEQ ID NO: 2058169 - DNA, 11 bp, Homo sapiens
tgcatgtttac

SEQ ID NO: 2058170 - DNA, 12 bp, Homo sapiens
tgcatgtttact

SEQ ID NO: 2058171 - DNA, 17 bp, Homo sapiens
tgcattaacttaaaaga

SEQ ID NO: 2058172 - DNA, 18 bp, Homo sapiens
tgcattaacttaaaagat

SEQ ID NO: 2058173 - DNA, 15 bp, Homo sapiens
tgcattactgcatgc

SEQ ID NO: 2058174 - DNA, 17 bp, Homo sapiens
tgcattactgcatgcac

SEQ ID NO: 2058175 - DNA, 16 bp, Homo sapiens
tgcattagacagatga

SEQ ID NO: 2058176 - DNA, 21 bp, Homo sapiens
tgcattcacaaggtcaaagtt

SEQ ID NO: 2058177 - DNA, 15 bp, Homo sapiens
tgcattccatgattt

SEQ ID NO: 2058178 - DNA, 22 bp, Homo sapiens
tgcattcttaatctccactgtt

SEQ ID NO: 2058179 - DNA, 13 bp, Homo sapiens
tgcattgaatata

SEQ ID NO: 2058180 - DNA, 16 bp, Homo sapiens
tgcattgtcttgtgga

SEQ ID NO: 2058181 - DNA, 17 bp, Homo sapiens
tgcattgtcttgtggag

SEQ ID NO: 2058182 - DNA, 13 bp, Homo sapiens
tgcatttcctgac

SEQ ID NO: 2058183 - DNA, 15 bp, Homo sapiens
tgccaaaatattgct

SEQ ID NO: 2058184 - DNA, 17 bp, Homo sapiens
tgccaaagcaaaagaag

SEQ ID NO: 2058185 - DNA, 22 bp, Homo sapiens
tgccaaagcaaaagaagtaaaa

SEQ ID NO: 2058186 - DNA, 22 bp, Homo sapiens
tgccaacctgatgccccttccc

SEQ ID NO: 2058187 - DNA, 16 bp, Homo sapiens
tgccaactaagccctc

SEQ ID NO: 2058188 - DNA, 15 bp, Homo sapiens
tgccaactggtcact

SEQ ID NO: 2058189 - DNA, 17 bp, Homo sapiens
tgccaagaaaaggcatg

SEQ ID NO: 2058190 - DNA, 14 bp, Homo sapiens
tgccaagcactcga

SEQ ID NO: 2058191 - DNA, 19 bp, Homo sapiens
tgccaagcttgtgagagct

SEQ ID NO: 2058192 - DNA, 22 bp, Homo sapiens
tgccaagcttgtgagagctggt

SEQ ID NO: 2058193 - DNA, 16 bp, Homo sapiens
tgccaagctttcttct

SEQ ID NO: 2058194 - DNA, 20 bp, Homo sapiens
tgccaaggtgtggcctgcac

SEQ ID NO: 2058195 - DNA, 17 bp, Homo sapiens
tgccaaggttgtcctgg

SEQ ID NO: 2058196 - DNA, 13 bp, Homo sapiens
tgccaagtccagg

SEQ ID NO: 2058197 - DNA, 21 bp, Homo sapiens
tgccaagtccaggtcctggtg

SEQ ID NO: 2058198 - DNA, 17 bp, Homo sapiens
tgccacaatgcctctcc

SEQ ID NO: 2058199 - DNA, 16 bp, Homo sapiens
tgccacaccctcccca

SEQ ID NO: 2058200 - DNA, 17 bp, Homo sapiens
tgccacaccctccccat

SEQ ID NO: 2058201 - DNA, 18 bp, Homo sapiens
tgccacaccctccccatt

SEQ ID NO: 2058202 - DNA, 17 bp, Homo sapiens
tgccacactcagtcccc

SEQ ID NO: 2058203 - DNA, 14 bp, Homo sapiens
tgccacacttcagg

SEQ ID NO: 2058204 - DNA, 13 bp, Homo sapiens
tgccacagagaag

SEQ ID NO: 2058205 - DNA, 11 bp, Homo sapiens
tgccaccaata

SEQ ID NO: 2058206 - DNA, 14 bp, Homo sapiens
tgccaccaataaaa

SEQ ID NO: 2058207 - DNA, 19 bp, Homo sapiens
tgccaccaataaaaatcct

SEQ ID NO: 2058208 - DNA, 20 bp, Homo sapiens
tgccaccaccagatgagaag

SEQ ID NO: 2058209 - DNA, 19 bp, Homo sapiens
tgccaccacgtctgccagg

SEQ ID NO: 2058210 - DNA, 20 bp, Homo sapiens
tgccaccacgtctgccaggc

SEQ ID NO: 2058211 - DNA, 21 bp, Homo sapiens
tgccaccacgtctgccaggcc

SEQ ID NO: 2058212 - DNA, 20 bp, Homo sapiens
tgccaccactagagctgaga

SEQ ID NO: 2058213 - DNA, 20 bp, Homo sapiens
tgccacccagcaacacagag

SEQ ID NO: 2058214 - DNA, 14 bp, Homo sapiens
tgccaccctctcca

SEQ ID NO: 2058215 - DNA, 15 bp, Homo sapiens
tgccaccctctccat

SEQ ID NO: 2058216 - DNA, 17 bp, Homo sapiens
tgccaccctctccatgc

SEQ ID NO: 2058217 - DNA, 22 bp, Homo sapiens
tgccaccctctccatgcccaac

SEQ ID NO: 2058218 - DNA, 16 bp, Homo sapiens
tgccaccgattgcagg

SEQ ID NO: 2058219 - DNA, 15 bp, Homo sapiens
tgccaccgccagagg

SEQ ID NO: 2058220 - DNA, 20 bp, Homo sapiens
tgccaccggggaacccagcc

SEQ ID NO: 2058221 - DNA, 17 bp, Homo sapiens
tgccacctcccctatcc

SEQ ID NO: 2058222 - DNA, 18 bp, Homo sapiens
tgccacctcccctatcca

SEQ ID NO: 2058223 - DNA, 21 bp, Homo sapiens
tgccacctcccctatccaccc

SEQ ID NO: 2058224 - DNA, 22 bp, Homo sapiens
tgccacctcccctatccaccca

SEQ ID NO: 2058225 - DNA, 19 bp, Homo sapiens
tgccacctgcaagtgcccg

SEQ ID NO: 2058226 - DNA, 15 bp, Homo sapiens
tgccacctgtctgtc

SEQ ID NO: 2058227 - DNA, 16 bp, Homo sapiens
tgccacctgtctgtct

SEQ ID NO: 2058228 - DNA, 22 bp, Homo sapiens
tgccactacggaatagttggct

SEQ ID NO: 2058229 - DNA, 17 bp, Homo sapiens
tgccactcattcctgta

SEQ ID NO: 2058230 - DNA, 18 bp, Homo sapiens
tgccactcattcctgtag

SEQ ID NO: 2058231 - DNA, 17 bp, Homo sapiens
tgccactccctgagctt

SEQ ID NO: 2058232 - DNA, 14 bp, Homo sapiens
tgccactgccaggc

SEQ ID NO: 2058233 - DNA, 19 bp, Homo sapiens
tgccactgccaggcacctg

SEQ ID NO: 2058234 - DNA, 19 bp, Homo sapiens
tgccactgcctcttcctcc

SEQ ID NO: 2058235 - DNA, 20 bp, Homo sapiens
tgccactgcctcttcctccc

SEQ ID NO: 2058236 - DNA, 14 bp, Homo sapiens
tgccacttccagga

SEQ ID NO: 2058237 - DNA, 22 bp, Homo sapiens
tgccacttccaggagcccagag

SEQ ID NO: 2058238 - DNA, 23 bp, Homo sapiens
tgccacttccaggagcccagagg

SEQ ID NO: 2058239 - DNA, 18 bp, Homo sapiens
tgccacttcccagaggca

SEQ ID NO: 2058240 - DNA, 23 bp, Homo sapiens
tgccacttcttaaaggcctggaa

SEQ ID NO: 2058241 - DNA, 19 bp, Homo sapiens
tgccacttgacattccttg

SEQ ID NO: 2058242 - DNA, 14 bp, Homo sapiens
tgccagaacagttt

SEQ ID NO: 2058243 - DNA, 14 bp, Homo sapiens
tgccagagcctggg

SEQ ID NO: 2058244 - DNA, 18 bp, Homo sapiens
tgccagagcctggggctc

SEQ ID NO: 2058245 - DNA, 20 bp, Homo sapiens
tgccagagcctggggctcta

SEQ ID NO: 2058246 - DNA, 14 bp, Homo sapiens
tgccagcacagggg

SEQ ID NO: 2058247 - DNA, 16 bp, Homo sapiens
tgccagcacaggggcc

SEQ ID NO: 2058248 - DNA, 17 bp, Homo sapiens
tgccagcacaggggccc

SEQ ID NO: 2058249 - DNA, 20 bp, Homo sapiens
tgccagcacaggggccccag

SEQ ID NO: 2058250 - DNA, 21 bp, Homo sapiens
tgccagcacaggggccccaga

SEQ ID NO: 2058251 - DNA, 11 bp, Homo sapiens
tgccagccaga

SEQ ID NO: 2058252 - DNA, 11 bp, Homo sapiens
tgccagccagc

SEQ ID NO: 2058253 - DNA, 12 bp, Homo sapiens
tgccagccagca

SEQ ID NO: 2058254 - DNA, 23 bp, Homo sapiens
tgccagccagcagccagctctca

SEQ ID NO: 2058255 - DNA, 23 bp, Homo sapiens
tgccagcccattttgaggccaga

SEQ ID NO: 2058256 - DNA, 17 bp, Homo sapiens
tgccagcctggcttctg

SEQ ID NO: 2058257 - DNA, 13 bp, Homo sapiens
tgccagctgcctt

SEQ ID NO: 2058258 - DNA, 17 bp, Homo sapiens
tgccagctgccttcctc

SEQ ID NO: 2058259 - DNA, 21 bp, Homo sapiens
tgccagcttcctgtgggccag

SEQ ID NO: 2058260 - DNA, 16 bp, Homo sapiens
tgccaggacacctgcc

SEQ ID NO: 2058261 - DNA, 20 bp, Homo sapiens
tgccaggacacctgccccag

SEQ ID NO: 2058262 - DNA, 21 bp, Homo sapiens
tgccaggacacctgccccagc

SEQ ID NO: 2058263 - DNA, 22 bp, Homo sapiens
tgccaggacacctgccccagcg

SEQ ID NO: 2058264 - DNA, 14 bp, Homo sapiens
tgccaggacagctg

SEQ ID NO: 2058265 - DNA, 18 bp, Homo sapiens
tgccaggacagctggctg

SEQ ID NO: 2058266 - DNA, 21 bp, Homo sapiens
tgccaggacagctggctgctg

SEQ ID NO: 2058267 - DNA, 12 bp, Homo sapiens
tgccaggactcc

SEQ ID NO: 2058268 - DNA, 16 bp, Homo sapiens
tgccaggactccccag

SEQ ID NO: 2058269 - DNA, 23 bp, Homo sapiens
tgccaggactccccaggccaggc

SEQ ID NO: 2058270 - DNA, 18 bp, Homo sapiens
tgccaggcacctggcctg

SEQ ID NO: 2058271 - DNA, 23 bp, Homo sapiens
tgccaggcccccgctggctcctc

SEQ ID NO: 2058272 - DNA, 22 bp, Homo sapiens
tgccaggcgttggtgccacttc

SEQ ID NO: 2058273 - DNA, 14 bp, Homo sapiens
tgccaggctccctt

SEQ ID NO: 2058274 - DNA, 23 bp, Homo sapiens
tgccagggcaggctaccccttca

SEQ ID NO: 2058275 - DNA, 18 bp, Homo sapiens
tgccagggcccctgttcc

SEQ ID NO: 2058276 - DNA, 22 bp, Homo sapiens
tgccaggtttttggtctgaccc

SEQ ID NO: 2058277 - DNA, 16 bp, Homo sapiens
tgctatatatataaat

SEQ ID NO: 2058278 - DNA, 20 bp, Homo sapiens
tgctatctctgtgtgcacaa

SEQ ID NO: 2058279 - DNA, 13 bp, Homo sapiens
tgctatgaatgat

SEQ ID NO: 2058280 - DNA, 15 bp, Homo sapiens
tgctattatgtaaca

SEQ ID NO: 2058281 - DNA, 22 bp, Homo sapiens
tgctatttctggcctcagcagg

SEQ ID NO: 2058282 - DNA, 13 bp, Homo sapiens
tgctatttgaagt

SEQ ID NO: 2058283 - DNA, 17 bp, Homo sapiens
tgctatttgagcatgca

SEQ ID NO: 2058284 - DNA, 24 bp, Homo sapiens
tgctatttgagcatgcacagctgc

SEQ ID NO: 2058285 - DNA, 19 bp, Homo sapiens
tgctatttgttgtttttaa

SEQ ID NO: 2058286 - DNA, 16 bp, Homo sapiens
tgctcaaccactgtgg

SEQ ID NO: 2058287 - DNA, 16 bp, Homo sapiens
tgctcaacctctctcc

SEQ ID NO: 2058288 - DNA, 19 bp, Homo sapiens
tgctcaacctctctccttc

SEQ ID NO: 2058289 - DNA, 20 bp, Homo sapiens
tgctcaacctctctccttct

SEQ ID NO: 2058290 - DNA, 15 bp, Homo sapiens
tgctcaagaagacat

SEQ ID NO: 2058291 - DNA, 15 bp, Homo sapiens
tgctcacatatctgt

SEQ ID NO: 2058292 - DNA, 23 bp, Homo sapiens
tgctcacgactcttcctgcaaag

SEQ ID NO: 2058293 - DNA, 16 bp, Homo sapiens
tgctcactcaggactt

SEQ ID NO: 2058294 - DNA, 14 bp, Homo sapiens
tgctcactgttcta

SEQ ID NO: 2058295 - DNA, 17 bp, Homo sapiens
tgctcaggaattgaaga

SEQ ID NO: 2058296 - DNA, 17 bp, Homo sapiens
tgctcagtaatttgagg

SEQ ID NO: 2058297 - DNA, 12 bp, Homo sapiens
tgctcagtgcct

SEQ ID NO: 2058298 - DNA, 14 bp, Homo sapiens
tgctcagtgcctcc

SEQ ID NO: 2058299 - DNA, 16 bp, Homo sapiens
tgctcagtgcctcctg

SEQ ID NO: 2058300 - DNA, 19 bp, Homo sapiens
tgctcataacatctttgaa

SEQ ID NO: 2058301 - DNA, 19 bp, Homo sapiens
tgctcatcacccagtcctg

SEQ ID NO: 2058302 - DNA, 23 bp, Homo sapiens
tgctcatcacccagtcctggcca

SEQ ID NO: 2058303 - DNA, 22 bp, Homo sapiens
tgctccaagtggtgggaatcag

SEQ ID NO: 2058304 - DNA, 15 bp, Homo sapiens
tgctccagggcagcc

SEQ ID NO: 2058305 - DNA, 12 bp, Homo sapiens
tgctccagggtc

SEQ ID NO: 2058306 - DNA, 15 bp, Homo sapiens
tgctcccagcagccc

SEQ ID NO: 2058307 - DNA, 16 bp, Homo sapiens
tgctccccagccctgg

SEQ ID NO: 2058308 - DNA, 14 bp, Homo sapiens
tgctcccccacccc

SEQ ID NO: 2058309 - DNA, 16 bp, Homo sapiens
tgctcccccaccccct

SEQ ID NO: 2058310 - DNA, 23 bp, Homo sapiens
tgctcccccaccccctccccagg

SEQ ID NO: 2058311 - DNA, 22 bp, Homo sapiens
tgctcctaaacccccgctccag

SEQ ID NO: 2058312 - DNA, 13 bp, Homo sapiens
tgctcctcccatt

SEQ ID NO: 2058313 - DNA, 18 bp, Homo sapiens
tgctcctcccattcccct

SEQ ID NO: 2058314 - DNA, 13 bp, Homo sapiens
tgctcctctccag

SEQ ID NO: 2058315 - DNA, 19 bp, Homo sapiens
tgctcctctccccagcaag

SEQ ID NO: 2058316 - DNA, 13 bp, Homo sapiens
tgctcgcagcctg

SEQ ID NO: 2058317 - DNA, 14 bp, Homo sapiens
tgctcgcagcctgg

SEQ ID NO: 2058318 - DNA, 23 bp, Homo sapiens
tgctcgcagcctggcggggcagg

SEQ ID NO: 2058319 - DNA, 19 bp, Homo sapiens
tgctcgcccacaaactgat

SEQ ID NO: 2058320 - DNA, 19 bp, Homo sapiens
tgctcggggtgcacaggag

SEQ ID NO: 2058321 - DNA, 12 bp, Homo sapiens
tgctctagccag

SEQ ID NO: 2058322 - DNA, 19 bp, Homo sapiens
tgctctagccaggagtctg

SEQ ID NO: 2058323 - DNA, 22 bp, Homo sapiens
tgctctagccaggagtctgtgc

SEQ ID NO: 2058324 - DNA, 15 bp, Homo sapiens
tgctctagctggcag

SEQ ID NO: 2058325 - DNA, 14 bp, Homo sapiens
tgctctcccctgcc

SEQ ID NO: 2058326 - DNA, 19 bp, Homo sapiens
tgctctcctaccccacctc

SEQ ID NO: 2058327 - DNA, 16 bp, Homo sapiens
tgctctcctcttgcca

SEQ ID NO: 2058328 - DNA, 12 bp, Homo sapiens
tgctctctgagg

SEQ ID NO: 2058329 - DNA, 17 bp, Homo sapiens
tgctctctgcagccagc

SEQ ID NO: 2058330 - DNA, 20 bp, Homo sapiens
tgctctgaatattttgtaat

SEQ ID NO: 2058331 - DNA, 19 bp, Homo sapiens
tgctctgatcatccactgt

SEQ ID NO: 2058332 - DNA, 16 bp, Homo sapiens
tgctctgatgcatcag

SEQ ID NO: 2058333 - DNA, 18 bp, Homo sapiens
tgctctgatgcatcagaa

SEQ ID NO: 2058334 - DNA, 15 bp, Homo sapiens
tgctctgcaggcacc

SEQ ID NO: 2058335 - DNA, 14 bp, Homo sapiens
tgctctgcccactg

SEQ ID NO: 2058336 - DNA, 16 bp, Homo sapiens
tgctctgccccaagcc

SEQ ID NO: 2058337 - DNA, 17 bp, Homo sapiens
tgctctgccccaagccc

SEQ ID NO: 2058338 - DNA, 18 bp, Homo sapiens
tgctctgccccaagcccc

SEQ ID NO: 2058339 - DNA, 13 bp, Homo sapiens
tgctctgcccctt

SEQ ID NO: 2058340 - DNA, 14 bp, Homo sapiens
tgctctgctgacag

SEQ ID NO: 2058341 - DNA, 16 bp, Homo sapiens
tgctctggaagagagg

SEQ ID NO: 2058342 - DNA, 16 bp, Homo sapiens
tgctctggacaggcat

SEQ ID NO: 2058343 - DNA, 24 bp, Homo sapiens
tgctctggcggcttcctgtccact

SEQ ID NO: 2058344 - DNA, 18 bp, Homo sapiens
tgctcttagtgcccgcct

SEQ ID NO: 2058345 - DNA, 13 bp, Homo sapiens
tgctcttcagtgg

SEQ ID NO: 2058346 - DNA, 22 bp, Homo sapiens
tgctcttctcttacgctctctg

SEQ ID NO: 2058347 - DNA, 17 bp, Homo sapiens
tgctcttgcctgcaccc

SEQ ID NO: 2058348 - DNA, 20 bp, Homo sapiens
tgctcttttggtggggagca

SEQ ID NO: 2058349 - DNA, 22 bp, Homo sapiens
tgctcttttggtggggagcact

SEQ ID NO: 2058350 - DNA, 18 bp, Homo sapiens
tgctgaaacacctcccag

SEQ ID NO: 2058351 - DNA, 14 bp, Homo sapiens
tgctgaaactgtgt

SEQ ID NO: 2058352 - DNA, 14 bp, Homo sapiens
tgctgaagaggcaa

SEQ ID NO: 2058353 - DNA, 23 bp, Homo sapiens
tgctgaattattttgttgtgatt

SEQ ID NO: 2058354 - DNA, 15 bp, Homo sapiens
tgctgacagacacag

SEQ ID NO: 2058355 - DNA, 16 bp, Homo sapiens
tgctgacagacacagg

SEQ ID NO: 2058356 - DNA, 19 bp, Homo sapiens
tgctgacagacacaggccc

SEQ ID NO: 2058357 - DNA, 14 bp, Homo sapiens
tgctgacaggatgt

SEQ ID NO: 2058358 - DNA, 21 bp, Homo sapiens
tgctgacaggatgtggcactg

SEQ ID NO: 2058359 - DNA, 19 bp, Homo sapiens
tgctgacatggctttgctt

SEQ ID NO: 2058360 - DNA, 23 bp, Homo sapiens
tgctgacatggctttgctttgtg

SEQ ID NO: 2058361 - DNA, 21 bp, Homo sapiens
tgctgactccatatggaggcc

SEQ ID NO: 2058362 - DNA, 21 bp, Homo sapiens
tgctgactgtactcctcccag

SEQ ID NO: 2058363 - DNA, 17 bp, Homo sapiens
tgctgagaacctggcct

SEQ ID NO: 2058364 - DNA, 18 bp, Homo sapiens
tgctgagaacctggcctt

SEQ ID NO: 2058365 - DNA, 21 bp, Homo sapiens
tgctgagagacccaaggagga

SEQ ID NO: 2058366 - DNA, 22 bp, Homo sapiens
tgctgagagacccaaggaggaa

SEQ ID NO: 2058367 - DNA, 20 bp, Homo sapiens
tgctgagattacaggtgtga

SEQ ID NO: 2058368 - DNA, 17 bp, Homo sapiens
tgctgagcaccctctcc

SEQ ID NO: 2058369 - DNA, 15 bp, Homo sapiens
tgctgagctctgaga

SEQ ID NO: 2058370 - DNA, 22 bp, Homo sapiens
tgctgagctctgagaggccctg

SEQ ID NO: 2058371 - DNA, 21 bp, Homo sapiens
tgctgagtatgttaagctctt

SEQ ID NO: 2058372 - DNA, 21 bp, Homo sapiens
tgctgatgaactcttaatcaa

SEQ ID NO: 2058373 - DNA, 15 bp, Homo sapiens
tgctgattcaagaaa

SEQ ID NO: 2058374 - DNA, 16 bp, Homo sapiens
tgctgattcagcctgg

SEQ ID NO: 2058375 - DNA, 14 bp, Homo sapiens
tgctgcaaagtgca

SEQ ID NO: 2058376 - DNA, 13 bp, Homo sapiens
tgctgcaccagag

SEQ ID NO: 2058377 - DNA, 15 bp, Homo sapiens
tgctgccatccaggt

SEQ ID NO: 2058378 - DNA, 22 bp, Homo sapiens
tgctgccccgcttccccacaga

SEQ ID NO: 2058379 - DNA, 22 bp, Homo sapiens
tgctgccccgttccctgtcaga

SEQ ID NO: 2058380 - DNA, 18 bp, Homo sapiens
tgctgccctgctctgggg

SEQ ID NO: 2058381 - DNA, 21 bp, Homo sapiens
tgctgccgcctcccagcctgg

SEQ ID NO: 2058382 - DNA, 16 bp, Homo sapiens
tgctgcctccctctgc

SEQ ID NO: 2058383 - DNA, 15 bp, Homo sapiens
tgctgcgtcagacca

SEQ ID NO: 2058384 - DNA, 16 bp, Homo sapiens
tgctgctctctgaggg

SEQ ID NO: 2058385 - DNA, 18 bp, Homo sapiens
tgctgctgagaacctggc

SEQ ID NO: 2058386 - DNA, 19 bp, Homo sapiens
tgctgctgagaacctggcc

SEQ ID NO: 2058387 - DNA, 21 bp, Homo sapiens
tgctgctgagaacctggcctt

SEQ ID NO: 2058388 - DNA, 18 bp, Homo sapiens
tgctgctgtaactgctga

SEQ ID NO: 2058389 - DNA, 20 bp, Homo sapiens
tgctgctgtaactgctgagc

SEQ ID NO: 2058390 - DNA, 23 bp, Homo sapiens
tgctgctgtaactgctgagccac

SEQ ID NO: 2058391 - DNA, 18 bp, Homo sapiens
tggacatttgccttgctg

SEQ ID NO: 2058392 - DNA, 12 bp, Homo sapiens
tggaccaagaat

SEQ ID NO: 2058393 - DNA, 15 bp, Homo sapiens
tggaccacaggcatc

SEQ ID NO: 2058394 - DNA, 22 bp, Homo sapiens
tggaccacaggcatctacacag

SEQ ID NO: 2058395 - DNA, 21 bp, Homo sapiens
tggaccaccagccccagcaag

SEQ ID NO: 2058396 - DNA, 23 bp, Homo sapiens
tggaccacccgccctggcagttg

SEQ ID NO: 2058397 - DNA, 19 bp, Homo sapiens
tggaccactgggcaatgat

SEQ ID NO: 2058398 - DNA, 18 bp, Homo sapiens
tggaccaggacaggacca

SEQ ID NO: 2058399 - DNA, 17 bp, Homo sapiens
tggaccagtagacaact

SEQ ID NO: 2058400 - DNA, 16 bp, Homo sapiens
tggaccccgcctccca

SEQ ID NO: 2058401 - DNA, 19 bp, Homo sapiens
tggaccccgcctcccagcc

SEQ ID NO: 2058402 - DNA, 18 bp, Homo sapiens
tggacccctcccttgctc

SEQ ID NO: 2058403 - DNA, 15 bp, Homo sapiens
tggacccgctctgga

SEQ ID NO: 2058404 - DNA, 16 bp, Homo sapiens
tggaccgggtgggcct

SEQ ID NO: 2058405 - DNA, 22 bp, Homo sapiens
tggaccgggtgggcctggcctg

SEQ ID NO: 2058406 - DNA, 15 bp, Homo sapiens
tggacctctgctctg

SEQ ID NO: 2058407 - DNA, 17 bp, Homo sapiens
tggacctctgctctgag

SEQ ID NO: 2058408 - DNA, 12 bp, Homo sapiens
tggaccttcctg

SEQ ID NO: 2058409 - DNA, 16 bp, Homo sapiens
tggaccttttgtctca

SEQ ID NO: 2058410 - DNA, 22 bp, Homo sapiens
tggacgcccagctgaggctggg

SEQ ID NO: 2058411 - DNA, 18 bp, Homo sapiens
tggactattataatttaa

SEQ ID NO: 2058412 - DNA, 19 bp, Homo sapiens
tggactctaagctggagct

SEQ ID NO: 2058413 - DNA, 13 bp, Homo sapiens
tggactctgcaca

SEQ ID NO: 2058414 - DNA, 14 bp, Homo sapiens
tggactctgcacat

SEQ ID NO: 2058415 - DNA, 19 bp, Homo sapiens
tggactctgcacatgtctt

SEQ ID NO: 2058416 - DNA, 21 bp, Homo sapiens
tggactgactaccagctaact

SEQ ID NO: 2058417 - DNA, 14 bp, Homo sapiens
tggacttcctgggg

SEQ ID NO: 2058418 - DNA, 23 bp, Homo sapiens
tggactttggttctctccaggaa

SEQ ID NO: 2058419 - DNA, 14 bp, Homo sapiens
tggagaaaccctgt

SEQ ID NO: 2058420 - DNA, 21 bp, Homo sapiens
tggagaaataaaaatacctct

SEQ ID NO: 2058421 - DNA, 21 bp, Homo sapiens
tggagaaattatttaataaaa

SEQ ID NO: 2058422 - DNA, 18 bp, Homo sapiens
tggagaactagaacctgg

SEQ ID NO: 2058423 - DNA, 19 bp, Homo sapiens
tggagaactagaacctgga

SEQ ID NO: 2058424 - DNA, 19 bp, Homo sapiens
tggagaactttccatctgc

SEQ ID NO: 2058425 - DNA, 16 bp, Homo sapiens
tggagaagctcaccca

SEQ ID NO: 2058426 - DNA, 15 bp, Homo sapiens
tggagacagcgaact

SEQ ID NO: 2058427 - DNA, 19 bp, Homo sapiens
tggagaccgcttcacccct

SEQ ID NO: 2058428 - DNA, 18 bp, Homo sapiens
tggagactaagccctgtc

SEQ ID NO: 2058429 - DNA, 18 bp, Homo sapiens
tggagactcctgccctgt

SEQ ID NO: 2058430 - DNA, 19 bp, Homo sapiens
tggagactggtcctgtgtg

SEQ ID NO: 2058431 - DNA, 17 bp, Homo sapiens
tggagacttggaagagt

SEQ ID NO: 2058432 - DNA, 13 bp, Homo sapiens
tggagagcagctg

SEQ ID NO: 2058433 - DNA, 18 bp, Homo sapiens
tggagagccagaacctgg

SEQ ID NO: 2058434 - DNA, 18 bp, Homo sapiens
tggagagctagaacctgg

SEQ ID NO: 2058435 - DNA, 22 bp, Homo sapiens
tggagagctagaacctggagag

SEQ ID NO: 2058436 - DNA, 21 bp, Homo sapiens
tggagagctagaacctggagg

SEQ ID NO: 2058437 - DNA, 15 bp, Homo sapiens
tggagaggcggcctc

SEQ ID NO: 2058438 - DNA, 17 bp, Homo sapiens
tggagagggacgaagaa

SEQ ID NO: 2058439 - DNA, 18 bp, Homo sapiens
tggagaggggcctgggaa

SEQ ID NO: 2058440 - DNA, 23 bp, Homo sapiens
tggagagtgagaataattgtgta

SEQ ID NO: 2058441 - DNA, 19 bp, Homo sapiens
tggagatcctaactgagaa

SEQ ID NO: 2058442 - DNA, 16 bp, Homo sapiens
tggagattctgattca

SEQ ID NO: 2058443 - DNA, 22 bp, Homo sapiens
tggagcaagaaggaaggaggca

SEQ ID NO: 2058444 - DNA, 15 bp, Homo sapiens
tggagcaagagagag

SEQ ID NO: 2058445 - DNA, 14 bp, Homo sapiens
tggagcagaatcag

SEQ ID NO: 2058446 - DNA, 11 bp, Homo sapiens
tggagcaggga

SEQ ID NO: 2058447 - DNA, 22 bp, Homo sapiens
tggagcagtacatgggaaagga

SEQ ID NO: 2058448 - DNA, 14 bp, Homo sapiens
tggagccactcctg

SEQ ID NO: 2058449 - DNA, 16 bp, Homo sapiens
tggagccactcctgtc

SEQ ID NO: 2058450 - DNA, 19 bp, Homo sapiens
tggagccactcctgtcccg

SEQ ID NO: 2058451 - DNA, 23 bp, Homo sapiens
tggagccactcctgtcccgcctt

SEQ ID NO: 2058452 - DNA, 22 bp, Homo sapiens
tggagcccgagggcctgacagg

SEQ ID NO: 2058453 - DNA, 15 bp, Homo sapiens
tggagcccttgggtt

SEQ ID NO: 2058454 - DNA, 19 bp, Homo sapiens
tggagcctcggtggccatg

SEQ ID NO: 2058455 - DNA, 21 bp, Homo sapiens
tggagcctcggtggccatgct

SEQ ID NO: 2058456 - DNA, 14 bp, Homo sapiens
tggagcctggcaca

SEQ ID NO: 2058457 - DNA, 18 bp, Homo sapiens
tggagcctggcacaggac

SEQ ID NO: 2058458 - DNA, 19 bp, Homo sapiens
tggagcctggcacaggact

SEQ ID NO: 2058459 - DNA, 14 bp, Homo sapiens
tggagcgcacctgc

SEQ ID NO: 2058460 - DNA, 16 bp, Homo sapiens
tggagcgcacctgccc

SEQ ID NO: 2058461 - DNA, 14 bp, Homo sapiens
tggagcggctctcc

SEQ ID NO: 2058462 - DNA, 12 bp, Homo sapiens
tggaggaacagc

SEQ ID NO: 2058463 - DNA, 22 bp, Homo sapiens
tggaggaagatccaaacagaaa

SEQ ID NO: 2058464 - DNA, 15 bp, Homo sapiens
tggaggaaggtgctg

SEQ ID NO: 2058465 - DNA, 18 bp, Homo sapiens
tggaggaaggtgctgagc

SEQ ID NO: 2058466 - DNA, 13 bp, Homo sapiens
tggaggacctgag

SEQ ID NO: 2058467 - DNA, 15 bp, Homo sapiens
tggaggacctgagcc

SEQ ID NO: 2058468 - DNA, 16 bp, Homo sapiens
tggaggacctgagcct

SEQ ID NO: 2058469 - DNA, 19 bp, Homo sapiens
tggaggacctgagcctgcc

SEQ ID NO: 2058470 - DNA, 20 bp, Homo sapiens
tggaggacctgagcctgccg

SEQ ID NO: 2058471 - DNA, 20 bp, Homo sapiens
tggaggagctcaggacacta

SEQ ID NO: 2058472 - DNA, 19 bp, Homo sapiens
tggaggaggtgtcccaagc

SEQ ID NO: 2058473 - DNA, 15 bp, Homo sapiens
tggaggatggagaga

SEQ ID NO: 2058474 - DNA, 14 bp, Homo sapiens
tggaggcagacagc

SEQ ID NO: 2058475 - DNA, 17 bp, Homo sapiens
tggaggccaccgggaca

SEQ ID NO: 2058476 - DNA, 18 bp, Homo sapiens
tggaggcctgatgctgcc

SEQ ID NO: 2058477 - DNA, 19 bp, Homo sapiens
tggaggcctgatgctgccc

SEQ ID NO: 2058478 - DNA, 20 bp, Homo sapiens
tggaggcctgatgctgcccc

SEQ ID NO: 2058479 - DNA, 16 bp, Homo sapiens
tggagggaagacaggt

SEQ ID NO: 2058480 - DNA, 20 bp, Homo sapiens
tggagggaatgaacctggag

SEQ ID NO: 2058481 - DNA, 22 bp, Homo sapiens
tggagggctagaacctggagaa

SEQ ID NO: 2058482 - DNA, 21 bp, Homo sapiens
tggagggctagaactggagag

SEQ ID NO: 2058483 - DNA, 22 bp, Homo sapiens
tggagggctggaatctggagag

SEQ ID NO: 2058484 - DNA, 17 bp, Homo sapiens
tggagggtaggggagtg

SEQ ID NO: 2058485 - DNA, 18 bp, Homo sapiens
tggagggtcgcctggctt

SEQ ID NO: 2058486 - DNA, 18 bp, Homo sapiens
tggaggtgaagtccctgt

SEQ ID NO: 2058487 - DNA, 20 bp, Homo sapiens
tggaggttgcagtgagctga

SEQ ID NO: 2058488 - DNA, 21 bp, Homo sapiens
tggaggttgcagtgagctgag

SEQ ID NO: 2058489 - DNA, 13 bp, Homo sapiens
tggagtctgagtc

SEQ ID NO: 2058490 - DNA, 16 bp, Homo sapiens
tggagtctgagtctga

SEQ ID NO: 2058491 - DNA, 17 bp, Homo sapiens
tggagtgaggcttccag

SEQ ID NO: 2058492 - DNA, 19 bp, Homo sapiens
tggagtgaggcttccaggc

SEQ ID NO: 2058493 - DNA, 15 bp, Homo sapiens
tggagtgcagggagg

SEQ ID NO: 2058494 - DNA, 13 bp, Homo sapiens
tggagtgggagat

SEQ ID NO: 2058495 - DNA, 18 bp, Homo sapiens
tggagttacattaatgtt

SEQ ID NO: 2058496 - DNA, 20 bp, Homo sapiens
tggagttacattaatgttaa

SEQ ID NO: 2058497 - DNA, 13 bp, Homo sapiens
tggagttcagaga

SEQ ID NO: 2058498 - DNA, 14 bp, Homo sapiens
tggagttcttgtgc

SEQ ID NO: 2058499 - DNA, 17 bp, Homo sapiens
tggatagctgccttttt

SEQ ID NO: 2058500 - DNA, 18 bp, Homo sapiens
tggatcagcgtggccttg

SEQ ID NO: 2058501 - DNA, 14 bp, Homo sapiens
tggatctcaatctt

SEQ ID NO: 2058502 - DNA, 21 bp, Homo sapiens
tggatctccaaggaccaggtt

SEQ ID NO: 2058503 - DNA, 15 bp, Homo sapiens
tggatctccccactc

SEQ ID NO: 2058504 - DNA, 13 bp, Homo sapiens
tggatgaccagaa

SEQ ID NO: 2058505 - DNA, 15 bp, Homo sapiens
tggggacagttggca

SEQ ID NO: 2058506 - DNA, 11 bp, Homo sapiens
tggggagaaat

SEQ ID NO: 2058507 - DNA, 16 bp, Homo sapiens
tggggagaaataattg

SEQ ID NO: 2058508 - DNA, 20 bp, Homo sapiens
tggggagaagtgagggctgg

SEQ ID NO: 2058509 - DNA, 20 bp, Homo sapiens
tggggagacctggttggccg

SEQ ID NO: 2058510 - DNA, 14 bp, Homo sapiens
tggggagcagagta

SEQ ID NO: 2058511 - DNA, 17 bp, Homo sapiens
tggggaggaagggccag

SEQ ID NO: 2058512 - DNA, 18 bp, Homo sapiens
tggggaggaagggccagg

SEQ ID NO: 2058513 - DNA, 19 bp, Homo sapiens
tggggaggaagggccagga

SEQ ID NO: 2058514 - DNA, 21 bp, Homo sapiens
tggggaggaagggccaggaga

SEQ ID NO: 2058515 - DNA, 21 bp, Homo sapiens
tggggagggagacagagacag

SEQ ID NO: 2058516 - DNA, 22 bp, Homo sapiens
tggggagggggaagagaaattt

SEQ ID NO: 2058517 - DNA, 23 bp, Homo sapiens
tggggatgagaaaggttgaagca

SEQ ID NO: 2058518 - DNA, 19 bp, Homo sapiens
tggggattgggagggacag

SEQ ID NO: 2058519 - DNA, 19 bp, Homo sapiens
tggggcaacgacggtttca

SEQ ID NO: 2058520 - DNA, 16 bp, Homo sapiens
tggggcaatggggaga

SEQ ID NO: 2058521 - DNA, 19 bp, Homo sapiens
tggggcaatggggagaggc

SEQ ID NO: 2058522 - DNA, 21 bp, Homo sapiens
tggggcaatggggagaggcaa

SEQ ID NO: 2058523 - DNA, 21 bp, Homo sapiens
tggggcagaggggcagccgct

SEQ ID NO: 2058524 - DNA, 15 bp, Homo sapiens
tggggcagctcctct

SEQ ID NO: 2058525 - DNA, 12 bp, Homo sapiens
tggggcaggagt

SEQ ID NO: 2058526 - DNA, 14 bp, Homo sapiens
tggggcaggagtag

SEQ ID NO: 2058527 - DNA, 15 bp, Homo sapiens
tggggcaggagtagc

SEQ ID NO: 2058528 - DNA, 21 bp, Homo sapiens
tggggcaggagtagctgagct

SEQ ID NO: 2058529 - DNA, 22 bp, Homo sapiens
tggggcaggagtagctgagctc

SEQ ID NO: 2058530 - DNA, 15 bp, Homo sapiens
tggggcatgtgtgcc

SEQ ID NO: 2058531 - DNA, 13 bp, Homo sapiens
tggggccagtgta

SEQ ID NO: 2058532 - DNA, 16 bp, Homo sapiens
tggggccccgctggga

SEQ ID NO: 2058533 - DNA, 16 bp, Homo sapiens
tggggccctgggcctc

SEQ ID NO: 2058534 - DNA, 15 bp, Homo sapiens
tggggcctggagagg

SEQ ID NO: 2058535 - DNA, 13 bp, Homo sapiens
tggggcctggctt

SEQ ID NO: 2058536 - DNA, 18 bp, Homo sapiens
tggggcctgtactgcctg

SEQ ID NO: 2058537 - DNA, 20 bp, Homo sapiens
tggggcctgtactgcctgct

SEQ ID NO: 2058538 - DNA, 11 bp, Homo sapiens
tggggctcctt

SEQ ID NO: 2058539 - DNA, 21 bp, Homo sapiens
tggggctcgccccacccaggg

SEQ ID NO: 2058540 - DNA, 21 bp, Homo sapiens
tggggctctaacgcctgagcc

SEQ ID NO: 2058541 - DNA, 22 bp, Homo sapiens
tggggctgcgaaaacgttgacc

SEQ ID NO: 2058542 - DNA, 14 bp, Homo sapiens
tggggctgctcctc

SEQ ID NO: 2058543 - DNA, 15 bp, Homo sapiens
tggggctgctcctcc

SEQ ID NO: 2058544 - DNA, 17 bp, Homo sapiens
tggggctgctcctccag

SEQ ID NO: 2058545 - DNA, 21 bp, Homo sapiens
tggggctgctcctccagggcc

SEQ ID NO: 2058546 - DNA, 17 bp, Homo sapiens
tggggctggagaggaca

SEQ ID NO: 2058547 - DNA, 15 bp, Homo sapiens
tggggcttctcctga

SEQ ID NO: 2058548 - DNA, 16 bp, Homo sapiens
tgggggaagccctgga

SEQ ID NO: 2058549 - DNA, 14 bp, Homo sapiens
tgggggacttacat

SEQ ID NO: 2058550 - DNA, 17 bp, Homo sapiens
tgggggagggaggttcc

SEQ ID NO: 2058551 - DNA, 20 bp, Homo sapiens
tgggggaggtccctgccagt

SEQ ID NO: 2058552 - DNA, 21 bp, Homo sapiens
tgggggaggtccctgccagtg

SEQ ID NO: 2058553 - DNA, 19 bp, Homo sapiens
tgggggcagtgactggcag

SEQ ID NO: 2058554 - DNA, 14 bp, Homo sapiens
tgggggccagctgg

SEQ ID NO: 2058555 - DNA, 21 bp, Homo sapiens
tgggggccagctggtgctgca

SEQ ID NO: 2058556 - DNA, 17 bp, Homo sapiens
tgggggccgctggccca

SEQ ID NO: 2058557 - DNA, 18 bp, Homo sapiens
tgggggccgctggcccag

SEQ ID NO: 2058558 - DNA, 11 bp, Homo sapiens
tgggggcctgg

SEQ ID NO: 2058559 - DNA, 13 bp, Homo sapiens
tgggggcctggct

SEQ ID NO: 2058560 - DNA, 17 bp, Homo sapiens
tgggggcctggctggct

SEQ ID NO: 2058561 - DNA, 15 bp, Homo sapiens
tgggggtggcaggca

SEQ ID NO: 2058562 - DNA, 21 bp, Homo sapiens
tgggggtggccatccctgggc

SEQ ID NO: 2058563 - DNA, 11 bp, Homo sapiens
tgggggtgggg

SEQ ID NO: 2058564 - DNA, 20 bp, Homo sapiens
tgggggttctttcttcctct

SEQ ID NO: 2058565 - DNA, 21 bp, Homo sapiens
tgggggttggatgggaagatg

SEQ ID NO: 2058566 - DNA, 18 bp, Homo sapiens
tggggtaagccagagcct

SEQ ID NO: 2058567 - DNA, 19 bp, Homo sapiens
tggggtaagccagagcctg

SEQ ID NO: 2058568 - DNA, 13 bp, Homo sapiens
tggggtcagccag

SEQ ID NO: 2058569 - DNA, 19 bp, Homo sapiens
tggggtcagccagggccag

SEQ ID NO: 2058570 - DNA, 13 bp, Homo sapiens
tggggtctccctc

SEQ ID NO: 2058571 - DNA, 22 bp, Homo sapiens
tggggtctccctctcctgccta

SEQ ID NO: 2058572 - DNA, 22 bp, Homo sapiens
tggggtgacccggcaccccctg

SEQ ID NO: 2058573 - DNA, 13 bp, Homo sapiens
tggggtgggccca

SEQ ID NO: 2058574 - DNA, 14 bp, Homo sapiens
tggggtggggcagg

SEQ ID NO: 2058575 - DNA, 14 bp, Homo sapiens
tggggttcagcccc

SEQ ID NO: 2058576 - DNA, 15 bp, Homo sapiens
tggggttcagcccct

SEQ ID NO: 2058577 - DNA, 14 bp, Homo sapiens
tgggtaacgtgaga

SEQ ID NO: 2058578 - DNA, 15 bp, Homo sapiens
tgggtacatgtgagg

SEQ ID NO: 2058579 - DNA, 22 bp, Homo sapiens
tgggtactactgctgcaaagtg

SEQ ID NO: 2058580 - DNA, 21 bp, Homo sapiens
tgggtaggtgttgaaaatgag

SEQ ID NO: 2058581 - DNA, 22 bp, Homo sapiens
tgggtattaaacttgtcagaat

SEQ ID NO: 2058582 - DNA, 15 bp, Homo sapiens
tgggtatttcctgct

SEQ ID NO: 2058583 - DNA, 16 bp, Homo sapiens
tgggtatttcctgcta

SEQ ID NO: 2058584 - DNA, 19 bp, Homo sapiens
tgggtcctgcaatctccag

SEQ ID NO: 2058585 - DNA, 14 bp, Homo sapiens
tgggtcctgcaatt

SEQ ID NO: 2058586 - DNA, 18 bp, Homo sapiens
tgggtctcactcctgagt

SEQ ID NO: 2058587 - DNA, 15 bp, Homo sapiens
tgggtctggctgagc

SEQ ID NO: 2058588 - DNA, 17 bp, Homo sapiens
tgggtctggctgagctg

SEQ ID NO: 2058589 - DNA, 15 bp, Homo sapiens
tgggtgaaagtgact

SEQ ID NO: 2058590 - DNA, 22 bp, Homo sapiens
tgggtgaggatccctgaaggcc

SEQ ID NO: 2058591 - DNA, 19 bp, Homo sapiens
tgggtgatcagaaggctgg

SEQ ID NO: 2058592 - DNA, 17 bp, Homo sapiens
tgggtgccattcccagc

SEQ ID NO: 2058593 - DNA, 23 bp, Homo sapiens
tgggtggatgcctggtggcagct

SEQ ID NO: 2058594 - DNA, 23 bp, Homo sapiens
tgggtggctactctgtgccagag

SEQ ID NO: 2058595 - DNA, 14 bp, Homo sapiens
tgggtggctcctgc

SEQ ID NO: 2058596 - DNA, 18 bp, Homo sapiens
tgggtggctcctgccact

SEQ ID NO: 2058597 - DNA, 22 bp, Homo sapiens
tgggtggctcctgccactgacc

SEQ ID NO: 2058598 - DNA, 21 bp, Homo sapiens
tgggtggggctgctcctccag

SEQ ID NO: 2058599 - DNA, 14 bp, Homo sapiens
tgggtggtggatct

SEQ ID NO: 2058600 - DNA, 23 bp, Homo sapiens
tgggtgtcaagagggtctgagga

SEQ ID NO: 2058601 - DNA, 16 bp, Homo sapiens
tgggtgtgccaggcta

SEQ ID NO: 2058602 - DNA, 21 bp, Homo sapiens
tgggttatttttgtccctgct

SEQ ID NO: 2058603 - DNA, 15 bp, Homo sapiens
tgggttcactagagc

SEQ ID NO: 2058604 - DNA, 16 bp, Homo sapiens
tgggttcattccccgg

SEQ ID NO: 2058605 - DNA, 23 bp, Homo sapiens
tgggttcctttttcaacttggaa

SEQ ID NO: 2058606 - DNA, 17 bp, Homo sapiens
tgggtttggatctccaa

SEQ ID NO: 2058607 - DNA, 14 bp, Homo sapiens
tgggttttatcagt

SEQ ID NO: 2058608 - DNA, 18 bp, Homo sapiens
tgggttttctaactgtaa

SEQ ID NO: 2058609 - DNA, 17 bp, Homo sapiens
tgggttttgtctctgca

SEQ ID NO: 2058610 - DNA, 16 bp, Homo sapiens
tggtaagcagaggctt

SEQ ID NO: 2058611 - DNA, 20 bp, Homo sapiens
tggtacaaattgttcatgtt

SEQ ID NO: 2058612 - DNA, 24 bp, Homo sapiens
tggtacttgtttcaccatacttca

SEQ ID NO: 2058613 - DNA, 17 bp, Homo sapiens
tggtagaccaaaataaa

SEQ ID NO: 2058614 - DNA, 15 bp, Homo sapiens
tggtaggatttatat

SEQ ID NO: 2058615 - DNA, 15 bp, Homo sapiens
tggtaggcttatcaa

SEQ ID NO: 2058616 - DNA, 15 bp, Homo sapiens
tggtatcaagaaagt

SEQ ID NO: 2058617 - DNA, 19 bp, Homo sapiens
tggtatgaacttgaggaca

SEQ ID NO: 2058618 - DNA, 22 bp, Homo sapiens
tggtatgaacttgaggacacat

SEQ ID NO: 2058619 - DNA, 21 bp, Homo sapiens
tgtcccacctcttctcttcct

SEQ ID NO: 2058620 - DNA, 22 bp, Homo sapiens
tgtcccacctcttctcttcctg

SEQ ID NO: 2058621 - DNA, 23 bp, Homo sapiens
tgtcccacctcttctcttcctgt

SEQ ID NO: 2058622 - DNA, 23 bp, Homo sapiens
tgtcccagaggttatctgcctgg

SEQ ID NO: 2058623 - DNA, 14 bp, Homo sapiens
tgtcccaggtcctc

SEQ ID NO: 2058624 - DNA, 17 bp, Homo sapiens
tgtcccaggtcctcact

SEQ ID NO: 2058625 - DNA, 19 bp, Homo sapiens
tgtcccatctgctcctccc

SEQ ID NO: 2058626 - DNA, 15 bp, Homo sapiens
tgtcccatttccttg

SEQ ID NO: 2058627 - DNA, 17 bp, Homo sapiens
tgtcccatttccttgga

SEQ ID NO: 2058628 - DNA, 12 bp, Homo sapiens
tgtccccagggc

SEQ ID NO: 2058629 - DNA, 14 bp, Homo sapiens
tgtcccccccagtg

SEQ ID NO: 2058630 - DNA, 14 bp, Homo sapiens
tgtcccccggggca

SEQ ID NO: 2058631 - DNA, 20 bp, Homo sapiens
tgtccccctgagatcagagt

SEQ ID NO: 2058632 - DNA, 21 bp, Homo sapiens
tgtccccctgagatcagagtc

SEQ ID NO: 2058633 - DNA, 15 bp, Homo sapiens
tgtcccctcactctg

SEQ ID NO: 2058634 - DNA, 16 bp, Homo sapiens
tgtcccctcactctgt

SEQ ID NO: 2058635 - DNA, 18 bp, Homo sapiens
tgtcccctccactgtcac

SEQ ID NO: 2058636 - DNA, 20 bp, Homo sapiens
tgtcccctgtcccaccaact

SEQ ID NO: 2058637 - DNA, 19 bp, Homo sapiens
tgtccctacacccctcccc

SEQ ID NO: 2058638 - DNA, 18 bp, Homo sapiens
tgtccctacccactcttt

SEQ ID NO: 2058639 - DNA, 21 bp, Homo sapiens
tgtccctctcggaaggctggc

SEQ ID NO: 2058640 - DNA, 12 bp, Homo sapiens
tgtccctgctcc

SEQ ID NO: 2058641 - DNA, 18 bp, Homo sapiens
tgtccctgtttcaaactg

SEQ ID NO: 2058642 - DNA, 22 bp, Homo sapiens
tgtccgaagaccgaattttatt

SEQ ID NO: 2058643 - DNA, 15 bp, Homo sapiens
tgtccgttccaggag

SEQ ID NO: 2058644 - DNA, 16 bp, Homo sapiens
tgtcctaaggacacac

SEQ ID NO: 2058645 - DNA, 18 bp, Homo sapiens
tgtcctaaggacacacta

SEQ ID NO: 2058646 - DNA, 14 bp, Homo sapiens
tgtcctatgtcaat

SEQ ID NO: 2058647 - DNA, 21 bp, Homo sapiens
tgtcctccaacaataaagagc

SEQ ID NO: 2058648 - DNA, 23 bp, Homo sapiens
tgtcctccaacaataaagagctc

SEQ ID NO: 2058649 - DNA, 24 bp, Homo sapiens
tgtcctccagcttcccctcgctgt

SEQ ID NO: 2058650 - DNA, 19 bp, Homo sapiens
tgtcctcccatcccctgga

SEQ ID NO: 2058651 - DNA, 21 bp, Homo sapiens
tgtcctcctcggatcaccgag

SEQ ID NO: 2058652 - DNA, 12 bp, Homo sapiens
tgtcctctcccc

SEQ ID NO: 2058653 - DNA, 16 bp, Homo sapiens
tgtcctctcccctctg

SEQ ID NO: 2058654 - DNA, 21 bp, Homo sapiens
tgtcctctcccctctgccctg

SEQ ID NO: 2058655 - DNA, 23 bp, Homo sapiens
tgtcctctttactcccttcctgg

SEQ ID NO: 2058656 - DNA, 12 bp, Homo sapiens
tgtcctgccagc

SEQ ID NO: 2058657 - DNA, 15 bp, Homo sapiens
tgtcctgccagctgc

SEQ ID NO: 2058658 - DNA, 21 bp, Homo sapiens
tgtcctgcctctctgctccag

SEQ ID NO: 2058659 - DNA, 22 bp, Homo sapiens
tgtcctgcctctctgctccaga

SEQ ID NO: 2058660 - DNA, 15 bp, Homo sapiens
tgtcctgccttgatg

SEQ ID NO: 2058661 - DNA, 12 bp, Homo sapiens
tgtcctgctgtg

SEQ ID NO: 2058662 - DNA, 15 bp, Homo sapiens
tgtcctggctgctct

SEQ ID NO: 2058663 - DNA, 19 bp, Homo sapiens
tgtcctggtacagcagggt

SEQ ID NO: 2058664 - DNA, 24 bp, Homo sapiens
tgtcctgtagttgcgtggactctg

SEQ ID NO: 2058665 - DNA, 18 bp, Homo sapiens
tgtccttcagagctcttc

SEQ ID NO: 2058666 - DNA, 19 bp, Homo sapiens
tgtccttcagagctcttca

SEQ ID NO: 2058667 - DNA, 14 bp, Homo sapiens
tgtccttccctgca

SEQ ID NO: 2058668 - DNA, 16 bp, Homo sapiens
tgtccttccctgcatt

SEQ ID NO: 2058669 - DNA, 17 bp, Homo sapiens
tgtcctttgagaaagaa

SEQ ID NO: 2058670 - DNA, 23 bp, Homo sapiens
tgtcctttgttattatcctgcat

SEQ ID NO: 2058671 - DNA, 15 bp, Homo sapiens
tgtcgagacacttgc

SEQ ID NO: 2058672 - DNA, 19 bp, Homo sapiens
tgtcgccccaggccctccc

SEQ ID NO: 2058673 - DNA, 23 bp, Homo sapiens
tgtcgccccaggccctccctgac

SEQ ID NO: 2058674 - DNA, 12 bp, Homo sapiens
tgtcgcctgccc

SEQ ID NO: 2058675 - DNA, 24 bp, Homo sapiens
tgtcgcctgcccccagcactcctc

SEQ ID NO: 2058676 - DNA, 12 bp, Homo sapiens
tgtcgctgcttc

SEQ ID NO: 2058677 - DNA, 15 bp, Homo sapiens
tgtcgctgcttcgtg

SEQ ID NO: 2058678 - DNA, 17 bp, Homo sapiens
tgtcggagtagaaattg

SEQ ID NO: 2058679 - DNA, 18 bp, Homo sapiens
tgtcggcacgtcccatgt

SEQ ID NO: 2058680 - DNA, 23 bp, Homo sapiens
tgtcggttttttttaaataaaag

SEQ ID NO: 2058681 - DNA, 15 bp, Homo sapiens
tgtcgtgtttacaaa

SEQ ID NO: 2058682 - DNA, 21 bp, Homo sapiens
tgtctagaggtgagaccaaag

SEQ ID NO: 2058683 - DNA, 21 bp, Homo sapiens
tgtctataatggaaacattta

SEQ ID NO: 2058684 - DNA, 18 bp, Homo sapiens
tgtctcaagagggcactg

SEQ ID NO: 2058685 - DNA, 20 bp, Homo sapiens
tgtctcaagagggcactggt

SEQ ID NO: 2058686 - DNA, 21 bp, Homo sapiens
tgtctcaagagggcactggtg

SEQ ID NO: 2058687 - DNA, 23 bp, Homo sapiens
tgtctcaagagggcactggtggc

SEQ ID NO: 2058688 - DNA, 16 bp, Homo sapiens
tgtctcaggtccctgc

SEQ ID NO: 2058689 - DNA, 17 bp, Homo sapiens
tgtctcaggtccctgca

SEQ ID NO: 2058690 - DNA, 13 bp, Homo sapiens
tgtctcagtgctg

SEQ ID NO: 2058691 - DNA, 17 bp, Homo sapiens
tgtctccataatgccac

SEQ ID NO: 2058692 - DNA, 20 bp, Homo sapiens
tgtctcctacctgctgctgc

SEQ ID NO: 2058693 - DNA, 18 bp, Homo sapiens
tgtctcctggtctgtgct

SEQ ID NO: 2058694 - DNA, 18 bp, Homo sapiens
tgtctcgagcgccctgca

SEQ ID NO: 2058695 - DNA, 19 bp, Homo sapiens
tgtctcgagcgccctgcag

SEQ ID NO: 2058696 - DNA, 15 bp, Homo sapiens
tgtctctagccactt

SEQ ID NO: 2058697 - DNA, 16 bp, Homo sapiens
tgtctctagccacttt

SEQ ID NO: 2058698 - DNA, 19 bp, Homo sapiens
tgtctctagccactttggt

SEQ ID NO: 2058699 - DNA, 12 bp, Homo sapiens
tgtctctcatga

SEQ ID NO: 2058700 - DNA, 13 bp, Homo sapiens
tgtctctcattct

SEQ ID NO: 2058701 - DNA, 16 bp, Homo sapiens
tgtctctcattctctt

SEQ ID NO: 2058702 - DNA, 11 bp, Homo sapiens
tgtctctccca

SEQ ID NO: 2058703 - DNA, 15 bp, Homo sapiens
tgtctctcccacccc

SEQ ID NO: 2058704 - DNA, 10 bp, Homo sapiens
tgtctctctt

SEQ ID NO: 2058705 - DNA, 15 bp, Homo sapiens
tgtctcttgtagaag

SEQ ID NO: 2058706 - DNA, 21 bp, Homo sapiens
tgtctctttaatgtcacaggc

SEQ ID NO: 2058707 - DNA, 18 bp, Homo sapiens
tgtctgaagtcactgcac

SEQ ID NO: 2058708 - DNA, 19 bp, Homo sapiens
tgtctgaagtcactgcaca

SEQ ID NO: 2058709 - DNA, 13 bp, Homo sapiens
tgtctgaggcctc

SEQ ID NO: 2058710 - DNA, 14 bp, Homo sapiens
tgtctgaggcctca

SEQ ID NO: 2058711 - DNA, 15 bp, Homo sapiens
tgtctgcacccaggg

SEQ ID NO: 2058712 - DNA, 16 bp, Homo sapiens
tgtctgcacccagggg

SEQ ID NO: 2058713 - DNA, 16 bp, Homo sapiens
tgtctgccagccagca

SEQ ID NO: 2058714 - DNA, 18 bp, Homo sapiens
tgtctgcccccgtcttct

SEQ ID NO: 2058715 - DNA, 19 bp, Homo sapiens
tgtctgcttctgtccagga

SEQ ID NO: 2058716 - DNA, 13 bp, Homo sapiens
tgtctggaagctg

SEQ ID NO: 2058717 - DNA, 19 bp, Homo sapiens
tgtctggctgaggatttca

SEQ ID NO: 2058718 - DNA, 23 bp, Homo sapiens
tgtctggctgaggatttcaagcc

SEQ ID NO: 2058719 - DNA, 21 bp, Homo sapiens
tgtctgtcaccagctatctgt

SEQ ID NO: 2058720 - DNA, 18 bp, Homo sapiens
tgtctgtctttgtgggag

SEQ ID NO: 2058721 - DNA, 14 bp, Homo sapiens
tgtcttaattaaaa

SEQ ID NO: 2058722 - DNA, 19 bp, Homo sapiens
tgtcttatggcgttgcagg

SEQ ID NO: 2058723 - DNA, 15 bp, Homo sapiens
tgtcttcactcttca

SEQ ID NO: 2058724 - DNA, 17 bp, Homo sapiens
tgtcttcatttcattgt

SEQ ID NO: 2058725 - DNA, 14 bp, Homo sapiens
tgtcttccaacccc

SEQ ID NO: 2058726 - DNA, 15 bp, Homo sapiens
tgtcttccaacccca

SEQ ID NO: 2058727 - DNA, 16 bp, Homo sapiens
tgtcttccaaccccag

SEQ ID NO: 2058728 - DNA, 17 bp, Homo sapiens
tgtcttccaaccccagc

SEQ ID NO: 2058729 - DNA, 23 bp, Homo sapiens
tgtcttccaaccccagctggcct

SEQ ID NO: 2058730 - DNA, 20 bp, Homo sapiens
tgtcttctctaacaccttgt

SEQ ID NO: 2058731 - DNA, 12 bp, Homo sapiens
tgtcttctctca

SEQ ID NO: 2058732 - DNA, 21 bp, Homo sapiens
tgtcttgcaatggcagccttg

SEQ ID NO: 2058733 - DNA, 20 bp, Homo sapiens
ttaaggaggtagctcccagc

SEQ ID NO: 2058734 - DNA, 15 bp, Homo sapiens
ttaagggcattttaa

SEQ ID NO: 2058735 - DNA, 17 bp, Homo sapiens
ttaaggtgggtccagga

SEQ ID NO: 2058736 - DNA, 21 bp, Homo sapiens
ttaaggtttgccctgcctgca

SEQ ID NO: 2058737 - DNA, 15 bp, Homo sapiens
ttaagtaaaccaaaa

SEQ ID NO: 2058738 - DNA, 14 bp, Homo sapiens
ttaagtatatagta

SEQ ID NO: 2058739 - DNA, 16 bp, Homo sapiens
ttaagtatttatatat

SEQ ID NO: 2058740 - DNA, 17 bp, Homo sapiens
ttaagtatttatatatt

SEQ ID NO: 2058741 - DNA, 12 bp, Homo sapiens
ttaagtcatcca

SEQ ID NO: 2058742 - DNA, 21 bp, Homo sapiens
ttaagtccaaggagaagaaga

SEQ ID NO: 2058743 - DNA, 17 bp, Homo sapiens
ttaagtcctctcttctc

SEQ ID NO: 2058744 - DNA, 12 bp, Homo sapiens
ttaagtctctga

SEQ ID NO: 2058745 - DNA, 23 bp, Homo sapiens
ttaagtctctgactcttgccttt

SEQ ID NO: 2058746 - DNA, 21 bp, Homo sapiens
ttaagtgttgtaaatatttat

SEQ ID NO: 2058747 - DNA, 18 bp, Homo sapiens
ttaagttagggaatggca

SEQ ID NO: 2058748 - DNA, 11 bp, Homo sapiens
ttaagttattg

SEQ ID NO: 2058749 - DNA, 18 bp, Homo sapiens
ttaagttgctgatgaact

SEQ ID NO: 2058750 - DNA, 20 bp, Homo sapiens
ttaataaaaaaacaatcatt

SEQ ID NO: 2058751 - DNA, 13 bp, Homo sapiens
ttaataaaattga

SEQ ID NO: 2058752 - DNA, 18 bp, Homo sapiens
ttaataaacgaagataaa

SEQ ID NO: 2058753 - DNA, 20 bp, Homo sapiens
ttaataaattttaacatttt

SEQ ID NO: 2058754 - DNA, 16 bp, Homo sapiens
ttaataataagataat

SEQ ID NO: 2058755 - DNA, 14 bp, Homo sapiens
ttaataatttcatc

SEQ ID NO: 2058756 - DNA, 15 bp, Homo sapiens
ttaataccaaatatt

SEQ ID NO: 2058757 - DNA, 19 bp, Homo sapiens
ttaatacctttggaaaaat

SEQ ID NO: 2058758 - DNA, 21 bp, Homo sapiens
ttaatagacagtagccaagtt

SEQ ID NO: 2058759 - DNA, 18 bp, Homo sapiens
ttaatagcaaagaattga

SEQ ID NO: 2058760 - DNA, 20 bp, Homo sapiens
ttaatagcaaagaattgact

SEQ ID NO: 2058761 - DNA, 20 bp, Homo sapiens
ttaatagcttttattgtata

SEQ ID NO: 2058762 - DNA, 22 bp, Homo sapiens
ttaatagcttttattgtataaa

SEQ ID NO: 2058763 - DNA, 12 bp, Homo sapiens
ttaatatttaaa

SEQ ID NO: 2058764 - DNA, 15 bp, Homo sapiens
ttaatatttaaacag

SEQ ID NO: 2058765 - DNA, 17 bp, Homo sapiens
ttaatatttaaacagca

SEQ ID NO: 2058766 - DNA, 22 bp, Homo sapiens
ttaatatttaaacagcagtgtt

SEQ ID NO: 2058767 - DNA, 12 bp, Homo sapiens
ttaatatttgct

SEQ ID NO: 2058768 - DNA, 19 bp, Homo sapiens
ttaatatttgctgacagct

SEQ ID NO: 2058769 - DNA, 19 bp, Homo sapiens
ttaatattttgtattttca

SEQ ID NO: 2058770 - DNA, 17 bp, Homo sapiens
ttaatcagatagatatt

SEQ ID NO: 2058771 - DNA, 17 bp, Homo sapiens
ttaatcttcagttttat

SEQ ID NO: 2058772 - DNA, 24 bp, Homo sapiens
ttaatctttctttacctgagacca

SEQ ID NO: 2058773 - DNA, 15 bp, Homo sapiens
ttaatgaaaatgtca

SEQ ID NO: 2058774 - DNA, 13 bp, Homo sapiens
ttaatgaactgtg

SEQ ID NO: 2058775 - DNA, 22 bp, Homo sapiens
ttaatgagaacatttacacatt

SEQ ID NO: 2058776 - DNA, 12 bp, Homo sapiens
ttaatgcatttt

SEQ ID NO: 2058777 - DNA, 19 bp, Homo sapiens
ttaatgctttcctccctgg

SEQ ID NO: 2058778 - DNA, 22 bp, Homo sapiens
ttaatgctttcctccctggcat

SEQ ID NO: 2058779 - DNA, 18 bp, Homo sapiens
ttaatggctgataatttt

SEQ ID NO: 2058780 - DNA, 22 bp, Homo sapiens
ttaatggtctaaaaataaacca

SEQ ID NO: 2058781 - DNA, 20 bp, Homo sapiens
ttaatggtgccttcatttgg

SEQ ID NO: 2058782 - DNA, 22 bp, Homo sapiens
ttaatgttctgaataatttctt

SEQ ID NO: 2058783 - DNA, 15 bp, Homo sapiens
ttaatgtttattcct

SEQ ID NO: 2058784 - DNA, 17 bp, Homo sapiens
ttaatgtttattcctga

SEQ ID NO: 2058785 - DNA, 13 bp, Homo sapiens
ttaatgttttgta

SEQ ID NO: 2058786 - DNA, 17 bp, Homo sapiens
ttaatgttttgtacaat

SEQ ID NO: 2058787 - DNA, 15 bp, Homo sapiens
ttaattcactcccac

SEQ ID NO: 2058788 - DNA, 17 bp, Homo sapiens
ttaattctcatgtgatc

SEQ ID NO: 2058789 - DNA, 23 bp, Homo sapiens
ttaattgtaggtcaatgaaatat

SEQ ID NO: 2058790 - DNA, 11 bp, Homo sapiens
ttaattgtgtc

SEQ ID NO: 2058791 - DNA, 15 bp, Homo sapiens
ttaattgtgtgtctt

SEQ ID NO: 2058792 - DNA, 15 bp, Homo sapiens
ttaatttagaaaact

SEQ ID NO: 2058793 - DNA, 15 bp, Homo sapiens
ttaatttatgagttt

SEQ ID NO: 2058794 - DNA, 18 bp, Homo sapiens
ttaatttatgagtttttg

SEQ ID NO: 2058795 - DNA, 20 bp, Homo sapiens
ttaatttatgagtttttgat

SEQ ID NO: 2058796 - DNA, 12 bp, Homo sapiens
ttaatttatggt

SEQ ID NO: 2058797 - DNA, 16 bp, Homo sapiens
ttaatttgatacaaaa

SEQ ID NO: 2058798 - DNA, 12 bp, Homo sapiens
ttaatttttgat

SEQ ID NO: 2058799 - DNA, 18 bp, Homo sapiens
ttaattttttttaatgta

SEQ ID NO: 2058800 - DNA, 14 bp, Homo sapiens
ttacaaaaggcagc

SEQ ID NO: 2058801 - DNA, 12 bp, Homo sapiens
ttacaaacatgt

SEQ ID NO: 2058802 - DNA, 17 bp, Homo sapiens
ttacaaagaggttttat

SEQ ID NO: 2058803 - DNA, 18 bp, Homo sapiens
ttacaaagcccttttata

SEQ ID NO: 2058804 - DNA, 14 bp, Homo sapiens
ttacaaatttaatt

SEQ ID NO: 2058805 - DNA, 15 bp, Homo sapiens
ttacaaatttaattt

SEQ ID NO: 2058806 - DNA, 14 bp, Homo sapiens
ttacaacagtaaca

SEQ ID NO: 2058807 - DNA, 18 bp, Homo sapiens
ttacaagaattgtccatg

SEQ ID NO: 2058808 - DNA, 21 bp, Homo sapiens
ttacaagcgtgagccactgca

SEQ ID NO: 2058809 - DNA, 14 bp, Homo sapiens
ttacaagtgtatat

SEQ ID NO: 2058810 - DNA, 14 bp, Homo sapiens
ttacaataaacata

SEQ ID NO: 2058811 - DNA, 19 bp, Homo sapiens
ttacaataaatattctgca

SEQ ID NO: 2058812 - DNA, 14 bp, Homo sapiens
ttacaatggaaaca

SEQ ID NO: 2058813 - DNA, 13 bp, Homo sapiens
ttacaattgtcat

SEQ ID NO: 2058814 - DNA, 17 bp, Homo sapiens
ttacacagcccaagagg

SEQ ID NO: 2058815 - DNA, 14 bp, Homo sapiens
ttacacattatgtt

SEQ ID NO: 2058816 - DNA, 21 bp, Homo sapiens
ttacactacaagtttataagc

SEQ ID NO: 2058817 - DNA, 16 bp, Homo sapiens
ttacactctctgtaca

SEQ ID NO: 2058818 - DNA, 15 bp, Homo sapiens
ttacacttggagccc

SEQ ID NO: 2058819 - DNA, 15 bp, Homo sapiens
ttacagcgagaggca

SEQ ID NO: 2058820 - DNA, 21 bp, Homo sapiens
ttacagcgagaggcagagaaa

SEQ ID NO: 2058821 - DNA, 19 bp, Homo sapiens
ttacaggaggttgtggatg

SEQ ID NO: 2058822 - DNA, 18 bp, Homo sapiens
ttacaggtggacacacaa

SEQ ID NO: 2058823 - DNA, 16 bp, Homo sapiens
ttacaggtgtactatg

SEQ ID NO: 2058824 - DNA, 22 bp, Homo sapiens
ttacagtaaataaattgtttga

SEQ ID NO: 2058825 - DNA, 12 bp, Homo sapiens
ttacagtgactg

SEQ ID NO: 2058826 - DNA, 13 bp, Homo sapiens
ttacagtgactgt

SEQ ID NO: 2058827 - DNA, 22 bp, Homo sapiens
ttacataatcaaagctacctgt

SEQ ID NO: 2058828 - DNA, 16 bp, Homo sapiens
ttacatcatcctcctt

SEQ ID NO: 2058829 - DNA, 13 bp, Homo sapiens
ttacatccttaaa

SEQ ID NO: 2058830 - DNA, 18 bp, Homo sapiens
ttacatctgttttaaatt

SEQ ID NO: 2058831 - DNA, 14 bp, Homo sapiens
ttacatgaacacag

SEQ ID NO: 2058832 - DNA, 17 bp, Homo sapiens
ttacatgaattgcattt

SEQ ID NO: 2058833 - DNA, 15 bp, Homo sapiens
ttacatggctgtggt

SEQ ID NO: 2058834 - DNA, 14 bp, Homo sapiens
ttacatgtttgcac

SEQ ID NO: 2058835 - DNA, 19 bp, Homo sapiens
ttacattattatcaacaat

SEQ ID NO: 2058836 - DNA, 12 bp, Homo sapiens
ttacattcctag

SEQ ID NO: 2058837 - DNA, 13 bp, Homo sapiens
ttacattcctaga

SEQ ID NO: 2058838 - DNA, 14 bp, Homo sapiens
ttacatttatacat

SEQ ID NO: 2058839 - DNA, 15 bp, Homo sapiens
ttacatttatacatc

SEQ ID NO: 2058840 - DNA, 19 bp, Homo sapiens
ttacattttatttattagc

SEQ ID NO: 2058841 - DNA, 15 bp, Homo sapiens
ttacatttttacaat

SEQ ID NO: 2058842 - DNA, 16 bp, Homo sapiens
ttaccaaagcaatatt

SEQ ID NO: 2058843 - DNA, 13 bp, Homo sapiens
ttaccaactttct

SEQ ID NO: 2058844 - DNA, 15 bp, Homo sapiens
ttaccaactttctgt

SEQ ID NO: 2058845 - DNA, 21 bp, Homo sapiens
ttaccagatttttacacatgt

SEQ ID NO: 2058846 - DNA, 23 bp, Homo sapiens
ttaccaggcaccaaaagaagtaa

SEQ ID NO: 2058847 - DNA, 20 bp, Homo sapiens
ttaccatgagaagagggcct

SEQ ID NO: 2058848 - DNA, 21 bp, Homo sapiens
ttacccagagaatatatacat

SEQ ID NO: 2058849 - DNA, 20 bp, Homo sapiens
ttcaaggtggccaaattatt

SEQ ID NO: 2058850 - DNA, 14 bp, Homo sapiens
ttcaaggtgtaaaa

SEQ ID NO: 2058851 - DNA, 17 bp, Homo sapiens
ttcaagtgaatctaaaa

SEQ ID NO: 2058852 - DNA, 17 bp, Homo sapiens
ttcaagtgatatatgta

SEQ ID NO: 2058853 - DNA, 18 bp, Homo sapiens
ttcaagtgatatatgtat

SEQ ID NO: 2058854 - DNA, 20 bp, Homo sapiens
ttcaagtgatatatgtattt

SEQ ID NO: 2058855 - DNA, 17 bp, Homo sapiens
ttcaagttagctcagga

SEQ ID NO: 2058856 - DNA, 23 bp, Homo sapiens
ttcaataaaaaaaagaaatgaaa

SEQ ID NO: 2058857 - DNA, 19 bp, Homo sapiens
ttcaataaagtatctacat

SEQ ID NO: 2058858 - DNA, 17 bp, Homo sapiens
ttcaatgacctgtattt

SEQ ID NO: 2058859 - DNA, 15 bp, Homo sapiens
ttcaatgttagcctc

SEQ ID NO: 2058860 - DNA, 12 bp, Homo sapiens
ttcaattatttc

SEQ ID NO: 2058861 - DNA, 16 bp, Homo sapiens
ttcaattcctgggccc

SEQ ID NO: 2058862 - DNA, 13 bp, Homo sapiens
ttcaattgtattt

SEQ ID NO: 2058863 - DNA, 23 bp, Homo sapiens
ttcaatttaattcttatttctgt

SEQ ID NO: 2058864 - DNA, 19 bp, Homo sapiens
ttcaatttccaagagctga

SEQ ID NO: 2058865 - DNA, 22 bp, Homo sapiens
ttcacaacagcctgacaacatt

SEQ ID NO: 2058866 - DNA, 15 bp, Homo sapiens
ttcacaacaggcatt

SEQ ID NO: 2058867 - DNA, 16 bp, Homo sapiens
ttcacaaccagccaca

SEQ ID NO: 2058868 - DNA, 12 bp, Homo sapiens
ttcacaactagg

SEQ ID NO: 2058869 - DNA, 13 bp, Homo sapiens
ttcacaatagaaa

SEQ ID NO: 2058870 - DNA, 19 bp, Homo sapiens
ttcacacctcacgctctgg

SEQ ID NO: 2058871 - DNA, 21 bp, Homo sapiens
ttcacactgcaagagccttgg

SEQ ID NO: 2058872 - DNA, 22 bp, Homo sapiens
ttcacactgtgcgttttagagt

SEQ ID NO: 2058873 - DNA, 19 bp, Homo sapiens
ttcacagcctataaccaga

SEQ ID NO: 2058874 - DNA, 20 bp, Homo sapiens
ttcacaggtgtggtgtaatt

SEQ ID NO: 2058875 - DNA, 23 bp, Homo sapiens
ttcacaggttctgcgttacaaca

SEQ ID NO: 2058876 - DNA, 13 bp, Homo sapiens
ttcacatctcatt

SEQ ID NO: 2058877 - DNA, 20 bp, Homo sapiens
ttcacattaatggtctaaaa

SEQ ID NO: 2058878 - DNA, 15 bp, Homo sapiens
ttcaccagagcccat

SEQ ID NO: 2058879 - DNA, 15 bp, Homo sapiens
ttcacccgctgcagc

SEQ ID NO: 2058880 - DNA, 21 bp, Homo sapiens
ttcacctgggcgccaactgct

SEQ ID NO: 2058881 - DNA, 13 bp, Homo sapiens
ttcaccttatgta

SEQ ID NO: 2058882 - DNA, 14 bp, Homo sapiens
ttcaccttatgtat

SEQ ID NO: 2058883 - DNA, 17 bp, Homo sapiens
ttcaccttatgtattat

SEQ ID NO: 2058884 - DNA, 20 bp, Homo sapiens
ttcaccttatgtattatttt

SEQ ID NO: 2058885 - DNA, 23 bp, Homo sapiens
ttcaccttatgtattattttcta

SEQ ID NO: 2058886 - DNA, 19 bp, Homo sapiens
ttcacctttggtgcagagg

SEQ ID NO: 2058887 - DNA, 21 bp, Homo sapiens
ttcacgggaactctccaaata

SEQ ID NO: 2058888 - DNA, 14 bp, Homo sapiens
ttcactaccaaatg

SEQ ID NO: 2058889 - DNA, 17 bp, Homo sapiens
ttcactatgattttcta

SEQ ID NO: 2058890 - DNA, 15 bp, Homo sapiens
ttcactattagagaa

SEQ ID NO: 2058891 - DNA, 14 bp, Homo sapiens
ttcactcagccaca

SEQ ID NO: 2058892 - DNA, 15 bp, Homo sapiens
ttcactcagccacac

SEQ ID NO: 2058893 - DNA, 23 bp, Homo sapiens
ttcactccggtgtgcctgcagcc

SEQ ID NO: 2058894 - DNA, 14 bp, Homo sapiens
ttcactgccatgcc

SEQ ID NO: 2058895 - DNA, 15 bp, Homo sapiens
ttcactgctggctgc

SEQ ID NO: 2058896 - DNA, 16 bp, Homo sapiens
ttcactgctggctgcc

SEQ ID NO: 2058897 - DNA, 17 bp, Homo sapiens
ttcactggagttacatt

SEQ ID NO: 2058898 - DNA, 15 bp, Homo sapiens
ttcactttaaagtct

SEQ ID NO: 2058899 - DNA, 13 bp, Homo sapiens
ttcactttaattc

SEQ ID NO: 2058900 - DNA, 18 bp, Homo sapiens
ttcagaaggagaaggaaa

SEQ ID NO: 2058901 - DNA, 22 bp, Homo sapiens
ttcagaattgaaggagaaaatg

SEQ ID NO: 2058902 - DNA, 15 bp, Homo sapiens
ttcagaccccagcgg

SEQ ID NO: 2058903 - DNA, 11 bp, Homo sapiens
ttcagagaagt

SEQ ID NO: 2058904 - DNA, 13 bp, Homo sapiens
ttcagagaagtca

SEQ ID NO: 2058905 - DNA, 14 bp, Homo sapiens
ttcagagcctagcc

SEQ ID NO: 2058906 - DNA, 22 bp, Homo sapiens
ttcagagcctagccacctccca

SEQ ID NO: 2058907 - DNA, 23 bp, Homo sapiens
ttcagagcctagccacctcccac

SEQ ID NO: 2058908 - DNA, 13 bp, Homo sapiens
ttcagatcgtatt

SEQ ID NO: 2058909 - DNA, 14 bp, Homo sapiens
ttcagattcccaga

SEQ ID NO: 2058910 - DNA, 22 bp, Homo sapiens
ttcagattcccagagcaaaata

SEQ ID NO: 2058911 - DNA, 14 bp, Homo sapiens
ttcagcacacccca

SEQ ID NO: 2058912 - DNA, 17 bp, Homo sapiens
ttcagcacaccccaagg

SEQ ID NO: 2058913 - DNA, 18 bp, Homo sapiens
ttcagcacaccccaaggg

SEQ ID NO: 2058914 - DNA, 10 bp, Homo sapiens
ttcagcacca

SEQ ID NO: 2058915 - DNA, 21 bp, Homo sapiens
ttcagccatcaacaagagttg

SEQ ID NO: 2058916 - DNA, 11 bp, Homo sapiens
ttcagcccagc

SEQ ID NO: 2058917 - DNA, 14 bp, Homo sapiens
ttcagcccctcctc

SEQ ID NO: 2058918 - DNA, 16 bp, Homo sapiens
ttcagcccctcctctg

SEQ ID NO: 2058919 - DNA, 21 bp, Homo sapiens
ttcagcctagccgacctcagc

SEQ ID NO: 2058920 - DNA, 22 bp, Homo sapiens
ttcagcctagccgacctcagcc

SEQ ID NO: 2058921 - DNA, 14 bp, Homo sapiens
ttcagctaagctag

SEQ ID NO: 2058922 - DNA, 18 bp, Homo sapiens
ttcagctattagcaactg

SEQ ID NO: 2058923 - DNA, 23 bp, Homo sapiens
ttcagctccagctcaccagcccc

SEQ ID NO: 2058924 - DNA, 21 bp, Homo sapiens
ttcagctcccatagcgctggc

SEQ ID NO: 2058925 - DNA, 17 bp, Homo sapiens
ttcagctctctgtataa

SEQ ID NO: 2058926 - DNA, 19 bp, Homo sapiens
ttcagctgacagctgctca

SEQ ID NO: 2058927 - DNA, 23 bp, Homo sapiens
ttcagctgtgaacatggactctt

SEQ ID NO: 2058928 - DNA, 23 bp, Homo sapiens
ttcagctttggtgaaagggaggg

SEQ ID NO: 2058929 - DNA, 14 bp, Homo sapiens
ttcaggaagatgaa

SEQ ID NO: 2058930 - DNA, 14 bp, Homo sapiens
ttcaggacatgggg

SEQ ID NO: 2058931 - DNA, 21 bp, Homo sapiens
ttcaggagagagttgaaccta

SEQ ID NO: 2058932 - DNA, 15 bp, Homo sapiens
ttcaggagctgaagc

SEQ ID NO: 2058933 - DNA, 20 bp, Homo sapiens
ttcaggaggccctggtgtca

SEQ ID NO: 2058934 - DNA, 21 bp, Homo sapiens
ttcaggagggtccccagctgg

SEQ ID NO: 2058935 - DNA, 17 bp, Homo sapiens
ttcaggcagcactgaca

SEQ ID NO: 2058936 - DNA, 13 bp, Homo sapiens
ttcagggaagcag

SEQ ID NO: 2058937 - DNA, 18 bp, Homo sapiens
ttcagggaatttcaggaa

SEQ ID NO: 2058938 - DNA, 23 bp, Homo sapiens
ttcagggctggaaaagtcacaca

SEQ ID NO: 2058939 - DNA, 22 bp, Homo sapiens
ttcagggggcctttaaagactt

SEQ ID NO: 2058940 - DNA, 21 bp, Homo sapiens
ttcaggggggttgtgaggcct

SEQ ID NO: 2058941 - DNA, 17 bp, Homo sapiens
ttcagggtgagtgaatg

SEQ ID NO: 2058942 - DNA, 17 bp, Homo sapiens
ttcagggttggcccctg

SEQ ID NO: 2058943 - DNA, 17 bp, Homo sapiens
ttcaggtaacaggcaga

SEQ ID NO: 2058944 - DNA, 14 bp, Homo sapiens
ttcaggtactaaat

SEQ ID NO: 2058945 - DNA, 20 bp, Homo sapiens
ttcaggtaggcccttgtcct

SEQ ID NO: 2058946 - DNA, 20 bp, Homo sapiens
ttcaggtgcttttgatgtga

SEQ ID NO: 2058947 - DNA, 14 bp, Homo sapiens
ttcaggttgttctg

SEQ ID NO: 2058948 - DNA, 16 bp, Homo sapiens
ttcaggttgttctgta

SEQ ID NO: 2058949 - DNA, 15 bp, Homo sapiens
ttcagtaaaaaacaa

SEQ ID NO: 2058950 - DNA, 16 bp, Homo sapiens
ttcagtataatttaac

SEQ ID NO: 2058951 - DNA, 23 bp, Homo sapiens
ttcagtataatttaacttcagag

SEQ ID NO: 2058952 - DNA, 13 bp, Homo sapiens
ttcagtcttggag

SEQ ID NO: 2058953 - DNA, 23 bp, Homo sapiens
ttcagtgagacacagagtggagc

SEQ ID NO: 2058954 - DNA, 14 bp, Homo sapiens
ttcagtgcccacca

SEQ ID NO: 2058955 - DNA, 16 bp, Homo sapiens
ttcagtgccttggagc

SEQ ID NO: 2058956 - DNA, 12 bp, Homo sapiens
ttcagtggagaa

SEQ ID NO: 2058957 - DNA, 18 bp, Homo sapiens
ttcagttgatcactggca

SEQ ID NO: 2058958 - DNA, 13 bp, Homo sapiens
ttcataacaatgt

SEQ ID NO: 2058959 - DNA, 23 bp, Homo sapiens
ttcataacttgctgaatttcagg

SEQ ID NO: 2058960 - DNA, 17 bp, Homo sapiens
ttcataactttcattaa

SEQ ID NO: 2058961 - DNA, 23 bp, Homo sapiens
ttcataggcggtcatgtgtgcat

SEQ ID NO: 2058962 - DNA, 16 bp, Homo sapiens
ttcatataaagtatca

SEQ ID NO: 2058963 - DNA, 15 bp, Homo sapiens
ttcatatttctttgg

SEQ ID NO: 2058964 - DNA, 18 bp, Homo sapiens
ttctccaggctctttggg

SEQ ID NO: 2058965 - DNA, 13 bp, Homo sapiens
ttctccatcagct

SEQ ID NO: 2058966 - DNA, 14 bp, Homo sapiens
ttctcccatctagt

SEQ ID NO: 2058967 - DNA, 21 bp, Homo sapiens
ttctcccccgacactgctgca

SEQ ID NO: 2058968 - DNA, 21 bp, Homo sapiens
ttctcccgttcacgttgccta

SEQ ID NO: 2058969 - DNA, 22 bp, Homo sapiens
ttctccctcacccccaggtgtt

SEQ ID NO: 2058970 - DNA, 15 bp, Homo sapiens
ttctccctgggaact

SEQ ID NO: 2058971 - DNA, 21 bp, Homo sapiens
ttctccgggtgtggcctcagc

SEQ ID NO: 2058972 - DNA, 16 bp, Homo sapiens
ttctcctactttacac

SEQ ID NO: 2058973 - DNA, 18 bp, Homo sapiens
ttctcctgacccagtccc

SEQ ID NO: 2058974 - DNA, 22 bp, Homo sapiens
ttctcctgggcccgctttgcct

SEQ ID NO: 2058975 - DNA, 20 bp, Homo sapiens
ttctcctttattgctcctgt

SEQ ID NO: 2058976 - DNA, 18 bp, Homo sapiens
ttctcctttcacaacctt

SEQ ID NO: 2058977 - DNA, 22 bp, Homo sapiens
ttctcctttcacaaccttctgt

SEQ ID NO: 2058978 - DNA, 16 bp, Homo sapiens
ttctctacccatctcc

SEQ ID NO: 2058979 - DNA, 20 bp, Homo sapiens
ttctctacccatctccccca

SEQ ID NO: 2058980 - DNA, 15 bp, Homo sapiens
ttctctactctggaa

SEQ ID NO: 2058981 - DNA, 17 bp, Homo sapiens
ttctctattcctgaccc

SEQ ID NO: 2058982 - DNA, 22 bp, Homo sapiens
ttctctattttgcctttaaatt

SEQ ID NO: 2058983 - DNA, 14 bp, Homo sapiens
ttctctccttccct

SEQ ID NO: 2058984 - DNA, 16 bp, Homo sapiens
ttctctccttccctct

SEQ ID NO: 2058985 - DNA, 17 bp, Homo sapiens
ttctctccttccctctt

SEQ ID NO: 2058986 - DNA, 20 bp, Homo sapiens
ttctctccttccctctttcc

SEQ ID NO: 2058987 - DNA, 21 bp, Homo sapiens
ttctctccttccctctttccc

SEQ ID NO: 2058988 - DNA, 23 bp, Homo sapiens
ttctctccttcttccctgtttta

SEQ ID NO: 2058989 - DNA, 14 bp, Homo sapiens
ttctctgaggacac

SEQ ID NO: 2058990 - DNA, 14 bp, Homo sapiens
ttctctgtatagta

SEQ ID NO: 2058991 - DNA, 20 bp, Homo sapiens
ttctctgtgaacgatttaga

SEQ ID NO: 2058992 - DNA, 13 bp, Homo sapiens
ttctcttcctgta

SEQ ID NO: 2058993 - DNA, 19 bp, Homo sapiens
ttctctttcttattttgta

SEQ ID NO: 2058994 - DNA, 23 bp, Homo sapiens
ttctctttcttattttgtaataa

SEQ ID NO: 2058995 - DNA, 15 bp, Homo sapiens
ttctctttgcctcaa

SEQ ID NO: 2058996 - DNA, 14 bp, Homo sapiens
ttctgaaaactgtt

SEQ ID NO: 2058997 - DNA, 15 bp, Homo sapiens
ttctgaaaactgttt

SEQ ID NO: 2058998 - DNA, 21 bp, Homo sapiens
ttctgaaacttcataaatgtt

SEQ ID NO: 2058999 - DNA, 14 bp, Homo sapiens
ttctgaagatctca

SEQ ID NO: 2059000 - DNA, 19 bp, Homo sapiens
ttctgaagctgacagcact

SEQ ID NO: 2059001 - DNA, 18 bp, Homo sapiens
ttctgaagtctactttgt

SEQ ID NO: 2059002 - DNA, 17 bp, Homo sapiens
ttctgaataacatttgt

SEQ ID NO: 2059003 - DNA, 14 bp, Homo sapiens
ttctgaatctgaaa

SEQ ID NO: 2059004 - DNA, 22 bp, Homo sapiens
ttctgagtacttgatttcaggt

SEQ ID NO: 2059005 - DNA, 23 bp, Homo sapiens
ttctgagtacttgatttcaggtc

SEQ ID NO: 2059006 - DNA, 23 bp, Homo sapiens
ttctgagtgacatgggtgtgcca

SEQ ID NO: 2059007 - DNA, 14 bp, Homo sapiens
ttctgagtgttttt

SEQ ID NO: 2059008 - DNA, 16 bp, Homo sapiens
ttctgagtttcattct

SEQ ID NO: 2059009 - DNA, 19 bp, Homo sapiens
ttctgagtttcattctcct

SEQ ID NO: 2059010 - DNA, 18 bp, Homo sapiens
ttctgattcactattaga

SEQ ID NO: 2059011 - DNA, 15 bp, Homo sapiens
ttctgcaactagcca

SEQ ID NO: 2059012 - DNA, 14 bp, Homo sapiens
ttctgcactgaaaa

SEQ ID NO: 2059013 - DNA, 17 bp, Homo sapiens
ttctgcagcaactccca

SEQ ID NO: 2059014 - DNA, 23 bp, Homo sapiens
ttctgcattttattctggatgga

SEQ ID NO: 2059015 - DNA, 15 bp, Homo sapiens
ttctgccatattctg

SEQ ID NO: 2059016 - DNA, 18 bp, Homo sapiens
ttctgcctgcccaggccc

SEQ ID NO: 2059017 - DNA, 16 bp, Homo sapiens
ttctgctacctcactg

SEQ ID NO: 2059018 - DNA, 19 bp, Homo sapiens
ttctgctcacatatctgtc

SEQ ID NO: 2059019 - DNA, 16 bp, Homo sapiens
ttctgctcctctccag

SEQ ID NO: 2059020 - DNA, 17 bp, Homo sapiens
ttctgctcctctccagg

SEQ ID NO: 2059021 - DNA, 13 bp, Homo sapiens
ttctgctgcccct

SEQ ID NO: 2059022 - DNA, 19 bp, Homo sapiens
ttctgctggcctggatctc

SEQ ID NO: 2059023 - DNA, 13 bp, Homo sapiens
ttctgctgtttaa

SEQ ID NO: 2059024 - DNA, 16 bp, Homo sapiens
ttctgcttcagcctcc

SEQ ID NO: 2059025 - DNA, 19 bp, Homo sapiens
ttctgcttcagcctcccga

SEQ ID NO: 2059026 - DNA, 11 bp, Homo sapiens
ttctgcttcta

SEQ ID NO: 2059027 - DNA, 20 bp, Homo sapiens
ttctggaaaaaaaatatata

SEQ ID NO: 2059028 - DNA, 19 bp, Homo sapiens
ttctggaaggctggctgag

SEQ ID NO: 2059029 - DNA, 17 bp, Homo sapiens
ttctggaatacatgaaa

SEQ ID NO: 2059030 - DNA, 20 bp, Homo sapiens
ttctggaatgtaatcaatgt

SEQ ID NO: 2059031 - DNA, 19 bp, Homo sapiens
ttctggacccgttcaactt

SEQ ID NO: 2059032 - DNA, 23 bp, Homo sapiens
ttctggagcaagagagagctcgc

SEQ ID NO: 2059033 - DNA, 10 bp, Homo sapiens
ttctggagcc

SEQ ID NO: 2059034 - DNA, 17 bp, Homo sapiens
ttctggagtctccagtg

SEQ ID NO: 2059035 - DNA, 21 bp, Homo sapiens
ttctggattttcccctgaaga

SEQ ID NO: 2059036 - DNA, 13 bp, Homo sapiens
ttctggcctcagc

SEQ ID NO: 2059037 - DNA, 22 bp, Homo sapiens
ttctggctctcccatttcctga

SEQ ID NO: 2059038 - DNA, 10 bp, Homo sapiens
ttctgggaca

SEQ ID NO: 2059039 - DNA, 11 bp, Homo sapiens
ttctgggacac

SEQ ID NO: 2059040 - DNA, 22 bp, Homo sapiens
ttctgggtgttgaccactccag

SEQ ID NO: 2059041 - DNA, 22 bp, Homo sapiens
ttctggtatgaacttgaggaca

SEQ ID NO: 2059042 - DNA, 19 bp, Homo sapiens
ttctggtgcctatttattc

SEQ ID NO: 2059043 - DNA, 16 bp, Homo sapiens
ttctggttgcttcaga

SEQ ID NO: 2059044 - DNA, 17 bp, Homo sapiens
ttctgtaaaatgtctgt

SEQ ID NO: 2059045 - DNA, 23 bp, Homo sapiens
ttctgtaaactcaaaacttaaca

SEQ ID NO: 2059046 - DNA, 17 bp, Homo sapiens
ttctgtaatggaactga

SEQ ID NO: 2059047 - DNA, 11 bp, Homo sapiens
ttctgtatttt

SEQ ID NO: 2059048 - DNA, 13 bp, Homo sapiens
ttctgtattttaa

SEQ ID NO: 2059049 - DNA, 12 bp, Homo sapiens
ttctgtattttc

SEQ ID NO: 2059050 - DNA, 18 bp, Homo sapiens
ttctgtccagtttccaaa

SEQ ID NO: 2059051 - DNA, 22 bp, Homo sapiens
ttctgtccttttggcactgaga

SEQ ID NO: 2059052 - DNA, 14 bp, Homo sapiens
ttctgtctctcttg

SEQ ID NO: 2059053 - DNA, 17 bp, Homo sapiens
ttctgtcttcacaacag

SEQ ID NO: 2059054 - DNA, 14 bp, Homo sapiens
ttctgtctttagat

SEQ ID NO: 2059055 - DNA, 20 bp, Homo sapiens
ttctgtgcactagcctgtga

SEQ ID NO: 2059056 - DNA, 19 bp, Homo sapiens
ttctgtgggcttggccttg

SEQ ID NO: 2059057 - DNA, 12 bp, Homo sapiens
ttctgtgtattt

SEQ ID NO: 2059058 - DNA, 18 bp, Homo sapiens
ttctgtgtattttgagat

SEQ ID NO: 2059059 - DNA, 22 bp, Homo sapiens
ttctgtgtcacagttcttggtg

SEQ ID NO: 2059060 - DNA, 16 bp, Homo sapiens
ttctgtgttgaacaca

SEQ ID NO: 2059061 - DNA, 14 bp, Homo sapiens
ttctgttctgttga

SEQ ID NO: 2059062 - DNA, 15 bp, Homo sapiens
ttctgttctgttgat

SEQ ID NO: 2059063 - DNA, 17 bp, Homo sapiens
ttctgttgatcccactt

SEQ ID NO: 2059064 - DNA, 13 bp, Homo sapiens
ttctgttgcccag

SEQ ID NO: 2059065 - DNA, 21 bp, Homo sapiens
ttctgttggccagtgtgacaa

SEQ ID NO: 2059066 - DNA, 20 bp, Homo sapiens
ttctgtttccataggaatca

SEQ ID NO: 2059067 - DNA, 22 bp, Homo sapiens
ttctgtttctattctctcctca

SEQ ID NO: 2059068 - DNA, 21 bp, Homo sapiens
ttcttaaaatatatttcagat

SEQ ID NO: 2059069 - DNA, 17 bp, Homo sapiens
ttcttaaacaaatgtat

SEQ ID NO: 2059070 - DNA, 14 bp, Homo sapiens
ttcttaaaggcctg

SEQ ID NO: 2059071 - DNA, 20 bp, Homo sapiens
ttcttaagatttctcctgac

SEQ ID NO: 2059072 - DNA, 20 bp, Homo sapiens
ttcttaaggattgtgatatt

SEQ ID NO: 2059073 - DNA, 22 bp, Homo sapiens
ttcttaataggctttatcgttt

SEQ ID NO: 2059074 - DNA, 15 bp, Homo sapiens
ttcttacaaacatgt

SEQ ID NO: 2059075 - DNA, 13 bp, Homo sapiens
ttcttatgatttt

SEQ ID NO: 2059076 - DNA, 15 bp, Homo sapiens
ttcttatttcatttc

SEQ ID NO: 2059077 - DNA, 14 bp, Homo sapiens
ttcttatttgcaat

SEQ ID NO: 2059078 - DNA, 19 bp, Homo sapiens
ttcttattttgtaataaac

SEQ ID NO: 2059079 - DNA, 18 bp, Homo sapiens
ttgtttctgagaaaagaa

SEQ ID NO: 2059080 - DNA, 15 bp, Homo sapiens
ttgtttcttaaataa

SEQ ID NO: 2059081 - DNA, 23 bp, Homo sapiens
ttgtttcttaaataagaaacttt

SEQ ID NO: 2059082 - DNA, 16 bp, Homo sapiens
ttgtttgggccactgc

SEQ ID NO: 2059083 - DNA, 20 bp, Homo sapiens
ttgtttggggatgagaaagg

SEQ ID NO: 2059084 - DNA, 12 bp, Homo sapiens
ttgtttgtaatc

SEQ ID NO: 2059085 - DNA, 20 bp, Homo sapiens
ttgttttaagattgtaattc

SEQ ID NO: 2059086 - DNA, 14 bp, Homo sapiens
ttgttttcattatc

SEQ ID NO: 2059087 - DNA, 19 bp, Homo sapiens
ttgttttgacggatgattg

SEQ ID NO: 2059088 - DNA, 13 bp, Homo sapiens
ttgttttgcactg

SEQ ID NO: 2059089 - DNA, 22 bp, Homo sapiens
ttgtttttaacaactaatcaag

SEQ ID NO: 2059090 - DNA, 21 bp, Homo sapiens
ttgtttttccttgtatttaaa

SEQ ID NO: 2059091 - DNA, 22 bp, Homo sapiens
ttgtttttccttgtatttaaat

SEQ ID NO: 2059092 - DNA, 19 bp, Homo sapiens
ttgttttttttttccactt

SEQ ID NO: 2059093 - DNA, 18 bp, Homo sapiens
tttaaaaaaagtatatat

SEQ ID NO: 2059094 - DNA, 21 bp, Homo sapiens
tttaaaaaactaaaaactaga

SEQ ID NO: 2059095 - DNA, 21 bp, Homo sapiens
tttaaaaaagcttaaaacttt

SEQ ID NO: 2059096 - DNA, 19 bp, Homo sapiens
tttaaaaaataaaaaaata

SEQ ID NO: 2059097 - DNA, 22 bp, Homo sapiens
tttaaaaaataaaaaaatacag

SEQ ID NO: 2059098 - DNA, 20 bp, Homo sapiens
tttaaaaaataaatataatt

SEQ ID NO: 2059099 - DNA, 20 bp, Homo sapiens
tttaaaaaataactaccaag

SEQ ID NO: 2059100 - DNA, 18 bp, Homo sapiens
tttaaaaacatgagaaat

SEQ ID NO: 2059101 - DNA, 19 bp, Homo sapiens
tttaaaaacatgagaaatg

SEQ ID NO: 2059102 - DNA, 22 bp, Homo sapiens
tttaaaaacatgagaaatgtga

SEQ ID NO: 2059103 - DNA, 20 bp, Homo sapiens
tttaaaaataaagctactga

SEQ ID NO: 2059104 - DNA, 21 bp, Homo sapiens
tttaaaaataaagctactgaa

SEQ ID NO: 2059105 - DNA, 12 bp, Homo sapiens
tttaaaaatcat

SEQ ID NO: 2059106 - DNA, 15 bp, Homo sapiens
tttaaaaccatgcag

SEQ ID NO: 2059107 - DNA, 12 bp, Homo sapiens
tttaaaagaaat

SEQ ID NO: 2059108 - DNA, 20 bp, Homo sapiens
tttaaaagcaattatattgt

SEQ ID NO: 2059109 - DNA, 20 bp, Homo sapiens
tttaaaatctgatttaatgt

SEQ ID NO: 2059110 - DNA, 12 bp, Homo sapiens
tttaaaatgatt

SEQ ID NO: 2059111 - DNA, 23 bp, Homo sapiens
tttaaaattaaaaaaaagaagag

SEQ ID NO: 2059112 - DNA, 20 bp, Homo sapiens
tttaaacaaaatagaagctg

SEQ ID NO: 2059113 - DNA, 16 bp, Homo sapiens
tttaaacatagaaagt

SEQ ID NO: 2059114 - DNA, 13 bp, Homo sapiens
tttaaaccagcag

SEQ ID NO: 2059115 - DNA, 23 bp, Homo sapiens
tttaaaccgctaaaagaaacttt

SEQ ID NO: 2059116 - DNA, 15 bp, Homo sapiens
tttaaactagtaatg

SEQ ID NO: 2059117 - DNA, 13 bp, Homo sapiens
tttaaagacttaa

SEQ ID NO: 2059118 - DNA, 16 bp, Homo sapiens
tttaaaggggcagaaa

SEQ ID NO: 2059119 - DNA, 22 bp, Homo sapiens
tttaaaggggcagaaaaactct

SEQ ID NO: 2059120 - DNA, 14 bp, Homo sapiens
tttaaaggtagaga

SEQ ID NO: 2059121 - DNA, 18 bp, Homo sapiens
tttaaagtgtaataatat

SEQ ID NO: 2059122 - DNA, 19 bp, Homo sapiens
tttaaagttttatatgcat

SEQ ID NO: 2059123 - DNA, 23 bp, Homo sapiens
tttaaataaaagaaaaaatatct

SEQ ID NO: 2059124 - DNA, 22 bp, Homo sapiens
tttaaataaagtatcatgcatt

SEQ ID NO: 2059125 - DNA, 18 bp, Homo sapiens
tttaaatattaatcaact

SEQ ID NO: 2059126 - DNA, 18 bp, Homo sapiens
tttaaatcaaaagctgct

SEQ ID NO: 2059127 - DNA, 13 bp, Homo sapiens
tttaaatgaaaat

SEQ ID NO: 2059128 - DNA, 19 bp, Homo sapiens
tttaaatgtgcagtacaca

SEQ ID NO: 2059129 - DNA, 20 bp, Homo sapiens
tttaaattataacttaaaat

SEQ ID NO: 2059130 - DNA, 17 bp, Homo sapiens
tttaaattctttttcaa

SEQ ID NO: 2059131 - DNA, 14 bp, Homo sapiens
tttaaatttgttat

SEQ ID NO: 2059132 - DNA, 12 bp, Homo sapiens
tttaacaaaaca

SEQ ID NO: 2059133 - DNA, 22 bp, Homo sapiens
tttaacaaaacaagaaagaaac

SEQ ID NO: 2059134 - DNA, 15 bp, Homo sapiens
tttaacaaaagcaag

SEQ ID NO: 2059135 - DNA, 19 bp, Homo sapiens
tttaacacaagtcctgtga

SEQ ID NO: 2059136 - DNA, 21 bp, Homo sapiens
tttaaccatggtgcttgttaa

SEQ ID NO: 2059137 - DNA, 19 bp, Homo sapiens
tttaaccgtttttcaagaa

SEQ ID NO: 2059138 - DNA, 13 bp, Homo sapiens
tttaactaattta

SEQ ID NO: 2059139 - DNA, 16 bp, Homo sapiens
tttaactaatttaaac

SEQ ID NO: 2059140 - DNA, 22 bp, Homo sapiens
tttaactaatttaaaccagcag

SEQ ID NO: 2059141 - DNA, 12 bp, Homo sapiens
tttaactacaaa

SEQ ID NO: 2059142 - DNA, 22 bp, Homo sapiens
tttaactggggtattaactttt

SEQ ID NO: 2059143 - DNA, 16 bp, Homo sapiens
tttaacttaaatttta

SEQ ID NO: 2059144 - DNA, 19 bp, Homo sapiens
tttaacttgagggtaataa

SEQ ID NO: 2059145 - DNA, 19 bp, Homo sapiens
tttaactttatcacattat

SEQ ID NO: 2059146 - DNA, 21 bp, Homo sapiens
tttaagagagaaatctgaaaa

SEQ ID NO: 2059147 - DNA, 14 bp, Homo sapiens
tttaagataattat

SEQ ID NO: 2059148 - DNA, 15 bp, Homo sapiens
tttaagattgtaatt

SEQ ID NO: 2059149 - DNA, 21 bp, Homo sapiens
tttaagcattttactgtctgt

SEQ ID NO: 2059150 - DNA, 12 bp, Homo sapiens
tttaagccaaaa

SEQ ID NO: 2059151 - DNA, 18 bp, Homo sapiens
tttaagccaaaacaatgt

SEQ ID NO: 2059152 - DNA, 19 bp, Homo sapiens
tttaagcctcatatttaaa

SEQ ID NO: 2059153 - DNA, 17 bp, Homo sapiens
tttaagccttttgtgta

SEQ ID NO: 2059154 - DNA, 15 bp, Homo sapiens
tttaagcttgaagat

SEQ ID NO: 2059155 - DNA, 13 bp, Homo sapiens
tttaagtatatag

SEQ ID NO: 2059156 - DNA, 16 bp, Homo sapiens
tttaagtatatagtat

SEQ ID NO: 2059157 - DNA, 12 bp, Homo sapiens
tttaagtattta

SEQ ID NO: 2059158 - DNA, 14 bp, Homo sapiens
tttaagtatttata

SEQ ID NO: 2059159 - DNA, 15 bp, Homo sapiens
tttaagtatttatat

SEQ ID NO: 2059160 - DNA, 20 bp, Homo sapiens
tttaagtttgttgctgtcaa

SEQ ID NO: 2059161 - DNA, 14 bp, Homo sapiens
tttaataaatttat

SEQ ID NO: 2059162 - DNA, 14 bp, Homo sapiens
tttaataacaattg

SEQ ID NO: 2059163 - DNA, 22 bp, Homo sapiens
tttaataattatgtgccatttt

SEQ ID NO: 2059164 - DNA, 11 bp, Homo sapiens
tttaataattt

SEQ ID NO: 2059165 - DNA, 14 bp, Homo sapiens
tttaatacagggta

SEQ ID NO: 2059166 - DNA, 17 bp, Homo sapiens
tttaatacctttggaaa

SEQ ID NO: 2059167 - DNA, 19 bp, Homo sapiens
tttaatactcacctcctcc

SEQ ID NO: 2059168 - DNA, 17 bp, Homo sapiens
tttaatagcaaagaatt

SEQ ID NO: 2059169 - DNA, 14 bp, Homo sapiens
tttaatatagctat

SEQ ID NO: 2059170 - DNA, 15 bp, Homo sapiens
tttaatgaacaaatg

SEQ ID NO: 2059171 - DNA, 16 bp, Homo sapiens
tttaatgaacaaatgg

SEQ ID NO: 2059172 - DNA, 17 bp, Homo sapiens
tttaatgactttttata

SEQ ID NO: 2059173 - DNA, 12 bp, Homo sapiens
tttaatgccttc

SEQ ID NO: 2059174 - DNA, 18 bp, Homo sapiens
tttaatgtatagtaaatc

SEQ ID NO: 2059175 - DNA, 13 bp, Homo sapiens
tttaatgttttct

SEQ ID NO: 2059176 - DNA, 17 bp, Homo sapiens
tttaatgttttctgctg

SEQ ID NO: 2059177 - DNA, 21 bp, Homo sapiens
tttaattaggggttgctaaga

SEQ ID NO: 2059178 - DNA, 23 bp, Homo sapiens
tttaattattattcttcataaca

SEQ ID NO: 2059179 - DNA, 12 bp, Homo sapiens
tttaattcataa

SEQ ID NO: 2059180 - DNA, 14 bp, Homo sapiens
tttaattcataatt

SEQ ID NO: 2059181 - DNA, 17 bp, Homo sapiens
tttaattcataattaga

SEQ ID NO: 2059182 - DNA, 13 bp, Homo sapiens
tttaatttaaagc

SEQ ID NO: 2059183 - DNA, 14 bp, Homo sapiens
tttaatttatttca

SEQ ID NO: 2059184 - DNA, 16 bp, Homo sapiens
tttaatttgatacaaa

SEQ ID NO: 2059185 - DNA, 19 bp, Homo sapiens
tttaatttttttgagacag

SEQ ID NO: 2059186 - DNA, 16 bp, Homo sapiens
tttacaataaataatc

SEQ ID NO: 2059187 - DNA, 16 bp, Homo sapiens
tttacactctttgtaa

SEQ ID NO: 2059188 - DNA, 16 bp, Homo sapiens
tttacagagaatctga

SEQ ID NO: 2059189 - DNA, 15 bp, Homo sapiens
tttacagctgcctgc

SEQ ID NO: 2059190 - DNA, 16 bp, Homo sapiens
tttacagctgcctgca

SEQ ID NO: 2059191 - DNA, 16 bp, Homo sapiens
tttacagctttacaca

SEQ ID NO: 2059192 - DNA, 18 bp, Homo sapiens
tttacatggggttttcaa

SEQ ID NO: 2059193 - DNA, 20 bp, Homo sapiens
tttacattctgtctgttttt

SEQ ID NO: 2059194 - DNA, 18 bp, Homo sapiens
tttgcaaagttacagatg

SEQ ID NO: 2059195 - DNA, 21 bp, Homo sapiens
tttgcaaggaagccacagctg

SEQ ID NO: 2059196 - DNA, 15 bp, Homo sapiens
tttgcaattattcta

SEQ ID NO: 2059197 - DNA, 13 bp, Homo sapiens
tttgcacatgtga

SEQ ID NO: 2059198 - DNA, 22 bp, Homo sapiens
tttgcactgagggccacactat

SEQ ID NO: 2059199 - DNA, 14 bp, Homo sapiens
tttgcactgttact

SEQ ID NO: 2059200 - DNA, 19 bp, Homo sapiens
tttgcagattattttagtc

SEQ ID NO: 2059201 - DNA, 18 bp, Homo sapiens
tttgcagcagaagccaaa

SEQ ID NO: 2059202 - DNA, 13 bp, Homo sapiens
tttgcaggctctg

SEQ ID NO: 2059203 - DNA, 14 bp, Homo sapiens
tttgcaggctctgg

SEQ ID NO: 2059204 - DNA, 16 bp, Homo sapiens
tttgcaggctctgggc

SEQ ID NO: 2059205 - DNA, 16 bp, Homo sapiens
tttgcattagacagat

SEQ ID NO: 2059206 - DNA, 14 bp, Homo sapiens
tttgcattccatga

SEQ ID NO: 2059207 - DNA, 19 bp, Homo sapiens
tttgcattccatgatttta

SEQ ID NO: 2059208 - DNA, 14 bp, Homo sapiens
tttgcattcctaca

SEQ ID NO: 2059209 - DNA, 22 bp, Homo sapiens
tttgccaagcttgtgagagctg

SEQ ID NO: 2059210 - DNA, 21 bp, Homo sapiens
tttgccagaacagtttgtaca

SEQ ID NO: 2059211 - DNA, 16 bp, Homo sapiens
tttgccagtgaagact

SEQ ID NO: 2059212 - DNA, 19 bp, Homo sapiens
tttgccatgggcctgctgc

SEQ ID NO: 2059213 - DNA, 22 bp, Homo sapiens
tttgccatgttggccaggctgg

SEQ ID NO: 2059214 - DNA, 13 bp, Homo sapiens
tttgccctgcctg

SEQ ID NO: 2059215 - DNA, 13 bp, Homo sapiens
tttgccctgtgga

SEQ ID NO: 2059216 - DNA, 16 bp, Homo sapiens
tttgcctaattcctgg

SEQ ID NO: 2059217 - DNA, 13 bp, Homo sapiens
tttgcctctgaaa

SEQ ID NO: 2059218 - DNA, 22 bp, Homo sapiens
tttgctaactagcttggaaact

SEQ ID NO: 2059219 - DNA, 18 bp, Homo sapiens
tttgctacaataaatgct

SEQ ID NO: 2059220 - DNA, 13 bp, Homo sapiens
tttgctattgaca

SEQ ID NO: 2059221 - DNA, 20 bp, Homo sapiens
tttgctattgacaagtcatt

SEQ ID NO: 2059222 - DNA, 18 bp, Homo sapiens
tttgctctagtcttgctt

SEQ ID NO: 2059223 - DNA, 15 bp, Homo sapiens
tttggaaagagacca

SEQ ID NO: 2059224 - DNA, 11 bp, Homo sapiens
tttggaatgtg

SEQ ID NO: 2059225 - DNA, 16 bp, Homo sapiens
tttggactgttttgtt

SEQ ID NO: 2059226 - DNA, 12 bp, Homo sapiens
tttggatgtggg

SEQ ID NO: 2059227 - DNA, 19 bp, Homo sapiens
tttggatttacgactgaag

SEQ ID NO: 2059228 - DNA, 17 bp, Homo sapiens
tttggcctgcactaatt

SEQ ID NO: 2059229 - DNA, 10 bp, Homo sapiens
tttggccttg

SEQ ID NO: 2059230 - DNA, 17 bp, Homo sapiens
tttgggaggctgaggcg

SEQ ID NO: 2059231 - DNA, 23 bp, Homo sapiens
tttgggccactgcactctagcct

SEQ ID NO: 2059232 - DNA, 22 bp, Homo sapiens
tttggtattacactgtatttgt

SEQ ID NO: 2059233 - DNA, 12 bp, Homo sapiens
tttggtggtccc

SEQ ID NO: 2059234 - DNA, 21 bp, Homo sapiens
tttgtaaaagaacagtaaaca

SEQ ID NO: 2059235 - DNA, 17 bp, Homo sapiens
tttgtaaattaatactt

SEQ ID NO: 2059236 - DNA, 11 bp, Homo sapiens
tttgtaacttc

SEQ ID NO: 2059237 - DNA, 17 bp, Homo sapiens
tttgtaagcaacttgct

SEQ ID NO: 2059238 - DNA, 21 bp, Homo sapiens
tttgtaagcaacttgcttcta

SEQ ID NO: 2059239 - DNA, 20 bp, Homo sapiens
tttgtaataaaaggtatgaa

SEQ ID NO: 2059240 - DNA, 15 bp, Homo sapiens
tttgtaataaactct

SEQ ID NO: 2059241 - DNA, 17 bp, Homo sapiens
tttgtaataaactctct

SEQ ID NO: 2059242 - DNA, 21 bp, Homo sapiens
tttgtaatcgttatgtgtgta

SEQ ID NO: 2059243 - DNA, 18 bp, Homo sapiens
tttgtaatgtatcttatt

SEQ ID NO: 2059244 - DNA, 14 bp, Homo sapiens
tttgtacagaattt

SEQ ID NO: 2059245 - DNA, 19 bp, Homo sapiens
tttgtacatagttatttat

SEQ ID NO: 2059246 - DNA, 13 bp, Homo sapiens
tttgtacattcct

SEQ ID NO: 2059247 - DNA, 14 bp, Homo sapiens
tttgtacattcctg

SEQ ID NO: 2059248 - DNA, 15 bp, Homo sapiens
tttgtacattcctga

SEQ ID NO: 2059249 - DNA, 18 bp, Homo sapiens
tttgtacgttatatattg

SEQ ID NO: 2059250 - DNA, 19 bp, Homo sapiens
tttgtacgttatatattgt

SEQ ID NO: 2059251 - DNA, 18 bp, Homo sapiens
tttgtactagttgatgaa

SEQ ID NO: 2059252 - DNA, 18 bp, Homo sapiens
tttgtataacttcttaaa

SEQ ID NO: 2059253 - DNA, 17 bp, Homo sapiens
tttgtatagtaaagtga

SEQ ID NO: 2059254 - DNA, 16 bp, Homo sapiens
tttgtatattgtagga

SEQ ID NO: 2059255 - DNA, 21 bp, Homo sapiens
tttgtatctctgaagcatgtt

SEQ ID NO: 2059256 - DNA, 18 bp, Homo sapiens
tttgtatttatattagag

SEQ ID NO: 2059257 - DNA, 10 bp, Homo sapiens
tttgtatttt

SEQ ID NO: 2059258 - DNA, 14 bp, Homo sapiens
tttgtatttttgaa

SEQ ID NO: 2059259 - DNA, 16 bp, Homo sapiens
tttgtatttttgaata

SEQ ID NO: 2059260 - DNA, 14 bp, Homo sapiens
tttgtcagacttta

SEQ ID NO: 2059261 - DNA, 21 bp, Homo sapiens
tttgtcatatattcatgtaat

SEQ ID NO: 2059262 - DNA, 23 bp, Homo sapiens
tttgtcattcaagcctgtgaata

SEQ ID NO: 2059263 - DNA, 18 bp, Homo sapiens
tttgtcattttaaaatct

SEQ ID NO: 2059264 - DNA, 20 bp, Homo sapiens
tttgtcattttaaaatctga

SEQ ID NO: 2059265 - DNA, 20 bp, Homo sapiens
tttgtccaatggctgtaaac

SEQ ID NO: 2059266 - DNA, 22 bp, Homo sapiens
tttgtccaatggctgtaaacta

SEQ ID NO: 2059267 - DNA, 14 bp, Homo sapiens
tttgtccaggcctg

SEQ ID NO: 2059268 - DNA, 24 bp, Homo sapiens
tttgtcccatttccttggaggcca

SEQ ID NO: 2059269 - DNA, 20 bp, Homo sapiens
tttgtccccagggcccctcc

SEQ ID NO: 2059270 - DNA, 19 bp, Homo sapiens
tttgtcctttgagaaagaa

SEQ ID NO: 2059271 - DNA, 18 bp, Homo sapiens
tttgtcgagtttacttca

SEQ ID NO: 2059272 - DNA, 18 bp, Homo sapiens
tttgtctctgagaacaga

SEQ ID NO: 2059273 - DNA, 17 bp, Homo sapiens
tttgtctgtcttcatag

SEQ ID NO: 2059274 - DNA, 16 bp, Homo sapiens
tttgtgaatctttgtg

SEQ ID NO: 2059275 - DNA, 18 bp, Homo sapiens
tttgtgagccaaagagaa

SEQ ID NO: 2059276 - DNA, 17 bp, Homo sapiens
tttgtgctgtgggcagc

SEQ ID NO: 2059277 - DNA, 22 bp, Homo sapiens
tttgtgctgtgggcagcaccct

SEQ ID NO: 2059278 - DNA, 14 bp, Homo sapiens
tttgtgtgagagac

SEQ ID NO: 2059279 - DNA, 23 bp, Homo sapiens
tttgtgtgtcttttataaaaagt

SEQ ID NO: 2059280 - DNA, 20 bp, Homo sapiens
tttgttaaaaatattttctg

SEQ ID NO: 2059281 - DNA, 18 bp, Homo sapiens
tttgttaaatatttacat

SEQ ID NO: 2059282 - DNA, 22 bp, Homo sapiens
tttgttaaatatttacatatga

SEQ ID NO: 2059283 - DNA, 18 bp, Homo sapiens
tttgttaataataagata

SEQ ID NO: 2059284 - DNA, 22 bp, Homo sapiens
tttgttaatttagaaaacttta

SEQ ID NO: 2059285 - DNA, 17 bp, Homo sapiens
tttgttatagaatactt

SEQ ID NO: 2059286 - DNA, 12 bp, Homo sapiens
tttgttatttgt

SEQ ID NO: 2059287 - DNA, 19 bp, Homo sapiens
tttgttatttgtacagttc

SEQ ID NO: 2059288 - DNA, 21 bp, Homo sapiens
tttgttctccgggtgtggcct

SEQ ID NO: 2059289 - DNA, 16 bp, Homo sapiens
tttgttgccttatctt

SEQ ID NO: 2059290 - DNA, 15 bp, Homo sapiens
tttgttgctgtcaag

SEQ ID NO: 2059291 - DNA, 20 bp, Homo sapiens
tttgttgtgattttgtacag

SEQ ID NO: 2059292 - DNA, 13 bp, Homo sapiens
tttgtttaaagtt

SEQ ID NO: 2059293 - DNA, 18 bp, Homo sapiens
tttgtttagaagtacgtt

SEQ ID NO: 2059294 - DNA, 13 bp, Homo sapiens
tttgtttgtgcat

SEQ ID NO: 2059295 - DNA, 13 bp, Homo sapiens
tttgttttctttg

SEQ ID NO: 2059296 - DNA, 14 bp, Homo sapiens
tttgttttgcactg

SEQ ID NO: 2059297 - DNA, 14 bp, Homo sapiens
tttgtttttgtaaa

SEQ ID NO: 2059298 - DNA, 19 bp, Homo sapiens
ttttaaaaacatgagaaat

SEQ ID NO: 2059299 - DNA, 16 bp, Homo sapiens
ttttaaaacacttcca

SEQ ID NO: 2059300 - DNA, 16 bp, Homo sapiens
ttttaaaaccatgcag

SEQ ID NO: 2059301 - DNA, 11 bp, Homo sapiens
ttttaaaagaa

SEQ ID NO: 2059302 - DNA, 18 bp, Homo sapiens
ttttaaaagcaattatat

SEQ ID NO: 2059303 - DNA, 23 bp, Homo sapiens
ttttaaaaggttgactcaagttt

SEQ ID NO: 2059304 - DNA, 22 bp, Homo sapiens
ttttaaaagtttcaatgtgatt

SEQ ID NO: 2059305 - DNA, 13 bp, Homo sapiens
ttttaaaatctga

SEQ ID NO: 2059306 - DNA, 16 bp, Homo sapiens
ttttaaaatctgattt

SEQ ID NO: 2059307 - DNA, 13 bp, Homo sapiens
ttttaaacagtga

SEQ ID NO: 2059308 - DNA, 19 bp, Homo sapiens
ttttaaacagtgagcctga

SEQ ID NO: 2059309 - DNA, 13 bp, Homo sapiens
aaaaaaacacaaa

SEQ ID NO: 2059310 - DNA, 10 bp, Homo sapiens
aaaaaaagaa

SEQ ID NO: 2059311 - DNA, 13 bp, Homo sapiens
aaaaaaagacaag

SEQ ID NO: 2059312 - DNA, 12 bp, Homo sapiens
aaaaaaataata

SEQ ID NO: 2059313 - DNA, 10 bp, Homo sapiens
aaaaaaatac

SEQ ID NO: 2059314 - DNA, 12 bp, Homo sapiens
aaaaaaatacag

SEQ ID NO: 2059315 - DNA, 13 bp, Homo sapiens
aaaaaaatacagt

SEQ ID NO: 2059316 - DNA, 11 bp, Homo sapiens
aaaaaaatata

SEQ ID NO: 2059317 - DNA, 12 bp, Homo sapiens
aaaaaaatatat

SEQ ID NO: 2059318 - DNA, 12 bp, Homo sapiens
aaaaaaatgaca

SEQ ID NO: 2059319 - DNA, 13 bp, Homo sapiens
aaaaaaatgacta

SEQ ID NO: 2059320 - DNA, 11 bp, Homo sapiens
aaaaaaatttg

SEQ ID NO: 2059321 - DNA, 12 bp, Homo sapiens
aaaaaagaaacc

SEQ ID NO: 2059322 - DNA, 11 bp, Homo sapiens
aaaaaagtata

SEQ ID NO: 2059323 - DNA, 11 bp, Homo sapiens
aaaaaattgca

SEQ ID NO: 2059324 - DNA, 13 bp, Homo sapiens
aaaaacaaaacaa

SEQ ID NO: 2059325 - DNA, 17 bp, Homo sapiens
aaaaacaaaaccagctg

SEQ ID NO: 2059326 - DNA, 16 bp, Homo sapiens
aaaaacacggcagctg

SEQ ID NO: 2059327 - DNA, 20 bp, Homo sapiens
aaaaaccaaataagcatctg

SEQ ID NO: 2059328 - DNA, 18 bp, Homo sapiens
aaaaaccactgaacattt

SEQ ID NO: 2059329 - DNA, 23 bp, Homo sapiens
aaaaaccagaatcataattttca

SEQ ID NO: 2059330 - DNA, 20 bp, Homo sapiens
aaaaactctgggaaataaga

SEQ ID NO: 2059331 - DNA, 12 bp, Homo sapiens
aaaaacttgtaa

SEQ ID NO: 2059332 - DNA, 18 bp, Homo sapiens
aaaaacttgtaaatgctg

SEQ ID NO: 2059333 - DNA, 13 bp, Homo sapiens
aaaaactttcatt

SEQ ID NO: 2059334 - DNA, 16 bp, Homo sapiens
aaaaactttgttatat

SEQ ID NO: 2059335 - DNA, 11 bp, Homo sapiens
aaaaagaaatg

SEQ ID NO: 2059336 - DNA, 12 bp, Homo sapiens
aaaaagaaatga

SEQ ID NO: 2059337 - DNA, 18 bp, Homo sapiens
aaaaagattatatatcat

SEQ ID NO: 2059338 - DNA, 13 bp, Homo sapiens
aaaaagatttgtt

SEQ ID NO: 2059339 - DNA, 19 bp, Homo sapiens
aaaaagctcatattttgta

SEQ ID NO: 2059340 - DNA, 15 bp, Homo sapiens
aaaaagcttaaaact

SEQ ID NO: 2059341 - DNA, 19 bp, Homo sapiens
aaaaagcttaaaactttga

SEQ ID NO: 2059342 - DNA, 22 bp, Homo sapiens
aaaaaggatgaaagtctgagaa

SEQ ID NO: 2059343 - DNA, 19 bp, Homo sapiens
aaaaagggctgtccatgta

SEQ ID NO: 2059344 - DNA, 13 bp, Homo sapiens
aaaaagtatatat

SEQ ID NO: 2059345 - DNA, 14 bp, Homo sapiens
aaaaagtatttttt

SEQ ID NO: 2059346 - DNA, 22 bp, Homo sapiens
aaaaagtctacgctctcctttc

SEQ ID NO: 2059347 - DNA, 13 bp, Homo sapiens
aaaaagtggctaa

SEQ ID NO: 2059348 - DNA, 23 bp, Homo sapiens
aaaaagtgtttatttttcatatt

SEQ ID NO: 2059349 - DNA, 20 bp, Homo sapiens
aaaaagttgcagtctcagaa

SEQ ID NO: 2059350 - DNA, 21 bp, Homo sapiens
aaaaataaaaactgactcctt

SEQ ID NO: 2059351 - DNA, 15 bp, Homo sapiens
aaaaataaaatgatg

SEQ ID NO: 2059352 - DNA, 12 bp, Homo sapiens
aaaaataaagct

SEQ ID NO: 2059353 - DNA, 13 bp, Homo sapiens
aaaaataaagcta

SEQ ID NO: 2059354 - DNA, 16 bp, Homo sapiens
aaaaataagaagaatg

SEQ ID NO: 2059355 - DNA, 22 bp, Homo sapiens
aaaaataagaagaatgcttaat

SEQ ID NO: 2059356 - DNA, 14 bp, Homo sapiens
aaaaatacatttta

SEQ ID NO: 2059357 - DNA, 15 bp, Homo sapiens
aaaaatacattttat

SEQ ID NO: 2059358 - DNA, 23 bp, Homo sapiens
aaaaatactatgaaatgaaagaa

SEQ ID NO: 2059359 - DNA, 14 bp, Homo sapiens
aaaaatacttgagc

SEQ ID NO: 2059360 - DNA, 19 bp, Homo sapiens
aaaaatagtaagcctccct

SEQ ID NO: 2059361 - DNA, 22 bp, Homo sapiens
aaaaatagtaagcctccctcct

SEQ ID NO: 2059362 - DNA, 23 bp, Homo sapiens
aaaaatagtttggatatgtaaaa

SEQ ID NO: 2059363 - DNA, 11 bp, Homo sapiens
aaaaatattta

SEQ ID NO: 2059364 - DNA, 14 bp, Homo sapiens
aaaaatctagtttt

SEQ ID NO: 2059365 - DNA, 15 bp, Homo sapiens
aaaaatctagttttt

SEQ ID NO: 2059366 - DNA, 16 bp, Homo sapiens
aaaaatctagtttttt

SEQ ID NO: 2059367 - DNA, 12 bp, Homo sapiens
aaaaatgaaagc

SEQ ID NO: 2059368 - DNA, 14 bp, Homo sapiens
aaaaatgaaattat

SEQ ID NO: 2059369 - DNA, 22 bp, Homo sapiens
aaaaatggaacataaaatacaa

SEQ ID NO: 2059370 - DNA, 21 bp, Homo sapiens
aaaaatgttcccttgaccatt

SEQ ID NO: 2059371 - DNA, 15 bp, Homo sapiens
aaaaatgttctatat

SEQ ID NO: 2059372 - DNA, 19 bp, Homo sapiens
aaaaattaagagatacatt

SEQ ID NO: 2059373 - DNA, 10 bp, Homo sapiens
aaaaattgca

SEQ ID NO: 2059374 - DNA, 12 bp, Homo sapiens
aaaaattgcaca

SEQ ID NO: 2059375 - DNA, 14 bp, Homo sapiens
aaaaattgcacaat

SEQ ID NO: 2059376 - DNA, 14 bp, Homo sapiens
aaaaattgtgatca

SEQ ID NO: 2059377 - DNA, 23 bp, Homo sapiens
aaaaattgtgtttagattttatg

SEQ ID NO: 2059378 - DNA, 15 bp, Homo sapiens
aaaaatttgtttaaa

SEQ ID NO: 2059379 - DNA, 16 bp, Homo sapiens
aaaacaaaaataaata

SEQ ID NO: 2059380 - DNA, 13 bp, Homo sapiens
aaaacaaaaccag

SEQ ID NO: 2059381 - DNA, 14 bp, Homo sapiens
aaaacaacaacaat

SEQ ID NO: 2059382 - DNA, 19 bp, Homo sapiens
aaaacaatcatttgctttt

SEQ ID NO: 2059383 - DNA, 12 bp, Homo sapiens
aaaacacagcaa

SEQ ID NO: 2059384 - DNA, 13 bp, Homo sapiens
aaaacacagcaag

SEQ ID NO: 2059385 - DNA, 17 bp, Homo sapiens
aaaacatacccagtgtt

SEQ ID NO: 2059386 - DNA, 16 bp, Homo sapiens
aaaacatacttcaaaa

SEQ ID NO: 2059387 - DNA, 13 bp, Homo sapiens
aaaacatatcaat

SEQ ID NO: 2059388 - DNA, 19 bp, Homo sapiens
aaaacatatcaattcaaca

SEQ ID NO: 2059389 - DNA, 16 bp, Homo sapiens
aaaacatgagaaatgt

SEQ ID NO: 2059390 - DNA, 22 bp, Homo sapiens
aaaacattcatccagttgcaat

SEQ ID NO: 2059391 - DNA, 21 bp, Homo sapiens
aaaacattccccaattatctt

SEQ ID NO: 2059392 - DNA, 17 bp, Homo sapiens
aaaacatttactgacca

SEQ ID NO: 2059393 - DNA, 13 bp, Homo sapiens
aaaacatttgtac

SEQ ID NO: 2059394 - DNA, 13 bp, Homo sapiens
aaaaccaatgatt

SEQ ID NO: 2059395 - DNA, 23 bp, Homo sapiens
aaaaccaatgattcataacaatg

SEQ ID NO: 2059396 - DNA, 13 bp, Homo sapiens
aaaaccacagcag

SEQ ID NO: 2059397 - DNA, 18 bp, Homo sapiens
aaaaccactgaacatttg

SEQ ID NO: 2059398 - DNA, 19 bp, Homo sapiens
aaaaccagaatcataattt

SEQ ID NO: 2059399 - DNA, 13 bp, Homo sapiens
aaaaccagctgct

SEQ ID NO: 2059400 - DNA, 20 bp, Homo sapiens
aaaaccagctgctactcata

SEQ ID NO: 2059401 - DNA, 12 bp, Homo sapiens
aaaaccagggat

SEQ ID NO: 2059402 - DNA, 16 bp, Homo sapiens
aaaaccatgcagcttc

SEQ ID NO: 2059403 - DNA, 15 bp, Homo sapiens
aaaaccattttagtt

SEQ ID NO: 2059404 - DNA, 14 bp, Homo sapiens
aaaacccagcatgt

SEQ ID NO: 2059405 - DNA, 16 bp, Homo sapiens
aaaacccagcatgtac

SEQ ID NO: 2059406 - DNA, 20 bp, Homo sapiens
aaaacctcatgacagccaga

SEQ ID NO: 2059407 - DNA, 13 bp, Homo sapiens
aaaacctttcaaa

SEQ ID NO: 2059408 - DNA, 20 bp, Homo sapiens
aaaacctttcaaatttcaca

SEQ ID NO: 2059409 - DNA, 23 bp, Homo sapiens
aaaacgcctcttttccctctcta

SEQ ID NO: 2059410 - DNA, 21 bp, Homo sapiens
aaaacgttgacccctttcccc

SEQ ID NO: 2059411 - DNA, 17 bp, Homo sapiens
aaaactaaatatatgtc

SEQ ID NO: 2059412 - DNA, 18 bp, Homo sapiens
aaaactaaatctctaata

SEQ ID NO: 2059413 - DNA, 22 bp, Homo sapiens
aaaactagaggtgagaaattta

SEQ ID NO: 2059414 - DNA, 13 bp, Homo sapiens
aaaactattttaa

SEQ ID NO: 2059415 - DNA, 13 bp, Homo sapiens
aaaactcaggatt

SEQ ID NO: 2059416 - DNA, 18 bp, Homo sapiens
aaaactcagttaaaatgt

SEQ ID NO: 2059417 - DNA, 19 bp, Homo sapiens
aaaactgaaaaattttatt

SEQ ID NO: 2059418 - DNA, 18 bp, Homo sapiens
aaaactgaaaatctaata

SEQ ID NO: 2059419 - DNA, 19 bp, Homo sapiens
aaaactgaaaatctaatat

SEQ ID NO: 2059420 - DNA, 17 bp, Homo sapiens
aaaactggaataagaag

SEQ ID NO: 2059421 - DNA, 12 bp, Homo sapiens
aaaactgtaaat

SEQ ID NO: 2059422 - DNA, 18 bp, Homo sapiens
aaaactgtaaatacaaaa

SEQ ID NO: 2059423 - DNA, 12 bp, Homo sapiens
aaaactgtttat

SEQ ID NO: 2059424 - DNA, 20 bp, Homo sapiens
aaaacttatgctagtttatt

SEQ ID NO: 2059425 - DNA, 15 bp, Homo sapiens
aaaacttgaatctgt

SEQ ID NO: 2059426 - DNA, 22 bp, Homo sapiens
aaaacttgaatctgttactgaa

SEQ ID NO: 2059427 - DNA, 17 bp, Homo sapiens
aaaacttgtaaatgctg

SEQ ID NO: 2059428 - DNA, 12 bp, Homo sapiens
aaaactttcatt

SEQ ID NO: 2059429 - DNA, 14 bp, Homo sapiens
aaaagaaaaccatt

SEQ ID NO: 2059430 - DNA, 17 bp, Homo sapiens
aaaagaacactagagtc

SEQ ID NO: 2059431 - DNA, 13 bp, Homo sapiens
aaaagaagactgg

SEQ ID NO: 2059432 - DNA, 11 bp, Homo sapiens
aaaagaagtaa

SEQ ID NO: 2059433 - DNA, 23 bp, Homo sapiens
aaaagaatctagataggtgcttt

SEQ ID NO: 2059434 - DNA, 17 bp, Homo sapiens
aaaagaatttaaattct

SEQ ID NO: 2059435 - DNA, 18 bp, Homo sapiens
aaaagacatgttgtaaat

SEQ ID NO: 2059436 - DNA, 20 bp, Homo sapiens
aaaagaccacagacttctgg

SEQ ID NO: 2059437 - DNA, 19 bp, Homo sapiens
aaaagaccctgagactcca

SEQ ID NO: 2059438 - DNA, 18 bp, Homo sapiens
aaaagagaaaaaccaatg

SEQ ID NO: 2059439 - DNA, 19 bp, Homo sapiens
aaaagaggatgatttcaga

SEQ ID NO: 2059440 - DNA, 14 bp, Homo sapiens
aaaagataaagatg

SEQ ID NO: 2059441 - DNA, 17 bp, Homo sapiens
aaaagataaagatgatc

SEQ ID NO: 2059442 - DNA, 22 bp, Homo sapiens
aaaagattatatatcataaagt

SEQ ID NO: 2059443 - DNA, 17 bp, Homo sapiens
aaaagatttgttttgtc

SEQ ID NO: 2059444 - DNA, 11 bp, Homo sapiens
aaaagcacttt

SEQ ID NO: 2059445 - DNA, 23 bp, Homo sapiens
aaaagcagacgcagcagctggga

SEQ ID NO: 2059446 - DNA, 12 bp, Homo sapiens
aaaagcagtcct

SEQ ID NO: 2059447 - DNA, 13 bp, Homo sapiens
aaaagcataaatg

SEQ ID NO: 2059448 - DNA, 22 bp, Homo sapiens
aaaagcatgactatttccacca

SEQ ID NO: 2059449 - DNA, 11 bp, Homo sapiens
aaaagcccagt

SEQ ID NO: 2059450 - DNA, 12 bp, Homo sapiens
aaaagctcctgt

SEQ ID NO: 2059451 - DNA, 14 bp, Homo sapiens
aaaagctgcttgac

SEQ ID NO: 2059452 - DNA, 11 bp, Homo sapiens
aaaaggcctgg

SEQ ID NO: 2059453 - DNA, 20 bp, Homo sapiens
aaaaggctaggtacacagct

SEQ ID NO: 2059454 - DNA, 19 bp, Homo sapiens
aaaagggaagttgtgcctt

SEQ ID NO: 2059455 - DNA, 20 bp, Homo sapiens
aaaagggaagttgtgccttt

SEQ ID NO: 2059456 - DNA, 23 bp, Homo sapiens
aaaagggacagtattctcagtgc

SEQ ID NO: 2059457 - DNA, 19 bp, Homo sapiens
aaaaggttgactcaagttt

SEQ ID NO: 2059458 - DNA, 20 bp, Homo sapiens
aaaagtaacaaggtgtcttt

SEQ ID NO: 2059459 - DNA, 14 bp, Homo sapiens
aaaagtaattgtag

SEQ ID NO: 2059460 - DNA, 20 bp, Homo sapiens
aaaagtaggtttacattcat

SEQ ID NO: 2059461 - DNA, 11 bp, Homo sapiens
aaaagtatata

SEQ ID NO: 2059462 - DNA, 19 bp, Homo sapiens
aaaagtatttttttaagtt

SEQ ID NO: 2059463 - DNA, 15 bp, Homo sapiens
aaaagtcaaaaggtg

SEQ ID NO: 2059464 - DNA, 14 bp, Homo sapiens
aaaagtcacacaga

SEQ ID NO: 2059465 - DNA, 15 bp, Homo sapiens
aaaagtcacacagac

SEQ ID NO: 2059466 - DNA, 16 bp, Homo sapiens
aaaagtcacacagaca

SEQ ID NO: 2059467 - DNA, 17 bp, Homo sapiens
aaaagtgactctcagcg

SEQ ID NO: 2059468 - DNA, 20 bp, Homo sapiens
aaaagtgcttagaaagttat

SEQ ID NO: 2059469 - DNA, 19 bp, Homo sapiens
aaaagtggaatcactgtat

SEQ ID NO: 2059470 - DNA, 18 bp, Homo sapiens
aaaagtggattttcctga

SEQ ID NO: 2059471 - DNA, 16 bp, Homo sapiens
aaaagttaaactactt

SEQ ID NO: 2059472 - DNA, 18 bp, Homo sapiens
aaaagttacatgtttgca

SEQ ID NO: 2059473 - DNA, 14 bp, Homo sapiens
aaaagttgcacatt

SEQ ID NO: 2059474 - DNA, 16 bp, Homo sapiens
aaaagttgcacattag

SEQ ID NO: 2059475 - DNA, 12 bp, Homo sapiens
aaaagtttcaat

SEQ ID NO: 2059476 - DNA, 14 bp, Homo sapiens
aaaataaaaaccag

SEQ ID NO: 2059477 - DNA, 16 bp, Homo sapiens
aaaataaaaaccagaa

SEQ ID NO: 2059478 - DNA, 14 bp, Homo sapiens
aaaataaacaaata

SEQ ID NO: 2059479 - DNA, 18 bp, Homo sapiens
aaaataaactagtttcca

SEQ ID NO: 2059480 - DNA, 12 bp, Homo sapiens
aaaataaagcta

SEQ ID NO: 2059481 - DNA, 18 bp, Homo sapiens
aaaataaagctactgaat

SEQ ID NO: 2059482 - DNA, 20 bp, Homo sapiens
aaaataaagctactgaattt

SEQ ID NO: 2059483 - DNA, 12 bp, Homo sapiens
aaaataaataaa

SEQ ID NO: 2059484 - DNA, 16 bp, Homo sapiens
aaaataaatataattg

SEQ ID NO: 2059485 - DNA, 11 bp, Homo sapiens
aaaataaatgg

SEQ ID NO: 2059486 - DNA, 15 bp, Homo sapiens
aaaataaattttgaa

SEQ ID NO: 2059487 - DNA, 18 bp, Homo sapiens
aaaataaattttgaatgt

SEQ ID NO: 2059488 - DNA, 14 bp, Homo sapiens
aaaataagtatttc

SEQ ID NO: 2059489 - DNA, 18 bp, Homo sapiens
aaaataatagccatcctt

SEQ ID NO: 2059490 - DNA, 16 bp, Homo sapiens
aaaataattgatttca

SEQ ID NO: 2059491 - DNA, 13 bp, Homo sapiens
aaaataatttaac

SEQ ID NO: 2059492 - DNA, 14 bp, Homo sapiens
aaaataatttaact

SEQ ID NO: 2059493 - DNA, 15 bp, Homo sapiens
aaaataatttaacta

SEQ ID NO: 2059494 - DNA, 17 bp, Homo sapiens
aaaataatttaactaat

SEQ ID NO: 2059495 - DNA, 18 bp, Homo sapiens
aaaataatttaactaatt

SEQ ID NO: 2059496 - DNA, 22 bp, Homo sapiens
aaaataatttaactaatttaaa

SEQ ID NO: 2059497 - DNA, 12 bp, Homo sapiens
aaaatacagtaa

SEQ ID NO: 2059498 - DNA, 15 bp, Homo sapiens
aaaatactctagcct

SEQ ID NO: 2059499 - DNA, 17 bp, Homo sapiens
aaaatacttgagctgta

SEQ ID NO: 2059500 - DNA, 12 bp, Homo sapiens
aaaatagcttgt

SEQ ID NO: 2059501 - DNA, 19 bp, Homo sapiens
aaaatagtaaatgctttgt

SEQ ID NO: 2059502 - DNA, 19 bp, Homo sapiens
aaaatagtagaacaagcaa

SEQ ID NO: 2059503 - DNA, 16 bp, Homo sapiens
aaaatagtttggatat

SEQ ID NO: 2059504 - DNA, 19 bp, Homo sapiens
aaaatagtttggatatgta

SEQ ID NO: 2059505 - DNA, 20 bp, Homo sapiens
aaaatagtttggatatgtaa

SEQ ID NO: 2059506 - DNA, 22 bp, Homo sapiens
aaaatagtttggatatgtaaaa

SEQ ID NO: 2059507 - DNA, 13 bp, Homo sapiens
aaaatataaatgc

SEQ ID NO: 2059508 - DNA, 14 bp, Homo sapiens
aaaatataaatgca

SEQ ID NO: 2059509 - DNA, 15 bp, Homo sapiens
aaaatataaatgcat

SEQ ID NO: 2059510 - DNA, 13 bp, Homo sapiens
aaaatataaatta

SEQ ID NO: 2059511 - DNA, 22 bp, Homo sapiens
aaaatataaattaagactttaa

SEQ ID NO: 2059512 - DNA, 19 bp, Homo sapiens
aaaatataaccattacatg

SEQ ID NO: 2059513 - DNA, 21 bp, Homo sapiens
aaaatatatatatatatttaa

SEQ ID NO: 2059514 - DNA, 17 bp, Homo sapiens
aaaatatattttatgat

SEQ ID NO: 2059515 - DNA, 20 bp, Homo sapiens
aaaatatattttatgattta

SEQ ID NO: 2059516 - DNA, 16 bp, Homo sapiens
aaaatatggaacttct

SEQ ID NO: 2059517 - DNA, 14 bp, Homo sapiens
aaaatatgtatgtc

SEQ ID NO: 2059518 - DNA, 23 bp, Homo sapiens
aaaatatgtctcgctagtgatgt

SEQ ID NO: 2059519 - DNA, 19 bp, Homo sapiens
aaaatattataacttaaaa

SEQ ID NO: 2059520 - DNA, 12 bp, Homo sapiens
aaaatattttct

SEQ ID NO: 2059521 - DNA, 16 bp, Homo sapiens
aaaatcaaagctgagg

SEQ ID NO: 2059522 - DNA, 22 bp, Homo sapiens
aaaatcacaagcaataattagg

SEQ ID NO: 2059523 - DNA, 23 bp, Homo sapiens
aaaatcacaagcaataattagga

SEQ ID NO: 2059524 - DNA, 15 bp, Homo sapiens
aaaatcatgtacatt

SEQ ID NO: 2059525 - DNA, 16 bp, Homo sapiens
aaaatcatgtacattt

SEQ ID NO: 2059526 - DNA, 19 bp, Homo sapiens
aaaatcattcaatatctga

SEQ ID NO: 2059527 - DNA, 17 bp, Homo sapiens
aaaatcattccctttcc

SEQ ID NO: 2059528 - DNA, 13 bp, Homo sapiens
aaaatccttgctt

SEQ ID NO: 2059529 - DNA, 20 bp, Homo sapiens
aaaatccttgcttatgacat

SEQ ID NO: 2059530 - DNA, 15 bp, Homo sapiens
aaaatctaatattaa

SEQ ID NO: 2059531 - DNA, 19 bp, Homo sapiens
aaaatctagttttttttgt

SEQ ID NO: 2059532 - DNA, 12 bp, Homo sapiens
aaaatctgattt

SEQ ID NO: 2059533 - DNA, 16 bp, Homo sapiens
aaaatctgatttaatg

SEQ ID NO: 2059534 - DNA, 15 bp, Homo sapiens
attcccattttgcaa

SEQ ID NO: 2059535 - DNA, 18 bp, Homo sapiens
attcccattttgcaaaat

SEQ ID NO: 2059536 - DNA, 20 bp, Homo sapiens
attccccagattgcaacagg

SEQ ID NO: 2059537 - DNA, 22 bp, Homo sapiens
attccccaggtggctgacccag

SEQ ID NO: 2059538 - DNA, 17 bp, Homo sapiens
attccctagatctttct

SEQ ID NO: 2059539 - DNA, 16 bp, Homo sapiens
attccctatcaaaaca

SEQ ID NO: 2059540 - DNA, 22 bp, Homo sapiens
attccctatcttttagttttag

SEQ ID NO: 2059541 - DNA, 15 bp, Homo sapiens
attccctctcccagg

SEQ ID NO: 2059542 - DNA, 14 bp, Homo sapiens
attccctcttgcta

SEQ ID NO: 2059543 - DNA, 19 bp, Homo sapiens
attccctgagtcaccagga

SEQ ID NO: 2059544 - DNA, 20 bp, Homo sapiens
attccctgagtcaccaggaa

SEQ ID NO: 2059545 - DNA, 13 bp, Homo sapiens
attccctggcctg

SEQ ID NO: 2059546 - DNA, 15 bp, Homo sapiens
attcccttttatttc

SEQ ID NO: 2059547 - DNA, 21 bp, Homo sapiens
attcctaagcagtgcttgtaa

SEQ ID NO: 2059548 - DNA, 23 bp, Homo sapiens
attcctagagggtaaatatgact

SEQ ID NO: 2059549 - DNA, 17 bp, Homo sapiens
attcctatctgtggatg

SEQ ID NO: 2059550 - DNA, 22 bp, Homo sapiens
attcctattgtgcaatgtaaat

SEQ ID NO: 2059551 - DNA, 16 bp, Homo sapiens
attcctcagctgccaa

SEQ ID NO: 2059552 - DNA, 22 bp, Homo sapiens
attcctctgggaatgttacatt

SEQ ID NO: 2059553 - DNA, 16 bp, Homo sapiens
attcctgaagccagat

SEQ ID NO: 2059554 - DNA, 19 bp, Homo sapiens
attcctgaatgaaatatca

SEQ ID NO: 2059555 - DNA, 16 bp, Homo sapiens
attcctgaccctccct

SEQ ID NO: 2059556 - DNA, 21 bp, Homo sapiens
attcctgaccctccctacctg

SEQ ID NO: 2059557 - DNA, 19 bp, Homo sapiens
attcctgatactgggtaca

SEQ ID NO: 2059558 - DNA, 15 bp, Homo sapiens
attcctgcatttgtg

SEQ ID NO: 2059559 - DNA, 20 bp, Homo sapiens
attcctggcatgacactcta

SEQ ID NO: 2059560 - DNA, 17 bp, Homo sapiens
attcctggccccgggct

SEQ ID NO: 2059561 - DNA, 13 bp, Homo sapiens
attcctgggcctg

SEQ ID NO: 2059562 - DNA, 17 bp, Homo sapiens
attcctgggcctgtccc

SEQ ID NO: 2059563 - DNA, 22 bp, Homo sapiens
attcctgggctcaagcagtcct

SEQ ID NO: 2059564 - DNA, 16 bp, Homo sapiens
attcctggtattattt

SEQ ID NO: 2059565 - DNA, 24 bp, Homo sapiens
attcctggtattatttacaatgca

SEQ ID NO: 2059566 - DNA, 23 bp, Homo sapiens
attcctgtagcatcttctggagt

SEQ ID NO: 2059567 - DNA, 17 bp, Homo sapiens
attccttcactcatcca

SEQ ID NO: 2059568 - DNA, 11 bp, Homo sapiens
attccttccca

SEQ ID NO: 2059569 - DNA, 15 bp, Homo sapiens
attccttcccactca

SEQ ID NO: 2059570 - DNA, 17 bp, Homo sapiens
attccttttgatgggga

SEQ ID NO: 2059571 - DNA, 19 bp, Homo sapiens
attccttttgatggggaga

SEQ ID NO: 2059572 - DNA, 16 bp, Homo sapiens
attcgaatgacactgt

SEQ ID NO: 2059573 - DNA, 22 bp, Homo sapiens
attcgaggtgtcaccctgcaga

SEQ ID NO: 2059574 - DNA, 19 bp, Homo sapiens
attcgtctgtcccagagct

SEQ ID NO: 2059575 - DNA, 15 bp, Homo sapiens
attctaaaatgcctt

SEQ ID NO: 2059576 - DNA, 17 bp, Homo sapiens
attctaaagctttctga

SEQ ID NO: 2059577 - DNA, 19 bp, Homo sapiens
attctaacttttttgctat

SEQ ID NO: 2059578 - DNA, 13 bp, Homo sapiens
attctaatgtctt

SEQ ID NO: 2059579 - DNA, 13 bp, Homo sapiens
attctaggcatcc

SEQ ID NO: 2059580 - DNA, 16 bp, Homo sapiens
attctaggcatcccag

SEQ ID NO: 2059581 - DNA, 13 bp, Homo sapiens
attctcaccagga

SEQ ID NO: 2059582 - DNA, 16 bp, Homo sapiens
attctcaccaggaagg

SEQ ID NO: 2059583 - DNA, 20 bp, Homo sapiens
attctcatatgtagccctca

SEQ ID NO: 2059584 - DNA, 21 bp, Homo sapiens
attctcatatgtagccctcat

SEQ ID NO: 2059585 - DNA, 17 bp, Homo sapiens
attctcatttgtcacac

SEQ ID NO: 2059586 - DNA, 20 bp, Homo sapiens
attctccaggattccaaagt

SEQ ID NO: 2059587 - DNA, 22 bp, Homo sapiens
attgcatcacctctgtaatttt

SEQ ID NO: 2059588 - DNA, 17 bp, Homo sapiens
attgcatgtaaaatgca

SEQ ID NO: 2059589 - DNA, 18 bp, Homo sapiens
attgcatgtaaaatgcag

SEQ ID NO: 2059590 - DNA, 19 bp, Homo sapiens
attgcatgtattgtaaaca

SEQ ID NO: 2059591 - DNA, 17 bp, Homo sapiens
attgcatttcctgacag

SEQ ID NO: 2059592 - DNA, 14 bp, Homo sapiens
attgcatttctgct

SEQ ID NO: 2059593 - DNA, 19 bp, Homo sapiens
attgccacaatgcctctcc

SEQ ID NO: 2059594 - DNA, 20 bp, Homo sapiens
attgccacaatgcctctccc

SEQ ID NO: 2059595 - DNA, 22 bp, Homo sapiens
attgccacaatgcctctcccac

SEQ ID NO: 2059596 - DNA, 20 bp, Homo sapiens
attgcctccacctctccttg

SEQ ID NO: 2059597 - DNA, 11 bp, Homo sapiens
attgcctctga

SEQ ID NO: 2059598 - DNA, 14 bp, Homo sapiens
attgcctgcagaga

SEQ ID NO: 2059599 - DNA, 17 bp, Homo sapiens
attgcctgcagagagaa

SEQ ID NO: 2059600 - DNA, 15 bp, Homo sapiens
attgcctttgcctct

SEQ ID NO: 2059601 - DNA, 15 bp, Homo sapiens
attgcgaatgtgcag

SEQ ID NO: 2059602 - DNA, 10 bp, Homo sapiens
attgctgtga

SEQ ID NO: 2059603 - DNA, 17 bp, Homo sapiens
attgctgttgttgcagg

SEQ ID NO: 2059604 - DNA, 19 bp, Homo sapiens
attgctgttgttgcaggga

SEQ ID NO: 2059605 - DNA, 17 bp, Homo sapiens
attgcttaaaagacatt

SEQ ID NO: 2059606 - DNA, 16 bp, Homo sapiens
attgcttaaaatagca

SEQ ID NO: 2059607 - DNA, 22 bp, Homo sapiens
attgcttacatttttacaataa

SEQ ID NO: 2059608 - DNA, 17 bp, Homo sapiens
attgcttgagcccagga

SEQ ID NO: 2059609 - DNA, 20 bp, Homo sapiens
attgcttttgttgtgacttt

SEQ ID NO: 2059610 - DNA, 15 bp, Homo sapiens
attggaattttctta

SEQ ID NO: 2059611 - DNA, 22 bp, Homo sapiens
attggagggtgggagagcccag

SEQ ID NO: 2059612 - DNA, 21 bp, Homo sapiens
attggcatggatttctgtctt

SEQ ID NO: 2059613 - DNA, 23 bp, Homo sapiens
attggcgttgtttgtggctgttg

SEQ ID NO: 2059614 - DNA, 21 bp, Homo sapiens
attggctcacccaagcaaggc

SEQ ID NO: 2059615 - DNA, 13 bp, Homo sapiens
attggctcctcca

SEQ ID NO: 2059616 - DNA, 19 bp, Homo sapiens
attggcttattttttaaaa

SEQ ID NO: 2059617 - DNA, 23 bp, Homo sapiens
attggctttaaacacccttcaca

SEQ ID NO: 2059618 - DNA, 18 bp, Homo sapiens
attgggagcttgggaatg

SEQ ID NO: 2059619 - DNA, 21 bp, Homo sapiens
attgggagggacagggcttgg

SEQ ID NO: 2059620 - DNA, 17 bp, Homo sapiens
attgggcaagtgattga

SEQ ID NO: 2059621 - DNA, 18 bp, Homo sapiens
attgggcaagtgattgaa

SEQ ID NO: 2059622 - DNA, 16 bp, Homo sapiens
attggtaacatccttt

SEQ ID NO: 2059623 - DNA, 16 bp, Homo sapiens
attggtaattgaatgg

SEQ ID NO: 2059624 - DNA, 18 bp, Homo sapiens
attggtattcactaatct

SEQ ID NO: 2059625 - DNA, 15 bp, Homo sapiens
attggtccagcttgc

SEQ ID NO: 2059626 - DNA, 17 bp, Homo sapiens
attggtccagcttgctc

SEQ ID NO: 2059627 - DNA, 19 bp, Homo sapiens
attggtgataagtggaaaa

SEQ ID NO: 2059628 - DNA, 12 bp, Homo sapiens
attgtaaaaaaa

SEQ ID NO: 2059629 - DNA, 19 bp, Homo sapiens
attgtaaaatagcttgtat

SEQ ID NO: 2059630 - DNA, 22 bp, Homo sapiens
attgtaaaatagcttgtatagt

SEQ ID NO: 2059631 - DNA, 17 bp, Homo sapiens
attgtaaaattgtatag

SEQ ID NO: 2059632 - DNA, 16 bp, Homo sapiens
attgtaaacagaagga

SEQ ID NO: 2059633 - DNA, 17 bp, Homo sapiens
attgtacagctgtttaa

SEQ ID NO: 2059634 - DNA, 12 bp, Homo sapiens
attgtacctctc

SEQ ID NO: 2059635 - DNA, 15 bp, Homo sapiens
attgtagatggaaat

SEQ ID NO: 2059636 - DNA, 18 bp, Homo sapiens
attgtagcatttcttgat

SEQ ID NO: 2059637 - DNA, 21 bp, Homo sapiens
attgtaggtcaatgaaatatt

SEQ ID NO: 2059638 - DNA, 15 bp, Homo sapiens
atttcaaatgaacac

SEQ ID NO: 2059639 - DNA, 21 bp, Homo sapiens
atttcaacaagaatattgtat

SEQ ID NO: 2059640 - DNA, 23 bp, Homo sapiens
atttcaacaagtagctaaagtct

SEQ ID NO: 2059641 - DNA, 14 bp, Homo sapiens
atttcaactccaga

SEQ ID NO: 2059642 - DNA, 17 bp, Homo sapiens
atttcaactccagaagt

SEQ ID NO: 2059643 - DNA, 19 bp, Homo sapiens
atttcaagaaaaaataaat

SEQ ID NO: 2059644 - DNA, 20 bp, Homo sapiens
atttcaagaaaaaataaatg

SEQ ID NO: 2059645 - DNA, 22 bp, Homo sapiens
atttcaagaaaaaataaatgga

SEQ ID NO: 2059646 - DNA, 23 bp, Homo sapiens
atttcaagaaaaaataaatggaa

SEQ ID NO: 2059647 - DNA, 17 bp, Homo sapiens
atttcaatgattgttta

SEQ ID NO: 2059648 - DNA, 23 bp, Homo sapiens
atttcaatgattgtttaattgta

SEQ ID NO: 2059649 - DNA, 13 bp, Homo sapiens
atttcacaacaga

SEQ ID NO: 2059650 - DNA, 13 bp, Homo sapiens
atttcacattaat

SEQ ID NO: 2059651 - DNA, 21 bp, Homo sapiens
atttcacattaatatttgctg

SEQ ID NO: 2059652 - DNA, 22 bp, Homo sapiens
atttcacattaatggtctaaaa

SEQ ID NO: 2059653 - DNA, 22 bp, Homo sapiens
atttcagagaggccttttggaa

SEQ ID NO: 2059654 - DNA, 17 bp, Homo sapiens
atttcagaggctgcagg

SEQ ID NO: 2059655 - DNA, 18 bp, Homo sapiens
atttcagaggctgcagga

SEQ ID NO: 2059656 - DNA, 18 bp, Homo sapiens
atttcagattcccagagc

SEQ ID NO: 2059657 - DNA, 22 bp, Homo sapiens
atttcaggggtcgtcaccacct

SEQ ID NO: 2059658 - DNA, 13 bp, Homo sapiens
atttcagttactt

SEQ ID NO: 2059659 - DNA, 18 bp, Homo sapiens
atttcataaacaacttaa

SEQ ID NO: 2059660 - DNA, 23 bp, Homo sapiens
atttcatccagtttgttctccgg

SEQ ID NO: 2059661 - DNA, 14 bp, Homo sapiens
atttcatctatttc

SEQ ID NO: 2059662 - DNA, 16 bp, Homo sapiens
atttcatctatttctg

SEQ ID NO: 2059663 - DNA, 18 bp, Homo sapiens
atttcatctatttctgag

SEQ ID NO: 2059664 - DNA, 14 bp, Homo sapiens
atttcatctcattt

SEQ ID NO: 2059665 - DNA, 22 bp, Homo sapiens
atttcatctcatttaagggaaa

SEQ ID NO: 2059666 - DNA, 17 bp, Homo sapiens
atttcattgtatgatgt

SEQ ID NO: 2059667 - DNA, 18 bp, Homo sapiens
atttcatttcaactgttt

SEQ ID NO: 2059668 - DNA, 12 bp, Homo sapiens
atttcatttctt

SEQ ID NO: 2059669 - DNA, 21 bp, Homo sapiens
atttcattttgtaacaaatga

SEQ ID NO: 2059670 - DNA, 23 bp, Homo sapiens
atttccaaaataaaatgaaaaat

SEQ ID NO: 2059671 - DNA, 13 bp, Homo sapiens
atttccaaataaa

SEQ ID NO: 2059672 - DNA, 17 bp, Homo sapiens
atttccaaataaaatga

SEQ ID NO: 2059673 - DNA, 15 bp, Homo sapiens
atttccaagagctga

SEQ ID NO: 2059674 - DNA, 16 bp, Homo sapiens
atttccaagagctgag

SEQ ID NO: 2059675 - DNA, 15 bp, Homo sapiens
atttccaggcccctg

SEQ ID NO: 2059676 - DNA, 22 bp, Homo sapiens
atttccaggcccctgaggactg

SEQ ID NO: 2059677 - DNA, 13 bp, Homo sapiens
atttccagtacct

SEQ ID NO: 2059678 - DNA, 17 bp, Homo sapiens
atttccagtacctttgt

SEQ ID NO: 2059679 - DNA, 20 bp, Homo sapiens
atttccccaggggaaaatga

SEQ ID NO: 2059680 - DNA, 21 bp, Homo sapiens
atttccccaggggaaaatgaa

SEQ ID NO: 2059681 - DNA, 23 bp, Homo sapiens
atttcccctctgtgtcctctccc

SEQ ID NO: 2059682 - DNA, 21 bp, Homo sapiens
atttccctcatcttgccccct

SEQ ID NO: 2059683 - DNA, 13 bp, Homo sapiens
aggcaggagtggc

SEQ ID NO: 2059684 - DNA, 21 bp, Homo sapiens
aggcaggcacctagcaattcc

SEQ ID NO: 2059685 - DNA, 15 bp, Homo sapiens
aggcaggcagggctc

SEQ ID NO: 2059686 - DNA, 18 bp, Homo sapiens
aggcaggcagggctctcc

SEQ ID NO: 2059687 - DNA, 20 bp, Homo sapiens
aggcaggcagggctctcctg

SEQ ID NO: 2059688 - DNA, 15 bp, Homo sapiens
aggcaggctccccct

SEQ ID NO: 2059689 - DNA, 16 bp, Homo sapiens
aggcagggatttgagg

SEQ ID NO: 2059690 - DNA, 16 bp, Homo sapiens
aggcagggcaaatgac

SEQ ID NO: 2059691 - DNA, 16 bp, Homo sapiens
aggcagggcagaggga

SEQ ID NO: 2059692 - DNA, 19 bp, Homo sapiens
aggcagggccttgcccaga

SEQ ID NO: 2059693 - DNA, 15 bp, Homo sapiens
aggcagggctctcct

SEQ ID NO: 2059694 - DNA, 21 bp, Homo sapiens
aggcagggctctcctggcttc

SEQ ID NO: 2059695 - DNA, 16 bp, Homo sapiens
aggcaggggtgggaga

SEQ ID NO: 2059696 - DNA, 18 bp, Homo sapiens
aggcaggggtgggagagc

SEQ ID NO: 2059697 - DNA, 19 bp, Homo sapiens
aggcaggggtgggagagcc

SEQ ID NO: 2059698 - DNA, 22 bp, Homo sapiens
aggcaggggtgggagagccagc

SEQ ID NO: 2059699 - DNA, 19 bp, Homo sapiens
aggcagggtcaggagaggg

SEQ ID NO: 2059700 - DNA, 20 bp, Homo sapiens
aggcagggtcaggagagggg

SEQ ID NO: 2059701 - DNA, 15 bp, Homo sapiens
aggcaggtgcctgga

SEQ ID NO: 2059702 - DNA, 14 bp, Homo sapiens
aggcagtctgaacc

SEQ ID NO: 2059703 - DNA, 22 bp, Homo sapiens
aggcagtgttcctcaccaataa

SEQ ID NO: 2059704 - DNA, 20 bp, Homo sapiens
aggcatctacacagcctgga

SEQ ID NO: 2059705 - DNA, 23 bp, Homo sapiens
aggcatctacacagcctggactt

SEQ ID NO: 2059706 - DNA, 15 bp, Homo sapiens
aggcatgagggatca

SEQ ID NO: 2059707 - DNA, 15 bp, Homo sapiens
aggcatgcctctgat

SEQ ID NO: 2059708 - DNA, 17 bp, Homo sapiens
aggcatgcctctgatat

SEQ ID NO: 2059709 - DNA, 18 bp, Homo sapiens
aggcatgcctctgatatg

SEQ ID NO: 2059710 - DNA, 21 bp, Homo sapiens
aggcatgcctctgatatggga

SEQ ID NO: 2059711 - DNA, 23 bp, Homo sapiens
aggcatgcctctgatatgggact

SEQ ID NO: 2059712 - DNA, 16 bp, Homo sapiens
aggcatgctggcctcc

SEQ ID NO: 2059713 - DNA, 14 bp, Homo sapiens
aggcatggccctgg

SEQ ID NO: 2059714 - DNA, 15 bp, Homo sapiens
aggcatggccctggg

SEQ ID NO: 2059715 - DNA, 16 bp, Homo sapiens
aggcatggccctgggg

SEQ ID NO: 2059716 - DNA, 12 bp, Homo sapiens
aggcatggctgg

SEQ ID NO: 2059717 - DNA, 12 bp, Homo sapiens
aggcatgttctc

SEQ ID NO: 2059718 - DNA, 20 bp, Homo sapiens
aggcatgttctctgaggaca

SEQ ID NO: 2059719 - DNA, 15 bp, Homo sapiens
aggcattatttaatg

SEQ ID NO: 2059720 - DNA, 17 bp, Homo sapiens
aggcattatttaatgtt

SEQ ID NO: 2059721 - DNA, 20 bp, Homo sapiens
aggcatttaaaatggaaaag

SEQ ID NO: 2059722 - DNA, 13 bp, Homo sapiens
aggcatttcctgg

SEQ ID NO: 2059723 - DNA, 20 bp, Homo sapiens
aggcatttcctgggtggcta

SEQ ID NO: 2059724 - DNA, 20 bp, Homo sapiens
aggccaagagcagaggcagc

SEQ ID NO: 2059725 - DNA, 22 bp, Homo sapiens
aggccaagctgaagtgaaggag

SEQ ID NO: 2059726 - DNA, 22 bp, Homo sapiens
aggccaagtgtgataaataaac

SEQ ID NO: 2059727 - DNA, 21 bp, Homo sapiens
aggccaccgggacagacctgg

SEQ ID NO: 2059728 - DNA, 22 bp, Homo sapiens
aggccaccgggacagacctgga

SEQ ID NO: 2059729 - DNA, 19 bp, Homo sapiens
aggccacgctcaggcccgg

SEQ ID NO: 2059730 - DNA, 17 bp, Homo sapiens
aggccactgtggccaga

SEQ ID NO: 2059731 - DNA, 23 bp, Homo sapiens
aggccactgtggccagagctgga

SEQ ID NO: 2059732 - DNA, 13 bp, Homo sapiens
aggccagccccat

SEQ ID NO: 2059733 - DNA, 15 bp, Homo sapiens
aggccagccccatct

SEQ ID NO: 2059734 - DNA, 18 bp, Homo sapiens
aggccagccccatcttgg

SEQ ID NO: 2059735 - DNA, 14 bp, Homo sapiens
aggccagcctggcc

SEQ ID NO: 2059736 - DNA, 18 bp, Homo sapiens
aggccagcctggcctcct

SEQ ID NO: 2059737 - DNA, 22 bp, Homo sapiens
aggccagcctggcctcctgcct

SEQ ID NO: 2059738 - DNA, 17 bp, Homo sapiens
aggccaggaatctgcca

SEQ ID NO: 2059739 - DNA, 14 bp, Homo sapiens
aggccaggccacca

SEQ ID NO: 2059740 - DNA, 13 bp, Homo sapiens
aggccagtgccag

SEQ ID NO: 2059741 - DNA, 15 bp, Homo sapiens
aggccatggcagaat

SEQ ID NO: 2059742 - DNA, 18 bp, Homo sapiens
aggcccagcctgtcctgg

SEQ ID NO: 2059743 - DNA, 21 bp, Homo sapiens
aggcccagcctgtcctggtac

SEQ ID NO: 2059744 - DNA, 21 bp, Homo sapiens
aggcccagctatggccccagg

SEQ ID NO: 2059745 - DNA, 12 bp, Homo sapiens
aggcccagggag

SEQ ID NO: 2059746 - DNA, 20 bp, Homo sapiens
aggcccagggagcaatggga

SEQ ID NO: 2059747 - DNA, 18 bp, Homo sapiens
aggcccatctcaggtgcc

SEQ ID NO: 2059748 - DNA, 22 bp, Homo sapiens
aggcccatctcaggtgccactc

SEQ ID NO: 2059749 - DNA, 20 bp, Homo sapiens
aggccccatgacctccagct

SEQ ID NO: 2059750 - DNA, 16 bp, Homo sapiens
aggccccccgcagcac

SEQ ID NO: 2059751 - DNA, 17 bp, Homo sapiens
aggccccccgcagcacc

SEQ ID NO: 2059752 - DNA, 19 bp, Homo sapiens
aggccccccgcagcaccct

SEQ ID NO: 2059753 - DNA, 17 bp, Homo sapiens
aggccccgcttgtccag

SEQ ID NO: 2059754 - DNA, 17 bp, Homo sapiens
aggcccctgccaccctg

SEQ ID NO: 2059755 - DNA, 21 bp, Homo sapiens
aggcccctgccaccctgggga

SEQ ID NO: 2059756 - DNA, 19 bp, Homo sapiens
aggcccctggtctgccctg

SEQ ID NO: 2059757 - DNA, 14 bp, Homo sapiens
aggcccgacagaga

SEQ ID NO: 2059758 - DNA, 16 bp, Homo sapiens
aggcccgacagagaga

SEQ ID NO: 2059759 - DNA, 17 bp, Homo sapiens
aggcccgacagagagat

SEQ ID NO: 2059760 - DNA, 19 bp, Homo sapiens
aggcccgacagagagatga

SEQ ID NO: 2059761 - DNA, 19 bp, Homo sapiens
aggcccggcccagcctagg

SEQ ID NO: 2059762 - DNA, 14 bp, Homo sapiens
aggcccggccccat

SEQ ID NO: 2059763 - DNA, 13 bp, Homo sapiens
aggcccggctcca

SEQ ID NO: 2059764 - DNA, 15 bp, Homo sapiens
aggcccggctccagg

SEQ ID NO: 2059765 - DNA, 17 bp, Homo sapiens
aggcccggctccaggct

SEQ ID NO: 2059766 - DNA, 15 bp, Homo sapiens
aggcccggggctggc

SEQ ID NO: 2059767 - DNA, 22 bp, Homo sapiens
aggccctaggattcctccccca

SEQ ID NO: 2059768 - DNA, 14 bp, Homo sapiens
aggccctccctgac

SEQ ID NO: 2059769 - DNA, 22 bp, Homo sapiens
aggccctggagaggggctgtcc

SEQ ID NO: 2059770 - DNA, 21 bp, Homo sapiens
aggccctggatcagcgtggcc

SEQ ID NO: 2059771 - DNA, 22 bp, Homo sapiens
aggccctggatgtgcccacagg

SEQ ID NO: 2059772 - DNA, 12 bp, Homo sapiens
aggccctgtccc

SEQ ID NO: 2059773 - DNA, 16 bp, Homo sapiens
aggccctgtcccagca

SEQ ID NO: 2059774 - DNA, 20 bp, Homo sapiens
aggcccttattttcaagaaa

SEQ ID NO: 2059775 - DNA, 15 bp, Homo sapiens
aggcccttcctctcc

SEQ ID NO: 2059776 - DNA, 21 bp, Homo sapiens
aggcccttggggttcccccag

SEQ ID NO: 2059777 - DNA, 14 bp, Homo sapiens
aggcccttgtcctg

SEQ ID NO: 2059778 - DNA, 19 bp, Homo sapiens
aggcccttgtcctgccagc

SEQ ID NO: 2059779 - DNA, 18 bp, Homo sapiens
aggccgctgccccagccc

SEQ ID NO: 2059780 - DNA, 20 bp, Homo sapiens
aggccgctgttcacccacag

SEQ ID NO: 2059781 - DNA, 21 bp, Homo sapiens
aggccgggcttgggccctgca

SEQ ID NO: 2059782 - DNA, 16 bp, Homo sapiens
aggccgtgtctctgag

SEQ ID NO: 2059783 - DNA, 22 bp, Homo sapiens
aggccgttccccttggcttcct

SEQ ID NO: 2059784 - DNA, 18 bp, Homo sapiens
aggcctaggacctcaggc

SEQ ID NO: 2059785 - DNA, 20 bp, Homo sapiens
aggcctcacacccagagggt

SEQ ID NO: 2059786 - DNA, 14 bp, Homo sapiens
aggcctcatccctc

SEQ ID NO: 2059787 - DNA, 14 bp, Homo sapiens
aggcctccagcctc

SEQ ID NO: 2059788 - DNA, 16 bp, Homo sapiens
aggcctccagcctctc

SEQ ID NO: 2059789 - DNA, 22 bp, Homo sapiens
aggcctccagcctctcccggct

SEQ ID NO: 2059790 - DNA, 18 bp, Homo sapiens
aggcctcctctctgccac

SEQ ID NO: 2059791 - DNA, 17 bp, Homo sapiens
aggcctcgtaccagcca

SEQ ID NO: 2059792 - DNA, 22 bp, Homo sapiens
aggcctcgtaccagccaggatc

SEQ ID NO: 2059793 - DNA, 15 bp, Homo sapiens
aggcctctgtgtcct

SEQ ID NO: 2059794 - DNA, 24 bp, Homo sapiens
aggcctcttggacctctgctctga

SEQ ID NO: 2059795 - DNA, 21 bp, Homo sapiens
aggcctcttgtgctcacgctc

SEQ ID NO: 2059796 - DNA, 16 bp, Homo sapiens
aggcctgatgctgccc

SEQ ID NO: 2059797 - DNA, 17 bp, Homo sapiens
aggcctgatgctgcccc

SEQ ID NO: 2059798 - DNA, 16 bp, Homo sapiens
aggcctgccctcaggg

SEQ ID NO: 2059799 - DNA, 19 bp, Homo sapiens
aggcctgccctcccatgtt

SEQ ID NO: 2059800 - DNA, 15 bp, Homo sapiens
aggcctggaaccagg

SEQ ID NO: 2059801 - DNA, 19 bp, Homo sapiens
aggcctggaaccagggagg

SEQ ID NO: 2059802 - DNA, 20 bp, Homo sapiens
aggcctggaaccagggagga

SEQ ID NO: 2059803 - DNA, 13 bp, Homo sapiens
aggcctggccaga

SEQ ID NO: 2059804 - DNA, 15 bp, Homo sapiens
aggcctggccagatg

SEQ ID NO: 2059805 - DNA, 23 bp, Homo sapiens
aggcctggccagatgcaccagcc

SEQ ID NO: 2059806 - DNA, 16 bp, Homo sapiens
aggcctggccaggcac

SEQ ID NO: 2059807 - DNA, 15 bp, Homo sapiens
aggcctggccttgtc

SEQ ID NO: 2059808 - DNA, 16 bp, Homo sapiens
aggcctggccttgtca

SEQ ID NO: 2059809 - DNA, 23 bp, Homo sapiens
aggcctggccttgtcaggaccca

SEQ ID NO: 2059810 - DNA, 15 bp, Homo sapiens
aggcctgggacccag

SEQ ID NO: 2059811 - DNA, 18 bp, Homo sapiens
aggcctgggacccagcta

SEQ ID NO: 2059812 - DNA, 23 bp, Homo sapiens
aggcctgggacccagctactctg

SEQ ID NO: 2059813 - DNA, 20 bp, Homo sapiens
aggcctgtgtagctgtgacc

SEQ ID NO: 2059814 - DNA, 24 bp, Homo sapiens
aggcctgtgtagctgtgacctgct

SEQ ID NO: 2059815 - DNA, 17 bp, Homo sapiens
aggcctttccccagtgt

SEQ ID NO: 2059816 - DNA, 13 bp, Homo sapiens
aggccttttcacg

SEQ ID NO: 2059817 - DNA, 23 bp, Homo sapiens
gcacctgcatccgtagttccctg

SEQ ID NO: 2059818 - DNA, 13 bp, Homo sapiens
gcacctgccaccg

SEQ ID NO: 2059819 - DNA, 16 bp, Homo sapiens
gcacctgccaccgcca

SEQ ID NO: 2059820 - DNA, 17 bp, Homo sapiens
gcacctgccccctggtg

SEQ ID NO: 2059821 - DNA, 18 bp, Homo sapiens
gcacctgccccctggtgg

SEQ ID NO: 2059822 - DNA, 22 bp, Homo sapiens
gcacctgccccctggtggacag

SEQ ID NO: 2059823 - DNA, 15 bp, Homo sapiens
gcacctgctggaaac

SEQ ID NO: 2059824 - DNA, 13 bp, Homo sapiens
gcacctggcctgc

SEQ ID NO: 2059825 - DNA, 20 bp, Homo sapiens
gcacctggcctgctgggaac

SEQ ID NO: 2059826 - DNA, 19 bp, Homo sapiens
gcacctgggaaaacagagg

SEQ ID NO: 2059827 - DNA, 20 bp, Homo sapiens
gcacctgggaaaacagagga

SEQ ID NO: 2059828 - DNA, 16 bp, Homo sapiens
gcacctgggccctggg

SEQ ID NO: 2059829 - DNA, 18 bp, Homo sapiens
gcacctgggccctggggc

SEQ ID NO: 2059830 - DNA, 22 bp, Homo sapiens
gcacctggtttctgttctgttg

SEQ ID NO: 2059831 - DNA, 20 bp, Homo sapiens
gcaccttaatattattgggg

SEQ ID NO: 2059832 - DNA, 15 bp, Homo sapiens
gcaccttacattcct

SEQ ID NO: 2059833 - DNA, 16 bp, Homo sapiens
gcaccttacattccta

SEQ ID NO: 2059834 - DNA, 19 bp, Homo sapiens
gcaccttaccaactttctg

SEQ ID NO: 2059835 - DNA, 21 bp, Homo sapiens
gcaccttaccaactttctgta

SEQ ID NO: 2059836 - DNA, 22 bp, Homo sapiens
gcacctttccttcaagccagca

SEQ ID NO: 2059837 - DNA, 13 bp, Homo sapiens
gcacctttctagt

SEQ ID NO: 2059838 - DNA, 17 bp, Homo sapiens
gcacctttctagttgaa

SEQ ID NO: 2059839 - DNA, 22 bp, Homo sapiens
gcaccttttataccagagacct

SEQ ID NO: 2059840 - DNA, 17 bp, Homo sapiens
gcacgaacccacctgct

SEQ ID NO: 2059841 - DNA, 23 bp, Homo sapiens
gcacgaacccacctgctgagaga

SEQ ID NO: 2059842 - DNA, 21 bp, Homo sapiens
gcacgatcttggctcactgca

SEQ ID NO: 2059843 - DNA, 13 bp, Homo sapiens
gcacgcacatgcc

SEQ ID NO: 2059844 - DNA, 16 bp, Homo sapiens
gcacgccgtggagcat

SEQ ID NO: 2059845 - DNA, 18 bp, Homo sapiens
gcacgcctgcccagcctc

SEQ ID NO: 2059846 - DNA, 14 bp, Homo sapiens
gcacggagagaagg

SEQ ID NO: 2059847 - DNA, 16 bp, Homo sapiens
gcacggcagcttgagc

SEQ ID NO: 2059848 - DNA, 19 bp, Homo sapiens
gcacgtgatctgctggcct

SEQ ID NO: 2059849 - DNA, 14 bp, Homo sapiens
gcacgtgtgtgcac

SEQ ID NO: 2059850 - DNA, 23 bp, Homo sapiens
gcactaaaacccatcttccccgg

SEQ ID NO: 2059851 - DNA, 20 bp, Homo sapiens
gcactaaagcagtggacacc

SEQ ID NO: 2059852 - DNA, 20 bp, Homo sapiens
gcactaaagtatgtaaagta

SEQ ID NO: 2059853 - DNA, 23 bp, Homo sapiens
gcactaaggccgtgtctctgagg

SEQ ID NO: 2059854 - DNA, 18 bp, Homo sapiens
gcactaaggtgtgctctg

SEQ ID NO: 2059855 - DNA, 19 bp, Homo sapiens
gcactaatttgatgtttac

SEQ ID NO: 2059856 - DNA, 22 bp, Homo sapiens
gcactcaaccaacctccccgca

SEQ ID NO: 2059857 - DNA, 14 bp, Homo sapiens
gcactcacatgccg

SEQ ID NO: 2059858 - DNA, 17 bp, Homo sapiens
gcactcacccatgtgcc

SEQ ID NO: 2059859 - DNA, 17 bp, Homo sapiens
gcactccagcctgggca

SEQ ID NO: 2059860 - DNA, 21 bp, Homo sapiens
gcactccagcctgggcgacag

SEQ ID NO: 2059861 - DNA, 14 bp, Homo sapiens
gcactccagtctgg

SEQ ID NO: 2059862 - DNA, 13 bp, Homo sapiens
gcactccatggcc

SEQ ID NO: 2059863 - DNA, 18 bp, Homo sapiens
gcactccatggccacccc

SEQ ID NO: 2059864 - DNA, 15 bp, Homo sapiens
gcactccctaagaaa

SEQ ID NO: 2059865 - DNA, 18 bp, Homo sapiens
gcactccctaagaaaccc

SEQ ID NO: 2059866 - DNA, 22 bp, Homo sapiens
gcactccctaagaaaccccagg

SEQ ID NO: 2059867 - DNA, 17 bp, Homo sapiens
gcactccggcctgatga

SEQ ID NO: 2059868 - DNA, 17 bp, Homo sapiens
gcactcctctgtctctg

SEQ ID NO: 2059869 - DNA, 19 bp, Homo sapiens
gcactcctctgtctctgct

SEQ ID NO: 2059870 - DNA, 17 bp, Homo sapiens
gcactcgagaccatcct

SEQ ID NO: 2059871 - DNA, 21 bp, Homo sapiens
gcactcgagaccatcctggcc

SEQ ID NO: 2059872 - DNA, 14 bp, Homo sapiens
gcactgaaaaggtt

SEQ ID NO: 2059873 - DNA, 20 bp, Homo sapiens
gcactgaaaataccatcagg

SEQ ID NO: 2059874 - DNA, 20 bp, Homo sapiens
gcactgacccacagcctctg

SEQ ID NO: 2059875 - DNA, 14 bp, Homo sapiens
gcactgacccttcc

SEQ ID NO: 2059876 - DNA, 13 bp, Homo sapiens
gcactgagggcca

SEQ ID NO: 2059877 - DNA, 20 bp, Homo sapiens
gcactgagggccacactatt

SEQ ID NO: 2059878 - DNA, 19 bp, Homo sapiens
gcactgatttcacaacaga

SEQ ID NO: 2059879 - DNA, 20 bp, Homo sapiens
gcactgatttcacaacagat

SEQ ID NO: 2059880 - DNA, 22 bp, Homo sapiens
gcactgctaggcgagtgccagg

SEQ ID NO: 2059881 - DNA, 15 bp, Homo sapiens
gcactgctgcccagc

SEQ ID NO: 2059882 - DNA, 21 bp, Homo sapiens
gcactgcttgaggaggggcac

SEQ ID NO: 2059883 - DNA, 13 bp, Homo sapiens
gcactggccagag

SEQ ID NO: 2059884 - DNA, 18 bp, Homo sapiens
gcactggccagagagggc

SEQ ID NO: 2059885 - DNA, 19 bp, Homo sapiens
gcactggccagagagggcc

SEQ ID NO: 2059886 - DNA, 23 bp, Homo sapiens
gcactgggatgagccgctgtgag

SEQ ID NO: 2059887 - DNA, 14 bp, Homo sapiens
gcactggtggcccg

SEQ ID NO: 2059888 - DNA, 24 bp, Homo sapiens
gcactggtggcccgacagcctggc

SEQ ID NO: 2059889 - DNA, 15 bp, Homo sapiens
gcactgtctgcgtga

SEQ ID NO: 2059890 - DNA, 18 bp, Homo sapiens
gcactgtggattatttca

SEQ ID NO: 2059891 - DNA, 18 bp, Homo sapiens
gcactgtgggggctggtc

SEQ ID NO: 2059892 - DNA, 19 bp, Homo sapiens
gcacttagctatcagaaga

SEQ ID NO: 2059893 - DNA, 18 bp, Homo sapiens
gcacttgcgtcctgcaga

SEQ ID NO: 2059894 - DNA, 15 bp, Homo sapiens
gcacttggctgcata

SEQ ID NO: 2059895 - DNA, 21 bp, Homo sapiens
gcacttggggcaccttgctcc

SEQ ID NO: 2059896 - DNA, 21 bp, Homo sapiens
gcactttaaccctctcttccc

SEQ ID NO: 2059897 - DNA, 15 bp, Homo sapiens
gcactttataaaagc

SEQ ID NO: 2059898 - DNA, 18 bp, Homo sapiens
gcactttttaaaaagtac

SEQ ID NO: 2059899 - DNA, 14 bp, Homo sapiens
gcagaaaagaggag

SEQ ID NO: 2059900 - DNA, 19 bp, Homo sapiens
gcagaaaagaggagaccct

SEQ ID NO: 2059901 - DNA, 15 bp, Homo sapiens
gcagaaaagcacctg

SEQ ID NO: 2059902 - DNA, 17 bp, Homo sapiens
gcagaaaagcacctgcc

SEQ ID NO: 2059903 - DNA, 14 bp, Homo sapiens
gcagaaaagtgctt

SEQ ID NO: 2059904 - DNA, 18 bp, Homo sapiens
gcagaaaagtgcttagaa

SEQ ID NO: 2059905 - DNA, 21 bp, Homo sapiens
gcagaaaagtgcttagaaagt

SEQ ID NO: 2059906 - DNA, 21 bp, Homo sapiens
gcagaacatgtgggaggaaga

SEQ ID NO: 2059907 - DNA, 24 bp, Homo sapiens
gcagaacggagccccaggcctctg

SEQ ID NO: 2059908 - DNA, 21 bp, Homo sapiens
gcagaacgtattggtccagct

SEQ ID NO: 2059909 - DNA, 12 bp, Homo sapiens
gcagaagaggga

SEQ ID NO: 2059910 - DNA, 14 bp, Homo sapiens
gcagaagagggagg

SEQ ID NO: 2059911 - DNA, 12 bp, Homo sapiens
gcagaaggaagg

SEQ ID NO: 2059912 - DNA, 13 bp, Homo sapiens
gcagaaggaaggc

SEQ ID NO: 2059913 - DNA, 15 bp, Homo sapiens
gcagaaggaaggcag

SEQ ID NO: 2059914 - DNA, 22 bp, Homo sapiens
gcagaaggaaggcagggaggag

SEQ ID NO: 2059915 - DNA, 14 bp, Homo sapiens
gcagaaggccaaga

SEQ ID NO: 2059916 - DNA, 15 bp, Homo sapiens
gcagaagggagaagg

SEQ ID NO: 2059917 - DNA, 16 bp, Homo sapiens
gcagacacctgtgcac

SEQ ID NO: 2059918 - DNA, 14 bp, Homo sapiens
gcagacagcagctc

SEQ ID NO: 2059919 - DNA, 18 bp, Homo sapiens
gcagacagcagctcaggc

SEQ ID NO: 2059920 - DNA, 12 bp, Homo sapiens
gcagacaggcaa

SEQ ID NO: 2059921 - DNA, 13 bp, Homo sapiens
gcagacaggcaag

SEQ ID NO: 2059922 - DNA, 14 bp, Homo sapiens
gcagacaggcaagc

SEQ ID NO: 2059923 - DNA, 14 bp, Homo sapiens
gcagaccctgccct

SEQ ID NO: 2059924 - DNA, 18 bp, Homo sapiens
gcagacgcagcagctggg

SEQ ID NO: 2059925 - DNA, 13 bp, Homo sapiens
gcagactcactgt

SEQ ID NO: 2059926 - DNA, 17 bp, Homo sapiens
gcagactcagtttgtca

SEQ ID NO: 2059927 - DNA, 16 bp, Homo sapiens
gcagactcctcagatc

SEQ ID NO: 2059928 - DNA, 17 bp, Homo sapiens
gcagactctacagaggc

SEQ ID NO: 2059929 - DNA, 22 bp, Homo sapiens
gcagactctacagaggccatgg

SEQ ID NO: 2059930 - DNA, 20 bp, Homo sapiens
gcagactgatgggacatcaa

SEQ ID NO: 2059931 - DNA, 14 bp, Homo sapiens
gcagactgtggctg

SEQ ID NO: 2059932 - DNA, 18 bp, Homo sapiens
gcagagaaagaagagaca

SEQ ID NO: 2059933 - DNA, 22 bp, Homo sapiens
tctccactgctctcagcctccc

SEQ ID NO: 2059934 - DNA, 18 bp, Homo sapiens
tctccagcatcctgcttc

SEQ ID NO: 2059935 - DNA, 16 bp, Homo sapiens
tctccagccagcaatg

SEQ ID NO: 2059936 - DNA, 19 bp, Homo sapiens
tctccagcccacacccctc

SEQ ID NO: 2059937 - DNA, 16 bp, Homo sapiens
tctccaggattccaaa

SEQ ID NO: 2059938 - DNA, 16 bp, Homo sapiens
tctccaggctgtatcc

SEQ ID NO: 2059939 - DNA, 19 bp, Homo sapiens
tctccaggctgtttctttt

SEQ ID NO: 2059940 - DNA, 17 bp, Homo sapiens
tctccatgtagaataaa

SEQ ID NO: 2059941 - DNA, 21 bp, Homo sapiens
tctcccaccccggcctccact

SEQ ID NO: 2059942 - DNA, 12 bp, Homo sapiens
tctcccaggccc

SEQ ID NO: 2059943 - DNA, 16 bp, Homo sapiens
tcctttaggcagcctg

SEQ ID NO: 2059944 - DNA, 21 bp, Homo sapiens
tcctttaggcagcctgccgcc

SEQ ID NO: 2059945 - DNA, 19 bp, Homo sapiens
tcctttcaatggtttgcaa

SEQ ID NO: 2059946 - DNA, 15 bp, Homo sapiens
tcctttcaccacatg

SEQ ID NO: 2059947 - DNA, 24 bp, Homo sapiens
tcctttcaggagggtccccagctg

SEQ ID NO: 2059948 - DNA, 13 bp, Homo sapiens
tcctttcctctga

SEQ ID NO: 2059949 - DNA, 15 bp, Homo sapiens
tcctttcctctgcag

SEQ ID NO: 2059950 - DNA, 14 bp, Homo sapiens
tcctttctcagccg

SEQ ID NO: 2059951 - DNA, 22 bp, Homo sapiens
tcctttgacttattgtccccac

SEQ ID NO: 2059952 - DNA, 12 bp, Homo sapiens
tcctttgagaaa

SEQ ID NO: 2059953 - DNA, 16 bp, Homo sapiens
tcctttgagaatgtga

SEQ ID NO: 2059954 - DNA, 17 bp, Homo sapiens
tcctttgccccaaggct

SEQ ID NO: 2059955 - DNA, 10 bp, Homo sapiens
tcctttgttc

SEQ ID NO: 2059956 - DNA, 15 bp, Homo sapiens
tcctttgtttttatg

SEQ ID NO: 2059957 - DNA, 14 bp, Homo sapiens
tccttttatgttat

SEQ ID NO: 2059958 - DNA, 15 bp, Homo sapiens
tccttttatgttatt

SEQ ID NO: 2059959 - DNA, 15 bp, Homo sapiens
tccttttcttccttc

SEQ ID NO: 2059960 - DNA, 21 bp, Homo sapiens
tccttttgcaacaagacaaag

SEQ ID NO: 2059961 - DNA, 14 bp, Homo sapiens
tccttttgctgtct

SEQ ID NO: 2059962 - DNA, 20 bp, Homo sapiens
tccttttgctgtctttctct

SEQ ID NO: 2059963 - DNA, 13 bp, Homo sapiens
tccttttgcttga

SEQ ID NO: 2059964 - DNA, 18 bp, Homo sapiens
tccttttgtccccagggc

SEQ ID NO: 2059965 - DNA, 18 bp, Homo sapiens
tccttttgtgtacagtgt

SEQ ID NO: 2059966 - DNA, 14 bp, Homo sapiens
tcctttttctttat

SEQ ID NO: 2059967 - DNA, 19 bp, Homo sapiens
tcctttttctttataaact

SEQ ID NO: 2059968 - DNA, 24 bp, Homo sapiens
tcgaaaattcatttcacattaatg

SEQ ID NO: 2059969 - DNA, 21 bp, Homo sapiens
tcgaaatgaatttatctgaat

SEQ ID NO: 2059970 - DNA, 13 bp, Homo sapiens
tcgaactggctgc

SEQ ID NO: 2059971 - DNA, 15 bp, Homo sapiens
tcgaactggctgcaa

SEQ ID NO: 2059972 - DNA, 23 bp, Homo sapiens
tcgaagaacaatgtcagaaactc

SEQ ID NO: 2059973 - DNA, 12 bp, Homo sapiens
tcgaatgaaatt

SEQ ID NO: 2059974 - DNA, 16 bp, Homo sapiens
tcgaattaatagcttt

SEQ ID NO: 2059975 - DNA, 21 bp, Homo sapiens
tcgaattaatagcttttattg

SEQ ID NO: 2059976 - DNA, 14 bp, Homo sapiens
tcgaccccaaagcc

SEQ ID NO: 2059977 - DNA, 19 bp, Homo sapiens
tcgaccccaaagccccttg

SEQ ID NO: 2059978 - DNA, 17 bp, Homo sapiens
tcgactttatacagaac

SEQ ID NO: 2059979 - DNA, 15 bp, Homo sapiens
tcgagaccagcctgg

SEQ ID NO: 2059980 - DNA, 19 bp, Homo sapiens
tcgagaccagcctggccaa

SEQ ID NO: 2059981 - DNA, 19 bp, Homo sapiens
tcgagaccatcctggcccc

SEQ ID NO: 2059982 - DNA, 13 bp, Homo sapiens
tcgagcccagatg

SEQ ID NO: 2059983 - DNA, 22 bp, Homo sapiens
tcgagccccctggatgtcccct

SEQ ID NO: 2059984 - DNA, 12 bp, Homo sapiens
tcgagccctgca

SEQ ID NO: 2059985 - DNA, 16 bp, Homo sapiens
tcgagccctgcagcca

SEQ ID NO: 2059986 - DNA, 15 bp, Homo sapiens
tcgagcgccctgcag

SEQ ID NO: 2059987 - DNA, 12 bp, Homo sapiens
tcgaggacaagt

SEQ ID NO: 2059988 - DNA, 17 bp, Homo sapiens
tcgaggacagggaggtg

SEQ ID NO: 2059989 - DNA, 19 bp, Homo sapiens
tcgaggcaccggcgctgca

SEQ ID NO: 2059990 - DNA, 20 bp, Homo sapiens
tcgaggcaccggcgctgcag

SEQ ID NO: 2059991 - DNA, 22 bp, Homo sapiens
tcgaggcggtttccaggaagag

SEQ ID NO: 2059992 - DNA, 17 bp, Homo sapiens
tcgaggtgtcaccctgc

SEQ ID NO: 2059993 - DNA, 20 bp, Homo sapiens
tcgaggtgtcaccctgcaga

SEQ ID NO: 2059994 - DNA, 23 bp, Homo sapiens
tcgaggtgtcaccctgcagagct

SEQ ID NO: 2059995 - DNA, 22 bp, Homo sapiens
tcgaggttgccccttccccatc

SEQ ID NO: 2059996 - DNA, 19 bp, Homo sapiens
tcgatcctggattcactca

SEQ ID NO: 2059997 - DNA, 20 bp, Homo sapiens
tcgatgaatgtgttgatttg

SEQ ID NO: 2059998 - DNA, 23 bp, Homo sapiens
tcgatgaatgtgttgatttgaga

SEQ ID NO: 2059999 - DNA, 22 bp, Homo sapiens
tcgatgccactcctgcttctct

SEQ ID NO: 2060000 - DNA, 13 bp, Homo sapiens
tcgattagactgg

SEQ ID NO: 2060001 - DNA, 14 bp, Homo sapiens
tcgattagactgga

SEQ ID NO: 2060002 - DNA, 22 bp, Homo sapiens
tcgattagactggacagcttgt

SEQ ID NO: 2060003 - DNA, 22 bp, Homo sapiens
tcgcacagattacttcagggct

SEQ ID NO: 2060004 - DNA, 17 bp, Homo sapiens
tcgcagcaggtgcaaga

SEQ ID NO: 2060005 - DNA, 21 bp, Homo sapiens
tcgcagcaggtgcaagagaca

SEQ ID NO: 2060006 - DNA, 19 bp, Homo sapiens
tcgcagccaccctgaggag

SEQ ID NO: 2060007 - DNA, 13 bp, Homo sapiens
tcgcagcctggcg

SEQ ID NO: 2060008 - DNA, 20 bp, Homo sapiens
tcgcaggatccgctgccacc

SEQ ID NO: 2060009 - DNA, 22 bp, Homo sapiens
tcgccacacccggctccccctg

SEQ ID NO: 2060010 - DNA, 20 bp, Homo sapiens
tcgcccacaagccttactca

SEQ ID NO: 2060011 - DNA, 13 bp, Homo sapiens
tcgccccacccag

SEQ ID NO: 2060012 - DNA, 22 bp, Homo sapiens
tcgccccagatcaccagcccgg

SEQ ID NO: 2060013 - DNA, 20 bp, Homo sapiens
tcgccccaggccctccctga

SEQ ID NO: 2060014 - DNA, 19 bp, Homo sapiens
tcgccggccttgttttatt

SEQ ID NO: 2060015 - DNA, 17 bp, Homo sapiens
tcgccgttgaagaggaa

SEQ ID NO: 2060016 - DNA, 14 bp, Homo sapiens
tcgcctaggcctgt

SEQ ID NO: 2060017 - DNA, 17 bp, Homo sapiens
tcgcctgggcccaggct

SEQ ID NO: 2060018 - DNA, 18 bp, Homo sapiens
tcgcctgggcccaggctc

SEQ ID NO: 2060019 - DNA, 19 bp, Homo sapiens
tcgcctgggcccaggctct

SEQ ID NO: 2060020 - DNA, 22 bp, Homo sapiens
tcgcctgggcccaggctctggg

SEQ ID NO: 2060021 - DNA, 14 bp, Homo sapiens
tcgctccccactct

SEQ ID NO: 2060022 - DNA, 16 bp, Homo sapiens
tcgctccctgtagctc

SEQ ID NO: 2060023 - DNA, 22 bp, Homo sapiens
tcgctccctgtagctctgcctc

SEQ ID NO: 2060024 - DNA, 23 bp, Homo sapiens
tcgctccctgtagctctgcctcc

SEQ ID NO: 2060025 - DNA, 12 bp, Homo sapiens
tcgctcctgtgt

SEQ ID NO: 2060026 - DNA, 20 bp, Homo sapiens
tcgctctgctggcctggccg

SEQ ID NO: 2060027 - DNA, 15 bp, Homo sapiens
tcgctgccaggacac

SEQ ID NO: 2060028 - DNA, 20 bp, Homo sapiens
tcgctgccaggacacctgcc

SEQ ID NO: 2060029 - DNA, 21 bp, Homo sapiens
tcgctgccaggacacctgccc

SEQ ID NO: 2060030 - DNA, 16 bp, Homo sapiens
tcgctgccttgccatg

SEQ ID NO: 2060031 - DNA, 18 bp, Homo sapiens
tcgctgctctagctggca

SEQ ID NO: 2060032 - DNA, 21 bp, Homo sapiens
tcgctggaatcaatttcccag

SEQ ID NO: 2060033 - DNA, 14 bp, Homo sapiens
tcgctggacaaccc

SEQ ID NO: 2060034 - DNA, 20 bp, Homo sapiens
tcgctggcagagaaggcttc

SEQ ID NO: 2060035 - DNA, 14 bp, Homo sapiens
tcgctgggctgtgg

SEQ ID NO: 2060036 - DNA, 16 bp, Homo sapiens
tcgctgtcctgctgtg

SEQ ID NO: 2060037 - DNA, 17 bp, Homo sapiens
tcgcttagctgaaacct

SEQ ID NO: 2060038 - DNA, 13 bp, Homo sapiens
tcggaagcagtgc

SEQ ID NO: 2060039 - DNA, 22 bp, Homo sapiens
tcggaagcagtgccttccataa

SEQ ID NO: 2060040 - DNA, 19 bp, Homo sapiens
tcggaaggctggctgggca

SEQ ID NO: 2060041 - DNA, 18 bp, Homo sapiens
tcggacagtgcccatgca

SEQ ID NO: 2060042 - DNA, 15 bp, Homo sapiens
tcggagacagtgatc

SEQ ID NO: 2060043 - DNA, 21 bp, Homo sapiens
tcggagacagtgatctccata

SEQ ID NO: 2060044 - DNA, 23 bp, Homo sapiens
tcggagagggctgcgagcatttc

SEQ ID NO: 2060045 - DNA, 23 bp, Homo sapiens
tcggagcctcatccgaggcaggg

SEQ ID NO: 2060046 - DNA, 15 bp, Homo sapiens
tcggagctgccagcc

SEQ ID NO: 2060047 - DNA, 13 bp, Homo sapiens
tcggaggctgggc

SEQ ID NO: 2060048 - DNA, 21 bp, Homo sapiens
tcggaggctgggcccctggga

SEQ ID NO: 2060049 - DNA, 15 bp, Homo sapiens
tcggaggtggtggag

SEQ ID NO: 2060050 - DNA, 16 bp, Homo sapiens
tcggagtagaaattgt

SEQ ID NO: 2060051 - DNA, 19 bp, Homo sapiens
tcggctgtaaacagctctg

SEQ ID NO: 2060052 - DNA, 13 bp, Homo sapiens
tcgggagcagtgt

SEQ ID NO: 2060053 - DNA, 15 bp, Homo sapiens
tcgggagcagtgtct

SEQ ID NO: 2060054 - DNA, 23 bp, Homo sapiens
tcgggagcagtgtcttccataat

SEQ ID NO: 2060055 - DNA, 18 bp, Homo sapiens
tcgggcgctgtggctcct

SEQ ID NO: 2060056 - DNA, 16 bp, Homo sapiens
tcggggaactcctgga

SEQ ID NO: 2060057 - DNA, 19 bp, Homo sapiens
tcggggagaggctgaggac

SEQ ID NO: 2060058 - DNA, 18 bp, Homo sapiens
tcggggcatgctggggca

SEQ ID NO: 2060059 - DNA, 16 bp, Homo sapiens
aggagggcaagggcca

SEQ ID NO: 2060060 - DNA, 13 bp, Homo sapiens
aggagggcagagc

SEQ ID NO: 2060061 - DNA, 17 bp, Homo sapiens
aggagggcgtgactcac

SEQ ID NO: 2060062 - DNA, 17 bp, Homo sapiens
aggaggggatagagaga

SEQ ID NO: 2060063 - DNA, 14 bp, Homo sapiens
aggaggggcacctg

SEQ ID NO: 2060064 - DNA, 16 bp, Homo sapiens
aggaggggcacctgcc

SEQ ID NO: 2060065 - DNA, 18 bp, Homo sapiens
aggaggggcacctgccac

SEQ ID NO: 2060066 - DNA, 13 bp, Homo sapiens
aggagggtgccct

SEQ ID NO: 2060067 - DNA, 16 bp, Homo sapiens
aggagggtggaggaag

SEQ ID NO: 2060068 - DNA, 21 bp, Homo sapiens
aggaggtagctcccagcactc

SEQ ID NO: 2060069 - DNA, 13 bp, Homo sapiens
aggaggtgaggga

SEQ ID NO: 2060070 - DNA, 14 bp, Homo sapiens
aggaggtgagggat

SEQ ID NO: 2060071 - DNA, 20 bp, Homo sapiens
aggaggtggcagccctgtag

SEQ ID NO: 2060072 - DNA, 23 bp, Homo sapiens
aggaggtggcagccctgtaggga

SEQ ID NO: 2060073 - DNA, 18 bp, Homo sapiens
aggaggttgtggatgctc

SEQ ID NO: 2060074 - DNA, 21 bp, Homo sapiens
aggaggttgtggatgctccag

SEQ ID NO: 2060075 - DNA, 15 bp, Homo sapiens
aggagtagctgagag

SEQ ID NO: 2060076 - DNA, 15 bp, Homo sapiens
aggagtagctgagct

SEQ ID NO: 2060077 - DNA, 22 bp, Homo sapiens
aggagtcaactggctggccagt

SEQ ID NO: 2060078 - DNA, 16 bp, Homo sapiens
aggagtcccaaggaaa

SEQ ID NO: 2060079 - DNA, 17 bp, Homo sapiens
aggagtcccaaggaaag

SEQ ID NO: 2060080 - DNA, 12 bp, Homo sapiens
aggagtccctgg

SEQ ID NO: 2060081 - DNA, 15 bp, Homo sapiens
aggagtctgaggtcc

SEQ ID NO: 2060082 - DNA, 22 bp, Homo sapiens
aggagtctgaggtcctgagcac

SEQ ID NO: 2060083 - DNA, 12 bp, Homo sapiens
aggagtgagcac

SEQ ID NO: 2060084 - DNA, 23 bp, Homo sapiens
aggagtgggttttattgtccttc

SEQ ID NO: 2060085 - DNA, 20 bp, Homo sapiens
aggagttccttgatctgtat

SEQ ID NO: 2060086 - DNA, 21 bp, Homo sapiens
aggagttcgagaccagcccag

SEQ ID NO: 2060087 - DNA, 14 bp, Homo sapiens
aggagttgctgttt

SEQ ID NO: 2060088 - DNA, 19 bp, Homo sapiens
aggagtttcgaggtagagt

SEQ ID NO: 2060089 - DNA, 16 bp, Homo sapiens
aggagtttgagaccag

SEQ ID NO: 2060090 - DNA, 19 bp, Homo sapiens
aggagtttgaggctgcagc

SEQ ID NO: 2060091 - DNA, 15 bp, Homo sapiens
tactacccgagccca

SEQ ID NO: 2060092 - DNA, 16 bp, Homo sapiens
tactacttcttggaaa

SEQ ID NO: 2060093 - DNA, 20 bp, Homo sapiens
tactacttttgcatgaaaat

SEQ ID NO: 2060094 - DNA, 19 bp, Homo sapiens
tactagttttccttgaaaa

SEQ ID NO: 2060095 - DNA, 22 bp, Homo sapiens
tactagttttccttgaaaaaaa

SEQ ID NO: 2060096 - DNA, 20 bp, Homo sapiens
tactatgaaatgaaagaact

SEQ ID NO: 2060097 - DNA, 13 bp, Homo sapiens
tactattctgtta

SEQ ID NO: 2060098 - DNA, 16 bp, Homo sapiens
tactatttgaagcaat

SEQ ID NO: 2060099 - DNA, 14 bp, Homo sapiens
tactattttacttc

SEQ ID NO: 2060100 - DNA, 15 bp, Homo sapiens
tactcacagtctctt

SEQ ID NO: 2060101 - DNA, 14 bp, Homo sapiens
tactcacctcctcc

SEQ ID NO: 2060102 - DNA, 17 bp, Homo sapiens
tactcagaagcctgagg

SEQ ID NO: 2060103 - DNA, 13 bp, Homo sapiens
tactcagagcaga

SEQ ID NO: 2060104 - DNA, 19 bp, Homo sapiens
tactcagcagcagagagcc

SEQ ID NO: 2060105 - DNA, 22 bp, Homo sapiens
tactcagcagcagagagccctg

SEQ ID NO: 2060106 - DNA, 15 bp, Homo sapiens
tactcagcagccctc

SEQ ID NO: 2060107 - DNA, 16 bp, Homo sapiens
tactcagcagccctcc

SEQ ID NO: 2060108 - DNA, 18 bp, Homo sapiens
tactcagcagccctcctc

SEQ ID NO: 2060109 - DNA, 15 bp, Homo sapiens
tactcagccctgggc

SEQ ID NO: 2060110 - DNA, 22 bp, Homo sapiens
tactcagccctgggccccacca

SEQ ID NO: 2060111 - DNA, 16 bp, Homo sapiens
tactcagctctcctgc

SEQ ID NO: 2060112 - DNA, 19 bp, Homo sapiens
tactcatgtacattggtct

SEQ ID NO: 2060113 - DNA, 12 bp, Homo sapiens
tactcattgtct

SEQ ID NO: 2060114 - DNA, 11 bp, Homo sapiens
tactcatttct

SEQ ID NO: 2060115 - DNA, 20 bp, Homo sapiens
tactcccaggcactgtctta

SEQ ID NO: 2060116 - DNA, 18 bp, Homo sapiens
tactcccttcctggcctc

SEQ ID NO: 2060117 - DNA, 14 bp, Homo sapiens
tactcctacctcag

SEQ ID NO: 2060118 - DNA, 12 bp, Homo sapiens
tactcctcccag

SEQ ID NO: 2060119 - DNA, 12 bp, Homo sapiens
tactcctgcaaa

SEQ ID NO: 2060120 - DNA, 17 bp, Homo sapiens
tactcctgcaaaatttt

SEQ ID NO: 2060121 - DNA, 19 bp, Homo sapiens
tactcctgtgctctggagg

SEQ ID NO: 2060122 - DNA, 12 bp, Homo sapiens
tactcctgtggg

SEQ ID NO: 2060123 - DNA, 21 bp, Homo sapiens
tactcctgtgggagcctcgca

SEQ ID NO: 2060124 - DNA, 23 bp, Homo sapiens
tactctccaaaggccctaccaga

SEQ ID NO: 2060125 - DNA, 16 bp, Homo sapiens
tactctccaacctgga

SEQ ID NO: 2060126 - DNA, 18 bp, Homo sapiens
tactctccaacctggaca

SEQ ID NO: 2060127 - DNA, 16 bp, Homo sapiens
tactctcttgccagca

SEQ ID NO: 2060128 - DNA, 14 bp, Homo sapiens
tactctgaaaagca

SEQ ID NO: 2060129 - DNA, 16 bp, Homo sapiens
tactctgtccaggcca

SEQ ID NO: 2060130 - DNA, 20 bp, Homo sapiens
tactctgtgccagagcctgg

SEQ ID NO: 2060131 - DNA, 21 bp, Homo sapiens
tactctgtgtcaggtggggca

SEQ ID NO: 2060132 - DNA, 18 bp, Homo sapiens
tactcttaggaagagaaa

SEQ ID NO: 2060133 - DNA, 21 bp, Homo sapiens
tactcttaggaagagaaacca

SEQ ID NO: 2060134 - DNA, 21 bp, Homo sapiens
tactcttcagaatatggacaa

SEQ ID NO: 2060135 - DNA, 15 bp, Homo sapiens
tactcttcctttcta

SEQ ID NO: 2060136 - DNA, 19 bp, Homo sapiens
tactgaaaacaaaatatct

SEQ ID NO: 2060137 - DNA, 20 bp, Homo sapiens
tactgaaaacaaaatatctg

SEQ ID NO: 2060138 - DNA, 23 bp, Homo sapiens
tactgaaaacaaaatatctgaca

SEQ ID NO: 2060139 - DNA, 20 bp, Homo sapiens
tactgaaaggttaccctgta

SEQ ID NO: 2060140 - DNA, 16 bp, Homo sapiens
tactgataaagaaaga

SEQ ID NO: 2060141 - DNA, 23 bp, Homo sapiens
tactgatgttcctagtgaaagag

SEQ ID NO: 2060142 - DNA, 13 bp, Homo sapiens
tactgcaataaat

SEQ ID NO: 2060143 - DNA, 19 bp, Homo sapiens
tactgcccaggcctgcctg

SEQ ID NO: 2060144 - DNA, 20 bp, Homo sapiens
tactgcccaggcctgcctgt

SEQ ID NO: 2060145 - DNA, 19 bp, Homo sapiens
tactgccggtcacccaggc

SEQ ID NO: 2060146 - DNA, 21 bp, Homo sapiens
tactgctttcaacttaaatca

SEQ ID NO: 2060147 - DNA, 18 bp, Homo sapiens
tactggaagttttgcatt

SEQ ID NO: 2060148 - DNA, 19 bp, Homo sapiens
ctcagctgctcgcacagat

SEQ ID NO: 2060149 - DNA, 18 bp, Homo sapiens
ctcagctgtctgtggctt

SEQ ID NO: 2060150 - DNA, 15 bp, Homo sapiens
ctcagcttcatttcc

SEQ ID NO: 2060151 - DNA, 20 bp, Homo sapiens
ctcagcttcatttccgtgaa

SEQ ID NO: 2060152 - DNA, 20 bp, Homo sapiens
ctcaggaagaaaccccaagc

SEQ ID NO: 2060153 - DNA, 13 bp, Homo sapiens
ctcaggacacagg

SEQ ID NO: 2060154 - DNA, 16 bp, Homo sapiens
ctcaggacccaggccc

SEQ ID NO: 2060155 - DNA, 17 bp, Homo sapiens
ctcaggacccaggccct

SEQ ID NO: 2060156 - DNA, 23 bp, Homo sapiens
ctcaggacccaggccctccatgg

SEQ ID NO: 2060157 - DNA, 22 bp, Homo sapiens
ctcaggacggaaggtcagttgc

SEQ ID NO: 2060158 - DNA, 18 bp, Homo sapiens
ctcaggagcacaggcagc

SEQ ID NO: 2060159 - DNA, 22 bp, Homo sapiens
ctcaggagcacaggcagctgga

SEQ ID NO: 2060160 - DNA, 21 bp, Homo sapiens
ctcaggagcttgcaagaagca

SEQ ID NO: 2060161 - DNA, 19 bp, Homo sapiens
ctcaggaggcgaataaatg

SEQ ID NO: 2060162 - DNA, 20 bp, Homo sapiens
ctcaggaggcgaataaatgt

SEQ ID NO: 2060163 - DNA, 21 bp, Homo sapiens
ctcaggaggcgaataaatgtt

SEQ ID NO: 2060164 - DNA, 19 bp, Homo sapiens
ctcaggaggcgcagcccga

SEQ ID NO: 2060165 - DNA, 20 bp, Homo sapiens
ctcaggaggctgaggcagaa

SEQ ID NO: 2060166 - DNA, 22 bp, Homo sapiens
ctcaggaggctgaggcaggagg

SEQ ID NO: 2060167 - DNA, 15 bp, Homo sapiens
ctcaggcaagcccct

SEQ ID NO: 2060168 - DNA, 19 bp, Homo sapiens
ctcaggcaagcccctcagc

SEQ ID NO: 2060169 - DNA, 20 bp, Homo sapiens
ctcaggcaagcccctcagcc

SEQ ID NO: 2060170 - DNA, 23 bp, Homo sapiens
ctcaggcaagcccctcagccctt

SEQ ID NO: 2060171 - DNA, 17 bp, Homo sapiens
ctcaggcagacaagagc

SEQ ID NO: 2060172 - DNA, 19 bp, Homo sapiens
ctcaggcagacaagagctg

SEQ ID NO: 2060173 - DNA, 18 bp, Homo sapiens
ctcaggccagtgccagga

SEQ ID NO: 2060174 - DNA, 22 bp, Homo sapiens
ctcaggcccccacctggctcac

SEQ ID NO: 2060175 - DNA, 23 bp, Homo sapiens
ctcaggcctataaccccagctcc

SEQ ID NO: 2060176 - DNA, 20 bp, Homo sapiens
ctcaggctgagcccagccac

SEQ ID NO: 2060177 - DNA, 22 bp, Homo sapiens
ctcaggctgagcccagccacct

SEQ ID NO: 2060178 - DNA, 14 bp, Homo sapiens
ctcaggctgctgct

SEQ ID NO: 2060179 - DNA, 17 bp, Homo sapiens
ctcagggacaacatttt

SEQ ID NO: 2060180 - DNA, 14 bp, Homo sapiens
ctcagggacagaga

SEQ ID NO: 2060181 - DNA, 19 bp, Homo sapiens
ctcagggacagagacacct

SEQ ID NO: 2060182 - DNA, 21 bp, Homo sapiens
ctcagggacagagacacctgc

SEQ ID NO: 2060183 - DNA, 13 bp, Homo sapiens
ctcagggccccag

SEQ ID NO: 2060184 - DNA, 14 bp, Homo sapiens
ctcagggccccagc

SEQ ID NO: 2060185 - DNA, 11 bp, Homo sapiens
ctcagggctgg

SEQ ID NO: 2060186 - DNA, 22 bp, Homo sapiens
ctcagggctggagtgcgctctt

SEQ ID NO: 2060187 - DNA, 23 bp, Homo sapiens
ctcaggggccagtgagggctggg

SEQ ID NO: 2060188 - DNA, 19 bp, Homo sapiens
ctcagggggtcagcagagt

SEQ ID NO: 2060189 - DNA, 20 bp, Homo sapiens
ctcagggggtcagcagagtt

SEQ ID NO: 2060190 - DNA, 16 bp, Homo sapiens
ctcagggtccagaccc

SEQ ID NO: 2060191 - DNA, 20 bp, Homo sapiens
ctcaggtgactggagcccga

SEQ ID NO: 2060192 - DNA, 19 bp, Homo sapiens
ctcaggtgatccacccacc

SEQ ID NO: 2060193 - DNA, 16 bp, Homo sapiens
ctcaggtgccactccc

SEQ ID NO: 2060194 - DNA, 19 bp, Homo sapiens
ctcaggtgccactccctga

SEQ ID NO: 2060195 - DNA, 20 bp, Homo sapiens
ctcaggtgccactccctgag

SEQ ID NO: 2060196 - DNA, 22 bp, Homo sapiens
ctcaggtgccactccctgagct

SEQ ID NO: 2060197 - DNA, 16 bp, Homo sapiens
ctcaggtgtccctgca

SEQ ID NO: 2060198 - DNA, 23 bp, Homo sapiens
ctcaggtgtccctgcacttgcag

SEQ ID NO: 2060199 - DNA, 18 bp, Homo sapiens
ctcagtaatttagaaatc

SEQ ID NO: 2060200 - DNA, 22 bp, Homo sapiens
ctcagtaatttagaaatcattt

SEQ ID NO: 2060201 - DNA, 16 bp, Homo sapiens
ctcagtcatattctta

SEQ ID NO: 2060202 - DNA, 22 bp, Homo sapiens
ctcagtcccccaccacactgaa

SEQ ID NO: 2060203 - DNA, 12 bp, Homo sapiens
ctcagtcctgga

SEQ ID NO: 2060204 - DNA, 13 bp, Homo sapiens
taatgaactgtga

SEQ ID NO: 2060205 - DNA, 14 bp, Homo sapiens
taatgaactgtgac

SEQ ID NO: 2060206 - DNA, 15 bp, Homo sapiens
taatgaactgtgaca

SEQ ID NO: 2060207 - DNA, 17 bp, Homo sapiens
taatgaagacccagtgt

SEQ ID NO: 2060208 - DNA, 12 bp, Homo sapiens
taatgaatgcta

SEQ ID NO: 2060209 - DNA, 22 bp, Homo sapiens
taatgactttttataatgtgga

SEQ ID NO: 2060210 - DNA, 20 bp, Homo sapiens
taatgagaacttcaatcact

SEQ ID NO: 2060211 - DNA, 17 bp, Homo sapiens
taatgattatatgacaa

SEQ ID NO: 2060212 - DNA, 21 bp, Homo sapiens
taatgcacaatttagaaaaca

SEQ ID NO: 2060213 - DNA, 20 bp, Homo sapiens
taatgcatgtggtatgagta

SEQ ID NO: 2060214 - DNA, 17 bp, Homo sapiens
taatgcatgttaggaaa

SEQ ID NO: 2060215 - DNA, 21 bp, Homo sapiens
taatgcatgttaggaaaattt

SEQ ID NO: 2060216 - DNA, 20 bp, Homo sapiens
taatgctcccatctcctgat

SEQ ID NO: 2060217 - DNA, 17 bp, Homo sapiens
taatgctgttgcctcat

SEQ ID NO: 2060218 - DNA, 16 bp, Homo sapiens
taatgcttcaagtgtt

SEQ ID NO: 2060219 - DNA, 18 bp, Homo sapiens
taatggaaacatttacaa

SEQ ID NO: 2060220 - DNA, 20 bp, Homo sapiens
taatggaaacatttacaata

SEQ ID NO: 2060221 - DNA, 20 bp, Homo sapiens
taatggaaagcagcagcttg

SEQ ID NO: 2060222 - DNA, 19 bp, Homo sapiens
taatggaactgaccccctc

SEQ ID NO: 2060223 - DNA, 13 bp, Homo sapiens
taatggcactgat

SEQ ID NO: 2060224 - DNA, 21 bp, Homo sapiens
taatggctgataattttaaat

SEQ ID NO: 2060225 - DNA, 18 bp, Homo sapiens
taatgggccaattaaaat

SEQ ID NO: 2060226 - DNA, 20 bp, Homo sapiens
taatgggccaattaaaatat

SEQ ID NO: 2060227 - DNA, 23 bp, Homo sapiens
taatgggccaattaaaatatata

SEQ ID NO: 2060228 - DNA, 16 bp, Homo sapiens
taatgggcctgcccaa

SEQ ID NO: 2060229 - DNA, 16 bp, Homo sapiens
taatggtttactgctg

SEQ ID NO: 2060230 - DNA, 17 bp, Homo sapiens
taatggtttactgctgt

SEQ ID NO: 2060231 - DNA, 19 bp, Homo sapiens
taatggtttactgctgtca

SEQ ID NO: 2060232 - DNA, 15 bp, Homo sapiens
taatggtttgaatat

SEQ ID NO: 2060233 - DNA, 20 bp, Homo sapiens
taatgtaagaaaatttgaag

SEQ ID NO: 2060234 - DNA, 21 bp, Homo sapiens
taatgtacaagttttgtataa

SEQ ID NO: 2060235 - DNA, 19 bp, Homo sapiens
taatgtaggtttagatata

SEQ ID NO: 2060236 - DNA, 18 bp, Homo sapiens
taatgtagtatgatgtaa

SEQ ID NO: 2060237 - DNA, 20 bp, Homo sapiens
taatgtagtatgatgtaatg

SEQ ID NO: 2060238 - DNA, 16 bp, Homo sapiens
taatgtatcttattta

SEQ ID NO: 2060239 - DNA, 21 bp, Homo sapiens
taatgtatcttatttatatat

SEQ ID NO: 2060240 - DNA, 15 bp, Homo sapiens
taatgtcacaggcag

SEQ ID NO: 2060241 - DNA, 18 bp, Homo sapiens
taatgtcacaggcaggtc

SEQ ID NO: 2060242 - DNA, 21 bp, Homo sapiens
taatgtcaccaccttcccagc

SEQ ID NO: 2060243 - DNA, 22 bp, Homo sapiens
taatgtcaccaccttcccagct

SEQ ID NO: 2060244 - DNA, 16 bp, Homo sapiens
taatgtctcttcctct

SEQ ID NO: 2060245 - DNA, 16 bp, Homo sapiens
taatgtgcaaattttg

SEQ ID NO: 2060246 - DNA, 17 bp, Homo sapiens
taatgtgcaaattttgc

SEQ ID NO: 2060247 - DNA, 18 bp, Homo sapiens
taatgtgcaaattttgca

SEQ ID NO: 2060248 - DNA, 21 bp, Homo sapiens
taatgtgcaaattttgcattt

SEQ ID NO: 2060249 - DNA, 23 bp, Homo sapiens
taatgtggatttcctattttaaa

SEQ ID NO: 2060250 - DNA, 18 bp, Homo sapiens
atatatacacatacatac

SEQ ID NO: 2060251 - DNA, 14 bp, Homo sapiens
atatatacatatgt

SEQ ID NO: 2060252 - DNA, 13 bp, Homo sapiens
atatatacatgta

SEQ ID NO: 2060253 - DNA, 14 bp, Homo sapiens
atatatacatgtat

SEQ ID NO: 2060254 - DNA, 16 bp, Homo sapiens
atatatatatatatgt

SEQ ID NO: 2060255 - DNA, 15 bp, Homo sapiens
atatatatatatatt

SEQ ID NO: 2060256 - DNA, 14 bp, Homo sapiens
atatatatatatgt

SEQ ID NO: 2060257 - DNA, 13 bp, Homo sapiens
atatatatatgta

SEQ ID NO: 2060258 - DNA, 16 bp, Homo sapiens
atatatatatgtatat

SEQ ID NO: 2060259 - DNA, 12 bp, Homo sapiens
atatatatattt

SEQ ID NO: 2060260 - DNA, 13 bp, Homo sapiens
atatatatattta

SEQ ID NO: 2060261 - DNA, 14 bp, Homo sapiens
atatatatctgata

SEQ ID NO: 2060262 - DNA, 20 bp, Homo sapiens
atatatatgtacagttatct

SEQ ID NO: 2060263 - DNA, 23 bp, Homo sapiens
atatatatttgattgtaaaaaca

SEQ ID NO: 2060264 - DNA, 15 bp, Homo sapiens
atatatcataaagta

SEQ ID NO: 2060265 - DNA, 19 bp, Homo sapiens
atatatctatctatttgag

SEQ ID NO: 2060266 - DNA, 18 bp, Homo sapiens
atatatctgaaaactgga

SEQ ID NO: 2060267 - DNA, 20 bp, Homo sapiens
atatatctgataaaattgtg

SEQ ID NO: 2060268 - DNA, 22 bp, Homo sapiens
atatatctgataaaattgtgat

SEQ ID NO: 2060269 - DNA, 18 bp, Homo sapiens
atatatctgcttcagtgg

SEQ ID NO: 2060270 - DNA, 12 bp, Homo sapiens
atatatcttatg

SEQ ID NO: 2060271 - DNA, 17 bp, Homo sapiens
atatatgaagtaagttc

SEQ ID NO: 2060272 - DNA, 14 bp, Homo sapiens
atatatggcatatt

SEQ ID NO: 2060273 - DNA, 21 bp, Homo sapiens
atatatggtctgtgtgtctga

SEQ ID NO: 2060274 - DNA, 12 bp, Homo sapiens
atatatgtatat

SEQ ID NO: 2060275 - DNA, 14 bp, Homo sapiens
atatatgtatatgt

SEQ ID NO: 2060276 - DNA, 17 bp, Homo sapiens
atatatgtatatgtata

SEQ ID NO: 2060277 - DNA, 20 bp, Homo sapiens
atatatgtatatgtatatat

SEQ ID NO: 2060278 - DNA, 12 bp, Homo sapiens
atatatgtattt

SEQ ID NO: 2060279 - DNA, 20 bp, Homo sapiens
atatatgtatttattgtcat

SEQ ID NO: 2060280 - DNA, 12 bp, Homo sapiens
atatatgtgtgt

SEQ ID NO: 2060281 - DNA, 13 bp, Homo sapiens
atatatgtgtgtg

SEQ ID NO: 2060282 - DNA, 16 bp, Homo sapiens
atatatgtgtgtttaa

SEQ ID NO: 2060283 - DNA, 18 bp, Homo sapiens
atatatgtgtgtttaaat

SEQ ID NO: 2060284 - DNA, 21 bp, Homo sapiens
atatatgtgtgtttaaataaa

SEQ ID NO: 2060285 - DNA, 22 bp, Homo sapiens
atatattaaaatgtaggaagaa

SEQ ID NO: 2060286 - DNA, 23 bp, Homo sapiens
atatattctacacatatatgtat

SEQ ID NO: 2060287 - DNA, 17 bp, Homo sapiens
atatatttactaaaaga

SEQ ID NO: 2060288 - DNA, 12 bp, Homo sapiens
atatatttataa

SEQ ID NO: 2060289 - DNA, 15 bp, Homo sapiens
atatatttataactc

SEQ ID NO: 2060290 - DNA, 16 bp, Homo sapiens
atatatttataactca

SEQ ID NO: 2060291 - DNA, 22 bp, Homo sapiens
atatatttgattgtaaaaacaa

SEQ ID NO: 2060292 - DNA, 22 bp, Homo sapiens
atatatttggctgggtgttttc

SEQ ID NO: 2060293 - DNA, 21 bp, Homo sapiens
atatatttttatatttagtta

SEQ ID NO: 2060294 - DNA, 14 bp, Homo sapiens
atatatttttcaac

SEQ ID NO: 2060295 - DNA, 16 bp, Homo sapiens
atatatttttcaacca

SEQ ID NO: 2060296 - DNA, 21 bp, Homo sapiens
atatatttttcacagtttttc

SEQ ID NO: 2060297 - DNA, 16 bp, Homo sapiens
atatcaagatgattct

SEQ ID NO: 2060298 - DNA, 14 bp, Homo sapiens
atatcaaggatgtt

SEQ ID NO: 2060299 - DNA, 15 bp, Homo sapiens
atatcaaggatgttc

SEQ ID NO: 2060300 - DNA, 12 bp, Homo sapiens
atatcagaaaag

SEQ ID NO: 2060301 - DNA, 17 bp, Homo sapiens
atatcagaaaagtagaa

SEQ ID NO: 2060302 - DNA, 19 bp, Homo sapiens
atatcagaaaagtagaatt

SEQ ID NO: 2060303 - DNA, 20 bp, Homo sapiens
atatcagaaaagtagaatta

SEQ ID NO: 2060304 - DNA, 18 bp, Homo sapiens
atatcagaatcgctaata

SEQ ID NO: 2060305 - DNA, 16 bp, Homo sapiens
atatcagacctctgat

SEQ ID NO: 2060306 - DNA, 21 bp, Homo sapiens
atatcagagctcttaatgttg

SEQ ID NO: 2060307 - DNA, 15 bp, Homo sapiens
atatcagagctggga

SEQ ID NO: 2060308 - DNA, 17 bp, Homo sapiens
atatcagagctgggaaa

SEQ ID NO: 2060309 - DNA, 17 bp, Homo sapiens
atatcagttactcagcc

SEQ ID NO: 2060310 - DNA, 16 bp, Homo sapiens
atatcagttataatta

SEQ ID NO: 2060311 - DNA, 12 bp, Homo sapiens
atatcataaagt

SEQ ID NO: 2060312 - DNA, 21 bp, Homo sapiens
atatcatcagcatacctttat

SEQ ID NO: 2060313 - DNA, 20 bp, Homo sapiens
atatcatgctttaaagtgta

SEQ ID NO: 2060314 - DNA, 20 bp, Homo sapiens
atatcccaaacttcggaaac

SEQ ID NO: 2060315 - DNA, 20 bp, Homo sapiens
atatcggaggtggtggagga

SEQ ID NO: 2060316 - DNA, 23 bp, Homo sapiens
atatctaatttatacaaaataat

SEQ ID NO: 2060317 - DNA, 17 bp, Homo sapiens
atatctacctgccctct

SEQ ID NO: 2060318 - DNA, 18 bp, Homo sapiens
atatctatatctctaaac

SEQ ID NO: 2060319 - DNA, 13 bp, Homo sapiens
atatctatctatt

SEQ ID NO: 2060320 - DNA, 16 bp, Homo sapiens
atatctatctatttga

SEQ ID NO: 2060321 - DNA, 17 bp, Homo sapiens
atatctatctatttgag

SEQ ID NO: 2060322 - DNA, 13 bp, Homo sapiens
atatctatcttat

SEQ ID NO: 2060323 - DNA, 14 bp, Homo sapiens
atatctatcttata

SEQ ID NO: 2060324 - DNA, 21 bp, Homo sapiens
atatctattattataaaaata

SEQ ID NO: 2060325 - DNA, 11 bp, Homo sapiens
atatctgaaaa

SEQ ID NO: 2060326 - DNA, 17 bp, Homo sapiens
atatctgagaagtgtat

SEQ ID NO: 2060327 - DNA, 18 bp, Homo sapiens
atatctgagaagtgtata

SEQ ID NO: 2060328 - DNA, 14 bp, Homo sapiens
atatctgataaaat

SEQ ID NO: 2060329 - DNA, 18 bp, Homo sapiens
atatctgataaaattgtg

SEQ ID NO: 2060330 - DNA, 13 bp, Homo sapiens
atatctgcttcag

SEQ ID NO: 2060331 - DNA, 15 bp, Homo sapiens
atatcttatgttaaa

SEQ ID NO: 2060332 - DNA, 14 bp, Homo sapiens
atatcttgaagaat

SEQ ID NO: 2060333 - DNA, 16 bp, Homo sapiens
atatcttgaagaatat

SEQ ID NO: 2060334 - DNA, 18 bp, Homo sapiens
atatgaaatgataaagat

SEQ ID NO: 2060335 - DNA, 13 bp, Homo sapiens
atatgaaatgttt

SEQ ID NO: 2060336 - DNA, 17 bp, Homo sapiens
atatgaaatgtttcact

SEQ ID NO: 2060337 - DNA, 11 bp, Homo sapiens
atatgaacaaa

SEQ ID NO: 2060338 - DNA, 23 bp, Homo sapiens
atatgaaggactattaattccaa

SEQ ID NO: 2060339 - DNA, 22 bp, Homo sapiens
atatgaatacagggcatgcatt

SEQ ID NO: 2060340 - DNA, 14 bp, Homo sapiens
atatgaatgttctt

SEQ ID NO: 2060341 - DNA, 21 bp, Homo sapiens
atatgacagctgtccctgtca

SEQ ID NO: 2060342 - DNA, 18 bp, Homo sapiens
atatgactcctttctcta

SEQ ID NO: 2060343 - DNA, 21 bp, Homo sapiens
atatgactgtttttcggacag

SEQ ID NO: 2060344 - DNA, 16 bp, Homo sapiens
atatgagtatacaata

SEQ ID NO: 2060345 - DNA, 17 bp, Homo sapiens
atatgagtatacaatat

SEQ ID NO: 2060346 - DNA, 20 bp, Homo sapiens
atatgagtatacaatatata

SEQ ID NO: 2060347 - DNA, 21 bp, Homo sapiens
atatgagtatacaatatataa

SEQ ID NO: 2060348 - DNA, 14 bp, Homo sapiens
atatgatatgtaaa

SEQ ID NO: 2060349 - DNA, 16 bp, Homo sapiens
atatgatatgtaaaca

SEQ ID NO: 2060350 - DNA, 13 bp, Homo sapiens
atatgatttatag

SEQ ID NO: 2060351 - DNA, 22 bp, Homo sapiens
atatgattttatttgacaaaat

SEQ ID NO: 2060352 - DNA, 19 bp, Homo sapiens
atatgattttttaaaagaa

SEQ ID NO: 2060353 - DNA, 14 bp, Homo sapiens
atatgcaaagcact

SEQ ID NO: 2060354 - DNA, 14 bp, Homo sapiens
gaaaccagtatgga

SEQ ID NO: 2060355 - DNA, 21 bp, Homo sapiens
gaaacccaccagcctaagaag

SEQ ID NO: 2060356 - DNA, 16 bp, Homo sapiens
gaaaccccaagcagca

SEQ ID NO: 2060357 - DNA, 17 bp, Homo sapiens
gaaaccgtaattttatt

SEQ ID NO: 2060358 - DNA, 20 bp, Homo sapiens
gaaaccttattgtacctctc

SEQ ID NO: 2060359 - DNA, 11 bp, Homo sapiens
gaaaccttgca

SEQ ID NO: 2060360 - DNA, 14 bp, Homo sapiens
gaaaccttgcagca

SEQ ID NO: 2060361 - DNA, 18 bp, Homo sapiens
gaaaccttgcagcatttt

SEQ ID NO: 2060362 - DNA, 19 bp, Homo sapiens
gaaacgaatgtttcaaatc

SEQ ID NO: 2060363 - DNA, 18 bp, Homo sapiens
gaaactccttttgctgtc

SEQ ID NO: 2060364 - DNA, 18 bp, Homo sapiens
gaaactgaaaactgtaaa

SEQ ID NO: 2060365 - DNA, 22 bp, Homo sapiens
gaaactgaggaattttctttgt

SEQ ID NO: 2060366 - DNA, 13 bp, Homo sapiens
gaaactgccagca

SEQ ID NO: 2060367 - DNA, 11 bp, Homo sapiens
gaaactggctg

SEQ ID NO: 2060368 - DNA, 12 bp, Homo sapiens
gaaactggctga

SEQ ID NO: 2060369 - DNA, 20 bp, Homo sapiens
gaaactgtatgattaagcaa

SEQ ID NO: 2060370 - DNA, 18 bp, Homo sapiens
gaaactttgatctctgct

SEQ ID NO: 2060371 - DNA, 19 bp, Homo sapiens
gaaactttgatctctgctt

SEQ ID NO: 2060372 - DNA, 17 bp, Homo sapiens
gaaacttttttatttaa

SEQ ID NO: 2060373 - DNA, 18 bp, Homo sapiens
gaaacttttttatttaaa

SEQ ID NO: 2060374 - DNA, 19 bp, Homo sapiens
gaaagaaaagaccctgaga

SEQ ID NO: 2060375 - DNA, 20 bp, Homo sapiens
gaaagaaacgtacttaactg

SEQ ID NO: 2060376 - DNA, 15 bp, Homo sapiens
gaaagaaagaaggaa

SEQ ID NO: 2060377 - DNA, 16 bp, Homo sapiens
gaaagaaataattgtt

SEQ ID NO: 2060378 - DNA, 16 bp, Homo sapiens
gaaagaacggaagaag

SEQ ID NO: 2060379 - DNA, 15 bp, Homo sapiens
gaaagaagagacagg

SEQ ID NO: 2060380 - DNA, 21 bp, Homo sapiens
gaaagaattatttttgtgttt

SEQ ID NO: 2060381 - DNA, 16 bp, Homo sapiens
gaaagacagagctggg

SEQ ID NO: 2060382 - DNA, 20 bp, Homo sapiens
gaaagacgtttttgtgctgt

SEQ ID NO: 2060383 - DNA, 13 bp, Homo sapiens
gaaagagagtacc

SEQ ID NO: 2060384 - DNA, 20 bp, Homo sapiens
gaaagaggcagcttgaaact

SEQ ID NO: 2060385 - DNA, 14 bp, Homo sapiens
gaaagaggtgaccc

SEQ ID NO: 2060386 - DNA, 19 bp, Homo sapiens
gaaagaggtgaccccaggg

SEQ ID NO: 2060387 - DNA, 15 bp, Homo sapiens
gaaagatccaccctc

SEQ ID NO: 2060388 - DNA, 19 bp, Homo sapiens
gaaagcatcacctcaggcc

SEQ ID NO: 2060389 - DNA, 20 bp, Homo sapiens
gaaagccagggtcctgagtg

SEQ ID NO: 2060390 - DNA, 14 bp, Homo sapiens
gaaagccctccccc

SEQ ID NO: 2060391 - DNA, 15 bp, Homo sapiens
gaaagcctctgctgc

SEQ ID NO: 2060392 - DNA, 13 bp, Homo sapiens
gaaagctagagat

SEQ ID NO: 2060393 - DNA, 13 bp, Homo sapiens
gaaagctgagacc

SEQ ID NO: 2060394 - DNA, 22 bp, Homo sapiens
gaaagcttaggctgcttattgg

SEQ ID NO: 2060395 - DNA, 17 bp, Homo sapiens
gaaagcttcaaactgca

SEQ ID NO: 2060396 - DNA, 18 bp, Homo sapiens
gaaaggaaaaccagggat

SEQ ID NO: 2060397 - DNA, 22 bp, Homo sapiens
gaaaggagccggaccaagatgg

SEQ ID NO: 2060398 - DNA, 22 bp, Homo sapiens
gaaaggatgtaaacagtgcctg

SEQ ID NO: 2060399 - DNA, 18 bp, Homo sapiens
gaaaggctcagtctcagg

SEQ ID NO: 2060400 - DNA, 19 bp, Homo sapiens
gaaaggctcagtctcagga

SEQ ID NO: 2060401 - DNA, 22 bp, Homo sapiens
gaaaggctcagtctcaggagca

SEQ ID NO: 2060402 - DNA, 17 bp, Homo sapiens
gaaaggctctgaaagcc

SEQ ID NO: 2060403 - DNA, 19 bp, Homo sapiens
gaaagggacccgaagccca

SEQ ID NO: 2060404 - DNA, 19 bp, Homo sapiens
gaaagggacttggaagctc

SEQ ID NO: 2060405 - DNA, 22 bp, Homo sapiens
gaaagggacttggaagctccgc

SEQ ID NO: 2060406 - DNA, 15 bp, Homo sapiens
gaaagggcccagaga

SEQ ID NO: 2060407 - DNA, 16 bp, Homo sapiens
gaaagggcccagagag

SEQ ID NO: 2060408 - DNA, 13 bp, Homo sapiens
gaaaggtttcaag

SEQ ID NO: 2060409 - DNA, 14 bp, Homo sapiens
gaaaggtttcaaga

SEQ ID NO: 2060410 - DNA, 16 bp, Homo sapiens
gaaaggtttcaagact

SEQ ID NO: 2060411 - DNA, 21 bp, Homo sapiens
gaaaggtttcaagacttgata

SEQ ID NO: 2060412 - DNA, 15 bp, Homo sapiens
gaaagtgaataaact

SEQ ID NO: 2060413 - DNA, 17 bp, Homo sapiens
gaaagtgaataaacttc

SEQ ID NO: 2060414 - DNA, 21 bp, Homo sapiens
gaaagtgaataaacttcagca

SEQ ID NO: 2060415 - DNA, 22 bp, Homo sapiens
gaaagtgcagaatcaacttgaa

SEQ ID NO: 2060416 - DNA, 23 bp, Homo sapiens
gaaagtggctcttctaacctcag

SEQ ID NO: 2060417 - DNA, 22 bp, Homo sapiens
gaaagtgggttcactagagctg

SEQ ID NO: 2060418 - DNA, 17 bp, Homo sapiens
gaaagtgtaaaatagaa

SEQ ID NO: 2060419 - DNA, 14 bp, Homo sapiens
gaaagttattgtgt

SEQ ID NO: 2060420 - DNA, 11 bp, Homo sapiens
gaaagtttctt

SEQ ID NO: 2060421 - DNA, 22 bp, Homo sapiens
gaaagtttcttggtctcagctt

SEQ ID NO: 2060422 - DNA, 23 bp, Homo sapiens
gaaagtttcttggtctcagcttc

SEQ ID NO: 2060423 - DNA, 14 bp, Homo sapiens
gaaataaaaccttt

SEQ ID NO: 2060424 - DNA, 16 bp, Homo sapiens
gaaataaaacctttca

SEQ ID NO: 2060425 - DNA, 18 bp, Homo sapiens
gaaataaaacctttcaaa

SEQ ID NO: 2060426 - DNA, 17 bp, Homo sapiens
gaaataaaagcctctgg

SEQ ID NO: 2060427 - DNA, 12 bp, Homo sapiens
gaaataaaatcc

SEQ ID NO: 2060428 - DNA, 22 bp, Homo sapiens
gaaataaacctggagatgatga

SEQ ID NO: 2060429 - DNA, 20 bp, Homo sapiens
gaaataaacttattcctcct

SEQ ID NO: 2060430 - DNA, 18 bp, Homo sapiens
gaaataaattttgtttca

SEQ ID NO: 2060431 - DNA, 19 bp, Homo sapiens
gaaataattgttgattaat

SEQ ID NO: 2060432 - DNA, 19 bp, Homo sapiens
gaaatagacagtatattta

SEQ ID NO: 2060433 - DNA, 20 bp, Homo sapiens
gaaatagctccgtggagcag

SEQ ID NO: 2060434 - DNA, 21 bp, Homo sapiens
gaaatagtgttctttttaaaa

SEQ ID NO: 2060435 - DNA, 16 bp, Homo sapiens
gaaatatagttctgat

SEQ ID NO: 2060436 - DNA, 18 bp, Homo sapiens
gaaatatatatacatatg

SEQ ID NO: 2060437 - DNA, 21 bp, Homo sapiens
gaaatatatatacatatgtag

SEQ ID NO: 2060438 - DNA, 20 bp, Homo sapiens
gaaatatcagttactcagcc

SEQ ID NO: 2060439 - DNA, 15 bp, Homo sapiens
gaaatatgattttat

SEQ ID NO: 2060440 - DNA, 18 bp, Homo sapiens
gaaatatgcacaatagca

SEQ ID NO: 2060441 - DNA, 23 bp, Homo sapiens
gaaatattataaatccaaagtaa

SEQ ID NO: 2060442 - DNA, 16 bp, Homo sapiens
gaaatcaaatatgcaa

SEQ ID NO: 2060443 - DNA, 19 bp, Homo sapiens
gaaatcaaatatgcaaagc

SEQ ID NO: 2060444 - DNA, 23 bp, Homo sapiens
gaaatcaaatatgcaaagcactg

SEQ ID NO: 2060445 - DNA, 16 bp, Homo sapiens
gaaatcattgtagaaa

SEQ ID NO: 2060446 - DNA, 23 bp, Homo sapiens
gaaatccctgtttaatatttaaa

SEQ ID NO: 2060447 - DNA, 14 bp, Homo sapiens
gaaatcctgttact

SEQ ID NO: 2060448 - DNA, 20 bp, Homo sapiens
gaaatctgtaattctattgt

SEQ ID NO: 2060449 - DNA, 21 bp, Homo sapiens
gaaatgaatttatctgaatat

SEQ ID NO: 2060450 - DNA, 17 bp, Homo sapiens
gaaatgcaaaaatctct

SEQ ID NO: 2060451 - DNA, 18 bp, Homo sapiens
gaaatgctgatggataac

SEQ ID NO: 2060452 - DNA, 18 bp, Homo sapiens
gaaatggagaagctctgt

SEQ ID NO: 2060453 - DNA, 17 bp, Homo sapiens
gaaatggagggtggggc

SEQ ID NO: 2060454 - DNA, 21 bp, Homo sapiens
gaaatggcaacacgtggaggt

SEQ ID NO: 2060455 - DNA, 15 bp, Homo sapiens
gaaatgggagatggt

SEQ ID NO: 2060456 - DNA, 21 bp, Homo sapiens
gaaatggtatgagctgagggg

SEQ ID NO: 2060457 - DNA, 16 bp, Homo sapiens
gaaatgtatcctgata

SEQ ID NO: 2060458 - DNA, 14 bp, Homo sapiens
gaaatgtctttcta

SEQ ID NO: 2060459 - DNA, 17 bp, Homo sapiens
gaaatgtctttctattc

SEQ ID NO: 2060460 - DNA, 23 bp, Homo sapiens
gaaatgtggtagcctcactttta

SEQ ID NO: 2060461 - DNA, 22 bp, Homo sapiens
gaaatgttaaactgagacaata

SEQ ID NO: 2060462 - DNA, 13 bp, Homo sapiens
gaaattatatctg

SEQ ID NO: 2060463 - DNA, 15 bp, Homo sapiens
gaaattatatctgtg

SEQ ID NO: 2060464 - DNA, 18 bp, Homo sapiens
gaaattatgtatgtttac

SEQ ID NO: 2060465 - DNA, 21 bp, Homo sapiens
gaaattatgtatgtttacata

SEQ ID NO: 2060466 - DNA, 15 bp, Homo sapiens
gaaattatttaataa

SEQ ID NO: 2060467 - DNA, 17 bp, Homo sapiens
gaaattatttaataaaa

SEQ ID NO: 2060468 - DNA, 15 bp, Homo sapiens
gaagctttgaaggcc

SEQ ID NO: 2060469 - DNA, 18 bp, Homo sapiens
gaaggaaggaggcagact

SEQ ID NO: 2060470 - DNA, 18 bp, Homo sapiens
gaaggaaggcagggagga

SEQ ID NO: 2060471 - DNA, 19 bp, Homo sapiens
gaaggaaggcagggaggag

SEQ ID NO: 2060472 - DNA, 22 bp, Homo sapiens
gaaggaaggctccatctccagt

SEQ ID NO: 2060473 - DNA, 15 bp, Homo sapiens
gaaggaatagccaga

SEQ ID NO: 2060474 - DNA, 19 bp, Homo sapiens
gaaggaatagccagagagg

SEQ ID NO: 2060475 - DNA, 23 bp, Homo sapiens
gaaggaatagccagagaggagca

SEQ ID NO: 2060476 - DNA, 16 bp, Homo sapiens
gaaggaatctgtgcag

SEQ ID NO: 2060477 - DNA, 19 bp, Homo sapiens
gaaggacattgcggacagc

SEQ ID NO: 2060478 - DNA, 21 bp, Homo sapiens
gaaggacattgcggacagcca

SEQ ID NO: 2060479 - DNA, 21 bp, Homo sapiens
gaaggacattttctctttaaa

SEQ ID NO: 2060480 - DNA, 23 bp, Homo sapiens
gaaggacccggaggggcctggca

SEQ ID NO: 2060481 - DNA, 21 bp, Homo sapiens
gaaggactatgaaaagctaga

SEQ ID NO: 2060482 - DNA, 16 bp, Homo sapiens
gaaggactattaattc

SEQ ID NO: 2060483 - DNA, 18 bp, Homo sapiens
gaaggagaaaggagccgg

SEQ ID NO: 2060484 - DNA, 16 bp, Homo sapiens
gaaggagaaggaagga

SEQ ID NO: 2060485 - DNA, 13 bp, Homo sapiens
gaaggaggcagac

SEQ ID NO: 2060486 - DNA, 21 bp, Homo sapiens
gaaggagggcagagccatggg

SEQ ID NO: 2060487 - DNA, 22 bp, Homo sapiens
gaaggatctgtttttaaaaatc

SEQ ID NO: 2060488 - DNA, 21 bp, Homo sapiens
gaaggatgtccgttccaggag

SEQ ID NO: 2060489 - DNA, 23 bp, Homo sapiens
gaaggatgtccgttccaggagca

SEQ ID NO: 2060490 - DNA, 19 bp, Homo sapiens
gaaggcaaagcccctggaa

SEQ ID NO: 2060491 - DNA, 12 bp, Homo sapiens
gaaggcagaata

SEQ ID NO: 2060492 - DNA, 23 bp, Homo sapiens
gaaggcaggcagggctctcctgg

SEQ ID NO: 2060493 - DNA, 14 bp, Homo sapiens
gaaggcagggagga

SEQ ID NO: 2060494 - DNA, 18 bp, Homo sapiens
gaaggcagggaggaggca

SEQ ID NO: 2060495 - DNA, 20 bp, Homo sapiens
gaaggcagggaggaggcaga

SEQ ID NO: 2060496 - DNA, 20 bp, Homo sapiens
gaaggccgctgccccagccc

SEQ ID NO: 2060497 - DNA, 19 bp, Homo sapiens
gaaggcctcttgtgctcac

SEQ ID NO: 2060498 - DNA, 12 bp, Homo sapiens
gaaggcgaggag

SEQ ID NO: 2060499 - DNA, 20 bp, Homo sapiens
gaaggcgtgcaaggggctca

SEQ ID NO: 2060500 - DNA, 21 bp, Homo sapiens
gaaggcgtgcaaggggctcag

SEQ ID NO: 2060501 - DNA, 19 bp, Homo sapiens
gaaggctacttcggggctg

SEQ ID NO: 2060502 - DNA, 21 bp, Homo sapiens
gaaggctacttcggggctggg

SEQ ID NO: 2060503 - DNA, 13 bp, Homo sapiens
gaaggctggctgg

SEQ ID NO: 2060504 - DNA, 11 bp, Homo sapiens
gaagggaaatt

SEQ ID NO: 2060505 - DNA, 12 bp, Homo sapiens
gaagggaagcct

SEQ ID NO: 2060506 - DNA, 15 bp, Homo sapiens
gaagggacacacaca

SEQ ID NO: 2060507 - DNA, 18 bp, Homo sapiens
gaagggaccttgaagggt

SEQ ID NO: 2060508 - DNA, 15 bp, Homo sapiens
gaagggcaccgagaa

SEQ ID NO: 2060509 - DNA, 10 bp, Homo sapiens
gaagggccag

SEQ ID NO: 2060510 - DNA, 17 bp, Homo sapiens
gaagggccagccctaca

SEQ ID NO: 2060511 - DNA, 15 bp, Homo sapiens
gaagggccaggagag

SEQ ID NO: 2060512 - DNA, 17 bp, Homo sapiens
gaagggccaggagagag

SEQ ID NO: 2060513 - DNA, 19 bp, Homo sapiens
gaagggccagtctgggctg

SEQ ID NO: 2060514 - DNA, 20 bp, Homo sapiens
gaagggctagaacctggaga

SEQ ID NO: 2060515 - DNA, 23 bp, Homo sapiens
gaaggggcacaccactgccctgc

SEQ ID NO: 2060516 - DNA, 19 bp, Homo sapiens
gaaggggcacgcctgccca

SEQ ID NO: 2060517 - DNA, 20 bp, Homo sapiens
gaaggggccccggggctggc

SEQ ID NO: 2060518 - DNA, 23 bp, Homo sapiens
gaaggggccccggggctggcaag

SEQ ID NO: 2060519 - DNA, 15 bp, Homo sapiens
gaaggggtgccctct

SEQ ID NO: 2060520 - DNA, 15 bp, Homo sapiens
gaagggtgacatccc

SEQ ID NO: 2060521 - DNA, 17 bp, Homo sapiens
gaagggtgacatcccag

SEQ ID NO: 2060522 - DNA, 22 bp, Homo sapiens
gaagggtgggaagcttgctggc

SEQ ID NO: 2060523 - DNA, 22 bp, Homo sapiens
gaagggtggtctgagcaccccc

SEQ ID NO: 2060524 - DNA, 20 bp, Homo sapiens
gaagggttttccaccctgga

SEQ ID NO: 2060525 - DNA, 21 bp, Homo sapiens
gaaggtagcccagcactgtga

SEQ ID NO: 2060526 - DNA, 22 bp, Homo sapiens
gaaggtagcccagcactgtgaa

SEQ ID NO: 2060527 - DNA, 21 bp, Homo sapiens
gaaggtcactcttcctgcaag

SEQ ID NO: 2060528 - DNA, 22 bp, Homo sapiens
gaaggtgccccaaaatgcaaga

SEQ ID NO: 2060529 - DNA, 14 bp, Homo sapiens
gaaggtgctgagct

SEQ ID NO: 2060530 - DNA, 15 bp, Homo sapiens
gaaggtgctgagctt

SEQ ID NO: 2060531 - DNA, 22 bp, Homo sapiens
gaaggtgctgagcttagccttg

SEQ ID NO: 2060532 - DNA, 20 bp, Homo sapiens
gaaggtttggtgtgtggaga

SEQ ID NO: 2060533 - DNA, 15 bp, Homo sapiens
gaagtaaatttgtcc

SEQ ID NO: 2060534 - DNA, 18 bp, Homo sapiens
gaagtaacttttacaaaa

SEQ ID NO: 2060535 - DNA, 21 bp, Homo sapiens
gaagtaagagctaagttctaa

SEQ ID NO: 2060536 - DNA, 22 bp, Homo sapiens
gaagtaagttctgaaaactgtt

SEQ ID NO: 2060537 - DNA, 22 bp, Homo sapiens
gaagtacgtttttgcattattc

SEQ ID NO: 2060538 - DNA, 21 bp, Homo sapiens
gaagtatccaattatgtgaca

SEQ ID NO: 2060539 - DNA, 20 bp, Homo sapiens
gaagtcagcccgaatgcctg

SEQ ID NO: 2060540 - DNA, 18 bp, Homo sapiens
gaagtcagttggagaaaa

SEQ ID NO: 2060541 - DNA, 19 bp, Homo sapiens
gaagtcataaacagcattt

SEQ ID NO: 2060542 - DNA, 15 bp, Homo sapiens
gaagtccaggcagag

SEQ ID NO: 2060543 - DNA, 17 bp, Homo sapiens
gaagtccccaggtcatg

SEQ ID NO: 2060544 - DNA, 19 bp, Homo sapiens
gaagtccctgttctcagct

SEQ ID NO: 2060545 - DNA, 21 bp, Homo sapiens
gaagtccctgttctcagctcc

SEQ ID NO: 2060546 - DNA, 24 bp, Homo sapiens
gaagtcgtccttactcctgtggga

SEQ ID NO: 2060547 - DNA, 12 bp, Homo sapiens
gaagtgaagccc

SEQ ID NO: 2060548 - DNA, 13 bp, Homo sapiens
gaagtgaaggaga

SEQ ID NO: 2060549 - DNA, 22 bp, Homo sapiens
gaagtggaccaggacaggacca

SEQ ID NO: 2060550 - DNA, 23 bp, Homo sapiens
gaagtgggggccgctggcccagg

SEQ ID NO: 2060551 - DNA, 13 bp, Homo sapiens
gaagtgtatatag

SEQ ID NO: 2060552 - DNA, 17 bp, Homo sapiens
gaagtgttcaagaaata

SEQ ID NO: 2060553 - DNA, 17 bp, Homo sapiens
gaagttagctttaactt

SEQ ID NO: 2060554 - DNA, 13 bp, Homo sapiens
gaagttttcagga

SEQ ID NO: 2060555 - DNA, 23 bp, Homo sapiens
gaagttttcaggacttggtctga

SEQ ID NO: 2060556 - DNA, 18 bp, Homo sapiens
gaataaaaaacatttgta

SEQ ID NO: 2060557 - DNA, 20 bp, Homo sapiens
gaataaaaaacatttgtaca

SEQ ID NO: 2060558 - DNA, 14 bp, Homo sapiens
gaataaaaattgac

SEQ ID NO: 2060559 - DNA, 18 bp, Homo sapiens
gaataaaaattgatgaga

SEQ ID NO: 2060560 - DNA, 12 bp, Homo sapiens
gaataaacttca

SEQ ID NO: 2060561 - DNA, 19 bp, Homo sapiens
gaataaagacttcatgttc

SEQ ID NO: 2060562 - DNA, 18 bp, Homo sapiens
gaataaagtctgagtggg

SEQ ID NO: 2060563 - DNA, 14 bp, Homo sapiens
gaataaagttctga

SEQ ID NO: 2060564 - DNA, 12 bp, Homo sapiens
gaataaatgttc

SEQ ID NO: 2060565 - DNA, 14 bp, Homo sapiens
gaataaatgttcaa

SEQ ID NO: 2060566 - DNA, 15 bp, Homo sapiens
gaataaatgttcaaa

SEQ ID NO: 2060567 - DNA, 18 bp, Homo sapiens
gaataaatgttcaaactg

SEQ ID NO: 2060568 - DNA, 15 bp, Homo sapiens
gaataaattgctcct

SEQ ID NO: 2060569 - DNA, 13 bp, Homo sapiens
gaataagccatga

SEQ ID NO: 2060570 - DNA, 13 bp, Homo sapiens
gaataagtattct

SEQ ID NO: 2060571 - DNA, 17 bp, Homo sapiens
gaataagtattcttcat

SEQ ID NO: 2060572 - DNA, 19 bp, Homo sapiens
gaataagtgctgtttgaga

SEQ ID NO: 2060573 - DNA, 22 bp, Homo sapiens
gaataataattaggttaacatt

SEQ ID NO: 2060574 - DNA, 14 bp, Homo sapiens
gaataatttcttac

SEQ ID NO: 2060575 - DNA, 15 bp, Homo sapiens
gaatagatgtgatca

SEQ ID NO: 2060576 - DNA, 22 bp, Homo sapiens
gaatagctgggactacaggtgt

SEQ ID NO: 2060577 - DNA, 18 bp, Homo sapiens
gaatataaagttaaaaaa

SEQ ID NO: 2060578 - DNA, 12 bp, Homo sapiens
gaatatattata

SEQ ID NO: 2060579 - DNA, 15 bp, Homo sapiens
gaatatgactgtttt

SEQ ID NO: 2060580 - DNA, 15 bp, Homo sapiens
gaatattcaggactt

SEQ ID NO: 2060581 - DNA, 15 bp, Homo sapiens
gaatatttattacct

SEQ ID NO: 2060582 - DNA, 23 bp, Homo sapiens
ttttcacctgtttttaagctgtt

SEQ ID NO: 2060583 - DNA, 19 bp, Homo sapiens
ttttcactgctggctgcct

SEQ ID NO: 2060584 - DNA, 20 bp, Homo sapiens
ttttcactgctggctgcctt

SEQ ID NO: 2060585 - DNA, 15 bp, Homo sapiens
ttttcagaaatatgt

SEQ ID NO: 2060586 - DNA, 16 bp, Homo sapiens
ttttcagaatgctctt

SEQ ID NO: 2060587 - DNA, 11 bp, Homo sapiens
ttttcagaccc

SEQ ID NO: 2060588 - DNA, 23 bp, Homo sapiens
ttttcagattccacacaaaatgt

SEQ ID NO: 2060589 - DNA, 16 bp, Homo sapiens
ttttcaggtttcttaa

SEQ ID NO: 2060590 - DNA, 15 bp, Homo sapiens
ttttcataaactgag

SEQ ID NO: 2060591 - DNA, 17 bp, Homo sapiens
ttttcataacttgctga

SEQ ID NO: 2060592 - DNA, 13 bp, Homo sapiens
ttttcatattgtg

SEQ ID NO: 2060593 - DNA, 15 bp, Homo sapiens
ttttcatctgttgtt

SEQ ID NO: 2060594 - DNA, 19 bp, Homo sapiens
ttttcattacaatggaaac

SEQ ID NO: 2060595 - DNA, 13 bp, Homo sapiens
ttttcatttaact

SEQ ID NO: 2060596 - DNA, 12 bp, Homo sapiens
ttttccaataaa

SEQ ID NO: 2060597 - DNA, 17 bp, Homo sapiens
ttttccaataaaatttt

SEQ ID NO: 2060598 - DNA, 22 bp, Homo sapiens
ttttccacaagattcccagaga

SEQ ID NO: 2060599 - DNA, 15 bp, Homo sapiens
ttttccaccctggaa

SEQ ID NO: 2060600 - DNA, 19 bp, Homo sapiens
ttttccatgaaaatgcaac

SEQ ID NO: 2060601 - DNA, 20 bp, Homo sapiens
ttttcccagatacttcccat

SEQ ID NO: 2060602 - DNA, 23 bp, Homo sapiens
ttttcccgagcaaagtctaaagt

SEQ ID NO: 2060603 - DNA, 19 bp, Homo sapiens
ttttccctctcttgccttt

SEQ ID NO: 2060604 - DNA, 17 bp, Homo sapiens
ttttcctttgaatcctc

SEQ ID NO: 2060605 - DNA, 21 bp, Homo sapiens
ttttcgcttgcttctgcagca

SEQ ID NO: 2060606 - DNA, 16 bp, Homo sapiens
ttttctaactgtaaat

SEQ ID NO: 2060607 - DNA, 18 bp, Homo sapiens
ttttctaactgtaaatca

SEQ ID NO: 2060608 - DNA, 20 bp, Homo sapiens
ttttctaactgtaaatcact

SEQ ID NO: 2060609 - DNA, 20 bp, Homo sapiens
ttttctacacagtaaaaact

SEQ ID NO: 2060610 - DNA, 17 bp, Homo sapiens
ttttctactttttttaa

SEQ ID NO: 2060611 - DNA, 14 bp, Homo sapiens
ttttctagactttc

SEQ ID NO: 2060612 - DNA, 24 bp, Homo sapiens
ttttctagcaactgttggataata

SEQ ID NO: 2060613 - DNA, 20 bp, Homo sapiens
ttttctagtttcagtaaata

SEQ ID NO: 2060614 - DNA, 20 bp, Homo sapiens
ttttctatttttcttctaaa

SEQ ID NO: 2060615 - DNA, 15 bp, Homo sapiens
ttttctccaccaact

SEQ ID NO: 2060616 - DNA, 14 bp, Homo sapiens
ttttctcctaggag

SEQ ID NO: 2060617 - DNA, 19 bp, Homo sapiens
ttttctcctcccaggaact

SEQ ID NO: 2060618 - DNA, 17 bp, Homo sapiens
ttttctctttaaaagaa

SEQ ID NO: 2060619 - DNA, 17 bp, Homo sapiens
ttttctgaataacattt

SEQ ID NO: 2060620 - DNA, 20 bp, Homo sapiens
ttttctgatgacataataaa

SEQ ID NO: 2060621 - DNA, 21 bp, Homo sapiens
ttttctgatgacataataaag

SEQ ID NO: 2060622 - DNA, 14 bp, Homo sapiens
ttttctggaagaca

SEQ ID NO: 2060623 - DNA, 12 bp, Homo sapiens
ttttctgtctct

SEQ ID NO: 2060624 - DNA, 15 bp, Homo sapiens
ttttctgtctctctt

SEQ ID NO: 2060625 - DNA, 23 bp, Homo sapiens
ttttctgttactttgttttttaa

SEQ ID NO: 2060626 - DNA, 13 bp, Homo sapiens
ttttcttaaagca

SEQ ID NO: 2060627 - DNA, 13 bp, Homo sapiens
ttttcttacataa

SEQ ID NO: 2060628 - DNA, 16 bp, Homo sapiens
ttttcttatataagac

SEQ ID NO: 2060629 - DNA, 20 bp, Homo sapiens
ttttcttcccatttgtaatg

SEQ ID NO: 2060630 - DNA, 21 bp, Homo sapiens
ttgaagaatgttaagacttga

SEQ ID NO: 2060631 - DNA, 20 bp, Homo sapiens
ttgaagagatttcaacatat

SEQ ID NO: 2060632 - DNA, 20 bp, Homo sapiens
ttgaagcaaatcgaatgaaa

SEQ ID NO: 2060633 - DNA, 13 bp, Homo sapiens
ttgaagccttttt

SEQ ID NO: 2060634 - DNA, 14 bp, Homo sapiens
ttgaagctaagatt

SEQ ID NO: 2060635 - DNA, 16 bp, Homo sapiens
ttgaaggcagtctgaa

SEQ ID NO: 2060636 - DNA, 19 bp, Homo sapiens
ttgaagttagctttaactt

SEQ ID NO: 2060637 - DNA, 18 bp, Homo sapiens
ttgaataaaaaacatttg

SEQ ID NO: 2060638 - DNA, 16 bp, Homo sapiens
ttgaataaagtctgag

SEQ ID NO: 2060639 - DNA, 17 bp, Homo sapiens
ttgaataaagtctgagt

SEQ ID NO: 2060640 - DNA, 14 bp, Homo sapiens
ttgaataagtattc

SEQ ID NO: 2060641 - DNA, 16 bp, Homo sapiens
ttgaataagtattctt

SEQ ID NO: 2060642 - DNA, 18 bp, Homo sapiens
ttgaatacccccagagac

SEQ ID NO: 2060643 - DNA, 16 bp, Homo sapiens
ttgaatataaacacta

SEQ ID NO: 2060644 - DNA, 20 bp, Homo sapiens
ttgaatatatcagaatctgt

SEQ ID NO: 2060645 - DNA, 15 bp, Homo sapiens
ttgaatatttgctta

SEQ ID NO: 2060646 - DNA, 19 bp, Homo sapiens
ttgaatctgttactgaaat

SEQ ID NO: 2060647 - DNA, 16 bp, Homo sapiens
ttgaatggaagcaaaa

SEQ ID NO: 2060648 - DNA, 16 bp, Homo sapiens
ttgaatggctatgttt

SEQ ID NO: 2060649 - DNA, 15 bp, Homo sapiens
ttgaatggtgcagaa

SEQ ID NO: 2060650 - DNA, 16 bp, Homo sapiens
ttgaatggtgcagaaa

SEQ ID NO: 2060651 - DNA, 12 bp, Homo sapiens
ttgaattctgga

SEQ ID NO: 2060652 - DNA, 23 bp, Homo sapiens
ttgaattggatacaaggatcaga

SEQ ID NO: 2060653 - DNA, 22 bp, Homo sapiens
ttgaatttcctatctgtatgtc

SEQ ID NO: 2060654 - DNA, 15 bp, Homo sapiens
ttgacaaaataacat

SEQ ID NO: 2060655 - DNA, 19 bp, Homo sapiens
ttgacaaaataacatttga

SEQ ID NO: 2060656 - DNA, 18 bp, Homo sapiens
ttgacaataaatgtgctt

SEQ ID NO: 2060657 - DNA, 18 bp, Homo sapiens
ttgacaataatttcaggt

SEQ ID NO: 2060658 - DNA, 13 bp, Homo sapiens
ttgacacacagca

SEQ ID NO: 2060659 - DNA, 10 bp, Homo sapiens
ttgacagggc

SEQ ID NO: 2060660 - DNA, 19 bp, Homo sapiens
ttgacagtgttgaaaatgt

SEQ ID NO: 2060661 - DNA, 20 bp, Homo sapiens
ttgacataacactataaagg

SEQ ID NO: 2060662 - DNA, 21 bp, Homo sapiens
ttgacattgtatgtatctatt

SEQ ID NO: 2060663 - DNA, 22 bp, Homo sapiens
ttgaccaagatgatcacatgga

SEQ ID NO: 2060664 - DNA, 22 bp, Homo sapiens
ttgaccagacctagacctgggc

SEQ ID NO: 2060665 - DNA, 12 bp, Homo sapiens
ttgacccactca

SEQ ID NO: 2060666 - DNA, 15 bp, Homo sapiens
ttgacccctttcccc

SEQ ID NO: 2060667 - DNA, 17 bp, Homo sapiens
ttgacccctttccccca

SEQ ID NO: 2060668 - DNA, 21 bp, Homo sapiens
ttgaccgttttcatcctggcc

SEQ ID NO: 2060669 - DNA, 16 bp, Homo sapiens
ttgacctcagctgcac

SEQ ID NO: 2060670 - DNA, 21 bp, Homo sapiens
ttgacctcaggtgatccaccc

SEQ ID NO: 2060671 - DNA, 23 bp, Homo sapiens
ttgaccttctccctcactcctgc

SEQ ID NO: 2060672 - DNA, 17 bp, Homo sapiens
ttgacgggaggcctcag

SEQ ID NO: 2060673 - DNA, 17 bp, Homo sapiens
ttgactatcaaactgaa

SEQ ID NO: 2060674 - DNA, 13 bp, Homo sapiens
ttgactcaagttt

SEQ ID NO: 2060675 - DNA, 20 bp, Homo sapiens
ttgactcaagtttttacaaa

SEQ ID NO: 2060676 - DNA, 14 bp, Homo sapiens
ttgactcacctgtt

SEQ ID NO: 2060677 - DNA, 19 bp, Homo sapiens
ttgactcttttatctgagt

SEQ ID NO: 2060678 - DNA, 19 bp, Homo sapiens
ttgacttgacagaacactg

SEQ ID NO: 2060679 - DNA, 21 bp, Homo sapiens
ttgacttgacagaacactgtc

SEQ ID NO: 2060680 - DNA, 15 bp, Homo sapiens
ttgactttcaggtac

SEQ ID NO: 2060681 - DNA, 21 bp, Homo sapiens
ttgactttcaggtactaaata

SEQ ID NO: 2060682 - DNA, 20 bp, Homo sapiens
ttgagaaggaaaattttagc

SEQ ID NO: 2060683 - DNA, 16 bp, Homo sapiens
ttgagaagttttgtac

SEQ ID NO: 2060684 - DNA, 15 bp, Homo sapiens
ttgagaatgtgattc

SEQ ID NO: 2060685 - DNA, 18 bp, Homo sapiens
ttgagacaagccctggca

SEQ ID NO: 2060686 - DNA, 13 bp, Homo sapiens
ttgagagaagcca

SEQ ID NO: 2060687 - DNA, 18 bp, Homo sapiens
ttgagagaagccacgctg

SEQ ID NO: 2060688 - DNA, 23 bp, Homo sapiens
ttgagagaagccacgctgtcctc

SEQ ID NO: 2060689 - DNA, 13 bp, Homo sapiens
ttgagcaattcat

SEQ ID NO: 2060690 - DNA, 18 bp, Homo sapiens
ttgagcaattcatttcac

SEQ ID NO: 2060691 - DNA, 19 bp, Homo sapiens
ttgagcaattcatttcact

SEQ ID NO: 2060692 - DNA, 20 bp, Homo sapiens
ttgagcatgcacagctgctt

SEQ ID NO: 2060693 - DNA, 13 bp, Homo sapiens
ttgagcccaggag

SEQ ID NO: 2060694 - DNA, 22 bp, Homo sapiens
ttgagctgagttccttataaga

SEQ ID NO: 2060695 - DNA, 14 bp, Homo sapiens
ttgagctgtatata

SEQ ID NO: 2060696 - DNA, 15 bp, Homo sapiens
ttgaggacaaagaga

SEQ ID NO: 2060697 - DNA, 16 bp, Homo sapiens
ttgaggacacatgtcc

SEQ ID NO: 2060698 - DNA, 19 bp, Homo sapiens
ttgaggagcagcttcagtt

SEQ ID NO: 2060699 - DNA, 20 bp, Homo sapiens
ttgaggaggggcacctgcca

SEQ ID NO: 2060700 - DNA, 21 bp, Homo sapiens
ttgaggaggggcacctgccac

SEQ ID NO: 2060701 - DNA, 16 bp, Homo sapiens
ttgaggattttgagta

SEQ ID NO: 2060702 - DNA, 20 bp, Homo sapiens
ttgagggacgatctttgaat

SEQ ID NO: 2060703 - DNA, 18 bp, Homo sapiens
ttgagggtaataaactta

SEQ ID NO: 2060704 - DNA, 18 bp, Homo sapiens
ttgaggttaaaatataaa

SEQ ID NO: 2060705 - DNA, 19 bp, Homo sapiens
ttgagtacagtgaggaggg

SEQ ID NO: 2060706 - DNA, 18 bp, Homo sapiens
ttgagtagatctgcttct

SEQ ID NO: 2060707 - DNA, 18 bp, Homo sapiens
ttgagtctcctctctgag

SEQ ID NO: 2060708 - DNA, 14 bp, Homo sapiens
ttgagtgactcgag

SEQ ID NO: 2060709 - DNA, 20 bp, Homo sapiens
ttgagtgactcgagggttgg

SEQ ID NO: 2060710 - DNA, 22 bp, Homo sapiens
ttgagtggatggaggagaaata

SEQ ID NO: 2060711 - DNA, 16 bp, Homo sapiens
ttgagttcaaattttg

SEQ ID NO: 2060712 - DNA, 14 bp, Homo sapiens
ttgagttggacaca

SEQ ID NO: 2060713 - DNA, 18 bp, Homo sapiens
ttgagtttaagtctctga

SEQ ID NO: 2060714 - DNA, 23 bp, Homo sapiens
ttgataaagagagccctggtcct

SEQ ID NO: 2060715 - DNA, 14 bp, Homo sapiens
ttgataaagatttt

SEQ ID NO: 2060716 - DNA, 19 bp, Homo sapiens
ttgataaattccactggac

SEQ ID NO: 2060717 - DNA, 20 bp, Homo sapiens
ttgatacttcaggtgctttt

SEQ ID NO: 2060718 - DNA, 22 bp, Homo sapiens
ttgatattttcaacgcagccct

SEQ ID NO: 2060719 - DNA, 13 bp, Homo sapiens
ttgatcacagtgg

SEQ ID NO: 2060720 - DNA, 18 bp, Homo sapiens
ttgatcccacttcactgt

SEQ ID NO: 2060721 - DNA, 20 bp, Homo sapiens
ttgatcccacttcactgtga

SEQ ID NO: 2060722 - DNA, 21 bp, Homo sapiens
ttgatccctgttacccagaga

SEQ ID NO: 2060723 - DNA, 13 bp, Homo sapiens
ttgatctctgctt

SEQ ID NO: 2060724 - DNA, 19 bp, Homo sapiens
ttgatgaagcctgtgccac

SEQ ID NO: 2060725 - DNA, 19 bp, Homo sapiens
ttgatgaccaatctctgtg

SEQ ID NO: 2060726 - DNA, 12 bp, Homo sapiens
ttgatggggaga

SEQ ID NO: 2060727 - DNA, 16 bp, Homo sapiens
ttgatggggagaaagg

SEQ ID NO: 2060728 - DNA, 15 bp, Homo sapiens
ttgatgtacatgtgt

SEQ ID NO: 2060729 - DNA, 11 bp, Homo sapiens
ttgggcctctt

SEQ ID NO: 2060730 - DNA, 15 bp, Homo sapiens
ttgggctactggcag

SEQ ID NO: 2060731 - DNA, 16 bp, Homo sapiens
ttgggctcctggctgc

SEQ ID NO: 2060732 - DNA, 17 bp, Homo sapiens
ttgggctcctggctgcc

SEQ ID NO: 2060733 - DNA, 20 bp, Homo sapiens
ttgggctcctggctgccagg

SEQ ID NO: 2060734 - DNA, 21 bp, Homo sapiens
ttgggctcctggctgccaggc

SEQ ID NO: 2060735 - DNA, 19 bp, Homo sapiens
ttgggctttgcaggctctg

SEQ ID NO: 2060736 - DNA, 20 bp, Homo sapiens
ttgggctttgcaggctctgg

SEQ ID NO: 2060737 - DNA, 18 bp, Homo sapiens
ttggggacagttggcaga

SEQ ID NO: 2060738 - DNA, 23 bp, Homo sapiens
ttggggagacggtgttgcagaga

SEQ ID NO: 2060739 - DNA, 13 bp, Homo sapiens
ttggggagcagag

SEQ ID NO: 2060740 - DNA, 23 bp, Homo sapiens
ttggggcaggagtagctgagctc

SEQ ID NO: 2060741 - DNA, 13 bp, Homo sapiens
ttggggcctggct

SEQ ID NO: 2060742 - DNA, 14 bp, Homo sapiens
ttggggcctggctt

SEQ ID NO: 2060743 - DNA, 20 bp, Homo sapiens
ttggggggccgggcaggtcc

SEQ ID NO: 2060744 - DNA, 17 bp, Homo sapiens
ttggggtacccactgct

SEQ ID NO: 2060745 - DNA, 16 bp, Homo sapiens
ttggggtcagccaggg

SEQ ID NO: 2060746 - DNA, 15 bp, Homo sapiens
ttggggtcccaggga

SEQ ID NO: 2060747 - DNA, 16 bp, Homo sapiens
ttgggtggatgcctgg

SEQ ID NO: 2060748 - DNA, 16 bp, Homo sapiens
ttgggttcatctgagc

SEQ ID NO: 2060749 - DNA, 14 bp, Homo sapiens
ttgggttttatcag

SEQ ID NO: 2060750 - DNA, 20 bp, Homo sapiens
ttggtacatggccagtgtga

SEQ ID NO: 2060751 - DNA, 12 bp, Homo sapiens
ttggtccctggt

SEQ ID NO: 2060752 - DNA, 15 bp, Homo sapiens
ttggtctgctggtgt

SEQ ID NO: 2060753 - DNA, 15 bp, Homo sapiens
ttggtgacaatgtca

SEQ ID NO: 2060754 - DNA, 12 bp, Homo sapiens
ttgtcagacttt

SEQ ID NO: 2060755 - DNA, 18 bp, Homo sapiens
ttgtcagatatgatatgt

SEQ ID NO: 2060756 - DNA, 19 bp, Homo sapiens
ttgtcaggttggagtgtaa

SEQ ID NO: 2060757 - DNA, 17 bp, Homo sapiens
ttgtcatataaacctga

SEQ ID NO: 2060758 - DNA, 16 bp, Homo sapiens
ttgtcatgtaccatca

SEQ ID NO: 2060759 - DNA, 23 bp, Homo sapiens
ttgtcattactgcctttggaaga

SEQ ID NO: 2060760 - DNA, 19 bp, Homo sapiens
ttgtcattttaaaatctga

SEQ ID NO: 2060761 - DNA, 20 bp, Homo sapiens
ttgtcattttaaaatctgat

SEQ ID NO: 2060762 - DNA, 18 bp, Homo sapiens
ttgtccaatggctgtaaa

SEQ ID NO: 2060763 - DNA, 13 bp, Homo sapiens
ttgtccagcgcct

SEQ ID NO: 2060764 - DNA, 22 bp, Homo sapiens
ttgtccatatcagacctctgat

SEQ ID NO: 2060765 - DNA, 16 bp, Homo sapiens
ttgtccatattttcac

SEQ ID NO: 2060766 - DNA, 17 bp, Homo sapiens
ttgtccatgcctacaga

SEQ ID NO: 2060767 - DNA, 20 bp, Homo sapiens
ttgtccatgtgcttccctag

SEQ ID NO: 2060768 - DNA, 23 bp, Homo sapiens
ttgtcccatttccttggaggcca

SEQ ID NO: 2060769 - DNA, 24 bp, Homo sapiens
ttgtccccaatcccggtcatgctt

SEQ ID NO: 2060770 - DNA, 13 bp, Homo sapiens
ttgtccccagggc

SEQ ID NO: 2060771 - DNA, 14 bp, Homo sapiens
ttgtccccagggcc

SEQ ID NO: 2060772 - DNA, 14 bp, Homo sapiens
ttgtcccctcttga

SEQ ID NO: 2060773 - DNA, 19 bp, Homo sapiens
ttgtcccggatttttgtta

SEQ ID NO: 2060774 - DNA, 17 bp, Homo sapiens
ttgtccctgctcctccc

SEQ ID NO: 2060775 - DNA, 19 bp, Homo sapiens
ttgtcctcccctattttaa

SEQ ID NO: 2060776 - DNA, 12 bp, Homo sapiens
ttgtcctctccc

SEQ ID NO: 2060777 - DNA, 12 bp, Homo sapiens
ttgtcctgccag

SEQ ID NO: 2060778 - DNA, 13 bp, Homo sapiens
ttgtcctgccagc

SEQ ID NO: 2060779 - DNA, 18 bp, Homo sapiens
ttgtcctgccagctgcct

SEQ ID NO: 2060780 - DNA, 21 bp, Homo sapiens
ttgtcctgccagctgccttcc

SEQ ID NO: 2060781 - DNA, 15 bp, Homo sapiens
ttgtccttcagagct

SEQ ID NO: 2060782 - DNA, 15 bp, Homo sapiens
ttgtcctttgagaaa

SEQ ID NO: 2060783 - DNA, 17 bp, Homo sapiens
ttgtcctttgagaaaga

SEQ ID NO: 2060784 - DNA, 21 bp, Homo sapiens
ttgtctagaggtgagaccaaa

SEQ ID NO: 2060785 - DNA, 19 bp, Homo sapiens
ttgtctattctgagccttg

SEQ ID NO: 2060786 - DNA, 13 bp, Homo sapiens
ttgtctcaagatt

SEQ ID NO: 2060787 - DNA, 19 bp, Homo sapiens
ttgtctctatgccagctca

SEQ ID NO: 2060788 - DNA, 11 bp, Homo sapiens
ttgtctctgag

SEQ ID NO: 2060789 - DNA, 18 bp, Homo sapiens
ttgtctgaagtcactgca

SEQ ID NO: 2060790 - DNA, 14 bp, Homo sapiens
ttgtctgaggcctc

SEQ ID NO: 2060791 - DNA, 19 bp, Homo sapiens
ttgtctgaggcctcatccc

SEQ ID NO: 2060792 - DNA, 21 bp, Homo sapiens
ttgtctgaggcctcatccctc

SEQ ID NO: 2060793 - DNA, 12 bp, Homo sapiens
ttgtcttaatat

SEQ ID NO: 2060794 - DNA, 13 bp, Homo sapiens
ttgtcttccaacc

SEQ ID NO: 2060795 - DNA, 19 bp, Homo sapiens
ttgtcttccaaccccagct

SEQ ID NO: 2060796 - DNA, 23 bp, Homo sapiens
ttgtgaaaccacaggcccttggg

SEQ ID NO: 2060797 - DNA, 20 bp, Homo sapiens
ttgtgaaattcaacctgtgt

SEQ ID NO: 2060798 - DNA, 17 bp, Homo sapiens
ttgtgacaggaaagccc

SEQ ID NO: 2060799 - DNA, 21 bp, Homo sapiens
ttgtgacaggaaagccctccc

SEQ ID NO: 2060800 - DNA, 23 bp, Homo sapiens
ttgtgacaggaaagccctccccc

SEQ ID NO: 2060801 - DNA, 16 bp, Homo sapiens
ttgtgacgattattta

SEQ ID NO: 2060802 - DNA, 17 bp, Homo sapiens
ttgtgacgattatttat

SEQ ID NO: 2060803 - DNA, 19 bp, Homo sapiens
ttgtgacgattatttattt

SEQ ID NO: 2060804 - DNA, 21 bp, Homo sapiens
ttgtgactatatagagatgtt

SEQ ID NO: 2060805 - DNA, 12 bp, Homo sapiens
ttgtgagatggg

SEQ ID NO: 2060806 - DNA, 15 bp, Homo sapiens
ttgtgattttgtaca

SEQ ID NO: 2060807 - DNA, 18 bp, Homo sapiens
ttgtgcaatgtaaatatt

SEQ ID NO: 2060808 - DNA, 19 bp, Homo sapiens
ttgtgcatgtttactttat

SEQ ID NO: 2060809 - DNA, 14 bp, Homo sapiens
ttgtgctgtgggca

SEQ ID NO: 2060810 - DNA, 17 bp, Homo sapiens
ttgtgctgtgggcagca

SEQ ID NO: 2060811 - DNA, 21 bp, Homo sapiens
ttgtgctgtgggcagcaccct

SEQ ID NO: 2060812 - DNA, 21 bp, Homo sapiens
ttgtggaaaatgaaaattagg

SEQ ID NO: 2060813 - DNA, 18 bp, Homo sapiens
ttgtggaaagcctctgct

SEQ ID NO: 2060814 - DNA, 21 bp, Homo sapiens
ttgtggaattgggagcttggg

SEQ ID NO: 2060815 - DNA, 16 bp, Homo sapiens
ttgtggacacagctct

SEQ ID NO: 2060816 - DNA, 16 bp, Homo sapiens
ttgtggcaagtgaatt

SEQ ID NO: 2060817 - DNA, 14 bp, Homo sapiens
ttgtggtttatgtc

SEQ ID NO: 2060818 - DNA, 15 bp, Homo sapiens
ttgtgtacagttatt

SEQ ID NO: 2060819 - DNA, 18 bp, Homo sapiens
ttgtgtactccgaaacaa

SEQ ID NO: 2060820 - DNA, 18 bp, Homo sapiens
ttgtgtagattgtgtaaa

SEQ ID NO: 2060821 - DNA, 15 bp, Homo sapiens
ttgtgtatgatccaa

SEQ ID NO: 2060822 - DNA, 17 bp, Homo sapiens
ttgtgtgcatttctgtc

SEQ ID NO: 2060823 - DNA, 15 bp, Homo sapiens
ttgtgtgttatttaa

SEQ ID NO: 2060824 - DNA, 13 bp, Homo sapiens
ttgtgttcacctt

SEQ ID NO: 2060825 - DNA, 18 bp, Homo sapiens
ttgttaaaaccttactta

SEQ ID NO: 2060826 - DNA, 19 bp, Homo sapiens
ttgttaatggtttgaatat

SEQ ID NO: 2060827 - DNA, 11 bp, Homo sapiens
ttgttaatgtt

SEQ ID NO: 2060828 - DNA, 20 bp, Homo sapiens
ttgttaatttagaaaacttt

SEQ ID NO: 2060829 - DNA, 22 bp, Homo sapiens
ttgttaatttagaaaactttaa

SEQ ID NO: 2060830 - DNA, 12 bp, Homo sapiens
ttgttaccttta

SEQ ID NO: 2060831 - DNA, 16 bp, Homo sapiens
ttgttacctttcccat

SEQ ID NO: 2060832 - DNA, 13 bp, Homo sapiens
ttgttatgtatat

SEQ ID NO: 2060833 - DNA, 21 bp, Homo sapiens
ttgttatgtatatagatgtgc

SEQ ID NO: 2060834 - DNA, 14 bp, Homo sapiens
ttgttattgtggaa

SEQ ID NO: 2060835 - DNA, 14 bp, Homo sapiens
ttgttatttataac

SEQ ID NO: 2060836 - DNA, 17 bp, Homo sapiens
ttgttcagttgacttac

SEQ ID NO: 2060837 - DNA, 12 bp, Homo sapiens
ttgttcccacac

SEQ ID NO: 2060838 - DNA, 16 bp, Homo sapiens
ttgttccttaccttta

SEQ ID NO: 2060839 - DNA, 14 bp, Homo sapiens
ttgttccttctgct

SEQ ID NO: 2060840 - DNA, 17 bp, Homo sapiens
ttgttccttctgcttct

SEQ ID NO: 2060841 - DNA, 22 bp, Homo sapiens
ttgttctccgggtgtggcctca

SEQ ID NO: 2060842 - DNA, 15 bp, Homo sapiens
ttgttctgtattttc

SEQ ID NO: 2060843 - DNA, 20 bp, Homo sapiens
ttgttgataaattccactgg

SEQ ID NO: 2060844 - DNA, 19 bp, Homo sapiens
ttgttgattaatttgagaa

SEQ ID NO: 2060845 - DNA, 12 bp, Homo sapiens
ttgttgccaact

SEQ ID NO: 2060846 - DNA, 18 bp, Homo sapiens
ttgttgctccctgtgaca

SEQ ID NO: 2060847 - DNA, 13 bp, Homo sapiens
ttgttggaatgaa

SEQ ID NO: 2060848 - DNA, 20 bp, Homo sapiens
ttgttgggcttgggggaaaa

SEQ ID NO: 2060849 - DNA, 12 bp, Homo sapiens
ttgttgtacttt

SEQ ID NO: 2060850 - DNA, 15 bp, Homo sapiens
ttgttgtcaagtata

SEQ ID NO: 2060851 - DNA, 17 bp, Homo sapiens
ttgttgtcaagtataaa

SEQ ID NO: 2060852 - DNA, 20 bp, Homo sapiens
ttgtttaaaaacaggaaaaa

SEQ ID NO: 2060853 - DNA, 17 bp, Homo sapiens
ttgtttaaaatcatttc

SEQ ID NO: 2060854 - DNA, 20 bp, Homo sapiens
ttgtttattctttttaaagt

SEQ ID NO: 2060855 - DNA, 14 bp, Homo sapiens
ttgtttctactttg

SEQ ID NO: 2060856 - DNA, 12 bp, Homo sapiens
ttgtttcttaaa

SEQ ID NO: 2060857 - DNA, 13 bp, Homo sapiens
ttgtttcttccaa

SEQ ID NO: 2060858 - DNA, 15 bp, Homo sapiens
ttgtttcttccaaag

SEQ ID NO: 2060859 - DNA, 19 bp, Homo sapiens
ttgttttatcatgacatgt

SEQ ID NO: 2060860 - DNA, 14 bp, Homo sapiens
ttgttttccactgt

SEQ ID NO: 2060861 - DNA, 18 bp, Homo sapiens
ttgttttccactgtgcta

SEQ ID NO: 2060862 - DNA, 20 bp, Homo sapiens
ttgttttcttctgtatgtta

SEQ ID NO: 2060863 - DNA, 14 bp, Homo sapiens
ttgttttgttttaa

SEQ ID NO: 2060864 - DNA, 12 bp, Homo sapiens
ttgtttttatga

SEQ ID NO: 2060865 - DNA, 18 bp, Homo sapiens
ttgttttttttttccact

SEQ ID NO: 2060866 - DNA, 22 bp, Homo sapiens
tttaaaaaaagtatatattcta

SEQ ID NO: 2060867 - DNA, 15 bp, Homo sapiens
tttaaaaaactaaaa

SEQ ID NO: 2060868 - DNA, 13 bp, Homo sapiens
tttaaaaaagctt

SEQ ID NO: 2060869 - DNA, 14 bp, Homo sapiens
tttaaaaaagctta

SEQ ID NO: 2060870 - DNA, 19 bp, Homo sapiens
tttaaaaaataaatataat

SEQ ID NO: 2060871 - DNA, 19 bp, Homo sapiens
tttaaaaaatgaaaataag

SEQ ID NO: 2060872 - DNA, 15 bp, Homo sapiens
tttaaaaacaggaaa

SEQ ID NO: 2060873 - DNA, 16 bp, Homo sapiens
tttaaaaacaggaaaa

SEQ ID NO: 2060874 - DNA, 23 bp, Homo sapiens
tttaaaaacatgagaaatgtgaa

SEQ ID NO: 2060875 - DNA, 22 bp, Homo sapiens
tttaaaaataaagctactgaat

SEQ ID NO: 2060876 - DNA, 18 bp, Homo sapiens
tttaaaaggttgactcaa

SEQ ID NO: 2060877 - DNA, 21 bp, Homo sapiens
tttaaaaggttgactcaagtt

SEQ ID NO: 2060878 - DNA, 19 bp, Homo sapiens
tttaaaatacacactcaaa

SEQ ID NO: 2060879 - DNA, 12 bp, Homo sapiens
tttaaaatctga

SEQ ID NO: 2060880 - DNA, 14 bp, Homo sapiens
tttaaaatgattag

SEQ ID NO: 2060881 - DNA, 21 bp, Homo sapiens
tttaaaccagcagaaaagtgc

SEQ ID NO: 2060882 - DNA, 22 bp, Homo sapiens
tttaaaccagcagaaaagtgct

SEQ ID NO: 2060883 - DNA, 17 bp, Homo sapiens
tttaaaccgctaaaaga

SEQ ID NO: 2060884 - DNA, 21 bp, Homo sapiens
tttaaaccgctaaaagaaact

SEQ ID NO: 2060885 - DNA, 21 bp, Homo sapiens
tttaaactaccctccagagtg

SEQ ID NO: 2060886 - DNA, 15 bp, Homo sapiens
tttaaactataagca

SEQ ID NO: 2060887 - DNA, 17 bp, Homo sapiens
tttaaactgttctgtgt

SEQ ID NO: 2060888 - DNA, 19 bp, Homo sapiens
tttaaagaagtaaatttgt

SEQ ID NO: 2060889 - DNA, 12 bp, Homo sapiens
tttaaagactta

SEQ ID NO: 2060890 - DNA, 17 bp, Homo sapiens
tttaaagttgtttgtgc

SEQ ID NO: 2060891 - DNA, 20 bp, Homo sapiens
tttaaagttttatatgcata

SEQ ID NO: 2060892 - DNA, 20 bp, Homo sapiens
tttaaatacgcactacatgt

SEQ ID NO: 2060893 - DNA, 17 bp, Homo sapiens
tttaaatataaatgttt

SEQ ID NO: 2060894 - DNA, 12 bp, Homo sapiens
tttaaatatgaa

SEQ ID NO: 2060895 - DNA, 17 bp, Homo sapiens
tttaaatcaaaagctgc

SEQ ID NO: 2060896 - DNA, 20 bp, Homo sapiens
tttaaatctgtttttctaac

SEQ ID NO: 2060897 - DNA, 16 bp, Homo sapiens
tttaaatcttcaatat

SEQ ID NO: 2060898 - DNA, 14 bp, Homo sapiens
tttaaatgaagaaa

SEQ ID NO: 2060899 - DNA, 22 bp, Homo sapiens
tttaaatgacatttttgataaa

SEQ ID NO: 2060900 - DNA, 10 bp, Homo sapiens
tttaaatgtt

SEQ ID NO: 2060901 - DNA, 19 bp, Homo sapiens
tttaaattatactgtagct

SEQ ID NO: 2060902 - DNA, 21 bp, Homo sapiens
tttaaattcacaatagaaact

SEQ ID NO: 2060903 - DNA, 16 bp, Homo sapiens
tttaacaaaagcaaga

SEQ ID NO: 2060904 - DNA, 15 bp, Homo sapiens
tttaacagtcattta

SEQ ID NO: 2060905 - DNA, 16 bp, Homo sapiens
tttaacagtcatttaa

SEQ ID NO: 2060906 - DNA, 17 bp, Homo sapiens
tttaaccagtacttcta

SEQ ID NO: 2060907 - DNA, 18 bp, Homo sapiens
tttaaccctctcttccct

SEQ ID NO: 2060908 - DNA, 18 bp, Homo sapiens
tttaaccgtttttcaaga

SEQ ID NO: 2060909 - DNA, 20 bp, Homo sapiens
tttaaccgtttttcaagaaa

SEQ ID NO: 2060910 - DNA, 20 bp, Homo sapiens
tttaactaatttaaaccagc

SEQ ID NO: 2060911 - DNA, 24 bp, Homo sapiens
tttaactcaatattttccatgaaa

SEQ ID NO: 2060912 - DNA, 14 bp, Homo sapiens
tttaactgccttgt

SEQ ID NO: 2060913 - DNA, 14 bp, Homo sapiens
tttaacttaaatag

SEQ ID NO: 2060914 - DNA, 21 bp, Homo sapiens
tttaagacgtgaatgtctcag

SEQ ID NO: 2060915 - DNA, 13 bp, Homo sapiens
tttaagagagaaa

SEQ ID NO: 2060916 - DNA, 14 bp, Homo sapiens
tttaagaggcaggg

SEQ ID NO: 2060917 - DNA, 22 bp, Homo sapiens
tttaagagtgaaataattaaaa

SEQ ID NO: 2060918 - DNA, 11 bp, Homo sapiens
tttaagctgtt

SEQ ID NO: 2060919 - DNA, 12 bp, Homo sapiens
tttaagctgttt

SEQ ID NO: 2060920 - DNA, 21 bp, Homo sapiens
tttaagtatatagtatattta

SEQ ID NO: 2060921 - DNA, 18 bp, Homo sapiens
tttaagtatttaggtttt

SEQ ID NO: 2060922 - DNA, 13 bp, Homo sapiens
tttaataaaagta

SEQ ID NO: 2060923 - DNA, 22 bp, Homo sapiens
tttaataaaagtactgaagacc

SEQ ID NO: 2060924 - DNA, 15 bp, Homo sapiens
tttaataatttcatc

SEQ ID NO: 2060925 - DNA, 21 bp, Homo sapiens
tttaatagaatataattatcg

SEQ ID NO: 2060926 - DNA, 15 bp, Homo sapiens
tttaatatagctatt

SEQ ID NO: 2060927 - DNA, 16 bp, Homo sapiens
tttaatatagctattt

SEQ ID NO: 2060928 - DNA, 12 bp, Homo sapiens
tttaatatttaa

SEQ ID NO: 2060929 - DNA, 13 bp, Homo sapiens
tttaatatttaaa

SEQ ID NO: 2060930 - DNA, 20 bp, Homo sapiens
tttaatattttgtattttca

SEQ ID NO: 2060931 - DNA, 13 bp, Homo sapiens
tttaatcttcagt

SEQ ID NO: 2060932 - DNA, 22 bp, Homo sapiens
tttaatgaagacccagtgtaaa

SEQ ID NO: 2060933 - DNA, 15 bp, Homo sapiens
tttaatgacttttta

SEQ ID NO: 2060934 - DNA, 13 bp, Homo sapiens
tttaatgccttcc

SEQ ID NO: 2060935 - DNA, 14 bp, Homo sapiens
tttaatgtacaagt

SEQ ID NO: 2060936 - DNA, 20 bp, Homo sapiens
tttaatgtatagtaaatcac

SEQ ID NO: 2060937 - DNA, 12 bp, Homo sapiens
tttaatgtttga

SEQ ID NO: 2060938 - DNA, 13 bp, Homo sapiens
tttaattaaataa

SEQ ID NO: 2060939 - DNA, 19 bp, Homo sapiens
tttaattaactatgtgatg

SEQ ID NO: 2060940 - DNA, 16 bp, Homo sapiens
tttaattaatatgttc

SEQ ID NO: 2060941 - DNA, 14 bp, Homo sapiens
tttaattattattc

SEQ ID NO: 2060942 - DNA, 11 bp, Homo sapiens
tttaattcata

SEQ ID NO: 2060943 - DNA, 13 bp, Homo sapiens
tttaattctgaaa

SEQ ID NO: 2060944 - DNA, 21 bp, Homo sapiens
tttaattgtaggtcaatgaaa

SEQ ID NO: 2060945 - DNA, 17 bp, Homo sapiens
tttaatttatatttgaa

SEQ ID NO: 2060946 - DNA, 16 bp, Homo sapiens
tttaatttatgagttt

SEQ ID NO: 2060947 - DNA, 18 bp, Homo sapiens
tttaatttttacatgacc

SEQ ID NO: 2060948 - DNA, 13 bp, Homo sapiens
tttacaaaacata

SEQ ID NO: 2060949 - DNA, 14 bp, Homo sapiens
tttacaaaatacta

SEQ ID NO: 2060950 - DNA, 20 bp, Homo sapiens
tttacaagaattgtccatgt

SEQ ID NO: 2060951 - DNA, 21 bp, Homo sapiens
tttacaagtgtatatcagaaa

SEQ ID NO: 2060952 - DNA, 15 bp, Homo sapiens
tttacaataaatatt

SEQ ID NO: 2060953 - DNA, 21 bp, Homo sapiens
tttacaccagttcctttcaat

SEQ ID NO: 2060954 - DNA, 15 bp, Homo sapiens
tttacactctctgta

SEQ ID NO: 2060955 - DNA, 19 bp, Homo sapiens
tttacactctctgtacaaa

SEQ ID NO: 2060956 - DNA, 24 bp, Homo sapiens
tttacagatgagattccctctcct

SEQ ID NO: 2060957 - DNA, 20 bp, Homo sapiens
tttacagcctcacttgaatg

SEQ ID NO: 2060958 - DNA, 23 bp, Homo sapiens
tttacagctcttggcattttcct

SEQ ID NO: 2060959 - DNA, 18 bp, Homo sapiens
tttacagctttacacaca

SEQ ID NO: 2060960 - DNA, 19 bp, Homo sapiens
tttacagctttacacacac

SEQ ID NO: 2060961 - DNA, 21 bp, Homo sapiens
tttacaggaggttgtggatgc

SEQ ID NO: 2060962 - DNA, 19 bp, Homo sapiens
tttacagtaaataaattgt

SEQ ID NO: 2060963 - DNA, 13 bp, Homo sapiens
tttacattttatt

SEQ ID NO: 2060964 - DNA, 13 bp, Homo sapiens
tttacccttggct

SEQ ID NO: 2060965 - DNA, 18 bp, Homo sapiens
tttacctaccacagtgtc

SEQ ID NO: 2060966 - DNA, 13 bp, Homo sapiens
tttacctgagacc

SEQ ID NO: 2060967 - DNA, 17 bp, Homo sapiens
tttacctttattaatga

SEQ ID NO: 2060968 - DNA, 20 bp, Homo sapiens
tttacctttattaatgaact

SEQ ID NO: 2060969 - DNA, 21 bp, Homo sapiens
tttactaagccacaagaaatt

SEQ ID NO: 2060970 - DNA, 17 bp, Homo sapiens
tttactactattctgtt

SEQ ID NO: 2060971 - DNA, 21 bp, Homo sapiens
tttactactgtggaaaaatat

SEQ ID NO: 2060972 - DNA, 13 bp, Homo sapiens
tttactattttac

SEQ ID NO: 2060973 - DNA, 19 bp, Homo sapiens
tttactcccttcctggcct

SEQ ID NO: 2060974 - DNA, 19 bp, Homo sapiens
tttactcctttgcattcca

SEQ ID NO: 2060975 - DNA, 15 bp, Homo sapiens
tttactgacagaaat

SEQ ID NO: 2060976 - DNA, 14 bp, Homo sapiens
tttactgagcttct

SEQ ID NO: 2060977 - DNA, 21 bp, Homo sapiens
tttactgagcttctctgtgaa

SEQ ID NO: 2060978 - DNA, 13 bp, Homo sapiens
tttacttcatgag

SEQ ID NO: 2060979 - DNA, 14 bp, Homo sapiens
tttacttccacaga

SEQ ID NO: 2060980 - DNA, 13 bp, Homo sapiens
tttagaaaacttt

SEQ ID NO: 2060981 - DNA, 15 bp, Homo sapiens
tttagaaaactttaa

SEQ ID NO: 2060982 - DNA, 15 bp, Homo sapiens
tttagacttcaagca

SEQ ID NO: 2060983 - DNA, 22 bp, Homo sapiens
tttagagattaatttgtgtaga

SEQ ID NO: 2060984 - DNA, 18 bp, Homo sapiens
tttagagtagcatgagag

SEQ ID NO: 2060985 - DNA, 22 bp, Homo sapiens
tttcactgtgttggccaggctg

SEQ ID NO: 2060986 - DNA, 16 bp, Homo sapiens
tttcactttagctatg

SEQ ID NO: 2060987 - DNA, 20 bp, Homo sapiens
tttcactttagctatgtgga

SEQ ID NO: 2060988 - DNA, 10 bp, Homo sapiens
tttcagaccc

SEQ ID NO: 2060989 - DNA, 17 bp, Homo sapiens
tttcagaggctgcagga

SEQ ID NO: 2060990 - DNA, 16 bp, Homo sapiens
tttcagatatatatca

SEQ ID NO: 2060991 - DNA, 16 bp, Homo sapiens
tttcagattccacaca

SEQ ID NO: 2060992 - DNA, 21 bp, Homo sapiens
tttcagattccacacaaaatg

SEQ ID NO: 2060993 - DNA, 20 bp, Homo sapiens
tttcagattcccagagcaaa

SEQ ID NO: 2060994 - DNA, 13 bp, Homo sapiens
tttcagctagttt

SEQ ID NO: 2060995 - DNA, 18 bp, Homo sapiens
tttcagctgacagctgct

SEQ ID NO: 2060996 - DNA, 18 bp, Homo sapiens
tttcaggttttgtaaaga

SEQ ID NO: 2060997 - DNA, 21 bp, Homo sapiens
tttcagttgatcactggcaat

SEQ ID NO: 2060998 - DNA, 14 bp, Homo sapiens
tttcataaggcctg

SEQ ID NO: 2060999 - DNA, 20 bp, Homo sapiens
tttcataaggcctgccctcc

SEQ ID NO: 2061000 - DNA, 22 bp, Homo sapiens
tttcataaggcctgccctccca

SEQ ID NO: 2061001 - DNA, 20 bp, Homo sapiens
tttcatagattgagaagttt

SEQ ID NO: 2061002 - DNA, 14 bp, Homo sapiens
tttcatcctggcct

SEQ ID NO: 2061003 - DNA, 23 bp, Homo sapiens
tttcatgtaaccaagagtattcc

SEQ ID NO: 2061004 - DNA, 16 bp, Homo sapiens
tttcatgttttgtgac

SEQ ID NO: 2061005 - DNA, 18 bp, Homo sapiens
tttcatgttttgtgacta

SEQ ID NO: 2061006 - DNA, 13 bp, Homo sapiens
tttcattaaaaat

SEQ ID NO: 2061007 - DNA, 14 bp, Homo sapiens
tttcattaaaaatg

SEQ ID NO: 2061008 - DNA, 16 bp, Homo sapiens
tttcattaaagcattt

SEQ ID NO: 2061009 - DNA, 14 bp, Homo sapiens
tttcattacaatgg

SEQ ID NO: 2061010 - DNA, 22 bp, Homo sapiens
tttcattaccaagttacttgaa

SEQ ID NO: 2061011 - DNA, 15 bp, Homo sapiens
tttcattctcctgcc

SEQ ID NO: 2061012 - DNA, 15 bp, Homo sapiens
tttcattgtatgatg

SEQ ID NO: 2061013 - DNA, 17 bp, Homo sapiens
tttcattgtatgatgtg

SEQ ID NO: 2061014 - DNA, 15 bp, Homo sapiens
tttcattttaattta

SEQ ID NO: 2061015 - DNA, 17 bp, Homo sapiens
tttcattttcattaaaa

SEQ ID NO: 2061016 - DNA, 20 bp, Homo sapiens
tttccacaagattcccagag

SEQ ID NO: 2061017 - DNA, 21 bp, Homo sapiens
tttccacctgctttctcctgg

SEQ ID NO: 2061018 - DNA, 18 bp, Homo sapiens
tttccactgtcttgcctg

SEQ ID NO: 2061019 - DNA, 23 bp, Homo sapiens
tttccactgtcttgcctgccagg

SEQ ID NO: 2061020 - DNA, 23 bp, Homo sapiens
tttccagaaaatataaatgcatg

SEQ ID NO: 2061021 - DNA, 19 bp, Homo sapiens
tttccaggatcctgcagga

SEQ ID NO: 2061022 - DNA, 19 bp, Homo sapiens
tttccaggcccctgaggac

SEQ ID NO: 2061023 - DNA, 23 bp, Homo sapiens
tttccatctgcttgtattttcca

SEQ ID NO: 2061024 - DNA, 17 bp, Homo sapiens
tttccatgaagtttgaa

SEQ ID NO: 2061025 - DNA, 21 bp, Homo sapiens
tttccatgcagactcctcaga

SEQ ID NO: 2061026 - DNA, 11 bp, Homo sapiens
tttccatttct

SEQ ID NO: 2061027 - DNA, 13 bp, Homo sapiens
tttcccaccacct

SEQ ID NO: 2061028 - DNA, 17 bp, Homo sapiens
tttcccaggagaccatt

SEQ ID NO: 2061029 - DNA, 14 bp, Homo sapiens
tttcccataatttt

SEQ ID NO: 2061030 - DNA, 12 bp, Homo sapiens
tttccccacctc

SEQ ID NO: 2061031 - DNA, 19 bp, Homo sapiens
tttccccagtgtggcccca

SEQ ID NO: 2061032 - DNA, 12 bp, Homo sapiens
tttcccccaccc

SEQ ID NO: 2061033 - DNA, 18 bp, Homo sapiens
tttcccccaccccagagt

SEQ ID NO: 2061034 - DNA, 23 bp, Homo sapiens
tttccctcaaatgcgcgtgtgca

SEQ ID NO: 2061035 - DNA, 15 bp, Homo sapiens
tttccctcaccccct

SEQ ID NO: 2061036 - DNA, 19 bp, Homo sapiens
tttccctcaccccctccca

SEQ ID NO: 2061037 - DNA, 14 bp, Homo sapiens
tttccctcccggga

SEQ ID NO: 2061038 - DNA, 13 bp, Homo sapiens
tttccctgacctc

SEQ ID NO: 2061039 - DNA, 13 bp, Homo sapiens
tttccctgagagc

SEQ ID NO: 2061040 - DNA, 14 bp, Homo sapiens
tttcccttccagtt

SEQ ID NO: 2061041 - DNA, 24 bp, Homo sapiens
tttccgctgtcgccccaggccctc

SEQ ID NO: 2061042 - DNA, 13 bp, Homo sapiens
tttcctaacattt

SEQ ID NO: 2061043 - DNA, 14 bp, Homo sapiens
tttcctacaaaatg

SEQ ID NO: 2061044 - DNA, 15 bp, Homo sapiens
tttcctacaaaatgg

SEQ ID NO: 2061045 - DNA, 16 bp, Homo sapiens
tttcctacctatatta

SEQ ID NO: 2061046 - DNA, 22 bp, Homo sapiens
tttcctagactaattaaaatct

SEQ ID NO: 2061047 - DNA, 17 bp, Homo sapiens
tttcctagccctctcac

SEQ ID NO: 2061048 - DNA, 23 bp, Homo sapiens
tttcctagccctctcacatttat

SEQ ID NO: 2061049 - DNA, 19 bp, Homo sapiens
tttcctcattcctgaaaga

SEQ ID NO: 2061050 - DNA, 22 bp, Homo sapiens
tttcctccaaactcctgcctgt

SEQ ID NO: 2061051 - DNA, 17 bp, Homo sapiens
tttcctccagacagata

SEQ ID NO: 2061052 - DNA, 12 bp, Homo sapiens
tttcctccccac

SEQ ID NO: 2061053 - DNA, 14 bp, Homo sapiens
tttcctctgcagca

SEQ ID NO: 2061054 - DNA, 22 bp, Homo sapiens
tttcctgggtggctactctgtg

SEQ ID NO: 2061055 - DNA, 19 bp, Homo sapiens
tttccttcaagccagcaac

SEQ ID NO: 2061056 - DNA, 13 bp, Homo sapiens
tttccttcagtgc

SEQ ID NO: 2061057 - DNA, 16 bp, Homo sapiens
tttccttccttccctg

SEQ ID NO: 2061058 - DNA, 13 bp, Homo sapiens
tttccttgtctct

SEQ ID NO: 2061059 - DNA, 14 bp, Homo sapiens
tttccttgtctctc

SEQ ID NO: 2061060 - DNA, 15 bp, Homo sapiens
tttccttgtctctca

SEQ ID NO: 2061061 - DNA, 17 bp, Homo sapiens
tttccttttttgttatt

SEQ ID NO: 2061062 - DNA, 15 bp, Homo sapiens
tttcgcttgcttctg

SEQ ID NO: 2061063 - DNA, 17 bp, Homo sapiens
tttcgcttgcttctgca

SEQ ID NO: 2061064 - DNA, 18 bp, Homo sapiens
tttcgcttgcttctgcag

SEQ ID NO: 2061065 - DNA, 12 bp, Homo sapiens
tttcgctttcct

SEQ ID NO: 2061066 - DNA, 19 bp, Homo sapiens
tttctaaagctctgaacaa

SEQ ID NO: 2061067 - DNA, 22 bp, Homo sapiens
tttctaaagctctgaacaaaag

SEQ ID NO: 2061068 - DNA, 13 bp, Homo sapiens
tttctaacatatg

SEQ ID NO: 2061069 - DNA, 14 bp, Homo sapiens
tttctaactgtaaa

SEQ ID NO: 2061070 - DNA, 16 bp, Homo sapiens
tttctaactgtaaatc

SEQ ID NO: 2061071 - DNA, 15 bp, Homo sapiens
tttctaatcttgtta

SEQ ID NO: 2061072 - DNA, 16 bp, Homo sapiens
tttctaccatttcaga

SEQ ID NO: 2061073 - DNA, 15 bp, Homo sapiens
tttctacccagcgag

SEQ ID NO: 2061074 - DNA, 22 bp, Homo sapiens
tttctacccagcgagccctggt

SEQ ID NO: 2061075 - DNA, 16 bp, Homo sapiens
tttctacttatcctca

SEQ ID NO: 2061076 - DNA, 16 bp, Homo sapiens
tttctagacttgtgct

SEQ ID NO: 2061077 - DNA, 19 bp, Homo sapiens
tttctagctgttgagctgt

SEQ ID NO: 2061078 - DNA, 21 bp, Homo sapiens
tttctagctgttgagctgttt

SEQ ID NO: 2061079 - DNA, 13 bp, Homo sapiens
tttctattccaaa

SEQ ID NO: 2061080 - DNA, 15 bp, Homo sapiens
tttctccaagagcta

SEQ ID NO: 2061081 - DNA, 21 bp, Homo sapiens
tttctcccccgacactgctgc

SEQ ID NO: 2061082 - DNA, 13 bp, Homo sapiens
tttctccccctgg

SEQ ID NO: 2061083 - DNA, 15 bp, Homo sapiens
tttctcctcccagga

SEQ ID NO: 2061084 - DNA, 23 bp, Homo sapiens
tttctcctgggcccgctttgcct

SEQ ID NO: 2061085 - DNA, 19 bp, Homo sapiens
tttctctagctgatcagaa

SEQ ID NO: 2061086 - DNA, 12 bp, Homo sapiens
tttctctgagca

SEQ ID NO: 2061087 - DNA, 16 bp, Homo sapiens
tttctcttcatacttt

SEQ ID NO: 2061088 - DNA, 19 bp, Homo sapiens
tttctgaaaattaacactg

SEQ ID NO: 2061089 - DNA, 18 bp, Homo sapiens
tttctgaagctttaccag

SEQ ID NO: 2061090 - DNA, 20 bp, Homo sapiens
tttctgaccaatcactgagt

SEQ ID NO: 2061091 - DNA, 12 bp, Homo sapiens
tttctgagaaaa

SEQ ID NO: 2061092 - DNA, 19 bp, Homo sapiens
tttctgagcttttcatgga

SEQ ID NO: 2061093 - DNA, 16 bp, Homo sapiens
tttctgagttcctgca

SEQ ID NO: 2061094 - DNA, 22 bp, Homo sapiens
tttctgatgacataataaagac

SEQ ID NO: 2061095 - DNA, 14 bp, Homo sapiens
tttctgcatcagct

SEQ ID NO: 2061096 - DNA, 20 bp, Homo sapiens
tttctggaaattttgtccat

SEQ ID NO: 2061097 - DNA, 16 bp, Homo sapiens
tttctggagcaagaga

SEQ ID NO: 2061098 - DNA, 16 bp, Homo sapiens
tttctgggataagtaa

SEQ ID NO: 2061099 - DNA, 22 bp, Homo sapiens
tttctggtgcctatttattcat

SEQ ID NO: 2061100 - DNA, 13 bp, Homo sapiens
tttgtagagccag

SEQ ID NO: 2061101 - DNA, 19 bp, Homo sapiens
tttgtataacttcttaaaa

SEQ ID NO: 2061102 - DNA, 14 bp, Homo sapiens
tttgtatgtactgt

SEQ ID NO: 2061103 - DNA, 13 bp, Homo sapiens
tttgtattaccat

SEQ ID NO: 2061104 - DNA, 13 bp, Homo sapiens
tttgtattcatga

SEQ ID NO: 2061105 - DNA, 21 bp, Homo sapiens
tttgtattctttactaaagat

SEQ ID NO: 2061106 - DNA, 10 bp, Homo sapiens
tttgtattta

SEQ ID NO: 2061107 - DNA, 13 bp, Homo sapiens
tttgtattttgct

SEQ ID NO: 2061108 - DNA, 17 bp, Homo sapiens
tttgtatttttgaataa

SEQ ID NO: 2061109 - DNA, 23 bp, Homo sapiens
tttgtcacaatcctaacacatta

SEQ ID NO: 2061110 - DNA, 19 bp, Homo sapiens
tttgtcatatattcatgta

SEQ ID NO: 2061111 - DNA, 21 bp, Homo sapiens
tttgtcatgaattcttatgct

SEQ ID NO: 2061112 - DNA, 21 bp, Homo sapiens
tttgtcattttaaaatctgat

SEQ ID NO: 2061113 - DNA, 15 bp, Homo sapiens
tttgtcccatttcct

SEQ ID NO: 2061114 - DNA, 17 bp, Homo sapiens
tttgtccccagggcccc

SEQ ID NO: 2061115 - DNA, 16 bp, Homo sapiens
tttgtccctgctcctc

SEQ ID NO: 2061116 - DNA, 14 bp, Homo sapiens
tttgtctcctacct

SEQ ID NO: 2061117 - DNA, 22 bp, Homo sapiens
tttgtgaaatgatggtgaaagt

SEQ ID NO: 2061118 - DNA, 20 bp, Homo sapiens
tttgtgactatatagagatg

SEQ ID NO: 2061119 - DNA, 23 bp, Homo sapiens
tttgtgctatcagactgtaggat

SEQ ID NO: 2061120 - DNA, 13 bp, Homo sapiens
tttgtgctgtggg

SEQ ID NO: 2061121 - DNA, 11 bp, Homo sapiens
tttgtggaaaa

SEQ ID NO: 2061122 - DNA, 23 bp, Homo sapiens
tttgtggcatacaacctgagcct

SEQ ID NO: 2061123 - DNA, 19 bp, Homo sapiens
tttgtgtaatagaaaactg

SEQ ID NO: 2061124 - DNA, 14 bp, Homo sapiens
tttgtgtacagtgt

SEQ ID NO: 2061125 - DNA, 14 bp, Homo sapiens
tttgtgtgattgaa

SEQ ID NO: 2061126 - DNA, 13 bp, Homo sapiens
tttgttaccttta

SEQ ID NO: 2061127 - DNA, 21 bp, Homo sapiens
tttgttatgtatatagatgtg

SEQ ID NO: 2061128 - DNA, 18 bp, Homo sapiens
tttgttatttgtacagtt

SEQ ID NO: 2061129 - DNA, 15 bp, Homo sapiens
tttgttcaaagttgt

SEQ ID NO: 2061130 - DNA, 14 bp, Homo sapiens
tttgttctacatga

SEQ ID NO: 2061131 - DNA, 15 bp, Homo sapiens
tttgttgaaattatg

SEQ ID NO: 2061132 - DNA, 12 bp, Homo sapiens
tttgttgtactt

SEQ ID NO: 2061133 - DNA, 13 bp, Homo sapiens
tttgttgtacttt

SEQ ID NO: 2061134 - DNA, 13 bp, Homo sapiens
tttgttgtgactg

SEQ ID NO: 2061135 - DNA, 13 bp, Homo sapiens
tttgttgttgttg

SEQ ID NO: 2061136 - DNA, 14 bp, Homo sapiens
tttgtttcctttgt

SEQ ID NO: 2061137 - DNA, 16 bp, Homo sapiens
tttgtttcttccaaag

SEQ ID NO: 2061138 - DNA, 19 bp, Homo sapiens
tttgttttctgatgacata

SEQ ID NO: 2061139 - DNA, 14 bp, Homo sapiens
tttgtttttatgaa

SEQ ID NO: 2061140 - DNA, 16 bp, Homo sapiens
ttttaaaaaaattcat

SEQ ID NO: 2061141 - DNA, 22 bp, Homo sapiens
ttttaaaaaatgaaaataagtg

SEQ ID NO: 2061142 - DNA, 18 bp, Homo sapiens
ttttaaaaacatgagaaa

SEQ ID NO: 2061143 - DNA, 17 bp, Homo sapiens
ttttaaaaagttgcaca

SEQ ID NO: 2061144 - DNA, 18 bp, Homo sapiens
ttctggctgaaaaaggcc

SEQ ID NO: 2061145 - DNA, 15 bp, Homo sapiens
ttctggcttctagtc

SEQ ID NO: 2061146 - DNA, 16 bp, Homo sapiens
ttctgggaggaagcag

SEQ ID NO: 2061147 - DNA, 15 bp, Homo sapiens
ttctggggaggaagg

SEQ ID NO: 2061148 - DNA, 15 bp, Homo sapiens
ttctgggtggctcct

SEQ ID NO: 2061149 - DNA, 16 bp, Homo sapiens
ttctgggtgttgacca

SEQ ID NO: 2061150 - DNA, 18 bp, Homo sapiens
ttctggtcttcactgcca

SEQ ID NO: 2061151 - DNA, 23 bp, Homo sapiens
ttctggtttagtgttctgtattt

SEQ ID NO: 2061152 - DNA, 20 bp, Homo sapiens
ttctgtaaaatttgtttaga

SEQ ID NO: 2061153 - DNA, 19 bp, Homo sapiens
ttctgtaaactcaaaactt

SEQ ID NO: 2061154 - DNA, 12 bp, Homo sapiens
ttctgtcatccc

SEQ ID NO: 2061155 - DNA, 19 bp, Homo sapiens
ttctgtcatcccgctcctg

SEQ ID NO: 2061156 - DNA, 16 bp, Homo sapiens
ttctgtccagtttcca

SEQ ID NO: 2061157 - DNA, 23 bp, Homo sapiens
ttctgtccttttggcactgagat

SEQ ID NO: 2061158 - DNA, 19 bp, Homo sapiens
ttctgtggagagtgagaat

SEQ ID NO: 2061159 - DNA, 12 bp, Homo sapiens
ttctgtggctca

SEQ ID NO: 2061160 - DNA, 17 bp, Homo sapiens
ttctgttgcccaggctg

SEQ ID NO: 2061161 - DNA, 23 bp, Homo sapiens
ttctgttgcccaggctggcctga

SEQ ID NO: 2061162 - DNA, 17 bp, Homo sapiens
ttctgttgtaaagagtg

SEQ ID NO: 2061163 - DNA, 23 bp, Homo sapiens
ttctgttgtagaataataataaa

SEQ ID NO: 2061164 - DNA, 18 bp, Homo sapiens
ttcttaaaaacagctgta

SEQ ID NO: 2061165 - DNA, 13 bp, Homo sapiens
ttcttaaagagtt

SEQ ID NO: 2061166 - DNA, 15 bp, Homo sapiens
ttcttaaaggaaaag

SEQ ID NO: 2061167 - DNA, 15 bp, Homo sapiens
ttcttaaaggcctgg

SEQ ID NO: 2061168 - DNA, 13 bp, Homo sapiens
ttcttacataatt

SEQ ID NO: 2061169 - DNA, 23 bp, Homo sapiens
ttcttagactagttgaacatctc

SEQ ID NO: 2061170 - DNA, 13 bp, Homo sapiens
ttcttagtgtcac

SEQ ID NO: 2061171 - DNA, 13 bp, Homo sapiens
ttcttatataaga

SEQ ID NO: 2061172 - DNA, 15 bp, Homo sapiens
ttcttatcttctgca

SEQ ID NO: 2061173 - DNA, 19 bp, Homo sapiens
ttcttattctcactccacc

SEQ ID NO: 2061174 - DNA, 15 bp, Homo sapiens
ttcttatttgcaata

SEQ ID NO: 2061175 - DNA, 18 bp, Homo sapiens
ttcttatttgcaataaaa

SEQ ID NO: 2061176 - DNA, 15 bp, Homo sapiens
ttcttattttgtaat

SEQ ID NO: 2061177 - DNA, 20 bp, Homo sapiens
ttcttattttgtaataaact

SEQ ID NO: 2061178 - DNA, 19 bp, Homo sapiens
ttcttcaagggaagaaaca

SEQ ID NO: 2061179 - DNA, 21 bp, Homo sapiens
ttcttcacccagctaatctgt

SEQ ID NO: 2061180 - DNA, 14 bp, Homo sapiens
ttcttcagaagaca

SEQ ID NO: 2061181 - DNA, 23 bp, Homo sapiens
ttcttcagccacctctctttttc

SEQ ID NO: 2061182 - DNA, 18 bp, Homo sapiens
ttcttcataacaatttta

SEQ ID NO: 2061183 - DNA, 13 bp, Homo sapiens
ttcttcatcttga

SEQ ID NO: 2061184 - DNA, 16 bp, Homo sapiens
ttcttcatcttgacat

SEQ ID NO: 2061185 - DNA, 14 bp, Homo sapiens
ttcttcatgcaatg

SEQ ID NO: 2061186 - DNA, 15 bp, Homo sapiens
ttcttcatgcaatga

SEQ ID NO: 2061187 - DNA, 20 bp, Homo sapiens
ttcttcattcaatacaagtg

SEQ ID NO: 2061188 - DNA, 19 bp, Homo sapiens
ttcttcccatcactggagc

SEQ ID NO: 2061189 - DNA, 21 bp, Homo sapiens
ttcttccccaggtccttcctt

SEQ ID NO: 2061190 - DNA, 22 bp, Homo sapiens
ttcttccttaattcactcccac

SEQ ID NO: 2061191 - DNA, 20 bp, Homo sapiens
ttcttccttctttctcttcc

SEQ ID NO: 2061192 - DNA, 20 bp, Homo sapiens
ttcttcgctgctctagctgg

SEQ ID NO: 2061193 - DNA, 20 bp, Homo sapiens
ttcttcggggaactcctgga

SEQ ID NO: 2061194 - DNA, 12 bp, Homo sapiens
ttcttctaaaat

SEQ ID NO: 2061195 - DNA, 14 bp, Homo sapiens
ttcttctaaaattg

SEQ ID NO: 2061196 - DNA, 15 bp, Homo sapiens
ttcttctgcttcagc

SEQ ID NO: 2061197 - DNA, 13 bp, Homo sapiens
ttcttgaaagctg

SEQ ID NO: 2061198 - DNA, 17 bp, Homo sapiens
ttcttgaagttcatggt

SEQ ID NO: 2061199 - DNA, 15 bp, Homo sapiens
ttcttgaatatctgc

SEQ ID NO: 2061200 - DNA, 19 bp, Homo sapiens
ttcttgagtagatctgctt

SEQ ID NO: 2061201 - DNA, 14 bp, Homo sapiens
ttcttgatgtcatg

SEQ ID NO: 2061202 - DNA, 18 bp, Homo sapiens
ttcttgcagtcatcagaa

SEQ ID NO: 2061203 - DNA, 15 bp, Homo sapiens
ttcttgccccttggg

SEQ ID NO: 2061204 - DNA, 18 bp, Homo sapiens
ttcttgccccttgggcct

SEQ ID NO: 2061205 - DNA, 12 bp, Homo sapiens
ttcttgcctcat

SEQ ID NO: 2061206 - DNA, 16 bp, Homo sapiens
ttcttggaaaaaaatt

SEQ ID NO: 2061207 - DNA, 19 bp, Homo sapiens
ttcttggcttctgggacct

SEQ ID NO: 2061208 - DNA, 17 bp, Homo sapiens
ttcttggggtcccaggg

SEQ ID NO: 2061209 - DNA, 12 bp, Homo sapiens
ttcttgggtagt

SEQ ID NO: 2061210 - DNA, 16 bp, Homo sapiens
ttcttggtctcagctt

SEQ ID NO: 2061211 - DNA, 18 bp, Homo sapiens
ttcttggtgactgtccca

SEQ ID NO: 2061212 - DNA, 13 bp, Homo sapiens
ttcttgtcaaaaa

SEQ ID NO: 2061213 - DNA, 15 bp, Homo sapiens
ttcttgtgcatgttt

SEQ ID NO: 2061214 - DNA, 15 bp, Homo sapiens
ttcttgtgcctcagc

SEQ ID NO: 2061215 - DNA, 21 bp, Homo sapiens
ttcttgtgctgactaactata

SEQ ID NO: 2061216 - DNA, 15 bp, Homo sapiens
ttcttgttgttctgt

SEQ ID NO: 2061217 - DNA, 13 bp, Homo sapiens
ttctttaaatcaa

SEQ ID NO: 2061218 - DNA, 20 bp, Homo sapiens
ttctttaaatcaaaagctgc

SEQ ID NO: 2061219 - DNA, 21 bp, Homo sapiens
ttctttaagaattacaggttg

SEQ ID NO: 2061220 - DNA, 16 bp, Homo sapiens
ttctttactaaagata

SEQ ID NO: 2061221 - DNA, 18 bp, Homo sapiens
ttctttaggtgcctcctg

SEQ ID NO: 2061222 - DNA, 20 bp, Homo sapiens
ttctttaggtgcctcctgtc

SEQ ID NO: 2061223 - DNA, 14 bp, Homo sapiens
ttctttcaaagtgt

SEQ ID NO: 2061224 - DNA, 20 bp, Homo sapiens
ttctttcaagtgaatctaaa

SEQ ID NO: 2061225 - DNA, 22 bp, Homo sapiens
ttctttcaagtgaatctaaaag

SEQ ID NO: 2061226 - DNA, 23 bp, Homo sapiens
ttctttctcttccctccttccct

SEQ ID NO: 2061227 - DNA, 12 bp, Homo sapiens
ttctttctgaga

SEQ ID NO: 2061228 - DNA, 15 bp, Homo sapiens
ttctttcttcctctg

SEQ ID NO: 2061229 - DNA, 18 bp, Homo sapiens
ttctttcttttgtgttgg

SEQ ID NO: 2061230 - DNA, 17 bp, Homo sapiens
ttctttctttttctgga

SEQ ID NO: 2061231 - DNA, 15 bp, Homo sapiens
ttctttgaaattgtt

SEQ ID NO: 2061232 - DNA, 17 bp, Homo sapiens
ttctttgtaccatctgt

SEQ ID NO: 2061233 - DNA, 21 bp, Homo sapiens
ttcttttaaaggggcagaaaa

SEQ ID NO: 2061234 - DNA, 13 bp, Homo sapiens
ttcttttactgta

SEQ ID NO: 2061235 - DNA, 21 bp, Homo sapiens
ttcttttctggaatgtaatca

SEQ ID NO: 2061236 - DNA, 22 bp, Homo sapiens
ttcttttgtgttggatttgttt

SEQ ID NO: 2061237 - DNA, 15 bp, Homo sapiens
ttctttttattttct

SEQ ID NO: 2061238 - DNA, 15 bp, Homo sapiens
ttctttttctgtctc

SEQ ID NO: 2061239 - DNA, 15 bp, Homo sapiens
ttctttttttgcttt

SEQ ID NO: 2061240 - DNA, 13 bp, Homo sapiens
ttgaaaaagcgaa

SEQ ID NO: 2061241 - DNA, 15 bp, Homo sapiens
ttgaaaaatctagtt

SEQ ID NO: 2061242 - DNA, 22 bp, Homo sapiens
ttgaaaagactccaaagaaatg

SEQ ID NO: 2061243 - DNA, 23 bp, Homo sapiens
ttgaaaagactccaaagaaatgt

SEQ ID NO: 2061244 - DNA, 16 bp, Homo sapiens
ttgaaaagctaatgaa

SEQ ID NO: 2061245 - DNA, 18 bp, Homo sapiens
ttgaaaattcaaaaagtg

SEQ ID NO: 2061246 - DNA, 20 bp, Homo sapiens
ttgaaactgtaaatatgttt

SEQ ID NO: 2061247 - DNA, 22 bp, Homo sapiens
ttcaggagggtccccagctggt

SEQ ID NO: 2061248 - DNA, 15 bp, Homo sapiens
ttcaggcagcactga

SEQ ID NO: 2061249 - DNA, 16 bp, Homo sapiens
ttcaggcattttgttc

SEQ ID NO: 2061250 - DNA, 16 bp, Homo sapiens
ttcaggctcttctcct

SEQ ID NO: 2061251 - DNA, 21 bp, Homo sapiens
ttcaggcttctttcaaagtgt

SEQ ID NO: 2061252 - DNA, 21 bp, Homo sapiens
ttcagggaaatggagggtggg

SEQ ID NO: 2061253 - DNA, 22 bp, Homo sapiens
ttcagggaatttcaggaactag

SEQ ID NO: 2061254 - DNA, 23 bp, Homo sapiens
ttcagggccagaaggagggcaga

SEQ ID NO: 2061255 - DNA, 19 bp, Homo sapiens
ttcagggttggcccctgcc

SEQ ID NO: 2061256 - DNA, 15 bp, Homo sapiens
ttcaggtaacaggca

SEQ ID NO: 2061257 - DNA, 20 bp, Homo sapiens
ttcaggtttcttaaaaacag

SEQ ID NO: 2061258 - DNA, 15 bp, Homo sapiens
ttcaggttttgtaaa

SEQ ID NO: 2061259 - DNA, 17 bp, Homo sapiens
ttcagtaggctttatgc

SEQ ID NO: 2061260 - DNA, 20 bp, Homo sapiens
ttcagtataatttaacttca

SEQ ID NO: 2061261 - DNA, 19 bp, Homo sapiens
ttcagtattttggagaaat

SEQ ID NO: 2061262 - DNA, 21 bp, Homo sapiens
ttcagtattttggagaaatta

SEQ ID NO: 2061263 - DNA, 23 bp, Homo sapiens
ttcagtcctggtctgctcaggaa

SEQ ID NO: 2061264 - DNA, 16 bp, Homo sapiens
ttcagtgaaagcatca

SEQ ID NO: 2061265 - DNA, 13 bp, Homo sapiens
ttcagtgccttgg

SEQ ID NO: 2061266 - DNA, 18 bp, Homo sapiens
ttcagtgccttggagcag

SEQ ID NO: 2061267 - DNA, 17 bp, Homo sapiens
ttcagtggcagctgctt

SEQ ID NO: 2061268 - DNA, 14 bp, Homo sapiens
ttcataactttcat

SEQ ID NO: 2061269 - DNA, 17 bp, Homo sapiens
ttcataaggcctgccct

SEQ ID NO: 2061270 - DNA, 18 bp, Homo sapiens
ttcataaggcctgccctc

SEQ ID NO: 2061271 - DNA, 22 bp, Homo sapiens
ttcataataaactagatactgt

SEQ ID NO: 2061272 - DNA, 13 bp, Homo sapiens
ttcataattagaa

SEQ ID NO: 2061273 - DNA, 22 bp, Homo sapiens
ttcatacaaaactgttcacgtt

SEQ ID NO: 2061274 - DNA, 21 bp, Homo sapiens
ttcataggcggtcatgtgtgc

SEQ ID NO: 2061275 - DNA, 14 bp, Homo sapiens
ttcatattgtgcca

SEQ ID NO: 2061276 - DNA, 16 bp, Homo sapiens
ttcatattgtgccaat

SEQ ID NO: 2061277 - DNA, 22 bp, Homo sapiens
ttcatattgtgccaatatgtat

SEQ ID NO: 2061278 - DNA, 19 bp, Homo sapiens
ttcatcaatttttatacat

SEQ ID NO: 2061279 - DNA, 21 bp, Homo sapiens
ttcatcatgttggccaggctg

SEQ ID NO: 2061280 - DNA, 16 bp, Homo sapiens
ttcatccaaggaacct

SEQ ID NO: 2061281 - DNA, 23 bp, Homo sapiens
ttcatccagtttgttctccgggt

SEQ ID NO: 2061282 - DNA, 13 bp, Homo sapiens
ttcatcctggcct

SEQ ID NO: 2061283 - DNA, 14 bp, Homo sapiens
ttcatcctggcctc

SEQ ID NO: 2061284 - DNA, 16 bp, Homo sapiens
ttcatcctggcctcct

SEQ ID NO: 2061285 - DNA, 18 bp, Homo sapiens
ttcatcgaacaaactgat

SEQ ID NO: 2061286 - DNA, 13 bp, Homo sapiens
ttcatctactaca

SEQ ID NO: 2061287 - DNA, 14 bp, Homo sapiens
ttcatctactacag

SEQ ID NO: 2061288 - DNA, 23 bp, Homo sapiens
ttcatctatggcagtccagccag

SEQ ID NO: 2061289 - DNA, 16 bp, Homo sapiens
ttcatctatttctgag

SEQ ID NO: 2061290 - DNA, 13 bp, Homo sapiens
ttcatctcattta

SEQ ID NO: 2061291 - DNA, 16 bp, Homo sapiens
ttcatctcatttaagg

SEQ ID NO: 2061292 - DNA, 19 bp, Homo sapiens
ttcatctcatttaagggaa

SEQ ID NO: 2061293 - DNA, 23 bp, Homo sapiens
ttcatctcatttaagggaaaaat

SEQ ID NO: 2061294 - DNA, 14 bp, Homo sapiens
ttcatctccagtgt

SEQ ID NO: 2061295 - DNA, 15 bp, Homo sapiens
ttcatgataatgaac

SEQ ID NO: 2061296 - DNA, 18 bp, Homo sapiens
ttcatgatgaattacttc

SEQ ID NO: 2061297 - DNA, 17 bp, Homo sapiens
ttcatgatttcatttca

SEQ ID NO: 2061298 - DNA, 23 bp, Homo sapiens
ttcatgatttcatttcaactgtt

SEQ ID NO: 2061299 - DNA, 17 bp, Homo sapiens
ttcatgctcagccctga

SEQ ID NO: 2061300 - DNA, 16 bp, Homo sapiens
ttcatgttttgtgact

SEQ ID NO: 2061301 - DNA, 17 bp, Homo sapiens
ttcatgttttgtgacta

SEQ ID NO: 2061302 - DNA, 16 bp, Homo sapiens
ttcattaaaaatgaaa

SEQ ID NO: 2061303 - DNA, 20 bp, Homo sapiens
ttcattacaatggaaacaat

SEQ ID NO: 2061304 - DNA, 18 bp, Homo sapiens
ttcattgatatgaaaaat

SEQ ID NO: 2061305 - DNA, 16 bp, Homo sapiens
ttcattgctggagaca

SEQ ID NO: 2061306 - DNA, 14 bp, Homo sapiens
ttcatttaaaatga

SEQ ID NO: 2061307 - DNA, 16 bp, Homo sapiens
ttcatttcactttaaa

SEQ ID NO: 2061308 - DNA, 13 bp, Homo sapiens
ttcatttcatcta

SEQ ID NO: 2061309 - DNA, 15 bp, Homo sapiens
ttcatttcattgtat

SEQ ID NO: 2061310 - DNA, 13 bp, Homo sapiens
ttcatttcctcaa

SEQ ID NO: 2061311 - DNA, 20 bp, Homo sapiens
ttcatttgagttattttaat

SEQ ID NO: 2061312 - DNA, 17 bp, Homo sapiens
ttcattttagtgactgt

SEQ ID NO: 2061313 - DNA, 16 bp, Homo sapiens
ttcattttcagagtga

SEQ ID NO: 2061314 - DNA, 11 bp, Homo sapiens
ttcatttttgg

SEQ ID NO: 2061315 - DNA, 23 bp, Homo sapiens
ttcatttttttcactggagttac

SEQ ID NO: 2061316 - DNA, 21 bp, Homo sapiens
ttccaaagggcagtaaagttt

SEQ ID NO: 2061317 - DNA, 16 bp, Homo sapiens
ttccaacagacagggc

SEQ ID NO: 2061318 - DNA, 12 bp, Homo sapiens
ttccaaccccag

SEQ ID NO: 2061319 - DNA, 15 bp, Homo sapiens
ttccaaccccagctg

SEQ ID NO: 2061320 - DNA, 18 bp, Homo sapiens
ttccaaccccagctggcc

SEQ ID NO: 2061321 - DNA, 23 bp, Homo sapiens
ttccaagggtatgggaagccata

SEQ ID NO: 2061322 - DNA, 13 bp, Homo sapiens
ttccaagtaatat

SEQ ID NO: 2061323 - DNA, 11 bp, Homo sapiens
ttccaataaaa

SEQ ID NO: 2061324 - DNA, 21 bp, Homo sapiens
ttccaattttctggaatacat

SEQ ID NO: 2061325 - DNA, 13 bp, Homo sapiens
ttccacacaaaat

SEQ ID NO: 2061326 - DNA, 17 bp, Homo sapiens
ttccacacaaaatgtca

SEQ ID NO: 2061327 - DNA, 19 bp, Homo sapiens
ttccacacaaaatgtcaca

SEQ ID NO: 2061328 - DNA, 20 bp, Homo sapiens
ttccacattaattagatttt

SEQ ID NO: 2061329 - DNA, 20 bp, Homo sapiens
ttccacctgctttctcctgg

SEQ ID NO: 2061330 - DNA, 15 bp, Homo sapiens
ttccaccttcccatg

SEQ ID NO: 2061331 - DNA, 19 bp, Homo sapiens
ttccacgtccccctggggc

SEQ ID NO: 2061332 - DNA, 16 bp, Homo sapiens
ttccactcctatggaa

SEQ ID NO: 2061333 - DNA, 19 bp, Homo sapiens
ttccactgccaaaacaatg

SEQ ID NO: 2061334 - DNA, 21 bp, Homo sapiens
ttccagaaaaccccagcatcc

SEQ ID NO: 2061335 - DNA, 11 bp, Homo sapiens
ttccagaaaat

SEQ ID NO: 2061336 - DNA, 17 bp, Homo sapiens
ttccagaaaatataaat

SEQ ID NO: 2061337 - DNA, 20 bp, Homo sapiens
ttccagaaaatataaatgca

SEQ ID NO: 2061338 - DNA, 21 bp, Homo sapiens
ttccagaaaatataaatgcat

SEQ ID NO: 2061339 - DNA, 18 bp, Homo sapiens
ttccagaagatgccctcc

SEQ ID NO: 2061340 - DNA, 11 bp, Homo sapiens
ttccagaccac

SEQ ID NO: 2061341 - DNA, 14 bp, Homo sapiens
ttccagacctgaag

SEQ ID NO: 2061342 - DNA, 17 bp, Homo sapiens
ttccagacctgaagaat

SEQ ID NO: 2061343 - DNA, 17 bp, Homo sapiens
ttccagagagtggctcc

SEQ ID NO: 2061344 - DNA, 18 bp, Homo sapiens
ttccagagagtggctcct

SEQ ID NO: 2061345 - DNA, 20 bp, Homo sapiens
ttccagagagtggctcctcc

SEQ ID NO: 2061346 - DNA, 18 bp, Homo sapiens
ttccagagcactgctcca

SEQ ID NO: 2061347 - DNA, 18 bp, Homo sapiens
ttccagataaccagctgt

SEQ ID NO: 2061348 - DNA, 23 bp, Homo sapiens
ttccagataaccagctgtaacac

SEQ ID NO: 2061349 - DNA, 18 bp, Homo sapiens
ttccagattcttccactg

SEQ ID NO: 2061350 - DNA, 11 bp, Homo sapiens
ttccagctggt

SEQ ID NO: 2061351 - DNA, 20 bp, Homo sapiens
ttccaggagcacacggccct

SEQ ID NO: 2061352 - DNA, 17 bp, Homo sapiens
ttccaggagttctgaag

SEQ ID NO: 2061353 - DNA, 16 bp, Homo sapiens
ttccaggatcctgcag

SEQ ID NO: 2061354 - DNA, 14 bp, Homo sapiens
ttccaggccaccgc

SEQ ID NO: 2061355 - DNA, 11 bp, Homo sapiens
ttccaggcccc

SEQ ID NO: 2061356 - DNA, 13 bp, Homo sapiens
ttccaggcccctg

SEQ ID NO: 2061357 - DNA, 21 bp, Homo sapiens
ttccaggcccctgaggactgg

SEQ ID NO: 2061358 - DNA, 19 bp, Homo sapiens
ttccaggtatctccaggat

SEQ ID NO: 2061359 - DNA, 19 bp, Homo sapiens
ttatctgcctggcctggct

SEQ ID NO: 2061360 - DNA, 20 bp, Homo sapiens
ttatctgcctggcctggctc

SEQ ID NO: 2061361 - DNA, 20 bp, Homo sapiens
ttatctgtattttttacagt

SEQ ID NO: 2061362 - DNA, 13 bp, Homo sapiens
ttatcttactttt

SEQ ID NO: 2061363 - DNA, 14 bp, Homo sapiens
ttatcttatttaat

SEQ ID NO: 2061364 - DNA, 17 bp, Homo sapiens
ttatcttatttaatttt

SEQ ID NO: 2061365 - DNA, 20 bp, Homo sapiens
ttatcttatttaatttttgc

SEQ ID NO: 2061366 - DNA, 14 bp, Homo sapiens
ttatgaaaaagaag

SEQ ID NO: 2061367 - DNA, 21 bp, Homo sapiens
ttatgacatcacttgtacaaa

SEQ ID NO: 2061368 - DNA, 18 bp, Homo sapiens
ttatgagctcttcatgtt

SEQ ID NO: 2061369 - DNA, 20 bp, Homo sapiens
ttatgaggtgaaacaattat

SEQ ID NO: 2061370 - DNA, 15 bp, Homo sapiens
ttatgagtttttgat

SEQ ID NO: 2061371 - DNA, 21 bp, Homo sapiens
ttatgagtttttgatagcttt

SEQ ID NO: 2061372 - DNA, 21 bp, Homo sapiens
ttatgatgtgggtcaaggaat

SEQ ID NO: 2061373 - DNA, 18 bp, Homo sapiens
ttatgcaaggaaggaaag

SEQ ID NO: 2061374 - DNA, 15 bp, Homo sapiens
ttatgccttttattt

SEQ ID NO: 2061375 - DNA, 15 bp, Homo sapiens
ttatgctattaaagt

SEQ ID NO: 2061376 - DNA, 19 bp, Homo sapiens
ttatggaagattttaaatt

SEQ ID NO: 2061377 - DNA, 14 bp, Homo sapiens
ttatggcaagtgat

SEQ ID NO: 2061378 - DNA, 19 bp, Homo sapiens
ttatggcttataaatgtgt

SEQ ID NO: 2061379 - DNA, 22 bp, Homo sapiens
ttatggggtattttaagcattc

SEQ ID NO: 2061380 - DNA, 21 bp, Homo sapiens
ttatggtattttcgtgcattt

SEQ ID NO: 2061381 - DNA, 23 bp, Homo sapiens
ttatggtattttcgtgcatttgt

SEQ ID NO: 2061382 - DNA, 10 bp, Homo sapiens
ttatggtgaa

SEQ ID NO: 2061383 - DNA, 11 bp, Homo sapiens
ttatggtgaaa

SEQ ID NO: 2061384 - DNA, 17 bp, Homo sapiens
ttatgtaacatccagaa

SEQ ID NO: 2061385 - DNA, 13 bp, Homo sapiens
ttatgtagaaata

SEQ ID NO: 2061386 - DNA, 23 bp, Homo sapiens
ttatgtatatactatacaacaat

SEQ ID NO: 2061387 - DNA, 18 bp, Homo sapiens
ttatgtatatagatgtgc

SEQ ID NO: 2061388 - DNA, 17 bp, Homo sapiens
ttatgtctgtggatttt

SEQ ID NO: 2061389 - DNA, 18 bp, Homo sapiens
ttatgtgtgcatgtgtgt

SEQ ID NO: 2061390 - DNA, 22 bp, Homo sapiens
ttatgtgtgtatatgtatgtgt

SEQ ID NO: 2061391 - DNA, 12 bp, Homo sapiens
ttatgttaaaat

SEQ ID NO: 2061392 - DNA, 20 bp, Homo sapiens
ttatgttatttatatattgg

SEQ ID NO: 2061393 - DNA, 16 bp, Homo sapiens
ttatgttctcagaatc

SEQ ID NO: 2061394 - DNA, 14 bp, Homo sapiens
ttattaaaatgatt

SEQ ID NO: 2061395 - DNA, 19 bp, Homo sapiens
ttattaaaatgattgtaaa

SEQ ID NO: 2061396 - DNA, 21 bp, Homo sapiens
ttattaaaatgattgtaaaat

SEQ ID NO: 2061397 - DNA, 19 bp, Homo sapiens
ttattaaagcaacatttta

SEQ ID NO: 2061398 - DNA, 21 bp, Homo sapiens
ttattaaatctttttttaatg

SEQ ID NO: 2061399 - DNA, 24 bp, Homo sapiens
ttattaagtctgggatgtagaact

SEQ ID NO: 2061400 - DNA, 18 bp, Homo sapiens
ttattaataccaaatatt

SEQ ID NO: 2061401 - DNA, 12 bp, Homo sapiens
ttattacattta

SEQ ID NO: 2061402 - DNA, 13 bp, Homo sapiens
ttattacctctga

SEQ ID NO: 2061403 - DNA, 20 bp, Homo sapiens
ttattacttgttgcaaaggt

SEQ ID NO: 2061404 - DNA, 15 bp, Homo sapiens
ttattagttaatata

SEQ ID NO: 2061405 - DNA, 16 bp, Homo sapiens
ttattattagattctc

SEQ ID NO: 2061406 - DNA, 15 bp, Homo sapiens
ttattcaaatgaagg

SEQ ID NO: 2061407 - DNA, 23 bp, Homo sapiens
ttattcaataaaaaaaagaaatg

SEQ ID NO: 2061408 - DNA, 18 bp, Homo sapiens
ttattcaattcctctggg

SEQ ID NO: 2061409 - DNA, 19 bp, Homo sapiens
ttattcaattcctctggga

SEQ ID NO: 2061410 - DNA, 16 bp, Homo sapiens
ttattcaattctgtat

SEQ ID NO: 2061411 - DNA, 16 bp, Homo sapiens
ttattcattagctgtg

SEQ ID NO: 2061412 - DNA, 17 bp, Homo sapiens
ttattcattagctgtga

SEQ ID NO: 2061413 - DNA, 16 bp, Homo sapiens
ttattcatttaaaatg

SEQ ID NO: 2061414 - DNA, 16 bp, Homo sapiens
ttattccctgtacaat

SEQ ID NO: 2061415 - DNA, 20 bp, Homo sapiens
ttattcctatatagtttatt

SEQ ID NO: 2061416 - DNA, 22 bp, Homo sapiens
ttattgaagaaacagataccat

SEQ ID NO: 2061417 - DNA, 17 bp, Homo sapiens
ttattgatttttgtaat

SEQ ID NO: 2061418 - DNA, 22 bp, Homo sapiens
ttattgtataaactatcagttt

SEQ ID NO: 2061419 - DNA, 19 bp, Homo sapiens
ttattgtcattactgcctt

SEQ ID NO: 2061420 - DNA, 22 bp, Homo sapiens
ttattgtccccactaaaacaaa

SEQ ID NO: 2061421 - DNA, 18 bp, Homo sapiens
ttattgtccttcagagct

SEQ ID NO: 2061422 - DNA, 16 bp, Homo sapiens
ttatttaaaatagcaa

SEQ ID NO: 2061423 - DNA, 23 bp, Homo sapiens
ttatttaaaccgctaaaagaaac

SEQ ID NO: 2061424 - DNA, 14 bp, Homo sapiens
ttatttaaatctgt

SEQ ID NO: 2061425 - DNA, 12 bp, Homo sapiens
ttatttaaatga

SEQ ID NO: 2061426 - DNA, 22 bp, Homo sapiens
ttatttaaatgttgaaatctta

SEQ ID NO: 2061427 - DNA, 14 bp, Homo sapiens
ttatttaatgtttg

SEQ ID NO: 2061428 - DNA, 17 bp, Homo sapiens
ttatttacaatgcagaa

SEQ ID NO: 2061429 - DNA, 19 bp, Homo sapiens
ttatttacttgtagaaatc

SEQ ID NO: 2061430 - DNA, 22 bp, Homo sapiens
ttatttacttgtagaaatctgt

SEQ ID NO: 2061431 - DNA, 22 bp, Homo sapiens
ttatttagttgaaaaatctagt

SEQ ID NO: 2061432 - DNA, 23 bp, Homo sapiens
ttatttatggcttataaatgtgt

SEQ ID NO: 2061433 - DNA, 17 bp, Homo sapiens
ttatttattcagcttca

SEQ ID NO: 2061434 - DNA, 13 bp, Homo sapiens
ttatttatttaat

SEQ ID NO: 2061435 - DNA, 15 bp, Homo sapiens
ttatttatttatgga

SEQ ID NO: 2061436 - DNA, 18 bp, Homo sapiens
ttatttcataaacaactt

SEQ ID NO: 2061437 - DNA, 19 bp, Homo sapiens
ttatttccaaataaaatga

SEQ ID NO: 2061438 - DNA, 17 bp, Homo sapiens
ttatttccacataaagg

SEQ ID NO: 2061439 - DNA, 14 bp, Homo sapiens
ttatttccctcatc

SEQ ID NO: 2061440 - DNA, 14 bp, Homo sapiens
ttatttctaaaata

SEQ ID NO: 2061441 - DNA, 21 bp, Homo sapiens
ttatttctagcagagtgagga

SEQ ID NO: 2061442 - DNA, 15 bp, Homo sapiens
ttatttgcagagaca

SEQ ID NO: 2061443 - DNA, 13 bp, Homo sapiens
ttatttgtacagt

SEQ ID NO: 2061444 - DNA, 13 bp, Homo sapiens
ttatttgtattca

SEQ ID NO: 2061445 - DNA, 14 bp, Homo sapiens
ttattttcagtatt

SEQ ID NO: 2061446 - DNA, 16 bp, Homo sapiens
ttattttctatagctc

SEQ ID NO: 2061447 - DNA, 15 bp, Homo sapiens
ttattttgacataaa

SEQ ID NO: 2061448 - DNA, 17 bp, Homo sapiens
ttattttgacataaagt

SEQ ID NO: 2061449 - DNA, 23 bp, Homo sapiens
ttattttgccatggatgagagtc

SEQ ID NO: 2061450 - DNA, 17 bp, Homo sapiens
ttatttttagacagagt

SEQ ID NO: 2061451 - DNA, 20 bp, Homo sapiens
ttatttttatatcagcctga

SEQ ID NO: 2061452 - DNA, 16 bp, Homo sapiens
ttatttttattaaata

SEQ ID NO: 2061453 - DNA, 19 bp, Homo sapiens
ttatttttattaaataaat

SEQ ID NO: 2061454 - DNA, 19 bp, Homo sapiens
ttatttttcatattgtgcc

SEQ ID NO: 2061455 - DNA, 16 bp, Homo sapiens
ttatttttgtccctgc

SEQ ID NO: 2061456 - DNA, 16 bp, Homo sapiens
ttattttttaattatt

SEQ ID NO: 2061457 - DNA, 13 bp, Homo sapiens
ttattttttattg

SEQ ID NO: 2061458 - DNA, 14 bp, Homo sapiens
ttcaaaaacctggt

SEQ ID NO: 2061459 - DNA, 23 bp, Homo sapiens
ttcaaaaattgtgtttagatttt

SEQ ID NO: 2061460 - DNA, 16 bp, Homo sapiens
ttcaaaatggagggaa

SEQ ID NO: 2061461 - DNA, 13 bp, Homo sapiens
ttcaaacaagaat

SEQ ID NO: 2061462 - DNA, 16 bp, Homo sapiens
ttcaaaccaggatttt

SEQ ID NO: 2061463 - DNA, 15 bp, Homo sapiens
ttcaaaccatttaat

SEQ ID NO: 2061464 - DNA, 20 bp, Homo sapiens
ttcaaactgacaacctgtgc

SEQ ID NO: 2061465 - DNA, 19 bp, Homo sapiens
ttcaaactgagtaaattgg

SEQ ID NO: 2061466 - DNA, 13 bp, Homo sapiens
ttcaaagagacta

SEQ ID NO: 2061467 - DNA, 22 bp, Homo sapiens
ttcaaagagactaatagagaca

SEQ ID NO: 2061468 - DNA, 12 bp, Homo sapiens
ttcaaagctgag

SEQ ID NO: 2061469 - DNA, 22 bp, Homo sapiens
ttcaaagctttttccagaggct

SEQ ID NO: 2061470 - DNA, 21 bp, Homo sapiens
ttcaaagttgtagttcttgtg

SEQ ID NO: 2061471 - DNA, 16 bp, Homo sapiens
ttcaaatgaacacgtg

SEQ ID NO: 2061472 - DNA, 14 bp, Homo sapiens
ttcaaatgcatttt

SEQ ID NO: 2061473 - DNA, 17 bp, Homo sapiens
tagcaatgtaacattaa

SEQ ID NO: 2061474 - DNA, 18 bp, Homo sapiens
tagcacaaactttaaatt

SEQ ID NO: 2061475 - DNA, 16 bp, Homo sapiens
tagcacaatttatatt

SEQ ID NO: 2061476 - DNA, 23 bp, Homo sapiens
tagcagaaaccaagtctacttca

SEQ ID NO: 2061477 - DNA, 19 bp, Homo sapiens
tagcagagaatgaaagggc

SEQ ID NO: 2061478 - DNA, 22 bp, Homo sapiens
tagcagagtgaggatgtgtttt

SEQ ID NO: 2061479 - DNA, 12 bp, Homo sapiens
tagcagataaag

SEQ ID NO: 2061480 - DNA, 19 bp, Homo sapiens
tagcagataaagacagctg

SEQ ID NO: 2061481 - DNA, 23 bp, Homo sapiens
tagcagataaagacagctgacag

SEQ ID NO: 2061482 - DNA, 20 bp, Homo sapiens
tagcagcaaaaatataaaat

SEQ ID NO: 2061483 - DNA, 21 bp, Homo sapiens
tagcagcaaaaatataaaata

SEQ ID NO: 2061484 - DNA, 20 bp, Homo sapiens
tagcagctcttcccctttcc

SEQ ID NO: 2061485 - DNA, 13 bp, Homo sapiens
tagcaggaaatag

SEQ ID NO: 2061486 - DNA, 15 bp, Homo sapiens
tagcaggcacaggac

SEQ ID NO: 2061487 - DNA, 20 bp, Homo sapiens
tagcagggcatggctgggaa

SEQ ID NO: 2061488 - DNA, 22 bp, Homo sapiens
tagcatgcctccaaaaattcac

SEQ ID NO: 2061489 - DNA, 17 bp, Homo sapiens
tagcatggactctgggt

SEQ ID NO: 2061490 - DNA, 13 bp, Homo sapiens
tagcattgaacat

SEQ ID NO: 2061491 - DNA, 18 bp, Homo sapiens
tagcattgaacatttctt

SEQ ID NO: 2061492 - DNA, 14 bp, Homo sapiens
tagcatttttgatt

SEQ ID NO: 2061493 - DNA, 16 bp, Homo sapiens
tagccaaaaatagcta

SEQ ID NO: 2061494 - DNA, 17 bp, Homo sapiens
tagccaagttatattga

SEQ ID NO: 2061495 - DNA, 19 bp, Homo sapiens
tagccacatccctttgaaa

SEQ ID NO: 2061496 - DNA, 13 bp, Homo sapiens
tagccacctccca

SEQ ID NO: 2061497 - DNA, 14 bp, Homo sapiens
tagccacctcccac

SEQ ID NO: 2061498 - DNA, 19 bp, Homo sapiens
tagccactggtttctcaga

SEQ ID NO: 2061499 - DNA, 16 bp, Homo sapiens
tagccacttaccttca

SEQ ID NO: 2061500 - DNA, 17 bp, Homo sapiens
tagccacttaccttcaa

SEQ ID NO: 2061501 - DNA, 19 bp, Homo sapiens
tagccagagaggagcacct

SEQ ID NO: 2061502 - DNA, 20 bp, Homo sapiens
tagccagagaggagcacctg

SEQ ID NO: 2061503 - DNA, 20 bp, Homo sapiens
tagccagagggtgggagcct

SEQ ID NO: 2061504 - DNA, 19 bp, Homo sapiens
tagccaggagtctgtgctc

SEQ ID NO: 2061505 - DNA, 21 bp, Homo sapiens
tagccaggagtctgtgctctt

SEQ ID NO: 2061506 - DNA, 15 bp, Homo sapiens
tagccatggctcagg

SEQ ID NO: 2061507 - DNA, 20 bp, Homo sapiens
tagccatggctcaggcaagc

SEQ ID NO: 2061508 - DNA, 13 bp, Homo sapiens
tagcccagcactg

SEQ ID NO: 2061509 - DNA, 15 bp, Homo sapiens
tagcccagcactgtg

SEQ ID NO: 2061510 - DNA, 19 bp, Homo sapiens
tagcccaggtcctctgata

SEQ ID NO: 2061511 - DNA, 17 bp, Homo sapiens
tagccccagtgacagct

SEQ ID NO: 2061512 - DNA, 18 bp, Homo sapiens
tagcccggccagggcctg

SEQ ID NO: 2061513 - DNA, 13 bp, Homo sapiens
tagccctccctgg

SEQ ID NO: 2061514 - DNA, 22 bp, Homo sapiens
tagccctccctggcatgtcaga

SEQ ID NO: 2061515 - DNA, 13 bp, Homo sapiens
tagccctttctgt

SEQ ID NO: 2061516 - DNA, 15 bp, Homo sapiens
tagccctttctgtgt

SEQ ID NO: 2061517 - DNA, 13 bp, Homo sapiens
tagccgacctcag

SEQ ID NO: 2061518 - DNA, 15 bp, Homo sapiens
tagccgacctcagcc

SEQ ID NO: 2061519 - DNA, 16 bp, Homo sapiens
tagccgacctcagcct

SEQ ID NO: 2061520 - DNA, 17 bp, Homo sapiens
tagccgacctcagcctt

SEQ ID NO: 2061521 - DNA, 15 bp, Homo sapiens
ttagctgtctgctca

SEQ ID NO: 2061522 - DNA, 15 bp, Homo sapiens
ttagctgtgtgaaat

SEQ ID NO: 2061523 - DNA, 17 bp, Homo sapiens
ttagctgttatttctat

SEQ ID NO: 2061524 - DNA, 13 bp, Homo sapiens
ttagctttaactt

SEQ ID NO: 2061525 - DNA, 14 bp, Homo sapiens
ttaggaaacctggc

SEQ ID NO: 2061526 - DNA, 11 bp, Homo sapiens
ttaggaaataa

SEQ ID NO: 2061527 - DNA, 12 bp, Homo sapiens
ttaggaaataaa

SEQ ID NO: 2061528 - DNA, 17 bp, Homo sapiens
ttaggaaataaaacctt

SEQ ID NO: 2061529 - DNA, 18 bp, Homo sapiens
ttaggaaataaaaccttt

SEQ ID NO: 2061530 - DNA, 21 bp, Homo sapiens
ttaggaaataaaacctttcaa

SEQ ID NO: 2061531 - DNA, 20 bp, Homo sapiens
ttaggaggctgcatgctctg

SEQ ID NO: 2061532 - DNA, 20 bp, Homo sapiens
ttaggatagaatatttacaa

SEQ ID NO: 2061533 - DNA, 16 bp, Homo sapiens
ttaggatctatgcaat

SEQ ID NO: 2061534 - DNA, 13 bp, Homo sapiens
ttaggcagcctgc

SEQ ID NO: 2061535 - DNA, 14 bp, Homo sapiens
ttaggcatgcctaa

SEQ ID NO: 2061536 - DNA, 16 bp, Homo sapiens
ttaggcattatttaat

SEQ ID NO: 2061537 - DNA, 20 bp, Homo sapiens
ttaggcattatttaatgttt

SEQ ID NO: 2061538 - DNA, 18 bp, Homo sapiens
ttaggcttttaagaaaca

SEQ ID NO: 2061539 - DNA, 12 bp, Homo sapiens
ttagggaggggt

SEQ ID NO: 2061540 - DNA, 15 bp, Homo sapiens
ttagggccaggcagg

SEQ ID NO: 2061541 - DNA, 19 bp, Homo sapiens
ttaggggaagtatgtgtgg

SEQ ID NO: 2061542 - DNA, 12 bp, Homo sapiens
ttaggttaacat

SEQ ID NO: 2061543 - DNA, 19 bp, Homo sapiens
ttaggtttttttgtatagt

SEQ ID NO: 2061544 - DNA, 18 bp, Homo sapiens
ttagtaaagtcaaggaga

SEQ ID NO: 2061545 - DNA, 15 bp, Homo sapiens
ttagtatcctgttag

SEQ ID NO: 2061546 - DNA, 15 bp, Homo sapiens
ttagtatctaacatg

SEQ ID NO: 2061547 - DNA, 18 bp, Homo sapiens
ttagtatctaacatgtat

SEQ ID NO: 2061548 - DNA, 14 bp, Homo sapiens
ttagtgcctgtgtg

SEQ ID NO: 2061549 - DNA, 16 bp, Homo sapiens
ttagtgctttacatgc

SEQ ID NO: 2061550 - DNA, 15 bp, Homo sapiens
ttagtgtgtgtgcat

SEQ ID NO: 2061551 - DNA, 16 bp, Homo sapiens
ttagtgtgtgtgcatg

SEQ ID NO: 2061552 - DNA, 22 bp, Homo sapiens
ttagtgtgtgtgcatgtgtgtg

SEQ ID NO: 2061553 - DNA, 18 bp, Homo sapiens
ttagtgtgttgtctgtgc

SEQ ID NO: 2061554 - DNA, 17 bp, Homo sapiens
ttagttaggtgtgccaa

SEQ ID NO: 2061555 - DNA, 15 bp, Homo sapiens
ttagttatagtttca

SEQ ID NO: 2061556 - DNA, 22 bp, Homo sapiens
ttagttatagtttcagatatat

SEQ ID NO: 2061557 - DNA, 19 bp, Homo sapiens
ttagtttgatttaatatct

SEQ ID NO: 2061558 - DNA, 14 bp, Homo sapiens
ttagttttctttgt

SEQ ID NO: 2061559 - DNA, 12 bp, Homo sapiens
ttataaaaatac

SEQ ID NO: 2061560 - DNA, 15 bp, Homo sapiens
ttataaaattatttt

SEQ ID NO: 2061561 - DNA, 15 bp, Homo sapiens
ttataaatatattta

SEQ ID NO: 2061562 - DNA, 17 bp, Homo sapiens
ttataaatccaaagtaa

SEQ ID NO: 2061563 - DNA, 21 bp, Homo sapiens
ttataaatgtgtattctggct

SEQ ID NO: 2061564 - DNA, 16 bp, Homo sapiens
ttataactcatcataa

SEQ ID NO: 2061565 - DNA, 19 bp, Homo sapiens
ttataactcatcataaaat

SEQ ID NO: 2061566 - DNA, 17 bp, Homo sapiens
ttataacttaaaatatt

SEQ ID NO: 2061567 - DNA, 11 bp, Homo sapiens
ttataagaatt

SEQ ID NO: 2061568 - DNA, 18 bp, Homo sapiens
ttataagaattaatctta

SEQ ID NO: 2061569 - DNA, 13 bp, Homo sapiens
ttataatatacta

SEQ ID NO: 2061570 - DNA, 13 bp, Homo sapiens
ttataatgggtaa

SEQ ID NO: 2061571 - DNA, 18 bp, Homo sapiens
ttataatgtggatttcct

SEQ ID NO: 2061572 - DNA, 23 bp, Homo sapiens
ttataatgtggatttcctatttt

SEQ ID NO: 2061573 - DNA, 21 bp, Homo sapiens
ttataatttttttattactga

SEQ ID NO: 2061574 - DNA, 16 bp, Homo sapiens
ttataatttttttcaa

SEQ ID NO: 2061575 - DNA, 13 bp, Homo sapiens
ttatacaaaataa

SEQ ID NO: 2061576 - DNA, 20 bp, Homo sapiens
ttatacaaaataatttaact

SEQ ID NO: 2061577 - DNA, 12 bp, Homo sapiens
ttatacatagtc

SEQ ID NO: 2061578 - DNA, 17 bp, Homo sapiens
ttatacatagtcacaaa

SEQ ID NO: 2061579 - DNA, 21 bp, Homo sapiens
ttatacatagtcacaaaaatg

SEQ ID NO: 2061580 - DNA, 15 bp, Homo sapiens
ttatacatatcagaa

SEQ ID NO: 2061581 - DNA, 20 bp, Homo sapiens
ttatacatatcagaaaagta

SEQ ID NO: 2061582 - DNA, 16 bp, Homo sapiens
ttatactcaaaattca

SEQ ID NO: 2061583 - DNA, 17 bp, Homo sapiens
ttatactccatacataa

SEQ ID NO: 2061584 - DNA, 14 bp, Homo sapiens
ttatagaatacttt

SEQ ID NO: 2061585 - DNA, 15 bp, Homo sapiens
ttatagaatactttt

SEQ ID NO: 2061586 - DNA, 17 bp, Homo sapiens
ttatagctattactgtc

SEQ ID NO: 2061587 - DNA, 16 bp, Homo sapiens
ttataggatcatttgt

SEQ ID NO: 2061588 - DNA, 18 bp, Homo sapiens
ttataggatttatttaaa

SEQ ID NO: 2061589 - DNA, 24 bp, Homo sapiens
ttataggatttatttaaaatagca

SEQ ID NO: 2061590 - DNA, 17 bp, Homo sapiens
ttataggtcacatatgt

SEQ ID NO: 2061591 - DNA, 20 bp, Homo sapiens
ttatagtttgctttgctttt

SEQ ID NO: 2061592 - DNA, 12 bp, Homo sapiens
ttatagtttgta

SEQ ID NO: 2061593 - DNA, 15 bp, Homo sapiens
ttatagtttgtacat

SEQ ID NO: 2061594 - DNA, 14 bp, Homo sapiens
ttatatatatatgt

SEQ ID NO: 2061595 - DNA, 16 bp, Homo sapiens
ttatatatcataaagt

SEQ ID NO: 2061596 - DNA, 15 bp, Homo sapiens
ttatatatggcatat

SEQ ID NO: 2061597 - DNA, 14 bp, Homo sapiens
ttatatatgtattt

SEQ ID NO: 2061598 - DNA, 13 bp, Homo sapiens
ttatatatttata

SEQ ID NO: 2061599 - DNA, 15 bp, Homo sapiens
ttatatatttataac

SEQ ID NO: 2061600 - DNA, 18 bp, Homo sapiens
ttatatctaatttataca

SEQ ID NO: 2061601 - DNA, 15 bp, Homo sapiens
ttatatctatagtag

SEQ ID NO: 2061602 - DNA, 22 bp, Homo sapiens
ttatatctgtggtcttcaaatt

SEQ ID NO: 2061603 - DNA, 18 bp, Homo sapiens
ttatatgagagaatcaca

SEQ ID NO: 2061604 - DNA, 18 bp, Homo sapiens
ttatattagagtgccctt

SEQ ID NO: 2061605 - DNA, 14 bp, Homo sapiens
ttatattatgtagt

SEQ ID NO: 2061606 - DNA, 23 bp, Homo sapiens
ttatattcagagatgtaccatgt

SEQ ID NO: 2061607 - DNA, 15 bp, Homo sapiens
ttatattctttaaat

SEQ ID NO: 2061608 - DNA, 17 bp, Homo sapiens
ttatattgaatatatca

SEQ ID NO: 2061609 - DNA, 17 bp, Homo sapiens
ttatattgtatattctg

SEQ ID NO: 2061610 - DNA, 17 bp, Homo sapiens
ttatatttagttatagt

SEQ ID NO: 2061611 - DNA, 15 bp, Homo sapiens
ttatatttttataga

SEQ ID NO: 2061612 - DNA, 15 bp, Homo sapiens
ttatcaaaactttct

SEQ ID NO: 2061613 - DNA, 18 bp, Homo sapiens
ttatcaaacttgtgctga

SEQ ID NO: 2061614 - DNA, 12 bp, Homo sapiens
ttatcacatcaa

SEQ ID NO: 2061615 - DNA, 17 bp, Homo sapiens
ttatcagccatgtttgg

SEQ ID NO: 2061616 - DNA, 22 bp, Homo sapiens
ttatcagctacttaagagaaat

SEQ ID NO: 2061617 - DNA, 16 bp, Homo sapiens
ttatcagtgacagagt

SEQ ID NO: 2061618 - DNA, 17 bp, Homo sapiens
ttatcagtgacagagtt

SEQ ID NO: 2061619 - DNA, 19 bp, Homo sapiens
ttatcagtgcttaatgtga

SEQ ID NO: 2061620 - DNA, 17 bp, Homo sapiens
ttatcagttaacattaa

SEQ ID NO: 2061621 - DNA, 13 bp, Homo sapiens
ttatcatgctgtc

SEQ ID NO: 2061622 - DNA, 12 bp, Homo sapiens
ttatcattttca

SEQ ID NO: 2061623 - DNA, 12 bp, Homo sapiens
ttatccaggact

SEQ ID NO: 2061624 - DNA, 16 bp, Homo sapiens
ttatcctgaaatttca

SEQ ID NO: 2061625 - DNA, 17 bp, Homo sapiens
ttatcctgaaatttcag

SEQ ID NO: 2061626 - DNA, 24 bp, Homo sapiens
ttatccttttttaaaagtaaatgt

SEQ ID NO: 2061627 - DNA, 19 bp, Homo sapiens
ttatcgggagcagtgtctt

SEQ ID NO: 2061628 - DNA, 11 bp, Homo sapiens
ttatctctgta

SEQ ID NO: 2061629 - DNA, 20 bp, Homo sapiens
ttatctgaatataggaagca

SEQ ID NO: 2061630 - DNA, 20 bp, Homo sapiens
ttatctgaatttttaaacaa

SEQ ID NO: 2061631 - DNA, 16 bp, Homo sapiens
aaaaatttgtttaaag

SEQ ID NO: 2061632 - DNA, 14 bp, Homo sapiens
aaaacaaaaataaa

SEQ ID NO: 2061633 - DNA, 15 bp, Homo sapiens
aaaacaaatcactgt

SEQ ID NO: 2061634 - DNA, 14 bp, Homo sapiens
aaaacaaatcttca

SEQ ID NO: 2061635 - DNA, 18 bp, Homo sapiens
aaaacacagcaagggtga

SEQ ID NO: 2061636 - DNA, 21 bp, Homo sapiens
aaaacaccaccaaatgacaag

SEQ ID NO: 2061637 - DNA, 17 bp, Homo sapiens
aaaacagcccaggtcct

SEQ ID NO: 2061638 - DNA, 12 bp, Homo sapiens
aaaacaggaaaa

SEQ ID NO: 2061639 - DNA, 13 bp, Homo sapiens
aaaacaggaaaaa

SEQ ID NO: 2061640 - DNA, 14 bp, Homo sapiens
aaaacataatatct

SEQ ID NO: 2061641 - DNA, 11 bp, Homo sapiens
aaaacatatca

SEQ ID NO: 2061642 - DNA, 16 bp, Homo sapiens
aaaacatatcaattca

SEQ ID NO: 2061643 - DNA, 20 bp, Homo sapiens
aaaacatatcaattcaacac

SEQ ID NO: 2061644 - DNA, 23 bp, Homo sapiens
aaaacatatcaattcaacacatt

SEQ ID NO: 2061645 - DNA, 13 bp, Homo sapiens
aaaacatgagaaa

SEQ ID NO: 2061646 - DNA, 21 bp, Homo sapiens
aaaacatgagaaatgtgaact

SEQ ID NO: 2061647 - DNA, 16 bp, Homo sapiens
aaaacatggtagaatt

SEQ ID NO: 2061648 - DNA, 13 bp, Homo sapiens
aaaacattcatcc

SEQ ID NO: 2061649 - DNA, 12 bp, Homo sapiens
aaaacatttatt

SEQ ID NO: 2061650 - DNA, 22 bp, Homo sapiens
aaaacatttattttgacataaa

SEQ ID NO: 2061651 - DNA, 21 bp, Homo sapiens
aaaacatttgtacattcctga

SEQ ID NO: 2061652 - DNA, 13 bp, Homo sapiens
aaaaccaaataag

SEQ ID NO: 2061653 - DNA, 12 bp, Homo sapiens
aaaaccacagca

SEQ ID NO: 2061654 - DNA, 21 bp, Homo sapiens
aaaaccagaatcataattttc

SEQ ID NO: 2061655 - DNA, 22 bp, Homo sapiens
aaaaccatgcagcttcatcaat

SEQ ID NO: 2061656 - DNA, 22 bp, Homo sapiens
aaaacctcacccgaggctgccc

SEQ ID NO: 2061657 - DNA, 14 bp, Homo sapiens
aaaacctgtcaatg

SEQ ID NO: 2061658 - DNA, 17 bp, Homo sapiens
aaaacctgtcaatgata

SEQ ID NO: 2061659 - DNA, 13 bp, Homo sapiens
aaaaccttgattt

SEQ ID NO: 2061660 - DNA, 20 bp, Homo sapiens
aaaacctttccccagacaca

SEQ ID NO: 2061661 - DNA, 17 bp, Homo sapiens
aaaacgcaaagggctga

SEQ ID NO: 2061662 - DNA, 13 bp, Homo sapiens
aaaacgtgggtat

SEQ ID NO: 2061663 - DNA, 17 bp, Homo sapiens
aaaactatccaattaaa

SEQ ID NO: 2061664 - DNA, 12 bp, Homo sapiens
aaaactatggtt

SEQ ID NO: 2061665 - DNA, 15 bp, Homo sapiens
aaaactgacagagga

SEQ ID NO: 2061666 - DNA, 17 bp, Homo sapiens
aaaactgatcaaaaata

SEQ ID NO: 2061667 - DNA, 12 bp, Homo sapiens
aaaactggaaat

SEQ ID NO: 2061668 - DNA, 17 bp, Homo sapiens
aaaactggaaatctgga

SEQ ID NO: 2061669 - DNA, 21 bp, Homo sapiens
aaaactggaataagaagcaaa

SEQ ID NO: 2061670 - DNA, 15 bp, Homo sapiens
aaaacttcagaaaaa

SEQ ID NO: 2061671 - DNA, 13 bp, Homo sapiens
aaaactttaaagc

SEQ ID NO: 2061672 - DNA, 17 bp, Homo sapiens
aaaagaaaaccatttta

SEQ ID NO: 2061673 - DNA, 12 bp, Homo sapiens
aaaagaagaagt

SEQ ID NO: 2061674 - DNA, 14 bp, Homo sapiens
aaaagaagaagttt

SEQ ID NO: 2061675 - DNA, 16 bp, Homo sapiens
aaaagaagagccttgt

SEQ ID NO: 2061676 - DNA, 14 bp, Homo sapiens
aaaagaatattcag

SEQ ID NO: 2061677 - DNA, 16 bp, Homo sapiens
aaaagactcagtgttc

SEQ ID NO: 2061678 - DNA, 16 bp, Homo sapiens
aaaagagaaaaaccaa

SEQ ID NO: 2061679 - DNA, 20 bp, Homo sapiens
aaaagataaagatgatctac

SEQ ID NO: 2061680 - DNA, 17 bp, Homo sapiens
aaaagatgaaaatattt

SEQ ID NO: 2061681 - DNA, 18 bp, Homo sapiens
aaaagattaaaattagtg

SEQ ID NO: 2061682 - DNA, 17 bp, Homo sapiens
aaaagattatatatcat

SEQ ID NO: 2061683 - DNA, 12 bp, Homo sapiens
aaaagcaagact

SEQ ID NO: 2061684 - DNA, 18 bp, Homo sapiens
aaaagcaattatattgtc

SEQ ID NO: 2061685 - DNA, 16 bp, Homo sapiens
aaaagcctctggtgga

SEQ ID NO: 2061686 - DNA, 14 bp, Homo sapiens
aaaagctcatattt

SEQ ID NO: 2061687 - DNA, 18 bp, Homo sapiens
aaaagctcatattttgta

SEQ ID NO: 2061688 - DNA, 20 bp, Homo sapiens
aaaagctctctttggaatga

SEQ ID NO: 2061689 - DNA, 19 bp, Homo sapiens
aaaagctgaagcctattta

SEQ ID NO: 2061690 - DNA, 11 bp, Homo sapiens
aaaaggagaga

SEQ ID NO: 2061691 - DNA, 18 bp, Homo sapiens
aaaaggccagtggaaatt

SEQ ID NO: 2061692 - DNA, 14 bp, Homo sapiens
aaaaggcctggggt

SEQ ID NO: 2061693 - DNA, 14 bp, Homo sapiens
aaaagggcagccag

SEQ ID NO: 2061694 - DNA, 20 bp, Homo sapiens
aaaaggttcttcatcccttt

SEQ ID NO: 2061695 - DNA, 20 bp, Homo sapiens
aaaaggtttatgaaaaagaa

SEQ ID NO: 2061696 - DNA, 11 bp, Homo sapiens
aaaagtaaaca

SEQ ID NO: 2061697 - DNA, 23 bp, Homo sapiens
aaaagtaagtaccactcaggcca

SEQ ID NO: 2061698 - DNA, 14 bp, Homo sapiens
aaaagtaccataga

SEQ ID NO: 2061699 - DNA, 18 bp, Homo sapiens
aaaagtagaattatatct

SEQ ID NO: 2061700 - DNA, 19 bp, Homo sapiens
aaaagtagaattatatcta

SEQ ID NO: 2061701 - DNA, 20 bp, Homo sapiens
aaaagtatacttttgtttca

SEQ ID NO: 2061702 - DNA, 19 bp, Homo sapiens
aaaagtcagactgctggga

SEQ ID NO: 2061703 - DNA, 14 bp, Homo sapiens
aaaagtgactctca

SEQ ID NO: 2061704 - DNA, 14 bp, Homo sapiens
aaaagtgcaatgcg

SEQ ID NO: 2061705 - DNA, 17 bp, Homo sapiens
aaaagtgcttagaaagt

SEQ ID NO: 2061706 - DNA, 20 bp, Homo sapiens
aaaagtggggctaaatgaag

SEQ ID NO: 2061707 - DNA, 13 bp, Homo sapiens
aaaagtgtttatt

SEQ ID NO: 2061708 - DNA, 22 bp, Homo sapiens
aaaagtttacaagtgtatatca

SEQ ID NO: 2061709 - DNA, 18 bp, Homo sapiens
aaaagtttcaatgtgatt

SEQ ID NO: 2061710 - DNA, 17 bp, Homo sapiens
aaaagtttgccagaagt

SEQ ID NO: 2061711 - DNA, 18 bp, Homo sapiens
aaaataaaaacataaaat

SEQ ID NO: 2061712 - DNA, 15 bp, Homo sapiens
aaaataaaaaccaga

SEQ ID NO: 2061713 - DNA, 20 bp, Homo sapiens
aaaataaaccaaaggacatt

SEQ ID NO: 2061714 - DNA, 15 bp, Homo sapiens
aaaataaactagttt

SEQ ID NO: 2061715 - DNA, 12 bp, Homo sapiens
aaaataaagcct

SEQ ID NO: 2061716 - DNA, 19 bp, Homo sapiens
aaaataaagctactgaatt

SEQ ID NO: 2061717 - DNA, 22 bp, Homo sapiens
aaaataaatataattgggattt

SEQ ID NO: 2061718 - DNA, 15 bp, Homo sapiens
aaaataaatggaaat

SEQ ID NO: 2061719 - DNA, 17 bp, Homo sapiens
aaaataatagccatcct

SEQ ID NO: 2061720 - DNA, 15 bp, Homo sapiens
aaaataatgtaaggg

SEQ ID NO: 2061721 - DNA, 22 bp, Homo sapiens
aaaataattgatttcaagacct

SEQ ID NO: 2061722 - DNA, 16 bp, Homo sapiens
aaaataatttaactaa

SEQ ID NO: 2061723 - DNA, 20 bp, Homo sapiens
aaaataatttaactaattta

SEQ ID NO: 2061724 - DNA, 19 bp, Homo sapiens
aaaataattttaaacaaag

SEQ ID NO: 2061725 - DNA, 13 bp, Homo sapiens
aaaatacagtaaa

SEQ ID NO: 2061726 - DNA, 10 bp, Homo sapiens
aaaatacatg

SEQ ID NO: 2061727 - DNA, 13 bp, Homo sapiens
aaaatacatttta

SEQ ID NO: 2061728 - DNA, 14 bp, Homo sapiens
aaaatacattttat

SEQ ID NO: 2061729 - DNA, 19 bp, Homo sapiens
aaaatactatgaaatgaaa

SEQ ID NO: 2061730 - DNA, 21 bp, Homo sapiens
aaaatactatgaaatgaaaga

SEQ ID NO: 2061731 - DNA, 15 bp, Homo sapiens
aaaatagaagctgta

SEQ ID NO: 2061732 - DNA, 21 bp, Homo sapiens
aaaatagcaacactctatatt

SEQ ID NO: 2061733 - DNA, 10 bp, Homo sapiens
aaaatagcca

SEQ ID NO: 2061734 - DNA, 20 bp, Homo sapiens
aaaatagctaaatacctcaa

SEQ ID NO: 2061735 - DNA, 19 bp, Homo sapiens
aaaatagcttgtatagtgt

SEQ ID NO: 2061736 - DNA, 18 bp, Homo sapiens
aaaataggtatacagtgg

SEQ ID NO: 2061737 - DNA, 16 bp, Homo sapiens
aaaatagttgtccata

SEQ ID NO: 2061738 - DNA, 13 bp, Homo sapiens
aaaatagtttgga

SEQ ID NO: 2061739 - DNA, 10 bp, Homo sapiens
aaaatataaa

SEQ ID NO: 2061740 - DNA, 22 bp, Homo sapiens
aaaatataaaatagttgtccat

SEQ ID NO: 2061741 - DNA, 20 bp, Homo sapiens
aaaatataaatgcatgattt

SEQ ID NO: 2061742 - DNA, 19 bp, Homo sapiens
aaaatatatatatatattt

SEQ ID NO: 2061743 - DNA, 18 bp, Homo sapiens
aaaatatatatgtgcagt

SEQ ID NO: 2061744 - DNA, 14 bp, Homo sapiens
aaaatatcctcagg

SEQ ID NO: 2061745 - DNA, 22 bp, Homo sapiens
aaaatatctgacatcttattta

SEQ ID NO: 2061746 - DNA, 20 bp, Homo sapiens
aaaatatggaacttctaata

SEQ ID NO: 2061747 - DNA, 11 bp, Homo sapiens
aaaatatgtat

SEQ ID NO: 2061748 - DNA, 22 bp, Homo sapiens
aaaatatgtatgtctaattgag

SEQ ID NO: 2061749 - DNA, 14 bp, Homo sapiens
aaagtacatttaat

SEQ ID NO: 2061750 - DNA, 23 bp, Homo sapiens
aaagtagaattatatctaattta

SEQ ID NO: 2061751 - DNA, 19 bp, Homo sapiens
aaagtagagaagtatccaa

SEQ ID NO: 2061752 - DNA, 22 bp, Homo sapiens
aaagtagcaaccttcattttac

SEQ ID NO: 2061753 - DNA, 23 bp, Homo sapiens
aaagtagcaaccttcattttaca

SEQ ID NO: 2061754 - DNA, 20 bp, Homo sapiens
aaagtaggaactcttaagca

SEQ ID NO: 2061755 - DNA, 22 bp, Homo sapiens
aaagtatacttttgtttcaggg

SEQ ID NO: 2061756 - DNA, 14 bp, Homo sapiens
aaagtatatattta

SEQ ID NO: 2061757 - DNA, 15 bp, Homo sapiens
aaagtatatatttat

SEQ ID NO: 2061758 - DNA, 20 bp, Homo sapiens
aaagtcaaaaggtgcctgtg

SEQ ID NO: 2061759 - DNA, 19 bp, Homo sapiens
aaagtcaacaaccatgcca

SEQ ID NO: 2061760 - DNA, 14 bp, Homo sapiens
aaagtcacacagac

SEQ ID NO: 2061761 - DNA, 15 bp, Homo sapiens
aaagtcacacagaca

SEQ ID NO: 2061762 - DNA, 12 bp, Homo sapiens
aaagtctaaagt

SEQ ID NO: 2061763 - DNA, 23 bp, Homo sapiens
aaagtctgtgtgatgaactttct

SEQ ID NO: 2061764 - DNA, 14 bp, Homo sapiens
aaagtcttgttaat

SEQ ID NO: 2061765 - DNA, 16 bp, Homo sapiens
aaagtgaataaacttc

SEQ ID NO: 2061766 - DNA, 21 bp, Homo sapiens
aaagtgataatttctggaatt

SEQ ID NO: 2061767 - DNA, 20 bp, Homo sapiens
aaagtgatctgtcccctctc

SEQ ID NO: 2061768 - DNA, 14 bp, Homo sapiens
aaagtgcaatgcgt

SEQ ID NO: 2061769 - DNA, 16 bp, Homo sapiens
aaagtgccagaaagtg

SEQ ID NO: 2061770 - DNA, 22 bp, Homo sapiens
aaagtgccagtttgcttagttc

SEQ ID NO: 2061771 - DNA, 12 bp, Homo sapiens
aaagtgccctca

SEQ ID NO: 2061772 - DNA, 11 bp, Homo sapiens
aaagtgctggg

SEQ ID NO: 2061773 - DNA, 18 bp, Homo sapiens
aaagtggaatcactgtat

SEQ ID NO: 2061774 - DNA, 16 bp, Homo sapiens
aaagtggctaattcaa

SEQ ID NO: 2061775 - DNA, 22 bp, Homo sapiens
aaagtggctaattcaatttatg

SEQ ID NO: 2061776 - DNA, 21 bp, Homo sapiens
aaagtggctcttctaacctca

SEQ ID NO: 2061777 - DNA, 23 bp, Homo sapiens
aaagtggctcttctaacctcagc

SEQ ID NO: 2061778 - DNA, 15 bp, Homo sapiens
aaagtgtaaaataga

SEQ ID NO: 2061779 - DNA, 20 bp, Homo sapiens
aaagtgttattatttggcat

SEQ ID NO: 2061780 - DNA, 21 bp, Homo sapiens
aaagtgttattatttggcatg

SEQ ID NO: 2061781 - DNA, 19 bp, Homo sapiens
aaagtgttggctaatgaag

SEQ ID NO: 2061782 - DNA, 18 bp, Homo sapiens
aaagtgtttatttttcat

SEQ ID NO: 2061783 - DNA, 13 bp, Homo sapiens
aaagtgtttgcct

SEQ ID NO: 2061784 - DNA, 14 bp, Homo sapiens
aaagttagctgagc

SEQ ID NO: 2061785 - DNA, 18 bp, Homo sapiens
aaagttaggttataagaa

SEQ ID NO: 2061786 - DNA, 23 bp, Homo sapiens
aaagttagtgtgttgtctgtgca

SEQ ID NO: 2061787 - DNA, 23 bp, Homo sapiens
aaagttatgagggtcagggcagt

SEQ ID NO: 2061788 - DNA, 19 bp, Homo sapiens
aaagttattgtgatatcct

SEQ ID NO: 2061789 - DNA, 18 bp, Homo sapiens
aaagttattgtgttgcct

SEQ ID NO: 2061790 - DNA, 18 bp, Homo sapiens
aaagttcaacatgttatt

SEQ ID NO: 2061791 - DNA, 20 bp, Homo sapiens
aaagttgataaagatttttt

SEQ ID NO: 2061792 - DNA, 18 bp, Homo sapiens
aaagttgctttgttatta

SEQ ID NO: 2061793 - DNA, 13 bp, Homo sapiens
aaagtttaaaaaa

SEQ ID NO: 2061794 - DNA, 15 bp, Homo sapiens
aaagtttaaaaaata

SEQ ID NO: 2061795 - DNA, 16 bp, Homo sapiens
aaagtttaaaaaatac

SEQ ID NO: 2061796 - DNA, 15 bp, Homo sapiens
aaagtttaataaatt

SEQ ID NO: 2061797 - DNA, 21 bp, Homo sapiens
aaagtttacagtaaataaatt

SEQ ID NO: 2061798 - DNA, 22 bp, Homo sapiens
aaagtttacagtaaataaattg

SEQ ID NO: 2061799 - DNA, 15 bp, Homo sapiens
aaagtttatttcatg

SEQ ID NO: 2061800 - DNA, 22 bp, Homo sapiens
aaagtttgccctggatgtcata

SEQ ID NO: 2061801 - DNA, 17 bp, Homo sapiens
aaataaaaaaatacagt

SEQ ID NO: 2061802 - DNA, 19 bp, Homo sapiens
aaataaaaaaatacagtaa

SEQ ID NO: 2061803 - DNA, 23 bp, Homo sapiens
aaataaaaaaatacagtaaagtt

SEQ ID NO: 2061804 - DNA, 15 bp, Homo sapiens
aaataaaaaccagaa

SEQ ID NO: 2061805 - DNA, 20 bp, Homo sapiens
aaataaaaaccagaatcata

SEQ ID NO: 2061806 - DNA, 22 bp, Homo sapiens
aaataaaaatcaacttgtgtac

SEQ ID NO: 2061807 - DNA, 13 bp, Homo sapiens
aaataaaaccttt

SEQ ID NO: 2061808 - DNA, 15 bp, Homo sapiens
aaataaaacctttca

SEQ ID NO: 2061809 - DNA, 12 bp, Homo sapiens
aaataaaataat

SEQ ID NO: 2061810 - DNA, 14 bp, Homo sapiens
aaataaaatgatgt

SEQ ID NO: 2061811 - DNA, 18 bp, Homo sapiens
aaataaacaaataacaat

SEQ ID NO: 2061812 - DNA, 11 bp, Homo sapiens
aaataaacctg

SEQ ID NO: 2061813 - DNA, 22 bp, Homo sapiens
aaataaacctggagatgatgat

SEQ ID NO: 2061814 - DNA, 12 bp, Homo sapiens
aaataaactagt

SEQ ID NO: 2061815 - DNA, 17 bp, Homo sapiens
aaataaactagtttcca

SEQ ID NO: 2061816 - DNA, 15 bp, Homo sapiens
aaataaagtatatat

SEQ ID NO: 2061817 - DNA, 16 bp, Homo sapiens
aaataaagtatatata

SEQ ID NO: 2061818 - DNA, 20 bp, Homo sapiens
aaataaagtatatatagaat

SEQ ID NO: 2061819 - DNA, 15 bp, Homo sapiens
aaataaagtatcatg

SEQ ID NO: 2061820 - DNA, 18 bp, Homo sapiens
aaataaagttggtgacag

SEQ ID NO: 2061821 - DNA, 14 bp, Homo sapiens
aaataaatagattt

SEQ ID NO: 2061822 - DNA, 11 bp, Homo sapiens
aaataaatata

SEQ ID NO: 2061823 - DNA, 14 bp, Homo sapiens
aaataaatataatt

SEQ ID NO: 2061824 - DNA, 15 bp, Homo sapiens
aaataaatataattg

SEQ ID NO: 2061825 - DNA, 15 bp, Homo sapiens
aaataaatattttac

SEQ ID NO: 2061826 - DNA, 16 bp, Homo sapiens
aaataaatattttaca

SEQ ID NO: 2061827 - DNA, 15 bp, Homo sapiens
aaataaatgtatcat

SEQ ID NO: 2061828 - DNA, 12 bp, Homo sapiens
aaataaattcaa

SEQ ID NO: 2061829 - DNA, 19 bp, Homo sapiens
aaataaattggtgataagt

SEQ ID NO: 2061830 - DNA, 23 bp, Homo sapiens
aaataaattggtgataagtggaa

SEQ ID NO: 2061831 - DNA, 12 bp, Homo sapiens
aaataaattgtt

SEQ ID NO: 2061832 - DNA, 13 bp, Homo sapiens
aaataaattttgt

SEQ ID NO: 2061833 - DNA, 21 bp, Homo sapiens
aaataagaaacttttttattt

SEQ ID NO: 2061834 - DNA, 15 bp, Homo sapiens
aaataagaagaatgc

SEQ ID NO: 2061835 - DNA, 20 bp, Homo sapiens
aaataagaagaatgcttaat

SEQ ID NO: 2061836 - DNA, 14 bp, Homo sapiens
aaataagtgaaaat

SEQ ID NO: 2061837 - DNA, 20 bp, Homo sapiens
aaataagtggttatttctca

SEQ ID NO: 2061838 - DNA, 15 bp, Homo sapiens
aaataatgaacagca

SEQ ID NO: 2061839 - DNA, 13 bp, Homo sapiens
aaataatgattta

SEQ ID NO: 2061840 - DNA, 22 bp, Homo sapiens
aaataatgatttaagcatttta

SEQ ID NO: 2061841 - DNA, 18 bp, Homo sapiens
aaataatgttctgtcacg

SEQ ID NO: 2061842 - DNA, 23 bp, Homo sapiens
aaataatgttctgtcacgtgaaa

SEQ ID NO: 2061843 - DNA, 11 bp, Homo sapiens
aaataatttaa

SEQ ID NO: 2061844 - DNA, 21 bp, Homo sapiens
aaataatttaactaatttaaa

SEQ ID NO: 2061845 - DNA, 14 bp, Homo sapiens
aaataattttaaac

SEQ ID NO: 2061846 - DNA, 18 bp, Homo sapiens
aaataattttaaacaaag

SEQ ID NO: 2061847 - DNA, 21 bp, Homo sapiens
aaatacaaaataaaattatgg

SEQ ID NO: 2061848 - DNA, 15 bp, Homo sapiens
aaatacacactcaaa

SEQ ID NO: 2061849 - DNA, 22 bp, Homo sapiens
aaatacaccacctcactcctgt

SEQ ID NO: 2061850 - DNA, 20 bp, Homo sapiens
aaatacagtaaagtttaaaa

SEQ ID NO: 2061851 - DNA, 13 bp, Homo sapiens
aaatacatgctaa

SEQ ID NO: 2061852 - DNA, 21 bp, Homo sapiens
aaataccagtgaaccaaagag

SEQ ID NO: 2061853 - DNA, 19 bp, Homo sapiens
aaataccatgtctctaagc

SEQ ID NO: 2061854 - DNA, 16 bp, Homo sapiens
aaatactccaagcttc

SEQ ID NO: 2061855 - DNA, 17 bp, Homo sapiens
aaatactccaagcttca

SEQ ID NO: 2061856 - DNA, 18 bp, Homo sapiens
aaatactccaagcttcaa

SEQ ID NO: 2061857 - DNA, 23 bp, Homo sapiens
aaatactccaagcttcaagtgat

SEQ ID NO: 2061858 - DNA, 15 bp, Homo sapiens
aaatactgctctgaa

SEQ ID NO: 2061859 - DNA, 12 bp, Homo sapiens
aaatactgtaca

SEQ ID NO: 2061860 - DNA, 13 bp, Homo sapiens
aaatactgtacat

SEQ ID NO: 2061861 - DNA, 14 bp, Homo sapiens
aaatactgtacata

SEQ ID NO: 2061862 - DNA, 15 bp, Homo sapiens
aaatactgtacatag

SEQ ID NO: 2061863 - DNA, 14 bp, Homo sapiens
aaatagaaataagt

SEQ ID NO: 2061864 - DNA, 15 bp, Homo sapiens
aaatagacagtatat

SEQ ID NO: 2061865 - DNA, 18 bp, Homo sapiens
aaatagatttgattattt

SEQ ID NO: 2061866 - DNA, 18 bp, Homo sapiens
aaagaacggcatgtgaat

SEQ ID NO: 2061867 - DNA, 13 bp, Homo sapiens
aaagaagtaaaag

SEQ ID NO: 2061868 - DNA, 16 bp, Homo sapiens
aaagaagtaaaagcta

SEQ ID NO: 2061869 - DNA, 18 bp, Homo sapiens
aaagaataaatgaatctt

SEQ ID NO: 2061870 - DNA, 20 bp, Homo sapiens
aaagaatataaagttaaaaa

SEQ ID NO: 2061871 - DNA, 21 bp, Homo sapiens
aaagaatataaagttaaaaaa

SEQ ID NO: 2061872 - DNA, 22 bp, Homo sapiens
aaagaatgagaaggagtcagaa

SEQ ID NO: 2061873 - DNA, 23 bp, Homo sapiens
aaagaattatttttgtgtttcta

SEQ ID NO: 2061874 - DNA, 12 bp, Homo sapiens
aaagacagaatg

SEQ ID NO: 2061875 - DNA, 21 bp, Homo sapiens
aaagacagcactacagatatc

SEQ ID NO: 2061876 - DNA, 22 bp, Homo sapiens
aaagactattaagagcaataaa

SEQ ID NO: 2061877 - DNA, 17 bp, Homo sapiens
aaagactgcagctgctg

SEQ ID NO: 2061878 - DNA, 12 bp, Homo sapiens
aaagagaaaaaa

SEQ ID NO: 2061879 - DNA, 18 bp, Homo sapiens
aaagagaaaaaaagtttg

SEQ ID NO: 2061880 - DNA, 10 bp, Homo sapiens
aaagagacca

SEQ ID NO: 2061881 - DNA, 23 bp, Homo sapiens
aaagagactaatagagacacaga

SEQ ID NO: 2061882 - DNA, 15 bp, Homo sapiens
aaagaggcagcttga

SEQ ID NO: 2061883 - DNA, 20 bp, Homo sapiens
aaagaggcgtcttgtatttt

SEQ ID NO: 2061884 - DNA, 11 bp, Homo sapiens
aaagagtggag

SEQ ID NO: 2061885 - DNA, 22 bp, Homo sapiens
aaagagtgggctgcatctggga

SEQ ID NO: 2061886 - DNA, 16 bp, Homo sapiens
aaagagttcttaagga

SEQ ID NO: 2061887 - DNA, 22 bp, Homo sapiens
aaagataacaagatctttcagg

SEQ ID NO: 2061888 - DNA, 18 bp, Homo sapiens
aaagatagtatcttttaa

SEQ ID NO: 2061889 - DNA, 22 bp, Homo sapiens
aaagatagtatcttttaaaatg

SEQ ID NO: 2061890 - DNA, 20 bp, Homo sapiens
aaagatatatgaatatgaca

SEQ ID NO: 2061891 - DNA, 23 bp, Homo sapiens
aaagatccaccctcaaatgtcag

SEQ ID NO: 2061892 - DNA, 16 bp, Homo sapiens
aaagatgaaaatattt

SEQ ID NO: 2061893 - DNA, 20 bp, Homo sapiens
aaagatgagctctgaacaaa

SEQ ID NO: 2061894 - DNA, 22 bp, Homo sapiens
aaagatgccgggttttatattt

SEQ ID NO: 2061895 - DNA, 21 bp, Homo sapiens
aaagatggctgtgcctctgcc

SEQ ID NO: 2061896 - DNA, 22 bp, Homo sapiens
aaagatggctgtgcctctgcct

SEQ ID NO: 2061897 - DNA, 20 bp, Homo sapiens
aaagattctagctattattt

SEQ ID NO: 2061898 - DNA, 13 bp, Homo sapiens
aaagcaaaagaag

SEQ ID NO: 2061899 - DNA, 14 bp, Homo sapiens
aaagcaaaagaagt

SEQ ID NO: 2061900 - DNA, 15 bp, Homo sapiens
aaagcaaaagaagta

SEQ ID NO: 2061901 - DNA, 14 bp, Homo sapiens
aaagcaaaataata

SEQ ID NO: 2061902 - DNA, 22 bp, Homo sapiens
aaagcaagggctccagcatcca

SEQ ID NO: 2061903 - DNA, 19 bp, Homo sapiens
aaagcacaggagacactgt

SEQ ID NO: 2061904 - DNA, 13 bp, Homo sapiens
aaagcacctgccg

SEQ ID NO: 2061905 - DNA, 19 bp, Homo sapiens
aaagcacgaaatgttattt

SEQ ID NO: 2061906 - DNA, 21 bp, Homo sapiens
aaagcactcccttaggcatta

SEQ ID NO: 2061907 - DNA, 22 bp, Homo sapiens
aaagcactcccttaggcattat

SEQ ID NO: 2061908 - DNA, 18 bp, Homo sapiens
aaagcagtagacaatccc

SEQ ID NO: 2061909 - DNA, 23 bp, Homo sapiens
aaagcagtgtgtccttggggcac

SEQ ID NO: 2061910 - DNA, 12 bp, Homo sapiens
aaagcagtgttt

SEQ ID NO: 2061911 - DNA, 15 bp, Homo sapiens
aaagcattgtaaatg

SEQ ID NO: 2061912 - DNA, 20 bp, Homo sapiens
aaagcattgtaaatgtgctt

SEQ ID NO: 2061913 - DNA, 15 bp, Homo sapiens
aaagccaaagctagg

SEQ ID NO: 2061914 - DNA, 14 bp, Homo sapiens
aaagccaaatttat

SEQ ID NO: 2061915 - DNA, 15 bp, Homo sapiens
aaagccaaatttata

SEQ ID NO: 2061916 - DNA, 15 bp, Homo sapiens
aaagccacattttgc

SEQ ID NO: 2061917 - DNA, 19 bp, Homo sapiens
aaagccagctgccgaccag

SEQ ID NO: 2061918 - DNA, 15 bp, Homo sapiens
aaccctgttttatac

SEQ ID NO: 2061919 - DNA, 20 bp, Homo sapiens
aacccttctcttctcccccc

SEQ ID NO: 2061920 - DNA, 16 bp, Homo sapiens
aacccttttcctccag

SEQ ID NO: 2061921 - DNA, 18 bp, Homo sapiens
aaccgcactcacccatgt

SEQ ID NO: 2061922 - DNA, 11 bp, Homo sapiens
aaccgtggccc

SEQ ID NO: 2061923 - DNA, 19 bp, Homo sapiens
aaccgtggcccttcctgga

SEQ ID NO: 2061924 - DNA, 21 bp, Homo sapiens
aaccgtggcccttcctggaca

SEQ ID NO: 2061925 - DNA, 14 bp, Homo sapiens
aaccgtttttcaag

SEQ ID NO: 2061926 - DNA, 16 bp, Homo sapiens
aaccgtttttcaagaa

SEQ ID NO: 2061927 - DNA, 22 bp, Homo sapiens
aacctaaatttggttctaggcc

SEQ ID NO: 2061928 - DNA, 16 bp, Homo sapiens
aacctaattgaaattt

SEQ ID NO: 2061929 - DNA, 18 bp, Homo sapiens
aacctaccaccccttcct

SEQ ID NO: 2061930 - DNA, 11 bp, Homo sapiens
aacctagagat

SEQ ID NO: 2061931 - DNA, 20 bp, Homo sapiens
aacctagcatcttacaaaaa

SEQ ID NO: 2061932 - DNA, 18 bp, Homo sapiens
aacctagtactctctgct

SEQ ID NO: 2061933 - DNA, 20 bp, Homo sapiens
aacctagtactctctgctct

SEQ ID NO: 2061934 - DNA, 21 bp, Homo sapiens
aacctagtactctctgctcta

SEQ ID NO: 2061935 - DNA, 11 bp, Homo sapiens
aacctcaaact

SEQ ID NO: 2061936 - DNA, 13 bp, Homo sapiens
aacctcaaactgg

SEQ ID NO: 2061937 - DNA, 20 bp, Homo sapiens
aacctcagggacaacatttt

SEQ ID NO: 2061938 - DNA, 14 bp, Homo sapiens
aacctcagtaattt

SEQ ID NO: 2061939 - DNA, 17 bp, Homo sapiens
aacctcagtttcctcat

SEQ ID NO: 2061940 - DNA, 19 bp, Homo sapiens
aacctcatgacagccagag

SEQ ID NO: 2061941 - DNA, 15 bp, Homo sapiens
aacctcccaacccag

SEQ ID NO: 2061942 - DNA, 18 bp, Homo sapiens
aacctccgtgctgggctt

SEQ ID NO: 2061943 - DNA, 11 bp, Homo sapiens
aacctgaaaaa

SEQ ID NO: 2061944 - DNA, 21 bp, Homo sapiens
aacctgaaaaaaagtttacaa

SEQ ID NO: 2061945 - DNA, 14 bp, Homo sapiens
aacctgcctgtgca

SEQ ID NO: 2061946 - DNA, 16 bp, Homo sapiens
aagaatattctatgaa

SEQ ID NO: 2061947 - DNA, 13 bp, Homo sapiens
aagaatgagcatt

SEQ ID NO: 2061948 - DNA, 16 bp, Homo sapiens
aagaatgcaagagtgg

SEQ ID NO: 2061949 - DNA, 15 bp, Homo sapiens
aagaatgctggtttt

SEQ ID NO: 2061950 - DNA, 18 bp, Homo sapiens
aagaatgttaagacttga

SEQ ID NO: 2061951 - DNA, 15 bp, Homo sapiens
aagaattatttttgt

SEQ ID NO: 2061952 - DNA, 15 bp, Homo sapiens
aagaattcacacctt

SEQ ID NO: 2061953 - DNA, 20 bp, Homo sapiens
aagaattcctgaagccagat

SEQ ID NO: 2061954 - DNA, 20 bp, Homo sapiens
aagaattgaacccaggaggt

SEQ ID NO: 2061955 - DNA, 22 bp, Homo sapiens
aagaatttaaattctttttcaa

SEQ ID NO: 2061956 - DNA, 17 bp, Homo sapiens
aagacaaaggttttcct

SEQ ID NO: 2061957 - DNA, 22 bp, Homo sapiens
aagacaagaaaagaggaaaaaa

SEQ ID NO: 2061958 - DNA, 22 bp, Homo sapiens
aagacaatatgaacaaactatg

SEQ ID NO: 2061959 - DNA, 23 bp, Homo sapiens
aagacaatggcttactccaggag

SEQ ID NO: 2061960 - DNA, 16 bp, Homo sapiens
aagacagaatgtcacc

SEQ ID NO: 2061961 - DNA, 16 bp, Homo sapiens
aagacagagctgggat

SEQ ID NO: 2061962 - DNA, 17 bp, Homo sapiens
aagacagctgacagata

SEQ ID NO: 2061963 - DNA, 23 bp, Homo sapiens
aagacaggacagtgcttcagcct

SEQ ID NO: 2061964 - DNA, 18 bp, Homo sapiens
aagacatggagactcctg

SEQ ID NO: 2061965 - DNA, 15 bp, Homo sapiens
aagaccagcctggcc

SEQ ID NO: 2061966 - DNA, 20 bp, Homo sapiens
aagacccagtgtaaagaata

SEQ ID NO: 2061967 - DNA, 14 bp, Homo sapiens
aagaccccatctct

SEQ ID NO: 2061968 - DNA, 13 bp, Homo sapiens
aagaccctccccg

SEQ ID NO: 2061969 - DNA, 22 bp, Homo sapiens
aagaccgtgtcccaaggagctg

SEQ ID NO: 2061970 - DNA, 14 bp, Homo sapiens
aagacctaaatgac

SEQ ID NO: 2061971 - DNA, 18 bp, Homo sapiens
aagacctaaatgacctca

SEQ ID NO: 2061972 - DNA, 17 bp, Homo sapiens
aagacctgttgctagaa

SEQ ID NO: 2061973 - DNA, 20 bp, Homo sapiens
aagaccttctgaagatctca

SEQ ID NO: 2061974 - DNA, 17 bp, Homo sapiens
aagacgcctttctcctc

SEQ ID NO: 2061975 - DNA, 21 bp, Homo sapiens
aagacgctcaagaatcctctg

SEQ ID NO: 2061976 - DNA, 21 bp, Homo sapiens
aagacgtttttgtgctgtggg

SEQ ID NO: 2061977 - DNA, 19 bp, Homo sapiens
aagactaatttaaaaaata

SEQ ID NO: 2061978 - DNA, 13 bp, Homo sapiens
aagactattcaaa

SEQ ID NO: 2061979 - DNA, 14 bp, Homo sapiens
aagactattcaaac

SEQ ID NO: 2061980 - DNA, 17 bp, Homo sapiens
aagactccaaagaaatg

SEQ ID NO: 2061981 - DNA, 17 bp, Homo sapiens
aagactcctgggcttca

SEQ ID NO: 2061982 - DNA, 14 bp, Homo sapiens
aagactgaaacggc

SEQ ID NO: 2061983 - DNA, 16 bp, Homo sapiens
aagactgcagctgctg

SEQ ID NO: 2061984 - DNA, 21 bp, Homo sapiens
aagacttgatactgcaataaa

SEQ ID NO: 2061985 - DNA, 16 bp, Homo sapiens
aagacttggcaacaga

SEQ ID NO: 2061986 - DNA, 19 bp, Homo sapiens
aagacttggcaacagaagc

SEQ ID NO: 2061987 - DNA, 18 bp, Homo sapiens
aagactttaaaagatgaa

SEQ ID NO: 2061988 - DNA, 20 bp, Homo sapiens
aagagaaaaaccaatgattc

SEQ ID NO: 2061989 - DNA, 18 bp, Homo sapiens
aagagaaaaagaaatgca

SEQ ID NO: 2061990 - DNA, 14 bp, Homo sapiens
aagagaaatctcat

SEQ ID NO: 2061991 - DNA, 12 bp, Homo sapiens
aagagaagaaaa

SEQ ID NO: 2061992 - DNA, 14 bp, Homo sapiens
aagagaagaaaaaa

SEQ ID NO: 2061993 - DNA, 11 bp, Homo sapiens
aagagaagctg

SEQ ID NO: 2061994 - DNA, 14 bp, Homo sapiens
aagagaagggaagc

SEQ ID NO: 2061995 - DNA, 13 bp, Homo sapiens
aagagaagtagaa

SEQ ID NO: 2061996 - DNA, 21 bp, Homo sapiens
aagagacaaacacctcccagg

SEQ ID NO: 2061997 - DNA, 14 bp, Homo sapiens
aagagacagaatga

SEQ ID NO: 2061998 - DNA, 21 bp, Homo sapiens
aagagacagagcccccaagcc

SEQ ID NO: 2061999 - DNA, 20 bp, Homo sapiens
aagagactctcttagggaaa

SEQ ID NO: 2062000 - DNA, 14 bp, Homo sapiens
aagagactggagca

SEQ ID NO: 2062001 - DNA, 18 bp, Homo sapiens
aagagagaaaacttattt

SEQ ID NO: 2062002 - DNA, 17 bp, Homo sapiens
aagagagatatatctga

SEQ ID NO: 2062003 - DNA, 19 bp, Homo sapiens
aagagaggcacctgctgga

SEQ ID NO: 2062004 - DNA, 18 bp, Homo sapiens
aagagatgtagcagaata

SEQ ID NO: 2062005 - DNA, 15 bp, Homo sapiens
aagagcaagtctgga

SEQ ID NO: 2062006 - DNA, 10 bp, Homo sapiens
aagagcacaa

SEQ ID NO: 2062007 - DNA, 11 bp, Homo sapiens
aagagcagcct

SEQ ID NO: 2062008 - DNA, 12 bp, Homo sapiens
aagagcagcctg

SEQ ID NO: 2062009 - DNA, 13 bp, Homo sapiens
aagagcagcctga

SEQ ID NO: 2062010 - DNA, 23 bp, Homo sapiens
aagagcagcctgatggccaaggg

SEQ ID NO: 2062011 - DNA, 17 bp, Homo sapiens
aagagcatcatgcctct

SEQ ID NO: 2062012 - DNA, 20 bp, Homo sapiens
aagagcatcatgcctctgag

SEQ ID NO: 2062013 - DNA, 11 bp, Homo sapiens
aagagccctga

SEQ ID NO: 2062014 - DNA, 13 bp, Homo sapiens
aagagcctggaga

SEQ ID NO: 2062015 - DNA, 16 bp, Homo sapiens
aagagcctggagaagc

SEQ ID NO: 2062016 - DNA, 18 bp, Homo sapiens
aagagctacgtatttaat

SEQ ID NO: 2062017 - DNA, 20 bp, Homo sapiens
aagagctagcgctgccgcac

SEQ ID NO: 2062018 - DNA, 18 bp, Homo sapiens
aagagctgaggcaattct

SEQ ID NO: 2062019 - DNA, 23 bp, Homo sapiens
aagagctgatgtgagtgtgtgtg

SEQ ID NO: 2062020 - DNA, 12 bp, Homo sapiens
aagagctgctgt

SEQ ID NO: 2062021 - DNA, 19 bp, Homo sapiens
aagagctgttcacagccag

SEQ ID NO: 2062022 - DNA, 14 bp, Homo sapiens
aagaggagaccctg

SEQ ID NO: 2062023 - DNA, 16 bp, Homo sapiens
aagaggagaccctgga

SEQ ID NO: 2062024 - DNA, 17 bp, Homo sapiens
aagaggcaagagacaga

SEQ ID NO: 2062025 - DNA, 23 bp, Homo sapiens
aagaggccctgtctgtacctaac

SEQ ID NO: 2062026 - DNA, 16 bp, Homo sapiens
aagaggcgacttcctc

SEQ ID NO: 2062027 - DNA, 18 bp, Homo sapiens
aagagggagatggagact

SEQ ID NO: 2062028 - DNA, 12 bp, Homo sapiens
aagagggcctgt

SEQ ID NO: 2062029 - DNA, 19 bp, Homo sapiens
aagaggggaggggcctagg

SEQ ID NO: 2062030 - DNA, 21 bp, Homo sapiens
aagaggggaggggcctaggga

SEQ ID NO: 2062031 - DNA, 22 bp, Homo sapiens
aagagggtctgaggaatccaga

SEQ ID NO: 2062032 - DNA, 13 bp, Homo sapiens
aagaggtctgagc

SEQ ID NO: 2062033 - DNA, 17 bp, Homo sapiens
aagaggtgaccccaggg

SEQ ID NO: 2062034 - DNA, 16 bp, Homo sapiens
aagagtgggctgcatc

SEQ ID NO: 2062035 - DNA, 17 bp, Homo sapiens
aagagttattcaaatga

SEQ ID NO: 2062036 - DNA, 23 bp, Homo sapiens
aagagttcttaaggattgtgata

SEQ ID NO: 2062037 - DNA, 23 bp, Homo sapiens
aagagtttaactttgggcccaga

SEQ ID NO: 2062038 - DNA, 20 bp, Homo sapiens
aagagtttgcaaatgcaaca

SEQ ID NO: 2062039 - DNA, 21 bp, Homo sapiens
aagataacaagatctttcagg

SEQ ID NO: 2062040 - DNA, 22 bp, Homo sapiens
aagataacaagatctttcagga

SEQ ID NO: 2062041 - DNA, 14 bp, Homo sapiens
aacaatacaacaag

SEQ ID NO: 2062042 - DNA, 15 bp, Homo sapiens
aacaatacaacaaga

SEQ ID NO: 2062043 - DNA, 20 bp, Homo sapiens
aacaatacaacaagaacaac

SEQ ID NO: 2062044 - DNA, 12 bp, Homo sapiens
aacaatgtatgt

SEQ ID NO: 2062045 - DNA, 14 bp, Homo sapiens
aacaatgtcagaaa

SEQ ID NO: 2062046 - DNA, 20 bp, Homo sapiens
aacaatgttgttttaagact

SEQ ID NO: 2062047 - DNA, 22 bp, Homo sapiens
aacaattctaaaatgattgtag

SEQ ID NO: 2062048 - DNA, 14 bp, Homo sapiens
aacacaagccacag

SEQ ID NO: 2062049 - DNA, 18 bp, Homo sapiens
aacacaagctggaagcac

SEQ ID NO: 2062050 - DNA, 20 bp, Homo sapiens
aacacaattgatacttcagg

SEQ ID NO: 2062051 - DNA, 17 bp, Homo sapiens
aacacacatggatgcac

SEQ ID NO: 2062052 - DNA, 15 bp, Homo sapiens
aacacaccgatgcac

SEQ ID NO: 2062053 - DNA, 12 bp, Homo sapiens
aacacacctggt

SEQ ID NO: 2062054 - DNA, 12 bp, Homo sapiens
aacacactgtaa

SEQ ID NO: 2062055 - DNA, 22 bp, Homo sapiens
aacacactgtaaatatccacag

SEQ ID NO: 2062056 - DNA, 21 bp, Homo sapiens
aacacagagctggcgactgca

SEQ ID NO: 2062057 - DNA, 15 bp, Homo sapiens
aacacagcaagggtg

SEQ ID NO: 2062058 - DNA, 20 bp, Homo sapiens
aacacagcaagggtgatggg

SEQ ID NO: 2062059 - DNA, 14 bp, Homo sapiens
aacacagctgctga

SEQ ID NO: 2062060 - DNA, 17 bp, Homo sapiens
aacacagctgctgaaga

SEQ ID NO: 2062061 - DNA, 21 bp, Homo sapiens
aacacagctgctgaagaggca

SEQ ID NO: 2062062 - DNA, 22 bp, Homo sapiens
aacacagctttacaacttccat

SEQ ID NO: 2062063 - DNA, 15 bp, Homo sapiens
aacacaggcaaaatc

SEQ ID NO: 2062064 - DNA, 12 bp, Homo sapiens
aacacagtgctg

SEQ ID NO: 2062065 - DNA, 19 bp, Homo sapiens
aacacagtttagtgcttta

SEQ ID NO: 2062066 - DNA, 17 bp, Homo sapiens
aacacataactagaaac

SEQ ID NO: 2062067 - DNA, 22 bp, Homo sapiens
aacacattacttgcacaagctt

SEQ ID NO: 2062068 - DNA, 15 bp, Homo sapiens
aacaccaacataaaa

SEQ ID NO: 2062069 - DNA, 16 bp, Homo sapiens
aacacccggaaagact

SEQ ID NO: 2062070 - DNA, 20 bp, Homo sapiens
aacacccggaaagactgaaa

SEQ ID NO: 2062071 - DNA, 16 bp, Homo sapiens
aacaccctatattttg

SEQ ID NO: 2062072 - DNA, 13 bp, Homo sapiens
aacaccggcagaa

SEQ ID NO: 2062073 - DNA, 13 bp, Homo sapiens
aacacctcccagg

SEQ ID NO: 2062074 - DNA, 17 bp, Homo sapiens
aacacctgacacatctt

SEQ ID NO: 2062075 - DNA, 19 bp, Homo sapiens
aacactaaacagactattt

SEQ ID NO: 2062076 - DNA, 15 bp, Homo sapiens
aacactataaaggtt

SEQ ID NO: 2062077 - DNA, 16 bp, Homo sapiens
aacactcaacaataaa

SEQ ID NO: 2062078 - DNA, 18 bp, Homo sapiens
aacactcagaagcctggg

SEQ ID NO: 2062079 - DNA, 20 bp, Homo sapiens
aacactcttcttgagcagac

SEQ ID NO: 2062080 - DNA, 20 bp, Homo sapiens
aacactgaagtgcttgcaga

SEQ ID NO: 2062081 - DNA, 14 bp, Homo sapiens
aacactgcttgtgt

SEQ ID NO: 2062082 - DNA, 17 bp, Homo sapiens
aacactgggggagggga

SEQ ID NO: 2062083 - DNA, 16 bp, Homo sapiens
aacactgtaatcttaa

SEQ ID NO: 2062084 - DNA, 11 bp, Homo sapiens
aacacttccat

SEQ ID NO: 2062085 - DNA, 16 bp, Homo sapiens
aacagaaacaaaaaca

SEQ ID NO: 2062086 - DNA, 23 bp, Homo sapiens
aacagaactgctaaatactgtac

SEQ ID NO: 2062087 - DNA, 11 bp, Homo sapiens
aacagacagga

SEQ ID NO: 2062088 - DNA, 17 bp, Homo sapiens
aacagactatttaactt

SEQ ID NO: 2062089 - DNA, 16 bp, Homo sapiens
aacagagaaggcagga

SEQ ID NO: 2062090 - DNA, 19 bp, Homo sapiens
aacagagacaggcccaaga

SEQ ID NO: 2062091 - DNA, 13 bp, Homo sapiens
aacagagatgtga

SEQ ID NO: 2062092 - DNA, 12 bp, Homo sapiens
aacagagcaaga

SEQ ID NO: 2062093 - DNA, 17 bp, Homo sapiens
aacagagcgggcctctt

SEQ ID NO: 2062094 - DNA, 13 bp, Homo sapiens
aacagaggcagga

SEQ ID NO: 2062095 - DNA, 15 bp, Homo sapiens
aacagaggcatttaa

SEQ ID NO: 2062096 - DNA, 13 bp, Homo sapiens
aacagagtatata

SEQ ID NO: 2062097 - DNA, 18 bp, Homo sapiens
aacagagtatatatgtac

SEQ ID NO: 2062098 - DNA, 18 bp, Homo sapiens
aacagatgataaatattt

SEQ ID NO: 2062099 - DNA, 15 bp, Homo sapiens
aacagccaacaggtg

SEQ ID NO: 2062100 - DNA, 16 bp, Homo sapiens
aacagccaacaggtgg

SEQ ID NO: 2062101 - DNA, 21 bp, Homo sapiens
aacagccgctcctgtctgcca

SEQ ID NO: 2062102 - DNA, 11 bp, Homo sapiens
aacagctcaga

SEQ ID NO: 2062103 - DNA, 11 bp, Homo sapiens
aacaggaaaaa

SEQ ID NO: 2062104 - DNA, 14 bp, Homo sapiens
aacaggcaagtgaa

SEQ ID NO: 2062105 - DNA, 11 bp, Homo sapiens
aacaggcagat

SEQ ID NO: 2062106 - DNA, 18 bp, Homo sapiens
aacaggctactctcctcg

SEQ ID NO: 2062107 - DNA, 21 bp, Homo sapiens
aacaggctcaatattcctgaa

SEQ ID NO: 2062108 - DNA, 23 bp, Homo sapiens
aacaggctgggcttcagtggcag

SEQ ID NO: 2062109 - DNA, 21 bp, Homo sapiens
aacaggctgttctgcactgaa

SEQ ID NO: 2062110 - DNA, 15 bp, Homo sapiens
aacagggaaggcagg

SEQ ID NO: 2062111 - DNA, 22 bp, Homo sapiens
aacagggaaggcaggcagggct

SEQ ID NO: 2062112 - DNA, 22 bp, Homo sapiens
aacagggcagtgacaagtggag

SEQ ID NO: 2062113 - DNA, 19 bp, Homo sapiens
aacaggggatcaaagttcc

SEQ ID NO: 2062114 - DNA, 18 bp, Homo sapiens
aacaggtctcctcttaaa

SEQ ID NO: 2062115 - DNA, 19 bp, Homo sapiens
aacaggtggcaggaccagg

SEQ ID NO: 2062116 - DNA, 21 bp, Homo sapiens
aacaggtggcaggaccaggac

SEQ ID NO: 2062117 - DNA, 16 bp, Homo sapiens
aacaggttttataatt

SEQ ID NO: 2062118 - DNA, 16 bp, Homo sapiens
aacagtaacacatctt

SEQ ID NO: 2062119 - DNA, 22 bp, Homo sapiens
aacagtagttttgaaactagaa

SEQ ID NO: 2062120 - DNA, 15 bp, Homo sapiens
aacagtcacccttct

SEQ ID NO: 2062121 - DNA, 19 bp, Homo sapiens
aacagtcacccttctgggc

SEQ ID NO: 2062122 - DNA, 19 bp, Homo sapiens
aaacgtacttaactgtgtg

SEQ ID NO: 2062123 - DNA, 13 bp, Homo sapiens
aaacgttgacccc

SEQ ID NO: 2062124 - DNA, 13 bp, Homo sapiens
aaactaaatatat

SEQ ID NO: 2062125 - DNA, 17 bp, Homo sapiens
aaactaaatctctaata

SEQ ID NO: 2062126 - DNA, 17 bp, Homo sapiens
aaactaccctccagagt

SEQ ID NO: 2062127 - DNA, 22 bp, Homo sapiens
aaactagaggtgagaaatttaa

SEQ ID NO: 2062128 - DNA, 22 bp, Homo sapiens
aaactagatactgttgatcttt

SEQ ID NO: 2062129 - DNA, 22 bp, Homo sapiens
aaactagtaatgggccaattaa

SEQ ID NO: 2062130 - DNA, 17 bp, Homo sapiens
aaactagtttccagtgg

SEQ ID NO: 2062131 - DNA, 17 bp, Homo sapiens
aaactataaactactgt

SEQ ID NO: 2062132 - DNA, 22 bp, Homo sapiens
aaactataaactactgtaatta

SEQ ID NO: 2062133 - DNA, 11 bp, Homo sapiens
aaactatcagt

SEQ ID NO: 2062134 - DNA, 20 bp, Homo sapiens
aaactatccaattaaaatta

SEQ ID NO: 2062135 - DNA, 20 bp, Homo sapiens
aaactatggctttaaactac

SEQ ID NO: 2062136 - DNA, 13 bp, Homo sapiens
aaactcaaaactt

SEQ ID NO: 2062137 - DNA, 19 bp, Homo sapiens
aaactcaaaacttaacata

SEQ ID NO: 2062138 - DNA, 21 bp, Homo sapiens
aaactcaaaatatttgtacat

SEQ ID NO: 2062139 - DNA, 20 bp, Homo sapiens
aaactcactgctcaagaaga

SEQ ID NO: 2062140 - DNA, 14 bp, Homo sapiens
aaactccttttgct

SEQ ID NO: 2062141 - DNA, 20 bp, Homo sapiens
aaactccttttgctgtcttt

SEQ ID NO: 2062142 - DNA, 16 bp, Homo sapiens
aaactcgttttttaca

SEQ ID NO: 2062143 - DNA, 22 bp, Homo sapiens
aaactctgggaaataagagaga

SEQ ID NO: 2062144 - DNA, 17 bp, Homo sapiens
aaactcttgacctcagg

SEQ ID NO: 2062145 - DNA, 17 bp, Homo sapiens
aaactgaaaactgtaaa

SEQ ID NO: 2062146 - DNA, 18 bp, Homo sapiens
aaactgaaaatctaatat

SEQ ID NO: 2062147 - DNA, 12 bp, Homo sapiens
aaactgaagaag

SEQ ID NO: 2062148 - DNA, 23 bp, Homo sapiens
aaactgagatgtgaacacatcag

SEQ ID NO: 2062149 - DNA, 14 bp, Homo sapiens
aaactgagcctctt

SEQ ID NO: 2062150 - DNA, 19 bp, Homo sapiens
aaactgagcctcttttcaa

SEQ ID NO: 2062151 - DNA, 23 bp, Homo sapiens
aaactgagcctcttttcaattat

SEQ ID NO: 2062152 - DNA, 18 bp, Homo sapiens
aaactgaggaattttctt

SEQ ID NO: 2062153 - DNA, 21 bp, Homo sapiens
aaactgaggagtagctgagag

SEQ ID NO: 2062154 - DNA, 18 bp, Homo sapiens
aaactgatcaaaaataaa

SEQ ID NO: 2062155 - DNA, 21 bp, Homo sapiens
aaactgatgcgaaaacttgaa

SEQ ID NO: 2062156 - DNA, 13 bp, Homo sapiens
aaactgatttctc

SEQ ID NO: 2062157 - DNA, 15 bp, Homo sapiens
aaactgcactgtcaa

SEQ ID NO: 2062158 - DNA, 23 bp, Homo sapiens
aaactggggcttgcaagaggagg

SEQ ID NO: 2062159 - DNA, 17 bp, Homo sapiens
aaacttaacatatttac

SEQ ID NO: 2062160 - DNA, 13 bp, Homo sapiens
aaacttatgctag

SEQ ID NO: 2062161 - DNA, 18 bp, Homo sapiens
aaacttatgctagtttat

SEQ ID NO: 2062162 - DNA, 14 bp, Homo sapiens
aaacttgaatctgt

SEQ ID NO: 2062163 - DNA, 18 bp, Homo sapiens
aaacttgaatctgttact

SEQ ID NO: 2062164 - DNA, 21 bp, Homo sapiens
aaacttgaatctgttactgaa

SEQ ID NO: 2062165 - DNA, 12 bp, Homo sapiens
aaacttgtaaat

SEQ ID NO: 2062166 - DNA, 22 bp, Homo sapiens
aaacttgtatctgaagacctac

SEQ ID NO: 2062167 - DNA, 22 bp, Homo sapiens
aaactttaaagcgtttgcacag

SEQ ID NO: 2062168 - DNA, 16 bp, Homo sapiens
aaactttgaagttagc

SEQ ID NO: 2062169 - DNA, 16 bp, Homo sapiens
aaactttgtgcctttg

SEQ ID NO: 2062170 - DNA, 20 bp, Homo sapiens
aaactttgttatatatatca

SEQ ID NO: 2062171 - DNA, 15 bp, Homo sapiens
aaacttttaatgcct

SEQ ID NO: 2062172 - DNA, 21 bp, Homo sapiens
aaacttttaatgccttccaca

SEQ ID NO: 2062173 - DNA, 12 bp, Homo sapiens
aaacttttttat

SEQ ID NO: 2062174 - DNA, 19 bp, Homo sapiens
aaacttttttatttaaaaa

SEQ ID NO: 2062175 - DNA, 18 bp, Homo sapiens
aaagaaaaaaatatattt

SEQ ID NO: 2062176 - DNA, 18 bp, Homo sapiens
aaagaaaaaataattgat

SEQ ID NO: 2062177 - DNA, 19 bp, Homo sapiens
aaagaaaaccattttagtt

SEQ ID NO: 2062178 - DNA, 18 bp, Homo sapiens
aaagaaaattcttggaat

SEQ ID NO: 2062179 - DNA, 21 bp, Homo sapiens
aaagaaagggaaactggctga

SEQ ID NO: 2062180 - DNA, 14 bp, Homo sapiens
aaagaaatgcaaaa

SEQ ID NO: 2062181 - DNA, 19 bp, Homo sapiens
aaagaacggaagaagagat

SEQ ID NO: 2062182 - DNA, 21 bp, Homo sapiens
aaatagccgggcatggtggcg

SEQ ID NO: 2062183 - DNA, 16 bp, Homo sapiens
aaatagcttgtatagt

SEQ ID NO: 2062184 - DNA, 16 bp, Homo sapiens
aaatagtattgaaagt

SEQ ID NO: 2062185 - DNA, 20 bp, Homo sapiens
aaatagtgcagaatctcata

SEQ ID NO: 2062186 - DNA, 21 bp, Homo sapiens
aaatagtgcagaatctcatag

SEQ ID NO: 2062187 - DNA, 19 bp, Homo sapiens
aaatagttttaaatatgaa

SEQ ID NO: 2062188 - DNA, 20 bp, Homo sapiens
aaatagttttaaatatgaac

SEQ ID NO: 2062189 - DNA, 14 bp, Homo sapiens
aaatataaacttgt

SEQ ID NO: 2062190 - DNA, 15 bp, Homo sapiens
aaatataaatgcatg

SEQ ID NO: 2062191 - DNA, 19 bp, Homo sapiens
aaatataaccattacatgt

SEQ ID NO: 2062192 - DNA, 20 bp, Homo sapiens
aaatataattgggattttaa

SEQ ID NO: 2062193 - DNA, 21 bp, Homo sapiens
aaatataattgggattttaaa

SEQ ID NO: 2062194 - DNA, 16 bp, Homo sapiens
aaatatacaaacatgt

SEQ ID NO: 2062195 - DNA, 20 bp, Homo sapiens
aaatatacaaacatgtggca

SEQ ID NO: 2062196 - DNA, 20 bp, Homo sapiens
aaatatagagatatttttgt

SEQ ID NO: 2062197 - DNA, 18 bp, Homo sapiens
aaatatagatcagttata

SEQ ID NO: 2062198 - DNA, 10 bp, Homo sapiens
aaatatagcg

SEQ ID NO: 2062199 - DNA, 16 bp, Homo sapiens
aaatatataatggttt

SEQ ID NO: 2062200 - DNA, 20 bp, Homo sapiens
aaatatataatggtttactg

SEQ ID NO: 2062201 - DNA, 17 bp, Homo sapiens
aaatatatagcttgaaa

SEQ ID NO: 2062202 - DNA, 24 bp, Homo sapiens
aaatatatagcttgaaagcagtta

SEQ ID NO: 2062203 - DNA, 14 bp, Homo sapiens
aaatatatataaat

SEQ ID NO: 2062204 - DNA, 16 bp, Homo sapiens
aaatatatatacatat

SEQ ID NO: 2062205 - DNA, 19 bp, Homo sapiens
aaatatatatacatatgta

SEQ ID NO: 2062206 - DNA, 13 bp, Homo sapiens
aaatatatatagt

SEQ ID NO: 2062207 - DNA, 12 bp, Homo sapiens
aaatatatatat

SEQ ID NO: 2062208 - DNA, 16 bp, Homo sapiens
aaatatatatttttca

SEQ ID NO: 2062209 - DNA, 22 bp, Homo sapiens
aaatatatatttttcaaccagc

SEQ ID NO: 2062210 - DNA, 12 bp, Homo sapiens
aaatatatgtct

SEQ ID NO: 2062211 - DNA, 12 bp, Homo sapiens
aaatatatttaa

SEQ ID NO: 2062212 - DNA, 17 bp, Homo sapiens
aaatatatttaattgtg

SEQ ID NO: 2062213 - DNA, 23 bp, Homo sapiens
aaatatcctcaggggtggagaag

SEQ ID NO: 2062214 - DNA, 15 bp, Homo sapiens
aaatatgaacaaaga

SEQ ID NO: 2062215 - DNA, 21 bp, Homo sapiens
aaatatgatgttaaaaaaata

SEQ ID NO: 2062216 - DNA, 19 bp, Homo sapiens
aaatatgattttatttgac

SEQ ID NO: 2062217 - DNA, 16 bp, Homo sapiens
aaatatgcaaagcact

SEQ ID NO: 2062218 - DNA, 19 bp, Homo sapiens
aaatatggaacttctaata

SEQ ID NO: 2062219 - DNA, 18 bp, Homo sapiens
aaatatgtctcgctagtg

SEQ ID NO: 2062220 - DNA, 21 bp, Homo sapiens
aaatatgttctaacagcatct

SEQ ID NO: 2062221 - DNA, 23 bp, Homo sapiens
aaatattccatccatatactttg

SEQ ID NO: 2062222 - DNA, 19 bp, Homo sapiens
aaatattgaataagtattc

SEQ ID NO: 2062223 - DNA, 16 bp, Homo sapiens
aaatatttaacatagg

SEQ ID NO: 2062224 - DNA, 19 bp, Homo sapiens
aaatatttaagtatatagt

SEQ ID NO: 2062225 - DNA, 17 bp, Homo sapiens
aaatatttacatatgaa

SEQ ID NO: 2062226 - DNA, 19 bp, Homo sapiens
aaatatttacatatgaaat

SEQ ID NO: 2062227 - DNA, 12 bp, Homo sapiens
aaatatttatgc

SEQ ID NO: 2062228 - DNA, 22 bp, Homo sapiens
aaatatttatgcttaaaatatg

SEQ ID NO: 2062229 - DNA, 15 bp, Homo sapiens
aaatatttgtacata

SEQ ID NO: 2062230 - DNA, 14 bp, Homo sapiens
aaatattttaaaga

SEQ ID NO: 2062231 - DNA, 23 bp, Homo sapiens
aaatattttaaagaattgtgtca

SEQ ID NO: 2062232 - DNA, 14 bp, Homo sapiens
aaatattttagcct

SEQ ID NO: 2062233 - DNA, 16 bp, Homo sapiens
aaatattttctgggtt

SEQ ID NO: 2062234 - DNA, 14 bp, Homo sapiens
aaatcaaaagctgc

SEQ ID NO: 2062235 - DNA, 20 bp, Homo sapiens
aaatcaaaagctgcttgact

SEQ ID NO: 2062236 - DNA, 21 bp, Homo sapiens
aaatcaaaagctgcttgacta

SEQ ID NO: 2062237 - DNA, 15 bp, Homo sapiens
aaatcaaatatgcaa

SEQ ID NO: 2062238 - DNA, 16 bp, Homo sapiens
aaatcaaatatgcaaa

SEQ ID NO: 2062239 - DNA, 13 bp, Homo sapiens
aaatcaatgtcac

SEQ ID NO: 2062240 - DNA, 15 bp, Homo sapiens
aaatcacaagcaata

SEQ ID NO: 2062241 - DNA, 23 bp, Homo sapiens
aaatcacagatgggtattaaact

SEQ ID NO: 2062242 - DNA, 20 bp, Homo sapiens
aaatcaccatgtaacaacca

SEQ ID NO: 2062243 - DNA, 14 bp, Homo sapiens
aaatcacttgtaaa

SEQ ID NO: 2062244 - DNA, 17 bp, Homo sapiens
aaatcacttgtaaataa

SEQ ID NO: 2062245 - DNA, 19 bp, Homo sapiens
aaatcacttgtaaataaat

SEQ ID NO: 2062246 - DNA, 20 bp, Homo sapiens
aaatcacttgtaaataaata

SEQ ID NO: 2062247 - DNA, 17 bp, Homo sapiens
aaatcagaagtgcaaag

SEQ ID NO: 2062248 - DNA, 19 bp, Homo sapiens
aaatcagcgatgtgtcacc

SEQ ID NO: 2062249 - DNA, 17 bp, Homo sapiens
aaatcaggattttagtg

SEQ ID NO: 2062250 - DNA, 13 bp, Homo sapiens
aaatcagtaattg

SEQ ID NO: 2062251 - DNA, 19 bp, Homo sapiens
aaatcagttatattcttta

SEQ ID NO: 2062252 - DNA, 22 bp, Homo sapiens
aaatcagttatattctttaaat

SEQ ID NO: 2062253 - DNA, 16 bp, Homo sapiens
aaatcataaactgtgt

SEQ ID NO: 2062254 - DNA, 23 bp, Homo sapiens
aaatcataaactgtgtgcagact

SEQ ID NO: 2062255 - DNA, 17 bp, Homo sapiens
aaatcatgaatatttca

SEQ ID NO: 2062256 - DNA, 16 bp, Homo sapiens
aaatcatgtacatttc

SEQ ID NO: 2062257 - DNA, 17 bp, Homo sapiens
aaatcattccctttccc

SEQ ID NO: 2062258 - DNA, 14 bp, Homo sapiens
aaatccaaagaaaa

SEQ ID NO: 2062259 - DNA, 15 bp, Homo sapiens
aaatccagaaagaaa

SEQ ID NO: 2062260 - DNA, 17 bp, Homo sapiens
aaatccagtttcccacc

SEQ ID NO: 2062261 - DNA, 16 bp, Homo sapiens
aaatcctttactgtta

SEQ ID NO: 2062262 - DNA, 18 bp, Homo sapiens
aaatcctttttctttata

SEQ ID NO: 2062263 - DNA, 14 bp, Homo sapiens
aaatcgattggctt

SEQ ID NO: 2062264 - DNA, 14 bp, Homo sapiens
aaatctaactacaa

SEQ ID NO: 2062265 - DNA, 23 bp, Homo sapiens
aaatctaatcaggttgttaatgt

SEQ ID NO: 2062266 - DNA, 16 bp, Homo sapiens
aaatctagatcaatta

SEQ ID NO: 2062267 - DNA, 23 bp, Homo sapiens
aaatctagatcaattaattctta

SEQ ID NO: 2062268 - DNA, 20 bp, Homo sapiens
aaatctagttttttttgtaa

SEQ ID NO: 2062269 - DNA, 20 bp, Homo sapiens
aaatctatattaaagtgtta

SEQ ID NO: 2062270 - DNA, 13 bp, Homo sapiens
aaatctattcaga

SEQ ID NO: 2062271 - DNA, 11 bp, Homo sapiens
aaatctcatac

SEQ ID NO: 2062272 - DNA, 18 bp, Homo sapiens
aaatctgagcctaaatct

SEQ ID NO: 2062273 - DNA, 19 bp, Homo sapiens
aaatctgagcctaaatcta

SEQ ID NO: 2062274 - DNA, 20 bp, Homo sapiens
aaatctgagcctaaatctaa

SEQ ID NO: 2062275 - DNA, 22 bp, Homo sapiens
aaatctgagcctaaatctaatc

SEQ ID NO: 2062276 - DNA, 12 bp, Homo sapiens
aaatctggaaat

SEQ ID NO: 2062277 - DNA, 22 bp, Homo sapiens
aaatctggcaaagttatattta

SEQ ID NO: 2062278 - DNA, 18 bp, Homo sapiens
aaatctgtaattctattg

SEQ ID NO: 2062279 - DNA, 20 bp, Homo sapiens
aaatctgtgaattaaaaaag

SEQ ID NO: 2062280 - DNA, 20 bp, Homo sapiens
aaatcttcaaggtgtaaaat

SEQ ID NO: 2062281 - DNA, 13 bp, Homo sapiens
aaatcttccttgt

SEQ ID NO: 2062282 - DNA, 18 bp, Homo sapiens
aaatctttgattcagaca

SEQ ID NO: 2062283 - DNA, 18 bp, Homo sapiens
aaatcttttataggattt

SEQ ID NO: 2062284 - DNA, 11 bp, Homo sapiens
aaatgaaaata

SEQ ID NO: 2062285 - DNA, 15 bp, Homo sapiens
aaatgaaagcatgtg

SEQ ID NO: 2062286 - DNA, 14 bp, Homo sapiens
aaatgaaagggtca

SEQ ID NO: 2062287 - DNA, 14 bp, Homo sapiens
aaatgaaattgtaa

SEQ ID NO: 2062288 - DNA, 19 bp, Homo sapiens
aaatgaacgatatgtagca

SEQ ID NO: 2062289 - DNA, 19 bp, Homo sapiens
aaatgaaggttaggattta

SEQ ID NO: 2062290 - DNA, 15 bp, Homo sapiens
aaatgaatgttgtct

SEQ ID NO: 2062291 - DNA, 15 bp, Homo sapiens
aaatgacagcgggga

SEQ ID NO: 2062292 - DNA, 13 bp, Homo sapiens
aaatgacattttg

SEQ ID NO: 2062293 - DNA, 15 bp, Homo sapiens
aaatgacattttgct

SEQ ID NO: 2062294 - DNA, 15 bp, Homo sapiens
aaatgacatttttga

SEQ ID NO: 2062295 - DNA, 20 bp, Homo sapiens
aaatgactaaaaatattata

SEQ ID NO: 2062296 - DNA, 15 bp, Homo sapiens
aaatgagcctgtaat

SEQ ID NO: 2062297 - DNA, 22 bp, Homo sapiens
aaatgagtttttatggggctga

SEQ ID NO: 2062298 - DNA, 18 bp, Homo sapiens
aaatgataaagatgtcaa

SEQ ID NO: 2062299 - DNA, 21 bp, Homo sapiens
aaatgataaagatgtcaaata

SEQ ID NO: 2062300 - DNA, 13 bp, Homo sapiens
aaatgatctaaac

SEQ ID NO: 2062301 - DNA, 22 bp, Homo sapiens
aaatgattgtaaaatagcttgt

SEQ ID NO: 2062302 - DNA, 14 bp, Homo sapiens
aaatgattgtagta

SEQ ID NO: 2062303 - DNA, 16 bp, Homo sapiens
aaatgattttcatcaa

SEQ ID NO: 2062304 - DNA, 20 bp, Homo sapiens
aaatgattttcatcaattta

SEQ ID NO: 2062305 - DNA, 17 bp, Homo sapiens
aaatgcaaacacacaaa

SEQ ID NO: 2062306 - DNA, 15 bp, Homo sapiens
aaatgcaaacactgt

SEQ ID NO: 2062307 - DNA, 16 bp, Homo sapiens
aaatgcaaacactgtg

SEQ ID NO: 2062308 - DNA, 16 bp, Homo sapiens
aaatgcaatatgtatt

SEQ ID NO: 2062309 - DNA, 14 bp, Homo sapiens
aaatgcagtccaga

SEQ ID NO: 2062310 - DNA, 23 bp, Homo sapiens
aaatgcatccattcctcagggac

SEQ ID NO: 2062311 - DNA, 13 bp, Homo sapiens
aaatgcattatgt

SEQ ID NO: 2062312 - DNA, 15 bp, Homo sapiens
aaatgccaacatacc

SEQ ID NO: 2062313 - DNA, 21 bp, Homo sapiens
aaatgccaactggtcactgtg

SEQ ID NO: 2062314 - DNA, 15 bp, Homo sapiens
aaatgcccagttcac

SEQ ID NO: 2062315 - DNA, 15 bp, Homo sapiens
aaatgcccatttcga

SEQ ID NO: 2062316 - DNA, 14 bp, Homo sapiens
aaatgccctctctg

SEQ ID NO: 2062317 - DNA, 15 bp, Homo sapiens
aaatgcgtccctgta

SEQ ID NO: 2062318 - DNA, 19 bp, Homo sapiens
aaatgctcgtgtgatttcc

SEQ ID NO: 2062319 - DNA, 17 bp, Homo sapiens
aaatgctgaatgaatcc

SEQ ID NO: 2062320 - DNA, 19 bp, Homo sapiens
aaatgctgttggtgagaat

SEQ ID NO: 2062321 - DNA, 19 bp, Homo sapiens
aaatggagaagctctgttt

SEQ ID NO: 2062322 - DNA, 15 bp, Homo sapiens
aaatggagggtgggg

SEQ ID NO: 2062323 - DNA, 13 bp, Homo sapiens
aaatggccatttg

SEQ ID NO: 2062324 - DNA, 16 bp, Homo sapiens
aaatggccatttgctt

SEQ ID NO: 2062325 - DNA, 16 bp, Homo sapiens
aaatggtcgcccagga

SEQ ID NO: 2062326 - DNA, 19 bp, Homo sapiens
aaatggtttttgcaagatt

SEQ ID NO: 2062327 - DNA, 18 bp, Homo sapiens
aaatgtaacttttgtaag

SEQ ID NO: 2062328 - DNA, 22 bp, Homo sapiens
aaatgtaagggaaactgccagc

SEQ ID NO: 2062329 - DNA, 12 bp, Homo sapiens
aaatgtaattga

SEQ ID NO: 2062330 - DNA, 19 bp, Homo sapiens
aaatgtatatacacatata

SEQ ID NO: 2062331 - DNA, 17 bp, Homo sapiens
aaatgtatcatagaaat

SEQ ID NO: 2062332 - DNA, 18 bp, Homo sapiens
aaatgtcttatatagcag

SEQ ID NO: 2062333 - DNA, 19 bp, Homo sapiens
aaatgtgtaaatgtggaca

SEQ ID NO: 2062334 - DNA, 15 bp, Homo sapiens
aaatgtgtggtgcta

SEQ ID NO: 2062335 - DNA, 16 bp, Homo sapiens
aaatgtgtggtgctaa

SEQ ID NO: 2062336 - DNA, 16 bp, Homo sapiens
aaatgttaaaccctta

SEQ ID NO: 2062337 - DNA, 15 bp, Homo sapiens
aaatgttgaaatctt

SEQ ID NO: 2062338 - DNA, 17 bp, Homo sapiens
aaatgttggaattttca

SEQ ID NO: 2062339 - DNA, 13 bp, Homo sapiens
aaatgtttctgca

SEQ ID NO: 2062340 - DNA, 13 bp, Homo sapiens
aaattaaacttta

SEQ ID NO: 2062341 - DNA, 13 bp, Homo sapiens
aaattaacactgc

SEQ ID NO: 2062342 - DNA, 20 bp, Homo sapiens
aaattaactgggtaatgaaa

SEQ ID NO: 2062343 - DNA, 17 bp, Homo sapiens
aaattaagagatacatt

SEQ ID NO: 2062344 - DNA, 22 bp, Homo sapiens
aaattacttctctctatctgga

SEQ ID NO: 2062345 - DNA, 23 bp, Homo sapiens
aaattagaaaccttaatatgtgg

SEQ ID NO: 2062346 - DNA, 17 bp, Homo sapiens
aaattagctgtgtgaaa

SEQ ID NO: 2062347 - DNA, 18 bp, Homo sapiens
aaattagctgtgtgaaat

SEQ ID NO: 2062348 - DNA, 19 bp, Homo sapiens
aaattagctgtgtgaaata

SEQ ID NO: 2062349 - DNA, 23 bp, Homo sapiens
aaattaggaggctcaacaataaa

SEQ ID NO: 2062350 - DNA, 19 bp, Homo sapiens
aaattaggatttcatgatt

SEQ ID NO: 2062351 - DNA, 19 bp, Homo sapiens
aaattaggttttgtacaat

SEQ ID NO: 2062352 - DNA, 13 bp, Homo sapiens
aaattagtaattg

SEQ ID NO: 2062353 - DNA, 14 bp, Homo sapiens
aaattagtaattgt

SEQ ID NO: 2062354 - DNA, 15 bp, Homo sapiens
aaattagtgagattt

SEQ ID NO: 2062355 - DNA, 18 bp, Homo sapiens
aaattagtgagatttgta

SEQ ID NO: 2062356 - DNA, 19 bp, Homo sapiens
aaattagtgagatttgtat

SEQ ID NO: 2062357 - DNA, 16 bp, Homo sapiens
aaattataacttaaaa

SEQ ID NO: 2062358 - DNA, 19 bp, Homo sapiens
aaattataacttaaaatat

SEQ ID NO: 2062359 - DNA, 12 bp, Homo sapiens
aaattataagaa

SEQ ID NO: 2062360 - DNA, 16 bp, Homo sapiens
aaattataagatgtca

SEQ ID NO: 2062361 - DNA, 17 bp, Homo sapiens
aaattatgtatgtttac

SEQ ID NO: 2062362 - DNA, 19 bp, Homo sapiens
aaattatgtatgtttacat

SEQ ID NO: 2062363 - DNA, 17 bp, Homo sapiens
aaattattatgactcaa

SEQ ID NO: 2062364 - DNA, 13 bp, Homo sapiens
aaattatttaaac

SEQ ID NO: 2062365 - DNA, 14 bp, Homo sapiens
aaattatttcatac

SEQ ID NO: 2062366 - DNA, 15 bp, Homo sapiens
aaattattttaaaca

SEQ ID NO: 2062367 - DNA, 16 bp, Homo sapiens
aaattattttaaacaa

SEQ ID NO: 2062368 - DNA, 17 bp, Homo sapiens
aaattattttaaacaaa

SEQ ID NO: 2062369 - DNA, 20 bp, Homo sapiens
aaattattttaatattttgt

SEQ ID NO: 2062370 - DNA, 23 bp, Homo sapiens
aaattatttttatacaccattgt

SEQ ID NO: 2062371 - DNA, 14 bp, Homo sapiens
aaattcaaaaagtg

SEQ ID NO: 2062372 - DNA, 19 bp, Homo sapiens
aaattcaacctgtgtctta

SEQ ID NO: 2062373 - DNA, 16 bp, Homo sapiens
aaattcacaatagaaa

SEQ ID NO: 2062374 - DNA, 13 bp, Homo sapiens
aaattcacactgt

SEQ ID NO: 2062375 - DNA, 20 bp, Homo sapiens
aaattcagatatatttttca

SEQ ID NO: 2062376 - DNA, 22 bp, Homo sapiens
aaattcaggtgaaaatgttcat

SEQ ID NO: 2062377 - DNA, 19 bp, Homo sapiens
aaattcatttcacattaat

SEQ ID NO: 2062378 - DNA, 22 bp, Homo sapiens
aaattcatttttttcactggag

SEQ ID NO: 2062379 - DNA, 13 bp, Homo sapiens
aaattccaaactt

SEQ ID NO: 2062380 - DNA, 13 bp, Homo sapiens
aaattccactgga

SEQ ID NO: 2062381 - DNA, 20 bp, Homo sapiens
aaattcctaataagtttgat

SEQ ID NO: 2062382 - DNA, 13 bp, Homo sapiens
aaattcctgttgt

SEQ ID NO: 2062383 - DNA, 22 bp, Homo sapiens
aaattccttagcttagacctca

SEQ ID NO: 2062384 - DNA, 20 bp, Homo sapiens
aaattctcagtcagtaattg

SEQ ID NO: 2062385 - DNA, 15 bp, Homo sapiens
aaattctttatttct

SEQ ID NO: 2062386 - DNA, 11 bp, Homo sapiens
aaattcttttt

SEQ ID NO: 2062387 - DNA, 21 bp, Homo sapiens
aaattgagaagggaaatctta

SEQ ID NO: 2062388 - DNA, 14 bp, Homo sapiens
aaattgcacaattt

SEQ ID NO: 2062389 - DNA, 23 bp, Homo sapiens
aaattgcacaatttgagcaattc

SEQ ID NO: 2062390 - DNA, 13 bp, Homo sapiens
aaattgctccttg

SEQ ID NO: 2062391 - DNA, 19 bp, Homo sapiens
aaattgcttttgttgtgac

SEQ ID NO: 2062392 - DNA, 16 bp, Homo sapiens
aaattggaaacatttt

SEQ ID NO: 2062393 - DNA, 19 bp, Homo sapiens
aaattggaaacattttctt

SEQ ID NO: 2062394 - DNA, 21 bp, Homo sapiens
aaattggtaattgaatggaag

SEQ ID NO: 2062395 - DNA, 19 bp, Homo sapiens
aaattggtgataagtggaa

SEQ ID NO: 2062396 - DNA, 20 bp, Homo sapiens
aaattggtgataagtggaaa

SEQ ID NO: 2062397 - DNA, 14 bp, Homo sapiens
aaattggtgtttct

SEQ ID NO: 2062398 - DNA, 17 bp, Homo sapiens
aaattgtaaattttaga

SEQ ID NO: 2062399 - DNA, 18 bp, Homo sapiens
aaattgtatacattttgt

SEQ ID NO: 2062400 - DNA, 20 bp, Homo sapiens
aaattgtatacattttgtta

SEQ ID NO: 2062401 - DNA, 18 bp, Homo sapiens
aaattgtgatgttttgtt

SEQ ID NO: 2062402 - DNA, 22 bp, Homo sapiens
aaattgtgtttagattttatga

SEQ ID NO: 2062403 - DNA, 13 bp, Homo sapiens
aaattgttcatgt

SEQ ID NO: 2062404 - DNA, 22 bp, Homo sapiens
aaattgtttggcttcctcctga

SEQ ID NO: 2062405 - DNA, 20 bp, Homo sapiens
aaatttaatatagctatttt

SEQ ID NO: 2062406 - DNA, 19 bp, Homo sapiens
aaatttactgtgagactgt

SEQ ID NO: 2062407 - DNA, 14 bp, Homo sapiens
aaatttatataaaa

SEQ ID NO: 2062408 - DNA, 19 bp, Homo sapiens
aaatttcaaaagacatgtt

SEQ ID NO: 2062409 - DNA, 16 bp, Homo sapiens
aaatttccagtacctt

SEQ ID NO: 2062410 - DNA, 19 bp, Homo sapiens
aaatttccagtgagcttat

SEQ ID NO: 2062411 - DNA, 14 bp, Homo sapiens
aaatttgaagtaaa

SEQ ID NO: 2062412 - DNA, 21 bp, Homo sapiens
aaatttgccaccactagagct

SEQ ID NO: 2062413 - DNA, 23 bp, Homo sapiens
aaatttgccaccactagagctga

SEQ ID NO: 2062414 - DNA, 23 bp, Homo sapiens
aaattttaaggccacggccttgt

SEQ ID NO: 2062415 - DNA, 22 bp, Homo sapiens
aaattttataagcaaatttcaa

SEQ ID NO: 2062416 - DNA, 21 bp, Homo sapiens
aatgcacaccaaaaaaatact

SEQ ID NO: 2062417 - DNA, 16 bp, Homo sapiens
aatgcacatccattcc

SEQ ID NO: 2062418 - DNA, 16 bp, Homo sapiens
aatgcacctaaagaaa

SEQ ID NO: 2062419 - DNA, 18 bp, Homo sapiens
aatgcagggaagagggca

SEQ ID NO: 2062420 - DNA, 14 bp, Homo sapiens
aatgcataaatgca

SEQ ID NO: 2062421 - DNA, 19 bp, Homo sapiens
aatgcatgattttatacat

SEQ ID NO: 2062422 - DNA, 21 bp, Homo sapiens
aatgcatgattttatacatag

SEQ ID NO: 2062423 - DNA, 22 bp, Homo sapiens
aatgcatgattttatacatagt

SEQ ID NO: 2062424 - DNA, 18 bp, Homo sapiens
aatgcatgttaggaaaat

SEQ ID NO: 2062425 - DNA, 22 bp, Homo sapiens
aatgcattataggatcatttgt

SEQ ID NO: 2062426 - DNA, 14 bp, Homo sapiens
aagatgggcacatg

SEQ ID NO: 2062427 - DNA, 18 bp, Homo sapiens
aagatgggcagctagttc

SEQ ID NO: 2062428 - DNA, 23 bp, Homo sapiens
aagatggtagcagataaagacag

SEQ ID NO: 2062429 - DNA, 23 bp, Homo sapiens
aagatgtaactaggccatttgta

SEQ ID NO: 2062430 - DNA, 14 bp, Homo sapiens
aagatgtcaaatat

SEQ ID NO: 2062431 - DNA, 21 bp, Homo sapiens
aagatgtcaaatatctcagag

SEQ ID NO: 2062432 - DNA, 15 bp, Homo sapiens
aagattaaaggaagg

SEQ ID NO: 2062433 - DNA, 16 bp, Homo sapiens
aagattaaaggaagga

SEQ ID NO: 2062434 - DNA, 17 bp, Homo sapiens
aagattaaaggaaggaa

SEQ ID NO: 2062435 - DNA, 19 bp, Homo sapiens
aagattaaaggaaggaaaa

SEQ ID NO: 2062436 - DNA, 14 bp, Homo sapiens
aagattatatatca

SEQ ID NO: 2062437 - DNA, 21 bp, Homo sapiens
aagattatatatcataaagta

SEQ ID NO: 2062438 - DNA, 23 bp, Homo sapiens
aagattatatatcataaagtatg

SEQ ID NO: 2062439 - DNA, 20 bp, Homo sapiens
aagattcccagagacaggaa

SEQ ID NO: 2062440 - DNA, 13 bp, Homo sapiens
aagattgtaattc

SEQ ID NO: 2062441 - DNA, 17 bp, Homo sapiens
aagatttccaagtgcca

SEQ ID NO: 2062442 - DNA, 20 bp, Homo sapiens
aagattttttttgtaacttc

SEQ ID NO: 2062443 - DNA, 15 bp, Homo sapiens
aagcaaaaaagaaaa

SEQ ID NO: 2062444 - DNA, 15 bp, Homo sapiens
aagcaaaagaagtaa

SEQ ID NO: 2062445 - DNA, 17 bp, Homo sapiens
aagcaaaggtgaagaga

SEQ ID NO: 2062446 - DNA, 23 bp, Homo sapiens
aagcaaatggatggggataagaa

SEQ ID NO: 2062447 - DNA, 13 bp, Homo sapiens
aagcaaatttcaa

SEQ ID NO: 2062448 - DNA, 20 bp, Homo sapiens
aagcaaatttcaaaagacat

SEQ ID NO: 2062449 - DNA, 14 bp, Homo sapiens
aagcaacaggtttt

SEQ ID NO: 2062450 - DNA, 12 bp, Homo sapiens
aagcaacataaa

SEQ ID NO: 2062451 - DNA, 21 bp, Homo sapiens
aagcaacctcagtaatttaga

SEQ ID NO: 2062452 - DNA, 16 bp, Homo sapiens
aagcaacttgcttcta

SEQ ID NO: 2062453 - DNA, 19 bp, Homo sapiens
aagcaagacttccaggtag

SEQ ID NO: 2062454 - DNA, 21 bp, Homo sapiens
aagcaagcattcagaagaaaa

SEQ ID NO: 2062455 - DNA, 17 bp, Homo sapiens
aagcaagccaatttgga

SEQ ID NO: 2062456 - DNA, 18 bp, Homo sapiens
aagcaagccaatttggaa

SEQ ID NO: 2062457 - DNA, 20 bp, Homo sapiens
aagcaataattaggatctat

SEQ ID NO: 2062458 - DNA, 16 bp, Homo sapiens
aagcaattatattgtc

SEQ ID NO: 2062459 - DNA, 15 bp, Homo sapiens
aagcaattgccctgt

SEQ ID NO: 2062460 - DNA, 16 bp, Homo sapiens
aagcacatgtttattt

SEQ ID NO: 2062461 - DNA, 19 bp, Homo sapiens
aagcaccagcttctccagg

SEQ ID NO: 2062462 - DNA, 19 bp, Homo sapiens
aagcaccgcctccaaatgc

SEQ ID NO: 2062463 - DNA, 16 bp, Homo sapiens
aagcacctcctgcctc

SEQ ID NO: 2062464 - DNA, 21 bp, Homo sapiens
aagcacctgcagattctgatt

SEQ ID NO: 2062465 - DNA, 12 bp, Homo sapiens
aagcacctgccg

SEQ ID NO: 2062466 - DNA, 17 bp, Homo sapiens
aagcacctgccgacctc

SEQ ID NO: 2062467 - DNA, 15 bp, Homo sapiens
aagcacgaaatgtta

SEQ ID NO: 2062468 - DNA, 23 bp, Homo sapiens
aagcactcccttaggcattattt

SEQ ID NO: 2062469 - DNA, 23 bp, Homo sapiens
aagcactgctaggcgagtgccag

SEQ ID NO: 2062470 - DNA, 13 bp, Homo sapiens
aagcactgctgtg

SEQ ID NO: 2062471 - DNA, 18 bp, Homo sapiens
aagcagagaggtggagaa

SEQ ID NO: 2062472 - DNA, 14 bp, Homo sapiens
aagcagcattcagc

SEQ ID NO: 2062473 - DNA, 19 bp, Homo sapiens
aagcagcctttctgtggag

SEQ ID NO: 2062474 - DNA, 16 bp, Homo sapiens
aagcaggaaggatggc

SEQ ID NO: 2062475 - DNA, 17 bp, Homo sapiens
aagcaggaaggatggca

SEQ ID NO: 2062476 - DNA, 19 bp, Homo sapiens
aagcaggaaggatggcaag

SEQ ID NO: 2062477 - DNA, 12 bp, Homo sapiens
aagcaggcagag

SEQ ID NO: 2062478 - DNA, 20 bp, Homo sapiens
aagcagggaaagctccacgg

SEQ ID NO: 2062479 - DNA, 20 bp, Homo sapiens
aagcaggttcttgatgtcat

SEQ ID NO: 2062480 - DNA, 17 bp, Homo sapiens
aagcagtgcctcgaggc

SEQ ID NO: 2062481 - DNA, 20 bp, Homo sapiens
aagcagtgcctcgaggcacc

SEQ ID NO: 2062482 - DNA, 17 bp, Homo sapiens
aagcagtgccttccata

SEQ ID NO: 2062483 - DNA, 17 bp, Homo sapiens
aagcagtggacaccagg

SEQ ID NO: 2062484 - DNA, 15 bp, Homo sapiens
aagcagtgtgtcctt

SEQ ID NO: 2062485 - DNA, 11 bp, Homo sapiens
aagcagtgttt

SEQ ID NO: 2062486 - DNA, 15 bp, Homo sapiens
aagcagtgtttctac

SEQ ID NO: 2062487 - DNA, 15 bp, Homo sapiens
aagcagttgtgtcag

SEQ ID NO: 2062488 - DNA, 23 bp, Homo sapiens
aagcatatgcctacttgtaattt

SEQ ID NO: 2062489 - DNA, 22 bp, Homo sapiens
aagcatcattatttgcagagac

SEQ ID NO: 2062490 - DNA, 17 bp, Homo sapiens
aagcatcattgtaaatt

SEQ ID NO: 2062491 - DNA, 12 bp, Homo sapiens
aagcatctgtgt

SEQ ID NO: 2062492 - DNA, 22 bp, Homo sapiens
aagcatctgtgtaacctccaca

SEQ ID NO: 2062493 - DNA, 19 bp, Homo sapiens
aagcatcttgtcaagaaat

SEQ ID NO: 2062494 - DNA, 17 bp, Homo sapiens
aagcatgtctcaatagt

SEQ ID NO: 2062495 - DNA, 19 bp, Homo sapiens
aagcatgtggcatgttcat

SEQ ID NO: 2062496 - DNA, 12 bp, Homo sapiens
aagcatgtttca

SEQ ID NO: 2062497 - DNA, 14 bp, Homo sapiens
aagcatgtttcatg

SEQ ID NO: 2062498 - DNA, 16 bp, Homo sapiens
aagcatgtttcatgtt

SEQ ID NO: 2062499 - DNA, 16 bp, Homo sapiens
aagcattctgagctgg

SEQ ID NO: 2062500 - DNA, 18 bp, Homo sapiens
aagcattctgagctgggc

SEQ ID NO: 2062501 - DNA, 13 bp, Homo sapiens
aagcattgaatgg

SEQ ID NO: 2062502 - DNA, 16 bp, Homo sapiens
aagcatttactttgaa

SEQ ID NO: 2062503 - DNA, 19 bp, Homo sapiens
aagcatttgtttctacttt

SEQ ID NO: 2062504 - DNA, 22 bp, Homo sapiens
aagcattttactgtctgtaaga

SEQ ID NO: 2062505 - DNA, 19 bp, Homo sapiens
aagcattttgtaagttgaa

SEQ ID NO: 2062506 - DNA, 23 bp, Homo sapiens
aagcattttgtaagttgaagcaa

SEQ ID NO: 2062507 - DNA, 12 bp, Homo sapiens
aagccaaaacaa

SEQ ID NO: 2062508 - DNA, 18 bp, Homo sapiens
aagccaaaacaatgttta

SEQ ID NO: 2062509 - DNA, 16 bp, Homo sapiens
aagccaaagacttagt

SEQ ID NO: 2062510 - DNA, 18 bp, Homo sapiens
aagccaaagctaggcctg

SEQ ID NO: 2062511 - DNA, 22 bp, Homo sapiens
aagccaaagctaggcctggcca

SEQ ID NO: 2062512 - DNA, 15 bp, Homo sapiens
aagccaaattttttg

SEQ ID NO: 2062513 - DNA, 14 bp, Homo sapiens
aagccacagctggt

SEQ ID NO: 2062514 - DNA, 13 bp, Homo sapiens
aagccacatagag

SEQ ID NO: 2062515 - DNA, 20 bp, Homo sapiens
aagccactatgtccagctag

SEQ ID NO: 2062516 - DNA, 12 bp, Homo sapiens
aagccagagcct

SEQ ID NO: 2062517 - DNA, 15 bp, Homo sapiens
aagccagagcctggg

SEQ ID NO: 2062518 - DNA, 23 bp, Homo sapiens
aagccaggctgagtgagccacag

SEQ ID NO: 2062519 - DNA, 15 bp, Homo sapiens
aagccatctttcttt

SEQ ID NO: 2062520 - DNA, 12 bp, Homo sapiens
aagccatggtga

SEQ ID NO: 2062521 - DNA, 23 bp, Homo sapiens
aagccattcttactcgggcgacc

SEQ ID NO: 2062522 - DNA, 14 bp, Homo sapiens
aagcccaaatggct

SEQ ID NO: 2062523 - DNA, 20 bp, Homo sapiens
aagcccaaatggctctgtga

SEQ ID NO: 2062524 - DNA, 11 bp, Homo sapiens
aagcccaggct

SEQ ID NO: 2062525 - DNA, 19 bp, Homo sapiens
aatatataatggtttactg

SEQ ID NO: 2062526 - DNA, 21 bp, Homo sapiens
aatatataatggtttactgct

SEQ ID NO: 2062527 - DNA, 22 bp, Homo sapiens
acacctggccgcctccaggagc

SEQ ID NO: 2062528 - DNA, 18 bp, Homo sapiens
acaccttagcagctcttc

SEQ ID NO: 2062529 - DNA, 14 bp, Homo sapiens
acaccttgacaggg

SEQ ID NO: 2062530 - DNA, 22 bp, Homo sapiens
acaccttgtgaccttctctata

SEQ ID NO: 2062531 - DNA, 17 bp, Homo sapiens
acacgcctgtaatccca

SEQ ID NO: 2062532 - DNA, 17 bp, Homo sapiens
acacgcgtgcacacacc

SEQ ID NO: 2062533 - DNA, 19 bp, Homo sapiens
acacgcttaaaacctagaa

SEQ ID NO: 2062534 - DNA, 14 bp, Homo sapiens
acacggaggcatct

SEQ ID NO: 2062535 - DNA, 17 bp, Homo sapiens
acacggaggcatctgca

SEQ ID NO: 2062536 - DNA, 17 bp, Homo sapiens
acacggcagctgtagct

SEQ ID NO: 2062537 - DNA, 13 bp, Homo sapiens
acacggccctgcc

SEQ ID NO: 2062538 - DNA, 21 bp, Homo sapiens
acacggccctgccccatcctg

SEQ ID NO: 2062539 - DNA, 18 bp, Homo sapiens
acacggtgaaatccaggt

SEQ ID NO: 2062540 - DNA, 19 bp, Homo sapiens
acacgtatttatatttgga

SEQ ID NO: 2062541 - DNA, 18 bp, Homo sapiens
acacgtgctcgcagcctg

SEQ ID NO: 2062542 - DNA, 14 bp, Homo sapiens
acacgtggcctgca

SEQ ID NO: 2062543 - DNA, 14 bp, Homo sapiens
acacgtgtctataa

SEQ ID NO: 2062544 - DNA, 14 bp, Homo sapiens
acactaaaaataaa

SEQ ID NO: 2062545 - DNA, 17 bp, Homo sapiens
acactaaccacgctgga

SEQ ID NO: 2062546 - DNA, 17 bp, Homo sapiens
acactacaagtttataa

SEQ ID NO: 2062547 - DNA, 17 bp, Homo sapiens
acactagggtcaggcgg

SEQ ID NO: 2062548 - DNA, 18 bp, Homo sapiens
acactagttttgtgccag

SEQ ID NO: 2062549 - DNA, 23 bp, Homo sapiens
acactagttttgtgccagccgtg

SEQ ID NO: 2062550 - DNA, 19 bp, Homo sapiens
acactatggtatttgagtg

SEQ ID NO: 2062551 - DNA, 16 bp, Homo sapiens
acactattgcattgtt

SEQ ID NO: 2062552 - DNA, 20 bp, Homo sapiens
acactcagaagcctgggggc

SEQ ID NO: 2062553 - DNA, 19 bp, Homo sapiens
acactccaccccctccagc

SEQ ID NO: 2062554 - DNA, 14 bp, Homo sapiens
acactccagcctga

SEQ ID NO: 2062555 - DNA, 23 bp, Homo sapiens
acactccccgcctgtcctgcctc

SEQ ID NO: 2062556 - DNA, 17 bp, Homo sapiens
acactctctgtacaaaa

SEQ ID NO: 2062557 - DNA, 13 bp, Homo sapiens
acactcttcttga

SEQ ID NO: 2062558 - DNA, 20 bp, Homo sapiens
acactcttcttgagcagacc

SEQ ID NO: 2062559 - DNA, 16 bp, Homo sapiens
acactctttgtaagag

SEQ ID NO: 2062560 - DNA, 12 bp, Homo sapiens
acacaacattta

SEQ ID NO: 2062561 - DNA, 13 bp, Homo sapiens
acacaacatttat

SEQ ID NO: 2062562 - DNA, 15 bp, Homo sapiens
acacaagccacagaa

SEQ ID NO: 2062563 - DNA, 16 bp, Homo sapiens
acacaagccacagaag

SEQ ID NO: 2062564 - DNA, 15 bp, Homo sapiens
acacaagctggaagc

SEQ ID NO: 2062565 - DNA, 14 bp, Homo sapiens
acacaagtaaacat

SEQ ID NO: 2062566 - DNA, 19 bp, Homo sapiens
acacaatgctattgaaatt

SEQ ID NO: 2062567 - DNA, 15 bp, Homo sapiens
acacaattaattgtc

SEQ ID NO: 2062568 - DNA, 19 bp, Homo sapiens
acacaattgatacttcagg

SEQ ID NO: 2062569 - DNA, 15 bp, Homo sapiens
acacacacacacaca

SEQ ID NO: 2062570 - DNA, 15 bp, Homo sapiens
acacacacacacata

SEQ ID NO: 2062571 - DNA, 14 bp, Homo sapiens
acacacacagatgt

SEQ ID NO: 2062572 - DNA, 14 bp, Homo sapiens
acacacacatacac

SEQ ID NO: 2062573 - DNA, 19 bp, Homo sapiens
acacacagactacagccag

SEQ ID NO: 2062574 - DNA, 13 bp, Homo sapiens
acacacagaggaa

SEQ ID NO: 2062575 - DNA, 22 bp, Homo sapiens
acacacagaggaagagcaggca

SEQ ID NO: 2062576 - DNA, 14 bp, Homo sapiens
acacacagctctgt

SEQ ID NO: 2062577 - DNA, 17 bp, Homo sapiens
acacacaggcaactgag

SEQ ID NO: 2062578 - DNA, 15 bp, Homo sapiens
acacacatatacata

SEQ ID NO: 2062579 - DNA, 21 bp, Homo sapiens
acacacatatacatatatata

SEQ ID NO: 2062580 - DNA, 18 bp, Homo sapiens
acacacatggatgagcac

SEQ ID NO: 2062581 - DNA, 14 bp, Homo sapiens
acacaccagagccc

SEQ ID NO: 2062582 - DNA, 15 bp, Homo sapiens
acacacctcaccaga

SEQ ID NO: 2062583 - DNA, 23 bp, Homo sapiens
acacacctctggatccctggagg

SEQ ID NO: 2062584 - DNA, 20 bp, Homo sapiens
acacacgcaggaactcccag

SEQ ID NO: 2062585 - DNA, 16 bp, Homo sapiens
acacacggaccatgtg

SEQ ID NO: 2062586 - DNA, 23 bp, Homo sapiens
acacacggatgcacacacagatg

SEQ ID NO: 2062587 - DNA, 13 bp, Homo sapiens
acacactaatcga

SEQ ID NO: 2062588 - DNA, 10 bp, Homo sapiens
acacactgta

SEQ ID NO: 2062589 - DNA, 12 bp, Homo sapiens
acacactgtaaa

SEQ ID NO: 2062590 - DNA, 21 bp, Homo sapiens
aatttgggggacttacatgat

SEQ ID NO: 2062591 - DNA, 19 bp, Homo sapiens
aatttggtgtggctgtatt

SEQ ID NO: 2062592 - DNA, 22 bp, Homo sapiens
aatttgtaagcaacttgcttct

SEQ ID NO: 2062593 - DNA, 23 bp, Homo sapiens
aatttgtaagcaacttgcttcta

SEQ ID NO: 2062594 - DNA, 15 bp, Homo sapiens
aatttgtaagtttat

SEQ ID NO: 2062595 - DNA, 20 bp, Homo sapiens
aatttgtacatatgtaaaat

SEQ ID NO: 2062596 - DNA, 15 bp, Homo sapiens
aatttgtatctgaag

SEQ ID NO: 2062597 - DNA, 18 bp, Homo sapiens
aatttgtatctgaaggag

SEQ ID NO: 2062598 - DNA, 19 bp, Homo sapiens
aatttgtatctgaaggaga

SEQ ID NO: 2062599 - DNA, 14 bp, Homo sapiens
aatttgttgtactt

SEQ ID NO: 2062600 - DNA, 15 bp, Homo sapiens
aatttgttgtacttt

SEQ ID NO: 2062601 - DNA, 21 bp, Homo sapiens
aatttgtttagaagtacgttt

SEQ ID NO: 2062602 - DNA, 12 bp, Homo sapiens
aattttaaatta

SEQ ID NO: 2062603 - DNA, 21 bp, Homo sapiens
aattttactgacagaaatgca

SEQ ID NO: 2062604 - DNA, 14 bp, Homo sapiens
aattttagagcata

SEQ ID NO: 2062605 - DNA, 23 bp, Homo sapiens
aattttattggtaggatttatat

SEQ ID NO: 2062606 - DNA, 18 bp, Homo sapiens
aattttcacttgcttaaa

SEQ ID NO: 2062607 - DNA, 20 bp, Homo sapiens
aattttcacttgcttaaaaa

SEQ ID NO: 2062608 - DNA, 17 bp, Homo sapiens
aattttcagaccccagc

SEQ ID NO: 2062609 - DNA, 18 bp, Homo sapiens
aattttctagactttctg

SEQ ID NO: 2062610 - DNA, 20 bp, Homo sapiens
aattttctagactttctgtt

SEQ ID NO: 2062611 - DNA, 21 bp, Homo sapiens
aattttgaataaataaatgta

SEQ ID NO: 2062612 - DNA, 21 bp, Homo sapiens
aattcctctcactaaacttta

SEQ ID NO: 2062613 - DNA, 17 bp, Homo sapiens
aattcctgaagccagat

SEQ ID NO: 2062614 - DNA, 21 bp, Homo sapiens
aattcctgtagcatcttctgg

SEQ ID NO: 2062615 - DNA, 19 bp, Homo sapiens
aattctaaatgaatgttta

SEQ ID NO: 2062616 - DNA, 18 bp, Homo sapiens
aattctaagattgtacat

SEQ ID NO: 2062617 - DNA, 14 bp, Homo sapiens
aattctacaggatg

SEQ ID NO: 2062618 - DNA, 20 bp, Homo sapiens
aattctactaaatattttat

SEQ ID NO: 2062619 - DNA, 21 bp, Homo sapiens
aattctcatttgtcacacact

SEQ ID NO: 2062620 - DNA, 22 bp, Homo sapiens
aattctctctaaaaataaaatg

SEQ ID NO: 2062621 - DNA, 23 bp, Homo sapiens
aattctctctaaaaataaaatga

SEQ ID NO: 2062622 - DNA, 17 bp, Homo sapiens
aattctcttacccagaa

SEQ ID NO: 2062623 - DNA, 15 bp, Homo sapiens
aattctgctacctca

SEQ ID NO: 2062624 - DNA, 21 bp, Homo sapiens
aattctggctggtagagcagg

SEQ ID NO: 2062625 - DNA, 13 bp, Homo sapiens
aattctgtgaaga

SEQ ID NO: 2062626 - DNA, 15 bp, Homo sapiens
aattcttatgcttat

SEQ ID NO: 2062627 - DNA, 18 bp, Homo sapiens
aattcttcaggtggaaaa

SEQ ID NO: 2062628 - DNA, 21 bp, Homo sapiens
aattcttccagtgcaacaaaa

SEQ ID NO: 2062629 - DNA, 13 bp, Homo sapiens
aattcttgaagtt

SEQ ID NO: 2062630 - DNA, 23 bp, Homo sapiens
acatatgtagactatatacatgt

SEQ ID NO: 2062631 - DNA, 23 bp, Homo sapiens
acatatgtattaagccaaacatg

SEQ ID NO: 2062632 - DNA, 12 bp, Homo sapiens
acatattataaa

SEQ ID NO: 2062633 - DNA, 20 bp, Homo sapiens
acatattataaataaatgcc

SEQ ID NO: 2062634 - DNA, 16 bp, Homo sapiens
acatattcttggagaa

SEQ ID NO: 2062635 - DNA, 14 bp, Homo sapiens
acatatttgttaaa

SEQ ID NO: 2062636 - DNA, 19 bp, Homo sapiens
acatatttgttaaatattt

SEQ ID NO: 2062637 - DNA, 20 bp, Homo sapiens
acatcaaatttgccaccact

SEQ ID NO: 2062638 - DNA, 13 bp, Homo sapiens
acatcacagcaga

SEQ ID NO: 2062639 - DNA, 20 bp, Homo sapiens
acatcacagcagaatgaaga

SEQ ID NO: 2062640 - DNA, 13 bp, Homo sapiens
acatcacaggaca

SEQ ID NO: 2062641 - DNA, 21 bp, Homo sapiens
acatcaccgacgcgtctcctg

SEQ ID NO: 2062642 - DNA, 20 bp, Homo sapiens
acatcacctttttgactttt

SEQ ID NO: 2062643 - DNA, 18 bp, Homo sapiens
acatcactgattgggtgc

SEQ ID NO: 2062644 - DNA, 15 bp, Homo sapiens
acatcacttgtacaa

SEQ ID NO: 2062645 - DNA, 15 bp, Homo sapiens
acatcatgcattcac

SEQ ID NO: 2062646 - DNA, 17 bp, Homo sapiens
acatcatgcattcacaa

SEQ ID NO: 2062647 - DNA, 18 bp, Homo sapiens
acatcatgcattcacaag

SEQ ID NO: 2062648 - DNA, 15 bp, Homo sapiens
acatcattcattttt

SEQ ID NO: 2062649 - DNA, 21 bp, Homo sapiens
acatccatgtcctatgtgtga

SEQ ID NO: 2062650 - DNA, 15 bp, Homo sapiens
acatcccaggagggg

SEQ ID NO: 2062651 - DNA, 18 bp, Homo sapiens
acatcccatcatggctgc

SEQ ID NO: 2062652 - DNA, 18 bp, Homo sapiens
acatcccattgccctggt

SEQ ID NO: 2062653 - DNA, 18 bp, Homo sapiens
acatcccggcctcttcca

SEQ ID NO: 2062654 - DNA, 23 bp, Homo sapiens
acatccctacaaaaaattagaaa

SEQ ID NO: 2062655 - DNA, 21 bp, Homo sapiens
acatcctttctattgaaaaat

SEQ ID NO: 2062656 - DNA, 18 bp, Homo sapiens
acatctaagcctgttgag

SEQ ID NO: 2062657 - DNA, 19 bp, Homo sapiens
acatctaatgtctcttcct

SEQ ID NO: 2062658 - DNA, 17 bp, Homo sapiens
acatctggcatggctcc

SEQ ID NO: 2062659 - DNA, 13 bp, Homo sapiens
acatcttcaaagc

SEQ ID NO: 2062660 - DNA, 13 bp, Homo sapiens
acatcttcagctc

SEQ ID NO: 2062661 - DNA, 15 bp, Homo sapiens
acatcttcagctccc

SEQ ID NO: 2062662 - DNA, 14 bp, Homo sapiens
acatcttctcagtg

SEQ ID NO: 2062663 - DNA, 13 bp, Homo sapiens
acatcttgctctg

SEQ ID NO: 2062664 - DNA, 16 bp, Homo sapiens
acatcttgctctgctg

SEQ ID NO: 2062665 - DNA, 17 bp, Homo sapiens
acatcttgctctgctga

SEQ ID NO: 2062666 - DNA, 17 bp, Homo sapiens
acatctttttcctccct

SEQ ID NO: 2062667 - DNA, 22 bp, Homo sapiens
acatctttttcctccctttccc

SEQ ID NO: 2062668 - DNA, 16 bp, Homo sapiens
acatgaaaactatttt

SEQ ID NO: 2062669 - DNA, 18 bp, Homo sapiens
acatgaaaactattttaa

SEQ ID NO: 2062670 - DNA, 16 bp, Homo sapiens
acatgaagaagctaaa

SEQ ID NO: 2062671 - DNA, 21 bp, Homo sapiens
acatgaagtgtgtttccttca

SEQ ID NO: 2062672 - DNA, 21 bp, Homo sapiens
acatgaatcccacccacatgt

SEQ ID NO: 2062673 - DNA, 11 bp, Homo sapiens
acatgacactg

SEQ ID NO: 2062674 - DNA, 13 bp, Homo sapiens
acatgacactgac

SEQ ID NO: 2062675 - DNA, 12 bp, Homo sapiens
acatgagaaatg

SEQ ID NO: 2062676 - DNA, 13 bp, Homo sapiens
acatgagaaatgt

SEQ ID NO: 2062677 - DNA, 16 bp, Homo sapiens
acatgagaaatgtgaa

SEQ ID NO: 2062678 - DNA, 21 bp, Homo sapiens
acatgaggacatgatggagcg

SEQ ID NO: 2062679 - DNA, 15 bp, Homo sapiens
acatgatacccctta

SEQ ID NO: 2062680 - DNA, 14 bp, Homo sapiens
acatgatgtgagat

SEQ ID NO: 2062681 - DNA, 21 bp, Homo sapiens
acatgatttagggaagcaggg

SEQ ID NO: 2062682 - DNA, 15 bp, Homo sapiens
acatgcacatttata

SEQ ID NO: 2062683 - DNA, 16 bp, Homo sapiens
acatgcacatttatat

SEQ ID NO: 2062684 - DNA, 13 bp, Homo sapiens
acatgcacgtgtg

SEQ ID NO: 2062685 - DNA, 13 bp, Homo sapiens
acatgcactgacc

SEQ ID NO: 2062686 - DNA, 14 bp, Homo sapiens
acatgcactgaccc

SEQ ID NO: 2062687 - DNA, 16 bp, Homo sapiens
acatgcagctctgatg

SEQ ID NO: 2062688 - DNA, 17 bp, Homo sapiens
acatgcatcatcagcct

SEQ ID NO: 2062689 - DNA, 20 bp, Homo sapiens
acatgcattactgcatgcac

SEQ ID NO: 2062690 - DNA, 15 bp, Homo sapiens
acatgccaccctctc

SEQ ID NO: 2062691 - DNA, 22 bp, Homo sapiens
acatgccaccctctccatgccc

SEQ ID NO: 2062692 - DNA, 23 bp, Homo sapiens
acatgccagcttcctgtgggcca

SEQ ID NO: 2062693 - DNA, 21 bp, Homo sapiens
acatgccatttgtactgaccc

SEQ ID NO: 2062694 - DNA, 23 bp, Homo sapiens
acatgcctgattttaaaaggttg

SEQ ID NO: 2062695 - DNA, 21 bp, Homo sapiens
acatgctgtgctctttgaaga

SEQ ID NO: 2062696 - DNA, 13 bp, Homo sapiens
acatggacacaga

SEQ ID NO: 2062697 - DNA, 13 bp, Homo sapiens
acatggagagaga

SEQ ID NO: 2062698 - DNA, 15 bp, Homo sapiens
accaaccaaccaacc

SEQ ID NO: 2062699 - DNA, 22 bp, Homo sapiens
accaacccatcagaaggagaag

SEQ ID NO: 2062700 - DNA, 14 bp, Homo sapiens
accaaccctgtttc

SEQ ID NO: 2062701 - DNA, 17 bp, Homo sapiens
accaaccctgtttcctg

SEQ ID NO: 2062702 - DNA, 22 bp, Homo sapiens
accaacctccccgcagagctcc

SEQ ID NO: 2062703 - DNA, 19 bp, Homo sapiens
accaactggcttctgtgca

SEQ ID NO: 2062704 - DNA, 19 bp, Homo sapiens
accaactttctgtaaactc

SEQ ID NO: 2062705 - DNA, 16 bp, Homo sapiens
accaagactctgaaat

SEQ ID NO: 2062706 - DNA, 20 bp, Homo sapiens
accaagagagaaagaagtag

SEQ ID NO: 2062707 - DNA, 18 bp, Homo sapiens
accaagagccaaaaatga

SEQ ID NO: 2062708 - DNA, 14 bp, Homo sapiens
accaagatgatcac

SEQ ID NO: 2062709 - DNA, 15 bp, Homo sapiens
accaagatgggcaca

SEQ ID NO: 2062710 - DNA, 12 bp, Homo sapiens
accaagcccagt

SEQ ID NO: 2062711 - DNA, 21 bp, Homo sapiens
accaagccccttggccctctc

SEQ ID NO: 2062712 - DNA, 15 bp, Homo sapiens
accaagccgtggctt

SEQ ID NO: 2062713 - DNA, 18 bp, Homo sapiens
accaagccgtggcttccc

SEQ ID NO: 2062714 - DNA, 18 bp, Homo sapiens
accaagctcacagttcct

SEQ ID NO: 2062715 - DNA, 23 bp, Homo sapiens
accaagctgttccacttctctag

SEQ ID NO: 2062716 - DNA, 13 bp, Homo sapiens
accaagcttcaga

SEQ ID NO: 2062717 - DNA, 17 bp, Homo sapiens
accaagcttcagagcct

SEQ ID NO: 2062718 - DNA, 15 bp, Homo sapiens
accaaggcagcctcc

SEQ ID NO: 2062719 - DNA, 17 bp, Homo sapiens
accaaggcagcctccag

SEQ ID NO: 2062720 - DNA, 23 bp, Homo sapiens
accaaggcagcctccagagccag

SEQ ID NO: 2062721 - DNA, 19 bp, Homo sapiens
accaaggtcttcagccatc

SEQ ID NO: 2062722 - DNA, 18 bp, Homo sapiens
accaataacttcagagaa

SEQ ID NO: 2062723 - DNA, 15 bp, Homo sapiens
accaatactactgta

SEQ ID NO: 2062724 - DNA, 22 bp, Homo sapiens
accaatactactgtaaatgtat

SEQ ID NO: 2062725 - DNA, 20 bp, Homo sapiens
accaatcattttaattatta

SEQ ID NO: 2062726 - DNA, 14 bp, Homo sapiens
accaatctctgtga

SEQ ID NO: 2062727 - DNA, 21 bp, Homo sapiens
accaatgattcataacaatgt

SEQ ID NO: 2062728 - DNA, 22 bp, Homo sapiens
accaatgattcataacaatgta

SEQ ID NO: 2062729 - DNA, 17 bp, Homo sapiens
accaatgcatgcagcca

SEQ ID NO: 2062730 - DNA, 14 bp, Homo sapiens
accacaaccaggaa

SEQ ID NO: 2062731 - DNA, 13 bp, Homo sapiens
accacaactgaca

SEQ ID NO: 2062732 - DNA, 16 bp, Homo sapiens
accacacccagcccac

SEQ ID NO: 2062733 - DNA, 21 bp, Homo sapiens
accacacccagcccacttctg

SEQ ID NO: 2062734 - DNA, 23 bp, Homo sapiens
accacacccagcccacttctgcc

SEQ ID NO: 2062735 - DNA, 15 bp, Homo sapiens
accacacgctgtctc

SEQ ID NO: 2062736 - DNA, 14 bp, Homo sapiens
accacactgttgag

SEQ ID NO: 2062737 - DNA, 14 bp, Homo sapiens
accacacttcttga

SEQ ID NO: 2062738 - DNA, 18 bp, Homo sapiens
accacacttcttgaaaca

SEQ ID NO: 2062739 - DNA, 18 bp, Homo sapiens
accacagcaattggctcc

SEQ ID NO: 2062740 - DNA, 17 bp, Homo sapiens
accacaggcatctacac

SEQ ID NO: 2062741 - DNA, 11 bp, Homo sapiens
accacagtgtc

SEQ ID NO: 2062742 - DNA, 23 bp, Homo sapiens
accacatccacacacgcaggaac

SEQ ID NO: 2062743 - DNA, 20 bp, Homo sapiens
accacatcttgctctgctga

SEQ ID NO: 2062744 - DNA, 21 bp, Homo sapiens
accacatcttgctctgctgac

SEQ ID NO: 2062745 - DNA, 15 bp, Homo sapiens
accaccacacccagc

SEQ ID NO: 2062746 - DNA, 15 bp, Homo sapiens
accaccagccccagc

SEQ ID NO: 2062747 - DNA, 16 bp, Homo sapiens
accaccagccccagca

SEQ ID NO: 2062748 - DNA, 17 bp, Homo sapiens
accaccctcccaccatg

SEQ ID NO: 2062749 - DNA, 18 bp, Homo sapiens
accacctaatcaggctga

SEQ ID NO: 2062750 - DNA, 17 bp, Homo sapiens
accacctaggccactcc

SEQ ID NO: 2062751 - DNA, 22 bp, Homo sapiens
acaggtttggggagggggaaga

SEQ ID NO: 2062752 - DNA, 17 bp, Homo sapiens
acagtaaaaacttgtac

SEQ ID NO: 2062753 - DNA, 23 bp, Homo sapiens
acagtaaaaacttgtactatgtt

SEQ ID NO: 2062754 - DNA, 19 bp, Homo sapiens
acagtaaagtttaaaaaat

SEQ ID NO: 2062755 - DNA, 21 bp, Homo sapiens
acagtaaagtttaaaaaatac

SEQ ID NO: 2062756 - DNA, 12 bp, Homo sapiens
acagtaaataaa

SEQ ID NO: 2062757 - DNA, 23 bp, Homo sapiens
acagtaaataaattgtttgacca

SEQ ID NO: 2062758 - DNA, 14 bp, Homo sapiens
acagtaagctgctc

SEQ ID NO: 2062759 - DNA, 22 bp, Homo sapiens
acagtagcagggaattgatcca

SEQ ID NO: 2062760 - DNA, 12 bp, Homo sapiens
acagtagcttaa

SEQ ID NO: 2062761 - DNA, 15 bp, Homo sapiens
acagtagcttaaata

SEQ ID NO: 2062762 - DNA, 21 bp, Homo sapiens
acagtagcttaaataaattca

SEQ ID NO: 2062763 - DNA, 15 bp, Homo sapiens
acagtattacttctg

SEQ ID NO: 2062764 - DNA, 16 bp, Homo sapiens
acagtattacttctgc

SEQ ID NO: 2062765 - DNA, 19 bp, Homo sapiens
acagtattacttctgctac

SEQ ID NO: 2062766 - DNA, 18 bp, Homo sapiens
acagtatttgtacaaata

SEQ ID NO: 2062767 - DNA, 17 bp, Homo sapiens
acagtcatgaggcagct

SEQ ID NO: 2062768 - DNA, 13 bp, Homo sapiens
acagtcatttaaa

SEQ ID NO: 2062769 - DNA, 16 bp, Homo sapiens
acagtcctcacagcct

SEQ ID NO: 2062770 - DNA, 18 bp, Homo sapiens
acagtcctcacagcctct

SEQ ID NO: 2062771 - DNA, 20 bp, Homo sapiens
acagtcctcacagcctctcc

SEQ ID NO: 2062772 - DNA, 12 bp, Homo sapiens
acagtcctggga

SEQ ID NO: 2062773 - DNA, 22 bp, Homo sapiens
acagtcctgggagaacctcagg

SEQ ID NO: 2062774 - DNA, 14 bp, Homo sapiens
acagtctaaagctg

SEQ ID NO: 2062775 - DNA, 15 bp, Homo sapiens
acagtctcaggaaat

SEQ ID NO: 2062776 - DNA, 11 bp, Homo sapiens
acagtctctgg

SEQ ID NO: 2062777 - DNA, 19 bp, Homo sapiens
acagtctctttaatcttca

SEQ ID NO: 2062778 - DNA, 19 bp, Homo sapiens
acagtctttctttctgaat

SEQ ID NO: 2062779 - DNA, 19 bp, Homo sapiens
acagtgacaaattgtaact

SEQ ID NO: 2062780 - DNA, 13 bp, Homo sapiens
acagtgagccaag

SEQ ID NO: 2062781 - DNA, 18 bp, Homo sapiens
acagtgagcctgaatttt

SEQ ID NO: 2062782 - DNA, 23 bp, Homo sapiens
acagtgagtcgaggacagggagg

SEQ ID NO: 2062783 - DNA, 15 bp, Homo sapiens
acagtgatctccata

SEQ ID NO: 2062784 - DNA, 18 bp, Homo sapiens
acagtgatctccatatgt

SEQ ID NO: 2062785 - DNA, 21 bp, Homo sapiens
acagtgatctccatatgttac

SEQ ID NO: 2062786 - DNA, 22 bp, Homo sapiens
acagtgatctccatatgttaca

SEQ ID NO: 2062787 - DNA, 17 bp, Homo sapiens
acagtgcatctcagccc

SEQ ID NO: 2062788 - DNA, 14 bp, Homo sapiens
acagtgctgcgaga

SEQ ID NO: 2062789 - DNA, 13 bp, Homo sapiens
acagtgctgttct

SEQ ID NO: 2062790 - DNA, 20 bp, Homo sapiens
acagtgcttcagcctgaggc

SEQ ID NO: 2062791 - DNA, 14 bp, Homo sapiens
acagtggagaaata

SEQ ID NO: 2062792 - DNA, 16 bp, Homo sapiens
acagtggagaaatatt

SEQ ID NO: 2062793 - DNA, 17 bp, Homo sapiens
acagtggagaaatattt

SEQ ID NO: 2062794 - DNA, 14 bp, Homo sapiens
acagtggagtgaga

SEQ ID NO: 2062795 - DNA, 16 bp, Homo sapiens
acagtggatcatgaaa

SEQ ID NO: 2062796 - DNA, 20 bp, Homo sapiens
acagtggcgagaggagagga

SEQ ID NO: 2062797 - DNA, 18 bp, Homo sapiens
acagtgggaactctgaca

SEQ ID NO: 2062798 - DNA, 16 bp, Homo sapiens
acagtgtagcttgccc

SEQ ID NO: 2062799 - DNA, 21 bp, Homo sapiens
acagtgttgaaaatgttcaga

SEQ ID NO: 2062800 - DNA, 9 bp, Homo sapiens
acagtgttt

SEQ ID NO: 2062801 - DNA, 16 bp, Homo sapiens
acagtgtttcccataa

SEQ ID NO: 2062802 - DNA, 23 bp, Homo sapiens
acagtgtttcccataattttctt

SEQ ID NO: 2062803 - DNA, 16 bp, Homo sapiens
acagttaactctccca

SEQ ID NO: 2062804 - DNA, 14 bp, Homo sapiens
acagttaactttca

SEQ ID NO: 2062805 - DNA, 20 bp, Homo sapiens
acagttcaagaaagcttcaa

SEQ ID NO: 2062806 - DNA, 21 bp, Homo sapiens
acagttcagttcctctttgca

SEQ ID NO: 2062807 - DNA, 16 bp, Homo sapiens
acagttcctcgccctg

SEQ ID NO: 2062808 - DNA, 19 bp, Homo sapiens
acagttcctcgccctgggt

SEQ ID NO: 2062809 - DNA, 13 bp, Homo sapiens
acagttccttcag

SEQ ID NO: 2062810 - DNA, 19 bp, Homo sapiens
acagttcttggtgactgtc

SEQ ID NO: 2062811 - DNA, 21 bp, Homo sapiens
acagttgctgtcataagaatg

SEQ ID NO: 2062812 - DNA, 20 bp, Homo sapiens
acagtttgatgtcattaatg

SEQ ID NO: 2062813 - DNA, 18 bp, Homo sapiens
acagttttctgagaaaga

SEQ ID NO: 2062814 - DNA, 21 bp, Homo sapiens
acagttttctgagaaagacta

SEQ ID NO: 2062815 - DNA, 15 bp, Homo sapiens
acagttttgaaagaa

SEQ ID NO: 2062816 - DNA, 13 bp, Homo sapiens
acataaaatatac

SEQ ID NO: 2062817 - DNA, 14 bp, Homo sapiens
acataaaatctgtg

SEQ ID NO: 2062818 - DNA, 13 bp, Homo sapiens
acataaagcaaat

SEQ ID NO: 2062819 - DNA, 21 bp, Homo sapiens
acataaagcaaatagacacag

SEQ ID NO: 2062820 - DNA, 21 bp, Homo sapiens
acataaaggtggtatgtgtgt

SEQ ID NO: 2062821 - DNA, 15 bp, Homo sapiens
acataaagttgataa

SEQ ID NO: 2062822 - DNA, 17 bp, Homo sapiens
accgagagtagccgaga

SEQ ID NO: 2062823 - DNA, 18 bp, Homo sapiens
accgagcgctttctggaa

SEQ ID NO: 2062824 - DNA, 20 bp, Homo sapiens
accgagcgctttctggaaaa

SEQ ID NO: 2062825 - DNA, 20 bp, Homo sapiens
accgagtctcttctccactg

SEQ ID NO: 2062826 - DNA, 13 bp, Homo sapiens
accgatgccagcc

SEQ ID NO: 2062827 - DNA, 15 bp, Homo sapiens
accgcagaaggaagg

SEQ ID NO: 2062828 - DNA, 16 bp, Homo sapiens
accgccagaggacaag

SEQ ID NO: 2062829 - DNA, 16 bp, Homo sapiens
accgccgcagggacgg

SEQ ID NO: 2062830 - DNA, 20 bp, Homo sapiens
accgcgagactgagaggcag

SEQ ID NO: 2062831 - DNA, 19 bp, Homo sapiens
accgcgtagagagccgggc

SEQ ID NO: 2062832 - DNA, 13 bp, Homo sapiens
accgctaaaagaa

SEQ ID NO: 2062833 - DNA, 20 bp, Homo sapiens
accgctgcctaagtggctgc

SEQ ID NO: 2062834 - DNA, 21 bp, Homo sapiens
accgctgcctaagtggctgct

SEQ ID NO: 2062835 - DNA, 16 bp, Homo sapiens
accgctggggaacaga

SEQ ID NO: 2062836 - DNA, 17 bp, Homo sapiens
accgctggggaacagag

SEQ ID NO: 2062837 - DNA, 18 bp, Homo sapiens
accgctggggaacagagc

SEQ ID NO: 2062838 - DNA, 14 bp, Homo sapiens
accgcttcacccct

SEQ ID NO: 2062839 - DNA, 15 bp, Homo sapiens
accgcttcacccctg

SEQ ID NO: 2062840 - DNA, 16 bp, Homo sapiens
accgcttcacccctgc

SEQ ID NO: 2062841 - DNA, 14 bp, Homo sapiens
accgcttcccagag

SEQ ID NO: 2062842 - DNA, 14 bp, Homo sapiens
accggcatgctggc

SEQ ID NO: 2062843 - DNA, 22 bp, Homo sapiens
accggcatgctggcctgtggca

SEQ ID NO: 2062844 - DNA, 12 bp, Homo sapiens
accggccctgcc

SEQ ID NO: 2062845 - DNA, 16 bp, Homo sapiens
accgggacagacctgg

SEQ ID NO: 2062846 - DNA, 15 bp, Homo sapiens
accgggagcctcccc

SEQ ID NO: 2062847 - DNA, 20 bp, Homo sapiens
accgggagcctccccctcag

SEQ ID NO: 2062848 - DNA, 14 bp, Homo sapiens
accgggcactcaga

SEQ ID NO: 2062849 - DNA, 15 bp, Homo sapiens
accgggccctccttg

SEQ ID NO: 2062850 - DNA, 23 bp, Homo sapiens
accgggctgggagctctgcagag

SEQ ID NO: 2062851 - DNA, 15 bp, Homo sapiens
accgggtgggcctgg

SEQ ID NO: 2062852 - DNA, 16 bp, Homo sapiens
accgggtgggcctggc

SEQ ID NO: 2062853 - DNA, 18 bp, Homo sapiens
accgggtgggcctggcct

SEQ ID NO: 2062854 - DNA, 15 bp, Homo sapiens
accggtcaccgagac

SEQ ID NO: 2062855 - DNA, 12 bp, Homo sapiens
accgtaatttta

SEQ ID NO: 2062856 - DNA, 13 bp, Homo sapiens
accgtagcctccg

SEQ ID NO: 2062857 - DNA, 12 bp, Homo sapiens
accgtccctcag

SEQ ID NO: 2062858 - DNA, 14 bp, Homo sapiens
accgtccctcagtg

SEQ ID NO: 2062859 - DNA, 16 bp, Homo sapiens
accgtctacagatggc

SEQ ID NO: 2062860 - DNA, 23 bp, Homo sapiens
accgtgatttggaagagaggcac

SEQ ID NO: 2062861 - DNA, 19 bp, Homo sapiens
accgtggccctgccctctc

SEQ ID NO: 2062862 - DNA, 20 bp, Homo sapiens
accgtggccctgccctctcc

SEQ ID NO: 2062863 - DNA, 23 bp, Homo sapiens
accgtgtccagcacagaaggaat

SEQ ID NO: 2062864 - DNA, 19 bp, Homo sapiens
accgtgtcccaaggagctg

SEQ ID NO: 2062865 - DNA, 18 bp, Homo sapiens
accgttttcatcctggcc

SEQ ID NO: 2062866 - DNA, 19 bp, Homo sapiens
accgttttcatcctggcct

SEQ ID NO: 2062867 - DNA, 12 bp, Homo sapiens
accgtttttcaa

SEQ ID NO: 2062868 - DNA, 14 bp, Homo sapiens
accgtttttcaaga

SEQ ID NO: 2062869 - DNA, 23 bp, Homo sapiens
accgtttttcaagaaaactggaa

SEQ ID NO: 2062870 - DNA, 12 bp, Homo sapiens
acctaaagaaaa

SEQ ID NO: 2062871 - DNA, 17 bp, Homo sapiens
acctaaagaaaaacaaa

SEQ ID NO: 2062872 - DNA, 16 bp, Homo sapiens
acctaaatgacctcag

SEQ ID NO: 2062873 - DNA, 22 bp, Homo sapiens
acctctgctctgaggcttccag

SEQ ID NO: 2062874 - DNA, 13 bp, Homo sapiens
acctctgggcttc

SEQ ID NO: 2062875 - DNA, 15 bp, Homo sapiens
acctctgtgtgctcc

SEQ ID NO: 2062876 - DNA, 22 bp, Homo sapiens
acctcttctatgcaagccttgc

SEQ ID NO: 2062877 - DNA, 15 bp, Homo sapiens
acctgaaaaaaagtt

SEQ ID NO: 2062878 - DNA, 21 bp, Homo sapiens
acctgaagggtgacatcccag

SEQ ID NO: 2062879 - DNA, 23 bp, Homo sapiens
acctgaagggtgacatcccagga

SEQ ID NO: 2062880 - DNA, 16 bp, Homo sapiens
acctgacaagcactgc

SEQ ID NO: 2062881 - DNA, 14 bp, Homo sapiens
acctgacacatctt

SEQ ID NO: 2062882 - DNA, 12 bp, Homo sapiens
acctgacagatg

SEQ ID NO: 2062883 - DNA, 20 bp, Homo sapiens
acctgactattgaagttgca

SEQ ID NO: 2062884 - DNA, 16 bp, Homo sapiens
acctgagccagcctgc

SEQ ID NO: 2062885 - DNA, 17 bp, Homo sapiens
acctgagcctgccgagc

SEQ ID NO: 2062886 - DNA, 20 bp, Homo sapiens
acctgagccttttcttatat

SEQ ID NO: 2062887 - DNA, 16 bp, Homo sapiens
acctgatcatggtcag

SEQ ID NO: 2062888 - DNA, 21 bp, Homo sapiens
acctgatggcacttagctatc

SEQ ID NO: 2062889 - DNA, 16 bp, Homo sapiens
acctgcaagatttcac

SEQ ID NO: 2062890 - DNA, 12 bp, Homo sapiens
acctgcaagccc

SEQ ID NO: 2062891 - DNA, 15 bp, Homo sapiens
acctgcaagccccag

SEQ ID NO: 2062892 - DNA, 16 bp, Homo sapiens
acctgcaagccccagg

SEQ ID NO: 2062893 - DNA, 17 bp, Homo sapiens
acctgcaagccccaggg

SEQ ID NO: 2062894 - DNA, 19 bp, Homo sapiens
acctgcaagccccagggcc

SEQ ID NO: 2062895 - DNA, 20 bp, Homo sapiens
acctgcaagccccagggcct

SEQ ID NO: 2062896 - DNA, 23 bp, Homo sapiens
acctgcaagccccagggcctggg

SEQ ID NO: 2062897 - DNA, 20 bp, Homo sapiens
acctgcaccgccccttctcc

SEQ ID NO: 2062898 - DNA, 16 bp, Homo sapiens
acctgcacctcccccc

SEQ ID NO: 2062899 - DNA, 20 bp, Homo sapiens
acctgcacctccccccactg

SEQ ID NO: 2062900 - DNA, 21 bp, Homo sapiens
acctgcacctccccccactgc

SEQ ID NO: 2062901 - DNA, 16 bp, Homo sapiens
acctgcacgccaccgc

SEQ ID NO: 2062902 - DNA, 15 bp, Homo sapiens
acctgcagttcctga

SEQ ID NO: 2062903 - DNA, 21 bp, Homo sapiens
acctgcatccgtagttccctg

SEQ ID NO: 2062904 - DNA, 22 bp, Homo sapiens
acctgcatccgtagttccctga

SEQ ID NO: 2062905 - DNA, 20 bp, Homo sapiens
acctgcatgtgttgtacaat

SEQ ID NO: 2062906 - DNA, 21 bp, Homo sapiens
acctgcatgtgttgtacaata

SEQ ID NO: 2062907 - DNA, 11 bp, Homo sapiens
acctgccaccg

SEQ ID NO: 2062908 - DNA, 14 bp, Homo sapiens
acctgccagccatc

SEQ ID NO: 2062909 - DNA, 16 bp, Homo sapiens
acctgccagcctggct

SEQ ID NO: 2062910 - DNA, 19 bp, Homo sapiens
acctgccatttgcaccctc

SEQ ID NO: 2062911 - DNA, 20 bp, Homo sapiens
acctgccccagcgcggcttg

SEQ ID NO: 2062912 - DNA, 13 bp, Homo sapiens
acctgccccctgg

SEQ ID NO: 2062913 - DNA, 17 bp, Homo sapiens
acctgccccgcccagct

SEQ ID NO: 2062914 - DNA, 15 bp, Homo sapiens
acctgccctctctca

SEQ ID NO: 2062915 - DNA, 16 bp, Homo sapiens
acctgccctctctcag

SEQ ID NO: 2062916 - DNA, 12 bp, Homo sapiens
acctgccctgcc

SEQ ID NO: 2062917 - DNA, 20 bp, Homo sapiens
acctgccctgccctgccacc

SEQ ID NO: 2062918 - DNA, 22 bp, Homo sapiens
acctgccctgccctgccacctg

SEQ ID NO: 2062919 - DNA, 18 bp, Homo sapiens
acctgccgacctcgtcct

SEQ ID NO: 2062920 - DNA, 22 bp, Homo sapiens
acctgcctctcacacacataga

SEQ ID NO: 2062921 - DNA, 23 bp, Homo sapiens
acctgcctctcacacacatagat

SEQ ID NO: 2062922 - DNA, 13 bp, Homo sapiens
acctgcctgccct

SEQ ID NO: 2062923 - DNA, 23 bp, Homo sapiens
acctgcgagaggtccctgcttac

SEQ ID NO: 2062924 - DNA, 18 bp, Homo sapiens
acctgctctcctcttgcc

SEQ ID NO: 2062925 - DNA, 13 bp, Homo sapiens
acctgctgagctc

SEQ ID NO: 2062926 - DNA, 14 bp, Homo sapiens
acctgctgagctct

SEQ ID NO: 2062927 - DNA, 15 bp, Homo sapiens
acctgctgagctctg

SEQ ID NO: 2062928 - DNA, 16 bp, Homo sapiens
acctgctgagctctga

SEQ ID NO: 2062929 - DNA, 23 bp, Homo sapiens
acctgctgagctctgagaggccc

SEQ ID NO: 2062930 - DNA, 15 bp, Homo sapiens
acctgctgctgctat

SEQ ID NO: 2062931 - DNA, 17 bp, Homo sapiens
acctgctgggtaaactg

SEQ ID NO: 2062932 - DNA, 20 bp, Homo sapiens
acctgctgtgcaccttacat

SEQ ID NO: 2062933 - DNA, 23 bp, Homo sapiens
acctgcttcatgctcagccctga

SEQ ID NO: 2062934 - DNA, 15 bp, Homo sapiens
acctgcttctgaact

SEQ ID NO: 2062935 - DNA, 23 bp, Homo sapiens
acctgcttctgaactcaagctgc

SEQ ID NO: 2062936 - DNA, 15 bp, Homo sapiens
acctgctttctcctg

SEQ ID NO: 2062937 - DNA, 21 bp, Homo sapiens
acctggaagggctagaacctg

SEQ ID NO: 2062938 - DNA, 13 bp, Homo sapiens
acctggagaccag

SEQ ID NO: 2062939 - DNA, 20 bp, Homo sapiens
acctggagagccagaacctg

SEQ ID NO: 2062940 - DNA, 21 bp, Homo sapiens
acctggagagctagaacctag

SEQ ID NO: 2062941 - DNA, 23 bp, Homo sapiens
acctggagagctagaacctggag

SEQ ID NO: 2062942 - DNA, 16 bp, Homo sapiens
accatttaattcataa

SEQ ID NO: 2062943 - DNA, 19 bp, Homo sapiens
accatttaattcataatta

SEQ ID NO: 2062944 - DNA, 15 bp, Homo sapiens
acccaaaagagaaaa

SEQ ID NO: 2062945 - DNA, 21 bp, Homo sapiens
acccaaataaatgtgtaaatg

SEQ ID NO: 2062946 - DNA, 15 bp, Homo sapiens
acccaacagctcaga

SEQ ID NO: 2062947 - DNA, 12 bp, Homo sapiens
acccaaccactc

SEQ ID NO: 2062948 - DNA, 14 bp, Homo sapiens
acccaagaggtggg

SEQ ID NO: 2062949 - DNA, 21 bp, Homo sapiens
acccaattcaggactggctca

SEQ ID NO: 2062950 - DNA, 21 bp, Homo sapiens
acccaatttaattccataatc

SEQ ID NO: 2062951 - DNA, 12 bp, Homo sapiens
acccacagcctc

SEQ ID NO: 2062952 - DNA, 16 bp, Homo sapiens
acccacatgtgacaca

SEQ ID NO: 2062953 - DNA, 14 bp, Homo sapiens
acccacccatcttc

SEQ ID NO: 2062954 - DNA, 21 bp, Homo sapiens
acccacccatcttcctgctgc

SEQ ID NO: 2062955 - DNA, 23 bp, Homo sapiens
acccaccgggccactccttcctg

SEQ ID NO: 2062956 - DNA, 22 bp, Homo sapiens
acccacctgctgagagacccaa

SEQ ID NO: 2062957 - DNA, 18 bp, Homo sapiens
acccacgaacgctcttag

SEQ ID NO: 2062958 - DNA, 22 bp, Homo sapiens
acccacgtgagagaatctgcct

SEQ ID NO: 2062959 - DNA, 13 bp, Homo sapiens
acccactcacact

SEQ ID NO: 2062960 - DNA, 15 bp, Homo sapiens
acccactcaccaggg

SEQ ID NO: 2062961 - DNA, 18 bp, Homo sapiens
acccactcaccagggtcc

SEQ ID NO: 2062962 - DNA, 18 bp, Homo sapiens
acccactcctcactgccc

SEQ ID NO: 2062963 - DNA, 19 bp, Homo sapiens
acccactcctcactgcccc

SEQ ID NO: 2062964 - DNA, 18 bp, Homo sapiens
acccactctcctctgcct

SEQ ID NO: 2062965 - DNA, 13 bp, Homo sapiens
acccactgctctg

SEQ ID NO: 2062966 - DNA, 15 bp, Homo sapiens
acccactgctctggt

SEQ ID NO: 2062967 - DNA, 13 bp, Homo sapiens
acccactggccag

SEQ ID NO: 2062968 - DNA, 17 bp, Homo sapiens
acccactggccagtcct

SEQ ID NO: 2062969 - DNA, 23 bp, Homo sapiens
acccagagcattacgtgagccag

SEQ ID NO: 2062970 - DNA, 17 bp, Homo sapiens
acccagagccttctcct

SEQ ID NO: 2062971 - DNA, 18 bp, Homo sapiens
acccagagccttctcctg

SEQ ID NO: 2062972 - DNA, 23 bp, Homo sapiens
acccagaggaggcagaataagaa

SEQ ID NO: 2062973 - DNA, 19 bp, Homo sapiens
acccagagtggagtctgag

SEQ ID NO: 2062974 - DNA, 20 bp, Homo sapiens
acccagagtggagtctgagt

SEQ ID NO: 2062975 - DNA, 22 bp, Homo sapiens
acccagcaggaagccaggctga

SEQ ID NO: 2062976 - DNA, 16 bp, Homo sapiens
acccagcccacttctg

SEQ ID NO: 2062977 - DNA, 19 bp, Homo sapiens
acccagcccattctctctc

SEQ ID NO: 2062978 - DNA, 16 bp, Homo sapiens
acccagccccttgaga

SEQ ID NO: 2062979 - DNA, 21 bp, Homo sapiens
acccagccccttgagaaacct

SEQ ID NO: 2062980 - DNA, 14 bp, Homo sapiens
acccagccctgggg

SEQ ID NO: 2062981 - DNA, 16 bp, Homo sapiens
acccagccctggggta

SEQ ID NO: 2062982 - DNA, 21 bp, Homo sapiens
acccagccgccatcagcccaa

SEQ ID NO: 2062983 - DNA, 13 bp, Homo sapiens
acccagcgagccc

SEQ ID NO: 2062984 - DNA, 16 bp, Homo sapiens
acccagcgagccctgg

SEQ ID NO: 2062985 - DNA, 17 bp, Homo sapiens
acccagcgagccctggt

SEQ ID NO: 2062986 - DNA, 14 bp, Homo sapiens
acccagctactctg

SEQ ID NO: 2062987 - DNA, 18 bp, Homo sapiens
acccagctactctgtcca

SEQ ID NO: 2062988 - DNA, 21 bp, Homo sapiens
acccagctactctgtccaggc

SEQ ID NO: 2062989 - DNA, 20 bp, Homo sapiens
acccagctcccttcttccct

SEQ ID NO: 2062990 - DNA, 14 bp, Homo sapiens
acccaggacaagca

SEQ ID NO: 2062991 - DNA, 16 bp, Homo sapiens
acccaggacaagcatg

SEQ ID NO: 2062992 - DNA, 13 bp, Homo sapiens
acccaggagcccc

SEQ ID NO: 2062993 - DNA, 23 bp, Homo sapiens
acccaggagccccgaggccttct

SEQ ID NO: 2062994 - DNA, 23 bp, Homo sapiens
acccaggaggcggaggttgcagt

SEQ ID NO: 2062995 - DNA, 14 bp, Homo sapiens
acccaggaggtgga

SEQ ID NO: 2062996 - DNA, 19 bp, Homo sapiens
acccaggctccatggggaa

SEQ ID NO: 2062997 - DNA, 11 bp, Homo sapiens
acccaggctgc

SEQ ID NO: 2062998 - DNA, 12 bp, Homo sapiens
acccaggctgca

SEQ ID NO: 2062999 - DNA, 19 bp, Homo sapiens
acggcagagaccccaggat

SEQ ID NO: 2063000 - DNA, 21 bp, Homo sapiens
acggcagcttgagcctgtcac

SEQ ID NO: 2063001 - DNA, 10 bp, Homo sapiens
acggccaccc

SEQ ID NO: 2063002 - DNA, 12 bp, Homo sapiens
acggccaggcca

SEQ ID NO: 2063003 - DNA, 13 bp, Homo sapiens
acggccaggccag

SEQ ID NO: 2063004 - DNA, 11 bp, Homo sapiens
acggccctgcc

SEQ ID NO: 2063005 - DNA, 12 bp, Homo sapiens
acggccctgccc

SEQ ID NO: 2063006 - DNA, 19 bp, Homo sapiens
acggccctgccccatcctg

SEQ ID NO: 2063007 - DNA, 20 bp, Homo sapiens
acggccctgccccatcctgg

SEQ ID NO: 2063008 - DNA, 13 bp, Homo sapiens
acggcgttttttt

SEQ ID NO: 2063009 - DNA, 16 bp, Homo sapiens
acggctcactgcagcc

SEQ ID NO: 2063010 - DNA, 19 bp, Homo sapiens
acgggaagcaacctcccaa

SEQ ID NO: 2063011 - DNA, 14 bp, Homo sapiens
acgggagcctcctc

SEQ ID NO: 2063012 - DNA, 15 bp, Homo sapiens
acgggagcctcctct

SEQ ID NO: 2063013 - DNA, 15 bp, Homo sapiens
acgggaggcctcagt

SEQ ID NO: 2063014 - DNA, 17 bp, Homo sapiens
acgggcctcagtttccc

SEQ ID NO: 2063015 - DNA, 14 bp, Homo sapiens
acggggactgggga

SEQ ID NO: 2063016 - DNA, 13 bp, Homo sapiens
acggggaggggga

SEQ ID NO: 2063017 - DNA, 21 bp, Homo sapiens
acggtcctttaggcagcctgc

SEQ ID NO: 2063018 - DNA, 20 bp, Homo sapiens
acggtgctcgcttctcctcc

SEQ ID NO: 2063019 - DNA, 21 bp, Homo sapiens
acggtggggcgtagacttgac

SEQ ID NO: 2063020 - DNA, 20 bp, Homo sapiens
acggttaacttgtatattcc

SEQ ID NO: 2063021 - DNA, 15 bp, Homo sapiens
acgtaatgtatttat

SEQ ID NO: 2063022 - DNA, 13 bp, Homo sapiens
acgtacacacaca

SEQ ID NO: 2063023 - DNA, 16 bp, Homo sapiens
acgtacaccatatgca

SEQ ID NO: 2063024 - DNA, 19 bp, Homo sapiens
acgtataaatatgaaatga

SEQ ID NO: 2063025 - DNA, 13 bp, Homo sapiens
acgtatcatttct

SEQ ID NO: 2063026 - DNA, 15 bp, Homo sapiens
acgtatcatttctaa

SEQ ID NO: 2063027 - DNA, 23 bp, Homo sapiens
acgtatgtcggcacgtcccatgt

SEQ ID NO: 2063028 - DNA, 20 bp, Homo sapiens
acgtatgtttttgtgtattt

SEQ ID NO: 2063029 - DNA, 16 bp, Homo sapiens
acgtattggtccagct

SEQ ID NO: 2063030 - DNA, 15 bp, Homo sapiens
acgtatttaatagca

SEQ ID NO: 2063031 - DNA, 21 bp, Homo sapiens
acgtatttaatagcaaagaat

SEQ ID NO: 2063032 - DNA, 14 bp, Homo sapiens
acgtcaaacatgaa

SEQ ID NO: 2063033 - DNA, 21 bp, Homo sapiens
acgtcactggaccactgggca

SEQ ID NO: 2063034 - DNA, 17 bp, Homo sapiens
acgtcatctcagggtcc

SEQ ID NO: 2063035 - DNA, 18 bp, Homo sapiens
acgtcctggaatgaagca

SEQ ID NO: 2063036 - DNA, 21 bp, Homo sapiens
acgtcctggaatgaagcatgt

SEQ ID NO: 2063037 - DNA, 19 bp, Homo sapiens
acgtcgtcttctgtatact

SEQ ID NO: 2063038 - DNA, 14 bp, Homo sapiens
acgtctgacaggca

SEQ ID NO: 2063039 - DNA, 23 bp, Homo sapiens
acgtctgacaggcaatgctggct

SEQ ID NO: 2063040 - DNA, 12 bp, Homo sapiens
acgtctgccagg

SEQ ID NO: 2063041 - DNA, 13 bp, Homo sapiens
acgtctgccaggc

SEQ ID NO: 2063042 - DNA, 19 bp, Homo sapiens
acgtctgccaggcccatct

SEQ ID NO: 2063043 - DNA, 17 bp, Homo sapiens
acgtctgggcccccact

SEQ ID NO: 2063044 - DNA, 19 bp, Homo sapiens
acgtgaaagatgcaagcac

SEQ ID NO: 2063045 - DNA, 14 bp, Homo sapiens
acgtgaatgtctca

SEQ ID NO: 2063046 - DNA, 18 bp, Homo sapiens
acgtgactgccccaactc

SEQ ID NO: 2063047 - DNA, 16 bp, Homo sapiens
acgtgagagaatctgc

SEQ ID NO: 2063048 - DNA, 18 bp, Homo sapiens
acgtgagagaatctgcct

SEQ ID NO: 2063049 - DNA, 20 bp, Homo sapiens
acgtgcacctgtactcagga

SEQ ID NO: 2063050 - DNA, 18 bp, Homo sapiens
acgtgccaggcccggggc

SEQ ID NO: 2063051 - DNA, 17 bp, Homo sapiens
acgtgctaggggatgag

SEQ ID NO: 2063052 - DNA, 13 bp, Homo sapiens
acgtgctcgcagc

SEQ ID NO: 2063053 - DNA, 18 bp, Homo sapiens
acgtgctcgcagcctggc

SEQ ID NO: 2063054 - DNA, 18 bp, Homo sapiens
acgtgctcttctgttctc

SEQ ID NO: 2063055 - DNA, 11 bp, Homo sapiens
acgtgggagac

SEQ ID NO: 2063056 - DNA, 18 bp, Homo sapiens
acgtgggtatttcctgct

SEQ ID NO: 2063057 - DNA, 21 bp, Homo sapiens
acgtgggtatttcctgctaca

SEQ ID NO: 2063058 - DNA, 15 bp, Homo sapiens
acgttatatattgta

SEQ ID NO: 2063059 - DNA, 16 bp, Homo sapiens
acgttatatattgtat

SEQ ID NO: 2063060 - DNA, 17 bp, Homo sapiens
acgttatatattgtatt

SEQ ID NO: 2063061 - DNA, 19 bp, Homo sapiens
acgttccttactgcagaat

SEQ ID NO: 2063062 - DNA, 16 bp, Homo sapiens
acgttgacccctttcc

SEQ ID NO: 2063063 - DNA, 17 bp, Homo sapiens
acgtttaagccaaaaca

SEQ ID NO: 2063064 - DNA, 19 bp, Homo sapiens
acgtttaagccaaaacaat

SEQ ID NO: 2063065 - DNA, 23 bp, Homo sapiens
acgtttaagccaaaacaatgttt

SEQ ID NO: 2063066 - DNA, 12 bp, Homo sapiens
acgtttccatca

SEQ ID NO: 2063067 - DNA, 19 bp, Homo sapiens
acgtttttgtgctgtgggc

SEQ ID NO: 2063068 - DNA, 18 bp, Homo sapiens
actaaaaaatgtctatag

SEQ ID NO: 2063069 - DNA, 21 bp, Homo sapiens
actaaaaagtggctaattcaa

SEQ ID NO: 2063070 - DNA, 13 bp, Homo sapiens
actaaacattttg

SEQ ID NO: 2063071 - DNA, 14 bp, Homo sapiens
actaaacattttgt

SEQ ID NO: 2063072 - DNA, 23 bp, Homo sapiens
actaaactggtttgttgcagcca

SEQ ID NO: 2063073 - DNA, 13 bp, Homo sapiens
actaaactttacc

SEQ ID NO: 2063074 - DNA, 19 bp, Homo sapiens
actaaagagacatatttat

SEQ ID NO: 2063075 - DNA, 14 bp, Homo sapiens
actaaagtatgtaa

SEQ ID NO: 2063076 - DNA, 22 bp, Homo sapiens
actaaagtatgtaaagtatgta

SEQ ID NO: 2063077 - DNA, 14 bp, Homo sapiens
actaaatattttat

SEQ ID NO: 2063078 - DNA, 16 bp, Homo sapiens
actaaatctctaatat

SEQ ID NO: 2063079 - DNA, 14 bp, Homo sapiens
actaaatgagctcc

SEQ ID NO: 2063080 - DNA, 18 bp, Homo sapiens
actaaatgagctcctgcg

SEQ ID NO: 2063081 - DNA, 18 bp, Homo sapiens
actaaattgtatacattt

SEQ ID NO: 2063082 - DNA, 15 bp, Homo sapiens
actaacactcagaag

SEQ ID NO: 2063083 - DNA, 18 bp, Homo sapiens
actaacactcagaagcct

SEQ ID NO: 2063084 - DNA, 20 bp, Homo sapiens
actaacactcagaagcctgg

SEQ ID NO: 2063085 - DNA, 21 bp, Homo sapiens
actaacactcagaagcctggg

SEQ ID NO: 2063086 - DNA, 18 bp, Homo sapiens
actaacataaaatctgtg

SEQ ID NO: 2063087 - DNA, 17 bp, Homo sapiens
actaacatataatgttg

SEQ ID NO: 2063088 - DNA, 17 bp, Homo sapiens
actaaccccaacgcaca

SEQ ID NO: 2063089 - DNA, 16 bp, Homo sapiens
actaagccacaagaaa

SEQ ID NO: 2063090 - DNA, 17 bp, Homo sapiens
actaagttatagtatat

SEQ ID NO: 2063091 - DNA, 16 bp, Homo sapiens
actaatgctaagaaat

SEQ ID NO: 2063092 - DNA, 18 bp, Homo sapiens
actaatggggcggtgaga

SEQ ID NO: 2063093 - DNA, 16 bp, Homo sapiens
actaattaaaatctgg

SEQ ID NO: 2063094 - DNA, 17 bp, Homo sapiens
actaattaaaatctgga

SEQ ID NO: 2063095 - DNA, 15 bp, Homo sapiens
actaatttaaaccag

SEQ ID NO: 2063096 - DNA, 16 bp, Homo sapiens
actaatttaaaccagc

SEQ ID NO: 2063097 - DNA, 17 bp, Homo sapiens
actaatttgatgtttac

SEQ ID NO: 2063098 - DNA, 21 bp, Homo sapiens
actacaaaaaagttgttaact

SEQ ID NO: 2063099 - DNA, 16 bp, Homo sapiens
actacaaaatttgaaa

SEQ ID NO: 2063100 - DNA, 22 bp, Homo sapiens
actacaatttaaagcaaaggag

SEQ ID NO: 2063101 - DNA, 22 bp, Homo sapiens
actacacactgtgtactgcagt

SEQ ID NO: 2063102 - DNA, 15 bp, Homo sapiens
actacactccagcct

SEQ ID NO: 2063103 - DNA, 19 bp, Homo sapiens
actacactccagcctgagc

SEQ ID NO: 2063104 - DNA, 15 bp, Homo sapiens
actacagaataatgt

SEQ ID NO: 2063105 - DNA, 17 bp, Homo sapiens
actacagaataatgtgt

SEQ ID NO: 2063106 - DNA, 17 bp, Homo sapiens
actacagtctaaagctg

SEQ ID NO: 2063107 - DNA, 14 bp, Homo sapiens
actacatgcacttg

SEQ ID NO: 2063108 - DNA, 15 bp, Homo sapiens
actacatgtggttta

SEQ ID NO: 2063109 - DNA, 14 bp, Homo sapiens
actaccaagtgacc

SEQ ID NO: 2063110 - DNA, 19 bp, Homo sapiens
actacctttgtccaggcct

SEQ ID NO: 2063111 - DNA, 14 bp, Homo sapiens
actacgtgccagct

SEQ ID NO: 2063112 - DNA, 14 bp, Homo sapiens
actactattctgtt

SEQ ID NO: 2063113 - DNA, 21 bp, Homo sapiens
actactcatacttaagcaaaa

SEQ ID NO: 2063114 - DNA, 12 bp, Homo sapiens
actttaaagcgt

SEQ ID NO: 2063115 - DNA, 20 bp, Homo sapiens
actttaaccctctcttccct

SEQ ID NO: 2063116 - DNA, 14 bp, Homo sapiens
actttaagagagaa

SEQ ID NO: 2063117 - DNA, 16 bp, Homo sapiens
actttaagagagaaat

SEQ ID NO: 2063118 - DNA, 19 bp, Homo sapiens
actttaatactcacctcct

SEQ ID NO: 2063119 - DNA, 14 bp, Homo sapiens
actttaattgtgtg

SEQ ID NO: 2063120 - DNA, 17 bp, Homo sapiens
actttacccaaaaacta

SEQ ID NO: 2063121 - DNA, 13 bp, Homo sapiens
actttactctaag

SEQ ID NO: 2063122 - DNA, 15 bp, Homo sapiens
actttagaatgagag

SEQ ID NO: 2063123 - DNA, 21 bp, Homo sapiens
actttagagtagcatgagaga

SEQ ID NO: 2063124 - DNA, 16 bp, Homo sapiens
actttagctatgtgga

SEQ ID NO: 2063125 - DNA, 18 bp, Homo sapiens
actttcagtgaaagcatc

SEQ ID NO: 2063126 - DNA, 19 bp, Homo sapiens
actttcattaaagcattta

SEQ ID NO: 2063127 - DNA, 12 bp, Homo sapiens
actttcattttt

SEQ ID NO: 2063128 - DNA, 14 bp, Homo sapiens
actttccaaaacct

SEQ ID NO: 2063129 - DNA, 16 bp, Homo sapiens
actttcctacaaaatg

SEQ ID NO: 2063130 - DNA, 22 bp, Homo sapiens
actttctatagcagattgtgta

SEQ ID NO: 2063131 - DNA, 19 bp, Homo sapiens
actttctcttcatactttt

SEQ ID NO: 2063132 - DNA, 14 bp, Homo sapiens
actttgaagttagc

SEQ ID NO: 2063133 - DNA, 22 bp, Homo sapiens
acaggcccaagagatgaagagt

SEQ ID NO: 2063134 - DNA, 21 bp, Homo sapiens
acaggccccccgcagcaccct

SEQ ID NO: 2063135 - DNA, 22 bp, Homo sapiens
acaggcccggcgcggtggctca

SEQ ID NO: 2063136 - DNA, 16 bp, Homo sapiens
acaggcccggctccag

SEQ ID NO: 2063137 - DNA, 18 bp, Homo sapiens
acaggcccggctccaggc

SEQ ID NO: 2063138 - DNA, 22 bp, Homo sapiens
acaggcccggctccaggctcct

SEQ ID NO: 2063139 - DNA, 22 bp, Homo sapiens
acaggcccttcctctccactgc

SEQ ID NO: 2063140 - DNA, 12 bp, Homo sapiens
acaggcccttgg

SEQ ID NO: 2063141 - DNA, 18 bp, Homo sapiens
acaggctactctcctcgg

SEQ ID NO: 2063142 - DNA, 14 bp, Homo sapiens
acaggctcaatatt

SEQ ID NO: 2063143 - DNA, 14 bp, Homo sapiens
acaggctgggcttc

SEQ ID NO: 2063144 - DNA, 17 bp, Homo sapiens
acaggctgggcttcagt

SEQ ID NO: 2063145 - DNA, 22 bp, Homo sapiens
acaggctgggcttcagtggcag

SEQ ID NO: 2063146 - DNA, 23 bp, Homo sapiens
acaggctgggcttcagtggcagc

SEQ ID NO: 2063147 - DNA, 19 bp, Homo sapiens
acaggctgttctgcactga

SEQ ID NO: 2063148 - DNA, 23 bp, Homo sapiens
acagggaaccctgcttgcacttt

SEQ ID NO: 2063149 - DNA, 15 bp, Homo sapiens
acagggaagagcaga

SEQ ID NO: 2063150 - DNA, 17 bp, Homo sapiens
acagggaaggcaggcag

SEQ ID NO: 2063151 - DNA, 20 bp, Homo sapiens
acagggagactgcatctcaa

SEQ ID NO: 2063152 - DNA, 14 bp, Homo sapiens
acagggcagtgaca

SEQ ID NO: 2063153 - DNA, 20 bp, Homo sapiens
acagggcagtgacaagtgga

SEQ ID NO: 2063154 - DNA, 14 bp, Homo sapiens
acagggccagatgt

SEQ ID NO: 2063155 - DNA, 14 bp, Homo sapiens
acaggggcaggcct

SEQ ID NO: 2063156 - DNA, 15 bp, Homo sapiens
acaggggcaggcctg

SEQ ID NO: 2063157 - DNA, 19 bp, Homo sapiens
acagggttttgccatgttg

SEQ ID NO: 2063158 - DNA, 13 bp, Homo sapiens
acagggttttgta

SEQ ID NO: 2063159 - DNA, 15 bp, Homo sapiens
acaggtaaccacaat

SEQ ID NO: 2063160 - DNA, 17 bp, Homo sapiens
acaggtatcaggcacag

SEQ ID NO: 2063161 - DNA, 23 bp, Homo sapiens
acaggtatcaggcacaggcagga

SEQ ID NO: 2063162 - DNA, 17 bp, Homo sapiens
acaggtctagactttct

SEQ ID NO: 2063163 - DNA, 14 bp, Homo sapiens
acaggtctcctctt

SEQ ID NO: 2063164 - DNA, 18 bp, Homo sapiens
acaggtggacacacaagg

SEQ ID NO: 2063165 - DNA, 19 bp, Homo sapiens
acaggtggcaggaccagga

SEQ ID NO: 2063166 - DNA, 20 bp, Homo sapiens
acaggtggcaggaccaggac

SEQ ID NO: 2063167 - DNA, 12 bp, Homo sapiens
acaggtgtaaat

SEQ ID NO: 2063168 - DNA, 13 bp, Homo sapiens
acaggtgtaaata

SEQ ID NO: 2063169 - DNA, 20 bp, Homo sapiens
acaggtgtgaaccaccacac

SEQ ID NO: 2063170 - DNA, 23 bp, Homo sapiens
acaggtgtgaaccaccacaccca

SEQ ID NO: 2063171 - DNA, 17 bp, Homo sapiens
acaggtgtggtgtaatt

SEQ ID NO: 2063172 - DNA, 12 bp, Homo sapiens
acaggttcccag

SEQ ID NO: 2063173 - DNA, 16 bp, Homo sapiens
acaggttcccagcagc

SEQ ID NO: 2063174 - DNA, 15 bp, Homo sapiens
acttaagagaaatgg

SEQ ID NO: 2063175 - DNA, 17 bp, Homo sapiens
acttaataaattcagat

SEQ ID NO: 2063176 - DNA, 13 bp, Homo sapiens
acttaatgaacca

SEQ ID NO: 2063177 - DNA, 22 bp, Homo sapiens
acttacagagcgtggctgtgct

SEQ ID NO: 2063178 - DNA, 17 bp, Homo sapiens
acttacatgattcattt

SEQ ID NO: 2063179 - DNA, 18 bp, Homo sapiens
acttacatgattcatttt

SEQ ID NO: 2063180 - DNA, 21 bp, Homo sapiens
acttaccaggcaccaaaagaa

SEQ ID NO: 2063181 - DNA, 15 bp, Homo sapiens
acttaccttcaataa

SEQ ID NO: 2063182 - DNA, 17 bp, Homo sapiens
acttaccttcaataaag

SEQ ID NO: 2063183 - DNA, 16 bp, Homo sapiens
acttagaaattgcatt

SEQ ID NO: 2063184 - DNA, 12 bp, Homo sapiens
acttagaaggat

SEQ ID NO: 2063185 - DNA, 16 bp, Homo sapiens
acttagaataaaattg

SEQ ID NO: 2063186 - DNA, 18 bp, Homo sapiens
acttagatctccaggaga

SEQ ID NO: 2063187 - DNA, 15 bp, Homo sapiens
acttagcccaagagg

SEQ ID NO: 2063188 - DNA, 23 bp, Homo sapiens
acttagcccaagaggtctgagcc

SEQ ID NO: 2063189 - DNA, 21 bp, Homo sapiens
acttagccgtccatggcacca

SEQ ID NO: 2063190 - DNA, 22 bp, Homo sapiens
agaaatcattgtagaaacacag

SEQ ID NO: 2063191 - DNA, 19 bp, Homo sapiens
agaaatccctgtttaatat

SEQ ID NO: 2063192 - DNA, 13 bp, Homo sapiens
agaaatctgaaaa

SEQ ID NO: 2063193 - DNA, 13 bp, Homo sapiens
agaaatgaatgct

SEQ ID NO: 2063194 - DNA, 20 bp, Homo sapiens
agaaatgtgaagggtggggt

SEQ ID NO: 2063195 - DNA, 13 bp, Homo sapiens
agaaattcctgta

SEQ ID NO: 2063196 - DNA, 19 bp, Homo sapiens
agaaattcctgtagcatct

SEQ ID NO: 2063197 - DNA, 17 bp, Homo sapiens
agaaattccttcccact

SEQ ID NO: 2063198 - DNA, 13 bp, Homo sapiens
agaaattctgtgg

SEQ ID NO: 2063199 - DNA, 17 bp, Homo sapiens
agaaattgcatttcctg

SEQ ID NO: 2063200 - DNA, 16 bp, Homo sapiens
agaaattgcctcctta

SEQ ID NO: 2063201 - DNA, 19 bp, Homo sapiens
agaaattgttcctgatgtg

SEQ ID NO: 2063202 - DNA, 16 bp, Homo sapiens
agaaatttgatttcta

SEQ ID NO: 2063203 - DNA, 22 bp, Homo sapiens
agaaattttactgacagaaatg

SEQ ID NO: 2063204 - DNA, 13 bp, Homo sapiens
agaaatttttatt

SEQ ID NO: 2063205 - DNA, 22 bp, Homo sapiens
agaaatttttatttttctaagg

SEQ ID NO: 2063206 - DNA, 13 bp, Homo sapiens
agaacaacaacaa

SEQ ID NO: 2063207 - DNA, 21 bp, Homo sapiens
agaacaacaacaacaataaca

SEQ ID NO: 2063208 - DNA, 17 bp, Homo sapiens
agaacaaggtagttttt

SEQ ID NO: 2063209 - DNA, 18 bp, Homo sapiens
agaacaagtcacagctgc

SEQ ID NO: 2063210 - DNA, 20 bp, Homo sapiens
agaacaagtcacagctgcag

SEQ ID NO: 2063211 - DNA, 21 bp, Homo sapiens
agaacaagtcacagctgcagc

SEQ ID NO: 2063212 - DNA, 22 bp, Homo sapiens
agaacaagtcacagctgcagct

SEQ ID NO: 2063213 - DNA, 16 bp, Homo sapiens
agaacacaaggtcatt

SEQ ID NO: 2063214 - DNA, 15 bp, Homo sapiens
agaacacccctgtgc

SEQ ID NO: 2063215 - DNA, 21 bp, Homo sapiens
agaacacctttgttttgcact

SEQ ID NO: 2063216 - DNA, 14 bp, Homo sapiens
agaacacgctttca

SEQ ID NO: 2063217 - DNA, 11 bp, Homo sapiens
agaacactggt

SEQ ID NO: 2063218 - DNA, 14 bp, Homo sapiens
agaacagaggcatt

SEQ ID NO: 2063219 - DNA, 18 bp, Homo sapiens
agaacagcagaggttctt

SEQ ID NO: 2063220 - DNA, 14 bp, Homo sapiens
agaacagtaaacat

SEQ ID NO: 2063221 - DNA, 15 bp, Homo sapiens
agaacagtttgtaca

SEQ ID NO: 2063222 - DNA, 17 bp, Homo sapiens
agaacataaagcaaata

SEQ ID NO: 2063223 - DNA, 20 bp, Homo sapiens
agaacatgcacatttatata

SEQ ID NO: 2063224 - DNA, 16 bp, Homo sapiens
agaacatttacacatt

SEQ ID NO: 2063225 - DNA, 16 bp, Homo sapiens
agaaccaagaagggct

SEQ ID NO: 2063226 - DNA, 15 bp, Homo sapiens
agaaccaagcttcag

SEQ ID NO: 2063227 - DNA, 17 bp, Homo sapiens
agaaccaagcttcagag

SEQ ID NO: 2063228 - DNA, 19 bp, Homo sapiens
agaaccaagcttcagagcc

SEQ ID NO: 2063229 - DNA, 15 bp, Homo sapiens
agaaccacttggctg

SEQ ID NO: 2063230 - DNA, 18 bp, Homo sapiens
agaaccagtttcaggtgt

SEQ ID NO: 2063231 - DNA, 15 bp, Homo sapiens
agaacctaattcaat

SEQ ID NO: 2063232 - DNA, 19 bp, Homo sapiens
agaacctaattcaattcaa

SEQ ID NO: 2063233 - DNA, 16 bp, Homo sapiens
agaacctagaagggct

SEQ ID NO: 2063234 - DNA, 14 bp, Homo sapiens
agaacctcctattt

SEQ ID NO: 2063235 - DNA, 18 bp, Homo sapiens
agaacctcctattttaat

SEQ ID NO: 2063236 - DNA, 12 bp, Homo sapiens
agaacctggagg

SEQ ID NO: 2063237 - DNA, 23 bp, Homo sapiens
agaacctggagggctagaactgg

SEQ ID NO: 2063238 - DNA, 17 bp, Homo sapiens
agaacctgtagagctag

SEQ ID NO: 2063239 - DNA, 21 bp, Homo sapiens
agaacctgtgctctaagtgaa

SEQ ID NO: 2063240 - DNA, 21 bp, Homo sapiens
agaacggagccccaggcctct

SEQ ID NO: 2063241 - DNA, 20 bp, Homo sapiens
agaacgtattttaaaagcca

SEQ ID NO: 2063242 - DNA, 16 bp, Homo sapiens
agaactactaaagtgc

SEQ ID NO: 2063243 - DNA, 19 bp, Homo sapiens
agaactgaggtcactgggt

SEQ ID NO: 2063244 - DNA, 19 bp, Homo sapiens
agaactgccccatctcctc

SEQ ID NO: 2063245 - DNA, 21 bp, Homo sapiens
agaactgccccatctcctccc

SEQ ID NO: 2063246 - DNA, 20 bp, Homo sapiens
agaactgctaaatactgtac

SEQ ID NO: 2063247 - DNA, 23 bp, Homo sapiens
agaactgctaaatactgtacata

SEQ ID NO: 2063248 - DNA, 18 bp, Homo sapiens
agaactggacgcccagct

SEQ ID NO: 2063249 - DNA, 15 bp, Homo sapiens
agaactgggatttga

SEQ ID NO: 2063250 - DNA, 23 bp, Homo sapiens
agaactgggatttgaacccccgc

SEQ ID NO: 2063251 - DNA, 15 bp, Homo sapiens
agaacttcaaaatgt

SEQ ID NO: 2063252 - DNA, 21 bp, Homo sapiens
agaacttcgaccctttctctg

SEQ ID NO: 2063253 - DNA, 13 bp, Homo sapiens
agaagaaaaagaa

SEQ ID NO: 2063254 - DNA, 21 bp, Homo sapiens
agaagaaacaaggttttcagt

SEQ ID NO: 2063255 - DNA, 22 bp, Homo sapiens
agaagaaattctgtcatagaaa

SEQ ID NO: 2063256 - DNA, 13 bp, Homo sapiens
agaagaaggcagc

SEQ ID NO: 2063257 - DNA, 21 bp, Homo sapiens
agaagaaggcagcaggtggca

SEQ ID NO: 2063258 - DNA, 22 bp, Homo sapiens
agaagaagtttcatcatttttt

SEQ ID NO: 2063259 - DNA, 13 bp, Homo sapiens
agaagaatataaa

SEQ ID NO: 2063260 - DNA, 14 bp, Homo sapiens
agaagaatattcag

SEQ ID NO: 2063261 - DNA, 19 bp, Homo sapiens
agaagaatattcaggactt

SEQ ID NO: 2063262 - DNA, 22 bp, Homo sapiens
agaagaatctcatctcagtgaa

SEQ ID NO: 2063263 - DNA, 19 bp, Homo sapiens
agaagaatgcttaatcaga

SEQ ID NO: 2063264 - DNA, 16 bp, Homo sapiens
agaagacatggagact

SEQ ID NO: 2063265 - DNA, 19 bp, Homo sapiens
agaagacatggagactcct

SEQ ID NO: 2063266 - DNA, 21 bp, Homo sapiens
agaagaccacaaaaattgact

SEQ ID NO: 2063267 - DNA, 19 bp, Homo sapiens
agaagacccacgtgctagg

SEQ ID NO: 2063268 - DNA, 15 bp, Homo sapiens
agaagagatgtggca

SEQ ID NO: 2063269 - DNA, 12 bp, Homo sapiens
agaagagcctga

SEQ ID NO: 2063270 - DNA, 21 bp, Homo sapiens
agaagagctgttcacagccag

SEQ ID NO: 2063271 - DNA, 22 bp, Homo sapiens
agaagaggaggagggattctgg

SEQ ID NO: 2063272 - DNA, 14 bp, Homo sapiens
agaagagggcctgt

SEQ ID NO: 2063273 - DNA, 18 bp, Homo sapiens
agaagagggcctgtggga

SEQ ID NO: 2063274 - DNA, 24 bp, Homo sapiens
agaagagggcctgtgggagcctgc

SEQ ID NO: 2063275 - DNA, 16 bp, Homo sapiens
agaagagtcaggaagg

SEQ ID NO: 2063276 - DNA, 14 bp, Homo sapiens
agaagagtttgcaa

SEQ ID NO: 2063277 - DNA, 15 bp, Homo sapiens
agaagataatgttct

SEQ ID NO: 2063278 - DNA, 15 bp, Homo sapiens
agaagatgccctcca

SEQ ID NO: 2063279 - DNA, 16 bp, Homo sapiens
agaagatggactctga

SEQ ID NO: 2063280 - DNA, 14 bp, Homo sapiens
agaagcaggaaggg

SEQ ID NO: 2063281 - DNA, 23 bp, Homo sapiens
agaatgtatattaaggtgtggct

SEQ ID NO: 2063282 - DNA, 17 bp, Homo sapiens
agaatgtatctcctcct

SEQ ID NO: 2063283 - DNA, 18 bp, Homo sapiens
agaatgtcaccagtcctg

SEQ ID NO: 2063284 - DNA, 23 bp, Homo sapiens
agaatgtcattttggtactttgg

SEQ ID NO: 2063285 - DNA, 16 bp, Homo sapiens
agaatgtgattccttt

SEQ ID NO: 2063286 - DNA, 20 bp, Homo sapiens
agaatgtgattccttttgat

SEQ ID NO: 2063287 - DNA, 19 bp, Homo sapiens
agaatgttaagacttgaca

SEQ ID NO: 2063288 - DNA, 17 bp, Homo sapiens
agaattaaaaatgaaat

SEQ ID NO: 2063289 - DNA, 19 bp, Homo sapiens
agaattaatcttaattttg

SEQ ID NO: 2063290 - DNA, 22 bp, Homo sapiens
agaattatataggttgtgcaaa

SEQ ID NO: 2063291 - DNA, 16 bp, Homo sapiens
agaattatatctaatt

SEQ ID NO: 2063292 - DNA, 19 bp, Homo sapiens
agaattatatctaatttat

SEQ ID NO: 2063293 - DNA, 17 bp, Homo sapiens
agaattatttttgtgtt

SEQ ID NO: 2063294 - DNA, 21 bp, Homo sapiens
agaattatttttgtgtttcta

SEQ ID NO: 2063295 - DNA, 15 bp, Homo sapiens
agaattcacacctta

SEQ ID NO: 2063296 - DNA, 17 bp, Homo sapiens
agaattcctgaagccag

SEQ ID NO: 2063297 - DNA, 20 bp, Homo sapiens
agaattctgctacctcactg

SEQ ID NO: 2063298 - DNA, 22 bp, Homo sapiens
agaattctgctacctcactggg

SEQ ID NO: 2063299 - DNA, 17 bp, Homo sapiens
agaattgaacccaggag

SEQ ID NO: 2063300 - DNA, 19 bp, Homo sapiens
agaattgaaggagaaaatg

SEQ ID NO: 2063301 - DNA, 12 bp, Homo sapiens
agaattgcctct

SEQ ID NO: 2063302 - DNA, 19 bp, Homo sapiens
agaattgtccatgtgcttc

SEQ ID NO: 2063303 - DNA, 23 bp, Homo sapiens
agaattgtccatgtgcttcccta

SEQ ID NO: 2063304 - DNA, 22 bp, Homo sapiens
agaattgtgcgacttcacaaaa

SEQ ID NO: 2063305 - DNA, 20 bp, Homo sapiens
agaattgtgtcagactgttt

SEQ ID NO: 2063306 - DNA, 22 bp, Homo sapiens
agaatttaaattctttttcaaa

SEQ ID NO: 2063307 - DNA, 14 bp, Homo sapiens
agaatttattcaat

SEQ ID NO: 2063308 - DNA, 21 bp, Homo sapiens
agaatttattcaattcctctg

SEQ ID NO: 2063309 - DNA, 23 bp, Homo sapiens
agacctctgtgaggaaagcacac

SEQ ID NO: 2063310 - DNA, 19 bp, Homo sapiens
agacctgacaagcactgct

SEQ ID NO: 2063311 - DNA, 19 bp, Homo sapiens
agacctgacaccgtccctc

SEQ ID NO: 2063312 - DNA, 23 bp, Homo sapiens
agacctgacaccgtccctcagtg

SEQ ID NO: 2063313 - DNA, 14 bp, Homo sapiens
agacctgaggcaga

SEQ ID NO: 2063314 - DNA, 23 bp, Homo sapiens
agacctgggccaaaagggcagcc

SEQ ID NO: 2063315 - DNA, 16 bp, Homo sapiens
agaccttctccaaatg

SEQ ID NO: 2063316 - DNA, 18 bp, Homo sapiens
agaccttctgaagatctc

SEQ ID NO: 2063317 - DNA, 23 bp, Homo sapiens
agaccttttctctcccataccat

SEQ ID NO: 2063318 - DNA, 14 bp, Homo sapiens
agaccttttttagg

SEQ ID NO: 2063319 - DNA, 16 bp, Homo sapiens
agaccttttttaggaa

SEQ ID NO: 2063320 - DNA, 18 bp, Homo sapiens
agacgcctttctcctcca

SEQ ID NO: 2063321 - DNA, 18 bp, Homo sapiens
agacgctcaagaatcctc

SEQ ID NO: 2063322 - DNA, 20 bp, Homo sapiens
agacgctcaagaatcctctg

SEQ ID NO: 2063323 - DNA, 18 bp, Homo sapiens
agacggagtcccaccttg

SEQ ID NO: 2063324 - DNA, 23 bp, Homo sapiens
agacgggatttgaagctgtaccc

SEQ ID NO: 2063325 - DNA, 15 bp, Homo sapiens
agacggtgttgcaga

SEQ ID NO: 2063326 - DNA, 19 bp, Homo sapiens
agacgtgatgccaggacca

SEQ ID NO: 2063327 - DNA, 13 bp, Homo sapiens
agacgtgtacata

SEQ ID NO: 2063328 - DNA, 17 bp, Homo sapiens
agacgttaccaattatg

SEQ ID NO: 2063329 - DNA, 21 bp, Homo sapiens
agacgtttttgtgctgtgggc

SEQ ID NO: 2063330 - DNA, 13 bp, Homo sapiens
agactaaatgaaa

SEQ ID NO: 2063331 - DNA, 14 bp, Homo sapiens
agactaagccctgt

SEQ ID NO: 2063332 - DNA, 17 bp, Homo sapiens
agactaattaaaatctg

SEQ ID NO: 2063333 - DNA, 22 bp, Homo sapiens
agactaattaaaatctggaaat

SEQ ID NO: 2063334 - DNA, 15 bp, Homo sapiens
agactacagccagaa

SEQ ID NO: 2063335 - DNA, 19 bp, Homo sapiens
agactacagccagaagccc

SEQ ID NO: 2063336 - DNA, 12 bp, Homo sapiens
agactatataca

SEQ ID NO: 2063337 - DNA, 14 bp, Homo sapiens
agactatatacatg

SEQ ID NO: 2063338 - DNA, 15 bp, Homo sapiens
agactatatacatgt

SEQ ID NO: 2063339 - DNA, 19 bp, Homo sapiens
agactatatacatgtgtgt

SEQ ID NO: 2063340 - DNA, 17 bp, Homo sapiens
agactatcttactattt

SEQ ID NO: 2063341 - DNA, 20 bp, Homo sapiens
agactatggagcctggcaca

SEQ ID NO: 2063342 - DNA, 12 bp, Homo sapiens
agactattcaaa

SEQ ID NO: 2063343 - DNA, 16 bp, Homo sapiens
agactattcaaacagt

SEQ ID NO: 2063344 - DNA, 18 bp, Homo sapiens
agactatttaacttgagg

SEQ ID NO: 2063345 - DNA, 17 bp, Homo sapiens
agactcacctctgcctc

SEQ ID NO: 2063346 - DNA, 16 bp, Homo sapiens
agactcagggccccag

SEQ ID NO: 2063347 - DNA, 21 bp, Homo sapiens
agactcagggccccagcacta

SEQ ID NO: 2063348 - DNA, 18 bp, Homo sapiens
agactcattcttctgtac

SEQ ID NO: 2063349 - DNA, 13 bp, Homo sapiens
agactccaaagaa

SEQ ID NO: 2063350 - DNA, 14 bp, Homo sapiens
agactccaaagaaa

SEQ ID NO: 2063351 - DNA, 19 bp, Homo sapiens
agactccaaagaaatgtaa

SEQ ID NO: 2063352 - DNA, 22 bp, Homo sapiens
agactccaaagaaatgtaaggg

SEQ ID NO: 2063353 - DNA, 15 bp, Homo sapiens
agactccctcccctg

SEQ ID NO: 2063354 - DNA, 15 bp, Homo sapiens
agactcctgccctgt

SEQ ID NO: 2063355 - DNA, 17 bp, Homo sapiens
agactccttcaacaatt

SEQ ID NO: 2063356 - DNA, 15 bp, Homo sapiens
agactcctttcctct

SEQ ID NO: 2063357 - DNA, 21 bp, Homo sapiens
agactctaggacataaattag

SEQ ID NO: 2063358 - DNA, 13 bp, Homo sapiens
agactgagaggca

SEQ ID NO: 2063359 - DNA, 19 bp, Homo sapiens
agactgagaggcagaagtc

SEQ ID NO: 2063360 - DNA, 17 bp, Homo sapiens
agactgagcacctgctt

SEQ ID NO: 2063361 - DNA, 12 bp, Homo sapiens
agactgcagctg

SEQ ID NO: 2063362 - DNA, 14 bp, Homo sapiens
agactgcatctcaa

SEQ ID NO: 2063363 - DNA, 20 bp, Homo sapiens
agactgcgggatggtcctgg

SEQ ID NO: 2063364 - DNA, 23 bp, Homo sapiens
agactgcgggatggtcctggggc

SEQ ID NO: 2063365 - DNA, 17 bp, Homo sapiens
agactggaacttgaact

SEQ ID NO: 2063366 - DNA, 18 bp, Homo sapiens
agactggaacttgaactg

SEQ ID NO: 2063367 - DNA, 13 bp, Homo sapiens
agactggacagct

SEQ ID NO: 2063368 - DNA, 14 bp, Homo sapiens
agactggacagctt

SEQ ID NO: 2063369 - DNA, 17 bp, Homo sapiens
agactggacagcttgtg

SEQ ID NO: 2063370 - DNA, 20 bp, Homo sapiens
agactggacggggaaaccta

SEQ ID NO: 2063371 - DNA, 21 bp, Homo sapiens
agactggagtgaggcttccag

SEQ ID NO: 2063372 - DNA, 23 bp, Homo sapiens
agactggcacagttttctgagaa

SEQ ID NO: 2063373 - DNA, 14 bp, Homo sapiens
agactggctggctg

SEQ ID NO: 2063374 - DNA, 20 bp, Homo sapiens
agactggctggctgcagtga

SEQ ID NO: 2063375 - DNA, 22 bp, Homo sapiens
agactggtttatccacccacaa

SEQ ID NO: 2063376 - DNA, 21 bp, Homo sapiens
agactgtacttattttccaat

SEQ ID NO: 2063377 - DNA, 23 bp, Homo sapiens
agactgttgctcaaatctattca

SEQ ID NO: 2063378 - DNA, 22 bp, Homo sapiens
agacttaaatagttcagtataa

SEQ ID NO: 2063379 - DNA, 21 bp, Homo sapiens
agacttaagaaagcttaaggt

SEQ ID NO: 2063380 - DNA, 18 bp, Homo sapiens
agacttagtatattttct

SEQ ID NO: 2063381 - DNA, 22 bp, Homo sapiens
agacttagtatattttcttttc

SEQ ID NO: 2063382 - DNA, 19 bp, Homo sapiens
agacttcaagcatggctat

SEQ ID NO: 2063383 - DNA, 22 bp, Homo sapiens
agacttcaagcatggctatttt

SEQ ID NO: 2063384 - DNA, 20 bp, Homo sapiens
agacttcagaacatgctgga

SEQ ID NO: 2063385 - DNA, 16 bp, Homo sapiens
agacttcgactcagga

SEQ ID NO: 2063386 - DNA, 15 bp, Homo sapiens
agacttctctttctt

SEQ ID NO: 2063387 - DNA, 20 bp, Homo sapiens
agacttctctttcttatttt

SEQ ID NO: 2063388 - DNA, 16 bp, Homo sapiens
agacttctctttgcct

SEQ ID NO: 2063389 - DNA, 18 bp, Homo sapiens
agagacaataaaacattc

SEQ ID NO: 2063390 - DNA, 13 bp, Homo sapiens
agagacacctgca

SEQ ID NO: 2063391 - DNA, 15 bp, Homo sapiens
agagacacctgcacc

SEQ ID NO: 2063392 - DNA, 13 bp, Homo sapiens
agagacagaatga

SEQ ID NO: 2063393 - DNA, 21 bp, Homo sapiens
agagacagaccccttggcttt

SEQ ID NO: 2063394 - DNA, 21 bp, Homo sapiens
agagacagagcccccaagcct

SEQ ID NO: 2063395 - DNA, 23 bp, Homo sapiens
agagacaggaaaatcctctggct

SEQ ID NO: 2063396 - DNA, 16 bp, Homo sapiens
agagacaggaaagaat

SEQ ID NO: 2063397 - DNA, 18 bp, Homo sapiens
agagacaggcccaagaga

SEQ ID NO: 2063398 - DNA, 18 bp, Homo sapiens
agagacattaactcatta

SEQ ID NO: 2063399 - DNA, 22 bp, Homo sapiens
agagacattaactcattagact

SEQ ID NO: 2063400 - DNA, 14 bp, Homo sapiens
agagacccaaggag

SEQ ID NO: 2063401 - DNA, 21 bp, Homo sapiens
agagacccaaggaggaaaaac

SEQ ID NO: 2063402 - DNA, 14 bp, Homo sapiens
agagacccagatct

SEQ ID NO: 2063403 - DNA, 14 bp, Homo sapiens
agagaccccttcct

SEQ ID NO: 2063404 - DNA, 20 bp, Homo sapiens
agagaccccttcctttcctc

SEQ ID NO: 2063405 - DNA, 17 bp, Homo sapiens
agagacccttgtttgat

SEQ ID NO: 2063406 - DNA, 13 bp, Homo sapiens
agagaccttttct

SEQ ID NO: 2063407 - DNA, 16 bp, Homo sapiens
agagacgcaagggaga

SEQ ID NO: 2063408 - DNA, 19 bp, Homo sapiens
agagactcagggccccagc

SEQ ID NO: 2063409 - DNA, 19 bp, Homo sapiens
agagactgaaagcagcagc

SEQ ID NO: 2063410 - DNA, 14 bp, Homo sapiens
agagactgagggag

SEQ ID NO: 2063411 - DNA, 20 bp, Homo sapiens
agagactgagggagagactc

SEQ ID NO: 2063412 - DNA, 13 bp, Homo sapiens
agagactggagca

SEQ ID NO: 2063413 - DNA, 21 bp, Homo sapiens
agagactggagcatctgactc

SEQ ID NO: 2063414 - DNA, 14 bp, Homo sapiens
agagacttaagaaa

SEQ ID NO: 2063415 - DNA, 18 bp, Homo sapiens
agagagacattgcctcca

SEQ ID NO: 2063416 - DNA, 14 bp, Homo sapiens
agagagaccctcac

SEQ ID NO: 2063417 - DNA, 18 bp, Homo sapiens
agagagactcaaagagac

SEQ ID NO: 2063418 - DNA, 17 bp, Homo sapiens
agagagactgagggaga

SEQ ID NO: 2063419 - DNA, 14 bp, Homo sapiens
agagagagacagag

SEQ ID NO: 2063420 - DNA, 15 bp, Homo sapiens
agagagagaccctca

SEQ ID NO: 2063421 - DNA, 12 bp, Homo sapiens
agagagagactg

SEQ ID NO: 2063422 - DNA, 14 bp, Homo sapiens
agagagagagaggt

SEQ ID NO: 2063423 - DNA, 21 bp, Homo sapiens
agagagaggttctggggagga

SEQ ID NO: 2063424 - DNA, 15 bp, Homo sapiens
agagagcagaaataa

SEQ ID NO: 2063425 - DNA, 22 bp, Homo sapiens
agagagctcgctcttgggagtc

SEQ ID NO: 2063426 - DNA, 15 bp, Homo sapiens
agagaggagcacctg

SEQ ID NO: 2063427 - DNA, 12 bp, Homo sapiens
agagaggcacct

SEQ ID NO: 2063428 - DNA, 22 bp, Homo sapiens
agagaggcagaagaaccctggc

SEQ ID NO: 2063429 - DNA, 20 bp, Homo sapiens
agagaggcatgtgatgtgca

SEQ ID NO: 2063430 - DNA, 14 bp, Homo sapiens
agagaggccttttg

SEQ ID NO: 2063431 - DNA, 15 bp, Homo sapiens
agagagggcaagtgt

SEQ ID NO: 2063432 - DNA, 12 bp, Homo sapiens
agagagggccca

SEQ ID NO: 2063433 - DNA, 17 bp, Homo sapiens
agagaggggacatttcc

SEQ ID NO: 2063434 - DNA, 19 bp, Homo sapiens
agagaggggtacatttccc

SEQ ID NO: 2063435 - DNA, 22 bp, Homo sapiens
agagagggtggtgacctctgcc

SEQ ID NO: 2063436 - DNA, 17 bp, Homo sapiens
agagaggtagcgagctg

SEQ ID NO: 2063437 - DNA, 19 bp, Homo sapiens
agagaggtagcgagctgct

SEQ ID NO: 2063438 - DNA, 22 bp, Homo sapiens
agagaggtagcgagctgctctg

SEQ ID NO: 2063439 - DNA, 20 bp, Homo sapiens
agagaggtggagaactggga

SEQ ID NO: 2063440 - DNA, 15 bp, Homo sapiens
agagaggtgggcagc

SEQ ID NO: 2063441 - DNA, 14 bp, Homo sapiens
agagaggttctggg

SEQ ID NO: 2063442 - DNA, 18 bp, Homo sapiens
agagaggttctggggagg

SEQ ID NO: 2063443 - DNA, 22 bp, Homo sapiens
agagaggttctggggaggaagg

SEQ ID NO: 2063444 - DNA, 16 bp, Homo sapiens
agagagtattaaatat

SEQ ID NO: 2063445 - DNA, 16 bp, Homo sapiens
agagagtcctctggat

SEQ ID NO: 2063446 - DNA, 14 bp, Homo sapiens
agagatatatctga

SEQ ID NO: 2063447 - DNA, 13 bp, Homo sapiens
agagatatgcaca

SEQ ID NO: 2063448 - DNA, 20 bp, Homo sapiens
agagatatgcagaaggaagg

SEQ ID NO: 2063449 - DNA, 16 bp, Homo sapiens
agagatccaggaagca

SEQ ID NO: 2063450 - DNA, 12 bp, Homo sapiens
agagatgaatta

SEQ ID NO: 2063451 - DNA, 12 bp, Homo sapiens
agagatgcctcc

SEQ ID NO: 2063452 - DNA, 12 bp, Homo sapiens
agagatgtagca

SEQ ID NO: 2063453 - DNA, 20 bp, Homo sapiens
agagatgtttttaaaagttt

SEQ ID NO: 2063454 - DNA, 14 bp, Homo sapiens
agagattaatttgt

SEQ ID NO: 2063455 - DNA, 19 bp, Homo sapiens
agagattgccccagagccc

SEQ ID NO: 2063456 - DNA, 18 bp, Homo sapiens
agagcaaaataattttaa

SEQ ID NO: 2063457 - DNA, 16 bp, Homo sapiens
agagcaaatgagggag

SEQ ID NO: 2063458 - DNA, 18 bp, Homo sapiens
agagcaaatgagggaggg

SEQ ID NO: 2063459 - DNA, 21 bp, Homo sapiens
agagcaacccctgtacccagc

SEQ ID NO: 2063460 - DNA, 22 bp, Homo sapiens
agagcaacccctgtacccagct

SEQ ID NO: 2063461 - DNA, 23 bp, Homo sapiens
agagcaagatcctgtctttaagg

SEQ ID NO: 2063462 - DNA, 15 bp, Homo sapiens
agagcactagaagtg

SEQ ID NO: 2063463 - DNA, 12 bp, Homo sapiens
agagcactgctc

SEQ ID NO: 2063464 - DNA, 16 bp, Homo sapiens
agagcactgctccagt

SEQ ID NO: 2063465 - DNA, 15 bp, Homo sapiens
agagcagaaataaaa

SEQ ID NO: 2063466 - DNA, 23 bp, Homo sapiens
agagcagaacggagccccaggcc

SEQ ID NO: 2063467 - DNA, 15 bp, Homo sapiens
agaccagcctggcca

SEQ ID NO: 2063468 - DNA, 15 bp, Homo sapiens
agaccagctcagagg

SEQ ID NO: 2063469 - DNA, 18 bp, Homo sapiens
agaccagggcttttccca

SEQ ID NO: 2063470 - DNA, 17 bp, Homo sapiens
agaccatccaccaggcc

SEQ ID NO: 2063471 - DNA, 16 bp, Homo sapiens
agaccatcctggcccc

SEQ ID NO: 2063472 - DNA, 17 bp, Homo sapiens
agaccatcctggcccct

SEQ ID NO: 2063473 - DNA, 20 bp, Homo sapiens
agaccatcctggcccctcca

SEQ ID NO: 2063474 - DNA, 21 bp, Homo sapiens
agaccatcctggcccctccag

SEQ ID NO: 2063475 - DNA, 23 bp, Homo sapiens
agaccatctccagcatcctgctt

SEQ ID NO: 2063476 - DNA, 12 bp, Homo sapiens
agaccatttgta

SEQ ID NO: 2063477 - DNA, 14 bp, Homo sapiens
agacccaaggagga

SEQ ID NO: 2063478 - DNA, 14 bp, Homo sapiens
agacccacacatgt

SEQ ID NO: 2063479 - DNA, 16 bp, Homo sapiens
agacccagtgtaaaga

SEQ ID NO: 2063480 - DNA, 13 bp, Homo sapiens
agacccccactct

SEQ ID NO: 2063481 - DNA, 18 bp, Homo sapiens
agacccctctcaacaccc

SEQ ID NO: 2063482 - DNA, 15 bp, Homo sapiens
agacccctggctttt

SEQ ID NO: 2063483 - DNA, 19 bp, Homo sapiens
agaccctaagcctcctttt

SEQ ID NO: 2063484 - DNA, 13 bp, Homo sapiens
agaccctgcctga

SEQ ID NO: 2063485 - DNA, 21 bp, Homo sapiens
agaccgagcgctttctggaaa

SEQ ID NO: 2063486 - DNA, 18 bp, Homo sapiens
agaccgcttcacccctgc

SEQ ID NO: 2063487 - DNA, 17 bp, Homo sapiens
agaccgggggccagaca

SEQ ID NO: 2063488 - DNA, 19 bp, Homo sapiens
agaccgtgatttggaagag

SEQ ID NO: 2063489 - DNA, 18 bp, Homo sapiens
agacctaaatgacctcag

SEQ ID NO: 2063490 - DNA, 15 bp, Homo sapiens
agacctagacctggg

SEQ ID NO: 2063491 - DNA, 16 bp, Homo sapiens
agacctatttgacata

SEQ ID NO: 2063492 - DNA, 12 bp, Homo sapiens
agacctcagcct

SEQ ID NO: 2063493 - DNA, 13 bp, Homo sapiens
agacctcagcctg

SEQ ID NO: 2063494 - DNA, 14 bp, Homo sapiens
agacctcagcctgt

SEQ ID NO: 2063495 - DNA, 19 bp, Homo sapiens
agacctcagcctgtgctgc

SEQ ID NO: 2063496 - DNA, 13 bp, Homo sapiens
agacctccccacc

SEQ ID NO: 2063497 - DNA, 20 bp, Homo sapiens
agacctctcaacagatctgt

SEQ ID NO: 2063498 - DNA, 11 bp, Homo sapiens
agacctctgat

SEQ ID NO: 2063499 - DNA, 14 bp, Homo sapiens
agacctctgatccc

SEQ ID NO: 2063500 - DNA, 21 bp, Homo sapiens
agcactttgggaggccgaggc

SEQ ID NO: 2063501 - DNA, 19 bp, Homo sapiens
agcactttgggaggctgaa

SEQ ID NO: 2063502 - DNA, 21 bp, Homo sapiens
agcactttgggaggctgaagt

SEQ ID NO: 2063503 - DNA, 21 bp, Homo sapiens
agcactttgggaggctgaggc

SEQ ID NO: 2063504 - DNA, 15 bp, Homo sapiens
agcagaaagccaggg

SEQ ID NO: 2063505 - DNA, 18 bp, Homo sapiens
agcagaaaggcacgtcca

SEQ ID NO: 2063506 - DNA, 21 bp, Homo sapiens
agcagaacggagccccaggcc

SEQ ID NO: 2063507 - DNA, 13 bp, Homo sapiens
agcagaagccaaa

SEQ ID NO: 2063508 - DNA, 12 bp, Homo sapiens
agcagaatgaag

SEQ ID NO: 2063509 - DNA, 14 bp, Homo sapiens
agcagacagagaaa

SEQ ID NO: 2063510 - DNA, 20 bp, Homo sapiens
agcagacgcagcagctggga

SEQ ID NO: 2063511 - DNA, 16 bp, Homo sapiens
agcagactcagctctg

SEQ ID NO: 2063512 - DNA, 19 bp, Homo sapiens
agcagactcagctctgaca

SEQ ID NO: 2063513 - DNA, 21 bp, Homo sapiens
agcagagaatgaaagggccca

SEQ ID NO: 2063514 - DNA, 19 bp, Homo sapiens
agcagagagccctgggtga

SEQ ID NO: 2063515 - DNA, 18 bp, Homo sapiens
agcagagcaaatgaggga

SEQ ID NO: 2063516 - DNA, 15 bp, Homo sapiens
agcagagctctgccg

SEQ ID NO: 2063517 - DNA, 16 bp, Homo sapiens
agcagagcttcctcag

SEQ ID NO: 2063518 - DNA, 17 bp, Homo sapiens
agcagaggagtccaggg

SEQ ID NO: 2063519 - DNA, 18 bp, Homo sapiens
agcagagtataggatgga

SEQ ID NO: 2063520 - DNA, 19 bp, Homo sapiens
agcagagtataggatggat

SEQ ID NO: 2063521 - DNA, 15 bp, Homo sapiens
agcagagtcattgtt

SEQ ID NO: 2063522 - DNA, 17 bp, Homo sapiens
agcagagtgattcaggg

SEQ ID NO: 2063523 - DNA, 19 bp, Homo sapiens
agcagagttattgaatctt

SEQ ID NO: 2063524 - DNA, 19 bp, Homo sapiens
agcagatctgaaaggcaca

SEQ ID NO: 2063525 - DNA, 21 bp, Homo sapiens
agcagattttaattttgaata

SEQ ID NO: 2063526 - DNA, 22 bp, Homo sapiens
agcagattttaattttgaataa

SEQ ID NO: 2063527 - DNA, 15 bp, Homo sapiens
agcagcaaaaatata

SEQ ID NO: 2063528 - DNA, 16 bp, Homo sapiens
agcagcaaaaatataa

SEQ ID NO: 2063529 - DNA, 13 bp, Homo sapiens
agcagcagagagc

SEQ ID NO: 2063530 - DNA, 15 bp, Homo sapiens
agcagcattcagcac

SEQ ID NO: 2063531 - DNA, 17 bp, Homo sapiens
agcagcattcagcacac

SEQ ID NO: 2063532 - DNA, 18 bp, Homo sapiens
agcagcattcagcacacc

SEQ ID NO: 2063533 - DNA, 14 bp, Homo sapiens
agcagccagccagt

SEQ ID NO: 2063534 - DNA, 15 bp, Homo sapiens
agcagccagccagtc

SEQ ID NO: 2063535 - DNA, 18 bp, Homo sapiens
agcagccagccctgcctg

SEQ ID NO: 2063536 - DNA, 15 bp, Homo sapiens
agcagccagctctca

SEQ ID NO: 2063537 - DNA, 18 bp, Homo sapiens
agcagccagctctcagcc

SEQ ID NO: 2063538 - DNA, 19 bp, Homo sapiens
agcagccagctctcagcca

SEQ ID NO: 2063539 - DNA, 13 bp, Homo sapiens
agcagcccaaatt

SEQ ID NO: 2063540 - DNA, 18 bp, Homo sapiens
agcagcccatggcctctg

SEQ ID NO: 2063541 - DNA, 18 bp, Homo sapiens
agcagccctaaggatctc

SEQ ID NO: 2063542 - DNA, 16 bp, Homo sapiens
agcagccctcctcacc

SEQ ID NO: 2063543 - DNA, 18 bp, Homo sapiens
agcagccgtttctccttg

SEQ ID NO: 2063544 - DNA, 15 bp, Homo sapiens
agcagcctcctgggc

SEQ ID NO: 2063545 - DNA, 15 bp, Homo sapiens
agcagctcagcctcc

SEQ ID NO: 2063546 - DNA, 13 bp, Homo sapiens
agcagctcaggca

SEQ ID NO: 2063547 - DNA, 14 bp, Homo sapiens
agcagctcaggcac

SEQ ID NO: 2063548 - DNA, 16 bp, Homo sapiens
agcagctgagcagggc

SEQ ID NO: 2063549 - DNA, 17 bp, Homo sapiens
agcagctgagcagggcc

SEQ ID NO: 2063550 - DNA, 12 bp, Homo sapiens
agcagctgcggg

SEQ ID NO: 2063551 - DNA, 17 bp, Homo sapiens
agcagctgcgggtctga

SEQ ID NO: 2063552 - DNA, 20 bp, Homo sapiens
agcagctggctctccacctt

SEQ ID NO: 2063553 - DNA, 21 bp, Homo sapiens
agcagctgggacccctcccaa

SEQ ID NO: 2063554 - DNA, 13 bp, Homo sapiens
agccagggccagg

SEQ ID NO: 2063555 - DNA, 19 bp, Homo sapiens
agccaggggctgctcatca

SEQ ID NO: 2063556 - DNA, 15 bp, Homo sapiens
agccagggtcctgag

SEQ ID NO: 2063557 - DNA, 19 bp, Homo sapiens
agccagggtcctgagtggc

SEQ ID NO: 2063558 - DNA, 23 bp, Homo sapiens
agccaggtaatgagggactggaa

SEQ ID NO: 2063559 - DNA, 18 bp, Homo sapiens
agccatattcacacctca

SEQ ID NO: 2063560 - DNA, 20 bp, Homo sapiens
agccatcatgtgcctggaaa

SEQ ID NO: 2063561 - DNA, 23 bp, Homo sapiens
agccatgaccagttctggccagg

SEQ ID NO: 2063562 - DNA, 20 bp, Homo sapiens
agccatgaggagttgctgtt

SEQ ID NO: 2063563 - DNA, 19 bp, Homo sapiens
agccatgatcgagccactg

SEQ ID NO: 2063564 - DNA, 17 bp, Homo sapiens
agccatgcctcatgcca

SEQ ID NO: 2063565 - DNA, 15 bp, Homo sapiens
agccatggctcaggc

SEQ ID NO: 2063566 - DNA, 21 bp, Homo sapiens
agccatgggcctgggcctgct

SEQ ID NO: 2063567 - DNA, 19 bp, Homo sapiens
agccatggtgacacacagc

SEQ ID NO: 2063568 - DNA, 17 bp, Homo sapiens
agccatttgttggggca

SEQ ID NO: 2063569 - DNA, 18 bp, Homo sapiens
agccatttgttggggcag

SEQ ID NO: 2063570 - DNA, 21 bp, Homo sapiens
agcccaagaggtctgagccct

SEQ ID NO: 2063571 - DNA, 16 bp, Homo sapiens
agcccaagcagagtga

SEQ ID NO: 2063572 - DNA, 23 bp, Homo sapiens
agcccaagtgccatcccacattc

SEQ ID NO: 2063573 - DNA, 15 bp, Homo sapiens
agcccaatattataa

SEQ ID NO: 2063574 - DNA, 14 bp, Homo sapiens
agcccacacccctc

SEQ ID NO: 2063575 - DNA, 13 bp, Homo sapiens
agcccaccttggc

SEQ ID NO: 2063576 - DNA, 14 bp, Homo sapiens
agcccacttctgcc

SEQ ID NO: 2063577 - DNA, 15 bp, Homo sapiens
agcccacttctgcca

SEQ ID NO: 2063578 - DNA, 18 bp, Homo sapiens
agcccagaaaacctccag

SEQ ID NO: 2063579 - DNA, 20 bp, Homo sapiens
agcccagagggccaagagag

SEQ ID NO: 2063580 - DNA, 20 bp, Homo sapiens
agcccagatggaaagacgtt

SEQ ID NO: 2063581 - DNA, 12 bp, Homo sapiens
agcccagcactg

SEQ ID NO: 2063582 - DNA, 15 bp, Homo sapiens
agcccagcactgtga

SEQ ID NO: 2063583 - DNA, 17 bp, Homo sapiens
agcccagcactgtgaag

SEQ ID NO: 2063584 - DNA, 24 bp, Homo sapiens
agcccagcactgtgaagacccagc

SEQ ID NO: 2063585 - DNA, 20 bp, Homo sapiens
agcccagcagggcctcaaag

SEQ ID NO: 2063586 - DNA, 16 bp, Homo sapiens
agcccagccacctccc

SEQ ID NO: 2063587 - DNA, 17 bp, Homo sapiens
agcccagccacctccca

SEQ ID NO: 2063588 - DNA, 16 bp, Homo sapiens
agcccagcccagctgg

SEQ ID NO: 2063589 - DNA, 11 bp, Homo sapiens
agcccagcctc

SEQ ID NO: 2063590 - DNA, 21 bp, Homo sapiens
agcccagcctctgtccctctt

SEQ ID NO: 2063591 - DNA, 18 bp, Homo sapiens
agcccagctacattcctc

SEQ ID NO: 2063592 - DNA, 20 bp, Homo sapiens
agcccagctacattcctcag

SEQ ID NO: 2063593 - DNA, 18 bp, Homo sapiens
agcccagcttcctggtgt

SEQ ID NO: 2063594 - DNA, 23 bp, Homo sapiens
agcccaggagctgagtcacctcc

SEQ ID NO: 2063595 - DNA, 19 bp, Homo sapiens
agcccaggagtttgaggct

SEQ ID NO: 2063596 - DNA, 23 bp, Homo sapiens
agcccaggccgttccccttggct

SEQ ID NO: 2063597 - DNA, 19 bp, Homo sapiens
agcccaggctggagatcct

SEQ ID NO: 2063598 - DNA, 16 bp, Homo sapiens
agcccagggaggccga

SEQ ID NO: 2063599 - DNA, 17 bp, Homo sapiens
agcccagtgacctgacc

SEQ ID NO: 2063600 - DNA, 21 bp, Homo sapiens
agcccataaggccagaaactc

SEQ ID NO: 2063601 - DNA, 17 bp, Homo sapiens
agcccatggagcaggga

SEQ ID NO: 2063602 - DNA, 15 bp, Homo sapiens
agcccatggcctctg

SEQ ID NO: 2063603 - DNA, 16 bp, Homo sapiens
agcccattctctctcc

SEQ ID NO: 2063604 - DNA, 17 bp, Homo sapiens
agcccattctctctcct

SEQ ID NO: 2063605 - DNA, 18 bp, Homo sapiens
agcccattctctctcctg

SEQ ID NO: 2063606 - DNA, 20 bp, Homo sapiens
agcccattctctctcctgtc

SEQ ID NO: 2063607 - DNA, 19 bp, Homo sapiens
agcccattttatctttgaa

SEQ ID NO: 2063608 - DNA, 19 bp, Homo sapiens
agcccattttgaggccaga

SEQ ID NO: 2063609 - DNA, 13 bp, Homo sapiens
agccccacagcac

SEQ ID NO: 2063610 - DNA, 13 bp, Homo sapiens
agccccactcccg

SEQ ID NO: 2063611 - DNA, 15 bp, Homo sapiens
agccccagcactaac

SEQ ID NO: 2063612 - DNA, 12 bp, Homo sapiens
agccccaggcct

SEQ ID NO: 2063613 - DNA, 16 bp, Homo sapiens
agccccaggcctctgt

SEQ ID NO: 2063614 - DNA, 13 bp, Homo sapiens
agccccagggccc

SEQ ID NO: 2063615 - DNA, 17 bp, Homo sapiens
agccccagggcctgggg

SEQ ID NO: 2063616 - DNA, 17 bp, Homo sapiens
agccccagtgacagcta

SEQ ID NO: 2063617 - DNA, 23 bp, Homo sapiens
agccccataattttttttttcct

SEQ ID NO: 2063618 - DNA, 18 bp, Homo sapiens
agccccattctgcctgcc

SEQ ID NO: 2063619 - DNA, 22 bp, Homo sapiens
agccccattctgcctgcccagg

SEQ ID NO: 2063620 - DNA, 19 bp, Homo sapiens
agcccccaagcctctgccc

SEQ ID NO: 2063621 - DNA, 21 bp, Homo sapiens
agcccccaagcctctgcccca

SEQ ID NO: 2063622 - DNA, 16 bp, Homo sapiens
agccccccacctttct

SEQ ID NO: 2063623 - DNA, 17 bp, Homo sapiens
agccccccacctttctc

SEQ ID NO: 2063624 - DNA, 22 bp, Homo sapiens
agccccccacctttctcgctgg

SEQ ID NO: 2063625 - DNA, 23 bp, Homo sapiens
agccccccacctttctcgctgga

SEQ ID NO: 2063626 - DNA, 22 bp, Homo sapiens
agccccccccttgaatctgcag

SEQ ID NO: 2063627 - DNA, 20 bp, Homo sapiens
agccccctggatgtcccctg

SEQ ID NO: 2063628 - DNA, 20 bp, Homo sapiens
agccccgactccagccagcg

SEQ ID NO: 2063629 - DNA, 21 bp, Homo sapiens
agccccgactccagccagcgc

SEQ ID NO: 2063630 - DNA, 15 bp, Homo sapiens
agcccctcagccctt

SEQ ID NO: 2063631 - DNA, 18 bp, Homo sapiens
agcccctcagcccttgcc

SEQ ID NO: 2063632 - DNA, 14 bp, Homo sapiens
agcccctcctcccc

SEQ ID NO: 2063633 - DNA, 17 bp, Homo sapiens
agcccctcctccccttc

SEQ ID NO: 2063634 - DNA, 12 bp, Homo sapiens
agcccctcctct

SEQ ID NO: 2063635 - DNA, 14 bp, Homo sapiens
agcccctcctctgc

SEQ ID NO: 2063636 - DNA, 21 bp, Homo sapiens
agcccctcctctgccacctcc

SEQ ID NO: 2063637 - DNA, 22 bp, Homo sapiens
agcccctcctctgccacctccc

SEQ ID NO: 2063638 - DNA, 15 bp, Homo sapiens
agccccttgtcctct

SEQ ID NO: 2063639 - DNA, 15 bp, Homo sapiens
agcccgaagcccagt

SEQ ID NO: 2063640 - DNA, 18 bp, Homo sapiens
agcccgaggaccgggctg

SEQ ID NO: 2063641 - DNA, 19 bp, Homo sapiens
agcccgaggaccgggctgg

SEQ ID NO: 2063642 - DNA, 21 bp, Homo sapiens
agcccggccagggcctggtgt

SEQ ID NO: 2063643 - DNA, 13 bp, Homo sapiens
agcccgggacagg

SEQ ID NO: 2063644 - DNA, 20 bp, Homo sapiens
agcccgtgaagcagtgcctc

SEQ ID NO: 2063645 - DNA, 17 bp, Homo sapiens
agcccgtgtcctgcctt

SEQ ID NO: 2063646 - DNA, 13 bp, Homo sapiens
agccctaaacatc

SEQ ID NO: 2063647 - DNA, 21 bp, Homo sapiens
agccctacatcttcagctccc

SEQ ID NO: 2063648 - DNA, 12 bp, Homo sapiens
agccctatggat

SEQ ID NO: 2063649 - DNA, 14 bp, Homo sapiens
agccctatggatgt

SEQ ID NO: 2063650 - DNA, 15 bp, Homo sapiens
agccctcaggccagt

SEQ ID NO: 2063651 - DNA, 17 bp, Homo sapiens
agccctcaggccagtgc

SEQ ID NO: 2063652 - DNA, 23 bp, Homo sapiens
agccctcatgataatctgggcat

SEQ ID NO: 2063653 - DNA, 13 bp, Homo sapiens
agccctccctgcc

SEQ ID NO: 2063654 - DNA, 17 bp, Homo sapiens
agccctccctgcccctc

SEQ ID NO: 2063655 - DNA, 19 bp, Homo sapiens
agccctccctgcccctccc

SEQ ID NO: 2063656 - DNA, 23 bp, Homo sapiens
agccctccctgcccctcccttca

SEQ ID NO: 2063657 - DNA, 21 bp, Homo sapiens
agccctccctggcatgtcaga

SEQ ID NO: 2063658 - DNA, 22 bp, Homo sapiens
agccctccctggcatgtcagag

SEQ ID NO: 2063659 - DNA, 14 bp, Homo sapiens
agccctccctgtcc

SEQ ID NO: 2063660 - DNA, 16 bp, Homo sapiens
agccctccctgtcctc

SEQ ID NO: 2063661 - DNA, 19 bp, Homo sapiens
agccctccctgtcctcctc

SEQ ID NO: 2063662 - DNA, 21 bp, Homo sapiens
agccctccctgtcctcctcgg

SEQ ID NO: 2063663 - DNA, 12 bp, Homo sapiens
agccctcctcac

SEQ ID NO: 2063664 - DNA, 19 bp, Homo sapiens
agccctcgaaccaaggcag

SEQ ID NO: 2063665 - DNA, 20 bp, Homo sapiens
agccctgcctggaggacctg

SEQ ID NO: 2063666 - DNA, 21 bp, Homo sapiens
agccctgcctggaggacctga

SEQ ID NO: 2063667 - DNA, 23 bp, Homo sapiens
agccctgcctggaggacctgagc

SEQ ID NO: 2063668 - DNA, 15 bp, Homo sapiens
agccctgctgtggga

SEQ ID NO: 2063669 - DNA, 17 bp, Homo sapiens
agccctgctttgggctg

SEQ ID NO: 2063670 - DNA, 21 bp, Homo sapiens
agccctgctttgggctgccct

SEQ ID NO: 2063671 - DNA, 23 bp, Homo sapiens
agccctgctttgggctgccctgg

SEQ ID NO: 2063672 - DNA, 12 bp, Homo sapiens
agccctggcagg

SEQ ID NO: 2063673 - DNA, 17 bp, Homo sapiens
agccctggcaggatgac

SEQ ID NO: 2063674 - DNA, 11 bp, Homo sapiens
agccctgggac

SEQ ID NO: 2063675 - DNA, 21 bp, Homo sapiens
agccctgggccccaccaccta

SEQ ID NO: 2063676 - DNA, 12 bp, Homo sapiens
agccctgggggc

SEQ ID NO: 2063677 - DNA, 17 bp, Homo sapiens
agccctgggggccagct

SEQ ID NO: 2063678 - DNA, 19 bp, Homo sapiens
agccctgggggccagctgg

SEQ ID NO: 2063679 - DNA, 23 bp, Homo sapiens
agccctgggtgacttcaggtgga

SEQ ID NO: 2063680 - DNA, 22 bp, Homo sapiens
agccctggtggcagtgggagct

SEQ ID NO: 2063681 - DNA, 17 bp, Homo sapiens
agccctgtcgagacact

SEQ ID NO: 2063682 - DNA, 16 bp, Homo sapiens
agcccttagcagggaa

SEQ ID NO: 2063683 - DNA, 14 bp, Homo sapiens
agcccttcatttgg

SEQ ID NO: 2063684 - DNA, 19 bp, Homo sapiens
agcccttccatgtcgcctc

SEQ ID NO: 2063685 - DNA, 13 bp, Homo sapiens
agcccttccctgc

SEQ ID NO: 2063686 - DNA, 22 bp, Homo sapiens
agcccttcctcctgaagcctct

SEQ ID NO: 2063687 - DNA, 14 bp, Homo sapiens
agcccttctgcctt

SEQ ID NO: 2063688 - DNA, 18 bp, Homo sapiens
agcccttgcccccatccc

SEQ ID NO: 2063689 - DNA, 20 bp, Homo sapiens
agcccttgcccccatccctc

SEQ ID NO: 2063690 - DNA, 16 bp, Homo sapiens
agccctttctgtgtgc

SEQ ID NO: 2063691 - DNA, 17 bp, Homo sapiens
agccctttctgtgtgca

SEQ ID NO: 2063692 - DNA, 20 bp, Homo sapiens
agccctttgcaggcccagca

SEQ ID NO: 2063693 - DNA, 21 bp, Homo sapiens
agccctttgggaggctgaggc

SEQ ID NO: 2063694 - DNA, 12 bp, Homo sapiens
agccgacctcag

SEQ ID NO: 2063695 - DNA, 13 bp, Homo sapiens
agccgagagcctg

SEQ ID NO: 2063696 - DNA, 16 bp, Homo sapiens
agccgagagcctgctc

SEQ ID NO: 2063697 - DNA, 21 bp, Homo sapiens
agccgagagcctgctccccca

SEQ ID NO: 2063698 - DNA, 19 bp, Homo sapiens
agccgagatcacgccactg

SEQ ID NO: 2063699 - DNA, 21 bp, Homo sapiens
agccgagccgggcctggggct

SEQ ID NO: 2063700 - DNA, 18 bp, Homo sapiens
agccgcaaatcaacccca

SEQ ID NO: 2063701 - DNA, 14 bp, Homo sapiens
agccgcagcctccc

SEQ ID NO: 2063702 - DNA, 17 bp, Homo sapiens
agccgcatcttctccat

SEQ ID NO: 2063703 - DNA, 22 bp, Homo sapiens
agccgccctgggctgtctgtca

SEQ ID NO: 2063704 - DNA, 24 bp, Homo sapiens
agccgccctgggctgtctgtcacc

SEQ ID NO: 2063705 - DNA, 18 bp, Homo sapiens
agccgctaggagagactg

SEQ ID NO: 2063706 - DNA, 17 bp, Homo sapiens
agccgctcctgtctgcc

SEQ ID NO: 2063707 - DNA, 22 bp, Homo sapiens
agccggaccaagatgggcacat

SEQ ID NO: 2063708 - DNA, 23 bp, Homo sapiens
agccggaccaagatgggcacatg

SEQ ID NO: 2063709 - DNA, 19 bp, Homo sapiens
agccggcgtggcaaatata

SEQ ID NO: 2063710 - DNA, 19 bp, Homo sapiens
agccgggcctggggctcct

SEQ ID NO: 2063711 - DNA, 22 bp, Homo sapiens
agccggtgcctggcgcccctgc

SEQ ID NO: 2063712 - DNA, 17 bp, Homo sapiens
agccgtagagggtggcc

SEQ ID NO: 2063713 - DNA, 19 bp, Homo sapiens
agccgtcagccaaatgtaa

SEQ ID NO: 2063714 - DNA, 17 bp, Homo sapiens
agccgtccatggcacca

SEQ ID NO: 2063715 - DNA, 19 bp, Homo sapiens
agccgtccatggcaccagc

SEQ ID NO: 2063716 - DNA, 17 bp, Homo sapiens
agccgtctgactccaga

SEQ ID NO: 2063717 - DNA, 18 bp, Homo sapiens
agccgtctgactccagag

SEQ ID NO: 2063718 - DNA, 21 bp, Homo sapiens
agccgtctgactccagagtct

SEQ ID NO: 2063719 - DNA, 22 bp, Homo sapiens
agccgtctgactccagagtctg

SEQ ID NO: 2063720 - DNA, 19 bp, Homo sapiens
agccgtgatgctcaggctt

SEQ ID NO: 2063721 - DNA, 13 bp, Homo sapiens
agccgtggcttcc

SEQ ID NO: 2063722 - DNA, 21 bp, Homo sapiens
agccgtggcttcccgctcagc

SEQ ID NO: 2063723 - DNA, 22 bp, Homo sapiens
agccgtggcttcccgctcagcc

SEQ ID NO: 2063724 - DNA, 14 bp, Homo sapiens
agcctaaatctaat

SEQ ID NO: 2063725 - DNA, 16 bp, Homo sapiens
agcctaagaagctctg

SEQ ID NO: 2063726 - DNA, 22 bp, Homo sapiens
agcctacccttgtaccccatcc

SEQ ID NO: 2063727 - DNA, 18 bp, Homo sapiens
agcctagaccctcctcct

SEQ ID NO: 2063728 - DNA, 16 bp, Homo sapiens
agcctagccacctccc

SEQ ID NO: 2063729 - DNA, 20 bp, Homo sapiens
agcctagccacctcccaccc

SEQ ID NO: 2063730 - DNA, 17 bp, Homo sapiens
agcctaggtgacagagt

SEQ ID NO: 2063731 - DNA, 20 bp, Homo sapiens
agcctcaacctcctgggcta

SEQ ID NO: 2063732 - DNA, 21 bp, Homo sapiens
agcctcaagtcttatttcctc

SEQ ID NO: 2063733 - DNA, 15 bp, Homo sapiens
agcctcacagaagaa

SEQ ID NO: 2063734 - DNA, 22 bp, Homo sapiens
agcctcacttgaatgtgtcact

SEQ ID NO: 2063735 - DNA, 14 bp, Homo sapiens
agcctcagcatcct

SEQ ID NO: 2063736 - DNA, 17 bp, Homo sapiens
agcctcagcatcctggc

SEQ ID NO: 2063737 - DNA, 14 bp, Homo sapiens
agcctcatccgagg

SEQ ID NO: 2063738 - DNA, 18 bp, Homo sapiens
agcctcatccgaggcagg

SEQ ID NO: 2063739 - DNA, 21 bp, Homo sapiens
agcctccaagctccatctcca

SEQ ID NO: 2063740 - DNA, 19 bp, Homo sapiens
agcctccaccttgctcttc

SEQ ID NO: 2063741 - DNA, 23 bp, Homo sapiens
agcctccagagccagcctgggac

SEQ ID NO: 2063742 - DNA, 15 bp, Homo sapiens
agcctccatttagtt

SEQ ID NO: 2063743 - DNA, 18 bp, Homo sapiens
agcctccatttctggctt

SEQ ID NO: 2063744 - DNA, 17 bp, Homo sapiens
agcctcccaaagtgctg

SEQ ID NO: 2063745 - DNA, 18 bp, Homo sapiens
agcctcccaaagtgctgg

SEQ ID NO: 2063746 - DNA, 19 bp, Homo sapiens
agcctcccaaagtgctggg

SEQ ID NO: 2063747 - DNA, 17 bp, Homo sapiens
agcctcccaagtagctg

SEQ ID NO: 2063748 - DNA, 14 bp, Homo sapiens
agcctcccccacaa

SEQ ID NO: 2063749 - DNA, 13 bp, Homo sapiens
agcctccccctca

SEQ ID NO: 2063750 - DNA, 20 bp, Homo sapiens
agcctcccgaatagctggga

SEQ ID NO: 2063751 - DNA, 19 bp, Homo sapiens
agcctcccgagtagctggg

SEQ ID NO: 2063752 - DNA, 24 bp, Homo sapiens
agcctccctcctcgtcccctgcct

SEQ ID NO: 2063753 - DNA, 13 bp, Homo sapiens
agcctccctctga

SEQ ID NO: 2063754 - DNA, 21 bp, Homo sapiens
agcctccctctgacctgcagg

SEQ ID NO: 2063755 - DNA, 22 bp, Homo sapiens
agcctccggtttccactactgt

SEQ ID NO: 2063756 - DNA, 20 bp, Homo sapiens
agcctccgtttatgggcctt

SEQ ID NO: 2063757 - DNA, 20 bp, Homo sapiens
agcctcctcccaccaccctc

SEQ ID NO: 2063758 - DNA, 12 bp, Homo sapiens
agcctcctcctg

SEQ ID NO: 2063759 - DNA, 16 bp, Homo sapiens
agcctcctgacctgag

SEQ ID NO: 2063760 - DNA, 18 bp, Homo sapiens
agcctcctgacctgaggc

SEQ ID NO: 2063761 - DNA, 19 bp, Homo sapiens
agcctcctgacctgaggct

SEQ ID NO: 2063762 - DNA, 21 bp, Homo sapiens
agcctcgcaacccgtgccaag

SEQ ID NO: 2063763 - DNA, 23 bp, Homo sapiens
agcctcgcaacccgtgccaagtc

SEQ ID NO: 2063764 - DNA, 14 bp, Homo sapiens
agcctcgcatgcca

SEQ ID NO: 2063765 - DNA, 21 bp, Homo sapiens
agcctcggtggccatgcttct

SEQ ID NO: 2063766 - DNA, 12 bp, Homo sapiens
agcctctccagg

SEQ ID NO: 2063767 - DNA, 14 bp, Homo sapiens
agcctctccaggaa

SEQ ID NO: 2063768 - DNA, 10 bp, Homo sapiens
agcctctccc

SEQ ID NO: 2063769 - DNA, 13 bp, Homo sapiens
agcctctcccggc

SEQ ID NO: 2063770 - DNA, 19 bp, Homo sapiens
agcctctccttgcctggtg

SEQ ID NO: 2063771 - DNA, 16 bp, Homo sapiens
agcctctgccccaagg

SEQ ID NO: 2063772 - DNA, 17 bp, Homo sapiens
agcctctgccccaaggg

SEQ ID NO: 2063773 - DNA, 16 bp, Homo sapiens
agcctctgggccaaga

SEQ ID NO: 2063774 - DNA, 16 bp, Homo sapiens
agcctctgtccctctt

SEQ ID NO: 2063775 - DNA, 23 bp, Homo sapiens
agcctctgtccctctttgcctgt

SEQ ID NO: 2063776 - DNA, 22 bp, Homo sapiens
agcctcttaaagctgcctgtag

SEQ ID NO: 2063777 - DNA, 21 bp, Homo sapiens
agcctcttttcaattatttca

SEQ ID NO: 2063778 - DNA, 21 bp, Homo sapiens
agcctgaattttgttgctgtt

SEQ ID NO: 2063779 - DNA, 16 bp, Homo sapiens
agcctgacctttctga

SEQ ID NO: 2063780 - DNA, 23 bp, Homo sapiens
agcctgacctttctgagtgacat

SEQ ID NO: 2063781 - DNA, 20 bp, Homo sapiens
agcctgactgtgttcagtgc

SEQ ID NO: 2063782 - DNA, 13 bp, Homo sapiens
agcctgatggcca

SEQ ID NO: 2063783 - DNA, 15 bp, Homo sapiens
agcctgatggccaag

SEQ ID NO: 2063784 - DNA, 19 bp, Homo sapiens
agcctgatggccaaggggg

SEQ ID NO: 2063785 - DNA, 17 bp, Homo sapiens
agcctgcaaactcactg

SEQ ID NO: 2063786 - DNA, 19 bp, Homo sapiens
agcctgccgccgtctctgt

SEQ ID NO: 2063787 - DNA, 16 bp, Homo sapiens
agcctgctaaatgaag

SEQ ID NO: 2063788 - DNA, 19 bp, Homo sapiens
agcctgctcccccaccccc

SEQ ID NO: 2063789 - DNA, 20 bp, Homo sapiens
agcctgctccttcccaggag

SEQ ID NO: 2063790 - DNA, 17 bp, Homo sapiens
agcctggcaacagagca

SEQ ID NO: 2063791 - DNA, 13 bp, Homo sapiens
agcctggcacagg

SEQ ID NO: 2063792 - DNA, 17 bp, Homo sapiens
agcctggcacagggcag

SEQ ID NO: 2063793 - DNA, 18 bp, Homo sapiens
agcctggcacagggcagt

SEQ ID NO: 2063794 - DNA, 20 bp, Homo sapiens
agcctggcacagggcagtgg

SEQ ID NO: 2063795 - DNA, 19 bp, Homo sapiens
agcctggcccatagaaaca

SEQ ID NO: 2063796 - DNA, 14 bp, Homo sapiens
agcctggcctcctg

SEQ ID NO: 2063797 - DNA, 15 bp, Homo sapiens
agcctggcctcctgc

SEQ ID NO: 2063798 - DNA, 23 bp, Homo sapiens
agcctggcggggcaggaggcctg

SEQ ID NO: 2063799 - DNA, 20 bp, Homo sapiens
agcctggcttctggagccct

SEQ ID NO: 2063800 - DNA, 15 bp, Homo sapiens
agcctgggaccaggg

SEQ ID NO: 2063801 - DNA, 17 bp, Homo sapiens
agcctgggaccagggca

SEQ ID NO: 2063802 - DNA, 13 bp, Homo sapiens
agcctgggcaaca

SEQ ID NO: 2063803 - DNA, 12 bp, Homo sapiens
agcctgggccta

SEQ ID NO: 2063804 - DNA, 20 bp, Homo sapiens
agcctgggcctatggagagc

SEQ ID NO: 2063805 - DNA, 15 bp, Homo sapiens
agcctgggcgacaga

SEQ ID NO: 2063806 - DNA, 15 bp, Homo sapiens
agcctggggctctaa

SEQ ID NO: 2063807 - DNA, 22 bp, Homo sapiens
agcctggggctctaacgcctga

SEQ ID NO: 2063808 - DNA, 23 bp, Homo sapiens
agcctggggctctaacgcctgag

SEQ ID NO: 2063809 - DNA, 14 bp, Homo sapiens
agcctgggggcctg

SEQ ID NO: 2063810 - DNA, 16 bp, Homo sapiens
agcctgggggcctggc

SEQ ID NO: 2063811 - DNA, 22 bp, Homo sapiens
agcctgggggcctggctggctg

SEQ ID NO: 2063812 - DNA, 16 bp, Homo sapiens
agcctggggtgttctc

SEQ ID NO: 2063813 - DNA, 15 bp, Homo sapiens
agcctggtctcctcc

SEQ ID NO: 2063814 - DNA, 17 bp, Homo sapiens
agcctggtgcccatcct

SEQ ID NO: 2063815 - DNA, 11 bp, Homo sapiens
agcctggtggg

SEQ ID NO: 2063816 - DNA, 14 bp, Homo sapiens
agcctggtgggcct

SEQ ID NO: 2063817 - DNA, 16 bp, Homo sapiens
agccaaaacagatcca

SEQ ID NO: 2063818 - DNA, 18 bp, Homo sapiens
agccaaacacactgtaaa

SEQ ID NO: 2063819 - DNA, 20 bp, Homo sapiens
agccaaacacactgtaaata

SEQ ID NO: 2063820 - DNA, 14 bp, Homo sapiens
agccaaacagagcc

SEQ ID NO: 2063821 - DNA, 14 bp, Homo sapiens
agccaaactctgcc

SEQ ID NO: 2063822 - DNA, 15 bp, Homo sapiens
agccaaactctgcca

SEQ ID NO: 2063823 - DNA, 23 bp, Homo sapiens
agccaacaccctgtctaaaaaac

SEQ ID NO: 2063824 - DNA, 18 bp, Homo sapiens
agccaacagaagcttcca

SEQ ID NO: 2063825 - DNA, 12 bp, Homo sapiens
agccaacagcag

SEQ ID NO: 2063826 - DNA, 13 bp, Homo sapiens
agccaacagcagc

SEQ ID NO: 2063827 - DNA, 17 bp, Homo sapiens
agccaacaggtggcagg

SEQ ID NO: 2063828 - DNA, 20 bp, Homo sapiens
agccaactcactcttatgaa

SEQ ID NO: 2063829 - DNA, 20 bp, Homo sapiens
agccaacttggctttcccgg

SEQ ID NO: 2063830 - DNA, 15 bp, Homo sapiens
agccaacttgtaaat

SEQ ID NO: 2063831 - DNA, 20 bp, Homo sapiens
agccaacttgtaaatacacc

SEQ ID NO: 2063832 - DNA, 18 bp, Homo sapiens
agccaagggttcagagac

SEQ ID NO: 2063833 - DNA, 20 bp, Homo sapiens
agccacaaagtagttgtccc

SEQ ID NO: 2063834 - DNA, 12 bp, Homo sapiens
agccacacagag

SEQ ID NO: 2063835 - DNA, 14 bp, Homo sapiens
agccacacagagcc

SEQ ID NO: 2063836 - DNA, 18 bp, Homo sapiens
agccacacagagcctgcc

SEQ ID NO: 2063837 - DNA, 19 bp, Homo sapiens
agccacacagagcctgcct

SEQ ID NO: 2063838 - DNA, 23 bp, Homo sapiens
agccacacttctcaggacacagg

SEQ ID NO: 2063839 - DNA, 12 bp, Homo sapiens
agccacagaagc

SEQ ID NO: 2063840 - DNA, 19 bp, Homo sapiens
agccacagaagccaggagc

SEQ ID NO: 2063841 - DNA, 13 bp, Homo sapiens
agccacagaccac

SEQ ID NO: 2063842 - DNA, 15 bp, Homo sapiens
agccacagccgtgct

SEQ ID NO: 2063843 - DNA, 13 bp, Homo sapiens
agccacagctggt

SEQ ID NO: 2063844 - DNA, 12 bp, Homo sapiens
agccaccctgag

SEQ ID NO: 2063845 - DNA, 18 bp, Homo sapiens
agccaccctgaggagtct

SEQ ID NO: 2063846 - DNA, 13 bp, Homo sapiens
agccacctcccac

SEQ ID NO: 2063847 - DNA, 18 bp, Homo sapiens
agccacctctctttttca

SEQ ID NO: 2063848 - DNA, 15 bp, Homo sapiens
agccacgtgaatggc

SEQ ID NO: 2063849 - DNA, 15 bp, Homo sapiens
agccactaccttctg

SEQ ID NO: 2063850 - DNA, 17 bp, Homo sapiens
agccactcctgtcccgc

SEQ ID NO: 2063851 - DNA, 22 bp, Homo sapiens
agccactcctgtcccgccttcc

SEQ ID NO: 2063852 - DNA, 16 bp, Homo sapiens
agccactgaagctggg

SEQ ID NO: 2063853 - DNA, 23 bp, Homo sapiens
agccagaaggggcacgcctgccc

SEQ ID NO: 2063854 - DNA, 15 bp, Homo sapiens
agccagagaggagca

SEQ ID NO: 2063855 - DNA, 15 bp, Homo sapiens
agccagagcctgggg

SEQ ID NO: 2063856 - DNA, 14 bp, Homo sapiens
agccagatccaccc

SEQ ID NO: 2063857 - DNA, 22 bp, Homo sapiens
agccagcaatgatgtccagaag

SEQ ID NO: 2063858 - DNA, 23 bp, Homo sapiens
agccagcaatgatgtccagaaga

SEQ ID NO: 2063859 - DNA, 13 bp, Homo sapiens
agccagcagccag

SEQ ID NO: 2063860 - DNA, 16 bp, Homo sapiens
agccagcccagcccag

SEQ ID NO: 2063861 - DNA, 18 bp, Homo sapiens
agccagcccagcccagct

SEQ ID NO: 2063862 - DNA, 18 bp, Homo sapiens
agccagccctccctgtcc

SEQ ID NO: 2063863 - DNA, 22 bp, Homo sapiens
agccagccctccctgtcctcct

SEQ ID NO: 2063864 - DNA, 15 bp, Homo sapiens
agccagccctgcctg

SEQ ID NO: 2063865 - DNA, 16 bp, Homo sapiens
agccagccctgcctgg

SEQ ID NO: 2063866 - DNA, 17 bp, Homo sapiens
agccagccctgcctgga

SEQ ID NO: 2063867 - DNA, 19 bp, Homo sapiens
agccagccctgcctggagg

SEQ ID NO: 2063868 - DNA, 15 bp, Homo sapiens
agccagccgccctgg

SEQ ID NO: 2063869 - DNA, 16 bp, Homo sapiens
agccagccgccctggg

SEQ ID NO: 2063870 - DNA, 17 bp, Homo sapiens
agccagccgccctgggc

SEQ ID NO: 2063871 - DNA, 21 bp, Homo sapiens
agccagccgccctgggctgtc

SEQ ID NO: 2063872 - DNA, 16 bp, Homo sapiens
agccagccggggcgag

SEQ ID NO: 2063873 - DNA, 14 bp, Homo sapiens
agccagcctgggac

SEQ ID NO: 2063874 - DNA, 15 bp, Homo sapiens
agccagcgcctccct

SEQ ID NO: 2063875 - DNA, 17 bp, Homo sapiens
agccagctcctgggcag

SEQ ID NO: 2063876 - DNA, 19 bp, Homo sapiens
agccagctcctgggcagct

SEQ ID NO: 2063877 - DNA, 20 bp, Homo sapiens
agccagctcctgggcagctt

SEQ ID NO: 2063878 - DNA, 14 bp, Homo sapiens
agccagctctctct

SEQ ID NO: 2063879 - DNA, 15 bp, Homo sapiens
agccagctctctcta

SEQ ID NO: 2063880 - DNA, 16 bp, Homo sapiens
agccagctctgcatta

SEQ ID NO: 2063881 - DNA, 22 bp, Homo sapiens
agccaggagcaaatgtttctgc

SEQ ID NO: 2063882 - DNA, 23 bp, Homo sapiens
agccaggagcaaatgtttctgca

SEQ ID NO: 2063883 - DNA, 17 bp, Homo sapiens
agccaggagtctgtgct

SEQ ID NO: 2063884 - DNA, 15 bp, Homo sapiens
agccaggctctgcct

SEQ ID NO: 2063885 - DNA, 15 bp, Homo sapiens
agccaggctgagtga

SEQ ID NO: 2063886 - DNA, 17 bp, Homo sapiens
agccaggctgagtgagc

SEQ ID NO: 2063887 - DNA, 11 bp, Homo sapiens
agccagggcca

SEQ ID NO: 2063888 - DNA, 22 bp, Homo sapiens
agctgacccagagtggagtctg

SEQ ID NO: 2063889 - DNA, 15 bp, Homo sapiens
agctgagaggaagat

SEQ ID NO: 2063890 - DNA, 16 bp, Homo sapiens
agctgagaggaagatg

SEQ ID NO: 2063891 - DNA, 22 bp, Homo sapiens
agctgagagtctgaaagacaga

SEQ ID NO: 2063892 - DNA, 16 bp, Homo sapiens
agctgagcaggcccga

SEQ ID NO: 2063893 - DNA, 22 bp, Homo sapiens
agctgagcaggcccgacagaga

SEQ ID NO: 2063894 - DNA, 15 bp, Homo sapiens
agctgagcagggccg

SEQ ID NO: 2063895 - DNA, 16 bp, Homo sapiens
agctgaggatgacaga

SEQ ID NO: 2063896 - DNA, 17 bp, Homo sapiens
agctgaggatgacagag

SEQ ID NO: 2063897 - DNA, 23 bp, Homo sapiens
agctgaggggggccgtgcccagg

SEQ ID NO: 2063898 - DNA, 19 bp, Homo sapiens
agctgaggtgcccaggaga

SEQ ID NO: 2063899 - DNA, 21 bp, Homo sapiens
agctgagttacttgtctgagg

SEQ ID NO: 2063900 - DNA, 22 bp, Homo sapiens
agctgagttacttgtctgaggc

SEQ ID NO: 2063901 - DNA, 20 bp, Homo sapiens
agctgatattatggcaagtg

SEQ ID NO: 2063902 - DNA, 16 bp, Homo sapiens
agctgatggagaagga

SEQ ID NO: 2063903 - DNA, 17 bp, Homo sapiens
agctgatggagaaggaa

SEQ ID NO: 2063904 - DNA, 20 bp, Homo sapiens
agctgattttgtcactgtct

SEQ ID NO: 2063905 - DNA, 21 bp, Homo sapiens
agctgcaagtgacatctcttt

SEQ ID NO: 2063906 - DNA, 21 bp, Homo sapiens
agctgcagaaacgaagccatc

SEQ ID NO: 2063907 - DNA, 12 bp, Homo sapiens
agctgcagctgg

SEQ ID NO: 2063908 - DNA, 13 bp, Homo sapiens
agctgcagctggg

SEQ ID NO: 2063909 - DNA, 15 bp, Homo sapiens
agctgcagctgggcc

SEQ ID NO: 2063910 - DNA, 14 bp, Homo sapiens
agctgcagcttcct

SEQ ID NO: 2063911 - DNA, 17 bp, Homo sapiens
agctactcaggaggctg

SEQ ID NO: 2063912 - DNA, 14 bp, Homo sapiens
agctactctcttgc

SEQ ID NO: 2063913 - DNA, 18 bp, Homo sapiens
agctactctgtccaggcc

SEQ ID NO: 2063914 - DNA, 21 bp, Homo sapiens
agctactctgtccaggccact

SEQ ID NO: 2063915 - DNA, 12 bp, Homo sapiens
agctactgaatt

SEQ ID NO: 2063916 - DNA, 21 bp, Homo sapiens
agctactgaatttattgccgc

SEQ ID NO: 2063917 - DNA, 19 bp, Homo sapiens
agctactgcggaaaaggaa

SEQ ID NO: 2063918 - DNA, 19 bp, Homo sapiens
agctacttaagagaaatgg

SEQ ID NO: 2063919 - DNA, 17 bp, Homo sapiens
agctacttgggaggctg

SEQ ID NO: 2063920 - DNA, 15 bp, Homo sapiens
agctagaacctggag

SEQ ID NO: 2063921 - DNA, 16 bp, Homo sapiens
agctagcgctgccgca

SEQ ID NO: 2063922 - DNA, 18 bp, Homo sapiens
agctagcgctgccgcacc

SEQ ID NO: 2063923 - DNA, 13 bp, Homo sapiens
agctaggactgag

SEQ ID NO: 2063924 - DNA, 16 bp, Homo sapiens
agctaggagcaaagcc

SEQ ID NO: 2063925 - DNA, 14 bp, Homo sapiens
agctaggcctggcc

SEQ ID NO: 2063926 - DNA, 15 bp, Homo sapiens
agctaggcctggcca

SEQ ID NO: 2063927 - DNA, 16 bp, Homo sapiens
agctaggcctggccag

SEQ ID NO: 2063928 - DNA, 13 bp, Homo sapiens
agctagggctgga

SEQ ID NO: 2063929 - DNA, 18 bp, Homo sapiens
agctataaaatgaataca

SEQ ID NO: 2063930 - DNA, 20 bp, Homo sapiens
agctatcagaagaccacaaa

SEQ ID NO: 2063931 - DNA, 19 bp, Homo sapiens
agctatcatttcttttcca

SEQ ID NO: 2063932 - DNA, 18 bp, Homo sapiens
agctatctgtcatctctc

SEQ ID NO: 2063933 - DNA, 18 bp, Homo sapiens
agctatgttccctccagc

SEQ ID NO: 2063934 - DNA, 15 bp, Homo sapiens
agctattactgtctg

SEQ ID NO: 2063935 - DNA, 14 bp, Homo sapiens
agctattgatgttt

SEQ ID NO: 2063936 - DNA, 16 bp, Homo sapiens
agctattgatgtttcc

SEQ ID NO: 2063937 - DNA, 13 bp, Homo sapiens
agctattgcatgt

SEQ ID NO: 2063938 - DNA, 15 bp, Homo sapiens
agggtgggggaggga

SEQ ID NO: 2063939 - DNA, 23 bp, Homo sapiens
agggtggggttttatgtgtggga

SEQ ID NO: 2063940 - DNA, 19 bp, Homo sapiens
agggtggtgacctctgcct

SEQ ID NO: 2063941 - DNA, 18 bp, Homo sapiens
agggttactatgcacaat

SEQ ID NO: 2063942 - DNA, 21 bp, Homo sapiens
agggttgagttacttcctatc

SEQ ID NO: 2063943 - DNA, 17 bp, Homo sapiens
agggttggcccctgccc

SEQ ID NO: 2063944 - DNA, 14 bp, Homo sapiens
agggttgtgatttt

SEQ ID NO: 2063945 - DNA, 19 bp, Homo sapiens
agggttgtgattttgtctg

SEQ ID NO: 2063946 - DNA, 14 bp, Homo sapiens
agggtttcattgtg

SEQ ID NO: 2063947 - DNA, 14 bp, Homo sapiens
aggtaacaggcaga

SEQ ID NO: 2063948 - DNA, 16 bp, Homo sapiens
aggtaacaggcagata

SEQ ID NO: 2063949 - DNA, 20 bp, Homo sapiens
aggtaactgagagcagatgg

SEQ ID NO: 2063950 - DNA, 16 bp, Homo sapiens
aggtaagggccgccgg

SEQ ID NO: 2063951 - DNA, 12 bp, Homo sapiens
aggtacactctt

SEQ ID NO: 2063952 - DNA, 22 bp, Homo sapiens
aggtacagcaacaggaatctca

SEQ ID NO: 2063953 - DNA, 21 bp, Homo sapiens
aggtaccactgatttggagat

SEQ ID NO: 2063954 - DNA, 22 bp, Homo sapiens
aggtaccagcaatatgtaaata

SEQ ID NO: 2063955 - DNA, 17 bp, Homo sapiens
aggtacccctttctggc

SEQ ID NO: 2063956 - DNA, 12 bp, Homo sapiens
aggtactattat

SEQ ID NO: 2063957 - DNA, 21 bp, Homo sapiens
aggtactgatcctgtttcttg

SEQ ID NO: 2063958 - DNA, 14 bp, Homo sapiens
aggtagaatgtaaa

SEQ ID NO: 2063959 - DNA, 17 bp, Homo sapiens
aggtagagtttgaagga

SEQ ID NO: 2063960 - DNA, 12 bp, Homo sapiens
aggtagcccagc

SEQ ID NO: 2063961 - DNA, 15 bp, Homo sapiens
aggtagcccagcact

SEQ ID NO: 2063962 - DNA, 19 bp, Homo sapiens
aggtagcccagcactgtga

SEQ ID NO: 2063963 - DNA, 21 bp, Homo sapiens
aggtagcccagcactgtgaag

SEQ ID NO: 2063964 - DNA, 14 bp, Homo sapiens
aggtagcgagctgc

SEQ ID NO: 2063965 - DNA, 20 bp, Homo sapiens
aggtagcgagctgctctgct

SEQ ID NO: 2063966 - DNA, 14 bp, Homo sapiens
aggtagctcccagc

SEQ ID NO: 2063967 - DNA, 17 bp, Homo sapiens
aggtagtgggtgaatgt

SEQ ID NO: 2063968 - DNA, 15 bp, Homo sapiens
aggtatacaatgttc

SEQ ID NO: 2063969 - DNA, 15 bp, Homo sapiens
aggtatcaggcacag

SEQ ID NO: 2063970 - DNA, 17 bp, Homo sapiens
aggtatcaggcacaggc

SEQ ID NO: 2063971 - DNA, 19 bp, Homo sapiens
aggtatcaggcacaggcag

SEQ ID NO: 2063972 - DNA, 20 bp, Homo sapiens
aggtatcaggcacaggcagg

SEQ ID NO: 2063973 - DNA, 14 bp, Homo sapiens
aggtatctccagga

SEQ ID NO: 2063974 - DNA, 17 bp, Homo sapiens
aggtattaaagatgtgt

SEQ ID NO: 2063975 - DNA, 18 bp, Homo sapiens
aggtattaaagatgtgtt

SEQ ID NO: 2063976 - DNA, 19 bp, Homo sapiens
aggtattaaagatgtgttg

SEQ ID NO: 2063977 - DNA, 15 bp, Homo sapiens
aggtcacattcagga

SEQ ID NO: 2063978 - DNA, 18 bp, Homo sapiens
aggtcacattcaggaaga

SEQ ID NO: 2063979 - DNA, 19 bp, Homo sapiens
aggtcactagatggcgagc

SEQ ID NO: 2063980 - DNA, 21 bp, Homo sapiens
aggtcactcttcctgcaagga

SEQ ID NO: 2063981 - DNA, 23 bp, Homo sapiens
aggtcactcttcctgcaaggact

SEQ ID NO: 2063982 - DNA, 14 bp, Homo sapiens
aggtcactgggttc

SEQ ID NO: 2063983 - DNA, 15 bp, Homo sapiens
aggtcactgggttct

SEQ ID NO: 2063984 - DNA, 18 bp, Homo sapiens
aggtcagagatgggctga

SEQ ID NO: 2063985 - DNA, 14 bp, Homo sapiens
aggtcagagcctgc

SEQ ID NO: 2063986 - DNA, 15 bp, Homo sapiens
aggtcaggagttcct

SEQ ID NO: 2063987 - DNA, 23 bp, Homo sapiens
aggtcattcttaagatttctcct

SEQ ID NO: 2063988 - DNA, 15 bp, Homo sapiens
aggtcattttctatt

SEQ ID NO: 2063989 - DNA, 19 bp, Homo sapiens
aggtcattttctattcacc

SEQ ID NO: 2063990 - DNA, 15 bp, Homo sapiens
aggtccagacccact

SEQ ID NO: 2063991 - DNA, 11 bp, Homo sapiens
aggtcccaggc

SEQ ID NO: 2063992 - DNA, 13 bp, Homo sapiens
aggtcccaggcag

SEQ ID NO: 2063993 - DNA, 20 bp, Homo sapiens
aggtccctgcttacctgacg

SEQ ID NO: 2063994 - DNA, 14 bp, Homo sapiens
aggtcccttgtttc

SEQ ID NO: 2063995 - DNA, 21 bp, Homo sapiens
aggtcctctacttaatgagat

SEQ ID NO: 2063996 - DNA, 15 bp, Homo sapiens
aggtcctgagcactg

SEQ ID NO: 2063997 - DNA, 16 bp, Homo sapiens
aggtcctgagcactgc

SEQ ID NO: 2063998 - DNA, 18 bp, Homo sapiens
aggtcctgagcactgcca

SEQ ID NO: 2063999 - DNA, 17 bp, Homo sapiens
aggtcctgcccatgtgt

SEQ ID NO: 2064000 - DNA, 12 bp, Homo sapiens
aggtcctggctt

SEQ ID NO: 2064001 - DNA, 22 bp, Homo sapiens
aggtcctggcttctagatctgg

SEQ ID NO: 2064002 - DNA, 22 bp, Homo sapiens
aggtcctggtggggcagctcct

SEQ ID NO: 2064003 - DNA, 21 bp, Homo sapiens
aggtcgaccccaaagcccctt

SEQ ID NO: 2064004 - DNA, 21 bp, Homo sapiens
aggtctccactgaggatgtga

SEQ ID NO: 2064005 - DNA, 13 bp, Homo sapiens
aggtctcctctta

SEQ ID NO: 2064006 - DNA, 19 bp, Homo sapiens
aggtctccttactctgagc

SEQ ID NO: 2064007 - DNA, 21 bp, Homo sapiens
aggtctccttactctgagccc

SEQ ID NO: 2064008 - DNA, 22 bp, Homo sapiens
aggtctccttactctgagccca

SEQ ID NO: 2064009 - DNA, 14 bp, Homo sapiens
aggtctctccactg

SEQ ID NO: 2064010 - DNA, 15 bp, Homo sapiens
aggtctgagccctgg

SEQ ID NO: 2064011 - DNA, 22 bp, Homo sapiens
aggtctgagccctggtgtgttt

SEQ ID NO: 2064012 - DNA, 18 bp, Homo sapiens
aggtcttgaactcctggc

SEQ ID NO: 2064013 - DNA, 23 bp, Homo sapiens
aggtcttgaactcctggcctcaa

SEQ ID NO: 2064014 - DNA, 13 bp, Homo sapiens
aggtcttgcctga

SEQ ID NO: 2064015 - DNA, 16 bp, Homo sapiens
aggtctttgcacatgt

SEQ ID NO: 2064016 - DNA, 22 bp, Homo sapiens
aggtgaaaacagcccaggtcct

SEQ ID NO: 2064017 - DNA, 22 bp, Homo sapiens
aggtgaaatgggagatggtcag

SEQ ID NO: 2064018 - DNA, 19 bp, Homo sapiens
aggtgaacaccactttgtc

SEQ ID NO: 2064019 - DNA, 20 bp, Homo sapiens
aggtgacccaatgctcctgg

SEQ ID NO: 2064020 - DNA, 14 bp, Homo sapiens
aggtgaccccaggg

SEQ ID NO: 2064021 - DNA, 16 bp, Homo sapiens
aggtgaccccagggca

SEQ ID NO: 2064022 - DNA, 17 bp, Homo sapiens
aggtgaccccagggcac

SEQ ID NO: 2064023 - DNA, 18 bp, Homo sapiens
aggtgaccccagggcaca

SEQ ID NO: 2064024 - DNA, 14 bp, Homo sapiens
aggtgactggagcc

SEQ ID NO: 2064025 - DNA, 18 bp, Homo sapiens
aggtgagaaaaggggcat

SEQ ID NO: 2064026 - DNA, 20 bp, Homo sapiens
aggtgagaccaaaggatcca

SEQ ID NO: 2064027 - DNA, 13 bp, Homo sapiens
aggtgagggatgt

SEQ ID NO: 2064028 - DNA, 14 bp, Homo sapiens
aggtgatccaccca

SEQ ID NO: 2064029 - DNA, 18 bp, Homo sapiens
aggtgcaagagacagagc

SEQ ID NO: 2064030 - DNA, 19 bp, Homo sapiens
aggtgcaagagacagagcc

SEQ ID NO: 2064031 - DNA, 21 bp, Homo sapiens
aggtgcatctggggaactaga

SEQ ID NO: 2064032 - DNA, 12 bp, Homo sapiens
aggtgccactcc

SEQ ID NO: 2064033 - DNA, 17 bp, Homo sapiens
aggtgccactccctgag

SEQ ID NO: 2064034 - DNA, 18 bp, Homo sapiens
aggtgccactccctgagc

SEQ ID NO: 2064035 - DNA, 13 bp, Homo sapiens
aggtgcccaggag

SEQ ID NO: 2064036 - DNA, 17 bp, Homo sapiens
aggtgcctcacgcctgt

SEQ ID NO: 2064037 - DNA, 16 bp, Homo sapiens
aggtgcctgagctggg

SEQ ID NO: 2064038 - DNA, 18 bp, Homo sapiens
aggtgcctgagctggggc

SEQ ID NO: 2064039 - DNA, 19 bp, Homo sapiens
aggtgcctgagctggggcc

SEQ ID NO: 2064040 - DNA, 11 bp, Homo sapiens
aggtgcctgtg

SEQ ID NO: 2064041 - DNA, 20 bp, Homo sapiens
aggtgcctgtgaggcagggg

SEQ ID NO: 2064042 - DNA, 13 bp, Homo sapiens
aggtgccttctta

SEQ ID NO: 2064043 - DNA, 23 bp, Homo sapiens
aggtgctaaatggtcgcccagga

SEQ ID NO: 2064044 - DNA, 21 bp, Homo sapiens
aggtgctacaaaaacacagca

SEQ ID NO: 2064045 - DNA, 22 bp, Homo sapiens
aggtgctacaaaaacacagcaa

SEQ ID NO: 2064046 - DNA, 23 bp, Homo sapiens
aggtgctacaaaaacacagcaag

SEQ ID NO: 2064047 - DNA, 24 bp, Homo sapiens
aggtgctacaaaaacacagcaagg

SEQ ID NO: 2064048 - DNA, 13 bp, Homo sapiens
aggtgctgagctt

SEQ ID NO: 2064049 - DNA, 20 bp, Homo sapiens
aggtgctgagcttagccttg

SEQ ID NO: 2064050 - DNA, 20 bp, Homo sapiens
aggtgctggatgctttgtca

SEQ ID NO: 2064051 - DNA, 18 bp, Homo sapiens
aggtggaaaaacatctga

SEQ ID NO: 2064052 - DNA, 14 bp, Homo sapiens
aggtggaagccctc

SEQ ID NO: 2064053 - DNA, 17 bp, Homo sapiens
aggtggaagccctcctt

SEQ ID NO: 2064054 - DNA, 22 bp, Homo sapiens
aggtggagaactgggatttgaa

SEQ ID NO: 2064055 - DNA, 20 bp, Homo sapiens
aggtggaggttgcagtgagc

SEQ ID NO: 2064056 - DNA, 19 bp, Homo sapiens
aggtggcaggaccaggact

SEQ ID NO: 2064057 - DNA, 17 bp, Homo sapiens
aggtggctatggccacc

SEQ ID NO: 2064058 - DNA, 17 bp, Homo sapiens
aggtggctctccagtta

SEQ ID NO: 2064059 - DNA, 21 bp, Homo sapiens
aggtggctgacccagtccctg

SEQ ID NO: 2064060 - DNA, 22 bp, Homo sapiens
aggtggctgacccagtccctgg

SEQ ID NO: 2064061 - DNA, 11 bp, Homo sapiens
aggtgggagag

SEQ ID NO: 2064062 - DNA, 13 bp, Homo sapiens
aggtgggcagctg

SEQ ID NO: 2064063 - DNA, 16 bp, Homo sapiens
aggtgggcagctgggc

SEQ ID NO: 2064064 - DNA, 17 bp, Homo sapiens
aggtgggcagctgggcc

SEQ ID NO: 2064065 - DNA, 18 bp, Homo sapiens
aggtgggctgagccctgg

SEQ ID NO: 2064066 - DNA, 14 bp, Homo sapiens
aggtggggcagctt

SEQ ID NO: 2064067 - DNA, 16 bp, Homo sapiens
aggtggggcagcttga

SEQ ID NO: 2064068 - DNA, 21 bp, Homo sapiens
aggtggggtacatttctctga

SEQ ID NO: 2064069 - DNA, 22 bp, Homo sapiens
aggtggggtatttaccacagca

SEQ ID NO: 2064070 - DNA, 19 bp, Homo sapiens
aggtgggtccaggaaggca

SEQ ID NO: 2064071 - DNA, 23 bp, Homo sapiens
aggtgggttttcttcccatcact

SEQ ID NO: 2064072 - DNA, 15 bp, Homo sapiens
aggtggtatgtgtgt

SEQ ID NO: 2064073 - DNA, 18 bp, Homo sapiens
aggtggtatgtgtgtgta

SEQ ID NO: 2064074 - DNA, 15 bp, Homo sapiens
aggtggtggaggagg

SEQ ID NO: 2064075 - DNA, 17 bp, Homo sapiens
aggtgtactatggctgt

SEQ ID NO: 2064076 - DNA, 19 bp, Homo sapiens
aggtgtcaccctgcagagc

SEQ ID NO: 2064077 - DNA, 15 bp, Homo sapiens
aggtgtcatacagat

SEQ ID NO: 2064078 - DNA, 13 bp, Homo sapiens
aggtgtcccaagc

SEQ ID NO: 2064079 - DNA, 21 bp, Homo sapiens
aggtgtctatccacctggggt

SEQ ID NO: 2064080 - DNA, 23 bp, Homo sapiens
aggtgtcttttccactcctatgg

SEQ ID NO: 2064081 - DNA, 14 bp, Homo sapiens
aggtgtgagtcacc

SEQ ID NO: 2064082 - DNA, 21 bp, Homo sapiens
aggtgtgagtcaccaagccca

SEQ ID NO: 2064083 - DNA, 13 bp, Homo sapiens
aggtgtgccaaac

SEQ ID NO: 2064084 - DNA, 20 bp, Homo sapiens
aggtgtgctctgatcatcca

SEQ ID NO: 2064085 - DNA, 22 bp, Homo sapiens
aggtgttcaagaccagcctgac

SEQ ID NO: 2064086 - DNA, 16 bp, Homo sapiens
aggtgttgaaaatgag

SEQ ID NO: 2064087 - DNA, 22 bp, Homo sapiens
aggtgtttccatttctcaatca

SEQ ID NO: 2064088 - DNA, 16 bp, Homo sapiens
aggttaaggtgggtcc

SEQ ID NO: 2064089 - DNA, 18 bp, Homo sapiens
aggttactcataaggcat

SEQ ID NO: 2064090 - DNA, 18 bp, Homo sapiens
aggttagaacctagaagg

SEQ ID NO: 2064091 - DNA, 21 bp, Homo sapiens
aggttagcctttgccctgtca

SEQ ID NO: 2064092 - DNA, 15 bp, Homo sapiens
aggttataagaaaca

SEQ ID NO: 2064093 - DNA, 22 bp, Homo sapiens
aggttatctgcctggcctggct

SEQ ID NO: 2064094 - DNA, 12 bp, Homo sapiens
aggttcctaaga

SEQ ID NO: 2064095 - DNA, 13 bp, Homo sapiens
aggttcctgagga

SEQ ID NO: 2064096 - DNA, 16 bp, Homo sapiens
aggttctaggtcctgg

SEQ ID NO: 2064097 - DNA, 19 bp, Homo sapiens
aggttctaggtcctggctt

SEQ ID NO: 2064098 - DNA, 15 bp, Homo sapiens
aggttctggggagga

SEQ ID NO: 2064099 - DNA, 17 bp, Homo sapiens
aggttcttagtgtcact

SEQ ID NO: 2064100 - DNA, 21 bp, Homo sapiens
aggttgagaagactcctgggc

SEQ ID NO: 2064101 - DNA, 20 bp, Homo sapiens
aggttgaggggctcctggaa

SEQ ID NO: 2064102 - DNA, 12 bp, Homo sapiens
aggttgcagtga

SEQ ID NO: 2064103 - DNA, 17 bp, Homo sapiens
aggttgcagtgagctga

SEQ ID NO: 2064104 - DNA, 23 bp, Homo sapiens
aggttgttctgtataaaatgcaa

SEQ ID NO: 2064105 - DNA, 16 bp, Homo sapiens
aggtttatgaaaaaga

SEQ ID NO: 2064106 - DNA, 18 bp, Homo sapiens
aggtttcaagacttgata

SEQ ID NO: 2064107 - DNA, 14 bp, Homo sapiens
aggtttctgaaaat

SEQ ID NO: 2064108 - DNA, 14 bp, Homo sapiens
aggtttgccctgcc

SEQ ID NO: 2064109 - DNA, 12 bp, Homo sapiens
aggtttgtatat

SEQ ID NO: 2064110 - DNA, 20 bp, Homo sapiens
aggtttgtatattgtcagat

SEQ ID NO: 2064111 - DNA, 14 bp, Homo sapiens
aggttttctccact

SEQ ID NO: 2064112 - DNA, 17 bp, Homo sapiens
aggttttgttgttttat

SEQ ID NO: 2064113 - DNA, 18 bp, Homo sapiens
agtaaaaaattaaagccc

SEQ ID NO: 2064114 - DNA, 16 bp, Homo sapiens
agtaaaaccacagcag

SEQ ID NO: 2064115 - DNA, 19 bp, Homo sapiens
agtaaaaccacagcagttg

SEQ ID NO: 2064116 - DNA, 16 bp, Homo sapiens
agtaaaggcctcatct

SEQ ID NO: 2064117 - DNA, 17 bp, Homo sapiens
agtaaagtttaaaaaat

SEQ ID NO: 2064118 - DNA, 15 bp, Homo sapiens
agtaaataaattgtt

SEQ ID NO: 2064119 - DNA, 14 bp, Homo sapiens
agtaaataatgaaa

SEQ ID NO: 2064120 - DNA, 19 bp, Homo sapiens
agtaaatccttatttatat

SEQ ID NO: 2064121 - DNA, 12 bp, Homo sapiens
agtaaattggaa

SEQ ID NO: 2064122 - DNA, 14 bp, Homo sapiens
agtaactcatctgt

SEQ ID NO: 2064123 - DNA, 20 bp, Homo sapiens
agtaagatattatttaaatg

SEQ ID NO: 2064124 - DNA, 18 bp, Homo sapiens
agtaagcctccctcctcg

SEQ ID NO: 2064125 - DNA, 21 bp, Homo sapiens
agtaagttctgaaaactgttt

SEQ ID NO: 2064126 - DNA, 17 bp, Homo sapiens
agtaataaaacccagca

SEQ ID NO: 2064127 - DNA, 18 bp, Homo sapiens
agtaataaaacccagcat

SEQ ID NO: 2064128 - DNA, 16 bp, Homo sapiens
agtaatcaggcagcct

SEQ ID NO: 2064129 - DNA, 13 bp, Homo sapiens
agtaatctgcatt

SEQ ID NO: 2064130 - DNA, 23 bp, Homo sapiens
agtaatctgcattattggaatat

SEQ ID NO: 2064131 - DNA, 21 bp, Homo sapiens
agtaatgggccaattaaaata

SEQ ID NO: 2064132 - DNA, 22 bp, Homo sapiens
agtaattatcgggaacagtgtt

SEQ ID NO: 2064133 - DNA, 17 bp, Homo sapiens
agtaattgcatttctgc

SEQ ID NO: 2064134 - DNA, 22 bp, Homo sapiens
agtaattggtccgatctttgac

SEQ ID NO: 2064135 - DNA, 12 bp, Homo sapiens
agtaatttagaa

SEQ ID NO: 2064136 - DNA, 17 bp, Homo sapiens
agtaatttagaaatcat

SEQ ID NO: 2064137 - DNA, 23 bp, Homo sapiens
agtaatttagaaatcattttgca

SEQ ID NO: 2064138 - DNA, 14 bp, Homo sapiens
agtacaatgtttca

SEQ ID NO: 2064139 - DNA, 22 bp, Homo sapiens
agtacagtagcttaaataaatt

SEQ ID NO: 2064140 - DNA, 12 bp, Homo sapiens
agtacatttaat

SEQ ID NO: 2064141 - DNA, 21 bp, Homo sapiens
agtacatttaatacagcagtg

SEQ ID NO: 2064142 - DNA, 18 bp, Homo sapiens
agtacctgtagtgagaaa

SEQ ID NO: 2064143 - DNA, 19 bp, Homo sapiens
agtactcctgcaaaatttt

SEQ ID NO: 2064144 - DNA, 23 bp, Homo sapiens
agtactctctgctctagccagga

SEQ ID NO: 2064145 - DNA, 19 bp, Homo sapiens
agtacttctccaccctgct

SEQ ID NO: 2064146 - DNA, 21 bp, Homo sapiens
agtacttctccaccctgctct

SEQ ID NO: 2064147 - DNA, 14 bp, Homo sapiens
agtacttgatttca

SEQ ID NO: 2064148 - DNA, 23 bp, Homo sapiens
agtacttgggagacctgtaatca

SEQ ID NO: 2064149 - DNA, 17 bp, Homo sapiens
agtactttagcctggta

SEQ ID NO: 2064150 - DNA, 19 bp, Homo sapiens
agtagaaaaatctcattcc

SEQ ID NO: 2064151 - DNA, 12 bp, Homo sapiens
agtagaaatcat

SEQ ID NO: 2064152 - DNA, 20 bp, Homo sapiens
agtagaacaagcaacataaa

SEQ ID NO: 2064153 - DNA, 17 bp, Homo sapiens
agtagaatggcagctgg

SEQ ID NO: 2064154 - DNA, 14 bp, Homo sapiens
agtagaattatatc

SEQ ID NO: 2064155 - DNA, 12 bp, Homo sapiens
agtagagacagg

SEQ ID NO: 2064156 - DNA, 16 bp, Homo sapiens
agtagcaagttctaga

SEQ ID NO: 2064157 - DNA, 20 bp, Homo sapiens
agtagcaagttctagagaag

SEQ ID NO: 2064158 - DNA, 16 bp, Homo sapiens
agtagcagggaattga

SEQ ID NO: 2064159 - DNA, 13 bp, Homo sapiens
agtagccagcacg

SEQ ID NO: 2064160 - DNA, 16 bp, Homo sapiens
agtagccctttctgtg

SEQ ID NO: 2064161 - DNA, 15 bp, Homo sapiens
agtagccgagagcct

SEQ ID NO: 2064162 - DNA, 19 bp, Homo sapiens
agtagccgagagcctgctc

SEQ ID NO: 2064163 - DNA, 19 bp, Homo sapiens
agtagctatgactgcagat

SEQ ID NO: 2064164 - DNA, 19 bp, Homo sapiens
agtagctgagaggaagatg

SEQ ID NO: 2064165 - DNA, 22 bp, Homo sapiens
agtagctgagctcacaaggcag

SEQ ID NO: 2064166 - DNA, 23 bp, Homo sapiens
agtagctgagctcacaaggcagc

SEQ ID NO: 2064167 - DNA, 22 bp, Homo sapiens
agtagctgggactacaggcacc

SEQ ID NO: 2064168 - DNA, 20 bp, Homo sapiens
agtagcttaaataaattcaa

SEQ ID NO: 2064169 - DNA, 22 bp, Homo sapiens
agtagcttaaataaattcaaac

SEQ ID NO: 2064170 - DNA, 20 bp, Homo sapiens
agtctgtgtttgaccttcac

SEQ ID NO: 2064171 - DNA, 17 bp, Homo sapiens
agtcttaaaataactta

SEQ ID NO: 2064172 - DNA, 23 bp, Homo sapiens
agtcttaaaataacttatatcat

SEQ ID NO: 2064173 - DNA, 21 bp, Homo sapiens
agtcttcggtgtttaaagtca

SEQ ID NO: 2064174 - DNA, 18 bp, Homo sapiens
agtcttgctttgctgtct

SEQ ID NO: 2064175 - DNA, 16 bp, Homo sapiens
agtcttggaatacttg

SEQ ID NO: 2064176 - DNA, 15 bp, Homo sapiens
agtcttggcctgcct

SEQ ID NO: 2064177 - DNA, 21 bp, Homo sapiens
agtcttgtcagaattggcctc

SEQ ID NO: 2064178 - DNA, 14 bp, Homo sapiens
agtctttaatccca

SEQ ID NO: 2064179 - DNA, 14 bp, Homo sapiens
agtgaaaaatatgt

SEQ ID NO: 2064180 - DNA, 16 bp, Homo sapiens
agtgaaagctagagat

SEQ ID NO: 2064181 - DNA, 17 bp, Homo sapiens
agtgaacttgattttaa

SEQ ID NO: 2064182 - DNA, 22 bp, Homo sapiens
agtgaagaaaagtgaatgctca

SEQ ID NO: 2064183 - DNA, 19 bp, Homo sapiens
agtgaagagggagaaggga

SEQ ID NO: 2064184 - DNA, 15 bp, Homo sapiens
agtgaaggagaaagg

SEQ ID NO: 2064185 - DNA, 20 bp, Homo sapiens
agtgaaggagaaaggagccg

SEQ ID NO: 2064186 - DNA, 16 bp, Homo sapiens
agtgaataaacttcag

SEQ ID NO: 2064187 - DNA, 17 bp, Homo sapiens
agtgaataaacttcagc

SEQ ID NO: 2064188 - DNA, 21 bp, Homo sapiens
agtgaataaacttcagcacca

SEQ ID NO: 2064189 - DNA, 18 bp, Homo sapiens
agtgaataactgcaaagt

SEQ ID NO: 2064190 - DNA, 13 bp, Homo sapiens
agtgacagagacc

SEQ ID NO: 2064191 - DNA, 18 bp, Homo sapiens
agtgacagagacccagat

SEQ ID NO: 2064192 - DNA, 15 bp, Homo sapiens
agtgacagagttcac

SEQ ID NO: 2064193 - DNA, 19 bp, Homo sapiens
agtgacatgggtgtgccag

SEQ ID NO: 2064194 - DNA, 21 bp, Homo sapiens
agtgaccaggctcacaactgt

SEQ ID NO: 2064195 - DNA, 21 bp, Homo sapiens
agtgaccataaaggcatggca

SEQ ID NO: 2064196 - DNA, 17 bp, Homo sapiens
agtgacccacatgccat

SEQ ID NO: 2064197 - DNA, 15 bp, Homo sapiens
agtgacccagatatt

SEQ ID NO: 2064198 - DNA, 13 bp, Homo sapiens
agtgacctgaccg

SEQ ID NO: 2064199 - DNA, 16 bp, Homo sapiens
agtgacgggagcctcc

SEQ ID NO: 2064200 - DNA, 19 bp, Homo sapiens
agtgactcggtgtaaaacc

SEQ ID NO: 2064201 - DNA, 20 bp, Homo sapiens
agtgactcggtgtaaaacca

SEQ ID NO: 2064202 - DNA, 17 bp, Homo sapiens
agtgactggcaggtgca

SEQ ID NO: 2064203 - DNA, 23 bp, Homo sapiens
agtgactgtcgtgtttacaaaag

SEQ ID NO: 2064204 - DNA, 17 bp, Homo sapiens
agtgactttacaggagg

SEQ ID NO: 2064205 - DNA, 19 bp, Homo sapiens
agtgactttttctgagctt

SEQ ID NO: 2064206 - DNA, 20 bp, Homo sapiens
agtgactttttctgagcttt

SEQ ID NO: 2064207 - DNA, 18 bp, Homo sapiens
agtgagaaaaagctcctg

SEQ ID NO: 2064208 - DNA, 23 bp, Homo sapiens
agtgagacacagagtggagccct

SEQ ID NO: 2064209 - DNA, 12 bp, Homo sapiens
agtgagacagaa

SEQ ID NO: 2064210 - DNA, 16 bp, Homo sapiens
agtgagaccctgtctc

SEQ ID NO: 2064211 - DNA, 17 bp, Homo sapiens
agtgagaccctgtctct

SEQ ID NO: 2064212 - DNA, 17 bp, Homo sapiens
agtgagactctgtctca

SEQ ID NO: 2064213 - DNA, 20 bp, Homo sapiens
agtgagccacagaccacctg

SEQ ID NO: 2064214 - DNA, 18 bp, Homo sapiens
agtgaggaaatggcaaca

SEQ ID NO: 2064215 - DNA, 12 bp, Homo sapiens
agtgaggagggt

SEQ ID NO: 2064216 - DNA, 18 bp, Homo sapiens
agtgaggagggtggagga

SEQ ID NO: 2064217 - DNA, 14 bp, Homo sapiens
agtgagtctgtcag

SEQ ID NO: 2064218 - DNA, 15 bp, Homo sapiens
agtgagtctgtcagc

SEQ ID NO: 2064219 - DNA, 22 bp, Homo sapiens
agtgagttacagcgagaggcag

SEQ ID NO: 2064220 - DNA, 19 bp, Homo sapiens
agtgagttttttagtgcgt

SEQ ID NO: 2064221 - DNA, 15 bp, Homo sapiens
agtgatatcacctct

SEQ ID NO: 2064222 - DNA, 14 bp, Homo sapiens
agtgatcctcccac

SEQ ID NO: 2064223 - DNA, 24 bp, Homo sapiens
agtgatcctcccacctcagcctcc

SEQ ID NO: 2064224 - DNA, 14 bp, Homo sapiens
agtgatctccatat

SEQ ID NO: 2064225 - DNA, 20 bp, Homo sapiens
agtgatctgtcccctctccc

SEQ ID NO: 2064226 - DNA, 23 bp, Homo sapiens
agtgatggcgcgggaggcaccag

SEQ ID NO: 2064227 - DNA, 19 bp, Homo sapiens
agtgatgtgctggagctgg

SEQ ID NO: 2064228 - DNA, 14 bp, Homo sapiens
agtgatgtttttat

SEQ ID NO: 2064229 - DNA, 22 bp, Homo sapiens
agtgattctcctgcctcagcct

SEQ ID NO: 2064230 - DNA, 24 bp, Homo sapiens
agtgattctcctgcctcagcctcc

SEQ ID NO: 2064231 - DNA, 17 bp, Homo sapiens
agtgattgacacacagc

SEQ ID NO: 2064232 - DNA, 24 bp, Homo sapiens
agtgattgtgtctgcattgttatt

SEQ ID NO: 2064233 - DNA, 22 bp, Homo sapiens
agtcacacagtattacttctgc

SEQ ID NO: 2064234 - DNA, 23 bp, Homo sapiens
agtcacacagtattacttctgct

SEQ ID NO: 2064235 - DNA, 11 bp, Homo sapiens
agtcacagctg

SEQ ID NO: 2064236 - DNA, 13 bp, Homo sapiens
agtcacagctgca

SEQ ID NO: 2064237 - DNA, 15 bp, Homo sapiens
agtcacagctgcagc

SEQ ID NO: 2064238 - DNA, 16 bp, Homo sapiens
agtcacagctgcagct

SEQ ID NO: 2064239 - DNA, 19 bp, Homo sapiens
agtcacagctgcagctggg

SEQ ID NO: 2064240 - DNA, 23 bp, Homo sapiens
agtcacatggcctatgcacatat

SEQ ID NO: 2064241 - DNA, 14 bp, Homo sapiens
agtcaccaagccca

SEQ ID NO: 2064242 - DNA, 15 bp, Homo sapiens
agtcaccaagcccag

SEQ ID NO: 2064243 - DNA, 19 bp, Homo sapiens
agtcaccactccattccca

SEQ ID NO: 2064244 - DNA, 16 bp, Homo sapiens
agtcacccatgaagac

SEQ ID NO: 2064245 - DNA, 17 bp, Homo sapiens
agtcacccttctgggca

SEQ ID NO: 2064246 - DNA, 13 bp, Homo sapiens
agtcacctgcaag

SEQ ID NO: 2064247 - DNA, 16 bp, Homo sapiens
agtcacctgcaagccc

SEQ ID NO: 2064248 - DNA, 19 bp, Homo sapiens
agtcacctgcaagccccag

SEQ ID NO: 2064249 - DNA, 13 bp, Homo sapiens
agtcactgcacag

SEQ ID NO: 2064250 - DNA, 23 bp, Homo sapiens
agtcagccttccccctcccaggg

SEQ ID NO: 2064251 - DNA, 15 bp, Homo sapiens
agtcaggacctccgg

SEQ ID NO: 2064252 - DNA, 17 bp, Homo sapiens
agtcagtctctctctcc

SEQ ID NO: 2064253 - DNA, 15 bp, Homo sapiens
agtcagttcccggag

SEQ ID NO: 2064254 - DNA, 13 bp, Homo sapiens
agtcatgaagccc

SEQ ID NO: 2064255 - DNA, 16 bp, Homo sapiens
agtcatgatctccctg

SEQ ID NO: 2064256 - DNA, 19 bp, Homo sapiens
agtcatggcccaaatccag

SEQ ID NO: 2064257 - DNA, 20 bp, Homo sapiens
agtcattgggttttatcagt

SEQ ID NO: 2064258 - DNA, 13 bp, Homo sapiens
agtcatttaataa

SEQ ID NO: 2064259 - DNA, 16 bp, Homo sapiens
agtcatttattttaaa

SEQ ID NO: 2064260 - DNA, 19 bp, Homo sapiens
agtcattttaactttatca

SEQ ID NO: 2064261 - DNA, 21 bp, Homo sapiens
agtcattttaactttatcaca

SEQ ID NO: 2064262 - DNA, 15 bp, Homo sapiens
agtccaacctgcctg

SEQ ID NO: 2064263 - DNA, 17 bp, Homo sapiens
agtccagaataagtgct

SEQ ID NO: 2064264 - DNA, 16 bp, Homo sapiens
agtccagatgccttcc

SEQ ID NO: 2064265 - DNA, 16 bp, Homo sapiens
agtccagccagctcct

SEQ ID NO: 2064266 - DNA, 13 bp, Homo sapiens
agtccaggtcctg

SEQ ID NO: 2064267 - DNA, 16 bp, Homo sapiens
agtccaggtcctggtg

SEQ ID NO: 2064268 - DNA, 17 bp, Homo sapiens
agtccaggtcctggtgg

SEQ ID NO: 2064269 - DNA, 19 bp, Homo sapiens
agtccaggtcctggtgggg

SEQ ID NO: 2064270 - DNA, 14 bp, Homo sapiens
agtcccaaggaaag

SEQ ID NO: 2064271 - DNA, 17 bp, Homo sapiens
agtcccaaggaaagccc

SEQ ID NO: 2064272 - DNA, 16 bp, Homo sapiens
agtcccaccttggctg

SEQ ID NO: 2064273 - DNA, 19 bp, Homo sapiens
agtcccaccttggctgcag

SEQ ID NO: 2064274 - DNA, 22 bp, Homo sapiens
agtccccacagataactgaaaa

SEQ ID NO: 2064275 - DNA, 14 bp, Homo sapiens
agtccccagccctt

SEQ ID NO: 2064276 - DNA, 18 bp, Homo sapiens
agtccccagcccttctgc

SEQ ID NO: 2064277 - DNA, 16 bp, Homo sapiens
agtccccaggtcatgc

SEQ ID NO: 2064278 - DNA, 19 bp, Homo sapiens
agtccccatcagcaccatg

SEQ ID NO: 2064279 - DNA, 22 bp, Homo sapiens
agtccccatcagcaccatggag

SEQ ID NO: 2064280 - DNA, 19 bp, Homo sapiens
agtcccccaccacactgaa

SEQ ID NO: 2064281 - DNA, 23 bp, Homo sapiens
agtccccgtgccccgcctccccg

SEQ ID NO: 2064282 - DNA, 13 bp, Homo sapiens
agtcccctgggcc

SEQ ID NO: 2064283 - DNA, 19 bp, Homo sapiens
agtccctgactctctgtga

SEQ ID NO: 2064284 - DNA, 21 bp, Homo sapiens
agtccctgactctctgtgacc

SEQ ID NO: 2064285 - DNA, 21 bp, Homo sapiens
agtccctgccacactcagtcc

SEQ ID NO: 2064286 - DNA, 21 bp, Homo sapiens
agtccctgggggaagccctgg

SEQ ID NO: 2064287 - DNA, 23 bp, Homo sapiens
agtccgaaagggacttggaagct

SEQ ID NO: 2064288 - DNA, 19 bp, Homo sapiens
agtccgcctggccggctcc

SEQ ID NO: 2064289 - DNA, 20 bp, Homo sapiens
agtccgcctggccggctcca

SEQ ID NO: 2064290 - DNA, 14 bp, Homo sapiens
agtccgtcaaaaca

SEQ ID NO: 2064291 - DNA, 18 bp, Homo sapiens
agtcctagagctcctgtc

SEQ ID NO: 2064292 - DNA, 18 bp, Homo sapiens
aggggtgacagtggagga

SEQ ID NO: 2064293 - DNA, 22 bp, Homo sapiens
aggggtgatttcagagagggca

SEQ ID NO: 2064294 - DNA, 17 bp, Homo sapiens
aggggttgcgggggagc

SEQ ID NO: 2064295 - DNA, 21 bp, Homo sapiens
aggggttgcgggggagctgga

SEQ ID NO: 2064296 - DNA, 21 bp, Homo sapiens
agggtaccaatcctggcagga

SEQ ID NO: 2064297 - DNA, 23 bp, Homo sapiens
agggtagaattctggctggtaga

SEQ ID NO: 2064298 - DNA, 15 bp, Homo sapiens
agggtagcaggtacc

SEQ ID NO: 2064299 - DNA, 14 bp, Homo sapiens
agggtaggggagtg

SEQ ID NO: 2064300 - DNA, 19 bp, Homo sapiens
agggtatcaggtgctgcca

SEQ ID NO: 2064301 - DNA, 15 bp, Homo sapiens
agggtatgatccttg

SEQ ID NO: 2064302 - DNA, 13 bp, Homo sapiens
agggtccagaccc

SEQ ID NO: 2064303 - DNA, 15 bp, Homo sapiens
agggtccccacctgg

SEQ ID NO: 2064304 - DNA, 18 bp, Homo sapiens
agggtccccacctgggac

SEQ ID NO: 2064305 - DNA, 17 bp, Homo sapiens
agggtccccgggagcac

SEQ ID NO: 2064306 - DNA, 16 bp, Homo sapiens
agggtccgcaccagct

SEQ ID NO: 2064307 - DNA, 17 bp, Homo sapiens
agggtccgcaccagctg

SEQ ID NO: 2064308 - DNA, 15 bp, Homo sapiens
agggtcctccacaat

SEQ ID NO: 2064309 - DNA, 23 bp, Homo sapiens
agggtcctggtcctaaagagtta

SEQ ID NO: 2064310 - DNA, 23 bp, Homo sapiens
agggtcgccacacccggctcccc

SEQ ID NO: 2064311 - DNA, 23 bp, Homo sapiens
agggtctcactatgttgcccagg

SEQ ID NO: 2064312 - DNA, 16 bp, Homo sapiens
agggtctcactctgtc

SEQ ID NO: 2064313 - DNA, 22 bp, Homo sapiens
agggtctcactctgtcgcccag

SEQ ID NO: 2064314 - DNA, 18 bp, Homo sapiens
agggtctggctgtccctt

SEQ ID NO: 2064315 - DNA, 13 bp, Homo sapiens
agggtctgttgta

SEQ ID NO: 2064316 - DNA, 15 bp, Homo sapiens
agggtctgttgtaaa

SEQ ID NO: 2064317 - DNA, 13 bp, Homo sapiens
agggtcttgcaag

SEQ ID NO: 2064318 - DNA, 17 bp, Homo sapiens
agggtcttgggctactg

SEQ ID NO: 2064319 - DNA, 21 bp, Homo sapiens
agggtcttgggctactggcag

SEQ ID NO: 2064320 - DNA, 23 bp, Homo sapiens
agggtcttgggctactggcagct

SEQ ID NO: 2064321 - DNA, 18 bp, Homo sapiens
agggtgacatcccaggag

SEQ ID NO: 2064322 - DNA, 14 bp, Homo sapiens
agggtgagagctgc

SEQ ID NO: 2064323 - DNA, 22 bp, Homo sapiens
agggtgatgggaaagcattgta

SEQ ID NO: 2064324 - DNA, 14 bp, Homo sapiens
agggtgcatggctt

SEQ ID NO: 2064325 - DNA, 22 bp, Homo sapiens
agggtgcatggcttggggagca

SEQ ID NO: 2064326 - DNA, 23 bp, Homo sapiens
agggtgcatggcttggggagcag

SEQ ID NO: 2064327 - DNA, 20 bp, Homo sapiens
agggtgctaacgtatctcta

SEQ ID NO: 2064328 - DNA, 12 bp, Homo sapiens
agggtggagact

SEQ ID NO: 2064329 - DNA, 18 bp, Homo sapiens
agggtggaggaaggtgct

SEQ ID NO: 2064330 - DNA, 19 bp, Homo sapiens
agggtggaggaaggtgctg

SEQ ID NO: 2064331 - DNA, 22 bp, Homo sapiens
agggtggaggaaggtgctgagc

SEQ ID NO: 2064332 - DNA, 23 bp, Homo sapiens
agggtggaggaaggtgctgagct

SEQ ID NO: 2064333 - DNA, 19 bp, Homo sapiens
agggtggccccctgtgcca

SEQ ID NO: 2064334 - DNA, 22 bp, Homo sapiens
agggtggccccctgtgccagct

SEQ ID NO: 2064335 - DNA, 16 bp, Homo sapiens
agggtgggagagccca

SEQ ID NO: 2064336 - DNA, 18 bp, Homo sapiens
agggtgggagagcccagc

SEQ ID NO: 2064337 - DNA, 14 bp, Homo sapiens
agggtgggagccta

SEQ ID NO: 2064338 - DNA, 17 bp, Homo sapiens
agggtgggatggaggag

SEQ ID NO: 2064339 - DNA, 18 bp, Homo sapiens
agggtgggccactctccc

SEQ ID NO: 2064340 - DNA, 23 bp, Homo sapiens
agggtgggccactctcccctccc

SEQ ID NO: 2064341 - DNA, 19 bp, Homo sapiens
agggcccagctgtagccat

SEQ ID NO: 2064342 - DNA, 17 bp, Homo sapiens
agggcccaggcaggcca

SEQ ID NO: 2064343 - DNA, 12 bp, Homo sapiens
agggccccagca

SEQ ID NO: 2064344 - DNA, 18 bp, Homo sapiens
agggccccagcactaaag

SEQ ID NO: 2064345 - DNA, 19 bp, Homo sapiens
agggcccctccctctgccc

SEQ ID NO: 2064346 - DNA, 20 bp, Homo sapiens
agggcccctccctctgcccc

SEQ ID NO: 2064347 - DNA, 18 bp, Homo sapiens
agggccggggaactggcc

SEQ ID NO: 2064348 - DNA, 23 bp, Homo sapiens
agggccggggaactggccaagct

SEQ ID NO: 2064349 - DNA, 12 bp, Homo sapiens
agggcctgtggg

SEQ ID NO: 2064350 - DNA, 23 bp, Homo sapiens
agggcggggctatgccttgtctg

SEQ ID NO: 2064351 - DNA, 21 bp, Homo sapiens
agggcgtcgctggacaaccca

SEQ ID NO: 2064352 - DNA, 15 bp, Homo sapiens
agggcgtgactcacc

SEQ ID NO: 2064353 - DNA, 14 bp, Homo sapiens
agggctaagagcta

SEQ ID NO: 2064354 - DNA, 17 bp, Homo sapiens
agggctagaacctagaa

SEQ ID NO: 2064355 - DNA, 16 bp, Homo sapiens
agggctagaacctgga

SEQ ID NO: 2064356 - DNA, 19 bp, Homo sapiens
agggctagaacctggaagg

SEQ ID NO: 2064357 - DNA, 22 bp, Homo sapiens
agggctagaacctggaagggct

SEQ ID NO: 2064358 - DNA, 19 bp, Homo sapiens
agggctagaacctggagaa

SEQ ID NO: 2064359 - DNA, 20 bp, Homo sapiens
agggctagaacctggagagc

SEQ ID NO: 2064360 - DNA, 18 bp, Homo sapiens
agggctagaacctggagg

SEQ ID NO: 2064361 - DNA, 22 bp, Homo sapiens
agggctagaacctgtagagcta

SEQ ID NO: 2064362 - DNA, 12 bp, Homo sapiens
agggctcagcct

SEQ ID NO: 2064363 - DNA, 15 bp, Homo sapiens
agggctccagcatcc

SEQ ID NO: 2064364 - DNA, 18 bp, Homo sapiens
agggctccagcatccagc

SEQ ID NO: 2064365 - DNA, 23 bp, Homo sapiens
agggctccagcatccagcctgtg

SEQ ID NO: 2064366 - DNA, 15 bp, Homo sapiens
agggctcgggcgctg

SEQ ID NO: 2064367 - DNA, 14 bp, Homo sapiens
agggctctcctggc

SEQ ID NO: 2064368 - DNA, 11 bp, Homo sapiens
agggctctgag

SEQ ID NO: 2064369 - DNA, 13 bp, Homo sapiens
agggctctgaggc

SEQ ID NO: 2064370 - DNA, 17 bp, Homo sapiens
agggctgacctgcctct

SEQ ID NO: 2064371 - DNA, 12 bp, Homo sapiens
agggctgcccct

SEQ ID NO: 2064372 - DNA, 13 bp, Homo sapiens
agggctgctgtga

SEQ ID NO: 2064373 - DNA, 20 bp, Homo sapiens
agggctggaaaagtcacaca

SEQ ID NO: 2064374 - DNA, 22 bp, Homo sapiens
agggctggacctatgtcctaag

SEQ ID NO: 2064375 - DNA, 20 bp, Homo sapiens
agggctgtagacttactttc

SEQ ID NO: 2064376 - DNA, 17 bp, Homo sapiens
agggctgttggacagct

SEQ ID NO: 2064377 - DNA, 16 bp, Homo sapiens
agggcttcttcttata

SEQ ID NO: 2064378 - DNA, 13 bp, Homo sapiens
agggcttggggag

SEQ ID NO: 2064379 - DNA, 14 bp, Homo sapiens
agggcttggggagc

SEQ ID NO: 2064380 - DNA, 16 bp, Homo sapiens
agggcttggggagcag

SEQ ID NO: 2064381 - DNA, 21 bp, Homo sapiens
agggcttggtaaaacacagat

SEQ ID NO: 2064382 - DNA, 21 bp, Homo sapiens
agggcttttttttgagaatac

SEQ ID NO: 2064383 - DNA, 13 bp, Homo sapiens
aggggaaaatgaa

SEQ ID NO: 2064384 - DNA, 14 bp, Homo sapiens
aggggaagggccag

SEQ ID NO: 2064385 - DNA, 13 bp, Homo sapiens
aggggaatgtttg

SEQ ID NO: 2064386 - DNA, 20 bp, Homo sapiens
aggggaatgtttgcctctgc

SEQ ID NO: 2064387 - DNA, 12 bp, Homo sapiens
agtttgttttac

SEQ ID NO: 2064388 - DNA, 13 bp, Homo sapiens
agtttgttttaca

SEQ ID NO: 2064389 - DNA, 13 bp, Homo sapiens
agttttaaatatg

SEQ ID NO: 2064390 - DNA, 18 bp, Homo sapiens
agttttaaatatgaacaa

SEQ ID NO: 2064391 - DNA, 19 bp, Homo sapiens
agttttaaatatgaacaaa

SEQ ID NO: 2064392 - DNA, 14 bp, Homo sapiens
agttttataaaact

SEQ ID NO: 2064393 - DNA, 14 bp, Homo sapiens
agttttatcatttt

SEQ ID NO: 2064394 - DNA, 22 bp, Homo sapiens
agttttcactcttattgcccac

SEQ ID NO: 2064395 - DNA, 13 bp, Homo sapiens
agttttcagcctt

SEQ ID NO: 2064396 - DNA, 17 bp, Homo sapiens
agttttccttgaaaaaa

SEQ ID NO: 2064397 - DNA, 19 bp, Homo sapiens
agttttctgagaaagacta

SEQ ID NO: 2064398 - DNA, 17 bp, Homo sapiens
agttttctttgtaaagg

SEQ ID NO: 2064399 - DNA, 15 bp, Homo sapiens
agttttgaaagaaaa

SEQ ID NO: 2064400 - DNA, 21 bp, Homo sapiens
agttttgatgaaattcttgaa

SEQ ID NO: 2064401 - DNA, 18 bp, Homo sapiens
agttttgtataaataata

SEQ ID NO: 2064402 - DNA, 20 bp, Homo sapiens
agttttgtataaataataaa

SEQ ID NO: 2064403 - DNA, 17 bp, Homo sapiens
agtttttatggggctga

SEQ ID NO: 2064404 - DNA, 17 bp, Homo sapiens
agtttttcagaaagcat

SEQ ID NO: 2064405 - DNA, 14 bp, Homo sapiens
agttttttttgtaa

SEQ ID NO: 2064406 - DNA, 17 bp, Homo sapiens
ataaaaaaaagaaatga

SEQ ID NO: 2064407 - DNA, 17 bp, Homo sapiens
ataaaaaaatacagtaa

SEQ ID NO: 2064408 - DNA, 20 bp, Homo sapiens
ataaaaaacatttgtacatt

SEQ ID NO: 2064409 - DNA, 14 bp, Homo sapiens
ataaaaaccagaat

SEQ ID NO: 2064410 - DNA, 22 bp, Homo sapiens
ataaaaagaggatgatttcaga

SEQ ID NO: 2064411 - DNA, 18 bp, Homo sapiens
ataaaaataatatatgct

SEQ ID NO: 2064412 - DNA, 23 bp, Homo sapiens
ataaaaatatatatagtgctata

SEQ ID NO: 2064413 - DNA, 13 bp, Homo sapiens
ataaaacattatg

SEQ ID NO: 2064414 - DNA, 12 bp, Homo sapiens
ataaaacattcc

SEQ ID NO: 2064415 - DNA, 11 bp, Homo sapiens
ataaaaccatg

SEQ ID NO: 2064416 - DNA, 21 bp, Homo sapiens
ataaaacctttcaaatttcac

SEQ ID NO: 2064417 - DNA, 22 bp, Homo sapiens
ataaaacctttcaaatttcaca

SEQ ID NO: 2064418 - DNA, 16 bp, Homo sapiens
ataaaactaaatatat

SEQ ID NO: 2064419 - DNA, 15 bp, Homo sapiens
ataaaagcataaatg

SEQ ID NO: 2064420 - DNA, 22 bp, Homo sapiens
ataaaagtagcaaccttcattt

SEQ ID NO: 2064421 - DNA, 16 bp, Homo sapiens
ataaaataaagtatat

SEQ ID NO: 2064422 - DNA, 12 bp, Homo sapiens
ataaaatagtat

SEQ ID NO: 2064423 - DNA, 13 bp, Homo sapiens
ataaaatagtatt

SEQ ID NO: 2064424 - DNA, 16 bp, Homo sapiens
ataaaatagtattgaa

SEQ ID NO: 2064425 - DNA, 19 bp, Homo sapiens
ataaaatagttgtccatat

SEQ ID NO: 2064426 - DNA, 17 bp, Homo sapiens
agtgcaaagtgccctca

SEQ ID NO: 2064427 - DNA, 20 bp, Homo sapiens
agtgcaaatactccaagctt

SEQ ID NO: 2064428 - DNA, 16 bp, Homo sapiens
agtgcaacaaaatcaa

SEQ ID NO: 2064429 - DNA, 16 bp, Homo sapiens
agtgcaaccacacacc

SEQ ID NO: 2064430 - DNA, 24 bp, Homo sapiens
agtgcaaccacacacctcaccaga

SEQ ID NO: 2064431 - DNA, 14 bp, Homo sapiens
agtgcaatgcgtgt

SEQ ID NO: 2064432 - DNA, 19 bp, Homo sapiens
agtgcaatgcgtgttgtac

SEQ ID NO: 2064433 - DNA, 21 bp, Homo sapiens
agtgcaatttcccctctgtgt

SEQ ID NO: 2064434 - DNA, 17 bp, Homo sapiens
agtgcacacagaaatat

SEQ ID NO: 2064435 - DNA, 15 bp, Homo sapiens
agtgcagcccttcct

SEQ ID NO: 2064436 - DNA, 20 bp, Homo sapiens
agtgcagcccttcctcctga

SEQ ID NO: 2064437 - DNA, 21 bp, Homo sapiens
agtgcatccttgaactgtcag

SEQ ID NO: 2064438 - DNA, 16 bp, Homo sapiens
agtgcatctcagccca

SEQ ID NO: 2064439 - DNA, 17 bp, Homo sapiens
agtgcatctcagcccac

SEQ ID NO: 2064440 - DNA, 15 bp, Homo sapiens
agtgcatgctctctg

SEQ ID NO: 2064441 - DNA, 10 bp, Homo sapiens
agtgccacag

SEQ ID NO: 2064442 - DNA, 19 bp, Homo sapiens
agtgccactcattcctgta

SEQ ID NO: 2064443 - DNA, 19 bp, Homo sapiens
agtgccacttgacattcct

SEQ ID NO: 2064444 - DNA, 23 bp, Homo sapiens
agtgccacttgacattccttgtc

SEQ ID NO: 2064445 - DNA, 13 bp, Homo sapiens
agtgccaggacag

SEQ ID NO: 2064446 - DNA, 23 bp, Homo sapiens
agtgccaggactccccaggccag

SEQ ID NO: 2064447 - DNA, 20 bp, Homo sapiens
agtgccagtcttgtgtctgc

SEQ ID NO: 2064448 - DNA, 14 bp, Homo sapiens
agtgcccacaggat

SEQ ID NO: 2064449 - DNA, 19 bp, Homo sapiens
agtgcccaccaacatccca

SEQ ID NO: 2064450 - DNA, 16 bp, Homo sapiens
agtgcccccacccagt

SEQ ID NO: 2064451 - DNA, 15 bp, Homo sapiens
agtgcccgccctgcc

SEQ ID NO: 2064452 - DNA, 19 bp, Homo sapiens
agtgcccgcctaggagttg

SEQ ID NO: 2064453 - DNA, 14 bp, Homo sapiens
agtgccgcctgtgc

SEQ ID NO: 2064454 - DNA, 17 bp, Homo sapiens
agtgcctggcaaggcct

SEQ ID NO: 2064455 - DNA, 19 bp, Homo sapiens
agtgccttacctcctgccc

SEQ ID NO: 2064456 - DNA, 20 bp, Homo sapiens
agtgccttacctcctgccca

SEQ ID NO: 2064457 - DNA, 23 bp, Homo sapiens
agtgccttacctcctgcccagga

SEQ ID NO: 2064458 - DNA, 15 bp, Homo sapiens
agtgccttggagcag

SEQ ID NO: 2064459 - DNA, 20 bp, Homo sapiens
agtgcgctcttggtccctgg

SEQ ID NO: 2064460 - DNA, 14 bp, Homo sapiens
agtgctactgctag

SEQ ID NO: 2064461 - DNA, 16 bp, Homo sapiens
agtgctatatatataa

SEQ ID NO: 2064462 - DNA, 19 bp, Homo sapiens
agtgctatatatataaata

SEQ ID NO: 2064463 - DNA, 22 bp, Homo sapiens
agtgctatatatataaatattt

SEQ ID NO: 2064464 - DNA, 23 bp, Homo sapiens
agtgctatatatataaatatttg

SEQ ID NO: 2064465 - DNA, 13 bp, Homo sapiens
agtgctattctgt

SEQ ID NO: 2064466 - DNA, 16 bp, Homo sapiens
agtgctattctgtgtt

SEQ ID NO: 2064467 - DNA, 19 bp, Homo sapiens
agtgctctaggctgccccg

SEQ ID NO: 2064468 - DNA, 16 bp, Homo sapiens
agtgctgccatgccac

SEQ ID NO: 2064469 - DNA, 21 bp, Homo sapiens
agtgctgccatgccactgcca

SEQ ID NO: 2064470 - DNA, 22 bp, Homo sapiens
agtgctgccatgccactgccag

SEQ ID NO: 2064471 - DNA, 23 bp, Homo sapiens
agtgctgccatgccactgccagg

SEQ ID NO: 2064472 - DNA, 13 bp, Homo sapiens
agtgctgccctgc

SEQ ID NO: 2064473 - DNA, 13 bp, Homo sapiens
agtgctgcttctc

SEQ ID NO: 2064474 - DNA, 17 bp, Homo sapiens
ataaattcaaaccattt

SEQ ID NO: 2064475 - DNA, 12 bp, Homo sapiens
ataaattcagat

SEQ ID NO: 2064476 - DNA, 13 bp, Homo sapiens
ataaattcagata

SEQ ID NO: 2064477 - DNA, 16 bp, Homo sapiens
ataaattcagatatat

SEQ ID NO: 2064478 - DNA, 15 bp, Homo sapiens
ataaattccactgga

SEQ ID NO: 2064479 - DNA, 13 bp, Homo sapiens
ataaattgaaata

SEQ ID NO: 2064480 - DNA, 14 bp, Homo sapiens
ataaattgaaatat

SEQ ID NO: 2064481 - DNA, 22 bp, Homo sapiens
ataaattgaaatataatgcaaa

SEQ ID NO: 2064482 - DNA, 13 bp, Homo sapiens
ataaattgctcct

SEQ ID NO: 2064483 - DNA, 13 bp, Homo sapiens
ataaattgtttga

SEQ ID NO: 2064484 - DNA, 15 bp, Homo sapiens
ataaattgtttgacc

SEQ ID NO: 2064485 - DNA, 20 bp, Homo sapiens
ataaattgtttggcttcctc

SEQ ID NO: 2064486 - DNA, 11 bp, Homo sapiens
ataacaaaatc

SEQ ID NO: 2064487 - DNA, 15 bp, Homo sapiens
ataacaacctggaga

SEQ ID NO: 2064488 - DNA, 14 bp, Homo sapiens
ataacaagatcttt

SEQ ID NO: 2064489 - DNA, 16 bp, Homo sapiens
ataacaagatctttca

SEQ ID NO: 2064490 - DNA, 22 bp, Homo sapiens
ataacaaggttcttctaaaatt

SEQ ID NO: 2064491 - DNA, 17 bp, Homo sapiens
ataacaatgtatgtgaa

SEQ ID NO: 2064492 - DNA, 15 bp, Homo sapiens
ataacaattgtttgg

SEQ ID NO: 2064493 - DNA, 22 bp, Homo sapiens
ataacatctttgaaaagaaaaa

SEQ ID NO: 2064494 - DNA, 13 bp, Homo sapiens
ataaccacttaaa

SEQ ID NO: 2064495 - DNA, 16 bp, Homo sapiens
ataaccatcagttact

SEQ ID NO: 2064496 - DNA, 18 bp, Homo sapiens
ataaccatcagttactgg

SEQ ID NO: 2064497 - DNA, 20 bp, Homo sapiens
ataaccatgtgaaaaggcaa

SEQ ID NO: 2064498 - DNA, 16 bp, Homo sapiens
ataaccattacatgtt

SEQ ID NO: 2064499 - DNA, 12 bp, Homo sapiens
ataaccccacct

SEQ ID NO: 2064500 - DNA, 21 bp, Homo sapiens
ataaccccaccttgccaagct

SEQ ID NO: 2064501 - DNA, 16 bp, Homo sapiens
ataaccttcatgatga

SEQ ID NO: 2064502 - DNA, 23 bp, Homo sapiens
ataaccttccttctaaacatttt

SEQ ID NO: 2064503 - DNA, 20 bp, Homo sapiens
ataacgtttaagccaaaaca

SEQ ID NO: 2064504 - DNA, 13 bp, Homo sapiens
ataactagatctc

SEQ ID NO: 2064505 - DNA, 14 bp, Homo sapiens
ataactagatctcc

SEQ ID NO: 2064506 - DNA, 17 bp, Homo sapiens
ataactcatcataaaat

SEQ ID NO: 2064507 - DNA, 20 bp, Homo sapiens
ataactgaaaattatttaaa

SEQ ID NO: 2064508 - DNA, 16 bp, Homo sapiens
ataacttaaaaaaatg

SEQ ID NO: 2064509 - DNA, 19 bp, Homo sapiens
ataacttaaaaaaatgaca

SEQ ID NO: 2064510 - DNA, 16 bp, Homo sapiens
ataacttcagagaagt

SEQ ID NO: 2064511 - DNA, 19 bp, Homo sapiens
ataactttagaaataagaa

SEQ ID NO: 2064512 - DNA, 18 bp, Homo sapiens
ataagaaacatgatgtga

SEQ ID NO: 2064513 - DNA, 21 bp, Homo sapiens
ataagaaacttttttatttaa

SEQ ID NO: 2064514 - DNA, 20 bp, Homo sapiens
ataagaagaatgcttaatca

SEQ ID NO: 2064515 - DNA, 16 bp, Homo sapiens
ataagaatgctggttt

SEQ ID NO: 2064516 - DNA, 19 bp, Homo sapiens
ataagaatgctggttttcc

SEQ ID NO: 2064517 - DNA, 22 bp, Homo sapiens
ataagaatgctggttttcctaa

SEQ ID NO: 2064518 - DNA, 11 bp, Homo sapiens
ataagaattaa

SEQ ID NO: 2064519 - DNA, 20 bp, Homo sapiens
ataagagagaacaactactg

SEQ ID NO: 2064520 - DNA, 15 bp, Homo sapiens
ataagataatgatga

SEQ ID NO: 2064521 - DNA, 19 bp, Homo sapiens
ataagattaaaggaaggaa

SEQ ID NO: 2064522 - DNA, 13 bp, Homo sapiens
ataagattagaat

SEQ ID NO: 2064523 - DNA, 23 bp, Homo sapiens
ataagcaaagggagcactgggtt

SEQ ID NO: 2064524 - DNA, 19 bp, Homo sapiens
ataagcccaaatggctctg

SEQ ID NO: 2064525 - DNA, 17 bp, Homo sapiens
ataagcccagctctgct

SEQ ID NO: 2064526 - DNA, 24 bp, Homo sapiens
ataaggaggaaaacgggaaagaat

SEQ ID NO: 2064527 - DNA, 15 bp, Homo sapiens
ataaggataataatc

SEQ ID NO: 2064528 - DNA, 22 bp, Homo sapiens
ataaggcaagttttgaagcctg

SEQ ID NO: 2064529 - DNA, 16 bp, Homo sapiens
ataagtactgtgtaca

SEQ ID NO: 2064530 - DNA, 14 bp, Homo sapiens
ataagtcattgaaa

SEQ ID NO: 2064531 - DNA, 16 bp, Homo sapiens
ataagtcattgaaatt

SEQ ID NO: 2064532 - DNA, 21 bp, Homo sapiens
ataagtgcacacagaaatata

SEQ ID NO: 2064533 - DNA, 13 bp, Homo sapiens
ataagtggaaaaa

SEQ ID NO: 2064534 - DNA, 14 bp, Homo sapiens
ataagtggaaaaaa

SEQ ID NO: 2064535 - DNA, 15 bp, Homo sapiens
ataagtggaaaaaag

SEQ ID NO: 2064536 - DNA, 13 bp, Homo sapiens
ataataaagccag

SEQ ID NO: 2064537 - DNA, 23 bp, Homo sapiens
ataataaattgtttggcttcctc

SEQ ID NO: 2064538 - DNA, 21 bp, Homo sapiens
ataataactagatctcctgta

SEQ ID NO: 2064539 - DNA, 14 bp, Homo sapiens
ataataatgttctc

SEQ ID NO: 2064540 - DNA, 22 bp, Homo sapiens
ataataattaggttaacattgt

SEQ ID NO: 2064541 - DNA, 14 bp, Homo sapiens
ataatactaaagtg

SEQ ID NO: 2064542 - DNA, 12 bp, Homo sapiens
ataatagaagaa

SEQ ID NO: 2064543 - DNA, 16 bp, Homo sapiens
ataatagacacatcaa

SEQ ID NO: 2064544 - DNA, 22 bp, Homo sapiens
ataataggatataaaacacatc

SEQ ID NO: 2064545 - DNA, 16 bp, Homo sapiens
ataatataagaatcat

SEQ ID NO: 2064546 - DNA, 21 bp, Homo sapiens
ataatatctgtgaggtgctga

SEQ ID NO: 2064547 - DNA, 24 bp, Homo sapiens
ataatatctgtgaggtgctgatga

SEQ ID NO: 2064548 - DNA, 23 bp, Homo sapiens
ataatatcttgaagaatattgtt

SEQ ID NO: 2064549 - DNA, 21 bp, Homo sapiens
ataatatgctgccaaattttg

SEQ ID NO: 2064550 - DNA, 13 bp, Homo sapiens
ataatcagcctct

SEQ ID NO: 2064551 - DNA, 18 bp, Homo sapiens
ataatcatctctgtcaca

SEQ ID NO: 2064552 - DNA, 12 bp, Homo sapiens
ataatctagaac

SEQ ID NO: 2064553 - DNA, 18 bp, Homo sapiens
ataatctggactcctctg

SEQ ID NO: 2064554 - DNA, 19 bp, Homo sapiens
ataatctggactcctctgt

SEQ ID NO: 2064555 - DNA, 20 bp, Homo sapiens
ataatctggactcctctgtc

SEQ ID NO: 2064556 - DNA, 20 bp, Homo sapiens
ataatgagtctgcataaact

SEQ ID NO: 2064557 - DNA, 19 bp, Homo sapiens
ataatgatttaagcatttt

SEQ ID NO: 2064558 - DNA, 20 bp, Homo sapiens
ataatgctcccatctcctga

SEQ ID NO: 2064559 - DNA, 18 bp, Homo sapiens
ataatgctgttgcctcat

SEQ ID NO: 2064560 - DNA, 17 bp, Homo sapiens
ataatggaagagaaatc

SEQ ID NO: 2064561 - DNA, 18 bp, Homo sapiens
ataatggaagagaaatct

SEQ ID NO: 2064562 - DNA, 21 bp, Homo sapiens
ataatggaagagaaatctcat

SEQ ID NO: 2064563 - DNA, 19 bp, Homo sapiens
ataatggtgttactaaagt

SEQ ID NO: 2064564 - DNA, 21 bp, Homo sapiens
ataatggtgttactaaagtca

SEQ ID NO: 2064565 - DNA, 14 bp, Homo sapiens
ataatggttgactg

SEQ ID NO: 2064566 - DNA, 14 bp, Homo sapiens
ataatggtttactg

SEQ ID NO: 2064567 - DNA, 16 bp, Homo sapiens
ataatggtttactgct

SEQ ID NO: 2064568 - DNA, 18 bp, Homo sapiens
ataatggtttactgctgt

SEQ ID NO: 2064569 - DNA, 16 bp, Homo sapiens
ataatgtcaaaatcat

SEQ ID NO: 2064570 - DNA, 13 bp, Homo sapiens
ataatgtgtgtat

SEQ ID NO: 2064571 - DNA, 14 bp, Homo sapiens
ataatgtgtgtatg

SEQ ID NO: 2064572 - DNA, 11 bp, Homo sapiens
ataatgttctt

SEQ ID NO: 2064573 - DNA, 21 bp, Homo sapiens
ataatgttctttaatgttgtc

SEQ ID NO: 2064574 - DNA, 14 bp, Homo sapiens
ataatgttgttatt

SEQ ID NO: 2064575 - DNA, 15 bp, Homo sapiens
ataattaatgtgtgt

SEQ ID NO: 2064576 - DNA, 15 bp, Homo sapiens
ataattagaacaata

SEQ ID NO: 2064577 - DNA, 16 bp, Homo sapiens
ataattaggatctatg

SEQ ID NO: 2064578 - DNA, 19 bp, Homo sapiens
ataattaggatctatgcaa

SEQ ID NO: 2064579 - DNA, 16 bp, Homo sapiens
ataattaggttaacat

SEQ ID NO: 2064580 - DNA, 22 bp, Homo sapiens
ataattatcggaagcagtgcct

SEQ ID NO: 2064581 - DNA, 16 bp, Homo sapiens
ataattatgacagtta

SEQ ID NO: 2064582 - DNA, 18 bp, Homo sapiens
ataattatgacagttata

SEQ ID NO: 2064583 - DNA, 18 bp, Homo sapiens
ataattatttatttaata

SEQ ID NO: 2064584 - DNA, 12 bp, Homo sapiens
ataattccctat

SEQ ID NO: 2064585 - DNA, 22 bp, Homo sapiens
ataattgaaaggaaatgtttga

SEQ ID NO: 2064586 - DNA, 12 bp, Homo sapiens
ataattgtgtac

SEQ ID NO: 2064587 - DNA, 12 bp, Homo sapiens
ataatttaacta

SEQ ID NO: 2064588 - DNA, 13 bp, Homo sapiens
ataatttaactaa

SEQ ID NO: 2064589 - DNA, 17 bp, Homo sapiens
ataatttagtttcatat

SEQ ID NO: 2064590 - DNA, 15 bp, Homo sapiens
ataatttattttgta

SEQ ID NO: 2064591 - DNA, 17 bp, Homo sapiens
ataatttgttgtacttt

SEQ ID NO: 2064592 - DNA, 20 bp, Homo sapiens
ataattttcaagagaagaaa

SEQ ID NO: 2064593 - DNA, 15 bp, Homo sapiens
ataattttcctccta

SEQ ID NO: 2064594 - DNA, 13 bp, Homo sapiens
ataattttcttca

SEQ ID NO: 2064595 - DNA, 17 bp, Homo sapiens
ataattttcttcatgca

SEQ ID NO: 2064596 - DNA, 23 bp, Homo sapiens
ataattttcttcatgcaatgaca

SEQ ID NO: 2064597 - DNA, 19 bp, Homo sapiens
ataatttttaaagtatata

SEQ ID NO: 2064598 - DNA, 21 bp, Homo sapiens
ataatttttaaagtatatatt

SEQ ID NO: 2064599 - DNA, 20 bp, Homo sapiens
atacaaaataatttaactaa

SEQ ID NO: 2064600 - DNA, 21 bp, Homo sapiens
atacaaaataatttaactaat

SEQ ID NO: 2064601 - DNA, 14 bp, Homo sapiens
atacaacaagaaca

SEQ ID NO: 2064602 - DNA, 15 bp, Homo sapiens
atacaacaagaacaa

SEQ ID NO: 2064603 - DNA, 16 bp, Homo sapiens
atacaacacaaagaga

SEQ ID NO: 2064604 - DNA, 20 bp, Homo sapiens
atacaacatgtagctgagtt

SEQ ID NO: 2064605 - DNA, 15 bp, Homo sapiens
atacaatatataaaa

SEQ ID NO: 2064606 - DNA, 19 bp, Homo sapiens
atacaatgttctgttgtaa

SEQ ID NO: 2064607 - DNA, 13 bp, Homo sapiens
atacaatttgcac

SEQ ID NO: 2064608 - DNA, 16 bp, Homo sapiens
atacaatttgcactgt

SEQ ID NO: 2064609 - DNA, 14 bp, Homo sapiens
atacacaggatcct

SEQ ID NO: 2064610 - DNA, 12 bp, Homo sapiens
atacacatacat

SEQ ID NO: 2064611 - DNA, 15 bp, Homo sapiens
atacacatacataca

SEQ ID NO: 2064612 - DNA, 23 bp, Homo sapiens
atacacatatacctataatgtgt

SEQ ID NO: 2064613 - DNA, 15 bp, Homo sapiens
atacactcctgctgt

SEQ ID NO: 2064614 - DNA, 17 bp, Homo sapiens
atacacttgtataaatg

SEQ ID NO: 2064615 - DNA, 19 bp, Homo sapiens
atacacttgtataaatgta

SEQ ID NO: 2064616 - DNA, 22 bp, Homo sapiens
atacacttgtataaatgtatat

SEQ ID NO: 2064617 - DNA, 14 bp, Homo sapiens
atacagaatgaatc

SEQ ID NO: 2064618 - DNA, 12 bp, Homo sapiens
atacagacacta

SEQ ID NO: 2064619 - DNA, 15 bp, Homo sapiens
atacagacactaagt

SEQ ID NO: 2064620 - DNA, 18 bp, Homo sapiens
atacagacactaagttat

SEQ ID NO: 2064621 - DNA, 22 bp, Homo sapiens
atacagattctagccaaactat

SEQ ID NO: 2064622 - DNA, 13 bp, Homo sapiens
atacagctcagaa

SEQ ID NO: 2064623 - DNA, 18 bp, Homo sapiens
atacagtaaagtttaaaa

SEQ ID NO: 2064624 - DNA, 20 bp, Homo sapiens
atacagtaaagtttaaaaaa

SEQ ID NO: 2064625 - DNA, 17 bp, Homo sapiens
atacagtccctaaagaa

SEQ ID NO: 2064626 - DNA, 22 bp, Homo sapiens
atacagtccctaaagaaaaaaa

SEQ ID NO: 2064627 - DNA, 14 bp, Homo sapiens
atacatacacatac

SEQ ID NO: 2064628 - DNA, 13 bp, Homo sapiens
atacatacataca

SEQ ID NO: 2064629 - DNA, 15 bp, Homo sapiens
atacatacatacata

SEQ ID NO: 2064630 - DNA, 17 bp, Homo sapiens
atacatacatacataca

SEQ ID NO: 2064631 - DNA, 13 bp, Homo sapiens
atacatacctact

SEQ ID NO: 2064632 - DNA, 14 bp, Homo sapiens
atacatagtcacaa

SEQ ID NO: 2064633 - DNA, 17 bp, Homo sapiens
atacatagtcacaaaaa

SEQ ID NO: 2064634 - DNA, 12 bp, Homo sapiens
atacatatatat

SEQ ID NO: 2064635 - DNA, 15 bp, Homo sapiens
atacatatatatctg

SEQ ID NO: 2064636 - DNA, 16 bp, Homo sapiens
atacatatatatctga

SEQ ID NO: 2064637 - DNA, 13 bp, Homo sapiens
atacatatcagaa

SEQ ID NO: 2064638 - DNA, 18 bp, Homo sapiens
atacatatgtagactata

SEQ ID NO: 2064639 - DNA, 21 bp, Homo sapiens
atacatatgtagactatatac

SEQ ID NO: 2064640 - DNA, 23 bp, Homo sapiens
atacatatgtagactatatacat

SEQ ID NO: 2064641 - DNA, 15 bp, Homo sapiens
atacatattataaat

SEQ ID NO: 2064642 - DNA, 17 bp, Homo sapiens
atacatattataaataa

SEQ ID NO: 2064643 - DNA, 15 bp, Homo sapiens
atacatggggaactg

SEQ ID NO: 2064644 - DNA, 21 bp, Homo sapiens
atacatgtactccagagggac

SEQ ID NO: 2064645 - DNA, 12 bp, Homo sapiens
atacatgtgtgt

SEQ ID NO: 2064646 - DNA, 18 bp, Homo sapiens
atacatgtgtgtatatat

SEQ ID NO: 2064647 - DNA, 19 bp, Homo sapiens
atacatgtgtgtatatatg

SEQ ID NO: 2064648 - DNA, 20 bp, Homo sapiens
atacatgtgtgtatatatgt

SEQ ID NO: 2064649 - DNA, 22 bp, Homo sapiens
atacattccctatcaaaacata

SEQ ID NO: 2064650 - DNA, 23 bp, Homo sapiens
atacatttataatgtttgctatt

SEQ ID NO: 2064651 - DNA, 21 bp, Homo sapiens
atacattttatatctggattt

SEQ ID NO: 2064652 - DNA, 22 bp, Homo sapiens
atacattttgttatagaatact

SEQ ID NO: 2064653 - DNA, 24 bp, Homo sapiens
ataccaaatagcttctgttttgtt

SEQ ID NO: 2064654 - DNA, 12 bp, Homo sapiens
ataccaaatatt

SEQ ID NO: 2064655 - DNA, 14 bp, Homo sapiens
ataccaaatatttt

SEQ ID NO: 2064656 - DNA, 19 bp, Homo sapiens
ataccagatcactcaaaaa

SEQ ID NO: 2064657 - DNA, 17 bp, Homo sapiens
ataccagtgaaccaaag

SEQ ID NO: 2064658 - DNA, 15 bp, Homo sapiens
ataccatcctgccca

SEQ ID NO: 2064659 - DNA, 13 bp, Homo sapiens
atacccctgcctg

SEQ ID NO: 2064660 - DNA, 15 bp, Homo sapiens
atacctactgactga

SEQ ID NO: 2064661 - DNA, 13 bp, Homo sapiens
atacctataatgt

SEQ ID NO: 2064662 - DNA, 15 bp, Homo sapiens
atacctataatgtgt

SEQ ID NO: 2064663 - DNA, 20 bp, Homo sapiens
atacctctctctatatatac

SEQ ID NO: 2064664 - DNA, 21 bp, Homo sapiens
atacctctctctatatataca

SEQ ID NO: 2064665 - DNA, 12 bp, Homo sapiens
atacctctgtgt

SEQ ID NO: 2064666 - DNA, 14 bp, Homo sapiens
atacctctgtgtgc

SEQ ID NO: 2064667 - DNA, 21 bp, Homo sapiens
atacctgtgtttcttgcctca

SEQ ID NO: 2064668 - DNA, 14 bp, Homo sapiens
ataccttcttcgct

SEQ ID NO: 2064669 - DNA, 15 bp, Homo sapiens
ataccttggactgac

SEQ ID NO: 2064670 - DNA, 16 bp, Homo sapiens
atacctttggaaaaat

SEQ ID NO: 2064671 - DNA, 13 bp, Homo sapiens
atactaaaaatca

SEQ ID NO: 2064672 - DNA, 18 bp, Homo sapiens
atactaaaaatcatgaga

SEQ ID NO: 2064673 - DNA, 21 bp, Homo sapiens
atactaaaagttcttctccaa

SEQ ID NO: 2064674 - DNA, 21 bp, Homo sapiens
atactaagcattgaatggcta

SEQ ID NO: 2064675 - DNA, 12 bp, Homo sapiens
atactatacaac

SEQ ID NO: 2064676 - DNA, 14 bp, Homo sapiens
atactcatttctaa

SEQ ID NO: 2064677 - DNA, 19 bp, Homo sapiens
atactcatttctaaaagaa

SEQ ID NO: 2064678 - DNA, 23 bp, Homo sapiens
atactcatttctaaaagaatatt

SEQ ID NO: 2064679 - DNA, 17 bp, Homo sapiens
atactcatttttcatga

SEQ ID NO: 2064680 - DNA, 20 bp, Homo sapiens
atactccaagcttcaagtga

SEQ ID NO: 2064681 - DNA, 15 bp, Homo sapiens
atactctgtcagatg

SEQ ID NO: 2064682 - DNA, 19 bp, Homo sapiens
atactcttaggaagagaaa

SEQ ID NO: 2064683 - DNA, 21 bp, Homo sapiens
atactgcctagaaaatgcaaa

SEQ ID NO: 2064684 - DNA, 11 bp, Homo sapiens
atactgctctg

SEQ ID NO: 2064685 - DNA, 20 bp, Homo sapiens
atactggaagttttgcattt

SEQ ID NO: 2064686 - DNA, 18 bp, Homo sapiens
atactgggtacaagagcc

SEQ ID NO: 2064687 - DNA, 15 bp, Homo sapiens
atactgtacatagat

SEQ ID NO: 2064688 - DNA, 12 bp, Homo sapiens
atacttaacatt

SEQ ID NO: 2064689 - DNA, 14 bp, Homo sapiens
atacttaagcaaaa

SEQ ID NO: 2064690 - DNA, 14 bp, Homo sapiens
atacttcactcact

SEQ ID NO: 2064691 - DNA, 16 bp, Homo sapiens
atacttctcatttttt

SEQ ID NO: 2064692 - DNA, 13 bp, Homo sapiens
atagaaacatgac

SEQ ID NO: 2064693 - DNA, 16 bp, Homo sapiens
atagaaacatgacact

SEQ ID NO: 2064694 - DNA, 21 bp, Homo sapiens
atagaaactcaccatgtaaaa

SEQ ID NO: 2064695 - DNA, 16 bp, Homo sapiens
atagaaagtgccagaa

SEQ ID NO: 2064696 - DNA, 15 bp, Homo sapiens
atagaaatacctcat

SEQ ID NO: 2064697 - DNA, 13 bp, Homo sapiens
atagaacagaact

SEQ ID NO: 2064698 - DNA, 21 bp, Homo sapiens
atagaatacttttttctagtt

SEQ ID NO: 2064699 - DNA, 22 bp, Homo sapiens
atagaatatttattacctctga

SEQ ID NO: 2064700 - DNA, 13 bp, Homo sapiens
atagaatgacagt

SEQ ID NO: 2064701 - DNA, 16 bp, Homo sapiens
atagacagaagaaaca

SEQ ID NO: 2064702 - DNA, 17 bp, Homo sapiens
atagacagaagaaacaa

SEQ ID NO: 2064703 - DNA, 20 bp, Homo sapiens
atagacagcacttggctcct

SEQ ID NO: 2064704 - DNA, 16 bp, Homo sapiens
atagacatttgtaaat

SEQ ID NO: 2064705 - DNA, 15 bp, Homo sapiens
atagactaaatgaaa

SEQ ID NO: 2064706 - DNA, 14 bp, Homo sapiens
atagagaaaaactt

SEQ ID NO: 2064707 - DNA, 19 bp, Homo sapiens
atagagaaaaactttcatt

SEQ ID NO: 2064708 - DNA, 21 bp, Homo sapiens
atcaaaacctttcaaatatca

SEQ ID NO: 2064709 - DNA, 21 bp, Homo sapiens
atcaaaactttcttttctgga

SEQ ID NO: 2064710 - DNA, 15 bp, Homo sapiens
atcaaaagctgcttg

SEQ ID NO: 2064711 - DNA, 21 bp, Homo sapiens
atcaaaatcactatctttctg

SEQ ID NO: 2064712 - DNA, 22 bp, Homo sapiens
atcaaaatcactatctttctga

SEQ ID NO: 2064713 - DNA, 21 bp, Homo sapiens
atcaaaatccctatttaattt

SEQ ID NO: 2064714 - DNA, 23 bp, Homo sapiens
atcaaacaccaacataaaaatga

SEQ ID NO: 2064715 - DNA, 16 bp, Homo sapiens
atcaaactgaagccag

SEQ ID NO: 2064716 - DNA, 15 bp, Homo sapiens
atcaaacttgtgctg

SEQ ID NO: 2064717 - DNA, 14 bp, Homo sapiens
atcaaagcaagggc

SEQ ID NO: 2064718 - DNA, 23 bp, Homo sapiens
atcaaagtaaaaaattaaagccc

SEQ ID NO: 2064719 - DNA, 16 bp, Homo sapiens
atcaaatatgcaaagc

SEQ ID NO: 2064720 - DNA, 17 bp, Homo sapiens
atcaaatatgcaaagca

SEQ ID NO: 2064721 - DNA, 21 bp, Homo sapiens
atcaaatctgtatatgttgta

SEQ ID NO: 2064722 - DNA, 22 bp, Homo sapiens
atcaaatttcacgtcgtcttct

SEQ ID NO: 2064723 - DNA, 17 bp, Homo sapiens
atcaaatttgccaccac

SEQ ID NO: 2064724 - DNA, 15 bp, Homo sapiens
atcaacaaagaaata

SEQ ID NO: 2064725 - DNA, 19 bp, Homo sapiens
atcaaccccagactcaaac

SEQ ID NO: 2064726 - DNA, 21 bp, Homo sapiens
atcaacttaccaggcaccaaa

SEQ ID NO: 2064727 - DNA, 16 bp, Homo sapiens
atcaacttgtgtactg

SEQ ID NO: 2064728 - DNA, 19 bp, Homo sapiens
atcaagaatattcaaatgt

SEQ ID NO: 2064729 - DNA, 13 bp, Homo sapiens
atcaagagactga

SEQ ID NO: 2064730 - DNA, 15 bp, Homo sapiens
atcaaggatgttctg

SEQ ID NO: 2064731 - DNA, 14 bp, Homo sapiens
atcaagtccagagc

SEQ ID NO: 2064732 - DNA, 15 bp, Homo sapiens
atcaataaaaatctt

SEQ ID NO: 2064733 - DNA, 13 bp, Homo sapiens
atcaatcctgccc

SEQ ID NO: 2064734 - DNA, 16 bp, Homo sapiens
atcaatcctgccccca

SEQ ID NO: 2064735 - DNA, 16 bp, Homo sapiens
atcaatccttgttcag

SEQ ID NO: 2064736 - DNA, 20 bp, Homo sapiens
atcaatggaaacagggcagt

SEQ ID NO: 2064737 - DNA, 15 bp, Homo sapiens
atcaattaaatgtag

SEQ ID NO: 2064738 - DNA, 15 bp, Homo sapiens
atcaattaattctta

SEQ ID NO: 2064739 - DNA, 16 bp, Homo sapiens
atcaattattacattt

SEQ ID NO: 2064740 - DNA, 17 bp, Homo sapiens
atcaattattacattta

SEQ ID NO: 2064741 - DNA, 24 bp, Homo sapiens
atcaattcaacacattacttgcac

SEQ ID NO: 2064742 - DNA, 14 bp, Homo sapiens
atcaatttttatac

SEQ ID NO: 2064743 - DNA, 18 bp, Homo sapiens
atcaatttttatacatat

SEQ ID NO: 2064744 - DNA, 21 bp, Homo sapiens
atcaatttttatacatatcag

SEQ ID NO: 2064745 - DNA, 24 bp, Homo sapiens
atcaatttttatacatatcagaaa

SEQ ID NO: 2064746 - DNA, 14 bp, Homo sapiens
atcaatttttctta

SEQ ID NO: 2064747 - DNA, 19 bp, Homo sapiens
atcaatttttcttatttca

SEQ ID NO: 2064748 - DNA, 16 bp, Homo sapiens
atcacaacaagaaatt

SEQ ID NO: 2064749 - DNA, 14 bp, Homo sapiens
atcacaagcaataa

SEQ ID NO: 2064750 - DNA, 17 bp, Homo sapiens
atcacaagcaataatta

SEQ ID NO: 2064751 - DNA, 21 bp, Homo sapiens
atcacaagcaataattaggat

SEQ ID NO: 2064752 - DNA, 14 bp, Homo sapiens
atcacacagccact

SEQ ID NO: 2064753 - DNA, 16 bp, Homo sapiens
atcacacctctgggct

SEQ ID NO: 2064754 - DNA, 15 bp, Homo sapiens
atcacagaggcttct

SEQ ID NO: 2064755 - DNA, 21 bp, Homo sapiens
atcacagcagaatgaagacct

SEQ ID NO: 2064756 - DNA, 13 bp, Homo sapiens
atcacagctcctc

SEQ ID NO: 2064757 - DNA, 16 bp, Homo sapiens
atcacagggccccaga

SEQ ID NO: 2064758 - DNA, 22 bp, Homo sapiens
atcacagggccccagaaggcag

SEQ ID NO: 2064759 - DNA, 22 bp, Homo sapiens
atcacagtggcgagaggagagg

SEQ ID NO: 2064760 - DNA, 15 bp, Homo sapiens
atcacatattctagt

SEQ ID NO: 2064761 - DNA, 15 bp, Homo sapiens
atcacattatttgca

SEQ ID NO: 2064762 - DNA, 22 bp, Homo sapiens
atcacattatttgcatgttacc

SEQ ID NO: 2064763 - DNA, 21 bp, Homo sapiens
atcaccagcccggcctgctcc

SEQ ID NO: 2064764 - DNA, 13 bp, Homo sapiens
atcacccaggctg

SEQ ID NO: 2064765 - DNA, 14 bp, Homo sapiens
atcacccagtcctg

SEQ ID NO: 2064766 - DNA, 16 bp, Homo sapiens
atcaccctctgggcag

SEQ ID NO: 2064767 - DNA, 12 bp, Homo sapiens
atcacctcaggc

SEQ ID NO: 2064768 - DNA, 15 bp, Homo sapiens
atcacctctcttcag

SEQ ID NO: 2064769 - DNA, 20 bp, Homo sapiens
atcacctctggctttgtctc

SEQ ID NO: 2064770 - DNA, 13 bp, Homo sapiens
atcacgccactgc

SEQ ID NO: 2064771 - DNA, 14 bp, Homo sapiens
atcacgccactgca

SEQ ID NO: 2064772 - DNA, 15 bp, Homo sapiens
atcacggctcactgc

SEQ ID NO: 2064773 - DNA, 20 bp, Homo sapiens
atcactgattgggtgccatg

SEQ ID NO: 2064774 - DNA, 23 bp, Homo sapiens
atcactgattgggtgccatgtgg

SEQ ID NO: 2064775 - DNA, 19 bp, Homo sapiens
atcacttgaggtcaggagt

SEQ ID NO: 2064776 - DNA, 13 bp, Homo sapiens
atcacttgtaaat

SEQ ID NO: 2064777 - DNA, 17 bp, Homo sapiens
atcacttgtaaataaat

SEQ ID NO: 2064778 - DNA, 16 bp, Homo sapiens
atcacttgtacaaaat

SEQ ID NO: 2064779 - DNA, 21 bp, Homo sapiens
atcacttgtacaaaataaaca

SEQ ID NO: 2064780 - DNA, 11 bp, Homo sapiens
atcagaaaagt

SEQ ID NO: 2064781 - DNA, 12 bp, Homo sapiens
atcagaaaagta

SEQ ID NO: 2064782 - DNA, 15 bp, Homo sapiens
atcagaaaagtagaa

SEQ ID NO: 2064783 - DNA, 18 bp, Homo sapiens
atcagaaaagtagaatta

SEQ ID NO: 2064784 - DNA, 20 bp, Homo sapiens
atcagaaaagtagaattata

SEQ ID NO: 2064785 - DNA, 21 bp, Homo sapiens
atcagaaaagtagaattatat

SEQ ID NO: 2064786 - DNA, 22 bp, Homo sapiens
atcagaaagggagggctctgag

SEQ ID NO: 2064787 - DNA, 20 bp, Homo sapiens
atcagaaatgtcatcaaata

SEQ ID NO: 2064788 - DNA, 14 bp, Homo sapiens
atcagaagataact

SEQ ID NO: 2064789 - DNA, 15 bp, Homo sapiens
atcagaaggctgggg

SEQ ID NO: 2064790 - DNA, 18 bp, Homo sapiens
atcagaagtttctcagct

SEQ ID NO: 2064791 - DNA, 18 bp, Homo sapiens
atcagaatcgctaataga

SEQ ID NO: 2064792 - DNA, 13 bp, Homo sapiens
atcagaatggaaa

SEQ ID NO: 2064793 - DNA, 16 bp, Homo sapiens
atcagaattttaccaa

SEQ ID NO: 2064794 - DNA, 15 bp, Homo sapiens
atcagaccctacccc

SEQ ID NO: 2064795 - DNA, 12 bp, Homo sapiens
atcagacctctg

SEQ ID NO: 2064796 - DNA, 22 bp, Homo sapiens
atcagactagtgacaagctcct

SEQ ID NO: 2064797 - DNA, 15 bp, Homo sapiens
atcagatagcatctt

SEQ ID NO: 2064798 - DNA, 14 bp, Homo sapiens
atcagccatgtttg

SEQ ID NO: 2064799 - DNA, 22 bp, Homo sapiens
atcagccccgctcctcccctct

SEQ ID NO: 2064800 - DNA, 11 bp, Homo sapiens
atcagcctctt

SEQ ID NO: 2064801 - DNA, 15 bp, Homo sapiens
atcagcctcttaaag

SEQ ID NO: 2064802 - DNA, 18 bp, Homo sapiens
atcagcctgagtctcctg

SEQ ID NO: 2064803 - DNA, 20 bp, Homo sapiens
atcagctacttaagagaaat

SEQ ID NO: 2064804 - DNA, 21 bp, Homo sapiens
atcagctacttaagagaaatg

SEQ ID NO: 2064805 - DNA, 22 bp, Homo sapiens
atcagctacttaagagaaatgg

SEQ ID NO: 2064806 - DNA, 18 bp, Homo sapiens
atcagctccactttcagt

SEQ ID NO: 2064807 - DNA, 23 bp, Homo sapiens
atcagctcccttcccctgcctgg

SEQ ID NO: 2064808 - DNA, 22 bp, Homo sapiens
atcagctgctgaaacaacaaat

SEQ ID NO: 2064809 - DNA, 23 bp, Homo sapiens
atcagctgctgaaacaacaaata

SEQ ID NO: 2064810 - DNA, 22 bp, Homo sapiens
atcagcttgccctgttaaaaga

SEQ ID NO: 2064811 - DNA, 14 bp, Homo sapiens
atcaggaagagaag

SEQ ID NO: 2064812 - DNA, 19 bp, Homo sapiens
atcaggaagagaaggagca

SEQ ID NO: 2064813 - DNA, 16 bp, Homo sapiens
atcaggcacaggcagg

SEQ ID NO: 2064814 - DNA, 18 bp, Homo sapiens
atcaggcttggaatgaat

SEQ ID NO: 2064815 - DNA, 22 bp, Homo sapiens
atcagggcaggcttgccaccgg

SEQ ID NO: 2064816 - DNA, 15 bp, Homo sapiens
atcaggtgctgccat

SEQ ID NO: 2064817 - DNA, 15 bp, Homo sapiens
atcaggttgttaatg

SEQ ID NO: 2064818 - DNA, 21 bp, Homo sapiens
atcagtatgctgttttaataa

SEQ ID NO: 2064819 - DNA, 15 bp, Homo sapiens
atcagtgcagtgata

SEQ ID NO: 2064820 - DNA, 16 bp, Homo sapiens
atcagttactcagccc

SEQ ID NO: 2064821 - DNA, 15 bp, Homo sapiens
atcagttactggttt

SEQ ID NO: 2064822 - DNA, 22 bp, Homo sapiens
atcagttactggtttcagttga

SEQ ID NO: 2064823 - DNA, 19 bp, Homo sapiens
atcagttatattctttaaa

SEQ ID NO: 2064824 - DNA, 16 bp, Homo sapiens
atatgcaaagcactga

SEQ ID NO: 2064825 - DNA, 15 bp, Homo sapiens
atatgcaccttgtgt

SEQ ID NO: 2064826 - DNA, 19 bp, Homo sapiens
atatgcaccttgtgtctgt

SEQ ID NO: 2064827 - DNA, 21 bp, Homo sapiens
atatgcataatcagcgccctg

SEQ ID NO: 2064828 - DNA, 15 bp, Homo sapiens
atatgcatatatttt

SEQ ID NO: 2064829 - DNA, 15 bp, Homo sapiens
atatgcatttaattc

SEQ ID NO: 2064830 - DNA, 17 bp, Homo sapiens
atatgccaccgattgca

SEQ ID NO: 2064831 - DNA, 20 bp, Homo sapiens
atatgcctacttgtaatttc

SEQ ID NO: 2064832 - DNA, 22 bp, Homo sapiens
atatgctgccaaattttggcca

SEQ ID NO: 2064833 - DNA, 19 bp, Homo sapiens
atatggaaatcctgttact

SEQ ID NO: 2064834 - DNA, 20 bp, Homo sapiens
atatggaaccttccctccaa

SEQ ID NO: 2064835 - DNA, 13 bp, Homo sapiens
atatggcaagaaa

SEQ ID NO: 2064836 - DNA, 15 bp, Homo sapiens
atatggcaagaaagc

SEQ ID NO: 2064837 - DNA, 17 bp, Homo sapiens
atatggcatatttatat

SEQ ID NO: 2064838 - DNA, 16 bp, Homo sapiens
atatggggatgcagca

SEQ ID NO: 2064839 - DNA, 14 bp, Homo sapiens
atatgggtgctggc

SEQ ID NO: 2064840 - DNA, 16 bp, Homo sapiens
atatgggtgctggcag

SEQ ID NO: 2064841 - DNA, 16 bp, Homo sapiens
atatgtaaaacattta

SEQ ID NO: 2064842 - DNA, 14 bp, Homo sapiens
atatgtaaaataaa

SEQ ID NO: 2064843 - DNA, 15 bp, Homo sapiens
atatgtaaaataaaa

SEQ ID NO: 2064844 - DNA, 16 bp, Homo sapiens
atatgtaacaagccac

SEQ ID NO: 2064845 - DNA, 13 bp, Homo sapiens
atatgtagactat

SEQ ID NO: 2064846 - DNA, 13 bp, Homo sapiens
atatgtagccctc

SEQ ID NO: 2064847 - DNA, 17 bp, Homo sapiens
atatgtagccctcatga

SEQ ID NO: 2064848 - DNA, 19 bp, Homo sapiens
atatgtagtataaagaaaa

SEQ ID NO: 2064849 - DNA, 14 bp, Homo sapiens
atatgtatatatat

SEQ ID NO: 2064850 - DNA, 16 bp, Homo sapiens
atatgtattaatattc

SEQ ID NO: 2064851 - DNA, 21 bp, Homo sapiens
atatgtattgtaaacatgtgt

SEQ ID NO: 2064852 - DNA, 15 bp, Homo sapiens
atatgtatttattgt

SEQ ID NO: 2064853 - DNA, 21 bp, Homo sapiens
atatgtctcgctagtgatgtt

SEQ ID NO: 2064854 - DNA, 13 bp, Homo sapiens
atatgtctgtatc

SEQ ID NO: 2064855 - DNA, 14 bp, Homo sapiens
atatgtctgtatct

SEQ ID NO: 2064856 - DNA, 16 bp, Homo sapiens
atatgtgtatatatac

SEQ ID NO: 2064857 - DNA, 19 bp, Homo sapiens
atatgtgtatatatacata

SEQ ID NO: 2064858 - DNA, 21 bp, Homo sapiens
atatgtgtatatatacataca

SEQ ID NO: 2064859 - DNA, 22 bp, Homo sapiens
atatgtgtatatatacatacac

SEQ ID NO: 2064860 - DNA, 14 bp, Homo sapiens
atatgtgtgtgtgt

SEQ ID NO: 2064861 - DNA, 12 bp, Homo sapiens
atatgttcaact

SEQ ID NO: 2064862 - DNA, 15 bp, Homo sapiens
atatgttcaactgga

SEQ ID NO: 2064863 - DNA, 12 bp, Homo sapiens
atatgttcacat

SEQ ID NO: 2064864 - DNA, 16 bp, Homo sapiens
atatgttcacatcttg

SEQ ID NO: 2064865 - DNA, 17 bp, Homo sapiens
atatgttgagtgttcat

SEQ ID NO: 2064866 - DNA, 23 bp, Homo sapiens
atattaaaaatatggaacttcta

SEQ ID NO: 2064867 - DNA, 14 bp, Homo sapiens
atattaaacttctg

SEQ ID NO: 2064868 - DNA, 17 bp, Homo sapiens
atattaaacttctgatt

SEQ ID NO: 2064869 - DNA, 13 bp, Homo sapiens
atattaaagtgtt

SEQ ID NO: 2064870 - DNA, 22 bp, Homo sapiens
atattaatttttgaaacccatt

SEQ ID NO: 2064871 - DNA, 12 bp, Homo sapiens
atattaccaaaa

SEQ ID NO: 2064872 - DNA, 19 bp, Homo sapiens
atattaccaaaaaagtatt

SEQ ID NO: 2064873 - DNA, 16 bp, Homo sapiens
atattagcaaagaagc

SEQ ID NO: 2064874 - DNA, 22 bp, Homo sapiens
atattagcatttagtccaatgt

SEQ ID NO: 2064875 - DNA, 18 bp, Homo sapiens
atattaggggatggagag

SEQ ID NO: 2064876 - DNA, 14 bp, Homo sapiens
atattataaataaa

SEQ ID NO: 2064877 - DNA, 16 bp, Homo sapiens
atattatggaagattt

SEQ ID NO: 2064878 - DNA, 15 bp, Homo sapiens
atattatggtgtaat

SEQ ID NO: 2064879 - DNA, 22 bp, Homo sapiens
atattatgtagtccgttaacac

SEQ ID NO: 2064880 - DNA, 13 bp, Homo sapiens
atattatttaaat

SEQ ID NO: 2064881 - DNA, 15 bp, Homo sapiens
atattcaataaagct

SEQ ID NO: 2064882 - DNA, 14 bp, Homo sapiens
atattcagagatgt

SEQ ID NO: 2064883 - DNA, 19 bp, Homo sapiens
atattcagagatgtaccat

SEQ ID NO: 2064884 - DNA, 15 bp, Homo sapiens
atattcatgtaataa

SEQ ID NO: 2064885 - DNA, 21 bp, Homo sapiens
atattcatgtaataaatctga

SEQ ID NO: 2064886 - DNA, 18 bp, Homo sapiens
atattccatatattagca

SEQ ID NO: 2064887 - DNA, 17 bp, Homo sapiens
atattcctattgtgcaa

SEQ ID NO: 2064888 - DNA, 15 bp, Homo sapiens
atattcctgaatgaa

SEQ ID NO: 2064889 - DNA, 22 bp, Homo sapiens
atattcctgaatgaaatatcag

SEQ ID NO: 2064890 - DNA, 21 bp, Homo sapiens
atattcctgcatttgtgaaat

SEQ ID NO: 2064891 - DNA, 21 bp, Homo sapiens
atattctagtgtaacactgca

SEQ ID NO: 2064892 - DNA, 20 bp, Homo sapiens
atattctggaaaaaaaatat

SEQ ID NO: 2064893 - DNA, 14 bp, Homo sapiens
atattgaatatatc

SEQ ID NO: 2064894 - DNA, 21 bp, Homo sapiens
atattgctgctggtaatttgt

SEQ ID NO: 2064895 - DNA, 17 bp, Homo sapiens
atattggcatggatttc

SEQ ID NO: 2064896 - DNA, 12 bp, Homo sapiens
atattgtaaata

SEQ ID NO: 2064897 - DNA, 16 bp, Homo sapiens
atattgtatattctgg

SEQ ID NO: 2064898 - DNA, 16 bp, Homo sapiens
atattgtattatgcta

SEQ ID NO: 2064899 - DNA, 16 bp, Homo sapiens
atattgtcagatattt

SEQ ID NO: 2064900 - DNA, 18 bp, Homo sapiens
atattgtgccaatatgta

SEQ ID NO: 2064901 - DNA, 19 bp, Homo sapiens
atattgtgcttaaattatt

SEQ ID NO: 2064902 - DNA, 19 bp, Homo sapiens
atattgtgggtgttaattt

SEQ ID NO: 2064903 - DNA, 14 bp, Homo sapiens
atatttaagtatat

SEQ ID NO: 2064904 - DNA, 15 bp, Homo sapiens
atatttaagtttgtt

SEQ ID NO: 2064905 - DNA, 20 bp, Homo sapiens
atatttaatttttacatgac

SEQ ID NO: 2064906 - DNA, 21 bp, Homo sapiens
atatttacatgaattgcattt

SEQ ID NO: 2064907 - DNA, 14 bp, Homo sapiens
atatttacgtatga

SEQ ID NO: 2064908 - DNA, 15 bp, Homo sapiens
atatttagaccctgt

SEQ ID NO: 2064909 - DNA, 11 bp, Homo sapiens
atatttataac

SEQ ID NO: 2064910 - DNA, 15 bp, Homo sapiens
atatttataactcat

SEQ ID NO: 2064911 - DNA, 23 bp, Homo sapiens
atatttataactcatcataaaat

SEQ ID NO: 2064912 - DNA, 20 bp, Homo sapiens
atatttatactctagaacat

SEQ ID NO: 2064913 - DNA, 15 bp, Homo sapiens
atatttatatatatt

SEQ ID NO: 2064914 - DNA, 20 bp, Homo sapiens
atatttatattgtatattct

SEQ ID NO: 2064915 - DNA, 19 bp, Homo sapiens
atatttatgcttaaaatat

SEQ ID NO: 2064916 - DNA, 21 bp, Homo sapiens
atatttatgtctatttaagcc

SEQ ID NO: 2064917 - DNA, 16 bp, Homo sapiens
atatttccatttcttc

SEQ ID NO: 2064918 - DNA, 20 bp, Homo sapiens
atatttccctggaatttaat

SEQ ID NO: 2064919 - DNA, 17 bp, Homo sapiens
atatttctcgtatttaa

SEQ ID NO: 2064920 - DNA, 18 bp, Homo sapiens
atatttctcgtatttaat

SEQ ID NO: 2064921 - DNA, 17 bp, Homo sapiens
atatttgaatatcatta

SEQ ID NO: 2064922 - DNA, 21 bp, Homo sapiens
atatttgattgtaaaaacaaa

SEQ ID NO: 2064923 - DNA, 15 bp, Homo sapiens
atatttgcttattta

SEQ ID NO: 2064924 - DNA, 18 bp, Homo sapiens
atatttgcttatttatat

SEQ ID NO: 2064925 - DNA, 14 bp, Homo sapiens
atatttggaaagag

SEQ ID NO: 2064926 - DNA, 16 bp, Homo sapiens
atatttggaaagagac

SEQ ID NO: 2064927 - DNA, 13 bp, Homo sapiens
atatttgttaaat

SEQ ID NO: 2064928 - DNA, 22 bp, Homo sapiens
atatttgttaaatatttacata

SEQ ID NO: 2064929 - DNA, 12 bp, Homo sapiens
atattttaactt

SEQ ID NO: 2064930 - DNA, 11 bp, Homo sapiens
atattttaatt

SEQ ID NO: 2064931 - DNA, 17 bp, Homo sapiens
atattttatcttgttct

SEQ ID NO: 2064932 - DNA, 20 bp, Homo sapiens
atattttccctctcttgcct

SEQ ID NO: 2064933 - DNA, 22 bp, Homo sapiens
atattttcctcccagttctaca

SEQ ID NO: 2064934 - DNA, 19 bp, Homo sapiens
atattttcttccaagcaaa

SEQ ID NO: 2064935 - DNA, 15 bp, Homo sapiens
atatttttaattaaa

SEQ ID NO: 2064936 - DNA, 15 bp, Homo sapiens
atatttttcaaccag

SEQ ID NO: 2064937 - DNA, 22 bp, Homo sapiens
atatttttcaaccagcatttta

SEQ ID NO: 2064938 - DNA, 19 bp, Homo sapiens
atcaaaaattgaagagaga

SEQ ID NO: 2064939 - DNA, 12 bp, Homo sapiens
atcaaaacatat

SEQ ID NO: 2064940 - DNA, 19 bp, Homo sapiens
atcaaaacatatcaattca

SEQ ID NO: 2064941 - DNA, 21 bp, Homo sapiens
atcagttatattctttaaatt

SEQ ID NO: 2064942 - DNA, 12 bp, Homo sapiens
atcataaaataa

SEQ ID NO: 2064943 - DNA, 11 bp, Homo sapiens
atcataaagta

SEQ ID NO: 2064944 - DNA, 14 bp, Homo sapiens
atcatagaaaaact

SEQ ID NO: 2064945 - DNA, 22 bp, Homo sapiens
atcatatcctttgccccaaggc

SEQ ID NO: 2064946 - DNA, 17 bp, Homo sapiens
atcatatgaatgttctt

SEQ ID NO: 2064947 - DNA, 19 bp, Homo sapiens
atcatatgacatgccaccc

SEQ ID NO: 2064948 - DNA, 13 bp, Homo sapiens
atcatattgtatg

SEQ ID NO: 2064949 - DNA, 18 bp, Homo sapiens
atcatgacatgttatata

SEQ ID NO: 2064950 - DNA, 23 bp, Homo sapiens
atcatgatctgactttaattgtg

SEQ ID NO: 2064951 - DNA, 14 bp, Homo sapiens
atcatgcattcaca

SEQ ID NO: 2064952 - DNA, 15 bp, Homo sapiens
atcatgcattcacaa

SEQ ID NO: 2064953 - DNA, 14 bp, Homo sapiens
atcatgcctctgag

SEQ ID NO: 2064954 - DNA, 16 bp, Homo sapiens
atcatgcctctgaggc

SEQ ID NO: 2064955 - DNA, 20 bp, Homo sapiens
atcatgcctctgaggccagc

SEQ ID NO: 2064956 - DNA, 23 bp, Homo sapiens
atcatgcctctgaggccagcctg

SEQ ID NO: 2064957 - DNA, 17 bp, Homo sapiens
atcatgctttaaagtgt

SEQ ID NO: 2064958 - DNA, 22 bp, Homo sapiens
atcatgctttaaagtgtaataa

SEQ ID NO: 2064959 - DNA, 22 bp, Homo sapiens
atcatgggaaaagaccagggct

SEQ ID NO: 2064960 - DNA, 18 bp, Homo sapiens
atcatgtaaatgattatc

SEQ ID NO: 2064961 - DNA, 14 bp, Homo sapiens
atcatgtacatttc

SEQ ID NO: 2064962 - DNA, 19 bp, Homo sapiens
atcatgtcaggcctgtgtg

SEQ ID NO: 2064963 - DNA, 19 bp, Homo sapiens
atcatgttaatagacagta

SEQ ID NO: 2064964 - DNA, 20 bp, Homo sapiens
atcattataactgaaggaga

SEQ ID NO: 2064965 - DNA, 22 bp, Homo sapiens
atcattataactgaaggagaag

SEQ ID NO: 2064966 - DNA, 15 bp, Homo sapiens
atcattcaaaacaac

SEQ ID NO: 2064967 - DNA, 17 bp, Homo sapiens
atcattctttcccctca

SEQ ID NO: 2064968 - DNA, 14 bp, Homo sapiens
atcatttaagaagg

SEQ ID NO: 2064969 - DNA, 17 bp, Homo sapiens
atcatttctaattttaa

SEQ ID NO: 2064970 - DNA, 13 bp, Homo sapiens
atcatttgctttt

SEQ ID NO: 2064971 - DNA, 18 bp, Homo sapiens
atcatttgttggaatgaa

SEQ ID NO: 2064972 - DNA, 22 bp, Homo sapiens
atcattttaagaagacatgaca

SEQ ID NO: 2064973 - DNA, 15 bp, Homo sapiens
atcattttaattatt

SEQ ID NO: 2064974 - DNA, 13 bp, Homo sapiens
atccaaaggaatc

SEQ ID NO: 2064975 - DNA, 20 bp, Homo sapiens
atccaaccccccacctgcca

SEQ ID NO: 2064976 - DNA, 23 bp, Homo sapiens
atccaagcttttttaaagtaaaa

SEQ ID NO: 2064977 - DNA, 20 bp, Homo sapiens
atccaaggaacctaattgaa

SEQ ID NO: 2064978 - DNA, 22 bp, Homo sapiens
atccaaggaacctaattgaaat

SEQ ID NO: 2064979 - DNA, 19 bp, Homo sapiens
atccaaggagaaacagaga

SEQ ID NO: 2064980 - DNA, 14 bp, Homo sapiens
atccaatcctcagg

SEQ ID NO: 2064981 - DNA, 23 bp, Homo sapiens
atccaatctgctcagcaggccct

SEQ ID NO: 2064982 - DNA, 14 bp, Homo sapiens
atccaattatgtga

SEQ ID NO: 2064983 - DNA, 23 bp, Homo sapiens
atccaattatgtgacaacctttg

SEQ ID NO: 2064984 - DNA, 13 bp, Homo sapiens
atccacagactcc

SEQ ID NO: 2064985 - DNA, 21 bp, Homo sapiens
atccacagactccctcccctg

SEQ ID NO: 2064986 - DNA, 13 bp, Homo sapiens
atccacccagccc

SEQ ID NO: 2064987 - DNA, 15 bp, Homo sapiens
atccaccctatccct

SEQ ID NO: 2064988 - DNA, 20 bp, Homo sapiens
atccaccctcaaatgtcaga

SEQ ID NO: 2064989 - DNA, 23 bp, Homo sapiens
atccagaactgaggtcactgggt

SEQ ID NO: 2064990 - DNA, 20 bp, Homo sapiens
atccagagggttgtgatttt

SEQ ID NO: 2064991 - DNA, 22 bp, Homo sapiens
atccagagtttagaggaaaaaa

SEQ ID NO: 2064992 - DNA, 15 bp, Homo sapiens
atccaggtgggagag

SEQ ID NO: 2064993 - DNA, 18 bp, Homo sapiens
atccaggtgggagagaca

SEQ ID NO: 2064994 - DNA, 15 bp, Homo sapiens
atccaggttcagctt

SEQ ID NO: 2064995 - DNA, 17 bp, Homo sapiens
atccagtaagcacatgt

SEQ ID NO: 2064996 - DNA, 18 bp, Homo sapiens
atccagtgatgtgctgga

SEQ ID NO: 2064997 - DNA, 23 bp, Homo sapiens
atccagtgtgcacccctccccat

SEQ ID NO: 2064998 - DNA, 18 bp, Homo sapiens
atccagttgcaataaaat

SEQ ID NO: 2064999 - DNA, 19 bp, Homo sapiens
atccagttgcaataaaata

SEQ ID NO: 2065000 - DNA, 20 bp, Homo sapiens
atccagttgcaataaaatag

SEQ ID NO: 2065001 - DNA, 22 bp, Homo sapiens
atccagttgcaataaaatagta

SEQ ID NO: 2065002 - DNA, 20 bp, Homo sapiens
atccagtttgttctccgggt

SEQ ID NO: 2065003 - DNA, 18 bp, Homo sapiens
atccatgtcctatgtgtg

SEQ ID NO: 2065004 - DNA, 16 bp, Homo sapiens
atccatgtttgtaaaa

SEQ ID NO: 2065005 - DNA, 18 bp, Homo sapiens
atccattcctcagggaca

SEQ ID NO: 2065006 - DNA, 22 bp, Homo sapiens
atccattcctcagggacagaga

SEQ ID NO: 2065007 - DNA, 21 bp, Homo sapiens
atccatttcatctatttctga

SEQ ID NO: 2065008 - DNA, 18 bp, Homo sapiens
atccatttggacaaaatg

SEQ ID NO: 2065009 - DNA, 18 bp, Homo sapiens
atcccaagcgtcccgtcc

SEQ ID NO: 2065010 - DNA, 15 bp, Homo sapiens
atcccaagtgccagt

SEQ ID NO: 2065011 - DNA, 16 bp, Homo sapiens
atcccaattcatttca

SEQ ID NO: 2065012 - DNA, 15 bp, Homo sapiens
atcccaccaaccctc

SEQ ID NO: 2065013 - DNA, 20 bp, Homo sapiens
atcccacccaacagctcaga

SEQ ID NO: 2065014 - DNA, 14 bp, Homo sapiens
atcccacccacatg

SEQ ID NO: 2065015 - DNA, 23 bp, Homo sapiens
atcccagctactcaagaggctga

SEQ ID NO: 2065016 - DNA, 20 bp, Homo sapiens
atcccagctactcgggaggc

SEQ ID NO: 2065017 - DNA, 19 bp, Homo sapiens
atcccaggcttcaccctga

SEQ ID NO: 2065018 - DNA, 12 bp, Homo sapiens
atcccaggggac

SEQ ID NO: 2065019 - DNA, 19 bp, Homo sapiens
atcccaggggaccacacct

SEQ ID NO: 2065020 - DNA, 20 bp, Homo sapiens
atcccaggggaccacacctc

SEQ ID NO: 2065021 - DNA, 19 bp, Homo sapiens
atcccatccatcagctccc

SEQ ID NO: 2065022 - DNA, 11 bp, Homo sapiens
atcccatctct

SEQ ID NO: 2065023 - DNA, 19 bp, Homo sapiens
atcccatgagcctcagcat

SEQ ID NO: 2065024 - DNA, 19 bp, Homo sapiens
atcccatgtcacctcagct

SEQ ID NO: 2065025 - DNA, 16 bp, Homo sapiens
atccccaagctggcag

SEQ ID NO: 2065026 - DNA, 13 bp, Homo sapiens
atccccaggtctc

SEQ ID NO: 2065027 - DNA, 17 bp, Homo sapiens
atccccaggtctctcca

SEQ ID NO: 2065028 - DNA, 21 bp, Homo sapiens
atccccggctgcttccttctg

SEQ ID NO: 2065029 - DNA, 21 bp, Homo sapiens
atcccctcgtcctgtcccaga

SEQ ID NO: 2065030 - DNA, 16 bp, Homo sapiens
atcccctttcctcccc

SEQ ID NO: 2065031 - DNA, 14 bp, Homo sapiens
atcccgaaaatctc

SEQ ID NO: 2065032 - DNA, 22 bp, Homo sapiens
atcccgcctcttcttcttcaga

SEQ ID NO: 2065033 - DNA, 18 bp, Homo sapiens
atcccggcctcttccacc

SEQ ID NO: 2065034 - DNA, 18 bp, Homo sapiens
atccctaatgtgtgccat

SEQ ID NO: 2065035 - DNA, 12 bp, Homo sapiens
atccctccatcc

SEQ ID NO: 2065036 - DNA, 18 bp, Homo sapiens
atccctcggaagccgtct

SEQ ID NO: 2065037 - DNA, 19 bp, Homo sapiens
atccctgatcctaactgaa

SEQ ID NO: 2065038 - DNA, 16 bp, Homo sapiens
atccctggaggggctg

SEQ ID NO: 2065039 - DNA, 11 bp, Homo sapiens
atccctgggcc

SEQ ID NO: 2065040 - DNA, 16 bp, Homo sapiens
atccctgggcccctcc

SEQ ID NO: 2065041 - DNA, 17 bp, Homo sapiens
atccctgggcctgctgc

SEQ ID NO: 2065042 - DNA, 22 bp, Homo sapiens
atccctgggcctgctgctgaga

SEQ ID NO: 2065043 - DNA, 17 bp, Homo sapiens
atccctgtttaatattt

SEQ ID NO: 2065044 - DNA, 21 bp, Homo sapiens
atccctgtttaatatttaaac

SEQ ID NO: 2065045 - DNA, 20 bp, Homo sapiens
atcccttaatatcctaaaca

SEQ ID NO: 2065046 - DNA, 21 bp, Homo sapiens
atcccttaatatcctaaacat

SEQ ID NO: 2065047 - DNA, 22 bp, Homo sapiens
atccctttcccatgatccagaa

SEQ ID NO: 2065048 - DNA, 12 bp, Homo sapiens
atccgctgccac

SEQ ID NO: 2065049 - DNA, 14 bp, Homo sapiens
atccgctgccacca

SEQ ID NO: 2065050 - DNA, 16 bp, Homo sapiens
atccgggacgcttcca

SEQ ID NO: 2065051 - DNA, 19 bp, Homo sapiens
atccgggacgcttccagac

SEQ ID NO: 2065052 - DNA, 20 bp, Homo sapiens
atccgggacgcttccagacc

SEQ ID NO: 2065053 - DNA, 21 bp, Homo sapiens
atccgggacgcttccagacca

SEQ ID NO: 2065054 - DNA, 22 bp, Homo sapiens
atccgggacgcttccagaccac

SEQ ID NO: 2065055 - DNA, 14 bp, Homo sapiens
atcctaaacatcat

SEQ ID NO: 2065056 - DNA, 14 bp, Homo sapiens
atcctaactgagaa

SEQ ID NO: 2065057 - DNA, 23 bp, Homo sapiens
atctatgcaatttttaaactagt

SEQ ID NO: 2065058 - DNA, 18 bp, Homo sapiens
atctatgcattttctgga

SEQ ID NO: 2065059 - DNA, 13 bp, Homo sapiens
atctatggagggc

SEQ ID NO: 2065060 - DNA, 21 bp, Homo sapiens
atctatggcagtccagccagc

SEQ ID NO: 2065061 - DNA, 17 bp, Homo sapiens
atctattcagacaagca

SEQ ID NO: 2065062 - DNA, 21 bp, Homo sapiens
atctattcagacaagcaacag

SEQ ID NO: 2065063 - DNA, 12 bp, Homo sapiens
atctatttacat

SEQ ID NO: 2065064 - DNA, 14 bp, Homo sapiens
atctatttctgaga

SEQ ID NO: 2065065 - DNA, 22 bp, Homo sapiens
atctcagagacaggtggcctag

SEQ ID NO: 2065066 - DNA, 21 bp, Homo sapiens
atctcaggagcttgcaagaag

SEQ ID NO: 2065067 - DNA, 24 bp, Homo sapiens
atctcaggtgccactccctgagct

SEQ ID NO: 2065068 - DNA, 15 bp, Homo sapiens
atctcagtgaagaat

SEQ ID NO: 2065069 - DNA, 20 bp, Homo sapiens
atctcagtgaagaatacttc

SEQ ID NO: 2065070 - DNA, 16 bp, Homo sapiens
atctcatcaacaaaga

SEQ ID NO: 2065071 - DNA, 19 bp, Homo sapiens
atctcatctcagtgaagaa

SEQ ID NO: 2065072 - DNA, 20 bp, Homo sapiens
atctcatctcagtgaagaat

SEQ ID NO: 2065073 - DNA, 21 bp, Homo sapiens
atctcatggaaactggccagg

SEQ ID NO: 2065074 - DNA, 19 bp, Homo sapiens
atctcatttaagggaaaaa

SEQ ID NO: 2065075 - DNA, 23 bp, Homo sapiens
atctcatttaagggaaaaatata

SEQ ID NO: 2065076 - DNA, 17 bp, Homo sapiens
atctccagcatcctgct

SEQ ID NO: 2065077 - DNA, 18 bp, Homo sapiens
atctccagggctgcccct

SEQ ID NO: 2065078 - DNA, 20 bp, Homo sapiens
atctccagggctgcccctgt

SEQ ID NO: 2065079 - DNA, 23 bp, Homo sapiens
atctccatgtagaataaatgaag

SEQ ID NO: 2065080 - DNA, 15 bp, Homo sapiens
atctccatttcacac

SEQ ID NO: 2065081 - DNA, 13 bp, Homo sapiens
atctccccactct

SEQ ID NO: 2065082 - DNA, 19 bp, Homo sapiens
atctccccaggcctccagc

SEQ ID NO: 2065083 - DNA, 23 bp, Homo sapiens
atctccccttgcactaaagtatg

SEQ ID NO: 2065084 - DNA, 21 bp, Homo sapiens
atctcctatttttcagaatgc

SEQ ID NO: 2065085 - DNA, 20 bp, Homo sapiens
atctcctcccatggccttcc

SEQ ID NO: 2065086 - DNA, 14 bp, Homo sapiens
atctcctgatttct

SEQ ID NO: 2065087 - DNA, 15 bp, Homo sapiens
atctcgagccccctg

SEQ ID NO: 2065088 - DNA, 23 bp, Homo sapiens
atctcgtttttcttcttaagact

SEQ ID NO: 2065089 - DNA, 15 bp, Homo sapiens
atctctaatatggca

SEQ ID NO: 2065090 - DNA, 14 bp, Homo sapiens
atctctaccccaaa

SEQ ID NO: 2065091 - DNA, 22 bp, Homo sapiens
atctctatgtggatctaaataa

SEQ ID NO: 2065092 - DNA, 14 bp, Homo sapiens
atctctatttaata

SEQ ID NO: 2065093 - DNA, 16 bp, Homo sapiens
atctctatttaatatt

SEQ ID NO: 2065094 - DNA, 18 bp, Homo sapiens
atctctatttaatattta

SEQ ID NO: 2065095 - DNA, 23 bp, Homo sapiens
atctctcaggagcacaggcagct

SEQ ID NO: 2065096 - DNA, 19 bp, Homo sapiens
atctctcggttccacgtcc

SEQ ID NO: 2065097 - DNA, 19 bp, Homo sapiens
atctctctgcctatttatt

SEQ ID NO: 2065098 - DNA, 16 bp, Homo sapiens
atctctctggggccct

SEQ ID NO: 2065099 - DNA, 20 bp, Homo sapiens
atctctctggggccctgggc

SEQ ID NO: 2065100 - DNA, 22 bp, Homo sapiens
atctctctggggccctgggcct

SEQ ID NO: 2065101 - DNA, 23 bp, Homo sapiens
atctctctggggccctgggcctc

SEQ ID NO: 2065102 - DNA, 11 bp, Homo sapiens
atctctcttcc

SEQ ID NO: 2065103 - DNA, 17 bp, Homo sapiens
atctctctttaatataa

SEQ ID NO: 2065104 - DNA, 19 bp, Homo sapiens
atctctgaagcatgtttca

SEQ ID NO: 2065105 - DNA, 19 bp, Homo sapiens
atctctgtgtacccactcc

SEQ ID NO: 2065106 - DNA, 22 bp, Homo sapiens
atctctgtgtacccactcctca

SEQ ID NO: 2065107 - DNA, 23 bp, Homo sapiens
atctctgtgtacccactcctcac

SEQ ID NO: 2065108 - DNA, 15 bp, Homo sapiens
atctctgtgtgcaca

SEQ ID NO: 2065109 - DNA, 19 bp, Homo sapiens
atctcttcctgattcccca

SEQ ID NO: 2065110 - DNA, 14 bp, Homo sapiens
atctgaaagtatat

SEQ ID NO: 2065111 - DNA, 18 bp, Homo sapiens
atctgaacacagtttagt

SEQ ID NO: 2065112 - DNA, 13 bp, Homo sapiens
atctgaagctatt

SEQ ID NO: 2065113 - DNA, 13 bp, Homo sapiens
atctgaaggagat

SEQ ID NO: 2065114 - DNA, 17 bp, Homo sapiens
atctgaatataggaagc

SEQ ID NO: 2065115 - DNA, 12 bp, Homo sapiens
atctgaattttt

SEQ ID NO: 2065116 - DNA, 21 bp, Homo sapiens
atctgagatctccctccaggg

SEQ ID NO: 2065117 - DNA, 17 bp, Homo sapiens
atctgagcctaaatcta

SEQ ID NO: 2065118 - DNA, 19 bp, Homo sapiens
atctgagcctaaatctaat

SEQ ID NO: 2065119 - DNA, 13 bp, Homo sapiens
atctgagtgtgga

SEQ ID NO: 2065120 - DNA, 17 bp, Homo sapiens
atctgatacttatttac

SEQ ID NO: 2065121 - DNA, 17 bp, Homo sapiens
atctgataggaaaagaa

SEQ ID NO: 2065122 - DNA, 19 bp, Homo sapiens
atctgatcgggataacaaa

SEQ ID NO: 2065123 - DNA, 21 bp, Homo sapiens
atctgatcgggataacaaaat

SEQ ID NO: 2065124 - DNA, 14 bp, Homo sapiens
atctgatttaatgt

SEQ ID NO: 2065125 - DNA, 14 bp, Homo sapiens
atctgcagggagca

SEQ ID NO: 2065126 - DNA, 22 bp, Homo sapiens
atctgcctctattcaatttaat

SEQ ID NO: 2065127 - DNA, 11 bp, Homo sapiens
atctgcctggc

SEQ ID NO: 2065128 - DNA, 18 bp, Homo sapiens
atctgcctggcctggctc

SEQ ID NO: 2065129 - DNA, 14 bp, Homo sapiens
atctgcctgggcct

SEQ ID NO: 2065130 - DNA, 16 bp, Homo sapiens
atctgcctgggcctgt

SEQ ID NO: 2065131 - DNA, 15 bp, Homo sapiens
atctgcctgtggcct

SEQ ID NO: 2065132 - DNA, 15 bp, Homo sapiens
atctgcctttgtttc

SEQ ID NO: 2065133 - DNA, 15 bp, Homo sapiens
atctgctcctcccat

SEQ ID NO: 2065134 - DNA, 20 bp, Homo sapiens
atctgctgttgccatagccc

SEQ ID NO: 2065135 - DNA, 22 bp, Homo sapiens
atctgctgttgccatagcccca

SEQ ID NO: 2065136 - DNA, 21 bp, Homo sapiens
atctgcttggttggctggcag

SEQ ID NO: 2065137 - DNA, 13 bp, Homo sapiens
atctggaaatctg

SEQ ID NO: 2065138 - DNA, 17 bp, Homo sapiens
atctggaaatctgtttt

SEQ ID NO: 2065139 - DNA, 16 bp, Homo sapiens
atctggaatttaatta

SEQ ID NO: 2065140 - DNA, 15 bp, Homo sapiens
atctggactcctctg

SEQ ID NO: 2065141 - DNA, 23 bp, Homo sapiens
atctggagagctagaacctggag

SEQ ID NO: 2065142 - DNA, 12 bp, Homo sapiens
atctggcagggt

SEQ ID NO: 2065143 - DNA, 14 bp, Homo sapiens
atctggcatggctc

SEQ ID NO: 2065144 - DNA, 18 bp, Homo sapiens
atctggctcctgtttcca

SEQ ID NO: 2065145 - DNA, 16 bp, Homo sapiens
atctgggaagatttct

SEQ ID NO: 2065146 - DNA, 17 bp, Homo sapiens
atctgggttcactgcaa

SEQ ID NO: 2065147 - DNA, 16 bp, Homo sapiens
atctggttagataatg

SEQ ID NO: 2065148 - DNA, 15 bp, Homo sapiens
atctgtaaggaactg

SEQ ID NO: 2065149 - DNA, 13 bp, Homo sapiens
atctgtactgtaa

SEQ ID NO: 2065150 - DNA, 20 bp, Homo sapiens
atctgtactgtaattttgtt

SEQ ID NO: 2065151 - DNA, 20 bp, Homo sapiens
atctgtatatgttgtaataa

SEQ ID NO: 2065152 - DNA, 19 bp, Homo sapiens
atctgtcatctctctgggg

SEQ ID NO: 2065153 - DNA, 13 bp, Homo sapiens
atctgtccaagga

SEQ ID NO: 2065154 - DNA, 14 bp, Homo sapiens
atctgtccaaggaa

SEQ ID NO: 2065155 - DNA, 15 bp, Homo sapiens
atctgtgattccccc

SEQ ID NO: 2065156 - DNA, 16 bp, Homo sapiens
atctgtggaaatgaca

SEQ ID NO: 2065157 - DNA, 16 bp, Homo sapiens
atctgtggtcttcaaa

SEQ ID NO: 2065158 - DNA, 20 bp, Homo sapiens
atctgtgtaacctccacagt

SEQ ID NO: 2065159 - DNA, 13 bp, Homo sapiens
atctgtgtctctg

SEQ ID NO: 2065160 - DNA, 13 bp, Homo sapiens
atctgtgtgaaaa

SEQ ID NO: 2065161 - DNA, 15 bp, Homo sapiens
atctgtgtgaaaatg

SEQ ID NO: 2065162 - DNA, 16 bp, Homo sapiens
atctgtgttgtctctc

SEQ ID NO: 2065163 - DNA, 19 bp, Homo sapiens
atctgtgttgtctctctaa

SEQ ID NO: 2065164 - DNA, 19 bp, Homo sapiens
attatggtgtaatgcacaa

SEQ ID NO: 2065165 - DNA, 21 bp, Homo sapiens
attatggtgtaatgcacaatt

SEQ ID NO: 2065166 - DNA, 23 bp, Homo sapiens
attatggtgtaatgcacaattta

SEQ ID NO: 2065167 - DNA, 24 bp, Homo sapiens
attatgtgacaacctttgtgtaat

SEQ ID NO: 2065168 - DNA, 13 bp, Homo sapiens
attattaataaat

SEQ ID NO: 2065169 - DNA, 20 bp, Homo sapiens
attattaccttacagaagtt

SEQ ID NO: 2065170 - DNA, 21 bp, Homo sapiens
attattagtaagaaaacatca

SEQ ID NO: 2065171 - DNA, 21 bp, Homo sapiens
attattcaagtgcctcttgtt

SEQ ID NO: 2065172 - DNA, 15 bp, Homo sapiens
attattcatatgctt

SEQ ID NO: 2065173 - DNA, 12 bp, Homo sapiens
attattccctct

SEQ ID NO: 2065174 - DNA, 22 bp, Homo sapiens
attattccctgtacaatattta

SEQ ID NO: 2065175 - DNA, 12 bp, Homo sapiens
attattctaatt

SEQ ID NO: 2065176 - DNA, 18 bp, Homo sapiens
attattgttgcattaaaa

SEQ ID NO: 2065177 - DNA, 14 bp, Homo sapiens
attatttaatgttt

SEQ ID NO: 2065178 - DNA, 23 bp, Homo sapiens
attatttattcagcttcatttgt

SEQ ID NO: 2065179 - DNA, 15 bp, Homo sapiens
attatttatttctgt

SEQ ID NO: 2065180 - DNA, 21 bp, Homo sapiens
attatttcaaccgcttgccat

SEQ ID NO: 2065181 - DNA, 14 bp, Homo sapiens
attatttcatacaa

SEQ ID NO: 2065182 - DNA, 20 bp, Homo sapiens
attatttgtgtaatagaaaa

SEQ ID NO: 2065183 - DNA, 23 bp, Homo sapiens
attatttgtgtaatagaaaactg

SEQ ID NO: 2065184 - DNA, 22 bp, Homo sapiens
attatttgttatttgtacagtt

SEQ ID NO: 2065185 - DNA, 13 bp, Homo sapiens
attattttaaaca

SEQ ID NO: 2065186 - DNA, 21 bp, Homo sapiens
attattttaaacaaaatagaa

SEQ ID NO: 2065187 - DNA, 18 bp, Homo sapiens
attattttaatattttgt

SEQ ID NO: 2065188 - DNA, 20 bp, Homo sapiens
attattttagtctgtcatcc

SEQ ID NO: 2065189 - DNA, 14 bp, Homo sapiens
attatttttataca

SEQ ID NO: 2065190 - DNA, 21 bp, Homo sapiens
attcaaaagctctctttggaa

SEQ ID NO: 2065191 - DNA, 23 bp, Homo sapiens
attcaaaagctctctttggaatg

SEQ ID NO: 2065192 - DNA, 22 bp, Homo sapiens
attcaaaagtgaacttgatttt

SEQ ID NO: 2065193 - DNA, 17 bp, Homo sapiens
attcaaaccatttaatt

SEQ ID NO: 2065194 - DNA, 19 bp, Homo sapiens
attcaaaccatttaattca

SEQ ID NO: 2065195 - DNA, 13 bp, Homo sapiens
attcaaatgaagg

SEQ ID NO: 2065196 - DNA, 14 bp, Homo sapiens
attcaaatgggtga

SEQ ID NO: 2065197 - DNA, 20 bp, Homo sapiens
attcaaatgggtgatatcct

SEQ ID NO: 2065198 - DNA, 16 bp, Homo sapiens
attcaaccactgtaaa

SEQ ID NO: 2065199 - DNA, 14 bp, Homo sapiens
attcaacctgtgtc

SEQ ID NO: 2065200 - DNA, 12 bp, Homo sapiens
attcaagtgcct

SEQ ID NO: 2065201 - DNA, 21 bp, Homo sapiens
attcaagtgcctcttgttgca

SEQ ID NO: 2065202 - DNA, 12 bp, Homo sapiens
attcaataaaaa

SEQ ID NO: 2065203 - DNA, 18 bp, Homo sapiens
attcaataaaaaaaagaa

SEQ ID NO: 2065204 - DNA, 18 bp, Homo sapiens
atgttgtaaacaggaagc

SEQ ID NO: 2065205 - DNA, 15 bp, Homo sapiens
atgttgtcattatgt

SEQ ID NO: 2065206 - DNA, 16 bp, Homo sapiens
atgttgtgttctaata

SEQ ID NO: 2065207 - DNA, 12 bp, Homo sapiens
atgttgttattt

SEQ ID NO: 2065208 - DNA, 19 bp, Homo sapiens
atgttgttcaaatgcattt

SEQ ID NO: 2065209 - DNA, 20 bp, Homo sapiens
atgttgttcaaatgcatttt

SEQ ID NO: 2065210 - DNA, 21 bp, Homo sapiens
atgtttaaaaacattccccaa

SEQ ID NO: 2065211 - DNA, 15 bp, Homo sapiens
atgtttaaattgtaa

SEQ ID NO: 2065212 - DNA, 22 bp, Homo sapiens
atgtttacactctttgtaagag

SEQ ID NO: 2065213 - DNA, 20 bp, Homo sapiens
atgtttacatatcacctcat

SEQ ID NO: 2065214 - DNA, 18 bp, Homo sapiens
atgtttactttattagag

SEQ ID NO: 2065215 - DNA, 16 bp, Homo sapiens
atgtttagattccagg

SEQ ID NO: 2065216 - DNA, 18 bp, Homo sapiens
atgtttagattccaggat

SEQ ID NO: 2065217 - DNA, 20 bp, Homo sapiens
atgtttatgcaaggaaggaa

SEQ ID NO: 2065218 - DNA, 14 bp, Homo sapiens
atgtttattccttg

SEQ ID NO: 2065219 - DNA, 13 bp, Homo sapiens
atgtttatttata

SEQ ID NO: 2065220 - DNA, 21 bp, Homo sapiens
atgtttatttattctgcattt

SEQ ID NO: 2065221 - DNA, 12 bp, Homo sapiens
atgtttcacaac

SEQ ID NO: 2065222 - DNA, 15 bp, Homo sapiens
atgtttccagaaaat

SEQ ID NO: 2065223 - DNA, 18 bp, Homo sapiens
atgtttccagaaaatata

SEQ ID NO: 2065224 - DNA, 20 bp, Homo sapiens
atgtttccagaaaatataaa

SEQ ID NO: 2065225 - DNA, 21 bp, Homo sapiens
atgtttccagaaaatataaat

SEQ ID NO: 2065226 - DNA, 23 bp, Homo sapiens
atgtttctgcagtagtctctgtg

SEQ ID NO: 2065227 - DNA, 18 bp, Homo sapiens
atgtttgaggttaaaata

SEQ ID NO: 2065228 - DNA, 16 bp, Homo sapiens
atgtttgatcacacag

SEQ ID NO: 2065229 - DNA, 19 bp, Homo sapiens
atgtttgcacctttctagt

SEQ ID NO: 2065230 - DNA, 22 bp, Homo sapiens
atgtttgcacctttctagttga

SEQ ID NO: 2065231 - DNA, 15 bp, Homo sapiens
atgtttgcctctgcc

SEQ ID NO: 2065232 - DNA, 18 bp, Homo sapiens
atgtttgcctctgcctct

SEQ ID NO: 2065233 - DNA, 18 bp, Homo sapiens
atgtttgggcagaaggga

SEQ ID NO: 2065234 - DNA, 23 bp, Homo sapiens
atgttttcctttgtcatcattgt

SEQ ID NO: 2065235 - DNA, 23 bp, Homo sapiens
atgttttggccaatgcacctaaa

SEQ ID NO: 2065236 - DNA, 17 bp, Homo sapiens
atgttttgtacaattac

SEQ ID NO: 2065237 - DNA, 19 bp, Homo sapiens
atgttttgtacaattacta

SEQ ID NO: 2065238 - DNA, 23 bp, Homo sapiens
atgttttgtcccatttccttgga

SEQ ID NO: 2065239 - DNA, 19 bp, Homo sapiens
atgttttgtgactatatag

SEQ ID NO: 2065240 - DNA, 14 bp, Homo sapiens
atgttttgttcaaa

SEQ ID NO: 2065241 - DNA, 18 bp, Homo sapiens
atgtttttaaaagtttca

SEQ ID NO: 2065242 - DNA, 22 bp, Homo sapiens
atgtttttaaaagtttcaatgt

SEQ ID NO: 2065243 - DNA, 12 bp, Homo sapiens
atgtttttaatg

SEQ ID NO: 2065244 - DNA, 14 bp, Homo sapiens
atgtttttaatgta

SEQ ID NO: 2065245 - DNA, 16 bp, Homo sapiens
atgtttttatgatatc

SEQ ID NO: 2065246 - DNA, 15 bp, Homo sapiens
atgtttttcatgaaa

SEQ ID NO: 2065247 - DNA, 18 bp, Homo sapiens
atgtttttgaaaagctaa

SEQ ID NO: 2065248 - DNA, 12 bp, Homo sapiens
attaaaaaacaa

SEQ ID NO: 2065249 - DNA, 12 bp, Homo sapiens
attaaaaaattt

SEQ ID NO: 2065250 - DNA, 13 bp, Homo sapiens
attaaaaagttaa

SEQ ID NO: 2065251 - DNA, 17 bp, Homo sapiens
attaaaaagttaatctt

SEQ ID NO: 2065252 - DNA, 22 bp, Homo sapiens
attaaaaatgaaattatttata

SEQ ID NO: 2065253 - DNA, 15 bp, Homo sapiens
attaaaagaatattt

SEQ ID NO: 2065254 - DNA, 20 bp, Homo sapiens
attaaaatatatataaatat

SEQ ID NO: 2065255 - DNA, 21 bp, Homo sapiens
attaaaatatatataaatata

SEQ ID NO: 2065256 - DNA, 22 bp, Homo sapiens
attaaaatatatataaatatat

SEQ ID NO: 2065257 - DNA, 22 bp, Homo sapiens
attaaaatatggctataaatat

SEQ ID NO: 2065258 - DNA, 16 bp, Homo sapiens
attaaaatctggaaat

SEQ ID NO: 2065259 - DNA, 20 bp, Homo sapiens
attaaaatctggaaatctgt

SEQ ID NO: 2065260 - DNA, 21 bp, Homo sapiens
attaaaatctggcaaagttat

SEQ ID NO: 2065261 - DNA, 23 bp, Homo sapiens
attaaaatctggcaaagttatat

SEQ ID NO: 2065262 - DNA, 16 bp, Homo sapiens
attaaaattagtgaga

SEQ ID NO: 2065263 - DNA, 12 bp, Homo sapiens
attaaacacctg

SEQ ID NO: 2065264 - DNA, 13 bp, Homo sapiens
attaaacacctga

SEQ ID NO: 2065265 - DNA, 15 bp, Homo sapiens
attaaacacctgaca

SEQ ID NO: 2065266 - DNA, 20 bp, Homo sapiens
attaaacacctgacacatct

SEQ ID NO: 2065267 - DNA, 13 bp, Homo sapiens
attaaagatgtgt

SEQ ID NO: 2065268 - DNA, 19 bp, Homo sapiens
attaaagcaccaaattcat

SEQ ID NO: 2065269 - DNA, 12 bp, Homo sapiens
attaaagtgcca

SEQ ID NO: 2065270 - DNA, 19 bp, Homo sapiens
attaaataaatattttaca

SEQ ID NO: 2065271 - DNA, 17 bp, Homo sapiens
attaaattggaattttc

SEQ ID NO: 2065272 - DNA, 20 bp, Homo sapiens
attaacaaattatgttacat

SEQ ID NO: 2065273 - DNA, 15 bp, Homo sapiens
atgctggccagcacc

SEQ ID NO: 2065274 - DNA, 16 bp, Homo sapiens
atgctggccagcaccc

SEQ ID NO: 2065275 - DNA, 18 bp, Homo sapiens
atgctggccagcaccctc

SEQ ID NO: 2065276 - DNA, 22 bp, Homo sapiens
atgctggccagcaccctctcct

SEQ ID NO: 2065277 - DNA, 19 bp, Homo sapiens
atgctggcctgtggcaggc

SEQ ID NO: 2065278 - DNA, 20 bp, Homo sapiens
atgctggcctgtggcaggcc

SEQ ID NO: 2065279 - DNA, 18 bp, Homo sapiens
atgctggctgttggctgg

SEQ ID NO: 2065280 - DNA, 22 bp, Homo sapiens
atgctggctgttggctgggggc

SEQ ID NO: 2065281 - DNA, 18 bp, Homo sapiens
atgctggggagaatgaag

SEQ ID NO: 2065282 - DNA, 22 bp, Homo sapiens
atgctggggcaagtccctgact

SEQ ID NO: 2065283 - DNA, 22 bp, Homo sapiens
atgctggttttcctaaatgcag

SEQ ID NO: 2065284 - DNA, 14 bp, Homo sapiens
atgctgtatatgtt

SEQ ID NO: 2065285 - DNA, 22 bp, Homo sapiens
atgctgtctccataatgccact

SEQ ID NO: 2065286 - DNA, 15 bp, Homo sapiens
atgctgtgctctttg

SEQ ID NO: 2065287 - DNA, 14 bp, Homo sapiens
atgctgttgcctca

SEQ ID NO: 2065288 - DNA, 16 bp, Homo sapiens
atgctgttttaataat

SEQ ID NO: 2065289 - DNA, 15 bp, Homo sapiens
atgcttaaaatatgt

SEQ ID NO: 2065290 - DNA, 15 bp, Homo sapiens
atgcttacaaaaaag

SEQ ID NO: 2065291 - DNA, 21 bp, Homo sapiens
atgcttattttaaaattttat

SEQ ID NO: 2065292 - DNA, 15 bp, Homo sapiens
atgcttcttgcccct

SEQ ID NO: 2065293 - DNA, 21 bp, Homo sapiens
atgcttcttgccccttgggcc

SEQ ID NO: 2065294 - DNA, 23 bp, Homo sapiens
atgctttatgtttaaaaacattc

SEQ ID NO: 2065295 - DNA, 20 bp, Homo sapiens
atgctttcccaccagcatgt

SEQ ID NO: 2065296 - DNA, 13 bp, Homo sapiens
atgctttcctccc

SEQ ID NO: 2065297 - DNA, 14 bp, Homo sapiens
atgctttctccttt

SEQ ID NO: 2065298 - DNA, 15 bp, Homo sapiens
atgctttctcctttt

SEQ ID NO: 2065299 - DNA, 15 bp, Homo sapiens
atgctttgggaggcc

SEQ ID NO: 2065300 - DNA, 16 bp, Homo sapiens
atgctttgtgtgattg

SEQ ID NO: 2065301 - DNA, 21 bp, Homo sapiens
atgcttttctagcaactgttg

SEQ ID NO: 2065302 - DNA, 22 bp, Homo sapiens
atgctttttgaatgttatttgt

SEQ ID NO: 2065303 - DNA, 16 bp, Homo sapiens
atggaaaaatactgcc

SEQ ID NO: 2065304 - DNA, 13 bp, Homo sapiens
atggaaaagagag

SEQ ID NO: 2065305 - DNA, 15 bp, Homo sapiens
atggaaaagcccagt

SEQ ID NO: 2065306 - DNA, 17 bp, Homo sapiens
atggaaatatgttctaa

SEQ ID NO: 2065307 - DNA, 13 bp, Homo sapiens
atggaaatcctgt

SEQ ID NO: 2065308 - DNA, 15 bp, Homo sapiens
atggaaccttccctc

SEQ ID NO: 2065309 - DNA, 19 bp, Homo sapiens
atggaaccttccctccaaa

SEQ ID NO: 2065310 - DNA, 21 bp, Homo sapiens
atggaaccttccctccaaatt

SEQ ID NO: 2065311 - DNA, 22 bp, Homo sapiens
atggaactcagctgtctgtggc

SEQ ID NO: 2065312 - DNA, 14 bp, Homo sapiens
atggaactgacccc

SEQ ID NO: 2065313 - DNA, 19 bp, Homo sapiens
atggaagacaaaatgtttt

SEQ ID NO: 2065314 - DNA, 12 bp, Homo sapiens
atggaagagaaa

SEQ ID NO: 2065315 - DNA, 13 bp, Homo sapiens
atggaagagaaat

SEQ ID NO: 2065316 - DNA, 17 bp, Homo sapiens
atggaagagaaatctca

SEQ ID NO: 2065317 - DNA, 22 bp, Homo sapiens
atggaaggtttgtatattgtca

SEQ ID NO: 2065318 - DNA, 10 bp, Homo sapiens
atggaagtgt

SEQ ID NO: 2065319 - DNA, 15 bp, Homo sapiens
atggaatacagtgtt

SEQ ID NO: 2065320 - DNA, 18 bp, Homo sapiens
atggacaatataaactga

SEQ ID NO: 2065321 - DNA, 22 bp, Homo sapiens
atggacacagacccacacatgt

SEQ ID NO: 2065322 - DNA, 18 bp, Homo sapiens
atggacacattttctcct

SEQ ID NO: 2065323 - DNA, 14 bp, Homo sapiens
atggacccctccct

SEQ ID NO: 2065324 - DNA, 15 bp, Homo sapiens
atggacccctccctt

SEQ ID NO: 2065325 - DNA, 21 bp, Homo sapiens
atggaccgggtgggcctggcc

SEQ ID NO: 2065326 - DNA, 22 bp, Homo sapiens
atggaccgggtgggcctggcct

SEQ ID NO: 2065327 - DNA, 17 bp, Homo sapiens
atggacgaacaggggcc

SEQ ID NO: 2065328 - DNA, 21 bp, Homo sapiens
atggacggccccgtcagccac

SEQ ID NO: 2065329 - DNA, 18 bp, Homo sapiens
atggactctgggtttcat

SEQ ID NO: 2065330 - DNA, 17 bp, Homo sapiens
atggactcttcccccac

SEQ ID NO: 2065331 - DNA, 19 bp, Homo sapiens
atggacttttgggggttgg

SEQ ID NO: 2065332 - DNA, 20 bp, Homo sapiens
atggacttttgggggttgga

SEQ ID NO: 2065333 - DNA, 23 bp, Homo sapiens
atggagacttcaggttgttctgt

SEQ ID NO: 2065334 - DNA, 11 bp, Homo sapiens
atggagagaga

SEQ ID NO: 2065335 - DNA, 15 bp, Homo sapiens
atggagagaggggaa

SEQ ID NO: 2065336 - DNA, 20 bp, Homo sapiens
atggtgttgccctgagtgga

SEQ ID NO: 2065337 - DNA, 16 bp, Homo sapiens
atggttccatgcctga

SEQ ID NO: 2065338 - DNA, 16 bp, Homo sapiens
atggttcccaataaaa

SEQ ID NO: 2065339 - DNA, 19 bp, Homo sapiens
atggttcccaataaaagtg

SEQ ID NO: 2065340 - DNA, 19 bp, Homo sapiens
atggttcccctgttcactc

SEQ ID NO: 2065341 - DNA, 18 bp, Homo sapiens
atggttccttccctggga

SEQ ID NO: 2065342 - DNA, 20 bp, Homo sapiens
atggttccttccctgggaag

SEQ ID NO: 2065343 - DNA, 18 bp, Homo sapiens
atggttgccttaaagaaa

SEQ ID NO: 2065344 - DNA, 19 bp, Homo sapiens
atggtttctgcgtgcttta

SEQ ID NO: 2065345 - DNA, 22 bp, Homo sapiens
atggtttgaatataaacactat

SEQ ID NO: 2065346 - DNA, 16 bp, Homo sapiens
atggtttgcaaggaag

SEQ ID NO: 2065347 - DNA, 17 bp, Homo sapiens
atggtttgcaaggaagc

SEQ ID NO: 2065348 - DNA, 18 bp, Homo sapiens
atggtttgcaaggaagcc

SEQ ID NO: 2065349 - DNA, 13 bp, Homo sapiens
atgtaaaacattt

SEQ ID NO: 2065350 - DNA, 14 bp, Homo sapiens
atgtaaaacattta

SEQ ID NO: 2065351 - DNA, 15 bp, Homo sapiens
atgtaaaacatttat

SEQ ID NO: 2065352 - DNA, 21 bp, Homo sapiens
atgtaaaacatttattttgac

SEQ ID NO: 2065353 - DNA, 18 bp, Homo sapiens
atgtaaaatgcagtccag

SEQ ID NO: 2065354 - DNA, 22 bp, Homo sapiens
atgtaaacagtgcctgctgaat

SEQ ID NO: 2065355 - DNA, 23 bp, Homo sapiens
atgtaaacataattcttgtatat

SEQ ID NO: 2065356 - DNA, 23 bp, Homo sapiens
atgtaaatattttaaagaattgt

SEQ ID NO: 2065357 - DNA, 17 bp, Homo sapiens
atgtaacccaaatgtcc

SEQ ID NO: 2065358 - DNA, 16 bp, Homo sapiens
atgtaacttttgtaag

SEQ ID NO: 2065359 - DNA, 18 bp, Homo sapiens
atgtaacttttgtaagac

SEQ ID NO: 2065360 - DNA, 16 bp, Homo sapiens
atgtaagggaaactgc

SEQ ID NO: 2065361 - DNA, 20 bp, Homo sapiens
atgtaagggaaactgccagc

SEQ ID NO: 2065362 - DNA, 21 bp, Homo sapiens
atgtaagggaaactgccagca

SEQ ID NO: 2065363 - DNA, 11 bp, Homo sapiens
atgtaattgtt

SEQ ID NO: 2065364 - DNA, 18 bp, Homo sapiens
atgtacaaaagtaccata

SEQ ID NO: 2065365 - DNA, 15 bp, Homo sapiens
atgtacaagttttgt

SEQ ID NO: 2065366 - DNA, 22 bp, Homo sapiens
atgtacacacacagatgcacac

SEQ ID NO: 2065367 - DNA, 13 bp, Homo sapiens
atgtacatgtgta

SEQ ID NO: 2065368 - DNA, 14 bp, Homo sapiens
atgtacatgtgtag

SEQ ID NO: 2065369 - DNA, 19 bp, Homo sapiens
atgtacatttctgaaatga

SEQ ID NO: 2065370 - DNA, 18 bp, Homo sapiens
atgtaccagtgtactgct

SEQ ID NO: 2065371 - DNA, 22 bp, Homo sapiens
atgtaccagtgtactgctttca

SEQ ID NO: 2065372 - DNA, 16 bp, Homo sapiens
atgtacccaccgggcc

SEQ ID NO: 2065373 - DNA, 21 bp, Homo sapiens
atgtacccaccgggccactcc

SEQ ID NO: 2065374 - DNA, 19 bp, Homo sapiens
atgtacgaaactgtatgat

SEQ ID NO: 2065375 - DNA, 14 bp, Homo sapiens
atgtacttcctgtg

SEQ ID NO: 2065376 - DNA, 23 bp, Homo sapiens
atgtagaaatattataaatccaa

SEQ ID NO: 2065377 - DNA, 16 bp, Homo sapiens
atgtagaataaatgaa

SEQ ID NO: 2065378 - DNA, 19 bp, Homo sapiens
atgtagactatatacatgt

SEQ ID NO: 2065379 - DNA, 16 bp, Homo sapiens
atgtagcccggccagg

SEQ ID NO: 2065380 - DNA, 21 bp, Homo sapiens
atgtagcccggccagggcctg

SEQ ID NO: 2065381 - DNA, 23 bp, Homo sapiens
atgtagcccggccagggcctggt

SEQ ID NO: 2065382 - DNA, 18 bp, Homo sapiens
atgtagggtaaggtgcct

SEQ ID NO: 2065383 - DNA, 17 bp, Homo sapiens
atgtaggtatgaataag

SEQ ID NO: 2065384 - DNA, 17 bp, Homo sapiens
atgtagtataaagaaaa

SEQ ID NO: 2065385 - DNA, 17 bp, Homo sapiens
atgtagtatgatgtaat

SEQ ID NO: 2065386 - DNA, 14 bp, Homo sapiens
atgtatacacacat

SEQ ID NO: 2065387 - DNA, 16 bp, Homo sapiens
atgtatacacacatat

SEQ ID NO: 2065388 - DNA, 19 bp, Homo sapiens
atgtatacacacatataca

SEQ ID NO: 2065389 - DNA, 15 bp, Homo sapiens
atgtatagtaaatca

SEQ ID NO: 2065390 - DNA, 15 bp, Homo sapiens
atgtatatacacata

SEQ ID NO: 2065391 - DNA, 16 bp, Homo sapiens
atgtatatacacatat

SEQ ID NO: 2065392 - DNA, 22 bp, Homo sapiens
atgtatatactatacaacaatg

SEQ ID NO: 2065393 - DNA, 13 bp, Homo sapiens
atgtatatctata

SEQ ID NO: 2065394 - DNA, 20 bp, Homo sapiens
atgtatatctatatctctaa

SEQ ID NO: 2065395 - DNA, 14 bp, Homo sapiens
atgtatatgtatat

SEQ ID NO: 2065396 - DNA, 19 bp, Homo sapiens
attccctgtacaatattta

SEQ ID NO: 2065397 - DNA, 21 bp, Homo sapiens
attccctgtacaatatttaaa

SEQ ID NO: 2065398 - DNA, 20 bp, Homo sapiens
attcctaagcagtgcttgta

SEQ ID NO: 2065399 - DNA, 17 bp, Homo sapiens
attcctatatagtttat

SEQ ID NO: 2065400 - DNA, 13 bp, Homo sapiens
attcctcagctgc

SEQ ID NO: 2065401 - DNA, 17 bp, Homo sapiens
attcctcccccagagcc

SEQ ID NO: 2065402 - DNA, 18 bp, Homo sapiens
attcctcttgcctctctc

SEQ ID NO: 2065403 - DNA, 13 bp, Homo sapiens
attcctgaaagaa

SEQ ID NO: 2065404 - DNA, 15 bp, Homo sapiens
attcctgaagccaga

SEQ ID NO: 2065405 - DNA, 17 bp, Homo sapiens
attcctgaatgaaatat

SEQ ID NO: 2065406 - DNA, 12 bp, Homo sapiens
attcctgaccct

SEQ ID NO: 2065407 - DNA, 18 bp, Homo sapiens
attcctgcatttgtgaaa

SEQ ID NO: 2065408 - DNA, 13 bp, Homo sapiens
attcctgcatttt

SEQ ID NO: 2065409 - DNA, 16 bp, Homo sapiens
attcctggcatgacac

SEQ ID NO: 2065410 - DNA, 19 bp, Homo sapiens
attcctggcatgacactct

SEQ ID NO: 2065411 - DNA, 10 bp, Homo sapiens
attcctgggc

SEQ ID NO: 2065412 - DNA, 21 bp, Homo sapiens
attcctgggcaagaacctaaa

SEQ ID NO: 2065413 - DNA, 11 bp, Homo sapiens
attcctgggcc

SEQ ID NO: 2065414 - DNA, 16 bp, Homo sapiens
attcctgtagcatctt

SEQ ID NO: 2065415 - DNA, 18 bp, Homo sapiens
attcctgtagcatcttct

SEQ ID NO: 2065416 - DNA, 20 bp, Homo sapiens
attccttagcttagacctca

SEQ ID NO: 2065417 - DNA, 23 bp, Homo sapiens
attccttagcttagacctcagcc

SEQ ID NO: 2065418 - DNA, 13 bp, Homo sapiens
attccttcactca

SEQ ID NO: 2065419 - DNA, 16 bp, Homo sapiens
attccttgtcaccagc

SEQ ID NO: 2065420 - DNA, 21 bp, Homo sapiens
attccttttgatggggagaaa

SEQ ID NO: 2065421 - DNA, 22 bp, Homo sapiens
attccttttgatggggagaaag

SEQ ID NO: 2065422 - DNA, 23 bp, Homo sapiens
attcgtggtgatcaattaaatgt

SEQ ID NO: 2065423 - DNA, 20 bp, Homo sapiens
attctaaaatgattgtagta

SEQ ID NO: 2065424 - DNA, 15 bp, Homo sapiens
attctaaatgaatgt

SEQ ID NO: 2065425 - DNA, 18 bp, Homo sapiens
attctaagattgtacata

SEQ ID NO: 2065426 - DNA, 18 bp, Homo sapiens
attctaatgtcttcattt

SEQ ID NO: 2065427 - DNA, 15 bp, Homo sapiens
attctacacatatat

SEQ ID NO: 2065428 - DNA, 24 bp, Homo sapiens
attctacacatatatgtatatgta

SEQ ID NO: 2065429 - DNA, 19 bp, Homo sapiens
attctaggaaacccaagga

SEQ ID NO: 2065430 - DNA, 16 bp, Homo sapiens
attctaggtctgtaat

SEQ ID NO: 2065431 - DNA, 21 bp, Homo sapiens
attctatcactggcaatattt

SEQ ID NO: 2065432 - DNA, 21 bp, Homo sapiens
attctatggccattactaaca

SEQ ID NO: 2065433 - DNA, 18 bp, Homo sapiens
attaccaaaaaagtattt

SEQ ID NO: 2065434 - DNA, 17 bp, Homo sapiens
attaccagagttgttct

SEQ ID NO: 2065435 - DNA, 20 bp, Homo sapiens
attaccatgagaagagggcc

SEQ ID NO: 2065436 - DNA, 15 bp, Homo sapiens
attaccatggagaca

SEQ ID NO: 2065437 - DNA, 16 bp, Homo sapiens
attacgtgagccaggt

SEQ ID NO: 2065438 - DNA, 13 bp, Homo sapiens
attactaaattgt

SEQ ID NO: 2065439 - DNA, 22 bp, Homo sapiens
attactctgcggtggtgccaga

SEQ ID NO: 2065440 - DNA, 17 bp, Homo sapiens
attactgcatgcacttc

SEQ ID NO: 2065441 - DNA, 19 bp, Homo sapiens
attacttatttttgacagt

SEQ ID NO: 2065442 - DNA, 12 bp, Homo sapiens
attacttctgct

SEQ ID NO: 2065443 - DNA, 18 bp, Homo sapiens
attacttgaactttccaa

SEQ ID NO: 2065444 - DNA, 13 bp, Homo sapiens
attacttgcacaa

SEQ ID NO: 2065445 - DNA, 20 bp, Homo sapiens
attacttgcacaagcttgta

SEQ ID NO: 2065446 - DNA, 20 bp, Homo sapiens
attagaaattagctgtgtga

SEQ ID NO: 2065447 - DNA, 13 bp, Homo sapiens
attagaacaatag

SEQ ID NO: 2065448 - DNA, 13 bp, Homo sapiens
attagaagtgttt

SEQ ID NO: 2065449 - DNA, 22 bp, Homo sapiens
attagactggaacttgaactga

SEQ ID NO: 2065450 - DNA, 14 bp, Homo sapiens
attagactggacag

SEQ ID NO: 2065451 - DNA, 15 bp, Homo sapiens
attagactggacagc

SEQ ID NO: 2065452 - DNA, 20 bp, Homo sapiens
attagactggacagcttgtg

SEQ ID NO: 2065453 - DNA, 20 bp, Homo sapiens
attagatcttcaaacagaat

SEQ ID NO: 2065454 - DNA, 16 bp, Homo sapiens
attagattttcttgca

SEQ ID NO: 2065455 - DNA, 21 bp, Homo sapiens
attagcaagtgagtttggtgt

SEQ ID NO: 2065456 - DNA, 17 bp, Homo sapiens
attagcagtttgctttg

SEQ ID NO: 2065457 - DNA, 14 bp, Homo sapiens
attagcatttagtc

SEQ ID NO: 2065458 - DNA, 17 bp, Homo sapiens
attagccagtgaaaaac

SEQ ID NO: 2065459 - DNA, 22 bp, Homo sapiens
attagctacttttcagaattga

SEQ ID NO: 2065460 - DNA, 13 bp, Homo sapiens
attagctctggac

SEQ ID NO: 2065461 - DNA, 21 bp, Homo sapiens
attagctgtaaatacatgtgt

SEQ ID NO: 2065462 - DNA, 15 bp, Homo sapiens
attagctgtgatttt

SEQ ID NO: 2065463 - DNA, 22 bp, Homo sapiens
attaggaacagagtatatatgt

SEQ ID NO: 2065464 - DNA, 23 bp, Homo sapiens
attaggaacagagtatatatgta

SEQ ID NO: 2065465 - DNA, 19 bp, Homo sapiens
attaggatctatgcaattt

SEQ ID NO: 2065466 - DNA, 19 bp, Homo sapiens
attaggtactatctgtgaa

SEQ ID NO: 2065467 - DNA, 15 bp, Homo sapiens
attaggttttgtaca

SEQ ID NO: 2065468 - DNA, 14 bp, Homo sapiens
attagtaattgtaa

SEQ ID NO: 2065469 - DNA, 15 bp, Homo sapiens
attagtaattgtaag

SEQ ID NO: 2065470 - DNA, 18 bp, Homo sapiens
attagtatttatttaatg

SEQ ID NO: 2065471 - DNA, 14 bp, Homo sapiens
attagttaatatat

SEQ ID NO: 2065472 - DNA, 20 bp, Homo sapiens
attagttaggtgtgccaaac

SEQ ID NO: 2065473 - DNA, 20 bp, Homo sapiens
attagtttgatttaatatct

SEQ ID NO: 2065474 - DNA, 21 bp, Homo sapiens
attagtttgatttaatatctg

SEQ ID NO: 2065475 - DNA, 15 bp, Homo sapiens
attagttttctttgt

SEQ ID NO: 2065476 - DNA, 18 bp, Homo sapiens
attataaaattattttta

SEQ ID NO: 2065477 - DNA, 17 bp, Homo sapiens
attataaataaatgcca

SEQ ID NO: 2065478 - DNA, 20 bp, Homo sapiens
attataataatgttctctgg

SEQ ID NO: 2065479 - DNA, 15 bp, Homo sapiens
attataatttaatgc

SEQ ID NO: 2065480 - DNA, 23 bp, Homo sapiens
attataatttttttcaatattta

SEQ ID NO: 2065481 - DNA, 20 bp, Homo sapiens
attatactgtagctgatgaa

SEQ ID NO: 2065482 - DNA, 20 bp, Homo sapiens
attatagagtatactaaaaa

SEQ ID NO: 2065483 - DNA, 20 bp, Homo sapiens
attatataggttgtgcaaat

SEQ ID NO: 2065484 - DNA, 22 bp, Homo sapiens
attatatagtataccatacatt

SEQ ID NO: 2065485 - DNA, 12 bp, Homo sapiens
attatatatcat

SEQ ID NO: 2065486 - DNA, 17 bp, Homo sapiens
attatatatcataaagt

SEQ ID NO: 2065487 - DNA, 18 bp, Homo sapiens
attatatatcataaagta

SEQ ID NO: 2065488 - DNA, 14 bp, Homo sapiens
attatatctaattt

SEQ ID NO: 2065489 - DNA, 21 bp, Homo sapiens
attatatctaatttatacaaa

SEQ ID NO: 2065490 - DNA, 13 bp, Homo sapiens
attatattaaaat

SEQ ID NO: 2065491 - DNA, 13 bp, Homo sapiens
attatattataat

SEQ ID NO: 2065492 - DNA, 14 bp, Homo sapiens
attatcacatcaag

SEQ ID NO: 2065493 - DNA, 20 bp, Homo sapiens
attatcgggaacagtgtttc

SEQ ID NO: 2065494 - DNA, 17 bp, Homo sapiens
attatcgggagcagtgt

SEQ ID NO: 2065495 - DNA, 19 bp, Homo sapiens
attatcgggagcagtgtct

SEQ ID NO: 2065496 - DNA, 21 bp, Homo sapiens
attatcgggagcagtgtcttc

SEQ ID NO: 2065497 - DNA, 22 bp, Homo sapiens
attatctgatcgggataacaaa

SEQ ID NO: 2065498 - DNA, 17 bp, Homo sapiens
attatgacagttatact

SEQ ID NO: 2065499 - DNA, 20 bp, Homo sapiens
attatgagtctctatgatct

SEQ ID NO: 2065500 - DNA, 21 bp, Homo sapiens
attatgatgtgggtcaaggaa

SEQ ID NO: 2065501 - DNA, 14 bp, Homo sapiens
attatgcactggcc

SEQ ID NO: 2065502 - DNA, 17 bp, Homo sapiens
attatggaagattttaa

SEQ ID NO: 2065503 - DNA, 14 bp, Homo sapiens
attatggtgaaatt

SEQ ID NO: 2065504 - DNA, 15 bp, Homo sapiens
attatggtgtaatgc

SEQ ID NO: 2065505 - DNA, 17 bp, Homo sapiens
attatggtgtaatgcac

SEQ ID NO: 2065506 - DNA, 21 bp, Homo sapiens
attttctacctggtctctcct

SEQ ID NO: 2065507 - DNA, 22 bp, Homo sapiens
attttctatagctcttctattt

SEQ ID NO: 2065508 - DNA, 22 bp, Homo sapiens
attttctatttttcttctaaaa

SEQ ID NO: 2065509 - DNA, 17 bp, Homo sapiens
attttctcctaggagaa

SEQ ID NO: 2065510 - DNA, 15 bp, Homo sapiens
attttctctttaaaa

SEQ ID NO: 2065511 - DNA, 21 bp, Homo sapiens
attttctctttaaaagaaagt

SEQ ID NO: 2065512 - DNA, 22 bp, Homo sapiens
attttcttcccatttgtaatgt

SEQ ID NO: 2065513 - DNA, 16 bp, Homo sapiens
attttctttctgtaac

SEQ ID NO: 2065514 - DNA, 23 bp, Homo sapiens
attttctttctttttctggaaat

SEQ ID NO: 2065515 - DNA, 14 bp, Homo sapiens
attttgaatgttta

SEQ ID NO: 2065516 - DNA, 24 bp, Homo sapiens
attttgacataaagttgataaaga

SEQ ID NO: 2065517 - DNA, 21 bp, Homo sapiens
attttgagtatctcggacctt

SEQ ID NO: 2065518 - DNA, 13 bp, Homo sapiens
attttgagtgact

SEQ ID NO: 2065519 - DNA, 23 bp, Homo sapiens
attttgagtgactcgagggttgg

SEQ ID NO: 2065520 - DNA, 19 bp, Homo sapiens
attttgatccaagctggtc

SEQ ID NO: 2065521 - DNA, 18 bp, Homo sapiens
caaagttattccccatct

SEQ ID NO: 2065522 - DNA, 20 bp, Homo sapiens
caaagttccctacttcctgt

SEQ ID NO: 2065523 - DNA, 21 bp, Homo sapiens
caaagttccctacttcctgtg

SEQ ID NO: 2065524 - DNA, 22 bp, Homo sapiens
caaagttgtagttcttgtgcat

SEQ ID NO: 2065525 - DNA, 17 bp, Homo sapiens
caaataaaaagtgcttt

SEQ ID NO: 2065526 - DNA, 18 bp, Homo sapiens
caaataaaaagtgctttt

SEQ ID NO: 2065527 - DNA, 18 bp, Homo sapiens
caaataaactctaaacat

SEQ ID NO: 2065528 - DNA, 12 bp, Homo sapiens
caaataaatgtg

SEQ ID NO: 2065529 - DNA, 14 bp, Homo sapiens
caaataaatgtgta

SEQ ID NO: 2065530 - DNA, 15 bp, Homo sapiens
caaataaatgtgtaa

SEQ ID NO: 2065531 - DNA, 20 bp, Homo sapiens
caaataaatgtgtaaatgtg

SEQ ID NO: 2065532 - DNA, 14 bp, Homo sapiens
caaataataagcaa

SEQ ID NO: 2065533 - DNA, 14 bp, Homo sapiens
caaatactccaagc

SEQ ID NO: 2065534 - DNA, 12 bp, Homo sapiens
caaatataaact

SEQ ID NO: 2065535 - DNA, 14 bp, Homo sapiens
caaatataaacttg

SEQ ID NO: 2065536 - DNA, 15 bp, Homo sapiens
caaatataaacttgt

SEQ ID NO: 2065537 - DNA, 13 bp, Homo sapiens
caaatatctcaga

SEQ ID NO: 2065538 - DNA, 14 bp, Homo sapiens
caaatatctcagag

SEQ ID NO: 2065539 - DNA, 14 bp, Homo sapiens
caaatatgcaaagc

SEQ ID NO: 2065540 - DNA, 16 bp, Homo sapiens
caaatatgcaaagcac

SEQ ID NO: 2065541 - DNA, 23 bp, Homo sapiens
caaatattaccaaaaaagtattt

SEQ ID NO: 2065542 - DNA, 14 bp, Homo sapiens
caaatattattcaa

SEQ ID NO: 2065543 - DNA, 21 bp, Homo sapiens
caaatattattcaagtgcctc

SEQ ID NO: 2065544 - DNA, 19 bp, Homo sapiens
caaatattgttaccatgaa

SEQ ID NO: 2065545 - DNA, 12 bp, Homo sapiens
caaatatttatt

SEQ ID NO: 2065546 - DNA, 14 bp, Homo sapiens
caaatatttatttt

SEQ ID NO: 2065547 - DNA, 16 bp, Homo sapiens
caaatcaaccccagac

SEQ ID NO: 2065548 - DNA, 22 bp, Homo sapiens
caaatcaaccccagactcaaac

SEQ ID NO: 2065549 - DNA, 15 bp, Homo sapiens
caaatcacacctctg

SEQ ID NO: 2065550 - DNA, 15 bp, Homo sapiens
caaatccagtgtgca

SEQ ID NO: 2065551 - DNA, 21 bp, Homo sapiens
caaatctatattaaagtgtta

SEQ ID NO: 2065552 - DNA, 16 bp, Homo sapiens
caaatctattcagaca

SEQ ID NO: 2065553 - DNA, 20 bp, Homo sapiens
caaatctattcagacaagca

SEQ ID NO: 2065554 - DNA, 12 bp, Homo sapiens
caaatctgtata

SEQ ID NO: 2065555 - DNA, 21 bp, Homo sapiens
caaatcttcaaggtgtaaaat

SEQ ID NO: 2065556 - DNA, 15 bp, Homo sapiens
caaatgacatgcact

SEQ ID NO: 2065557 - DNA, 17 bp, Homo sapiens
caaatgacatgcactga

SEQ ID NO: 2065558 - DNA, 19 bp, Homo sapiens
caaatgacatgcactgacc

SEQ ID NO: 2065559 - DNA, 15 bp, Homo sapiens
caaatgagggagggg

SEQ ID NO: 2065560 - DNA, 20 bp, Homo sapiens
caaatgattttcatcaattt

SEQ ID NO: 2065561 - DNA, 18 bp, Homo sapiens
caaatgcatggtgcagtt

SEQ ID NO: 2065562 - DNA, 17 bp, Homo sapiens
caaatgctaaatgcaaa

SEQ ID NO: 2065563 - DNA, 13 bp, Homo sapiens
caaatgcttaaaa

SEQ ID NO: 2065564 - DNA, 15 bp, Homo sapiens
caaatggctctgtga

SEQ ID NO: 2065565 - DNA, 16 bp, Homo sapiens
caaatggctctgtgaa

SEQ ID NO: 2065566 - DNA, 22 bp, Homo sapiens
caaatggctctgtgaaatcaga

SEQ ID NO: 2065567 - DNA, 21 bp, Homo sapiens
caaatggtttttgcaagattt

SEQ ID NO: 2065568 - DNA, 18 bp, Homo sapiens
caaatgtaaaataagtat

SEQ ID NO: 2065569 - DNA, 17 bp, Homo sapiens
caaatgtcagcttaaaa

SEQ ID NO: 2065570 - DNA, 14 bp, Homo sapiens
caaatgtggctcct

SEQ ID NO: 2065571 - DNA, 19 bp, Homo sapiens
caaattaggttttgtacaa

SEQ ID NO: 2065572 - DNA, 14 bp, Homo sapiens
caaattatttgtgt

SEQ ID NO: 2065573 - DNA, 17 bp, Homo sapiens
caaattatttgtgtaat

SEQ ID NO: 2065574 - DNA, 23 bp, Homo sapiens
caaattcaaggagatataaaatc

SEQ ID NO: 2065575 - DNA, 22 bp, Homo sapiens
caaattctacagcatacagagc

SEQ ID NO: 2065576 - DNA, 17 bp, Homo sapiens
caaattgtaactacact

SEQ ID NO: 2065577 - DNA, 12 bp, Homo sapiens
caaattgttcat

SEQ ID NO: 2065578 - DNA, 12 bp, Homo sapiens
caaatttatatg

SEQ ID NO: 2065579 - DNA, 17 bp, Homo sapiens
caaatttcaaaagacat

SEQ ID NO: 2065580 - DNA, 19 bp, Homo sapiens
caaatttgaaaataattgt

SEQ ID NO: 2065581 - DNA, 23 bp, Homo sapiens
caaatttgccaccactagagctg

SEQ ID NO: 2065582 - DNA, 13 bp, Homo sapiens
caaattttgcatt

SEQ ID NO: 2065583 - DNA, 14 bp, Homo sapiens
caaattttgcattt

SEQ ID NO: 2065584 - DNA, 20 bp, Homo sapiens
caaatttttctcagtttgta

SEQ ID NO: 2065585 - DNA, 14 bp, Homo sapiens
caacaaaatcaatt

SEQ ID NO: 2065586 - DNA, 17 bp, Homo sapiens
caacaaagcacagtgtt

SEQ ID NO: 2065587 - DNA, 19 bp, Homo sapiens
caacaaattaggttttgta

SEQ ID NO: 2065588 - DNA, 12 bp, Homo sapiens
caacaacaacaa

SEQ ID NO: 2065589 - DNA, 15 bp, Homo sapiens
caacaacaaggaccc

SEQ ID NO: 2065590 - DNA, 13 bp, Homo sapiens
caacaacaataac

SEQ ID NO: 2065591 - DNA, 14 bp, Homo sapiens
caacaacaataaca

SEQ ID NO: 2065592 - DNA, 16 bp, Homo sapiens
caacaacaataacaac

SEQ ID NO: 2065593 - DNA, 15 bp, Homo sapiens
caacaacaatacaac

SEQ ID NO: 2065594 - DNA, 18 bp, Homo sapiens
caacaacaatacaacaag

SEQ ID NO: 2065595 - DNA, 14 bp, Homo sapiens
caacaacatccatg

SEQ ID NO: 2065596 - DNA, 21 bp, Homo sapiens
caacaacatgtataatatttt

SEQ ID NO: 2065597 - DNA, 14 bp, Homo sapiens
caacaactccagga

SEQ ID NO: 2065598 - DNA, 14 bp, Homo sapiens
caacaagttgcctc

SEQ ID NO: 2065599 - DNA, 14 bp, Homo sapiens
caacaatacaacaa

SEQ ID NO: 2065600 - DNA, 18 bp, Homo sapiens
caacaatacaacaagaac

SEQ ID NO: 2065601 - DNA, 21 bp, Homo sapiens
caacaatacaacaagaacaac

SEQ ID NO: 2065602 - DNA, 16 bp, Homo sapiens
caacaatggggtgggc

SEQ ID NO: 2065603 - DNA, 18 bp, Homo sapiens
caacaatggggtgggccc

SEQ ID NO: 2065604 - DNA, 17 bp, Homo sapiens
caacaatggtttacatg

SEQ ID NO: 2065605 - DNA, 20 bp, Homo sapiens
caacacaaagagaaaaagaa

SEQ ID NO: 2065606 - DNA, 14 bp, Homo sapiens
caacacacacactc

SEQ ID NO: 2065607 - DNA, 16 bp, Homo sapiens
caacacacctggtgaa

SEQ ID NO: 2065608 - DNA, 16 bp, Homo sapiens
caacacattacttgca

SEQ ID NO: 2065609 - DNA, 20 bp, Homo sapiens
caacacattacttgcacaag

SEQ ID NO: 2065610 - DNA, 21 bp, Homo sapiens
caacacattacttgcacaagc

SEQ ID NO: 2065611 - DNA, 22 bp, Homo sapiens
caacacctccttgctttgctgt

SEQ ID NO: 2065612 - DNA, 23 bp, Homo sapiens
caacacgagcaggctactgtcag

SEQ ID NO: 2065613 - DNA, 17 bp, Homo sapiens
caacagaagcttcagaa

SEQ ID NO: 2065614 - DNA, 20 bp, Homo sapiens
caacagaagtcatgaagccc

SEQ ID NO: 2065615 - DNA, 23 bp, Homo sapiens
caacagaagtcatgaagcccaag

SEQ ID NO: 2065616 - DNA, 19 bp, Homo sapiens
caacagagtgagaccctgt

SEQ ID NO: 2065617 - DNA, 10 bp, Homo sapiens
caacagcagc

SEQ ID NO: 2065618 - DNA, 15 bp, Homo sapiens
caacagctcaagtct

SEQ ID NO: 2065619 - DNA, 19 bp, Homo sapiens
caacagcttttcccaggag

SEQ ID NO: 2065620 - DNA, 17 bp, Homo sapiens
caacaggctgggcttca

SEQ ID NO: 2065621 - DNA, 20 bp, Homo sapiens
caacaggctgttctgcactg

SEQ ID NO: 2065622 - DNA, 11 bp, Homo sapiens
caacagtgagt

SEQ ID NO: 2065623 - DNA, 12 bp, Homo sapiens
caacagttcaaa

SEQ ID NO: 2065624 - DNA, 19 bp, Homo sapiens
caacagttgggctgtcaac

SEQ ID NO: 2065625 - DNA, 17 bp, Homo sapiens
caacatacccttcttta

SEQ ID NO: 2065626 - DNA, 15 bp, Homo sapiens
caacatcttctctct

SEQ ID NO: 2065627 - DNA, 23 bp, Homo sapiens
caacatctttttcctccctttcc

SEQ ID NO: 2065628 - DNA, 21 bp, Homo sapiens
caacatggcaaaaccccatct

SEQ ID NO: 2065629 - DNA, 14 bp, Homo sapiens
caaccaaccacaaa

SEQ ID NO: 2065630 - DNA, 21 bp, Homo sapiens
caaccactgtaaaatgaaatt

SEQ ID NO: 2065631 - DNA, 12 bp, Homo sapiens
caaccactgtgg

SEQ ID NO: 2065632 - DNA, 14 bp, Homo sapiens
caaccactgtggcg

SEQ ID NO: 2065633 - DNA, 23 bp, Homo sapiens
caaccactgtggcgttctgctgc

SEQ ID NO: 2065634 - DNA, 11 bp, Homo sapiens
caaccagagcc

SEQ ID NO: 2065635 - DNA, 13 bp, Homo sapiens
caaccagagcccc

SEQ ID NO: 2065636 - DNA, 19 bp, Homo sapiens
caaccagagccccccacaa

SEQ ID NO: 2065637 - DNA, 20 bp, Homo sapiens
caaccagccacacagagcct

SEQ ID NO: 2065638 - DNA, 17 bp, Homo sapiens
cacaggccccccgcagc

SEQ ID NO: 2065639 - DNA, 21 bp, Homo sapiens
cacaggccccccgcagcaccc

SEQ ID NO: 2065640 - DNA, 14 bp, Homo sapiens
cacaggcccggctc

SEQ ID NO: 2065641 - DNA, 18 bp, Homo sapiens
cacaggcccttcctctcc

SEQ ID NO: 2065642 - DNA, 17 bp, Homo sapiens
cacaggcccttggggtt

SEQ ID NO: 2065643 - DNA, 14 bp, Homo sapiens
cacaggcctgtgta

SEQ ID NO: 2065644 - DNA, 21 bp, Homo sapiens
cacaggctgcctcatgaccct

SEQ ID NO: 2065645 - DNA, 19 bp, Homo sapiens
cacagggccccagaaggca

SEQ ID NO: 2065646 - DNA, 13 bp, Homo sapiens
cacaggggcaggc

SEQ ID NO: 2065647 - DNA, 14 bp, Homo sapiens
cacaggggcaggcc

SEQ ID NO: 2065648 - DNA, 15 bp, Homo sapiens
cacaggggcaggcct

SEQ ID NO: 2065649 - DNA, 19 bp, Homo sapiens
cacaggggcaggcctggga

SEQ ID NO: 2065650 - DNA, 13 bp, Homo sapiens
cacaggggcccca

SEQ ID NO: 2065651 - DNA, 16 bp, Homo sapiens
cacaggggcggggcag

SEQ ID NO: 2065652 - DNA, 16 bp, Homo sapiens
cacaggtacagcaaca

SEQ ID NO: 2065653 - DNA, 21 bp, Homo sapiens
cacaggtacagcaacaggaat

SEQ ID NO: 2065654 - DNA, 23 bp, Homo sapiens
cacaggtatgaccttctaggaag

SEQ ID NO: 2065655 - DNA, 23 bp, Homo sapiens
cacaggtcctgaaagtctgtgtc

SEQ ID NO: 2065656 - DNA, 13 bp, Homo sapiens
cacaggtgtaaat

SEQ ID NO: 2065657 - DNA, 16 bp, Homo sapiens
cacaggtgtaaatata

SEQ ID NO: 2065658 - DNA, 16 bp, Homo sapiens
cacaggtgtggtgtaa

SEQ ID NO: 2065659 - DNA, 20 bp, Homo sapiens
cacagtaaaaacttgtacta

SEQ ID NO: 2065660 - DNA, 18 bp, Homo sapiens
cacagtacaatgtttcag

SEQ ID NO: 2065661 - DNA, 16 bp, Homo sapiens
cacagtcctcacagcc

SEQ ID NO: 2065662 - DNA, 17 bp, Homo sapiens
cacagtctcagtccaga

SEQ ID NO: 2065663 - DNA, 14 bp, Homo sapiens
cacagtctctggga

SEQ ID NO: 2065664 - DNA, 11 bp, Homo sapiens
cacagtgaccc

SEQ ID NO: 2065665 - DNA, 13 bp, Homo sapiens
cacagtgagctga

SEQ ID NO: 2065666 - DNA, 17 bp, Homo sapiens
cacagtgcatctcagcc

SEQ ID NO: 2065667 - DNA, 19 bp, Homo sapiens
cacagtgcatctcagccca

SEQ ID NO: 2065668 - DNA, 17 bp, Homo sapiens
cacagtgctgcttctct

SEQ ID NO: 2065669 - DNA, 15 bp, Homo sapiens
cacagtgggtggcac

SEQ ID NO: 2065670 - DNA, 23 bp, Homo sapiens
cacagtgggtggcacctcctgag

SEQ ID NO: 2065671 - DNA, 18 bp, Homo sapiens
cacagtgtctgtatcgga

SEQ ID NO: 2065672 - DNA, 16 bp, Homo sapiens
cacagttcctcgccct

SEQ ID NO: 2065673 - DNA, 22 bp, Homo sapiens
cacagttggctggatgaaattt

SEQ ID NO: 2065674 - DNA, 20 bp, Homo sapiens
cacagttgtctattctgagc

SEQ ID NO: 2065675 - DNA, 22 bp, Homo sapiens
cacagttgtctattctgagcct

SEQ ID NO: 2065676 - DNA, 23 bp, Homo sapiens
cacagttgtctattctgagcctt

SEQ ID NO: 2065677 - DNA, 24 bp, Homo sapiens
cacagttgtctattctgagccttg

SEQ ID NO: 2065678 - DNA, 20 bp, Homo sapiens
cacagtttagaacagaggga

SEQ ID NO: 2065679 - DNA, 20 bp, Homo sapiens
cacagtttgatgtcattaat

SEQ ID NO: 2065680 - DNA, 16 bp, Homo sapiens
cacagttttctgagaa

SEQ ID NO: 2065681 - DNA, 13 bp, Homo sapiens
cacataatttgaa

SEQ ID NO: 2065682 - DNA, 13 bp, Homo sapiens
cacatacaacaca

SEQ ID NO: 2065683 - DNA, 19 bp, Homo sapiens
cacatacaatttgcactgt

SEQ ID NO: 2065684 - DNA, 20 bp, Homo sapiens
cacatagattaatggcactg

SEQ ID NO: 2065685 - DNA, 16 bp, Homo sapiens
cacatatacatatata

SEQ ID NO: 2065686 - DNA, 18 bp, Homo sapiens
cacatatacatatatata

SEQ ID NO: 2065687 - DNA, 14 bp, Homo sapiens
cacatatacctata

SEQ ID NO: 2065688 - DNA, 18 bp, Homo sapiens
cacatatacctataatgt

SEQ ID NO: 2065689 - DNA, 12 bp, Homo sapiens
cacatatctgtc

SEQ ID NO: 2065690 - DNA, 18 bp, Homo sapiens
cacatatgcaccttgtgt

SEQ ID NO: 2065691 - DNA, 16 bp, Homo sapiens
cacatatgggtgctgg

SEQ ID NO: 2065692 - DNA, 17 bp, Homo sapiens
cacatatgggtgctggc

SEQ ID NO: 2065693 - DNA, 18 bp, Homo sapiens
cacatatgggtgctggca

SEQ ID NO: 2065694 - DNA, 13 bp, Homo sapiens
cacatcagcttgc

SEQ ID NO: 2065695 - DNA, 23 bp, Homo sapiens
cacatcagcttgccctgttaaaa

SEQ ID NO: 2065696 - DNA, 17 bp, Homo sapiens
cacatccaatgcatagt

SEQ ID NO: 2065697 - DNA, 22 bp, Homo sapiens
cacatcccaggcttcaccctga

SEQ ID NO: 2065698 - DNA, 20 bp, Homo sapiens
cacatcccggcctcttccac

SEQ ID NO: 2065699 - DNA, 16 bp, Homo sapiens
cacatccctgggcctg

SEQ ID NO: 2065700 - DNA, 22 bp, Homo sapiens
cacatccctgggcctgctgctg

SEQ ID NO: 2065701 - DNA, 23 bp, Homo sapiens
cacatctgtgtctctggaaccca

SEQ ID NO: 2065702 - DNA, 16 bp, Homo sapiens
cacatcttctcagtgt

SEQ ID NO: 2065703 - DNA, 14 bp, Homo sapiens
cacatcttgctctg

SEQ ID NO: 2065704 - DNA, 15 bp, Homo sapiens
cacatcttgctctgc

SEQ ID NO: 2065705 - DNA, 19 bp, Homo sapiens
cacatcttgctctgctgac

SEQ ID NO: 2065706 - DNA, 23 bp, Homo sapiens
cacatcttgctctgctgacagac

SEQ ID NO: 2065707 - DNA, 22 bp, Homo sapiens
cacatgaaccatccttcccatg

SEQ ID NO: 2065708 - DNA, 23 bp, Homo sapiens
cacatgaaccatccttcccatga

SEQ ID NO: 2065709 - DNA, 24 bp, Homo sapiens
cacatgaatcccacccacatgtga

SEQ ID NO: 2065710 - DNA, 17 bp, Homo sapiens
cacatgacgtaaaattt

SEQ ID NO: 2065711 - DNA, 18 bp, Homo sapiens
cacatgcacgtgtgtgca

SEQ ID NO: 2065712 - DNA, 17 bp, Homo sapiens
cacatgctttgtttcca

SEQ ID NO: 2065713 - DNA, 16 bp, Homo sapiens
cacatggacacagacc

SEQ ID NO: 2065714 - DNA, 15 bp, Homo sapiens
cacatggatgagcac

SEQ ID NO: 2065715 - DNA, 22 bp, Homo sapiens
cacatggctatcctagagaggc

SEQ ID NO: 2065716 - DNA, 18 bp, Homo sapiens
cacatggtgttgtatact

SEQ ID NO: 2065717 - DNA, 20 bp, Homo sapiens
cacatgtcaccgtggacctt

SEQ ID NO: 2065718 - DNA, 15 bp, Homo sapiens
cacatgtcttgtaca

SEQ ID NO: 2065719 - DNA, 20 bp, Homo sapiens
cacatgtcttgtacatgtgt

SEQ ID NO: 2065720 - DNA, 15 bp, Homo sapiens
cacatgtgcacatgc

SEQ ID NO: 2065721 - DNA, 17 bp, Homo sapiens
cacatgtgcacatgcac

SEQ ID NO: 2065722 - DNA, 18 bp, Homo sapiens
cacattaatatttgctga

SEQ ID NO: 2065723 - DNA, 19 bp, Homo sapiens
cacattaatatttgctgac

SEQ ID NO: 2065724 - DNA, 22 bp, Homo sapiens
cacattaatggtctaaaaataa

SEQ ID NO: 2065725 - DNA, 21 bp, Homo sapiens
cacattaattagattttcttg

SEQ ID NO: 2065726 - DNA, 22 bp, Homo sapiens
cacattaattagattttcttgc

SEQ ID NO: 2065727 - DNA, 23 bp, Homo sapiens
cacattaattagattttcttgca

SEQ ID NO: 2065728 - DNA, 20 bp, Homo sapiens
cacattacttgcacaagctt

SEQ ID NO: 2065729 - DNA, 21 bp, Homo sapiens
cacattaggaacagagtatat

SEQ ID NO: 2065730 - DNA, 21 bp, Homo sapiens
cacattatgttagagaggtag

SEQ ID NO: 2065731 - DNA, 14 bp, Homo sapiens
cacattatttgcat

SEQ ID NO: 2065732 - DNA, 15 bp, Homo sapiens
cacattatttgcatg

SEQ ID NO: 2065733 - DNA, 19 bp, Homo sapiens
cacattctcctgtgcccct

SEQ ID NO: 2065734 - DNA, 17 bp, Homo sapiens
cacattcttaaaggaaa

SEQ ID NO: 2065735 - DNA, 22 bp, Homo sapiens
cacattcttaacacatgtcctt

SEQ ID NO: 2065736 - DNA, 20 bp, Homo sapiens
cacatttatatatatatgta

SEQ ID NO: 2065737 - DNA, 21 bp, Homo sapiens
cacattttgcctttctcgtgg

SEQ ID NO: 2065738 - DNA, 19 bp, Homo sapiens
cacattttgtacaaagata

SEQ ID NO: 2065739 - DNA, 18 bp, Homo sapiens
caccaaaaaaatacttga

SEQ ID NO: 2065740 - DNA, 15 bp, Homo sapiens
caccaaaagaagtaa

SEQ ID NO: 2065741 - DNA, 16 bp, Homo sapiens
caccaaactgcacaca

SEQ ID NO: 2065742 - DNA, 14 bp, Homo sapiens
caccaacatcccat

SEQ ID NO: 2065743 - DNA, 22 bp, Homo sapiens
caccaacatcccattgccctgg

SEQ ID NO: 2065744 - DNA, 15 bp, Homo sapiens
caccaactctgcact

SEQ ID NO: 2065745 - DNA, 16 bp, Homo sapiens
caccaactctgcactc

SEQ ID NO: 2065746 - DNA, 12 bp, Homo sapiens
caccaagcccag

SEQ ID NO: 2065747 - DNA, 15 bp, Homo sapiens
caccaagctcacagt

SEQ ID NO: 2065748 - DNA, 20 bp, Homo sapiens
caccaagctcacagttcctc

SEQ ID NO: 2065749 - DNA, 14 bp, Homo sapiens
caccaagctgttcc

SEQ ID NO: 2065750 - DNA, 21 bp, Homo sapiens
caccaaggtcttcagccatca

SEQ ID NO: 2065751 - DNA, 15 bp, Homo sapiens
caccaagttctggaa

SEQ ID NO: 2065752 - DNA, 13 bp, Homo sapiens
caccaataaaaat

SEQ ID NO: 2065753 - DNA, 16 bp, Homo sapiens
caccaataacttcaga

SEQ ID NO: 2065754 - DNA, 20 bp, Homo sapiens
caattcacttcattgaccaa

SEQ ID NO: 2065755 - DNA, 14 bp, Homo sapiens
caattcaggactgg

SEQ ID NO: 2065756 - DNA, 16 bp, Homo sapiens
caattcaggactggct

SEQ ID NO: 2065757 - DNA, 18 bp, Homo sapiens
caattcaggactggctca

SEQ ID NO: 2065758 - DNA, 17 bp, Homo sapiens
caattcatttcacttta

SEQ ID NO: 2065759 - DNA, 14 bp, Homo sapiens
caattcctctggga

SEQ ID NO: 2065760 - DNA, 15 bp, Homo sapiens
caattcctctgggaa

SEQ ID NO: 2065761 - DNA, 17 bp, Homo sapiens
caattctacccagagcc

SEQ ID NO: 2065762 - DNA, 17 bp, Homo sapiens
caattctctttagttct

SEQ ID NO: 2065763 - DNA, 15 bp, Homo sapiens
caattggctcctcca

SEQ ID NO: 2065764 - DNA, 18 bp, Homo sapiens
caattggctcctccatct

SEQ ID NO: 2065765 - DNA, 15 bp, Homo sapiens
caattgtattttata

SEQ ID NO: 2065766 - DNA, 13 bp, Homo sapiens
caattgtcttttt

SEQ ID NO: 2065767 - DNA, 22 bp, Homo sapiens
caattgtttggggttgaaaatt

SEQ ID NO: 2065768 - DNA, 12 bp, Homo sapiens
caatttaaagca

SEQ ID NO: 2065769 - DNA, 21 bp, Homo sapiens
caatttatatttaataaaatt

SEQ ID NO: 2065770 - DNA, 23 bp, Homo sapiens
caatttattaaaatgattgtaaa

SEQ ID NO: 2065771 - DNA, 22 bp, Homo sapiens
caatttcccctctgtgtcctct

SEQ ID NO: 2065772 - DNA, 16 bp, Homo sapiens
caatttcctttatatt

SEQ ID NO: 2065773 - DNA, 20 bp, Homo sapiens
caatttcctttatatttagt

SEQ ID NO: 2065774 - DNA, 21 bp, Homo sapiens
caatttgagcaattcatttca

SEQ ID NO: 2065775 - DNA, 15 bp, Homo sapiens
caatttgcacatgta

SEQ ID NO: 2065776 - DNA, 11 bp, Homo sapiens
caattttgtaa

SEQ ID NO: 2065777 - DNA, 12 bp, Homo sapiens
caatttttaaac

SEQ ID NO: 2065778 - DNA, 19 bp, Homo sapiens
caatttttaaactagtaat

SEQ ID NO: 2065779 - DNA, 15 bp, Homo sapiens
caatttttatacata

SEQ ID NO: 2065780 - DNA, 21 bp, Homo sapiens
caatttttatacatatcagaa

SEQ ID NO: 2065781 - DNA, 11 bp, Homo sapiens
caatttttcca

SEQ ID NO: 2065782 - DNA, 22 bp, Homo sapiens
caatttttcttatttcatttct

SEQ ID NO: 2065783 - DNA, 12 bp, Homo sapiens
cacaaaaatgaa

SEQ ID NO: 2065784 - DNA, 14 bp, Homo sapiens
cacaaacacctcct

SEQ ID NO: 2065785 - DNA, 18 bp, Homo sapiens
cacaaagagaaaaagaaa

SEQ ID NO: 2065786 - DNA, 18 bp, Homo sapiens
cacaaagcccttccatgt

SEQ ID NO: 2065787 - DNA, 21 bp, Homo sapiens
cacaaaggggagaagggccag

SEQ ID NO: 2065788 - DNA, 13 bp, Homo sapiens
cacaaatatttat

SEQ ID NO: 2065789 - DNA, 14 bp, Homo sapiens
cacaaatctatatt

SEQ ID NO: 2065790 - DNA, 20 bp, Homo sapiens
cacaaatctatattaaagtg

SEQ ID NO: 2065791 - DNA, 21 bp, Homo sapiens
cacaaatctatattaaagtgt

SEQ ID NO: 2065792 - DNA, 16 bp, Homo sapiens
cacaacacacacactc

SEQ ID NO: 2065793 - DNA, 13 bp, Homo sapiens
cacaacaggcatt

SEQ ID NO: 2065794 - DNA, 14 bp, Homo sapiens
cacaacaggcattc

SEQ ID NO: 2065795 - DNA, 13 bp, Homo sapiens
cacaacatttatt

SEQ ID NO: 2065796 - DNA, 14 bp, Homo sapiens
cacaaccaggaaga

SEQ ID NO: 2065797 - DNA, 23 bp, Homo sapiens
cacaaccatctgtccctgcctca

SEQ ID NO: 2065798 - DNA, 17 bp, Homo sapiens
cacaaccctgttttata

SEQ ID NO: 2065799 - DNA, 18 bp, Homo sapiens
cacaaccttctgtggctc

SEQ ID NO: 2065800 - DNA, 19 bp, Homo sapiens
cacaaccttctgtggctca

SEQ ID NO: 2065801 - DNA, 13 bp, Homo sapiens
cacaactgacaca

SEQ ID NO: 2065802 - DNA, 17 bp, Homo sapiens
cacaactgacacaggaa

SEQ ID NO: 2065803 - DNA, 12 bp, Homo sapiens
cacaagaaattt

SEQ ID NO: 2065804 - DNA, 14 bp, Homo sapiens
cacaagaaatttga

SEQ ID NO: 2065805 - DNA, 19 bp, Homo sapiens
cacaagaagaccagactgt

SEQ ID NO: 2065806 - DNA, 20 bp, Homo sapiens
cacaagagcccagcagggcc

SEQ ID NO: 2065807 - DNA, 21 bp, Homo sapiens
cacaagagcccagcagggcct

SEQ ID NO: 2065808 - DNA, 14 bp, Homo sapiens
cacaagattcccag

SEQ ID NO: 2065809 - DNA, 15 bp, Homo sapiens
cacaagattcccaga

SEQ ID NO: 2065810 - DNA, 17 bp, Homo sapiens
cacaagattcccagaga

SEQ ID NO: 2065811 - DNA, 18 bp, Homo sapiens
cacaagattcccagagac

SEQ ID NO: 2065812 - DNA, 15 bp, Homo sapiens
cacaagcaataatta

SEQ ID NO: 2065813 - DNA, 22 bp, Homo sapiens
cacaagcaataattaggatcta

SEQ ID NO: 2065814 - DNA, 23 bp, Homo sapiens
cacaagccattttttgaggagag

SEQ ID NO: 2065815 - DNA, 14 bp, Homo sapiens
cacaagcccaggct

SEQ ID NO: 2065816 - DNA, 12 bp, Homo sapiens
cacaagctggaa

SEQ ID NO: 2065817 - DNA, 13 bp, Homo sapiens
cacaagcttgtat

SEQ ID NO: 2065818 - DNA, 16 bp, Homo sapiens
cacaaggcagcaaggc

SEQ ID NO: 2065819 - DNA, 19 bp, Homo sapiens
cacaaggctgaccaagaga

SEQ ID NO: 2065820 - DNA, 12 bp, Homo sapiens
cacaaggctggg

SEQ ID NO: 2065821 - DNA, 13 bp, Homo sapiens
cacaagtaaacat

SEQ ID NO: 2065822 - DNA, 16 bp, Homo sapiens
cacaagttatttaaat

SEQ ID NO: 2065823 - DNA, 19 bp, Homo sapiens
cacaagttccagctggtct

SEQ ID NO: 2065824 - DNA, 22 bp, Homo sapiens
cacaatcctaacacattatcgg

SEQ ID NO: 2065825 - DNA, 23 bp, Homo sapiens
cacaatcctaacacattatcggg

SEQ ID NO: 2065826 - DNA, 22 bp, Homo sapiens
cacaatgatgattaaacacctg

SEQ ID NO: 2065827 - DNA, 23 bp, Homo sapiens
cacaatgatgattaaacacctga

SEQ ID NO: 2065828 - DNA, 22 bp, Homo sapiens
cacaatggagtgggagatcagc

SEQ ID NO: 2065829 - DNA, 20 bp, Homo sapiens
cacaatggctaattcccaga

SEQ ID NO: 2065830 - DNA, 21 bp, Homo sapiens
cacaattccatttccagttca

SEQ ID NO: 2065831 - DNA, 22 bp, Homo sapiens
cacaattgatacttcaggtgct

SEQ ID NO: 2065832 - DNA, 16 bp, Homo sapiens
cacaatttagaaaaca

SEQ ID NO: 2065833 - DNA, 21 bp, Homo sapiens
cacaatttagaaaacattcat

SEQ ID NO: 2065834 - DNA, 20 bp, Homo sapiens
cacaatttgagcaattcatt

SEQ ID NO: 2065835 - DNA, 17 bp, Homo sapiens
cacagcccgggtgtgcc

SEQ ID NO: 2065836 - DNA, 14 bp, Homo sapiens
cacagccctgggag

SEQ ID NO: 2065837 - DNA, 12 bp, Homo sapiens
cacagcctctcc

SEQ ID NO: 2065838 - DNA, 13 bp, Homo sapiens
cacagcctctccc

SEQ ID NO: 2065839 - DNA, 17 bp, Homo sapiens
cacagcctgggaccagg

SEQ ID NO: 2065840 - DNA, 18 bp, Homo sapiens
cacagcctgggaccaggg

SEQ ID NO: 2065841 - DNA, 21 bp, Homo sapiens
cacagcctgggaccagggcat

SEQ ID NO: 2065842 - DNA, 18 bp, Homo sapiens
cacagcgcgggcggaggc

SEQ ID NO: 2065843 - DNA, 22 bp, Homo sapiens
cacagcggaggagaccagctca

SEQ ID NO: 2065844 - DNA, 23 bp, Homo sapiens
cacagcggaggagaccagctcag

SEQ ID NO: 2065845 - DNA, 22 bp, Homo sapiens
cacagcgtccctagcagtgaac

SEQ ID NO: 2065846 - DNA, 12 bp, Homo sapiens
cacagctatgaa

SEQ ID NO: 2065847 - DNA, 22 bp, Homo sapiens
cacagctcccaccccaccccct

SEQ ID NO: 2065848 - DNA, 21 bp, Homo sapiens
cacagctctccggtctctctc

SEQ ID NO: 2065849 - DNA, 10 bp, Homo sapiens
cacagctctt

SEQ ID NO: 2065850 - DNA, 13 bp, Homo sapiens
cacagctgcagct

SEQ ID NO: 2065851 - DNA, 14 bp, Homo sapiens
cacagctgcagctg

SEQ ID NO: 2065852 - DNA, 16 bp, Homo sapiens
cacagctgcagctggg

SEQ ID NO: 2065853 - DNA, 12 bp, Homo sapiens
cacagctgcttg

SEQ ID NO: 2065854 - DNA, 21 bp, Homo sapiens
cacagcttcatttcctgtgtc

SEQ ID NO: 2065855 - DNA, 21 bp, Homo sapiens
cacaggacacctggccgcctc

SEQ ID NO: 2065856 - DNA, 21 bp, Homo sapiens
cacaggactgattctgggatg

SEQ ID NO: 2065857 - DNA, 12 bp, Homo sapiens
cacaggaggggg

SEQ ID NO: 2065858 - DNA, 16 bp, Homo sapiens
cacaggatcagtctga

SEQ ID NO: 2065859 - DNA, 17 bp, Homo sapiens
cacaggatcagtctgat

SEQ ID NO: 2065860 - DNA, 19 bp, Homo sapiens
cacaggatcctattctcac

SEQ ID NO: 2065861 - DNA, 13 bp, Homo sapiens
cacaggcaactga

SEQ ID NO: 2065862 - DNA, 14 bp, Homo sapiens
cacaggcaactgag

SEQ ID NO: 2065863 - DNA, 20 bp, Homo sapiens
cacaggcaactgaggcagac

SEQ ID NO: 2065864 - DNA, 22 bp, Homo sapiens
cacaggcaactgaggcagacag

SEQ ID NO: 2065865 - DNA, 23 bp, Homo sapiens
cacaggcaactgaggcagacagc

SEQ ID NO: 2065866 - DNA, 18 bp, Homo sapiens
cacaggcatctacacagc

SEQ ID NO: 2065867 - DNA, 20 bp, Homo sapiens
cacaggcatctacacagcct

SEQ ID NO: 2065868 - DNA, 22 bp, Homo sapiens
cacaggcatctacacagcctgg

SEQ ID NO: 2065869 - DNA, 17 bp, Homo sapiens
cacaggcatttcctggg

SEQ ID NO: 2065870 - DNA, 20 bp, Homo sapiens
cacaggcatttcctgggtgg

SEQ ID NO: 2065871 - DNA, 13 bp, Homo sapiens
cacaggccagccc

SEQ ID NO: 2065872 - DNA, 14 bp, Homo sapiens
cacaggccagcccc

SEQ ID NO: 2065873 - DNA, 17 bp, Homo sapiens
cacaggccagccccatc

SEQ ID NO: 2065874 - DNA, 18 bp, Homo sapiens
caatggtttgcaaggaag

SEQ ID NO: 2065875 - DNA, 19 bp, Homo sapiens
caatggtttgcaaggaagc

SEQ ID NO: 2065876 - DNA, 17 bp, Homo sapiens
caatgtagaaagctttg

SEQ ID NO: 2065877 - DNA, 14 bp, Homo sapiens
caatgtcagaaact

SEQ ID NO: 2065878 - DNA, 21 bp, Homo sapiens
caatgtcccttgcacagccca

SEQ ID NO: 2065879 - DNA, 18 bp, Homo sapiens
caatgtgaatcagaccct

SEQ ID NO: 2065880 - DNA, 13 bp, Homo sapiens
caatgtgctctcg

SEQ ID NO: 2065881 - DNA, 21 bp, Homo sapiens
caatgttctgttgtaaagagt

SEQ ID NO: 2065882 - DNA, 13 bp, Homo sapiens
caatgtttctttt

SEQ ID NO: 2065883 - DNA, 18 bp, Homo sapiens
caatgtttcttttatcac

SEQ ID NO: 2065884 - DNA, 14 bp, Homo sapiens
caattaaaatatat

SEQ ID NO: 2065885 - DNA, 20 bp, Homo sapiens
caattaaaatatatataaat

SEQ ID NO: 2065886 - DNA, 21 bp, Homo sapiens
caattaaaatatatataaata

SEQ ID NO: 2065887 - DNA, 12 bp, Homo sapiens
caattaaatgta

SEQ ID NO: 2065888 - DNA, 15 bp, Homo sapiens
caattaataaaaaat

SEQ ID NO: 2065889 - DNA, 13 bp, Homo sapiens
caattaattctta

SEQ ID NO: 2065890 - DNA, 15 bp, Homo sapiens
caattagtacagtag

SEQ ID NO: 2065891 - DNA, 12 bp, Homo sapiens
caattatattgt

SEQ ID NO: 2065892 - DNA, 17 bp, Homo sapiens
caattatgcactggcca

SEQ ID NO: 2065893 - DNA, 15 bp, Homo sapiens
caattatgtgacaac

SEQ ID NO: 2065894 - DNA, 21 bp, Homo sapiens
caattatgtgacaacctttgt

SEQ ID NO: 2065895 - DNA, 22 bp, Homo sapiens
caattatgtgacaacctttgtg

SEQ ID NO: 2065896 - DNA, 20 bp, Homo sapiens
caattattacatttatacat

SEQ ID NO: 2065897 - DNA, 11 bp, Homo sapiens
caattatttca

SEQ ID NO: 2065898 - DNA, 13 bp, Homo sapiens
caattatttcaat

SEQ ID NO: 2065899 - DNA, 13 bp, Homo sapiens
caattcaaaagct

SEQ ID NO: 2065900 - DNA, 14 bp, Homo sapiens
caattcaacacatt

SEQ ID NO: 2065901 - DNA, 22 bp, Homo sapiens
caattcaacacattacttgcac

SEQ ID NO: 2065902 - DNA, 19 bp, Homo sapiens
caccgctgcctaagtggct

SEQ ID NO: 2065903 - DNA, 13 bp, Homo sapiens
caccggcatgctg

SEQ ID NO: 2065904 - DNA, 18 bp, Homo sapiens
caccggcatgctggcctg

SEQ ID NO: 2065905 - DNA, 14 bp, Homo sapiens
caccggcgctgcag

SEQ ID NO: 2065906 - DNA, 13 bp, Homo sapiens
caccgggagcctc

SEQ ID NO: 2065907 - DNA, 21 bp, Homo sapiens
caccgggagcctccccctcag

SEQ ID NO: 2065908 - DNA, 14 bp, Homo sapiens
caccgggcactcag

SEQ ID NO: 2065909 - DNA, 18 bp, Homo sapiens
caccgggccacagagaaa

SEQ ID NO: 2065910 - DNA, 19 bp, Homo sapiens
caccgggccactccttcct

SEQ ID NO: 2065911 - DNA, 16 bp, Homo sapiens
caccgtccctcagtga

SEQ ID NO: 2065912 - DNA, 18 bp, Homo sapiens
caccgtctacagatggct

SEQ ID NO: 2065913 - DNA, 16 bp, Homo sapiens
caccgtggaccttcct

SEQ ID NO: 2065914 - DNA, 13 bp, Homo sapiens
cacctaaagaaaa

SEQ ID NO: 2065915 - DNA, 14 bp, Homo sapiens
cacctacatcccca

SEQ ID NO: 2065916 - DNA, 16 bp, Homo sapiens
cacctacatccccagg

SEQ ID NO: 2065917 - DNA, 14 bp, Homo sapiens
cacctaccatgctg

SEQ ID NO: 2065918 - DNA, 15 bp, Homo sapiens
cacctaccatgctgc

SEQ ID NO: 2065919 - DNA, 21 bp, Homo sapiens
cacctacttgtgactgaaggg

SEQ ID NO: 2065920 - DNA, 18 bp, Homo sapiens
cacctaggccactcctcc

SEQ ID NO: 2065921 - DNA, 19 bp, Homo sapiens
cacctaggccactcctcca

SEQ ID NO: 2065922 - DNA, 17 bp, Homo sapiens
cacctatcacccaggct

SEQ ID NO: 2065923 - DNA, 15 bp, Homo sapiens
cacctcactcctgtt

SEQ ID NO: 2065924 - DNA, 13 bp, Homo sapiens
cacctcagacaat

SEQ ID NO: 2065925 - DNA, 15 bp, Homo sapiens
cacctcagccttgga

SEQ ID NO: 2065926 - DNA, 14 bp, Homo sapiens
cacctcatgcctgg

SEQ ID NO: 2065927 - DNA, 23 bp, Homo sapiens
cacctcatgcctggcccccctcc

SEQ ID NO: 2065928 - DNA, 16 bp, Homo sapiens
cacctcccaaggactt

SEQ ID NO: 2065929 - DNA, 14 bp, Homo sapiens
cacctcccacccca

SEQ ID NO: 2065930 - DNA, 15 bp, Homo sapiens
cacctcccaccccac

SEQ ID NO: 2065931 - DNA, 19 bp, Homo sapiens
cacctcccaccccactcca

SEQ ID NO: 2065932 - DNA, 14 bp, Homo sapiens
cacctccccccact

SEQ ID NO: 2065933 - DNA, 21 bp, Homo sapiens
cacctccccccactgcaggcc

SEQ ID NO: 2065934 - DNA, 23 bp, Homo sapiens
cacctccccccactgcaggcccc

SEQ ID NO: 2065935 - DNA, 13 bp, Homo sapiens
cacctcccctatc

SEQ ID NO: 2065936 - DNA, 19 bp, Homo sapiens
cacctccctgaaccatccc

SEQ ID NO: 2065937 - DNA, 21 bp, Homo sapiens
cacctccgctgggaggaacct

SEQ ID NO: 2065938 - DNA, 21 bp, Homo sapiens
cacctcctagaggtgggcagc

SEQ ID NO: 2065939 - DNA, 19 bp, Homo sapiens
cacctcctgagaaggcgag

SEQ ID NO: 2065940 - DNA, 16 bp, Homo sapiens
cacctccttgctttgc

SEQ ID NO: 2065941 - DNA, 13 bp, Homo sapiens
cacctctcaatat

SEQ ID NO: 2065942 - DNA, 21 bp, Homo sapiens
cacctctcaatattcaataaa

SEQ ID NO: 2065943 - DNA, 23 bp, Homo sapiens
cacctctcaatattcaataaagc

SEQ ID NO: 2065944 - DNA, 12 bp, Homo sapiens
cacctctcttca

SEQ ID NO: 2065945 - DNA, 17 bp, Homo sapiens
cacctctggatccctgg

SEQ ID NO: 2065946 - DNA, 13 bp, Homo sapiens
cacctctggcttt

SEQ ID NO: 2065947 - DNA, 23 bp, Homo sapiens
cacctctggctttgtctctagcc

SEQ ID NO: 2065948 - DNA, 13 bp, Homo sapiens
cacctctgggctt

SEQ ID NO: 2065949 - DNA, 13 bp, Homo sapiens
cacctctgtaatt

SEQ ID NO: 2065950 - DNA, 15 bp, Homo sapiens
cacctcttctgccag

SEQ ID NO: 2065951 - DNA, 19 bp, Homo sapiens
cacctgaaccccatgggct

SEQ ID NO: 2065952 - DNA, 14 bp, Homo sapiens
cacctgaagactca

SEQ ID NO: 2065953 - DNA, 23 bp, Homo sapiens
cacctgaagactcattcttctgt

SEQ ID NO: 2065954 - DNA, 17 bp, Homo sapiens
cacctgacgtcagtagt

SEQ ID NO: 2065955 - DNA, 22 bp, Homo sapiens
cacctgaggctgaggcaggaga

SEQ ID NO: 2065956 - DNA, 23 bp, Homo sapiens
cacctgagtcaccctacctgtgc

SEQ ID NO: 2065957 - DNA, 15 bp, Homo sapiens
cacctgcaagtgccc

SEQ ID NO: 2065958 - DNA, 22 bp, Homo sapiens
cacctgcaagtgcccgccctgc

SEQ ID NO: 2065959 - DNA, 14 bp, Homo sapiens
cacctgcacctccc

SEQ ID NO: 2065960 - DNA, 22 bp, Homo sapiens
cacctgcacctccccccactgc

SEQ ID NO: 2065961 - DNA, 10 bp, Homo sapiens
cacctgccac

SEQ ID NO: 2065962 - DNA, 12 bp, Homo sapiens
cacctgccagcc

SEQ ID NO: 2065963 - DNA, 17 bp, Homo sapiens
cacctgccagccatcac

SEQ ID NO: 2065964 - DNA, 15 bp, Homo sapiens
cacctgccagcctgg

SEQ ID NO: 2065965 - DNA, 22 bp, Homo sapiens
cacctgccatttgcaccctccg

SEQ ID NO: 2065966 - DNA, 19 bp, Homo sapiens
cacctgcccaacctgctct

SEQ ID NO: 2065967 - DNA, 13 bp, Homo sapiens
cacctgccccagc

SEQ ID NO: 2065968 - DNA, 12 bp, Homo sapiens
cacctgccctgc

SEQ ID NO: 2065969 - DNA, 14 bp, Homo sapiens
cacctgccctgccc

SEQ ID NO: 2065970 - DNA, 16 bp, Homo sapiens
cacctgccctgccctg

SEQ ID NO: 2065971 - DNA, 17 bp, Homo sapiens
cacctgccctgccctgc

SEQ ID NO: 2065972 - DNA, 23 bp, Homo sapiens
cacctgccgacctcgtcctcccc

SEQ ID NO: 2065973 - DNA, 17 bp, Homo sapiens
cacctgcctatccatcc

SEQ ID NO: 2065974 - DNA, 15 bp, Homo sapiens
cacctgcctgccctc

SEQ ID NO: 2065975 - DNA, 18 bp, Homo sapiens
cacctgctgagagaccca

SEQ ID NO: 2065976 - DNA, 19 bp, Homo sapiens
cacctgctgagagacccaa

SEQ ID NO: 2065977 - DNA, 22 bp, Homo sapiens
cacctgctgagagacccaagga

SEQ ID NO: 2065978 - DNA, 10 bp, Homo sapiens
cacctgctgg

SEQ ID NO: 2065979 - DNA, 11 bp, Homo sapiens
cacctgctgga

SEQ ID NO: 2065980 - DNA, 13 bp, Homo sapiens
cacctgctggaaa

SEQ ID NO: 2065981 - DNA, 22 bp, Homo sapiens
cacctgctggaaaccacacttc

SEQ ID NO: 2065982 - DNA, 16 bp, Homo sapiens
cacctggccccatgtc

SEQ ID NO: 2065983 - DNA, 22 bp, Homo sapiens
cacctggccgcctccaggagcc

SEQ ID NO: 2065984 - DNA, 18 bp, Homo sapiens
cacctggcctgctgggaa

SEQ ID NO: 2065985 - DNA, 19 bp, Homo sapiens
cacctggcctgctgggaac

SEQ ID NO: 2065986 - DNA, 19 bp, Homo sapiens
cacctgggccctggggcct

SEQ ID NO: 2065987 - DNA, 20 bp, Homo sapiens
cacctgggccctggggcctg

SEQ ID NO: 2065988 - DNA, 15 bp, Homo sapiens
cacctgggcctttcc

SEQ ID NO: 2065989 - DNA, 18 bp, Homo sapiens
cacctggtttctgttctg

SEQ ID NO: 2065990 - DNA, 16 bp, Homo sapiens
cacctgtactcaggag

SEQ ID NO: 2065991 - DNA, 15 bp, Homo sapiens
cacctgtcccagaaa

SEQ ID NO: 2065992 - DNA, 11 bp, Homo sapiens
cacctgtctgt

SEQ ID NO: 2065993 - DNA, 13 bp, Homo sapiens
cacctgtctgtct

SEQ ID NO: 2065994 - DNA, 16 bp, Homo sapiens
cacctgtctgtctgtc

SEQ ID NO: 2065995 - DNA, 23 bp, Homo sapiens
cacctgtgcagcgaagcttagcg

SEQ ID NO: 2065996 - DNA, 17 bp, Homo sapiens
cacctgtggtgcctgcc

SEQ ID NO: 2065997 - DNA, 20 bp, Homo sapiens
cacctgttaaaatgtacact

SEQ ID NO: 2065998 - DNA, 18 bp, Homo sapiens
cacctgttcaggagctga

SEQ ID NO: 2065999 - DNA, 15 bp, Homo sapiens
cacctgttgcacctc

SEQ ID NO: 2066000 - DNA, 20 bp, Homo sapiens
cacctgtttttaagctgttt

SEQ ID NO: 2066001 - DNA, 18 bp, Homo sapiens
caccttaatattattggg

SEQ ID NO: 2066002 - DNA, 16 bp, Homo sapiens
caccttagcagctctt

SEQ ID NO: 2066003 - DNA, 13 bp, Homo sapiens
caccttagctggc

SEQ ID NO: 2066004 - DNA, 15 bp, Homo sapiens
caccttagtggcttt

SEQ ID NO: 2066005 - DNA, 14 bp, Homo sapiens
caccttatgtatta

SEQ ID NO: 2066006 - DNA, 22 bp, Homo sapiens
caccttatgtattattttctat

SEQ ID NO: 2066007 - DNA, 18 bp, Homo sapiens
caccttcaattcctgggc

SEQ ID NO: 2066008 - DNA, 19 bp, Homo sapiens
caccttcaccttcatccat

SEQ ID NO: 2066009 - DNA, 15 bp, Homo sapiens
cacgtccccctgggg

SEQ ID NO: 2066010 - DNA, 16 bp, Homo sapiens
cacgtccccctggggc

SEQ ID NO: 2066011 - DNA, 16 bp, Homo sapiens
cacgtctgccaggccc

SEQ ID NO: 2066012 - DNA, 14 bp, Homo sapiens
cacgtgccaggccc

SEQ ID NO: 2066013 - DNA, 15 bp, Homo sapiens
cacgtgccaggcccg

SEQ ID NO: 2066014 - DNA, 20 bp, Homo sapiens
cacgtggaggtgaagtccct

SEQ ID NO: 2066015 - DNA, 21 bp, Homo sapiens
cacgtggaggtgaagtccctg

SEQ ID NO: 2066016 - DNA, 15 bp, Homo sapiens
cacgtgtgcagactg

SEQ ID NO: 2066017 - DNA, 13 bp, Homo sapiens
cacgttctatata

SEQ ID NO: 2066018 - DNA, 20 bp, Homo sapiens
cacgttctatattgtgccaa

SEQ ID NO: 2066019 - DNA, 17 bp, Homo sapiens
cactaaacagactattt

SEQ ID NO: 2066020 - DNA, 13 bp, Homo sapiens
cactaaagcagtg

SEQ ID NO: 2066021 - DNA, 21 bp, Homo sapiens
cactaacggttgagttttgac

SEQ ID NO: 2066022 - DNA, 20 bp, Homo sapiens
cactaagctttctcctttga

SEQ ID NO: 2066023 - DNA, 22 bp, Homo sapiens
cactaagtagaataaagaaaaa

SEQ ID NO: 2066024 - DNA, 14 bp, Homo sapiens
cactaagttatagt

SEQ ID NO: 2066025 - DNA, 18 bp, Homo sapiens
cactacactccagcctga

SEQ ID NO: 2066026 - DNA, 21 bp, Homo sapiens
cactacactccagcctgagca

SEQ ID NO: 2066027 - DNA, 17 bp, Homo sapiens
cactaccttctgacctc

SEQ ID NO: 2066028 - DNA, 23 bp, Homo sapiens
cactagagctgagagtctgaaag

SEQ ID NO: 2066029 - DNA, 13 bp, Homo sapiens
cactagagctggg

SEQ ID NO: 2066030 - DNA, 16 bp, Homo sapiens
cactagcctctccagg

SEQ ID NO: 2066031 - DNA, 17 bp, Homo sapiens
cactagcctctccagga

SEQ ID NO: 2066032 - DNA, 16 bp, Homo sapiens
cactagcctgtgatta

SEQ ID NO: 2066033 - DNA, 21 bp, Homo sapiens
cactagggcagggacaggata

SEQ ID NO: 2066034 - DNA, 16 bp, Homo sapiens
cactatgaaaatcagt

SEQ ID NO: 2066035 - DNA, 15 bp, Homo sapiens
cactatgattttcta

SEQ ID NO: 2066036 - DNA, 15 bp, Homo sapiens
cactatgctatttct

SEQ ID NO: 2066037 - DNA, 18 bp, Homo sapiens
cactatgttgcccaggct

SEQ ID NO: 2066038 - DNA, 13 bp, Homo sapiens
cactattagagaa

SEQ ID NO: 2066039 - DNA, 15 bp, Homo sapiens
cactattgcattgtt

SEQ ID NO: 2066040 - DNA, 22 bp, Homo sapiens
cactcaaaaaggtgtgtcaaag

SEQ ID NO: 2066041 - DNA, 17 bp, Homo sapiens
cactcaaacaatcatga

SEQ ID NO: 2066042 - DNA, 14 bp, Homo sapiens
cactcaccagggtc

SEQ ID NO: 2066043 - DNA, 14 bp, Homo sapiens
cactcactccagcc

SEQ ID NO: 2066044 - DNA, 19 bp, Homo sapiens
cactcagaagacactgatg

SEQ ID NO: 2066045 - DNA, 22 bp, Homo sapiens
cactcagaagacactgatgggc

SEQ ID NO: 2066046 - DNA, 13 bp, Homo sapiens
cactcagaagcct

SEQ ID NO: 2066047 - DNA, 15 bp, Homo sapiens
cactcagaagcctgg

SEQ ID NO: 2066048 - DNA, 16 bp, Homo sapiens
cactcagaagcctggg

SEQ ID NO: 2066049 - DNA, 17 bp, Homo sapiens
cactcagaagcctgggg

SEQ ID NO: 2066050 - DNA, 19 bp, Homo sapiens
cactcagaagcctgggggc

SEQ ID NO: 2066051 - DNA, 23 bp, Homo sapiens
cactcagaagcctgggggcctgg

SEQ ID NO: 2066052 - DNA, 21 bp, Homo sapiens
cactcagccgcagacaagtaa

SEQ ID NO: 2066053 - DNA, 21 bp, Homo sapiens
cactcaggaggctgaggcagg

SEQ ID NO: 2066054 - DNA, 19 bp, Homo sapiens
cactcaggccaacaagcca

SEQ ID NO: 2066055 - DNA, 17 bp, Homo sapiens
tatacctataatgtgtg

SEQ ID NO: 2066056 - DNA, 18 bp, Homo sapiens
tatacctataatgtgtgt

SEQ ID NO: 2066057 - DNA, 22 bp, Homo sapiens
tatacctgtgtttcttgcctca

SEQ ID NO: 2066058 - DNA, 23 bp, Homo sapiens
tatacctgtgtttcttgcctcat

SEQ ID NO: 2066059 - DNA, 13 bp, Homo sapiens
tataccttctcaa

SEQ ID NO: 2066060 - DNA, 16 bp, Homo sapiens
tatactatatttatgg

SEQ ID NO: 2066061 - DNA, 19 bp, Homo sapiens
tatacttttttcttattta

SEQ ID NO: 2066062 - DNA, 20 bp, Homo sapiens
tatagaatacttttttctag

SEQ ID NO: 2066063 - DNA, 22 bp, Homo sapiens
tatagaatacttttttctagtt

SEQ ID NO: 2066064 - DNA, 23 bp, Homo sapiens
tatagagaaaaactttcattttt

SEQ ID NO: 2066065 - DNA, 21 bp, Homo sapiens
tatagagatatttttgtacgt

SEQ ID NO: 2066066 - DNA, 16 bp, Homo sapiens
tatagagttcatccca

SEQ ID NO: 2066067 - DNA, 18 bp, Homo sapiens
tatagcagcaaaaatata

SEQ ID NO: 2066068 - DNA, 22 bp, Homo sapiens
tatagcagcaaaaatataaaat

SEQ ID NO: 2066069 - DNA, 21 bp, Homo sapiens
tatagccacatccctttgaaa

SEQ ID NO: 2066070 - DNA, 13 bp, Homo sapiens
tatagcccaggtc

SEQ ID NO: 2066071 - DNA, 18 bp, Homo sapiens
tatagcctaggtgacaga

SEQ ID NO: 2066072 - DNA, 20 bp, Homo sapiens
tatagcctaggtgacagagt

SEQ ID NO: 2066073 - DNA, 17 bp, Homo sapiens
tatagctatcatttctt

SEQ ID NO: 2066074 - DNA, 21 bp, Homo sapiens
tataggatttatttaaaatag

SEQ ID NO: 2066075 - DNA, 21 bp, Homo sapiens
tataggtgctacaaaaacaca

SEQ ID NO: 2066076 - DNA, 22 bp, Homo sapiens
tatagtagtcaattagtacagt

SEQ ID NO: 2066077 - DNA, 19 bp, Homo sapiens
tatagttaggatagcattt

SEQ ID NO: 2066078 - DNA, 17 bp, Homo sapiens
tatagtttactatttta

SEQ ID NO: 2066079 - DNA, 13 bp, Homo sapiens
tatagtttcagat

SEQ ID NO: 2066080 - DNA, 18 bp, Homo sapiens
tatagtttgtacatgcat

SEQ ID NO: 2066081 - DNA, 19 bp, Homo sapiens
tatataaaaagaaaagata

SEQ ID NO: 2066082 - DNA, 23 bp, Homo sapiens
tatataaaaagaaaagataaaga

SEQ ID NO: 2066083 - DNA, 15 bp, Homo sapiens
tatataaaaatatat

SEQ ID NO: 2066084 - DNA, 11 bp, Homo sapiens
tatataaatat

SEQ ID NO: 2066085 - DNA, 18 bp, Homo sapiens
tatataatggtttactgc

SEQ ID NO: 2066086 - DNA, 17 bp, Homo sapiens
tatataattttgcagca

SEQ ID NO: 2066087 - DNA, 17 bp, Homo sapiens
tatatacaataacataa

SEQ ID NO: 2066088 - DNA, 14 bp, Homo sapiens
tatatacacataca

SEQ ID NO: 2066089 - DNA, 13 bp, Homo sapiens
tatatacatatgt

SEQ ID NO: 2066090 - DNA, 19 bp, Homo sapiens
tatcagaaaagtagaatta

SEQ ID NO: 2066091 - DNA, 20 bp, Homo sapiens
tatcagaaaagtagaattat

SEQ ID NO: 2066092 - DNA, 21 bp, Homo sapiens
tatcagaaaagtagaattata

SEQ ID NO: 2066093 - DNA, 21 bp, Homo sapiens
tatcagaagaccacaaaaatt

SEQ ID NO: 2066094 - DNA, 14 bp, Homo sapiens
tatcagaatctgtg

SEQ ID NO: 2066095 - DNA, 18 bp, Homo sapiens
tatcagaatctgtgtgaa

SEQ ID NO: 2066096 - DNA, 18 bp, Homo sapiens
tatcagacctctgatccc

SEQ ID NO: 2066097 - DNA, 18 bp, Homo sapiens
tatcagctacttaagaga

SEQ ID NO: 2066098 - DNA, 19 bp, Homo sapiens
tatcagctacttaagagaa

SEQ ID NO: 2066099 - DNA, 20 bp, Homo sapiens
tatcagctacttaagagaaa

SEQ ID NO: 2066100 - DNA, 21 bp, Homo sapiens
tatcagctacttaagagaaat

SEQ ID NO: 2066101 - DNA, 15 bp, Homo sapiens
tatcaggcacaggca

SEQ ID NO: 2066102 - DNA, 15 bp, Homo sapiens
tatcaggtctcccac

SEQ ID NO: 2066103 - DNA, 17 bp, Homo sapiens
tatcaggtgctgccatc

SEQ ID NO: 2066104 - DNA, 19 bp, Homo sapiens
tatcaggtgctgccatcca

SEQ ID NO: 2066105 - DNA, 22 bp, Homo sapiens
tatcagtcataactaaataaag

SEQ ID NO: 2066106 - DNA, 20 bp, Homo sapiens
tatcagtgacagagttcact

SEQ ID NO: 2066107 - DNA, 19 bp, Homo sapiens
tatcagtgatggtctcaca

SEQ ID NO: 2066108 - DNA, 23 bp, Homo sapiens
tatcagtgatggtctcacagagc

SEQ ID NO: 2066109 - DNA, 12 bp, Homo sapiens
tatcataaagta

SEQ ID NO: 2066110 - DNA, 23 bp, Homo sapiens
tatcatagaaatgtaacttttgt

SEQ ID NO: 2066111 - DNA, 14 bp, Homo sapiens
tatcatgacatgtt

SEQ ID NO: 2066112 - DNA, 15 bp, Homo sapiens
tatcatggagtgacg

SEQ ID NO: 2066113 - DNA, 13 bp, Homo sapiens
tatcatttctaat

SEQ ID NO: 2066114 - DNA, 18 bp, Homo sapiens
tatcatttctaattttaa

SEQ ID NO: 2066115 - DNA, 14 bp, Homo sapiens
tatccacccagccc

SEQ ID NO: 2066116 - DNA, 14 bp, Homo sapiens
tatccacctggggt

SEQ ID NO: 2066117 - DNA, 18 bp, Homo sapiens
tatccactttgcacagct

SEQ ID NO: 2066118 - DNA, 11 bp, Homo sapiens
tatccaggact

SEQ ID NO: 2066119 - DNA, 15 bp, Homo sapiens
tatcccaagccaacc

SEQ ID NO: 2066120 - DNA, 20 bp, Homo sapiens
tatcccacccaacagctcag

SEQ ID NO: 2066121 - DNA, 21 bp, Homo sapiens
tatcccacccaacagctcaga

SEQ ID NO: 2066122 - DNA, 23 bp, Homo sapiens
tatcccacccaacagctcagaga

SEQ ID NO: 2066123 - DNA, 19 bp, Homo sapiens
tatcccccccctgtatagt

SEQ ID NO: 2066124 - DNA, 15 bp, Homo sapiens
tatcctacaacaaga

SEQ ID NO: 2066125 - DNA, 14 bp, Homo sapiens
tatcctgaaatttc

SEQ ID NO: 2066126 - DNA, 14 bp, Homo sapiens
tatcctgataaaca

SEQ ID NO: 2066127 - DNA, 21 bp, Homo sapiens
tatcctgcgggttttaattta

SEQ ID NO: 2066128 - DNA, 18 bp, Homo sapiens
tatcctgctagctgtaga

SEQ ID NO: 2066129 - DNA, 19 bp, Homo sapiens
tatccttaggaaaatgctt

SEQ ID NO: 2066130 - DNA, 18 bp, Homo sapiens
tatccttggagagcagct

SEQ ID NO: 2066131 - DNA, 20 bp, Homo sapiens
tatccttggagagcagctgg

SEQ ID NO: 2066132 - DNA, 16 bp, Homo sapiens
tatcctttgccccaag

SEQ ID NO: 2066133 - DNA, 12 bp, Homo sapiens
tatcgactttat

SEQ ID NO: 2066134 - DNA, 19 bp, Homo sapiens
tatctaagttaatttaaag

SEQ ID NO: 2066135 - DNA, 20 bp, Homo sapiens
tatctaatacctctgtgtgc

SEQ ID NO: 2066136 - DNA, 21 bp, Homo sapiens
tatctaatatgtaacaagcca

SEQ ID NO: 2066137 - DNA, 14 bp, Homo sapiens
tatctaatttatac

SEQ ID NO: 2066138 - DNA, 19 bp, Homo sapiens
tatctaatttatacaaaat

SEQ ID NO: 2066139 - DNA, 17 bp, Homo sapiens
tatctagaaagaaaaga

SEQ ID NO: 2066140 - DNA, 15 bp, Homo sapiens
tatctatatctctaa

SEQ ID NO: 2066141 - DNA, 23 bp, Homo sapiens
tatctatatctctaaactgctgt

SEQ ID NO: 2066142 - DNA, 18 bp, Homo sapiens
tatctatggccctgcaaa

SEQ ID NO: 2066143 - DNA, 17 bp, Homo sapiens
tatctcaaaactgcact

SEQ ID NO: 2066144 - DNA, 23 bp, Homo sapiens
tatctcatcaacaaagaaatatt

SEQ ID NO: 2066145 - DNA, 22 bp, Homo sapiens
tatctctaggctgttttctcca

SEQ ID NO: 2066146 - DNA, 18 bp, Homo sapiens
tatctctgtgtgcacaaa

SEQ ID NO: 2066147 - DNA, 13 bp, Homo sapiens
tatctgaaaactg

SEQ ID NO: 2066148 - DNA, 15 bp, Homo sapiens
tatctgaaaactgga

SEQ ID NO: 2066149 - DNA, 21 bp, Homo sapiens
tatctgaaggagattttcctt

SEQ ID NO: 2066150 - DNA, 17 bp, Homo sapiens
tatctgaggcactgata

SEQ ID NO: 2066151 - DNA, 11 bp, Homo sapiens
tatctgcattt

SEQ ID NO: 2066152 - DNA, 16 bp, Homo sapiens
tatctgcctggcctgg

SEQ ID NO: 2066153 - DNA, 18 bp, Homo sapiens
tatctgcctggcctggct

SEQ ID NO: 2066154 - DNA, 21 bp, Homo sapiens
tatctgcctggcctggctccc

SEQ ID NO: 2066155 - DNA, 22 bp, Homo sapiens
tatctgtattttcatttaacta

SEQ ID NO: 2066156 - DNA, 21 bp, Homo sapiens
tatctgtcatctctctggggc

SEQ ID NO: 2066157 - DNA, 20 bp, Homo sapiens
tatctgtcatttgagcaggg

SEQ ID NO: 2066158 - DNA, 23 bp, Homo sapiens
tatctgtcatttgagcagggctc

SEQ ID NO: 2066159 - DNA, 22 bp, Homo sapiens
tatcttatttaatttttgcaat

SEQ ID NO: 2066160 - DNA, 14 bp, Homo sapiens
tatcttatttatat

SEQ ID NO: 2066161 - DNA, 17 bp, Homo sapiens
tatcttatttatatatg

SEQ ID NO: 2066162 - DNA, 12 bp, Homo sapiens
tatcttcacata

SEQ ID NO: 2066163 - DNA, 23 bp, Homo sapiens
tatcttctccattctagatgctt

SEQ ID NO: 2066164 - DNA, 15 bp, Homo sapiens
tatcttgtctctggg

SEQ ID NO: 2066165 - DNA, 23 bp, Homo sapiens
tatcttttctattgtttattctt

SEQ ID NO: 2066166 - DNA, 14 bp, Homo sapiens
tatgaaaaagaaga

SEQ ID NO: 2066167 - DNA, 15 bp, Homo sapiens
tatgaaaagaataaa

SEQ ID NO: 2066168 - DNA, 20 bp, Homo sapiens
tatgaaagatggctgtgcct

SEQ ID NO: 2066169 - DNA, 21 bp, Homo sapiens
tatgaaatgataaagatgtca

SEQ ID NO: 2066170 - DNA, 20 bp, Homo sapiens
tatgaacaaagaaaaaaata

SEQ ID NO: 2066171 - DNA, 16 bp, Homo sapiens
tatgaacttgaggaca

SEQ ID NO: 2066172 - DNA, 19 bp, Homo sapiens
tatgaacttgaggacacat

SEQ ID NO: 2066173 - DNA, 21 bp, Homo sapiens
tatgaaggctgtacactgcac

SEQ ID NO: 2066174 - DNA, 18 bp, Homo sapiens
tatgaataaagacaccta

SEQ ID NO: 2066175 - DNA, 16 bp, Homo sapiens
tatgaatacagggcat

SEQ ID NO: 2066176 - DNA, 18 bp, Homo sapiens
tatgaatgtgcatttctt

SEQ ID NO: 2066177 - DNA, 13 bp, Homo sapiens
tatgaatgttctt

SEQ ID NO: 2066178 - DNA, 19 bp, Homo sapiens
tatgacaatcctgaagaaa

SEQ ID NO: 2066179 - DNA, 15 bp, Homo sapiens
tatgacatgccaccc

SEQ ID NO: 2066180 - DNA, 21 bp, Homo sapiens
tatgacatgccaccctctcca

SEQ ID NO: 2066181 - DNA, 23 bp, Homo sapiens
tatgacatgccaccctctccatg

SEQ ID NO: 2066182 - DNA, 16 bp, Homo sapiens
tatgaccttctaggaa

SEQ ID NO: 2066183 - DNA, 21 bp, Homo sapiens
tatgacttgggcacccccagc

SEQ ID NO: 2066184 - DNA, 22 bp, Homo sapiens
tatgagaacaagtcacagctgc

SEQ ID NO: 2066185 - DNA, 14 bp, Homo sapiens
tatgagagaatcac

SEQ ID NO: 2066186 - DNA, 14 bp, Homo sapiens
tatgagctcttcat

SEQ ID NO: 2066187 - DNA, 12 bp, Homo sapiens
tatgagctgagg

SEQ ID NO: 2066188 - DNA, 16 bp, Homo sapiens
tatgagctgagggggg

SEQ ID NO: 2066189 - DNA, 23 bp, Homo sapiens
tatgaggacttgtgtctctgtgc

SEQ ID NO: 2066190 - DNA, 13 bp, Homo sapiens
tatgaggcattga

SEQ ID NO: 2066191 - DNA, 15 bp, Homo sapiens
tatgagtcagtctct

SEQ ID NO: 2066192 - DNA, 16 bp, Homo sapiens
tatgagtcagtctctc

SEQ ID NO: 2066193 - DNA, 14 bp, Homo sapiens
tatgatactgatgc

SEQ ID NO: 2066194 - DNA, 18 bp, Homo sapiens
tatgatattgcatatgca

SEQ ID NO: 2066195 - DNA, 17 bp, Homo sapiens
tatgatcacagtgactt

SEQ ID NO: 2066196 - DNA, 14 bp, Homo sapiens
tatgatcacggctc

SEQ ID NO: 2066197 - DNA, 15 bp, Homo sapiens
tatgatcccagcact

SEQ ID NO: 2066198 - DNA, 15 bp, Homo sapiens
tatgatcgcgccact

SEQ ID NO: 2066199 - DNA, 15 bp, Homo sapiens
tatgatctaatacaa

SEQ ID NO: 2066200 - DNA, 18 bp, Homo sapiens
tatgatctaatacaaaga

SEQ ID NO: 2066201 - DNA, 21 bp, Homo sapiens
tatgatgactcccttaaaata

SEQ ID NO: 2066202 - DNA, 14 bp, Homo sapiens
tatgatgttaaaaa

SEQ ID NO: 2066203 - DNA, 12 bp, Homo sapiens
tatgatttaaaa

SEQ ID NO: 2066204 - DNA, 17 bp, Homo sapiens
tattataaataaatgcc

SEQ ID NO: 2066205 - DNA, 18 bp, Homo sapiens
tattataaataaatgcca

SEQ ID NO: 2066206 - DNA, 19 bp, Homo sapiens
tattataaatccaaagtaa

SEQ ID NO: 2066207 - DNA, 15 bp, Homo sapiens
tattataactgcata

SEQ ID NO: 2066208 - DNA, 23 bp, Homo sapiens
tattataatataatatggaacct

SEQ ID NO: 2066209 - DNA, 16 bp, Homo sapiens
tattatccccatttct

SEQ ID NO: 2066210 - DNA, 19 bp, Homo sapiens
tattatgaggctattaaaa

SEQ ID NO: 2066211 - DNA, 21 bp, Homo sapiens
tattatggaagattttaaatt

SEQ ID NO: 2066212 - DNA, 17 bp, Homo sapiens
tattatggtgtaatgca

SEQ ID NO: 2066213 - DNA, 20 bp, Homo sapiens
tattatggtgtaatgcacaa

SEQ ID NO: 2066214 - DNA, 23 bp, Homo sapiens
tattatggtgtaatgcacaattt

SEQ ID NO: 2066215 - DNA, 19 bp, Homo sapiens
tattattacttatttttga

SEQ ID NO: 2066216 - DNA, 16 bp, Homo sapiens
tattattcccattcta

SEQ ID NO: 2066217 - DNA, 15 bp, Homo sapiens
tattcaaacagtctc

SEQ ID NO: 2066218 - DNA, 23 bp, Homo sapiens
tattcaaacagtctcaggaaatc

SEQ ID NO: 2066219 - DNA, 17 bp, Homo sapiens
tattcaattcctctggg

SEQ ID NO: 2066220 - DNA, 18 bp, Homo sapiens
tattcaattcctctggga

SEQ ID NO: 2066221 - DNA, 14 bp, Homo sapiens
tattcactgtaagt

SEQ ID NO: 2066222 - DNA, 15 bp, Homo sapiens
tattcactgtaagtt

SEQ ID NO: 2066223 - DNA, 18 bp, Homo sapiens
tattcagacaagcaacag

SEQ ID NO: 2066224 - DNA, 14 bp, Homo sapiens
tattcagagatgta

SEQ ID NO: 2066225 - DNA, 19 bp, Homo sapiens
tattcagagatgtaccatg

SEQ ID NO: 2066226 - DNA, 14 bp, Homo sapiens
tattcagcttcatt

SEQ ID NO: 2066227 - DNA, 16 bp, Homo sapiens
tattcagcttcatttg

SEQ ID NO: 2066228 - DNA, 17 bp, Homo sapiens
tattcagcttcatttgt

SEQ ID NO: 2066229 - DNA, 18 bp, Homo sapiens
tattcaggcactgagaat

SEQ ID NO: 2066230 - DNA, 22 bp, Homo sapiens
tattcagtgctgtggcctgggc

SEQ ID NO: 2066231 - DNA, 18 bp, Homo sapiens
tattcatgccatctgttt

SEQ ID NO: 2066232 - DNA, 20 bp, Homo sapiens
tattcatgtaataaatctga

SEQ ID NO: 2066233 - DNA, 13 bp, Homo sapiens
tattcatttaaaa

SEQ ID NO: 2066234 - DNA, 15 bp, Homo sapiens
tattcatttaaaatg

SEQ ID NO: 2066235 - DNA, 16 bp, Homo sapiens
tattcatttaaaatga

SEQ ID NO: 2066236 - DNA, 16 bp, Homo sapiens
tattccaccattcaca

SEQ ID NO: 2066237 - DNA, 17 bp, Homo sapiens
tattccccattcttcct

SEQ ID NO: 2066238 - DNA, 19 bp, Homo sapiens
tattcccttttatttccaa

SEQ ID NO: 2066239 - DNA, 17 bp, Homo sapiens
tattcctatctgtggat

SEQ ID NO: 2066240 - DNA, 17 bp, Homo sapiens
tattcctgaccctccct

SEQ ID NO: 2066241 - DNA, 17 bp, Homo sapiens
tattcctgcatttgtga

SEQ ID NO: 2066242 - DNA, 21 bp, Homo sapiens
tattcctgcatttgtgaaatg

SEQ ID NO: 2066243 - DNA, 20 bp, Homo sapiens
tattcctggtattatttaca

SEQ ID NO: 2066244 - DNA, 22 bp, Homo sapiens
tattccttgatactaaaagttc

SEQ ID NO: 2066245 - DNA, 19 bp, Homo sapiens
tattccttttgtgtacagt

SEQ ID NO: 2066246 - DNA, 14 bp, Homo sapiens
tattctaattttat

SEQ ID NO: 2066247 - DNA, 16 bp, Homo sapiens
tattctcctcctccct

SEQ ID NO: 2066248 - DNA, 21 bp, Homo sapiens
tattctcttaatttttcttaa

SEQ ID NO: 2066249 - DNA, 16 bp, Homo sapiens
tattctgacttcctct

SEQ ID NO: 2066250 - DNA, 20 bp, Homo sapiens
tattctggaaaaaaaatata

SEQ ID NO: 2066251 - DNA, 17 bp, Homo sapiens
tattctgttttcttgtt

SEQ ID NO: 2066252 - DNA, 22 bp, Homo sapiens
tattcttaagggaacttccaca

SEQ ID NO: 2066253 - DNA, 14 bp, Homo sapiens
tattcttcataaca

SEQ ID NO: 2066254 - DNA, 15 bp, Homo sapiens
tattgaacctaggac

SEQ ID NO: 2066255 - DNA, 17 bp, Homo sapiens
tattgaagaaaagcact

SEQ ID NO: 2066256 - DNA, 18 bp, Homo sapiens
tattgaagaaaagcactt

SEQ ID NO: 2066257 - DNA, 13 bp, Homo sapiens
tattgaagaaaca

SEQ ID NO: 2066258 - DNA, 14 bp, Homo sapiens
tattgaagaaacag

SEQ ID NO: 2066259 - DNA, 15 bp, Homo sapiens
tattgaatatatcag

SEQ ID NO: 2066260 - DNA, 18 bp, Homo sapiens
tattgagaattttaaatt

SEQ ID NO: 2066261 - DNA, 17 bp, Homo sapiens
tattgatgtttccagaa

SEQ ID NO: 2066262 - DNA, 20 bp, Homo sapiens
tattgcatgtaaaatgcagt

SEQ ID NO: 2066263 - DNA, 21 bp, Homo sapiens
tattgccacaatgcctctccc

SEQ ID NO: 2066264 - DNA, 22 bp, Homo sapiens
tattgccacaatgcctctccca

SEQ ID NO: 2066265 - DNA, 17 bp, Homo sapiens
tattgcctttgcctctt

SEQ ID NO: 2066266 - DNA, 16 bp, Homo sapiens
tattgcgaatgtgcag

SEQ ID NO: 2066267 - DNA, 13 bp, Homo sapiens
tattgcttaatcc

SEQ ID NO: 2066268 - DNA, 19 bp, Homo sapiens
tattggaagtgttcaagaa

SEQ ID NO: 2066269 - DNA, 18 bp, Homo sapiens
tattgggagggatgagag

SEQ ID NO: 2066270 - DNA, 22 bp, Homo sapiens
tattggggttggttggggtggg

SEQ ID NO: 2066271 - DNA, 21 bp, Homo sapiens
tattggtaacatcctttctat

SEQ ID NO: 2066272 - DNA, 13 bp, Homo sapiens
tattggtccagct

SEQ ID NO: 2066273 - DNA, 17 bp, Homo sapiens
tattgtaaacatgtgtt

SEQ ID NO: 2066274 - DNA, 20 bp, Homo sapiens
tattgtacagctgtttaaga

SEQ ID NO: 2066275 - DNA, 18 bp, Homo sapiens
tattgtatattctggaaa

SEQ ID NO: 2066276 - DNA, 15 bp, Homo sapiens
tattgtatgtaagta

SEQ ID NO: 2066277 - DNA, 23 bp, Homo sapiens
tattgtccatatcagacctctga

SEQ ID NO: 2066278 - DNA, 17 bp, Homo sapiens
tattgtccccactaaaa

SEQ ID NO: 2066279 - DNA, 20 bp, Homo sapiens
tattgtcctcccctatttta

SEQ ID NO: 2066280 - DNA, 21 bp, Homo sapiens
tattgtgttgccttagcactt

SEQ ID NO: 2066281 - DNA, 20 bp, Homo sapiens
tattgttaaaaccttactta

SEQ ID NO: 2066282 - DNA, 15 bp, Homo sapiens
tattgtttaaaatca

SEQ ID NO: 2066283 - DNA, 14 bp, Homo sapiens
tatttaaaaaacta

SEQ ID NO: 2066284 - DNA, 20 bp, Homo sapiens
tatttaaaaaactaaaaact

SEQ ID NO: 2066285 - DNA, 21 bp, Homo sapiens
tatttaaaccgctaaaagaaa

SEQ ID NO: 2066286 - DNA, 22 bp, Homo sapiens
tatttaaagacagggaagagca

SEQ ID NO: 2066287 - DNA, 22 bp, Homo sapiens
tatttaaatattaaatatgtta

SEQ ID NO: 2066288 - DNA, 20 bp, Homo sapiens
tatttaaatgttgaaatctt

SEQ ID NO: 2066289 - DNA, 16 bp, Homo sapiens
tatttaactctcttta

SEQ ID NO: 2066290 - DNA, 21 bp, Homo sapiens
tatttaactgccttgtgtaca

SEQ ID NO: 2066291 - DNA, 14 bp, Homo sapiens
tatttaacttgagg

SEQ ID NO: 2066292 - DNA, 13 bp, Homo sapiens
tatttaagaataa

SEQ ID NO: 2066293 - DNA, 20 bp, Homo sapiens
tatttaagcctcatatttaa

SEQ ID NO: 2066294 - DNA, 16 bp, Homo sapiens
tatttaagcttatgtc

SEQ ID NO: 2066295 - DNA, 22 bp, Homo sapiens
tatttaagtatatagtatattt

SEQ ID NO: 2066296 - DNA, 20 bp, Homo sapiens
tatttaatagcaaagaattg

SEQ ID NO: 2066297 - DNA, 23 bp, Homo sapiens
tatttaatatgggtgaacaccaa

SEQ ID NO: 2066298 - DNA, 17 bp, Homo sapiens
tatttaattttcctgga

SEQ ID NO: 2066299 - DNA, 17 bp, Homo sapiens
tatttaatttttgcaat

SEQ ID NO: 2066300 - DNA, 14 bp, Homo sapiens
tatttactgagctt

SEQ ID NO: 2066301 - DNA, 23 bp, Homo sapiens
tatttactgagcttctctgtgaa

SEQ ID NO: 2066302 - DNA, 19 bp, Homo sapiens
tatttacttgtagaaatct

SEQ ID NO: 2066303 - DNA, 20 bp, Homo sapiens
tatttagaatatattaaatc

SEQ ID NO: 2066304 - DNA, 19 bp, Homo sapiens
tatttataacaacctaaat

SEQ ID NO: 2066305 - DNA, 20 bp, Homo sapiens
tatttataacaacctaaatt

SEQ ID NO: 2066306 - DNA, 21 bp, Homo sapiens
tatttataactcatcataaaa

SEQ ID NO: 2066307 - DNA, 23 bp, Homo sapiens
tatttataactcatcataaaata

SEQ ID NO: 2066308 - DNA, 14 bp, Homo sapiens
tatttataagcaga

SEQ ID NO: 2066309 - DNA, 12 bp, Homo sapiens
tatttatactct

SEQ ID NO: 2066310 - DNA, 17 bp, Homo sapiens
tatttatagaatgctga

SEQ ID NO: 2066311 - DNA, 20 bp, Homo sapiens
tatttatatattggtaacat

SEQ ID NO: 2066312 - DNA, 17 bp, Homo sapiens
tatttatatatttataa

SEQ ID NO: 2066313 - DNA, 18 bp, Homo sapiens
tatttatatatttataac

SEQ ID NO: 2066314 - DNA, 21 bp, Homo sapiens
tatttatatgttaatttgtta

SEQ ID NO: 2066315 - DNA, 13 bp, Homo sapiens
tatttatatttgg

SEQ ID NO: 2066316 - DNA, 14 bp, Homo sapiens
tatttatatttgga

SEQ ID NO: 2066317 - DNA, 15 bp, Homo sapiens
tatttatatttggaa

SEQ ID NO: 2066318 - DNA, 22 bp, Homo sapiens
tcaaactttactctaagtctcc

SEQ ID NO: 2066319 - DNA, 12 bp, Homo sapiens
tcaaagaaggaa

SEQ ID NO: 2066320 - DNA, 12 bp, Homo sapiens
tcaaagagactc

SEQ ID NO: 2066321 - DNA, 21 bp, Homo sapiens
tcaaagcaagcattcagaaga

SEQ ID NO: 2066322 - DNA, 17 bp, Homo sapiens
tcaaagccggttgcaga

SEQ ID NO: 2066323 - DNA, 13 bp, Homo sapiens
tcaaagtttaata

SEQ ID NO: 2066324 - DNA, 14 bp, Homo sapiens
tcaaagtttaataa

SEQ ID NO: 2066325 - DNA, 16 bp, Homo sapiens
tcaaatattaccaaaa

SEQ ID NO: 2066326 - DNA, 13 bp, Homo sapiens
tcaaatcctcacc

SEQ ID NO: 2066327 - DNA, 14 bp, Homo sapiens
tcaaatccttgagc

SEQ ID NO: 2066328 - DNA, 16 bp, Homo sapiens
tcaaatctattcagac

SEQ ID NO: 2066329 - DNA, 12 bp, Homo sapiens
tcaaatgaacac

SEQ ID NO: 2066330 - DNA, 15 bp, Homo sapiens
tcaaatgaacacgtg

SEQ ID NO: 2066331 - DNA, 23 bp, Homo sapiens
tcaaatgcgcgtgtgcacgtgtg

SEQ ID NO: 2066332 - DNA, 15 bp, Homo sapiens
tcaaatgctaaatgc

SEQ ID NO: 2066333 - DNA, 10 bp, Homo sapiens
tcaaatgtca

SEQ ID NO: 2066334 - DNA, 18 bp, Homo sapiens
tcaaatgtcagcttaaaa

SEQ ID NO: 2066335 - DNA, 19 bp, Homo sapiens
tcaaatgtcattatgtaga

SEQ ID NO: 2066336 - DNA, 20 bp, Homo sapiens
tcaaattcatttttttcact

SEQ ID NO: 2066337 - DNA, 16 bp, Homo sapiens
tcaaattctcaaccta

SEQ ID NO: 2066338 - DNA, 12 bp, Homo sapiens
tcaaatttcaca

SEQ ID NO: 2066339 - DNA, 15 bp, Homo sapiens
tcaaatttgccacca

SEQ ID NO: 2066340 - DNA, 21 bp, Homo sapiens
tcaacaaagaaatattatttg

SEQ ID NO: 2066341 - DNA, 18 bp, Homo sapiens
tcaacaaagcacagtgtt

SEQ ID NO: 2066342 - DNA, 17 bp, Homo sapiens
tcaacaacaaaccaaaa

SEQ ID NO: 2066343 - DNA, 15 bp, Homo sapiens
tcaacaataaaacat

SEQ ID NO: 2066344 - DNA, 12 bp, Homo sapiens
tcaacaataaag

SEQ ID NO: 2066345 - DNA, 15 bp, Homo sapiens
tcaacaattctaaaa

SEQ ID NO: 2066346 - DNA, 21 bp, Homo sapiens
tcaacacattacttgcacaag

SEQ ID NO: 2066347 - DNA, 17 bp, Homo sapiens
tcaacagttcaaagaag

SEQ ID NO: 2066348 - DNA, 19 bp, Homo sapiens
tcaaccaacctccccgcag

SEQ ID NO: 2066349 - DNA, 23 bp, Homo sapiens
tcaaccactgtggcgttctgctg

SEQ ID NO: 2066350 - DNA, 24 bp, Homo sapiens
tcaaccagaaaacttagaaataag

SEQ ID NO: 2066351 - DNA, 11 bp, Homo sapiens
tcaaccagcat

SEQ ID NO: 2066352 - DNA, 17 bp, Homo sapiens
tcaaccagcattttact

SEQ ID NO: 2066353 - DNA, 18 bp, Homo sapiens
tcaaccagcattttacta

SEQ ID NO: 2066354 - DNA, 21 bp, Homo sapiens
tcaaccagcattttactactt

SEQ ID NO: 2066355 - DNA, 18 bp, Homo sapiens
tcaaccatcaatggaaac

SEQ ID NO: 2066356 - DNA, 18 bp, Homo sapiens
tcaaccccagacactggt

SEQ ID NO: 2066357 - DNA, 14 bp, Homo sapiens
tcaaccccagactc

SEQ ID NO: 2066358 - DNA, 19 bp, Homo sapiens
tcaaccccttcgctcctgt

SEQ ID NO: 2066359 - DNA, 17 bp, Homo sapiens
tcaaccctcagccttga

SEQ ID NO: 2066360 - DNA, 16 bp, Homo sapiens
tcaacctaagcaacag

SEQ ID NO: 2066361 - DNA, 19 bp, Homo sapiens
tcaacctaagcaacagaaa

SEQ ID NO: 2066362 - DNA, 13 bp, Homo sapiens
tcaacctcctggg

SEQ ID NO: 2066363 - DNA, 11 bp, Homo sapiens
tcaacctgctc

SEQ ID NO: 2066364 - DNA, 17 bp, Homo sapiens
tcaacctggtggcacca

SEQ ID NO: 2066365 - DNA, 15 bp, Homo sapiens
tcaacctgtgtctta

SEQ ID NO: 2066366 - DNA, 15 bp, Homo sapiens
tcaacgcagccctgc

SEQ ID NO: 2066367 - DNA, 14 bp, Homo sapiens
tcaacggccctgtt

SEQ ID NO: 2066368 - DNA, 15 bp, Homo sapiens
tcaactccagctccc

SEQ ID NO: 2066369 - DNA, 18 bp, Homo sapiens
tcaactgaccagcctcca

SEQ ID NO: 2066370 - DNA, 20 bp, Homo sapiens
tcaactggacatcacagcag

SEQ ID NO: 2066371 - DNA, 15 bp, Homo sapiens
tcaacttgaagcaag

SEQ ID NO: 2066372 - DNA, 18 bp, Homo sapiens
tcaacttgaagcaagctt

SEQ ID NO: 2066373 - DNA, 22 bp, Homo sapiens
tcaactttcttttgattagtgt

SEQ ID NO: 2066374 - DNA, 21 bp, Homo sapiens
tcaacttttcctttgaatcct

SEQ ID NO: 2066375 - DNA, 15 bp, Homo sapiens
tcaagaaaactggaa

SEQ ID NO: 2066376 - DNA, 14 bp, Homo sapiens
tcaagaaataagtt

SEQ ID NO: 2066377 - DNA, 17 bp, Homo sapiens
tcaagaaataagttttt

SEQ ID NO: 2066378 - DNA, 12 bp, Homo sapiens
tcaagaagacat

SEQ ID NO: 2066379 - DNA, 17 bp, Homo sapiens
tcaagaagtaagagcta

SEQ ID NO: 2066380 - DNA, 15 bp, Homo sapiens
tcaagaatattcaaa

SEQ ID NO: 2066381 - DNA, 12 bp, Homo sapiens
tcaagactgaaa

SEQ ID NO: 2066382 - DNA, 18 bp, Homo sapiens
tcaagagaagaaaaaatt

SEQ ID NO: 2066383 - DNA, 14 bp, Homo sapiens
tcaagagagagtca

SEQ ID NO: 2066384 - DNA, 15 bp, Homo sapiens
tcaagaggcccaggg

SEQ ID NO: 2066385 - DNA, 22 bp, Homo sapiens
tcaagagtgcagttgattctga

SEQ ID NO: 2066386 - DNA, 19 bp, Homo sapiens
tcaagatacatttcatctg

SEQ ID NO: 2066387 - DNA, 20 bp, Homo sapiens
tcaagatgtcctccttgttc

SEQ ID NO: 2066388 - DNA, 19 bp, Homo sapiens
tcaagcaccctgttccctc

SEQ ID NO: 2066389 - DNA, 20 bp, Homo sapiens
tcaagcctgtgggagtagaa

SEQ ID NO: 2066390 - DNA, 15 bp, Homo sapiens
tcaagcgattctcat

SEQ ID NO: 2066391 - DNA, 21 bp, Homo sapiens
tcaagcgattcttctgcttca

SEQ ID NO: 2066392 - DNA, 23 bp, Homo sapiens
tcaagcgattcttgtgcctcagc

SEQ ID NO: 2066393 - DNA, 15 bp, Homo sapiens
tcaagctagccagag

SEQ ID NO: 2066394 - DNA, 13 bp, Homo sapiens
tcaagctgtcccc

SEQ ID NO: 2066395 - DNA, 17 bp, Homo sapiens
tcaaggaccacatgtgt

SEQ ID NO: 2066396 - DNA, 17 bp, Homo sapiens
tcaaggagatataaaat

SEQ ID NO: 2066397 - DNA, 18 bp, Homo sapiens
tcaaggagatataaaatc

SEQ ID NO: 2066398 - DNA, 15 bp, Homo sapiens
tcaaggagcccagaa

SEQ ID NO: 2066399 - DNA, 23 bp, Homo sapiens
tcaaggagcccagaaaacctcca

SEQ ID NO: 2066400 - DNA, 16 bp, Homo sapiens
tcaaggcccggcccca

SEQ ID NO: 2066401 - DNA, 23 bp, Homo sapiens
tcaagggtaccaatcctggcagg

SEQ ID NO: 2066402 - DNA, 15 bp, Homo sapiens
tcaagggtccagaag

SEQ ID NO: 2066403 - DNA, 16 bp, Homo sapiens
tcaagggtccagaagt

SEQ ID NO: 2066404 - DNA, 14 bp, Homo sapiens
tcaaggtctgcttt

SEQ ID NO: 2066405 - DNA, 16 bp, Homo sapiens
tcaaggtgtaaaatat

SEQ ID NO: 2066406 - DNA, 13 bp, Homo sapiens
tcaagtataaagt

SEQ ID NO: 2066407 - DNA, 15 bp, Homo sapiens
tcaagtataaagtca

SEQ ID NO: 2066408 - DNA, 23 bp, Homo sapiens
tcaagtcatgatggagacttcag

SEQ ID NO: 2066409 - DNA, 11 bp, Homo sapiens
tcaagtccaga

SEQ ID NO: 2066410 - DNA, 22 bp, Homo sapiens
tcaagtcctcttttctgagagg

SEQ ID NO: 2066411 - DNA, 12 bp, Homo sapiens
tcaagtcttccc

SEQ ID NO: 2066412 - DNA, 15 bp, Homo sapiens
tcaagtgatatatgt

SEQ ID NO: 2066413 - DNA, 16 bp, Homo sapiens
tcaagtgatatatgta

SEQ ID NO: 2066414 - DNA, 17 bp, Homo sapiens
tcaagtgatccacctgc

SEQ ID NO: 2066415 - DNA, 21 bp, Homo sapiens
tcaagtgattctcctgcctca

SEQ ID NO: 2066416 - DNA, 15 bp, Homo sapiens
tcaagtgtcatatgt

SEQ ID NO: 2066417 - DNA, 15 bp, Homo sapiens
tcaagttagctcagg

SEQ ID NO: 2066418 - DNA, 17 bp, Homo sapiens
tcaagttgaggggcttc

SEQ ID NO: 2066419 - DNA, 16 bp, Homo sapiens
tcaataaaaaaaagaa

SEQ ID NO: 2066420 - DNA, 19 bp, Homo sapiens
tcaataaaaaaaagaaatg

SEQ ID NO: 2066421 - DNA, 21 bp, Homo sapiens
tcaataaaaatctttgattca

SEQ ID NO: 2066422 - DNA, 13 bp, Homo sapiens
tcaataaaatcat

SEQ ID NO: 2066423 - DNA, 15 bp, Homo sapiens
tcaataaatgtctgt

SEQ ID NO: 2066424 - DNA, 22 bp, Homo sapiens
tcaataccccaagtccacctgc

SEQ ID NO: 2066425 - DNA, 16 bp, Homo sapiens
tcaatacccctgttaa

SEQ ID NO: 2066426 - DNA, 13 bp, Homo sapiens
tcaatactgcctt

SEQ ID NO: 2066427 - DNA, 19 bp, Homo sapiens
tcaatagtaaaagataaca

SEQ ID NO: 2066428 - DNA, 14 bp, Homo sapiens
tcaatagtcaagaa

SEQ ID NO: 2066429 - DNA, 16 bp, Homo sapiens
tcaatatgtgattttt

SEQ ID NO: 2066430 - DNA, 17 bp, Homo sapiens
tcaatattaaatacaga

SEQ ID NO: 2066431 - DNA, 16 bp, Homo sapiens
tcaatattcaataaag

SEQ ID NO: 2066432 - DNA, 17 bp, Homo sapiens
tcaatattcaataaagc

SEQ ID NO: 2066433 - DNA, 12 bp, Homo sapiens
tcaatatttaag

SEQ ID NO: 2066434 - DNA, 15 bp, Homo sapiens
tcaccaataacttca

SEQ ID NO: 2066435 - DNA, 16 bp, Homo sapiens
tcaccacatgtgcaca

SEQ ID NO: 2066436 - DNA, 13 bp, Homo sapiens
tcaccacctctcc

SEQ ID NO: 2066437 - DNA, 18 bp, Homo sapiens
tcaccaccttcccagctc

SEQ ID NO: 2066438 - DNA, 21 bp, Homo sapiens
tcaccacttcaatagatcaaa

SEQ ID NO: 2066439 - DNA, 19 bp, Homo sapiens
tcaccagagcccatgctca

SEQ ID NO: 2066440 - DNA, 17 bp, Homo sapiens
tcaccagaggtcaggag

SEQ ID NO: 2066441 - DNA, 15 bp, Homo sapiens
tcaccagatttgcta

SEQ ID NO: 2066442 - DNA, 21 bp, Homo sapiens
tcaccagatttgctaatttat

SEQ ID NO: 2066443 - DNA, 22 bp, Homo sapiens
tcaccagccccagtgcccacag

SEQ ID NO: 2066444 - DNA, 19 bp, Homo sapiens
tcaccagcccggcctgctc

SEQ ID NO: 2066445 - DNA, 22 bp, Homo sapiens
tcaccagggtccgcaccagctg

SEQ ID NO: 2066446 - DNA, 23 bp, Homo sapiens
tcaccagggtccgcaccagctgc

SEQ ID NO: 2066447 - DNA, 18 bp, Homo sapiens
tcaccatacttcattcag

SEQ ID NO: 2066448 - DNA, 18 bp, Homo sapiens
tcaccatgtaacaaccag

SEQ ID NO: 2066449 - DNA, 19 bp, Homo sapiens
tcacccaagcaaggccaaa

SEQ ID NO: 2066450 - DNA, 12 bp, Homo sapiens
tcacccacaggg

SEQ ID NO: 2066451 - DNA, 21 bp, Homo sapiens
tcacccagctaatctgtaggg

SEQ ID NO: 2066452 - DNA, 12 bp, Homo sapiens
tcacccaggctc

SEQ ID NO: 2066453 - DNA, 13 bp, Homo sapiens
tcacccagtcctg

SEQ ID NO: 2066454 - DNA, 14 bp, Homo sapiens
tcacccagtcctgg

SEQ ID NO: 2066455 - DNA, 15 bp, Homo sapiens
tcacccagtcctggc

SEQ ID NO: 2066456 - DNA, 17 bp, Homo sapiens
tcacccatgaagacagg

SEQ ID NO: 2066457 - DNA, 13 bp, Homo sapiens
tcaccccccactc

SEQ ID NO: 2066458 - DNA, 22 bp, Homo sapiens
tcaccccctcccacccccagcc

SEQ ID NO: 2066459 - DNA, 19 bp, Homo sapiens
tcacccgaggctgcccact

SEQ ID NO: 2066460 - DNA, 20 bp, Homo sapiens
tcacccgtacaggcaattcc

SEQ ID NO: 2066461 - DNA, 19 bp, Homo sapiens
tcaccctcataccatctgc

SEQ ID NO: 2066462 - DNA, 20 bp, Homo sapiens
tcaccctccacctcttcacc

SEQ ID NO: 2066463 - DNA, 13 bp, Homo sapiens
tcaccctgcagag

SEQ ID NO: 2066464 - DNA, 15 bp, Homo sapiens
tcaccctgcagagct

SEQ ID NO: 2066465 - DNA, 23 bp, Homo sapiens
tcaccctgcagagctatggtgag

SEQ ID NO: 2066466 - DNA, 14 bp, Homo sapiens
tcaccctggcccca

SEQ ID NO: 2066467 - DNA, 17 bp, Homo sapiens
tcaccctggccccaact

SEQ ID NO: 2066468 - DNA, 12 bp, Homo sapiens
tcacccttctgg

SEQ ID NO: 2066469 - DNA, 17 bp, Homo sapiens
tcaccgacgcgtctcct

SEQ ID NO: 2066470 - DNA, 19 bp, Homo sapiens
tcaccgacttattctgatt

SEQ ID NO: 2066471 - DNA, 20 bp, Homo sapiens
tcaccgagacggctggacct

SEQ ID NO: 2066472 - DNA, 23 bp, Homo sapiens
tcaccggagctttcaaagaagga

SEQ ID NO: 2066473 - DNA, 13 bp, Homo sapiens
tcaccggcatgct

SEQ ID NO: 2066474 - DNA, 14 bp, Homo sapiens
tcacctcctccact

SEQ ID NO: 2066475 - DNA, 16 bp, Homo sapiens
tcacctctcttcagcc

SEQ ID NO: 2066476 - DNA, 14 bp, Homo sapiens
tcacctctgcctca

SEQ ID NO: 2066477 - DNA, 15 bp, Homo sapiens
tcacctctgcctcaa

SEQ ID NO: 2066478 - DNA, 15 bp, Homo sapiens
tcacctgaggtcggg

SEQ ID NO: 2066479 - DNA, 15 bp, Homo sapiens
tcacctgatcatata

SEQ ID NO: 2066480 - DNA, 15 bp, Homo sapiens
tcacctgcaagcccc

SEQ ID NO: 2066481 - DNA, 20 bp, Homo sapiens
tcacctgcaagccccagggc

SEQ ID NO: 2066482 - DNA, 23 bp, Homo sapiens
tcacctgcaagccccagggcctg

SEQ ID NO: 2066483 - DNA, 16 bp, Homo sapiens
tcacctgggcctttcc

SEQ ID NO: 2066484 - DNA, 17 bp, Homo sapiens
tcacctgggcctttcct

SEQ ID NO: 2066485 - DNA, 21 bp, Homo sapiens
tcacctgggcctttcctgtgc

SEQ ID NO: 2066486 - DNA, 22 bp, Homo sapiens
tcacctgggcctttcctgtgcc

SEQ ID NO: 2066487 - DNA, 15 bp, Homo sapiens
tcacctggttgaccc

SEQ ID NO: 2066488 - DNA, 18 bp, Homo sapiens
tcacctgtttttaagctg

SEQ ID NO: 2066489 - DNA, 20 bp, Homo sapiens
tcacctgtttttaagctgtt

SEQ ID NO: 2066490 - DNA, 19 bp, Homo sapiens
tcaccttatgtattatttt

SEQ ID NO: 2066491 - DNA, 22 bp, Homo sapiens
tcaccttatgtattattttcta

SEQ ID NO: 2066492 - DNA, 19 bp, Homo sapiens
tcaccttgccgagagaggc

SEQ ID NO: 2066493 - DNA, 14 bp, Homo sapiens
tcacgactcttcct

SEQ ID NO: 2066494 - DNA, 17 bp, Homo sapiens
tcacgcccagcctcctc

SEQ ID NO: 2066495 - DNA, 21 bp, Homo sapiens
tcacgcccagcctcctcccac

SEQ ID NO: 2066496 - DNA, 20 bp, Homo sapiens
tcacgcctataatcccagca

SEQ ID NO: 2066497 - DNA, 23 bp, Homo sapiens
tcacgcctgtaatcccagcactt

SEQ ID NO: 2066498 - DNA, 16 bp, Homo sapiens
tcacgctttttgaaaa

SEQ ID NO: 2066499 - DNA, 20 bp, Homo sapiens
tcacggctcactgcagcctc

SEQ ID NO: 2066500 - DNA, 18 bp, Homo sapiens
tcacgggcagtagctgtg

SEQ ID NO: 2066501 - DNA, 22 bp, Homo sapiens
tcacgtgaaatatttaagtata

SEQ ID NO: 2066502 - DNA, 16 bp, Homo sapiens
tcactaaagggtgccc

SEQ ID NO: 2066503 - DNA, 21 bp, Homo sapiens
tcactacgggggggagaagga

SEQ ID NO: 2066504 - DNA, 22 bp, Homo sapiens
tcactactcacagtctctttaa

SEQ ID NO: 2066505 - DNA, 17 bp, Homo sapiens
tcactagatggcgagca

SEQ ID NO: 2066506 - DNA, 14 bp, Homo sapiens
tcactagcagctgc

SEQ ID NO: 2066507 - DNA, 14 bp, Homo sapiens
tcactagccatgat

SEQ ID NO: 2066508 - DNA, 17 bp, Homo sapiens
tcactataaatggtgtt

SEQ ID NO: 2066509 - DNA, 15 bp, Homo sapiens
tcactatctttctga

SEQ ID NO: 2066510 - DNA, 14 bp, Homo sapiens
tcactatgacactg

SEQ ID NO: 2066511 - DNA, 19 bp, Homo sapiens
tcactatgacactgagcaa

SEQ ID NO: 2066512 - DNA, 16 bp, Homo sapiens
tcactatgattttcta

SEQ ID NO: 2066513 - DNA, 20 bp, Homo sapiens
tcactatggtatgctggcca

SEQ ID NO: 2066514 - DNA, 18 bp, Homo sapiens
tcactatgttgcccaggc

SEQ ID NO: 2066515 - DNA, 16 bp, Homo sapiens
tcactcactcattcct

SEQ ID NO: 2066516 - DNA, 14 bp, Homo sapiens
tcactccaccaccc

SEQ ID NO: 2066517 - DNA, 14 bp, Homo sapiens
tcactccggtgtgc

SEQ ID NO: 2066518 - DNA, 19 bp, Homo sapiens
tcactccggtgtgcctgca

SEQ ID NO: 2066519 - DNA, 21 bp, Homo sapiens
tcactccggtgtgcctgcagc

SEQ ID NO: 2066520 - DNA, 17 bp, Homo sapiens
tcactctgtcagccagc

SEQ ID NO: 2066521 - DNA, 18 bp, Homo sapiens
tcactctgtcagccagcc

SEQ ID NO: 2066522 - DNA, 20 bp, Homo sapiens
tcactctgtcagccagccgc

SEQ ID NO: 2066523 - DNA, 12 bp, Homo sapiens
tcactctgtcgc

SEQ ID NO: 2066524 - DNA, 19 bp, Homo sapiens
tcactctgtcgcccagtct

SEQ ID NO: 2066525 - DNA, 19 bp, Homo sapiens
tcactcttcctgcaaggac

SEQ ID NO: 2066526 - DNA, 18 bp, Homo sapiens
tcactgaccctggagcgg

SEQ ID NO: 2066527 - DNA, 15 bp, Homo sapiens
tcactgattgggtgc

SEQ ID NO: 2066528 - DNA, 19 bp, Homo sapiens
tcactgcaacctccacctc

SEQ ID NO: 2066529 - DNA, 18 bp, Homo sapiens
tcactgcaacctccgcct

SEQ ID NO: 2066530 - DNA, 22 bp, Homo sapiens
tcactgcaacctcttcctcctg

SEQ ID NO: 2066531 - DNA, 22 bp, Homo sapiens
tcactgcacagtgcatctcagc

SEQ ID NO: 2066532 - DNA, 14 bp, Homo sapiens
tcactgcagcctca

SEQ ID NO: 2066533 - DNA, 15 bp, Homo sapiens
tcactgcagcctcaa

SEQ ID NO: 2066534 - DNA, 12 bp, Homo sapiens
tcactgccttcc

SEQ ID NO: 2066535 - DNA, 17 bp, Homo sapiens
tcactgctcccccgtgt

SEQ ID NO: 2066536 - DNA, 13 bp, Homo sapiens
tcactgctggctg

SEQ ID NO: 2066537 - DNA, 17 bp, Homo sapiens
tcactgctggctgcctt

SEQ ID NO: 2066538 - DNA, 22 bp, Homo sapiens
tcactgctggctgccttagaac

SEQ ID NO: 2066539 - DNA, 18 bp, Homo sapiens
tcactggagcaccaggca

SEQ ID NO: 2066540 - DNA, 22 bp, Homo sapiens
tcactggagcaccaggcacgaa

SEQ ID NO: 2066541 - DNA, 13 bp, Homo sapiens
tcactggagccca

SEQ ID NO: 2066542 - DNA, 14 bp, Homo sapiens
tcactggagcccag

SEQ ID NO: 2066543 - DNA, 14 bp, Homo sapiens
tcactggatgaaga

SEQ ID NO: 2066544 - DNA, 22 bp, Homo sapiens
tcactggcgaggtgcggccacc

SEQ ID NO: 2066545 - DNA, 19 bp, Homo sapiens
tcactggctggggcagagg

SEQ ID NO: 2066546 - DNA, 17 bp, Homo sapiens
tagaacacccctgtgca

SEQ ID NO: 2066547 - DNA, 16 bp, Homo sapiens
tagaacataaagcaaa

SEQ ID NO: 2066548 - DNA, 17 bp, Homo sapiens
tagaacataaagcaaat

SEQ ID NO: 2066549 - DNA, 23 bp, Homo sapiens
tagaaccaagaagggctagaacc

SEQ ID NO: 2066550 - DNA, 18 bp, Homo sapiens
tagaaccaagcttcagag

SEQ ID NO: 2066551 - DNA, 22 bp, Homo sapiens
tagaacccggcaggctagaacc

SEQ ID NO: 2066552 - DNA, 16 bp, Homo sapiens
tagaacctagaagggc

SEQ ID NO: 2066553 - DNA, 17 bp, Homo sapiens
tagaacctggagggctg

SEQ ID NO: 2066554 - DNA, 19 bp, Homo sapiens
tagaactcagttttaacta

SEQ ID NO: 2066555 - DNA, 12 bp, Homo sapiens
tagaacttcaaa

SEQ ID NO: 2066556 - DNA, 22 bp, Homo sapiens
tagaacttcaaaatgttcgtat

SEQ ID NO: 2066557 - DNA, 19 bp, Homo sapiens
tagaagatggactctgaaa

SEQ ID NO: 2066558 - DNA, 18 bp, Homo sapiens
tagaaggctgtggtgagg

SEQ ID NO: 2066559 - DNA, 23 bp, Homo sapiens
tagaaggctgtggtgagggaaga

SEQ ID NO: 2066560 - DNA, 16 bp, Homo sapiens
tagaagggttatattt

SEQ ID NO: 2066561 - DNA, 21 bp, Homo sapiens
tagaagtccaggcagagacaa

SEQ ID NO: 2066562 - DNA, 13 bp, Homo sapiens
tagaagtgtttta

SEQ ID NO: 2066563 - DNA, 15 bp, Homo sapiens
tagaataaatgaaga

SEQ ID NO: 2066564 - DNA, 13 bp, Homo sapiens
tagaataataata

SEQ ID NO: 2066565 - DNA, 17 bp, Homo sapiens
tagaatgaaaactcatt

SEQ ID NO: 2066566 - DNA, 16 bp, Homo sapiens
tagaatgatttcatgc

SEQ ID NO: 2066567 - DNA, 21 bp, Homo sapiens
tagaatgatttcatgctatct

SEQ ID NO: 2066568 - DNA, 19 bp, Homo sapiens
tagaatgcatgtaaggtct

SEQ ID NO: 2066569 - DNA, 16 bp, Homo sapiens
tagaatggcagctgga

SEQ ID NO: 2066570 - DNA, 16 bp, Homo sapiens
tagaatggtagcacta

SEQ ID NO: 2066571 - DNA, 13 bp, Homo sapiens
tagaatgtgtttt

SEQ ID NO: 2066572 - DNA, 16 bp, Homo sapiens
tagaattatatctaat

SEQ ID NO: 2066573 - DNA, 23 bp, Homo sapiens
tagaattatatctaatttataca

SEQ ID NO: 2066574 - DNA, 20 bp, Homo sapiens
tagaattgagtgtttaaagt

SEQ ID NO: 2066575 - DNA, 22 bp, Homo sapiens
tagaatttattcaattcctctg

SEQ ID NO: 2066576 - DNA, 22 bp, Homo sapiens
tagacaactggtccactcaggg

SEQ ID NO: 2066577 - DNA, 10 bp, Homo sapiens
tagacagagt

SEQ ID NO: 2066578 - DNA, 23 bp, Homo sapiens
tagacatagttcagccacaaagt

SEQ ID NO: 2066579 - DNA, 11 bp, Homo sapiens
tagacctcagc

SEQ ID NO: 2066580 - DNA, 12 bp, Homo sapiens
tagacctcagcc

SEQ ID NO: 2066581 - DNA, 16 bp, Homo sapiens
tagacctcagcctgtg

SEQ ID NO: 2066582 - DNA, 20 bp, Homo sapiens
tagacctgggaccacggctg

SEQ ID NO: 2066583 - DNA, 13 bp, Homo sapiens
tagacctgggcca

SEQ ID NO: 2066584 - DNA, 13 bp, Homo sapiens
tagactaaatgaa

SEQ ID NO: 2066585 - DNA, 18 bp, Homo sapiens
tagactaattaaaatctg

SEQ ID NO: 2066586 - DNA, 23 bp, Homo sapiens
tagactaattaaaatctggaaat

SEQ ID NO: 2066587 - DNA, 19 bp, Homo sapiens
tagactagttgaacatctc

SEQ ID NO: 2066588 - DNA, 22 bp, Homo sapiens
tagactatatacatgtgtgtat

SEQ ID NO: 2066589 - DNA, 23 bp, Homo sapiens
tagactatatacatgtgtgtata

SEQ ID NO: 2066590 - DNA, 16 bp, Homo sapiens
tagactcctgcttctt

SEQ ID NO: 2066591 - DNA, 19 bp, Homo sapiens
tagactggaacttgaactg

SEQ ID NO: 2066592 - DNA, 16 bp, Homo sapiens
tagactggacagcttg

SEQ ID NO: 2066593 - DNA, 18 bp, Homo sapiens
tagactggacagcttgtg

SEQ ID NO: 2066594 - DNA, 17 bp, Homo sapiens
tagactggagtgaggct

SEQ ID NO: 2066595 - DNA, 22 bp, Homo sapiens
tagactggagtgaggcttccag

SEQ ID NO: 2066596 - DNA, 20 bp, Homo sapiens
tagactgtacttattttcca

SEQ ID NO: 2066597 - DNA, 18 bp, Homo sapiens
tagacttgtgctgatcgt

SEQ ID NO: 2066598 - DNA, 22 bp, Homo sapiens
taaatctgagatctccctccag

SEQ ID NO: 2066599 - DNA, 21 bp, Homo sapiens
taaatcttcaatatgaaggac

SEQ ID NO: 2066600 - DNA, 16 bp, Homo sapiens
taaatcttccttgtga

SEQ ID NO: 2066601 - DNA, 19 bp, Homo sapiens
taaatcttccttgtgagga

SEQ ID NO: 2066602 - DNA, 12 bp, Homo sapiens
taaatgaagaaa

SEQ ID NO: 2066603 - DNA, 19 bp, Homo sapiens
taaatgaagagacttaaga

SEQ ID NO: 2066604 - DNA, 13 bp, Homo sapiens
taaatgaccaaga

SEQ ID NO: 2066605 - DNA, 14 bp, Homo sapiens
taaatgaccaagaa

SEQ ID NO: 2066606 - DNA, 19 bp, Homo sapiens
taaatgaccaagaaaaaga

SEQ ID NO: 2066607 - DNA, 17 bp, Homo sapiens
taaatgcaaacactgtg

SEQ ID NO: 2066608 - DNA, 14 bp, Homo sapiens
taaatgcatgattt

SEQ ID NO: 2066609 - DNA, 15 bp, Homo sapiens
taaatgcatgatttt

SEQ ID NO: 2066610 - DNA, 16 bp, Homo sapiens
taaatgccctctctga

SEQ ID NO: 2066611 - DNA, 17 bp, Homo sapiens
taaatgctcgtgtgatt

SEQ ID NO: 2066612 - DNA, 17 bp, Homo sapiens
taaatgctttatgcaaa

SEQ ID NO: 2066613 - DNA, 20 bp, Homo sapiens
taaatggagcttgtacatat

SEQ ID NO: 2066614 - DNA, 21 bp, Homo sapiens
taaatggagcttgtacatatt

SEQ ID NO: 2066615 - DNA, 19 bp, Homo sapiens
taaatgggcagtgcctcct

SEQ ID NO: 2066616 - DNA, 20 bp, Homo sapiens
taaatgggcagtgcctcctg

SEQ ID NO: 2066617 - DNA, 19 bp, Homo sapiens
taaatgtatcttattcaca

SEQ ID NO: 2066618 - DNA, 22 bp, Homo sapiens
taaatgtctctttaatgtcaca

SEQ ID NO: 2066619 - DNA, 13 bp, Homo sapiens
taaatgtgtaaat

SEQ ID NO: 2066620 - DNA, 14 bp, Homo sapiens
taaatgttgaaatc

SEQ ID NO: 2066621 - DNA, 15 bp, Homo sapiens
taaatgttgaaatct

SEQ ID NO: 2066622 - DNA, 16 bp, Homo sapiens
taaatgttgaaatctt

SEQ ID NO: 2066623 - DNA, 20 bp, Homo sapiens
taaattaaaaaggaaagaaa

SEQ ID NO: 2066624 - DNA, 17 bp, Homo sapiens
taaattaagactttaaa

SEQ ID NO: 2066625 - DNA, 18 bp, Homo sapiens
taaattagtatttattta

SEQ ID NO: 2066626 - DNA, 22 bp, Homo sapiens
taaattataacttaaaatattt

SEQ ID NO: 2066627 - DNA, 14 bp, Homo sapiens
taaattatttcata

SEQ ID NO: 2066628 - DNA, 19 bp, Homo sapiens
taaattatttttaagaaat

SEQ ID NO: 2066629 - DNA, 20 bp, Homo sapiens
taaattcaaccactgtaaaa

SEQ ID NO: 2066630 - DNA, 23 bp, Homo sapiens
taaattcagatatatttttcaca

SEQ ID NO: 2066631 - DNA, 20 bp, Homo sapiens
taaattctggaaatgtcttt

SEQ ID NO: 2066632 - DNA, 15 bp, Homo sapiens
taaattctttttcaa

SEQ ID NO: 2066633 - DNA, 17 bp, Homo sapiens
taaattctttttcaaaa

SEQ ID NO: 2066634 - DNA, 14 bp, Homo sapiens
taaattggaaacat

SEQ ID NO: 2066635 - DNA, 15 bp, Homo sapiens
taaattggaaacatt

SEQ ID NO: 2066636 - DNA, 16 bp, Homo sapiens
taaattggaattttct

SEQ ID NO: 2066637 - DNA, 16 bp, Homo sapiens
taaattggtgataagt

SEQ ID NO: 2066638 - DNA, 20 bp, Homo sapiens
taaattggtgataagtggaa

SEQ ID NO: 2066639 - DNA, 21 bp, Homo sapiens
taaattggtgataagtggaaa

SEQ ID NO: 2066640 - DNA, 23 bp, Homo sapiens
taaattggtgataagtggaaaaa

SEQ ID NO: 2066641 - DNA, 12 bp, Homo sapiens
taaattgtttga

SEQ ID NO: 2066642 - DNA, 22 bp, Homo sapiens
taaatttaaagaagtcataaac

SEQ ID NO: 2066643 - DNA, 17 bp, Homo sapiens
taaattttgtttcagaa

SEQ ID NO: 2066644 - DNA, 13 bp, Homo sapiens
taaatttttgtca

SEQ ID NO: 2066645 - DNA, 14 bp, Homo sapiens
taacaaaacaagaa

SEQ ID NO: 2066646 - DNA, 15 bp, Homo sapiens
taacaaaacaagaaa

SEQ ID NO: 2066647 - DNA, 18 bp, Homo sapiens
taacaaaacaagaaagaa

SEQ ID NO: 2066648 - DNA, 13 bp, Homo sapiens
taacaaaatcaca

SEQ ID NO: 2066649 - DNA, 17 bp, Homo sapiens
taacaagatctttcagg

SEQ ID NO: 2066650 - DNA, 12 bp, Homo sapiens
taacaaggtgtc

SEQ ID NO: 2066651 - DNA, 19 bp, Homo sapiens
taacaaggtgtcttttcca

SEQ ID NO: 2066652 - DNA, 16 bp, Homo sapiens
taacaatgtatgtgaa

SEQ ID NO: 2066653 - DNA, 21 bp, Homo sapiens
taacaatttcctttatattta

SEQ ID NO: 2066654 - DNA, 14 bp, Homo sapiens
taacactcagaagc

SEQ ID NO: 2066655 - DNA, 20 bp, Homo sapiens
taacactcagaagcctgggg

SEQ ID NO: 2066656 - DNA, 14 bp, Homo sapiens
taacagaaccagag

SEQ ID NO: 2066657 - DNA, 22 bp, Homo sapiens
taacaggctcaatattcctgaa

SEQ ID NO: 2066658 - DNA, 23 bp, Homo sapiens
taacaggctcaatattcctgaat

SEQ ID NO: 2066659 - DNA, 14 bp, Homo sapiens
taacagggaaggca

SEQ ID NO: 2066660 - DNA, 16 bp, Homo sapiens
taacagggaaggcagg

SEQ ID NO: 2066661 - DNA, 23 bp, Homo sapiens
taacagggaaggcaggcagggct

SEQ ID NO: 2066662 - DNA, 22 bp, Homo sapiens
taacagtatttgtacaaatact

SEQ ID NO: 2066663 - DNA, 16 bp, Homo sapiens
taacatagatttatgt

SEQ ID NO: 2066664 - DNA, 13 bp, Homo sapiens
taacataggtttt

SEQ ID NO: 2066665 - DNA, 14 bp, Homo sapiens
taacataggttttg

SEQ ID NO: 2066666 - DNA, 14 bp, Homo sapiens
taacatatgtatta

SEQ ID NO: 2066667 - DNA, 13 bp, Homo sapiens
taacatatttact

SEQ ID NO: 2066668 - DNA, 22 bp, Homo sapiens
taacatatttactaagccacaa

SEQ ID NO: 2066669 - DNA, 21 bp, Homo sapiens
taacatctattataaaaccat

SEQ ID NO: 2066670 - DNA, 19 bp, Homo sapiens
taacatgatactattcaga

SEQ ID NO: 2066671 - DNA, 15 bp, Homo sapiens
taacattaacatcta

SEQ ID NO: 2066672 - DNA, 20 bp, Homo sapiens
taaccagacacatactcatt

SEQ ID NO: 2066673 - DNA, 18 bp, Homo sapiens
taaccagcacatttctcc

SEQ ID NO: 2066674 - DNA, 22 bp, Homo sapiens
taaccatagttatttacttgaa

SEQ ID NO: 2066675 - DNA, 16 bp, Homo sapiens
taaccatcagttactg

SEQ ID NO: 2066676 - DNA, 17 bp, Homo sapiens
taaccatcagttactgg

SEQ ID NO: 2066677 - DNA, 22 bp, Homo sapiens
taaccatgtgaaaaggcaaaaa

SEQ ID NO: 2066678 - DNA, 17 bp, Homo sapiens
taaaaacttgtactatg

SEQ ID NO: 2066679 - DNA, 17 bp, Homo sapiens
taaaaagaaaagataaa

SEQ ID NO: 2066680 - DNA, 17 bp, Homo sapiens
taaaaagtgcttttgtg

SEQ ID NO: 2066681 - DNA, 12 bp, Homo sapiens
taaaaagttaat

SEQ ID NO: 2066682 - DNA, 16 bp, Homo sapiens
taaaaataaaatgatg

SEQ ID NO: 2066683 - DNA, 12 bp, Homo sapiens
taaaaataaagc

SEQ ID NO: 2066684 - DNA, 17 bp, Homo sapiens
taaaaataaatttggtt

SEQ ID NO: 2066685 - DNA, 19 bp, Homo sapiens
taaaaatatggaacttcta

SEQ ID NO: 2066686 - DNA, 23 bp, Homo sapiens
taaaaatatggaacttctaatat

SEQ ID NO: 2066687 - DNA, 15 bp, Homo sapiens
taaaaatattctcca

SEQ ID NO: 2066688 - DNA, 17 bp, Homo sapiens
taaaaatcataaactgt

SEQ ID NO: 2066689 - DNA, 14 bp, Homo sapiens
taaaaatgaaatta

SEQ ID NO: 2066690 - DNA, 16 bp, Homo sapiens
taaaaatgatttcagt

SEQ ID NO: 2066691 - DNA, 19 bp, Homo sapiens
taaaaatgatttcagtagc

SEQ ID NO: 2066692 - DNA, 17 bp, Homo sapiens
taaaaattgtgatcaga

SEQ ID NO: 2066693 - DNA, 14 bp, Homo sapiens
taaaaatttgttta

SEQ ID NO: 2066694 - DNA, 22 bp, Homo sapiens
taaaacaaggcttaaaagagta

SEQ ID NO: 2066695 - DNA, 23 bp, Homo sapiens
taaaacaatgaaggaaaacctca

SEQ ID NO: 2066696 - DNA, 15 bp, Homo sapiens
taaaacaatttattt

SEQ ID NO: 2066697 - DNA, 15 bp, Homo sapiens
taaaacacatcaagt

SEQ ID NO: 2066698 - DNA, 23 bp, Homo sapiens
taaaacatgaaaattatctccct

SEQ ID NO: 2066699 - DNA, 13 bp, Homo sapiens
taaaacatgcacg

SEQ ID NO: 2066700 - DNA, 20 bp, Homo sapiens
taaaacattatagattttca

SEQ ID NO: 2066701 - DNA, 14 bp, Homo sapiens
taaaacatttattt

SEQ ID NO: 2066702 - DNA, 15 bp, Homo sapiens
taaaaccacagcagt

SEQ ID NO: 2066703 - DNA, 15 bp, Homo sapiens
taaaaccatgcagct

SEQ ID NO: 2066704 - DNA, 17 bp, Homo sapiens
taaaacccagcatgtac

SEQ ID NO: 2066705 - DNA, 19 bp, Homo sapiens
taaaacccagcatgtacaa

SEQ ID NO: 2066706 - DNA, 17 bp, Homo sapiens
taaaacctagaacttca

SEQ ID NO: 2066707 - DNA, 16 bp, Homo sapiens
taaaacctgtcaatga

SEQ ID NO: 2066708 - DNA, 23 bp, Homo sapiens
taaaaccttacttaaagcttgtt

SEQ ID NO: 2066709 - DNA, 14 bp, Homo sapiens
taaaaccttgattt

SEQ ID NO: 2066710 - DNA, 16 bp, Homo sapiens
taaaaccttgatttaa

SEQ ID NO: 2066711 - DNA, 19 bp, Homo sapiens
taaaaccttgatttaaaat

SEQ ID NO: 2066712 - DNA, 10 bp, Homo sapiens
taaaaccttt

SEQ ID NO: 2066713 - DNA, 16 bp, Homo sapiens
taaaacctttcaaatt

SEQ ID NO: 2066714 - DNA, 20 bp, Homo sapiens
taaaacctttcaaatttcac

SEQ ID NO: 2066715 - DNA, 21 bp, Homo sapiens
taaaacctttcaaatttcaca

SEQ ID NO: 2066716 - DNA, 22 bp, Homo sapiens
taaaactatggttcccaataaa

SEQ ID NO: 2066717 - DNA, 16 bp, Homo sapiens
taaaactgctttgtat

SEQ ID NO: 2066718 - DNA, 12 bp, Homo sapiens
taaaagaaaaag

SEQ ID NO: 2066719 - DNA, 13 bp, Homo sapiens
taaaagaaacttt

SEQ ID NO: 2066720 - DNA, 17 bp, Homo sapiens
taaaagaatattcagag

SEQ ID NO: 2066721 - DNA, 16 bp, Homo sapiens
taaaagaatattttaa

SEQ ID NO: 2066722 - DNA, 18 bp, Homo sapiens
taaaagactgcagctgct

SEQ ID NO: 2066723 - DNA, 12 bp, Homo sapiens
taaaagcaaaaa

SEQ ID NO: 2066724 - DNA, 18 bp, Homo sapiens
taaaagcaaaaaagaaaa

SEQ ID NO: 2066725 - DNA, 19 bp, Homo sapiens
taaaagcaaaaaagaaaac

SEQ ID NO: 2066726 - DNA, 20 bp, Homo sapiens
taaaagcaaaaaagaaaacc

SEQ ID NO: 2066727 - DNA, 19 bp, Homo sapiens
taaaagcaattatattgtc

SEQ ID NO: 2066728 - DNA, 15 bp, Homo sapiens
taaaagcataaatgc

SEQ ID NO: 2066729 - DNA, 11 bp, Homo sapiens
taaaagctaat

SEQ ID NO: 2066730 - DNA, 12 bp, Homo sapiens
taaaagctaatt

SEQ ID NO: 2066731 - DNA, 14 bp, Homo sapiens
taaaagtgtgagca

SEQ ID NO: 2066732 - DNA, 13 bp, Homo sapiens
taaaagtttcaat

SEQ ID NO: 2066733 - DNA, 18 bp, Homo sapiens
taaaagtttcaatgtgat

SEQ ID NO: 2066734 - DNA, 16 bp, Homo sapiens
taaaataaaaaccaga

SEQ ID NO: 2066735 - DNA, 13 bp, Homo sapiens
taaaataaagcct

SEQ ID NO: 2066736 - DNA, 22 bp, Homo sapiens
taaaataaagcctatttttcaa

SEQ ID NO: 2066737 - DNA, 18 bp, Homo sapiens
taaaataatgatttaagc

SEQ ID NO: 2066738 - DNA, 21 bp, Homo sapiens
taaaatagcaaaagaagaagt

SEQ ID NO: 2066739 - DNA, 15 bp, Homo sapiens
taaaatagtattgaa

SEQ ID NO: 2066740 - DNA, 16 bp, Homo sapiens
taaaatataaattaag

SEQ ID NO: 2066741 - DNA, 17 bp, Homo sapiens
taaaatatatataaata

SEQ ID NO: 2066742 - DNA, 16 bp, Homo sapiens
taaaatatcctcaggg

SEQ ID NO: 2066743 - DNA, 15 bp, Homo sapiens
taaaatatctacctg

SEQ ID NO: 2066744 - DNA, 20 bp, Homo sapiens
taaaatatctacctgccctc

SEQ ID NO: 2066745 - DNA, 14 bp, Homo sapiens
taaaatcaggattt

SEQ ID NO: 2066746 - DNA, 18 bp, Homo sapiens
taaaatcatgtacatttc

SEQ ID NO: 2066747 - DNA, 10 bp, Homo sapiens
taaaatcatt

SEQ ID NO: 2066748 - DNA, 15 bp, Homo sapiens
taaaatcattcaata

SEQ ID NO: 2066749 - DNA, 13 bp, Homo sapiens
taaaatcatttct

SEQ ID NO: 2066750 - DNA, 15 bp, Homo sapiens
taaaatctgatttaa

SEQ ID NO: 2066751 - DNA, 16 bp, Homo sapiens
taaaatctgatttaat

SEQ ID NO: 2066752 - DNA, 14 bp, Homo sapiens
taaaatctggaaat

SEQ ID NO: 2066753 - DNA, 15 bp, Homo sapiens
taaaatgaaatgtct

SEQ ID NO: 2066754 - DNA, 16 bp, Homo sapiens
taaaatgaaatgtctt

SEQ ID NO: 2066755 - DNA, 14 bp, Homo sapiens
taaaatgattgtaa

SEQ ID NO: 2066756 - DNA, 15 bp, Homo sapiens
taaaatgattgtaaa

SEQ ID NO: 2066757 - DNA, 16 bp, Homo sapiens
taaaatgattgtaaaa

SEQ ID NO: 2066758 - DNA, 18 bp, Homo sapiens
taaaatgcagtccagaat

SEQ ID NO: 2066759 - DNA, 18 bp, Homo sapiens
taaaatgcccatttcgaa

SEQ ID NO: 2066760 - DNA, 13 bp, Homo sapiens
taaaatgtttcat

SEQ ID NO: 2066761 - DNA, 17 bp, Homo sapiens
taaaattagtgagattt

SEQ ID NO: 2066762 - DNA, 15 bp, Homo sapiens
taaaattatggtgaa

SEQ ID NO: 2066763 - DNA, 18 bp, Homo sapiens
taaaattatggtgaaatt

SEQ ID NO: 2066764 - DNA, 18 bp, Homo sapiens
taaaattatttttattaa

SEQ ID NO: 2066765 - DNA, 20 bp, Homo sapiens
taaaattatttttattaaat

SEQ ID NO: 2066766 - DNA, 22 bp, Homo sapiens
taaaattgacaacattttatta

SEQ ID NO: 2066767 - DNA, 17 bp, Homo sapiens
taaaattggtaattgaa

SEQ ID NO: 2066768 - DNA, 22 bp, Homo sapiens
gttcttttttgttacagctatg

SEQ ID NO: 2066769 - DNA, 15 bp, Homo sapiens
gttgaaagagtccta

SEQ ID NO: 2066770 - DNA, 16 bp, Homo sapiens
gttgaaatatgatgtt

SEQ ID NO: 2066771 - DNA, 20 bp, Homo sapiens
gttgaagaagagtttgcaaa

SEQ ID NO: 2066772 - DNA, 15 bp, Homo sapiens
gttgaatgacaacag

SEQ ID NO: 2066773 - DNA, 16 bp, Homo sapiens
gttgaatggcctgcct

SEQ ID NO: 2066774 - DNA, 19 bp, Homo sapiens
gttgacaaaatatataatg

SEQ ID NO: 2066775 - DNA, 18 bp, Homo sapiens
gttgacagttcatatgta

SEQ ID NO: 2066776 - DNA, 13 bp, Homo sapiens
gttgaccactcca

SEQ ID NO: 2066777 - DNA, 19 bp, Homo sapiens
gttgacccctttcccccac

SEQ ID NO: 2066778 - DNA, 23 bp, Homo sapiens
gttgacccctttcccccacccca

SEQ ID NO: 2066779 - DNA, 20 bp, Homo sapiens
gttgacttgacagaacactg

SEQ ID NO: 2066780 - DNA, 24 bp, Homo sapiens
gggcccacaatggagtgggagatc

SEQ ID NO: 2066781 - DNA, 17 bp, Homo sapiens
gggcccagagagggtgg

SEQ ID NO: 2066782 - DNA, 17 bp, Homo sapiens
gggcccaggctctggga

SEQ ID NO: 2066783 - DNA, 15 bp, Homo sapiens
gggccccaccaccta

SEQ ID NO: 2066784 - DNA, 13 bp, Homo sapiens
gggccccacctac

SEQ ID NO: 2066785 - DNA, 22 bp, Homo sapiens
gggccccacctacttgtgactg

SEQ ID NO: 2066786 - DNA, 13 bp, Homo sapiens
gggccccagatct

SEQ ID NO: 2066787 - DNA, 14 bp, Homo sapiens
gggccccagatctg

SEQ ID NO: 2066788 - DNA, 17 bp, Homo sapiens
gggccccatgctctgcc

SEQ ID NO: 2066789 - DNA, 20 bp, Homo sapiens
gggccccatgctctgcccca

SEQ ID NO: 2066790 - DNA, 15 bp, Homo sapiens
gggcccccctccttg

SEQ ID NO: 2066791 - DNA, 14 bp, Homo sapiens
gggccccggggctg

SEQ ID NO: 2066792 - DNA, 17 bp, Homo sapiens
gggccccggggctggca

SEQ ID NO: 2066793 - DNA, 21 bp, Homo sapiens
gggccccggggctggcaagca

SEQ ID NO: 2066794 - DNA, 14 bp, Homo sapiens
gggcccctccacgc

SEQ ID NO: 2066795 - DNA, 17 bp, Homo sapiens
gggcccctccctctgcc

SEQ ID NO: 2066796 - DNA, 19 bp, Homo sapiens
gggcccctccctctgcccc

SEQ ID NO: 2066797 - DNA, 19 bp, Homo sapiens
gggcccgaaagctgagacc

SEQ ID NO: 2066798 - DNA, 17 bp, Homo sapiens
gggcccgctttgcctgc

SEQ ID NO: 2066799 - DNA, 12 bp, Homo sapiens
gggccctgagct

SEQ ID NO: 2066800 - DNA, 12 bp, Homo sapiens
gggccctgcaca

SEQ ID NO: 2066801 - DNA, 17 bp, Homo sapiens
gggccctggggcctgta

SEQ ID NO: 2066802 - DNA, 15 bp, Homo sapiens
gggcccttggggcct

SEQ ID NO: 2066803 - DNA, 18 bp, Homo sapiens
gggcccttggggcctggc

SEQ ID NO: 2066804 - DNA, 19 bp, Homo sapiens
gggcccttggggcctggct

SEQ ID NO: 2066805 - DNA, 12 bp, Homo sapiens
gggccgctggcc

SEQ ID NO: 2066806 - DNA, 16 bp, Homo sapiens
gggccgctggcccagg

SEQ ID NO: 2066807 - DNA, 13 bp, Homo sapiens
gggccgggcaggt

SEQ ID NO: 2066808 - DNA, 20 bp, Homo sapiens
gggccgggcaggtcctgccc

SEQ ID NO: 2066809 - DNA, 16 bp, Homo sapiens
gggccggggaactggc

SEQ ID NO: 2066810 - DNA, 17 bp, Homo sapiens
gggccggggaactggcc

SEQ ID NO: 2066811 - DNA, 23 bp, Homo sapiens
gggccggggaactggccaagctg

SEQ ID NO: 2066812 - DNA, 20 bp, Homo sapiens
gggccgggtgaaaatgccag

SEQ ID NO: 2066813 - DNA, 13 bp, Homo sapiens
gggccgtgcccag

SEQ ID NO: 2066814 - DNA, 20 bp, Homo sapiens
gggcctagatccacacacag

SEQ ID NO: 2066815 - DNA, 19 bp, Homo sapiens
gggcctatggagagccctg

SEQ ID NO: 2066816 - DNA, 22 bp, Homo sapiens
gggcctatggagagccctggga

SEQ ID NO: 2066817 - DNA, 15 bp, Homo sapiens
gggcctcagtgccac

SEQ ID NO: 2066818 - DNA, 12 bp, Homo sapiens
gggcctcagttt

SEQ ID NO: 2066819 - DNA, 15 bp, Homo sapiens
gggcctcagtttccc

SEQ ID NO: 2066820 - DNA, 16 bp, Homo sapiens
gggcctcagtttcccc

SEQ ID NO: 2066821 - DNA, 17 bp, Homo sapiens
gggtgatgagggcagca

SEQ ID NO: 2066822 - DNA, 21 bp, Homo sapiens
gggtgatgagggcagcagcca

SEQ ID NO: 2066823 - DNA, 23 bp, Homo sapiens
gggtgatgagggcagcagccagc

SEQ ID NO: 2066824 - DNA, 19 bp, Homo sapiens
gggtgatgatgaccaagaa

SEQ ID NO: 2066825 - DNA, 16 bp, Homo sapiens
gggtgcacaggagggg

SEQ ID NO: 2066826 - DNA, 14 bp, Homo sapiens
gggtgcacccactc

SEQ ID NO: 2066827 - DNA, 19 bp, Homo sapiens
gggtgcacccactcaccag

SEQ ID NO: 2066828 - DNA, 23 bp, Homo sapiens
gggtgcacccactcaccagggtc

SEQ ID NO: 2066829 - DNA, 21 bp, Homo sapiens
gggtgccatgtggagtggaca

SEQ ID NO: 2066830 - DNA, 19 bp, Homo sapiens
gggtgcctatttattgggg

SEQ ID NO: 2066831 - DNA, 13 bp, Homo sapiens
gggtgcctcagag

SEQ ID NO: 2066832 - DNA, 22 bp, Homo sapiens
gggtgcctcagagcaggctcag

SEQ ID NO: 2066833 - DNA, 15 bp, Homo sapiens
gggtgcggcaggagc

SEQ ID NO: 2066834 - DNA, 20 bp, Homo sapiens
gggtggacgcaattgtggga

SEQ ID NO: 2066835 - DNA, 20 bp, Homo sapiens
gggtggatccactgtgcagg

SEQ ID NO: 2066836 - DNA, 17 bp, Homo sapiens
gggtggatgcctggtgg

SEQ ID NO: 2066837 - DNA, 17 bp, Homo sapiens
gggtggcacctcctgag

SEQ ID NO: 2066838 - DNA, 20 bp, Homo sapiens
gggtggcacctcctgagaag

SEQ ID NO: 2066839 - DNA, 12 bp, Homo sapiens
gggtggcaggca

SEQ ID NO: 2066840 - DNA, 22 bp, Homo sapiens
gggtggcaggcacacagcagcc

SEQ ID NO: 2066841 - DNA, 18 bp, Homo sapiens
gggtggccccctgtgcca

SEQ ID NO: 2066842 - DNA, 22 bp, Homo sapiens
gggtggccccctgtgccagctc

SEQ ID NO: 2066843 - DNA, 11 bp, Homo sapiens
gggtggcctcg

SEQ ID NO: 2066844 - DNA, 20 bp, Homo sapiens
gggtggctactctgtgccag

SEQ ID NO: 2066845 - DNA, 23 bp, Homo sapiens
gggtggctactctgtgccagagc

SEQ ID NO: 2066846 - DNA, 14 bp, Homo sapiens
gggtgggaagaaag

SEQ ID NO: 2066847 - DNA, 16 bp, Homo sapiens
gggtgggaagaaagaa

SEQ ID NO: 2066848 - DNA, 12 bp, Homo sapiens
gggtgggcaggg

SEQ ID NO: 2066849 - DNA, 14 bp, Homo sapiens
gggtgggcctggcc

SEQ ID NO: 2066850 - DNA, 15 bp, Homo sapiens
gggtgggcctggcct

SEQ ID NO: 2066851 - DNA, 20 bp, Homo sapiens
gggtgggcctggcctgagct

SEQ ID NO: 2066852 - DNA, 22 bp, Homo sapiens
gggtggggcaatggggagaggc

SEQ ID NO: 2066853 - DNA, 12 bp, Homo sapiens
gggtggggctgc

SEQ ID NO: 2066854 - DNA, 18 bp, Homo sapiens
gggtgtaacaggtctcct

SEQ ID NO: 2066855 - DNA, 17 bp, Homo sapiens
gggtgtcatctgaggag

SEQ ID NO: 2066856 - DNA, 14 bp, Homo sapiens
gggtgtctggaagc

SEQ ID NO: 2066857 - DNA, 16 bp, Homo sapiens
gggtgtctggaagctg

SEQ ID NO: 2066858 - DNA, 22 bp, Homo sapiens
gggtgtgtgtttgtgtgagaga

SEQ ID NO: 2066859 - DNA, 17 bp, Homo sapiens
gggtgttaaggcagtga

SEQ ID NO: 2066860 - DNA, 23 bp, Homo sapiens
gggttcaagcgattcttctgctt

SEQ ID NO: 2066861 - DNA, 17 bp, Homo sapiens
gggttcagcccctcctc

SEQ ID NO: 2066862 - DNA, 17 bp, Homo sapiens
gggttcccccagacaga

SEQ ID NO: 2066863 - DNA, 12 bp, Homo sapiens
gggttgaaaatt

SEQ ID NO: 2066864 - DNA, 23 bp, Homo sapiens
gggttgaaaattcaaaaagtgtt

SEQ ID NO: 2066865 - DNA, 22 bp, Homo sapiens
gggttgcgggggagctggaaat

SEQ ID NO: 2066866 - DNA, 18 bp, Homo sapiens
gggttgtactattgttta

SEQ ID NO: 2066867 - DNA, 14 bp, Homo sapiens
gggttgtgaggcct

SEQ ID NO: 2066868 - DNA, 20 bp, Homo sapiens
gggtttcactgtgttggcca

SEQ ID NO: 2066869 - DNA, 20 bp, Homo sapiens
gggtttcgtcatgttggcca

SEQ ID NO: 2066870 - DNA, 22 bp, Homo sapiens
gggtttctgacccaagaggtgg

SEQ ID NO: 2066871 - DNA, 23 bp, Homo sapiens
gggttttattgtccttcagagct

SEQ ID NO: 2066872 - DNA, 20 bp, Homo sapiens
gggttttattgtttaaaatc

SEQ ID NO: 2066873 - DNA, 16 bp, Homo sapiens
gggttttccaccctgg

SEQ ID NO: 2066874 - DNA, 20 bp, Homo sapiens
gggttttctaactgtaaatc

SEQ ID NO: 2066875 - DNA, 12 bp, Homo sapiens
gggttttgtatt

SEQ ID NO: 2066876 - DNA, 23 bp, Homo sapiens
ggtaaaaagattatatatcataa

SEQ ID NO: 2066877 - DNA, 18 bp, Homo sapiens
ggtaaaaaggatgaaagt

SEQ ID NO: 2066878 - DNA, 22 bp, Homo sapiens
ggtaacatcctttctattgaaa

SEQ ID NO: 2066879 - DNA, 23 bp, Homo sapiens
ggtaagaagccgggaacagacaa

SEQ ID NO: 2066880 - DNA, 21 bp, Homo sapiens
ggtacagcagggtcttgctgt

SEQ ID NO: 2066881 - DNA, 18 bp, Homo sapiens
ggtacatttctctgagca

SEQ ID NO: 2066882 - DNA, 21 bp, Homo sapiens
ggtaccagcagaaaggttagt

SEQ ID NO: 2066883 - DNA, 11 bp, Homo sapiens
ggtacccactg

SEQ ID NO: 2066884 - DNA, 13 bp, Homo sapiens
ggtacccactgct

SEQ ID NO: 2066885 - DNA, 16 bp, Homo sapiens
ggtacctcagtttctc

SEQ ID NO: 2066886 - DNA, 14 bp, Homo sapiens
ggtacggtggcacg

SEQ ID NO: 2066887 - DNA, 14 bp, Homo sapiens
ggtacttcctcctg

SEQ ID NO: 2066888 - DNA, 15 bp, Homo sapiens
ggtacttcctcctga

SEQ ID NO: 2066889 - DNA, 17 bp, Homo sapiens
ggtacttgtggacacag

SEQ ID NO: 2066890 - DNA, 20 bp, Homo sapiens
ggtacttgtggacacagctc

SEQ ID NO: 2066891 - DNA, 21 bp, Homo sapiens
ggtacttgtggacacagctct

SEQ ID NO: 2066892 - DNA, 19 bp, Homo sapiens
ggtagaatgtaaagcttgt

SEQ ID NO: 2066893 - DNA, 23 bp, Homo sapiens
ggtagagtttgaaggaggtgagg

SEQ ID NO: 2066894 - DNA, 18 bp, Homo sapiens
ggtagatcgcttgagccc

SEQ ID NO: 2066895 - DNA, 21 bp, Homo sapiens
ggtagatcgcttgagcccagg

SEQ ID NO: 2066896 - DNA, 22 bp, Homo sapiens
ggtagcagataaagacagctga

SEQ ID NO: 2066897 - DNA, 13 bp, Homo sapiens
ggtagcccagcac

SEQ ID NO: 2066898 - DNA, 18 bp, Homo sapiens
ggtagcccatcaaaatgt

SEQ ID NO: 2066899 - DNA, 14 bp, Homo sapiens
ggtagcgagctgct

SEQ ID NO: 2066900 - DNA, 16 bp, Homo sapiens
ggtagctcccagcact

SEQ ID NO: 2066901 - DNA, 18 bp, Homo sapiens
ggtagcttacctgacaca

SEQ ID NO: 2066902 - DNA, 13 bp, Homo sapiens
ggtaggaaagcac

SEQ ID NO: 2066903 - DNA, 12 bp, Homo sapiens
ggtaggaaatgt

SEQ ID NO: 2066904 - DNA, 11 bp, Homo sapiens
ggtaggccctt

SEQ ID NO: 2066905 - DNA, 23 bp, Homo sapiens
ggtaggcccttgtcctgccagct

SEQ ID NO: 2066906 - DNA, 22 bp, Homo sapiens
ggtagtactcctgcaaaatttt

SEQ ID NO: 2066907 - DNA, 20 bp, Homo sapiens
ggtataatggttgactgggt

SEQ ID NO: 2066908 - DNA, 18 bp, Homo sapiens
ggtatatttagaccctgt

SEQ ID NO: 2066909 - DNA, 17 bp, Homo sapiens
ggtatatttgtgtatgt

SEQ ID NO: 2066910 - DNA, 14 bp, Homo sapiens
ggtatcaggcacag

SEQ ID NO: 2066911 - DNA, 17 bp, Homo sapiens
ggtatcaggcacaggca

SEQ ID NO: 2066912 - DNA, 18 bp, Homo sapiens
ggtatcaggcacaggcag

SEQ ID NO: 2066913 - DNA, 19 bp, Homo sapiens
ggtatcaggcacaggcagg

SEQ ID NO: 2066914 - DNA, 22 bp, Homo sapiens
ggtatgaacttgaggacacatg

SEQ ID NO: 2066915 - DNA, 23 bp, Homo sapiens
ggtatgaacttgaggacacatgt

SEQ ID NO: 2066916 - DNA, 21 bp, Homo sapiens
ggtatgaccttctaggaagct

SEQ ID NO: 2066917 - DNA, 22 bp, Homo sapiens
ggtatgatcacggctcactgca

SEQ ID NO: 2066918 - DNA, 18 bp, Homo sapiens
ggtatgctggccagcacc

SEQ ID NO: 2066919 - DNA, 20 bp, Homo sapiens
ggtatgctggccagcaccct

SEQ ID NO: 2066920 - DNA, 21 bp, Homo sapiens
ggtatgctggccagcaccctc

SEQ ID NO: 2066921 - DNA, 15 bp, Homo sapiens
ggtatggaactctct

SEQ ID NO: 2066922 - DNA, 13 bp, Homo sapiens
ggtatgggaagcc

SEQ ID NO: 2066923 - DNA, 16 bp, Homo sapiens
ggtatgtagcccggcc

SEQ ID NO: 2066924 - DNA, 20 bp, Homo sapiens
ggtatgtagcccggccaggg

SEQ ID NO: 2066925 - DNA, 14 bp, Homo sapiens
ggtatgtgtgtgta

SEQ ID NO: 2066926 - DNA, 15 bp, Homo sapiens
ggtattaaagatgtg

SEQ ID NO: 2066927 - DNA, 19 bp, Homo sapiens
ggtattccttttgtgtaca

SEQ ID NO: 2066928 - DNA, 18 bp, Homo sapiens
ggtattgcgaaacaactt

SEQ ID NO: 2066929 - DNA, 14 bp, Homo sapiens
ggtatttataatat

SEQ ID NO: 2066930 - DNA, 22 bp, Homo sapiens
ggtattttaggcagggatttga

SEQ ID NO: 2066931 - DNA, 18 bp, Homo sapiens
ggtcaaaatagtgccact

SEQ ID NO: 2066932 - DNA, 22 bp, Homo sapiens
ggtcaaaccgcactcacccatg

SEQ ID NO: 2066933 - DNA, 19 bp, Homo sapiens
ggtcaacatggtgaaaccc

SEQ ID NO: 2066934 - DNA, 17 bp, Homo sapiens
ggtcacattcaggaaga

SEQ ID NO: 2066935 - DNA, 15 bp, Homo sapiens
ggtcaccaccctccc

SEQ ID NO: 2066936 - DNA, 18 bp, Homo sapiens
ggttgcgggggagctgga

SEQ ID NO: 2066937 - DNA, 19 bp, Homo sapiens
ggttgcttctggctcctcc

SEQ ID NO: 2066938 - DNA, 18 bp, Homo sapiens
ggttggatgggaagatgg

SEQ ID NO: 2066939 - DNA, 19 bp, Homo sapiens
ggttgggcgtgctacctgc

SEQ ID NO: 2066940 - DNA, 17 bp, Homo sapiens
ggttgtactattgttta

SEQ ID NO: 2066941 - DNA, 16 bp, Homo sapiens
ggttgtgaggcctggc

SEQ ID NO: 2066942 - DNA, 21 bp, Homo sapiens
ggttgtgaggcctggccaggc

SEQ ID NO: 2066943 - DNA, 22 bp, Homo sapiens
ggttgtgaggcctggccaggca

SEQ ID NO: 2066944 - DNA, 19 bp, Homo sapiens
ggttgttaatgttgggatt

SEQ ID NO: 2066945 - DNA, 22 bp, Homo sapiens
ggttgttgccaactaagccctc

SEQ ID NO: 2066946 - DNA, 19 bp, Homo sapiens
ggtttacattcatctcatt

SEQ ID NO: 2066947 - DNA, 22 bp, Homo sapiens
ggtttacattcatctcattcca

SEQ ID NO: 2066948 - DNA, 14 bp, Homo sapiens
ggtttacccagtgg

SEQ ID NO: 2066949 - DNA, 13 bp, Homo sapiens
ggtttactctcaa

SEQ ID NO: 2066950 - DNA, 12 bp, Homo sapiens
ggtttactgctg

SEQ ID NO: 2066951 - DNA, 15 bp, Homo sapiens
ggtttccactactgt

SEQ ID NO: 2066952 - DNA, 22 bp, Homo sapiens
ggtttccactgtcttgcctgcc

SEQ ID NO: 2066953 - DNA, 11 bp, Homo sapiens
ggtttccaggc

SEQ ID NO: 2066954 - DNA, 17 bp, Homo sapiens
ggtttctgagttcctgc

SEQ ID NO: 2066955 - DNA, 21 bp, Homo sapiens
ggtttgaaagtgaataaactt

SEQ ID NO: 2066956 - DNA, 17 bp, Homo sapiens
ggtttgccctgcctgca

SEQ ID NO: 2066957 - DNA, 12 bp, Homo sapiens
ggtttggggaga

SEQ ID NO: 2066958 - DNA, 13 bp, Homo sapiens
ggtttggggagaa

SEQ ID NO: 2066959 - DNA, 19 bp, Homo sapiens
ggtttgtgtttgagtttta

SEQ ID NO: 2066960 - DNA, 16 bp, Homo sapiens
ggtttgttgtaaataa

SEQ ID NO: 2066961 - DNA, 15 bp, Homo sapiens
ggttttatattttta

SEQ ID NO: 2066962 - DNA, 13 bp, Homo sapiens
ggttttatcagtg

SEQ ID NO: 2066963 - DNA, 18 bp, Homo sapiens
ggttttctaactgtaaat

SEQ ID NO: 2066964 - DNA, 23 bp, Homo sapiens
ggttttctaactgtaaatcactt

SEQ ID NO: 2066965 - DNA, 15 bp, Homo sapiens
ggttttctgttactt

SEQ ID NO: 2066966 - DNA, 14 bp, Homo sapiens
ggttttcttcccat

SEQ ID NO: 2066967 - DNA, 14 bp, Homo sapiens
ggttttggagtcag

SEQ ID NO: 2066968 - DNA, 19 bp, Homo sapiens
ggtttttatatttctcgta

SEQ ID NO: 2066969 - DNA, 17 bp, Homo sapiens
gtaaaaagattatatat

SEQ ID NO: 2066970 - DNA, 20 bp, Homo sapiens
gtaaaaagattatatatcat

SEQ ID NO: 2066971 - DNA, 18 bp, Homo sapiens
gtaaaaccacagcagttg

SEQ ID NO: 2066972 - DNA, 17 bp, Homo sapiens
gtaaaaggtattaaatt

SEQ ID NO: 2066973 - DNA, 15 bp, Homo sapiens
gtaaaagtgtgagca

SEQ ID NO: 2066974 - DNA, 13 bp, Homo sapiens
gtaaacagaagga

SEQ ID NO: 2066975 - DNA, 15 bp, Homo sapiens
gtaaacagtgcctgc

SEQ ID NO: 2066976 - DNA, 20 bp, Homo sapiens
gtaaacatgtgttttaattc

SEQ ID NO: 2066977 - DNA, 23 bp, Homo sapiens
gtaaactataaactactgtaatt

SEQ ID NO: 2066978 - DNA, 18 bp, Homo sapiens
gtaaagagtggagcaaat

SEQ ID NO: 2066979 - DNA, 17 bp, Homo sapiens
gtaaagcttaaattgct

SEQ ID NO: 2066980 - DNA, 16 bp, Homo sapiens
gtaaagtatgtaaaca

SEQ ID NO: 2066981 - DNA, 15 bp, Homo sapiens
gtaaagtcaaggaga

SEQ ID NO: 2066982 - DNA, 13 bp, Homo sapiens
gtaaataaataga

SEQ ID NO: 2066983 - DNA, 17 bp, Homo sapiens
gtaaatacatgtgtgga

SEQ ID NO: 2066984 - DNA, 20 bp, Homo sapiens
gtaaatagttttaaatatga

SEQ ID NO: 2066985 - DNA, 12 bp, Homo sapiens
gtaaatatttat

SEQ ID NO: 2066986 - DNA, 23 bp, Homo sapiens
gtaaatattttaaagaattgtgt

SEQ ID NO: 2066987 - DNA, 11 bp, Homo sapiens
gtaaatcactt

SEQ ID NO: 2066988 - DNA, 12 bp, Homo sapiens
gtaaatcacttg

SEQ ID NO: 2066989 - DNA, 19 bp, Homo sapiens
gtaaatcacttgtaaataa

SEQ ID NO: 2066990 - DNA, 20 bp, Homo sapiens
gtaaatcacttgtaaataaa

SEQ ID NO: 2066991 - DNA, 22 bp, Homo sapiens
gtaaatgaccaagaaaaagaaa

SEQ ID NO: 2066992 - DNA, 21 bp, Homo sapiens
gtaaatgctcgtgtgatttcc

SEQ ID NO: 2066993 - DNA, 17 bp, Homo sapiens
gtaaatgtttaggtttt

SEQ ID NO: 2066994 - DNA, 14 bp, Homo sapiens
gtaaattaggaggc

SEQ ID NO: 2066995 - DNA, 16 bp, Homo sapiens
gtaaattctggaaatg

SEQ ID NO: 2066996 - DNA, 13 bp, Homo sapiens
gtaacaagccaga

SEQ ID NO: 2066997 - DNA, 14 bp, Homo sapiens
gtaacaagccagat

SEQ ID NO: 2066998 - DNA, 19 bp, Homo sapiens
gtaacaattttaatgctat

SEQ ID NO: 2066999 - DNA, 17 bp, Homo sapiens
gtaacacaagccacaga

SEQ ID NO: 2067000 - DNA, 12 bp, Homo sapiens
gtaacacatctt

SEQ ID NO: 2067001 - DNA, 16 bp, Homo sapiens
gtaacactgcaagaag

SEQ ID NO: 2067002 - DNA, 16 bp, Homo sapiens
gtaacaggtctcctct

SEQ ID NO: 2067003 - DNA, 12 bp, Homo sapiens
gtaacatgttta

SEQ ID NO: 2067004 - DNA, 15 bp, Homo sapiens
gtaactattgaattg

SEQ ID NO: 2067005 - DNA, 12 bp, Homo sapiens
gtaactgctgag

SEQ ID NO: 2067006 - DNA, 16 bp, Homo sapiens
gtaacttaaccagcac

SEQ ID NO: 2067007 - DNA, 23 bp, Homo sapiens
gtaacttaaccagcacatttctc

SEQ ID NO: 2067008 - DNA, 11 bp, Homo sapiens
gtaacttcaaa

SEQ ID NO: 2067009 - DNA, 14 bp, Homo sapiens
gtaacttttgtaag

SEQ ID NO: 2067010 - DNA, 16 bp, Homo sapiens
gtaagaccccatctct

SEQ ID NO: 2067011 - DNA, 23 bp, Homo sapiens
gtaagagctgatgtgagtgtgtg

SEQ ID NO: 2067012 - DNA, 19 bp, Homo sapiens
gtaagcaacttgcttctaa

SEQ ID NO: 2067013 - DNA, 13 bp, Homo sapiens
gtaagctctggct

SEQ ID NO: 2067014 - DNA, 13 bp, Homo sapiens
gtaagtcaggagt

SEQ ID NO: 2067015 - DNA, 15 bp, Homo sapiens
gtaagttctgaaaac

SEQ ID NO: 2067016 - DNA, 22 bp, Homo sapiens
gtaagttctgaaaactgtttat

SEQ ID NO: 2067017 - DNA, 14 bp, Homo sapiens
gtaataaaacccag

SEQ ID NO: 2067018 - DNA, 13 bp, Homo sapiens
gtaataaactctc

SEQ ID NO: 2067019 - DNA, 13 bp, Homo sapiens
gtaataagaaagt

SEQ ID NO: 2067020 - DNA, 17 bp, Homo sapiens
gtaatagattatagttg

SEQ ID NO: 2067021 - DNA, 19 bp, Homo sapiens
gtaatataatggaagagaa

SEQ ID NO: 2067022 - DNA, 13 bp, Homo sapiens
gtaatatattgct

SEQ ID NO: 2067023 - DNA, 11 bp, Homo sapiens
gtaatcaggca

SEQ ID NO: 2067024 - DNA, 15 bp, Homo sapiens
gtaatcaggcagcct

SEQ ID NO: 2067025 - DNA, 14 bp, Homo sapiens
gtaatcccagcact

SEQ ID NO: 2067026 - DNA, 17 bp, Homo sapiens
gtaatcccagctactca

SEQ ID NO: 2067027 - DNA, 20 bp, Homo sapiens
gtaatcccagctacttggga

SEQ ID NO: 2067028 - DNA, 18 bp, Homo sapiens
gtaatgattatatgacaa

SEQ ID NO: 2067029 - DNA, 15 bp, Homo sapiens
gtaatgcacaattta

SEQ ID NO: 2067030 - DNA, 17 bp, Homo sapiens
gtaatgcacaatttaga

SEQ ID NO: 2067031 - DNA, 23 bp, Homo sapiens
gtaatgcacaatttagaaaacat

SEQ ID NO: 2067032 - DNA, 20 bp, Homo sapiens
gtaatgcttagagaatgttc

SEQ ID NO: 2067033 - DNA, 18 bp, Homo sapiens
gtaatgggccaattaaaa

SEQ ID NO: 2067034 - DNA, 22 bp, Homo sapiens
gtaatgggccaattaaaatata

SEQ ID NO: 2067035 - DNA, 12 bp, Homo sapiens
gtaatgggcctg

SEQ ID NO: 2067036 - DNA, 16 bp, Homo sapiens
gtaatgggcctgccca

SEQ ID NO: 2067037 - DNA, 12 bp, Homo sapiens
gtaatgtatctt

SEQ ID NO: 2067038 - DNA, 14 bp, Homo sapiens
gtaatgtatcttat

SEQ ID NO: 2067039 - DNA, 17 bp, Homo sapiens
gtaatgtatcttattta

SEQ ID NO: 2067040 - DNA, 19 bp, Homo sapiens
gtaatgtcaccaccttccc

SEQ ID NO: 2067041 - DNA, 20 bp, Homo sapiens
gtaattatcgggaacagtgt

SEQ ID NO: 2067042 - DNA, 23 bp, Homo sapiens
gtaattgcttacatttttacaat

SEQ ID NO: 2067043 - DNA, 17 bp, Homo sapiens
gtaattggtgacaatgt

SEQ ID NO: 2067044 - DNA, 21 bp, Homo sapiens
gtaattggtgacaatgtcaca

SEQ ID NO: 2067045 - DNA, 21 bp, Homo sapiens
gtaattgttgctaatcttctt

SEQ ID NO: 2067046 - DNA, 14 bp, Homo sapiens
gtaatttataaaat

SEQ ID NO: 2067047 - DNA, 21 bp, Homo sapiens
gtaatttctgtgtattttgag

SEQ ID NO: 2067048 - DNA, 14 bp, Homo sapiens
gtaatttgtatctg

SEQ ID NO: 2067049 - DNA, 15 bp, Homo sapiens
gtaatttgtatctga

SEQ ID NO: 2067050 - DNA, 21 bp, Homo sapiens
gtaatttgtatctgaaggaga

SEQ ID NO: 2067051 - DNA, 21 bp, Homo sapiens
gtaattttgtagtagttgatg

SEQ ID NO: 2067052 - DNA, 15 bp, Homo sapiens
gtaattttgtttgta

SEQ ID NO: 2067053 - DNA, 18 bp, Homo sapiens
gtaattttgtttgtaatc

SEQ ID NO: 2067054 - DNA, 17 bp, Homo sapiens
ggtgctataggctggag

SEQ ID NO: 2067055 - DNA, 19 bp, Homo sapiens
ggtgctataggctggagaa

SEQ ID NO: 2067056 - DNA, 18 bp, Homo sapiens
ggtgctcacgactcttcc

SEQ ID NO: 2067057 - DNA, 12 bp, Homo sapiens
ggtgctctggcg

SEQ ID NO: 2067058 - DNA, 12 bp, Homo sapiens
ggtgctgatgag

SEQ ID NO: 2067059 - DNA, 15 bp, Homo sapiens
ggtgctgccatccag

SEQ ID NO: 2067060 - DNA, 19 bp, Homo sapiens
ggtgctgtggccagggtga

SEQ ID NO: 2067061 - DNA, 18 bp, Homo sapiens
ggtgcttttgatgtgaaa

SEQ ID NO: 2067062 - DNA, 13 bp, Homo sapiens
ggtggaagccctc

SEQ ID NO: 2067063 - DNA, 15 bp, Homo sapiens
ggtggacagtcctgg

SEQ ID NO: 2067064 - DNA, 17 bp, Homo sapiens
ggtggacagtcctggga

SEQ ID NO: 2067065 - DNA, 18 bp, Homo sapiens
ggtggacagtcctgggag

SEQ ID NO: 2067066 - DNA, 17 bp, Homo sapiens
ggtggactgcgctggac

SEQ ID NO: 2067067 - DNA, 17 bp, Homo sapiens
ggtggatcacagaggct

SEQ ID NO: 2067068 - DNA, 13 bp, Homo sapiens
ggtggatgcctgg

SEQ ID NO: 2067069 - DNA, 12 bp, Homo sapiens
ggtggcaccaga

SEQ ID NO: 2067070 - DNA, 20 bp, Homo sapiens
ggtggcaccagatgcaacct

SEQ ID NO: 2067071 - DNA, 23 bp, Homo sapiens
ggtggcagctgcggtccacccag

SEQ ID NO: 2067072 - DNA, 14 bp, Homo sapiens
ggtggcaggaccag

SEQ ID NO: 2067073 - DNA, 23 bp, Homo sapiens
ggtggcaggcacacagcagcccc

SEQ ID NO: 2067074 - DNA, 15 bp, Homo sapiens
ggtggcatacgcctg

SEQ ID NO: 2067075 - DNA, 12 bp, Homo sapiens
ggtggccatgct

SEQ ID NO: 2067076 - DNA, 17 bp, Homo sapiens
ggtggccatgcttcttg

SEQ ID NO: 2067077 - DNA, 19 bp, Homo sapiens
ggtggccatgtcgcctgcc

SEQ ID NO: 2067078 - DNA, 17 bp, Homo sapiens
ggtggccccctgtgcca

SEQ ID NO: 2067079 - DNA, 22 bp, Homo sapiens
ggtggccccctgtgccagctca

SEQ ID NO: 2067080 - DNA, 17 bp, Homo sapiens
ggtggcccgacagcctg

SEQ ID NO: 2067081 - DNA, 19 bp, Homo sapiens
ggtggcgggcacctatagt

SEQ ID NO: 2067082 - DNA, 16 bp, Homo sapiens
ggtggctagtcagaga

SEQ ID NO: 2067083 - DNA, 14 bp, Homo sapiens
ggtggctcctgcca

SEQ ID NO: 2067084 - DNA, 18 bp, Homo sapiens
ggtggctgacccagtccc

SEQ ID NO: 2067085 - DNA, 19 bp, Homo sapiens
ggtggctgacccagtccct

SEQ ID NO: 2067086 - DNA, 22 bp, Homo sapiens
ggtggctgacccagtccctggg

SEQ ID NO: 2067087 - DNA, 13 bp, Homo sapiens
ggtggctgagctt

SEQ ID NO: 2067088 - DNA, 12 bp, Homo sapiens
ggtggctgggtt

SEQ ID NO: 2067089 - DNA, 17 bp, Homo sapiens
ggtggctgtctctgtcc

SEQ ID NO: 2067090 - DNA, 23 bp, Homo sapiens
ggtggcttttgcggttcaggaaa

SEQ ID NO: 2067091 - DNA, 12 bp, Homo sapiens
ggtgggaatcag

SEQ ID NO: 2067092 - DNA, 16 bp, Homo sapiens
ggtgggaatcagatct

SEQ ID NO: 2067093 - DNA, 16 bp, Homo sapiens
ggtgggagagcccagc

SEQ ID NO: 2067094 - DNA, 16 bp, Homo sapiens
ggtgggcagaggctgg

SEQ ID NO: 2067095 - DNA, 19 bp, Homo sapiens
ggtgggcagcagctcagcc

SEQ ID NO: 2067096 - DNA, 18 bp, Homo sapiens
ggtgggcagctgggcccc

SEQ ID NO: 2067097 - DNA, 13 bp, Homo sapiens
ggtgggcagggct

SEQ ID NO: 2067098 - DNA, 15 bp, Homo sapiens
ggtgggcagggctgg

SEQ ID NO: 2067099 - DNA, 17 bp, Homo sapiens
ggtgggcagggctggga

SEQ ID NO: 2067100 - DNA, 12 bp, Homo sapiens
ggtgggcctggc

SEQ ID NO: 2067101 - DNA, 13 bp, Homo sapiens
ggtgggcctggcc

SEQ ID NO: 2067102 - DNA, 14 bp, Homo sapiens
ggtgggcctggcct

SEQ ID NO: 2067103 - DNA, 15 bp, Homo sapiens
ggtgggcctggcctg

SEQ ID NO: 2067104 - DNA, 19 bp, Homo sapiens
ggtgggcctggcctgagct

SEQ ID NO: 2067105 - DNA, 15 bp, Homo sapiens
ggtgggctgagccct

SEQ ID NO: 2067106 - DNA, 16 bp, Homo sapiens
ggtgggctggcccagc

SEQ ID NO: 2067107 - DNA, 12 bp, Homo sapiens
ggtggggaccaa

SEQ ID NO: 2067108 - DNA, 12 bp, Homo sapiens
ggtggggcagct

SEQ ID NO: 2067109 - DNA, 20 bp, Homo sapiens
ggtggggggatcacaaggtc

SEQ ID NO: 2067110 - DNA, 20 bp, Homo sapiens
ggtgggtccaggaaggcagc

SEQ ID NO: 2067111 - DNA, 17 bp, Homo sapiens
ggtgggttttcttccca

SEQ ID NO: 2067112 - DNA, 13 bp, Homo sapiens
ggtggtctgcttt

SEQ ID NO: 2067113 - DNA, 14 bp, Homo sapiens
ggtggtgacctctg

SEQ ID NO: 2067114 - DNA, 15 bp, Homo sapiens
ggtggtgacctctgc

SEQ ID NO: 2067115 - DNA, 15 bp, Homo sapiens
ggtggtggaggagga

SEQ ID NO: 2067116 - DNA, 19 bp, Homo sapiens
ggtggtggcagctgggcag

SEQ ID NO: 2067117 - DNA, 18 bp, Homo sapiens
ggtgtaaaatatctacct

SEQ ID NO: 2067118 - DNA, 22 bp, Homo sapiens
ggtgtaaaatatctacctgccc

SEQ ID NO: 2067119 - DNA, 17 bp, Homo sapiens
ggtgtaaagttgttcgc

SEQ ID NO: 2067120 - DNA, 10 bp, Homo sapiens
ggtgtaaata

SEQ ID NO: 2067121 - DNA, 17 bp, Homo sapiens
ggtgtcaagagggtctg

SEQ ID NO: 2067122 - DNA, 19 bp, Homo sapiens
ggtgtcaagagggtctgag

SEQ ID NO: 2067123 - DNA, 13 bp, Homo sapiens
ggtgtcaccctgc

SEQ ID NO: 2067124 - DNA, 12 bp, Homo sapiens
ggtgtcccaagc

SEQ ID NO: 2067125 - DNA, 16 bp, Homo sapiens
ggtgtctgcacccagg

SEQ ID NO: 2067126 - DNA, 16 bp, Homo sapiens
ggtgtctggaagctga

SEQ ID NO: 2067127 - DNA, 10 bp, Homo sapiens
ggtgtctttt

SEQ ID NO: 2067128 - DNA, 21 bp, Homo sapiens
ggtgtcttttccactcctatg

SEQ ID NO: 2067129 - DNA, 13 bp, Homo sapiens
ggtgtgaggctgg

SEQ ID NO: 2067130 - DNA, 14 bp, Homo sapiens
ggtgtgaggctggg

SEQ ID NO: 2067131 - DNA, 15 bp, Homo sapiens
ggtgtgccaaactac

SEQ ID NO: 2067132 - DNA, 13 bp, Homo sapiens
ggtgtgcctgcag

SEQ ID NO: 2067133 - DNA, 15 bp, Homo sapiens
ggtgtgcctgccctg

SEQ ID NO: 2067134 - DNA, 16 bp, Homo sapiens
ggtgtgcctgccctgg

SEQ ID NO: 2067135 - DNA, 19 bp, Homo sapiens
ggtgtggcctcagccctca

SEQ ID NO: 2067136 - DNA, 16 bp, Homo sapiens
ggtgtggtggctcacg

SEQ ID NO: 2067137 - DNA, 18 bp, Homo sapiens
ggtgtggtggctcatggc

SEQ ID NO: 2067138 - DNA, 14 bp, Homo sapiens
ggtgtgtgtagcca

SEQ ID NO: 2067139 - DNA, 14 bp, Homo sapiens
ggtgttaatttttg

SEQ ID NO: 2067140 - DNA, 16 bp, Homo sapiens
ggtgttacaaggcact

SEQ ID NO: 2067141 - DNA, 19 bp, Homo sapiens
ggttaaggtgggtccagga

SEQ ID NO: 2067142 - DNA, 13 bp, Homo sapiens
ggttaattccata

SEQ ID NO: 2067143 - DNA, 20 bp, Homo sapiens
ggttaggagttcgagaccag

SEQ ID NO: 2067144 - DNA, 16 bp, Homo sapiens
ggttaggatttaacag

SEQ ID NO: 2067145 - DNA, 16 bp, Homo sapiens
ggttatctgcctggcc

SEQ ID NO: 2067146 - DNA, 23 bp, Homo sapiens
ggttatctgcctggcctggctcc

SEQ ID NO: 2067147 - DNA, 24 bp, Homo sapiens
ggttatttctcaacaaagcacagt

SEQ ID NO: 2067148 - DNA, 18 bp, Homo sapiens
ggttatttttgtccctgc

SEQ ID NO: 2067149 - DNA, 21 bp, Homo sapiens
ggttatttttgtccctgctcc

SEQ ID NO: 2067150 - DNA, 21 bp, Homo sapiens
ggttcaagcgattcttctgct

SEQ ID NO: 2067151 - DNA, 22 bp, Homo sapiens
ggttcaccttgccgagagaggc

SEQ ID NO: 2067152 - DNA, 16 bp, Homo sapiens
ggttcagcccctcctc

SEQ ID NO: 2067153 - DNA, 18 bp, Homo sapiens
ggttcagcccctcctctg

SEQ ID NO: 2067154 - DNA, 20 bp, Homo sapiens
ggttcagcccctcctctgcc

SEQ ID NO: 2067155 - DNA, 12 bp, Homo sapiens
ggttcagcttgt

SEQ ID NO: 2067156 - DNA, 19 bp, Homo sapiens
ggttcattccccggccctc

SEQ ID NO: 2067157 - DNA, 14 bp, Homo sapiens
ggttccatgcctga

SEQ ID NO: 2067158 - DNA, 15 bp, Homo sapiens
ggttccatgcctgag

SEQ ID NO: 2067159 - DNA, 16 bp, Homo sapiens
ggttcccaataaaagt

SEQ ID NO: 2067160 - DNA, 17 bp, Homo sapiens
ggttcccaataaaagtg

SEQ ID NO: 2067161 - DNA, 20 bp, Homo sapiens
ggttcccaataaaagtgact

SEQ ID NO: 2067162 - DNA, 22 bp, Homo sapiens
ggttcccagcagctgggccggc

SEQ ID NO: 2067163 - DNA, 18 bp, Homo sapiens
ggttctccccctttctct

SEQ ID NO: 2067164 - DNA, 23 bp, Homo sapiens
ggttctggggaggaagggccagg

SEQ ID NO: 2067165 - DNA, 16 bp, Homo sapiens
ggttctttcttcctct

SEQ ID NO: 2067166 - DNA, 15 bp, Homo sapiens
ggttgaaggcagtct

SEQ ID NO: 2067167 - DNA, 16 bp, Homo sapiens
ggttgaaggcagtctg

SEQ ID NO: 2067168 - DNA, 21 bp, Homo sapiens
ggttgaaggcagtctgaaccc

SEQ ID NO: 2067169 - DNA, 16 bp, Homo sapiens
ggttgactttcaggta

SEQ ID NO: 2067170 - DNA, 19 bp, Homo sapiens
ggttgaggggctcctggaa

SEQ ID NO: 2067171 - DNA, 14 bp, Homo sapiens
ggttgcaaccactg

SEQ ID NO: 2067172 - DNA, 15 bp, Homo sapiens
gtcaacatcttctct

SEQ ID NO: 2067173 - DNA, 15 bp, Homo sapiens
gtcaacggccctgtt

SEQ ID NO: 2067174 - DNA, 13 bp, Homo sapiens
gtcaactggagca

SEQ ID NO: 2067175 - DNA, 13 bp, Homo sapiens
gtcaactggctgg

SEQ ID NO: 2067176 - DNA, 18 bp, Homo sapiens
gtcaactggctggccagt

SEQ ID NO: 2067177 - DNA, 18 bp, Homo sapiens
gtcaagattttttttgta

SEQ ID NO: 2067178 - DNA, 14 bp, Homo sapiens
gtcaagtcatgatg

SEQ ID NO: 2067179 - DNA, 16 bp, Homo sapiens
gtcaatattaaataca

SEQ ID NO: 2067180 - DNA, 20 bp, Homo sapiens
gtcaatcccaaaagtcacca

SEQ ID NO: 2067181 - DNA, 16 bp, Homo sapiens
gtcaatcccctcattc

SEQ ID NO: 2067182 - DNA, 17 bp, Homo sapiens
gtcaatgaaatatttgc

SEQ ID NO: 2067183 - DNA, 21 bp, Homo sapiens
gtcaatttgtatatcatgaaa

SEQ ID NO: 2067184 - DNA, 18 bp, Homo sapiens
gtcacacaaggctgggca

SEQ ID NO: 2067185 - DNA, 13 bp, Homo sapiens
gtcacacagacac

SEQ ID NO: 2067186 - DNA, 14 bp, Homo sapiens
gtcacacagacaca

SEQ ID NO: 2067187 - DNA, 15 bp, Homo sapiens
gtcacacagacacac

SEQ ID NO: 2067188 - DNA, 20 bp, Homo sapiens
gtcacacagtattacttctg

SEQ ID NO: 2067189 - DNA, 22 bp, Homo sapiens
gtcacacagtattacttctgct

SEQ ID NO: 2067190 - DNA, 15 bp, Homo sapiens
gtcacaccatcttaa

SEQ ID NO: 2067191 - DNA, 13 bp, Homo sapiens
gtcacagctgcag

SEQ ID NO: 2067192 - DNA, 17 bp, Homo sapiens
gtcacaggactctgcct

SEQ ID NO: 2067193 - DNA, 18 bp, Homo sapiens
gtcacaggactctgcctc

SEQ ID NO: 2067194 - DNA, 15 bp, Homo sapiens
gtcacaggcaggtcc

SEQ ID NO: 2067195 - DNA, 20 bp, Homo sapiens
gtcacataatgaatgctatt

SEQ ID NO: 2067196 - DNA, 19 bp, Homo sapiens
gtcacatatacaaaagcaa

SEQ ID NO: 2067197 - DNA, 21 bp, Homo sapiens
gtcacatggcctatgcacata

SEQ ID NO: 2067198 - DNA, 14 bp, Homo sapiens
gtcacattcaggaa

SEQ ID NO: 2067199 - DNA, 11 bp, Homo sapiens
gtcaccacctt

SEQ ID NO: 2067200 - DNA, 19 bp, Homo sapiens
gtcaccaccttcccagctc

SEQ ID NO: 2067201 - DNA, 20 bp, Homo sapiens
gtcaccaccttcccagctct

SEQ ID NO: 2067202 - DNA, 15 bp, Homo sapiens
gtcaccagcaacatc

SEQ ID NO: 2067203 - DNA, 19 bp, Homo sapiens
gtcaccagctatctgtcat

SEQ ID NO: 2067204 - DNA, 23 bp, Homo sapiens
gtcaccagctatctgtcatctct

SEQ ID NO: 2067205 - DNA, 14 bp, Homo sapiens
gtcaccctggcccc

SEQ ID NO: 2067206 - DNA, 18 bp, Homo sapiens
gtcaccctggccccaact

SEQ ID NO: 2067207 - DNA, 16 bp, Homo sapiens
gtcacccttctgggca

SEQ ID NO: 2067208 - DNA, 22 bp, Homo sapiens
gtcaccgggatgaacctatcct

SEQ ID NO: 2067209 - DNA, 16 bp, Homo sapiens
gtcacctcagagacat

SEQ ID NO: 2067210 - DNA, 15 bp, Homo sapiens
gtcacctcctccact

SEQ ID NO: 2067211 - DNA, 12 bp, Homo sapiens
gtcacctgcaag

SEQ ID NO: 2067212 - DNA, 15 bp, Homo sapiens
gtcactagcagctgc

SEQ ID NO: 2067213 - DNA, 16 bp, Homo sapiens
gtcactatgctatttc

SEQ ID NO: 2067214 - DNA, 18 bp, Homo sapiens
gtcactatgctatttctg

SEQ ID NO: 2067215 - DNA, 19 bp, Homo sapiens
gtcactcttcctgcaagga

SEQ ID NO: 2067216 - DNA, 19 bp, Homo sapiens
gtcactggaccactgggca

SEQ ID NO: 2067217 - DNA, 13 bp, Homo sapiens
gtcactgggttct

SEQ ID NO: 2067218 - DNA, 21 bp, Homo sapiens
gtcactggtagaccaaaataa

SEQ ID NO: 2067219 - DNA, 16 bp, Homo sapiens
gtcacttatttcataa

SEQ ID NO: 2067220 - DNA, 14 bp, Homo sapiens
gtcacttccagtgt

SEQ ID NO: 2067221 - DNA, 13 bp, Homo sapiens
gtcagaaactgtt

SEQ ID NO: 2067222 - DNA, 16 bp, Homo sapiens
gtcagaacagcagact

SEQ ID NO: 2067223 - DNA, 15 bp, Homo sapiens
gtcagaagcaggttc

SEQ ID NO: 2067224 - DNA, 14 bp, Homo sapiens
gtcagactgctggg

SEQ ID NO: 2067225 - DNA, 24 bp, Homo sapiens
gtcagactgctgggactggccagg

SEQ ID NO: 2067226 - DNA, 22 bp, Homo sapiens
gtcagactggctggctgcagtg

SEQ ID NO: 2067227 - DNA, 14 bp, Homo sapiens
gtcagagcctgcag

SEQ ID NO: 2067228 - DNA, 15 bp, Homo sapiens
gtcagagcctgcagt

SEQ ID NO: 2067229 - DNA, 15 bp, Homo sapiens
gtcagccaaatgtaa

SEQ ID NO: 2067230 - DNA, 12 bp, Homo sapiens
gtcagccagccg

SEQ ID NO: 2067231 - DNA, 18 bp, Homo sapiens
gtcagccagccgccctgg

SEQ ID NO: 2067232 - DNA, 14 bp, Homo sapiens
gtcagccagggcca

SEQ ID NO: 2067233 - DNA, 16 bp, Homo sapiens
gtcagccagggccagg

SEQ ID NO: 2067234 - DNA, 19 bp, Homo sapiens
gtcagcccgaatgcctgtc

SEQ ID NO: 2067235 - DNA, 20 bp, Homo sapiens
gtcagccgagccgggcctgg

SEQ ID NO: 2067236 - DNA, 20 bp, Homo sapiens
gtcagcgtgcttagcctcct

SEQ ID NO: 2067237 - DNA, 13 bp, Homo sapiens
gtcagctcacacc

SEQ ID NO: 2067238 - DNA, 15 bp, Homo sapiens
gtcagctcacaccct

SEQ ID NO: 2067239 - DNA, 21 bp, Homo sapiens
gtcagctcacaccctaataag

SEQ ID NO: 2067240 - DNA, 21 bp, Homo sapiens
gtcagctcccctcggagaaga

SEQ ID NO: 2067241 - DNA, 21 bp, Homo sapiens
gtcagctttcagagccagtga

SEQ ID NO: 2067242 - DNA, 15 bp, Homo sapiens
gtcaggaacagaagg

SEQ ID NO: 2067243 - DNA, 13 bp, Homo sapiens
gtcaggcctgtgt

SEQ ID NO: 2067244 - DNA, 23 bp, Homo sapiens
gtcaggcctgtgtgtgaaaggaa

SEQ ID NO: 2067245 - DNA, 18 bp, Homo sapiens
gtcaggcggggtgctgtg

SEQ ID NO: 2067246 - DNA, 18 bp, Homo sapiens
gtcaggtggggcagcttg

SEQ ID NO: 2067247 - DNA, 22 bp, Homo sapiens
gtcaggtggggcagcttgaggg

SEQ ID NO: 2067248 - DNA, 17 bp, Homo sapiens
gtcagtaggtccaaggg

SEQ ID NO: 2067249 - DNA, 19 bp, Homo sapiens
gtcagtcatgatggcacca

SEQ ID NO: 2067250 - DNA, 19 bp, Homo sapiens
gtcagttcccggagcacag

SEQ ID NO: 2067251 - DNA, 20 bp, Homo sapiens
gtcagttcccggagcacagc

SEQ ID NO: 2067252 - DNA, 15 bp, Homo sapiens
gtcagttgataaaag

SEQ ID NO: 2067253 - DNA, 23 bp, Homo sapiens
gtcagttgtacgtaatgtattta

SEQ ID NO: 2067254 - DNA, 15 bp, Homo sapiens
gtcataaacagcatt

SEQ ID NO: 2067255 - DNA, 17 bp, Homo sapiens
gtcataaacagcattta

SEQ ID NO: 2067256 - DNA, 12 bp, Homo sapiens
gtcatataaacc

SEQ ID NO: 2067257 - DNA, 14 bp, Homo sapiens
gtcatatattcatg

SEQ ID NO: 2067258 - DNA, 17 bp, Homo sapiens
gtcatatattcatgtaa

SEQ ID NO: 2067259 - DNA, 20 bp, Homo sapiens
gtcatatattcatgtaataa

SEQ ID NO: 2067260 - DNA, 14 bp, Homo sapiens
gtcatcactccctg

SEQ ID NO: 2067261 - DNA, 19 bp, Homo sapiens
gtcatcactccctggatgt

SEQ ID NO: 2067262 - DNA, 15 bp, Homo sapiens
gtcatcacttttcag

SEQ ID NO: 2067263 - DNA, 21 bp, Homo sapiens
gtcatcattgtatatatgtgt

SEQ ID NO: 2067264 - DNA, 15 bp, Homo sapiens
gtcatcccgctcctg

SEQ ID NO: 2067265 - DNA, 22 bp, Homo sapiens
gtcatcggaggctgggcccctg

SEQ ID NO: 2067266 - DNA, 21 bp, Homo sapiens
gtcatctgcggggcttctggg

SEQ ID NO: 2067267 - DNA, 22 bp, Homo sapiens
gtcatctgcggggcttctgggt

SEQ ID NO: 2067268 - DNA, 16 bp, Homo sapiens
gtcatctggtagattt

SEQ ID NO: 2067269 - DNA, 22 bp, Homo sapiens
gtcatctttttctctaaaatag

SEQ ID NO: 2067270 - DNA, 15 bp, Homo sapiens
gtcatgatggcacca

SEQ ID NO: 2067271 - DNA, 15 bp, Homo sapiens
gtcatggcttaatgt

SEQ ID NO: 2067272 - DNA, 20 bp, Homo sapiens
gtcatggcttaatgtttatt

SEQ ID NO: 2067273 - DNA, 16 bp, Homo sapiens
gtcatgtaccatcaat

SEQ ID NO: 2067274 - DNA, 17 bp, Homo sapiens
gtcatgtaccatcaata

SEQ ID NO: 2067275 - DNA, 17 bp, Homo sapiens
gtcatgtacttcctgtg

SEQ ID NO: 2067276 - DNA, 18 bp, Homo sapiens
gtcatgtacttcctgtgt

SEQ ID NO: 2067277 - DNA, 13 bp, Homo sapiens
gtcatgtgtgcat

SEQ ID NO: 2067278 - DNA, 14 bp, Homo sapiens
gtcatgtgtgcatg

SEQ ID NO: 2067279 - DNA, 23 bp, Homo sapiens
gtcatgttggtcaaaagctggat

SEQ ID NO: 2067280 - DNA, 11 bp, Homo sapiens
gtcattaaatg

SEQ ID NO: 2067281 - DNA, 13 bp, Homo sapiens
gtcattaatgtgt

SEQ ID NO: 2067282 - DNA, 14 bp, Homo sapiens
gtcattaatgtgtt

SEQ ID NO: 2067283 - DNA, 16 bp, Homo sapiens
gtcattactgcctttg

SEQ ID NO: 2067284 - DNA, 15 bp, Homo sapiens
gtcattatgtagaaa

SEQ ID NO: 2067285 - DNA, 18 bp, Homo sapiens
gtcattcaagcctgtgaa

SEQ ID NO: 2067286 - DNA, 14 bp, Homo sapiens
gtcatttataaaac

SEQ ID NO: 2067287 - DNA, 11 bp, Homo sapiens
gtgagagctgg

SEQ ID NO: 2067288 - DNA, 16 bp, Homo sapiens
gtgagatcttacaggt

SEQ ID NO: 2067289 - DNA, 14 bp, Homo sapiens
gtgagatttgtatt

SEQ ID NO: 2067290 - DNA, 21 bp, Homo sapiens
gtgagcagatctgaaaggcac

SEQ ID NO: 2067291 - DNA, 16 bp, Homo sapiens
gtgagcatctctgtgt

SEQ ID NO: 2067292 - DNA, 16 bp, Homo sapiens
gtgagcatgggtgtgc

SEQ ID NO: 2067293 - DNA, 15 bp, Homo sapiens
gtgagccacagacca

SEQ ID NO: 2067294 - DNA, 19 bp, Homo sapiens
gtgagccgagatcacgcca

SEQ ID NO: 2067295 - DNA, 12 bp, Homo sapiens
gtgagccgcatc

SEQ ID NO: 2067296 - DNA, 13 bp, Homo sapiens
gtgagctgatgtg

SEQ ID NO: 2067297 - DNA, 16 bp, Homo sapiens
gtgagctgggaagctg

SEQ ID NO: 2067298 - DNA, 21 bp, Homo sapiens
gtctagaaaccagtatggaag

SEQ ID NO: 2067299 - DNA, 18 bp, Homo sapiens
gtctataatggaaacatt

SEQ ID NO: 2067300 - DNA, 19 bp, Homo sapiens
gtctataatggaaacattt

SEQ ID NO: 2067301 - DNA, 20 bp, Homo sapiens
gtctataatggaaacattta

SEQ ID NO: 2067302 - DNA, 23 bp, Homo sapiens
gtctatcaaccccagacactggt

SEQ ID NO: 2067303 - DNA, 15 bp, Homo sapiens
gtctatgggactcaa

SEQ ID NO: 2067304 - DNA, 14 bp, Homo sapiens
gtctattagttttc

SEQ ID NO: 2067305 - DNA, 14 bp, Homo sapiens
gtctattctgagcc

SEQ ID NO: 2067306 - DNA, 23 bp, Homo sapiens
gtctcaaaaaaagggcaataaat

SEQ ID NO: 2067307 - DNA, 17 bp, Homo sapiens
gtctcaagagggcactg

SEQ ID NO: 2067308 - DNA, 19 bp, Homo sapiens
gtctcaagcactaaaaagt

SEQ ID NO: 2067309 - DNA, 20 bp, Homo sapiens
gtctcaagcactaaaaagtg

SEQ ID NO: 2067310 - DNA, 13 bp, Homo sapiens
gtctcactcctga

SEQ ID NO: 2067311 - DNA, 11 bp, Homo sapiens
gtctcactctg

SEQ ID NO: 2067312 - DNA, 15 bp, Homo sapiens
gtctcactctgtcgc

SEQ ID NO: 2067313 - DNA, 22 bp, Homo sapiens
gtctcactctgtcgcccagtct

SEQ ID NO: 2067314 - DNA, 17 bp, Homo sapiens
gtctcactgttgcccag

SEQ ID NO: 2067315 - DNA, 21 bp, Homo sapiens
gtctcactgttgcccaggctg

SEQ ID NO: 2067316 - DNA, 12 bp, Homo sapiens
gtctcaggagca

SEQ ID NO: 2067317 - DNA, 16 bp, Homo sapiens
gtctcaggagcatggg

SEQ ID NO: 2067318 - DNA, 15 bp, Homo sapiens
gtcttccataatgta

SEQ ID NO: 2067319 - DNA, 13 bp, Homo sapiens
gtcttctctccat

SEQ ID NO: 2067320 - DNA, 21 bp, Homo sapiens
gtcttcttcacccgctgcagc

SEQ ID NO: 2067321 - DNA, 11 bp, Homo sapiens
gtcttcttggc

SEQ ID NO: 2067322 - DNA, 17 bp, Homo sapiens
gtcttcttgtgtcctga

SEQ ID NO: 2067323 - DNA, 16 bp, Homo sapiens
gtcttgaactcctggc

SEQ ID NO: 2067324 - DNA, 16 bp, Homo sapiens
gtcttgcaatggcagc

SEQ ID NO: 2067325 - DNA, 17 bp, Homo sapiens
gtcttgcaatggcagcc

SEQ ID NO: 2067326 - DNA, 20 bp, Homo sapiens
gtcttgcaatggcagccttg

SEQ ID NO: 2067327 - DNA, 13 bp, Homo sapiens
gtcttgcctgcca

SEQ ID NO: 2067328 - DNA, 18 bp, Homo sapiens
gtcttggacactgtacaa

SEQ ID NO: 2067329 - DNA, 22 bp, Homo sapiens
gtcttggccgactcagggacct

SEQ ID NO: 2067330 - DNA, 17 bp, Homo sapiens
gtcttgggctactggca

SEQ ID NO: 2067331 - DNA, 18 bp, Homo sapiens
gtcttgggctactggcag

SEQ ID NO: 2067332 - DNA, 20 bp, Homo sapiens
gtcttgggctactggcagct

SEQ ID NO: 2067333 - DNA, 22 bp, Homo sapiens
gtcttgggctactggcagctcc

SEQ ID NO: 2067334 - DNA, 13 bp, Homo sapiens
gtcttgtattttc

SEQ ID NO: 2067335 - DNA, 22 bp, Homo sapiens
gtcttgttttttttttccactt

SEQ ID NO: 2067336 - DNA, 17 bp, Homo sapiens
gtctttaggcagcagct

SEQ ID NO: 2067337 - DNA, 16 bp, Homo sapiens
gtctttcagcattcag

SEQ ID NO: 2067338 - DNA, 14 bp, Homo sapiens
gtctttctattcat

SEQ ID NO: 2067339 - DNA, 18 bp, Homo sapiens
gtctttctctaaatatga

SEQ ID NO: 2067340 - DNA, 19 bp, Homo sapiens
gtctttctctaaatatgat

SEQ ID NO: 2067341 - DNA, 12 bp, Homo sapiens
gtctttgaataa

SEQ ID NO: 2067342 - DNA, 14 bp, Homo sapiens
gtctttgaataaag

SEQ ID NO: 2067343 - DNA, 21 bp, Homo sapiens
gtctttgaataaagtctgagt

SEQ ID NO: 2067344 - DNA, 14 bp, Homo sapiens
gtctttgcacatgt

SEQ ID NO: 2067345 - DNA, 15 bp, Homo sapiens
gtctttgcacatgtg

SEQ ID NO: 2067346 - DNA, 13 bp, Homo sapiens
gtctttgtgggag

SEQ ID NO: 2067347 - DNA, 22 bp, Homo sapiens
gtctttgtgggagggtaagaca

SEQ ID NO: 2067348 - DNA, 16 bp, Homo sapiens
gtcttttttcactaca

SEQ ID NO: 2067349 - DNA, 23 bp, Homo sapiens
gtgaaaataatttgttgtacttt

SEQ ID NO: 2067350 - DNA, 14 bp, Homo sapiens
gtgaaaatgtactg

SEQ ID NO: 2067351 - DNA, 14 bp, Homo sapiens
gtgaaaccacaggc

SEQ ID NO: 2067352 - DNA, 17 bp, Homo sapiens
gtgaaactggggcttgc

SEQ ID NO: 2067353 - DNA, 19 bp, Homo sapiens
gtgaaagtgtaaaatagaa

SEQ ID NO: 2067354 - DNA, 17 bp, Homo sapiens
gtgaaatcaaaggtgct

SEQ ID NO: 2067355 - DNA, 15 bp, Homo sapiens
gtgaacacatcagct

SEQ ID NO: 2067356 - DNA, 22 bp, Homo sapiens
gtgaaccaccacacccagccca

SEQ ID NO: 2067357 - DNA, 17 bp, Homo sapiens
gtgaacccaggacaagc

SEQ ID NO: 2067358 - DNA, 13 bp, Homo sapiens
gtgaactcctgag

SEQ ID NO: 2067359 - DNA, 18 bp, Homo sapiens
gtgaacttcttgaatcta

SEQ ID NO: 2067360 - DNA, 22 bp, Homo sapiens
gtgaagcagtgcctcgaggcac

SEQ ID NO: 2067361 - DNA, 23 bp, Homo sapiens
gtgaagccccttgtcctctcccg

SEQ ID NO: 2067362 - DNA, 17 bp, Homo sapiens
gtgaaggaccctggctc

SEQ ID NO: 2067363 - DNA, 20 bp, Homo sapiens
gtgaaggaccctggctcttc

SEQ ID NO: 2067364 - DNA, 20 bp, Homo sapiens
gtgaaggagaaaggagccgg

SEQ ID NO: 2067365 - DNA, 16 bp, Homo sapiens
gtgaaggtcttgcctg

SEQ ID NO: 2067366 - DNA, 17 bp, Homo sapiens
gtgaagttacacaatta

SEQ ID NO: 2067367 - DNA, 15 bp, Homo sapiens
gtgaagttgcttctt

SEQ ID NO: 2067368 - DNA, 13 bp, Homo sapiens
gtgaataaaaacc

SEQ ID NO: 2067369 - DNA, 18 bp, Homo sapiens
gtgaataaaaattgatga

SEQ ID NO: 2067370 - DNA, 18 bp, Homo sapiens
gtgaataaacttcagcac

SEQ ID NO: 2067371 - DNA, 20 bp, Homo sapiens
gtgaataaagttagtgtgtt

SEQ ID NO: 2067372 - DNA, 15 bp, Homo sapiens
gtgaatatatggtct

SEQ ID NO: 2067373 - DNA, 15 bp, Homo sapiens
gtgaatctaaaagct

SEQ ID NO: 2067374 - DNA, 22 bp, Homo sapiens
gtgaattgcctgcagagagaag

SEQ ID NO: 2067375 - DNA, 23 bp, Homo sapiens
gtgaattgcctgcagagagaagc

SEQ ID NO: 2067376 - DNA, 18 bp, Homo sapiens
gtgacaacctttgtgtaa

SEQ ID NO: 2067377 - DNA, 20 bp, Homo sapiens
gtgacaaggattgctactgt

SEQ ID NO: 2067378 - DNA, 15 bp, Homo sapiens
gtgacaagtggaggg

SEQ ID NO: 2067379 - DNA, 19 bp, Homo sapiens
gtgacaagtggagggggtg

SEQ ID NO: 2067380 - DNA, 16 bp, Homo sapiens
gtgacagaggcagccc

SEQ ID NO: 2067381 - DNA, 19 bp, Homo sapiens
gtgacagaggcagccccat

SEQ ID NO: 2067382 - DNA, 19 bp, Homo sapiens
gtgacaggaaagccctccc

SEQ ID NO: 2067383 - DNA, 23 bp, Homo sapiens
gtgacaggaagcccaaggcagtg

SEQ ID NO: 2067384 - DNA, 20 bp, Homo sapiens
gtgacatcccaggaggggcc

SEQ ID NO: 2067385 - DNA, 22 bp, Homo sapiens
gtgacatcccaggaggggcctc

SEQ ID NO: 2067386 - DNA, 17 bp, Homo sapiens
gtgaccaaaagttacat

SEQ ID NO: 2067387 - DNA, 14 bp, Homo sapiens
gtgaccaggggtga

SEQ ID NO: 2067388 - DNA, 14 bp, Homo sapiens
gtgaccatctgttt

SEQ ID NO: 2067389 - DNA, 12 bp, Homo sapiens
gtgacccttccc

SEQ ID NO: 2067390 - DNA, 19 bp, Homo sapiens
gtgacctgaccggcacctg

SEQ ID NO: 2067391 - DNA, 13 bp, Homo sapiens
gtgacctgctgag

SEQ ID NO: 2067392 - DNA, 18 bp, Homo sapiens
gtgacctgctgagctctg

SEQ ID NO: 2067393 - DNA, 19 bp, Homo sapiens
gtgacctgctgagctctga

SEQ ID NO: 2067394 - DNA, 20 bp, Homo sapiens
gtgacctgctgagctctgag

SEQ ID NO: 2067395 - DNA, 21 bp, Homo sapiens
gtgacctgctgagctctgaga

SEQ ID NO: 2067396 - DNA, 18 bp, Homo sapiens
gtgacgggagcctcctct

SEQ ID NO: 2067397 - DNA, 19 bp, Homo sapiens
gtgacgggagcctcctctg

SEQ ID NO: 2067398 - DNA, 20 bp, Homo sapiens
gtgacggtcctttaggcagc

SEQ ID NO: 2067399 - DNA, 15 bp, Homo sapiens
gtgactatatagaga

SEQ ID NO: 2067400 - DNA, 19 bp, Homo sapiens
gtgactattttttaataaa

SEQ ID NO: 2067401 - DNA, 16 bp, Homo sapiens
gtgactctttttaggg

SEQ ID NO: 2067402 - DNA, 20 bp, Homo sapiens
gtgactctttttagggccag

SEQ ID NO: 2067403 - DNA, 21 bp, Homo sapiens
gtgactgaatttgggcctctt

SEQ ID NO: 2067404 - DNA, 21 bp, Homo sapiens
gtgactgatgttacatcacag

SEQ ID NO: 2067405 - DNA, 23 bp, Homo sapiens
gtgactgccccaactcctggaag

SEQ ID NO: 2067406 - DNA, 21 bp, Homo sapiens
gtgactggcaggtgcagatgg

SEQ ID NO: 2067407 - DNA, 12 bp, Homo sapiens
gtgactgtccca

SEQ ID NO: 2067408 - DNA, 13 bp, Homo sapiens
gtgactgtcccac

SEQ ID NO: 2067409 - DNA, 23 bp, Homo sapiens
gtgactgtcccaccgggagcctc

SEQ ID NO: 2067410 - DNA, 19 bp, Homo sapiens
gtgactgtcgtgtttacaa

SEQ ID NO: 2067411 - DNA, 15 bp, Homo sapiens
gtgactttttagcca

SEQ ID NO: 2067412 - DNA, 14 bp, Homo sapiens
gtgagaatcctgcc

SEQ ID NO: 2067413 - DNA, 20 bp, Homo sapiens
gtgagaatcctgcctctccc

SEQ ID NO: 2067414 - DNA, 13 bp, Homo sapiens
gtgagaccacctc

SEQ ID NO: 2067415 - DNA, 18 bp, Homo sapiens
gtgagactctgtctcaaa

SEQ ID NO: 2067416 - DNA, 20 bp, Homo sapiens
gtgagactgacacctcactg

SEQ ID NO: 2067417 - DNA, 19 bp, Homo sapiens
gtgagagacattaactcat

SEQ ID NO: 2067418 - DNA, 23 bp, Homo sapiens
gtgagagacattaactcattaga

SEQ ID NO: 2067419 - DNA, 17 bp, Homo sapiens
ggcagtgactggcaggt

SEQ ID NO: 2067420 - DNA, 21 bp, Homo sapiens
ggcagtgactggcaggtgcag

SEQ ID NO: 2067421 - DNA, 21 bp, Homo sapiens
ggcagtgatggttgccaggac

SEQ ID NO: 2067422 - DNA, 12 bp, Homo sapiens
ggcagtgcctcc

SEQ ID NO: 2067423 - DNA, 14 bp, Homo sapiens
ggagagacacagcg

SEQ ID NO: 2067424 - DNA, 22 bp, Homo sapiens
ggagagactctgaggacatgga

SEQ ID NO: 2067425 - DNA, 21 bp, Homo sapiens
ggagagactgaaagcagcagc

SEQ ID NO: 2067426 - DNA, 20 bp, Homo sapiens
ggagagagatctagaaagtg

SEQ ID NO: 2067427 - DNA, 12 bp, Homo sapiens
ggagagagggga

SEQ ID NO: 2067428 - DNA, 14 bp, Homo sapiens
ggagagaggggaat

SEQ ID NO: 2067429 - DNA, 16 bp, Homo sapiens
ggagagccagaacctg

SEQ ID NO: 2067430 - DNA, 21 bp, Homo sapiens
ggagagccagaacctggaggg

SEQ ID NO: 2067431 - DNA, 14 bp, Homo sapiens
ggagagccagccct

SEQ ID NO: 2067432 - DNA, 11 bp, Homo sapiens
ggagagcccag

SEQ ID NO: 2067433 - DNA, 12 bp, Homo sapiens
ggagagccctgg

SEQ ID NO: 2067434 - DNA, 18 bp, Homo sapiens
ggagagctagaacctgga

SEQ ID NO: 2067435 - DNA, 20 bp, Homo sapiens
ggagagctagaacctggaga

SEQ ID NO: 2067436 - DNA, 21 bp, Homo sapiens
ggagagctagaacctggaggg

SEQ ID NO: 2067437 - DNA, 14 bp, Homo sapiens
ggagagctaggagc

SEQ ID NO: 2067438 - DNA, 15 bp, Homo sapiens
ggagagctaggagca

SEQ ID NO: 2067439 - DNA, 14 bp, Homo sapiens
ggagaggactctgc

SEQ ID NO: 2067440 - DNA, 16 bp, Homo sapiens
ggagaggactctgcct

SEQ ID NO: 2067441 - DNA, 14 bp, Homo sapiens
ggagaggcggcctc

SEQ ID NO: 2067442 - DNA, 18 bp, Homo sapiens
ggatgcctggtggcagct

SEQ ID NO: 2067443 - DNA, 19 bp, Homo sapiens
ggatgcctggtggcagctg

SEQ ID NO: 2067444 - DNA, 14 bp, Homo sapiens
ggatgcggggcaga

SEQ ID NO: 2067445 - DNA, 23 bp, Homo sapiens
ggatgcgtgccctgacccctgca

SEQ ID NO: 2067446 - DNA, 16 bp, Homo sapiens
ggatgctccagggcag

SEQ ID NO: 2067447 - DNA, 14 bp, Homo sapiens
ggatgctgcctgag

SEQ ID NO: 2067448 - DNA, 18 bp, Homo sapiens
ggatggaaatatgttcta

SEQ ID NO: 2067449 - DNA, 19 bp, Homo sapiens
ggatggacagaatgatgga

SEQ ID NO: 2067450 - DNA, 20 bp, Homo sapiens
ggatggacagaatgatggac

SEQ ID NO: 2067451 - DNA, 19 bp, Homo sapiens
ggatggaccctcgcagcag

SEQ ID NO: 2067452 - DNA, 14 bp, Homo sapiens
ggatggaggagaaa

SEQ ID NO: 2067453 - DNA, 13 bp, Homo sapiens
ggatggatggaca

SEQ ID NO: 2067454 - DNA, 24 bp, Homo sapiens
ggatggcgagctccagtaagatga

SEQ ID NO: 2067455 - DNA, 20 bp, Homo sapiens
ggatgggaagatggtagcag

SEQ ID NO: 2067456 - DNA, 15 bp, Homo sapiens
ggatgggagtgagac

SEQ ID NO: 2067457 - DNA, 21 bp, Homo sapiens
ggatgggatcccaggccaggg

SEQ ID NO: 2067458 - DNA, 15 bp, Homo sapiens
ggatgggatttcatg

SEQ ID NO: 2067459 - DNA, 23 bp, Homo sapiens
ggatgggcattgggctgacacct

SEQ ID NO: 2067460 - DNA, 19 bp, Homo sapiens
ggatggggagaatggtcaa

SEQ ID NO: 2067461 - DNA, 20 bp, Homo sapiens
ggatggtcctggggctctgt

SEQ ID NO: 2067462 - DNA, 22 bp, Homo sapiens
ggatggtcctggggctctgtgc

SEQ ID NO: 2067463 - DNA, 17 bp, Homo sapiens
ggatgtaaacagtgcct

SEQ ID NO: 2067464 - DNA, 18 bp, Homo sapiens
ggatgtaaacagtgcctg

SEQ ID NO: 2067465 - DNA, 21 bp, Homo sapiens
ggatgtaaacagtgcctgctg

SEQ ID NO: 2067466 - DNA, 14 bp, Homo sapiens
ggatgtcagacaat

SEQ ID NO: 2067467 - DNA, 20 bp, Homo sapiens
ggatgtcccatctgctcctc

SEQ ID NO: 2067468 - DNA, 20 bp, Homo sapiens
ggatgtcccctgtcccacca

SEQ ID NO: 2067469 - DNA, 22 bp, Homo sapiens
ggatgtgaattgcctgcagaga

SEQ ID NO: 2067470 - DNA, 22 bp, Homo sapiens
ggatgtgcacggcagcttgagc

SEQ ID NO: 2067471 - DNA, 16 bp, Homo sapiens
ggatgtgcccacaggg

SEQ ID NO: 2067472 - DNA, 18 bp, Homo sapiens
ggatgtggagctcctgct

SEQ ID NO: 2067473 - DNA, 22 bp, Homo sapiens
ggattaatggtcctgtgatgct

SEQ ID NO: 2067474 - DNA, 23 bp, Homo sapiens
ggattacaagcgtgagccactgc

SEQ ID NO: 2067475 - DNA, 14 bp, Homo sapiens
ggattacaggcctt

SEQ ID NO: 2067476 - DNA, 22 bp, Homo sapiens
ggattagattcatctatggagg

SEQ ID NO: 2067477 - DNA, 17 bp, Homo sapiens
ggattattcatttaaaa

SEQ ID NO: 2067478 - DNA, 18 bp, Homo sapiens
ggattccagcatttgcca

SEQ ID NO: 2067479 - DNA, 22 bp, Homo sapiens
ggattcccaccaaggtcttcag

SEQ ID NO: 2067480 - DNA, 17 bp, Homo sapiens
ggattgggagggacagg

SEQ ID NO: 2067481 - DNA, 15 bp, Homo sapiens
ggattgttcctgtca

SEQ ID NO: 2067482 - DNA, 21 bp, Homo sapiens
ggatttaacagtcatttaaaa

SEQ ID NO: 2067483 - DNA, 23 bp, Homo sapiens
ggatttcctattttaaaaccatg

SEQ ID NO: 2067484 - DNA, 12 bp, Homo sapiens
ggattttgagta

SEQ ID NO: 2067485 - DNA, 21 bp, Homo sapiens
ggatttttacaaataaagatg

SEQ ID NO: 2067486 - DNA, 21 bp, Homo sapiens
ggatttttttgttttctgatg

SEQ ID NO: 2067487 - DNA, 19 bp, Homo sapiens
ggcaaaacacgcaagggca

SEQ ID NO: 2067488 - DNA, 16 bp, Homo sapiens
ggcaaaatccttgctt

SEQ ID NO: 2067489 - DNA, 16 bp, Homo sapiens
ggcaaacccttctctt

SEQ ID NO: 2067490 - DNA, 18 bp, Homo sapiens
ggcaaagaactgccccat

SEQ ID NO: 2067491 - DNA, 18 bp, Homo sapiens
ggcaaatgacatgcactg

SEQ ID NO: 2067492 - DNA, 13 bp, Homo sapiens
ggcaacagagcaa

SEQ ID NO: 2067493 - DNA, 18 bp, Homo sapiens
ggcaacagagcaagactc

SEQ ID NO: 2067494 - DNA, 22 bp, Homo sapiens
ggcaaccccagttctgctcctc

SEQ ID NO: 2067495 - DNA, 18 bp, Homo sapiens
ggcaactaagcagtccct

SEQ ID NO: 2067496 - DNA, 19 bp, Homo sapiens
ggcaactgaggcagacagc

SEQ ID NO: 2067497 - DNA, 16 bp, Homo sapiens
ggcaagagaaaataaa

SEQ ID NO: 2067498 - DNA, 18 bp, Homo sapiens
ggcaagcacctcctgcct

SEQ ID NO: 2067499 - DNA, 19 bp, Homo sapiens
ggcaagcacctcctgcctc

SEQ ID NO: 2067500 - DNA, 12 bp, Homo sapiens
ggcaagcaggga

SEQ ID NO: 2067501 - DNA, 14 bp, Homo sapiens
ggcaagcccctcag

SEQ ID NO: 2067502 - DNA, 19 bp, Homo sapiens
ggcaagcccctcagccctt

SEQ ID NO: 2067503 - DNA, 21 bp, Homo sapiens
ggcaagcccctcagcccttgc

SEQ ID NO: 2067504 - DNA, 22 bp, Homo sapiens
ggcaagcccctcagcccttgcc

SEQ ID NO: 2067505 - DNA, 20 bp, Homo sapiens
ggcaagctagaacctggagg

SEQ ID NO: 2067506 - DNA, 15 bp, Homo sapiens
ggcaagggggcgggg

SEQ ID NO: 2067507 - DNA, 20 bp, Homo sapiens
ggcaagtcgagagggctgtt

SEQ ID NO: 2067508 - DNA, 13 bp, Homo sapiens
ggcaagtgattga

SEQ ID NO: 2067509 - DNA, 11 bp, Homo sapiens
ggcaatatttg

SEQ ID NO: 2067510 - DNA, 17 bp, Homo sapiens
ggcaatatttgttctgg

SEQ ID NO: 2067511 - DNA, 13 bp, Homo sapiens
ggcaatggggaga

SEQ ID NO: 2067512 - DNA, 14 bp, Homo sapiens
ggcaattttgtaac

SEQ ID NO: 2067513 - DNA, 18 bp, Homo sapiens
ggcacacaatgctattga

SEQ ID NO: 2067514 - DNA, 14 bp, Homo sapiens
ggcacacagcagcc

SEQ ID NO: 2067515 - DNA, 14 bp, Homo sapiens
ggcacaccactgcc

SEQ ID NO: 2067516 - DNA, 16 bp, Homo sapiens
ggcacaccactgccct

SEQ ID NO: 2067517 - DNA, 18 bp, Homo sapiens
ggcacagacttctggaag

SEQ ID NO: 2067518 - DNA, 19 bp, Homo sapiens
ggcacaggagctacctgtg

SEQ ID NO: 2067519 - DNA, 12 bp, Homo sapiens
ggcacaggcagg

SEQ ID NO: 2067520 - DNA, 23 bp, Homo sapiens
ggcaccactagggtcctggccct

SEQ ID NO: 2067521 - DNA, 17 bp, Homo sapiens
ggcaccagatgcaacct

SEQ ID NO: 2067522 - DNA, 18 bp, Homo sapiens
ggcaccagatgcaacctc

SEQ ID NO: 2067523 - DNA, 19 bp, Homo sapiens
ggcaccagccccctggatg

SEQ ID NO: 2067524 - DNA, 18 bp, Homo sapiens
ggcaccagctctgtggcc

SEQ ID NO: 2067525 - DNA, 20 bp, Homo sapiens
ggcaccagctctgtggcctg

SEQ ID NO: 2067526 - DNA, 14 bp, Homo sapiens
ggcaccatctccct

SEQ ID NO: 2067527 - DNA, 15 bp, Homo sapiens
ggcacccccagcctg

SEQ ID NO: 2067528 - DNA, 21 bp, Homo sapiens
ggcacccccagcctgggccta

SEQ ID NO: 2067529 - DNA, 13 bp, Homo sapiens
ggcaccccctgca

SEQ ID NO: 2067530 - DNA, 20 bp, Homo sapiens
ggcacccggcccctgctggt

SEQ ID NO: 2067531 - DNA, 22 bp, Homo sapiens
ggcacccggcccctgctggttc

SEQ ID NO: 2067532 - DNA, 13 bp, Homo sapiens
ggcaccggcgctg

SEQ ID NO: 2067533 - DNA, 15 bp, Homo sapiens
ggcaccggcgctgca

SEQ ID NO: 2067534 - DNA, 18 bp, Homo sapiens
ggcacctatagtcccagc

SEQ ID NO: 2067535 - DNA, 13 bp, Homo sapiens
ggcacctgccacc

SEQ ID NO: 2067536 - DNA, 14 bp, Homo sapiens
ggcacctgccaccg

SEQ ID NO: 2067537 - DNA, 16 bp, Homo sapiens
ggcacctgccaccgcc

SEQ ID NO: 2067538 - DNA, 22 bp, Homo sapiens
ggcacctgccaccgccagagga

SEQ ID NO: 2067539 - DNA, 12 bp, Homo sapiens
ggcacctgctgg

SEQ ID NO: 2067540 - DNA, 12 bp, Homo sapiens
ggcacctggcct

SEQ ID NO: 2067541 - DNA, 13 bp, Homo sapiens
ggcacctggcctg

SEQ ID NO: 2067542 - DNA, 14 bp, Homo sapiens
ggcacctggcctgc

SEQ ID NO: 2067543 - DNA, 18 bp, Homo sapiens
ggcacctggcctgctggg

SEQ ID NO: 2067544 - DNA, 12 bp, Homo sapiens
ggcacctgggaa

SEQ ID NO: 2067545 - DNA, 23 bp, Homo sapiens
ggcacctgggccctggggcctgt

SEQ ID NO: 2067546 - DNA, 17 bp, Homo sapiens
ggcaccttagtggcttt

SEQ ID NO: 2067547 - DNA, 19 bp, Homo sapiens
ggcacgaacccacctgctg

SEQ ID NO: 2067548 - DNA, 20 bp, Homo sapiens
ggcacgaacccacctgctga

SEQ ID NO: 2067549 - DNA, 19 bp, Homo sapiens
ggcacgccaacagcccccc

SEQ ID NO: 2067550 - DNA, 13 bp, Homo sapiens
ggcacgcctgccc

SEQ ID NO: 2067551 - DNA, 19 bp, Homo sapiens
ggcacgcctgcccagcctc

SEQ ID NO: 2067552 - DNA, 18 bp, Homo sapiens
ggcacggagagaaggccc

SEQ ID NO: 2067553 - DNA, 15 bp, Homo sapiens
ggcacgtcccatgtg

SEQ ID NO: 2067554 - DNA, 15 bp, Homo sapiens
ggcactcacatgccg

SEQ ID NO: 2067555 - DNA, 13 bp, Homo sapiens
ggcactcccctga

SEQ ID NO: 2067556 - DNA, 18 bp, Homo sapiens
ggcactgcttgaggaggg

SEQ ID NO: 2067557 - DNA, 21 bp, Homo sapiens
ggcactgcttgaggaggggca

SEQ ID NO: 2067558 - DNA, 21 bp, Homo sapiens
ggcactgggatgagccgctgt

SEQ ID NO: 2067559 - DNA, 16 bp, Homo sapiens
ggcacttgattccttg

SEQ ID NO: 2067560 - DNA, 16 bp, Homo sapiens
ggcagaaaagaggaga

SEQ ID NO: 2067561 - DNA, 22 bp, Homo sapiens
ggcagaaaagaggagaccctgg

SEQ ID NO: 2067562 - DNA, 23 bp, Homo sapiens
ggcagaaaagaggagaccctgga

SEQ ID NO: 2067563 - DNA, 16 bp, Homo sapiens
ggcagaaagtggccat

SEQ ID NO: 2067564 - DNA, 15 bp, Homo sapiens
ggcagaagggagaag

SEQ ID NO: 2067565 - DNA, 13 bp, Homo sapiens
ggcagaaggggaa

SEQ ID NO: 2067566 - DNA, 16 bp, Homo sapiens
ggcctgatgctgcccc

SEQ ID NO: 2067567 - DNA, 11 bp, Homo sapiens
ggcctgccctc

SEQ ID NO: 2067568 - DNA, 16 bp, Homo sapiens
ggcctgccctcaggga

SEQ ID NO: 2067569 - DNA, 17 bp, Homo sapiens
ggcctgccctcagggat

SEQ ID NO: 2067570 - DNA, 18 bp, Homo sapiens
ggcctgcggccgggctgc

SEQ ID NO: 2067571 - DNA, 21 bp, Homo sapiens
ggcctgcgtgccgggagagga

SEQ ID NO: 2067572 - DNA, 14 bp, Homo sapiens
ggcctgctgctgag

SEQ ID NO: 2067573 - DNA, 18 bp, Homo sapiens
ggcctgctgctgagaacc

SEQ ID NO: 2067574 - DNA, 22 bp, Homo sapiens
ggcctgctgctgagaacctggc

SEQ ID NO: 2067575 - DNA, 23 bp, Homo sapiens
ggcctgctgctgagaacctggcc

SEQ ID NO: 2067576 - DNA, 23 bp, Homo sapiens
ggcctgctgggaaccccgcagcc

SEQ ID NO: 2067577 - DNA, 19 bp, Homo sapiens
ggcctgctgggctctccac

SEQ ID NO: 2067578 - DNA, 21 bp, Homo sapiens
ggcctgctgggctctccacct

SEQ ID NO: 2067579 - DNA, 22 bp, Homo sapiens
ggcctgctgggctctccacctc

SEQ ID NO: 2067580 - DNA, 22 bp, Homo sapiens
ggcctggaccgcttcccagagg

SEQ ID NO: 2067581 - DNA, 13 bp, Homo sapiens
ggcctggagaggg

SEQ ID NO: 2067582 - DNA, 15 bp, Homo sapiens
ggcctggccagatgc

SEQ ID NO: 2067583 - DNA, 12 bp, Homo sapiens
ggcctggcctga

SEQ ID NO: 2067584 - DNA, 13 bp, Homo sapiens
ggcctggcctgag

SEQ ID NO: 2067585 - DNA, 15 bp, Homo sapiens
ggcctggctccccac

SEQ ID NO: 2067586 - DNA, 17 bp, Homo sapiens
ggcctggcttgctccag

SEQ ID NO: 2067587 - DNA, 15 bp, Homo sapiens
ggcctgggacccagc

SEQ ID NO: 2067588 - DNA, 20 bp, Homo sapiens
ggcctgggacccagctactc

SEQ ID NO: 2067589 - DNA, 22 bp, Homo sapiens
ggcctgggacccagctactctg

SEQ ID NO: 2067590 - DNA, 18 bp, Homo sapiens
ggcctgggggcagggaga

SEQ ID NO: 2067591 - DNA, 15 bp, Homo sapiens
ggcctgggggcagtg

SEQ ID NO: 2067592 - DNA, 20 bp, Homo sapiens
ggcctgggggcagtgactgg

SEQ ID NO: 2067593 - DNA, 18 bp, Homo sapiens
ggcctggggtgacccggc

SEQ ID NO: 2067594 - DNA, 19 bp, Homo sapiens
ggcctggggtgacccggca

SEQ ID NO: 2067595 - DNA, 22 bp, Homo sapiens
ggcctggtggccatgtcgcctg

SEQ ID NO: 2067596 - DNA, 15 bp, Homo sapiens
ggcctgtactgcctg

SEQ ID NO: 2067597 - DNA, 22 bp, Homo sapiens
ggcctgtctcaagctcttcctt

SEQ ID NO: 2067598 - DNA, 13 bp, Homo sapiens
ggcctgtgcagca

SEQ ID NO: 2067599 - DNA, 15 bp, Homo sapiens
ggcctgtgcagcagc

SEQ ID NO: 2067600 - DNA, 16 bp, Homo sapiens
ggcctgtgcagcagcc

SEQ ID NO: 2067601 - DNA, 18 bp, Homo sapiens
ggcctgtgcagcagccca

SEQ ID NO: 2067602 - DNA, 20 bp, Homo sapiens
ggcctgtgggagcctgcaaa

SEQ ID NO: 2067603 - DNA, 17 bp, Homo sapiens
ggcctgtgtagctgtga

SEQ ID NO: 2067604 - DNA, 19 bp, Homo sapiens
ggcctgtgtagctgtgacc

SEQ ID NO: 2067605 - DNA, 21 bp, Homo sapiens
ggcctgtgtagctgtgacctg

SEQ ID NO: 2067606 - DNA, 22 bp, Homo sapiens
ggcctgtgtagctgtgacctgc

SEQ ID NO: 2067607 - DNA, 18 bp, Homo sapiens
ggcctgtgtccagcagct

SEQ ID NO: 2067608 - DNA, 21 bp, Homo sapiens
ggcctgtgtccagcagctgcg

SEQ ID NO: 2067609 - DNA, 14 bp, Homo sapiens
ggccttacctcccc

SEQ ID NO: 2067610 - DNA, 20 bp, Homo sapiens
ggccttacctcccctgccag

SEQ ID NO: 2067611 - DNA, 22 bp, Homo sapiens
ggccttacctcccctgccaggg

SEQ ID NO: 2067612 - DNA, 14 bp, Homo sapiens
ggccttgcccagag

SEQ ID NO: 2067613 - DNA, 20 bp, Homo sapiens
ggccttgtggataagggaga

SEQ ID NO: 2067614 - DNA, 15 bp, Homo sapiens
ggcgaataaatgttc

SEQ ID NO: 2067615 - DNA, 23 bp, Homo sapiens
ggcgacagagcgagagtctgtct

SEQ ID NO: 2067616 - DNA, 17 bp, Homo sapiens
ggcgacccctcagtgct

SEQ ID NO: 2067617 - DNA, 16 bp, Homo sapiens
ggcgagtgccaggact

SEQ ID NO: 2067618 - DNA, 15 bp, Homo sapiens
ggcgatcaagtccag

SEQ ID NO: 2067619 - DNA, 13 bp, Homo sapiens
ggcgcagagggaa

SEQ ID NO: 2067620 - DNA, 18 bp, Homo sapiens
ggcgcctgtagtcccagc

SEQ ID NO: 2067621 - DNA, 17 bp, Homo sapiens
ggcgctattgcactcca

SEQ ID NO: 2067622 - DNA, 18 bp, Homo sapiens
ggcgctattgcactccag

SEQ ID NO: 2067623 - DNA, 22 bp, Homo sapiens
ggcgctattgcactccagtctg

SEQ ID NO: 2067624 - DNA, 14 bp, Homo sapiens
ggcgctcaggaccc

SEQ ID NO: 2067625 - DNA, 15 bp, Homo sapiens
ggcgctcaggaccca

SEQ ID NO: 2067626 - DNA, 20 bp, Homo sapiens
ggcgctcaggacccaggccc

SEQ ID NO: 2067627 - DNA, 14 bp, Homo sapiens
ggcgctctgccctc

SEQ ID NO: 2067628 - DNA, 21 bp, Homo sapiens
ggcgctctgccctccctggcc

SEQ ID NO: 2067629 - DNA, 22 bp, Homo sapiens
ggcgctctgccctccctggcct

SEQ ID NO: 2067630 - DNA, 12 bp, Homo sapiens
ggcgctgcaggt

SEQ ID NO: 2067631 - DNA, 14 bp, Homo sapiens
ggcgctgtggctcc

SEQ ID NO: 2067632 - DNA, 16 bp, Homo sapiens
ggcgctgtggctcctg

SEQ ID NO: 2067633 - DNA, 15 bp, Homo sapiens
ggcggaaaccttgca

SEQ ID NO: 2067634 - DNA, 18 bp, Homo sapiens
ggcggaaaccttgcagca

SEQ ID NO: 2067635 - DNA, 13 bp, Homo sapiens
ggcggaggcggct

SEQ ID NO: 2067636 - DNA, 22 bp, Homo sapiens
ggcggcacattggcagtgtgtc

SEQ ID NO: 2067637 - DNA, 12 bp, Homo sapiens
ggcggcagggtg

SEQ ID NO: 2067638 - DNA, 17 bp, Homo sapiens
ggcggcttcctgtccac

SEQ ID NO: 2067639 - DNA, 13 bp, Homo sapiens
ggcgggcacctgt

SEQ ID NO: 2067640 - DNA, 16 bp, Homo sapiens
ggcgggcagcccagcc

SEQ ID NO: 2067641 - DNA, 14 bp, Homo sapiens
ggcggggaggagga

SEQ ID NO: 2067642 - DNA, 20 bp, Homo sapiens
ggcggggaggaggagctgcc

SEQ ID NO: 2067643 - DNA, 21 bp, Homo sapiens
ggcgggggagccaacagcagc

SEQ ID NO: 2067644 - DNA, 20 bp, Homo sapiens
ggcgggtggatcatgaggtc

SEQ ID NO: 2067645 - DNA, 22 bp, Homo sapiens
ggcgggtggatcatgaggtcag

SEQ ID NO: 2067646 - DNA, 15 bp, Homo sapiens
ggcgtgcaaggggct

SEQ ID NO: 2067647 - DNA, 18 bp, Homo sapiens
ggcgtgcaaggggctcag

SEQ ID NO: 2067648 - DNA, 14 bp, Homo sapiens
ggcgtgcagtggtg

SEQ ID NO: 2067649 - DNA, 23 bp, Homo sapiens
ggcgttctgctgcccctgcagtt

SEQ ID NO: 2067650 - DNA, 15 bp, Homo sapiens
ggcgttggtgccact

SEQ ID NO: 2067651 - DNA, 14 bp, Homo sapiens
ggcgtttgtaaatt

SEQ ID NO: 2067652 - DNA, 12 bp, Homo sapiens
ggctaaatgaag

SEQ ID NO: 2067653 - DNA, 20 bp, Homo sapiens
ggctaaatgcctaataaaca

SEQ ID NO: 2067654 - DNA, 15 bp, Homo sapiens
ggctaagatgagatt

SEQ ID NO: 2067655 - DNA, 15 bp, Homo sapiens
ggctaattaaataaa

SEQ ID NO: 2067656 - DNA, 19 bp, Homo sapiens
ggctaattcccagagtgtg

SEQ ID NO: 2067657 - DNA, 23 bp, Homo sapiens
ggctaattcccagagtgtgaaac

SEQ ID NO: 2067658 - DNA, 18 bp, Homo sapiens
ggctactcagcagccctc

SEQ ID NO: 2067659 - DNA, 13 bp, Homo sapiens
ggctactctgtgc

SEQ ID NO: 2067660 - DNA, 16 bp, Homo sapiens
ggctactctgtgccag

SEQ ID NO: 2067661 - DNA, 23 bp, Homo sapiens
ggctactctgtgccagagcctgg

SEQ ID NO: 2067662 - DNA, 15 bp, Homo sapiens
ggctactgcagcttt

SEQ ID NO: 2067663 - DNA, 23 bp, Homo sapiens
ggctactgcagctttacatgcaa

SEQ ID NO: 2067664 - DNA, 23 bp, Homo sapiens
ggctactggcagctcctctcctt

SEQ ID NO: 2067665 - DNA, 21 bp, Homo sapiens
ggctagaaccaagaagggcta

SEQ ID NO: 2067666 - DNA, 16 bp, Homo sapiens
ggctagaacctggaga

SEQ ID NO: 2067667 - DNA, 18 bp, Homo sapiens
ggctagaacctggagggc

SEQ ID NO: 2067668 - DNA, 14 bp, Homo sapiens
ggctagaacctggc

SEQ ID NO: 2067669 - DNA, 22 bp, Homo sapiens
ggctagaatctggagagctaga

SEQ ID NO: 2067670 - DNA, 16 bp, Homo sapiens
ggctaggacccctcca

SEQ ID NO: 2067671 - DNA, 22 bp, Homo sapiens
ggctaggacccctccatgtggg

SEQ ID NO: 2067672 - DNA, 17 bp, Homo sapiens
ggctaggggctggtcct

SEQ ID NO: 2067673 - DNA, 13 bp, Homo sapiens
ggctagtcagaga

SEQ ID NO: 2067674 - DNA, 14 bp, Homo sapiens
ggctagtcagagag

SEQ ID NO: 2067675 - DNA, 15 bp, Homo sapiens
ggctagttgggcttc

SEQ ID NO: 2067676 - DNA, 16 bp, Homo sapiens
ggctagttgggcttcc

SEQ ID NO: 2067677 - DNA, 23 bp, Homo sapiens
ggctataggtgctacaaaaacac

SEQ ID NO: 2067678 - DNA, 13 bp, Homo sapiens
ggctatcctagag

SEQ ID NO: 2067679 - DNA, 15 bp, Homo sapiens
ggctatgccttgtct

SEQ ID NO: 2067680 - DNA, 13 bp, Homo sapiens
ggctatttgttca

SEQ ID NO: 2067681 - DNA, 16 bp, Homo sapiens
ggctatttgttcagag

SEQ ID NO: 2067682 - DNA, 18 bp, Homo sapiens
ggctcaagaggcccaggg

SEQ ID NO: 2067683 - DNA, 23 bp, Homo sapiens
ggctcaagaggcccagggagcaa

SEQ ID NO: 2067684 - DNA, 23 bp, Homo sapiens
ggctcacgcctataatcccagca

SEQ ID NO: 2067685 - DNA, 23 bp, Homo sapiens
ggctcacgcctatgatcccagca

SEQ ID NO: 2067686 - DNA, 22 bp, Homo sapiens
ggctcactgcaacctcttcctc

SEQ ID NO: 2067687 - DNA, 13 bp, Homo sapiens
ggctcactgcagc

SEQ ID NO: 2067688 - DNA, 14 bp, Homo sapiens
ggctcactgcagcc

SEQ ID NO: 2067689 - DNA, 17 bp, Homo sapiens
ggctcactgcagcctca

SEQ ID NO: 2067690 - DNA, 14 bp, Homo sapiens
ggctcagactctgg

SEQ ID NO: 2067691 - DNA, 11 bp, Homo sapiens
ggctcagcctg

SEQ ID NO: 2067692 - DNA, 20 bp, Homo sapiens
ggctcagcctggtgggcctc

SEQ ID NO: 2067693 - DNA, 18 bp, Homo sapiens
ggctcagcggggacagct

SEQ ID NO: 2067694 - DNA, 22 bp, Homo sapiens
ggctcagcggggacagctcctt

SEQ ID NO: 2067695 - DNA, 23 bp, Homo sapiens
ggctcagcggggacagctccttc

SEQ ID NO: 2067696 - DNA, 12 bp, Homo sapiens
ggctcaggaaga

SEQ ID NO: 2067697 - DNA, 14 bp, Homo sapiens
ggctcagggctgga

SEQ ID NO: 2067698 - DNA, 22 bp, Homo sapiens
ggctcatggcgtaatgggcctg

SEQ ID NO: 2067699 - DNA, 17 bp, Homo sapiens
ggctccactccaagggt

SEQ ID NO: 2067700 - DNA, 14 bp, Homo sapiens
ggctccagcatcca

SEQ ID NO: 2067701 - DNA, 18 bp, Homo sapiens
ggctccagcatccagcct

SEQ ID NO: 2067702 - DNA, 20 bp, Homo sapiens
ggctccagcatccagcctgt

SEQ ID NO: 2067703 - DNA, 21 bp, Homo sapiens
ggctccagcatccagcctgtg

SEQ ID NO: 2067704 - DNA, 14 bp, Homo sapiens
ggctccaggctcct

SEQ ID NO: 2067705 - DNA, 15 bp, Homo sapiens
ggctccaggctcctt

SEQ ID NO: 2067706 - DNA, 19 bp, Homo sapiens
ggctccaggtccggagggg

SEQ ID NO: 2067707 - DNA, 20 bp, Homo sapiens
ggctccaggtccggaggggt

SEQ ID NO: 2067708 - DNA, 15 bp, Homo sapiens
ggctccatggaggag

SEQ ID NO: 2067709 - DNA, 17 bp, Homo sapiens
ggctcccacaggccctt

SEQ ID NO: 2067710 - DNA, 18 bp, Homo sapiens
ggctcccacaggcccttc

SEQ ID NO: 2067711 - DNA, 19 bp, Homo sapiens
ggctcccacaggcccttcc

SEQ ID NO: 2067712 - DNA, 13 bp, Homo sapiens
ggctccccacgag

SEQ ID NO: 2067713 - DNA, 16 bp, Homo sapiens
ggctccctcctggagc

SEQ ID NO: 2067714 - DNA, 18 bp, Homo sapiens
ggctccctcctggagcat

SEQ ID NO: 2067715 - DNA, 18 bp, Homo sapiens
ggctccgaaaaactttgt

SEQ ID NO: 2067716 - DNA, 12 bp, Homo sapiens
ggctcctgccac

SEQ ID NO: 2067717 - DNA, 14 bp, Homo sapiens
ggctcctgccactg

SEQ ID NO: 2067718 - DNA, 16 bp, Homo sapiens
ggctcctgccactgac

SEQ ID NO: 2067719 - DNA, 20 bp, Homo sapiens
ggctcctgccactgacctca

SEQ ID NO: 2067720 - DNA, 18 bp, Homo sapiens
ggctcctggctgccaggc

SEQ ID NO: 2067721 - DNA, 19 bp, Homo sapiens
ggctcctggctgccaggcg

SEQ ID NO: 2067722 - DNA, 13 bp, Homo sapiens
ggctcctgtgcta

SEQ ID NO: 2067723 - DNA, 23 bp, Homo sapiens
ggctcctgtgctactttgccttt

SEQ ID NO: 2067724 - DNA, 12 bp, Homo sapiens
ggctcctttctc

SEQ ID NO: 2067725 - DNA, 13 bp, Homo sapiens
ggctcctttctcc

SEQ ID NO: 2067726 - DNA, 20 bp, Homo sapiens
ggctcctttctccagccagc

SEQ ID NO: 2067727 - DNA, 15 bp, Homo sapiens
ggctcgccccaccca

SEQ ID NO: 2067728 - DNA, 23 bp, Homo sapiens
ggctcgctccctgtagctctgcc

SEQ ID NO: 2067729 - DNA, 13 bp, Homo sapiens
ggctcgggcgctg

SEQ ID NO: 2067730 - DNA, 21 bp, Homo sapiens
ggctcgggcgctgtggctcct

SEQ ID NO: 2067731 - DNA, 17 bp, Homo sapiens
ggctctaacgcctgagc

SEQ ID NO: 2067732 - DNA, 18 bp, Homo sapiens
ggctctccaaaggggctg

SEQ ID NO: 2067733 - DNA, 23 bp, Homo sapiens
ggctctccaaaggggctgctggg

SEQ ID NO: 2067734 - DNA, 14 bp, Homo sapiens
ggctctccacctca

SEQ ID NO: 2067735 - DNA, 15 bp, Homo sapiens
ggctctccacctcag

SEQ ID NO: 2067736 - DNA, 20 bp, Homo sapiens
ggctctccacctcagccttg

SEQ ID NO: 2067737 - DNA, 12 bp, Homo sapiens
ggctctcctggc

SEQ ID NO: 2067738 - DNA, 12 bp, Homo sapiens
ggctctgaggcg

SEQ ID NO: 2067739 - DNA, 17 bp, Homo sapiens
ggctctgccccagaggc

SEQ ID NO: 2067740 - DNA, 21 bp, Homo sapiens
ggctctgccccagaggcctct

SEQ ID NO: 2067741 - DNA, 20 bp, Homo sapiens
ggctctgccccagctctggc

SEQ ID NO: 2067742 - DNA, 16 bp, Homo sapiens
ggctctggagccagag

SEQ ID NO: 2067743 - DNA, 13 bp, Homo sapiens
ggctctggccacc

SEQ ID NO: 2067744 - DNA, 14 bp, Homo sapiens
ggctctggccaccc

SEQ ID NO: 2067745 - DNA, 18 bp, Homo sapiens
ggctctgggaaggggtgc

SEQ ID NO: 2067746 - DNA, 23 bp, Homo sapiens
ggctctgggatagctgacccagc

SEQ ID NO: 2067747 - DNA, 14 bp, Homo sapiens
ggctctgggctcag

SEQ ID NO: 2067748 - DNA, 17 bp, Homo sapiens
ggctctgggctcagggc

SEQ ID NO: 2067749 - DNA, 18 bp, Homo sapiens
ggctctgggctcagggct

SEQ ID NO: 2067750 - DNA, 19 bp, Homo sapiens
ggctctgggctcagggctg

SEQ ID NO: 2067751 - DNA, 15 bp, Homo sapiens
ggctctgtgcaggga

SEQ ID NO: 2067752 - DNA, 23 bp, Homo sapiens
ggctcttctcctttcacaacctt

SEQ ID NO: 2067753 - DNA, 12 bp, Homo sapiens
ggctctttcaga

SEQ ID NO: 2067754 - DNA, 13 bp, Homo sapiens
ggctctttcagag

SEQ ID NO: 2067755 - DNA, 15 bp, Homo sapiens
ggctctttcagagag

SEQ ID NO: 2067756 - DNA, 22 bp, Homo sapiens
ggctctttggggtcagccaggg

SEQ ID NO: 2067757 - DNA, 14 bp, Homo sapiens
ggctgaaaatcact

SEQ ID NO: 2067758 - DNA, 11 bp, Homo sapiens
ggctgaaagcc

SEQ ID NO: 2067759 - DNA, 22 bp, Homo sapiens
ggctgaaataaaagcctctggt

SEQ ID NO: 2067760 - DNA, 19 bp, Homo sapiens
ggctgacacctaccatgct

SEQ ID NO: 2067761 - DNA, 21 bp, Homo sapiens
ggctgacacctaccatgctgc

SEQ ID NO: 2067762 - DNA, 19 bp, Homo sapiens
ggctgaccccaaagagcct

SEQ ID NO: 2067763 - DNA, 18 bp, Homo sapiens
ggctgagacaggagaatc

SEQ ID NO: 2067764 - DNA, 14 bp, Homo sapiens
ggctgagcccagcc

SEQ ID NO: 2067765 - DNA, 21 bp, Homo sapiens
ggctgagcccagccacctccc

SEQ ID NO: 2067766 - DNA, 16 bp, Homo sapiens
ggctgagccctggcag

SEQ ID NO: 2067767 - DNA, 15 bp, Homo sapiens
ggctgagcttggccc

SEQ ID NO: 2067768 - DNA, 14 bp, Homo sapiens
ggctgaggcagaag

SEQ ID NO: 2067769 - DNA, 21 bp, Homo sapiens
ggctgagggcagttcgcagcc

SEQ ID NO: 2067770 - DNA, 22 bp, Homo sapiens
ggctgagggcagttcgcagcca

SEQ ID NO: 2067771 - DNA, 14 bp, Homo sapiens
ggctgatttctagg

SEQ ID NO: 2067772 - DNA, 18 bp, Homo sapiens
ggctgcaaagggtatcag

SEQ ID NO: 2067773 - DNA, 13 bp, Homo sapiens
ggctgcagggagt

SEQ ID NO: 2067774 - DNA, 23 bp, Homo sapiens
ggctgcatctgggattcccacca

SEQ ID NO: 2067775 - DNA, 14 bp, Homo sapiens
ggctgcatgctctg

SEQ ID NO: 2067776 - DNA, 19 bp, Homo sapiens
ggctgccccgggtccccag

SEQ ID NO: 2067777 - DNA, 12 bp, Homo sapiens
ggctgccctggt

SEQ ID NO: 2067778 - DNA, 15 bp, Homo sapiens
gggaactcatcctgt

SEQ ID NO: 2067779 - DNA, 18 bp, Homo sapiens
gggaactggccaagctga

SEQ ID NO: 2067780 - DNA, 19 bp, Homo sapiens
gggaactggccaagctgag

SEQ ID NO: 2067781 - DNA, 21 bp, Homo sapiens
gggaagagggcagtacctggg

SEQ ID NO: 2067782 - DNA, 14 bp, Homo sapiens
gggaagatggtagc

SEQ ID NO: 2067783 - DNA, 12 bp, Homo sapiens
gggaagcaggca

SEQ ID NO: 2067784 - DNA, 12 bp, Homo sapiens
gggaagcaggga

SEQ ID NO: 2067785 - DNA, 14 bp, Homo sapiens
gggaagctggggga

SEQ ID NO: 2067786 - DNA, 21 bp, Homo sapiens
gggaagctgggggaagggtgg

SEQ ID NO: 2067787 - DNA, 21 bp, Homo sapiens
gggaaggctacttcggggctg

SEQ ID NO: 2067788 - DNA, 22 bp, Homo sapiens
gggaaggctacttcggggctgg

SEQ ID NO: 2067789 - DNA, 16 bp, Homo sapiens
gggaaggctgctgtgt

SEQ ID NO: 2067790 - DNA, 16 bp, Homo sapiens
gggaagggagagcggg

SEQ ID NO: 2067791 - DNA, 12 bp, Homo sapiens
gggaagggccag

SEQ ID NO: 2067792 - DNA, 15 bp, Homo sapiens
gggaagtgaagcccc

SEQ ID NO: 2067793 - DNA, 15 bp, Homo sapiens
gggaagtgctcccca

SEQ ID NO: 2067794 - DNA, 20 bp, Homo sapiens
gggaatggatggggagaatg

SEQ ID NO: 2067795 - DNA, 16 bp, Homo sapiens
gggaatggcacagccc

SEQ ID NO: 2067796 - DNA, 21 bp, Homo sapiens
gggaatgtttgcctctgcctc

SEQ ID NO: 2067797 - DNA, 22 bp, Homo sapiens
gggaattctttacaataaacat

SEQ ID NO: 2067798 - DNA, 13 bp, Homo sapiens
gggaattgcatgc

SEQ ID NO: 2067799 - DNA, 16 bp, Homo sapiens
gggacaaagaggcctt

SEQ ID NO: 2067800 - DNA, 22 bp, Homo sapiens
gggacaaagaggcctttaacca

SEQ ID NO: 2067801 - DNA, 17 bp, Homo sapiens
gggcctcagtttcccca

SEQ ID NO: 2067802 - DNA, 21 bp, Homo sapiens
gggcctcctctgtccagggcc

SEQ ID NO: 2067803 - DNA, 13 bp, Homo sapiens
gggcctcctgtgt

SEQ ID NO: 2067804 - DNA, 16 bp, Homo sapiens
gggcctcttccctcag

SEQ ID NO: 2067805 - DNA, 17 bp, Homo sapiens
gggcctcttccctcagt

SEQ ID NO: 2067806 - DNA, 20 bp, Homo sapiens
gggcctgctgcgtcagacca

SEQ ID NO: 2067807 - DNA, 19 bp, Homo sapiens
gggcctgctgctgagaacc

SEQ ID NO: 2067808 - DNA, 12 bp, Homo sapiens
gggcctggagag

SEQ ID NO: 2067809 - DNA, 16 bp, Homo sapiens
gggcctggagaggggc

SEQ ID NO: 2067810 - DNA, 10 bp, Homo sapiens
gggcctggca

SEQ ID NO: 2067811 - DNA, 12 bp, Homo sapiens
gggcctggcctg

SEQ ID NO: 2067812 - DNA, 14 bp, Homo sapiens
gggcctggcctgag

SEQ ID NO: 2067813 - DNA, 14 bp, Homo sapiens
gggcctggctggct

SEQ ID NO: 2067814 - DNA, 15 bp, Homo sapiens
gggcctggctggctg

SEQ ID NO: 2067815 - DNA, 20 bp, Homo sapiens
gggcctggctggctgagggc

SEQ ID NO: 2067816 - DNA, 17 bp, Homo sapiens
gggcctggcttgctcca

SEQ ID NO: 2067817 - DNA, 19 bp, Homo sapiens
gggcctggcttgctccagg

SEQ ID NO: 2067818 - DNA, 21 bp, Homo sapiens
gggcctggcttgctccagggt

SEQ ID NO: 2067819 - DNA, 22 bp, Homo sapiens
gggcctggcttgctccagggtc

SEQ ID NO: 2067820 - DNA, 17 bp, Homo sapiens
gggcctgggaaaggaaa

SEQ ID NO: 2067821 - DNA, 22 bp, Homo sapiens
gggcctgggaaaggaaaaccag

SEQ ID NO: 2067822 - DNA, 22 bp, Homo sapiens
gggcctgggggcagtgactggc

SEQ ID NO: 2067823 - DNA, 18 bp, Homo sapiens
gggccttacctcccctgc

SEQ ID NO: 2067824 - DNA, 22 bp, Homo sapiens
gggccttacctcccctgccagg

SEQ ID NO: 2067825 - DNA, 14 bp, Homo sapiens
gggccttgcccaga

SEQ ID NO: 2067826 - DNA, 17 bp, Homo sapiens
gggcgacccctcagtgc

SEQ ID NO: 2067827 - DNA, 17 bp, Homo sapiens
gggcgctcaggacccag

SEQ ID NO: 2067828 - DNA, 16 bp, Homo sapiens
gggcgctgtggctcct

SEQ ID NO: 2067829 - DNA, 20 bp, Homo sapiens
gggcgctgtggctcctgcct

SEQ ID NO: 2067830 - DNA, 21 bp, Homo sapiens
gggcgctgtggctcctgcctt

SEQ ID NO: 2067831 - DNA, 22 bp, Homo sapiens
gggcggcctatgacttgggcac

SEQ ID NO: 2067832 - DNA, 21 bp, Homo sapiens
gggcgggagtgggggctgtgc

SEQ ID NO: 2067833 - DNA, 21 bp, Homo sapiens
gggcgtcgctggacaacccag

SEQ ID NO: 2067834 - DNA, 16 bp, Homo sapiens
gggcgtgactcaccca

SEQ ID NO: 2067835 - DNA, 20 bp, Homo sapiens
gggctaagagctagcgctgc

SEQ ID NO: 2067836 - DNA, 23 bp, Homo sapiens
gggctaagagctagcgctgccgc

SEQ ID NO: 2067837 - DNA, 19 bp, Homo sapiens
gggctactggcagctcctc

SEQ ID NO: 2067838 - DNA, 16 bp, Homo sapiens
gggctagaacctggca

SEQ ID NO: 2067839 - DNA, 12 bp, Homo sapiens
gggctagaatct

SEQ ID NO: 2067840 - DNA, 14 bp, Homo sapiens
gggctagcagaagt

SEQ ID NO: 2067841 - DNA, 19 bp, Homo sapiens
gggctagtgtgagtggcag

SEQ ID NO: 2067842 - DNA, 18 bp, Homo sapiens
gggctagttgggcttcct

SEQ ID NO: 2067843 - DNA, 20 bp, Homo sapiens
gggctatgtgtcacagctct

SEQ ID NO: 2067844 - DNA, 16 bp, Homo sapiens
gggctatttctctccc

SEQ ID NO: 2067845 - DNA, 14 bp, Homo sapiens
gggctcagcaaggt

SEQ ID NO: 2067846 - DNA, 20 bp, Homo sapiens
gggctcagcagccagaggag

SEQ ID NO: 2067847 - DNA, 20 bp, Homo sapiens
gggctcagcctggtgggcct

SEQ ID NO: 2067848 - DNA, 17 bp, Homo sapiens
gggctcagcggggacag

SEQ ID NO: 2067849 - DNA, 12 bp, Homo sapiens
gggctcagggct

SEQ ID NO: 2067850 - DNA, 16 bp, Homo sapiens
gggctccagcatccag

SEQ ID NO: 2067851 - DNA, 17 bp, Homo sapiens
gggctccagcatccagc

SEQ ID NO: 2067852 - DNA, 20 bp, Homo sapiens
gggctccagcatccagcctg

SEQ ID NO: 2067853 - DNA, 14 bp, Homo sapiens
gggctccatggagg

SEQ ID NO: 2067854 - DNA, 14 bp, Homo sapiens
gggctcctggctgc

SEQ ID NO: 2067855 - DNA, 18 bp, Homo sapiens
gggctcctggctgccagg

SEQ ID NO: 2067856 - DNA, 21 bp, Homo sapiens
gggctcctttctccagccagc

SEQ ID NO: 2067857 - DNA, 18 bp, Homo sapiens
gggctcgggcgctgtggc

SEQ ID NO: 2067858 - DNA, 16 bp, Homo sapiens
gggctctaacgcctga

SEQ ID NO: 2067859 - DNA, 19 bp, Homo sapiens
gggctctaacgcctgagcc

SEQ ID NO: 2067860 - DNA, 22 bp, Homo sapiens
gggctctaacgcctgagcccag

SEQ ID NO: 2067861 - DNA, 13 bp, Homo sapiens
gggctctccaaag

SEQ ID NO: 2067862 - DNA, 19 bp, Homo sapiens
gggctctccaaaggggctg

SEQ ID NO: 2067863 - DNA, 21 bp, Homo sapiens
gggctctccaaaggggctgct

SEQ ID NO: 2067864 - DNA, 22 bp, Homo sapiens
gggctctccaaaggggctgctg

SEQ ID NO: 2067865 - DNA, 12 bp, Homo sapiens
gggctctgaggc

SEQ ID NO: 2067866 - DNA, 19 bp, Homo sapiens
gggctctgccccagctctg

SEQ ID NO: 2067867 - DNA, 18 bp, Homo sapiens
gggctgaactgagcctag

SEQ ID NO: 2067868 - DNA, 23 bp, Homo sapiens
gggctgacacctaccatgctgct

SEQ ID NO: 2067869 - DNA, 18 bp, Homo sapiens
gggctgagccctggcagg

SEQ ID NO: 2067870 - DNA, 12 bp, Homo sapiens
gggctgccctgc

SEQ ID NO: 2067871 - DNA, 23 bp, Homo sapiens
gggctgcccttcgctgccaggac

SEQ ID NO: 2067872 - DNA, 19 bp, Homo sapiens
gggctgccgggccaggcgc

SEQ ID NO: 2067873 - DNA, 22 bp, Homo sapiens
gggctgctcatcacccagtcct

SEQ ID NO: 2067874 - DNA, 12 bp, Homo sapiens
gggctgctgtga

SEQ ID NO: 2067875 - DNA, 22 bp, Homo sapiens
gggctggaaaagtcacacagac

SEQ ID NO: 2067876 - DNA, 23 bp, Homo sapiens
gggctggaaaagtcacacagaca

SEQ ID NO: 2067877 - DNA, 20 bp, Homo sapiens
gggctggactctggcaccca

SEQ ID NO: 2067878 - DNA, 21 bp, Homo sapiens
gggctggagtgcgctcttggt

SEQ ID NO: 2067879 - DNA, 15 bp, Homo sapiens
gggctggcaagcagg

SEQ ID NO: 2067880 - DNA, 13 bp, Homo sapiens
gggctggcccagc

SEQ ID NO: 2067881 - DNA, 16 bp, Homo sapiens
gggctggcccagccaa

SEQ ID NO: 2067882 - DNA, 19 bp, Homo sapiens
gggctggcccagccaactg

SEQ ID NO: 2067883 - DNA, 19 bp, Homo sapiens
gggctggcggctactcagc

SEQ ID NO: 2067884 - DNA, 16 bp, Homo sapiens
gggctgggagctctgc

SEQ ID NO: 2067885 - DNA, 15 bp, Homo sapiens
gggctgggcccacag

SEQ ID NO: 2067886 - DNA, 22 bp, Homo sapiens
gggctgttggacagctgcttgt

SEQ ID NO: 2067887 - DNA, 18 bp, Homo sapiens
gggcttatggccagggga

SEQ ID NO: 2067888 - DNA, 15 bp, Homo sapiens
gggcttcctgggtcc

SEQ ID NO: 2067889 - DNA, 17 bp, Homo sapiens
gggcttcctgggtcctg

SEQ ID NO: 2067890 - DNA, 13 bp, Homo sapiens
gggcttctcctga

SEQ ID NO: 2067891 - DNA, 18 bp, Homo sapiens
gggcttctgggtggctcc

SEQ ID NO: 2067892 - DNA, 19 bp, Homo sapiens
gggcttctgggtggctcct

SEQ ID NO: 2067893 - DNA, 16 bp, Homo sapiens
gggcttggacttcctg

SEQ ID NO: 2067894 - DNA, 15 bp, Homo sapiens
gggcttgggccctgc

SEQ ID NO: 2067895 - DNA, 12 bp, Homo sapiens
gggcttggggag

SEQ ID NO: 2067896 - DNA, 14 bp, Homo sapiens
gggcttggggagca

SEQ ID NO: 2067897 - DNA, 22 bp, Homo sapiens
gggcttggggagcaggtctctg

SEQ ID NO: 2067898 - DNA, 15 bp, Homo sapiens
gggctttgcaggctc

SEQ ID NO: 2067899 - DNA, 20 bp, Homo sapiens
gggctttgcaggctctgggc

SEQ ID NO: 2067900 - DNA, 23 bp, Homo sapiens
gggctttgtttgggccactgcca

SEQ ID NO: 2067901 - DNA, 14 bp, Homo sapiens
ggggaacgcagagg

SEQ ID NO: 2067902 - DNA, 19 bp, Homo sapiens
ggggaacgcagaggcggaa

SEQ ID NO: 2067903 - DNA, 13 bp, Homo sapiens
ggggaactcctgg

SEQ ID NO: 2067904 - DNA, 23 bp, Homo sapiens
ggggaactgcatatcggaggtgg

SEQ ID NO: 2067905 - DNA, 13 bp, Homo sapiens
ggggaactggcca

SEQ ID NO: 2067906 - DNA, 21 bp, Homo sapiens
ggggaactggccaagctgagg

SEQ ID NO: 2067907 - DNA, 14 bp, Homo sapiens
ggggaagccctgga

SEQ ID NO: 2067908 - DNA, 14 bp, Homo sapiens
ggggaagggtggtc

SEQ ID NO: 2067909 - DNA, 18 bp, Homo sapiens
ggggaatgtttgcctctg

SEQ ID NO: 2067910 - DNA, 12 bp, Homo sapiens
ggggacagctcc

SEQ ID NO: 2067911 - DNA, 19 bp, Homo sapiens
ggggacatttccctcctgg

SEQ ID NO: 2067912 - DNA, 11 bp, Homo sapiens
ggggagaaagg

SEQ ID NO: 2067913 - DNA, 15 bp, Homo sapiens
ggggagaagggccag

SEQ ID NO: 2067914 - DNA, 13 bp, Homo sapiens
ggggagacctggt

SEQ ID NO: 2067915 - DNA, 20 bp, Homo sapiens
ggggagacggaggttgcagt

SEQ ID NO: 2067916 - DNA, 11 bp, Homo sapiens
ggggagcagag

SEQ ID NO: 2067917 - DNA, 17 bp, Homo sapiens
ggggagcaggtctctgg

SEQ ID NO: 2067918 - DNA, 24 bp, Homo sapiens
gggaggtctccactgaggatgtga

SEQ ID NO: 2067919 - DNA, 19 bp, Homo sapiens
gggaggtgcctgagctggg

SEQ ID NO: 2067920 - DNA, 21 bp, Homo sapiens
gggaggttttattctgacttc

SEQ ID NO: 2067921 - DNA, 23 bp, Homo sapiens
gggaggttttattctgacttcct

SEQ ID NO: 2067922 - DNA, 11 bp, Homo sapiens
gggagtgagct

SEQ ID NO: 2067923 - DNA, 18 bp, Homo sapiens
gggagtgcagagaaagaa

SEQ ID NO: 2067924 - DNA, 20 bp, Homo sapiens
gggagttcgagaccaacctg

SEQ ID NO: 2067925 - DNA, 20 bp, Homo sapiens
gggagttgagtcacaagagg

SEQ ID NO: 2067926 - DNA, 20 bp, Homo sapiens
gggagttgctcactcaggac

SEQ ID NO: 2067927 - DNA, 13 bp, Homo sapiens
gggatagagagag

SEQ ID NO: 2067928 - DNA, 23 bp, Homo sapiens
gggatcagcctccgccattccaa

SEQ ID NO: 2067929 - DNA, 17 bp, Homo sapiens
gggatcccaggccaggg

SEQ ID NO: 2067930 - DNA, 20 bp, Homo sapiens
gggatctgcattccccgctg

SEQ ID NO: 2067931 - DNA, 15 bp, Homo sapiens
gggatgactgtgatt

SEQ ID NO: 2067932 - DNA, 15 bp, Homo sapiens
gggatgagccgctgt

SEQ ID NO: 2067933 - DNA, 20 bp, Homo sapiens
gggatgagctcaagcaggaa

SEQ ID NO: 2067934 - DNA, 21 bp, Homo sapiens
gggatgccaacaccttcttgg

SEQ ID NO: 2067935 - DNA, 12 bp, Homo sapiens
gggatggaccct

SEQ ID NO: 2067936 - DNA, 19 bp, Homo sapiens
gggatggagaggcggcctc

SEQ ID NO: 2067937 - DNA, 15 bp, Homo sapiens
gggatggaggagaag

SEQ ID NO: 2067938 - DNA, 18 bp, Homo sapiens
gggatggaggagaagaat

SEQ ID NO: 2067939 - DNA, 20 bp, Homo sapiens
gggatgggggatgggccagg

SEQ ID NO: 2067940 - DNA, 16 bp, Homo sapiens
gggatggtcctggggc

SEQ ID NO: 2067941 - DNA, 22 bp, Homo sapiens
gggatgtgaattgcctgcagag

SEQ ID NO: 2067942 - DNA, 14 bp, Homo sapiens
gggatgtgggaggg

SEQ ID NO: 2067943 - DNA, 15 bp, Homo sapiens
gggattacaggtgtg

SEQ ID NO: 2067944 - DNA, 15 bp, Homo sapiens
gggattcccaccaag

SEQ ID NO: 2067945 - DNA, 19 bp, Homo sapiens
gggattgggagggacaggg

SEQ ID NO: 2067946 - DNA, 18 bp, Homo sapiens
gggatttcttcgctgctc

SEQ ID NO: 2067947 - DNA, 20 bp, Homo sapiens
gggatttcttcgctgctcta

SEQ ID NO: 2067948 - DNA, 22 bp, Homo sapiens
gggcaaatgacatgcactgacc

SEQ ID NO: 2067949 - DNA, 22 bp, Homo sapiens
gggcaacagagcaagatcctgt

SEQ ID NO: 2067950 - DNA, 13 bp, Homo sapiens
gggcaagggccat

SEQ ID NO: 2067951 - DNA, 16 bp, Homo sapiens
gggcaatgaaaccaaa

SEQ ID NO: 2067952 - DNA, 15 bp, Homo sapiens
gggcaatggggagag

SEQ ID NO: 2067953 - DNA, 18 bp, Homo sapiens
gctgactttgctctttct

SEQ ID NO: 2067954 - DNA, 17 bp, Homo sapiens
gctgagaacctggcctt

SEQ ID NO: 2067955 - DNA, 12 bp, Homo sapiens
gctgagaagaag

SEQ ID NO: 2067956 - DNA, 14 bp, Homo sapiens
gctgagaagaagct

SEQ ID NO: 2067957 - DNA, 15 bp, Homo sapiens
gctgagaagaagctg

SEQ ID NO: 2067958 - DNA, 23 bp, Homo sapiens
gctgagaagaagctgaggatcct

SEQ ID NO: 2067959 - DNA, 22 bp, Homo sapiens
gctgagagacccaaggaggaaa

SEQ ID NO: 2067960 - DNA, 17 bp, Homo sapiens
gctgagaggaagatgaa

SEQ ID NO: 2067961 - DNA, 18 bp, Homo sapiens
gctgagaggaagatgaag

SEQ ID NO: 2067962 - DNA, 21 bp, Homo sapiens
gctgagaggaagatgaagaga

SEQ ID NO: 2067963 - DNA, 22 bp, Homo sapiens
gctgagaggcagacttccctga

SEQ ID NO: 2067964 - DNA, 22 bp, Homo sapiens
gctgagagtctgaaagacagaa

SEQ ID NO: 2067965 - DNA, 13 bp, Homo sapiens
gctgagcagggcc

SEQ ID NO: 2067966 - DNA, 17 bp, Homo sapiens
gctgagccactcgcagt

SEQ ID NO: 2067967 - DNA, 13 bp, Homo sapiens
gctgagcccagcc

SEQ ID NO: 2067968 - DNA, 22 bp, Homo sapiens
gctgagctcacaaggcagcaag

SEQ ID NO: 2067969 - DNA, 17 bp, Homo sapiens
gctgagctctgagaggc

SEQ ID NO: 2067970 - DNA, 19 bp, Homo sapiens
gctgagctctgagaggccc

SEQ ID NO: 2067971 - DNA, 12 bp, Homo sapiens
gctgagctggca

SEQ ID NO: 2067972 - DNA, 21 bp, Homo sapiens
gctgaggactccctccatgtg

SEQ ID NO: 2067973 - DNA, 18 bp, Homo sapiens
gctgaggatttcaagcct

SEQ ID NO: 2067974 - DNA, 20 bp, Homo sapiens
gctgaggatttcaagcctgc

SEQ ID NO: 2067975 - DNA, 14 bp, Homo sapiens
gctgaggcaattct

SEQ ID NO: 2067976 - DNA, 13 bp, Homo sapiens
gctgaggcagaag

SEQ ID NO: 2067977 - DNA, 21 bp, Homo sapiens
gctgagggcagttcgcagcca

SEQ ID NO: 2067978 - DNA, 22 bp, Homo sapiens
gctgagggcagttcgcagccac

SEQ ID NO: 2067979 - DNA, 22 bp, Homo sapiens
gctgaggggaggatcactggag

SEQ ID NO: 2067980 - DNA, 17 bp, Homo sapiens
gctgaggtgcccaggag

SEQ ID NO: 2067981 - DNA, 21 bp, Homo sapiens
gctgagtatgttaagctcttt

SEQ ID NO: 2067982 - DNA, 16 bp, Homo sapiens
gctgagtcacctcctc

SEQ ID NO: 2067983 - DNA, 18 bp, Homo sapiens
gctgagtcacctcctcca

SEQ ID NO: 2067984 - DNA, 23 bp, Homo sapiens
gctgagtcatgatctccctgccg

SEQ ID NO: 2067985 - DNA, 18 bp, Homo sapiens
gctgagtccctccatgca

SEQ ID NO: 2067986 - DNA, 17 bp, Homo sapiens
gctgagtgagccacaga

SEQ ID NO: 2067987 - DNA, 19 bp, Homo sapiens
gctgagtggaatgcaggga

SEQ ID NO: 2067988 - DNA, 23 bp, Homo sapiens
gctgagttccttataagaattaa

SEQ ID NO: 2067989 - DNA, 12 bp, Homo sapiens
gctgataatttt

SEQ ID NO: 2067990 - DNA, 15 bp, Homo sapiens
gctgataattttaaa

SEQ ID NO: 2067991 - DNA, 16 bp, Homo sapiens
gctgatggagaaggaa

SEQ ID NO: 2067992 - DNA, 16 bp, Homo sapiens
gctgattcaagaaaca

SEQ ID NO: 2067993 - DNA, 16 bp, Homo sapiens
gctgatttccaggccc

SEQ ID NO: 2067994 - DNA, 18 bp, Homo sapiens
gctgatttccaggcccct

SEQ ID NO: 2067995 - DNA, 20 bp, Homo sapiens
gctgatttccaggcccctga

SEQ ID NO: 2067996 - DNA, 23 bp, Homo sapiens
gctgatttctaggtaggaaatgt

SEQ ID NO: 2067997 - DNA, 22 bp, Homo sapiens
gctgcaaaagaagtttctggag

SEQ ID NO: 2067998 - DNA, 23 bp, Homo sapiens
gctgcaaagggtatcaggtgctg

SEQ ID NO: 2067999 - DNA, 17 bp, Homo sapiens
gctgcaaggaagggtgg

SEQ ID NO: 2068000 - DNA, 13 bp, Homo sapiens
gctgcacattcct

SEQ ID NO: 2068001 - DNA, 14 bp, Homo sapiens
gctgcaccagagtg

SEQ ID NO: 2068002 - DNA, 15 bp, Homo sapiens
gctgcaccagagtga

SEQ ID NO: 2068003 - DNA, 15 bp, Homo sapiens
gctgcaccatcacac

SEQ ID NO: 2068004 - DNA, 21 bp, Homo sapiens
gctgcacctgccagcctggct

SEQ ID NO: 2068005 - DNA, 14 bp, Homo sapiens
gctgcactgcagtg

SEQ ID NO: 2068006 - DNA, 16 bp, Homo sapiens
gctgcagaaggccaag

SEQ ID NO: 2068007 - DNA, 19 bp, Homo sapiens
gctgcagaaggccaagaat

SEQ ID NO: 2068008 - DNA, 15 bp, Homo sapiens
gctgcagctgggccc

SEQ ID NO: 2068009 - DNA, 12 bp, Homo sapiens
gctgcagcttcc

SEQ ID NO: 2068010 - DNA, 21 bp, Homo sapiens
gctgcaggaatcaaaaattga

SEQ ID NO: 2068011 - DNA, 22 bp, Homo sapiens
gctgcaggaatcaaaaattgaa

SEQ ID NO: 2068012 - DNA, 20 bp, Homo sapiens
gctgcaggtacttcctcctg

SEQ ID NO: 2068013 - DNA, 23 bp, Homo sapiens
gctgcagtcaacagttcaaagaa

SEQ ID NO: 2068014 - DNA, 14 bp, Homo sapiens
gctgcatgctctgg

SEQ ID NO: 2068015 - DNA, 15 bp, Homo sapiens
gctgccaaattttgg

SEQ ID NO: 2068016 - DNA, 16 bp, Homo sapiens
gctgccacacctgagc

SEQ ID NO: 2068017 - DNA, 21 bp, Homo sapiens
gctgccacacttcaggctctt

SEQ ID NO: 2068018 - DNA, 22 bp, Homo sapiens
gctgccaccacgtctgccaggc

SEQ ID NO: 2068019 - DNA, 20 bp, Homo sapiens
gctgccactaacctgtagaa

SEQ ID NO: 2068020 - DNA, 10 bp, Homo sapiens
gctgccagga

SEQ ID NO: 2068021 - DNA, 15 bp, Homo sapiens
gctgccaggacacct

SEQ ID NO: 2068022 - DNA, 17 bp, Homo sapiens
gctgccatccaggttca

SEQ ID NO: 2068023 - DNA, 21 bp, Homo sapiens
gctgccatccaggttcagctt

SEQ ID NO: 2068024 - DNA, 23 bp, Homo sapiens
gctgccatccaggttcagcttgt

SEQ ID NO: 2068025 - DNA, 12 bp, Homo sapiens
gctgccatgcca

SEQ ID NO: 2068026 - DNA, 20 bp, Homo sapiens
gctgccatgccactgccagg

SEQ ID NO: 2068027 - DNA, 21 bp, Homo sapiens
gctgccatgccactgccaggc

SEQ ID NO: 2068028 - DNA, 22 bp, Homo sapiens
gctgccatgccactgccaggca

SEQ ID NO: 2068029 - DNA, 23 bp, Homo sapiens
gctgccatgccactgccaggcac

SEQ ID NO: 2068030 - DNA, 15 bp, Homo sapiens
gctgccccagccccg

SEQ ID NO: 2068031 - DNA, 13 bp, Homo sapiens
gctgccccgcttc

SEQ ID NO: 2068032 - DNA, 21 bp, Homo sapiens
gctgccccgcttccccacaga

SEQ ID NO: 2068033 - DNA, 22 bp, Homo sapiens
gctgccccgcttccccacagaa

SEQ ID NO: 2068034 - DNA, 23 bp, Homo sapiens
gctgccccgggtccccagctccc

SEQ ID NO: 2068035 - DNA, 20 bp, Homo sapiens
gctgcccctggtgcactggc

SEQ ID NO: 2068036 - DNA, 20 bp, Homo sapiens
gctgcccgtcttcagcctag

SEQ ID NO: 2068037 - DNA, 21 bp, Homo sapiens
gctgcccgtcttcagcctagc

SEQ ID NO: 2068038 - DNA, 15 bp, Homo sapiens
gctgccctggtgctg

SEQ ID NO: 2068039 - DNA, 19 bp, Homo sapiens
gctgccctggtgctgccac

SEQ ID NO: 2068040 - DNA, 18 bp, Homo sapiens
gctgccctgtaccccagc

SEQ ID NO: 2068041 - DNA, 18 bp, Homo sapiens
gctgcccttcgctgccag

SEQ ID NO: 2068042 - DNA, 21 bp, Homo sapiens
gctgcccttcgctgccaggac

SEQ ID NO: 2068043 - DNA, 17 bp, Homo sapiens
gctgccgaccagagccc

SEQ ID NO: 2068044 - DNA, 14 bp, Homo sapiens
gctgccgcaaggcc

SEQ ID NO: 2068045 - DNA, 15 bp, Homo sapiens
gctgccgcaaggccc

SEQ ID NO: 2068046 - DNA, 15 bp, Homo sapiens
gctgccgcctcccag

SEQ ID NO: 2068047 - DNA, 20 bp, Homo sapiens
gctgccgcctcccagcctgg

SEQ ID NO: 2068048 - DNA, 14 bp, Homo sapiens
gctgccgctgcacc

SEQ ID NO: 2068049 - DNA, 15 bp, Homo sapiens
gctgccgctgcacca

SEQ ID NO: 2068050 - DNA, 14 bp, Homo sapiens
gctgcctaataaag

SEQ ID NO: 2068051 - DNA, 23 bp, Homo sapiens
gctgcctcatgaccctcctgtcc

SEQ ID NO: 2068052 - DNA, 24 bp, Homo sapiens
gctgcctcatgaccctcctgtcca

SEQ ID NO: 2068053 - DNA, 18 bp, Homo sapiens
gctgcctccctctgctgt

SEQ ID NO: 2068054 - DNA, 15 bp, Homo sapiens
gctgcctgccgccca

SEQ ID NO: 2068055 - DNA, 15 bp, Homo sapiens
gctgcctgtagttag

SEQ ID NO: 2068056 - DNA, 20 bp, Homo sapiens
gctgccttagaacctttctt

SEQ ID NO: 2068057 - DNA, 16 bp, Homo sapiens
gctgccttcctcatcc

SEQ ID NO: 2068058 - DNA, 14 bp, Homo sapiens
gctgccttgccatg

SEQ ID NO: 2068059 - DNA, 19 bp, Homo sapiens
gctgccttttgctgctgct

SEQ ID NO: 2068060 - DNA, 15 bp, Homo sapiens
gctgcgagcatttcc

SEQ ID NO: 2068061 - DNA, 16 bp, Homo sapiens
gctgcgctaaccccca

SEQ ID NO: 2068062 - DNA, 18 bp, Homo sapiens
gctgcggccagcctgact

SEQ ID NO: 2068063 - DNA, 20 bp, Homo sapiens
gctgcggcctaggggtccac

SEQ ID NO: 2068064 - DNA, 14 bp, Homo sapiens
gctgcggtccaccc

SEQ ID NO: 2068065 - DNA, 21 bp, Homo sapiens
gctgcggtccacccaggagcc

SEQ ID NO: 2068066 - DNA, 22 bp, Homo sapiens
gctgcgtttattaatgcctctc

SEQ ID NO: 2068067 - DNA, 17 bp, Homo sapiens
gctgctactacccgagc

SEQ ID NO: 2068068 - DNA, 22 bp, Homo sapiens
gctcaggtgactggagcccgag

SEQ ID NO: 2068069 - DNA, 15 bp, Homo sapiens
gctcaggtgcaagtg

SEQ ID NO: 2068070 - DNA, 14 bp, Homo sapiens
gctcaggtgtccct

SEQ ID NO: 2068071 - DNA, 16 bp, Homo sapiens
gctcaggtgtccctgc

SEQ ID NO: 2068072 - DNA, 17 bp, Homo sapiens
gctcaggtgtccctgca

SEQ ID NO: 2068073 - DNA, 23 bp, Homo sapiens
gctcagtcccatcagagagcgag

SEQ ID NO: 2068074 - DNA, 20 bp, Homo sapiens
gctcagtctcaggagcatgg

SEQ ID NO: 2068075 - DNA, 21 bp, Homo sapiens
gctcagtctcaggagcatggg

SEQ ID NO: 2068076 - DNA, 17 bp, Homo sapiens
gctcataacatctttga

SEQ ID NO: 2068077 - DNA, 14 bp, Homo sapiens
gctcatattttgta

SEQ ID NO: 2068078 - DNA, 18 bp, Homo sapiens
gctcatattttgtatata

SEQ ID NO: 2068079 - DNA, 23 bp, Homo sapiens
gctcatcacccagtcctggccat

SEQ ID NO: 2068080 - DNA, 18 bp, Homo sapiens
gctcatggcgtaatgggc

SEQ ID NO: 2068081 - DNA, 22 bp, Homo sapiens
gctcatggcgtaatgggcctgc

SEQ ID NO: 2068082 - DNA, 15 bp, Homo sapiens
gctcattttttctta

SEQ ID NO: 2068083 - DNA, 14 bp, Homo sapiens
gctccaacagcttg

SEQ ID NO: 2068084 - DNA, 23 bp, Homo sapiens
gctccaccctcaccaggatgaag

SEQ ID NO: 2068085 - DNA, 19 bp, Homo sapiens
gctccacctgttcaggagc

SEQ ID NO: 2068086 - DNA, 18 bp, Homo sapiens
gctccactgtcaccctcc

SEQ ID NO: 2068087 - DNA, 15 bp, Homo sapiens
gctccagatctgcac

SEQ ID NO: 2068088 - DNA, 13 bp, Homo sapiens
gctccagcatcca

SEQ ID NO: 2068089 - DNA, 17 bp, Homo sapiens
gctccagcatccagcct

SEQ ID NO: 2068090 - DNA, 19 bp, Homo sapiens
gctccagcatccagcctgt

SEQ ID NO: 2068091 - DNA, 21 bp, Homo sapiens
gctccagcatccagcctgtgt

SEQ ID NO: 2068092 - DNA, 20 bp, Homo sapiens
gctccagctcaccagcccca

SEQ ID NO: 2068093 - DNA, 23 bp, Homo sapiens
gctccagggcagcctccaccttg

SEQ ID NO: 2068094 - DNA, 17 bp, Homo sapiens
gctccagggtcttgggc

SEQ ID NO: 2068095 - DNA, 22 bp, Homo sapiens
gctccagggtcttgggctactg

SEQ ID NO: 2068096 - DNA, 23 bp, Homo sapiens
gctccagggtcttgggctactgg

SEQ ID NO: 2068097 - DNA, 19 bp, Homo sapiens
gctccaggtccggaggggt

SEQ ID NO: 2068098 - DNA, 22 bp, Homo sapiens
gctccagtttccccatggggct

SEQ ID NO: 2068099 - DNA, 17 bp, Homo sapiens
gctccatggaggaggtg

SEQ ID NO: 2068100 - DNA, 22 bp, Homo sapiens
gctccatggaggaggtgtccca

SEQ ID NO: 2068101 - DNA, 12 bp, Homo sapiens
gctccatgggga

SEQ ID NO: 2068102 - DNA, 22 bp, Homo sapiens
gctccatggggaagtgctcccc

SEQ ID NO: 2068103 - DNA, 17 bp, Homo sapiens
gctcccacaggcccttc

SEQ ID NO: 2068104 - DNA, 22 bp, Homo sapiens
gctcccacaggcccttcctctc

SEQ ID NO: 2068105 - DNA, 19 bp, Homo sapiens
gctcccagcagccctaagg

SEQ ID NO: 2068106 - DNA, 19 bp, Homo sapiens
gctcccatagcgctggctc

SEQ ID NO: 2068107 - DNA, 20 bp, Homo sapiens
gctccccacacgtgctcgca

SEQ ID NO: 2068108 - DNA, 21 bp, Homo sapiens
gctccccacacgtgctcgcag

SEQ ID NO: 2068109 - DNA, 20 bp, Homo sapiens
gctccccactctgctctgat

SEQ ID NO: 2068110 - DNA, 22 bp, Homo sapiens
gctccccagccctggctctgca

SEQ ID NO: 2068111 - DNA, 15 bp, Homo sapiens
gctcccccgcagtcc

SEQ ID NO: 2068112 - DNA, 17 bp, Homo sapiens
gctccccctgcttctca

SEQ ID NO: 2068113 - DNA, 21 bp, Homo sapiens
gctccccctgcttctcagccc

SEQ ID NO: 2068114 - DNA, 16 bp, Homo sapiens
gctcccccttcccagt

SEQ ID NO: 2068115 - DNA, 20 bp, Homo sapiens
gctccccgggggcagacacc

SEQ ID NO: 2068116 - DNA, 16 bp, Homo sapiens
gctccctcctggagca

SEQ ID NO: 2068117 - DNA, 17 bp, Homo sapiens
gctccctgtagctctgc

SEQ ID NO: 2068118 - DNA, 23 bp, Homo sapiens
gctccctgtagctctgcctccct

SEQ ID NO: 2068119 - DNA, 17 bp, Homo sapiens
gctctggccaccctggc

SEQ ID NO: 2068120 - DNA, 13 bp, Homo sapiens
gctctgggaaggg

SEQ ID NO: 2068121 - DNA, 14 bp, Homo sapiens
gctctgggaagggg

SEQ ID NO: 2068122 - DNA, 21 bp, Homo sapiens
gctctgggaaggggtgccctc

SEQ ID NO: 2068123 - DNA, 23 bp, Homo sapiens
gctctgggaaggggtgccctctg

SEQ ID NO: 2068124 - DNA, 12 bp, Homo sapiens
gctctgggctca

SEQ ID NO: 2068125 - DNA, 15 bp, Homo sapiens
gctctgggctcaggg

SEQ ID NO: 2068126 - DNA, 19 bp, Homo sapiens
gctctgggctcagggctgg

SEQ ID NO: 2068127 - DNA, 14 bp, Homo sapiens
gctctgtcctggga

SEQ ID NO: 2068128 - DNA, 15 bp, Homo sapiens
gctctgtcctgggag

SEQ ID NO: 2068129 - DNA, 13 bp, Homo sapiens
gctctgtggcctg

SEQ ID NO: 2068130 - DNA, 16 bp, Homo sapiens
gctctgtggcctgtgt

SEQ ID NO: 2068131 - DNA, 17 bp, Homo sapiens
gctctgtggcctgtgtc

SEQ ID NO: 2068132 - DNA, 19 bp, Homo sapiens
gctctgtggcctgtgtcca

SEQ ID NO: 2068133 - DNA, 12 bp, Homo sapiens
gctcttaatgtt

SEQ ID NO: 2068134 - DNA, 16 bp, Homo sapiens
gctcttcaagctgtcc

SEQ ID NO: 2068135 - DNA, 24 bp, Homo sapiens
gctcttcaagctgtcccctctgtc

SEQ ID NO: 2068136 - DNA, 14 bp, Homo sapiens
gctcttcactcagc

SEQ ID NO: 2068137 - DNA, 14 bp, Homo sapiens
gctcttcatgtttc

SEQ ID NO: 2068138 - DNA, 21 bp, Homo sapiens
gctcttcccctttcctggggg

SEQ ID NO: 2068139 - DNA, 15 bp, Homo sapiens
gctcttcctggacct

SEQ ID NO: 2068140 - DNA, 18 bp, Homo sapiens
gctcttcctggacctgag

SEQ ID NO: 2068141 - DNA, 20 bp, Homo sapiens
gctcttcctggacctgagtc

SEQ ID NO: 2068142 - DNA, 13 bp, Homo sapiens
gctcttctaagga

SEQ ID NO: 2068143 - DNA, 18 bp, Homo sapiens
gctcttctatttaaaaaa

SEQ ID NO: 2068144 - DNA, 19 bp, Homo sapiens
gctcttctatttaaaaaat

SEQ ID NO: 2068145 - DNA, 14 bp, Homo sapiens
gctcttctccaggc

SEQ ID NO: 2068146 - DNA, 17 bp, Homo sapiens
gctcttctcctttcaca

SEQ ID NO: 2068147 - DNA, 15 bp, Homo sapiens
gctcttctgtcatcc

SEQ ID NO: 2068148 - DNA, 12 bp, Homo sapiens
gctcttctttct

SEQ ID NO: 2068149 - DNA, 15 bp, Homo sapiens
gctcttctttctgag

SEQ ID NO: 2068150 - DNA, 23 bp, Homo sapiens
gctcttgcatcctcctcccaact

SEQ ID NO: 2068151 - DNA, 12 bp, Homo sapiens
gctcttgcctgc

SEQ ID NO: 2068152 - DNA, 15 bp, Homo sapiens
gctcttgcctgcacc

SEQ ID NO: 2068153 - DNA, 13 bp, Homo sapiens
gctcttgcctgta

SEQ ID NO: 2068154 - DNA, 17 bp, Homo sapiens
gctcttggcattttcct

SEQ ID NO: 2068155 - DNA, 19 bp, Homo sapiens
gctcttggcccctgtgtga

SEQ ID NO: 2068156 - DNA, 14 bp, Homo sapiens
gctcttggtccctg

SEQ ID NO: 2068157 - DNA, 21 bp, Homo sapiens
gctcttggtccctggtccctc

SEQ ID NO: 2068158 - DNA, 15 bp, Homo sapiens
gctctttcagagagg

SEQ ID NO: 2068159 - DNA, 13 bp, Homo sapiens
gctctttcagggg

SEQ ID NO: 2068160 - DNA, 20 bp, Homo sapiens
gctctttggggtcagccagg

SEQ ID NO: 2068161 - DNA, 22 bp, Homo sapiens
gctctttggggtcagccagggc

SEQ ID NO: 2068162 - DNA, 19 bp, Homo sapiens
gctgaaaatcaaagtaaaa

SEQ ID NO: 2068163 - DNA, 15 bp, Homo sapiens
gctgaaaatcactat

SEQ ID NO: 2068164 - DNA, 16 bp, Homo sapiens
gctgaacggggagaaa

SEQ ID NO: 2068165 - DNA, 22 bp, Homo sapiens
gctgaagacaaaccactgtaca

SEQ ID NO: 2068166 - DNA, 21 bp, Homo sapiens
gctgaagaggcaagagacaga

SEQ ID NO: 2068167 - DNA, 20 bp, Homo sapiens
gctgaagcctatttatttga

SEQ ID NO: 2068168 - DNA, 20 bp, Homo sapiens
gctgaagtgaaggagaaagg

SEQ ID NO: 2068169 - DNA, 15 bp, Homo sapiens
gctgaagttctgagc

SEQ ID NO: 2068170 - DNA, 16 bp, Homo sapiens
gctgaatagcttctcc

SEQ ID NO: 2068171 - DNA, 13 bp, Homo sapiens
gctgaattatttt

SEQ ID NO: 2068172 - DNA, 19 bp, Homo sapiens
gctgacacataatttgaat

SEQ ID NO: 2068173 - DNA, 14 bp, Homo sapiens
gctgacacctacca

SEQ ID NO: 2068174 - DNA, 18 bp, Homo sapiens
gctgacacctaccatgct

SEQ ID NO: 2068175 - DNA, 21 bp, Homo sapiens
gctgacacctaccatgctgct

SEQ ID NO: 2068176 - DNA, 14 bp, Homo sapiens
gctgacagacacag

SEQ ID NO: 2068177 - DNA, 17 bp, Homo sapiens
gctgacagacacaggcc

SEQ ID NO: 2068178 - DNA, 13 bp, Homo sapiens
gctgacaggatgt

SEQ ID NO: 2068179 - DNA, 14 bp, Homo sapiens
gctgacatctcctc

SEQ ID NO: 2068180 - DNA, 15 bp, Homo sapiens
gctgaccaagagaga

SEQ ID NO: 2068181 - DNA, 16 bp, Homo sapiens
gctgaccaagagagaa

SEQ ID NO: 2068182 - DNA, 15 bp, Homo sapiens
gctgacccagtccct

SEQ ID NO: 2068183 - DNA, 13 bp, Homo sapiens
gctgacctctggt

SEQ ID NO: 2068184 - DNA, 16 bp, Homo sapiens
gctgacctgcctctca

SEQ ID NO: 2068185 - DNA, 14 bp, Homo sapiens
gctgactcagtcca

SEQ ID NO: 2068186 - DNA, 19 bp, Homo sapiens
gctgactgtactcctccca

SEQ ID NO: 2068187 - DNA, 23 bp, Homo sapiens
gctgacttgcagagttcatggaa

SEQ ID NO: 2068188 - DNA, 19 bp, Homo sapiens
gcgctcaggacccaggccc

SEQ ID NO: 2068189 - DNA, 21 bp, Homo sapiens
gcgctcaggacccaggccctc

SEQ ID NO: 2068190 - DNA, 19 bp, Homo sapiens
gcgctcattttaggcctcc

SEQ ID NO: 2068191 - DNA, 18 bp, Homo sapiens
gcgctcttggtccctggt

SEQ ID NO: 2068192 - DNA, 20 bp, Homo sapiens
gcgctcttggtccctggtcc

SEQ ID NO: 2068193 - DNA, 18 bp, Homo sapiens
gcgctggacagaggggca

SEQ ID NO: 2068194 - DNA, 16 bp, Homo sapiens
gcgctggctcaggaag

SEQ ID NO: 2068195 - DNA, 21 bp, Homo sapiens
gcgctggctcaggaagaaacc

SEQ ID NO: 2068196 - DNA, 18 bp, Homo sapiens
gcgctgtggctcctgcct

SEQ ID NO: 2068197 - DNA, 17 bp, Homo sapiens
gcggaaaccttgcagca

SEQ ID NO: 2068198 - DNA, 11 bp, Homo sapiens
gcggacagcca

SEQ ID NO: 2068199 - DNA, 23 bp, Homo sapiens
gcggacagccacggccaggccag

SEQ ID NO: 2068200 - DNA, 18 bp, Homo sapiens
gcggagaccctgagtccg

SEQ ID NO: 2068201 - DNA, 20 bp, Homo sapiens
gcggagagtacagtgagcca

SEQ ID NO: 2068202 - DNA, 18 bp, Homo sapiens
gcggagccggcacctaca

SEQ ID NO: 2068203 - DNA, 19 bp, Homo sapiens
gcggcacattggcagtgtg

SEQ ID NO: 2068204 - DNA, 17 bp, Homo sapiens
gcggccgcattccctga

SEQ ID NO: 2068205 - DNA, 15 bp, Homo sapiens
gcggctgtgggggag

SEQ ID NO: 2068206 - DNA, 17 bp, Homo sapiens
gcggcttcctgtccact

SEQ ID NO: 2068207 - DNA, 19 bp, Homo sapiens
gcggcttcctgtccactct

SEQ ID NO: 2068208 - DNA, 20 bp, Homo sapiens
gcggcttcctgtccactctc

SEQ ID NO: 2068209 - DNA, 16 bp, Homo sapiens
gcggcttggccgccat

SEQ ID NO: 2068210 - DNA, 17 bp, Homo sapiens
gcggcttggccgccatc

SEQ ID NO: 2068211 - DNA, 19 bp, Homo sapiens
gcgggaccggtacagaaag

SEQ ID NO: 2068212 - DNA, 23 bp, Homo sapiens
gcgggacgagaccctacaggaga

SEQ ID NO: 2068213 - DNA, 22 bp, Homo sapiens
gcgggaggatgttctgggacac

SEQ ID NO: 2068214 - DNA, 17 bp, Homo sapiens
gcgggaggcaccagctc

SEQ ID NO: 2068215 - DNA, 19 bp, Homo sapiens
gcgggagtgggggctgtgc

SEQ ID NO: 2068216 - DNA, 15 bp, Homo sapiens
gcgggatggtcctgg

SEQ ID NO: 2068217 - DNA, 16 bp, Homo sapiens
gcgggatggtcctggg

SEQ ID NO: 2068218 - DNA, 17 bp, Homo sapiens
gcgggatggtcctgggg

SEQ ID NO: 2068219 - DNA, 21 bp, Homo sapiens
gcgggcagcccagcctctgtc

SEQ ID NO: 2068220 - DNA, 21 bp, Homo sapiens
gcgggcggaggcggctccagg

SEQ ID NO: 2068221 - DNA, 12 bp, Homo sapiens
gcggggacagct

SEQ ID NO: 2068222 - DNA, 17 bp, Homo sapiens
gcggggcaggaggcctg

SEQ ID NO: 2068223 - DNA, 14 bp, Homo sapiens
gcgggggagctgga

SEQ ID NO: 2068224 - DNA, 19 bp, Homo sapiens
gcgggtggatcacctgagg

SEQ ID NO: 2068225 - DNA, 13 bp, Homo sapiens
gcggtcatgtgtg

SEQ ID NO: 2068226 - DNA, 16 bp, Homo sapiens
gcggtcatgtgtgcat

SEQ ID NO: 2068227 - DNA, 17 bp, Homo sapiens
gcggtcatgtgtgcatg

SEQ ID NO: 2068228 - DNA, 18 bp, Homo sapiens
gcggtcatgtgtgcatgt

SEQ ID NO: 2068229 - DNA, 14 bp, Homo sapiens
gcggtccacccagg

SEQ ID NO: 2068230 - DNA, 23 bp, Homo sapiens
gcggtccacccaggagccccgag

SEQ ID NO: 2068231 - DNA, 13 bp, Homo sapiens
gcggtgctctggc

SEQ ID NO: 2068232 - DNA, 22 bp, Homo sapiens
gcggtgctctggcggcttcctg

SEQ ID NO: 2068233 - DNA, 14 bp, Homo sapiens
gcggtggaaggccc

SEQ ID NO: 2068234 - DNA, 15 bp, Homo sapiens
gcggtggtgccagag

SEQ ID NO: 2068235 - DNA, 14 bp, Homo sapiens
gcgtaatgggcctg

SEQ ID NO: 2068236 - DNA, 15 bp, Homo sapiens
gcgtaatgggcctgc

SEQ ID NO: 2068237 - DNA, 22 bp, Homo sapiens
gcgtagaaaacgcacctccatc

SEQ ID NO: 2068238 - DNA, 22 bp, Homo sapiens
gcgtagacttgacaacatccca

SEQ ID NO: 2068239 - DNA, 15 bp, Homo sapiens
gcgtagagagccggg

SEQ ID NO: 2068240 - DNA, 16 bp, Homo sapiens
gcgtcccccagccctc

SEQ ID NO: 2068241 - DNA, 23 bp, Homo sapiens
gcgtcccccagccctcaggccag

SEQ ID NO: 2068242 - DNA, 20 bp, Homo sapiens
gcgtcccctgctactcctgt

SEQ ID NO: 2068243 - DNA, 18 bp, Homo sapiens
gcgtcctgacgccctgcg

SEQ ID NO: 2068244 - DNA, 15 bp, Homo sapiens
gcgtcctgcagagga

SEQ ID NO: 2068245 - DNA, 19 bp, Homo sapiens
gcgtcctgcagaggaccac

SEQ ID NO: 2068246 - DNA, 23 bp, Homo sapiens
gcgtctctctttctccctcaccc

SEQ ID NO: 2068247 - DNA, 15 bp, Homo sapiens
gcgtctgccccaccc

SEQ ID NO: 2068248 - DNA, 14 bp, Homo sapiens
gcgtcttgtatttt

SEQ ID NO: 2068249 - DNA, 22 bp, Homo sapiens
gctggaaggcagggcagaggga

SEQ ID NO: 2068250 - DNA, 21 bp, Homo sapiens
gctggaatcaatttcccagaa

SEQ ID NO: 2068251 - DNA, 16 bp, Homo sapiens
gctggaatctggagag

SEQ ID NO: 2068252 - DNA, 19 bp, Homo sapiens
gctggacaagaagctgcta

SEQ ID NO: 2068253 - DNA, 21 bp, Homo sapiens
gctggacggggactggggatg

SEQ ID NO: 2068254 - DNA, 16 bp, Homo sapiens
gctggactctggcacc

SEQ ID NO: 2068255 - DNA, 14 bp, Homo sapiens
gctggactgaggac

SEQ ID NO: 2068256 - DNA, 15 bp, Homo sapiens
gctggactgaggacc

SEQ ID NO: 2068257 - DNA, 20 bp, Homo sapiens
gctggagatcctaactgaga

SEQ ID NO: 2068258 - DNA, 21 bp, Homo sapiens
gctggagatcctaactgagaa

SEQ ID NO: 2068259 - DNA, 20 bp, Homo sapiens
gctggagcctcggtggccat

SEQ ID NO: 2068260 - DNA, 17 bp, Homo sapiens
gctggagctcttggaag

SEQ ID NO: 2068261 - DNA, 14 bp, Homo sapiens
gctggagctggctt

SEQ ID NO: 2068262 - DNA, 23 bp, Homo sapiens
gctggaggactagaacctggagg

SEQ ID NO: 2068263 - DNA, 17 bp, Homo sapiens
gctggagtgcagtgagc

SEQ ID NO: 2068264 - DNA, 18 bp, Homo sapiens
gctggagtgcagtgagcc

SEQ ID NO: 2068265 - DNA, 15 bp, Homo sapiens
gctggagtgcagtgg

SEQ ID NO: 2068266 - DNA, 20 bp, Homo sapiens
gctggagttcagtggtgtga

SEQ ID NO: 2068267 - DNA, 18 bp, Homo sapiens
gctggattaatgttttgt

SEQ ID NO: 2068268 - DNA, 20 bp, Homo sapiens
gctggcaaaggtggctctcc

SEQ ID NO: 2068269 - DNA, 14 bp, Homo sapiens
gctggcaagcaggg

SEQ ID NO: 2068270 - DNA, 11 bp, Homo sapiens
gctggcacctc

SEQ ID NO: 2068271 - DNA, 13 bp, Homo sapiens
gctggcagcactc

SEQ ID NO: 2068272 - DNA, 15 bp, Homo sapiens
gctggcagctgagag

SEQ ID NO: 2068273 - DNA, 19 bp, Homo sapiens
gctggcagctgagagccct

SEQ ID NO: 2068274 - DNA, 23 bp, Homo sapiens
gctggcagctgtcattcaggacc

SEQ ID NO: 2068275 - DNA, 14 bp, Homo sapiens
gctggccagcaccc

SEQ ID NO: 2068276 - DNA, 21 bp, Homo sapiens
gctggccagcaccctctcctg

SEQ ID NO: 2068277 - DNA, 12 bp, Homo sapiens
gctggcccagcc

SEQ ID NO: 2068278 - DNA, 21 bp, Homo sapiens
gctggcccagccaactgcccc

SEQ ID NO: 2068279 - DNA, 22 bp, Homo sapiens
gctggcctctagaacacccact

SEQ ID NO: 2068280 - DNA, 20 bp, Homo sapiens
gctggcctgatcttggctca

SEQ ID NO: 2068281 - DNA, 15 bp, Homo sapiens
gctggcctggatctc

SEQ ID NO: 2068282 - DNA, 17 bp, Homo sapiens
gctggcctggccggcaa

SEQ ID NO: 2068283 - DNA, 14 bp, Homo sapiens
gctggcctgtggca

SEQ ID NO: 2068284 - DNA, 17 bp, Homo sapiens
gctggcctgtggcaggc

SEQ ID NO: 2068285 - DNA, 18 bp, Homo sapiens
gctggcctgtggcaggcc

SEQ ID NO: 2068286 - DNA, 20 bp, Homo sapiens
gctggcctgtggcaggccta

SEQ ID NO: 2068287 - DNA, 15 bp, Homo sapiens
gctggcggcgcagag

SEQ ID NO: 2068288 - DNA, 18 bp, Homo sapiens
gctggcgtgcagtggtgc

SEQ ID NO: 2068289 - DNA, 12 bp, Homo sapiens
gctggctcagga

SEQ ID NO: 2068290 - DNA, 15 bp, Homo sapiens
gctggctcctccagg

SEQ ID NO: 2068291 - DNA, 16 bp, Homo sapiens
gctggctcctccaggc

SEQ ID NO: 2068292 - DNA, 23 bp, Homo sapiens
gctggctcctccaggcacgtccc

SEQ ID NO: 2068293 - DNA, 13 bp, Homo sapiens
gctggctgaaaat

SEQ ID NO: 2068294 - DNA, 18 bp, Homo sapiens
gctggctgaaaatcacta

SEQ ID NO: 2068295 - DNA, 12 bp, Homo sapiens
gctggctgagtg

SEQ ID NO: 2068296 - DNA, 13 bp, Homo sapiens
gctggctgcagtg

SEQ ID NO: 2068297 - DNA, 16 bp, Homo sapiens
gctggctgctgacagg

SEQ ID NO: 2068298 - DNA, 15 bp, Homo sapiens
gctggctgggcatgg

SEQ ID NO: 2068299 - DNA, 14 bp, Homo sapiens
gctggcttctgttg

SEQ ID NO: 2068300 - DNA, 22 bp, Homo sapiens
gctggcttctgttgcgccactg

SEQ ID NO: 2068301 - DNA, 22 bp, Homo sapiens
gctgggaagctgtactcagagc

SEQ ID NO: 2068302 - DNA, 22 bp, Homo sapiens
gctgggacccctcccaacctca

SEQ ID NO: 2068303 - DNA, 13 bp, Homo sapiens
gctgggactacag

SEQ ID NO: 2068304 - DNA, 14 bp, Homo sapiens
gctgggactacagg

SEQ ID NO: 2068305 - DNA, 19 bp, Homo sapiens
gctgggactacaggtgcaa

SEQ ID NO: 2068306 - DNA, 15 bp, Homo sapiens
gctgggagctctgca

SEQ ID NO: 2068307 - DNA, 19 bp, Homo sapiens
gctgggattacaggtgtga

SEQ ID NO: 2068308 - DNA, 20 bp, Homo sapiens
gctgggcaaacccttctctt

SEQ ID NO: 2068309 - DNA, 17 bp, Homo sapiens
gctgggcaccacaggct

SEQ ID NO: 2068310 - DNA, 21 bp, Homo sapiens
gctgggccagcctcagctcag

SEQ ID NO: 2068311 - DNA, 19 bp, Homo sapiens
gctgggccgagtaccttaa

SEQ ID NO: 2068312 - DNA, 13 bp, Homo sapiens
gctgggctctcca

SEQ ID NO: 2068313 - DNA, 14 bp, Homo sapiens
gctgggctctccac

SEQ ID NO: 2068314 - DNA, 15 bp, Homo sapiens
gctgggctctccacc

SEQ ID NO: 2068315 - DNA, 19 bp, Homo sapiens
gctgggctctccacctcag

SEQ ID NO: 2068316 - DNA, 20 bp, Homo sapiens
gctgggctctccacctcagc

SEQ ID NO: 2068317 - DNA, 21 bp, Homo sapiens
gctgggctctccacctcagcc

SEQ ID NO: 2068318 - DNA, 18 bp, Homo sapiens
gctgggcttcagtggcag

SEQ ID NO: 2068319 - DNA, 15 bp, Homo sapiens
gctggggaacagagc

SEQ ID NO: 2068320 - DNA, 18 bp, Homo sapiens
gctggggacaggtcctca

SEQ ID NO: 2068321 - DNA, 14 bp, Homo sapiens
gctggggcagaggg

SEQ ID NO: 2068322 - DNA, 24 bp, Homo sapiens
gctggggcagaggggcagccgcta

SEQ ID NO: 2068323 - DNA, 18 bp, Homo sapiens
gctggggcatgtgtgcct

SEQ ID NO: 2068324 - DNA, 12 bp, Homo sapiens
gctggggccagt

SEQ ID NO: 2068325 - DNA, 17 bp, Homo sapiens
gctggggcctggagagg

SEQ ID NO: 2068326 - DNA, 20 bp, Homo sapiens
gctgggggcctcagtgccac

SEQ ID NO: 2068327 - DNA, 17 bp, Homo sapiens
ggaagcacagcttcatt

SEQ ID NO: 2068328 - DNA, 13 bp, Homo sapiens
ggaagcactgctg

SEQ ID NO: 2068329 - DNA, 11 bp, Homo sapiens
ggaagcaggca

SEQ ID NO: 2068330 - DNA, 12 bp, Homo sapiens
ggaagcaggcag

SEQ ID NO: 2068331 - DNA, 13 bp, Homo sapiens
ggaagcaggcaga

SEQ ID NO: 2068332 - DNA, 12 bp, Homo sapiens
ggaagcagtgcc

SEQ ID NO: 2068333 - DNA, 20 bp, Homo sapiens
ggaagcatgtaggagaatcc

SEQ ID NO: 2068334 - DNA, 14 bp, Homo sapiens
ggaagccaggctga

SEQ ID NO: 2068335 - DNA, 17 bp, Homo sapiens
ggaagcccaaggcagtg

SEQ ID NO: 2068336 - DNA, 21 bp, Homo sapiens
ggaagccgtctgactccagag

SEQ ID NO: 2068337 - DNA, 23 bp, Homo sapiens
ggaagcgatgaatttggagactc

SEQ ID NO: 2068338 - DNA, 22 bp, Homo sapiens
ggaagcggaggttgcagggagc

SEQ ID NO: 2068339 - DNA, 23 bp, Homo sapiens
ggaagctccactgtcaccctcca

SEQ ID NO: 2068340 - DNA, 22 bp, Homo sapiens
ggaagctgggggaagggtggtc

SEQ ID NO: 2068341 - DNA, 18 bp, Homo sapiens
ggaagctgtactcagagc

SEQ ID NO: 2068342 - DNA, 19 bp, Homo sapiens
ggaagctgtactcagagca

SEQ ID NO: 2068343 - DNA, 16 bp, Homo sapiens
ggaaggaactctggct

SEQ ID NO: 2068344 - DNA, 23 bp, Homo sapiens
ggaaggaactctggcttccaggt

SEQ ID NO: 2068345 - DNA, 16 bp, Homo sapiens
ggaaggaagggacaca

SEQ ID NO: 2068346 - DNA, 20 bp, Homo sapiens
ggaaggagactcacctctgc

SEQ ID NO: 2068347 - DNA, 13 bp, Homo sapiens
ggaaggcaaagcc

SEQ ID NO: 2068348 - DNA, 12 bp, Homo sapiens
ggaaggcagctg

SEQ ID NO: 2068349 - DNA, 17 bp, Homo sapiens
ggaaggcagggcagagg

SEQ ID NO: 2068350 - DNA, 22 bp, Homo sapiens
ggaaggctacttcggggctggg

SEQ ID NO: 2068351 - DNA, 23 bp, Homo sapiens
ggaaggctacttcggggctggga

SEQ ID NO: 2068352 - DNA, 13 bp, Homo sapiens
ggaaggctgctgt

SEQ ID NO: 2068353 - DNA, 21 bp, Homo sapiens
gcctgtgcagcagcccagctt

SEQ ID NO: 2068354 - DNA, 19 bp, Homo sapiens
gcctgtgcctcctcacccc

SEQ ID NO: 2068355 - DNA, 16 bp, Homo sapiens
gcctgtgctgcccgtc

SEQ ID NO: 2068356 - DNA, 15 bp, Homo sapiens
gcctgtggagagaaa

SEQ ID NO: 2068357 - DNA, 14 bp, Homo sapiens
gcctgtggcaggcc

SEQ ID NO: 2068358 - DNA, 17 bp, Homo sapiens
gcctgtggccttgcccg

SEQ ID NO: 2068359 - DNA, 18 bp, Homo sapiens
gcctgtggcggtgcctgg

SEQ ID NO: 2068360 - DNA, 19 bp, Homo sapiens
gcctgtggcggtgcctggg

SEQ ID NO: 2068361 - DNA, 15 bp, Homo sapiens
gcctgtgggaagaga

SEQ ID NO: 2068362 - DNA, 11 bp, Homo sapiens
gcctgtgggag

SEQ ID NO: 2068363 - DNA, 15 bp, Homo sapiens
gcctgtgggagtaga

SEQ ID NO: 2068364 - DNA, 18 bp, Homo sapiens
gcctgtgtccagcagctg

SEQ ID NO: 2068365 - DNA, 21 bp, Homo sapiens
gcctgtgtccagcagctgcgg

SEQ ID NO: 2068366 - DNA, 22 bp, Homo sapiens
gcctgtgtgagcatctctgtgt

SEQ ID NO: 2068367 - DNA, 14 bp, Homo sapiens
gcctgtgtgttctg

SEQ ID NO: 2068368 - DNA, 19 bp, Homo sapiens
gcctgttcagctccagctc

SEQ ID NO: 2068369 - DNA, 19 bp, Homo sapiens
gcctgttgctgaagtcatt

SEQ ID NO: 2068370 - DNA, 19 bp, Homo sapiens
gcctgttggacccgctctg

SEQ ID NO: 2068371 - DNA, 22 bp, Homo sapiens
gccttaaaaggagagaagaaag

SEQ ID NO: 2068372 - DNA, 21 bp, Homo sapiens
gccttaaatttttgtcatttt

SEQ ID NO: 2068373 - DNA, 19 bp, Homo sapiens
gccttacctcccctgccag

SEQ ID NO: 2068374 - DNA, 13 bp, Homo sapiens
gccttacctcctg

SEQ ID NO: 2068375 - DNA, 17 bp, Homo sapiens
gccttagaacctttctt

SEQ ID NO: 2068376 - DNA, 19 bp, Homo sapiens
gccttagaagtcacacagt

SEQ ID NO: 2068377 - DNA, 20 bp, Homo sapiens
gccttagaagtcacacagta

SEQ ID NO: 2068378 - DNA, 21 bp, Homo sapiens
gccttatgtaattattttctt

SEQ ID NO: 2068379 - DNA, 18 bp, Homo sapiens
gccttcacaaccagccac

SEQ ID NO: 2068380 - DNA, 19 bp, Homo sapiens
gccttcacaaccagccaca

SEQ ID NO: 2068381 - DNA, 13 bp, Homo sapiens
gccttcagctcta

SEQ ID NO: 2068382 - DNA, 21 bp, Homo sapiens
gccttcataggcggtcatgtg

SEQ ID NO: 2068383 - DNA, 22 bp, Homo sapiens
gccttcataggcggtcatgtgt

SEQ ID NO: 2068384 - DNA, 20 bp, Homo sapiens
gccttccccttttgcctggc

SEQ ID NO: 2068385 - DNA, 21 bp, Homo sapiens
gccttccccttttgcctggct

SEQ ID NO: 2068386 - DNA, 16 bp, Homo sapiens
gccttccctccccaca

SEQ ID NO: 2068387 - DNA, 14 bp, Homo sapiens
gccttcctcctcca

SEQ ID NO: 2068388 - DNA, 19 bp, Homo sapiens
gccttcctcctccacagtg

SEQ ID NO: 2068389 - DNA, 22 bp, Homo sapiens
gccttcctcctccacagtgctg

SEQ ID NO: 2068390 - DNA, 23 bp, Homo sapiens
gccttctcctgcctacattccct

SEQ ID NO: 2068391 - DNA, 14 bp, Homo sapiens
gccttctctctctg

SEQ ID NO: 2068392 - DNA, 14 bp, Homo sapiens
gccttctctgttca

SEQ ID NO: 2068393 - DNA, 18 bp, Homo sapiens
gccttcttattctcactc

SEQ ID NO: 2068394 - DNA, 23 bp, Homo sapiens
gccttcttattctcactccacca

SEQ ID NO: 2068395 - DNA, 22 bp, Homo sapiens
gccttcttcggggaactcctgg

SEQ ID NO: 2068396 - DNA, 15 bp, Homo sapiens
gccttgaagccactg

SEQ ID NO: 2068397 - DNA, 21 bp, Homo sapiens
gccttgatgaagcctgtgcca

SEQ ID NO: 2068398 - DNA, 20 bp, Homo sapiens
gccttgccacatctgtgtct

SEQ ID NO: 2068399 - DNA, 17 bp, Homo sapiens
gccttgcccgccagcct

SEQ ID NO: 2068400 - DNA, 12 bp, Homo sapiens
gccttggagcag

SEQ ID NO: 2068401 - DNA, 23 bp, Homo sapiens
gccttggataatgctgttgcctc

SEQ ID NO: 2068402 - DNA, 17 bp, Homo sapiens
gccttgtaattctaaat

SEQ ID NO: 2068403 - DNA, 14 bp, Homo sapiens
gccttgtctgggga

SEQ ID NO: 2068404 - DNA, 12 bp, Homo sapiens
gccttgtgccct

SEQ ID NO: 2068405 - DNA, 13 bp, Homo sapiens
gccttgtgccctg

SEQ ID NO: 2068406 - DNA, 19 bp, Homo sapiens
gccttgtgccctgccccca

SEQ ID NO: 2068407 - DNA, 12 bp, Homo sapiens
gccttgtgtaca

SEQ ID NO: 2068408 - DNA, 14 bp, Homo sapiens
gccttgttttattc

SEQ ID NO: 2068409 - DNA, 22 bp, Homo sapiens
gccttgttttattcaaagacag

SEQ ID NO: 2068410 - DNA, 23 bp, Homo sapiens
gcctttccacctgctttctcctg

SEQ ID NO: 2068411 - DNA, 22 bp, Homo sapiens
gcctttccataaggaatgtagc

SEQ ID NO: 2068412 - DNA, 18 bp, Homo sapiens
gcctttccccagtgtggc

SEQ ID NO: 2068413 - DNA, 12 bp, Homo sapiens
gcctttcctgtg

SEQ ID NO: 2068414 - DNA, 13 bp, Homo sapiens
gcctttcctgtgc

SEQ ID NO: 2068415 - DNA, 21 bp, Homo sapiens
gcctttcctgtgccaacctga

SEQ ID NO: 2068416 - DNA, 20 bp, Homo sapiens
gcctttctctggctccagaa

SEQ ID NO: 2068417 - DNA, 20 bp, Homo sapiens
gcctttgaggcaaaggccag

SEQ ID NO: 2068418 - DNA, 20 bp, Homo sapiens
gcctcccagccccaggggtg

SEQ ID NO: 2068419 - DNA, 13 bp, Homo sapiens
gcctcccagcctg

SEQ ID NO: 2068420 - DNA, 18 bp, Homo sapiens
gcctccccccagcccctc

SEQ ID NO: 2068421 - DNA, 13 bp, Homo sapiens
gcctccccccgct

SEQ ID NO: 2068422 - DNA, 13 bp, Homo sapiens
gcctccccctcag

SEQ ID NO: 2068423 - DNA, 14 bp, Homo sapiens
gcctccccctgctg

SEQ ID NO: 2068424 - DNA, 21 bp, Homo sapiens
gcctcccgaatagctgggact

SEQ ID NO: 2068425 - DNA, 16 bp, Homo sapiens
gcctccctccacccca

SEQ ID NO: 2068426 - DNA, 15 bp, Homo sapiens
gcctccctctgctgt

SEQ ID NO: 2068427 - DNA, 15 bp, Homo sapiens
gcctccgtcaggaga

SEQ ID NO: 2068428 - DNA, 21 bp, Homo sapiens
gcctccgtcatgaatgccttc

SEQ ID NO: 2068429 - DNA, 22 bp, Homo sapiens
gcctccgtttatgggccttgct

SEQ ID NO: 2068430 - DNA, 23 bp, Homo sapiens
gcctccgtttatgggccttgctt

SEQ ID NO: 2068431 - DNA, 17 bp, Homo sapiens
gcctcctcacccccagc

SEQ ID NO: 2068432 - DNA, 13 bp, Homo sapiens
gcctcctcccacc

SEQ ID NO: 2068433 - DNA, 11 bp, Homo sapiens
gcctcctctgc

SEQ ID NO: 2068434 - DNA, 13 bp, Homo sapiens
gcctcctctgtcc

SEQ ID NO: 2068435 - DNA, 17 bp, Homo sapiens
gcctcctgacctgaggc

SEQ ID NO: 2068436 - DNA, 14 bp, Homo sapiens
gcctcctggccaga

SEQ ID NO: 2068437 - DNA, 19 bp, Homo sapiens
gcctcctggccagacgctg

SEQ ID NO: 2068438 - DNA, 12 bp, Homo sapiens
gcctcctgggca

SEQ ID NO: 2068439 - DNA, 13 bp, Homo sapiens
gcctcgaactggc

SEQ ID NO: 2068440 - DNA, 14 bp, Homo sapiens
gcctcgaggcaccg

SEQ ID NO: 2068441 - DNA, 16 bp, Homo sapiens
gcctcgaggcaccggc

SEQ ID NO: 2068442 - DNA, 21 bp, Homo sapiens
gcctcgaggcaccggcgctgc

SEQ ID NO: 2068443 - DNA, 23 bp, Homo sapiens
gcctcgcctgggcccaggctctg

SEQ ID NO: 2068444 - DNA, 16 bp, Homo sapiens
gcctcgctccccactc

SEQ ID NO: 2068445 - DNA, 19 bp, Homo sapiens
gcctcgctccccactctgc

SEQ ID NO: 2068446 - DNA, 20 bp, Homo sapiens
gcctcgctccccactctgct

SEQ ID NO: 2068447 - DNA, 14 bp, Homo sapiens
gcctcggagcctca

SEQ ID NO: 2068448 - DNA, 17 bp, Homo sapiens
gcctcggagcctcatcc

SEQ ID NO: 2068449 - DNA, 17 bp, Homo sapiens
gcctcggtggccatgct

SEQ ID NO: 2068450 - DNA, 20 bp, Homo sapiens
gcctcggtggccatgcttct

SEQ ID NO: 2068451 - DNA, 21 bp, Homo sapiens
gcctcggtggccatgcttctt

SEQ ID NO: 2068452 - DNA, 18 bp, Homo sapiens
gcctcgtaccagccagga

SEQ ID NO: 2068453 - DNA, 13 bp, Homo sapiens
gcctcgtgccatg

SEQ ID NO: 2068454 - DNA, 15 bp, Homo sapiens
gcctctactgggaag

SEQ ID NO: 2068455 - DNA, 13 bp, Homo sapiens
gcctctcacacac

SEQ ID NO: 2068456 - DNA, 15 bp, Homo sapiens
gcctctcacacacat

SEQ ID NO: 2068457 - DNA, 23 bp, Homo sapiens
gcctctccaggcaccatctccct

SEQ ID NO: 2068458 - DNA, 20 bp, Homo sapiens
gcctctcccgcaccaggccg

SEQ ID NO: 2068459 - DNA, 19 bp, Homo sapiens
gcctctcccggctgcctgc

SEQ ID NO: 2068460 - DNA, 23 bp, Homo sapiens
gcctctcccggctgcctgccgcc

SEQ ID NO: 2068461 - DNA, 14 bp, Homo sapiens
gcctctctgctcca

SEQ ID NO: 2068462 - DNA, 18 bp, Homo sapiens
gcctctgacacacagctc

SEQ ID NO: 2068463 - DNA, 12 bp, Homo sapiens
gcctctgaggcc

SEQ ID NO: 2068464 - DNA, 14 bp, Homo sapiens
gcctctgaggccag

SEQ ID NO: 2068465 - DNA, 17 bp, Homo sapiens
gcctctgaggccagcct

SEQ ID NO: 2068466 - DNA, 15 bp, Homo sapiens
gcctctgccatgccc

SEQ ID NO: 2068467 - DNA, 20 bp, Homo sapiens
gcctctgccatgcccagaga

SEQ ID NO: 2068468 - DNA, 13 bp, Homo sapiens
gcctctgccccaa

SEQ ID NO: 2068469 - DNA, 16 bp, Homo sapiens
gcctctgccccaaggg

SEQ ID NO: 2068470 - DNA, 21 bp, Homo sapiens
gcctctgccccaaggggccca

SEQ ID NO: 2068471 - DNA, 23 bp, Homo sapiens
gcctctgccccaaggggcccaca

SEQ ID NO: 2068472 - DNA, 13 bp, Homo sapiens
gcctctgccctgc

SEQ ID NO: 2068473 - DNA, 12 bp, Homo sapiens
gcctctgcctct

SEQ ID NO: 2068474 - DNA, 13 bp, Homo sapiens
gcctctgcctctg

SEQ ID NO: 2068475 - DNA, 12 bp, Homo sapiens
gcctctgcctgt

SEQ ID NO: 2068476 - DNA, 13 bp, Homo sapiens
gcctctgcctgtc

SEQ ID NO: 2068477 - DNA, 16 bp, Homo sapiens
gcctctgcctgtgcac

SEQ ID NO: 2068478 - DNA, 11 bp, Homo sapiens
gcctctgctgc

SEQ ID NO: 2068479 - DNA, 15 bp, Homo sapiens
gcctctgctgccatg

SEQ ID NO: 2068480 - DNA, 22 bp, Homo sapiens
gcctctgtcccggaagagtcat

SEQ ID NO: 2068481 - DNA, 14 bp, Homo sapiens
gcctctgtccctct

SEQ ID NO: 2068482 - DNA, 15 bp, Homo sapiens
gcctctgtgtccttc

SEQ ID NO: 2068483 - DNA, 19 bp, Homo sapiens
gcctcttaaagctgcctgt

SEQ ID NO: 2068484 - DNA, 20 bp, Homo sapiens
gcctcttaaagctgcctgta

SEQ ID NO: 2068485 - DNA, 23 bp, Homo sapiens
gcctcttaaagctgcctgtagtt

SEQ ID NO: 2068486 - DNA, 14 bp, Homo sapiens
gcctcttagtgatt

SEQ ID NO: 2068487 - DNA, 12 bp, Homo sapiens
gcctcttcctcc

SEQ ID NO: 2068488 - DNA, 15 bp, Homo sapiens
gcctcttcttcttca

SEQ ID NO: 2068489 - DNA, 16 bp, Homo sapiens
gcctcttcttcttcag

SEQ ID NO: 2068490 - DNA, 21 bp, Homo sapiens
gcctcttcttcttcagaagac

SEQ ID NO: 2068491 - DNA, 17 bp, Homo sapiens
gcctcttggacctctgc

SEQ ID NO: 2068492 - DNA, 14 bp, Homo sapiens
gcctcttgggttca

SEQ ID NO: 2068493 - DNA, 17 bp, Homo sapiens
gcctcttgtgctcacgc

SEQ ID NO: 2068494 - DNA, 21 bp, Homo sapiens
gcctgaaggaggtgagagaag

SEQ ID NO: 2068495 - DNA, 22 bp, Homo sapiens
gcctgacaggttcccagcagct

SEQ ID NO: 2068496 - DNA, 22 bp, Homo sapiens
gcctgagcaacagagtgagacc

SEQ ID NO: 2068497 - DNA, 18 bp, Homo sapiens
gcctgagcccagggaggc

SEQ ID NO: 2068498 - DNA, 19 bp, Homo sapiens
gcctgagcccagggaggcc

SEQ ID NO: 2068499 - DNA, 16 bp, Homo sapiens
gcctgagctggggcct

SEQ ID NO: 2068500 - DNA, 17 bp, Homo sapiens
gcctgagctggggcctg

SEQ ID NO: 2068501 - DNA, 22 bp, Homo sapiens
gcctgagctggggcctggagag

SEQ ID NO: 2068502 - DNA, 16 bp, Homo sapiens
gcctgaggctcaagag

SEQ ID NO: 2068503 - DNA, 18 bp, Homo sapiens
gcctgaggctcaagaggc

SEQ ID NO: 2068504 - DNA, 20 bp, Homo sapiens
gcctgaggctcaagaggccc

SEQ ID NO: 2068505 - DNA, 18 bp, Homo sapiens
gcctgaggctgagactgc

SEQ ID NO: 2068506 - DNA, 14 bp, Homo sapiens
gcctgaggctggga

SEQ ID NO: 2068507 - DNA, 12 bp, Homo sapiens
gcctgagggtgg

SEQ ID NO: 2068508 - DNA, 17 bp, Homo sapiens
gcctgagggtggagact

SEQ ID NO: 2068509 - DNA, 22 bp, Homo sapiens
cttgcagatcatctggggacct

SEQ ID NO: 2068510 - DNA, 20 bp, Homo sapiens
cttgcatcctcctcccaact

SEQ ID NO: 2068511 - DNA, 11 bp, Homo sapiens
cttgcattaga

SEQ ID NO: 2068512 - DNA, 12 bp, Homo sapiens
cttgcattccca

SEQ ID NO: 2068513 - DNA, 21 bp, Homo sapiens
cttgccaaattccatgtccct

SEQ ID NO: 2068514 - DNA, 22 bp, Homo sapiens
cttgccaatgaggtctgaaatg

SEQ ID NO: 2068515 - DNA, 22 bp, Homo sapiens
cttgccagccagaagcctctgc

SEQ ID NO: 2068516 - DNA, 23 bp, Homo sapiens
cttgccagccagaagcctctgcc

SEQ ID NO: 2068517 - DNA, 20 bp, Homo sapiens
cttgcccagggctcagcctg

SEQ ID NO: 2068518 - DNA, 18 bp, Homo sapiens
cttgcccccatccctcgg

SEQ ID NO: 2068519 - DNA, 19 bp, Homo sapiens
cttgccccctcatctcact

SEQ ID NO: 2068520 - DNA, 21 bp, Homo sapiens
cttgcccctccagagacagga

SEQ ID NO: 2068521 - DNA, 23 bp, Homo sapiens
cttgcccctccagagacaggaaa

SEQ ID NO: 2068522 - DNA, 14 bp, Homo sapiens
cttgccccttgggc

SEQ ID NO: 2068523 - DNA, 19 bp, Homo sapiens
cttgccccttgggcctccc

SEQ ID NO: 2068524 - DNA, 18 bp, Homo sapiens
cttgcccgccagcctcag

SEQ ID NO: 2068525 - DNA, 17 bp, Homo sapiens
cttgcccggattctggg

SEQ ID NO: 2068526 - DNA, 14 bp, Homo sapiens
cttgccctgacctc

SEQ ID NO: 2068527 - DNA, 18 bp, Homo sapiens
cttgccctgacctcccag

SEQ ID NO: 2068528 - DNA, 17 bp, Homo sapiens
cttgcccttgccctgac

SEQ ID NO: 2068529 - DNA, 23 bp, Homo sapiens
cttgccgagagaggcgcgtctgc

SEQ ID NO: 2068530 - DNA, 23 bp, Homo sapiens
cttgccgagcctaatgaaaggga

SEQ ID NO: 2068531 - DNA, 23 bp, Homo sapiens
cttgcctcatttttttccttgca

SEQ ID NO: 2068532 - DNA, 14 bp, Homo sapiens
cttgcctctctcag

SEQ ID NO: 2068533 - DNA, 17 bp, Homo sapiens
cttgcctctctcaggag

SEQ ID NO: 2068534 - DNA, 23 bp, Homo sapiens
cttgcctgaatccatcaggactt

SEQ ID NO: 2068535 - DNA, 17 bp, Homo sapiens
cttgcctgaggctcaag

SEQ ID NO: 2068536 - DNA, 22 bp, Homo sapiens
cttgcctgaggctcaagaggcc

SEQ ID NO: 2068537 - DNA, 23 bp, Homo sapiens
cttgcctgaggctcaagaggccc

SEQ ID NO: 2068538 - DNA, 23 bp, Homo sapiens
cttgcctgcacccttcctcctcc

SEQ ID NO: 2068539 - DNA, 15 bp, Homo sapiens
cttgcctttccacct

SEQ ID NO: 2068540 - DNA, 16 bp, Homo sapiens
cttgcctttccacctg

SEQ ID NO: 2068541 - DNA, 17 bp, Homo sapiens
cttgccttttaaaagaa

SEQ ID NO: 2068542 - DNA, 14 bp, Homo sapiens
cttgcgaccatgtg

SEQ ID NO: 2068543 - DNA, 16 bp, Homo sapiens
cttgcgtcctgcagag

SEQ ID NO: 2068544 - DNA, 24 bp, Homo sapiens
cttgcgtcctgcagaggaccacag

SEQ ID NO: 2068545 - DNA, 17 bp, Homo sapiens
cttgctcagtgcctcct

SEQ ID NO: 2068546 - DNA, 13 bp, Homo sapiens
cttgctccagggt

SEQ ID NO: 2068547 - DNA, 15 bp, Homo sapiens
cttgctccagggtct

SEQ ID NO: 2068548 - DNA, 20 bp, Homo sapiens
cttgctccagggtcttgggc

SEQ ID NO: 2068549 - DNA, 22 bp, Homo sapiens
cttgctccagggtcttgggcta

SEQ ID NO: 2068550 - DNA, 18 bp, Homo sapiens
cttgctcctccttctgct

SEQ ID NO: 2068551 - DNA, 20 bp, Homo sapiens
cttgctcgctgtaaaatctt

SEQ ID NO: 2068552 - DNA, 20 bp, Homo sapiens
cttgctctcccctgccctgc

SEQ ID NO: 2068553 - DNA, 14 bp, Homo sapiens
cttgctctgcaggc

SEQ ID NO: 2068554 - DNA, 16 bp, Homo sapiens
cttgctcttctttctg

SEQ ID NO: 2068555 - DNA, 14 bp, Homo sapiens
cttgctggcttctg

SEQ ID NO: 2068556 - DNA, 14 bp, Homo sapiens
cttgcttctgcagc

SEQ ID NO: 2068557 - DNA, 12 bp, Homo sapiens
cttgctttgctg

SEQ ID NO: 2068558 - DNA, 14 bp, Homo sapiens
cttgctttgctgtc

SEQ ID NO: 2068559 - DNA, 13 bp, Homo sapiens
cttgctttgggct

SEQ ID NO: 2068560 - DNA, 15 bp, Homo sapiens
cttgctttgggcttt

SEQ ID NO: 2068561 - DNA, 17 bp, Homo sapiens
cttgctttgggctttgc

SEQ ID NO: 2068562 - DNA, 23 bp, Homo sapiens
cttgctttgggctttgcaggctc

SEQ ID NO: 2068563 - DNA, 14 bp, Homo sapiens
cttggaaaaaaatt

SEQ ID NO: 2068564 - DNA, 20 bp, Homo sapiens
cttggaaaaaaattacaaaa

SEQ ID NO: 2068565 - DNA, 16 bp, Homo sapiens
cttggaaaaagaaaga

SEQ ID NO: 2068566 - DNA, 21 bp, Homo sapiens
cttggaaactggatgaggtca

SEQ ID NO: 2068567 - DNA, 20 bp, Homo sapiens
cttggaaagcatcacctcag

SEQ ID NO: 2068568 - DNA, 14 bp, Homo sapiens
cttggaagagctct

SEQ ID NO: 2068569 - DNA, 21 bp, Homo sapiens
cttggaagtcgtttcaggaca

SEQ ID NO: 2068570 - DNA, 22 bp, Homo sapiens
cttggaagtgtgtggaaggcag

SEQ ID NO: 2068571 - DNA, 21 bp, Homo sapiens
cttggaagtttcatatattgt

SEQ ID NO: 2068572 - DNA, 13 bp, Homo sapiens
cttggacactgta

SEQ ID NO: 2068573 - DNA, 13 bp, Homo sapiens
cttggacctctgc

SEQ ID NO: 2068574 - DNA, 14 bp, Homo sapiens
cttggacctctgct

SEQ ID NO: 2068575 - DNA, 14 bp, Homo sapiens
cttggacttcctgg

SEQ ID NO: 2068576 - DNA, 19 bp, Homo sapiens
cttggacttcctggggccc

SEQ ID NO: 2068577 - DNA, 13 bp, Homo sapiens
cttggacttgagg

SEQ ID NO: 2068578 - DNA, 15 bp, Homo sapiens
cttggagagcagctg

SEQ ID NO: 2068579 - DNA, 20 bp, Homo sapiens
cttggagagggacgaagaaa

SEQ ID NO: 2068580 - DNA, 22 bp, Homo sapiens
cttggagccaatggagactgtc

SEQ ID NO: 2068581 - DNA, 15 bp, Homo sapiens
cttggagcccgtgca

SEQ ID NO: 2068582 - DNA, 14 bp, Homo sapiens
cttggaggacagtg

SEQ ID NO: 2068583 - DNA, 13 bp, Homo sapiens
cttggagggatgg

SEQ ID NO: 2068584 - DNA, 22 bp, Homo sapiens
cttggataatgctgttgcctca

SEQ ID NO: 2068585 - DNA, 23 bp, Homo sapiens
cttggataatgctgttgcctcat

SEQ ID NO: 2068586 - DNA, 15 bp, Homo sapiens
cttggcagctgaact

SEQ ID NO: 2068587 - DNA, 18 bp, Homo sapiens
cttggcatcacagggcag

SEQ ID NO: 2068588 - DNA, 15 bp, Homo sapiens
cttggccgactcagg

SEQ ID NO: 2068589 - DNA, 18 bp, Homo sapiens
cttggccgactcagggac

SEQ ID NO: 2068590 - DNA, 19 bp, Homo sapiens
cttggccgactcagggacc

SEQ ID NO: 2068591 - DNA, 24 bp, Homo sapiens
cttggccgccatccgggacgcttc

SEQ ID NO: 2068592 - DNA, 11 bp, Homo sapiens
cttggccttgt

SEQ ID NO: 2068593 - DNA, 19 bp, Homo sapiens
cttggcgggcagcccagcc

SEQ ID NO: 2068594 - DNA, 22 bp, Homo sapiens
cttgggaaacagagaaccctgt

SEQ ID NO: 2068595 - DNA, 22 bp, Homo sapiens
cttgggaggttttattctgact

SEQ ID NO: 2068596 - DNA, 14 bp, Homo sapiens
cttgggagtcagga

SEQ ID NO: 2068597 - DNA, 17 bp, Homo sapiens
cttgggcacccccagcc

SEQ ID NO: 2068598 - DNA, 16 bp, Homo sapiens
cttgggccctgcacag

SEQ ID NO: 2068599 - DNA, 22 bp, Homo sapiens
cttgggcctccccccagcccct

SEQ ID NO: 2068600 - DNA, 16 bp, Homo sapiens
cttgggcgctctgccc

SEQ ID NO: 2068601 - DNA, 12 bp, Homo sapiens
cttgggctcctg

SEQ ID NO: 2068602 - DNA, 18 bp, Homo sapiens
cttgggctcctggctgcc

SEQ ID NO: 2068603 - DNA, 20 bp, Homo sapiens
cttgggctcctggctgccag

SEQ ID NO: 2068604 - DNA, 21 bp, Homo sapiens
cttgggctcctggctgccagg

SEQ ID NO: 2068605 - DNA, 22 bp, Homo sapiens
cttgggctcctggctgccaggc

SEQ ID NO: 2068606 - DNA, 23 bp, Homo sapiens
cttgggctcctggctgccaggcg

SEQ ID NO: 2068607 - DNA, 12 bp, Homo sapiens
cttggggagcag

SEQ ID NO: 2068608 - DNA, 19 bp, Homo sapiens
cttggggcctggcttgctc

SEQ ID NO: 2068609 - DNA, 15 bp, Homo sapiens
cttggggctcgcccc

SEQ ID NO: 2068610 - DNA, 20 bp, Homo sapiens
cttggggctcgccccaccca

SEQ ID NO: 2068611 - DNA, 16 bp, Homo sapiens
cttggggctggagagg

SEQ ID NO: 2068612 - DNA, 14 bp, Homo sapiens
cttggggcttccta

SEQ ID NO: 2068613 - DNA, 17 bp, Homo sapiens
cttggggtcccagggaa

SEQ ID NO: 2068614 - DNA, 20 bp, Homo sapiens
cttggggttcccccagacag

SEQ ID NO: 2068615 - DNA, 22 bp, Homo sapiens
cttggggttcccccagacagag

SEQ ID NO: 2068616 - DNA, 23 bp, Homo sapiens
cttgggtcctgcaatctccaggg

SEQ ID NO: 2068617 - DNA, 21 bp, Homo sapiens
cttgggtgtaacaggtctcct

SEQ ID NO: 2068618 - DNA, 16 bp, Homo sapiens
cttggtccctggtccc

SEQ ID NO: 2068619 - DNA, 16 bp, Homo sapiens
cttggtcctgtcaccc

SEQ ID NO: 2068620 - DNA, 14 bp, Homo sapiens
cttggtctcagctt

SEQ ID NO: 2068621 - DNA, 17 bp, Homo sapiens
cttggtctcagcttcat

SEQ ID NO: 2068622 - DNA, 20 bp, Homo sapiens
cttggtgaatttttttttcc

SEQ ID NO: 2068623 - DNA, 19 bp, Homo sapiens
ctttattttgttaataata

SEQ ID NO: 2068624 - DNA, 18 bp, Homo sapiens
ctttattttttaagtatt

SEQ ID NO: 2068625 - DNA, 14 bp, Homo sapiens
ctttcaaaaacatg

SEQ ID NO: 2068626 - DNA, 21 bp, Homo sapiens
ctttcaaagaaggaattctag

SEQ ID NO: 2068627 - DNA, 15 bp, Homo sapiens
ctttcaaatttcaca

SEQ ID NO: 2068628 - DNA, 16 bp, Homo sapiens
ctttcaacttaaatca

SEQ ID NO: 2068629 - DNA, 22 bp, Homo sapiens
ctttcaatggtttgcaaggaag

SEQ ID NO: 2068630 - DNA, 16 bp, Homo sapiens
ctttcacaaccttctg

SEQ ID NO: 2068631 - DNA, 20 bp, Homo sapiens
ctttcagagaggtctcaggt

SEQ ID NO: 2068632 - DNA, 15 bp, Homo sapiens
ctttcagagccagtg

SEQ ID NO: 2068633 - DNA, 20 bp, Homo sapiens
ctttcagagccagtgaagga

SEQ ID NO: 2068634 - DNA, 19 bp, Homo sapiens
ctttcagcactcagaaaag

SEQ ID NO: 2068635 - DNA, 20 bp, Homo sapiens
ctttcaggagggtccccagc

SEQ ID NO: 2068636 - DNA, 15 bp, Homo sapiens
ctttcagtgaaagca

SEQ ID NO: 2068637 - DNA, 21 bp, Homo sapiens
ctttcatctattctttcccta

SEQ ID NO: 2068638 - DNA, 22 bp, Homo sapiens
ctttccaaaacctaaagaggaa

SEQ ID NO: 2068639 - DNA, 22 bp, Homo sapiens
ctttccaccctattccctaact

SEQ ID NO: 2068640 - DNA, 14 bp, Homo sapiens
ctttccacctgctt

SEQ ID NO: 2068641 - DNA, 22 bp, Homo sapiens
ctttccacctgctttctcctgg

SEQ ID NO: 2068642 - DNA, 12 bp, Homo sapiens
ctttccagccaa

SEQ ID NO: 2068643 - DNA, 13 bp, Homo sapiens
ctttccagttaag

SEQ ID NO: 2068644 - DNA, 14 bp, Homo sapiens
ctttccatctgctt

SEQ ID NO: 2068645 - DNA, 22 bp, Homo sapiens
ctttccccgggggaggaagggg

SEQ ID NO: 2068646 - DNA, 17 bp, Homo sapiens
ctttcccctcagagctc

SEQ ID NO: 2068647 - DNA, 11 bp, Homo sapiens
ctttccctcac

SEQ ID NO: 2068648 - DNA, 14 bp, Homo sapiens
ctttccctcacccc

SEQ ID NO: 2068649 - DNA, 19 bp, Homo sapiens
ctttccctcaccccctccc

SEQ ID NO: 2068650 - DNA, 17 bp, Homo sapiens
ctttcccttccagttcc

SEQ ID NO: 2068651 - DNA, 21 bp, Homo sapiens
ctttccgctgtcgccccaggc

SEQ ID NO: 2068652 - DNA, 20 bp, Homo sapiens
ctttccgtctccctaaaata

SEQ ID NO: 2068653 - DNA, 22 bp, Homo sapiens
ctttccgtctccctaaaataaa

SEQ ID NO: 2068654 - DNA, 20 bp, Homo sapiens
ctttcctaaagtctctgctg

SEQ ID NO: 2068655 - DNA, 21 bp, Homo sapiens
ctttcctaaagtctctgctgc

SEQ ID NO: 2068656 - DNA, 18 bp, Homo sapiens
ctttcctatcatggagtg

SEQ ID NO: 2068657 - DNA, 11 bp, Homo sapiens
ctttcctcccc

SEQ ID NO: 2068658 - DNA, 22 bp, Homo sapiens
ctttcctctccaattgtaaaaa

SEQ ID NO: 2068659 - DNA, 11 bp, Homo sapiens
ctttcctctga

SEQ ID NO: 2068660 - DNA, 18 bp, Homo sapiens
ctttcctctgcagcactt

SEQ ID NO: 2068661 - DNA, 22 bp, Homo sapiens
ctttcctgatggtacaggaaag

SEQ ID NO: 2068662 - DNA, 14 bp, Homo sapiens
ctttccttgtctct

SEQ ID NO: 2068663 - DNA, 17 bp, Homo sapiens
ctttccttttcttcctt

SEQ ID NO: 2068664 - DNA, 23 bp, Homo sapiens
ctttctacattctcatctactca

SEQ ID NO: 2068665 - DNA, 23 bp, Homo sapiens
ctttctagctgttgagctgtttt

SEQ ID NO: 2068666 - DNA, 13 bp, Homo sapiens
ctttctattcata

SEQ ID NO: 2068667 - DNA, 17 bp, Homo sapiens
ctttctcactaaatctt

SEQ ID NO: 2068668 - DNA, 24 bp, Homo sapiens
ctttctcagggggtcagcagagtt

SEQ ID NO: 2068669 - DNA, 14 bp, Homo sapiens
ctttctccaaagtt

SEQ ID NO: 2068670 - DNA, 20 bp, Homo sapiens
ctttctccaaagttatccag

SEQ ID NO: 2068671 - DNA, 23 bp, Homo sapiens
ctttctccaaagttatccagagg

SEQ ID NO: 2068672 - DNA, 13 bp, Homo sapiens
ctttctccagcca

SEQ ID NO: 2068673 - DNA, 20 bp, Homo sapiens
ctttctccagccagcaatga

SEQ ID NO: 2068674 - DNA, 19 bp, Homo sapiens
ctttctcccccgacactgc

SEQ ID NO: 2068675 - DNA, 22 bp, Homo sapiens
ctttctcccccgacactgctgc

SEQ ID NO: 2068676 - DNA, 23 bp, Homo sapiens
ctttctcccccgacactgctgca

SEQ ID NO: 2068677 - DNA, 13 bp, Homo sapiens
ctttctccctcac

SEQ ID NO: 2068678 - DNA, 14 bp, Homo sapiens
ctttctccggggtc

SEQ ID NO: 2068679 - DNA, 20 bp, Homo sapiens
ctttctccggggtctgtgct

SEQ ID NO: 2068680 - DNA, 15 bp, Homo sapiens
ctttctcgctggaat

SEQ ID NO: 2068681 - DNA, 17 bp, Homo sapiens
ctttctcgctggaatca

SEQ ID NO: 2068682 - DNA, 21 bp, Homo sapiens
ctttctcgtggtagaagccag

SEQ ID NO: 2068683 - DNA, 11 bp, Homo sapiens
ctttctctgca

SEQ ID NO: 2068684 - DNA, 18 bp, Homo sapiens
ctttctctggctccagaa

SEQ ID NO: 2068685 - DNA, 19 bp, Homo sapiens
ctttctctggctccagaat

SEQ ID NO: 2068686 - DNA, 21 bp, Homo sapiens
ctttctcttccctccttccct

SEQ ID NO: 2068687 - DNA, 12 bp, Homo sapiens
ctttctgggagg

SEQ ID NO: 2068688 - DNA, 19 bp, Homo sapiens
ctttctgtccttttggcac

SEQ ID NO: 2068689 - DNA, 15 bp, Homo sapiens
ctttctgtgtgcacc

SEQ ID NO: 2068690 - DNA, 16 bp, Homo sapiens
ctttctgttgccacaa

SEQ ID NO: 2068691 - DNA, 15 bp, Homo sapiens
ctttctgttggtgta

SEQ ID NO: 2068692 - DNA, 14 bp, Homo sapiens
ctttcttatttgca

SEQ ID NO: 2068693 - DNA, 18 bp, Homo sapiens
ctttcttattttgtaata

SEQ ID NO: 2068694 - DNA, 23 bp, Homo sapiens
ctttcttattttgtaataaactc

SEQ ID NO: 2068695 - DNA, 11 bp, Homo sapiens
ctttcttcctc

SEQ ID NO: 2068696 - DNA, 14 bp, Homo sapiens
ctttcttcctctgc

SEQ ID NO: 2068697 - DNA, 20 bp, Homo sapiens
ctttcttctacaaccagagc

SEQ ID NO: 2068698 - DNA, 21 bp, Homo sapiens
ctttcttctacaaccagagcc

SEQ ID NO: 2068699 - DNA, 19 bp, Homo sapiens
ctttgaagcagttgtgtca

SEQ ID NO: 2068700 - DNA, 13 bp, Homo sapiens
ctttgaataaagt

SEQ ID NO: 2068701 - DNA, 14 bp, Homo sapiens
ctttgaataaagtc

SEQ ID NO: 2068702 - DNA, 15 bp, Homo sapiens
ctttgaataaagtct

SEQ ID NO: 2068703 - DNA, 17 bp, Homo sapiens
cttagctttccacagga

SEQ ID NO: 2068704 - DNA, 16 bp, Homo sapiens
cttagctttctcaggg

SEQ ID NO: 2068705 - DNA, 20 bp, Homo sapiens
cttaggaaaatgcttctgtt

SEQ ID NO: 2068706 - DNA, 15 bp, Homo sapiens
cttaggaacagctct

SEQ ID NO: 2068707 - DNA, 17 bp, Homo sapiens
cttaggaagagaaacca

SEQ ID NO: 2068708 - DNA, 17 bp, Homo sapiens
cttagtatggttctcag

SEQ ID NO: 2068709 - DNA, 23 bp, Homo sapiens
cttagtcgaatgttagattcctc

SEQ ID NO: 2068710 - DNA, 21 bp, Homo sapiens
cttagtgcccgcctaggagtt

SEQ ID NO: 2068711 - DNA, 19 bp, Homo sapiens
cttagtgcggacaagtttt

SEQ ID NO: 2068712 - DNA, 21 bp, Homo sapiens
cttagttaagtcatccacagc

SEQ ID NO: 2068713 - DNA, 23 bp, Homo sapiens
cttagttctcactgtctcctggt

SEQ ID NO: 2068714 - DNA, 12 bp, Homo sapiens
cttataaatgtg

SEQ ID NO: 2068715 - DNA, 16 bp, Homo sapiens
cttataaatgtgtatt

SEQ ID NO: 2068716 - DNA, 16 bp, Homo sapiens
cttataagaattaatc

SEQ ID NO: 2068717 - DNA, 13 bp, Homo sapiens
cttataccaaagg

SEQ ID NO: 2068718 - DNA, 17 bp, Homo sapiens
cttataccaaagggaaa

SEQ ID NO: 2068719 - DNA, 13 bp, Homo sapiens
cttatagaatatt

SEQ ID NO: 2068720 - DNA, 15 bp, Homo sapiens
cttatagaatattta

SEQ ID NO: 2068721 - DNA, 19 bp, Homo sapiens
cttatataagacaagaata

SEQ ID NO: 2068722 - DNA, 19 bp, Homo sapiens
cttatatagtttactattt

SEQ ID NO: 2068723 - DNA, 20 bp, Homo sapiens
cttatatagtttactatttt

SEQ ID NO: 2068724 - DNA, 22 bp, Homo sapiens
cttatcagctacttaagagaaa

SEQ ID NO: 2068725 - DNA, 12 bp, Homo sapiens
cttatccaggac

SEQ ID NO: 2068726 - DNA, 13 bp, Homo sapiens
cttatccaggact

SEQ ID NO: 2068727 - DNA, 19 bp, Homo sapiens
cttatccaggactctgtca

SEQ ID NO: 2068728 - DNA, 14 bp, Homo sapiens
cttatcttgaaaag

SEQ ID NO: 2068729 - DNA, 21 bp, Homo sapiens
cttatgctagtttattggaag

SEQ ID NO: 2068730 - DNA, 18 bp, Homo sapiens
cttatgggatccttgtct

SEQ ID NO: 2068731 - DNA, 19 bp, Homo sapiens
cttatgtattattttctat

SEQ ID NO: 2068732 - DNA, 23 bp, Homo sapiens
cttattcatgctttctccttttt

SEQ ID NO: 2068733 - DNA, 21 bp, Homo sapiens
cttattcccaaactacagaat

SEQ ID NO: 2068734 - DNA, 15 bp, Homo sapiens
cttattctcctccct

SEQ ID NO: 2068735 - DNA, 18 bp, Homo sapiens
cttattgcccacgctgga

SEQ ID NO: 2068736 - DNA, 21 bp, Homo sapiens
cttatttacttgtagaaatct

SEQ ID NO: 2068737 - DNA, 15 bp, Homo sapiens
cttatttcatttctt

SEQ ID NO: 2068738 - DNA, 12 bp, Homo sapiens
cttatttgcaat

SEQ ID NO: 2068739 - DNA, 16 bp, Homo sapiens
cttatttgcaataaaa

SEQ ID NO: 2068740 - DNA, 14 bp, Homo sapiens
cttattttcaagaa

SEQ ID NO: 2068741 - DNA, 16 bp, Homo sapiens
cttattttccaataaa

SEQ ID NO: 2068742 - DNA, 15 bp, Homo sapiens
cttattttgtaataa

SEQ ID NO: 2068743 - DNA, 18 bp, Homo sapiens
cttattttgtaataaact

SEQ ID NO: 2068744 - DNA, 15 bp, Homo sapiens
cttattttgtattac

SEQ ID NO: 2068745 - DNA, 18 bp, Homo sapiens
cttattttttaaaataat

SEQ ID NO: 2068746 - DNA, 16 bp, Homo sapiens
cttcaaatatagagat

SEQ ID NO: 2068747 - DNA, 17 bp, Homo sapiens
cttcaaatccatccaga

SEQ ID NO: 2068748 - DNA, 20 bp, Homo sapiens
cttcaaccattccccatggg

SEQ ID NO: 2068749 - DNA, 19 bp, Homo sapiens
cttcaaccctcagccttga

SEQ ID NO: 2068750 - DNA, 17 bp, Homo sapiens
cttcaactgaccagcct

SEQ ID NO: 2068751 - DNA, 20 bp, Homo sapiens
cttcaactgaccagcctcca

SEQ ID NO: 2068752 - DNA, 18 bp, Homo sapiens
cttcaagcaccctgttcc

SEQ ID NO: 2068753 - DNA, 22 bp, Homo sapiens
cttcaagcatggctattttata

SEQ ID NO: 2068754 - DNA, 16 bp, Homo sapiens
cttcaagtgatatatg

SEQ ID NO: 2068755 - DNA, 18 bp, Homo sapiens
cttcaagtgatatatgta

SEQ ID NO: 2068756 - DNA, 19 bp, Homo sapiens
cttcaagtgatatatgtat

SEQ ID NO: 2068757 - DNA, 22 bp, Homo sapiens
cttcaagtgatatatgtattta

SEQ ID NO: 2068758 - DNA, 23 bp, Homo sapiens
cttcaagtgatatatgtatttat

SEQ ID NO: 2068759 - DNA, 22 bp, Homo sapiens
cttcaagtgcatgctctctgca

SEQ ID NO: 2068760 - DNA, 19 bp, Homo sapiens
cttcaagttagctcaggag

SEQ ID NO: 2068761 - DNA, 14 bp, Homo sapiens
cttcaataaagtat

SEQ ID NO: 2068762 - DNA, 17 bp, Homo sapiens
cttcacaaccagccaca

SEQ ID NO: 2068763 - DNA, 21 bp, Homo sapiens
cttcacaaccagccacacaga

SEQ ID NO: 2068764 - DNA, 21 bp, Homo sapiens
cttcacacacaggcaactgag

SEQ ID NO: 2068765 - DNA, 20 bp, Homo sapiens
cttcacactgcaagagcctt

SEQ ID NO: 2068766 - DNA, 17 bp, Homo sapiens
cttcacataccctcccc

SEQ ID NO: 2068767 - DNA, 15 bp, Homo sapiens
cttcaccccccactc

SEQ ID NO: 2068768 - DNA, 15 bp, Homo sapiens
cttcacccctgcact

SEQ ID NO: 2068769 - DNA, 21 bp, Homo sapiens
cttcaccctgaatggttccat

SEQ ID NO: 2068770 - DNA, 22 bp, Homo sapiens
cttcacctgggcgccaactgct

SEQ ID NO: 2068771 - DNA, 17 bp, Homo sapiens
cttcaccttcaccttca

SEQ ID NO: 2068772 - DNA, 18 bp, Homo sapiens
cttcaccttggagcctga

SEQ ID NO: 2068773 - DNA, 23 bp, Homo sapiens
cttcaccttggagcctgaacatg

SEQ ID NO: 2068774 - DNA, 18 bp, Homo sapiens
cttcactattcctaggag

SEQ ID NO: 2068775 - DNA, 13 bp, Homo sapiens
cttcactcacttt

SEQ ID NO: 2068776 - DNA, 17 bp, Homo sapiens
cttcactgtgaggggaa

SEQ ID NO: 2068777 - DNA, 19 bp, Homo sapiens
cttcactgtgaggggaagg

SEQ ID NO: 2068778 - DNA, 23 bp, Homo sapiens
cttcactgtgaggggaaggcctt

SEQ ID NO: 2068779 - DNA, 16 bp, Homo sapiens
cttcactttaattctc

SEQ ID NO: 2068780 - DNA, 17 bp, Homo sapiens
cttcagaacagaggcat

SEQ ID NO: 2068781 - DNA, 17 bp, Homo sapiens
cttcagaagacactgca

SEQ ID NO: 2068782 - DNA, 20 bp, Homo sapiens
cttcagaaggggacctgttt

SEQ ID NO: 2068783 - DNA, 12 bp, Homo sapiens
cttcagagcagg

SEQ ID NO: 2068784 - DNA, 19 bp, Homo sapiens
cttcagagcctagccacct

SEQ ID NO: 2068785 - DNA, 15 bp, Homo sapiens
cttcagccacctctc

SEQ ID NO: 2068786 - DNA, 12 bp, Homo sapiens
cttcagcccagc

SEQ ID NO: 2068787 - DNA, 14 bp, Homo sapiens
cttcagcctgaggc

SEQ ID NO: 2068788 - DNA, 15 bp, Homo sapiens
cttcagcctgaggct

SEQ ID NO: 2068789 - DNA, 16 bp, Homo sapiens
cttcagcctgaggctg

SEQ ID NO: 2068790 - DNA, 22 bp, Homo sapiens
cttcagctcccatagcgctggc

SEQ ID NO: 2068791 - DNA, 14 bp, Homo sapiens
cttcagctttggtg

SEQ ID NO: 2068792 - DNA, 16 bp, Homo sapiens
cttcaggaggccctgg

SEQ ID NO: 2068793 - DNA, 14 bp, Homo sapiens
cttcaggctcttct

SEQ ID NO: 2068794 - DNA, 16 bp, Homo sapiens
cttcaggctcttctcc

SEQ ID NO: 2068795 - DNA, 22 bp, Homo sapiens
cttcaggctcttctcctttcac

SEQ ID NO: 2068796 - DNA, 11 bp, Homo sapiens
cttcagggcca

SEQ ID NO: 2068797 - DNA, 14 bp, Homo sapiens
cttcagggccagaa

SEQ ID NO: 2068798 - DNA, 18 bp, Homo sapiens
cttcagggccagaaggag

SEQ ID NO: 2068799 - DNA, 21 bp, Homo sapiens
cttcagggccagaaggagggc

SEQ ID NO: 2068800 - DNA, 20 bp, Homo sapiens
cttcagggtatcccagaccc

SEQ ID NO: 2068801 - DNA, 16 bp, Homo sapiens
cttcaggtggaaaaac

SEQ ID NO: 2068802 - DNA, 18 bp, Homo sapiens
cttcaggtggagagcact

SEQ ID NO: 2068803 - DNA, 15 bp, Homo sapiens
cttcaggttcttagt

SEQ ID NO: 2068804 - DNA, 16 bp, Homo sapiens
cttcaggttgttctgt

SEQ ID NO: 2068805 - DNA, 20 bp, Homo sapiens
cttcaggttgttctgtataa

SEQ ID NO: 2068806 - DNA, 17 bp, Homo sapiens
cttcagtgcccaccaac

SEQ ID NO: 2068807 - DNA, 15 bp, Homo sapiens
cttcagtgcctagct

SEQ ID NO: 2068808 - DNA, 17 bp, Homo sapiens
cttcagtggagaattat

SEQ ID NO: 2068809 - DNA, 16 bp, Homo sapiens
cttcagtggcagctgc

SEQ ID NO: 2068810 - DNA, 19 bp, Homo sapiens
cttcatcaatttttataca

SEQ ID NO: 2068811 - DNA, 12 bp, Homo sapiens
cttcatgcaatg

SEQ ID NO: 2068812 - DNA, 13 bp, Homo sapiens
cttcatgcaatga

SEQ ID NO: 2068813 - DNA, 17 bp, Homo sapiens
cttcatgcaatgacatc

SEQ ID NO: 2068814 - DNA, 17 bp, Homo sapiens
cttcatgcctcagtttc

SEQ ID NO: 2068815 - DNA, 17 bp, Homo sapiens
cttcatgctcagccctg

SEQ ID NO: 2068816 - DNA, 13 bp, Homo sapiens
cttcatggaccaa

SEQ ID NO: 2068817 - DNA, 18 bp, Homo sapiens
cttcatggtgactaacag

SEQ ID NO: 2068818 - DNA, 15 bp, Homo sapiens
cttcatttcattgta

SEQ ID NO: 2068819 - DNA, 19 bp, Homo sapiens
cttcatttcattgtatgat

SEQ ID NO: 2068820 - DNA, 20 bp, Homo sapiens
cttcatttccgtgaagggca

SEQ ID NO: 2068821 - DNA, 14 bp, Homo sapiens
cttcatttcctccg

SEQ ID NO: 2068822 - DNA, 18 bp, Homo sapiens
cttcatttcctgtgtctt

SEQ ID NO: 2068823 - DNA, 13 bp, Homo sapiens
cttcatttggaga

SEQ ID NO: 2068824 - DNA, 14 bp, Homo sapiens
cttcatttggagat

SEQ ID NO: 2068825 - DNA, 16 bp, Homo sapiens
cttcattttcagagtg

SEQ ID NO: 2068826 - DNA, 21 bp, Homo sapiens
cttccaaagacaagaaaagag

SEQ ID NO: 2068827 - DNA, 15 bp, Homo sapiens
cttccaaccccagct

SEQ ID NO: 2068828 - DNA, 20 bp, Homo sapiens
cttccaaccccagctggcct

SEQ ID NO: 2068829 - DNA, 22 bp, Homo sapiens
cttccaaccccagctggcctct

SEQ ID NO: 2068830 - DNA, 19 bp, Homo sapiens
cttccaagggttgaattct

SEQ ID NO: 2068831 - DNA, 21 bp, Homo sapiens
cttccacattaattagatttt

SEQ ID NO: 2068832 - DNA, 14 bp, Homo sapiens
cttccacccattcc

SEQ ID NO: 2068833 - DNA, 22 bp, Homo sapiens
cttccacccattcccccatgtg

SEQ ID NO: 2068834 - DNA, 17 bp, Homo sapiens
cttccaccgggcctgaa

SEQ ID NO: 2068835 - DNA, 20 bp, Homo sapiens
cttccaccgggcctgaacca

SEQ ID NO: 2068836 - DNA, 14 bp, Homo sapiens
cttccagaccacct

SEQ ID NO: 2068837 - DNA, 16 bp, Homo sapiens
cttccagaccacctgc

SEQ ID NO: 2068838 - DNA, 17 bp, Homo sapiens
cttccagaccacctgcc

SEQ ID NO: 2068839 - DNA, 18 bp, Homo sapiens
cttccagaccacctgcca

SEQ ID NO: 2068840 - DNA, 20 bp, Homo sapiens
cttccagaccacctgccagc

SEQ ID NO: 2068841 - DNA, 21 bp, Homo sapiens
cttccaggagcaatttgcaca

SEQ ID NO: 2068842 - DNA, 14 bp, Homo sapiens
cttccaggctcttc

SEQ ID NO: 2068843 - DNA, 18 bp, Homo sapiens
cttccaggtatctccagg

SEQ ID NO: 2068844 - DNA, 14 bp, Homo sapiens
cttccagtgcatgt

SEQ ID NO: 2068845 - DNA, 14 bp, Homo sapiens
cttccagtggtacc

SEQ ID NO: 2068846 - DNA, 18 bp, Homo sapiens
cttccagtggtaccagct

SEQ ID NO: 2068847 - DNA, 22 bp, Homo sapiens
cttccagtggtaccagctcact

SEQ ID NO: 2068848 - DNA, 11 bp, Homo sapiens
cttccataatc

SEQ ID NO: 2068849 - DNA, 23 bp, Homo sapiens
cttccataatgtataaagaacaa

SEQ ID NO: 2068850 - DNA, 11 bp, Homo sapiens
cttccataatt

SEQ ID NO: 2068851 - DNA, 14 bp, Homo sapiens
cttccataattatg

SEQ ID NO: 2068852 - DNA, 21 bp, Homo sapiens
cttccatccccaaactgtgcc

SEQ ID NO: 2068853 - DNA, 21 bp, Homo sapiens
cttccatgagaacagcagggt

SEQ ID NO: 2068854 - DNA, 17 bp, Homo sapiens
cttccatgtcgcctctg

SEQ ID NO: 2068855 - DNA, 13 bp, Homo sapiens
cttcccagaggcc

SEQ ID NO: 2068856 - DNA, 12 bp, Homo sapiens
cttcccaggatc

SEQ ID NO: 2068857 - DNA, 22 bp, Homo sapiens
cttcccagttcaggagtcccaa

SEQ ID NO: 2068858 - DNA, 22 bp, Homo sapiens
cttcccatgatgccgctcttct

SEQ ID NO: 2068859 - DNA, 14 bp, Homo sapiens
cttcccatttgtaa

SEQ ID NO: 2068860 - DNA, 17 bp, Homo sapiens
cttccccacagaactgc

SEQ ID NO: 2068861 - DNA, 22 bp, Homo sapiens
cttccccagacttctctttctt

SEQ ID NO: 2068862 - DNA, 13 bp, Homo sapiens
cttccccatctcc

SEQ ID NO: 2068863 - DNA, 18 bp, Homo sapiens
cttccccatctccatttc

SEQ ID NO: 2068864 - DNA, 20 bp, Homo sapiens
cttccccatctccatttcac

SEQ ID NO: 2068865 - DNA, 23 bp, Homo sapiens
cttcccccatcccctttcctccc

SEQ ID NO: 2068866 - DNA, 12 bp, Homo sapiens
cttccccctcca

SEQ ID NO: 2068867 - DNA, 20 bp, Homo sapiens
cttcccctcgctgtcctgct

SEQ ID NO: 2068868 - DNA, 13 bp, Homo sapiens
cttccccttgccc

SEQ ID NO: 2068869 - DNA, 14 bp, Homo sapiens
cttccccttgccct

SEQ ID NO: 2068870 - DNA, 17 bp, Homo sapiens
cttccccttgcccttgc

SEQ ID NO: 2068871 - DNA, 13 bp, Homo sapiens
cttcccctttccc

SEQ ID NO: 2068872 - DNA, 19 bp, Homo sapiens
cttcccctttcctggggga

SEQ ID NO: 2068873 - DNA, 18 bp, Homo sapiens
cttccccttttgcctggc

SEQ ID NO: 2068874 - DNA, 23 bp, Homo sapiens
ctgtgtggggaggcagctccaac

SEQ ID NO: 2068875 - DNA, 16 bp, Homo sapiens
ctgtgtgggtctgggg

SEQ ID NO: 2068876 - DNA, 18 bp, Homo sapiens
ctgtgtgggtctggggag

SEQ ID NO: 2068877 - DNA, 18 bp, Homo sapiens
ctgtgtgtgcgcctacag

SEQ ID NO: 2068878 - DNA, 20 bp, Homo sapiens
ctgtgtgtgcgcctacagga

SEQ ID NO: 2068879 - DNA, 18 bp, Homo sapiens
ctgtgttcacactgtaaa

SEQ ID NO: 2068880 - DNA, 14 bp, Homo sapiens
ctgtgttcattctt

SEQ ID NO: 2068881 - DNA, 14 bp, Homo sapiens
ctgtgttcttgctg

SEQ ID NO: 2068882 - DNA, 23 bp, Homo sapiens
ctgtgtttttgctatcacacagt

SEQ ID NO: 2068883 - DNA, 15 bp, Homo sapiens
ctgttaaaatcagga

SEQ ID NO: 2068884 - DNA, 16 bp, Homo sapiens
ctgttaatagttcagg

SEQ ID NO: 2068885 - DNA, 21 bp, Homo sapiens
ctgttacataacaagaaaatc

SEQ ID NO: 2068886 - DNA, 18 bp, Homo sapiens
ctgttacccagagaatat

SEQ ID NO: 2068887 - DNA, 19 bp, Homo sapiens
ctgttactattatctgtgc

SEQ ID NO: 2068888 - DNA, 13 bp, Homo sapiens
ctgttactgaaat

SEQ ID NO: 2068889 - DNA, 15 bp, Homo sapiens
ctgttacttaaatag

SEQ ID NO: 2068890 - DNA, 15 bp, Homo sapiens
ctgttacttacctaa

SEQ ID NO: 2068891 - DNA, 15 bp, Homo sapiens
ctgttagctgttatt

SEQ ID NO: 2068892 - DNA, 15 bp, Homo sapiens
ctgttagtcatttgc

SEQ ID NO: 2068893 - DNA, 18 bp, Homo sapiens
ctgttagtcatttgctga

SEQ ID NO: 2068894 - DNA, 23 bp, Homo sapiens
ctgttatcaaacaccaacataaa

SEQ ID NO: 2068895 - DNA, 19 bp, Homo sapiens
ctgttcacagccagactgg

SEQ ID NO: 2068896 - DNA, 18 bp, Homo sapiens
ctgttcacccacagggct

SEQ ID NO: 2068897 - DNA, 16 bp, Homo sapiens
ctgttcacttttcctc

SEQ ID NO: 2068898 - DNA, 14 bp, Homo sapiens
ctgttcatggcaga

SEQ ID NO: 2068899 - DNA, 23 bp, Homo sapiens
ctgttcccccgctggcagccacc

SEQ ID NO: 2068900 - DNA, 14 bp, Homo sapiens
ctgttctcaaatgc

SEQ ID NO: 2068901 - DNA, 13 bp, Homo sapiens
ctgttctcagctc

SEQ ID NO: 2068902 - DNA, 14 bp, Homo sapiens
ctgttctgcactga

SEQ ID NO: 2068903 - DNA, 16 bp, Homo sapiens
ctgttctgcactgaaa

SEQ ID NO: 2068904 - DNA, 17 bp, Homo sapiens
ctgttctggagctgctg

SEQ ID NO: 2068905 - DNA, 21 bp, Homo sapiens
ctgttctgtgtgggtctgggg

SEQ ID NO: 2068906 - DNA, 23 bp, Homo sapiens
ctgttctgtgtgggtctggggag

SEQ ID NO: 2068907 - DNA, 12 bp, Homo sapiens
ctgttgaaaatt

SEQ ID NO: 2068908 - DNA, 14 bp, Homo sapiens
ctgttgaaaattat

SEQ ID NO: 2068909 - DNA, 21 bp, Homo sapiens
ctgttgaaaattattttaaac

SEQ ID NO: 2068910 - DNA, 22 bp, Homo sapiens
ctgttgagtgcaacaagagcaa

SEQ ID NO: 2068911 - DNA, 13 bp, Homo sapiens
ctgttgccacaac

SEQ ID NO: 2068912 - DNA, 15 bp, Homo sapiens
ctgttgccatagccc

SEQ ID NO: 2068913 - DNA, 14 bp, Homo sapiens
ctgttgcctcatct

SEQ ID NO: 2068914 - DNA, 11 bp, Homo sapiens
ctgttgctcaa

SEQ ID NO: 2068915 - DNA, 21 bp, Homo sapiens
ctgttgctcaaatctattcag

SEQ ID NO: 2068916 - DNA, 22 bp, Homo sapiens
ctgttgctcaaatctattcaga

SEQ ID NO: 2068917 - DNA, 15 bp, Homo sapiens
ctgttgctggactga

SEQ ID NO: 2068918 - DNA, 18 bp, Homo sapiens
ctgttgctggactgagga

SEQ ID NO: 2068919 - DNA, 18 bp, Homo sapiens
ctgttggacagctgcttg

SEQ ID NO: 2068920 - DNA, 20 bp, Homo sapiens
ctgttggacagctgcttgtg

SEQ ID NO: 2068921 - DNA, 18 bp, Homo sapiens
ctgttggttagctggaca

SEQ ID NO: 2068922 - DNA, 16 bp, Homo sapiens
ctgtttataaaaacaa

SEQ ID NO: 2068923 - DNA, 17 bp, Homo sapiens
ctgtttatttattcact

SEQ ID NO: 2068924 - DNA, 14 bp, Homo sapiens
ctgtttcaaactga

SEQ ID NO: 2068925 - DNA, 15 bp, Homo sapiens
ctgtttcttacctta

SEQ ID NO: 2068926 - DNA, 11 bp, Homo sapiens
ctgtttgtcat

SEQ ID NO: 2068927 - DNA, 24 bp, Homo sapiens
ctgttttaaaaacaaagaaataaa

SEQ ID NO: 2068928 - DNA, 14 bp, Homo sapiens
ctgttttaataatt

SEQ ID NO: 2068929 - DNA, 22 bp, Homo sapiens
ctgttttacaaaaaagaaaaga

SEQ ID NO: 2068930 - DNA, 14 bp, Homo sapiens
ctgttttatactgt

SEQ ID NO: 2068931 - DNA, 19 bp, Homo sapiens
ctgttttgtatatgatcta

SEQ ID NO: 2068932 - DNA, 20 bp, Homo sapiens
ctgttttgtcctttgagaaa

SEQ ID NO: 2068933 - DNA, 22 bp, Homo sapiens
ctgttttgtcctttgagaaaga

SEQ ID NO: 2068934 - DNA, 16 bp, Homo sapiens
ctgtttttaagctgtt

SEQ ID NO: 2068935 - DNA, 18 bp, Homo sapiens
ctgtttttaagctgtttc

SEQ ID NO: 2068936 - DNA, 23 bp, Homo sapiens
ctgtttttaagctgtttccatag

SEQ ID NO: 2068937 - DNA, 15 bp, Homo sapiens
ctgtttttcggacag

SEQ ID NO: 2068938 - DNA, 17 bp, Homo sapiens
ctgtttttcggacagtt

SEQ ID NO: 2068939 - DNA, 20 bp, Homo sapiens
ctgtttttcggacagtttat

SEQ ID NO: 2068940 - DNA, 17 bp, Homo sapiens
ctgtttttctaactggg

SEQ ID NO: 2068941 - DNA, 14 bp, Homo sapiens
ctgtttttgtagtg

SEQ ID NO: 2068942 - DNA, 13 bp, Homo sapiens
ctgttttttagtt

SEQ ID NO: 2068943 - DNA, 20 bp, Homo sapiens
cttaaaaaagcaacagtagc

SEQ ID NO: 2068944 - DNA, 19 bp, Homo sapiens
cttaaaaagtaattgtaga

SEQ ID NO: 2068945 - DNA, 12 bp, Homo sapiens
cttaaaactttg

SEQ ID NO: 2068946 - DNA, 21 bp, Homo sapiens
cttaaaaggagagaagaaagt

SEQ ID NO: 2068947 - DNA, 18 bp, Homo sapiens
cttaaaatagaaataagt

SEQ ID NO: 2068948 - DNA, 22 bp, Homo sapiens
cttaaaattgctagtgatttca

SEQ ID NO: 2068949 - DNA, 14 bp, Homo sapiens
cttaaacttgaccc

SEQ ID NO: 2068950 - DNA, 22 bp, Homo sapiens
cttaaagaaagtcgaattaata

SEQ ID NO: 2068951 - DNA, 13 bp, Homo sapiens
cttaaagcttgtt

SEQ ID NO: 2068952 - DNA, 22 bp, Homo sapiens
cttaaaggaaaagtcaacatct

SEQ ID NO: 2068953 - DNA, 23 bp, Homo sapiens
cttaaaggaaaagtcaacatctt

SEQ ID NO: 2068954 - DNA, 14 bp, Homo sapiens
cttaaaggcctgga

SEQ ID NO: 2068955 - DNA, 16 bp, Homo sapiens
cttaaataaattcaaa

SEQ ID NO: 2068956 - DNA, 16 bp, Homo sapiens
cttaaataagaaactt

SEQ ID NO: 2068957 - DNA, 14 bp, Homo sapiens
cttaaatagcatct

SEQ ID NO: 2068958 - DNA, 22 bp, Homo sapiens
cttaaatagcatctgctcttct

SEQ ID NO: 2068959 - DNA, 13 bp, Homo sapiens
cttaaatcactga

SEQ ID NO: 2068960 - DNA, 16 bp, Homo sapiens
cttaaatgacagtgaa

SEQ ID NO: 2068961 - DNA, 20 bp, Homo sapiens
cttaaccagcacatttctcc

SEQ ID NO: 2068962 - DNA, 18 bp, Homo sapiens
cttaacctttccgctgtc

SEQ ID NO: 2068963 - DNA, 14 bp, Homo sapiens
cttaacggctccag

SEQ ID NO: 2068964 - DNA, 15 bp, Homo sapiens
cttaacggctccagg

SEQ ID NO: 2068965 - DNA, 16 bp, Homo sapiens
cttaacggctccagga

SEQ ID NO: 2068966 - DNA, 17 bp, Homo sapiens
cttaactgtgtgaagaa

SEQ ID NO: 2068967 - DNA, 21 bp, Homo sapiens
cttaactgtgtgaagaaatgg

SEQ ID NO: 2068968 - DNA, 16 bp, Homo sapiens
cttaagattaaattat

SEQ ID NO: 2068969 - DNA, 19 bp, Homo sapiens
cttaaggagaggagaaact

SEQ ID NO: 2068970 - DNA, 22 bp, Homo sapiens
cttaaggagaggagaaactgag

SEQ ID NO: 2068971 - DNA, 20 bp, Homo sapiens
cttaagggttgaaggcagtc

SEQ ID NO: 2068972 - DNA, 21 bp, Homo sapiens
cttaagggttgaaggcagtct

SEQ ID NO: 2068973 - DNA, 17 bp, Homo sapiens
cttaagtcagaacagca

SEQ ID NO: 2068974 - DNA, 18 bp, Homo sapiens
cttaagtcagaacagcag

SEQ ID NO: 2068975 - DNA, 18 bp, Homo sapiens
cttaataaattcagatat

SEQ ID NO: 2068976 - DNA, 14 bp, Homo sapiens
cttaatatgttaac

SEQ ID NO: 2068977 - DNA, 23 bp, Homo sapiens
cttaatcaagaatattcaaatgt

SEQ ID NO: 2068978 - DNA, 22 bp, Homo sapiens
cttaatcaggtcctcagagaat

SEQ ID NO: 2068979 - DNA, 12 bp, Homo sapiens
cttaatgagata

SEQ ID NO: 2068980 - DNA, 21 bp, Homo sapiens
cttaatgatccgttccattgc

SEQ ID NO: 2068981 - DNA, 16 bp, Homo sapiens
cttaatgctttcctcc

SEQ ID NO: 2068982 - DNA, 14 bp, Homo sapiens
cttaatgtttattc

SEQ ID NO: 2068983 - DNA, 16 bp, Homo sapiens
cttaattaaaagaata

SEQ ID NO: 2068984 - DNA, 20 bp, Homo sapiens
cttaattaaaagaatatttt

SEQ ID NO: 2068985 - DNA, 18 bp, Homo sapiens
cttaattttcagtataat

SEQ ID NO: 2068986 - DNA, 15 bp, Homo sapiens
cttaattttgtattt

SEQ ID NO: 2068987 - DNA, 16 bp, Homo sapiens
cttaattttttttaat

SEQ ID NO: 2068988 - DNA, 17 bp, Homo sapiens
cttacacttggagcccg

SEQ ID NO: 2068989 - DNA, 18 bp, Homo sapiens
ctgagctggccctttcca

SEQ ID NO: 2068990 - DNA, 19 bp, Homo sapiens
ctgagctggccctttccag

SEQ ID NO: 2068991 - DNA, 16 bp, Homo sapiens
ctgagctgggcaccac

SEQ ID NO: 2068992 - DNA, 20 bp, Homo sapiens
ctgagctgggcaccacaggc

SEQ ID NO: 2068993 - DNA, 15 bp, Homo sapiens
ctgagctggggccac

SEQ ID NO: 2068994 - DNA, 15 bp, Homo sapiens
ctgagctggggcctg

SEQ ID NO: 2068995 - DNA, 18 bp, Homo sapiens
ctgagctggggcctggag

SEQ ID NO: 2068996 - DNA, 15 bp, Homo sapiens
ctgagcttagccttg

SEQ ID NO: 2068997 - DNA, 18 bp, Homo sapiens
ctgagcttagccttgtgc

SEQ ID NO: 2068998 - DNA, 20 bp, Homo sapiens
ctgagcttagccttgtgccc

SEQ ID NO: 2068999 - DNA, 23 bp, Homo sapiens
ctgagcttagccttgtgccctgc

SEQ ID NO: 2069000 - DNA, 22 bp, Homo sapiens
ctgagcttcagtataaaagaca

SEQ ID NO: 2069001 - DNA, 16 bp, Homo sapiens
ctgagctttggggaca

SEQ ID NO: 2069002 - DNA, 22 bp, Homo sapiens
ctgagctttggggacagttggc

SEQ ID NO: 2069003 - DNA, 14 bp, Homo sapiens
ctgagcttttcatg

SEQ ID NO: 2069004 - DNA, 20 bp, Homo sapiens
ctgaggaagcacagcagcat

SEQ ID NO: 2069005 - DNA, 15 bp, Homo sapiens
ctgaggaagggagac

SEQ ID NO: 2069006 - DNA, 14 bp, Homo sapiens
ctgaggaatccaga

SEQ ID NO: 2069007 - DNA, 20 bp, Homo sapiens
ctgaggaatccagacccggc

SEQ ID NO: 2069008 - DNA, 23 bp, Homo sapiens
ctgaggaatccagacccggctgc

SEQ ID NO: 2069009 - DNA, 19 bp, Homo sapiens
ctgaggacatggagagaga

SEQ ID NO: 2069010 - DNA, 13 bp, Homo sapiens
ctgaggactccct

SEQ ID NO: 2069011 - DNA, 21 bp, Homo sapiens
ctgaggagctgttggcctggg

SEQ ID NO: 2069012 - DNA, 21 bp, Homo sapiens
ctgaggagtagctgagaggaa

SEQ ID NO: 2069013 - DNA, 22 bp, Homo sapiens
ctgaggagtagctgagaggaag

SEQ ID NO: 2069014 - DNA, 23 bp, Homo sapiens
ctgaggagtagctgagaggaaga

SEQ ID NO: 2069015 - DNA, 12 bp, Homo sapiens
ctgaggagtctg

SEQ ID NO: 2069016 - DNA, 15 bp, Homo sapiens
ctgaggagtctgagg

SEQ ID NO: 2069017 - DNA, 18 bp, Homo sapiens
ctgaggagtctgaggtcc

SEQ ID NO: 2069018 - DNA, 20 bp, Homo sapiens
ctgaggatcctcacaggagc

SEQ ID NO: 2069019 - DNA, 21 bp, Homo sapiens
ctgaggatcctcacaggagca

SEQ ID NO: 2069020 - DNA, 15 bp, Homo sapiens
ctgaggcagaagaat

SEQ ID NO: 2069021 - DNA, 19 bp, Homo sapiens
ctgaggccagcctggcctc

SEQ ID NO: 2069022 - DNA, 18 bp, Homo sapiens
ctgaggccattatttcaa

SEQ ID NO: 2069023 - DNA, 19 bp, Homo sapiens
ctgaggccccttaactcat

SEQ ID NO: 2069024 - DNA, 11 bp, Homo sapiens
ctgaggcctca

SEQ ID NO: 2069025 - DNA, 15 bp, Homo sapiens
ctgaggcctcatccc

SEQ ID NO: 2069026 - DNA, 23 bp, Homo sapiens
ctgaggcgccccaacccgtggag

SEQ ID NO: 2069027 - DNA, 16 bp, Homo sapiens
ctgaggctcaagaggc

SEQ ID NO: 2069028 - DNA, 23 bp, Homo sapiens
ctgaggctctgacccagtgagat

SEQ ID NO: 2069029 - DNA, 22 bp, Homo sapiens
ctgaggctgggggcgggggagc

SEQ ID NO: 2069030 - DNA, 16 bp, Homo sapiens
ctgagggccacactat

SEQ ID NO: 2069031 - DNA, 16 bp, Homo sapiens
ctgaggggggccgtgc

SEQ ID NO: 2069032 - DNA, 23 bp, Homo sapiens
ctgaggggggccgtgcccagggg

SEQ ID NO: 2069033 - DNA, 15 bp, Homo sapiens
ctgagggtggagact

SEQ ID NO: 2069034 - DNA, 18 bp, Homo sapiens
ctgaggtcactgggttct

SEQ ID NO: 2069035 - DNA, 14 bp, Homo sapiens
ctgaggtcctgagc

SEQ ID NO: 2069036 - DNA, 20 bp, Homo sapiens
ctgaggtcctgagcactgcc

SEQ ID NO: 2069037 - DNA, 21 bp, Homo sapiens
ctgaggtcctgcatttctcag

SEQ ID NO: 2069038 - DNA, 17 bp, Homo sapiens
ctgaggtgcccaggaga

SEQ ID NO: 2069039 - DNA, 18 bp, Homo sapiens
ctgaggtgcccaggagaa

SEQ ID NO: 2069040 - DNA, 12 bp, Homo sapiens
ctgagtaaattg

SEQ ID NO: 2069041 - DNA, 20 bp, Homo sapiens
ctgagtaaattggaaacatt

SEQ ID NO: 2069042 - DNA, 20 bp, Homo sapiens
ctgagtagctgggattacag

SEQ ID NO: 2069043 - DNA, 15 bp, Homo sapiens
ctgagtcaccaggaa

SEQ ID NO: 2069044 - DNA, 22 bp, Homo sapiens
ctgagtcacccatgaagacagg

SEQ ID NO: 2069045 - DNA, 22 bp, Homo sapiens
ctgagtcaccctacctgtgcct

SEQ ID NO: 2069046 - DNA, 14 bp, Homo sapiens
ctgagtcacctcct

SEQ ID NO: 2069047 - DNA, 17 bp, Homo sapiens
ctgagtcacctcctcca

SEQ ID NO: 2069048 - DNA, 23 bp, Homo sapiens
ctgagtcacctcctccactcact

SEQ ID NO: 2069049 - DNA, 21 bp, Homo sapiens
ctgagtcatgatctccctgcc

SEQ ID NO: 2069050 - DNA, 17 bp, Homo sapiens
ctgagtccctccatgca

SEQ ID NO: 2069051 - DNA, 14 bp, Homo sapiens
ctgagtcggcccca

SEQ ID NO: 2069052 - DNA, 19 bp, Homo sapiens
ctgagtctgagtcctgtct

SEQ ID NO: 2069053 - DNA, 22 bp, Homo sapiens
ctgagtctgctatattttcatg

SEQ ID NO: 2069054 - DNA, 19 bp, Homo sapiens
ctgagtcttggcctgcctc

SEQ ID NO: 2069055 - DNA, 16 bp, Homo sapiens
ctgagtgacatgggtg

SEQ ID NO: 2069056 - DNA, 11 bp, Homo sapiens
ctgagtgactc

SEQ ID NO: 2069057 - DNA, 15 bp, Homo sapiens
ctgagtgagccacag

SEQ ID NO: 2069058 - DNA, 16 bp, Homo sapiens
ctgagtgagccacaga

SEQ ID NO: 2069059 - DNA, 18 bp, Homo sapiens
ctgagtggaatgcaggga

SEQ ID NO: 2069060 - DNA, 23 bp, Homo sapiens
ctgagtggaatgcagggaagagg

SEQ ID NO: 2069061 - DNA, 22 bp, Homo sapiens
ctgagtggcttgtgattctggg

SEQ ID NO: 2069062 - DNA, 23 bp, Homo sapiens
ctgagtgtgggagtgcagagaaa

SEQ ID NO: 2069063 - DNA, 15 bp, Homo sapiens
ctgagttacttgtct

SEQ ID NO: 2069064 - DNA, 18 bp, Homo sapiens
ctgagttacttgtctgag

SEQ ID NO: 2069065 - DNA, 21 bp, Homo sapiens
ctgagttacttgtctgaggcc

SEQ ID NO: 2069066 - DNA, 16 bp, Homo sapiens
ctgagttcctgcatgc

SEQ ID NO: 2069067 - DNA, 19 bp, Homo sapiens
ctgagttccttataagaat

SEQ ID NO: 2069068 - DNA, 21 bp, Homo sapiens
ctgagttccttataagaatta

SEQ ID NO: 2069069 - DNA, 23 bp, Homo sapiens
ctgagttccttataagaattaat

SEQ ID NO: 2069070 - DNA, 21 bp, Homo sapiens
ctgagttggtgttgacatgtg

SEQ ID NO: 2069071 - DNA, 21 bp, Homo sapiens
ctgagtttcattctcctgcct

SEQ ID NO: 2069072 - DNA, 17 bp, Homo sapiens
ctgataacaacctggag

SEQ ID NO: 2069073 - DNA, 22 bp, Homo sapiens
ctgataacaacctggagaccag

SEQ ID NO: 2069074 - DNA, 21 bp, Homo sapiens
ctgataatatgtttgaggtta

SEQ ID NO: 2069075 - DNA, 15 bp, Homo sapiens
ctgataattttaaat

SEQ ID NO: 2069076 - DNA, 17 bp, Homo sapiens
ctgataattttaaattc

SEQ ID NO: 2069077 - DNA, 14 bp, Homo sapiens
ctgatacccagagc

SEQ ID NO: 2069078 - DNA, 15 bp, Homo sapiens
ctgatacccagagca

SEQ ID NO: 2069079 - DNA, 22 bp, Homo sapiens
ctgatactgggtacaagagcca

SEQ ID NO: 2069080 - DNA, 16 bp, Homo sapiens
ctgataggaaaagaag

SEQ ID NO: 2069081 - DNA, 15 bp, Homo sapiens
ctgatcaaaaataaa

SEQ ID NO: 2069082 - DNA, 19 bp, Homo sapiens
ctgatcaaaaataaactag

SEQ ID NO: 2069083 - DNA, 22 bp, Homo sapiens
ctgatcaagtcaccggagcttt

SEQ ID NO: 2069084 - DNA, 18 bp, Homo sapiens
ctgatcatggtcagctca

SEQ ID NO: 2069085 - DNA, 21 bp, Homo sapiens
ctgatcatggtcagctcacac

SEQ ID NO: 2069086 - DNA, 22 bp, Homo sapiens
ctgatcattacatggctgtggt

SEQ ID NO: 2069087 - DNA, 21 bp, Homo sapiens
ctgatcctaactgaagagaca

SEQ ID NO: 2069088 - DNA, 17 bp, Homo sapiens
ctgatcgggataacaaa

SEQ ID NO: 2069089 - DNA, 17 bp, Homo sapiens
ctgatcgtgctaaattt

SEQ ID NO: 2069090 - DNA, 21 bp, Homo sapiens
ctgatgaactcttaatcaaat

SEQ ID NO: 2069091 - DNA, 21 bp, Homo sapiens
ctgatgagtgattgacacaca

SEQ ID NO: 2069092 - DNA, 13 bp, Homo sapiens
ctgatgatgtctc

SEQ ID NO: 2069093 - DNA, 21 bp, Homo sapiens
ctgatgatgtctcttgtagaa

SEQ ID NO: 2069094 - DNA, 14 bp, Homo sapiens
ctgatgcatcagaa

SEQ ID NO: 2069095 - DNA, 17 bp, Homo sapiens
ctgatgcatcagaaagg

SEQ ID NO: 2069096 - DNA, 21 bp, Homo sapiens
ctgatgcatcagaaagggagg

SEQ ID NO: 2069097 - DNA, 22 bp, Homo sapiens
ctgatgcatcagaaagggaggg

SEQ ID NO: 2069098 - DNA, 19 bp, Homo sapiens
ctgatgctgccccgttccc

SEQ ID NO: 2069099 - DNA, 14 bp, Homo sapiens
ctgatggacaagga

SEQ ID NO: 2069100 - DNA, 20 bp, Homo sapiens
ctgatggaccgggtgggcct

SEQ ID NO: 2069101 - DNA, 16 bp, Homo sapiens
ctgatggagaaggaag

SEQ ID NO: 2069102 - DNA, 15 bp, Homo sapiens
ctgcaggaacgagca

SEQ ID NO: 2069103 - DNA, 19 bp, Homo sapiens
ctgcaggaacgagcactgg

SEQ ID NO: 2069104 - DNA, 16 bp, Homo sapiens
ctgcctgtagttagga

SEQ ID NO: 2069105 - DNA, 22 bp, Homo sapiens
ctgcctgtagttaggaaataaa

SEQ ID NO: 2069106 - DNA, 21 bp, Homo sapiens
ctgcctgtgcacggccagctg

SEQ ID NO: 2069107 - DNA, 13 bp, Homo sapiens
ctgcctgtgcatg

SEQ ID NO: 2069108 - DNA, 15 bp, Homo sapiens
ctgcctgttcagctc

SEQ ID NO: 2069109 - DNA, 17 bp, Homo sapiens
ctgcctgttcagctcca

SEQ ID NO: 2069110 - DNA, 19 bp, Homo sapiens
ctgcctgttcagctccagc

SEQ ID NO: 2069111 - DNA, 20 bp, Homo sapiens
ctgcctgttcagctccagct

SEQ ID NO: 2069112 - DNA, 20 bp, Homo sapiens
ctgccttacccgccatacat

SEQ ID NO: 2069113 - DNA, 18 bp, Homo sapiens
ctgccttcagccctggcc

SEQ ID NO: 2069114 - DNA, 22 bp, Homo sapiens
ctggattgatcggagcctcctc

SEQ ID NO: 2069115 - DNA, 19 bp, Homo sapiens
ctggattgttgacatgagt

SEQ ID NO: 2069116 - DNA, 23 bp, Homo sapiens
ctggatttttacaaataaagatg

SEQ ID NO: 2069117 - DNA, 21 bp, Homo sapiens
ctggcaaaggtggctctccag

SEQ ID NO: 2069118 - DNA, 19 bp, Homo sapiens
ctggcaaagttatatttac

SEQ ID NO: 2069119 - DNA, 22 bp, Homo sapiens
ctggcaacatagtgagatccca

SEQ ID NO: 2069120 - DNA, 22 bp, Homo sapiens
ctggcaagctagaacctggagg

SEQ ID NO: 2069121 - DNA, 22 bp, Homo sapiens
ctggcaatgaaaaattctcagt

SEQ ID NO: 2069122 - DNA, 19 bp, Homo sapiens
ctggcaatgtttatttcat

SEQ ID NO: 2069123 - DNA, 18 bp, Homo sapiens
ctggcacaggactgattc

SEQ ID NO: 2069124 - DNA, 15 bp, Homo sapiens
ctggcacagggcagt

SEQ ID NO: 2069125 - DNA, 16 bp, Homo sapiens
ctggcacagggcagtg

SEQ ID NO: 2069126 - DNA, 18 bp, Homo sapiens
ctggcacagttttctgag

SEQ ID NO: 2069127 - DNA, 19 bp, Homo sapiens
ctggcacagttttctgaga

SEQ ID NO: 2069128 - DNA, 20 bp, Homo sapiens
ctggcacagttttctgagaa

SEQ ID NO: 2069129 - DNA, 22 bp, Homo sapiens
ctggcacagttttctgagaaag

SEQ ID NO: 2069130 - DNA, 17 bp, Homo sapiens
ctggcacccggcccctg

SEQ ID NO: 2069131 - DNA, 19 bp, Homo sapiens
ctggcacccggcccctgct

SEQ ID NO: 2069132 - DNA, 12 bp, Homo sapiens
ctggcacctcag

SEQ ID NO: 2069133 - DNA, 21 bp, Homo sapiens
ctggcacggtggctcaggcct

SEQ ID NO: 2069134 - DNA, 15 bp, Homo sapiens
ctggcacgtttgtga

SEQ ID NO: 2069135 - DNA, 18 bp, Homo sapiens
ctggcactccagaacaaa

SEQ ID NO: 2069136 - DNA, 18 bp, Homo sapiens
ctggcacttagcccaaga

SEQ ID NO: 2069137 - DNA, 23 bp, Homo sapiens
ctggcacttagcccaagaggtct

SEQ ID NO: 2069138 - DNA, 15 bp, Homo sapiens
ctggcagagaaggat

SEQ ID NO: 2069139 - DNA, 15 bp, Homo sapiens
ctggcagagaaggct

SEQ ID NO: 2069140 - DNA, 18 bp, Homo sapiens
ctggcagagcccccaagg

SEQ ID NO: 2069141 - DNA, 12 bp, Homo sapiens
ctggcagccaca

SEQ ID NO: 2069142 - DNA, 15 bp, Homo sapiens
ctggcagccacactt

SEQ ID NO: 2069143 - DNA, 23 bp, Homo sapiens
ctggcagccacacttctcaggac

SEQ ID NO: 2069144 - DNA, 22 bp, Homo sapiens
ctggcagccgtgccttcagctc

SEQ ID NO: 2069145 - DNA, 16 bp, Homo sapiens
ctggcagctcctctcc

SEQ ID NO: 2069146 - DNA, 19 bp, Homo sapiens
ctggcagctcctctccttg

SEQ ID NO: 2069147 - DNA, 21 bp, Homo sapiens
ctggcagctcctctccttggg

SEQ ID NO: 2069148 - DNA, 22 bp, Homo sapiens
ctggcagctcctctccttgggc

SEQ ID NO: 2069149 - DNA, 24 bp, Homo sapiens
ctggcagctcctctccttgggctc

SEQ ID NO: 2069150 - DNA, 18 bp, Homo sapiens
ctggcagctgagagccct

SEQ ID NO: 2069151 - DNA, 14 bp, Homo sapiens
ctggcagctgtcat

SEQ ID NO: 2069152 - DNA, 17 bp, Homo sapiens
ctggcagggtgggatgg

SEQ ID NO: 2069153 - DNA, 21 bp, Homo sapiens
ctggcaggtgcagatgggctg

SEQ ID NO: 2069154 - DNA, 22 bp, Homo sapiens
ctggcaggtgcagatgggctgt

SEQ ID NO: 2069155 - DNA, 20 bp, Homo sapiens
ctggcagtttatatttaact

SEQ ID NO: 2069156 - DNA, 18 bp, Homo sapiens
ctggcattaattattaat

SEQ ID NO: 2069157 - DNA, 15 bp, Homo sapiens
ctggcattacagctg

SEQ ID NO: 2069158 - DNA, 16 bp, Homo sapiens
ctggcattggtctgct

SEQ ID NO: 2069159 - DNA, 13 bp, Homo sapiens
ctggccaagctga

SEQ ID NO: 2069160 - DNA, 19 bp, Homo sapiens
ctggccaagctgaggtgcc

SEQ ID NO: 2069161 - DNA, 23 bp, Homo sapiens
ctggccaagctgaggtgcccagg

SEQ ID NO: 2069162 - DNA, 10 bp, Homo sapiens
ctggccaccc

SEQ ID NO: 2069163 - DNA, 15 bp, Homo sapiens
ctggccaccctggcc

SEQ ID NO: 2069164 - DNA, 18 bp, Homo sapiens
ctggccagagagggccca

SEQ ID NO: 2069165 - DNA, 22 bp, Homo sapiens
ctggccagagagggcccagctg

SEQ ID NO: 2069166 - DNA, 14 bp, Homo sapiens
ctggccagatgcac

SEQ ID NO: 2069167 - DNA, 17 bp, Homo sapiens
ctggccagatgcaccag

SEQ ID NO: 2069168 - DNA, 22 bp, Homo sapiens
ctggccagatgcaccagccctt

SEQ ID NO: 2069169 - DNA, 15 bp, Homo sapiens
ctggccagcaccctc

SEQ ID NO: 2069170 - DNA, 20 bp, Homo sapiens
ctggccagcaccctctcctg

SEQ ID NO: 2069171 - DNA, 22 bp, Homo sapiens
ctggccagcaccctctcctggg

SEQ ID NO: 2069172 - DNA, 13 bp, Homo sapiens
ctggccaggagct

SEQ ID NO: 2069173 - DNA, 15 bp, Homo sapiens
ctggccaggcatggc

SEQ ID NO: 2069174 - DNA, 17 bp, Homo sapiens
ctggccagtcctagagc

SEQ ID NO: 2069175 - DNA, 22 bp, Homo sapiens
ctggccattttcttgcctgagg

SEQ ID NO: 2069176 - DNA, 23 bp, Homo sapiens
ctggccattttcttgcctgaggc

SEQ ID NO: 2069177 - DNA, 24 bp, Homo sapiens
ctggccattttcttgcctgaggct

SEQ ID NO: 2069178 - DNA, 20 bp, Homo sapiens
ctggcccagccaactgcccc

SEQ ID NO: 2069179 - DNA, 19 bp, Homo sapiens
ctggcccagggtaggggag

SEQ ID NO: 2069180 - DNA, 16 bp, Homo sapiens
ctggcccatagaaaca

SEQ ID NO: 2069181 - DNA, 21 bp, Homo sapiens
ctggcccatagaaacatgaca

SEQ ID NO: 2069182 - DNA, 23 bp, Homo sapiens
ctggcccatagaaacatgacact

SEQ ID NO: 2069183 - DNA, 12 bp, Homo sapiens
ctggccccaccc

SEQ ID NO: 2069184 - DNA, 15 bp, Homo sapiens
ctggccccagccccc

SEQ ID NO: 2069185 - DNA, 17 bp, Homo sapiens
ctggccccagcccccac

SEQ ID NO: 2069186 - DNA, 15 bp, Homo sapiens
ctggcccccctccag

SEQ ID NO: 2069187 - DNA, 19 bp, Homo sapiens
ctggccccgggctctggcc

SEQ ID NO: 2069188 - DNA, 23 bp, Homo sapiens
ctggccccgggctctggccaccc

SEQ ID NO: 2069189 - DNA, 21 bp, Homo sapiens
ctggcccctccagaccctgcc

SEQ ID NO: 2069190 - DNA, 21 bp, Homo sapiens
ctggcccgcccctcgctgctg

SEQ ID NO: 2069191 - DNA, 21 bp, Homo sapiens
ctggcccgtcatgttcctcaa

SEQ ID NO: 2069192 - DNA, 13 bp, Homo sapiens
ctggccgcctcca

SEQ ID NO: 2069193 - DNA, 14 bp, Homo sapiens
ctggccgcctccag

SEQ ID NO: 2069194 - DNA, 20 bp, Homo sapiens
ctggccggcccaggcctcca

SEQ ID NO: 2069195 - DNA, 23 bp, Homo sapiens
ctggccggctccagtttccccat

SEQ ID NO: 2069196 - DNA, 17 bp, Homo sapiens
ctggccggggcccctca

SEQ ID NO: 2069197 - DNA, 21 bp, Homo sapiens
ctggcctcaaagcaagcattc

SEQ ID NO: 2069198 - DNA, 23 bp, Homo sapiens
ctggcctcaagtgattctcctgc

SEQ ID NO: 2069199 - DNA, 17 bp, Homo sapiens
ctggcctcactggctgg

SEQ ID NO: 2069200 - DNA, 13 bp, Homo sapiens
ctggcctccacag

SEQ ID NO: 2069201 - DNA, 14 bp, Homo sapiens
ctggcctcctgcct

SEQ ID NO: 2069202 - DNA, 15 bp, Homo sapiens
ctggcctctagaaca

SEQ ID NO: 2069203 - DNA, 20 bp, Homo sapiens
ctggcctctagaacacccac

SEQ ID NO: 2069204 - DNA, 17 bp, Homo sapiens
ctggcctgagctggggc

SEQ ID NO: 2069205 - DNA, 18 bp, Homo sapiens
ctggcctgagctggggcc

SEQ ID NO: 2069206 - DNA, 21 bp, Homo sapiens
ctggcctgagctggggccaca

SEQ ID NO: 2069207 - DNA, 14 bp, Homo sapiens
ctggcctgctggga

SEQ ID NO: 2069208 - DNA, 15 bp, Homo sapiens
ctggcctgctgggct

SEQ ID NO: 2069209 - DNA, 19 bp, Homo sapiens
ctggcctgctgggctctcc

SEQ ID NO: 2069210 - DNA, 20 bp, Homo sapiens
ctggcctgctgggctctcca

SEQ ID NO: 2069211 - DNA, 18 bp, Homo sapiens
ctggcctggcacacatca

SEQ ID NO: 2069212 - DNA, 12 bp, Homo sapiens
ctggcctggctc

SEQ ID NO: 2069213 - DNA, 15 bp, Homo sapiens
ctggcctgtggcagg

SEQ ID NO: 2069214 - DNA, 17 bp, Homo sapiens
ctggccttgtcaggacc

SEQ ID NO: 2069215 - DNA, 18 bp, Homo sapiens
ctggccttgtcaggaccc

SEQ ID NO: 2069216 - DNA, 14 bp, Homo sapiens
ctggccttttccta

SEQ ID NO: 2069217 - DNA, 16 bp, Homo sapiens
ctggcgactgcagctg

SEQ ID NO: 2069218 - DNA, 19 bp, Homo sapiens
ctggcgcaagagaacattt

SEQ ID NO: 2069219 - DNA, 15 bp, Homo sapiens
ctggcggcgcagagg

SEQ ID NO: 2069220 - DNA, 14 bp, Homo sapiens
ctggcggcttcctg

SEQ ID NO: 2069221 - DNA, 15 bp, Homo sapiens
ctggcggcttcctgt

SEQ ID NO: 2069222 - DNA, 17 bp, Homo sapiens
ctggcggcttcctgtcc

SEQ ID NO: 2069223 - DNA, 18 bp, Homo sapiens
ctggcggcttcctgtcca

SEQ ID NO: 2069224 - DNA, 19 bp, Homo sapiens
ctggcggcttcctgtccac

SEQ ID NO: 2069225 - DNA, 14 bp, Homo sapiens
ctggcggggcagga

SEQ ID NO: 2069226 - DNA, 21 bp, Homo sapiens
ctggcggggcaggaggcctgg

SEQ ID NO: 2069227 - DNA, 18 bp, Homo sapiens
ctgggccctggggcctgt

SEQ ID NO: 2069228 - DNA, 22 bp, Homo sapiens
ctgggccctggggcctgtactg

SEQ ID NO: 2069229 - DNA, 14 bp, Homo sapiens
ctgggccggccagc

SEQ ID NO: 2069230 - DNA, 17 bp, Homo sapiens
ctgggcctatggagagc

SEQ ID NO: 2069231 - DNA, 18 bp, Homo sapiens
ctgggcctatggagagcc

SEQ ID NO: 2069232 - DNA, 20 bp, Homo sapiens
ctgggcctcagttcaacctg

SEQ ID NO: 2069233 - DNA, 17 bp, Homo sapiens
ctgggcctgctgctgag

SEQ ID NO: 2069234 - DNA, 19 bp, Homo sapiens
ctgggcctgctgctgagaa

SEQ ID NO: 2069235 - DNA, 20 bp, Homo sapiens
ctgggcctgcttttccagga

SEQ ID NO: 2069236 - DNA, 13 bp, Homo sapiens
ctgggcctgtccc

SEQ ID NO: 2069237 - DNA, 14 bp, Homo sapiens
ctgggcctgtcccc

SEQ ID NO: 2069238 - DNA, 12 bp, Homo sapiens
ctgggcctgtgc

SEQ ID NO: 2069239 - DNA, 18 bp, Homo sapiens
ctgggcctgtgcagcagc

SEQ ID NO: 2069240 - DNA, 22 bp, Homo sapiens
ctgggcctgtgcagcagcccag

SEQ ID NO: 2069241 - DNA, 19 bp, Homo sapiens
ctgggccttacctcccctg

SEQ ID NO: 2069242 - DNA, 21 bp, Homo sapiens
ctgggccttacctcccctgcc

SEQ ID NO: 2069243 - DNA, 24 bp, Homo sapiens
ctgggccttacctcccctgccagg

SEQ ID NO: 2069244 - DNA, 14 bp, Homo sapiens
ctgggcctttcctg

SEQ ID NO: 2069245 - DNA, 22 bp, Homo sapiens
ctgggcctttcctgtgccaacc

SEQ ID NO: 2069246 - DNA, 15 bp, Homo sapiens
ctgggctagggagaa

SEQ ID NO: 2069247 - DNA, 14 bp, Homo sapiens
ctgggctcagggct

SEQ ID NO: 2069248 - DNA, 16 bp, Homo sapiens
ctgggctcagggctgg

SEQ ID NO: 2069249 - DNA, 17 bp, Homo sapiens
ctgggctcagggctgga

SEQ ID NO: 2069250 - DNA, 14 bp, Homo sapiens
ctgggctcctggaa

SEQ ID NO: 2069251 - DNA, 20 bp, Homo sapiens
ctgggctctccacctcagcc

SEQ ID NO: 2069252 - DNA, 17 bp, Homo sapiens
ctgggctctgccccagc

SEQ ID NO: 2069253 - DNA, 18 bp, Homo sapiens
ctgggctctgccccagct

SEQ ID NO: 2069254 - DNA, 23 bp, Homo sapiens
ctgggctctgccccagctctggc

SEQ ID NO: 2069255 - DNA, 19 bp, Homo sapiens
ctgggctgctacccagaaa

SEQ ID NO: 2069256 - DNA, 21 bp, Homo sapiens
ctgggctgtctgtcaccagct

SEQ ID NO: 2069257 - DNA, 15 bp, Homo sapiens
ctgggctgtgggtgc

SEQ ID NO: 2069258 - DNA, 17 bp, Homo sapiens
ctgggcttcagtggcag

SEQ ID NO: 2069259 - DNA, 20 bp, Homo sapiens
ctgggcttcagtggcagctg

SEQ ID NO: 2069260 - DNA, 13 bp, Homo sapiens
ctggggaacagag

SEQ ID NO: 2069261 - DNA, 18 bp, Homo sapiens
ctttgccatgggcctgct

SEQ ID NO: 2069262 - DNA, 16 bp, Homo sapiens
ctttgccccaaggctg

SEQ ID NO: 2069263 - DNA, 16 bp, Homo sapiens
ctttgccccagttaca

SEQ ID NO: 2069264 - DNA, 16 bp, Homo sapiens
ctttgcccttctttct

SEQ ID NO: 2069265 - DNA, 13 bp, Homo sapiens
ctttgcctgtgtg

SEQ ID NO: 2069266 - DNA, 14 bp, Homo sapiens
ctttgccttttgca

SEQ ID NO: 2069267 - DNA, 15 bp, Homo sapiens
ctttgctacaataaa

SEQ ID NO: 2069268 - DNA, 20 bp, Homo sapiens
ctttgctttttaattgagga

SEQ ID NO: 2069269 - DNA, 15 bp, Homo sapiens
ctttggaagaaaaaa

SEQ ID NO: 2069270 - DNA, 16 bp, Homo sapiens
ctttggaagaaacagg

SEQ ID NO: 2069271 - DNA, 23 bp, Homo sapiens
ctttggaatgactataaacatta

SEQ ID NO: 2069272 - DNA, 23 bp, Homo sapiens
ctttggacaactgacaatatgat

SEQ ID NO: 2069273 - DNA, 13 bp, Homo sapiens
ctttggaccctgt

SEQ ID NO: 2069274 - DNA, 20 bp, Homo sapiens
ctttggcagaccatctccag

SEQ ID NO: 2069275 - DNA, 14 bp, Homo sapiens
ctttggcttctcct

SEQ ID NO: 2069276 - DNA, 17 bp, Homo sapiens
ctttggcttctcctgtg

SEQ ID NO: 2069277 - DNA, 18 bp, Homo sapiens
ctttgggaggccaaggca

SEQ ID NO: 2069278 - DNA, 17 bp, Homo sapiens
ctttgggaggctgaggc

SEQ ID NO: 2069279 - DNA, 17 bp, Homo sapiens
ctttgggatcagcctcc

SEQ ID NO: 2069280 - DNA, 19 bp, Homo sapiens
ctttgggattctaggaaac

SEQ ID NO: 2069281 - DNA, 14 bp, Homo sapiens
ctttgggctgccct

SEQ ID NO: 2069282 - DNA, 12 bp, Homo sapiens
ctttgggctttg

SEQ ID NO: 2069283 - DNA, 23 bp, Homo sapiens
ctttgggctttgcaggctctggg

SEQ ID NO: 2069284 - DNA, 19 bp, Homo sapiens
ctttggggacagttggcag

SEQ ID NO: 2069285 - DNA, 22 bp, Homo sapiens
ctttggggtcctagcccagtgc

SEQ ID NO: 2069286 - DNA, 23 bp, Homo sapiens
ctttggggtcctagcccagtgct

SEQ ID NO: 2069287 - DNA, 19 bp, Homo sapiens
ctttgggtactactgctgc

SEQ ID NO: 2069288 - DNA, 21 bp, Homo sapiens
ctttgggtactactgctgcaa

SEQ ID NO: 2069289 - DNA, 16 bp, Homo sapiens
ctttggttctctccag

SEQ ID NO: 2069290 - DNA, 17 bp, Homo sapiens
ctttggttctctccagg

SEQ ID NO: 2069291 - DNA, 20 bp, Homo sapiens
ctttggtttaatttaaagcc

SEQ ID NO: 2069292 - DNA, 17 bp, Homo sapiens
ctttgtctctagccggg

SEQ ID NO: 2069293 - DNA, 19 bp, Homo sapiens
ctttgtgagagtgagctgt

SEQ ID NO: 2069294 - DNA, 20 bp, Homo sapiens
ctttgtgggagggtaagaca

SEQ ID NO: 2069295 - DNA, 22 bp, Homo sapiens
ctttgtgtacttcagtcttgga

SEQ ID NO: 2069296 - DNA, 17 bp, Homo sapiens
ctttgtgtagctttgct

SEQ ID NO: 2069297 - DNA, 18 bp, Homo sapiens
ctttgtgtagctttgctc

SEQ ID NO: 2069298 - DNA, 21 bp, Homo sapiens
ctttgttattatcctgcattt

SEQ ID NO: 2069299 - DNA, 20 bp, Homo sapiens
ctttgttatttttgtttctt

SEQ ID NO: 2069300 - DNA, 21 bp, Homo sapiens
ctttgttgcaagtactgctgt

SEQ ID NO: 2069301 - DNA, 15 bp, Homo sapiens
ctttgtttactaaag

SEQ ID NO: 2069302 - DNA, 14 bp, Homo sapiens
cttttaaaagaaaa

SEQ ID NO: 2069303 - DNA, 17 bp, Homo sapiens
cttttaaaatgaaatgt

SEQ ID NO: 2069304 - DNA, 20 bp, Homo sapiens
cttttaaagaagtaaatttg

SEQ ID NO: 2069305 - DNA, 22 bp, Homo sapiens
cttttaaaggggcagaaaaact

SEQ ID NO: 2069306 - DNA, 22 bp, Homo sapiens
cttttaacatttatctaaaaga

SEQ ID NO: 2069307 - DNA, 16 bp, Homo sapiens
cttttaatacagggta

SEQ ID NO: 2069308 - DNA, 18 bp, Homo sapiens
cttttaatatgctgtggg

SEQ ID NO: 2069309 - DNA, 15 bp, Homo sapiens
cttttaatgaacaaa

SEQ ID NO: 2069310 - DNA, 16 bp, Homo sapiens
cttttaatgccttcca

SEQ ID NO: 2069311 - DNA, 20 bp, Homo sapiens
cttttacccctgcacagttt

SEQ ID NO: 2069312 - DNA, 19 bp, Homo sapiens
cttttagttgtatctcttt

SEQ ID NO: 2069313 - DNA, 21 bp, Homo sapiens
cttttagttgtatctcttttg

SEQ ID NO: 2069314 - DNA, 10 bp, Homo sapiens
cttttataaa

SEQ ID NO: 2069315 - DNA, 11 bp, Homo sapiens
cttttatacca

SEQ ID NO: 2069316 - DNA, 18 bp, Homo sapiens
cttttataccagagacct

SEQ ID NO: 2069317 - DNA, 18 bp, Homo sapiens
cttttatagctattactg

SEQ ID NO: 2069318 - DNA, 16 bp, Homo sapiens
cttttatcaaaatccc

SEQ ID NO: 2069319 - DNA, 19 bp, Homo sapiens
cttttatcacgatattatt

SEQ ID NO: 2069320 - DNA, 20 bp, Homo sapiens
cttttatgttatttatatat

SEQ ID NO: 2069321 - DNA, 14 bp, Homo sapiens
cttttatttccaaa

SEQ ID NO: 2069322 - DNA, 15 bp, Homo sapiens
cttttcaaaacattt

SEQ ID NO: 2069323 - DNA, 18 bp, Homo sapiens
cttttcaaacaagaatgt

SEQ ID NO: 2069324 - DNA, 21 bp, Homo sapiens
cttttcaagttgagaacaaaa

SEQ ID NO: 2069325 - DNA, 15 bp, Homo sapiens
cttttcatggaagtg

SEQ ID NO: 2069326 - DNA, 18 bp, Homo sapiens
cttttccactcctatgga

SEQ ID NO: 2069327 - DNA, 18 bp, Homo sapiens
cttttcccaaaatgttga

SEQ ID NO: 2069328 - DNA, 17 bp, Homo sapiens
cttttcccaggaatatc

SEQ ID NO: 2069329 - DNA, 14 bp, Homo sapiens
cttttccctctcta

SEQ ID NO: 2069330 - DNA, 16 bp, Homo sapiens
cttttcctatttgttt

SEQ ID NO: 2069331 - DNA, 19 bp, Homo sapiens
cttttcctattttcagccc

SEQ ID NO: 2069332 - DNA, 18 bp, Homo sapiens
cttttcgcttgcttctgc

SEQ ID NO: 2069333 - DNA, 13 bp, Homo sapiens
cttttctaatctt

SEQ ID NO: 2069334 - DNA, 16 bp, Homo sapiens
cttttctagcaactgt

SEQ ID NO: 2069335 - DNA, 13 bp, Homo sapiens
cttttctctccca

SEQ ID NO: 2069336 - DNA, 15 bp, Homo sapiens
cttttctctcccata

SEQ ID NO: 2069337 - DNA, 16 bp, Homo sapiens
cttttctgaccaaaga

SEQ ID NO: 2069338 - DNA, 18 bp, Homo sapiens
cttttctggaatgtaatc

SEQ ID NO: 2069339 - DNA, 14 bp, Homo sapiens
cttttctgttgtac

SEQ ID NO: 2069340 - DNA, 19 bp, Homo sapiens
cttttctttattgctgtga

SEQ ID NO: 2069341 - DNA, 19 bp, Homo sapiens
cttttgaatccatgcttgg

SEQ ID NO: 2069342 - DNA, 20 bp, Homo sapiens
cttttgaatccatgcttggg

SEQ ID NO: 2069343 - DNA, 14 bp, Homo sapiens
cttttgatggggag

SEQ ID NO: 2069344 - DNA, 17 bp, Homo sapiens
cttttgatggggagaaa

SEQ ID NO: 2069345 - DNA, 15 bp, Homo sapiens
cgcttcccagaggcc

SEQ ID NO: 2069346 - DNA, 12 bp, Homo sapiens
cgcttgagccca

SEQ ID NO: 2069347 - DNA, 18 bp, Homo sapiens
cgcttgagcccaggagtt

SEQ ID NO: 2069348 - DNA, 14 bp, Homo sapiens
cgcttgcttctgca

SEQ ID NO: 2069349 - DNA, 23 bp, Homo sapiens
cgcttgcttctgcagcaactccc

SEQ ID NO: 2069350 - DNA, 14 bp, Homo sapiens
cgctttctacccag

SEQ ID NO: 2069351 - DNA, 14 bp, Homo sapiens
gaaagactgaaaga

SEQ ID NO: 2069352 - DNA, 10 bp, Homo sapiens
gaaagagacc

SEQ ID NO: 2069353 - DNA, 19 bp, Homo sapiens
gaaagagagagaattcttt

SEQ ID NO: 2069354 - DNA, 14 bp, Homo sapiens
gaaagcaaagggct

SEQ ID NO: 2069355 - DNA, 16 bp, Homo sapiens
gaaagcacaggagaca

SEQ ID NO: 2069356 - DNA, 12 bp, Homo sapiens
gaaagcagcagc

SEQ ID NO: 2069357 - DNA, 22 bp, Homo sapiens
gaaagcagcagctaggactgag

SEQ ID NO: 2069358 - DNA, 22 bp, Homo sapiens
gaaagcatgtggcatgttcatc

SEQ ID NO: 2069359 - DNA, 17 bp, Homo sapiens
gaaagccgtactgtcta

SEQ ID NO: 2069360 - DNA, 16 bp, Homo sapiens
gaaagcctctgctgcc

SEQ ID NO: 2069361 - DNA, 15 bp, Homo sapiens
gaaagcctctggaaa

SEQ ID NO: 2069362 - DNA, 21 bp, Homo sapiens
gaaagctggtaaactatttgt

SEQ ID NO: 2069363 - DNA, 15 bp, Homo sapiens
gaaagctgtttattt

SEQ ID NO: 2069364 - DNA, 21 bp, Homo sapiens
gaaagctgtttatttattcac

SEQ ID NO: 2069365 - DNA, 11 bp, Homo sapiens
gaaaggaaaac

SEQ ID NO: 2069366 - DNA, 21 bp, Homo sapiens
gaaaggaggcatgcctctgat

SEQ ID NO: 2069367 - DNA, 20 bp, Homo sapiens
gaaaggatgtaaacagtgcc

SEQ ID NO: 2069368 - DNA, 19 bp, Homo sapiens
gaaaggattaagatacact

SEQ ID NO: 2069369 - DNA, 13 bp, Homo sapiens
gaaagggagggct

SEQ ID NO: 2069370 - DNA, 16 bp, Homo sapiens
gaaagggagggctctg

SEQ ID NO: 2069371 - DNA, 18 bp, Homo sapiens
gaaagggagggctctgag

SEQ ID NO: 2069372 - DNA, 19 bp, Homo sapiens
gaaagggagggctctgagg

SEQ ID NO: 2069373 - DNA, 20 bp, Homo sapiens
gaaagggagggctctgaggc

SEQ ID NO: 2069374 - DNA, 18 bp, Homo sapiens
gaaagggctatggcaagg

SEQ ID NO: 2069375 - DNA, 19 bp, Homo sapiens
gaaagggtcaacggccctg

SEQ ID NO: 2069376 - DNA, 22 bp, Homo sapiens
gaaagtacttctccaccctgct

SEQ ID NO: 2069377 - DNA, 14 bp, Homo sapiens
gaaagtatattttc

SEQ ID NO: 2069378 - DNA, 22 bp, Homo sapiens
gaaagtcgaattaatagctttt

SEQ ID NO: 2069379 - DNA, 16 bp, Homo sapiens
gaaagtctgtgtccaa

SEQ ID NO: 2069380 - DNA, 20 bp, Homo sapiens
gaaagtgaataaacttcagc

SEQ ID NO: 2069381 - DNA, 14 bp, Homo sapiens
gaaagtgacagaga

SEQ ID NO: 2069382 - DNA, 16 bp, Homo sapiens
gaaagtgccagaaagt

SEQ ID NO: 2069383 - DNA, 14 bp, Homo sapiens
gaaagttcagccag

SEQ ID NO: 2069384 - DNA, 22 bp, Homo sapiens
gaaataaaaagcatgactattt

SEQ ID NO: 2069385 - DNA, 23 bp, Homo sapiens
gaaataaaaagcatgactatttc

SEQ ID NO: 2069386 - DNA, 17 bp, Homo sapiens
gaaataaaacctttcaa

SEQ ID NO: 2069387 - DNA, 19 bp, Homo sapiens
gaaataaacctggagatga

SEQ ID NO: 2069388 - DNA, 20 bp, Homo sapiens
gaaataaattggtgataagt

SEQ ID NO: 2069389 - DNA, 23 bp, Homo sapiens
gaaataaattggtgataagtgga

SEQ ID NO: 2069390 - DNA, 14 bp, Homo sapiens
gaaatactgctctg

SEQ ID NO: 2069391 - DNA, 14 bp, Homo sapiens
gaaatatatataca

SEQ ID NO: 2069392 - DNA, 16 bp, Homo sapiens
gaaatatatatacata

SEQ ID NO: 2069393 - DNA, 21 bp, Homo sapiens
gaaatatcagttactcagccc

SEQ ID NO: 2069394 - DNA, 22 bp, Homo sapiens
gaaatatcagttactcagccct

SEQ ID NO: 2069395 - DNA, 23 bp, Homo sapiens
gaaatatcagttactcagccctg

SEQ ID NO: 2069396 - DNA, 13 bp, Homo sapiens
gaaatatgttcta

SEQ ID NO: 2069397 - DNA, 20 bp, Homo sapiens
gaaatatttgcttatttata

SEQ ID NO: 2069398 - DNA, 21 bp, Homo sapiens
gaaatatttgcttatttatat

SEQ ID NO: 2069399 - DNA, 17 bp, Homo sapiens
gaaatcaaatatgcaaa

SEQ ID NO: 2069400 - DNA, 22 bp, Homo sapiens
gaaatcacaggggcggggcagg

SEQ ID NO: 2069401 - DNA, 15 bp, Homo sapiens
gaaatccaggtctcg

SEQ ID NO: 2069402 - DNA, 19 bp, Homo sapiens
gaaatccagtttcccacca

SEQ ID NO: 2069403 - DNA, 22 bp, Homo sapiens
gaaatccctgtttaatatttaa

SEQ ID NO: 2069404 - DNA, 17 bp, Homo sapiens
gaaatctccagtgtgcg

SEQ ID NO: 2069405 - DNA, 22 bp, Homo sapiens
gaaatgaatttatctgaatata

SEQ ID NO: 2069406 - DNA, 14 bp, Homo sapiens
gaaatgataaagat

SEQ ID NO: 2069407 - DNA, 20 bp, Homo sapiens
gaaatgcattattttgaatg

SEQ ID NO: 2069408 - DNA, 18 bp, Homo sapiens
gaaatgctgttggtgaga

SEQ ID NO: 2069409 - DNA, 13 bp, Homo sapiens
gaaatggagggtg

SEQ ID NO: 2069410 - DNA, 15 bp, Homo sapiens
gaaatggagggtggg

SEQ ID NO: 2069411 - DNA, 17 bp, Homo sapiens
gaaatggtatgagctga

SEQ ID NO: 2069412 - DNA, 16 bp, Homo sapiens
gaaatgtctttctatt

SEQ ID NO: 2069413 - DNA, 18 bp, Homo sapiens
gaaattactacaaaattt

SEQ ID NO: 2069414 - DNA, 19 bp, Homo sapiens
gaaattactacaaaatttg

SEQ ID NO: 2069415 - DNA, 19 bp, Homo sapiens
gaaattagctgtgtgaaat

SEQ ID NO: 2069416 - DNA, 19 bp, Homo sapiens
gaaattatatctgtggtct

SEQ ID NO: 2069417 - DNA, 21 bp, Homo sapiens
gaaattcaacctgtgtcttat

SEQ ID NO: 2069418 - DNA, 15 bp, Homo sapiens
gaaattcacactgtg

SEQ ID NO: 2069419 - DNA, 20 bp, Homo sapiens
gaaattcagcttttgcagaa

SEQ ID NO: 2069420 - DNA, 22 bp, Homo sapiens
gaaattcccccacttgggagct

SEQ ID NO: 2069421 - DNA, 15 bp, Homo sapiens
gaaattcctgtagca

SEQ ID NO: 2069422 - DNA, 16 bp, Homo sapiens
gaaattcctgtagcat

SEQ ID NO: 2069423 - DNA, 12 bp, Homo sapiens
gaaattctgtgg

SEQ ID NO: 2069424 - DNA, 23 bp, Homo sapiens
gaaattgcctccttatttatcaa

SEQ ID NO: 2069425 - DNA, 17 bp, Homo sapiens
gaaattgcctgacgaac

SEQ ID NO: 2069426 - DNA, 13 bp, Homo sapiens
gaaattgctattt

SEQ ID NO: 2069427 - DNA, 14 bp, Homo sapiens
gaaattggctggat

SEQ ID NO: 2069428 - DNA, 15 bp, Homo sapiens
gaaattggctggatg

SEQ ID NO: 2069429 - DNA, 20 bp, Homo sapiens
gaaattgtctagcagagcag

SEQ ID NO: 2069430 - DNA, 17 bp, Homo sapiens
gaaatttaaaaataaag

SEQ ID NO: 2069431 - DNA, 20 bp, Homo sapiens
gaaatttaaaaataaagcta

SEQ ID NO: 2069432 - DNA, 13 bp, Homo sapiens
gaaatttaaacta

SEQ ID NO: 2069433 - DNA, 23 bp, Homo sapiens
gaaatttaaactataagcaagaa

SEQ ID NO: 2069434 - DNA, 20 bp, Homo sapiens
gaaatttactgtgagactgt

SEQ ID NO: 2069435 - DNA, 11 bp, Homo sapiens
gaaatttcaga

SEQ ID NO: 2069436 - DNA, 17 bp, Homo sapiens
gaacaaaaattgggttt

SEQ ID NO: 2069437 - DNA, 17 bp, Homo sapiens
gaacaaacactgaatca

SEQ ID NO: 2069438 - DNA, 12 bp, Homo sapiens
gaacaaactgat

SEQ ID NO: 2069439 - DNA, 14 bp, Homo sapiens
gaacaaactgatgc

SEQ ID NO: 2069440 - DNA, 22 bp, Homo sapiens
gaacaaatcacacctctgggct

SEQ ID NO: 2069441 - DNA, 15 bp, Homo sapiens
gaacaaatggccttt

SEQ ID NO: 2069442 - DNA, 14 bp, Homo sapiens
gaacaacaacaaca

SEQ ID NO: 2069443 - DNA, 18 bp, Homo sapiens
gaacaactatttataaac

SEQ ID NO: 2069444 - DNA, 19 bp, Homo sapiens
gaacaagttgtttcattga

SEQ ID NO: 2069445 - DNA, 20 bp, Homo sapiens
gaacaatagctattgcatgt

SEQ ID NO: 2069446 - DNA, 14 bp, Homo sapiens
gaacacactcagca

SEQ ID NO: 2069447 - DNA, 20 bp, Homo sapiens
gaacacagtttagtgcttta

SEQ ID NO: 2069448 - DNA, 17 bp, Homo sapiens
gaacaccaacttttatt

SEQ ID NO: 2069449 - DNA, 13 bp, Homo sapiens
gaacacccactgg

SEQ ID NO: 2069450 - DNA, 15 bp, Homo sapiens
gaacacccactggcc

SEQ ID NO: 2069451 - DNA, 22 bp, Homo sapiens
gaacacccactggccagtccta

SEQ ID NO: 2069452 - DNA, 21 bp, Homo sapiens
gaacacctttgttttgcactg

SEQ ID NO: 2069453 - DNA, 22 bp, Homo sapiens
gaacacgtccagaatttttcat

SEQ ID NO: 2069454 - DNA, 18 bp, Homo sapiens
gaacactgggggagggga

SEQ ID NO: 2069455 - DNA, 21 bp, Homo sapiens
gaacagaaaacaaaagagaga

SEQ ID NO: 2069456 - DNA, 23 bp, Homo sapiens
gaacagaacatagacagaagaaa

SEQ ID NO: 2069457 - DNA, 14 bp, Homo sapiens
gaacagaaggatga

SEQ ID NO: 2069458 - DNA, 17 bp, Homo sapiens
gaacagacaacagaagt

SEQ ID NO: 2069459 - DNA, 18 bp, Homo sapiens
gaacagacaacagaagtc

SEQ ID NO: 2069460 - DNA, 15 bp, Homo sapiens
gaacagacaggagaa

SEQ ID NO: 2069461 - DNA, 15 bp, Homo sapiens
gaacagactggaagc

SEQ ID NO: 2069462 - DNA, 19 bp, Homo sapiens
gaacagactggaagcacag

SEQ ID NO: 2069463 - DNA, 19 bp, Homo sapiens
gaacagagactctggaagc

SEQ ID NO: 2069464 - DNA, 21 bp, Homo sapiens
gaacagcagactcagctctga

SEQ ID NO: 2069465 - DNA, 22 bp, Homo sapiens
gacagacacaggcccggctcca

SEQ ID NO: 2069466 - DNA, 22 bp, Homo sapiens
gacagaccggggttcaagccat

SEQ ID NO: 2069467 - DNA, 13 bp, Homo sapiens
gaccacctgccag

SEQ ID NO: 2069468 - DNA, 14 bp, Homo sapiens
gaccacctgccagc

SEQ ID NO: 2069469 - DNA, 18 bp, Homo sapiens
gaccacctgccagccatc

SEQ ID NO: 2069470 - DNA, 13 bp, Homo sapiens
gaccacctgccca

SEQ ID NO: 2069471 - DNA, 17 bp, Homo sapiens
gaccacctgcttctgaa

SEQ ID NO: 2069472 - DNA, 21 bp, Homo sapiens
gaccacgctttctagctgttg

SEQ ID NO: 2069473 - DNA, 21 bp, Homo sapiens
gaccacggacgtttccatcag

SEQ ID NO: 2069474 - DNA, 14 bp, Homo sapiens
gaccactgttatca

SEQ ID NO: 2069475 - DNA, 11 bp, Homo sapiens
gaccagaatgc

SEQ ID NO: 2069476 - DNA, 21 bp, Homo sapiens
gaccagacaccttgacagggc

SEQ ID NO: 2069477 - DNA, 22 bp, Homo sapiens
gaccagacaccttgacagggca

SEQ ID NO: 2069478 - DNA, 24 bp, Homo sapiens
gaccagacaccttgacagggcaca

SEQ ID NO: 2069479 - DNA, 11 bp, Homo sapiens
gaccagaccta

SEQ ID NO: 2069480 - DNA, 17 bp, Homo sapiens
gaccagacctagacctg

SEQ ID NO: 2069481 - DNA, 20 bp, Homo sapiens
gaccagacctagacctgggc

SEQ ID NO: 2069482 - DNA, 17 bp, Homo sapiens
gaccagaggaagcccct

SEQ ID NO: 2069483 - DNA, 13 bp, Homo sapiens
gaccagcaaatac

SEQ ID NO: 2069484 - DNA, 17 bp, Homo sapiens
gaccagctcagaggccc

SEQ ID NO: 2069485 - DNA, 14 bp, Homo sapiens
gaccaggactatag

SEQ ID NO: 2069486 - DNA, 21 bp, Homo sapiens
gaccaggttattttaaaaaga

SEQ ID NO: 2069487 - DNA, 20 bp, Homo sapiens
gaccagtactgggaaggagg

SEQ ID NO: 2069488 - DNA, 16 bp, Homo sapiens
gaccagtcccagagca

SEQ ID NO: 2069489 - DNA, 18 bp, Homo sapiens
gaccatcgtccttcctct

SEQ ID NO: 2069490 - DNA, 16 bp, Homo sapiens
gaccatgaagagactc

SEQ ID NO: 2069491 - DNA, 16 bp, Homo sapiens
gaccattgacctcagc

SEQ ID NO: 2069492 - DNA, 13 bp, Homo sapiens
gaccatttaacat

SEQ ID NO: 2069493 - DNA, 13 bp, Homo sapiens
gacccaaagacca

SEQ ID NO: 2069494 - DNA, 15 bp, Homo sapiens
gacccaagaggtggg

SEQ ID NO: 2069495 - DNA, 13 bp, Homo sapiens
gacccaaggagga

SEQ ID NO: 2069496 - DNA, 14 bp, Homo sapiens
gacccacagcctct

SEQ ID NO: 2069497 - DNA, 14 bp, Homo sapiens
gacccacatgccat

SEQ ID NO: 2069498 - DNA, 18 bp, Homo sapiens
gacccacgtgctagggga

SEQ ID NO: 2069499 - DNA, 16 bp, Homo sapiens
gacccactcacacttg

SEQ ID NO: 2069500 - DNA, 15 bp, Homo sapiens
gacccagatctcatg

SEQ ID NO: 2069501 - DNA, 16 bp, Homo sapiens
gacccagctactctgt

SEQ ID NO: 2069502 - DNA, 19 bp, Homo sapiens
gacccagctactctgtcca

SEQ ID NO: 2069503 - DNA, 12 bp, Homo sapiens
gacccaggccct

SEQ ID NO: 2069504 - DNA, 14 bp, Homo sapiens
gacccagtccctgg

SEQ ID NO: 2069505 - DNA, 15 bp, Homo sapiens
gacccagtccctggg

SEQ ID NO: 2069506 - DNA, 12 bp, Homo sapiens
gacccagtgaga

SEQ ID NO: 2069507 - DNA, 19 bp, Homo sapiens
gaccccaaagagcctggag

SEQ ID NO: 2069508 - DNA, 14 bp, Homo sapiens
gaccccactggact

SEQ ID NO: 2069509 - DNA, 16 bp, Homo sapiens
gaccccagctagggct

SEQ ID NO: 2069510 - DNA, 19 bp, Homo sapiens
gaccccaggatcccagagc

SEQ ID NO: 2069511 - DNA, 11 bp, Homo sapiens
gaccccagggc

SEQ ID NO: 2069512 - DNA, 16 bp, Homo sapiens
gaccccagggcacagg

SEQ ID NO: 2069513 - DNA, 17 bp, Homo sapiens
gaccccagggcacagga

SEQ ID NO: 2069514 - DNA, 14 bp, Homo sapiens
gaccccatctcatt

SEQ ID NO: 2069515 - DNA, 12 bp, Homo sapiens
gaccccatctct

SEQ ID NO: 2069516 - DNA, 12 bp, Homo sapiens
gacccccaacca

SEQ ID NO: 2069517 - DNA, 19 bp, Homo sapiens
gacccccactctcattccc

SEQ ID NO: 2069518 - DNA, 14 bp, Homo sapiens
gaccccctcccctg

SEQ ID NO: 2069519 - DNA, 17 bp, Homo sapiens
gaccccctggccctgcc

SEQ ID NO: 2069520 - DNA, 21 bp, Homo sapiens
gaccccgcctcccagccccag

SEQ ID NO: 2069521 - DNA, 12 bp, Homo sapiens
gacccctcagtg

SEQ ID NO: 2069522 - DNA, 14 bp, Homo sapiens
gacccctccatgtg

SEQ ID NO: 2069523 - DNA, 22 bp, Homo sapiens
gacccctggcttttcactgctg

SEQ ID NO: 2069524 - DNA, 11 bp, Homo sapiens
gacccctgtgg

SEQ ID NO: 2069525 - DNA, 15 bp, Homo sapiens
gacccctgtggcaga

SEQ ID NO: 2069526 - DNA, 23 bp, Homo sapiens
gaccccttggcttttgcttggca

SEQ ID NO: 2069527 - DNA, 20 bp, Homo sapiens
gacccctttcccccacccca

SEQ ID NO: 2069528 - DNA, 13 bp, Homo sapiens
gacccgctctgga

SEQ ID NO: 2069529 - DNA, 14 bp, Homo sapiens
gacccgctctggac

SEQ ID NO: 2069530 - DNA, 19 bp, Homo sapiens
gacccggaggggcctggca

SEQ ID NO: 2069531 - DNA, 20 bp, Homo sapiens
gacccggaggggcctggcag

SEQ ID NO: 2069532 - DNA, 19 bp, Homo sapiens
gacccggcaccccctgcag

SEQ ID NO: 2069533 - DNA, 13 bp, Homo sapiens
gacccggctgcgt

SEQ ID NO: 2069534 - DNA, 16 bp, Homo sapiens
gaccctaccccaccac

SEQ ID NO: 2069535 - DNA, 17 bp, Homo sapiens
gaccctacttcctgcac

SEQ ID NO: 2069536 - DNA, 21 bp, Homo sapiens
gaccctacttcctgcactgac

SEQ ID NO: 2069537 - DNA, 21 bp, Homo sapiens
gaccctccaccgcagaaggaa

SEQ ID NO: 2069538 - DNA, 15 bp, Homo sapiens
gaccctccccgcacc

SEQ ID NO: 2069539 - DNA, 21 bp, Homo sapiens
gaccctcctccactccacctc

SEQ ID NO: 2069540 - DNA, 19 bp, Homo sapiens
gaccctcctcctcccccag

SEQ ID NO: 2069541 - DNA, 14 bp, Homo sapiens
gaccctcctgtcca

SEQ ID NO: 2069542 - DNA, 17 bp, Homo sapiens
gaccctcctgtccagca

SEQ ID NO: 2069543 - DNA, 12 bp, Homo sapiens
gaccctcgcagc

SEQ ID NO: 2069544 - DNA, 13 bp, Homo sapiens
gaccctcgcagca

SEQ ID NO: 2069545 - DNA, 17 bp, Homo sapiens
gaccctcgcagcaggtg

SEQ ID NO: 2069546 - DNA, 19 bp, Homo sapiens
gaccctcgcagcaggtgca

SEQ ID NO: 2069547 - DNA, 23 bp, Homo sapiens
gaccctctgaatggtccagggtt

SEQ ID NO: 2069548 - DNA, 19 bp, Homo sapiens
gaccctgagtccgggaggc

SEQ ID NO: 2069549 - DNA, 16 bp, Homo sapiens
gaccctgcccataccc

SEQ ID NO: 2069550 - DNA, 22 bp, Homo sapiens
gaccctgcccatacccctgcct

SEQ ID NO: 2069551 - DNA, 16 bp, Homo sapiens
gaccctgcctgagccc

SEQ ID NO: 2069552 - DNA, 22 bp, Homo sapiens
gaccctggaattcagcaccctg

SEQ ID NO: 2069553 - DNA, 21 bp, Homo sapiens
gaccctggagcggctctcctg

SEQ ID NO: 2069554 - DNA, 12 bp, Homo sapiens
gaccctggctct

SEQ ID NO: 2069555 - DNA, 14 bp, Homo sapiens
gaccctggctcttc

SEQ ID NO: 2069556 - DNA, 16 bp, Homo sapiens
gaccctggctcttctc

SEQ ID NO: 2069557 - DNA, 22 bp, Homo sapiens
gaccctggttactctggtgctg

SEQ ID NO: 2069558 - DNA, 19 bp, Homo sapiens
gaccctgtagagtcactga

SEQ ID NO: 2069559 - DNA, 17 bp, Homo sapiens
gacccttcagggccaga

SEQ ID NO: 2069560 - DNA, 20 bp, Homo sapiens
gacccttccagacatacgaa

SEQ ID NO: 2069561 - DNA, 23 bp, Homo sapiens
gacccttcccaatcagcactgaa

SEQ ID NO: 2069562 - DNA, 20 bp, Homo sapiens
gaccgcgtagagagccgggc

SEQ ID NO: 2069563 - DNA, 21 bp, Homo sapiens
gaccgctacaccactctggca

SEQ ID NO: 2069564 - DNA, 23 bp, Homo sapiens
gaccgctacaccactctggcagc

SEQ ID NO: 2069565 - DNA, 14 bp, Homo sapiens
gaccgcttcccaga

SEQ ID NO: 2069566 - DNA, 18 bp, Homo sapiens
gaccgggtgggcctggcc

SEQ ID NO: 2069567 - DNA, 21 bp, Homo sapiens
gaccgggtgggcctggcctga

SEQ ID NO: 2069568 - DNA, 16 bp, Homo sapiens
gaccgtgtcccaagga

SEQ ID NO: 2069569 - DNA, 20 bp, Homo sapiens
gaccgtgtcccaaggagctg

SEQ ID NO: 2069570 - DNA, 21 bp, Homo sapiens
gaccgttttcatcctggcctc

SEQ ID NO: 2069571 - DNA, 17 bp, Homo sapiens
gacctagacctgggcca

SEQ ID NO: 2069572 - DNA, 20 bp, Homo sapiens
gacctcaagtgatccacctg

SEQ ID NO: 2069573 - DNA, 20 bp, Homo sapiens
gacctcaccggcatgctggc

SEQ ID NO: 2069574 - DNA, 18 bp, Homo sapiens
gaggactagaacctggag

SEQ ID NO: 2069575 - DNA, 18 bp, Homo sapiens
gaggactccgggaccatt

SEQ ID NO: 2069576 - DNA, 11 bp, Homo sapiens
gaggactgaga

SEQ ID NO: 2069577 - DNA, 16 bp, Homo sapiens
gaggacttgtgtctct

SEQ ID NO: 2069578 - DNA, 22 bp, Homo sapiens
gaggacttgtgtctctgtgctt

SEQ ID NO: 2069579 - DNA, 20 bp, Homo sapiens
gaggacttttctttgtggct

SEQ ID NO: 2069580 - DNA, 23 bp, Homo sapiens
gaggacttttctttgtggcttcc

SEQ ID NO: 2069581 - DNA, 12 bp, Homo sapiens
gaggagaaataa

SEQ ID NO: 2069582 - DNA, 13 bp, Homo sapiens
gaggagaaataaa

SEQ ID NO: 2069583 - DNA, 12 bp, Homo sapiens
gaggagaagaat

SEQ ID NO: 2069584 - DNA, 20 bp, Homo sapiens
gaggagaagaattttcagac

SEQ ID NO: 2069585 - DNA, 22 bp, Homo sapiens
gaggagaagaattttcagaccc

SEQ ID NO: 2069586 - DNA, 13 bp, Homo sapiens
gaggagaccagct

SEQ ID NO: 2069587 - DNA, 12 bp, Homo sapiens
gaggagagaagg

SEQ ID NO: 2069588 - DNA, 16 bp, Homo sapiens
gaggagcacctgaacc

SEQ ID NO: 2069589 - DNA, 20 bp, Homo sapiens
gaggagcttccagtgcatgt

SEQ ID NO: 2069590 - DNA, 15 bp, Homo sapiens
gaggagcttggggga

SEQ ID NO: 2069591 - DNA, 12 bp, Homo sapiens
gaggaggagctg

SEQ ID NO: 2069592 - DNA, 14 bp, Homo sapiens
gaggaggaggaagg

SEQ ID NO: 2069593 - DNA, 15 bp, Homo sapiens
gaggaggaggaaggc

SEQ ID NO: 2069594 - DNA, 15 bp, Homo sapiens
gaggagggtgccctc

SEQ ID NO: 2069595 - DNA, 18 bp, Homo sapiens
gaggaggtggcagccctg

SEQ ID NO: 2069596 - DNA, 22 bp, Homo sapiens
gaggaggtggcagccctgtagg

SEQ ID NO: 2069597 - DNA, 20 bp, Homo sapiens
gaggagtagctgagaggaag

SEQ ID NO: 2069598 - DNA, 14 bp, Homo sapiens
gaggagtctgaggt

SEQ ID NO: 2069599 - DNA, 22 bp, Homo sapiens
gaggagtctgaggtcctgagca

SEQ ID NO: 2069600 - DNA, 23 bp, Homo sapiens
gaggagtctgaggtcctgagcac

SEQ ID NO: 2069601 - DNA, 18 bp, Homo sapiens
gaggatcacagtgctgag

SEQ ID NO: 2069602 - DNA, 15 bp, Homo sapiens
gaggatctagcttca

SEQ ID NO: 2069603 - DNA, 18 bp, Homo sapiens
gaggatgaatagatgtga

SEQ ID NO: 2069604 - DNA, 22 bp, Homo sapiens
gaggatgaatagatgtgatcac

SEQ ID NO: 2069605 - DNA, 22 bp, Homo sapiens
gaggatgatttcagaaggagaa

SEQ ID NO: 2069606 - DNA, 14 bp, Homo sapiens
gaggatgcagaggg

SEQ ID NO: 2069607 - DNA, 14 bp, Homo sapiens
gaggatgccacagc

SEQ ID NO: 2069608 - DNA, 22 bp, Homo sapiens
gaggatgccacagccccacagc

SEQ ID NO: 2069609 - DNA, 18 bp, Homo sapiens
gaggattgcttgagccca

SEQ ID NO: 2069610 - DNA, 18 bp, Homo sapiens
gaggatttaactgtgaac

SEQ ID NO: 2069611 - DNA, 14 bp, Homo sapiens
gaggattttccagt

SEQ ID NO: 2069612 - DNA, 22 bp, Homo sapiens
gaggattttccagttctgacac

SEQ ID NO: 2069613 - DNA, 14 bp, Homo sapiens
gaggcaccagctct

SEQ ID NO: 2069614 - DNA, 19 bp, Homo sapiens
gaggcaccagctctgtggc

SEQ ID NO: 2069615 - DNA, 22 bp, Homo sapiens
gaggcaccagctctgtggcctg

SEQ ID NO: 2069616 - DNA, 20 bp, Homo sapiens
gaggcaccggcgctgcaggt

SEQ ID NO: 2069617 - DNA, 23 bp, Homo sapiens
gaggcagaagaattgaacccagg

SEQ ID NO: 2069618 - DNA, 22 bp, Homo sapiens
gaggcagacttccctgaatgta

SEQ ID NO: 2069619 - DNA, 19 bp, Homo sapiens
gaggcagagaaagaagaga

SEQ ID NO: 2069620 - DNA, 21 bp, Homo sapiens
gaggcagagaaagaagagaca

SEQ ID NO: 2069621 - DNA, 16 bp, Homo sapiens
gaggcagagaagaaag

SEQ ID NO: 2069622 - DNA, 21 bp, Homo sapiens
gaggcagccccattctgcctg

SEQ ID NO: 2069623 - DNA, 12 bp, Homo sapiens
gaggcagctcca

SEQ ID NO: 2069624 - DNA, 23 bp, Homo sapiens
gaggcaggaggattgcttgagcc

SEQ ID NO: 2069625 - DNA, 16 bp, Homo sapiens
gaggcaggctccccct

SEQ ID NO: 2069626 - DNA, 21 bp, Homo sapiens
gaggcaggctccccctgcctt

SEQ ID NO: 2069627 - DNA, 19 bp, Homo sapiens
gaggcagggcaaatgacat

SEQ ID NO: 2069628 - DNA, 18 bp, Homo sapiens
gaggcagggccttgccca

SEQ ID NO: 2069629 - DNA, 18 bp, Homo sapiens
gaggcagggtctcactct

SEQ ID NO: 2069630 - DNA, 13 bp, Homo sapiens
gaggcatggccct

SEQ ID NO: 2069631 - DNA, 15 bp, Homo sapiens
gaggcatggctgggg

SEQ ID NO: 2069632 - DNA, 14 bp, Homo sapiens
gaggccaaggcagg

SEQ ID NO: 2069633 - DNA, 16 bp, Homo sapiens
gaggccaaggcaggta

SEQ ID NO: 2069634 - DNA, 12 bp, Homo sapiens
gaggccaaggtg

SEQ ID NO: 2069635 - DNA, 15 bp, Homo sapiens
gaggccagcctggcc

SEQ ID NO: 2069636 - DNA, 19 bp, Homo sapiens
gaggccaggaatctgccat

SEQ ID NO: 2069637 - DNA, 21 bp, Homo sapiens
gaggccatgggcctcctgtgt

SEQ ID NO: 2069638 - DNA, 15 bp, Homo sapiens
gaggcccagccgcag

SEQ ID NO: 2069639 - DNA, 16 bp, Homo sapiens
gaggcccagccgcagg

SEQ ID NO: 2069640 - DNA, 18 bp, Homo sapiens
gaggcccagcctgtcctg

SEQ ID NO: 2069641 - DNA, 15 bp, Homo sapiens
gaggcccagggagca

SEQ ID NO: 2069642 - DNA, 12 bp, Homo sapiens
gaggccctggat

SEQ ID NO: 2069643 - DNA, 22 bp, Homo sapiens
gaggccctggatcagcgtggcc

SEQ ID NO: 2069644 - DNA, 20 bp, Homo sapiens
gaggccctggtgtcaggcag

SEQ ID NO: 2069645 - DNA, 21 bp, Homo sapiens
gaggccctggtgtcaggcagg

SEQ ID NO: 2069646 - DNA, 19 bp, Homo sapiens
gaggcctaaaagtaaacat

SEQ ID NO: 2069647 - DNA, 20 bp, Homo sapiens
gaggcctcacacccagaggg

SEQ ID NO: 2069648 - DNA, 12 bp, Homo sapiens
gaggcctcagtt

SEQ ID NO: 2069649 - DNA, 23 bp, Homo sapiens
gaggcctcagtttctccatcagc

SEQ ID NO: 2069650 - DNA, 19 bp, Homo sapiens
gaggcctcgtaccagccag

SEQ ID NO: 2069651 - DNA, 15 bp, Homo sapiens
gagtggccggggaag

SEQ ID NO: 2069652 - DNA, 24 bp, Homo sapiens
gagtggctgaaataaaagcctctg

SEQ ID NO: 2069653 - DNA, 18 bp, Homo sapiens
gagtgtagcaactacagt

SEQ ID NO: 2069654 - DNA, 19 bp, Homo sapiens
gagtgtcttaattaaaaga

SEQ ID NO: 2069655 - DNA, 19 bp, Homo sapiens
gagttacagcgagaggcag

SEQ ID NO: 2069656 - DNA, 20 bp, Homo sapiens
gagttacagcgagaggcaga

SEQ ID NO: 2069657 - DNA, 17 bp, Homo sapiens
gagttacattaatgtta

SEQ ID NO: 2069658 - DNA, 23 bp, Homo sapiens
gagttattttaattatcttttct

SEQ ID NO: 2069659 - DNA, 19 bp, Homo sapiens
gagttcaagaccagcctgg

SEQ ID NO: 2069660 - DNA, 12 bp, Homo sapiens
gagttcctgcat

SEQ ID NO: 2069661 - DNA, 21 bp, Homo sapiens
gagttcgagaccagcctggcc

SEQ ID NO: 2069662 - DNA, 19 bp, Homo sapiens
gagttcgaggctgcagtca

SEQ ID NO: 2069663 - DNA, 20 bp, Homo sapiens
gagttctttaggtgcctcct

SEQ ID NO: 2069664 - DNA, 22 bp, Homo sapiens
gagttctttaggtgcctcctgt

SEQ ID NO: 2069665 - DNA, 22 bp, Homo sapiens
gagttgaccgttttcatcctgg

SEQ ID NO: 2069666 - DNA, 19 bp, Homo sapiens
gagttgacgcatcctgcag

SEQ ID NO: 2069667 - DNA, 17 bp, Homo sapiens
gagttgagtctcctctc

SEQ ID NO: 2069668 - DNA, 22 bp, Homo sapiens
gagttgagtctcctctctgaga

SEQ ID NO: 2069669 - DNA, 15 bp, Homo sapiens
gagttgctcactcag

SEQ ID NO: 2069670 - DNA, 18 bp, Homo sapiens
gagttgctcactcaggac

SEQ ID NO: 2069671 - DNA, 16 bp, Homo sapiens
gagttggacacactgt

SEQ ID NO: 2069672 - DNA, 17 bp, Homo sapiens
gagttggctcaggcaga

SEQ ID NO: 2069673 - DNA, 18 bp, Homo sapiens
gagttggctcaggcagac

SEQ ID NO: 2069674 - DNA, 16 bp, Homo sapiens
gagtttaagtctctga

SEQ ID NO: 2069675 - DNA, 19 bp, Homo sapiens
gagtttcattctcctgcct

SEQ ID NO: 2069676 - DNA, 20 bp, Homo sapiens
gagtttcattctcctgcctg

SEQ ID NO: 2069677 - DNA, 22 bp, Homo sapiens
gagtttgaaggaggtgagggat

SEQ ID NO: 2069678 - DNA, 21 bp, Homo sapiens
gagtttgagacaagccctggc

SEQ ID NO: 2069679 - DNA, 19 bp, Homo sapiens
gataaaattgtgatgtttt

SEQ ID NO: 2069680 - DNA, 21 bp, Homo sapiens
gataaacacagaggttttaaa

SEQ ID NO: 2069681 - DNA, 13 bp, Homo sapiens
gataaacattaaa

SEQ ID NO: 2069682 - DNA, 19 bp, Homo sapiens
gataaacattaaacactgt

SEQ ID NO: 2069683 - DNA, 13 bp, Homo sapiens
gataaagatgatc

SEQ ID NO: 2069684 - DNA, 18 bp, Homo sapiens
gataaataatcggcccac

SEQ ID NO: 2069685 - DNA, 13 bp, Homo sapiens
gataaatatttat

SEQ ID NO: 2069686 - DNA, 12 bp, Homo sapiens
gataaattataa

SEQ ID NO: 2069687 - DNA, 16 bp, Homo sapiens
gataacaaaatcacaa

SEQ ID NO: 2069688 - DNA, 17 bp, Homo sapiens
gataacaaaatcacaag

SEQ ID NO: 2069689 - DNA, 20 bp, Homo sapiens
gataacaaaatcacaagcaa

SEQ ID NO: 2069690 - DNA, 18 bp, Homo sapiens
gataacaagcaaggatat

SEQ ID NO: 2069691 - DNA, 13 bp, Homo sapiens
gataacagaggca

SEQ ID NO: 2069692 - DNA, 17 bp, Homo sapiens
gataacctatatgattt

SEQ ID NO: 2069693 - DNA, 21 bp, Homo sapiens
gataactgcaattttaattga

SEQ ID NO: 2069694 - DNA, 12 bp, Homo sapiens
gagcactgccag

SEQ ID NO: 2069695 - DNA, 14 bp, Homo sapiens
gagcactgccagga

SEQ ID NO: 2069696 - DNA, 20 bp, Homo sapiens
gagcactgccaggagggaca

SEQ ID NO: 2069697 - DNA, 14 bp, Homo sapiens
gagcactggccaga

SEQ ID NO: 2069698 - DNA, 18 bp, Homo sapiens
gagcactggccagagagg

SEQ ID NO: 2069699 - DNA, 17 bp, Homo sapiens
gagcagaaagccagggt

SEQ ID NO: 2069700 - DNA, 23 bp, Homo sapiens
gagcagaacggagccccaggcct

SEQ ID NO: 2069701 - DNA, 21 bp, Homo sapiens
gagcagacaggaggaatcatg

SEQ ID NO: 2069702 - DNA, 12 bp, Homo sapiens
gagcagagagct

SEQ ID NO: 2069703 - DNA, 20 bp, Homo sapiens
gagcagagctgatggagaag

SEQ ID NO: 2069704 - DNA, 13 bp, Homo sapiens
gagcagcctgatg

SEQ ID NO: 2069705 - DNA, 14 bp, Homo sapiens
gagcagcctgatgg

SEQ ID NO: 2069706 - DNA, 13 bp, Homo sapiens
gagcagctgagca

SEQ ID NO: 2069707 - DNA, 14 bp, Homo sapiens
gagcagctgagcag

SEQ ID NO: 2069708 - DNA, 18 bp, Homo sapiens
gagcagctgagcagggcc

SEQ ID NO: 2069709 - DNA, 20 bp, Homo sapiens
gagcagctgagcagggccgg

SEQ ID NO: 2069710 - DNA, 15 bp, Homo sapiens
gagcagctggctctc

SEQ ID NO: 2069711 - DNA, 17 bp, Homo sapiens
gagcagctggctctcca

SEQ ID NO: 2069712 - DNA, 22 bp, Homo sapiens
gagcaggaacagagactctgga

SEQ ID NO: 2069713 - DNA, 19 bp, Homo sapiens
gagcaggccacgctcaggc

SEQ ID NO: 2069714 - DNA, 15 bp, Homo sapiens
gagcagggccgggga

SEQ ID NO: 2069715 - DNA, 22 bp, Homo sapiens
gagcagggccggggaactggcc

SEQ ID NO: 2069716 - DNA, 16 bp, Homo sapiens
gagcaggggcagggtg

SEQ ID NO: 2069717 - DNA, 18 bp, Homo sapiens
gagcaggggtctgagcca

SEQ ID NO: 2069718 - DNA, 12 bp, Homo sapiens
gagcagggtcct

SEQ ID NO: 2069719 - DNA, 13 bp, Homo sapiens
gagcagggtcctg

SEQ ID NO: 2069720 - DNA, 14 bp, Homo sapiens
gagcaggtctctgg

SEQ ID NO: 2069721 - DNA, 15 bp, Homo sapiens
gagcaggtctctggc

SEQ ID NO: 2069722 - DNA, 14 bp, Homo sapiens
gagcagtcacactg

SEQ ID NO: 2069723 - DNA, 16 bp, Homo sapiens
gagcagtcacactgtt

SEQ ID NO: 2069724 - DNA, 19 bp, Homo sapiens
gagcagtcacactgttact

SEQ ID NO: 2069725 - DNA, 22 bp, Homo sapiens
gagcagtggccgcaagcgcagg

SEQ ID NO: 2069726 - DNA, 21 bp, Homo sapiens
gagcagtgggagggtaccagc

SEQ ID NO: 2069727 - DNA, 11 bp, Homo sapiens
gagcagtgtct

SEQ ID NO: 2069728 - DNA, 19 bp, Homo sapiens
gagcagtgtcttccataat

SEQ ID NO: 2069729 - DNA, 16 bp, Homo sapiens
gagcatcatgcctctg

SEQ ID NO: 2069730 - DNA, 18 bp, Homo sapiens
gagcatcatgcctctgag

SEQ ID NO: 2069731 - DNA, 21 bp, Homo sapiens
gagcatcatgcctctgaggcc

SEQ ID NO: 2069732 - DNA, 23 bp, Homo sapiens
gagcatcatgcctctgaggccag

SEQ ID NO: 2069733 - DNA, 24 bp, Homo sapiens
gagcatcatgcctctgaggccagc

SEQ ID NO: 2069734 - DNA, 19 bp, Homo sapiens
gagcatcgtgacccttcag

SEQ ID NO: 2069735 - DNA, 13 bp, Homo sapiens
gagcatctgactc

SEQ ID NO: 2069736 - DNA, 15 bp, Homo sapiens
gagcatgcacagctg

SEQ ID NO: 2069737 - DNA, 16 bp, Homo sapiens
gagcatgcacagctgc

SEQ ID NO: 2069738 - DNA, 18 bp, Homo sapiens
gagcatgcacagctgctt

SEQ ID NO: 2069739 - DNA, 20 bp, Homo sapiens
gagcatgcacagctgcttgt

SEQ ID NO: 2069740 - DNA, 14 bp, Homo sapiens
gagcatggctgtga

SEQ ID NO: 2069741 - DNA, 16 bp, Homo sapiens
gagcatggctgtgagg

SEQ ID NO: 2069742 - DNA, 19 bp, Homo sapiens
gagcatggctgtgaggatg

SEQ ID NO: 2069743 - DNA, 21 bp, Homo sapiens
gagcatggctgtgaggatggg

SEQ ID NO: 2069744 - DNA, 21 bp, Homo sapiens
gagcatggggataaaggagaa

SEQ ID NO: 2069745 - DNA, 13 bp, Homo sapiens
gagcatgggtgtg

SEQ ID NO: 2069746 - DNA, 18 bp, Homo sapiens
gagcattacgtgagccag

SEQ ID NO: 2069747 - DNA, 16 bp, Homo sapiens
gagcatttccctcccg

SEQ ID NO: 2069748 - DNA, 23 bp, Homo sapiens
gagccaactcactcttatgaaat

SEQ ID NO: 2069749 - DNA, 18 bp, Homo sapiens
gagccaagcttcaaccct

SEQ ID NO: 2069750 - DNA, 16 bp, Homo sapiens
gagccacagaccacct

SEQ ID NO: 2069751 - DNA, 18 bp, Homo sapiens
gagccacagaccacctgc

SEQ ID NO: 2069752 - DNA, 15 bp, Homo sapiens
gagccactacctttg

SEQ ID NO: 2069753 - DNA, 15 bp, Homo sapiens
gagccactcctgtcc

SEQ ID NO: 2069754 - DNA, 21 bp, Homo sapiens
gagccactcgcagtcgcagga

SEQ ID NO: 2069755 - DNA, 13 bp, Homo sapiens
gagccactgcacc

SEQ ID NO: 2069756 - DNA, 19 bp, Homo sapiens
gagccactgcaccgggcca

SEQ ID NO: 2069757 - DNA, 22 bp, Homo sapiens
gagccagaagtaaagtttattt

SEQ ID NO: 2069758 - DNA, 13 bp, Homo sapiens
gagccagccctcc

SEQ ID NO: 2069759 - DNA, 16 bp, Homo sapiens
gagccagccctccctg

SEQ ID NO: 2069760 - DNA, 19 bp, Homo sapiens
gagccagccctccctgtcc

SEQ ID NO: 2069761 - DNA, 20 bp, Homo sapiens
gagccagccctccctgtcct

SEQ ID NO: 2069762 - DNA, 21 bp, Homo sapiens
gagccagccctccctgtcctc

SEQ ID NO: 2069763 - DNA, 15 bp, Homo sapiens
gagccagcctgggac

SEQ ID NO: 2069764 - DNA, 18 bp, Homo sapiens
gagccaggtaatgaggga

SEQ ID NO: 2069765 - DNA, 19 bp, Homo sapiens
gagccaggtaatgagggac

SEQ ID NO: 2069766 - DNA, 19 bp, Homo sapiens
gagccatgggcctgggcct

SEQ ID NO: 2069767 - DNA, 23 bp, Homo sapiens
gagccattttggggggcccccct

SEQ ID NO: 2069768 - DNA, 15 bp, Homo sapiens
gagcccaagtgccat

SEQ ID NO: 2069769 - DNA, 17 bp, Homo sapiens
gagcccagaaaacctcc

SEQ ID NO: 2069770 - DNA, 14 bp, Homo sapiens
gagcccagagggcc

SEQ ID NO: 2069771 - DNA, 18 bp, Homo sapiens
gagcccagccacctccca

SEQ ID NO: 2069772 - DNA, 22 bp, Homo sapiens
gagcccagccacctcccaagga

SEQ ID NO: 2069773 - DNA, 19 bp, Homo sapiens
gagcccagctacattcctc

SEQ ID NO: 2069774 - DNA, 23 bp, Homo sapiens
gagcccaggagttcgaggctgca

SEQ ID NO: 2069775 - DNA, 11 bp, Homo sapiens
gagcccaggcc

SEQ ID NO: 2069776 - DNA, 15 bp, Homo sapiens
gagcccagggaggcc

SEQ ID NO: 2069777 - DNA, 17 bp, Homo sapiens
gacctcaggcggggagg

SEQ ID NO: 2069778 - DNA, 20 bp, Homo sapiens
gacctcaggtgatccaccca

SEQ ID NO: 2069779 - DNA, 20 bp, Homo sapiens
gacctcagttttatcatttt

SEQ ID NO: 2069780 - DNA, 21 bp, Homo sapiens
gacctcatatcttcctcatca

SEQ ID NO: 2069781 - DNA, 18 bp, Homo sapiens
gacctccagctttcctgt

SEQ ID NO: 2069782 - DNA, 16 bp, Homo sapiens
gacctcgtcctccccc

SEQ ID NO: 2069783 - DNA, 19 bp, Homo sapiens
gacctcgtcctccccctgc

SEQ ID NO: 2069784 - DNA, 13 bp, Homo sapiens
gacctctgatccc

SEQ ID NO: 2069785 - DNA, 14 bp, Homo sapiens
gacctctgatccct

SEQ ID NO: 2069786 - DNA, 13 bp, Homo sapiens
gacctctgcctga

SEQ ID NO: 2069787 - DNA, 15 bp, Homo sapiens
gacctctgctctgag

SEQ ID NO: 2069788 - DNA, 21 bp, Homo sapiens
gacctgaagggtgacatccca

SEQ ID NO: 2069789 - DNA, 22 bp, Homo sapiens
gacctgacaccgtccctcagtg

SEQ ID NO: 2069790 - DNA, 16 bp, Homo sapiens
gacctgaccggcacct

SEQ ID NO: 2069791 - DNA, 15 bp, Homo sapiens
gacctgactattgaa

SEQ ID NO: 2069792 - DNA, 13 bp, Homo sapiens
gacctgagcctgc

SEQ ID NO: 2069793 - DNA, 16 bp, Homo sapiens
gacctgagcctgccga

SEQ ID NO: 2069794 - DNA, 17 bp, Homo sapiens
gacctgagcctgccgag

SEQ ID NO: 2069795 - DNA, 16 bp, Homo sapiens
gacctgaggcagatga

SEQ ID NO: 2069796 - DNA, 18 bp, Homo sapiens
gacctgaggctcctgtgc

SEQ ID NO: 2069797 - DNA, 22 bp, Homo sapiens
gacctgatcattacatggctgt

SEQ ID NO: 2069798 - DNA, 16 bp, Homo sapiens
gacctgcggctgctgt

SEQ ID NO: 2069799 - DNA, 17 bp, Homo sapiens
gacctgctgagctctga

SEQ ID NO: 2069800 - DNA, 18 bp, Homo sapiens
gacctgctgagctctgag

SEQ ID NO: 2069801 - DNA, 12 bp, Homo sapiens
gacctgtaatca

SEQ ID NO: 2069802 - DNA, 21 bp, Homo sapiens
gacctgtctgtcgctgggctg

SEQ ID NO: 2069803 - DNA, 18 bp, Homo sapiens
gacctgtgttcttgctga

SEQ ID NO: 2069804 - DNA, 23 bp, Homo sapiens
gacctgtgttcttgctgagcacc

SEQ ID NO: 2069805 - DNA, 15 bp, Homo sapiens
gacctgtttagagaa

SEQ ID NO: 2069806 - DNA, 13 bp, Homo sapiens
gaccttagaaatc

SEQ ID NO: 2069807 - DNA, 19 bp, Homo sapiens
gaccttagaaatcattgta

SEQ ID NO: 2069808 - DNA, 16 bp, Homo sapiens
gaccttcctgccacca

SEQ ID NO: 2069809 - DNA, 13 bp, Homo sapiens
gaccttctgaaga

SEQ ID NO: 2069810 - DNA, 18 bp, Homo sapiens
gaccttctgaagatctca

SEQ ID NO: 2069811 - DNA, 23 bp, Homo sapiens
gaccttgaactgggtacttgtgg

SEQ ID NO: 2069812 - DNA, 19 bp, Homo sapiens
gaccttgaagggtaaagaa

SEQ ID NO: 2069813 - DNA, 17 bp, Homo sapiens
gaccttttctctcccat

SEQ ID NO: 2069814 - DNA, 14 bp, Homo sapiens
gacgattatttatt

SEQ ID NO: 2069815 - DNA, 15 bp, Homo sapiens
gacgattatttattt

SEQ ID NO: 2069816 - DNA, 18 bp, Homo sapiens
gacgattatttatttctg

SEQ ID NO: 2069817 - DNA, 19 bp, Homo sapiens
gacgattatttatttctgt

SEQ ID NO: 2069818 - DNA, 16 bp, Homo sapiens
gacgcaagggagaaga

SEQ ID NO: 2069819 - DNA, 12 bp, Homo sapiens
gacgcagcagct

SEQ ID NO: 2069820 - DNA, 20 bp, Homo sapiens
gacgcagccctgggggccag

SEQ ID NO: 2069821 - DNA, 21 bp, Homo sapiens
gacgcagccctgggggccagc

SEQ ID NO: 2069822 - DNA, 23 bp, Homo sapiens
gacgcagccctgggggccagctg

SEQ ID NO: 2069823 - DNA, 14 bp, Homo sapiens
gacgccactcattt

SEQ ID NO: 2069824 - DNA, 21 bp, Homo sapiens
gacgccactcatttcatctca

SEQ ID NO: 2069825 - DNA, 20 bp, Homo sapiens
gacgcccagctgaggctggg

SEQ ID NO: 2069826 - DNA, 22 bp, Homo sapiens
gacgcgcacacacaccggtcac

SEQ ID NO: 2069827 - DNA, 18 bp, Homo sapiens
gacgcgggctgtgcctta

SEQ ID NO: 2069828 - DNA, 14 bp, Homo sapiens
gacgcgtctcctgt

SEQ ID NO: 2069829 - DNA, 15 bp, Homo sapiens
gacgcgtctcctgtt

SEQ ID NO: 2069830 - DNA, 19 bp, Homo sapiens
gacgcttaacctttccgct

SEQ ID NO: 2069831 - DNA, 14 bp, Homo sapiens
gacgcttccagacc

SEQ ID NO: 2069832 - DNA, 18 bp, Homo sapiens
gacgcttccagaccacct

SEQ ID NO: 2069833 - DNA, 19 bp, Homo sapiens
gacgcttccagaccacctg

SEQ ID NO: 2069834 - DNA, 21 bp, Homo sapiens
gacgcttccagaccacctgcc

SEQ ID NO: 2069835 - DNA, 21 bp, Homo sapiens
gacggaagcctttttccccaa

SEQ ID NO: 2069836 - DNA, 18 bp, Homo sapiens
gacggaggttgcagtgag

SEQ ID NO: 2069837 - DNA, 13 bp, Homo sapiens
gacggagtcccac

SEQ ID NO: 2069838 - DNA, 23 bp, Homo sapiens
gacggagtcccaccttggctgca

SEQ ID NO: 2069839 - DNA, 21 bp, Homo sapiens
gacggcagagaccccaggatc

SEQ ID NO: 2069840 - DNA, 19 bp, Homo sapiens
gacggccccgtcagccaca

SEQ ID NO: 2069841 - DNA, 14 bp, Homo sapiens
gacggctggacctg

SEQ ID NO: 2069842 - DNA, 16 bp, Homo sapiens
gacggctggacctgca

SEQ ID NO: 2069843 - DNA, 15 bp, Homo sapiens
gacgggagcctcctc

SEQ ID NO: 2069844 - DNA, 15 bp, Homo sapiens
gacgggaggcctcag

SEQ ID NO: 2069845 - DNA, 16 bp, Homo sapiens
gacggtcccacactgg

SEQ ID NO: 2069846 - DNA, 23 bp, Homo sapiens
gacggtgctcgcttctcctccag

SEQ ID NO: 2069847 - DNA, 23 bp, Homo sapiens
gacggtgttgcagagacgcaagg

SEQ ID NO: 2069848 - DNA, 17 bp, Homo sapiens
gacggttaacttgtata

SEQ ID NO: 2069849 - DNA, 23 bp, Homo sapiens
gacggttaacttgtatattccac

SEQ ID NO: 2069850 - DNA, 23 bp, Homo sapiens
gacgtatgcttattttaaaattt

SEQ ID NO: 2069851 - DNA, 22 bp, Homo sapiens
gacgtcagtagtttgagaccag

SEQ ID NO: 2069852 - DNA, 19 bp, Homo sapiens
gacgtcatcggaggctggg

SEQ ID NO: 2069853 - DNA, 22 bp, Homo sapiens
gacgtcatcggaggctgggccc

SEQ ID NO: 2069854 - DNA, 11 bp, Homo sapiens
gacgtcctgga

SEQ ID NO: 2069855 - DNA, 18 bp, Homo sapiens
gacgtgcacctgtactca

SEQ ID NO: 2069856 - DNA, 19 bp, Homo sapiens
gacgtttttgtgctgtggg

SEQ ID NO: 2069857 - DNA, 20 bp, Homo sapiens
gacgtttttgtgctgtgggc

SEQ ID NO: 2069858 - DNA, 21 bp, Homo sapiens
gacgtttttgtgctgtgggca

SEQ ID NO: 2069859 - DNA, 23 bp, Homo sapiens
gactaacactcagaagcctgggg

SEQ ID NO: 2069860 - DNA, 18 bp, Homo sapiens
gactaacataaaatctgt

SEQ ID NO: 2069861 - DNA, 22 bp, Homo sapiens
gactaacataaaatctgtgaat

SEQ ID NO: 2069862 - DNA, 19 bp, Homo sapiens
gactaaccccaacgcacag

SEQ ID NO: 2069863 - DNA, 22 bp, Homo sapiens
gactaaccccaacgcacaggaa

SEQ ID NO: 2069864 - DNA, 14 bp, Homo sapiens
gactaagccctgtc

SEQ ID NO: 2069865 - DNA, 18 bp, Homo sapiens
gactaatagagacacaga

SEQ ID NO: 2069866 - DNA, 16 bp, Homo sapiens
gactaattaaaatctg

SEQ ID NO: 2069867 - DNA, 17 bp, Homo sapiens
gactaattaaaatctgg

SEQ ID NO: 2069868 - DNA, 18 bp, Homo sapiens
gactaattaaaatctgga

SEQ ID NO: 2069869 - DNA, 17 bp, Homo sapiens
gactacagccagaagcc

SEQ ID NO: 2069870 - DNA, 15 bp, Homo sapiens
gactacaggcaccca

SEQ ID NO: 2069871 - DNA, 18 bp, Homo sapiens
gactacaggtgtgagtca

SEQ ID NO: 2069872 - DNA, 17 bp, Homo sapiens
gactagaggcagggagg

SEQ ID NO: 2069873 - DNA, 12 bp, Homo sapiens
gactagcaggca

SEQ ID NO: 2069874 - DNA, 23 bp, Homo sapiens
gcaagtcatacttaggaatttct

SEQ ID NO: 2069875 - DNA, 20 bp, Homo sapiens
gcaagtccctgactctctgt

SEQ ID NO: 2069876 - DNA, 17 bp, Homo sapiens
gcaagtctggatctggg

SEQ ID NO: 2069877 - DNA, 18 bp, Homo sapiens
gcaagtgatatcacctct

SEQ ID NO: 2069878 - DNA, 20 bp, Homo sapiens
gcaagtgcccgccctgcccc

SEQ ID NO: 2069879 - DNA, 19 bp, Homo sapiens
gcaagtgttcccaaattga

SEQ ID NO: 2069880 - DNA, 18 bp, Homo sapiens
gcaagttcagggaagcag

SEQ ID NO: 2069881 - DNA, 20 bp, Homo sapiens
gcaagttcagggaagcaggc

SEQ ID NO: 2069882 - DNA, 14 bp, Homo sapiens
gcaagttgtactgt

SEQ ID NO: 2069883 - DNA, 19 bp, Homo sapiens
gcaataaatgccctctctg

SEQ ID NO: 2069884 - DNA, 20 bp, Homo sapiens
gcaataagttccatgttaaa

SEQ ID NO: 2069885 - DNA, 24 bp, Homo sapiens
gcaataattaggatctatgcaatt

SEQ ID NO: 2069886 - DNA, 20 bp, Homo sapiens
gcaatactaattgagaaaca

SEQ ID NO: 2069887 - DNA, 20 bp, Homo sapiens
gcaatccatgttagttttta

SEQ ID NO: 2069888 - DNA, 21 bp, Homo sapiens
gcaatccatgttagtttttac

SEQ ID NO: 2069889 - DNA, 13 bp, Homo sapiens
gcaatctccaggg

SEQ ID NO: 2069890 - DNA, 20 bp, Homo sapiens
gcaatctccagggctgcccc

SEQ ID NO: 2069891 - DNA, 20 bp, Homo sapiens
gcaatgaaaccaaagccagg

SEQ ID NO: 2069892 - DNA, 18 bp, Homo sapiens
gcaatgacaggtaaatta

SEQ ID NO: 2069893 - DNA, 17 bp, Homo sapiens
gcaatgatgtccagaag

SEQ ID NO: 2069894 - DNA, 18 bp, Homo sapiens
gcaatgcgtgttgtacat

SEQ ID NO: 2069895 - DNA, 22 bp, Homo sapiens
gcaatgctggctgttggctggg

SEQ ID NO: 2069896 - DNA, 23 bp, Homo sapiens
gcaatgctggctgttggctgggg

SEQ ID NO: 2069897 - DNA, 12 bp, Homo sapiens
gcaatggcagcc

SEQ ID NO: 2069898 - DNA, 15 bp, Homo sapiens
gcaatggcagccttg

SEQ ID NO: 2069899 - DNA, 14 bp, Homo sapiens
gcaatggggagagg

SEQ ID NO: 2069900 - DNA, 15 bp, Homo sapiens
gcaatggggagaggc

SEQ ID NO: 2069901 - DNA, 13 bp, Homo sapiens
gcaatgtaaatat

SEQ ID NO: 2069902 - DNA, 18 bp, Homo sapiens
gcaatgtaaatattttaa

SEQ ID NO: 2069903 - DNA, 20 bp, Homo sapiens
gcaatgtcccttgcacagcc

SEQ ID NO: 2069904 - DNA, 15 bp, Homo sapiens
gcaatgtttatttca

SEQ ID NO: 2069905 - DNA, 22 bp, Homo sapiens
gcaattattctaattttatata

SEQ ID NO: 2069906 - DNA, 14 bp, Homo sapiens
gcaattctacagtt

SEQ ID NO: 2069907 - DNA, 21 bp, Homo sapiens
gcaattctacccagagccttc

SEQ ID NO: 2069908 - DNA, 17 bp, Homo sapiens
gcaatttattaaaatga

SEQ ID NO: 2069909 - DNA, 18 bp, Homo sapiens
gcaattttgcatttgaat

SEQ ID NO: 2069910 - DNA, 23 bp, Homo sapiens
gcaatttttccatgaagtttgaa

SEQ ID NO: 2069911 - DNA, 17 bp, Homo sapiens
gcaatttttttatacta

SEQ ID NO: 2069912 - DNA, 13 bp, Homo sapiens
gcacaaagctcaa

SEQ ID NO: 2069913 - DNA, 19 bp, Homo sapiens
gcacaagaggaagagagag

SEQ ID NO: 2069914 - DNA, 18 bp, Homo sapiens
gcacaagctcagaataga

SEQ ID NO: 2069915 - DNA, 19 bp, Homo sapiens
gcacaatttagaaaacatt

SEQ ID NO: 2069916 - DNA, 21 bp, Homo sapiens
gcacaatttgagcaattcatt

SEQ ID NO: 2069917 - DNA, 22 bp, Homo sapiens
gcacaatttgagcaattcattt

SEQ ID NO: 2069918 - DNA, 20 bp, Homo sapiens
gcacacacacggatgcacac

SEQ ID NO: 2069919 - DNA, 23 bp, Homo sapiens
gcacacacagatatacacatgga

SEQ ID NO: 2069920 - DNA, 14 bp, Homo sapiens
gcacacacagctcc

SEQ ID NO: 2069921 - DNA, 15 bp, Homo sapiens
gcacacacagctcct

SEQ ID NO: 2069922 - DNA, 13 bp, Homo sapiens
gcacacacatgga

SEQ ID NO: 2069923 - DNA, 16 bp, Homo sapiens
gcacacaccagagccc

SEQ ID NO: 2069924 - DNA, 13 bp, Homo sapiens
gcacacagaaata

SEQ ID NO: 2069925 - DNA, 17 bp, Homo sapiens
gcacacagaaatatata

SEQ ID NO: 2069926 - DNA, 20 bp, Homo sapiens
gcacacagaaatatatatac

SEQ ID NO: 2069927 - DNA, 23 bp, Homo sapiens
gcacacagaaatatatatacata

SEQ ID NO: 2069928 - DNA, 21 bp, Homo sapiens
gcacacagcagccccccagca

SEQ ID NO: 2069929 - DNA, 12 bp, Homo sapiens
gcacaccactgc

SEQ ID NO: 2069930 - DNA, 23 bp, Homo sapiens
gattccttttgatggggagaaag

SEQ ID NO: 2069931 - DNA, 17 bp, Homo sapiens
gattcgaatgacactgt

SEQ ID NO: 2069932 - DNA, 15 bp, Homo sapiens
gattctcatgtctca

SEQ ID NO: 2069933 - DNA, 15 bp, Homo sapiens
gattctcctgcctca

SEQ ID NO: 2069934 - DNA, 18 bp, Homo sapiens
gattctcctgcctcagcc

SEQ ID NO: 2069935 - DNA, 20 bp, Homo sapiens
gattctcctgcctcagcctc

SEQ ID NO: 2069936 - DNA, 16 bp, Homo sapiens
gattctcctgtcagag

SEQ ID NO: 2069937 - DNA, 16 bp, Homo sapiens
gattctcctgtgctag

SEQ ID NO: 2069938 - DNA, 15 bp, Homo sapiens
gattctgggaggaag

SEQ ID NO: 2069939 - DNA, 14 bp, Homo sapiens
gattcttccatctg

SEQ ID NO: 2069940 - DNA, 13 bp, Homo sapiens
gattcttctgctt

SEQ ID NO: 2069941 - DNA, 15 bp, Homo sapiens
gattcttctgcttca

SEQ ID NO: 2069942 - DNA, 16 bp, Homo sapiens
gattcttgtgcctcag

SEQ ID NO: 2069943 - DNA, 23 bp, Homo sapiens
gattgacacacagcactctctaa

SEQ ID NO: 2069944 - DNA, 16 bp, Homo sapiens
gattgcaacaggctgg

SEQ ID NO: 2069945 - DNA, 20 bp, Homo sapiens
gattgcaacaggctgggctt

SEQ ID NO: 2069946 - DNA, 22 bp, Homo sapiens
gattgcattagaaatagacagt

SEQ ID NO: 2069947 - DNA, 15 bp, Homo sapiens
gattgccccagagcc

SEQ ID NO: 2069948 - DNA, 23 bp, Homo sapiens
gattgccccagagccccactccc

SEQ ID NO: 2069949 - DNA, 14 bp, Homo sapiens
gattgcttaaaata

SEQ ID NO: 2069950 - DNA, 17 bp, Homo sapiens
gattgcttcttgtgaaa

SEQ ID NO: 2069951 - DNA, 16 bp, Homo sapiens
gattgcttgagcccag

SEQ ID NO: 2069952 - DNA, 11 bp, Homo sapiens
gattggattat

SEQ ID NO: 2069953 - DNA, 17 bp, Homo sapiens
gattggattattcattt

SEQ ID NO: 2069954 - DNA, 18 bp, Homo sapiens
gattggctcacccaagca

SEQ ID NO: 2069955 - DNA, 19 bp, Homo sapiens
gattgggagggacagggct

SEQ ID NO: 2069956 - DNA, 11 bp, Homo sapiens
gattgggtgcc

SEQ ID NO: 2069957 - DNA, 12 bp, Homo sapiens
gattgggtgcca

SEQ ID NO: 2069958 - DNA, 23 bp, Homo sapiens
gattgggtgccatgtggagtgga

SEQ ID NO: 2069959 - DNA, 12 bp, Homo sapiens
gattgtaaaata

SEQ ID NO: 2069960 - DNA, 23 bp, Homo sapiens
gattgtaaaatagcttgtatagt

SEQ ID NO: 2069961 - DNA, 20 bp, Homo sapiens
gattgtacatatggaaatcc

SEQ ID NO: 2069962 - DNA, 22 bp, Homo sapiens
gattgttctgtccagtttccaa

SEQ ID NO: 2069963 - DNA, 12 bp, Homo sapiens
gatttaaaaaat

SEQ ID NO: 2069964 - DNA, 19 bp, Homo sapiens
gatttaacagtcatttaaa

SEQ ID NO: 2069965 - DNA, 20 bp, Homo sapiens
gatttaccttttctgttgta

SEQ ID NO: 2069966 - DNA, 19 bp, Homo sapiens
gatttagcacccttctgct

SEQ ID NO: 2069967 - DNA, 16 bp, Homo sapiens
gatttagggaagcagg

SEQ ID NO: 2069968 - DNA, 18 bp, Homo sapiens
gatttagggaagcaggga

SEQ ID NO: 2069969 - DNA, 13 bp, Homo sapiens
gatttatatctat

SEQ ID NO: 2069970 - DNA, 22 bp, Homo sapiens
gatttattttttaatcatttaa

SEQ ID NO: 2069971 - DNA, 12 bp, Homo sapiens
gatttcaacata

SEQ ID NO: 2069972 - DNA, 14 bp, Homo sapiens
gatttcaacatatc

SEQ ID NO: 2069973 - DNA, 17 bp, Homo sapiens
gatttcaacatatcatt

SEQ ID NO: 2069974 - DNA, 15 bp, Homo sapiens
gatttcaagcctgcc

SEQ ID NO: 2069975 - DNA, 21 bp, Homo sapiens
gatttcagaaagagcaagtct

SEQ ID NO: 2069976 - DNA, 19 bp, Homo sapiens
gatttcagaagccaagttt

SEQ ID NO: 2069977 - DNA, 16 bp, Homo sapiens
gatttcagaggctgca

SEQ ID NO: 2069978 - DNA, 19 bp, Homo sapiens
gatttcagggaaatggagg

SEQ ID NO: 2069979 - DNA, 20 bp, Homo sapiens
gatttcagggaaatggaggg

SEQ ID NO: 2069980 - DNA, 18 bp, Homo sapiens
gatttcatctgagtgtgg

SEQ ID NO: 2069981 - DNA, 16 bp, Homo sapiens
gatttcattgactgaa

SEQ ID NO: 2069982 - DNA, 15 bp, Homo sapiens
gatttccaagtaata

SEQ ID NO: 2069983 - DNA, 18 bp, Homo sapiens
gatttccaggcccctgag

SEQ ID NO: 2069984 - DNA, 17 bp, Homo sapiens
gatgcctggtggcagct

SEQ ID NO: 2069985 - DNA, 20 bp, Homo sapiens
gatgcctggtggcagctgcg

SEQ ID NO: 2069986 - DNA, 22 bp, Homo sapiens
gatgccttgagtctttaatccc

SEQ ID NO: 2069987 - DNA, 23 bp, Homo sapiens
gatgccttgagtctttaatccca

SEQ ID NO: 2069988 - DNA, 16 bp, Homo sapiens
gatgcgaaaacttgaa

SEQ ID NO: 2069989 - DNA, 20 bp, Homo sapiens
gatgcgaaaacttgaatctg

SEQ ID NO: 2069990 - DNA, 20 bp, Homo sapiens
gatgctggtaccactggaat

SEQ ID NO: 2069991 - DNA, 15 bp, Homo sapiens
gatggaaagaaagca

SEQ ID NO: 2069992 - DNA, 16 bp, Homo sapiens
gatggaatagaaaaga

SEQ ID NO: 2069993 - DNA, 12 bp, Homo sapiens
gatggacagaat

SEQ ID NO: 2069994 - DNA, 15 bp, Homo sapiens
gatggacagaatgat

SEQ ID NO: 2069995 - DNA, 15 bp, Homo sapiens
gatggacccctccct

SEQ ID NO: 2069996 - DNA, 18 bp, Homo sapiens
gatggaccctcgcagcag

SEQ ID NO: 2069997 - DNA, 20 bp, Homo sapiens
gatggaccctcgcagcaggt

SEQ ID NO: 2069998 - DNA, 20 bp, Homo sapiens
gatggaccgggtgggcctgg

SEQ ID NO: 2069999 - DNA, 23 bp, Homo sapiens
gatggaccgggtgggcctggcct

SEQ ID NO: 2070000 - DNA, 13 bp, Homo sapiens
gatggagaaggaa

SEQ ID NO: 2070001 - DNA, 14 bp, Homo sapiens
gatggagaaggaag

SEQ ID NO: 2070002 - DNA, 22 bp, Homo sapiens
gatggagactggtcctgtgtgc

SEQ ID NO: 2070003 - DNA, 14 bp, Homo sapiens
gatggagagagggg

SEQ ID NO: 2070004 - DNA, 15 bp, Homo sapiens
gatggagagagggga

SEQ ID NO: 2070005 - DNA, 15 bp, Homo sapiens
gatggagaggcggcc

SEQ ID NO: 2070006 - DNA, 22 bp, Homo sapiens
gatggagcgcacctgccccctg

SEQ ID NO: 2070007 - DNA, 23 bp, Homo sapiens
gatggaggaaaaccaagccgtgg

SEQ ID NO: 2070008 - DNA, 19 bp, Homo sapiens
gatggaggagaaataaact

SEQ ID NO: 2070009 - DNA, 13 bp, Homo sapiens
gatggaggagaag

SEQ ID NO: 2070010 - DNA, 21 bp, Homo sapiens
gatggagtgtgcgtgtgtgca

SEQ ID NO: 2070011 - DNA, 17 bp, Homo sapiens
gatggatggacagaatg

SEQ ID NO: 2070012 - DNA, 15 bp, Homo sapiens
gatggatttgtatca

SEQ ID NO: 2070013 - DNA, 14 bp, Homo sapiens
gatggcaccagagg

SEQ ID NO: 2070014 - DNA, 21 bp, Homo sapiens
gatggcacttagctatcagaa

SEQ ID NO: 2070015 - DNA, 16 bp, Homo sapiens
gatggccaagagcatc

SEQ ID NO: 2070016 - DNA, 15 bp, Homo sapiens
gatggcccttcccac

SEQ ID NO: 2070017 - DNA, 13 bp, Homo sapiens
gatggcgcgggag

SEQ ID NO: 2070018 - DNA, 20 bp, Homo sapiens
gatggcgcgggaggcaccag

SEQ ID NO: 2070019 - DNA, 22 bp, Homo sapiens
gatggcttagttaagtcatcca

SEQ ID NO: 2070020 - DNA, 18 bp, Homo sapiens
gatgggaagatggtagca

SEQ ID NO: 2070021 - DNA, 15 bp, Homo sapiens
gatgggagtgagaca

SEQ ID NO: 2070022 - DNA, 18 bp, Homo sapiens
gatgggcacatgaggagg

SEQ ID NO: 2070023 - DNA, 21 bp, Homo sapiens
gatgggcattgggctgacacc

SEQ ID NO: 2070024 - DNA, 16 bp, Homo sapiens
gatgggcccaattctt

SEQ ID NO: 2070025 - DNA, 18 bp, Homo sapiens
gatggggacactaatgaa

SEQ ID NO: 2070026 - DNA, 21 bp, Homo sapiens
gatggggacactaatgaagat

SEQ ID NO: 2070027 - DNA, 12 bp, Homo sapiens
gatggggagaaa

SEQ ID NO: 2070028 - DNA, 17 bp, Homo sapiens
gatgggggatgggccag

SEQ ID NO: 2070029 - DNA, 22 bp, Homo sapiens
gatgggtattaaacttgtcaga

SEQ ID NO: 2070030 - DNA, 15 bp, Homo sapiens
gatggtcctggggct

SEQ ID NO: 2070031 - DNA, 15 bp, Homo sapiens
gatggtctcacagag

SEQ ID NO: 2070032 - DNA, 16 bp, Homo sapiens
gatggtgagctgggaa

SEQ ID NO: 2070033 - DNA, 18 bp, Homo sapiens
gatggttcccctgttcac

SEQ ID NO: 2070034 - DNA, 16 bp, Homo sapiens
gatgtaaacagtgcct

SEQ ID NO: 2070035 - DNA, 17 bp, Homo sapiens
cctgggcctgtgcagca

SEQ ID NO: 2070036 - DNA, 18 bp, Homo sapiens
cctgggcctgtgcagcag

SEQ ID NO: 2070037 - DNA, 20 bp, Homo sapiens
cctgggcctgtgcagcagcc

SEQ ID NO: 2070038 - DNA, 22 bp, Homo sapiens
cctgggccttacctcccctgcc

SEQ ID NO: 2070039 - DNA, 23 bp, Homo sapiens
cctgggccttacctcccctgcca

SEQ ID NO: 2070040 - DNA, 17 bp, Homo sapiens
cctgggcctttcctgtg

SEQ ID NO: 2070041 - DNA, 14 bp, Homo sapiens
cctgggctcatcag

SEQ ID NO: 2070042 - DNA, 20 bp, Homo sapiens
cctgggctctgccccagctc

SEQ ID NO: 2070043 - DNA, 18 bp, Homo sapiens
cctgggctgtctgtcacc

SEQ ID NO: 2070044 - DNA, 20 bp, Homo sapiens
cctggggattgggagggaca

SEQ ID NO: 2070045 - DNA, 21 bp, Homo sapiens
cctggggattgggagggacag

SEQ ID NO: 2070046 - DNA, 22 bp, Homo sapiens
cctggggattgggagggacagg

SEQ ID NO: 2070047 - DNA, 13 bp, Homo sapiens
cctggggccccgc

SEQ ID NO: 2070048 - DNA, 22 bp, Homo sapiens
cctggggccccttggcgggcag

SEQ ID NO: 2070049 - DNA, 12 bp, Homo sapiens
cctggggcctcg

SEQ ID NO: 2070050 - DNA, 16 bp, Homo sapiens
cctggggcctgtactg

SEQ ID NO: 2070051 - DNA, 19 bp, Homo sapiens
cctggggcctgtactgcct

SEQ ID NO: 2070052 - DNA, 16 bp, Homo sapiens
cctggggctcctttct

SEQ ID NO: 2070053 - DNA, 20 bp, Homo sapiens
cctggggctcctttctccag

SEQ ID NO: 2070054 - DNA, 15 bp, Homo sapiens
cctggggctctgtgc

SEQ ID NO: 2070055 - DNA, 17 bp, Homo sapiens
cctggggcttctcctga

SEQ ID NO: 2070056 - DNA, 18 bp, Homo sapiens
cctgggggaagccctgga

SEQ ID NO: 2070057 - DNA, 19 bp, Homo sapiens
cctgggggaagccctggat

SEQ ID NO: 2070058 - DNA, 16 bp, Homo sapiens
cctgggggcagtgact

SEQ ID NO: 2070059 - DNA, 18 bp, Homo sapiens
cctgggggcagtgactgg

SEQ ID NO: 2070060 - DNA, 12 bp, Homo sapiens
cctgggggccag

SEQ ID NO: 2070061 - DNA, 14 bp, Homo sapiens
cctgggggccagct

SEQ ID NO: 2070062 - DNA, 18 bp, Homo sapiens
cctgggggccagctggtg

SEQ ID NO: 2070063 - DNA, 21 bp, Homo sapiens
ccttcccccatcccctttcct

SEQ ID NO: 2070064 - DNA, 17 bp, Homo sapiens
ccttccccctcccaggg

SEQ ID NO: 2070065 - DNA, 14 bp, Homo sapiens
ccttcccctgtggt

SEQ ID NO: 2070066 - DNA, 14 bp, Homo sapiens
ccttccctgggaag

SEQ ID NO: 2070067 - DNA, 11 bp, Homo sapiens
ccttcccttct

SEQ ID NO: 2070068 - DNA, 21 bp, Homo sapiens
ccttccgatgacagtgctcta

SEQ ID NO: 2070069 - DNA, 15 bp, Homo sapiens
ccttccgctccttta

SEQ ID NO: 2070070 - DNA, 21 bp, Homo sapiens
ccttccgctcctttacctacc

SEQ ID NO: 2070071 - DNA, 15 bp, Homo sapiens
ccttcctcctccaca

SEQ ID NO: 2070072 - DNA, 23 bp, Homo sapiens
ccttcctcctccacagtgctgct

SEQ ID NO: 2070073 - DNA, 19 bp, Homo sapiens
ccttcctcctcctttgcct

SEQ ID NO: 2070074 - DNA, 13 bp, Homo sapiens
ccttcctcctgaa

SEQ ID NO: 2070075 - DNA, 17 bp, Homo sapiens
ccttcctctcaagctag

SEQ ID NO: 2070076 - DNA, 16 bp, Homo sapiens
ccttcctctccactgc

SEQ ID NO: 2070077 - DNA, 17 bp, Homo sapiens
ccttcctctccactgcc

SEQ ID NO: 2070078 - DNA, 21 bp, Homo sapiens
ccttcctctccactgccttcg

SEQ ID NO: 2070079 - DNA, 17 bp, Homo sapiens
ccttcctgagacctcgc

SEQ ID NO: 2070080 - DNA, 14 bp, Homo sapiens
ccttcctgccacca

SEQ ID NO: 2070081 - DNA, 19 bp, Homo sapiens
ccttcctggacagctgtgc

SEQ ID NO: 2070082 - DNA, 20 bp, Homo sapiens
ccttcctggacagctgtgcc

SEQ ID NO: 2070083 - DNA, 14 bp, Homo sapiens
ccttcctggcctca

SEQ ID NO: 2070084 - DNA, 15 bp, Homo sapiens
ccttcctggcctcac

SEQ ID NO: 2070085 - DNA, 19 bp, Homo sapiens
ccttcctgtcccacctctt

SEQ ID NO: 2070086 - DNA, 16 bp, Homo sapiens
ccttccttccctggct

SEQ ID NO: 2070087 - DNA, 12 bp, Homo sapiens
ccttcctttcct

SEQ ID NO: 2070088 - DNA, 13 bp, Homo sapiens
ccttcctttcctc

SEQ ID NO: 2070089 - DNA, 19 bp, Homo sapiens
ccttcctttcctctgcagc

SEQ ID NO: 2070090 - DNA, 20 bp, Homo sapiens
ccttcgaggttgccccttcc

SEQ ID NO: 2070091 - DNA, 13 bp, Homo sapiens
ccttcgctcctgt

SEQ ID NO: 2070092 - DNA, 15 bp, Homo sapiens
ccttcgctcctgtgt

SEQ ID NO: 2070093 - DNA, 16 bp, Homo sapiens
ccttcgctgccaggac

SEQ ID NO: 2070094 - DNA, 17 bp, Homo sapiens
ccttcgtgtctctccca

SEQ ID NO: 2070095 - DNA, 22 bp, Homo sapiens
ccttcgtgtctctcccaccccg

SEQ ID NO: 2070096 - DNA, 15 bp, Homo sapiens
ccttctactgagcct

SEQ ID NO: 2070097 - DNA, 15 bp, Homo sapiens
ccttctccctgggaa

SEQ ID NO: 2070098 - DNA, 19 bp, Homo sapiens
ccttctcgcattttctcta

SEQ ID NO: 2070099 - DNA, 18 bp, Homo sapiens
ccttctctacccatctcc

SEQ ID NO: 2070100 - DNA, 15 bp, Homo sapiens
ccttctctctctggt

SEQ ID NO: 2070101 - DNA, 14 bp, Homo sapiens
ccttctctgaagga

SEQ ID NO: 2070102 - DNA, 16 bp, Homo sapiens
ccttctctgaaggaca

SEQ ID NO: 2070103 - DNA, 16 bp, Homo sapiens
ccttctgcttctccct

SEQ ID NO: 2070104 - DNA, 22 bp, Homo sapiens
ccttctgcttctccctggctga

SEQ ID NO: 2070105 - DNA, 22 bp, Homo sapiens
ccttctggaggacacacagtct

SEQ ID NO: 2070106 - DNA, 16 bp, Homo sapiens
ccttctggttgcttca

SEQ ID NO: 2070107 - DNA, 22 bp, Homo sapiens
ccttctgtcctactctgtgtca

SEQ ID NO: 2070108 - DNA, 14 bp, Homo sapiens
ccttctgtggctca

SEQ ID NO: 2070109 - DNA, 17 bp, Homo sapiens
ccttcttattctcactc

SEQ ID NO: 2070110 - DNA, 18 bp, Homo sapiens
ccttcttattctcactcc

SEQ ID NO: 2070111 - DNA, 20 bp, Homo sapiens
ccttcttattctcactccac

SEQ ID NO: 2070112 - DNA, 15 bp, Homo sapiens
ccttcttggcttctg

SEQ ID NO: 2070113 - DNA, 21 bp, Homo sapiens
ccttcttggcttctgggacct

SEQ ID NO: 2070114 - DNA, 13 bp, Homo sapiens
ccttctttctacc

SEQ ID NO: 2070115 - DNA, 17 bp, Homo sapiens
ccttctttctcttccct

SEQ ID NO: 2070116 - DNA, 20 bp, Homo sapiens
ccttctttctcttccctcct

SEQ ID NO: 2070117 - DNA, 16 bp, Homo sapiens
ccttctttttcttctt

SEQ ID NO: 2070118 - DNA, 19 bp, Homo sapiens
ccttgaaaaacaagtcttt

SEQ ID NO: 2070119 - DNA, 14 bp, Homo sapiens
ccttgaactgggta

SEQ ID NO: 2070120 - DNA, 21 bp, Homo sapiens
ccttgaagggtaaagaagttt

SEQ ID NO: 2070121 - DNA, 18 bp, Homo sapiens
ccttgacagggcacaccg

SEQ ID NO: 2070122 - DNA, 14 bp, Homo sapiens
ccttgagacctcag

SEQ ID NO: 2070123 - DNA, 16 bp, Homo sapiens
ccttgagacctcagcc

SEQ ID NO: 2070124 - DNA, 21 bp, Homo sapiens
ccttgagagtatcaggtctcc

SEQ ID NO: 2070125 - DNA, 17 bp, Homo sapiens
ccttgagctccccaaaa

SEQ ID NO: 2070126 - DNA, 17 bp, Homo sapiens
ccttgatgaagcctgtg

SEQ ID NO: 2070127 - DNA, 19 bp, Homo sapiens
ccttgatgaagcctgtgcc

SEQ ID NO: 2070128 - DNA, 21 bp, Homo sapiens
ccttgatgaagcctgtgccac

SEQ ID NO: 2070129 - DNA, 19 bp, Homo sapiens
ccttgatggagatatttac

SEQ ID NO: 2070130 - DNA, 12 bp, Homo sapiens
ccttgcacctgc

SEQ ID NO: 2070131 - DNA, 14 bp, Homo sapiens
ccttgcattagaaa

SEQ ID NO: 2070132 - DNA, 17 bp, Homo sapiens
ccttgcccagggctcag

SEQ ID NO: 2070133 - DNA, 22 bp, Homo sapiens
ccttgcccagggctcagcctgg

SEQ ID NO: 2070134 - DNA, 17 bp, Homo sapiens
ccttgcccccatccctc

SEQ ID NO: 2070135 - DNA, 17 bp, Homo sapiens
ccttgcccgccagcctc

SEQ ID NO: 2070136 - DNA, 18 bp, Homo sapiens
ccttgcccgccagcctca

SEQ ID NO: 2070137 - DNA, 15 bp, Homo sapiens
ccttgcccttgccct

SEQ ID NO: 2070138 - DNA, 18 bp, Homo sapiens
ccttgccttttaaaagaa

SEQ ID NO: 2070139 - DNA, 23 bp, Homo sapiens
ccttgctcaccaagctgttccac

SEQ ID NO: 2070140 - DNA, 19 bp, Homo sapiens
ccttgctcagtgcctcctg

SEQ ID NO: 2070141 - DNA, 20 bp, Homo sapiens
ccttgctcttctttctgaga

SEQ ID NO: 2070142 - DNA, 12 bp, Homo sapiens
ccttgctgctgc

SEQ ID NO: 2070143 - DNA, 16 bp, Homo sapiens
ccttgctgtcctaggc

SEQ ID NO: 2070144 - DNA, 19 bp, Homo sapiens
ccttggaaagttcagccag

SEQ ID NO: 2070145 - DNA, 20 bp, Homo sapiens
ccttggaaagttcagccaga

SEQ ID NO: 2070146 - DNA, 16 bp, Homo sapiens
ccttggactcctccca

SEQ ID NO: 2070147 - DNA, 15 bp, Homo sapiens
ccttggagagcagct

SEQ ID NO: 2070148 - DNA, 19 bp, Homo sapiens
ccttggagagcagctggct

SEQ ID NO: 2070149 - DNA, 22 bp, Homo sapiens
ccttggagagcagctggctctc

SEQ ID NO: 2070150 - DNA, 17 bp, Homo sapiens
ccttggagcagaaagcc

SEQ ID NO: 2070151 - DNA, 13 bp, Homo sapiens
ccttggaggacag

SEQ ID NO: 2070152 - DNA, 22 bp, Homo sapiens
ccttggctcaatcctctaagct

SEQ ID NO: 2070153 - DNA, 21 bp, Homo sapiens
ccttggctgtgaggcccctgg

SEQ ID NO: 2070154 - DNA, 13 bp, Homo sapiens
ccttggcttcctc

SEQ ID NO: 2070155 - DNA, 17 bp, Homo sapiens
ccttgggcatccaccca

SEQ ID NO: 2070156 - DNA, 19 bp, Homo sapiens
ccttgggcatccacccagt

SEQ ID NO: 2070157 - DNA, 13 bp, Homo sapiens
ccttgggctcctg

SEQ ID NO: 2070158 - DNA, 15 bp, Homo sapiens
ccttgggctcctggc

SEQ ID NO: 2070159 - DNA, 22 bp, Homo sapiens
ccttggggattcttccatctga

SEQ ID NO: 2070160 - DNA, 14 bp, Homo sapiens
ccttggggcacagt

SEQ ID NO: 2070161 - DNA, 13 bp, Homo sapiens
ccttggggcctgg

SEQ ID NO: 2070162 - DNA, 15 bp, Homo sapiens
ccttggggcctggct

SEQ ID NO: 2070163 - DNA, 23 bp, Homo sapiens
ccttggggtaagccagagcctgg

SEQ ID NO: 2070164 - DNA, 15 bp, Homo sapiens
ccttggtgtccacct

SEQ ID NO: 2070165 - DNA, 19 bp, Homo sapiens
ccttgtaattctaaatgaa

SEQ ID NO: 2070166 - DNA, 13 bp, Homo sapiens
ccttgtaccccat

SEQ ID NO: 2070167 - DNA, 13 bp, Homo sapiens
ccttgtatttaaa

SEQ ID NO: 2070168 - DNA, 16 bp, Homo sapiens
ccttgtcactggtaga

SEQ ID NO: 2070169 - DNA, 13 bp, Homo sapiens
ccttgtcctgcca

SEQ ID NO: 2070170 - DNA, 14 bp, Homo sapiens
ccttgtcctgccag

SEQ ID NO: 2070171 - DNA, 18 bp, Homo sapiens
ccttgtcctgccagctgc

SEQ ID NO: 2070172 - DNA, 19 bp, Homo sapiens
ccttgtcctgccagctgcc

SEQ ID NO: 2070173 - DNA, 20 bp, Homo sapiens
ccttgtcctgccagctgcct

SEQ ID NO: 2070174 - DNA, 22 bp, Homo sapiens
ccttgtctctcattctctttct

SEQ ID NO: 2070175 - DNA, 13 bp, Homo sapiens
ccttgtgccctgc

SEQ ID NO: 2070176 - DNA, 18 bp, Homo sapiens
ccttgtgccctgccccca

SEQ ID NO: 2070177 - DNA, 21 bp, Homo sapiens
ccttgtgcttggtggggctcg

SEQ ID NO: 2070178 - DNA, 18 bp, Homo sapiens
cgcagcctggcggggcag

SEQ ID NO: 2070179 - DNA, 20 bp, Homo sapiens
cgcagggaggatgccacagc

SEQ ID NO: 2070180 - DNA, 12 bp, Homo sapiens
cgcagtccccag

SEQ ID NO: 2070181 - DNA, 13 bp, Homo sapiens
cgcagtctggcct

SEQ ID NO: 2070182 - DNA, 14 bp, Homo sapiens
cgcagtctggcctg

SEQ ID NO: 2070183 - DNA, 21 bp, Homo sapiens
cgcatgtgccagttggggccc

SEQ ID NO: 2070184 - DNA, 13 bp, Homo sapiens
cgcattttctcta

SEQ ID NO: 2070185 - DNA, 15 bp, Homo sapiens
cgcattttctctagc

SEQ ID NO: 2070186 - DNA, 15 bp, Homo sapiens
cgccaaacactccac

SEQ ID NO: 2070187 - DNA, 14 bp, Homo sapiens
cgccaacgcacgca

SEQ ID NO: 2070188 - DNA, 17 bp, Homo sapiens
ctaatcaggttgttaat

SEQ ID NO: 2070189 - DNA, 13 bp, Homo sapiens
ctaatccaaccca

SEQ ID NO: 2070190 - DNA, 22 bp, Homo sapiens
ctaatctcatacctctgaccaa

SEQ ID NO: 2070191 - DNA, 14 bp, Homo sapiens
ctaatctgtagggc

SEQ ID NO: 2070192 - DNA, 22 bp, Homo sapiens
ctaatctgtagggctggaccta

SEQ ID NO: 2070193 - DNA, 23 bp, Homo sapiens
ctaatcttgttaaattgcttatt

SEQ ID NO: 2070194 - DNA, 16 bp, Homo sapiens
ctaatgaaattgagaa

SEQ ID NO: 2070195 - DNA, 19 bp, Homo sapiens
ctaatgtctcttcctctgt

SEQ ID NO: 2070196 - DNA, 13 bp, Homo sapiens
ctaatgtcttcat

SEQ ID NO: 2070197 - DNA, 22 bp, Homo sapiens
ctaatgtcttcatttcattgta

SEQ ID NO: 2070198 - DNA, 18 bp, Homo sapiens
ctaattcccattttgcaa

SEQ ID NO: 2070199 - DNA, 22 bp, Homo sapiens
ctaattgaaatttaaaaataaa

SEQ ID NO: 2070200 - DNA, 19 bp, Homo sapiens
ctaattggaagaaattcct

SEQ ID NO: 2070201 - DNA, 22 bp, Homo sapiens
ctatggcagtccagccagctcc

SEQ ID NO: 2070202 - DNA, 23 bp, Homo sapiens
ctatggcagtccagccagctcct

SEQ ID NO: 2070203 - DNA, 14 bp, Homo sapiens
ctatggctgcctgc

SEQ ID NO: 2070204 - DNA, 15 bp, Homo sapiens
ctatggctgtatttt

SEQ ID NO: 2070205 - DNA, 16 bp, Homo sapiens
ctatggctgtattttt

SEQ ID NO: 2070206 - DNA, 12 bp, Homo sapiens
ctatggtcatct

SEQ ID NO: 2070207 - DNA, 18 bp, Homo sapiens
ctatgtcatttcatttcc

SEQ ID NO: 2070208 - DNA, 20 bp, Homo sapiens
ctatgtcctaaggacacact

SEQ ID NO: 2070209 - DNA, 21 bp, Homo sapiens
ctatgtcctaaggacacacta

SEQ ID NO: 2070210 - DNA, 22 bp, Homo sapiens
ctatgtgtagggcgggaggatg

SEQ ID NO: 2070211 - DNA, 18 bp, Homo sapiens
ctatgtgtcacagctctg

SEQ ID NO: 2070212 - DNA, 14 bp, Homo sapiens
ctatgttgcccagg

SEQ ID NO: 2070213 - DNA, 16 bp, Homo sapiens
ctatgttgcccaggca

SEQ ID NO: 2070214 - DNA, 19 bp, Homo sapiens
ctatgttgcccaggcaggt

SEQ ID NO: 2070215 - DNA, 22 bp, Homo sapiens
ctatgttgcccaggcaggtctt

SEQ ID NO: 2070216 - DNA, 19 bp, Homo sapiens
ctatgttgcccaggctgct

SEQ ID NO: 2070217 - DNA, 15 bp, Homo sapiens
ctatgtttttaatgt

SEQ ID NO: 2070218 - DNA, 23 bp, Homo sapiens
ctattaattccaagattaaaagt

SEQ ID NO: 2070219 - DNA, 16 bp, Homo sapiens
ctattacttgaacttt

SEQ ID NO: 2070220 - DNA, 20 bp, Homo sapiens
ctattacttgaactttccaa

SEQ ID NO: 2070221 - DNA, 13 bp, Homo sapiens
ctattagagaaac

SEQ ID NO: 2070222 - DNA, 21 bp, Homo sapiens
ctattagatgttttacaaatt

SEQ ID NO: 2070223 - DNA, 15 bp, Homo sapiens
ctattataaaaccat

SEQ ID NO: 2070224 - DNA, 16 bp, Homo sapiens
ctattataaaaccatg

SEQ ID NO: 2070225 - DNA, 21 bp, Homo sapiens
ctattatgtaacatccagaag

SEQ ID NO: 2070226 - DNA, 22 bp, Homo sapiens
ctattattttcactgtagaatg

SEQ ID NO: 2070227 - DNA, 21 bp, Homo sapiens
ctattcaatttaattcttatt

SEQ ID NO: 2070228 - DNA, 14 bp, Homo sapiens
ctattcagacaagc

SEQ ID NO: 2070229 - DNA, 14 bp, Homo sapiens
ctattcctaggagg

SEQ ID NO: 2070230 - DNA, 15 bp, Homo sapiens
ctattctcaccagga

SEQ ID NO: 2070231 - DNA, 16 bp, Homo sapiens
ctattctcaccaggaa

SEQ ID NO: 2070232 - DNA, 14 bp, Homo sapiens
ctattctctcctca

SEQ ID NO: 2070233 - DNA, 18 bp, Homo sapiens
ctcaagggtccagaagtc

SEQ ID NO: 2070234 - DNA, 14 bp, Homo sapiens
ctcaagtcctcttt

SEQ ID NO: 2070235 - DNA, 20 bp, Homo sapiens
ctcaagtctagaaaccagta

SEQ ID NO: 2070236 - DNA, 16 bp, Homo sapiens
ctcaagtcttccctga

SEQ ID NO: 2070237 - DNA, 17 bp, Homo sapiens
ctcaagtgattctcctg

SEQ ID NO: 2070238 - DNA, 18 bp, Homo sapiens
ctcaagtgattctcctgc

SEQ ID NO: 2070239 - DNA, 19 bp, Homo sapiens
ctcaagtgattctcctgcc

SEQ ID NO: 2070240 - DNA, 20 bp, Homo sapiens
ctcaagtgattctcctgcct

SEQ ID NO: 2070241 - DNA, 21 bp, Homo sapiens
ctcaagtgattctcctgcctc

SEQ ID NO: 2070242 - DNA, 14 bp, Homo sapiens
ctcaagttgaaaga

SEQ ID NO: 2070243 - DNA, 19 bp, Homo sapiens
ctcaagtttttcagaaagc

SEQ ID NO: 2070244 - DNA, 20 bp, Homo sapiens
ctcaagtttttcagaaagca

SEQ ID NO: 2070245 - DNA, 11 bp, Homo sapiens
ctcaatatttt

SEQ ID NO: 2070246 - DNA, 19 bp, Homo sapiens
ctcaatattttccatgaaa

SEQ ID NO: 2070247 - DNA, 14 bp, Homo sapiens
ctcaatcctctaag

SEQ ID NO: 2070248 - DNA, 15 bp, Homo sapiens
ctcaatgccctgcca

SEQ ID NO: 2070249 - DNA, 16 bp, Homo sapiens
ctcaatgccctgccat

SEQ ID NO: 2070250 - DNA, 18 bp, Homo sapiens
ctcaatgccctgccatta

SEQ ID NO: 2070251 - DNA, 17 bp, Homo sapiens
ctcaatggacttcaaat

SEQ ID NO: 2070252 - DNA, 13 bp, Homo sapiens
ctcaatgtgaaaa

SEQ ID NO: 2070253 - DNA, 15 bp, Homo sapiens
ctcaatgtgaccagg

SEQ ID NO: 2070254 - DNA, 18 bp, Homo sapiens
ctcaatgtgaccaggggt

SEQ ID NO: 2070255 - DNA, 22 bp, Homo sapiens
ctcacaaaccatgcaaatgcta

SEQ ID NO: 2070256 - DNA, 19 bp, Homo sapiens
ctcacaagaagaccagact

SEQ ID NO: 2070257 - DNA, 19 bp, Homo sapiens
ctcacaaggcagcaaggcc

SEQ ID NO: 2070258 - DNA, 16 bp, Homo sapiens
ctcacaattgtaaagt

SEQ ID NO: 2070259 - DNA, 12 bp, Homo sapiens
ctcacacaggca

SEQ ID NO: 2070260 - DNA, 13 bp, Homo sapiens
ctcacacaggcat

SEQ ID NO: 2070261 - DNA, 21 bp, Homo sapiens
ctcacacaggcatttcctggg

SEQ ID NO: 2070262 - DNA, 22 bp, Homo sapiens
ctcacacaggcatttcctgggt

SEQ ID NO: 2070263 - DNA, 23 bp, Homo sapiens
ctcacacaggcatttcctgggtg

SEQ ID NO: 2070264 - DNA, 20 bp, Homo sapiens
ctcacacttgggcgctctgc

SEQ ID NO: 2070265 - DNA, 19 bp, Homo sapiens
ctcacagaaatgttaaact

SEQ ID NO: 2070266 - DNA, 16 bp, Homo sapiens
ctcacagagccaactc

SEQ ID NO: 2070267 - DNA, 22 bp, Homo sapiens
ctcacaggagcagacagagaaa

SEQ ID NO: 2070268 - DNA, 12 bp, Homo sapiens
ctcacagtgacc

SEQ ID NO: 2070269 - DNA, 23 bp, Homo sapiens
ctcacagttcctcgccctgggtc

SEQ ID NO: 2070270 - DNA, 12 bp, Homo sapiens
ctcacatttatg

SEQ ID NO: 2070271 - DNA, 19 bp, Homo sapiens
ctcacatttattctgctca

SEQ ID NO: 2070272 - DNA, 17 bp, Homo sapiens
ctcaccaataacttcag

SEQ ID NO: 2070273 - DNA, 21 bp, Homo sapiens
ctcaccagccccagtgcccac

SEQ ID NO: 2070274 - DNA, 18 bp, Homo sapiens
ctccagctcaccagcccc

SEQ ID NO: 2070275 - DNA, 12 bp, Homo sapiens
ctccagctccag

SEQ ID NO: 2070276 - DNA, 13 bp, Homo sapiens
ctccagctttcct

SEQ ID NO: 2070277 - DNA, 16 bp, Homo sapiens
ctccagctttcctgta

SEQ ID NO: 2070278 - DNA, 11 bp, Homo sapiens
ctccaggaagg

SEQ ID NO: 2070279 - DNA, 23 bp, Homo sapiens
ctccaggaaggtagcccagcact

SEQ ID NO: 2070280 - DNA, 16 bp, Homo sapiens
ctccaggagcctaccc

SEQ ID NO: 2070281 - DNA, 17 bp, Homo sapiens
ctccaggagcctacccc

SEQ ID NO: 2070282 - DNA, 19 bp, Homo sapiens
ctccaggagcctaccccct

SEQ ID NO: 2070283 - DNA, 17 bp, Homo sapiens
ctccaggatggtgcagg

SEQ ID NO: 2070284 - DNA, 22 bp, Homo sapiens
ctccaggatggtgcaggatggc

SEQ ID NO: 2070285 - DNA, 19 bp, Homo sapiens
ctccaggattgaagagcat

SEQ ID NO: 2070286 - DNA, 16 bp, Homo sapiens
ctccaggcacccttct

SEQ ID NO: 2070287 - DNA, 23 bp, Homo sapiens
ctccaggcatgctggcctcccaa

SEQ ID NO: 2070288 - DNA, 11 bp, Homo sapiens
ctccaggctcc

SEQ ID NO: 2070289 - DNA, 22 bp, Homo sapiens
ctccaggctgtatcccatgagc

SEQ ID NO: 2070290 - DNA, 14 bp, Homo sapiens
ctccagggcagcct

SEQ ID NO: 2070291 - DNA, 16 bp, Homo sapiens
ctccagggccacgtgc

SEQ ID NO: 2070292 - DNA, 13 bp, Homo sapiens
ctccagggtcttg

SEQ ID NO: 2070293 - DNA, 17 bp, Homo sapiens
ctccagggtcttgggct

SEQ ID NO: 2070294 - DNA, 18 bp, Homo sapiens
ctccagggtcttgggcta

SEQ ID NO: 2070295 - DNA, 20 bp, Homo sapiens
ctccagggtcttgggctact

SEQ ID NO: 2070296 - DNA, 22 bp, Homo sapiens
ctccagggtcttgggctactgg

SEQ ID NO: 2070297 - DNA, 22 bp, Homo sapiens
ctccaggtcctctacttaatga

SEQ ID NO: 2070298 - DNA, 20 bp, Homo sapiens
ctccagtattcttgtcaaaa

SEQ ID NO: 2070299 - DNA, 15 bp, Homo sapiens
ctccagtctcctgac

SEQ ID NO: 2070300 - DNA, 17 bp, Homo sapiens
ctccagtctcctgacat

SEQ ID NO: 2070301 - DNA, 20 bp, Homo sapiens
ctccagtctcctgacattaa

SEQ ID NO: 2070302 - DNA, 16 bp, Homo sapiens
ctccagtgagctggaa

SEQ ID NO: 2070303 - DNA, 16 bp, Homo sapiens
ctccagtggttgctgt

SEQ ID NO: 2070304 - DNA, 19 bp, Homo sapiens
ctccagtggttgctgttga

SEQ ID NO: 2070305 - DNA, 14 bp, Homo sapiens
ctccagtttcccca

SEQ ID NO: 2070306 - DNA, 16 bp, Homo sapiens
ctccataatgccactg

SEQ ID NO: 2070307 - DNA, 16 bp, Homo sapiens
ctccatatctccttcc

SEQ ID NO: 2070308 - DNA, 17 bp, Homo sapiens
ctccatatctccttccc

SEQ ID NO: 2070309 - DNA, 18 bp, Homo sapiens
ctccatcccgcccttccc

SEQ ID NO: 2070310 - DNA, 19 bp, Homo sapiens
ctccatcccgcccttccca

SEQ ID NO: 2070311 - DNA, 22 bp, Homo sapiens
ctccatcccgcccttcccacag

SEQ ID NO: 2070312 - DNA, 13 bp, Homo sapiens
ctccatctccact

SEQ ID NO: 2070313 - DNA, 16 bp, Homo sapiens
ctccatctggcagggt

SEQ ID NO: 2070314 - DNA, 13 bp, Homo sapiens
ctccatgctgcct

SEQ ID NO: 2070315 - DNA, 20 bp, Homo sapiens
ctccaccctcaccaggatga

SEQ ID NO: 2070316 - DNA, 16 bp, Homo sapiens
ctccaccctgagcctg

SEQ ID NO: 2070317 - DNA, 20 bp, Homo sapiens
ctccaccctgagcctgacct

SEQ ID NO: 2070318 - DNA, 17 bp, Homo sapiens
ctccaccgcagaaggaa

SEQ ID NO: 2070319 - DNA, 16 bp, Homo sapiens
ctccaccgctgcctaa

SEQ ID NO: 2070320 - DNA, 12 bp, Homo sapiens
ctccacctcagc

SEQ ID NO: 2070321 - DNA, 17 bp, Homo sapiens
ctccacctcagccttgg

SEQ ID NO: 2070322 - DNA, 18 bp, Homo sapiens
ctccacctcagccttgga

SEQ ID NO: 2070323 - DNA, 13 bp, Homo sapiens
ctccacctcctga

SEQ ID NO: 2070324 - DNA, 14 bp, Homo sapiens
ctccacctcctgag

SEQ ID NO: 2070325 - DNA, 19 bp, Homo sapiens
ctccacctgttcaggagct

SEQ ID NO: 2070326 - DNA, 23 bp, Homo sapiens
ctccacctgttcaggagctgaag

SEQ ID NO: 2070327 - DNA, 20 bp, Homo sapiens
ctccacgcctcctggccaga

SEQ ID NO: 2070328 - DNA, 21 bp, Homo sapiens
ctccacgcctcctggccagac

SEQ ID NO: 2070329 - DNA, 23 bp, Homo sapiens
ctccacggtgcgtggctgtggca

SEQ ID NO: 2070330 - DNA, 22 bp, Homo sapiens
ctccactaaatgagctcctgcg

SEQ ID NO: 2070331 - DNA, 18 bp, Homo sapiens
ctccactcactccagccc

SEQ ID NO: 2070332 - DNA, 13 bp, Homo sapiens
ctccactccccca

SEQ ID NO: 2070333 - DNA, 16 bp, Homo sapiens
ctccactcccccacct

SEQ ID NO: 2070334 - DNA, 22 bp, Homo sapiens
ctccactctccttcgtgtctct

SEQ ID NO: 2070335 - DNA, 19 bp, Homo sapiens
ctccactgctctcagcctc

SEQ ID NO: 2070336 - DNA, 13 bp, Homo sapiens
ctccactggatgg

SEQ ID NO: 2070337 - DNA, 13 bp, Homo sapiens
ctccactgtcaca

SEQ ID NO: 2070338 - DNA, 13 bp, Homo sapiens
ctccactgtcacc

SEQ ID NO: 2070339 - DNA, 20 bp, Homo sapiens
ctccagaagtggggctctgg

SEQ ID NO: 2070340 - DNA, 15 bp, Homo sapiens
ctccagaatctgctg

SEQ ID NO: 2070341 - DNA, 16 bp, Homo sapiens
ctccagaatctgctgt

SEQ ID NO: 2070342 - DNA, 18 bp, Homo sapiens
ctccagaatctgctgttg

SEQ ID NO: 2070343 - DNA, 20 bp, Homo sapiens
ctccagaatctgctgttgcc

SEQ ID NO: 2070344 - DNA, 22 bp, Homo sapiens
ctccagaatctgctgttgccat

SEQ ID NO: 2070345 - DNA, 14 bp, Homo sapiens
ctccagacccctgg

SEQ ID NO: 2070346 - DNA, 19 bp, Homo sapiens
ctccagacccctggctttt

SEQ ID NO: 2070347 - DNA, 16 bp, Homo sapiens
ctccagacccctgtgg

SEQ ID NO: 2070348 - DNA, 18 bp, Homo sapiens
ctccagacccctgtggca

SEQ ID NO: 2070349 - DNA, 14 bp, Homo sapiens
ctccagaccctgcc

SEQ ID NO: 2070350 - DNA, 16 bp, Homo sapiens
ctccagaccctgcctg

SEQ ID NO: 2070351 - DNA, 18 bp, Homo sapiens
ctccagagacaggaaaga

SEQ ID NO: 2070352 - DNA, 13 bp, Homo sapiens
ctccagagccagc

SEQ ID NO: 2070353 - DNA, 15 bp, Homo sapiens
ctccagagccagcct

SEQ ID NO: 2070354 - DNA, 17 bp, Homo sapiens
ctccagagccagcctgg

SEQ ID NO: 2070355 - DNA, 20 bp, Homo sapiens
ctccagagccagcctgggac

SEQ ID NO: 2070356 - DNA, 23 bp, Homo sapiens
ctccagagggacagggtggaccc

SEQ ID NO: 2070357 - DNA, 16 bp, Homo sapiens
ctccagagtctgagcc

SEQ ID NO: 2070358 - DNA, 20 bp, Homo sapiens
ctccagagtctgagcccccg

SEQ ID NO: 2070359 - DNA, 16 bp, Homo sapiens
ctccagagtgtgcaga

SEQ ID NO: 2070360 - DNA, 13 bp, Homo sapiens
ctccagccagcaa

SEQ ID NO: 2070361 - DNA, 16 bp, Homo sapiens
ctccagccagcaatga

SEQ ID NO: 2070362 - DNA, 23 bp, Homo sapiens
ctccagccagcaatgatgtccag

SEQ ID NO: 2070363 - DNA, 24 bp, Homo sapiens
ctccagccagcaatgatgtccaga

SEQ ID NO: 2070364 - DNA, 12 bp, Homo sapiens
ctccagccagcg

SEQ ID NO: 2070365 - DNA, 14 bp, Homo sapiens
ctccagccagcgcc

SEQ ID NO: 2070366 - DNA, 20 bp, Homo sapiens
ctccagccagcgcctccctc

SEQ ID NO: 2070367 - DNA, 21 bp, Homo sapiens
ctccagccagcgcctccctcc

SEQ ID NO: 2070368 - DNA, 14 bp, Homo sapiens
ctccagcccacacc

SEQ ID NO: 2070369 - DNA, 23 bp, Homo sapiens
ctccagcccacacccctccaaag

SEQ ID NO: 2070370 - DNA, 11 bp, Homo sapiens
ctccagccctg

SEQ ID NO: 2070371 - DNA, 12 bp, Homo sapiens
ctccagccctgt

SEQ ID NO: 2070372 - DNA, 13 bp, Homo sapiens
ctccagccctgtc

SEQ ID NO: 2070373 - DNA, 20 bp, Homo sapiens
ctccagcctctcccggctgc

SEQ ID NO: 2070374 - DNA, 22 bp, Homo sapiens
ctccagcctctcccggctgcct

SEQ ID NO: 2070375 - DNA, 23 bp, Homo sapiens
ctccagcctctcccggctgcctg

SEQ ID NO: 2070376 - DNA, 24 bp, Homo sapiens
ctccagcctctcccggctgcctgc

SEQ ID NO: 2070377 - DNA, 13 bp, Homo sapiens
ctccagcctgagc

SEQ ID NO: 2070378 - DNA, 14 bp, Homo sapiens
ctccagcctgagca

SEQ ID NO: 2070379 - DNA, 20 bp, Homo sapiens
ctccagccttctctctctgg

SEQ ID NO: 2070380 - DNA, 24 bp, Homo sapiens
ctccagccttctctctctggtcag

SEQ ID NO: 2070381 - DNA, 16 bp, Homo sapiens
ctccagctcaccagcc

SEQ ID NO: 2070382 - DNA, 19 bp, Homo sapiens
cctcatcagtagatggtac

SEQ ID NO: 2070383 - DNA, 18 bp, Homo sapiens
cctcatccaccaatctct

SEQ ID NO: 2070384 - DNA, 18 bp, Homo sapiens
cctcatcccctcgtcctg

SEQ ID NO: 2070385 - DNA, 11 bp, Homo sapiens
cctcatccctc

SEQ ID NO: 2070386 - DNA, 17 bp, Homo sapiens
cctcatccgaggcaggg

SEQ ID NO: 2070387 - DNA, 20 bp, Homo sapiens
cctcatccgaggcagggtca

SEQ ID NO: 2070388 - DNA, 15 bp, Homo sapiens
cctcatgacagccag

SEQ ID NO: 2070389 - DNA, 16 bp, Homo sapiens
cctcatgacagccaga

SEQ ID NO: 2070390 - DNA, 18 bp, Homo sapiens
cctcatgaccctcctgtc

SEQ ID NO: 2070391 - DNA, 23 bp, Homo sapiens
cctcatgaccctcctgtccagca

SEQ ID NO: 2070392 - DNA, 17 bp, Homo sapiens
cctcatgccacaccttc

SEQ ID NO: 2070393 - DNA, 20 bp, Homo sapiens
cctcatgccacaccttcttc

SEQ ID NO: 2070394 - DNA, 19 bp, Homo sapiens
cctcatgcctggcccccct

SEQ ID NO: 2070395 - DNA, 17 bp, Homo sapiens
cctcatgtgtgctgtgc

SEQ ID NO: 2070396 - DNA, 22 bp, Homo sapiens
cctcattcaggaaaactgacag

SEQ ID NO: 2070397 - DNA, 21 bp, Homo sapiens
cctcattccaccttcccatgc

SEQ ID NO: 2070398 - DNA, 15 bp, Homo sapiens
cctcattcccctcgt

SEQ ID NO: 2070399 - DNA, 19 bp, Homo sapiens
cctcattcgcctgtgggaa

SEQ ID NO: 2070400 - DNA, 20 bp, Homo sapiens
cctcatttatccctcaaccc

SEQ ID NO: 2070401 - DNA, 18 bp, Homo sapiens
cctcatttttttccttgc

SEQ ID NO: 2070402 - DNA, 14 bp, Homo sapiens
cctccaaagcccca

SEQ ID NO: 2070403 - DNA, 16 bp, Homo sapiens
cctccaaagccccacc

SEQ ID NO: 2070404 - DNA, 19 bp, Homo sapiens
cctccaacaataaagagct

SEQ ID NO: 2070405 - DNA, 21 bp, Homo sapiens
cctccaagctccatctccact

SEQ ID NO: 2070406 - DNA, 22 bp, Homo sapiens
cctccaaggggctttgtcctgg

SEQ ID NO: 2070407 - DNA, 23 bp, Homo sapiens
cctccaatcccaccaaccctcag

SEQ ID NO: 2070408 - DNA, 15 bp, Homo sapiens
cctccaatcctttcc

SEQ ID NO: 2070409 - DNA, 15 bp, Homo sapiens
cctccacagccgcag

SEQ ID NO: 2070410 - DNA, 16 bp, Homo sapiens
cctccacagccgcagc

SEQ ID NO: 2070411 - DNA, 14 bp, Homo sapiens
cctccacagtgctg

SEQ ID NO: 2070412 - DNA, 17 bp, Homo sapiens
cctccacagtgctgctt

SEQ ID NO: 2070413 - DNA, 21 bp, Homo sapiens
cctccacattaagtggctttt

SEQ ID NO: 2070414 - DNA, 13 bp, Homo sapiens
cctccaccccagg

SEQ ID NO: 2070415 - DNA, 16 bp, Homo sapiens
cctccacccccgccac

SEQ ID NO: 2070416 - DNA, 18 bp, Homo sapiens
cctccacccccgccacgg

SEQ ID NO: 2070417 - DNA, 13 bp, Homo sapiens
cctccacctcctg

SEQ ID NO: 2070418 - DNA, 17 bp, Homo sapiens
cctccacgcctcctggc

SEQ ID NO: 2070419 - DNA, 20 bp, Homo sapiens
cctccacgcctcctggccag

SEQ ID NO: 2070420 - DNA, 12 bp, Homo sapiens
cctccactcccc

SEQ ID NO: 2070421 - DNA, 20 bp, Homo sapiens
cctccactcccccacctgac

SEQ ID NO: 2070422 - DNA, 12 bp, Homo sapiens
cctccactgtca

SEQ ID NO: 2070423 - DNA, 22 bp, Homo sapiens
cctccagacagatacagcccca

SEQ ID NO: 2070424 - DNA, 21 bp, Homo sapiens
cctccagaccctgcctgagcc

SEQ ID NO: 2070425 - DNA, 16 bp, Homo sapiens
cctccagagacaggaa

SEQ ID NO: 2070426 - DNA, 20 bp, Homo sapiens
cctccagagacaggaaagaa

SEQ ID NO: 2070427 - DNA, 11 bp, Homo sapiens
cctccagagcc

SEQ ID NO: 2070428 - DNA, 12 bp, Homo sapiens
cctccagagcca

SEQ ID NO: 2070429 - DNA, 13 bp, Homo sapiens
cctccagagccag

SEQ ID NO: 2070430 - DNA, 14 bp, Homo sapiens
cctccagagccagc

SEQ ID NO: 2070431 - DNA, 15 bp, Homo sapiens
cctccagagccagcc

SEQ ID NO: 2070432 - DNA, 23 bp, Homo sapiens
cctccagagccagcctgggactc

SEQ ID NO: 2070433 - DNA, 17 bp, Homo sapiens
cctccagcctctcccgg

SEQ ID NO: 2070434 - DNA, 18 bp, Homo sapiens
cctccagcctctcccggc

SEQ ID NO: 2070435 - DNA, 16 bp, Homo sapiens
cctcgctgcgtctcca

SEQ ID NO: 2070436 - DNA, 12 bp, Homo sapiens
cctcgctgctgc

SEQ ID NO: 2070437 - DNA, 13 bp, Homo sapiens
cctcgctgctgct

SEQ ID NO: 2070438 - DNA, 16 bp, Homo sapiens
cctcgctgctgctact

SEQ ID NO: 2070439 - DNA, 17 bp, Homo sapiens
cctcgctgctgctacta

SEQ ID NO: 2070440 - DNA, 13 bp, Homo sapiens
cctcgctgtcctg

SEQ ID NO: 2070441 - DNA, 14 bp, Homo sapiens
cctcgctgtcctgc

SEQ ID NO: 2070442 - DNA, 12 bp, Homo sapiens
cctcggagaaga

SEQ ID NO: 2070443 - DNA, 14 bp, Homo sapiens
cctcggagcctcat

SEQ ID NO: 2070444 - DNA, 17 bp, Homo sapiens
cctcggagctgccagcc

SEQ ID NO: 2070445 - DNA, 15 bp, Homo sapiens
cctcggatcaccgag

SEQ ID NO: 2070446 - DNA, 15 bp, Homo sapiens
cctcggtggccatgc

SEQ ID NO: 2070447 - DNA, 21 bp, Homo sapiens
cctcggtggccatgcttcttg

SEQ ID NO: 2070448 - DNA, 14 bp, Homo sapiens
cctcgtaccagcca

SEQ ID NO: 2070449 - DNA, 23 bp, Homo sapiens
cctcgtccacaggggcaggcctg

SEQ ID NO: 2070450 - DNA, 17 bp, Homo sapiens
cctcgtcccctgcctca

SEQ ID NO: 2070451 - DNA, 17 bp, Homo sapiens
cctcgtcctccccctgc

SEQ ID NO: 2070452 - DNA, 15 bp, Homo sapiens
cctcgtcctgtccca

SEQ ID NO: 2070453 - DNA, 18 bp, Homo sapiens
cctcgtcctgtcccagag

SEQ ID NO: 2070454 - DNA, 18 bp, Homo sapiens
cctcgtggacacctgccc

SEQ ID NO: 2070455 - DNA, 22 bp, Homo sapiens
cctcgtggacacctgccctgcc

SEQ ID NO: 2070456 - DNA, 17 bp, Homo sapiens
cctctactgggaaggct

SEQ ID NO: 2070457 - DNA, 15 bp, Homo sapiens
cctctagaacaccca

SEQ ID NO: 2070458 - DNA, 18 bp, Homo sapiens
cctctagaacacccactg

SEQ ID NO: 2070459 - DNA, 20 bp, Homo sapiens
cctctagaacacccactggc

SEQ ID NO: 2070460 - DNA, 22 bp, Homo sapiens
cctctagaacacccactggcca

SEQ ID NO: 2070461 - DNA, 23 bp, Homo sapiens
cctctagaacacccactggccag

SEQ ID NO: 2070462 - DNA, 15 bp, Homo sapiens
cctctagtgccctcc

SEQ ID NO: 2070463 - DNA, 14 bp, Homo sapiens
cctctatttctctc

SEQ ID NO: 2070464 - DNA, 22 bp, Homo sapiens
cctctcaatattcaataaagct

SEQ ID NO: 2070465 - DNA, 16 bp, Homo sapiens
cctctcactaaacttt

SEQ ID NO: 2070466 - DNA, 17 bp, Homo sapiens
cctctccaattgtaaaa

SEQ ID NO: 2070467 - DNA, 19 bp, Homo sapiens
cctctccaattgtaaaaaa

SEQ ID NO: 2070468 - DNA, 12 bp, Homo sapiens
cctctccactgc

SEQ ID NO: 2070469 - DNA, 16 bp, Homo sapiens
cctctccactgccttc

SEQ ID NO: 2070470 - DNA, 14 bp, Homo sapiens
cctctccagccttc

SEQ ID NO: 2070471 - DNA, 12 bp, Homo sapiens
cctctccaggca

SEQ ID NO: 2070472 - DNA, 17 bp, Homo sapiens
cctctccatgcccaacc

SEQ ID NO: 2070473 - DNA, 14 bp, Homo sapiens
cctctcccacgatg

SEQ ID NO: 2070474 - DNA, 18 bp, Homo sapiens
cctctcccaggccccatg

SEQ ID NO: 2070475 - DNA, 22 bp, Homo sapiens
cctctcccgcgggcctggacac

SEQ ID NO: 2070476 - DNA, 17 bp, Homo sapiens
cctctcccggctgcctg

SEQ ID NO: 2070477 - DNA, 18 bp, Homo sapiens
cctctcccggctgcctgc

SEQ ID NO: 2070478 - DNA, 23 bp, Homo sapiens
cctctcccggctgcctgccgccc

SEQ ID NO: 2070479 - DNA, 12 bp, Homo sapiens
cctctccctggg

SEQ ID NO: 2070480 - DNA, 12 bp, Homo sapiens
cctctcctgcct

SEQ ID NO: 2070481 - DNA, 15 bp, Homo sapiens
cctctcctgcctact

SEQ ID NO: 2070482 - DNA, 14 bp, Homo sapiens
cctctcctgggggt

SEQ ID NO: 2070483 - DNA, 22 bp, Homo sapiens
cctctcctgggggtggcaggca

SEQ ID NO: 2070484 - DNA, 22 bp, Homo sapiens
cctctccttgggctcctggctg

SEQ ID NO: 2070485 - DNA, 19 bp, Homo sapiens
cctctctgagactgctaag

SEQ ID NO: 2070486 - DNA, 15 bp, Homo sapiens
cctctctgctccaga

SEQ ID NO: 2070487 - DNA, 11 bp, Homo sapiens
cctctcttccc

SEQ ID NO: 2070488 - DNA, 12 bp, Homo sapiens
cctctcttgcct

SEQ ID NO: 2070489 - DNA, 15 bp, Homo sapiens
cctctcttgcctttc

SEQ ID NO: 2070490 - DNA, 21 bp, Homo sapiens
cctctgaaatttcccacaccc

SEQ ID NO: 2070491 - DNA, 13 bp, Homo sapiens
cctctgacacaca

SEQ ID NO: 2070492 - DNA, 14 bp, Homo sapiens
cctctgacacacag

SEQ ID NO: 2070493 - DNA, 13 bp, Homo sapiens
cctctgaccaaca

SEQ ID NO: 2070494 - DNA, 20 bp, Homo sapiens
cctctgaccaacaggctgtt

SEQ ID NO: 2070495 - DNA, 19 bp, Homo sapiens
cctctgagaattccaagga

SEQ ID NO: 2070496 - DNA, 16 bp, Homo sapiens
cctctgaggccagcct

SEQ ID NO: 2070497 - DNA, 22 bp, Homo sapiens
cctctgaggccagcctggcctc

SEQ ID NO: 2070498 - DNA, 18 bp, Homo sapiens
cctctgatacccagagca

SEQ ID NO: 2070499 - DNA, 19 bp, Homo sapiens
cctctgatacccagagcat

SEQ ID NO: 2070500 - DNA, 18 bp, Homo sapiens
cctctgatatgggactga

SEQ ID NO: 2070501 - DNA, 12 bp, Homo sapiens
cctctgatccct

SEQ ID NO: 2070502 - DNA, 16 bp, Homo sapiens
cctagttttctcctcc

SEQ ID NO: 2070503 - DNA, 14 bp, Homo sapiens
cctataatgtgtgt

SEQ ID NO: 2070504 - DNA, 18 bp, Homo sapiens
cctataccatatgtctgc

SEQ ID NO: 2070505 - DNA, 21 bp, Homo sapiens
cctataccatatgtctgcttc

SEQ ID NO: 2070506 - DNA, 13 bp, Homo sapiens
cctatagtcccag

SEQ ID NO: 2070507 - DNA, 18 bp, Homo sapiens
cctatatgatttatagtt

SEQ ID NO: 2070508 - DNA, 15 bp, Homo sapiens
cctatcaaaacatat

SEQ ID NO: 2070509 - DNA, 18 bp, Homo sapiens
cctatcaaaacatatcaa

SEQ ID NO: 2070510 - DNA, 16 bp, Homo sapiens
cctatcaatcctgccc

SEQ ID NO: 2070511 - DNA, 13 bp, Homo sapiens
cctatccacccag

SEQ ID NO: 2070512 - DNA, 12 bp, Homo sapiens
cctatccatcct

SEQ ID NO: 2070513 - DNA, 23 bp, Homo sapiens
cctatccatcctgcgagctcctt

SEQ ID NO: 2070514 - DNA, 22 bp, Homo sapiens
cctatgacttgggcacccccag

SEQ ID NO: 2070515 - DNA, 14 bp, Homo sapiens
cctatgatcccagc

SEQ ID NO: 2070516 - DNA, 14 bp, Homo sapiens
cctatgcacatatg

SEQ ID NO: 2070517 - DNA, 15 bp, Homo sapiens
cctatggagagccct

SEQ ID NO: 2070518 - DNA, 24 bp, Homo sapiens
cctatgtactctacgccaaagtgc

SEQ ID NO: 2070519 - DNA, 15 bp, Homo sapiens
cctatgtcctaagga

SEQ ID NO: 2070520 - DNA, 21 bp, Homo sapiens
cctatgtcctaaggacacact

SEQ ID NO: 2070521 - DNA, 22 bp, Homo sapiens
cctatgtcctaaggacacacta

SEQ ID NO: 2070522 - DNA, 22 bp, Homo sapiens
cctattctattgcagttataga

SEQ ID NO: 2070523 - DNA, 13 bp, Homo sapiens
cctattctcacca

SEQ ID NO: 2070524 - DNA, 15 bp, Homo sapiens
cctattctcaccagg

SEQ ID NO: 2070525 - DNA, 19 bp, Homo sapiens
cctattctcaccaggaagg

SEQ ID NO: 2070526 - DNA, 17 bp, Homo sapiens
cctatttattcattcag

SEQ ID NO: 2070527 - DNA, 17 bp, Homo sapiens
cctatttattggggatc

SEQ ID NO: 2070528 - DNA, 14 bp, Homo sapiens
cctcaaaagcactt

SEQ ID NO: 2070529 - DNA, 11 bp, Homo sapiens
cctcaaactgg

SEQ ID NO: 2070530 - DNA, 18 bp, Homo sapiens
cctcaaataaaaagtgct

SEQ ID NO: 2070531 - DNA, 21 bp, Homo sapiens
cctcaaataaaaagtgctttt

SEQ ID NO: 2070532 - DNA, 19 bp, Homo sapiens
cctcaacgttgctccccat

SEQ ID NO: 2070533 - DNA, 16 bp, Homo sapiens
cctcaagaacaccttt

SEQ ID NO: 2070534 - DNA, 15 bp, Homo sapiens
cctcaagctgcatct

SEQ ID NO: 2070535 - DNA, 22 bp, Homo sapiens
cctcaagtgatccacctgcctt

SEQ ID NO: 2070536 - DNA, 21 bp, Homo sapiens
cctcaatccccaagctggcag

SEQ ID NO: 2070537 - DNA, 17 bp, Homo sapiens
cctcaatggacttcaaa

SEQ ID NO: 2070538 - DNA, 19 bp, Homo sapiens
cctcaatggacttcaaatt

SEQ ID NO: 2070539 - DNA, 22 bp, Homo sapiens
cctcaatgtgaatcagacccta

SEQ ID NO: 2070540 - DNA, 12 bp, Homo sapiens
cctcacagcctc

SEQ ID NO: 2070541 - DNA, 13 bp, Homo sapiens
cctcacagtgacc

SEQ ID NO: 2070542 - DNA, 19 bp, Homo sapiens
cctcaccaataacttcaga

SEQ ID NO: 2070543 - DNA, 23 bp, Homo sapiens
cctcaccaataacttcagagaag

SEQ ID NO: 2070544 - DNA, 17 bp, Homo sapiens
cctcaccccctcccacc

SEQ ID NO: 2070545 - DNA, 21 bp, Homo sapiens
cctcaccccctcccaccccca

SEQ ID NO: 2070546 - DNA, 16 bp, Homo sapiens
cctcaccccgtctggg

SEQ ID NO: 2070547 - DNA, 17 bp, Homo sapiens
cctcaccggcatgctgg

SEQ ID NO: 2070548 - DNA, 23 bp, Homo sapiens
cctcaccggcatgctggcctgtg

SEQ ID NO: 2070549 - DNA, 13 bp, Homo sapiens
cctcacctgcctg

SEQ ID NO: 2070550 - DNA, 14 bp, Homo sapiens
cctcacctgggcct

SEQ ID NO: 2070551 - DNA, 15 bp, Homo sapiens
cctcacctgggcctt

SEQ ID NO: 2070552 - DNA, 18 bp, Homo sapiens
cctcacctgggcctttcc

SEQ ID NO: 2070553 - DNA, 20 bp, Homo sapiens
cctcacctgggcctttcctg

SEQ ID NO: 2070554 - DNA, 16 bp, Homo sapiens
cctcacgcccagcctc

SEQ ID NO: 2070555 - DNA, 20 bp, Homo sapiens
cctcactattacttgaactt

SEQ ID NO: 2070556 - DNA, 13 bp, Homo sapiens
cctcactccacac

SEQ ID NO: 2070557 - DNA, 17 bp, Homo sapiens
cctcactccacactggc

SEQ ID NO: 2070558 - DNA, 14 bp, Homo sapiens
ccgtggtccagctc

SEQ ID NO: 2070559 - DNA, 15 bp, Homo sapiens
ccgtggtccagctct

SEQ ID NO: 2070560 - DNA, 18 bp, Homo sapiens
ccgtggtccagctcttgg

SEQ ID NO: 2070561 - DNA, 16 bp, Homo sapiens
ccgtggtctttgaata

SEQ ID NO: 2070562 - DNA, 18 bp, Homo sapiens
ccgtggtctttgaataaa

SEQ ID NO: 2070563 - DNA, 21 bp, Homo sapiens
ccgtggtggcaccgagaccaa

SEQ ID NO: 2070564 - DNA, 15 bp, Homo sapiens
ccgtgtccagcacag

SEQ ID NO: 2070565 - DNA, 11 bp, Homo sapiens
ccgtgtcccaa

SEQ ID NO: 2070566 - DNA, 17 bp, Homo sapiens
ccgtgtcccaaggagct

SEQ ID NO: 2070567 - DNA, 18 bp, Homo sapiens
ccgtgtcccaaggagctg

SEQ ID NO: 2070568 - DNA, 14 bp, Homo sapiens
ccgtgtcctgcctt

SEQ ID NO: 2070569 - DNA, 15 bp, Homo sapiens
ccgtgtcctgccttg

SEQ ID NO: 2070570 - DNA, 21 bp, Homo sapiens
ccgtgtgttctccgtccctgc

SEQ ID NO: 2070571 - DNA, 13 bp, Homo sapiens
ccgttccctgtca

SEQ ID NO: 2070572 - DNA, 15 bp, Homo sapiens
ccgttccctgtcaga

SEQ ID NO: 2070573 - DNA, 20 bp, Homo sapiens
ccgttccttccgatgacagt

SEQ ID NO: 2070574 - DNA, 15 bp, Homo sapiens
ccgttctgctggcct

SEQ ID NO: 2070575 - DNA, 23 bp, Homo sapiens
ccgttctgctggcctggatctcc

SEQ ID NO: 2070576 - DNA, 20 bp, Homo sapiens
ccgttggggattggggaaga

SEQ ID NO: 2070577 - DNA, 16 bp, Homo sapiens
ccgtttatgggccttg

SEQ ID NO: 2070578 - DNA, 19 bp, Homo sapiens
ccgttttcatcctggcctc

SEQ ID NO: 2070579 - DNA, 20 bp, Homo sapiens
ccgttttcatcctggcctcc

SEQ ID NO: 2070580 - DNA, 23 bp, Homo sapiens
ccgtttttcaagaaaactggaaa

SEQ ID NO: 2070581 - DNA, 14 bp, Homo sapiens
cctaaaagtaaaca

SEQ ID NO: 2070582 - DNA, 15 bp, Homo sapiens
cctaaaagtaaacat

SEQ ID NO: 2070583 - DNA, 13 bp, Homo sapiens
cctaaaataaaaa

SEQ ID NO: 2070584 - DNA, 15 bp, Homo sapiens
cctaaaataaaaacc

SEQ ID NO: 2070585 - DNA, 17 bp, Homo sapiens
cctaaaataaaaaccag

SEQ ID NO: 2070586 - DNA, 16 bp, Homo sapiens
cctaaaattcagtgga

SEQ ID NO: 2070587 - DNA, 16 bp, Homo sapiens
cctaaagaaaaacaaa

SEQ ID NO: 2070588 - DNA, 20 bp, Homo sapiens
cctaaagaggaaaagtgcaa

SEQ ID NO: 2070589 - DNA, 22 bp, Homo sapiens
cctaaagaggaaaagtgcaatg

SEQ ID NO: 2070590 - DNA, 15 bp, Homo sapiens
cctaaatccaaagaa

SEQ ID NO: 2070591 - DNA, 15 bp, Homo sapiens
cctaaatgacctcag

SEQ ID NO: 2070592 - DNA, 12 bp, Homo sapiens
cctaaccccttt

SEQ ID NO: 2070593 - DNA, 15 bp, Homo sapiens
cctaacccctttcct

SEQ ID NO: 2070594 - DNA, 19 bp, Homo sapiens
cctaactgagaattttcta

SEQ ID NO: 2070595 - DNA, 17 bp, Homo sapiens
cctaagacttcagtcct

SEQ ID NO: 2070596 - DNA, 21 bp, Homo sapiens
cctaagacttcagtcctggtc

SEQ ID NO: 2070597 - DNA, 14 bp, Homo sapiens
cctaaggacacact

SEQ ID NO: 2070598 - DNA, 15 bp, Homo sapiens
cctaaggacacacta

SEQ ID NO: 2070599 - DNA, 16 bp, Homo sapiens
cctaaggatctctcag

SEQ ID NO: 2070600 - DNA, 17 bp, Homo sapiens
cctaaggatctctcagg

SEQ ID NO: 2070601 - DNA, 19 bp, Homo sapiens
cctaaggatctctcaggag

SEQ ID NO: 2070602 - DNA, 22 bp, Homo sapiens
cctaaggcaacatttccgaaga

SEQ ID NO: 2070603 - DNA, 16 bp, Homo sapiens
cctaagtggctgctga

SEQ ID NO: 2070604 - DNA, 23 bp, Homo sapiens
cctaagtgggaagtgaagcccct

SEQ ID NO: 2070605 - DNA, 21 bp, Homo sapiens
cctaatatttaggcaagagaa

SEQ ID NO: 2070606 - DNA, 19 bp, Homo sapiens
cctaatggagaagacccac

SEQ ID NO: 2070607 - DNA, 16 bp, Homo sapiens
cctaattcaattcaaa

SEQ ID NO: 2070608 - DNA, 11 bp, Homo sapiens
cctaattgaaa

SEQ ID NO: 2070609 - DNA, 20 bp, Homo sapiens
cctacagaaatactgctctg

SEQ ID NO: 2070610 - DNA, 16 bp, Homo sapiens
cctacagatagtcaaa

SEQ ID NO: 2070611 - DNA, 13 bp, Homo sapiens
cctacagcctcag

SEQ ID NO: 2070612 - DNA, 18 bp, Homo sapiens
cctacaggagtgagcact

SEQ ID NO: 2070613 - DNA, 15 bp, Homo sapiens
cctacatccccaggt

SEQ ID NO: 2070614 - DNA, 19 bp, Homo sapiens
cctacatccccaggtctct

SEQ ID NO: 2070615 - DNA, 20 bp, Homo sapiens
cctacatccccaggtctctc

SEQ ID NO: 2070616 - DNA, 20 bp, Homo sapiens
cctacatcttcagctcccat

SEQ ID NO: 2070617 - DNA, 14 bp, Homo sapiens
cctaccaaatataa

SEQ ID NO: 2070618 - DNA, 18 bp, Homo sapiens
cctaccaaatataaactt

SEQ ID NO: 2070619 - DNA, 17 bp, Homo sapiens
ccgggcttgggccctgc

SEQ ID NO: 2070620 - DNA, 16 bp, Homo sapiens
ccggggaactggccaa

SEQ ID NO: 2070621 - DNA, 17 bp, Homo sapiens
ccggggaactggccaag

SEQ ID NO: 2070622 - DNA, 16 bp, Homo sapiens
ccggggagagcagagg

SEQ ID NO: 2070623 - DNA, 19 bp, Homo sapiens
ccggggcccctcaccccaa

SEQ ID NO: 2070624 - DNA, 17 bp, Homo sapiens
ccgggggccagacacag

SEQ ID NO: 2070625 - DNA, 13 bp, Homo sapiens
ccggggtctgtgc

SEQ ID NO: 2070626 - DNA, 22 bp, Homo sapiens
ccggggtctgtgctgtgcctgc

SEQ ID NO: 2070627 - DNA, 18 bp, Homo sapiens
ccgggtacctcagtttct

SEQ ID NO: 2070628 - DNA, 15 bp, Homo sapiens
ccgggtccccagctc

SEQ ID NO: 2070629 - DNA, 18 bp, Homo sapiens
ccgggtccccagctcccc

SEQ ID NO: 2070630 - DNA, 21 bp, Homo sapiens
ccgggtgaaaatgccagtctg

SEQ ID NO: 2070631 - DNA, 13 bp, Homo sapiens
ccgggtgggcctg

SEQ ID NO: 2070632 - DNA, 18 bp, Homo sapiens
ccgggtgggcctggcctg

SEQ ID NO: 2070633 - DNA, 19 bp, Homo sapiens
ccgggtgtgcctgccctgg

SEQ ID NO: 2070634 - DNA, 15 bp, Homo sapiens
ccgggtgtggcctca

SEQ ID NO: 2070635 - DNA, 16 bp, Homo sapiens
ccgggtgtggcctcag

SEQ ID NO: 2070636 - DNA, 18 bp, Homo sapiens
ccgggtgtggcctcagcc

SEQ ID NO: 2070637 - DNA, 16 bp, Homo sapiens
ccggtcacccaggctc

SEQ ID NO: 2070638 - DNA, 23 bp, Homo sapiens
ccggtcaccgagacggctggacc

SEQ ID NO: 2070639 - DNA, 16 bp, Homo sapiens
ccggtgtgcctgcagc

SEQ ID NO: 2070640 - DNA, 17 bp, Homo sapiens
ccggtgtgcctgcagcc

SEQ ID NO: 2070641 - DNA, 20 bp, Homo sapiens
ccgtacccccgtggtctttg

SEQ ID NO: 2070642 - DNA, 21 bp, Homo sapiens
ccgtacccccgtggtctttga

SEQ ID NO: 2070643 - DNA, 23 bp, Homo sapiens
ccgtacccccgtggtctttgaat

SEQ ID NO: 2070644 - DNA, 18 bp, Homo sapiens
ccgtagagggtggccgac

SEQ ID NO: 2070645 - DNA, 14 bp, Homo sapiens
ccgtaggcagcctc

SEQ ID NO: 2070646 - DNA, 21 bp, Homo sapiens
ccgtaggcagcctctctgcta

SEQ ID NO: 2070647 - DNA, 13 bp, Homo sapiens
ccgtccacccagg

SEQ ID NO: 2070648 - DNA, 19 bp, Homo sapiens
ccgtccacccaggctgcac

SEQ ID NO: 2070649 - DNA, 21 bp, Homo sapiens
ccgtccacccaggctgcactg

SEQ ID NO: 2070650 - DNA, 24 bp, Homo sapiens
ccgtccacccaggctgcactgcag

SEQ ID NO: 2070651 - DNA, 18 bp, Homo sapiens
ccgtccaggagcctgtgc

SEQ ID NO: 2070652 - DNA, 13 bp, Homo sapiens
ccgtccatggcac

SEQ ID NO: 2070653 - DNA, 23 bp, Homo sapiens
ccgtccatggcaccagccccctg

SEQ ID NO: 2070654 - DNA, 17 bp, Homo sapiens
ccgtctgactccagagt

SEQ ID NO: 2070655 - DNA, 19 bp, Homo sapiens
ccgtctgactccagagtct

SEQ ID NO: 2070656 - DNA, 22 bp, Homo sapiens
ccgtcttggggctcgccccacc

SEQ ID NO: 2070657 - DNA, 14 bp, Homo sapiens
ccgtgcactcccta

SEQ ID NO: 2070658 - DNA, 19 bp, Homo sapiens
ccgtgcagcttctgtcctg

SEQ ID NO: 2070659 - DNA, 20 bp, Homo sapiens
ccgtgccaagtccaggtcct

SEQ ID NO: 2070660 - DNA, 14 bp, Homo sapiens
ccgtgccttcagct

SEQ ID NO: 2070661 - DNA, 15 bp, Homo sapiens
ccgtgccttcagctc

SEQ ID NO: 2070662 - DNA, 17 bp, Homo sapiens
ccgtgccttcagctcta

SEQ ID NO: 2070663 - DNA, 14 bp, Homo sapiens
ccgtggaccttcct

SEQ ID NO: 2070664 - DNA, 14 bp, Homo sapiens
ccgtggaggctgct

SEQ ID NO: 2070665 - DNA, 15 bp, Homo sapiens
ccgtggccctgccct

SEQ ID NO: 2070666 - DNA, 15 bp, Homo sapiens
ccgtggcttcccgct

SEQ ID NO: 2070667 - DNA, 13 bp, Homo sapiens
ccgtggtccagct

SEQ ID NO: 2070668 - DNA, 13 bp, Homo sapiens
cccctaccccaga

SEQ ID NO: 2070669 - DNA, 16 bp, Homo sapiens
cccctatccacccagc

SEQ ID NO: 2070670 - DNA, 19 bp, Homo sapiens
cccctatccacccagccca

SEQ ID NO: 2070671 - DNA, 13 bp, Homo sapiens
cccctatgctcca

SEQ ID NO: 2070672 - DNA, 18 bp, Homo sapiens
cccctcacctgggccttt

SEQ ID NO: 2070673 - DNA, 21 bp, Homo sapiens
cccctcactctgtcagccagc

SEQ ID NO: 2070674 - DNA, 20 bp, Homo sapiens
cccctcagatgatctctcca

SEQ ID NO: 2070675 - DNA, 21 bp, Homo sapiens
cccctcagatgatctctccac

SEQ ID NO: 2070676 - DNA, 11 bp, Homo sapiens
cccctcagtgc

SEQ ID NO: 2070677 - DNA, 15 bp, Homo sapiens
cccctcatgtgtgct

SEQ ID NO: 2070678 - DNA, 14 bp, Homo sapiens
cccctccactgtca

SEQ ID NO: 2070679 - DNA, 19 bp, Homo sapiens
cccctccagaccctgcctg

SEQ ID NO: 2070680 - DNA, 11 bp, Homo sapiens
cccctccagct

SEQ ID NO: 2070681 - DNA, 22 bp, Homo sapiens
cccctccaggcatgctggcctc

SEQ ID NO: 2070682 - DNA, 14 bp, Homo sapiens
cccctccccagccc

SEQ ID NO: 2070683 - DNA, 15 bp, Homo sapiens
cccctccccagggga

SEQ ID NO: 2070684 - DNA, 20 bp, Homo sapiens
cccctccctcctctggccca

SEQ ID NO: 2070685 - DNA, 16 bp, Homo sapiens
cccctccctctgcccc

SEQ ID NO: 2070686 - DNA, 14 bp, Homo sapiens
cccctccctcttcc

SEQ ID NO: 2070687 - DNA, 15 bp, Homo sapiens
cccctcccttcaacc

SEQ ID NO: 2070688 - DNA, 21 bp, Homo sapiens
cccctcctccccttcctgcac

SEQ ID NO: 2070689 - DNA, 14 bp, Homo sapiens
cccctcgctgctgc

SEQ ID NO: 2070690 - DNA, 13 bp, Homo sapiens
cccctcgctgtcc

SEQ ID NO: 2070691 - DNA, 18 bp, Homo sapiens
cccctcgtcctgtcccag

SEQ ID NO: 2070692 - DNA, 17 bp, Homo sapiens
cccctcgtgtgactctc

SEQ ID NO: 2070693 - DNA, 19 bp, Homo sapiens
cccctctcccctcatggag

SEQ ID NO: 2070694 - DNA, 13 bp, Homo sapiens
cccctctccctgg

SEQ ID NO: 2070695 - DNA, 19 bp, Homo sapiens
cccctctgtgtcctctccc

SEQ ID NO: 2070696 - DNA, 16 bp, Homo sapiens
cccctcttttggcctt

SEQ ID NO: 2070697 - DNA, 18 bp, Homo sapiens
cccctcttttggccttgt

SEQ ID NO: 2070698 - DNA, 17 bp, Homo sapiens
cccctgacctcaccttt

SEQ ID NO: 2070699 - DNA, 16 bp, Homo sapiens
cccctgaggactggag

SEQ ID NO: 2070700 - DNA, 23 bp, Homo sapiens
cccctgcagcttgtagccagccg

SEQ ID NO: 2070701 - DNA, 16 bp, Homo sapiens
cccctgccagtgcctt

SEQ ID NO: 2070702 - DNA, 17 bp, Homo sapiens
cccctgcccggctgcgg

SEQ ID NO: 2070703 - DNA, 15 bp, Homo sapiens
cccctgccctgctgc

SEQ ID NO: 2070704 - DNA, 13 bp, Homo sapiens
cccctgcctgggt

SEQ ID NO: 2070705 - DNA, 15 bp, Homo sapiens
cccctgcctgggttt

SEQ ID NO: 2070706 - DNA, 18 bp, Homo sapiens
cccctgctactcctgtgc

SEQ ID NO: 2070707 - DNA, 16 bp, Homo sapiens
cccctgctgctcatcc

SEQ ID NO: 2070708 - DNA, 13 bp, Homo sapiens
cccctgctggttc

SEQ ID NO: 2070709 - DNA, 15 bp, Homo sapiens
cccctggactgggag

SEQ ID NO: 2070710 - DNA, 15 bp, Homo sapiens
cccctggatgtcccc

SEQ ID NO: 2070711 - DNA, 23 bp, Homo sapiens
cccctggcttttcactgctggct

SEQ ID NO: 2070712 - DNA, 11 bp, Homo sapiens
cccctgggctc

SEQ ID NO: 2070713 - DNA, 18 bp, Homo sapiens
cccctggggcttctcctg

SEQ ID NO: 2070714 - DNA, 22 bp, Homo sapiens
cccctggggtctctgctgcatt

SEQ ID NO: 2070715 - DNA, 16 bp, Homo sapiens
cccctggtctgccctg

SEQ ID NO: 2070716 - DNA, 19 bp, Homo sapiens
cccctggtctgccctgggc

SEQ ID NO: 2070717 - DNA, 19 bp, Homo sapiens
cccctggtggacagtcctg

SEQ ID NO: 2070718 - DNA, 11 bp, Homo sapiens
cccctgtccca

SEQ ID NO: 2070719 - DNA, 14 bp, Homo sapiens
cccctgtgccagct

SEQ ID NO: 2070720 - DNA, 17 bp, Homo sapiens
cccctgtgccagctcag

SEQ ID NO: 2070721 - DNA, 24 bp, Homo sapiens
cccctgtgtgagttgagtctcctc

SEQ ID NO: 2070722 - DNA, 19 bp, Homo sapiens
cccctgttcccccgctggc

SEQ ID NO: 2070723 - DNA, 22 bp, Homo sapiens
ccccttactatgatctcaggag

SEQ ID NO: 2070724 - DNA, 16 bp, Homo sapiens
ccccttatccaggact

SEQ ID NO: 2070725 - DNA, 14 bp, Homo sapiens
ccccttcagtgccc

SEQ ID NO: 2070726 - DNA, 13 bp, Homo sapiens
ccccttcctgcac

SEQ ID NO: 2070727 - DNA, 15 bp, Homo sapiens
ccccttcctgcaccc

SEQ ID NO: 2070728 - DNA, 12 bp, Homo sapiens
ccccttcctgtc

SEQ ID NO: 2070729 - DNA, 23 bp, Homo sapiens
ccccttcgaggttgccccttccc

SEQ ID NO: 2070730 - DNA, 14 bp, Homo sapiens
ccccttctgtgtca

SEQ ID NO: 2070731 - DNA, 22 bp, Homo sapiens
ccccttgaagaggggaggggcc

SEQ ID NO: 2070732 - DNA, 17 bp, Homo sapiens
ccccttgcccagggctc

SEQ ID NO: 2070733 - DNA, 23 bp, Homo sapiens
ccccttgcccagggctcagcctg

SEQ ID NO: 2070734 - DNA, 17 bp, Homo sapiens
ccccttgcccttgccct

SEQ ID NO: 2070735 - DNA, 19 bp, Homo sapiens
ccccttgcccttgccctga

SEQ ID NO: 2070736 - DNA, 21 bp, Homo sapiens
ccccttgcccttgccctgacc

SEQ ID NO: 2070737 - DNA, 22 bp, Homo sapiens
ccccttggcttttgcttggcag

SEQ ID NO: 2070738 - DNA, 13 bp, Homo sapiens
ccccttgggcctc

SEQ ID NO: 2070739 - DNA, 11 bp, Homo sapiens
cccctttcccc

SEQ ID NO: 2070740 - DNA, 14 bp, Homo sapiens
cccctttcctcccc

SEQ ID NO: 2070741 - DNA, 15 bp, Homo sapiens
ccccttttgcctggc

SEQ ID NO: 2070742 - DNA, 17 bp, Homo sapiens
ccccttttgcctggctg

SEQ ID NO: 2070743 - DNA, 16 bp, Homo sapiens
cccgaaagctgagacc

SEQ ID NO: 2070744 - DNA, 19 bp, Homo sapiens
cccgaacctcacctgacct

SEQ ID NO: 2070745 - DNA, 13 bp, Homo sapiens
cccgaagcccagt

SEQ ID NO: 2070746 - DNA, 22 bp, Homo sapiens
cccgaaggttatggtcaatccc

SEQ ID NO: 2070747 - DNA, 16 bp, Homo sapiens
cccgaatagctgggac

SEQ ID NO: 2070748 - DNA, 14 bp, Homo sapiens
cccgacactgctgc

SEQ ID NO: 2070749 - DNA, 19 bp, Homo sapiens
cccgacactgctgcaccag

SEQ ID NO: 2070750 - DNA, 23 bp, Homo sapiens
cccgacactgctgcaccagagtg

SEQ ID NO: 2070751 - DNA, 14 bp, Homo sapiens
cccgacagagagat

SEQ ID NO: 2070752 - DNA, 16 bp, Homo sapiens
cccgacagcccagcct

SEQ ID NO: 2070753 - DNA, 14 bp, Homo sapiens
cccgacagcctggc

SEQ ID NO: 2070754 - DNA, 15 bp, Homo sapiens
cccgacagcctggca

SEQ ID NO: 2070755 - DNA, 15 bp, Homo sapiens
cccgactccagccag

SEQ ID NO: 2070756 - DNA, 16 bp, Homo sapiens
cccgactccagccagc

SEQ ID NO: 2070757 - DNA, 21 bp, Homo sapiens
cccgagaacatggcctaaggg

SEQ ID NO: 2070758 - DNA, 13 bp, Homo sapiens
cccgagcagctga

SEQ ID NO: 2070759 - DNA, 16 bp, Homo sapiens
cccgcttccccacaga

SEQ ID NO: 2070760 - DNA, 14 bp, Homo sapiens
cccgcttgtccagc

SEQ ID NO: 2070761 - DNA, 18 bp, Homo sapiens
cccggagaaggccgctgc

SEQ ID NO: 2070762 - DNA, 20 bp, Homo sapiens
cccggagaaggccgctgccc

SEQ ID NO: 2070763 - DNA, 21 bp, Homo sapiens
cccggagtaatcaggcagcct

SEQ ID NO: 2070764 - DNA, 18 bp, Homo sapiens
cccggatcgaggacaagt

SEQ ID NO: 2070765 - DNA, 13 bp, Homo sapiens
cccggcaccccct

SEQ ID NO: 2070766 - DNA, 19 bp, Homo sapiens
cccggcaccccctgcagct

SEQ ID NO: 2070767 - DNA, 15 bp, Homo sapiens
cccggccagggcctg

SEQ ID NO: 2070768 - DNA, 18 bp, Homo sapiens
cccggccagggcctggtg

SEQ ID NO: 2070769 - DNA, 22 bp, Homo sapiens
cccggcccagagaccccttcct

SEQ ID NO: 2070770 - DNA, 15 bp, Homo sapiens
cccggcccctgctgg

SEQ ID NO: 2070771 - DNA, 16 bp, Homo sapiens
cccggcccctgctggt

SEQ ID NO: 2070772 - DNA, 18 bp, Homo sapiens
cccggcctcagcacccct

SEQ ID NO: 2070773 - DNA, 11 bp, Homo sapiens
cccggcctctt

SEQ ID NO: 2070774 - DNA, 15 bp, Homo sapiens
cccggcctcttccac

SEQ ID NO: 2070775 - DNA, 11 bp, Homo sapiens
cccggctccag

SEQ ID NO: 2070776 - DNA, 12 bp, Homo sapiens
cccggctccagg

SEQ ID NO: 2070777 - DNA, 15 bp, Homo sapiens
cccggctccaggctc

SEQ ID NO: 2070778 - DNA, 13 bp, Homo sapiens
cccggctccccct

SEQ ID NO: 2070779 - DNA, 13 bp, Homo sapiens
cccgggcctgcct

SEQ ID NO: 2070780 - DNA, 15 bp, Homo sapiens
cccgggctctggcca

SEQ ID NO: 2070781 - DNA, 17 bp, Homo sapiens
cccgggctctggccacc

SEQ ID NO: 2070782 - DNA, 12 bp, Homo sapiens
cccggggctggc

SEQ ID NO: 2070783 - DNA, 23 bp, Homo sapiens
cccgggggcagacacctgtgcac

SEQ ID NO: 2070784 - DNA, 14 bp, Homo sapiens
cccgggtccccagc

SEQ ID NO: 2070785 - DNA, 17 bp, Homo sapiens
cccgggtgcctcagagc

SEQ ID NO: 2070786 - DNA, 23 bp, Homo sapiens
cccgggtgcctcagagcaggctc

SEQ ID NO: 2070787 - DNA, 17 bp, Homo sapiens
cccggtcctggccccag

SEQ ID NO: 2070788 - DNA, 18 bp, Homo sapiens
cccggtcctggccccagc

SEQ ID NO: 2070789 - DNA, 18 bp, Homo sapiens
cccggtgcccaagaatag

SEQ ID NO: 2070790 - DNA, 16 bp, Homo sapiens
cccggtgtggtggctc

SEQ ID NO: 2070791 - DNA, 17 bp, Homo sapiens
cccggttcaccttgccg

SEQ ID NO: 2070792 - DNA, 22 bp, Homo sapiens
cccgtacccccgtggtctttga

SEQ ID NO: 2070793 - DNA, 15 bp, Homo sapiens
cccgtaggcagcctc

SEQ ID NO: 2070794 - DNA, 16 bp, Homo sapiens
cccgtaggcagcctct

SEQ ID NO: 2070795 - DNA, 18 bp, Homo sapiens
cccgtcatgttcctcaaa

SEQ ID NO: 2070796 - DNA, 11 bp, Homo sapiens
cccgtccctgc

SEQ ID NO: 2070797 - DNA, 12 bp, Homo sapiens
cccgtccctgcc

SEQ ID NO: 2070798 - DNA, 17 bp, Homo sapiens
cccgtcttcagcctagc

SEQ ID NO: 2070799 - DNA, 18 bp, Homo sapiens
cccgtcttcagcctagcc

SEQ ID NO: 2070800 - DNA, 19 bp, Homo sapiens
cccgtgaagcagtgcctcg

SEQ ID NO: 2070801 - DNA, 11 bp, Homo sapiens
cccgtgcagta

SEQ ID NO: 2070802 - DNA, 15 bp, Homo sapiens
cccgtgccaagtcca

SEQ ID NO: 2070803 - DNA, 21 bp, Homo sapiens
cccgtgccaagtccaggtcct

SEQ ID NO: 2070804 - DNA, 20 bp, Homo sapiens
cccgtggtctttgaataaag

SEQ ID NO: 2070805 - DNA, 15 bp, Homo sapiens
cccgtgtcctgcctt

SEQ ID NO: 2070806 - DNA, 17 bp, Homo sapiens
cccgttctgctggcctg

SEQ ID NO: 2070807 - DNA, 12 bp, Homo sapiens
ccctaaaataaa

SEQ ID NO: 2070808 - DNA, 18 bp, Homo sapiens
ccctaagagagcacctgg

SEQ ID NO: 2070809 - DNA, 19 bp, Homo sapiens
ccctaaggatctctcagga

SEQ ID NO: 2070810 - DNA, 14 bp, Homo sapiens
ccctaatcctccaa

SEQ ID NO: 2070811 - DNA, 15 bp, Homo sapiens
ccctacacctccctc

SEQ ID NO: 2070812 - DNA, 23 bp, Homo sapiens
ccctacatcttcagctcccatag

SEQ ID NO: 2070813 - DNA, 14 bp, Homo sapiens
ccctaccccaccac

SEQ ID NO: 2070814 - DNA, 18 bp, Homo sapiens
ccctaccgagtctcttct

SEQ ID NO: 2070815 - DNA, 21 bp, Homo sapiens
ccctaccgagtctcttctcca

SEQ ID NO: 2070816 - DNA, 14 bp, Homo sapiens
ccctacctgtgcct

SEQ ID NO: 2070817 - DNA, 16 bp, Homo sapiens
ccctactcccctgggc

SEQ ID NO: 2070818 - DNA, 21 bp, Homo sapiens
ccctatagagagggggctctc

SEQ ID NO: 2070819 - DNA, 23 bp, Homo sapiens
ccctatatgtagtataaagaaaa

SEQ ID NO: 2070820 - DNA, 16 bp, Homo sapiens
ccctatccacccagcc

SEQ ID NO: 2070821 - DNA, 18 bp, Homo sapiens
ccctatccacccagccca

SEQ ID NO: 2070822 - DNA, 19 bp, Homo sapiens
ccctatccacccagcccat

SEQ ID NO: 2070823 - DNA, 17 bp, Homo sapiens
ccctatccctgtacaga

SEQ ID NO: 2070824 - DNA, 12 bp, Homo sapiens
ccctattttaag

SEQ ID NO: 2070825 - DNA, 15 bp, Homo sapiens
ccctcaaaccctgtg

SEQ ID NO: 2070826 - DNA, 16 bp, Homo sapiens
ccctcaaaccctgtgg

SEQ ID NO: 2070827 - DNA, 19 bp, Homo sapiens
ccctcaaatgacccaaaga

SEQ ID NO: 2070828 - DNA, 15 bp, Homo sapiens
ccctcaaatgtcaga

SEQ ID NO: 2070829 - DNA, 13 bp, Homo sapiens
ccctcaccaggat

SEQ ID NO: 2070830 - DNA, 14 bp, Homo sapiens
ccctcaccccaagg

SEQ ID NO: 2070831 - DNA, 21 bp, Homo sapiens
ccctcacccccaggtgttgcc

SEQ ID NO: 2070832 - DNA, 18 bp, Homo sapiens
ccctcaccccctcccacc

SEQ ID NO: 2070833 - DNA, 18 bp, Homo sapiens
ccctcactccacactggc

SEQ ID NO: 2070834 - DNA, 14 bp, Homo sapiens
ccctcactctggcc

SEQ ID NO: 2070835 - DNA, 18 bp, Homo sapiens
ccctcactgaatgcctca

SEQ ID NO: 2070836 - DNA, 13 bp, Homo sapiens
ccctcagagaggc

SEQ ID NO: 2070837 - DNA, 13 bp, Homo sapiens
ccctcagcccttg

SEQ ID NO: 2070838 - DNA, 19 bp, Homo sapiens
ccctcaggccagtgccagg

SEQ ID NO: 2070839 - DNA, 20 bp, Homo sapiens
ccctcaggccagtgccagga

SEQ ID NO: 2070840 - DNA, 21 bp, Homo sapiens
ccctcaggccagtgccaggac

SEQ ID NO: 2070841 - DNA, 21 bp, Homo sapiens
ccctcagtgctcggcagtcat

SEQ ID NO: 2070842 - DNA, 17 bp, Homo sapiens
ccctcataccatctgct

SEQ ID NO: 2070843 - DNA, 20 bp, Homo sapiens
ccctcatggagaaacatcct

SEQ ID NO: 2070844 - DNA, 21 bp, Homo sapiens
ccctcatggagaaacatccta

SEQ ID NO: 2070845 - DNA, 15 bp, Homo sapiens
ccctgcagaccctgc

SEQ ID NO: 2070846 - DNA, 19 bp, Homo sapiens
ccctgcagaccctgccctt

SEQ ID NO: 2070847 - DNA, 19 bp, Homo sapiens
ccctgcagccaaacagagc

SEQ ID NO: 2070848 - DNA, 21 bp, Homo sapiens
ccctgcagccaaacagagcct

SEQ ID NO: 2070849 - DNA, 13 bp, Homo sapiens
ccctgcatcccct

SEQ ID NO: 2070850 - DNA, 17 bp, Homo sapiens
ccctgccaccctgggga

SEQ ID NO: 2070851 - DNA, 18 bp, Homo sapiens
ccctgccacctgtctgtc

SEQ ID NO: 2070852 - DNA, 23 bp, Homo sapiens
ccctgccagggctcgggcgctgt

SEQ ID NO: 2070853 - DNA, 21 bp, Homo sapiens
ccctgcccatacccctgcctg

SEQ ID NO: 2070854 - DNA, 22 bp, Homo sapiens
ccctgcccatacccctgcctgg

SEQ ID NO: 2070855 - DNA, 12 bp, Homo sapiens
ccctgccccatc

SEQ ID NO: 2070856 - DNA, 15 bp, Homo sapiens
ccctgcccccaaagg

SEQ ID NO: 2070857 - DNA, 22 bp, Homo sapiens
ccctgcccccaaaggtggtctg

SEQ ID NO: 2070858 - DNA, 20 bp, Homo sapiens
ccctgcccccatctccccag

SEQ ID NO: 2070859 - DNA, 21 bp, Homo sapiens
ccctgcccccatctccccagg

SEQ ID NO: 2070860 - DNA, 17 bp, Homo sapiens
ccctgcccctcccttca

SEQ ID NO: 2070861 - DNA, 23 bp, Homo sapiens
ccctgcccctcccttcaaccatt

SEQ ID NO: 2070862 - DNA, 13 bp, Homo sapiens
ccctgcccctgcc

SEQ ID NO: 2070863 - DNA, 19 bp, Homo sapiens
ccctgcccgaccccatctc

SEQ ID NO: 2070864 - DNA, 15 bp, Homo sapiens
ccctgccctgccacc

SEQ ID NO: 2070865 - DNA, 13 bp, Homo sapiens
ccctgccctgctg

SEQ ID NO: 2070866 - DNA, 13 bp, Homo sapiens
ccctgccctgtcc

SEQ ID NO: 2070867 - DNA, 15 bp, Homo sapiens
ccctgccctgtcctc

SEQ ID NO: 2070868 - DNA, 16 bp, Homo sapiens
ccctgcctcatccacc

SEQ ID NO: 2070869 - DNA, 17 bp, Homo sapiens
ccctgcctcatccacca

SEQ ID NO: 2070870 - DNA, 22 bp, Homo sapiens
ccctgcctccctttctgggagg

SEQ ID NO: 2070871 - DNA, 11 bp, Homo sapiens
ccctgcctgca

SEQ ID NO: 2070872 - DNA, 12 bp, Homo sapiens
ccctgcctgccc

SEQ ID NO: 2070873 - DNA, 22 bp, Homo sapiens
ccctgcctggaggacctgagcc

SEQ ID NO: 2070874 - DNA, 12 bp, Homo sapiens
ccctgcctgggt

SEQ ID NO: 2070875 - DNA, 13 bp, Homo sapiens
ccctgcctgggtt

SEQ ID NO: 2070876 - DNA, 17 bp, Homo sapiens
ccctgcctggtatgagt

SEQ ID NO: 2070877 - DNA, 23 bp, Homo sapiens
ccctgcctttgaaattcccccac

SEQ ID NO: 2070878 - DNA, 20 bp, Homo sapiens
ccctgcgaaggggccctggt

SEQ ID NO: 2070879 - DNA, 22 bp, Homo sapiens
ccctgcgtcctgacgccctgcg

SEQ ID NO: 2070880 - DNA, 16 bp, Homo sapiens
ccctgcgttggagcca

SEQ ID NO: 2070881 - DNA, 18 bp, Homo sapiens
ccctgctactcctgtgct

SEQ ID NO: 2070882 - DNA, 21 bp, Homo sapiens
ccctgctactcctgtgctctg

SEQ ID NO: 2070883 - DNA, 22 bp, Homo sapiens
ccctgctactcctgtgctctgg

SEQ ID NO: 2070884 - DNA, 10 bp, Homo sapiens
ccctgctcct

SEQ ID NO: 2070885 - DNA, 12 bp, Homo sapiens
ccctgctcctcc

SEQ ID NO: 2070886 - DNA, 15 bp, Homo sapiens
ccctgctcctcccaa

SEQ ID NO: 2070887 - DNA, 22 bp, Homo sapiens
ccctgctctccgaccagacacc

SEQ ID NO: 2070888 - DNA, 19 bp, Homo sapiens
ccctgctgccgcctcccag

SEQ ID NO: 2070889 - DNA, 23 bp, Homo sapiens
ccctgctgccgcctcccagcctg

SEQ ID NO: 2070890 - DNA, 22 bp, Homo sapiens
ccctgctgcggccagcctgact

SEQ ID NO: 2070891 - DNA, 13 bp, Homo sapiens
ccctgctggttca

SEQ ID NO: 2070892 - DNA, 13 bp, Homo sapiens
ccctgctgtggga

SEQ ID NO: 2070893 - DNA, 18 bp, Homo sapiens
ccctgctttgggctgccc

SEQ ID NO: 2070894 - DNA, 19 bp, Homo sapiens
ccctgctttgggctgccct

SEQ ID NO: 2070895 - DNA, 15 bp, Homo sapiens
ccctggaactgtctc

SEQ ID NO: 2070896 - DNA, 19 bp, Homo sapiens
ccctggaccaccagcccca

SEQ ID NO: 2070897 - DNA, 15 bp, Homo sapiens
ccctggagtgcagtt

SEQ ID NO: 2070898 - DNA, 15 bp, Homo sapiens
ccctggatcagaaca

SEQ ID NO: 2070899 - DNA, 15 bp, Homo sapiens
ccctggatgggcatt

SEQ ID NO: 2070900 - DNA, 17 bp, Homo sapiens
ccctggatgggcattgg

SEQ ID NO: 2070901 - DNA, 21 bp, Homo sapiens
ccctggatgggcattgggctg

SEQ ID NO: 2070902 - DNA, 20 bp, Homo sapiens
ccctggcaggatgaccctgc

SEQ ID NO: 2070903 - DNA, 23 bp, Homo sapiens
ccctggcatgtcagagccaggct

SEQ ID NO: 2070904 - DNA, 21 bp, Homo sapiens
ccctggcctcacgcccagcct

SEQ ID NO: 2070905 - DNA, 20 bp, Homo sapiens
ccctggcctggctctcctgt

SEQ ID NO: 2070906 - DNA, 15 bp, Homo sapiens
ccctggcctgtggag

SEQ ID NO: 2070907 - DNA, 20 bp, Homo sapiens
ccctggctcccacaggccct

SEQ ID NO: 2070908 - DNA, 10 bp, Homo sapiens
ccctggctct

SEQ ID NO: 2070909 - DNA, 13 bp, Homo sapiens
ccctggctcttct

SEQ ID NO: 2070910 - DNA, 23 bp, Homo sapiens
ccctggctgaccccaaagagcct

SEQ ID NO: 2070911 - DNA, 19 bp, Homo sapiens
ccctggcttgtaactccac

SEQ ID NO: 2070912 - DNA, 20 bp, Homo sapiens
ccctggcttgtaactccacc

SEQ ID NO: 2070913 - DNA, 19 bp, Homo sapiens
ccctggcttttcactgctg

SEQ ID NO: 2070914 - DNA, 13 bp, Homo sapiens
ccctgggaactca

SEQ ID NO: 2070915 - DNA, 16 bp, Homo sapiens
ccctgggaaggctaag

SEQ ID NO: 2070916 - DNA, 19 bp, Homo sapiens
ccctgggatgggaccaggg

SEQ ID NO: 2070917 - DNA, 19 bp, Homo sapiens
ccctgggcatcttctggct

SEQ ID NO: 2070918 - DNA, 18 bp, Homo sapiens
ccctgggccccaccacct

SEQ ID NO: 2070919 - DNA, 16 bp, Homo sapiens
ccctgggcccctccac

SEQ ID NO: 2070920 - DNA, 13 bp, Homo sapiens
ccctgggcctcag

SEQ ID NO: 2070921 - DNA, 23 bp, Homo sapiens
ccctgggcctcagttcaacctgg

SEQ ID NO: 2070922 - DNA, 14 bp, Homo sapiens
ccctgggcctgctg

SEQ ID NO: 2070923 - DNA, 16 bp, Homo sapiens
ccctgggctgtctgtc

SEQ ID NO: 2070924 - DNA, 18 bp, Homo sapiens
ccctgggctgtctgtcac

SEQ ID NO: 2070925 - DNA, 20 bp, Homo sapiens
ccctgggctgtctgtcacca

SEQ ID NO: 2070926 - DNA, 13 bp, Homo sapiens
ccctggggcctgt

SEQ ID NO: 2070927 - DNA, 18 bp, Homo sapiens
ccctggggcctgtactgc

SEQ ID NO: 2070928 - DNA, 23 bp, Homo sapiens
ccctggggcctgtactgcctgct

SEQ ID NO: 2070929 - DNA, 18 bp, Homo sapiens
ccctggggcttctcctga

SEQ ID NO: 2070930 - DNA, 19 bp, Homo sapiens
ccctggggcttctcctgac

SEQ ID NO: 2070931 - DNA, 21 bp, Homo sapiens
ccctggggcttctcctgaccc

SEQ ID NO: 2070932 - DNA, 14 bp, Homo sapiens
ccctgggggccagc

SEQ ID NO: 2070933 - DNA, 16 bp, Homo sapiens
ccctgggggccagctg

SEQ ID NO: 2070934 - DNA, 21 bp, Homo sapiens
ccctgggggccagctggtgct

SEQ ID NO: 2070935 - DNA, 18 bp, Homo sapiens
ccctgggggctagcagaa

SEQ ID NO: 2070936 - DNA, 22 bp, Homo sapiens
ccctggggtatgagctgccaag

SEQ ID NO: 2070937 - DNA, 16 bp, Homo sapiens
ccctggtccttccagg

SEQ ID NO: 2070938 - DNA, 17 bp, Homo sapiens
ccctggtgctgccacac

SEQ ID NO: 2070939 - DNA, 17 bp, Homo sapiens
ccctggtggacagtcct

SEQ ID NO: 2070940 - DNA, 19 bp, Homo sapiens
ccctggtggacagtcctgg

SEQ ID NO: 2070941 - DNA, 19 bp, Homo sapiens
ccctggtggcagtgggagc

SEQ ID NO: 2070942 - DNA, 17 bp, Homo sapiens
ccctggtgtcaggcagg

SEQ ID NO: 2070943 - DNA, 14 bp, Homo sapiens
ccctggtgtgtttc

SEQ ID NO: 2070944 - DNA, 17 bp, Homo sapiens
ccctgtacccagctcct

SEQ ID NO: 2070945 - DNA, 16 bp, Homo sapiens
ccctgtagctctgcct

SEQ ID NO: 2070946 - DNA, 17 bp, Homo sapiens
ccctgtagctctgcctc

SEQ ID NO: 2070947 - DNA, 19 bp, Homo sapiens
ccctgtatataatactaaa

SEQ ID NO: 2070948 - DNA, 14 bp, Homo sapiens
ccctgtcagaggct

SEQ ID NO: 2070949 - DNA, 17 bp, Homo sapiens
ccctgtcccaccaactc

SEQ ID NO: 2070950 - DNA, 14 bp, Homo sapiens
ccctgtcccagcag

SEQ ID NO: 2070951 - DNA, 14 bp, Homo sapiens
ccctgtcccctgaa

SEQ ID NO: 2070952 - DNA, 18 bp, Homo sapiens
ccctgtcctccagcttcc

SEQ ID NO: 2070953 - DNA, 19 bp, Homo sapiens
ccctgtcctccagcttccc

SEQ ID NO: 2070954 - DNA, 15 bp, Homo sapiens
ccctgtcctcctcgg

SEQ ID NO: 2070955 - DNA, 13 bp, Homo sapiens
ccctgtcttctct

SEQ ID NO: 2070956 - DNA, 15 bp, Homo sapiens
ccctgtgccagctca

SEQ ID NO: 2070957 - DNA, 12 bp, Homo sapiens
ccctgtggcaga

SEQ ID NO: 2070958 - DNA, 18 bp, Homo sapiens
ccctgtggggcctgatgg

SEQ ID NO: 2070959 - DNA, 19 bp, Homo sapiens
ccctgtgggggtggccatc

SEQ ID NO: 2070960 - DNA, 14 bp, Homo sapiens
ccccactccagccc

SEQ ID NO: 2070961 - DNA, 15 bp, Homo sapiens
ccccactctgctctg

SEQ ID NO: 2070962 - DNA, 17 bp, Homo sapiens
ccccactctgctctgat

SEQ ID NO: 2070963 - DNA, 16 bp, Homo sapiens
ccccactgcaggcccc

SEQ ID NO: 2070964 - DNA, 21 bp, Homo sapiens
ccccacttctctactctggaa

SEQ ID NO: 2070965 - DNA, 23 bp, Homo sapiens
ccccacttctctactctggaagt

SEQ ID NO: 2070966 - DNA, 21 bp, Homo sapiens
ccccagagccactacctttgt

SEQ ID NO: 2070967 - DNA, 19 bp, Homo sapiens
ccccagagccccactcccg

SEQ ID NO: 2070968 - DNA, 19 bp, Homo sapiens
ccccagatctgcctgggcc

SEQ ID NO: 2070969 - DNA, 22 bp, Homo sapiens
ccccagatctgcctgggcctgt

SEQ ID NO: 2070970 - DNA, 21 bp, Homo sapiens
ccccagcaagtgagagctggg

SEQ ID NO: 2070971 - DNA, 19 bp, Homo sapiens
ccccagcactaaagcagtg

SEQ ID NO: 2070972 - DNA, 22 bp, Homo sapiens
ccccagcactcctctgtctctg

SEQ ID NO: 2070973 - DNA, 23 bp, Homo sapiens
ccccagcagttgaatgacaacag

SEQ ID NO: 2070974 - DNA, 20 bp, Homo sapiens
ccccagccatggtgaggaag

SEQ ID NO: 2070975 - DNA, 20 bp, Homo sapiens
ccccagcccacagagcctga

SEQ ID NO: 2070976 - DNA, 13 bp, Homo sapiens
ccccagcccccac

SEQ ID NO: 2070977 - DNA, 23 bp, Homo sapiens
ccccagccccgactccagccagc

SEQ ID NO: 2070978 - DNA, 17 bp, Homo sapiens
cactgagaatgatagta

SEQ ID NO: 2070979 - DNA, 18 bp, Homo sapiens
cactgagacggcagagac

SEQ ID NO: 2070980 - DNA, 17 bp, Homo sapiens
cactgagatctgtttga

SEQ ID NO: 2070981 - DNA, 13 bp, Homo sapiens
cactgagctgggc

SEQ ID NO: 2070982 - DNA, 14 bp, Homo sapiens
cactgaggatgtga

SEQ ID NO: 2070983 - DNA, 18 bp, Homo sapiens
cactgaggatgtgagcct

SEQ ID NO: 2070984 - DNA, 14 bp, Homo sapiens
cactgagggccaca

SEQ ID NO: 2070985 - DNA, 18 bp, Homo sapiens
cactgatatattttccag

SEQ ID NO: 2070986 - DNA, 24 bp, Homo sapiens
cactgatgggcaacccccagcctg

SEQ ID NO: 2070987 - DNA, 21 bp, Homo sapiens
cactgcaacctccacctcctg

SEQ ID NO: 2070988 - DNA, 22 bp, Homo sapiens
cactgcaacctccacctcctga

SEQ ID NO: 2070989 - DNA, 21 bp, Homo sapiens
cactgcaacctcttcctcctg

SEQ ID NO: 2070990 - DNA, 23 bp, Homo sapiens
cactgcaacctcttcctcctggt

SEQ ID NO: 2070991 - DNA, 20 bp, Homo sapiens
cactgcaacttctacctccg

SEQ ID NO: 2070992 - DNA, 15 bp, Homo sapiens
cactgcaagagcctt

SEQ ID NO: 2070993 - DNA, 17 bp, Homo sapiens
cactgcaagagccttgg

SEQ ID NO: 2070994 - DNA, 20 bp, Homo sapiens
cactgcaagagccttggtgt

SEQ ID NO: 2070995 - DNA, 20 bp, Homo sapiens
cactgcaatctccacctccc

SEQ ID NO: 2070996 - DNA, 19 bp, Homo sapiens
cactgcaccgggccacaga

SEQ ID NO: 2070997 - DNA, 18 bp, Homo sapiens
cactgcactatagcctag

SEQ ID NO: 2070998 - DNA, 20 bp, Homo sapiens
cactgcactccagcctgggc

SEQ ID NO: 2070999 - DNA, 13 bp, Homo sapiens
cactgcactccgg

SEQ ID NO: 2071000 - DNA, 13 bp, Homo sapiens
cactgcagcctca

SEQ ID NO: 2071001 - DNA, 21 bp, Homo sapiens
cactgcagcctcaacctcctg

SEQ ID NO: 2071002 - DNA, 22 bp, Homo sapiens
cactgcagcctcaacctcctgg

SEQ ID NO: 2071003 - DNA, 13 bp, Homo sapiens
cactgcaggcccc

SEQ ID NO: 2071004 - DNA, 16 bp, Homo sapiens
cactgcaggccccgct

SEQ ID NO: 2071005 - DNA, 13 bp, Homo sapiens
cactgcagtgatg

SEQ ID NO: 2071006 - DNA, 20 bp, Homo sapiens
cactgccacaccctccccat

SEQ ID NO: 2071007 - DNA, 13 bp, Homo sapiens
cactgccaggagg

SEQ ID NO: 2071008 - DNA, 15 bp, Homo sapiens
cactgccaggaggga

SEQ ID NO: 2071009 - DNA, 12 bp, Homo sapiens
cactgccaggca

SEQ ID NO: 2071010 - DNA, 20 bp, Homo sapiens
cactgccaggcacctggcct

SEQ ID NO: 2071011 - DNA, 13 bp, Homo sapiens
caagagaagaaaa

SEQ ID NO: 2071012 - DNA, 19 bp, Homo sapiens
caagagaagaaaaaattaa

SEQ ID NO: 2071013 - DNA, 18 bp, Homo sapiens
cagagtcagaggagaaga

SEQ ID NO: 2071014 - DNA, 12 bp, Homo sapiens
cagagtcattgt

SEQ ID NO: 2071015 - DNA, 21 bp, Homo sapiens
cagagtctcactgttgcccag

SEQ ID NO: 2071016 - DNA, 23 bp, Homo sapiens
cagagtctcactgttgcccaggc

SEQ ID NO: 2071017 - DNA, 22 bp, Homo sapiens
cagagtgaggatgtgttttgca

SEQ ID NO: 2071018 - DNA, 17 bp, Homo sapiens
cagagtgattcaggggc

SEQ ID NO: 2071019 - DNA, 19 bp, Homo sapiens
cagagtggagtctgagtct

SEQ ID NO: 2071020 - DNA, 17 bp, Homo sapiens
cagagtgggctgcctgg

SEQ ID NO: 2071021 - DNA, 19 bp, Homo sapiens
cagagtgggctgcctgggg

SEQ ID NO: 2071022 - DNA, 19 bp, Homo sapiens
cagagtgtgcagactgatg

SEQ ID NO: 2071023 - DNA, 22 bp, Homo sapiens
cagagttattgaatcttaattt

SEQ ID NO: 2071024 - DNA, 15 bp, Homo sapiens
cagagttctgctcta

SEQ ID NO: 2071025 - DNA, 16 bp, Homo sapiens
cagagttgggatgcgg

SEQ ID NO: 2071026 - DNA, 16 bp, Homo sapiens
cacggatgcacagaga

SEQ ID NO: 2071027 - DNA, 19 bp, Homo sapiens
cacggcacctgggccctgg

SEQ ID NO: 2071028 - DNA, 22 bp, Homo sapiens
cacggcacctgggccctggggc

SEQ ID NO: 2071029 - DNA, 15 bp, Homo sapiens
cacggccaccctcct

SEQ ID NO: 2071030 - DNA, 17 bp, Homo sapiens
cacggccaccctccttc

SEQ ID NO: 2071031 - DNA, 12 bp, Homo sapiens
cacggccaggcc

SEQ ID NO: 2071032 - DNA, 15 bp, Homo sapiens
cacggccaggccaga

SEQ ID NO: 2071033 - DNA, 16 bp, Homo sapiens
cacggccaggccagag

SEQ ID NO: 2071034 - DNA, 22 bp, Homo sapiens
cacggccctgccccatcctggg

SEQ ID NO: 2071035 - DNA, 15 bp, Homo sapiens
cacggctcactgcag

SEQ ID NO: 2071036 - DNA, 19 bp, Homo sapiens
cacggctcactgcagcctc

SEQ ID NO: 2071037 - DNA, 16 bp, Homo sapiens
cacgggcctcagtttc

SEQ ID NO: 2071038 - DNA, 15 bp, Homo sapiens
cacggggtattttag

SEQ ID NO: 2071039 - DNA, 20 bp, Homo sapiens
cacggtgcgtggctgtggca

SEQ ID NO: 2071040 - DNA, 23 bp, Homo sapiens
cacggtgcgtggctgtggcacag

SEQ ID NO: 2071041 - DNA, 19 bp, Homo sapiens
cacgtatttatatttggaa

SEQ ID NO: 2071042 - DNA, 16 bp, Homo sapiens
cacgtccagaattttt

SEQ ID NO: 2071043 - DNA, 13 bp, Homo sapiens
cacgtcccatgtg

SEQ ID NO: 2071044 - DNA, 13 bp, Homo sapiens
cacgtctgccagg

SEQ ID NO: 2071045 - DNA, 14 bp, Homo sapiens
cacgtctgccaggc

SEQ ID NO: 2071046 - DNA, 13 bp, Homo sapiens
cacgtgccaggcc

SEQ ID NO: 2071047 - DNA, 17 bp, Homo sapiens
cacgtgctcgcagcctg

SEQ ID NO: 2071048 - DNA, 18 bp, Homo sapiens
cacgtgctcgcagcctgg

SEQ ID NO: 2071049 - DNA, 13 bp, Homo sapiens
cacgtggtgtccc

SEQ ID NO: 2071050 - DNA, 19 bp, Homo sapiens
cacgttccttactgcagaa

SEQ ID NO: 2071051 - DNA, 22 bp, Homo sapiens
cacgttcgaggcggtttccagg

SEQ ID NO: 2071052 - DNA, 16 bp, Homo sapiens
cactaaatgagctcct

SEQ ID NO: 2071053 - DNA, 18 bp, Homo sapiens
cactaaatgagctcctgc

SEQ ID NO: 2071054 - DNA, 14 bp, Homo sapiens
cactaaccacgctg

SEQ ID NO: 2071055 - DNA, 15 bp, Homo sapiens
cactaaccacgctgg

SEQ ID NO: 2071056 - DNA, 16 bp, Homo sapiens
cactaaccacgctgga

SEQ ID NO: 2071057 - DNA, 19 bp, Homo sapiens
cactaagctttctcctttg

SEQ ID NO: 2071058 - DNA, 23 bp, Homo sapiens
cactaaggccgtgtctctgagga

SEQ ID NO: 2071059 - DNA, 17 bp, Homo sapiens
cactaaggtgtgctctg

SEQ ID NO: 2071060 - DNA, 17 bp, Homo sapiens
cactacaagtttataag

SEQ ID NO: 2071061 - DNA, 16 bp, Homo sapiens
cactacactccagcct

SEQ ID NO: 2071062 - DNA, 17 bp, Homo sapiens
cactacactccagcctg

SEQ ID NO: 2071063 - DNA, 20 bp, Homo sapiens
cactacatgtggtttataga

SEQ ID NO: 2071064 - DNA, 21 bp, Homo sapiens
cactaccacgccaagctaatt

SEQ ID NO: 2071065 - DNA, 14 bp, Homo sapiens
cactaccttatcag

SEQ ID NO: 2071066 - DNA, 20 bp, Homo sapiens
cactaccttctgacctcccc

SEQ ID NO: 2071067 - DNA, 14 bp, Homo sapiens
cactacctttgtcc

SEQ ID NO: 2071068 - DNA, 21 bp, Homo sapiens
cactacctttgtccaggcctg

SEQ ID NO: 2071069 - DNA, 17 bp, Homo sapiens
cactagcattttcttga

SEQ ID NO: 2071070 - DNA, 14 bp, Homo sapiens
cactagcctctcca

SEQ ID NO: 2071071 - DNA, 21 bp, Homo sapiens
cactagcctctccaggaatgc

SEQ ID NO: 2071072 - DNA, 16 bp, Homo sapiens
cactaggactctgagg

SEQ ID NO: 2071073 - DNA, 17 bp, Homo sapiens
cactaggactctgaggc

SEQ ID NO: 2071074 - DNA, 12 bp, Homo sapiens
cactataaatgg

SEQ ID NO: 2071075 - DNA, 19 bp, Homo sapiens
cactataaatggtgttttt

SEQ ID NO: 2071076 - DNA, 19 bp, Homo sapiens
cactatctttctgataaca

SEQ ID NO: 2071077 - DNA, 17 bp, Homo sapiens
cactatgacactgagca

SEQ ID NO: 2071078 - DNA, 22 bp, Homo sapiens
cagaatatggacaaagaaggca

SEQ ID NO: 2071079 - DNA, 13 bp, Homo sapiens
cagaatccaaaga

SEQ ID NO: 2071080 - DNA, 15 bp, Homo sapiens
cagaatccaaagatc

SEQ ID NO: 2071081 - DNA, 20 bp, Homo sapiens
cagaatcttcgtcctgcccc

SEQ ID NO: 2071082 - DNA, 16 bp, Homo sapiens
cagaatgaagacctaa

SEQ ID NO: 2071083 - DNA, 18 bp, Homo sapiens
cagaatgaagacctaaat

SEQ ID NO: 2071084 - DNA, 21 bp, Homo sapiens
cagaatgctaaagtttcctaa

SEQ ID NO: 2071085 - DNA, 12 bp, Homo sapiens
cagaatgctgtt

SEQ ID NO: 2071086 - DNA, 18 bp, Homo sapiens
cagaatgctgttttaaaa

SEQ ID NO: 2071087 - DNA, 15 bp, Homo sapiens
cagaattcccagctg

SEQ ID NO: 2071088 - DNA, 23 bp, Homo sapiens
cagaattcccagctgtctgtgtc

SEQ ID NO: 2071089 - DNA, 21 bp, Homo sapiens
cagaattctgctacctcactg

SEQ ID NO: 2071090 - DNA, 23 bp, Homo sapiens
cagaattctgctacctcactggg

SEQ ID NO: 2071091 - DNA, 12 bp, Homo sapiens
cagaatttttaa

SEQ ID NO: 2071092 - DNA, 22 bp, Homo sapiens
cagaatttttaatgacttttta

SEQ ID NO: 2071093 - DNA, 19 bp, Homo sapiens
cagacaaaaacagcctcac

SEQ ID NO: 2071094 - DNA, 22 bp, Homo sapiens
cagacaaaaacagcctcacaga

SEQ ID NO: 2071095 - DNA, 14 bp, Homo sapiens
cagacaagagctgc

SEQ ID NO: 2071096 - DNA, 15 bp, Homo sapiens
cagacaagagctgct

SEQ ID NO: 2071097 - DNA, 16 bp, Homo sapiens
cagacaagtaatcact

SEQ ID NO: 2071098 - DNA, 14 bp, Homo sapiens
cagacaatccactc

SEQ ID NO: 2071099 - DNA, 21 bp, Homo sapiens
cagacaattcagaagcatcac

SEQ ID NO: 2071100 - DNA, 20 bp, Homo sapiens
cagacacacaaaatgtcaca

SEQ ID NO: 2071101 - DNA, 13 bp, Homo sapiens
cagacacaggccc

SEQ ID NO: 2071102 - DNA, 17 bp, Homo sapiens
cagacacaggcccggct

SEQ ID NO: 2071103 - DNA, 21 bp, Homo sapiens
cagacacaggcccggctccag

SEQ ID NO: 2071104 - DNA, 22 bp, Homo sapiens
cagacacattctcctgtgcccc

SEQ ID NO: 2071105 - DNA, 22 bp, Homo sapiens
cagacaccttgacagggcacac

SEQ ID NO: 2071106 - DNA, 18 bp, Homo sapiens
cagacactaagttatagt

SEQ ID NO: 2071107 - DNA, 18 bp, Homo sapiens
cagacacttcatggacca

SEQ ID NO: 2071108 - DNA, 13 bp, Homo sapiens
cagacagatccca

SEQ ID NO: 2071109 - DNA, 18 bp, Homo sapiens
cagacagcagctcaggca

SEQ ID NO: 2071110 - DNA, 13 bp, Homo sapiens
cagacaggagaaa

SEQ ID NO: 2071111 - DNA, 21 bp, Homo sapiens
cagacaggagaaatgcatcca

SEQ ID NO: 2071112 - DNA, 11 bp, Homo sapiens
cagacaggcaa

SEQ ID NO: 2071113 - DNA, 19 bp, Homo sapiens
cagacagtgttttctggga

SEQ ID NO: 2071114 - DNA, 17 bp, Homo sapiens
cagacatacgaaacaca

SEQ ID NO: 2071115 - DNA, 22 bp, Homo sapiens
cagacatgtggtgggacaggga

SEQ ID NO: 2071116 - DNA, 13 bp, Homo sapiens
cagaccacctgcc

SEQ ID NO: 2071117 - DNA, 18 bp, Homo sapiens
cagaccacctgccagcca

SEQ ID NO: 2071118 - DNA, 17 bp, Homo sapiens
cagaccattgtcttcca

SEQ ID NO: 2071119 - DNA, 21 bp, Homo sapiens
cagaccattgtcttccaaccc

SEQ ID NO: 2071120 - DNA, 23 bp, Homo sapiens
cagaccattgtcttccaacccca

SEQ ID NO: 2071121 - DNA, 16 bp, Homo sapiens
cagaccccagcggctg

SEQ ID NO: 2071122 - DNA, 13 bp, Homo sapiens
cagacccccactc

SEQ ID NO: 2071123 - DNA, 14 bp, Homo sapiens
cagacccccactct

SEQ ID NO: 2071124 - DNA, 13 bp, Homo sapiens
cagacccctctca

SEQ ID NO: 2071125 - DNA, 22 bp, Homo sapiens
cagacccctggcttttcactgc

SEQ ID NO: 2071126 - DNA, 13 bp, Homo sapiens
cagaccccttggc

SEQ ID NO: 2071127 - DNA, 17 bp, Homo sapiens
cagaccccttggctttt

SEQ ID NO: 2071128 - DNA, 15 bp, Homo sapiens
cagaccctaccccac

SEQ ID NO: 2071129 - DNA, 15 bp, Homo sapiens
cagaccctgcctgag

SEQ ID NO: 2071130 - DNA, 16 bp, Homo sapiens
cagaccctgcctgagc

SEQ ID NO: 2071131 - DNA, 15 bp, Homo sapiens
cagaccgggggccag

SEQ ID NO: 2071132 - DNA, 20 bp, Homo sapiens
cagaccgggggccagacaca

SEQ ID NO: 2071133 - DNA, 17 bp, Homo sapiens
cagacctagacctgggc

SEQ ID NO: 2071134 - DNA, 18 bp, Homo sapiens
cagacctagacctgggcc

SEQ ID NO: 2071135 - DNA, 14 bp, Homo sapiens
cagacctctgatcc

SEQ ID NO: 2071136 - DNA, 18 bp, Homo sapiens
cagacctctgatccctcg

SEQ ID NO: 2071137 - DNA, 12 bp, Homo sapiens
cagacctgacac

SEQ ID NO: 2071138 - DNA, 21 bp, Homo sapiens
cagacctgacaccgtccctca

SEQ ID NO: 2071139 - DNA, 12 bp, Homo sapiens
cagacctggaca

SEQ ID NO: 2071140 - DNA, 15 bp, Homo sapiens
cagaccttttttagg

SEQ ID NO: 2071141 - DNA, 16 bp, Homo sapiens
cagactacagccagaa

SEQ ID NO: 2071142 - DNA, 19 bp, Homo sapiens
cagactacagccagaagcc

SEQ ID NO: 2071143 - DNA, 13 bp, Homo sapiens
cagactcagctcc

SEQ ID NO: 2071144 - DNA, 14 bp, Homo sapiens
cagactcagctcca

SEQ ID NO: 2071145 - DNA, 17 bp, Homo sapiens
cagactcagtttgtcag

SEQ ID NO: 2071146 - DNA, 18 bp, Homo sapiens
cagactccctcccctgcc

SEQ ID NO: 2071147 - DNA, 17 bp, Homo sapiens
cagactcctttcctctg

SEQ ID NO: 2071148 - DNA, 19 bp, Homo sapiens
cagactctacagaggccat

SEQ ID NO: 2071149 - DNA, 18 bp, Homo sapiens
cagactgcgatttgtccc

SEQ ID NO: 2071150 - DNA, 13 bp, Homo sapiens
cagactgctggga

SEQ ID NO: 2071151 - DNA, 15 bp, Homo sapiens
cagactgctgggact

SEQ ID NO: 2071152 - DNA, 18 bp, Homo sapiens
cagactggaagcacagct

SEQ ID NO: 2071153 - DNA, 17 bp, Homo sapiens
cagactggcacagtttt

SEQ ID NO: 2071154 - DNA, 14 bp, Homo sapiens
cagactgtggctgc

SEQ ID NO: 2071155 - DNA, 14 bp, Homo sapiens
cagacttcacactg

SEQ ID NO: 2071156 - DNA, 15 bp, Homo sapiens
cagacttctccagac

SEQ ID NO: 2071157 - DNA, 20 bp, Homo sapiens
cagacttctccagacccacc

SEQ ID NO: 2071158 - DNA, 14 bp, Homo sapiens
cagacttctggaag

SEQ ID NO: 2071159 - DNA, 22 bp, Homo sapiens
cagacttctggaaggctggctg

SEQ ID NO: 2071160 - DNA, 23 bp, Homo sapiens
cagacttctggaaggctggctga

SEQ ID NO: 2071161 - DNA, 15 bp, Homo sapiens
cagactttaaagaat

SEQ ID NO: 2071162 - DNA, 20 bp, Homo sapiens
cagactttctacacctgttg

SEQ ID NO: 2071163 - DNA, 21 bp, Homo sapiens
cagactttctacacctgttgc

SEQ ID NO: 2071164 - DNA, 22 bp, Homo sapiens
cagagaaagaaagggaaactgg

SEQ ID NO: 2071165 - DNA, 19 bp, Homo sapiens
cagagaaagaagagacagg

SEQ ID NO: 2071166 - DNA, 20 bp, Homo sapiens
cagagaaatgtgaagggtgg

SEQ ID NO: 2071167 - DNA, 22 bp, Homo sapiens
cagagaaatgtgaagggtgggg

SEQ ID NO: 2071168 - DNA, 16 bp, Homo sapiens
cagagaaattctgtgg

SEQ ID NO: 2071169 - DNA, 19 bp, Homo sapiens
cagagaagataatgttctt

SEQ ID NO: 2071170 - DNA, 14 bp, Homo sapiens
cagagaagctcatt

SEQ ID NO: 2071171 - DNA, 13 bp, Homo sapiens
cagagaaggcagg

SEQ ID NO: 2071172 - DNA, 22 bp, Homo sapiens
cagagaaggcctcttgtgctca

SEQ ID NO: 2071173 - DNA, 19 bp, Homo sapiens
cagagaaggcttcctccag

SEQ ID NO: 2071174 - DNA, 21 bp, Homo sapiens
cagagaagtcagttggagaaa

SEQ ID NO: 2071175 - DNA, 23 bp, Homo sapiens
cagagaagtcagttggagaaaat

SEQ ID NO: 2071176 - DNA, 11 bp, Homo sapiens
cagagaagttc

SEQ ID NO: 2071177 - DNA, 11 bp, Homo sapiens
cagagaatata

SEQ ID NO: 2071178 - DNA, 18 bp, Homo sapiens
cagagaatatcaagatga

SEQ ID NO: 2071179 - DNA, 13 bp, Homo sapiens
cagagaatcaggg

SEQ ID NO: 2071180 - DNA, 17 bp, Homo sapiens
cagagaatcagggcagg

SEQ ID NO: 2071181 - DNA, 19 bp, Homo sapiens
cagagaatcatacttagca

SEQ ID NO: 2071182 - DNA, 19 bp, Homo sapiens
cagagaatgaaagggccca

SEQ ID NO: 2071183 - DNA, 14 bp, Homo sapiens
cagagaattcttag

SEQ ID NO: 2071184 - DNA, 22 bp, Homo sapiens
cagagaatttctaccatttcag

SEQ ID NO: 2071185 - DNA, 22 bp, Homo sapiens
cagagacagaaacagagagaga

SEQ ID NO: 2071186 - DNA, 22 bp, Homo sapiens
cagagacagaccccttggcttt

SEQ ID NO: 2071187 - DNA, 15 bp, Homo sapiens
cagagacaggaaaat

SEQ ID NO: 2071188 - DNA, 16 bp, Homo sapiens
cagagacaggaaagaa

SEQ ID NO: 2071189 - DNA, 19 bp, Homo sapiens
cagagacaggcccaagaga

SEQ ID NO: 2071190 - DNA, 18 bp, Homo sapiens
cagagacaggtggcctag

SEQ ID NO: 2071191 - DNA, 17 bp, Homo sapiens
cagagaccccaggatcc

SEQ ID NO: 2071192 - DNA, 18 bp, Homo sapiens
cagagacctgaggcagat

SEQ ID NO: 2071193 - DNA, 10 bp, Homo sapiens
cagagacctt

SEQ ID NO: 2071194 - DNA, 15 bp, Homo sapiens
cagagacgcaaggga

SEQ ID NO: 2071195 - DNA, 20 bp, Homo sapiens
cactttaattctcatgtgat

SEQ ID NO: 2071196 - DNA, 17 bp, Homo sapiens
cactttcagtgaaagca

SEQ ID NO: 2071197 - DNA, 18 bp, Homo sapiens
cactttcagtgaaagcat

SEQ ID NO: 2071198 - DNA, 17 bp, Homo sapiens
cactttgcacagctctc

SEQ ID NO: 2071199 - DNA, 13 bp, Homo sapiens
cactttggcttct

SEQ ID NO: 2071200 - DNA, 12 bp, Homo sapiens
cactttgggagg

SEQ ID NO: 2071201 - DNA, 19 bp, Homo sapiens
cactttggtacatggccag

SEQ ID NO: 2071202 - DNA, 22 bp, Homo sapiens
cacttttctttattgctgtgaa

SEQ ID NO: 2071203 - DNA, 19 bp, Homo sapiens
cagaaaaactctgggaaat

SEQ ID NO: 2071204 - DNA, 20 bp, Homo sapiens
cagaaaacaaaagagagaat

SEQ ID NO: 2071205 - DNA, 14 bp, Homo sapiens
cagaaaacaaatct

SEQ ID NO: 2071206 - DNA, 15 bp, Homo sapiens
cagaaaacctccagt

SEQ ID NO: 2071207 - DNA, 14 bp, Homo sapiens
cagaaaagaaaacc

SEQ ID NO: 2071208 - DNA, 15 bp, Homo sapiens
cagaaaagaaaacca

SEQ ID NO: 2071209 - DNA, 16 bp, Homo sapiens
cagaaaagaaaaccat

SEQ ID NO: 2071210 - DNA, 21 bp, Homo sapiens
cagaaaagaggagaccctgga

SEQ ID NO: 2071211 - DNA, 17 bp, Homo sapiens
cagaaaagcacctgccg

SEQ ID NO: 2071212 - DNA, 18 bp, Homo sapiens
cagaaaagggaagttgtg

SEQ ID NO: 2071213 - DNA, 17 bp, Homo sapiens
cagaaaagtgcaaagtt

SEQ ID NO: 2071214 - DNA, 18 bp, Homo sapiens
cagaaaagtgcttagaaa

SEQ ID NO: 2071215 - DNA, 23 bp, Homo sapiens
cagaaaagtgcttagaaagttat

SEQ ID NO: 2071216 - DNA, 15 bp, Homo sapiens
cagaaaatataaatg

SEQ ID NO: 2071217 - DNA, 21 bp, Homo sapiens
cagaaaatataaatgcatgat

SEQ ID NO: 2071218 - DNA, 18 bp, Homo sapiens
cagaaacaggtgcatctg

SEQ ID NO: 2071219 - DNA, 16 bp, Homo sapiens
cagaaagcattacatt

SEQ ID NO: 2071220 - DNA, 17 bp, Homo sapiens
cagaaagccttccatta

SEQ ID NO: 2071221 - DNA, 22 bp, Homo sapiens
cagaaagtggccatgccaccct

SEQ ID NO: 2071222 - DNA, 23 bp, Homo sapiens
cagaaagtggccatgccaccctg

SEQ ID NO: 2071223 - DNA, 21 bp, Homo sapiens
cagaaataaaatgaaatgtct

SEQ ID NO: 2071224 - DNA, 20 bp, Homo sapiens
cagaaataaagttggtgaca

SEQ ID NO: 2071225 - DNA, 16 bp, Homo sapiens
cagaaatactgctctg

SEQ ID NO: 2071226 - DNA, 13 bp, Homo sapiens
cagaaatatatat

SEQ ID NO: 2071227 - DNA, 16 bp, Homo sapiens
cagaaatatatataca

SEQ ID NO: 2071228 - DNA, 17 bp, Homo sapiens
cagaaatatatatacat

SEQ ID NO: 2071229 - DNA, 15 bp, Homo sapiens
cagaaatttttattt

SEQ ID NO: 2071230 - DNA, 11 bp, Homo sapiens
cagaacagagg

SEQ ID NO: 2071231 - DNA, 20 bp, Homo sapiens
cagaacagccgctcctgtct

SEQ ID NO: 2071232 - DNA, 16 bp, Homo sapiens
cagaacatcctccaat

SEQ ID NO: 2071233 - DNA, 14 bp, Homo sapiens
cagaacatgctgga

SEQ ID NO: 2071234 - DNA, 15 bp, Homo sapiens
cagaaccacactgtt

SEQ ID NO: 2071235 - DNA, 21 bp, Homo sapiens
cagaaccacactgttgagttg

SEQ ID NO: 2071236 - DNA, 23 bp, Homo sapiens
cagaacccctacatgaaacagaa

SEQ ID NO: 2071237 - DNA, 22 bp, Homo sapiens
cagaacctcaagtctagaaacc

SEQ ID NO: 2071238 - DNA, 21 bp, Homo sapiens
cagaacctggagggctagaac

SEQ ID NO: 2071239 - DNA, 21 bp, Homo sapiens
cagaacggagccccaggcctc

SEQ ID NO: 2071240 - DNA, 17 bp, Homo sapiens
cagaactgaggtcactg

SEQ ID NO: 2071241 - DNA, 20 bp, Homo sapiens
cagaactgaggtcactgggt

SEQ ID NO: 2071242 - DNA, 21 bp, Homo sapiens
cagaactgaggtcactgggtt

SEQ ID NO: 2071243 - DNA, 21 bp, Homo sapiens
cagaactggacgcccagctga

SEQ ID NO: 2071244 - DNA, 21 bp, Homo sapiens
cagaagaaaaagttgcagtct

SEQ ID NO: 2071245 - DNA, 22 bp, Homo sapiens
cagaagaaaaagttgcagtctc

SEQ ID NO: 2071246 - DNA, 15 bp, Homo sapiens
cagaagaaccctggc

SEQ ID NO: 2071247 - DNA, 15 bp, Homo sapiens
cagaagaaggcagca

SEQ ID NO: 2071248 - DNA, 15 bp, Homo sapiens
cagaagaatattcag

SEQ ID NO: 2071249 - DNA, 18 bp, Homo sapiens
cagaagaatattcaggac

SEQ ID NO: 2071250 - DNA, 20 bp, Homo sapiens
cagaagaattgaacccagga

SEQ ID NO: 2071251 - DNA, 20 bp, Homo sapiens
cagaagagggaggcttcctg

SEQ ID NO: 2071252 - DNA, 21 bp, Homo sapiens
cagaagagggaggcttcctga

SEQ ID NO: 2071253 - DNA, 23 bp, Homo sapiens
cagaagagggaggcttcctgact

SEQ ID NO: 2071254 - DNA, 15 bp, Homo sapiens
cagaagataacttga

SEQ ID NO: 2071255 - DNA, 22 bp, Homo sapiens
cagaagataacttgagcaccgt

SEQ ID NO: 2071256 - DNA, 14 bp, Homo sapiens
cagaagatgccctc

SEQ ID NO: 2071257 - DNA, 23 bp, Homo sapiens
cagaagcccatggagcagggatg

SEQ ID NO: 2071258 - DNA, 15 bp, Homo sapiens
cagaagcctgaggct

SEQ ID NO: 2071259 - DNA, 12 bp, Homo sapiens
cagaagcctggg

SEQ ID NO: 2071260 - DNA, 14 bp, Homo sapiens
cagaagcctggggg

SEQ ID NO: 2071261 - DNA, 16 bp, Homo sapiens
cagaagcttctgccca

SEQ ID NO: 2071262 - DNA, 15 bp, Homo sapiens
cagaaggaaggcagg

SEQ ID NO: 2071263 - DNA, 14 bp, Homo sapiens
cagaaggagaagga

SEQ ID NO: 2071264 - DNA, 23 bp, Homo sapiens
cagaaggagaaggaaaaagaaag

SEQ ID NO: 2071265 - DNA, 13 bp, Homo sapiens
cagaaggagggca

SEQ ID NO: 2071266 - DNA, 17 bp, Homo sapiens
cagaaggctggggccag

SEQ ID NO: 2071267 - DNA, 18 bp, Homo sapiens
cagaaggctggggccagt

SEQ ID NO: 2071268 - DNA, 23 bp, Homo sapiens
cagaagggagttgctcactcagg

SEQ ID NO: 2071269 - DNA, 18 bp, Homo sapiens
cagaagtggggctctggg

SEQ ID NO: 2071270 - DNA, 19 bp, Homo sapiens
cagaagtggggctctggga

SEQ ID NO: 2071271 - DNA, 17 bp, Homo sapiens
cagaataaatccttggg

SEQ ID NO: 2071272 - DNA, 13 bp, Homo sapiens
cagaataagtgct

SEQ ID NO: 2071273 - DNA, 15 bp, Homo sapiens
cagaataagtgctgt

SEQ ID NO: 2071274 - DNA, 16 bp, Homo sapiens
cagaataagtgctgtt

SEQ ID NO: 2071275 - DNA, 23 bp, Homo sapiens
cagaataagtgctgtttgagatg

SEQ ID NO: 2071276 - DNA, 19 bp, Homo sapiens
cacctgacaatggcagcta

SEQ ID NO: 2071277 - DNA, 20 bp, Homo sapiens
cacctgacaatggcagctag

SEQ ID NO: 2071278 - DNA, 21 bp, Homo sapiens
cacctgacaatggcagctaga

SEQ ID NO: 2071279 - DNA, 18 bp, Homo sapiens
cacctgaggttaggagtt

SEQ ID NO: 2071280 - DNA, 19 bp, Homo sapiens
cacctgagtcaccctacct

SEQ ID NO: 2071281 - DNA, 16 bp, Homo sapiens
cacctgcaagccccag

SEQ ID NO: 2071282 - DNA, 17 bp, Homo sapiens
cacctgcaagccccagg

SEQ ID NO: 2071283 - DNA, 18 bp, Homo sapiens
cacctgcaagccccaggg

SEQ ID NO: 2071284 - DNA, 19 bp, Homo sapiens
cacctgcaagccccagggc

SEQ ID NO: 2071285 - DNA, 15 bp, Homo sapiens
cacctgcacctcccc

SEQ ID NO: 2071286 - DNA, 17 bp, Homo sapiens
cacctgcacctcccccc

SEQ ID NO: 2071287 - DNA, 13 bp, Homo sapiens
cacctgcagattc

SEQ ID NO: 2071288 - DNA, 22 bp, Homo sapiens
cacctgcatccgtagttccctg

SEQ ID NO: 2071289 - DNA, 11 bp, Homo sapiens
cacctgccacc

SEQ ID NO: 2071290 - DNA, 16 bp, Homo sapiens
cacctgccaccgccag

SEQ ID NO: 2071291 - DNA, 14 bp, Homo sapiens
cacctgccagccat

SEQ ID NO: 2071292 - DNA, 17 bp, Homo sapiens
cacctgccagcctggct

SEQ ID NO: 2071293 - DNA, 22 bp, Homo sapiens
cacctgccagcctggcttctgg

SEQ ID NO: 2071294 - DNA, 13 bp, Homo sapiens
cacctgccctgcc

SEQ ID NO: 2071295 - DNA, 21 bp, Homo sapiens
cacctgccctgccctgccacc

SEQ ID NO: 2071296 - DNA, 22 bp, Homo sapiens
cacctgccctgccctgccacct

SEQ ID NO: 2071297 - DNA, 17 bp, Homo sapiens
cacctgctttctcctgg

SEQ ID NO: 2071298 - DNA, 21 bp, Homo sapiens
cacctggaagcatttgtttct

SEQ ID NO: 2071299 - DNA, 14 bp, Homo sapiens
cacctggaatcaga

SEQ ID NO: 2071300 - DNA, 14 bp, Homo sapiens
cacctggccccatg

SEQ ID NO: 2071301 - DNA, 20 bp, Homo sapiens
cacctggccccatgtctctc

SEQ ID NO: 2071302 - DNA, 22 bp, Homo sapiens
cacctggccccatgtctctcag

SEQ ID NO: 2071303 - DNA, 20 bp, Homo sapiens
cacctggccgcctccaggag

SEQ ID NO: 2071304 - DNA, 23 bp, Homo sapiens
cacctggccgcctccaggagcct

SEQ ID NO: 2071305 - DNA, 13 bp, Homo sapiens
cacctggcctgct

SEQ ID NO: 2071306 - DNA, 17 bp, Homo sapiens
cacctggcctgctggga

SEQ ID NO: 2071307 - DNA, 18 bp, Homo sapiens
cacctgggaaaacagagg

SEQ ID NO: 2071308 - DNA, 20 bp, Homo sapiens
cacctgggaaaacagaggaa

SEQ ID NO: 2071309 - DNA, 14 bp, Homo sapiens
cacctgggccctgg

SEQ ID NO: 2071310 - DNA, 17 bp, Homo sapiens
cacctgggccctggggc

SEQ ID NO: 2071311 - DNA, 21 bp, Homo sapiens
cacctgggccctggggcctgt

SEQ ID NO: 2071312 - DNA, 22 bp, Homo sapiens
cacctgggccctggggcctgta

SEQ ID NO: 2071313 - DNA, 20 bp, Homo sapiens
cacctggtactgcacatttt

SEQ ID NO: 2071314 - DNA, 17 bp, Homo sapiens
cacctgtaatcccagca

SEQ ID NO: 2071315 - DNA, 20 bp, Homo sapiens
cacctgtaatcccagcactt

SEQ ID NO: 2071316 - DNA, 16 bp, Homo sapiens
cacctgtagtcccagc

SEQ ID NO: 2071317 - DNA, 14 bp, Homo sapiens
cacctgtcccagaa

SEQ ID NO: 2071318 - DNA, 18 bp, Homo sapiens
cacctgtgcaccccatga

SEQ ID NO: 2071319 - DNA, 22 bp, Homo sapiens
cacctgttaaaatgtacactgg

SEQ ID NO: 2071320 - DNA, 19 bp, Homo sapiens
cacctgtttttaagctgtt

SEQ ID NO: 2071321 - DNA, 15 bp, Homo sapiens
caccttcccagctct

SEQ ID NO: 2071322 - DNA, 16 bp, Homo sapiens
caccttccccagactc

SEQ ID NO: 2071323 - DNA, 16 bp, Homo sapiens
caccttccctctttct

SEQ ID NO: 2071324 - DNA, 13 bp, Homo sapiens
caccttcttggct

SEQ ID NO: 2071325 - DNA, 16 bp, Homo sapiens
caccttcttggcttct

SEQ ID NO: 2071326 - DNA, 18 bp, Homo sapiens
caccttcttggcttctgg

SEQ ID NO: 2071327 - DNA, 19 bp, Homo sapiens
caccttcttggcttctggg

SEQ ID NO: 2071328 - DNA, 21 bp, Homo sapiens
caccttcttggcttctgggac

SEQ ID NO: 2071329 - DNA, 22 bp, Homo sapiens
caccttcttggcttctgggacc

SEQ ID NO: 2071330 - DNA, 15 bp, Homo sapiens
caccttgacagggca

SEQ ID NO: 2071331 - DNA, 19 bp, Homo sapiens
caccttgacagggcacacc

SEQ ID NO: 2071332 - DNA, 16 bp, Homo sapiens
caccttgccgagagag

SEQ ID NO: 2071333 - DNA, 22 bp, Homo sapiens
caccttgctcttctttctgaga

SEQ ID NO: 2071334 - DNA, 16 bp, Homo sapiens
caccttggactcctcc

SEQ ID NO: 2071335 - DNA, 21 bp, Homo sapiens
caccttggactcctcccacaa

SEQ ID NO: 2071336 - DNA, 22 bp, Homo sapiens
caccttggactcctcccacaat

SEQ ID NO: 2071337 - DNA, 15 bp, Homo sapiens
caccttggctgcagg

SEQ ID NO: 2071338 - DNA, 13 bp, Homo sapiens
caccttgtcatgt

SEQ ID NO: 2071339 - DNA, 22 bp, Homo sapiens
caccttgtcatgtaccatcaat

SEQ ID NO: 2071340 - DNA, 13 bp, Homo sapiens
cacctttctagtt

SEQ ID NO: 2071341 - DNA, 19 bp, Homo sapiens
cacctttctcgctggaatc

SEQ ID NO: 2071342 - DNA, 20 bp, Homo sapiens
cacctttctcgctggaatca

SEQ ID NO: 2071343 - DNA, 20 bp, Homo sapiens
cacctttgggatcagcctcc

SEQ ID NO: 2071344 - DNA, 21 bp, Homo sapiens
cacctttgtttagaacactgg

SEQ ID NO: 2071345 - DNA, 19 bp, Homo sapiens
cacctttgttttgcactga

SEQ ID NO: 2071346 - DNA, 21 bp, Homo sapiens
caccttttccaggagttctga

SEQ ID NO: 2071347 - DNA, 21 bp, Homo sapiens
caccttttgtatttaaaacct

SEQ ID NO: 2071348 - DNA, 16 bp, Homo sapiens
cacgaaatgttatttt

SEQ ID NO: 2071349 - DNA, 17 bp, Homo sapiens
cacgaaatgttattttt

SEQ ID NO: 2071350 - DNA, 16 bp, Homo sapiens
cacgaacccacctgct

SEQ ID NO: 2071351 - DNA, 16 bp, Homo sapiens
cacgaaccctgccagg

SEQ ID NO: 2071352 - DNA, 22 bp, Homo sapiens
cacgaagctgtgaactcagagc

SEQ ID NO: 2071353 - DNA, 17 bp, Homo sapiens
cacgagcaggctactgt

SEQ ID NO: 2071354 - DNA, 20 bp, Homo sapiens
cacgagcaggctactgtcag

SEQ ID NO: 2071355 - DNA, 21 bp, Homo sapiens
cacgagtaagatattatttaa

SEQ ID NO: 2071356 - DNA, 14 bp, Homo sapiens
cacgagtcacctgc

SEQ ID NO: 2071357 - DNA, 15 bp, Homo sapiens
cacgagtcacctgca

SEQ ID NO: 2071358 - DNA, 19 bp, Homo sapiens
cacgagtcacctgcaagcc

SEQ ID NO: 2071359 - DNA, 15 bp, Homo sapiens
cacgatgtggccctg

SEQ ID NO: 2071360 - DNA, 17 bp, Homo sapiens
cacgatgtggccctggc

SEQ ID NO: 2071361 - DNA, 22 bp, Homo sapiens
cacgatgtggccctggcctgct

SEQ ID NO: 2071362 - DNA, 13 bp, Homo sapiens
cacgcaacttgaa

SEQ ID NO: 2071363 - DNA, 18 bp, Homo sapiens
cacgcaagggcatcaggc

SEQ ID NO: 2071364 - DNA, 20 bp, Homo sapiens
cacgcaagggcatcaggcac

SEQ ID NO: 2071365 - DNA, 13 bp, Homo sapiens
cacgcacacatgg

SEQ ID NO: 2071366 - DNA, 20 bp, Homo sapiens
cacgcaggaactcccagcaa

SEQ ID NO: 2071367 - DNA, 16 bp, Homo sapiens
cacgccaacagccccc

SEQ ID NO: 2071368 - DNA, 22 bp, Homo sapiens
cacgcccagcctcctcccacca

SEQ ID NO: 2071369 - DNA, 17 bp, Homo sapiens
cacgcctataatcccag

SEQ ID NO: 2071370 - DNA, 19 bp, Homo sapiens
cacgcctataatcccagca

SEQ ID NO: 2071371 - DNA, 19 bp, Homo sapiens
cacgcctatgatcccagca

SEQ ID NO: 2071372 - DNA, 14 bp, Homo sapiens
cacgcctcctggcc

SEQ ID NO: 2071373 - DNA, 17 bp, Homo sapiens
cacgcctcctggccaga

SEQ ID NO: 2071374 - DNA, 18 bp, Homo sapiens
cacgcctcctggccagac

SEQ ID NO: 2071375 - DNA, 14 bp, Homo sapiens
cacgcctgcccagc

SEQ ID NO: 2071376 - DNA, 14 bp, Homo sapiens
cacgcctgtaatcc

SEQ ID NO: 2071377 - DNA, 18 bp, Homo sapiens
cacgcctgtaatcccagc

SEQ ID NO: 2071378 - DNA, 20 bp, Homo sapiens
cacgcctgtaatcccagcac

SEQ ID NO: 2071379 - DNA, 21 bp, Homo sapiens
cacgcctgtaatcccagcagt

SEQ ID NO: 2071380 - DNA, 19 bp, Homo sapiens
cacgcctgtaatcccagct

SEQ ID NO: 2071381 - DNA, 21 bp, Homo sapiens
cacgcgtgcacacaccagagc

SEQ ID NO: 2071382 - DNA, 23 bp, Homo sapiens
cacgcgtgcacacaccagagccc

SEQ ID NO: 2071383 - DNA, 20 bp, Homo sapiens
cacgctggaccttgaactgg

SEQ ID NO: 2071384 - DNA, 15 bp, Homo sapiens
cacgctggagtgcag

SEQ ID NO: 2071385 - DNA, 16 bp, Homo sapiens
cacgctggagtgcagt

SEQ ID NO: 2071386 - DNA, 18 bp, Homo sapiens
cacgctggagtgcagtga

SEQ ID NO: 2071387 - DNA, 13 bp, Homo sapiens
cacgctgtcctct

SEQ ID NO: 2071388 - DNA, 22 bp, Homo sapiens
cacgctgtcctctcgagcccag

SEQ ID NO: 2071389 - DNA, 14 bp, Homo sapiens
cacgctttctagct

SEQ ID NO: 2071390 - DNA, 15 bp, Homo sapiens
cacggagagaaggcc

SEQ ID NO: 2071391 - DNA, 21 bp, Homo sapiens
cacggaggcatctgcaccctc

SEQ ID NO: 2071392 - DNA, 20 bp, Homo sapiens
cagggagcccctaggaaagc

SEQ ID NO: 2071393 - DNA, 22 bp, Homo sapiens
cagggagcccctaggaaagcag

SEQ ID NO: 2071394 - DNA, 15 bp, Homo sapiens
cagggaggaggcaga

SEQ ID NO: 2071395 - DNA, 21 bp, Homo sapiens
cagggaggaggcagagaagaa

SEQ ID NO: 2071396 - DNA, 16 bp, Homo sapiens
cagggaggatgccaca

SEQ ID NO: 2071397 - DNA, 19 bp, Homo sapiens
cagggaggatgccacagcc

SEQ ID NO: 2071398 - DNA, 22 bp, Homo sapiens
cagggatgggggatgggccagg

SEQ ID NO: 2071399 - DNA, 22 bp, Homo sapiens
cagggcaaatgacatgcactga

SEQ ID NO: 2071400 - DNA, 18 bp, Homo sapiens
cagggcaactcggagagg

SEQ ID NO: 2071401 - DNA, 19 bp, Homo sapiens
cagggcacaccgggcactc

SEQ ID NO: 2071402 - DNA, 15 bp, Homo sapiens
cagggcagagccggg

SEQ ID NO: 2071403 - DNA, 16 bp, Homo sapiens
cagggcagagccggga

SEQ ID NO: 2071404 - DNA, 11 bp, Homo sapiens
cagggcagcct

SEQ ID NO: 2071405 - DNA, 13 bp, Homo sapiens
cagggcagtgaca

SEQ ID NO: 2071406 - DNA, 21 bp, Homo sapiens
cagggcagtgacaagtggagg

SEQ ID NO: 2071407 - DNA, 20 bp, Homo sapiens
cagggcatggccaggtggcc

SEQ ID NO: 2071408 - DNA, 17 bp, Homo sapiens
cagggcatggctgggaa

SEQ ID NO: 2071409 - DNA, 14 bp, Homo sapiens
cagggccagaagga

SEQ ID NO: 2071410 - DNA, 16 bp, Homo sapiens
cagggccagaaggagg

SEQ ID NO: 2071411 - DNA, 12 bp, Homo sapiens
cagggccagggc

SEQ ID NO: 2071412 - DNA, 18 bp, Homo sapiens
cagggccagggccctgca

SEQ ID NO: 2071413 - DNA, 13 bp, Homo sapiens
cagggccccagaa

SEQ ID NO: 2071414 - DNA, 15 bp, Homo sapiens
cagggccccagaagg

SEQ ID NO: 2071415 - DNA, 15 bp, Homo sapiens
cagggccccagcact

SEQ ID NO: 2071416 - DNA, 14 bp, Homo sapiens
cagggcccccacag

SEQ ID NO: 2071417 - DNA, 20 bp, Homo sapiens
cagggcccctccctctgccc

SEQ ID NO: 2071418 - DNA, 16 bp, Homo sapiens
cagggcccctgttccc

SEQ ID NO: 2071419 - DNA, 14 bp, Homo sapiens
cagggccctgcaga

SEQ ID NO: 2071420 - DNA, 20 bp, Homo sapiens
cagggccggggaactggcca

SEQ ID NO: 2071421 - DNA, 23 bp, Homo sapiens
cagggcctactgccacccgcttc

SEQ ID NO: 2071422 - DNA, 14 bp, Homo sapiens
cagggcctagcttt

SEQ ID NO: 2071423 - DNA, 16 bp, Homo sapiens
cagggcctgggggcag

SEQ ID NO: 2071424 - DNA, 15 bp, Homo sapiens
cagggcctggtgtga

SEQ ID NO: 2071425 - DNA, 14 bp, Homo sapiens
cagggcctgtctca

SEQ ID NO: 2071426 - DNA, 14 bp, Homo sapiens
cagggccttgccca

SEQ ID NO: 2071427 - DNA, 20 bp, Homo sapiens
cagggccttgcccagagatg

SEQ ID NO: 2071428 - DNA, 24 bp, Homo sapiens
cagggccttgcccagagatgcctc

SEQ ID NO: 2071429 - DNA, 13 bp, Homo sapiens
cagggcgcaagcc

SEQ ID NO: 2071430 - DNA, 17 bp, Homo sapiens
cagggctaagagctagc

SEQ ID NO: 2071431 - DNA, 14 bp, Homo sapiens
cagggctcagcctg

SEQ ID NO: 2071432 - DNA, 21 bp, Homo sapiens
cagggctcagcggggacagct

SEQ ID NO: 2071433 - DNA, 18 bp, Homo sapiens
cagggctccctcctggag

SEQ ID NO: 2071434 - DNA, 20 bp, Homo sapiens
cagggctccctcctggagca

SEQ ID NO: 2071435 - DNA, 17 bp, Homo sapiens
cagggctctcctggctt

SEQ ID NO: 2071436 - DNA, 21 bp, Homo sapiens
cagggctctgccccagaggcc

SEQ ID NO: 2071437 - DNA, 21 bp, Homo sapiens
cagggctgccactaacctgta

SEQ ID NO: 2071438 - DNA, 18 bp, Homo sapiens
cagggctgcccctgtagg

SEQ ID NO: 2071439 - DNA, 20 bp, Homo sapiens
cagggctggagtgcgctctt

SEQ ID NO: 2071440 - DNA, 16 bp, Homo sapiens
cagggcttggggagca

SEQ ID NO: 2071441 - DNA, 17 bp, Homo sapiens
cagggcttttcccagga

SEQ ID NO: 2071442 - DNA, 17 bp, Homo sapiens
caggggaccacacctcc

SEQ ID NO: 2071443 - DNA, 20 bp, Homo sapiens
caggggagagggtctggaga

SEQ ID NO: 2071444 - DNA, 13 bp, Homo sapiens
caggggcaggcct

SEQ ID NO: 2071445 - DNA, 17 bp, Homo sapiens
caggggcaggcctggga

SEQ ID NO: 2071446 - DNA, 21 bp, Homo sapiens
caggggccagtgagggctggg

SEQ ID NO: 2071447 - DNA, 19 bp, Homo sapiens
caggggccccagatctgcc

SEQ ID NO: 2071448 - DNA, 19 bp, Homo sapiens
caggggcggggcaggaatg

SEQ ID NO: 2071449 - DNA, 19 bp, Homo sapiens
caggggctccacctgttca

SEQ ID NO: 2071450 - DNA, 15 bp, Homo sapiens
caggggctccccggg

SEQ ID NO: 2071451 - DNA, 22 bp, Homo sapiens
caggggctgctcatcacccagt

SEQ ID NO: 2071452 - DNA, 20 bp, Homo sapiens
caggggggttgtgaggcctg

SEQ ID NO: 2071453 - DNA, 16 bp, Homo sapiens
cagggggtgtgtctgc

SEQ ID NO: 2071454 - DNA, 18 bp, Homo sapiens
caggggtcgtcaccacct

SEQ ID NO: 2071455 - DNA, 20 bp, Homo sapiens
caggggtgatttcagagagg

SEQ ID NO: 2071456 - DNA, 23 bp, Homo sapiens
caggggtgggagagccagctctc

SEQ ID NO: 2071457 - DNA, 22 bp, Homo sapiens
cagggtaggggagggtggggca

SEQ ID NO: 2071458 - DNA, 23 bp, Homo sapiens
cagggtaggggagggtggggcaa

SEQ ID NO: 2071459 - DNA, 17 bp, Homo sapiens
cagggtatcccagaccc

SEQ ID NO: 2071460 - DNA, 14 bp, Homo sapiens
cagggtcaggagag

SEQ ID NO: 2071461 - DNA, 19 bp, Homo sapiens
cagggtccgcaccagctgc

SEQ ID NO: 2071462 - DNA, 23 bp, Homo sapiens
cagggtccgcaccagctgctctg

SEQ ID NO: 2071463 - DNA, 17 bp, Homo sapiens
cagggtctcactctgtc

SEQ ID NO: 2071464 - DNA, 23 bp, Homo sapiens
cagggtctcactctgtcgcccag

SEQ ID NO: 2071465 - DNA, 13 bp, Homo sapiens
cagggtcttgggc

SEQ ID NO: 2071466 - DNA, 14 bp, Homo sapiens
cagggtcttgggct

SEQ ID NO: 2071467 - DNA, 19 bp, Homo sapiens
cagggtcttgggctactgg

SEQ ID NO: 2071468 - DNA, 21 bp, Homo sapiens
cagggtgagagctgctctgga

SEQ ID NO: 2071469 - DNA, 22 bp, Homo sapiens
cagggtgagagctgctctggaa

SEQ ID NO: 2071470 - DNA, 12 bp, Homo sapiens
cagggtgaggtg

SEQ ID NO: 2071471 - DNA, 14 bp, Homo sapiens
cagggtgcatggct

SEQ ID NO: 2071472 - DNA, 21 bp, Homo sapiens
cagggtgcatggcttggggag

SEQ ID NO: 2071473 - DNA, 21 bp, Homo sapiens
cagggtggccccctgtgccag

SEQ ID NO: 2071474 - DNA, 17 bp, Homo sapiens
cagggtgggaagaaaga

SEQ ID NO: 2071475 - DNA, 20 bp, Homo sapiens
cagggtgggaagaaagaatg

SEQ ID NO: 2071476 - DNA, 20 bp, Homo sapiens
cagggtgggatggaggagaa

SEQ ID NO: 2071477 - DNA, 20 bp, Homo sapiens
cagggtgggccactctcccc

SEQ ID NO: 2071478 - DNA, 18 bp, Homo sapiens
cagggttgatcacactct

SEQ ID NO: 2071479 - DNA, 17 bp, Homo sapiens
cagggttggcccctgcc

SEQ ID NO: 2071480 - DNA, 22 bp, Homo sapiens
cagggtttacccagtgggacag

SEQ ID NO: 2071481 - DNA, 15 bp, Homo sapiens
cagggttttgtattc

SEQ ID NO: 2071482 - DNA, 17 bp, Homo sapiens
caggtaaatgggcagtg

SEQ ID NO: 2071483 - DNA, 17 bp, Homo sapiens
caggtaaattaagacat

SEQ ID NO: 2071484 - DNA, 16 bp, Homo sapiens
caggtaacaggcagat

SEQ ID NO: 2071485 - DNA, 20 bp, Homo sapiens
caggtaacaggcagatacag

SEQ ID NO: 2071486 - DNA, 22 bp, Homo sapiens
caggtaatgagggactggaacc

SEQ ID NO: 2071487 - DNA, 23 bp, Homo sapiens
caggtaatgagggactggaacca

SEQ ID NO: 2071488 - DNA, 23 bp, Homo sapiens
caggtacagcaacaggaatctca

SEQ ID NO: 2071489 - DNA, 19 bp, Homo sapiens
caggtacttcctcctgatg

SEQ ID NO: 2071490 - DNA, 20 bp, Homo sapiens
caggtacttcctcctgatgg

SEQ ID NO: 2071491 - DNA, 19 bp, Homo sapiens
caggtagaacacaaggtca

SEQ ID NO: 2071492 - DNA, 19 bp, Homo sapiens
caggtagatcgcttgagcc

SEQ ID NO: 2071493 - DNA, 21 bp, Homo sapiens
caggtagatcgcttgagccca

SEQ ID NO: 2071494 - DNA, 22 bp, Homo sapiens
caggtagatcgcttgagcccag

SEQ ID NO: 2071495 - DNA, 14 bp, Homo sapiens
caggtaggcccttg

SEQ ID NO: 2071496 - DNA, 17 bp, Homo sapiens
caggtatcaggcacagg

SEQ ID NO: 2071497 - DNA, 19 bp, Homo sapiens
caggtatcaggcacaggca

SEQ ID NO: 2071498 - DNA, 15 bp, Homo sapiens
caggtcaacatctaa

SEQ ID NO: 2071499 - DNA, 20 bp, Homo sapiens
caggtcattcttaagatttc

SEQ ID NO: 2071500 - DNA, 16 bp, Homo sapiens
caggtcccccccaggt

SEQ ID NO: 2071501 - DNA, 20 bp, Homo sapiens
caggtcctcagagaatttct

SEQ ID NO: 2071502 - DNA, 20 bp, Homo sapiens
caggtcctcagtgtcctcag

SEQ ID NO: 2071503 - DNA, 13 bp, Homo sapiens
caggtcctgccca

SEQ ID NO: 2071504 - DNA, 18 bp, Homo sapiens
caggtcctgcccatgtgt

SEQ ID NO: 2071505 - DNA, 23 bp, Homo sapiens
caggtcctggtggggcagctcct

SEQ ID NO: 2071506 - DNA, 15 bp, Homo sapiens
caggtctagactttc

SEQ ID NO: 2071507 - DNA, 17 bp, Homo sapiens
caggactaacactcaga

SEQ ID NO: 2071508 - DNA, 18 bp, Homo sapiens
caggactatagcccaggt

SEQ ID NO: 2071509 - DNA, 15 bp, Homo sapiens
caggactccccaggc

SEQ ID NO: 2071510 - DNA, 16 bp, Homo sapiens
caggactccccaggcc

SEQ ID NO: 2071511 - DNA, 19 bp, Homo sapiens
caggactccccaggccagg

SEQ ID NO: 2071512 - DNA, 20 bp, Homo sapiens
caggactctgccccttctgt

SEQ ID NO: 2071513 - DNA, 13 bp, Homo sapiens
caggactctgcct

SEQ ID NO: 2071514 - DNA, 19 bp, Homo sapiens
caggactgaattgtcccca

SEQ ID NO: 2071515 - DNA, 12 bp, Homo sapiens
caggactggctc

SEQ ID NO: 2071516 - DNA, 13 bp, Homo sapiens
caggactggctca

SEQ ID NO: 2071517 - DNA, 15 bp, Homo sapiens
caggactggctcacc

SEQ ID NO: 2071518 - DNA, 19 bp, Homo sapiens
caggacttctgcctgaacc

SEQ ID NO: 2071519 - DNA, 21 bp, Homo sapiens
caggagaagaaagaggtgacc

SEQ ID NO: 2071520 - DNA, 23 bp, Homo sapiens
caggagacactgtgctataaatc

SEQ ID NO: 2071521 - DNA, 23 bp, Homo sapiens
caggagagacgcagccctggggg

SEQ ID NO: 2071522 - DNA, 12 bp, Homo sapiens
caggagagagat

SEQ ID NO: 2071523 - DNA, 20 bp, Homo sapiens
caggagagagatctagaaag

SEQ ID NO: 2071524 - DNA, 18 bp, Homo sapiens
caggagagccagccctcc

SEQ ID NO: 2071525 - DNA, 17 bp, Homo sapiens
caggagaggggcagaac

SEQ ID NO: 2071526 - DNA, 18 bp, Homo sapiens
caggagcaaatgtttctg

SEQ ID NO: 2071527 - DNA, 22 bp, Homo sapiens
caggagcaaatgtttctgcagt

SEQ ID NO: 2071528 - DNA, 16 bp, Homo sapiens
caggagcaatttgcac

SEQ ID NO: 2071529 - DNA, 17 bp, Homo sapiens
caggagcacacggccct

SEQ ID NO: 2071530 - DNA, 18 bp, Homo sapiens
caggagcacacggccctg

SEQ ID NO: 2071531 - DNA, 19 bp, Homo sapiens
caggagcacacggccctgc

SEQ ID NO: 2071532 - DNA, 16 bp, Homo sapiens
caggagcagacagaga

SEQ ID NO: 2071533 - DNA, 17 bp, Homo sapiens
caggagcaggaacagag

SEQ ID NO: 2071534 - DNA, 12 bp, Homo sapiens
caggagcccaga

SEQ ID NO: 2071535 - DNA, 14 bp, Homo sapiens
caggagcccagagg

SEQ ID NO: 2071536 - DNA, 15 bp, Homo sapiens
caggagccccgaggc

SEQ ID NO: 2071537 - DNA, 16 bp, Homo sapiens
caggagccccgaggcc

SEQ ID NO: 2071538 - DNA, 23 bp, Homo sapiens
caggagctacctgtgtggacagg

SEQ ID NO: 2071539 - DNA, 20 bp, Homo sapiens
caggagctgagtcacctcct

SEQ ID NO: 2071540 - DNA, 20 bp, Homo sapiens
caggagctgctcctggctga

SEQ ID NO: 2071541 - DNA, 19 bp, Homo sapiens
caggagcttgcaagaagca

SEQ ID NO: 2071542 - DNA, 17 bp, Homo sapiens
caggaggcctggccttg

SEQ ID NO: 2071543 - DNA, 17 bp, Homo sapiens
caggaggcgaataaatg

SEQ ID NO: 2071544 - DNA, 14 bp, Homo sapiens
caggaggcgcagcc

SEQ ID NO: 2071545 - DNA, 17 bp, Homo sapiens
caggaggcgcagcccga

SEQ ID NO: 2071546 - DNA, 21 bp, Homo sapiens
caggaggctgaggcagaagaa

SEQ ID NO: 2071547 - DNA, 15 bp, Homo sapiens
caggaggctgcggcc

SEQ ID NO: 2071548 - DNA, 19 bp, Homo sapiens
caggagggacaaaggagcc

SEQ ID NO: 2071549 - DNA, 22 bp, Homo sapiens
caggagggacaaaggagcctgt

SEQ ID NO: 2071550 - DNA, 24 bp, Homo sapiens
caggagggacaaaggagcctgtga

SEQ ID NO: 2071551 - DNA, 19 bp, Homo sapiens
caggagggcaagggccatg

SEQ ID NO: 2071552 - DNA, 19 bp, Homo sapiens
caggaggggcccacaatgg

SEQ ID NO: 2071553 - DNA, 15 bp, Homo sapiens
caggaggggcctctg

SEQ ID NO: 2071554 - DNA, 19 bp, Homo sapiens
caggaggtcctcctctctc

SEQ ID NO: 2071555 - DNA, 19 bp, Homo sapiens
caggaggtggaggttgcag

SEQ ID NO: 2071556 - DNA, 15 bp, Homo sapiens
caggagtagctgagc

SEQ ID NO: 2071557 - DNA, 16 bp, Homo sapiens
caggagtagctgagct

SEQ ID NO: 2071558 - DNA, 18 bp, Homo sapiens
caggagtagctgagctca

SEQ ID NO: 2071559 - DNA, 20 bp, Homo sapiens
caggagtagctgagctcaca

SEQ ID NO: 2071560 - DNA, 19 bp, Homo sapiens
caggagtcccaaggaaagc

SEQ ID NO: 2071561 - DNA, 21 bp, Homo sapiens
caggagtcccaaggaaagccc

SEQ ID NO: 2071562 - DNA, 12 bp, Homo sapiens
caggagtgagca

SEQ ID NO: 2071563 - DNA, 21 bp, Homo sapiens
caggagtggcagctgtcccct

SEQ ID NO: 2071564 - DNA, 21 bp, Homo sapiens
caggagttcgagaccagccca

SEQ ID NO: 2071565 - DNA, 12 bp, Homo sapiens
caggagttctga

SEQ ID NO: 2071566 - DNA, 19 bp, Homo sapiens
caggagttggagaccaggc

SEQ ID NO: 2071567 - DNA, 23 bp, Homo sapiens
caggagtttgagacaagccctgg

SEQ ID NO: 2071568 - DNA, 22 bp, Homo sapiens
caggagtttgaggctgcagcga

SEQ ID NO: 2071569 - DNA, 15 bp, Homo sapiens
caggatcccagagct

SEQ ID NO: 2071570 - DNA, 18 bp, Homo sapiens
caggatccgctgccacca

SEQ ID NO: 2071571 - DNA, 19 bp, Homo sapiens
caggatccgctgccaccac

SEQ ID NO: 2071572 - DNA, 20 bp, Homo sapiens
caggatgaaggcgtgcaagg

SEQ ID NO: 2071573 - DNA, 15 bp, Homo sapiens
caggatgaccctgcg

SEQ ID NO: 2071574 - DNA, 15 bp, Homo sapiens
caggatgtggcactg

SEQ ID NO: 2071575 - DNA, 19 bp, Homo sapiens
caggatgtggcactgcttg

SEQ ID NO: 2071576 - DNA, 15 bp, Homo sapiens
caggattcctctctc

SEQ ID NO: 2071577 - DNA, 13 bp, Homo sapiens
caggattgaagag

SEQ ID NO: 2071578 - DNA, 14 bp, Homo sapiens
caggcaaaatcctt

SEQ ID NO: 2071579 - DNA, 19 bp, Homo sapiens
caggcaactgaggcagaca

SEQ ID NO: 2071580 - DNA, 16 bp, Homo sapiens
caggcaagcacctcct

SEQ ID NO: 2071581 - DNA, 20 bp, Homo sapiens
caggcaagcccctcagccct

SEQ ID NO: 2071582 - DNA, 21 bp, Homo sapiens
caggcaagcccctcagccctt

SEQ ID NO: 2071583 - DNA, 17 bp, Homo sapiens
caggcaatgctggctgt

SEQ ID NO: 2071584 - DNA, 12 bp, Homo sapiens
caggcaattccg

SEQ ID NO: 2071585 - DNA, 16 bp, Homo sapiens
caggcacacagcagcc

SEQ ID NO: 2071586 - DNA, 15 bp, Homo sapiens
caggcacacttcttc

SEQ ID NO: 2071587 - DNA, 15 bp, Homo sapiens
caggcacaggcagga

SEQ ID NO: 2071588 - DNA, 12 bp, Homo sapiens
caggcacctggc

SEQ ID NO: 2071589 - DNA, 16 bp, Homo sapiens
caggcacctggcctgc

SEQ ID NO: 2071590 - DNA, 22 bp, Homo sapiens
caggcacctggcctgctgggaa

SEQ ID NO: 2071591 - DNA, 17 bp, Homo sapiens
caggcacgaacccacct

SEQ ID NO: 2071592 - DNA, 20 bp, Homo sapiens
caggcacgaacccacctgct

SEQ ID NO: 2071593 - DNA, 20 bp, Homo sapiens
caggcactgagaatgatagt

SEQ ID NO: 2071594 - DNA, 16 bp, Homo sapiens
caggcactgctgccca

SEQ ID NO: 2071595 - DNA, 14 bp, Homo sapiens
caggcactggtggc

SEQ ID NO: 2071596 - DNA, 19 bp, Homo sapiens
caggcagacaagagctgct

SEQ ID NO: 2071597 - DNA, 22 bp, Homo sapiens
caggcagacaagagctgctgtc

SEQ ID NO: 2071598 - DNA, 15 bp, Homo sapiens
caggcagagaatcat

SEQ ID NO: 2071599 - DNA, 23 bp, Homo sapiens
caggcagagaatcatacttagca

SEQ ID NO: 2071600 - DNA, 20 bp, Homo sapiens
caggcagagcggggaggtgc

SEQ ID NO: 2071601 - DNA, 14 bp, Homo sapiens
caggcagaggatgt

SEQ ID NO: 2071602 - DNA, 18 bp, Homo sapiens
caggcagatacaggaaaa

SEQ ID NO: 2071603 - DNA, 21 bp, Homo sapiens
caggcagcgatggtctcagaa

SEQ ID NO: 2071604 - DNA, 15 bp, Homo sapiens
caggcagctggatga

SEQ ID NO: 2071605 - DNA, 14 bp, Homo sapiens
caggcaggaagaga

SEQ ID NO: 2071606 - DNA, 18 bp, Homo sapiens
caggcaggaagagagaga

SEQ ID NO: 2071607 - DNA, 11 bp, Homo sapiens
caggcagggct

SEQ ID NO: 2071608 - DNA, 12 bp, Homo sapiens
caggcagggctc

SEQ ID NO: 2071609 - DNA, 13 bp, Homo sapiens
caggcagggctct

SEQ ID NO: 2071610 - DNA, 16 bp, Homo sapiens
caggcagggctctcct

SEQ ID NO: 2071611 - DNA, 17 bp, Homo sapiens
caggcagggctctcctg

SEQ ID NO: 2071612 - DNA, 19 bp, Homo sapiens
caggcagggctctcctggc

SEQ ID NO: 2071613 - DNA, 23 bp, Homo sapiens
caggcagggctctcctggcttcc

SEQ ID NO: 2071614 - DNA, 18 bp, Homo sapiens
caggcaggggtgggagag

SEQ ID NO: 2071615 - DNA, 15 bp, Homo sapiens
caggcaggtccaggg

SEQ ID NO: 2071616 - DNA, 12 bp, Homo sapiens
caggcaggtctt

SEQ ID NO: 2071617 - DNA, 22 bp, Homo sapiens
caggcaggtcttgaactcctgg

SEQ ID NO: 2071618 - DNA, 16 bp, Homo sapiens
caggcaggtgcctgga

SEQ ID NO: 2071619 - DNA, 18 bp, Homo sapiens
caggcaggtttgccagtg

SEQ ID NO: 2071620 - DNA, 15 bp, Homo sapiens
caggcatctacacag

SEQ ID NO: 2071621 - DNA, 21 bp, Homo sapiens
caggcatctacacagcctgga

SEQ ID NO: 2071622 - DNA, 23 bp, Homo sapiens
caggcatctacacagcctggact

SEQ ID NO: 2071623 - DNA, 20 bp, Homo sapiens
cagctgcggtccacccagga

SEQ ID NO: 2071624 - DNA, 22 bp, Homo sapiens
cagctgcggtccacccaggagc

SEQ ID NO: 2071625 - DNA, 14 bp, Homo sapiens
cagctgctacaaga

SEQ ID NO: 2071626 - DNA, 20 bp, Homo sapiens
cagctgctctgccccttggg

SEQ ID NO: 2071627 - DNA, 20 bp, Homo sapiens
cagctgctgaagttctgagc

SEQ ID NO: 2071628 - DNA, 15 bp, Homo sapiens
cagctgcttgtcctg

SEQ ID NO: 2071629 - DNA, 17 bp, Homo sapiens
cagctgcttgtcctgct

SEQ ID NO: 2071630 - DNA, 21 bp, Homo sapiens
cagctgcttgtcctgctctct

SEQ ID NO: 2071631 - DNA, 23 bp, Homo sapiens
cagctgcttgtcctgctctcttc

SEQ ID NO: 2071632 - DNA, 21 bp, Homo sapiens
cagctggaattgctgctctct

SEQ ID NO: 2071633 - DNA, 14 bp, Homo sapiens
cagctggaatttaa

SEQ ID NO: 2071634 - DNA, 21 bp, Homo sapiens
cagctggaatttaaggaggga

SEQ ID NO: 2071635 - DNA, 16 bp, Homo sapiens
cagctggagaagaccc

SEQ ID NO: 2071636 - DNA, 21 bp, Homo sapiens
cagctggatgagacttccaaa

SEQ ID NO: 2071637 - DNA, 20 bp, Homo sapiens
cagctggcctctagaacacc

SEQ ID NO: 2071638 - DNA, 14 bp, Homo sapiens
cagctggctctcca

SEQ ID NO: 2071639 - DNA, 16 bp, Homo sapiens
cagctggctctccacc

SEQ ID NO: 2071640 - DNA, 14 bp, Homo sapiens
cagctggctgctga

SEQ ID NO: 2071641 - DNA, 19 bp, Homo sapiens
cagctggctgctgacagga

SEQ ID NO: 2071642 - DNA, 15 bp, Homo sapiens
cagctgggacccctc

SEQ ID NO: 2071643 - DNA, 18 bp, Homo sapiens
cagctgggacccctccca

SEQ ID NO: 2071644 - DNA, 15 bp, Homo sapiens
cagctgggccccatg

SEQ ID NO: 2071645 - DNA, 17 bp, Homo sapiens
cagctgggccccatgct

SEQ ID NO: 2071646 - DNA, 23 bp, Homo sapiens
cagctgggccccatgctctgccc

SEQ ID NO: 2071647 - DNA, 19 bp, Homo sapiens
cagctgggccggccagcct

SEQ ID NO: 2071648 - DNA, 18 bp, Homo sapiens
cagctggtcaacctgctc

SEQ ID NO: 2071649 - DNA, 22 bp, Homo sapiens
cagctggtgggaagcgtctgtc

SEQ ID NO: 2071650 - DNA, 12 bp, Homo sapiens
cagctgtagcca

SEQ ID NO: 2071651 - DNA, 14 bp, Homo sapiens
cagctgtagccatg

SEQ ID NO: 2071652 - DNA, 22 bp, Homo sapiens
cagctgtcatggaaaagcccag

SEQ ID NO: 2071653 - DNA, 17 bp, Homo sapiens
cagctgtcccctctccc

SEQ ID NO: 2071654 - DNA, 20 bp, Homo sapiens
cagctgtcccctctccctgg

SEQ ID NO: 2071655 - DNA, 21 bp, Homo sapiens
cagctgtcccctctccctggg

SEQ ID NO: 2071656 - DNA, 22 bp, Homo sapiens
cagctgtcccctctccctgggg

SEQ ID NO: 2071657 - DNA, 13 bp, Homo sapiens
cagctgtccctgt

SEQ ID NO: 2071658 - DNA, 15 bp, Homo sapiens
cagctgtccctgtca

SEQ ID NO: 2071659 - DNA, 18 bp, Homo sapiens
cagctgtccctgtcacca

SEQ ID NO: 2071660 - DNA, 14 bp, Homo sapiens
cagctgtcgcatct

SEQ ID NO: 2071661 - DNA, 20 bp, Homo sapiens
cagctgtgcctcgctcccca

SEQ ID NO: 2071662 - DNA, 14 bp, Homo sapiens
cagctgtttgtcat

SEQ ID NO: 2071663 - DNA, 19 bp, Homo sapiens
cagcttaacattgacttct

SEQ ID NO: 2071664 - DNA, 20 bp, Homo sapiens
cagcttaagtataattaata

SEQ ID NO: 2071665 - DNA, 15 bp, Homo sapiens
cagcttcatttcctg

SEQ ID NO: 2071666 - DNA, 22 bp, Homo sapiens
cagcttcccctcgctgtcctgc

SEQ ID NO: 2071667 - DNA, 12 bp, Homo sapiens
cagcttcctgtc

SEQ ID NO: 2071668 - DNA, 13 bp, Homo sapiens
cagcttcctgtca

SEQ ID NO: 2071669 - DNA, 13 bp, Homo sapiens
cagcttctccagg

SEQ ID NO: 2071670 - DNA, 14 bp, Homo sapiens
cagcttctccaggc

SEQ ID NO: 2071671 - DNA, 15 bp, Homo sapiens
cagcttgaccagacc

SEQ ID NO: 2071672 - DNA, 16 bp, Homo sapiens
cagcttgaccagacct

SEQ ID NO: 2071673 - DNA, 14 bp, Homo sapiens
cagcttgagcctgt

SEQ ID NO: 2071674 - DNA, 21 bp, Homo sapiens
cagcttgagggttgggctggt

SEQ ID NO: 2071675 - DNA, 22 bp, Homo sapiens
cagcttgtaaatagctcaggtg

SEQ ID NO: 2071676 - DNA, 12 bp, Homo sapiens
cagcttgtagcc

SEQ ID NO: 2071677 - DNA, 15 bp, Homo sapiens
cagctttacatgcaa

SEQ ID NO: 2071678 - DNA, 11 bp, Homo sapiens
cagctttgcta

SEQ ID NO: 2071679 - DNA, 13 bp, Homo sapiens
cagcttttaataa

SEQ ID NO: 2071680 - DNA, 17 bp, Homo sapiens
cagcttttgcagaagca

SEQ ID NO: 2071681 - DNA, 15 bp, Homo sapiens
cagcttttgcttcat

SEQ ID NO: 2071682 - DNA, 19 bp, Homo sapiens
cagctttttgtcttttctg

SEQ ID NO: 2071683 - DNA, 19 bp, Homo sapiens
caggaaaactgacagagga

SEQ ID NO: 2071684 - DNA, 22 bp, Homo sapiens
caggaaaaggtagcttacctga

SEQ ID NO: 2071685 - DNA, 17 bp, Homo sapiens
caggaaaatcctctggc

SEQ ID NO: 2071686 - DNA, 13 bp, Homo sapiens
caggaaaattgaa

SEQ ID NO: 2071687 - DNA, 21 bp, Homo sapiens
caggaaatagtgttcttttta

SEQ ID NO: 2071688 - DNA, 22 bp, Homo sapiens
caggaaatcaaatatgcaaagc

SEQ ID NO: 2071689 - DNA, 13 bp, Homo sapiens
caggaacagaagg

SEQ ID NO: 2071690 - DNA, 15 bp, Homo sapiens
caggaacagagactc

SEQ ID NO: 2071691 - DNA, 19 bp, Homo sapiens
caggaacgagcactggcca

SEQ ID NO: 2071692 - DNA, 21 bp, Homo sapiens
caggaacgagcactggccaga

SEQ ID NO: 2071693 - DNA, 14 bp, Homo sapiens
caggaactcccagc

SEQ ID NO: 2071694 - DNA, 12 bp, Homo sapiens
caggaactgggc

SEQ ID NO: 2071695 - DNA, 13 bp, Homo sapiens
caggaagaaaccc

SEQ ID NO: 2071696 - DNA, 15 bp, Homo sapiens
caggaagaaacccca

SEQ ID NO: 2071697 - DNA, 20 bp, Homo sapiens
caggaagaaaccccaagcag

SEQ ID NO: 2071698 - DNA, 15 bp, Homo sapiens
caggaagagaaggag

SEQ ID NO: 2071699 - DNA, 14 bp, Homo sapiens
caggaagagagaga

SEQ ID NO: 2071700 - DNA, 17 bp, Homo sapiens
caggaagccaggctgag

SEQ ID NO: 2071701 - DNA, 18 bp, Homo sapiens
caggaagccaggctgagt

SEQ ID NO: 2071702 - DNA, 14 bp, Homo sapiens
caggaaggcagctg

SEQ ID NO: 2071703 - DNA, 18 bp, Homo sapiens
caggaaggcagctgctct

SEQ ID NO: 2071704 - DNA, 18 bp, Homo sapiens
caggaagggggtccaccc

SEQ ID NO: 2071705 - DNA, 23 bp, Homo sapiens
caggaataaggccttaatatgtt

SEQ ID NO: 2071706 - DNA, 22 bp, Homo sapiens
caggaatatcccaaacttcgga

SEQ ID NO: 2071707 - DNA, 13 bp, Homo sapiens
caggaatctcaga

SEQ ID NO: 2071708 - DNA, 19 bp, Homo sapiens
caggaatgttaaagtcagt

SEQ ID NO: 2071709 - DNA, 22 bp, Homo sapiens
caggaattgaagatgtaaggaa

SEQ ID NO: 2071710 - DNA, 14 bp, Homo sapiens
caggacaagcatgg

SEQ ID NO: 2071711 - DNA, 12 bp, Homo sapiens
caggacacaggc

SEQ ID NO: 2071712 - DNA, 18 bp, Homo sapiens
caggacacaggcctgtgt

SEQ ID NO: 2071713 - DNA, 22 bp, Homo sapiens
caggacacaggcctgtgtagct

SEQ ID NO: 2071714 - DNA, 20 bp, Homo sapiens
caggacacatcccggcctct

SEQ ID NO: 2071715 - DNA, 11 bp, Homo sapiens
caggacacctg

SEQ ID NO: 2071716 - DNA, 12 bp, Homo sapiens
caggacacctgc

SEQ ID NO: 2071717 - DNA, 17 bp, Homo sapiens
caggacacctgccccag

SEQ ID NO: 2071718 - DNA, 20 bp, Homo sapiens
caggacacctgccccagcgc

SEQ ID NO: 2071719 - DNA, 16 bp, Homo sapiens
cagcagcccctgcaca

SEQ ID NO: 2071720 - DNA, 23 bp, Homo sapiens
cagcagcccctgcacaaagccct

SEQ ID NO: 2071721 - DNA, 11 bp, Homo sapiens
cagcagcccta

SEQ ID NO: 2071722 - DNA, 15 bp, Homo sapiens
cagcagccctcctca

SEQ ID NO: 2071723 - DNA, 17 bp, Homo sapiens
cagcagccctcctcacc

SEQ ID NO: 2071724 - DNA, 17 bp, Homo sapiens
cagcagcggtaccccag

SEQ ID NO: 2071725 - DNA, 16 bp, Homo sapiens
cagctgcacattcctg

SEQ ID NO: 2071726 - DNA, 21 bp, Homo sapiens
cagctgcacattcctggcccc

SEQ ID NO: 2071727 - DNA, 19 bp, Homo sapiens
cagctgcagctgggcccca

SEQ ID NO: 2071728 - DNA, 15 bp, Homo sapiens
cagctgcagtcaaca

SEQ ID NO: 2071729 - DNA, 17 bp, Homo sapiens
cagctgcagtcaacagt

SEQ ID NO: 2071730 - DNA, 21 bp, Homo sapiens
cagctgccaagcactcgagac

SEQ ID NO: 2071731 - DNA, 22 bp, Homo sapiens
cagctgccaagcactcgagacc

SEQ ID NO: 2071732 - DNA, 23 bp, Homo sapiens
cagctgccaagcactcgagacca

SEQ ID NO: 2071733 - DNA, 17 bp, Homo sapiens
cagctgccgaccagagc

SEQ ID NO: 2071734 - DNA, 12 bp, Homo sapiens
cagctgcctgca

SEQ ID NO: 2071735 - DNA, 10 bp, Homo sapiens
cagctgcctt

SEQ ID NO: 2071736 - DNA, 14 bp, Homo sapiens
cagctgcgggtctg

SEQ ID NO: 2071737 - DNA, 18 bp, Homo sapiens
cagctgcggtccacccag

SEQ ID NO: 2071738 - DNA, 12 bp, Homo sapiens
cccactccagcc

SEQ ID NO: 2071739 - DNA, 20 bp, Homo sapiens
cccactccctggctctcaga

SEQ ID NO: 2071740 - DNA, 22 bp, Homo sapiens
cccactctttgctacaataaat

SEQ ID NO: 2071741 - DNA, 23 bp, Homo sapiens
cccactctttgctacaataaatg

SEQ ID NO: 2071742 - DNA, 15 bp, Homo sapiens
cccactgcaggcccc

SEQ ID NO: 2071743 - DNA, 18 bp, Homo sapiens
cccactgccacaccctcc

SEQ ID NO: 2071744 - DNA, 14 bp, Homo sapiens
cccactggccagtc

SEQ ID NO: 2071745 - DNA, 20 bp, Homo sapiens
cccacttagccgtccatggc

SEQ ID NO: 2071746 - DNA, 14 bp, Homo sapiens
cccacttcagccca

SEQ ID NO: 2071747 - DNA, 20 bp, Homo sapiens
cccacttctctactctggaa

SEQ ID NO: 2071748 - DNA, 14 bp, Homo sapiens
cccacttctctcca

SEQ ID NO: 2071749 - DNA, 16 bp, Homo sapiens
cccacttgtcatccat

SEQ ID NO: 2071750 - DNA, 21 bp, Homo sapiens
cccagaaataggacaattcac

SEQ ID NO: 2071751 - DNA, 16 bp, Homo sapiens
cccagaaattccttcc

SEQ ID NO: 2071752 - DNA, 23 bp, Homo sapiens
cccagacacatcgcactgtggat

SEQ ID NO: 2071753 - DNA, 18 bp, Homo sapiens
cccagacacattctcctg

SEQ ID NO: 2071754 - DNA, 13 bp, Homo sapiens
cccagacagagcc

SEQ ID NO: 2071755 - DNA, 22 bp, Homo sapiens
cccagaccacctccctgccctg

SEQ ID NO: 2071756 - DNA, 14 bp, Homo sapiens
cccagacccctctc

SEQ ID NO: 2071757 - DNA, 14 bp, Homo sapiens
cccagactcagctc

SEQ ID NO: 2071758 - DNA, 20 bp, Homo sapiens
cccagactcctttcctctga

SEQ ID NO: 2071759 - DNA, 16 bp, Homo sapiens
cccagagacaggaaaa

SEQ ID NO: 2071760 - DNA, 11 bp, Homo sapiens
cccagagacct

SEQ ID NO: 2071761 - DNA, 13 bp, Homo sapiens
cccagagaccttt

SEQ ID NO: 2071762 - DNA, 19 bp, Homo sapiens
cccagagaggaatcagact

SEQ ID NO: 2071763 - DNA, 21 bp, Homo sapiens
cccagagaggggacatttccc

SEQ ID NO: 2071764 - DNA, 16 bp, Homo sapiens
cccagagatgcctcca

SEQ ID NO: 2071765 - DNA, 23 bp, Homo sapiens
cccagagatgcctccaccgctgc

SEQ ID NO: 2071766 - DNA, 22 bp, Homo sapiens
cccagagattgcttctcatccc

SEQ ID NO: 2071767 - DNA, 17 bp, Homo sapiens
cccagagccttctcctg

SEQ ID NO: 2071768 - DNA, 21 bp, Homo sapiens
cccagagctgtggactttgtt

SEQ ID NO: 2071769 - DNA, 21 bp, Homo sapiens
cccagagcttattggccactg

SEQ ID NO: 2071770 - DNA, 23 bp, Homo sapiens
cccagagcttattggccactggg

SEQ ID NO: 2071771 - DNA, 13 bp, Homo sapiens
cccagaggccagg

SEQ ID NO: 2071772 - DNA, 14 bp, Homo sapiens
cccagaggccagga

SEQ ID NO: 2071773 - DNA, 13 bp, Homo sapiens
cccagagggccca

SEQ ID NO: 2071774 - DNA, 14 bp, Homo sapiens
cccagagggcccag

SEQ ID NO: 2071775 - DNA, 23 bp, Homo sapiens
cccagagggcccaggcaggccac

SEQ ID NO: 2071776 - DNA, 22 bp, Homo sapiens
cccagaggtgacccaatgctcc

SEQ ID NO: 2071777 - DNA, 18 bp, Homo sapiens
cccagaggttatctgcct

SEQ ID NO: 2071778 - DNA, 19 bp, Homo sapiens
cccagaggttatctgcctg

SEQ ID NO: 2071779 - DNA, 21 bp, Homo sapiens
cccagaggttatctgcctggc

SEQ ID NO: 2071780 - DNA, 17 bp, Homo sapiens
cccagagtcagaggaga

SEQ ID NO: 2071781 - DNA, 17 bp, Homo sapiens
cccagagtgtgaaactt

SEQ ID NO: 2071782 - DNA, 12 bp, Homo sapiens
cccagatcctca

SEQ ID NO: 2071783 - DNA, 12 bp, Homo sapiens
cccagatctcat

SEQ ID NO: 2071784 - DNA, 19 bp, Homo sapiens
cccagatctgcctgggcct

SEQ ID NO: 2071785 - DNA, 21 bp, Homo sapiens
cccagatctgcctgggcctgt

SEQ ID NO: 2071786 - DNA, 13 bp, Homo sapiens
cccagatgctggg

SEQ ID NO: 2071787 - DNA, 15 bp, Homo sapiens
cccagcaacacaagc

SEQ ID NO: 2071788 - DNA, 22 bp, Homo sapiens
cccagcaacacaagctggaagc

SEQ ID NO: 2071789 - DNA, 20 bp, Homo sapiens
cccagcaagagcacaagagg

SEQ ID NO: 2071790 - DNA, 16 bp, Homo sapiens
cccagcaagtgagagc

SEQ ID NO: 2071791 - DNA, 18 bp, Homo sapiens
cccagcaagtgagagctg

SEQ ID NO: 2071792 - DNA, 19 bp, Homo sapiens
cccagcaagtgagagctgg

SEQ ID NO: 2071793 - DNA, 21 bp, Homo sapiens
cccagcaagtgagagctgggt

SEQ ID NO: 2071794 - DNA, 17 bp, Homo sapiens
cccagcactaaagcagt

SEQ ID NO: 2071795 - DNA, 12 bp, Homo sapiens
cccagcactcct

SEQ ID NO: 2071796 - DNA, 16 bp, Homo sapiens
cccagcactcctctgt

SEQ ID NO: 2071797 - DNA, 13 bp, Homo sapiens
cccagcactgtga

SEQ ID NO: 2071798 - DNA, 22 bp, Homo sapiens
cccagcactgtgaagacccagc

SEQ ID NO: 2071799 - DNA, 20 bp, Homo sapiens
cccagcactttgggaggcca

SEQ ID NO: 2071800 - DNA, 14 bp, Homo sapiens
cccagcagaagagg

SEQ ID NO: 2071801 - DNA, 17 bp, Homo sapiens
cccagcagaagagggag

SEQ ID NO: 2071802 - DNA, 20 bp, Homo sapiens
cccagcagctgggccggcca

SEQ ID NO: 2071803 - DNA, 23 bp, Homo sapiens
cccagcagctgggccggccagcc

SEQ ID NO: 2071804 - DNA, 13 bp, Homo sapiens
cccagcagggcct

SEQ ID NO: 2071805 - DNA, 13 bp, Homo sapiens
cccagcatgtaca

SEQ ID NO: 2071806 - DNA, 12 bp, Homo sapiens
cccagccacctc

SEQ ID NO: 2071807 - DNA, 20 bp, Homo sapiens
cccagccacctcccaaggac

SEQ ID NO: 2071808 - DNA, 20 bp, Homo sapiens
cccagccattaccatggaga

SEQ ID NO: 2071809 - DNA, 14 bp, Homo sapiens
cccagcccacagag

SEQ ID NO: 2071810 - DNA, 17 bp, Homo sapiens
cccagcccacagagcct

SEQ ID NO: 2071811 - DNA, 16 bp, Homo sapiens
cccagcccagctggtg

SEQ ID NO: 2071812 - DNA, 18 bp, Homo sapiens
cccagcccccacctccgc

SEQ ID NO: 2071813 - DNA, 16 bp, Homo sapiens
ccatcatgtctggcta

SEQ ID NO: 2071814 - DNA, 17 bp, Homo sapiens
ccatcatgtgcctggaa

SEQ ID NO: 2071815 - DNA, 20 bp, Homo sapiens
ccatcatgtgcctggaaatt

SEQ ID NO: 2071816 - DNA, 14 bp, Homo sapiens
ccatccattctgcc

SEQ ID NO: 2071817 - DNA, 13 bp, Homo sapiens
ccatcccacattc

SEQ ID NO: 2071818 - DNA, 13 bp, Homo sapiens
ccatcccctggac

SEQ ID NO: 2071819 - DNA, 16 bp, Homo sapiens
ccatcccgaaaatctc

SEQ ID NO: 2071820 - DNA, 12 bp, Homo sapiens
ccatccctgggc

SEQ ID NO: 2071821 - DNA, 20 bp, Homo sapiens
ccatccctgggcccctccac

SEQ ID NO: 2071822 - DNA, 17 bp, Homo sapiens
ccatcccttcctcccca

SEQ ID NO: 2071823 - DNA, 16 bp, Homo sapiens
ccatccgggacgcttc

SEQ ID NO: 2071824 - DNA, 22 bp, Homo sapiens
ccatccgggacgcttccagacc

SEQ ID NO: 2071825 - DNA, 23 bp, Homo sapiens
ccatccgggacgcttccagacca

SEQ ID NO: 2071826 - DNA, 20 bp, Homo sapiens
ccatcctaccaatgcatgca

SEQ ID NO: 2071827 - DNA, 21 bp, Homo sapiens
ccatcctgcagcctcctcctg

SEQ ID NO: 2071828 - DNA, 13 bp, Homo sapiens
ccatcctggcccc

SEQ ID NO: 2071829 - DNA, 19 bp, Homo sapiens
ccatcctggcccctccaga

SEQ ID NO: 2071830 - DNA, 15 bp, Homo sapiens
ccatcctgtcctttg

SEQ ID NO: 2071831 - DNA, 17 bp, Homo sapiens
ccatccttcaccagagc

SEQ ID NO: 2071832 - DNA, 21 bp, Homo sapiens
ccatccttcaccagagcccat

SEQ ID NO: 2071833 - DNA, 20 bp, Homo sapiens
ccatctaagctgcagcttcc

SEQ ID NO: 2071834 - DNA, 22 bp, Homo sapiens
ccatctatgtcccttgctgtga

SEQ ID NO: 2071835 - DNA, 13 bp, Homo sapiens
ccatctcaggtgc

SEQ ID NO: 2071836 - DNA, 14 bp, Homo sapiens
ccatctcaggtgcc

SEQ ID NO: 2071837 - DNA, 21 bp, Homo sapiens
ccatctccaccctgagcctga

SEQ ID NO: 2071838 - DNA, 18 bp, Homo sapiens
ccatctccagcatcctgc

SEQ ID NO: 2071839 - DNA, 15 bp, Homo sapiens
ccatctccccaggcc

SEQ ID NO: 2071840 - DNA, 19 bp, Homo sapiens
ccatctccccaggcctcca

SEQ ID NO: 2071841 - DNA, 20 bp, Homo sapiens
ccatctcccccatcccccac

SEQ ID NO: 2071842 - DNA, 18 bp, Homo sapiens
ccatctgaaccactttgc

SEQ ID NO: 2071843 - DNA, 16 bp, Homo sapiens
ccatctgctcctccca

SEQ ID NO: 2071844 - DNA, 18 bp, Homo sapiens
ccatctgggtccttgcac

SEQ ID NO: 2071845 - DNA, 22 bp, Homo sapiens
ccatctgggtccttgcacccct

SEQ ID NO: 2071846 - DNA, 11 bp, Homo sapiens
ccatctgtctt

SEQ ID NO: 2071847 - DNA, 20 bp, Homo sapiens
ccatctgtcttgccagccag

SEQ ID NO: 2071848 - DNA, 21 bp, Homo sapiens
ccatctgtttgagaatatgat

SEQ ID NO: 2071849 - DNA, 21 bp, Homo sapiens
ccatcttagatagatggtact

SEQ ID NO: 2071850 - DNA, 16 bp, Homo sapiens
ccatcttcctgctgct

SEQ ID NO: 2071851 - DNA, 18 bp, Homo sapiens
ccatcttcctgctgctgt

SEQ ID NO: 2071852 - DNA, 22 bp, Homo sapiens
ccatcttggtcctgtcaccctg

SEQ ID NO: 2071853 - DNA, 20 bp, Homo sapiens
ccatgaagacacgcttaaaa

SEQ ID NO: 2071854 - DNA, 16 bp, Homo sapiens
ccatgaagacaggaca

SEQ ID NO: 2071855 - DNA, 13 bp, Homo sapiens
ccatgaagagact

SEQ ID NO: 2071856 - DNA, 22 bp, Homo sapiens
ccatgaccagttctggccagga

SEQ ID NO: 2071857 - DNA, 22 bp, Homo sapiens
ccatgagaataagagaaagaaa

SEQ ID NO: 2071858 - DNA, 19 bp, Homo sapiens
ccatgagcctcagcatcct

SEQ ID NO: 2071859 - DNA, 21 bp, Homo sapiens
ccatgagcctcagcatcctgg

SEQ ID NO: 2071860 - DNA, 18 bp, Homo sapiens
ccatgaggagttgctgtt

SEQ ID NO: 2071861 - DNA, 12 bp, Homo sapiens
ccatgatctgta

SEQ ID NO: 2071862 - DNA, 14 bp, Homo sapiens
ccatgattttacag

SEQ ID NO: 2071863 - DNA, 22 bp, Homo sapiens
ccatgcacacaaacacctccta

SEQ ID NO: 2071864 - DNA, 19 bp, Homo sapiens
ccatgcagcttcatcaatt

SEQ ID NO: 2071865 - DNA, 12 bp, Homo sapiens
ccatgcccaacc

SEQ ID NO: 2071866 - DNA, 15 bp, Homo sapiens
ccatgcctacagata

SEQ ID NO: 2071867 - DNA, 16 bp, Homo sapiens
ccatgcctcaagaaca

SEQ ID NO: 2071868 - DNA, 15 bp, Homo sapiens
ccatgcctcatgcca

SEQ ID NO: 2071869 - DNA, 12 bp, Homo sapiens
ccatgcctgagg

SEQ ID NO: 2071870 - DNA, 15 bp, Homo sapiens
ccatgcctgagggtg

SEQ ID NO: 2071871 - DNA, 17 bp, Homo sapiens
ccatgcctgagggtgga

SEQ ID NO: 2071872 - DNA, 18 bp, Homo sapiens
ccatgcctgagggtggag

SEQ ID NO: 2071873 - DNA, 14 bp, Homo sapiens
ccatgcgctgctca

SEQ ID NO: 2071874 - DNA, 16 bp, Homo sapiens
ccatgctcaaccactg

SEQ ID NO: 2071875 - DNA, 19 bp, Homo sapiens
ccatgctcaaccactgtgg

SEQ ID NO: 2071876 - DNA, 23 bp, Homo sapiens
ccatgctctgccccaagccccca

SEQ ID NO: 2071877 - DNA, 16 bp, Homo sapiens
ccatgctgaattattt

SEQ ID NO: 2071878 - DNA, 20 bp, Homo sapiens
ccatgctgctttttggcaca

SEQ ID NO: 2071879 - DNA, 22 bp, Homo sapiens
ccatgctgctttttggcacagt

SEQ ID NO: 2071880 - DNA, 21 bp, Homo sapiens
ccatgctggcggcgcagaggg

SEQ ID NO: 2071881 - DNA, 19 bp, Homo sapiens
ccatgcttcttgccccttg

SEQ ID NO: 2071882 - DNA, 15 bp, Homo sapiens
ccatgcttgggtgta

SEQ ID NO: 2071883 - DNA, 17 bp, Homo sapiens
ccatgctttccttttct

SEQ ID NO: 2071884 - DNA, 22 bp, Homo sapiens
ccatgctttccttttcttcctt

SEQ ID NO: 2071885 - DNA, 11 bp, Homo sapiens
ccatggccacc

SEQ ID NO: 2071886 - DNA, 13 bp, Homo sapiens
ccatggccacccc

SEQ ID NO: 2071887 - DNA, 21 bp, Homo sapiens
ccatggccttccctccccaca

SEQ ID NO: 2071888 - DNA, 13 bp, Homo sapiens
ccatggctcaggc

SEQ ID NO: 2071889 - DNA, 18 bp, Homo sapiens
ccatggctcaggcaagcc

SEQ ID NO: 2071890 - DNA, 13 bp, Homo sapiens
ccatgggcctcct

SEQ ID NO: 2071891 - DNA, 14 bp, Homo sapiens
ccatgggcctcctg

SEQ ID NO: 2071892 - DNA, 15 bp, Homo sapiens
ccatgggcctcctgt

SEQ ID NO: 2071893 - DNA, 20 bp, Homo sapiens
ccatgggcctgctgcgtcag

SEQ ID NO: 2071894 - DNA, 23 bp, Homo sapiens
ccatgggcctgctgcgtcagacc

SEQ ID NO: 2071895 - DNA, 12 bp, Homo sapiens
ccatgggcctgg

SEQ ID NO: 2071896 - DNA, 17 bp, Homo sapiens
ccatgggcctgggcctg

SEQ ID NO: 2071897 - DNA, 19 bp, Homo sapiens
ccatgggcctgggcctgct

SEQ ID NO: 2071898 - DNA, 17 bp, Homo sapiens
ccatgggctagtgtgag

SEQ ID NO: 2071899 - DNA, 21 bp, Homo sapiens
ccatgggcttggacttcctgg

SEQ ID NO: 2071900 - DNA, 17 bp, Homo sapiens
ccatggtgacacacagc

SEQ ID NO: 2071901 - DNA, 21 bp, Homo sapiens
ccatggttaccgaggaccctg

SEQ ID NO: 2071902 - DNA, 22 bp, Homo sapiens
ccatgtaccagtgtactgcttt

SEQ ID NO: 2071903 - DNA, 14 bp, Homo sapiens
ccatgtagacccct

SEQ ID NO: 2071904 - DNA, 16 bp, Homo sapiens
ccatgtagcaggactg

SEQ ID NO: 2071905 - DNA, 22 bp, Homo sapiens
ccatgtatttatctctatttaa

SEQ ID NO: 2071906 - DNA, 14 bp, Homo sapiens
ccatgtcacctcag

SEQ ID NO: 2071907 - DNA, 16 bp, Homo sapiens
ccatgtcacctcagct

SEQ ID NO: 2071908 - DNA, 19 bp, Homo sapiens
ccatgtccaagtccaacct

SEQ ID NO: 2071909 - DNA, 17 bp, Homo sapiens
ccatgtcctatgtgtga

SEQ ID NO: 2071910 - DNA, 19 bp, Homo sapiens
ccatgtcctatgtgtgact

SEQ ID NO: 2071911 - DNA, 14 bp, Homo sapiens
ccatgtcgcctgcc

SEQ ID NO: 2071912 - DNA, 13 bp, Homo sapiens
ccatgtgccaggt

SEQ ID NO: 2071913 - DNA, 17 bp, Homo sapiens
ccatgtggccccaggtg

SEQ ID NO: 2071914 - DNA, 21 bp, Homo sapiens
ccatgtggccccaggtgccac

SEQ ID NO: 2071915 - DNA, 15 bp, Homo sapiens
ccatgtggctgaaga

SEQ ID NO: 2071916 - DNA, 14 bp, Homo sapiens
ccatgtgtcccctc

SEQ ID NO: 2071917 - DNA, 16 bp, Homo sapiens
ccatgtgtcccctcac

SEQ ID NO: 2071918 - DNA, 20 bp, Homo sapiens
ccatgtgtcccctcactctg

SEQ ID NO: 2071919 - DNA, 22 bp, Homo sapiens
ccatgtgtcccctcactctgtc

SEQ ID NO: 2071920 - DNA, 18 bp, Homo sapiens
ccatgttagtttttactt

SEQ ID NO: 2071921 - DNA, 19 bp, Homo sapiens
ccatgttgcatgcctatgt

SEQ ID NO: 2071922 - DNA, 13 bp, Homo sapiens
ccatgttggccag

SEQ ID NO: 2071923 - DNA, 15 bp, Homo sapiens
ccatgttggccaggc

SEQ ID NO: 2071924 - DNA, 22 bp, Homo sapiens
ccatgtttagattccaggatca

SEQ ID NO: 2071925 - DNA, 17 bp, Homo sapiens
ccatgtttgagctcaga

SEQ ID NO: 2071926 - DNA, 13 bp, Homo sapiens
ccatgtttgtaaa

SEQ ID NO: 2071927 - DNA, 22 bp, Homo sapiens
ccattcacatttgatgtacatg

SEQ ID NO: 2071928 - DNA, 16 bp, Homo sapiens
ccattcagacacttca

SEQ ID NO: 2071929 - DNA, 17 bp, Homo sapiens
ccagcctcagtgccact

SEQ ID NO: 2071930 - DNA, 21 bp, Homo sapiens
ccagcctccaagctccatctc

SEQ ID NO: 2071931 - DNA, 16 bp, Homo sapiens
ccagcctcctcccacc

SEQ ID NO: 2071932 - DNA, 18 bp, Homo sapiens
ccagcctcctcccaccac

SEQ ID NO: 2071933 - DNA, 16 bp, Homo sapiens
ccagcctcgcatgcca

SEQ ID NO: 2071934 - DNA, 13 bp, Homo sapiens
ccagcctctcccg

SEQ ID NO: 2071935 - DNA, 20 bp, Homo sapiens
ccagcctctcccggctgcct

SEQ ID NO: 2071936 - DNA, 21 bp, Homo sapiens
ccagcctctcccggctgcctg

SEQ ID NO: 2071937 - DNA, 11 bp, Homo sapiens
ccagcctgagc

SEQ ID NO: 2071938 - DNA, 12 bp, Homo sapiens
ccagcctggcca

SEQ ID NO: 2071939 - DNA, 12 bp, Homo sapiens
ccagcctggcct

SEQ ID NO: 2071940 - DNA, 13 bp, Homo sapiens
ccagcctggcctc

SEQ ID NO: 2071941 - DNA, 14 bp, Homo sapiens
ccagcctggcctcc

SEQ ID NO: 2071942 - DNA, 15 bp, Homo sapiens
ccagcctggcctcct

SEQ ID NO: 2071943 - DNA, 16 bp, Homo sapiens
ccagcctggcctcctg

SEQ ID NO: 2071944 - DNA, 21 bp, Homo sapiens
ccagcctggcctcctgcctct

SEQ ID NO: 2071945 - DNA, 22 bp, Homo sapiens
ccagcctggcctcctgcctcta

SEQ ID NO: 2071946 - DNA, 17 bp, Homo sapiens
ccagcctggcttctgga

SEQ ID NO: 2071947 - DNA, 19 bp, Homo sapiens
ccagcctgggactcccagt

SEQ ID NO: 2071948 - DNA, 13 bp, Homo sapiens
ccagcctgggcct

SEQ ID NO: 2071949 - DNA, 22 bp, Homo sapiens
ccagcctggtgcccatcctccc

SEQ ID NO: 2071950 - DNA, 14 bp, Homo sapiens
ccagcctgtcctgg

SEQ ID NO: 2071951 - DNA, 18 bp, Homo sapiens
ccagcctgtcctggtaca

SEQ ID NO: 2071952 - DNA, 15 bp, Homo sapiens
ccagcctgtgtgttc

SEQ ID NO: 2071953 - DNA, 14 bp, Homo sapiens
ccagcctgttggac

SEQ ID NO: 2071954 - DNA, 15 bp, Homo sapiens
ccagccttctctctc

SEQ ID NO: 2071955 - DNA, 16 bp, Homo sapiens
ccagccttctctctct

SEQ ID NO: 2071956 - DNA, 17 bp, Homo sapiens
ccagccttctctctctg

SEQ ID NO: 2071957 - DNA, 15 bp, Homo sapiens
ccagcgagccctggt

SEQ ID NO: 2071958 - DNA, 19 bp, Homo sapiens
ccagcgattccctctccca

SEQ ID NO: 2071959 - DNA, 21 bp, Homo sapiens
ccagcgattccctctcccagg

SEQ ID NO: 2071960 - DNA, 15 bp, Homo sapiens
ccagcgcctccctcc

SEQ ID NO: 2071961 - DNA, 18 bp, Homo sapiens
ccagcgcctccctccacc

SEQ ID NO: 2071962 - DNA, 20 bp, Homo sapiens
ccagcgcctgtgctgaggac

SEQ ID NO: 2071963 - DNA, 22 bp, Homo sapiens
ccagcgcctgtgctgaggactc

SEQ ID NO: 2071964 - DNA, 22 bp, Homo sapiens
ccagcgcggcttggccgccatc

SEQ ID NO: 2071965 - DNA, 13 bp, Homo sapiens
ccagcggctgagt

SEQ ID NO: 2071966 - DNA, 21 bp, Homo sapiens
ccagcgtcagaggccctggag

SEQ ID NO: 2071967 - DNA, 17 bp, Homo sapiens
ccagctaatctgtaggg

SEQ ID NO: 2071968 - DNA, 15 bp, Homo sapiens
ccagctacattcctc

SEQ ID NO: 2071969 - DNA, 22 bp, Homo sapiens
ccagctacattcctcagctgcc

SEQ ID NO: 2071970 - DNA, 17 bp, Homo sapiens
ccagctactcagaagcc

SEQ ID NO: 2071971 - DNA, 20 bp, Homo sapiens
ccagctactcagaagcctga

SEQ ID NO: 2071972 - DNA, 15 bp, Homo sapiens
ccagctactcaggag

SEQ ID NO: 2071973 - DNA, 20 bp, Homo sapiens
ccagctactcaggaggctga

SEQ ID NO: 2071974 - DNA, 15 bp, Homo sapiens
ccagctactcgggag

SEQ ID NO: 2071975 - DNA, 17 bp, Homo sapiens
ccagctactcgggaggc

SEQ ID NO: 2071976 - DNA, 21 bp, Homo sapiens
ccagctactcgggaggctgag

SEQ ID NO: 2071977 - DNA, 15 bp, Homo sapiens
ccagctactctgtcc

SEQ ID NO: 2071978 - DNA, 17 bp, Homo sapiens
ccagctactctgtccag

SEQ ID NO: 2071979 - DNA, 20 bp, Homo sapiens
ccagctactctgtccaggcc

SEQ ID NO: 2071980 - DNA, 21 bp, Homo sapiens
ccagctagccaactcctcctt

SEQ ID NO: 2071981 - DNA, 14 bp, Homo sapiens
ccagctagggctgg

SEQ ID NO: 2071982 - DNA, 15 bp, Homo sapiens
ccagctatctgtcat

SEQ ID NO: 2071983 - DNA, 18 bp, Homo sapiens
ccagctatggccccaggg

SEQ ID NO: 2071984 - DNA, 14 bp, Homo sapiens
ccagctcactccct

SEQ ID NO: 2071985 - DNA, 14 bp, Homo sapiens
ccagctcagaggcc

SEQ ID NO: 2071986 - DNA, 15 bp, Homo sapiens
ccagctcagaggccc

SEQ ID NO: 2071987 - DNA, 19 bp, Homo sapiens
ccagctcagaggcccagga

SEQ ID NO: 2071988 - DNA, 15 bp, Homo sapiens
ccagctcaggtgact

SEQ ID NO: 2071989 - DNA, 14 bp, Homo sapiens
ccagctccccagga

SEQ ID NO: 2071990 - DNA, 15 bp, Homo sapiens
ccagctccccaggac

SEQ ID NO: 2071991 - DNA, 16 bp, Homo sapiens
ccagctccccaggact

SEQ ID NO: 2071992 - DNA, 21 bp, Homo sapiens
ccagagggtagggcagcagat

SEQ ID NO: 2071993 - DNA, 19 bp, Homo sapiens
ccagaggttatctgcctgg

SEQ ID NO: 2071994 - DNA, 20 bp, Homo sapiens
ccagaggttatctgcctggc

SEQ ID NO: 2071995 - DNA, 22 bp, Homo sapiens
ccagaggttatctgcctggcct

SEQ ID NO: 2071996 - DNA, 19 bp, Homo sapiens
ccagagtgaaagggctatg

SEQ ID NO: 2071997 - DNA, 19 bp, Homo sapiens
ccagagtggagtctgagtc

SEQ ID NO: 2071998 - DNA, 23 bp, Homo sapiens
ccagagttccacaaatctatatt

SEQ ID NO: 2071999 - DNA, 24 bp, Homo sapiens
ccagagttccacaaatctatatta

SEQ ID NO: 2072000 - DNA, 13 bp, Homo sapiens
ccagatccaccct

SEQ ID NO: 2072001 - DNA, 21 bp, Homo sapiens
ccagatcctctgctgactcca

SEQ ID NO: 2072002 - DNA, 20 bp, Homo sapiens
ccagatctgcctgggcctgt

SEQ ID NO: 2072003 - DNA, 14 bp, Homo sapiens
ccagatgagaagtt

SEQ ID NO: 2072004 - DNA, 22 bp, Homo sapiens
ccagatgagaagttaagcagcc

SEQ ID NO: 2072005 - DNA, 23 bp, Homo sapiens
ccagatgagaagttaagcagcct

SEQ ID NO: 2072006 - DNA, 13 bp, Homo sapiens
ccagatgccttcc

SEQ ID NO: 2072007 - DNA, 20 bp, Homo sapiens
ccagatgccttcctgtcttt

SEQ ID NO: 2072008 - DNA, 21 bp, Homo sapiens
ccagatgccttcctgtctttc

SEQ ID NO: 2072009 - DNA, 18 bp, Homo sapiens
ccagattgcaacaggctg

SEQ ID NO: 2072010 - DNA, 19 bp, Homo sapiens
ccagattgcaacaggctgg

SEQ ID NO: 2072011 - DNA, 19 bp, Homo sapiens
ccagattgttctgtccagt

SEQ ID NO: 2072012 - DNA, 16 bp, Homo sapiens
ccagatttttacacat

SEQ ID NO: 2072013 - DNA, 24 bp, Homo sapiens
ccagattttttacagctgcctgca

SEQ ID NO: 2072014 - DNA, 15 bp, Homo sapiens
ccagcaacacaagct

SEQ ID NO: 2072015 - DNA, 20 bp, Homo sapiens
ccagcaacatctcgagcccc

SEQ ID NO: 2072016 - DNA, 15 bp, Homo sapiens
ccagcaagtgagagc

SEQ ID NO: 2072017 - DNA, 17 bp, Homo sapiens
ccagcaagtgagagctg

SEQ ID NO: 2072018 - DNA, 19 bp, Homo sapiens
ccagcaagtgagagctggg

SEQ ID NO: 2072019 - DNA, 21 bp, Homo sapiens
ccagcaagtgagagctgggtg

SEQ ID NO: 2072020 - DNA, 17 bp, Homo sapiens
ccagcaatatgtaaata

SEQ ID NO: 2072021 - DNA, 23 bp, Homo sapiens
ccagcacagaaggaatctgtgca

SEQ ID NO: 2072022 - DNA, 13 bp, Homo sapiens
ccagcacaggggc

SEQ ID NO: 2072023 - DNA, 17 bp, Homo sapiens
ccagcacaggggcccca

SEQ ID NO: 2072024 - DNA, 20 bp, Homo sapiens
ccagcacaggggccccagat

SEQ ID NO: 2072025 - DNA, 16 bp, Homo sapiens
ccagcaccctctcctg

SEQ ID NO: 2072026 - DNA, 23 bp, Homo sapiens
ccagcaccctctcctgggggtgg

SEQ ID NO: 2072027 - DNA, 14 bp, Homo sapiens
ccagcactcctctg

SEQ ID NO: 2072028 - DNA, 15 bp, Homo sapiens
ccagcactcctctgt

SEQ ID NO: 2072029 - DNA, 18 bp, Homo sapiens
ccagcactcctctgtctc

SEQ ID NO: 2072030 - DNA, 21 bp, Homo sapiens
ccagcactcctctgtctctgc

SEQ ID NO: 2072031 - DNA, 12 bp, Homo sapiens
ccagcactgtga

SEQ ID NO: 2072032 - DNA, 14 bp, Homo sapiens
ccagcactttggga

SEQ ID NO: 2072033 - DNA, 22 bp, Homo sapiens
ccagcagaaaagtgcttagaaa

SEQ ID NO: 2072034 - DNA, 19 bp, Homo sapiens
ccagcagccagctctcagc

SEQ ID NO: 2072035 - DNA, 21 bp, Homo sapiens
ccagcagccagctctcagcca

SEQ ID NO: 2072036 - DNA, 21 bp, Homo sapiens
ccagcagccctggcctgtgga

SEQ ID NO: 2072037 - DNA, 12 bp, Homo sapiens
ccagcagctgcg

SEQ ID NO: 2072038 - DNA, 21 bp, Homo sapiens
ccagcagctgggccggccagc

SEQ ID NO: 2072039 - DNA, 14 bp, Homo sapiens
ccagcaggaagcca

SEQ ID NO: 2072040 - DNA, 17 bp, Homo sapiens
ccagcaggtgtggtggc

SEQ ID NO: 2072041 - DNA, 23 bp, Homo sapiens
ccagcaggtgtggtggctcatgg

SEQ ID NO: 2072042 - DNA, 20 bp, Homo sapiens
ccagcagtggtattaatact

SEQ ID NO: 2072043 - DNA, 14 bp, Homo sapiens
ccagcatccagcct

SEQ ID NO: 2072044 - DNA, 13 bp, Homo sapiens
ccagcatgtacaa

SEQ ID NO: 2072045 - DNA, 19 bp, Homo sapiens
ccagcatgtcactcccaga

SEQ ID NO: 2072046 - DNA, 22 bp, Homo sapiens
ccagcatttgccattcctggaa

SEQ ID NO: 2072047 - DNA, 24 bp, Homo sapiens
ccagccaataaatcaactccagct

SEQ ID NO: 2072048 - DNA, 15 bp, Homo sapiens
ccagccacacagagc

SEQ ID NO: 2072049 - DNA, 19 bp, Homo sapiens
ccagccacacagagcctgc

SEQ ID NO: 2072050 - DNA, 16 bp, Homo sapiens
ccagccacctcccaag

SEQ ID NO: 2072051 - DNA, 18 bp, Homo sapiens
ccagccacctcccaagga

SEQ ID NO: 2072052 - DNA, 12 bp, Homo sapiens
ccagccacctct

SEQ ID NO: 2072053 - DNA, 15 bp, Homo sapiens
ccagccacctcttgg

SEQ ID NO: 2072054 - DNA, 13 bp, Homo sapiens
ccagccagaagcc

SEQ ID NO: 2072055 - DNA, 15 bp, Homo sapiens
ccagccagcagccag

SEQ ID NO: 2072056 - DNA, 16 bp, Homo sapiens
ccagccagcagccagc

SEQ ID NO: 2072057 - DNA, 19 bp, Homo sapiens
ccagccagcagccagctct

SEQ ID NO: 2072058 - DNA, 12 bp, Homo sapiens
ccagccagctcc

SEQ ID NO: 2072059 - DNA, 22 bp, Homo sapiens
ccagccaggatcccaagcgtcc

SEQ ID NO: 2072060 - DNA, 15 bp, Homo sapiens
ccagtgccgcctgtg

SEQ ID NO: 2072061 - DNA, 17 bp, Homo sapiens
ccagtgccttacctcct

SEQ ID NO: 2072062 - DNA, 21 bp, Homo sapiens
ccagtgccttacctcctgccc

SEQ ID NO: 2072063 - DNA, 13 bp, Homo sapiens
ccagtgctgccat

SEQ ID NO: 2072064 - DNA, 14 bp, Homo sapiens
ccagtgctgccatg

SEQ ID NO: 2072065 - DNA, 15 bp, Homo sapiens
ccagtgctgccatgc

SEQ ID NO: 2072066 - DNA, 16 bp, Homo sapiens
ccagtgctgccatgcc

SEQ ID NO: 2072067 - DNA, 17 bp, Homo sapiens
ccagtgctgccatgcca

SEQ ID NO: 2072068 - DNA, 12 bp, Homo sapiens
ccagtgcttctc

SEQ ID NO: 2072069 - DNA, 21 bp, Homo sapiens
ccagtgcttctccaacactga

SEQ ID NO: 2072070 - DNA, 20 bp, Homo sapiens
ccagtgggaggtgagaccac

SEQ ID NO: 2072071 - DNA, 17 bp, Homo sapiens
ccagtggtaccagctca

SEQ ID NO: 2072072 - DNA, 18 bp, Homo sapiens
ccagtggtaccagctcac

SEQ ID NO: 2072073 - DNA, 14 bp, Homo sapiens
ccagtgtactgctt

SEQ ID NO: 2072074 - DNA, 15 bp, Homo sapiens
ccagtgtactgcttt

SEQ ID NO: 2072075 - DNA, 16 bp, Homo sapiens
ccagtgtactgctttc

SEQ ID NO: 2072076 - DNA, 17 bp, Homo sapiens
ccagtgtactgctttca

SEQ ID NO: 2072077 - DNA, 14 bp, Homo sapiens
ccagtgtgacaagg

SEQ ID NO: 2072078 - DNA, 15 bp, Homo sapiens
ccagtgtgatcccaa

SEQ ID NO: 2072079 - DNA, 13 bp, Homo sapiens
ccagtgtggcccc

SEQ ID NO: 2072080 - DNA, 23 bp, Homo sapiens
ccagtgttggctgtgtgacagaa

SEQ ID NO: 2072081 - DNA, 23 bp, Homo sapiens
ccagtgtttagaagagcctgact

SEQ ID NO: 2072082 - DNA, 14 bp, Homo sapiens
ccagttcaggagtc

SEQ ID NO: 2072083 - DNA, 21 bp, Homo sapiens
ccagttcaggagtcccaagga

SEQ ID NO: 2072084 - DNA, 22 bp, Homo sapiens
ccagttcctttcaatggtttgc

SEQ ID NO: 2072085 - DNA, 15 bp, Homo sapiens
ccagttctggccagg

SEQ ID NO: 2072086 - DNA, 22 bp, Homo sapiens
ccagttctggccaggagctgga

SEQ ID NO: 2072087 - DNA, 17 bp, Homo sapiens
ccagttgggagcactgg

SEQ ID NO: 2072088 - DNA, 23 bp, Homo sapiens
ccagtttagatttcaagaaaaaa

SEQ ID NO: 2072089 - DNA, 21 bp, Homo sapiens
ccagtttcaggtgtttagttg

SEQ ID NO: 2072090 - DNA, 12 bp, Homo sapiens
ccagtttcccac

SEQ ID NO: 2072091 - DNA, 14 bp, Homo sapiens
ccataaacttcatg

SEQ ID NO: 2072092 - DNA, 15 bp, Homo sapiens
ccataagggactgtg

SEQ ID NO: 2072093 - DNA, 22 bp, Homo sapiens
ccataaggtgcagtaggagcaa

SEQ ID NO: 2072094 - DNA, 14 bp, Homo sapiens
ccataatgccactg

SEQ ID NO: 2072095 - DNA, 17 bp, Homo sapiens
ccataattttcttcatg

SEQ ID NO: 2072096 - DNA, 15 bp, Homo sapiens
ccatacccctgcctg

SEQ ID NO: 2072097 - DNA, 16 bp, Homo sapiens
ccatacccctgcctgg

SEQ ID NO: 2072098 - DNA, 19 bp, Homo sapiens
ccataccgctggggaacag

SEQ ID NO: 2072099 - DNA, 13 bp, Homo sapiens
ccatagaaacatg

SEQ ID NO: 2072100 - DNA, 18 bp, Homo sapiens
ccatagaaacatgacact

SEQ ID NO: 2072101 - DNA, 22 bp, Homo sapiens
ccatagaaacatgacactgacc

SEQ ID NO: 2072102 - DNA, 16 bp, Homo sapiens
ccatagagtttaacac

SEQ ID NO: 2072103 - DNA, 17 bp, Homo sapiens
ccatagagtttaacaca

SEQ ID NO: 2072104 - DNA, 17 bp, Homo sapiens
ccatagatcttctgaaa

SEQ ID NO: 2072105 - DNA, 20 bp, Homo sapiens
ccatagatcttctgaaatga

SEQ ID NO: 2072106 - DNA, 14 bp, Homo sapiens
ccatatgttacact

SEQ ID NO: 2072107 - DNA, 15 bp, Homo sapiens
ccatattcacacctc

SEQ ID NO: 2072108 - DNA, 22 bp, Homo sapiens
ccatattcagtgctgtggcctg

SEQ ID NO: 2072109 - DNA, 18 bp, Homo sapiens
ccatattctgttggccag

SEQ ID NO: 2072110 - DNA, 19 bp, Homo sapiens
ccatattctgttggccagt

SEQ ID NO: 2072111 - DNA, 11 bp, Homo sapiens
ccatattttca

SEQ ID NO: 2072112 - DNA, 16 bp, Homo sapiens
ccatcaatggaaacag

SEQ ID NO: 2072113 - DNA, 19 bp, Homo sapiens
ccatcaccctctgggcagc

SEQ ID NO: 2072114 - DNA, 21 bp, Homo sapiens
ccatcacctactcacacaggc

SEQ ID NO: 2072115 - DNA, 13 bp, Homo sapiens
ccatcactgagtg

SEQ ID NO: 2072116 - DNA, 15 bp, Homo sapiens
ccatcactgagtggc

SEQ ID NO: 2072117 - DNA, 16 bp, Homo sapiens
ccatcactgagtggct

SEQ ID NO: 2072118 - DNA, 17 bp, Homo sapiens
ccatcactgagtggctt

SEQ ID NO: 2072119 - DNA, 18 bp, Homo sapiens
ccatcagaggctggggga

SEQ ID NO: 2072120 - DNA, 21 bp, Homo sapiens
ccatcagcccaacgggaagca

SEQ ID NO: 2072121 - DNA, 14 bp, Homo sapiens
ccatcagggtgggc

SEQ ID NO: 2072122 - DNA, 17 bp, Homo sapiens
ccatcaggttccatccc

SEQ ID NO: 2072123 - DNA, 14 bp, Homo sapiens
ccatcagttactgg

SEQ ID NO: 2072124 - DNA, 19 bp, Homo sapiens
ccatcatatgacatgccac

SEQ ID NO: 2072125 - DNA, 23 bp, Homo sapiens
ccatcatatgacatgccaccctc

SEQ ID NO: 2072126 - DNA, 12 bp, Homo sapiens
ccacccccttca

SEQ ID NO: 2072127 - DNA, 18 bp, Homo sapiens
ccacccccttcagtgccc

SEQ ID NO: 2072128 - DNA, 19 bp, Homo sapiens
ccaccctcgtggacacctg

SEQ ID NO: 2072129 - DNA, 16 bp, Homo sapiens
ccaccctctccatgcc

SEQ ID NO: 2072130 - DNA, 13 bp, Homo sapiens
ccaccctgagcct

SEQ ID NO: 2072131 - DNA, 17 bp, Homo sapiens
ccaccctgagcctgacc

SEQ ID NO: 2072132 - DNA, 22 bp, Homo sapiens
ccaccctgagcctgacctttct

SEQ ID NO: 2072133 - DNA, 13 bp, Homo sapiens
ccaccctggcccg

SEQ ID NO: 2072134 - DNA, 16 bp, Homo sapiens
ccaccgcagaaggaag

SEQ ID NO: 2072135 - DNA, 14 bp, Homo sapiens
ccaccgggagcctc

SEQ ID NO: 2072136 - DNA, 20 bp, Homo sapiens
ccaccgggagcctccccctc

SEQ ID NO: 2072137 - DNA, 18 bp, Homo sapiens
ccacctaggccactcctc

SEQ ID NO: 2072138 - DNA, 22 bp, Homo sapiens
ccacctaggccactcctccaaa

SEQ ID NO: 2072139 - DNA, 13 bp, Homo sapiens
ccacctcagcctc

SEQ ID NO: 2072140 - DNA, 14 bp, Homo sapiens
ccacctcagcctcc

SEQ ID NO: 2072141 - DNA, 14 bp, Homo sapiens
ccacctccaccccc

SEQ ID NO: 2072142 - DNA, 22 bp, Homo sapiens
ccacctccacccccgccacggc

SEQ ID NO: 2072143 - DNA, 15 bp, Homo sapiens
ccacctcccacccca

SEQ ID NO: 2072144 - DNA, 20 bp, Homo sapiens
cattatgttagagaggtagc

SEQ ID NO: 2072145 - DNA, 13 bp, Homo sapiens
cattattatcaac

SEQ ID NO: 2072146 - DNA, 18 bp, Homo sapiens
cattattcatatgcttcc

SEQ ID NO: 2072147 - DNA, 13 bp, Homo sapiens
cattatttaatgt

SEQ ID NO: 2072148 - DNA, 21 bp, Homo sapiens
cattatttaatgtttgattta

SEQ ID NO: 2072149 - DNA, 16 bp, Homo sapiens
cattcaatacaagtgt

SEQ ID NO: 2072150 - DNA, 14 bp, Homo sapiens
cattcacagagcct

SEQ ID NO: 2072151 - DNA, 13 bp, Homo sapiens
cattcagaagaaa

SEQ ID NO: 2072152 - DNA, 15 bp, Homo sapiens
cattcagacacttca

SEQ ID NO: 2072153 - DNA, 19 bp, Homo sapiens
cattcagcacaccccaagg

SEQ ID NO: 2072154 - DNA, 21 bp, Homo sapiens
cattcagcacaccccaaggga

SEQ ID NO: 2072155 - DNA, 14 bp, Homo sapiens
ccaactggtcactg

SEQ ID NO: 2072156 - DNA, 21 bp, Homo sapiens
ccaacttcatttgatgctaaa

SEQ ID NO: 2072157 - DNA, 13 bp, Homo sapiens
ccaacttggcttt

SEQ ID NO: 2072158 - DNA, 12 bp, Homo sapiens
ccaagaagggct

SEQ ID NO: 2072159 - DNA, 14 bp, Homo sapiens
ccaagaccccagct

SEQ ID NO: 2072160 - DNA, 17 bp, Homo sapiens
ccacctcccaccccact

SEQ ID NO: 2072161 - DNA, 18 bp, Homo sapiens
ccacctcccaccccactc

SEQ ID NO: 2072162 - DNA, 15 bp, Homo sapiens
ccacctccgccccag

SEQ ID NO: 2072163 - DNA, 23 bp, Homo sapiens
ccacctcctagaggtgggcagct

SEQ ID NO: 2072164 - DNA, 13 bp, Homo sapiens
ccacctctcaata

SEQ ID NO: 2072165 - DNA, 15 bp, Homo sapiens
ccacctctctttttc

SEQ ID NO: 2072166 - DNA, 17 bp, Homo sapiens
ccacctctgctgcctcc

SEQ ID NO: 2072167 - DNA, 12 bp, Homo sapiens
ccacctcttcct

SEQ ID NO: 2072168 - DNA, 19 bp, Homo sapiens
ccacctcttgggcatgctc

SEQ ID NO: 2072169 - DNA, 13 bp, Homo sapiens
ccacctgcaagtg

SEQ ID NO: 2072170 - DNA, 15 bp, Homo sapiens
ccacctgcaagtgcc

SEQ ID NO: 2072171 - DNA, 12 bp, Homo sapiens
ccacctgccagc

SEQ ID NO: 2072172 - DNA, 13 bp, Homo sapiens
ccacctgccagcc

SEQ ID NO: 2072173 - DNA, 15 bp, Homo sapiens
ccacctgcctatcca

SEQ ID NO: 2072174 - DNA, 16 bp, Homo sapiens
ccacctgcctatccat

SEQ ID NO: 2072175 - DNA, 19 bp, Homo sapiens
ccacctgcctatccatcct

SEQ ID NO: 2072176 - DNA, 22 bp, Homo sapiens
ccacctgctgagagacccaagg

SEQ ID NO: 2072177 - DNA, 12 bp, Homo sapiens
ccacctggcccc

SEQ ID NO: 2072178 - DNA, 21 bp, Homo sapiens
ccacctggccccatgtctctc

SEQ ID NO: 2072179 - DNA, 11 bp, Homo sapiens
ccacctgtctg

SEQ ID NO: 2072180 - DNA, 18 bp, Homo sapiens
ccacctgttcaggagctg

SEQ ID NO: 2072181 - DNA, 18 bp, Homo sapiens
ccaccttcaagcaccctg

SEQ ID NO: 2072182 - DNA, 19 bp, Homo sapiens
ccaccttcaattcctgggc

SEQ ID NO: 2072183 - DNA, 20 bp, Homo sapiens
ccaccttcaattcctgggcc

SEQ ID NO: 2072184 - DNA, 16 bp, Homo sapiens
ccaccttccagtgagc

SEQ ID NO: 2072185 - DNA, 15 bp, Homo sapiens
ccaccttcccagctc

SEQ ID NO: 2072186 - DNA, 16 bp, Homo sapiens
ccaccttcccagctct

SEQ ID NO: 2072187 - DNA, 12 bp, Homo sapiens
ccaccttccctc

SEQ ID NO: 2072188 - DNA, 15 bp, Homo sapiens
ccaccttccctcttt

SEQ ID NO: 2072189 - DNA, 19 bp, Homo sapiens
ccaccttgccaagctttct

SEQ ID NO: 2072190 - DNA, 13 bp, Homo sapiens
ccaccttgctctt

SEQ ID NO: 2072191 - DNA, 20 bp, Homo sapiens
ccaccttggactcctcccac

SEQ ID NO: 2072192 - DNA, 13 bp, Homo sapiens
ccaccttggctca

SEQ ID NO: 2072193 - DNA, 14 bp, Homo sapiens
ccaccttggctgca

SEQ ID NO: 2072194 - DNA, 15 bp, Homo sapiens
ccaccttggctgcag

SEQ ID NO: 2072195 - DNA, 16 bp, Homo sapiens
ccaccttggctgcagg

SEQ ID NO: 2072196 - DNA, 19 bp, Homo sapiens
ccaccttggctgcagggag

SEQ ID NO: 2072197 - DNA, 21 bp, Homo sapiens
ccacctttgggatcagcctcc

SEQ ID NO: 2072198 - DNA, 22 bp, Homo sapiens
ccacctttgggatcagcctccg

SEQ ID NO: 2072199 - DNA, 15 bp, Homo sapiens
ccacgaatttgctgg

SEQ ID NO: 2072200 - DNA, 18 bp, Homo sapiens
ccacgactgttgtacaag

SEQ ID NO: 2072201 - DNA, 16 bp, Homo sapiens
ccacgagtcacctgca

SEQ ID NO: 2072202 - DNA, 19 bp, Homo sapiens
ccacgagtcacctgcaagc

SEQ ID NO: 2072203 - DNA, 20 bp, Homo sapiens
ccacgatgtcaaggactcct

SEQ ID NO: 2072204 - DNA, 17 bp, Homo sapiens
ccacgatgtggccctgg

SEQ ID NO: 2072205 - DNA, 18 bp, Homo sapiens
ccacgatgtggccctggc

SEQ ID NO: 2072206 - DNA, 20 bp, Homo sapiens
ccacgatgtggccctggcct

SEQ ID NO: 2072207 - DNA, 14 bp, Homo sapiens
ccacgcacacatgg

SEQ ID NO: 2072208 - DNA, 17 bp, Homo sapiens
ccacgcctcctggccag

SEQ ID NO: 2072209 - DNA, 11 bp, Homo sapiens
ccacgctgtcc

SEQ ID NO: 2072210 - DNA, 13 bp, Homo sapiens
ccacgctgtcctc

SEQ ID NO: 2072211 - DNA, 12 bp, Homo sapiens
ccacggccaccc

SEQ ID NO: 2072212 - DNA, 16 bp, Homo sapiens
ccacggccaccctcct

SEQ ID NO: 2072213 - DNA, 13 bp, Homo sapiens
ccacggccaggcc

SEQ ID NO: 2072214 - DNA, 15 bp, Homo sapiens
ccacggccaggccag

SEQ ID NO: 2072215 - DNA, 16 bp, Homo sapiens
ccacggccaggccaga

SEQ ID NO: 2072216 - DNA, 23 bp, Homo sapiens
ccacggccaggccagagggagtg

SEQ ID NO: 2072217 - DNA, 13 bp, Homo sapiens
ccacgggcctcag

SEQ ID NO: 2072218 - DNA, 14 bp, Homo sapiens
ccacgggcctcagt

SEQ ID NO: 2072219 - DNA, 15 bp, Homo sapiens
ccacgggcctcagtt

SEQ ID NO: 2072220 - DNA, 20 bp, Homo sapiens
ccacggtgcgtggctgtggc

SEQ ID NO: 2072221 - DNA, 21 bp, Homo sapiens
ccacggtgcgtggctgtggca

SEQ ID NO: 2072222 - DNA, 24 bp, Homo sapiens
ccacggtgcgtggctgtggcacag

SEQ ID NO: 2072223 - DNA, 15 bp, Homo sapiens
ccacgtccccctggg

SEQ ID NO: 2072224 - DNA, 22 bp, Homo sapiens
ccacgtccccctggggcttctc

SEQ ID NO: 2072225 - DNA, 23 bp, Homo sapiens
ccacgtgaatggccctagaactg

SEQ ID NO: 2072226 - DNA, 17 bp, Homo sapiens
ccacgtgagagaatctg

SEQ ID NO: 2072227 - DNA, 23 bp, Homo sapiens
ccacgtgccaggcccggggctgg

SEQ ID NO: 2072228 - DNA, 14 bp, Homo sapiens
ccacgtgtgcagac

SEQ ID NO: 2072229 - DNA, 13 bp, Homo sapiens
ccacgttctatat

SEQ ID NO: 2072230 - DNA, 20 bp, Homo sapiens
ccactaaatgagctcctgcg

SEQ ID NO: 2072231 - DNA, 23 bp, Homo sapiens
ccactaaatgagctcctgcggga

SEQ ID NO: 2072232 - DNA, 19 bp, Homo sapiens
ccactaagctttctccttt

SEQ ID NO: 2072233 - DNA, 13 bp, Homo sapiens
ccactaagtagaa

SEQ ID NO: 2072234 - DNA, 22 bp, Homo sapiens
ccactacactccagcctgagca

SEQ ID NO: 2072235 - DNA, 13 bp, Homo sapiens
ccactaccttctg

SEQ ID NO: 2072236 - DNA, 22 bp, Homo sapiens
ccactaccttctgacctcccca

SEQ ID NO: 2072237 - DNA, 21 bp, Homo sapiens
ccactagaactctccatctta

SEQ ID NO: 2072238 - DNA, 18 bp, Homo sapiens
ccactaggactctgaggc

SEQ ID NO: 2072239 - DNA, 21 bp, Homo sapiens
ccactatggtcatctttttct

SEQ ID NO: 2072240 - DNA, 18 bp, Homo sapiens
ccactcaatatgtgattt

SEQ ID NO: 2072241 - DNA, 13 bp, Homo sapiens
ccactcaccaggg

SEQ ID NO: 2072242 - DNA, 15 bp, Homo sapiens
ccactcaccagggtc

SEQ ID NO: 2072243 - DNA, 12 bp, Homo sapiens
ccactcactcca

SEQ ID NO: 2072244 - DNA, 18 bp, Homo sapiens
ccactcagtccatagcag

SEQ ID NO: 2072245 - DNA, 13 bp, Homo sapiens
ccactcatttcat

SEQ ID NO: 2072246 - DNA, 15 bp, Homo sapiens
ccactcatttcatct

SEQ ID NO: 2072247 - DNA, 17 bp, Homo sapiens
ccactccagacccctgg

SEQ ID NO: 2072248 - DNA, 19 bp, Homo sapiens
ccactccagacccctggct

SEQ ID NO: 2072249 - DNA, 20 bp, Homo sapiens
ccactccagacccctggctt

SEQ ID NO: 2072250 - DNA, 14 bp, Homo sapiens
ccactccagccctg

SEQ ID NO: 2072251 - DNA, 15 bp, Homo sapiens
ccactccagccctgt

SEQ ID NO: 2072252 - DNA, 15 bp, Homo sapiens
ccactcctcttattt

SEQ ID NO: 2072253 - DNA, 21 bp, Homo sapiens
ccactcctgtcccgccttcct

SEQ ID NO: 2072254 - DNA, 21 bp, Homo sapiens
ccactctaggggtcaggctcc

SEQ ID NO: 2072255 - DNA, 22 bp, Homo sapiens
ccactctaggggtcaggctcca

SEQ ID NO: 2072256 - DNA, 18 bp, Homo sapiens
ccactctcattccccagg

SEQ ID NO: 2072257 - DNA, 11 bp, Homo sapiens
ccactctcctt

SEQ ID NO: 2072258 - DNA, 18 bp, Homo sapiens
ccactctcggggcccttg

SEQ ID NO: 2072259 - DNA, 14 bp, Homo sapiens
ccactctgctctga

SEQ ID NO: 2072260 - DNA, 13 bp, Homo sapiens
ccactctggcagc

SEQ ID NO: 2072261 - DNA, 19 bp, Homo sapiens
ccactctggcagccacact

SEQ ID NO: 2072262 - DNA, 12 bp, Homo sapiens
ccactctttgct

SEQ ID NO: 2072263 - DNA, 18 bp, Homo sapiens
ccactgagacggcagaga

SEQ ID NO: 2072264 - DNA, 13 bp, Homo sapiens
ccactgcaccggg

SEQ ID NO: 2072265 - DNA, 14 bp, Homo sapiens
ccactgcaccgggc

SEQ ID NO: 2072266 - DNA, 19 bp, Homo sapiens
ccactgcactatagcctag

SEQ ID NO: 2072267 - DNA, 20 bp, Homo sapiens
ccactgcagtccgcagtctg

SEQ ID NO: 2072268 - DNA, 12 bp, Homo sapiens
ccactgccaggc

SEQ ID NO: 2072269 - DNA, 15 bp, Homo sapiens
ccactgccaggcacc

SEQ ID NO: 2072270 - DNA, 16 bp, Homo sapiens
ccactgccaggcacct

SEQ ID NO: 2072271 - DNA, 20 bp, Homo sapiens
ccactgccaggcacctggcc

SEQ ID NO: 2072272 - DNA, 17 bp, Homo sapiens
ccactgccctgcctgcc

SEQ ID NO: 2072273 - DNA, 19 bp, Homo sapiens
ccactgccctgcctgccca

SEQ ID NO: 2072274 - DNA, 21 bp, Homo sapiens
ccactgccctgcctgcccact

SEQ ID NO: 2072275 - DNA, 11 bp, Homo sapiens
ccactgcctct

SEQ ID NO: 2072276 - DNA, 16 bp, Homo sapiens
ccactgcctcttcctc

SEQ ID NO: 2072277 - DNA, 21 bp, Homo sapiens
ccactgccttcgatacaccgg

SEQ ID NO: 2072278 - DNA, 13 bp, Homo sapiens
caggctgaagagt

SEQ ID NO: 2072279 - DNA, 13 bp, Homo sapiens
caggctgagccca

SEQ ID NO: 2072280 - DNA, 14 bp, Homo sapiens
caggctgagcccag

SEQ ID NO: 2072281 - DNA, 15 bp, Homo sapiens
caggctgagcccagc

SEQ ID NO: 2072282 - DNA, 18 bp, Homo sapiens
caggctgagcccagccac

SEQ ID NO: 2072283 - DNA, 20 bp, Homo sapiens
caggctgagcccagccacct

SEQ ID NO: 2072284 - DNA, 21 bp, Homo sapiens
caggctgagcccagccacctc

SEQ ID NO: 2072285 - DNA, 15 bp, Homo sapiens
caggctgagtgagcc

SEQ ID NO: 2072286 - DNA, 19 bp, Homo sapiens
caggctgagtgagccacag

SEQ ID NO: 2072287 - DNA, 17 bp, Homo sapiens
caggctgcactgcagtg

SEQ ID NO: 2072288 - DNA, 21 bp, Homo sapiens
caggctgcactgcagtgatgg

SEQ ID NO: 2072289 - DNA, 14 bp, Homo sapiens
caggctgggcttca

SEQ ID NO: 2072290 - DNA, 22 bp, Homo sapiens
caggctgggcttcagtggcagc

SEQ ID NO: 2072291 - DNA, 23 bp, Homo sapiens
caggctgggcttcagtggcagct

SEQ ID NO: 2072292 - DNA, 21 bp, Homo sapiens
caggctgtatcccatgagcct

SEQ ID NO: 2072293 - DNA, 20 bp, Homo sapiens
caggctgttctgcactgaaa

SEQ ID NO: 2072294 - DNA, 23 bp, Homo sapiens
caggctgtttctttttttatgac

SEQ ID NO: 2072295 - DNA, 15 bp, Homo sapiens
caggcttcaccctga

SEQ ID NO: 2072296 - DNA, 22 bp, Homo sapiens
caggcttcaccctgaatggttc

SEQ ID NO: 2072297 - DNA, 18 bp, Homo sapiens
caggcttgtcactagcag

SEQ ID NO: 2072298 - DNA, 22 bp, Homo sapiens
cagggaaacagctaatgggaca

SEQ ID NO: 2072299 - DNA, 14 bp, Homo sapiens
cagggaaaggctct

SEQ ID NO: 2072300 - DNA, 16 bp, Homo sapiens
cagggaaatggagggt

SEQ ID NO: 2072301 - DNA, 23 bp, Homo sapiens
cagggaaatggagggtggggccg

SEQ ID NO: 2072302 - DNA, 15 bp, Homo sapiens
cagggaagagcagaa

SEQ ID NO: 2072303 - DNA, 17 bp, Homo sapiens
cagggaagagcagaacg

SEQ ID NO: 2072304 - DNA, 20 bp, Homo sapiens
cagggaagagggcagtacct

SEQ ID NO: 2072305 - DNA, 22 bp, Homo sapiens
cagggaagagggcagtacctgg

SEQ ID NO: 2072306 - DNA, 21 bp, Homo sapiens
cagggaagtcttacttaaaaa

SEQ ID NO: 2072307 - DNA, 23 bp, Homo sapiens
cagggaatttcaggaactagaga

SEQ ID NO: 2072308 - DNA, 17 bp, Homo sapiens
cagggacagagacacct

SEQ ID NO: 2072309 - DNA, 20 bp, Homo sapiens
cagggacagagacacctgca

SEQ ID NO: 2072310 - DNA, 22 bp, Homo sapiens
cagggacagagacacctgcacc

SEQ ID NO: 2072311 - DNA, 18 bp, Homo sapiens
cagggacaggataagagg

SEQ ID NO: 2072312 - DNA, 22 bp, Homo sapiens
cagggacccacttcacacacag

SEQ ID NO: 2072313 - DNA, 21 bp, Homo sapiens
cagggactcaagggtccagaa

SEQ ID NO: 2072314 - DNA, 18 bp, Homo sapiens
cagggactgttcctgtct

SEQ ID NO: 2072315 - DNA, 22 bp, Homo sapiens
cagggagcaatgggagggggct

SEQ ID NO: 2072316 - DNA, 15 bp, Homo sapiens
cagggagcatggctg

SEQ ID NO: 2072317 - DNA, 16 bp, Homo sapiens
cagtatccactttgca

SEQ ID NO: 2072318 - DNA, 15 bp, Homo sapiens
cagtatgaatgatgt

SEQ ID NO: 2072319 - DNA, 19 bp, Homo sapiens
cagtatgctgttttaataa

SEQ ID NO: 2072320 - DNA, 19 bp, Homo sapiens
cagtattaatactaaaata

SEQ ID NO: 2072321 - DNA, 20 bp, Homo sapiens
cagtattaatactaaaatat

SEQ ID NO: 2072322 - DNA, 22 bp, Homo sapiens
cagtattaatactaaaatatgt

SEQ ID NO: 2072323 - DNA, 17 bp, Homo sapiens
cagtattctcagtgctc

SEQ ID NO: 2072324 - DNA, 13 bp, Homo sapiens
cagtattgccaca

SEQ ID NO: 2072325 - DNA, 21 bp, Homo sapiens
cagtattgccacaatgcctct

SEQ ID NO: 2072326 - DNA, 17 bp, Homo sapiens
cagtattttggagaaat

SEQ ID NO: 2072327 - DNA, 14 bp, Homo sapiens
cagtcaacagttca

SEQ ID NO: 2072328 - DNA, 18 bp, Homo sapiens
cagtcacactgttactcc

SEQ ID NO: 2072329 - DNA, 21 bp, Homo sapiens
cagtcacactgttactccaca

SEQ ID NO: 2072330 - DNA, 19 bp, Homo sapiens
cagtcacctcttctgccag

SEQ ID NO: 2072331 - DNA, 21 bp, Homo sapiens
cagtcactgtccctcaaatga

SEQ ID NO: 2072332 - DNA, 18 bp, Homo sapiens
cagtcagttcccggagca

SEQ ID NO: 2072333 - DNA, 21 bp, Homo sapiens
cagtcagttcccggagcacag

SEQ ID NO: 2072334 - DNA, 23 bp, Homo sapiens
cagtcagttcccggagcacagcc

SEQ ID NO: 2072335 - DNA, 18 bp, Homo sapiens
cagtccagaataagtgct

SEQ ID NO: 2072336 - DNA, 19 bp, Homo sapiens
cagtccagaataagtgctg

SEQ ID NO: 2072337 - DNA, 21 bp, Homo sapiens
cagtccagaataagtgctgtt

SEQ ID NO: 2072338 - DNA, 17 bp, Homo sapiens
cagtccagatgccttcc

SEQ ID NO: 2072339 - DNA, 13 bp, Homo sapiens
cagtccagccagc

SEQ ID NO: 2072340 - DNA, 16 bp, Homo sapiens
cagtccagccagctcc

SEQ ID NO: 2072341 - DNA, 16 bp, Homo sapiens
cagtccatagcagaga

SEQ ID NO: 2072342 - DNA, 19 bp, Homo sapiens
cagtcccatcagagagcga

SEQ ID NO: 2072343 - DNA, 15 bp, Homo sapiens
cagtccccagccctt

SEQ ID NO: 2072344 - DNA, 17 bp, Homo sapiens
cagtccccagcccttct

SEQ ID NO: 2072345 - DNA, 20 bp, Homo sapiens
cagtcccccaccacactgaa

SEQ ID NO: 2072346 - DNA, 15 bp, Homo sapiens
cagtcccgtggaggg

SEQ ID NO: 2072347 - DNA, 17 bp, Homo sapiens
cagtcccgtggagggta

SEQ ID NO: 2072348 - DNA, 23 bp, Homo sapiens
cagtccctgagaccatttaacat

SEQ ID NO: 2072349 - DNA, 20 bp, Homo sapiens
cagtccctgggggaagccct

SEQ ID NO: 2072350 - DNA, 20 bp, Homo sapiens
cagtccgccaaacactccac

SEQ ID NO: 2072351 - DNA, 18 bp, Homo sapiens
cagtccgcctggccggct

SEQ ID NO: 2072352 - DNA, 19 bp, Homo sapiens
cagtcctagagctcctgtc

SEQ ID NO: 2072353 - DNA, 19 bp, Homo sapiens
cagtcctcacagcctctcc

SEQ ID NO: 2072354 - DNA, 20 bp, Homo sapiens
cagtcctcacagcctctccc

SEQ ID NO: 2072355 - DNA, 22 bp, Homo sapiens
cagtcctcccaccctaccacag

SEQ ID NO: 2072356 - DNA, 16 bp, Homo sapiens
cagtcctcttattcct

SEQ ID NO: 2072357 - DNA, 24 bp, Homo sapiens
cagtcctggccattttcttgcctg

SEQ ID NO: 2072358 - DNA, 23 bp, Homo sapiens
cagtcctgggagaacctcaggct

SEQ ID NO: 2072359 - DNA, 18 bp, Homo sapiens
cagtcctggtctgctcag

SEQ ID NO: 2072360 - DNA, 20 bp, Homo sapiens
cagtcctggtctgctcagga

SEQ ID NO: 2072361 - DNA, 20 bp, Homo sapiens
cagtcgagccctgcagccaa

SEQ ID NO: 2072362 - DNA, 14 bp, Homo sapiens
cagtcgcaggatcc

SEQ ID NO: 2072363 - DNA, 20 bp, Homo sapiens
cagtcgcaggatccgctgcc

SEQ ID NO: 2072364 - DNA, 17 bp, Homo sapiens
cagtcgttggcaccttc

SEQ ID NO: 2072365 - DNA, 22 bp, Homo sapiens
cagtctagattagaagtgtttt

SEQ ID NO: 2072366 - DNA, 15 bp, Homo sapiens
cagtgcccacaggat

SEQ ID NO: 2072367 - DNA, 17 bp, Homo sapiens
cagtgccctcattttat

SEQ ID NO: 2072368 - DNA, 11 bp, Homo sapiens
cagtgcctcct

SEQ ID NO: 2072369 - DNA, 16 bp, Homo sapiens
cagtgcctcctggccg

SEQ ID NO: 2072370 - DNA, 15 bp, Homo sapiens
cagtgcctcgaggca

SEQ ID NO: 2072371 - DNA, 19 bp, Homo sapiens
cagtgcctcgaggcaccgg

SEQ ID NO: 2072372 - DNA, 20 bp, Homo sapiens
cagtgcctcgaggcaccggc

SEQ ID NO: 2072373 - DNA, 14 bp, Homo sapiens
cagtgcctggcaag

SEQ ID NO: 2072374 - DNA, 16 bp, Homo sapiens
cagtgcctggcaaggc

SEQ ID NO: 2072375 - DNA, 17 bp, Homo sapiens
cagtgccttacctcctg

SEQ ID NO: 2072376 - DNA, 18 bp, Homo sapiens
cagtgccttacctcctgc

SEQ ID NO: 2072377 - DNA, 19 bp, Homo sapiens
cagtgccttacctcctgcc

SEQ ID NO: 2072378 - DNA, 23 bp, Homo sapiens
cagtgccttacctcctgcccagg

SEQ ID NO: 2072379 - DNA, 14 bp, Homo sapiens
cagtgccttccata

SEQ ID NO: 2072380 - DNA, 16 bp, Homo sapiens
cagtgccttccataat

SEQ ID NO: 2072381 - DNA, 23 bp, Homo sapiens
cagtgccttccataattatgaca

SEQ ID NO: 2072382 - DNA, 16 bp, Homo sapiens
cagtgccttggagcag

SEQ ID NO: 2072383 - DNA, 18 bp, Homo sapiens
cagtgctgattcagcctg

SEQ ID NO: 2072384 - DNA, 12 bp, Homo sapiens
cagtgctgccat

SEQ ID NO: 2072385 - DNA, 15 bp, Homo sapiens
cagtgctgccatgcc

SEQ ID NO: 2072386 - DNA, 17 bp, Homo sapiens
cagtgctgccatgccac

SEQ ID NO: 2072387 - DNA, 16 bp, Homo sapiens
cagtgctgccctgcga

SEQ ID NO: 2072388 - DNA, 22 bp, Homo sapiens
cagtgctgcgagatcgctggca

SEQ ID NO: 2072389 - DNA, 11 bp, Homo sapiens
cagtgctgctt

SEQ ID NO: 2072390 - DNA, 14 bp, Homo sapiens
cagtgctgcttctc

SEQ ID NO: 2072391 - DNA, 12 bp, Homo sapiens
cagtgctgtggc

SEQ ID NO: 2072392 - DNA, 13 bp, Homo sapiens
cagtgctgtggcc

SEQ ID NO: 2072393 - DNA, 18 bp, Homo sapiens
cagtgctgtggcctgggc

SEQ ID NO: 2072394 - DNA, 18 bp, Homo sapiens
cagtgctgttctggagct

SEQ ID NO: 2072395 - DNA, 15 bp, Homo sapiens
cagtgcttcagcctg

SEQ ID NO: 2072396 - DNA, 19 bp, Homo sapiens
cagtgcttcagcctgaggc

SEQ ID NO: 2072397 - DNA, 23 bp, Homo sapiens
cagtgcttctccaacactgaagt

SEQ ID NO: 2072398 - DNA, 17 bp, Homo sapiens
cagtgcttctctacaga

SEQ ID NO: 2072399 - DNA, 20 bp, Homo sapiens
cagtgcttgagtttggggaa

SEQ ID NO: 2072400 - DNA, 12 bp, Homo sapiens
cagtgcttgtaa

SEQ ID NO: 2072401 - DNA, 22 bp, Homo sapiens
cagtggacaccaggagtccctg

SEQ ID NO: 2072402 - DNA, 14 bp, Homo sapiens
cagtggagaaatat

SEQ ID NO: 2072403 - DNA, 13 bp, Homo sapiens
cagtggagaatta

SEQ ID NO: 2072404 - DNA, 18 bp, Homo sapiens
cagtggcacggagagaag

SEQ ID NO: 2072405 - DNA, 16 bp, Homo sapiens
cagtggcagctgcttt

SEQ ID NO: 2072406 - DNA, 23 bp, Homo sapiens
cagtggccgcaagcgcagggagg

SEQ ID NO: 2072407 - DNA, 14 bp, Homo sapiens
cagtggcgagagga

SEQ ID NO: 2072408 - DNA, 13 bp, Homo sapiens
cagtggctgtcac

SEQ ID NO: 2072409 - DNA, 19 bp, Homo sapiens
cagtgggaacgtgactgcc

SEQ ID NO: 2072410 - DNA, 20 bp, Homo sapiens
cagtgggacaaaccagagca

SEQ ID NO: 2072411 - DNA, 13 bp, Homo sapiens
cagtgggacagag

SEQ ID NO: 2072412 - DNA, 11 bp, Homo sapiens
cagtgggagct

SEQ ID NO: 2072413 - DNA, 21 bp, Homo sapiens
cagtgggaggtgagaccacct

SEQ ID NO: 2072414 - DNA, 16 bp, Homo sapiens
cagtgggtggcacctc

SEQ ID NO: 2072415 - DNA, 20 bp, Homo sapiens
cagtgggtggcacctcctga

SEQ ID NO: 2072416 - DNA, 22 bp, Homo sapiens
cagtgggtggcacctcctgaga

SEQ ID NO: 2072417 - DNA, 15 bp, Homo sapiens
cagtgggtgggagct

SEQ ID NO: 2072418 - DNA, 17 bp, Homo sapiens
cagtggtaagctctggc

SEQ ID NO: 2072419 - DNA, 23 bp, Homo sapiens
cagtggtaccagctcactccctg

SEQ ID NO: 2072420 - DNA, 23 bp, Homo sapiens
cagtggtgaagaaaactccttta

SEQ ID NO: 2072421 - DNA, 14 bp, Homo sapiens
cagtggttgctgtt

SEQ ID NO: 2072422 - DNA, 20 bp, Homo sapiens
cagtgtaaagaataaatgaa

SEQ ID NO: 2072423 - DNA, 16 bp, Homo sapiens
catcttggtcctgtca

SEQ ID NO: 2072424 - DNA, 19 bp, Homo sapiens
catcttggtcctgtcaccc

SEQ ID NO: 2072425 - DNA, 21 bp, Homo sapiens
catcttggtcctgtcaccctg

SEQ ID NO: 2072426 - DNA, 23 bp, Homo sapiens
catcttggtcctgtcaccctggc

SEQ ID NO: 2072427 - DNA, 21 bp, Homo sapiens
catctttcttctattttattc

SEQ ID NO: 2072428 - DNA, 23 bp, Homo sapiens
catctttcttctattttattccc

SEQ ID NO: 2072429 - DNA, 18 bp, Homo sapiens
catctttgaaaagaaaaa

SEQ ID NO: 2072430 - DNA, 15 bp, Homo sapiens
catgaaacagaaaca

SEQ ID NO: 2072431 - DNA, 19 bp, Homo sapiens
catgaaacagaaacaaaaa

SEQ ID NO: 2072432 - DNA, 18 bp, Homo sapiens
catgaacacagcctggga

SEQ ID NO: 2072433 - DNA, 20 bp, Homo sapiens
catgaacctcaagctgcatc

SEQ ID NO: 2072434 - DNA, 14 bp, Homo sapiens
catgaagacaggac

SEQ ID NO: 2072435 - DNA, 15 bp, Homo sapiens
catgaagacaggaca

SEQ ID NO: 2072436 - DNA, 16 bp, Homo sapiens
catgaagacaggacag

SEQ ID NO: 2072437 - DNA, 17 bp, Homo sapiens
catgaagacaggacagt

SEQ ID NO: 2072438 - DNA, 13 bp, Homo sapiens
catgaagaccaca

SEQ ID NO: 2072439 - DNA, 17 bp, Homo sapiens
catgaagaccacatcca

SEQ ID NO: 2072440 - DNA, 14 bp, Homo sapiens
catgaagagactct

SEQ ID NO: 2072441 - DNA, 21 bp, Homo sapiens
catgaagctggaagcactgct

SEQ ID NO: 2072442 - DNA, 21 bp, Homo sapiens
catgaatcccacccacatgtg

SEQ ID NO: 2072443 - DNA, 15 bp, Homo sapiens
catgacactgacctt

SEQ ID NO: 2072444 - DNA, 16 bp, Homo sapiens
catgacatgttatata

SEQ ID NO: 2072445 - DNA, 19 bp, Homo sapiens
catgacatgttatatattt

SEQ ID NO: 2072446 - DNA, 13 bp, Homo sapiens
catgaccctcctg

SEQ ID NO: 2072447 - DNA, 15 bp, Homo sapiens
catgaccctcctgtc

SEQ ID NO: 2072448 - DNA, 17 bp, Homo sapiens
catgacctccagctttc

SEQ ID NO: 2072449 - DNA, 22 bp, Homo sapiens
catgacctccagctttcctgta

SEQ ID NO: 2072450 - DNA, 14 bp, Homo sapiens
catgactatttcca

SEQ ID NO: 2072451 - DNA, 17 bp, Homo sapiens
catgagaaaatcagtaa

SEQ ID NO: 2072452 - DNA, 14 bp, Homo sapiens
catgagaaatgtga

SEQ ID NO: 2072453 - DNA, 22 bp, Homo sapiens
catgagaagagggcctgtggga

SEQ ID NO: 2072454 - DNA, 16 bp, Homo sapiens
catgagcaattctcct

SEQ ID NO: 2072455 - DNA, 15 bp, Homo sapiens
catgagcctcagcat

SEQ ID NO: 2072456 - DNA, 17 bp, Homo sapiens
catgagcctcagcatcc

SEQ ID NO: 2072457 - DNA, 19 bp, Homo sapiens
catgagcctcagcatcctg

SEQ ID NO: 2072458 - DNA, 20 bp, Homo sapiens
catgagcctcagcatcctgg

SEQ ID NO: 2072459 - DNA, 23 bp, Homo sapiens
catgagcctcagcatcctggcac

SEQ ID NO: 2072460 - DNA, 15 bp, Homo sapiens
catgaggagggtgcc

SEQ ID NO: 2072461 - DNA, 16 bp, Homo sapiens
catgaggagttgctgt

SEQ ID NO: 2072462 - DNA, 23 bp, Homo sapiens
catgaggcaatgtcaggaacaga

SEQ ID NO: 2072463 - DNA, 19 bp, Homo sapiens
catgagggatcacagggcc

SEQ ID NO: 2072464 - DNA, 20 bp, Homo sapiens
catgagggatcacagggccc

SEQ ID NO: 2072465 - DNA, 13 bp, Homo sapiens
catgagtggatgg

SEQ ID NO: 2072466 - DNA, 14 bp, Homo sapiens
catgagtggatgga

SEQ ID NO: 2072467 - DNA, 19 bp, Homo sapiens
catgagtggatggatggac

SEQ ID NO: 2072468 - DNA, 21 bp, Homo sapiens
catgagtggatggatggacag

SEQ ID NO: 2072469 - DNA, 13 bp, Homo sapiens
catgatactattc

SEQ ID NO: 2072470 - DNA, 13 bp, Homo sapiens
catgatcctgagt

SEQ ID NO: 2072471 - DNA, 21 bp, Homo sapiens
catgatctccctgccgcctca

SEQ ID NO: 2072472 - DNA, 15 bp, Homo sapiens
catgatctcggctta

SEQ ID NO: 2072473 - DNA, 21 bp, Homo sapiens
catgatctgactttaattgtg

SEQ ID NO: 2072474 - DNA, 23 bp, Homo sapiens
catgatctgtatttaatggtttt

SEQ ID NO: 2072475 - DNA, 20 bp, Homo sapiens
catgatcttgttaatgcatt

SEQ ID NO: 2072476 - DNA, 23 bp, Homo sapiens
catgatgccgctcttctgtcatc

SEQ ID NO: 2072477 - DNA, 20 bp, Homo sapiens
catgatggtgctgacctctg

SEQ ID NO: 2072478 - DNA, 22 bp, Homo sapiens
catgattcacaactaggacctc

SEQ ID NO: 2072479 - DNA, 14 bp, Homo sapiens
catgattcatttta

SEQ ID NO: 2072480 - DNA, 21 bp, Homo sapiens
catgatttagggaagcaggga

SEQ ID NO: 2072481 - DNA, 12 bp, Homo sapiens
catgatttatat

SEQ ID NO: 2072482 - DNA, 16 bp, Homo sapiens
catgatttatatatgg

SEQ ID NO: 2072483 - DNA, 14 bp, Homo sapiens
catgattttacaga

SEQ ID NO: 2072484 - DNA, 11 bp, Homo sapiens
catgattttat

SEQ ID NO: 2072485 - DNA, 20 bp, Homo sapiens
catgattttatacatagtca

SEQ ID NO: 2072486 - DNA, 17 bp, Homo sapiens
catgcaagtgctatgcc

SEQ ID NO: 2072487 - DNA, 17 bp, Homo sapiens
catgcaattcatcccag

SEQ ID NO: 2072488 - DNA, 18 bp, Homo sapiens
catgcaatttattaaaat

SEQ ID NO: 2072489 - DNA, 21 bp, Homo sapiens
catgcacacaaacacctccta

SEQ ID NO: 2072490 - DNA, 21 bp, Homo sapiens
catgcacagctgcttgtcctg

SEQ ID NO: 2072491 - DNA, 15 bp, Homo sapiens
catgcacatttatat

SEQ ID NO: 2072492 - DNA, 16 bp, Homo sapiens
catgcacgtgtgtgca

SEQ ID NO: 2072493 - DNA, 14 bp, Homo sapiens
catgcactgaccct

SEQ ID NO: 2072494 - DNA, 17 bp, Homo sapiens
catgcactgacccttcc

SEQ ID NO: 2072495 - DNA, 17 bp, Homo sapiens
catgcacttggctgcat

SEQ ID NO: 2072496 - DNA, 18 bp, Homo sapiens
catgcagactcctcagat

SEQ ID NO: 2072497 - DNA, 19 bp, Homo sapiens
catgcagactcctcagatc

SEQ ID NO: 2072498 - DNA, 19 bp, Homo sapiens
catgcagcttcatcaattt

SEQ ID NO: 2072499 - DNA, 19 bp, Homo sapiens
catgcatagtgctaagaaa

SEQ ID NO: 2072500 - DNA, 14 bp, Homo sapiens
catgcatcatctca

SEQ ID NO: 2072501 - DNA, 18 bp, Homo sapiens
catgccaaagcaaaagaa

SEQ ID NO: 2072502 - DNA, 19 bp, Homo sapiens
catgccaaagcaaaagaag

SEQ ID NO: 2072503 - DNA, 12 bp, Homo sapiens
catgccaccctc

SEQ ID NO: 2072504 - DNA, 16 bp, Homo sapiens
catgccaccctctcca

SEQ ID NO: 2072505 - DNA, 21 bp, Homo sapiens
catgccaccctctccatgccc

SEQ ID NO: 2072506 - DNA, 16 bp, Homo sapiens
catgccactgccaggc

SEQ ID NO: 2072507 - DNA, 18 bp, Homo sapiens
catgccactgccaggcac

SEQ ID NO: 2072508 - DNA, 18 bp, Homo sapiens
catgccatccattctgcc

SEQ ID NO: 2072509 - DNA, 13 bp, Homo sapiens
ctgggcagacctt

SEQ ID NO: 2072510 - DNA, 17 bp, Homo sapiens
ctgggcagcatagcaag

SEQ ID NO: 2072511 - DNA, 22 bp, Homo sapiens
ctgggcagcttgagagggcaaa

SEQ ID NO: 2072512 - DNA, 18 bp, Homo sapiens
ctgggccaaaagggcagc

SEQ ID NO: 2072513 - DNA, 20 bp, Homo sapiens
ctgggccaagttcctctagt

SEQ ID NO: 2072514 - DNA, 16 bp, Homo sapiens
ctgggccagcctcagc

SEQ ID NO: 2072515 - DNA, 12 bp, Homo sapiens
ctgggcccaggc

SEQ ID NO: 2072516 - DNA, 14 bp, Homo sapiens
ctgggcccaggctc

SEQ ID NO: 2072517 - DNA, 18 bp, Homo sapiens
ctgggcccaggctctggg

SEQ ID NO: 2072518 - DNA, 19 bp, Homo sapiens
ctgggcccaggctctggga

SEQ ID NO: 2072519 - DNA, 13 bp, Homo sapiens
ctgggccccacca

SEQ ID NO: 2072520 - DNA, 15 bp, Homo sapiens
ctgggccccacctac

SEQ ID NO: 2072521 - DNA, 14 bp, Homo sapiens
ctgggccccatgct

SEQ ID NO: 2072522 - DNA, 20 bp, Homo sapiens
ctgggccccatgctctgccc

SEQ ID NO: 2072523 - DNA, 21 bp, Homo sapiens
ctgggccccatgctctgcccc

SEQ ID NO: 2072524 - DNA, 22 bp, Homo sapiens
ctgggccccatgctctgcccca

SEQ ID NO: 2072525 - DNA, 14 bp, Homo sapiens
ctgggcccctccac

SEQ ID NO: 2072526 - DNA, 12 bp, Homo sapiens
ctgggcccctgg

SEQ ID NO: 2072527 - DNA, 17 bp, Homo sapiens
ctgggcccctgggatgg

SEQ ID NO: 2072528 - DNA, 20 bp, Homo sapiens
ctgggcccgctttgcctgct

SEQ ID NO: 2072529 - DNA, 17 bp, Homo sapiens
ctgggccctggggcctg

SEQ ID NO: 2072530 - DNA, 12 bp, Homo sapiens
ctgggcctatgg

SEQ ID NO: 2072531 - DNA, 19 bp, Homo sapiens
ctgggcctatggagagccc

SEQ ID NO: 2072532 - DNA, 20 bp, Homo sapiens
ctgggcctatggagagccct

SEQ ID NO: 2072533 - DNA, 12 bp, Homo sapiens
ctgggcctgctg

SEQ ID NO: 2072534 - DNA, 13 bp, Homo sapiens
ctgggcctgctgc

SEQ ID NO: 2072535 - DNA, 14 bp, Homo sapiens
ctgggcctgctgct

SEQ ID NO: 2072536 - DNA, 15 bp, Homo sapiens
ctgggcctgctgctg

SEQ ID NO: 2072537 - DNA, 22 bp, Homo sapiens
ctgggcctgctgctgagaacct

SEQ ID NO: 2072538 - DNA, 12 bp, Homo sapiens
ctgggcctgctt

SEQ ID NO: 2072539 - DNA, 21 bp, Homo sapiens
ctgggcctgcttttccaggat

SEQ ID NO: 2072540 - DNA, 14 bp, Homo sapiens
ctgggcctgtgcag

SEQ ID NO: 2072541 - DNA, 15 bp, Homo sapiens
ctgggcctgtgcagc

SEQ ID NO: 2072542 - DNA, 16 bp, Homo sapiens
ctgggcctgtgcagca

SEQ ID NO: 2072543 - DNA, 17 bp, Homo sapiens
ctgggcctgtgcagcag

SEQ ID NO: 2072544 - DNA, 19 bp, Homo sapiens
ctgggcctgtgcagcagcc

SEQ ID NO: 2072545 - DNA, 15 bp, Homo sapiens
ctgggccttacctcc

SEQ ID NO: 2072546 - DNA, 23 bp, Homo sapiens
ctgggccttacctcccctgccag

SEQ ID NO: 2072547 - DNA, 21 bp, Homo sapiens
ctgggcctttcctgtgccaac

SEQ ID NO: 2072548 - DNA, 13 bp, Homo sapiens
ctgggcgacagag

SEQ ID NO: 2072549 - DNA, 18 bp, Homo sapiens
ctgggctaccccccctcc

SEQ ID NO: 2072550 - DNA, 14 bp, Homo sapiens
ctgggctctccacc

SEQ ID NO: 2072551 - DNA, 15 bp, Homo sapiens
ctgataggaaaagaa

SEQ ID NO: 2072552 - DNA, 18 bp, Homo sapiens
ctgatcaaaaataaacta

SEQ ID NO: 2072553 - DNA, 22 bp, Homo sapiens
ctgatcaaaaataaactagttt

SEQ ID NO: 2072554 - DNA, 23 bp, Homo sapiens
ctgatcaaaaataaactagtttc

SEQ ID NO: 2072555 - DNA, 18 bp, Homo sapiens
ctgatcaagtcaccggag

SEQ ID NO: 2072556 - DNA, 15 bp, Homo sapiens
ctgatcagaatttta

SEQ ID NO: 2072557 - DNA, 18 bp, Homo sapiens
ctgatcagaattttacca

SEQ ID NO: 2072558 - DNA, 20 bp, Homo sapiens
ctgatcatggtcagctcaca

SEQ ID NO: 2072559 - DNA, 20 bp, Homo sapiens
ctgatcattacatggctgtg

SEQ ID NO: 2072560 - DNA, 18 bp, Homo sapiens
ctgatccctttcccatga

SEQ ID NO: 2072561 - DNA, 21 bp, Homo sapiens
ctgatcgggataacaaaatca

SEQ ID NO: 2072562 - DNA, 24 bp, Homo sapiens
ctgatcgggataacaaaatcacaa

SEQ ID NO: 2072563 - DNA, 15 bp, Homo sapiens
ctgatcgtgctaaat

SEQ ID NO: 2072564 - DNA, 21 bp, Homo sapiens
ctgatcgtgctaaattttcag

SEQ ID NO: 2072565 - DNA, 15 bp, Homo sapiens
ctgatcttggctcac

SEQ ID NO: 2072566 - DNA, 15 bp, Homo sapiens
ctgatgacagagcga

SEQ ID NO: 2072567 - DNA, 19 bp, Homo sapiens
ctgatgacctaacctaagc

SEQ ID NO: 2072568 - DNA, 17 bp, Homo sapiens
ctgatgcgaaaacttga

SEQ ID NO: 2072569 - DNA, 22 bp, Homo sapiens
ctgatgctttgcttcaaatcca

SEQ ID NO: 2072570 - DNA, 21 bp, Homo sapiens
ctgatggaccgggtgggcctg

SEQ ID NO: 2072571 - DNA, 13 bp, Homo sapiens
ctgatggagaagg

SEQ ID NO: 2072572 - DNA, 17 bp, Homo sapiens
ctgatggccaagggggt

SEQ ID NO: 2072573 - DNA, 18 bp, Homo sapiens
ctgatgggcaacccccag

SEQ ID NO: 2072574 - DNA, 22 bp, Homo sapiens
ctgatgggcaacccccagcctg

SEQ ID NO: 2072575 - DNA, 21 bp, Homo sapiens
ctgatggggtggaaggcatgg

SEQ ID NO: 2072576 - DNA, 23 bp, Homo sapiens
ctgatggggtggaaggcatggcg

SEQ ID NO: 2072577 - DNA, 16 bp, Homo sapiens
ctgatggtgagctggg

SEQ ID NO: 2072578 - DNA, 17 bp, Homo sapiens
ctgatggtgagctggga

SEQ ID NO: 2072579 - DNA, 13 bp, Homo sapiens
ctgatgttcctag

SEQ ID NO: 2072580 - DNA, 17 bp, Homo sapiens
ctgattcaaaagtgaac

SEQ ID NO: 2072581 - DNA, 18 bp, Homo sapiens
ctgattcccaagctctgc

SEQ ID NO: 2072582 - DNA, 16 bp, Homo sapiens
ctgattctgggatgct

SEQ ID NO: 2072583 - DNA, 19 bp, Homo sapiens
ctgattgggtgccatgtgg

SEQ ID NO: 2072584 - DNA, 15 bp, Homo sapiens
ctgatttaatgtttt

SEQ ID NO: 2072585 - DNA, 16 bp, Homo sapiens
ctgatttagatatgca

SEQ ID NO: 2072586 - DNA, 13 bp, Homo sapiens
ctgatttcacaac

SEQ ID NO: 2072587 - DNA, 15 bp, Homo sapiens
ctgatttccaggccc

SEQ ID NO: 2072588 - DNA, 17 bp, Homo sapiens
ctgatttccaggcccct

SEQ ID NO: 2072589 - DNA, 23 bp, Homo sapiens
ctgatttctctgaacagaaaaca

SEQ ID NO: 2072590 - DNA, 19 bp, Homo sapiens
ctgatttttttgttgttgt

SEQ ID NO: 2072591 - DNA, 13 bp, Homo sapiens
ctgcaaaatttta

SEQ ID NO: 2072592 - DNA, 20 bp, Homo sapiens
ctgcaaactcactgctcaag

SEQ ID NO: 2072593 - DNA, 18 bp, Homo sapiens
ctgcaaagtgcaaatact

SEQ ID NO: 2072594 - DNA, 20 bp, Homo sapiens
ctgcaacctccacctcctga

SEQ ID NO: 2072595 - DNA, 22 bp, Homo sapiens
ctgcaacctccgcctcttgggt

SEQ ID NO: 2072596 - DNA, 13 bp, Homo sapiens
ctgcaactagcca

SEQ ID NO: 2072597 - DNA, 13 bp, Homo sapiens
ctgcaagagcctt

SEQ ID NO: 2072598 - DNA, 14 bp, Homo sapiens
ctgcaagagccttg

SEQ ID NO: 2072599 - DNA, 17 bp, Homo sapiens
ctgcaagagccttggtg

SEQ ID NO: 2072600 - DNA, 15 bp, Homo sapiens
ctgcaagccccaggg

SEQ ID NO: 2072601 - DNA, 19 bp, Homo sapiens
ctgcaagccccagggcctg

SEQ ID NO: 2072602 - DNA, 22 bp, Homo sapiens
ctgcaaggaagggtgggaagct

SEQ ID NO: 2072603 - DNA, 16 bp, Homo sapiens
ctgcaagggccagagt

SEQ ID NO: 2072604 - DNA, 12 bp, Homo sapiens
ctgcaagtgccc

SEQ ID NO: 2072605 - DNA, 20 bp, Homo sapiens
ctgcaagtgcccgccctgcc

SEQ ID NO: 2072606 - DNA, 21 bp, Homo sapiens
ctgcaagtgcccgccctgccc

SEQ ID NO: 2072607 - DNA, 22 bp, Homo sapiens
ctgcaagtgcccgccctgcccc

SEQ ID NO: 2072608 - DNA, 20 bp, Homo sapiens
ctgcaatactaattgagaaa

SEQ ID NO: 2072609 - DNA, 16 bp, Homo sapiens
ctgcaatctccagggc

SEQ ID NO: 2072610 - DNA, 17 bp, Homo sapiens
ctgcaatctccagggct

SEQ ID NO: 2072611 - DNA, 21 bp, Homo sapiens
ctgcaatgggcactgggatga

SEQ ID NO: 2072612 - DNA, 16 bp, Homo sapiens
ctgcaattgcttagga

SEQ ID NO: 2072613 - DNA, 13 bp, Homo sapiens
ctgcacaaagccc

SEQ ID NO: 2072614 - DNA, 20 bp, Homo sapiens
ctgcacaaagcccttccatg

SEQ ID NO: 2072615 - DNA, 21 bp, Homo sapiens
ctgcacaaagcccttccatgt

SEQ ID NO: 2072616 - DNA, 13 bp, Homo sapiens
ctgcacacacagc

SEQ ID NO: 2072617 - DNA, 14 bp, Homo sapiens
ctgcacacacagct

SEQ ID NO: 2072618 - DNA, 17 bp, Homo sapiens
ctgcacacacagctcct

SEQ ID NO: 2072619 - DNA, 19 bp, Homo sapiens
ctgcacagcggcccctgca

SEQ ID NO: 2072620 - DNA, 21 bp, Homo sapiens
ctgcacagtgcatctcagccc

SEQ ID NO: 2072621 - DNA, 24 bp, Homo sapiens
ctgcacagtttagaacagagggac

SEQ ID NO: 2072622 - DNA, 14 bp, Homo sapiens
ctgcacatgtcttg

SEQ ID NO: 2072623 - DNA, 16 bp, Homo sapiens
ctgcacatgtcttgta

SEQ ID NO: 2072624 - DNA, 12 bp, Homo sapiens
ctgcacattcct

SEQ ID NO: 2072625 - DNA, 17 bp, Homo sapiens
ctgcacattcctggccc

SEQ ID NO: 2072626 - DNA, 21 bp, Homo sapiens
ctgcacattcctggccccggg

SEQ ID NO: 2072627 - DNA, 14 bp, Homo sapiens
ctgcaccagagtga

SEQ ID NO: 2072628 - DNA, 18 bp, Homo sapiens
ctgcaccagcccttccct

SEQ ID NO: 2072629 - DNA, 14 bp, Homo sapiens
ctgcaccatcacac

SEQ ID NO: 2072630 - DNA, 13 bp, Homo sapiens
ctgcacccagggg

SEQ ID NO: 2072631 - DNA, 16 bp, Homo sapiens
ctgcacccgtaccccc

SEQ ID NO: 2072632 - DNA, 15 bp, Homo sapiens
ctgcaccctggaaag

SEQ ID NO: 2072633 - DNA, 13 bp, Homo sapiens
ctgcacccttcct

SEQ ID NO: 2072634 - DNA, 16 bp, Homo sapiens
ctgcacccttcctcct

SEQ ID NO: 2072635 - DNA, 13 bp, Homo sapiens
ctgcaccgcttgg

SEQ ID NO: 2072636 - DNA, 13 bp, Homo sapiens
ctgcacctgccag

SEQ ID NO: 2072637 - DNA, 16 bp, Homo sapiens
ctgccagctgccttcc

SEQ ID NO: 2072638 - DNA, 10 bp, Homo sapiens
ctgccaggac

SEQ ID NO: 2072639 - DNA, 14 bp, Homo sapiens
ctgccaggacacct

SEQ ID NO: 2072640 - DNA, 16 bp, Homo sapiens
ctgccaggacacctgc

SEQ ID NO: 2072641 - DNA, 17 bp, Homo sapiens
ctgccaggacacctgcc

SEQ ID NO: 2072642 - DNA, 18 bp, Homo sapiens
ctgccaggacacctgccc

SEQ ID NO: 2072643 - DNA, 23 bp, Homo sapiens
ctgccaggacacctgccccagcg

SEQ ID NO: 2072644 - DNA, 13 bp, Homo sapiens
ctgccaggaggga

SEQ ID NO: 2072645 - DNA, 21 bp, Homo sapiens
ctgccaggagggacaaaggag

SEQ ID NO: 2072646 - DNA, 23 bp, Homo sapiens
ctgccaggagggacaaaggagcc

SEQ ID NO: 2072647 - DNA, 15 bp, Homo sapiens
ctgccaggcacctgg

SEQ ID NO: 2072648 - DNA, 20 bp, Homo sapiens
ctgccaggcacctggcctgc

SEQ ID NO: 2072649 - DNA, 21 bp, Homo sapiens
ctgccaggcacctggcctgct

SEQ ID NO: 2072650 - DNA, 20 bp, Homo sapiens
ctgccaggcccatctcaggt

SEQ ID NO: 2072651 - DNA, 22 bp, Homo sapiens
ctgccaggcgttggtgccactt

SEQ ID NO: 2072652 - DNA, 12 bp, Homo sapiens
ctgccagggccc

SEQ ID NO: 2072653 - DNA, 20 bp, Homo sapiens
ctgccagggctcgggcgctg

SEQ ID NO: 2072654 - DNA, 21 bp, Homo sapiens
ctgccagtccccctgccccag

SEQ ID NO: 2072655 - DNA, 23 bp, Homo sapiens
ctgccagtgccttacctcctgcc

SEQ ID NO: 2072656 - DNA, 23 bp, Homo sapiens
ctgccagtgtttagaagagcctg

SEQ ID NO: 2072657 - DNA, 16 bp, Homo sapiens
ctgccataccgctggg

SEQ ID NO: 2072658 - DNA, 18 bp, Homo sapiens
ctgccataccgctgggga

SEQ ID NO: 2072659 - DNA, 23 bp, Homo sapiens
ctgccatattctgttggccagtg

SEQ ID NO: 2072660 - DNA, 21 bp, Homo sapiens
ctgccatccaggttcagcttg

SEQ ID NO: 2072661 - DNA, 14 bp, Homo sapiens
ctgccatgccactg

SEQ ID NO: 2072662 - DNA, 15 bp, Homo sapiens
ctgccatgccactgc

SEQ ID NO: 2072663 - DNA, 16 bp, Homo sapiens
ctgccatgccactgcc

SEQ ID NO: 2072664 - DNA, 17 bp, Homo sapiens
ctgccatgccactgcca

SEQ ID NO: 2072665 - DNA, 22 bp, Homo sapiens
ctgccatgccactgccaggcac

SEQ ID NO: 2072666 - DNA, 24 bp, Homo sapiens
ctgccatgccactgccaggcacct

SEQ ID NO: 2072667 - DNA, 13 bp, Homo sapiens
ctgccatgcccag

SEQ ID NO: 2072668 - DNA, 19 bp, Homo sapiens
ctgccatttgcaccctccg

SEQ ID NO: 2072669 - DNA, 19 bp, Homo sapiens
ctgcccaacctgctctcct

SEQ ID NO: 2072670 - DNA, 21 bp, Homo sapiens
ctgcccaattttgcagggagc

SEQ ID NO: 2072671 - DNA, 18 bp, Homo sapiens
ctgcccacttcagcccag

SEQ ID NO: 2072672 - DNA, 17 bp, Homo sapiens
ctgcccagcctccaagc

SEQ ID NO: 2072673 - DNA, 23 bp, Homo sapiens
ctgcccaggagagccagccctcc

SEQ ID NO: 2072674 - DNA, 13 bp, Homo sapiens
ctgcccaggcccc

SEQ ID NO: 2072675 - DNA, 15 bp, Homo sapiens
ctgcccaggcccctg

SEQ ID NO: 2072676 - DNA, 20 bp, Homo sapiens
ctgcccaggcccctgccacc

SEQ ID NO: 2072677 - DNA, 14 bp, Homo sapiens
catgccatctgttt

SEQ ID NO: 2072678 - DNA, 17 bp, Homo sapiens
catgccatttgtactga

SEQ ID NO: 2072679 - DNA, 15 bp, Homo sapiens
catgcccagagaatc

SEQ ID NO: 2072680 - DNA, 14 bp, Homo sapiens
catgccgggcgcag

SEQ ID NO: 2072681 - DNA, 16 bp, Homo sapiens
catgcctcagtttccc

SEQ ID NO: 2072682 - DNA, 19 bp, Homo sapiens
catgcctcatgccacacct

SEQ ID NO: 2072683 - DNA, 17 bp, Homo sapiens
catgcctctgaggccag

SEQ ID NO: 2072684 - DNA, 18 bp, Homo sapiens
catgcctctgaggccagc

SEQ ID NO: 2072685 - DNA, 19 bp, Homo sapiens
catgcctctgaggccagcc

SEQ ID NO: 2072686 - DNA, 12 bp, Homo sapiens
catgcctctgat

SEQ ID NO: 2072687 - DNA, 14 bp, Homo sapiens
catgcgcaggctca

SEQ ID NO: 2072688 - DNA, 19 bp, Homo sapiens
catgctaagagaagtagaa

SEQ ID NO: 2072689 - DNA, 15 bp, Homo sapiens
catgctcaaccactg

SEQ ID NO: 2072690 - DNA, 17 bp, Homo sapiens
catgctcaaccactgtg

SEQ ID NO: 2072691 - DNA, 15 bp, Homo sapiens
catgctcagccctga

SEQ ID NO: 2072692 - DNA, 21 bp, Homo sapiens
catgctcagcccttcctagaa

SEQ ID NO: 2072693 - DNA, 13 bp, Homo sapiens
catgctctctgca

SEQ ID NO: 2072694 - DNA, 19 bp, Homo sapiens
catgctctctgcagccagc

SEQ ID NO: 2072695 - DNA, 23 bp, Homo sapiens
catgctctctgcagccagcccag

SEQ ID NO: 2072696 - DNA, 14 bp, Homo sapiens
catgctctgcccca

SEQ ID NO: 2072697 - DNA, 22 bp, Homo sapiens
catgctctgccccaagccccca

SEQ ID NO: 2072698 - DNA, 23 bp, Homo sapiens
cctgtccccctgagatcagagtc

SEQ ID NO: 2072699 - DNA, 13 bp, Homo sapiens
cctgtcccgcctt

SEQ ID NO: 2072700 - DNA, 16 bp, Homo sapiens
cctgtcccgccttcct

SEQ ID NO: 2072701 - DNA, 15 bp, Homo sapiens
cctgtcctccagctt

SEQ ID NO: 2072702 - DNA, 14 bp, Homo sapiens
cctgtcctcctcgg

SEQ ID NO: 2072703 - DNA, 15 bp, Homo sapiens
cctgtcctcctcgga

SEQ ID NO: 2072704 - DNA, 18 bp, Homo sapiens
cctgtcgagacacttgcc

SEQ ID NO: 2072705 - DNA, 22 bp, Homo sapiens
cctgtcgattagactggacagc

SEQ ID NO: 2072706 - DNA, 15 bp, Homo sapiens
cctgtctctgcctgc

SEQ ID NO: 2072707 - DNA, 16 bp, Homo sapiens
cctgtctctgcctgcg

SEQ ID NO: 2072708 - DNA, 16 bp, Homo sapiens
cctgtctgccagccag

SEQ ID NO: 2072709 - DNA, 17 bp, Homo sapiens
cctgtctgccagccagc

SEQ ID NO: 2072710 - DNA, 22 bp, Homo sapiens
cctgtctgtcgctgggctgtgg

SEQ ID NO: 2072711 - DNA, 21 bp, Homo sapiens
cctgtctgtctgtctgtccca

SEQ ID NO: 2072712 - DNA, 14 bp, Homo sapiens
cctgtctttaagga

SEQ ID NO: 2072713 - DNA, 18 bp, Homo sapiens
cctgtctttcagcattca

SEQ ID NO: 2072714 - DNA, 14 bp, Homo sapiens
cctgtgaacccagg

SEQ ID NO: 2072715 - DNA, 15 bp, Homo sapiens
cctgtgaacccagga

SEQ ID NO: 2072716 - DNA, 21 bp, Homo sapiens
ctgctggggcatgtgtgcctg

SEQ ID NO: 2072717 - DNA, 22 bp, Homo sapiens
ctgctggtaatttgtatctgaa

SEQ ID NO: 2072718 - DNA, 15 bp, Homo sapiens
ctgctggttcagggt

SEQ ID NO: 2072719 - DNA, 15 bp, Homo sapiens
ctgctgtaactgctg

SEQ ID NO: 2072720 - DNA, 23 bp, Homo sapiens
ctgctgtaactgctgagccactc

SEQ ID NO: 2072721 - DNA, 15 bp, Homo sapiens
ctgctgtggcctcac

SEQ ID NO: 2072722 - DNA, 17 bp, Homo sapiens
ctgctgtggcctcactt

SEQ ID NO: 2072723 - DNA, 12 bp, Homo sapiens
ctgctgtgtagc

SEQ ID NO: 2072724 - DNA, 20 bp, Homo sapiens
ctgctgtgtagctctgtcca

SEQ ID NO: 2072725 - DNA, 22 bp, Homo sapiens
ctgctgtgtccgctttcatgaa

SEQ ID NO: 2072726 - DNA, 21 bp, Homo sapiens
ctgctgtgtgaattcccaggt

SEQ ID NO: 2072727 - DNA, 20 bp, Homo sapiens
ctgctgttgccatagcccca

SEQ ID NO: 2072728 - DNA, 12 bp, Homo sapiens
ctgcttacctga

SEQ ID NO: 2072729 - DNA, 13 bp, Homo sapiens
ctgcttacctgac

SEQ ID NO: 2072730 - DNA, 17 bp, Homo sapiens
ctgcttactagccctgc

SEQ ID NO: 2072731 - DNA, 23 bp, Homo sapiens
ctgcttatcaataaacctgtttg

SEQ ID NO: 2072732 - DNA, 14 bp, Homo sapiens
ctgcttcagcctcc

SEQ ID NO: 2072733 - DNA, 21 bp, Homo sapiens
ctgcttcagtgtatggaaata

SEQ ID NO: 2072734 - DNA, 21 bp, Homo sapiens
ctgcttcctaggccccagagc

SEQ ID NO: 2072735 - DNA, 22 bp, Homo sapiens
ctgcttcctaggccccagagca

SEQ ID NO: 2072736 - DNA, 19 bp, Homo sapiens
ctgcttccttctgcaccca

SEQ ID NO: 2072737 - DNA, 20 bp, Homo sapiens
ctgcttctgaactcaagctg

SEQ ID NO: 2072738 - DNA, 15 bp, Homo sapiens
ctgcttctgtccagg

SEQ ID NO: 2072739 - DNA, 17 bp, Homo sapiens
ctgcttgaaggaacagt

SEQ ID NO: 2072740 - DNA, 15 bp, Homo sapiens
ctgcttgaggagggg

SEQ ID NO: 2072741 - DNA, 20 bp, Homo sapiens
ctgcttgaggaggggcacct

SEQ ID NO: 2072742 - DNA, 23 bp, Homo sapiens
ctgcttgaggaggggcacctgcc

SEQ ID NO: 2072743 - DNA, 19 bp, Homo sapiens
ctgcttggggggtgatgag

SEQ ID NO: 2072744 - DNA, 15 bp, Homo sapiens
ctgcttgttgtcaag

SEQ ID NO: 2072745 - DNA, 16 bp, Homo sapiens
ctgcttgttgtcaagt

SEQ ID NO: 2072746 - DNA, 13 bp, Homo sapiens
ctgctttcaactt

SEQ ID NO: 2072747 - DNA, 18 bp, Homo sapiens
ctgctttgcgctggtgga

SEQ ID NO: 2072748 - DNA, 22 bp, Homo sapiens
ctgctttgggctgccctggtgc

SEQ ID NO: 2072749 - DNA, 23 bp, Homo sapiens
ctgctttgggctgccctggtgct

SEQ ID NO: 2072750 - DNA, 20 bp, Homo sapiens
ctgcttttccaggatcctgc

SEQ ID NO: 2072751 - DNA, 23 bp, Homo sapiens
ctgcttttccaggatcctgcagg

SEQ ID NO: 2072752 - DNA, 19 bp, Homo sapiens
ctgcttttgtctatgggac

SEQ ID NO: 2072753 - DNA, 21 bp, Homo sapiens
ctgcttttgtctatgggactc

SEQ ID NO: 2072754 - DNA, 17 bp, Homo sapiens
ctgctttttggcacagt

SEQ ID NO: 2072755 - DNA, 17 bp, Homo sapiens
ctggaaaactcaggatt

SEQ ID NO: 2072756 - DNA, 14 bp, Homo sapiens
ctggaaaagaggag

SEQ ID NO: 2072757 - DNA, 16 bp, Homo sapiens
ctggaaaagcacttta

SEQ ID NO: 2072758 - DNA, 23 bp, Homo sapiens
ctggaaaagtcacacagacacac

SEQ ID NO: 2072759 - DNA, 18 bp, Homo sapiens
ctggaaaatgtgacccag

SEQ ID NO: 2072760 - DNA, 20 bp, Homo sapiens
ctggaaaccacacttcttga

SEQ ID NO: 2072761 - DNA, 23 bp, Homo sapiens
ctggaaaggctcagtctcaggag

SEQ ID NO: 2072762 - DNA, 19 bp, Homo sapiens
ctggaaataaacctggaga

SEQ ID NO: 2072763 - DNA, 20 bp, Homo sapiens
ctggaaataaacctggagat

SEQ ID NO: 2072764 - DNA, 17 bp, Homo sapiens
ctggaaatctggatttt

SEQ ID NO: 2072765 - DNA, 20 bp, Homo sapiens
ctggaaatctggattttcag

SEQ ID NO: 2072766 - DNA, 21 bp, Homo sapiens
ctggaaatctgttttgtatat

SEQ ID NO: 2072767 - DNA, 22 bp, Homo sapiens
ctggaaatgtctttctattcat

SEQ ID NO: 2072768 - DNA, 16 bp, Homo sapiens
ctggaaattctggaac

SEQ ID NO: 2072769 - DNA, 13 bp, Homo sapiens
ctggaaccaggga

SEQ ID NO: 2072770 - DNA, 19 bp, Homo sapiens
ctggaaccagggaggagag

SEQ ID NO: 2072771 - DNA, 16 bp, Homo sapiens
ctggaactgtctctca

SEQ ID NO: 2072772 - DNA, 16 bp, Homo sapiens
ctggaacttgaactga

SEQ ID NO: 2072773 - DNA, 21 bp, Homo sapiens
ctgggttttctaactgtaaat

SEQ ID NO: 2072774 - DNA, 22 bp, Homo sapiens
ctgggttttctaactgtaaatc

SEQ ID NO: 2072775 - DNA, 16 bp, Homo sapiens
ctggtaaactatttgt

SEQ ID NO: 2072776 - DNA, 16 bp, Homo sapiens
ctggtaagcagaggct

SEQ ID NO: 2072777 - DNA, 15 bp, Homo sapiens
ctggtacaatccttt

SEQ ID NO: 2072778 - DNA, 14 bp, Homo sapiens
ctggtacagcaggg

SEQ ID NO: 2072779 - DNA, 22 bp, Homo sapiens
ctggtacagcagggtcttgctg

SEQ ID NO: 2072780 - DNA, 20 bp, Homo sapiens
ctggtagaattgggaagctg

SEQ ID NO: 2072781 - DNA, 13 bp, Homo sapiens
ctggtagagcagg

SEQ ID NO: 2072782 - DNA, 13 bp, Homo sapiens
ctggtaggaaagc

SEQ ID NO: 2072783 - DNA, 23 bp, Homo sapiens
ctggtatgaacttgaggacacat

SEQ ID NO: 2072784 - DNA, 19 bp, Homo sapiens
ctggtattatttacaatgc

SEQ ID NO: 2072785 - DNA, 16 bp, Homo sapiens
ctggtatttggagcaa

SEQ ID NO: 2072786 - DNA, 17 bp, Homo sapiens
ctggtcaggcccactgc

SEQ ID NO: 2072787 - DNA, 17 bp, Homo sapiens
ctggtcaggtatttcag

SEQ ID NO: 2072788 - DNA, 19 bp, Homo sapiens
ctggtccagggcctgggaa

SEQ ID NO: 2072789 - DNA, 14 bp, Homo sapiens
ctggtcccactcag

SEQ ID NO: 2072790 - DNA, 23 bp, Homo sapiens
ctggtccctcgtccacaggggca

SEQ ID NO: 2072791 - DNA, 15 bp, Homo sapiens
ctggtctaggagctg

SEQ ID NO: 2072792 - DNA, 23 bp, Homo sapiens
ctggtctcaaactcttgacctca

SEQ ID NO: 2072793 - DNA, 15 bp, Homo sapiens
ctggtctccctccag

SEQ ID NO: 2072794 - DNA, 16 bp, Homo sapiens
ctggtctgccctgggc

SEQ ID NO: 2072795 - DNA, 17 bp, Homo sapiens
ctggtctgtgctgccct

SEQ ID NO: 2072796 - DNA, 18 bp, Homo sapiens
ctggtcttgtggaattgg

SEQ ID NO: 2072797 - DNA, 17 bp, Homo sapiens
ctggtcttttgggagtg

SEQ ID NO: 2072798 - DNA, 22 bp, Homo sapiens
ctggtgactgcgatcttcagag

SEQ ID NO: 2072799 - DNA, 16 bp, Homo sapiens
ctggtgaggcccagcc

SEQ ID NO: 2072800 - DNA, 19 bp, Homo sapiens
ctggtgaggcccagcctgt

SEQ ID NO: 2072801 - DNA, 19 bp, Homo sapiens
ctggtgcactggccccacc

SEQ ID NO: 2072802 - DNA, 19 bp, Homo sapiens
ctggtgcagaggtgagcag

SEQ ID NO: 2072803 - DNA, 17 bp, Homo sapiens
ctggtgcctatttattc

SEQ ID NO: 2072804 - DNA, 22 bp, Homo sapiens
ctggtgctataggctggagaag

SEQ ID NO: 2072805 - DNA, 14 bp, Homo sapiens
ctggtgctgcaagg

SEQ ID NO: 2072806 - DNA, 16 bp, Homo sapiens
ctggtgctgcaaggaa

SEQ ID NO: 2072807 - DNA, 12 bp, Homo sapiens
ctggtgctgtgg

SEQ ID NO: 2072808 - DNA, 16 bp, Homo sapiens
ctggtgctgtggccag

SEQ ID NO: 2072809 - DNA, 18 bp, Homo sapiens
ctgtcaatttccctgact

SEQ ID NO: 2072810 - DNA, 23 bp, Homo sapiens
ctgtcacacaaggctgggcacct

SEQ ID NO: 2072811 - DNA, 14 bp, Homo sapiens
ctgtcaccaagctc

SEQ ID NO: 2072812 - DNA, 14 bp, Homo sapiens
ctgtcaccctccac

SEQ ID NO: 2072813 - DNA, 18 bp, Homo sapiens
ctgtcaccctccacctct

SEQ ID NO: 2072814 - DNA, 13 bp, Homo sapiens
ctgtcaccctggc

SEQ ID NO: 2072815 - DNA, 17 bp, Homo sapiens
ctgtcaccctggcccca

SEQ ID NO: 2072816 - DNA, 16 bp, Homo sapiens
ctgtcacgtgaaatat

SEQ ID NO: 2072817 - DNA, 13 bp, Homo sapiens
ctgtcactgtggg

SEQ ID NO: 2072818 - DNA, 18 bp, Homo sapiens
ctgtcagagctgttggcc

SEQ ID NO: 2072819 - DNA, 21 bp, Homo sapiens
ctgtcagagctgttggcctcg

SEQ ID NO: 2072820 - DNA, 12 bp, Homo sapiens
ctgtcagaggct

SEQ ID NO: 2072821 - DNA, 12 bp, Homo sapiens
ctgtcagccagc

SEQ ID NO: 2072822 - DNA, 21 bp, Homo sapiens
ctgtcaggacaccagcctggt

SEQ ID NO: 2072823 - DNA, 16 bp, Homo sapiens
ctgtcatagaaattac

SEQ ID NO: 2072824 - DNA, 18 bp, Homo sapiens
ctgtcatctagccccttc

SEQ ID NO: 2072825 - DNA, 15 bp, Homo sapiens
ctgtcattgtccatg

SEQ ID NO: 2072826 - DNA, 22 bp, Homo sapiens
ctgtcatttgagcagggctcag

SEQ ID NO: 2072827 - DNA, 23 bp, Homo sapiens
ctgtcatttgagcagggctcagc

SEQ ID NO: 2072828 - DNA, 12 bp, Homo sapiens
ctgtccaggaca

SEQ ID NO: 2072829 - DNA, 20 bp, Homo sapiens
ctgtccaggcactgctgccc

SEQ ID NO: 2072830 - DNA, 21 bp, Homo sapiens
ctgtccaggcactgctgccca

SEQ ID NO: 2072831 - DNA, 23 bp, Homo sapiens
ctgtccaggcactgctgcccagc

SEQ ID NO: 2072832 - DNA, 12 bp, Homo sapiens
ctgtccaggcca

SEQ ID NO: 2072833 - DNA, 13 bp, Homo sapiens
ctgtccaggccac

SEQ ID NO: 2072834 - DNA, 20 bp, Homo sapiens
ctgtccaggccactgtggcc

SEQ ID NO: 2072835 - DNA, 22 bp, Homo sapiens
ctgtccagggccctgagctcgg

SEQ ID NO: 2072836 - DNA, 23 bp, Homo sapiens
ctgtccagggccctgagctcggt

SEQ ID NO: 2072837 - DNA, 16 bp, Homo sapiens
ctgtccagtttccaaa

SEQ ID NO: 2072838 - DNA, 21 bp, Homo sapiens
ctgtccatgtattcacacacc

SEQ ID NO: 2072839 - DNA, 22 bp, Homo sapiens
ctgtccatgtattcacacaccc

SEQ ID NO: 2072840 - DNA, 19 bp, Homo sapiens
ctgtcccaccgggagcctc

SEQ ID NO: 2072841 - DNA, 13 bp, Homo sapiens
ctgtcccacctct

SEQ ID NO: 2072842 - DNA, 13 bp, Homo sapiens
ctgtcccagagct

SEQ ID NO: 2072843 - DNA, 22 bp, Homo sapiens
ctgtccccacagcaggtgcctg

SEQ ID NO: 2072844 - DNA, 22 bp, Homo sapiens
ctgtcccccttggaggagggct

SEQ ID NO: 2072845 - DNA, 18 bp, Homo sapiens
ctgtcccggttcaccttg

SEQ ID NO: 2072846 - DNA, 13 bp, Homo sapiens
ctgtccctaccca

SEQ ID NO: 2072847 - DNA, 15 bp, Homo sapiens
ctgtccctacccact

SEQ ID NO: 2072848 - DNA, 16 bp, Homo sapiens
ctgtccctacccactc

SEQ ID NO: 2072849 - DNA, 19 bp, Homo sapiens
ctgtccctacccactcttt

SEQ ID NO: 2072850 - DNA, 23 bp, Homo sapiens
ctgtccctacccactctttgcta

SEQ ID NO: 2072851 - DNA, 15 bp, Homo sapiens
ctgtccctcaaatga

SEQ ID NO: 2072852 - DNA, 18 bp, Homo sapiens
ctgtccctcactgccttc

SEQ ID NO: 2072853 - DNA, 14 bp, Homo sapiens
ctgtccctgcctca

SEQ ID NO: 2072854 - DNA, 12 bp, Homo sapiens
ctgtccctgtca

SEQ ID NO: 2072855 - DNA, 15 bp, Homo sapiens
ctgtccctgtcacca

SEQ ID NO: 2072856 - DNA, 19 bp, Homo sapiens
ctgtcccttcccccataag

SEQ ID NO: 2072857 - DNA, 18 bp, Homo sapiens
ctgtccgtttactccaag

SEQ ID NO: 2072858 - DNA, 11 bp, Homo sapiens
ctgtcctccag

SEQ ID NO: 2072859 - DNA, 23 bp, Homo sapiens
ctgtcctcctcggatcaccgaga

SEQ ID NO: 2072860 - DNA, 17 bp, Homo sapiens
ctgtcctctcgagccca

SEQ ID NO: 2072861 - DNA, 18 bp, Homo sapiens
ctgtcctctcgagcccag

SEQ ID NO: 2072862 - DNA, 13 bp, Homo sapiens
ctgtcctgggagt

SEQ ID NO: 2072863 - DNA, 20 bp, Homo sapiens
ctgtcctggtacagcagggt

SEQ ID NO: 2072864 - DNA, 14 bp, Homo sapiens
ctgtcgagacactt

SEQ ID NO: 2072865 - DNA, 13 bp, Homo sapiens
ctgtcgcccagtc

SEQ ID NO: 2072866 - DNA, 15 bp, Homo sapiens
ctgtcgcccagtctg

SEQ ID NO: 2072867 - DNA, 20 bp, Homo sapiens
ctgtcgccccaggccctccc

SEQ ID NO: 2072868 - DNA, 19 bp, Homo sapiens
ctgtcgtgtttacaaaagg

SEQ ID NO: 2072869 - DNA, 15 bp, Homo sapiens
ctgtctcgagcgccc

SEQ ID NO: 2072870 - DNA, 20 bp, Homo sapiens
ctgtctcgagcgccctgcag

SEQ ID NO: 2072871 - DNA, 22 bp, Homo sapiens
ctgtctcgagcgccctgcagac

SEQ ID NO: 2072872 - DNA, 17 bp, Homo sapiens
ctgtctctagccacttt

SEQ ID NO: 2072873 - DNA, 20 bp, Homo sapiens
ctgtctctagtttctttctg

SEQ ID NO: 2072874 - DNA, 11 bp, Homo sapiens
ctgtctctctt

SEQ ID NO: 2072875 - DNA, 15 bp, Homo sapiens
ctgtctctcttgctt

SEQ ID NO: 2072876 - DNA, 14 bp, Homo sapiens
ctgtctctgctctt

SEQ ID NO: 2072877 - DNA, 12 bp, Homo sapiens
ctgtctctgtcc

SEQ ID NO: 2072878 - DNA, 19 bp, Homo sapiens
ctgtctctgtccctcactg

SEQ ID NO: 2072879 - DNA, 15 bp, Homo sapiens
ctgtctgccagccag

SEQ ID NO: 2072880 - DNA, 16 bp, Homo sapiens
ctgtctggctgtacgt

SEQ ID NO: 2072881 - DNA, 18 bp, Homo sapiens
ctgtctggttttaacaat

SEQ ID NO: 2072882 - DNA, 18 bp, Homo sapiens
ctgtctgtaagagaattc

SEQ ID NO: 2072883 - DNA, 14 bp, Homo sapiens
ctgtctgtacctaa

SEQ ID NO: 2072884 - DNA, 19 bp, Homo sapiens
ctgtctgtcaccagctatc

SEQ ID NO: 2072885 - DNA, 17 bp, Homo sapiens
ctgtctgtcctggaggt

SEQ ID NO: 2072886 - DNA, 15 bp, Homo sapiens
ctgtctgtctgtccc

SEQ ID NO: 2072887 - DNA, 16 bp, Homo sapiens
ctgtctgtctgtccca

SEQ ID NO: 2072888 - DNA, 12 bp, Homo sapiens
ctgtctgtggct

SEQ ID NO: 2072889 - DNA, 19 bp, Homo sapiens
ctgtcttatggcgttgcag

SEQ ID NO: 2072890 - DNA, 13 bp, Homo sapiens
ctgtcttgccagc

SEQ ID NO: 2072891 - DNA, 15 bp, Homo sapiens
ctgtctttcagcatt

SEQ ID NO: 2072892 - DNA, 17 bp, Homo sapiens
ctgtctttcagcattca

SEQ ID NO: 2072893 - DNA, 15 bp, Homo sapiens
ctgtgaacccaggac

SEQ ID NO: 2072894 - DNA, 16 bp, Homo sapiens
ctgtgaacccaggaca

SEQ ID NO: 2072895 - DNA, 18 bp, Homo sapiens
ctgtgatgctttgaagta

SEQ ID NO: 2072896 - DNA, 19 bp, Homo sapiens
ctgtgatggggtgggcagg

SEQ ID NO: 2072897 - DNA, 16 bp, Homo sapiens
ctgtgcaaatccttga

SEQ ID NO: 2072898 - DNA, 17 bp, Homo sapiens
ctgtgcacggccagctg

SEQ ID NO: 2072899 - DNA, 17 bp, Homo sapiens
ctgtgcactagcctgtg

SEQ ID NO: 2072900 - DNA, 18 bp, Homo sapiens
ctgtgcactagcctgtga

SEQ ID NO: 2072901 - DNA, 15 bp, Homo sapiens
ctgtgcagatgagca

SEQ ID NO: 2072902 - DNA, 17 bp, Homo sapiens
ctgtgcagatgagcagt

SEQ ID NO: 2072903 - DNA, 23 bp, Homo sapiens
ctgtgcagatgagcagtcacact

SEQ ID NO: 2072904 - DNA, 15 bp, Homo sapiens
ctgtgcagcagccca

SEQ ID NO: 2072905 - DNA, 16 bp, Homo sapiens
ctgtgcagcagcccag

SEQ ID NO: 2072906 - DNA, 19 bp, Homo sapiens
ctgtgcagcagcccagctt

SEQ ID NO: 2072907 - DNA, 20 bp, Homo sapiens
ctgtgcagcagcccagcttc

SEQ ID NO: 2072908 - DNA, 24 bp, Homo sapiens
ctgtgcagcagcccagcttcctgg

SEQ ID NO: 2072909 - DNA, 15 bp, Homo sapiens
ctgtgcagggaggag

SEQ ID NO: 2072910 - DNA, 22 bp, Homo sapiens
ctgtgcagggaggaggtggcag

SEQ ID NO: 2072911 - DNA, 19 bp, Homo sapiens
ctgtgcagtcccgtggagg

SEQ ID NO: 2072912 - DNA, 21 bp, Homo sapiens
ctgtgcagtcccgtggagggt

SEQ ID NO: 2072913 - DNA, 14 bp, Homo sapiens
ctgtgcatgacctg

SEQ ID NO: 2072914 - DNA, 15 bp, Homo sapiens
ctgtgcatgtatgtc

SEQ ID NO: 2072915 - DNA, 16 bp, Homo sapiens
ctgtgcatgtatgtct

SEQ ID NO: 2072916 - DNA, 17 bp, Homo sapiens
ctgtgcatgtatgtctt

SEQ ID NO: 2072917 - DNA, 16 bp, Homo sapiens
ctgtgccacctgcaag

SEQ ID NO: 2072918 - DNA, 15 bp, Homo sapiens
ctgtgccagagcctg

SEQ ID NO: 2072919 - DNA, 11 bp, Homo sapiens
ctgtgccagct

SEQ ID NO: 2072920 - DNA, 14 bp, Homo sapiens
ctgtgccatgtgcc

SEQ ID NO: 2072921 - DNA, 15 bp, Homo sapiens
ctgtgccatgtgcca

SEQ ID NO: 2072922 - DNA, 19 bp, Homo sapiens
ctgtgcccacatcccaggc

SEQ ID NO: 2072923 - DNA, 15 bp, Homo sapiens
ctgtgcccctcagag

SEQ ID NO: 2072924 - DNA, 14 bp, Homo sapiens
ctgtgcccctgtaa

SEQ ID NO: 2072925 - DNA, 16 bp, Homo sapiens
ctgtgcccctgtaaat

SEQ ID NO: 2072926 - DNA, 17 bp, Homo sapiens
ctgtgcctcgctcccca

SEQ ID NO: 2072927 - DNA, 22 bp, Homo sapiens
ctgtgcctcgctccccactctg

SEQ ID NO: 2072928 - DNA, 23 bp, Homo sapiens
ctgtgcctcgctccccactctgc

SEQ ID NO: 2072929 - DNA, 14 bp, Homo sapiens
ctgtgcctctgcct

SEQ ID NO: 2072930 - DNA, 17 bp, Homo sapiens
ctgtgcctctgcctgtc

SEQ ID NO: 2072931 - DNA, 21 bp, Homo sapiens
ctgtgcctgctagagcaaccc

SEQ ID NO: 2072932 - DNA, 11 bp, Homo sapiens
ctgtgcctttg

SEQ ID NO: 2072933 - DNA, 17 bp, Homo sapiens
ctgtgcgttactaattg

SEQ ID NO: 2072934 - DNA, 16 bp, Homo sapiens
ctgtgcgttttagagt

SEQ ID NO: 2072935 - DNA, 24 bp, Homo sapiens
ctgtgctaaagaagccctgctggg

SEQ ID NO: 2072936 - DNA, 14 bp, Homo sapiens
ctgtgctactttgc

SEQ ID NO: 2072937 - DNA, 16 bp, Homo sapiens
ctgtgctactttgcct

SEQ ID NO: 2072938 - DNA, 18 bp, Homo sapiens
ctgtgctactttgccttt

SEQ ID NO: 2072939 - DNA, 16 bp, Homo sapiens
ctgtgctcttttggtg

SEQ ID NO: 2072940 - DNA, 22 bp, Homo sapiens
ctgtgctgcccgtcttcagcct

SEQ ID NO: 2072941 - DNA, 12 bp, Homo sapiens
ctgtgctgtgcc

SEQ ID NO: 2072942 - DNA, 17 bp, Homo sapiens
ctgtgctgtgcctgcta

SEQ ID NO: 2072943 - DNA, 18 bp, Homo sapiens
ctgtgctgtgcctgctag

SEQ ID NO: 2072944 - DNA, 19 bp, Homo sapiens
ctgtgctgtgcctgctaga

SEQ ID NO: 2072945 - DNA, 17 bp, Homo sapiens
ctgtgcttcaattaata

SEQ ID NO: 2072946 - DNA, 16 bp, Homo sapiens
ctgtgctttgactcac

SEQ ID NO: 2072947 - DNA, 17 bp, Homo sapiens
ctgtgcttttaaatgca

SEQ ID NO: 2072948 - DNA, 14 bp, Homo sapiens
ctgtggaaaaatat

SEQ ID NO: 2072949 - DNA, 12 bp, Homo sapiens
ctgtggaggcct

SEQ ID NO: 2072950 - DNA, 15 bp, Homo sapiens
ctgtggaggcctgat

SEQ ID NO: 2072951 - DNA, 18 bp, Homo sapiens
ctgtggaggcctgatgct

SEQ ID NO: 2072952 - DNA, 22 bp, Homo sapiens
ctgtggcacagacttctggaag

SEQ ID NO: 2072953 - DNA, 20 bp, Homo sapiens
ctgtggcagaccgggggcca

SEQ ID NO: 2072954 - DNA, 21 bp, Homo sapiens
ctgtggcagaccgggggccag

SEQ ID NO: 2072955 - DNA, 22 bp, Homo sapiens
ctgtggcagaccgggggccaga

SEQ ID NO: 2072956 - DNA, 15 bp, Homo sapiens
ctgtggcaggcctag

SEQ ID NO: 2072957 - DNA, 21 bp, Homo sapiens
ctgtggcaggcctaggacctc

SEQ ID NO: 2072958 - DNA, 14 bp, Homo sapiens
ctgtggccagagct

SEQ ID NO: 2072959 - DNA, 15 bp, Homo sapiens
ctgtggccagagctg

SEQ ID NO: 2072960 - DNA, 19 bp, Homo sapiens
ctgtggcctgtgtccagca

SEQ ID NO: 2072961 - DNA, 21 bp, Homo sapiens
ctgtggcctgtgtccagcagc

SEQ ID NO: 2072962 - DNA, 14 bp, Homo sapiens
ctgtggccttgccc

SEQ ID NO: 2072963 - DNA, 17 bp, Homo sapiens
ctgtggccttgcccgcc

SEQ ID NO: 2072964 - DNA, 15 bp, Homo sapiens
ctgtggcggtgcctg

SEQ ID NO: 2072965 - DNA, 18 bp, Homo sapiens
ctgtggcgttctgctgcc

SEQ ID NO: 2072966 - DNA, 12 bp, Homo sapiens
ctgtggctcctg

SEQ ID NO: 2072967 - DNA, 14 bp, Homo sapiens
ctgtggctcctgcc

SEQ ID NO: 2072968 - DNA, 17 bp, Homo sapiens
ctgtggctcctgccttg

SEQ ID NO: 2072969 - DNA, 16 bp, Homo sapiens
ctgtgggagcctcgca

SEQ ID NO: 2072970 - DNA, 17 bp, Homo sapiens
ctgtgggcagcaccctc

SEQ ID NO: 2072971 - DNA, 21 bp, Homo sapiens
ctgtgggcagcaccctccccc

SEQ ID NO: 2072972 - DNA, 14 bp, Homo sapiens
ctgtgggccaggag

SEQ ID NO: 2072973 - DNA, 21 bp, Homo sapiens
ctgtggggaaccaattgcttt

SEQ ID NO: 2072974 - DNA, 17 bp, Homo sapiens
ctgtgggggtggccatc

SEQ ID NO: 2072975 - DNA, 21 bp, Homo sapiens
ctgtgggggtggccatccctg

SEQ ID NO: 2072976 - DNA, 15 bp, Homo sapiens
ctgtgggtagtatga

SEQ ID NO: 2072977 - DNA, 23 bp, Homo sapiens
ctgtgggtgtagattacctgcca

SEQ ID NO: 2072978 - DNA, 14 bp, Homo sapiens
ctgtggtcatgtaa

SEQ ID NO: 2072979 - DNA, 13 bp, Homo sapiens
ctgtggtcttgga

SEQ ID NO: 2072980 - DNA, 17 bp, Homo sapiens
ctgtggtgactgaacga

SEQ ID NO: 2072981 - DNA, 20 bp, Homo sapiens
ctgtggtgggaacattcgag

SEQ ID NO: 2072982 - DNA, 19 bp, Homo sapiens
ctgtggttcctaagcctgt

SEQ ID NO: 2072983 - DNA, 15 bp, Homo sapiens
ctgtggttgcatttg

SEQ ID NO: 2072984 - DNA, 18 bp, Homo sapiens
ctgtgtaacctccacagt

SEQ ID NO: 2072985 - DNA, 21 bp, Homo sapiens
ctgtgtacagaattctgctac

SEQ ID NO: 2072986 - DNA, 15 bp, Homo sapiens
ctgtgtacccactcc

SEQ ID NO: 2072987 - DNA, 15 bp, Homo sapiens
ctgtgtactgcagtt

SEQ ID NO: 2072988 - DNA, 21 bp, Homo sapiens
ctgtgtagactcctgcttctt

SEQ ID NO: 2072989 - DNA, 17 bp, Homo sapiens
ctgtgtgaattcccagg

SEQ ID NO: 2072990 - DNA, 21 bp, Homo sapiens
ctgtgtgagcatctctgtgta

SEQ ID NO: 2072991 - DNA, 18 bp, Homo sapiens
ctgtgtgatgaactttct

SEQ ID NO: 2072992 - DNA, 16 bp, Homo sapiens
ctgtgtgcacaaatat

SEQ ID NO: 2072993 - DNA, 17 bp, Homo sapiens
ctgtgtgcagtgaaggt

SEQ ID NO: 2072994 - DNA, 23 bp, Homo sapiens
ctgtgtgctcctccttggtgcct

SEQ ID NO: 2072995 - DNA, 13 bp, Homo sapiens
ctgtgtggggagg

SEQ ID NO: 2072996 - DNA, 17 bp, Homo sapiens
ctgtgtggggaggcagc

SEQ ID NO: 2072997 - DNA, 19 bp, Homo sapiens
ctgtgtgggtctggggagg

SEQ ID NO: 2072998 - DNA, 15 bp, Homo sapiens
ctgtgtggtatattt

SEQ ID NO: 2072999 - DNA, 14 bp, Homo sapiens
ctgtgttcagtgcc

SEQ ID NO: 2073000 - DNA, 17 bp, Homo sapiens
ctgtgttcttgctgagc

SEQ ID NO: 2073001 - DNA, 20 bp, Homo sapiens
ctgtgttcttgctgagcacc

SEQ ID NO: 2073002 - DNA, 20 bp, Homo sapiens
ctgtgttgcgtgtcgtgggt

SEQ ID NO: 2073003 - DNA, 17 bp, Homo sapiens
ctgtgtttcttgcctca

SEQ ID NO: 2073004 - DNA, 15 bp, Homo sapiens
ctgttaaaagatgaa

SEQ ID NO: 2073005 - DNA, 20 bp, Homo sapiens
ctgttaaaagatgaaaatat

SEQ ID NO: 2073006 - DNA, 21 bp, Homo sapiens
ctgttaaaagatgaaaatatt

SEQ ID NO: 2073007 - DNA, 17 bp, Homo sapiens
ctgttaaaatgtacact

SEQ ID NO: 2073008 - DNA, 18 bp, Homo sapiens
ctgttaaaatgtacactg

SEQ ID NO: 2073009 - DNA, 18 bp, Homo sapiens
ctgttaacgtcatctcag

SEQ ID NO: 2073010 - DNA, 18 bp, Homo sapiens
ctgttaagcaattccttt

SEQ ID NO: 2073011 - DNA, 13 bp, Homo sapiens
ctgttactccaca

SEQ ID NO: 2073012 - DNA, 12 bp, Homo sapiens
ctgttacttttt

SEQ ID NO: 2073013 - DNA, 13 bp, Homo sapiens
ctgttagtcattt

SEQ ID NO: 2073014 - DNA, 14 bp, Homo sapiens
ctgttagtcatttg

SEQ ID NO: 2073015 - DNA, 23 bp, Homo sapiens
ctgttattgcactatgaaaatca

SEQ ID NO: 2073016 - DNA, 23 bp, Homo sapiens
ctgttcaatgtttttaaaaatct

SEQ ID NO: 2073017 - DNA, 12 bp, Homo sapiens
ctgttcacagcc

SEQ ID NO: 2073018 - DNA, 18 bp, Homo sapiens
ctgttcaccttatgtatt

SEQ ID NO: 2073019 - DNA, 21 bp, Homo sapiens
ctgttcaccttatgtattatt

SEQ ID NO: 2073020 - DNA, 15 bp, Homo sapiens
ctgttcagctccagc

SEQ ID NO: 2073021 - DNA, 16 bp, Homo sapiens
ctgttcagctccagct

SEQ ID NO: 2073022 - DNA, 22 bp, Homo sapiens
ctgttcagctccagctcaccag

SEQ ID NO: 2073023 - DNA, 14 bp, Homo sapiens
ctgttccacttctc

SEQ ID NO: 2073024 - DNA, 17 bp, Homo sapiens
ctgttccacttctctag

SEQ ID NO: 2073025 - DNA, 18 bp, Homo sapiens
ctgttcccattcttgcat

SEQ ID NO: 2073026 - DNA, 21 bp, Homo sapiens
ctgttcccccgctggcagcca

SEQ ID NO: 2073027 - DNA, 12 bp, Homo sapiens
ctgttctcaaat

SEQ ID NO: 2073028 - DNA, 15 bp, Homo sapiens
ctgttctcagctccg

SEQ ID NO: 2073029 - DNA, 13 bp, Homo sapiens
ctgttctggagct

SEQ ID NO: 2073030 - DNA, 19 bp, Homo sapiens
ctgttctggagctgctgtt

SEQ ID NO: 2073031 - DNA, 15 bp, Homo sapiens
ctgttctgtgtgggt

SEQ ID NO: 2073032 - DNA, 15 bp, Homo sapiens
ctgttgagctgtttt

SEQ ID NO: 2073033 - DNA, 23 bp, Homo sapiens
ctgttgagtgcaacaagagcaaa

SEQ ID NO: 2073034 - DNA, 17 bp, Homo sapiens
ctgttgatgaggcctct

SEQ ID NO: 2073035 - DNA, 17 bp, Homo sapiens
ctgttgcactgatgtcc

SEQ ID NO: 2073036 - DNA, 17 bp, Homo sapiens
ctgttgcccaggctggc

SEQ ID NO: 2073037 - DNA, 20 bp, Homo sapiens
ctgttgcccaggctggcctg

SEQ ID NO: 2073038 - DNA, 16 bp, Homo sapiens
ctgttgctgaagtcat

SEQ ID NO: 2073039 - DNA, 19 bp, Homo sapiens
ctgttgctggactgaggac

SEQ ID NO: 2073040 - DNA, 19 bp, Homo sapiens
ctgttggacagctgcttgt

SEQ ID NO: 2073041 - DNA, 12 bp, Homo sapiens
ctgttggccagt

SEQ ID NO: 2073042 - DNA, 17 bp, Homo sapiens
ctgttggcctcgcctgg

SEQ ID NO: 2073043 - DNA, 14 bp, Homo sapiens
ctgttggctggggg

SEQ ID NO: 2073044 - DNA, 19 bp, Homo sapiens
ctgttggttagctggacat

SEQ ID NO: 2073045 - DNA, 14 bp, Homo sapiens
ctgttgtaaatgac

SEQ ID NO: 2073046 - DNA, 18 bp, Homo sapiens
ctgttgtaaatgaccaag

SEQ ID NO: 2073047 - DNA, 22 bp, Homo sapiens
ctgttgttccttcacatttaag

SEQ ID NO: 2073048 - DNA, 23 bp, Homo sapiens
ctgttgttgaggtggtggtagtg

SEQ ID NO: 2073049 - DNA, 15 bp, Homo sapiens
ctgttgttgcaggga

SEQ ID NO: 2073050 - DNA, 13 bp, Homo sapiens
ctgttgttgttaa

SEQ ID NO: 2073051 - DNA, 16 bp, Homo sapiens
ctgttgttttgtttta

SEQ ID NO: 2073052 - DNA, 20 bp, Homo sapiens
ctgttgttttgttttaaata

SEQ ID NO: 2073053 - DNA, 23 bp, Homo sapiens
ctgtttaaaaaaagtatatattc

SEQ ID NO: 2073054 - DNA, 18 bp, Homo sapiens
ctgtttaatatttaaaca

SEQ ID NO: 2073055 - DNA, 20 bp, Homo sapiens
ctgtttaatatttaaacagc

SEQ ID NO: 2073056 - DNA, 17 bp, Homo sapiens
ctgtttataaaaacaaa

SEQ ID NO: 2073057 - DNA, 21 bp, Homo sapiens
ctgtttatataattttgcagc

SEQ ID NO: 2073058 - DNA, 21 bp, Homo sapiens
ctgtttccataggaatcatgt

SEQ ID NO: 2073059 - DNA, 13 bp, Homo sapiens
ctgtttcctttta

SEQ ID NO: 2073060 - DNA, 13 bp, Homo sapiens
ctgttttaataat

SEQ ID NO: 2073061 - DNA, 12 bp, Homo sapiens
ctgttttcttct

SEQ ID NO: 2073062 - DNA, 18 bp, Homo sapiens
ctgttttcttctattcca

SEQ ID NO: 2073063 - DNA, 15 bp, Homo sapiens
ctgttttgtatatga

SEQ ID NO: 2073064 - DNA, 23 bp, Homo sapiens
ctgttttgtcctttgagaaagaa

SEQ ID NO: 2073065 - DNA, 17 bp, Homo sapiens
ctgtttttaaaaatcat

SEQ ID NO: 2073066 - DNA, 22 bp, Homo sapiens
ctgtttttgaagaagggaaatt

SEQ ID NO: 2073067 - DNA, 18 bp, Homo sapiens
cttaaaaaacttgtaaat

SEQ ID NO: 2073068 - DNA, 17 bp, Homo sapiens
cttaaaaaataaaaact

SEQ ID NO: 2073069 - DNA, 16 bp, Homo sapiens
cttaaaaagtaattgt

SEQ ID NO: 2073070 - DNA, 20 bp, Homo sapiens
cttaaaatacggtacctggc

SEQ ID NO: 2073071 - DNA, 13 bp, Homo sapiens
cttaaaatagaaa

SEQ ID NO: 2073072 - DNA, 17 bp, Homo sapiens
cttaaaatatatttcag

SEQ ID NO: 2073073 - DNA, 18 bp, Homo sapiens
cttaaaatattcctgcat

SEQ ID NO: 2073074 - DNA, 13 bp, Homo sapiens
cttaaaatatttt

SEQ ID NO: 2073075 - DNA, 14 bp, Homo sapiens
cttaaacctgggag

SEQ ID NO: 2073076 - DNA, 21 bp, Homo sapiens
cttaaagaaagtcgaattaat

SEQ ID NO: 2073077 - DNA, 18 bp, Homo sapiens
cttaaagctgcctgtagt

SEQ ID NO: 2073078 - DNA, 13 bp, Homo sapiens
cttaaaggaaaag

SEQ ID NO: 2073079 - DNA, 17 bp, Homo sapiens
cttaaaggaaaagtcaa

SEQ ID NO: 2073080 - DNA, 19 bp, Homo sapiens
cttaaaggaaaagtcaaca

SEQ ID NO: 2073081 - DNA, 20 bp, Homo sapiens
cttaaaggcaccatctaata

SEQ ID NO: 2073082 - DNA, 15 bp, Homo sapiens
cttaaaggcctggaa

SEQ ID NO: 2073083 - DNA, 16 bp, Homo sapiens
cttaaaggcctggaac

SEQ ID NO: 2073084 - DNA, 12 bp, Homo sapiens
cttaaataaatt

SEQ ID NO: 2073085 - DNA, 14 bp, Homo sapiens
cttaaataaattca

SEQ ID NO: 2073086 - DNA, 17 bp, Homo sapiens
cttaaataagaaacttt

SEQ ID NO: 2073087 - DNA, 22 bp, Homo sapiens
cttaaatattgaataagtattc

SEQ ID NO: 2073088 - DNA, 15 bp, Homo sapiens
cttaacatatttact

SEQ ID NO: 2073089 - DNA, 19 bp, Homo sapiens
ctgcccagtgcacttgctg

SEQ ID NO: 2073090 - DNA, 17 bp, Homo sapiens
ctgcccatacccctgcc

SEQ ID NO: 2073091 - DNA, 14 bp, Homo sapiens
ctgccccaactcct

SEQ ID NO: 2073092 - DNA, 15 bp, Homo sapiens
ctgccccaagcagcc

SEQ ID NO: 2073093 - DNA, 20 bp, Homo sapiens
ctgccccaagcagccagcca

SEQ ID NO: 2073094 - DNA, 17 bp, Homo sapiens
ctgccccaaggggccca

SEQ ID NO: 2073095 - DNA, 15 bp, Homo sapiens
ctgccccaccagcca

SEQ ID NO: 2073096 - DNA, 11 bp, Homo sapiens
ctgccccaccc

SEQ ID NO: 2073097 - DNA, 14 bp, Homo sapiens
ctgccccagccccg

SEQ ID NO: 2073098 - DNA, 14 bp, Homo sapiens
ctgccccagcgcgg

SEQ ID NO: 2073099 - DNA, 20 bp, Homo sapiens
ctgccccagcgcggcttggc

SEQ ID NO: 2073100 - DNA, 22 bp, Homo sapiens
ctgccccagcgcggcttggccg

SEQ ID NO: 2073101 - DNA, 23 bp, Homo sapiens
ctgccccagcgcggcttggccgc

SEQ ID NO: 2073102 - DNA, 13 bp, Homo sapiens
ctgccccagctct

SEQ ID NO: 2073103 - DNA, 15 bp, Homo sapiens
ctgccccagctctgg

SEQ ID NO: 2073104 - DNA, 18 bp, Homo sapiens
ctgccccagtagtcagaa

SEQ ID NO: 2073105 - DNA, 20 bp, Homo sapiens
ctgccccatcctgggcctta

SEQ ID NO: 2073106 - DNA, 15 bp, Homo sapiens
ctgcccccagcactc

SEQ ID NO: 2073107 - DNA, 20 bp, Homo sapiens
ctgcccccagcactcctctg

SEQ ID NO: 2073108 - DNA, 19 bp, Homo sapiens
ctgcccccatctccccagg

SEQ ID NO: 2073109 - DNA, 20 bp, Homo sapiens
ctgcccccgtcttctctcca

SEQ ID NO: 2073110 - DNA, 12 bp, Homo sapiens
ctgccccctggt

SEQ ID NO: 2073111 - DNA, 17 bp, Homo sapiens
ctgccccgggtccccag

SEQ ID NO: 2073112 - DNA, 18 bp, Homo sapiens
ctgccccgggtccccagc

SEQ ID NO: 2073113 - DNA, 19 bp, Homo sapiens
ctgccccgggtccccagct

SEQ ID NO: 2073114 - DNA, 22 bp, Homo sapiens
ctgccccgggtccccagctccc

SEQ ID NO: 2073115 - DNA, 19 bp, Homo sapiens
ctgccccgggtgcctcaga

SEQ ID NO: 2073116 - DNA, 15 bp, Homo sapiens
ctgccccgttccctg

SEQ ID NO: 2073117 - DNA, 21 bp, Homo sapiens
ctgccccgttccctgtcagag

SEQ ID NO: 2073118 - DNA, 23 bp, Homo sapiens
ctgccccgttccctgtcagaggc

SEQ ID NO: 2073119 - DNA, 13 bp, Homo sapiens
ctgcccctccctt

SEQ ID NO: 2073120 - DNA, 14 bp, Homo sapiens
ctgcccctgcccca

SEQ ID NO: 2073121 - DNA, 16 bp, Homo sapiens
ctgccccttctgtttc

SEQ ID NO: 2073122 - DNA, 13 bp, Homo sapiens
ctgcccgcagagc

SEQ ID NO: 2073123 - DNA, 15 bp, Homo sapiens
ctgcccgcagagccc

SEQ ID NO: 2073124 - DNA, 21 bp, Homo sapiens
ctgccctagagcacactgtag

SEQ ID NO: 2073125 - DNA, 12 bp, Homo sapiens
ctgccctcaggg

SEQ ID NO: 2073126 - DNA, 13 bp, Homo sapiens
ctgccctcaggga

SEQ ID NO: 2073127 - DNA, 23 bp, Homo sapiens
ctgccctcccatgttgcatgcct

SEQ ID NO: 2073128 - DNA, 20 bp, Homo sapiens
ctgccctccctggcctcacg

SEQ ID NO: 2073129 - DNA, 17 bp, Homo sapiens
ctgccctctccttcctt

SEQ ID NO: 2073130 - DNA, 18 bp, Homo sapiens
ctgccctctccttcctta

SEQ ID NO: 2073131 - DNA, 14 bp, Homo sapiens
ctgccctctctcag

SEQ ID NO: 2073132 - DNA, 11 bp, Homo sapiens
ctgccctgcca

SEQ ID NO: 2073133 - DNA, 13 bp, Homo sapiens
ctgccctgccacc

SEQ ID NO: 2073134 - DNA, 14 bp, Homo sapiens
ctgccctgccacct

SEQ ID NO: 2073135 - DNA, 17 bp, Homo sapiens
ctgccctgccacctgtc

SEQ ID NO: 2073136 - DNA, 13 bp, Homo sapiens
ctgccctgcctgc

SEQ ID NO: 2073137 - DNA, 16 bp, Homo sapiens
ctgccctgcctgccca

SEQ ID NO: 2073138 - DNA, 18 bp, Homo sapiens
ctgccctgcctgcccact

SEQ ID NO: 2073139 - DNA, 22 bp, Homo sapiens
ctgccctgcgaagtggctctca

SEQ ID NO: 2073140 - DNA, 17 bp, Homo sapiens
ctgccctgctctgggga

SEQ ID NO: 2073141 - DNA, 12 bp, Homo sapiens
ctgccctggtgc

SEQ ID NO: 2073142 - DNA, 18 bp, Homo sapiens
ctgccctggtgctgccac

SEQ ID NO: 2073143 - DNA, 20 bp, Homo sapiens
ctgccctggtgctgccacac

SEQ ID NO: 2073144 - DNA, 23 bp, Homo sapiens
ctgccctggtgctgccacacttc

SEQ ID NO: 2073145 - DNA, 11 bp, Homo sapiens
ctgccctgtat

SEQ ID NO: 2073146 - DNA, 22 bp, Homo sapiens
ctgccctgtcctccagcttccc

SEQ ID NO: 2073147 - DNA, 15 bp, Homo sapiens
ctgcccttcgctgcc

SEQ ID NO: 2073148 - DNA, 23 bp, Homo sapiens
ctgcccttgtttggggcaggagt

SEQ ID NO: 2073149 - DNA, 13 bp, Homo sapiens
ctgccgaccagag

SEQ ID NO: 2073150 - DNA, 15 bp, Homo sapiens
ctgccgcctcccagc

SEQ ID NO: 2073151 - DNA, 16 bp, Homo sapiens
ctgccgcctcccagcc

SEQ ID NO: 2073152 - DNA, 16 bp, Homo sapiens
ctgccgctgcaccacg

SEQ ID NO: 2073153 - DNA, 14 bp, Homo sapiens
ctgccgggttctag

SEQ ID NO: 2073154 - DNA, 23 bp, Homo sapiens
ctgccgggttctagtctcctttg

SEQ ID NO: 2073155 - DNA, 18 bp, Homo sapiens
ctgccggtcacccaggct

SEQ ID NO: 2073156 - DNA, 15 bp, Homo sapiens
ctgcctaaggaggag

SEQ ID NO: 2073157 - DNA, 18 bp, Homo sapiens
ctgcctaagtggctgctg

SEQ ID NO: 2073158 - DNA, 11 bp, Homo sapiens
ctgcctaataa

SEQ ID NO: 2073159 - DNA, 15 bp, Homo sapiens
ctgcctaataaagag

SEQ ID NO: 2073160 - DNA, 14 bp, Homo sapiens
ctgcctacatccca

SEQ ID NO: 2073161 - DNA, 15 bp, Homo sapiens
ctgctctagccagga

SEQ ID NO: 2073162 - DNA, 16 bp, Homo sapiens
ctgctctagccaggag

SEQ ID NO: 2073163 - DNA, 14 bp, Homo sapiens
ctgctctcagcctc

SEQ ID NO: 2073164 - DNA, 16 bp, Homo sapiens
ctgctctcagcctccc

SEQ ID NO: 2073165 - DNA, 18 bp, Homo sapiens
ctgctctcagcctcccaa

SEQ ID NO: 2073166 - DNA, 19 bp, Homo sapiens
ctgctctccgaccagacac

SEQ ID NO: 2073167 - DNA, 20 bp, Homo sapiens
ctgctctcctcttgccactg

SEQ ID NO: 2073168 - DNA, 18 bp, Homo sapiens
ctgctctcttcaggaggc

SEQ ID NO: 2073169 - DNA, 19 bp, Homo sapiens
ctgctctgaggcttccaga

SEQ ID NO: 2073170 - DNA, 23 bp, Homo sapiens
ctgctctgagttatgttaaaatc

SEQ ID NO: 2073171 - DNA, 18 bp, Homo sapiens
ctgctctgatgcatcaga

SEQ ID NO: 2073172 - DNA, 12 bp, Homo sapiens
ctgctctggtta

SEQ ID NO: 2073173 - DNA, 18 bp, Homo sapiens
ctgctcttagtgcccgcc

SEQ ID NO: 2073174 - DNA, 13 bp, Homo sapiens
ctgctcttgcctg

SEQ ID NO: 2073175 - DNA, 16 bp, Homo sapiens
ctgctgaagttctgag

SEQ ID NO: 2073176 - DNA, 18 bp, Homo sapiens
ctgctgaagttctgagcc

SEQ ID NO: 2073177 - DNA, 15 bp, Homo sapiens
ctgctgacagacaca

SEQ ID NO: 2073178 - DNA, 19 bp, Homo sapiens
ctgctgacagacacaggcc

SEQ ID NO: 2073179 - DNA, 20 bp, Homo sapiens
ctgctgacagacacaggccc

SEQ ID NO: 2073180 - DNA, 23 bp, Homo sapiens
ctgctgacagacacaggcccggc

SEQ ID NO: 2073181 - DNA, 21 bp, Homo sapiens
ctgctgacaggatgtggcact

SEQ ID NO: 2073182 - DNA, 11 bp, Homo sapiens
ctgctgacagt

SEQ ID NO: 2073183 - DNA, 21 bp, Homo sapiens
ctgctgacctgatcacctctg

SEQ ID NO: 2073184 - DNA, 17 bp, Homo sapiens
ctgctgagaacctggcc

SEQ ID NO: 2073185 - DNA, 13 bp, Homo sapiens
ctgctgagctctg

SEQ ID NO: 2073186 - DNA, 15 bp, Homo sapiens
ctgctgagctctgag

SEQ ID NO: 2073187 - DNA, 17 bp, Homo sapiens
ctgctgagctctgagag

SEQ ID NO: 2073188 - DNA, 14 bp, Homo sapiens
ctgctgcaaagtgc

SEQ ID NO: 2073189 - DNA, 16 bp, Homo sapiens
ctgctgcaccagagtg

SEQ ID NO: 2073190 - DNA, 19 bp, Homo sapiens
ctgctgccccgcttcccca

SEQ ID NO: 2073191 - DNA, 17 bp, Homo sapiens
ctgctgccgcctcccag

SEQ ID NO: 2073192 - DNA, 21 bp, Homo sapiens
ctgctgccgcctcccagcctg

SEQ ID NO: 2073193 - DNA, 14 bp, Homo sapiens
ctgctgcctaataa

SEQ ID NO: 2073194 - DNA, 17 bp, Homo sapiens
ctgctgcctaataaaga

SEQ ID NO: 2073195 - DNA, 17 bp, Homo sapiens
ctgctgcggcgaccgcc

SEQ ID NO: 2073196 - DNA, 23 bp, Homo sapiens
ctgctgctaaggctctatttcct

SEQ ID NO: 2073197 - DNA, 10 bp, Homo sapiens
ctgctgctgt

SEQ ID NO: 2073198 - DNA, 14 bp, Homo sapiens
ctgctggaaaccac

SEQ ID NO: 2073199 - DNA, 12 bp, Homo sapiens
ctgctggcctgg

SEQ ID NO: 2073200 - DNA, 13 bp, Homo sapiens
ctgctggcctggc

SEQ ID NO: 2073201 - DNA, 16 bp, Homo sapiens
ctgctggcctggccgg

SEQ ID NO: 2073202 - DNA, 12 bp, Homo sapiens
ctgctggctgcc

SEQ ID NO: 2073203 - DNA, 13 bp, Homo sapiens
ctgctggctgcct

SEQ ID NO: 2073204 - DNA, 18 bp, Homo sapiens
ctgctgggaaccccgcag

SEQ ID NO: 2073205 - DNA, 19 bp, Homo sapiens
ctgctgggaaccccgcagc

SEQ ID NO: 2073206 - DNA, 20 bp, Homo sapiens
ctgctgggaaccccgcagcc

SEQ ID NO: 2073207 - DNA, 23 bp, Homo sapiens
ctgctgggctctccacctcagcc

SEQ ID NO: 2073208 - DNA, 17 bp, Homo sapiens
ctgctggggcatgtgtg

SEQ ID NO: 2073209 - DNA, 18 bp, Homo sapiens
ctgctggggcatgtgtgc

SEQ ID NO: 2073210 - DNA, 19 bp, Homo sapiens
ctctcagcctcccaacccc

SEQ ID NO: 2073211 - DNA, 19 bp, Homo sapiens
ctctcaggagcacaggcag

SEQ ID NO: 2073212 - DNA, 12 bp, Homo sapiens
ctctcaggaggc

SEQ ID NO: 2073213 - DNA, 19 bp, Homo sapiens
ctctcaggaggcgcagccc

SEQ ID NO: 2073214 - DNA, 20 bp, Homo sapiens
ctctcaggaggcgcagcccg

SEQ ID NO: 2073215 - DNA, 21 bp, Homo sapiens
ctctcaggaggcgcagcccga

SEQ ID NO: 2073216 - DNA, 22 bp, Homo sapiens
ctctcaggaggcgcagcccgaa

SEQ ID NO: 2073217 - DNA, 18 bp, Homo sapiens
ctctcaggggccagtgag

SEQ ID NO: 2073218 - DNA, 13 bp, Homo sapiens
ctctcatgaacct

SEQ ID NO: 2073219 - DNA, 14 bp, Homo sapiens
ctctcatgaacctc

SEQ ID NO: 2073220 - DNA, 16 bp, Homo sapiens
ctctcatgcctgcctg

SEQ ID NO: 2073221 - DNA, 14 bp, Homo sapiens
ctctcattccccag

SEQ ID NO: 2073222 - DNA, 21 bp, Homo sapiens
ctctcattccccaggtggctg

SEQ ID NO: 2073223 - DNA, 16 bp, Homo sapiens
ctctcattctctttct

SEQ ID NO: 2073224 - DNA, 21 bp, Homo sapiens
ctctccaaatattattcaagt

SEQ ID NO: 2073225 - DNA, 16 bp, Homo sapiens
ctctccaacctggaca

SEQ ID NO: 2073226 - DNA, 17 bp, Homo sapiens
ctctccaattgtaaaaa

SEQ ID NO: 2073227 - DNA, 12 bp, Homo sapiens
ctctccacctca

SEQ ID NO: 2073228 - DNA, 14 bp, Homo sapiens
ctctccactgcctt

SEQ ID NO: 2073229 - DNA, 16 bp, Homo sapiens
ctctccactgccttcg

SEQ ID NO: 2073230 - DNA, 14 bp, Homo sapiens
ctctccagccttct

SEQ ID NO: 2073231 - DNA, 13 bp, Homo sapiens
ctctccaggcacc

SEQ ID NO: 2073232 - DNA, 14 bp, Homo sapiens
ctctccaggcacca

SEQ ID NO: 2073233 - DNA, 18 bp, Homo sapiens
ctctccaggcacccttct

SEQ ID NO: 2073234 - DNA, 16 bp, Homo sapiens
ctctccaggctgtttc

SEQ ID NO: 2073235 - DNA, 13 bp, Homo sapiens
ctctccatgccca

SEQ ID NO: 2073236 - DNA, 15 bp, Homo sapiens
ctctccatgcccaac

SEQ ID NO: 2073237 - DNA, 13 bp, Homo sapiens
ctctcccaccccg

SEQ ID NO: 2073238 - DNA, 15 bp, Homo sapiens
ctctcccaccccggc

SEQ ID NO: 2073239 - DNA, 13 bp, Homo sapiens
ctctcccaggccc

SEQ ID NO: 2073240 - DNA, 21 bp, Homo sapiens
ctctcccaggccccatgacct

SEQ ID NO: 2073241 - DNA, 19 bp, Homo sapiens
ctctcccataccatcactg

SEQ ID NO: 2073242 - DNA, 14 bp, Homo sapiens
ctctccccagcaag

SEQ ID NO: 2073243 - DNA, 24 bp, Homo sapiens
ctctccccagcaagtgagagctgg

SEQ ID NO: 2073244 - DNA, 15 bp, Homo sapiens
ctctcccctccctct

SEQ ID NO: 2073245 - DNA, 16 bp, Homo sapiens
ctctcccctccctctt

SEQ ID NO: 2073246 - DNA, 17 bp, Homo sapiens
ctctcccctccctcttc

SEQ ID NO: 2073247 - DNA, 17 bp, Homo sapiens
ctctcccctgccctgct

SEQ ID NO: 2073248 - DNA, 17 bp, Homo sapiens
ctctcccggctgcctgc

SEQ ID NO: 2073249 - DNA, 18 bp, Homo sapiens
ctctcccggctgcctgcc

SEQ ID NO: 2073250 - DNA, 13 bp, Homo sapiens
ctctccctctggc

SEQ ID NO: 2073251 - DNA, 21 bp, Homo sapiens
ctctccgaccagacaccttga

SEQ ID NO: 2073252 - DNA, 22 bp, Homo sapiens
ctctcctaccccacctcatgcc

SEQ ID NO: 2073253 - DNA, 14 bp, Homo sapiens
ctctcctcagactg

SEQ ID NO: 2073254 - DNA, 13 bp, Homo sapiens
ctctcctgcctac

SEQ ID NO: 2073255 - DNA, 22 bp, Homo sapiens
ctctcctggcttcccatcccca

SEQ ID NO: 2073256 - DNA, 23 bp, Homo sapiens
ctctcctgggggtggcaggcaca

SEQ ID NO: 2073257 - DNA, 12 bp, Homo sapiens
ctctcctgtcca

SEQ ID NO: 2073258 - DNA, 12 bp, Homo sapiens
ctctccttccct

SEQ ID NO: 2073259 - DNA, 17 bp, Homo sapiens
ctctccttccttaccca

SEQ ID NO: 2073260 - DNA, 16 bp, Homo sapiens
ctctccttcttccctg

SEQ ID NO: 2073261 - DNA, 21 bp, Homo sapiens
ctctccttgggctcctggctg

SEQ ID NO: 2073262 - DNA, 19 bp, Homo sapiens
ctctcctttggccattcca

SEQ ID NO: 2073263 - DNA, 23 bp, Homo sapiens
ctctcgatgccactcctgcttct

SEQ ID NO: 2073264 - DNA, 13 bp, Homo sapiens
ctctctaaaaata

SEQ ID NO: 2073265 - DNA, 17 bp, Homo sapiens
ctctctaaaaataaaat

SEQ ID NO: 2073266 - DNA, 22 bp, Homo sapiens
ctctctaaaaataaaatgatgt

SEQ ID NO: 2073267 - DNA, 22 bp, Homo sapiens
ctctctaaatcttccttgtgag

SEQ ID NO: 2073268 - DNA, 17 bp, Homo sapiens
ctctctaagccacagct

SEQ ID NO: 2073269 - DNA, 19 bp, Homo sapiens
ctctctactcctacctcag

SEQ ID NO: 2073270 - DNA, 22 bp, Homo sapiens
ctctctactcctacctcagcct

SEQ ID NO: 2073271 - DNA, 15 bp, Homo sapiens
ctctctcctgtccaa

SEQ ID NO: 2073272 - DNA, 20 bp, Homo sapiens
ctctctgcagccagcccagc

SEQ ID NO: 2073273 - DNA, 21 bp, Homo sapiens
ctctctgcagccagcccagcc

SEQ ID NO: 2073274 - DNA, 13 bp, Homo sapiens
ctctctgctccag

SEQ ID NO: 2073275 - DNA, 15 bp, Homo sapiens
ctctctgctccagag

SEQ ID NO: 2073276 - DNA, 16 bp, Homo sapiens
ctctctgctctagcca

SEQ ID NO: 2073277 - DNA, 17 bp, Homo sapiens
ctctctgctctagccag

SEQ ID NO: 2073278 - DNA, 18 bp, Homo sapiens
ctctctgctctagccagg

SEQ ID NO: 2073279 - DNA, 18 bp, Homo sapiens
ctctctggggccctgggc

SEQ ID NO: 2073280 - DNA, 22 bp, Homo sapiens
ctctctggggccctgggcctca

SEQ ID NO: 2073281 - DNA, 16 bp, Homo sapiens
ctctctgtataaacat

SEQ ID NO: 2073282 - DNA, 21 bp, Homo sapiens
ctctcttatagaatatttatt

SEQ ID NO: 2073283 - DNA, 23 bp, Homo sapiens
ctctcttcaggaggccctggtgt

SEQ ID NO: 2073284 - DNA, 22 bp, Homo sapiens
ctctcttccagaagatgccctc

SEQ ID NO: 2073285 - DNA, 14 bp, Homo sapiens
ctctcttgcctttc

SEQ ID NO: 2073286 - DNA, 23 bp, Homo sapiens
ctctgaaaagcaattgccctgta

SEQ ID NO: 2073287 - DNA, 20 bp, Homo sapiens
ctctgaaacttaattacatc

SEQ ID NO: 2073288 - DNA, 14 bp, Homo sapiens
ctctgaagcatgtt

SEQ ID NO: 2073289 - DNA, 15 bp, Homo sapiens
ctctgaaggacattg

SEQ ID NO: 2073290 - DNA, 22 bp, Homo sapiens
ctctgaaggacattgcggacag

SEQ ID NO: 2073291 - DNA, 13 bp, Homo sapiens
ctctgaagtcaca

SEQ ID NO: 2073292 - DNA, 15 bp, Homo sapiens
ctctgaatattttgt

SEQ ID NO: 2073293 - DNA, 18 bp, Homo sapiens
ctctgaatggtccagggt

SEQ ID NO: 2073294 - DNA, 14 bp, Homo sapiens
ctctgacaagggct

SEQ ID NO: 2073295 - DNA, 16 bp, Homo sapiens
ctctgacaagggctga

SEQ ID NO: 2073296 - DNA, 19 bp, Homo sapiens
ctctgacaagggctgacct

SEQ ID NO: 2073297 - DNA, 15 bp, Homo sapiens
ctctgactcttgcct

SEQ ID NO: 2073298 - DNA, 16 bp, Homo sapiens
ctctgactcttgcctt

SEQ ID NO: 2073299 - DNA, 17 bp, Homo sapiens
ctctgactcttgccttt

SEQ ID NO: 2073300 - DNA, 15 bp, Homo sapiens
ctctgagcccaggcc

SEQ ID NO: 2073301 - DNA, 18 bp, Homo sapiens
ctctgaggccagcctggc

SEQ ID NO: 2073302 - DNA, 20 bp, Homo sapiens
ctctgaggctctttctgggc

SEQ ID NO: 2073303 - DNA, 17 bp, Homo sapiens
ctctgagggagaggctg

SEQ ID NO: 2073304 - DNA, 12 bp, Homo sapiens
ctctgagtgtga

SEQ ID NO: 2073305 - DNA, 18 bp, Homo sapiens
ctctgattttcaaagctt

SEQ ID NO: 2073306 - DNA, 13 bp, Homo sapiens
ctctgcaaagact

SEQ ID NO: 2073307 - DNA, 20 bp, Homo sapiens
ctctgcaaagactagatcct

SEQ ID NO: 2073308 - DNA, 17 bp, Homo sapiens
ctctgcaatgggcactg

SEQ ID NO: 2073309 - DNA, 14 bp, Homo sapiens
ctctgcacatgtct

SEQ ID NO: 2073310 - DNA, 20 bp, Homo sapiens
ctctgcactccatggccacc

SEQ ID NO: 2073311 - DNA, 17 bp, Homo sapiens
ctctgcagccagcccag

SEQ ID NO: 2073312 - DNA, 18 bp, Homo sapiens
ctctgcagccagcccagc

SEQ ID NO: 2073313 - DNA, 13 bp, Homo sapiens
ctctgcatgtgtg

SEQ ID NO: 2073314 - DNA, 19 bp, Homo sapiens
ctctgccaccaccccataa

SEQ ID NO: 2073315 - DNA, 17 bp, Homo sapiens
ctctgccatgcccagag

SEQ ID NO: 2073316 - DNA, 18 bp, Homo sapiens
ctcttccagaagatgccc

SEQ ID NO: 2073317 - DNA, 22 bp, Homo sapiens
ctcttccagaagatgccctcca

SEQ ID NO: 2073318 - DNA, 14 bp, Homo sapiens
ctcttccagtttgc

SEQ ID NO: 2073319 - DNA, 20 bp, Homo sapiens
ctcttccgtgacgtcactgg

SEQ ID NO: 2073320 - DNA, 12 bp, Homo sapiens
ctcttcctcctg

SEQ ID NO: 2073321 - DNA, 22 bp, Homo sapiens
ctcttcctcctggttcaagcga

SEQ ID NO: 2073322 - DNA, 18 bp, Homo sapiens
ctcttcctggacctgagt

SEQ ID NO: 2073323 - DNA, 13 bp, Homo sapiens
ctcttccttcccc

SEQ ID NO: 2073324 - DNA, 20 bp, Homo sapiens
ctcttccttcccccatcccc

SEQ ID NO: 2073325 - DNA, 22 bp, Homo sapiens
ctcttccttcccccatcccctt

SEQ ID NO: 2073326 - DNA, 16 bp, Homo sapiens
ctcttctaacctcagc

SEQ ID NO: 2073327 - DNA, 15 bp, Homo sapiens
ctcttctaactcatg

SEQ ID NO: 2073328 - DNA, 21 bp, Homo sapiens
ctcttctatgcaagccttgct

SEQ ID NO: 2073329 - DNA, 17 bp, Homo sapiens
ctcttctatttaaaaaa

SEQ ID NO: 2073330 - DNA, 12 bp, Homo sapiens
ctcttctccagg

SEQ ID NO: 2073331 - DNA, 21 bp, Homo sapiens
ctcttctcttacgctctctgt

SEQ ID NO: 2073332 - DNA, 22 bp, Homo sapiens
ctcttcttattcatgctttctc

SEQ ID NO: 2073333 - DNA, 13 bp, Homo sapiens
ctcttgacctcag

SEQ ID NO: 2073334 - DNA, 16 bp, Homo sapiens
ctcttgacctcaggtg

SEQ ID NO: 2073335 - DNA, 16 bp, Homo sapiens
ctcttgaggccaggag

SEQ ID NO: 2073336 - DNA, 14 bp, Homo sapiens
ctcttgcaggctga

SEQ ID NO: 2073337 - DNA, 18 bp, Homo sapiens
ctcttgcaggctgagtcc

SEQ ID NO: 2073338 - DNA, 16 bp, Homo sapiens
ctcttgccactgcctc

SEQ ID NO: 2073339 - DNA, 19 bp, Homo sapiens
ctcttgccactgcctcttc

SEQ ID NO: 2073340 - DNA, 22 bp, Homo sapiens
ctcttgccactgcctcttcctc

SEQ ID NO: 2073341 - DNA, 20 bp, Homo sapiens
ctcttgcctgcacccttcct

SEQ ID NO: 2073342 - DNA, 21 bp, Homo sapiens
ctcttgcctgcacccttcctc

SEQ ID NO: 2073343 - DNA, 23 bp, Homo sapiens
ctcttgcctgcacccttcctcct

SEQ ID NO: 2073344 - DNA, 12 bp, Homo sapiens
ctcttggacctc

SEQ ID NO: 2073345 - DNA, 21 bp, Homo sapiens
ctcttggcattttcctcgcct

SEQ ID NO: 2073346 - DNA, 19 bp, Homo sapiens
ctcttgggttcaagcgatt

SEQ ID NO: 2073347 - DNA, 19 bp, Homo sapiens
ctcttgtgctcacgctccc

SEQ ID NO: 2073348 - DNA, 20 bp, Homo sapiens
ctctttaaaagaaagttagg

SEQ ID NO: 2073349 - DNA, 16 bp, Homo sapiens
ctctttaatcttcagt

SEQ ID NO: 2073350 - DNA, 19 bp, Homo sapiens
ctctttatttctagcagag

SEQ ID NO: 2073351 - DNA, 16 bp, Homo sapiens
ctctttcactcaggct

SEQ ID NO: 2073352 - DNA, 15 bp, Homo sapiens
ctctttctccctcac

SEQ ID NO: 2073353 - DNA, 16 bp, Homo sapiens
ctctttctctccttct

SEQ ID NO: 2073354 - DNA, 23 bp, Homo sapiens
ctctttctctccttcttccctgt

SEQ ID NO: 2073355 - DNA, 12 bp, Homo sapiens
ctctttctgggc

SEQ ID NO: 2073356 - DNA, 20 bp, Homo sapiens
ctctttcttattttgtaata

SEQ ID NO: 2073357 - DNA, 22 bp, Homo sapiens
ctctttcttattttgtaataaa

SEQ ID NO: 2073358 - DNA, 14 bp, Homo sapiens
ctctttcttctttg

SEQ ID NO: 2073359 - DNA, 17 bp, Homo sapiens
ctctttctttttctgtc

SEQ ID NO: 2073360 - DNA, 23 bp, Homo sapiens
ctctttctttttctgtctctctt

SEQ ID NO: 2073361 - DNA, 23 bp, Homo sapiens
ctctttgacgggaggcctcagtt

SEQ ID NO: 2073362 - DNA, 13 bp, Homo sapiens
ctctttgcctcaa

SEQ ID NO: 2073363 - DNA, 14 bp, Homo sapiens
ctctttgcctgtgt

SEQ ID NO: 2073364 - DNA, 16 bp, Homo sapiens
ctctttgcctgtgtga

SEQ ID NO: 2073365 - DNA, 15 bp, Homo sapiens
ctctttgctacaata

SEQ ID NO: 2073366 - DNA, 16 bp, Homo sapiens
ctctttgctacaataa

SEQ ID NO: 2073367 - DNA, 18 bp, Homo sapiens
ctctttgctacaataaat

SEQ ID NO: 2073368 - DNA, 12 bp, Homo sapiens
ctctttgtaaga

SEQ ID NO: 2073369 - DNA, 14 bp, Homo sapiens
ctcttttcaaaaca

SEQ ID NO: 2073370 - DNA, 16 bp, Homo sapiens
ctcttttccctctcta

SEQ ID NO: 2073371 - DNA, 23 bp, Homo sapiens
ctcttttgttcctggctttgaca

SEQ ID NO: 2073372 - DNA, 14 bp, Homo sapiens
ctgaaaaaaagttt

SEQ ID NO: 2073373 - DNA, 21 bp, Homo sapiens
ctgaaaaatggtaattgttgc

SEQ ID NO: 2073374 - DNA, 20 bp, Homo sapiens
ctgaaaacatttcaaagctg

SEQ ID NO: 2073375 - DNA, 19 bp, Homo sapiens
ctgaaaactggaataagaa

SEQ ID NO: 2073376 - DNA, 14 bp, Homo sapiens
ctgaaaactgtaaa

SEQ ID NO: 2073377 - DNA, 20 bp, Homo sapiens
ctgaaaactgtaaatacaaa

SEQ ID NO: 2073378 - DNA, 18 bp, Homo sapiens
ctgaaaataccatcaggc

SEQ ID NO: 2073379 - DNA, 17 bp, Homo sapiens
ctgaaaatctaatatta

SEQ ID NO: 2073380 - DNA, 12 bp, Homo sapiens
ctgaaaatgttg

SEQ ID NO: 2073381 - DNA, 21 bp, Homo sapiens
ctgaaaatgttgttatgctat

SEQ ID NO: 2073382 - DNA, 16 bp, Homo sapiens
ctgaaacacctcccag

SEQ ID NO: 2073383 - DNA, 18 bp, Homo sapiens
ctgaaacacctcccaggg

SEQ ID NO: 2073384 - DNA, 19 bp, Homo sapiens
ctgaaagaaacagttaact

SEQ ID NO: 2073385 - DNA, 13 bp, Homo sapiens
ctgaaagacagaa

SEQ ID NO: 2073386 - DNA, 18 bp, Homo sapiens
ctgaaagacagaatgtca

SEQ ID NO: 2073387 - DNA, 18 bp, Homo sapiens
ctgaaagcagcagctagg

SEQ ID NO: 2073388 - DNA, 12 bp, Homo sapiens
ctgaaagccacg

SEQ ID NO: 2073389 - DNA, 21 bp, Homo sapiens
ctgaaagccacgttccttact

SEQ ID NO: 2073390 - DNA, 23 bp, Homo sapiens
ctgaaagccagctgccgaccaga

SEQ ID NO: 2073391 - DNA, 16 bp, Homo sapiens
ctgaaagtgacagaga

SEQ ID NO: 2073392 - DNA, 18 bp, Homo sapiens
ctgaaagtgacagagacc

SEQ ID NO: 2073393 - DNA, 19 bp, Homo sapiens
ctgaaataaaagcctctgg

SEQ ID NO: 2073394 - DNA, 19 bp, Homo sapiens
ctgaaatctcagaattcct

SEQ ID NO: 2073395 - DNA, 18 bp, Homo sapiens
ctgaaatgaaacaaataa

SEQ ID NO: 2073396 - DNA, 21 bp, Homo sapiens
ctgaaatgaggagagaaggac

SEQ ID NO: 2073397 - DNA, 22 bp, Homo sapiens
ctgaaatgaggagagaaggaca

SEQ ID NO: 2073398 - DNA, 14 bp, Homo sapiens
ctgaaatttcccac

SEQ ID NO: 2073399 - DNA, 20 bp, Homo sapiens
ctgaacaaacactgaatcat

SEQ ID NO: 2073400 - DNA, 14 bp, Homo sapiens
ctgaacaagaattg

SEQ ID NO: 2073401 - DNA, 14 bp, Homo sapiens
ctgaacaatgaatg

SEQ ID NO: 2073402 - DNA, 16 bp, Homo sapiens
ctgaacaattctctct

SEQ ID NO: 2073403 - DNA, 14 bp, Homo sapiens
ctgaaccatccctg

SEQ ID NO: 2073404 - DNA, 16 bp, Homo sapiens
ctgaaccatccctgat

SEQ ID NO: 2073405 - DNA, 14 bp, Homo sapiens
ctgaaccccatggg

SEQ ID NO: 2073406 - DNA, 15 bp, Homo sapiens
ctgaaccccatgggc

SEQ ID NO: 2073407 - DNA, 16 bp, Homo sapiens
ctgaaccccatgggct

SEQ ID NO: 2073408 - DNA, 18 bp, Homo sapiens
ctgaaccccatgggcttg

SEQ ID NO: 2073409 - DNA, 19 bp, Homo sapiens
ctgaaccccatgggcttgg

SEQ ID NO: 2073410 - DNA, 20 bp, Homo sapiens
ctgaacccttgtgcttggtg

SEQ ID NO: 2073411 - DNA, 22 bp, Homo sapiens
ctgaacctggggtcatcgattc

SEQ ID NO: 2073412 - DNA, 16 bp, Homo sapiens
ctgaacgtcctgcagc

SEQ ID NO: 2073413 - DNA, 15 bp, Homo sapiens
ctgaagaaaatgaag

SEQ ID NO: 2073414 - DNA, 23 bp, Homo sapiens
ctgaagacaaaccactgtacata

SEQ ID NO: 2073415 - DNA, 22 bp, Homo sapiens
ctgaagaggcaagagacagaat

SEQ ID NO: 2073416 - DNA, 12 bp, Homo sapiens
ctgaagatctca

SEQ ID NO: 2073417 - DNA, 17 bp, Homo sapiens
ctgaagatttcagaggc

SEQ ID NO: 2073418 - DNA, 20 bp, Homo sapiens
ctgaagcatgtttcatgttt

SEQ ID NO: 2073419 - DNA, 16 bp, Homo sapiens
ctgaagccagatccac

SEQ ID NO: 2073420 - DNA, 16 bp, Homo sapiens
ctgaagcctatttatt

SEQ ID NO: 2073421 - DNA, 20 bp, Homo sapiens
ctgaagcctctgccctgcct

SEQ ID NO: 2073422 - DNA, 18 bp, Homo sapiens
ctgaagctttaccagctg

SEQ ID NO: 2073423 - DNA, 16 bp, Homo sapiens
ctgaaggaatagccag

SEQ ID NO: 2073424 - DNA, 21 bp, Homo sapiens
ctgaagtcacacagtgagtcg

SEQ ID NO: 2073425 - DNA, 22 bp, Homo sapiens
ctgaagtcattgtcgctcagca

SEQ ID NO: 2073426 - DNA, 20 bp, Homo sapiens
ctgaagtgaaggagaaagga

SEQ ID NO: 2073427 - DNA, 23 bp, Homo sapiens
ctgaagtgatgatggatgagaaa

SEQ ID NO: 2073428 - DNA, 12 bp, Homo sapiens
ctgaagtgcttg

SEQ ID NO: 2073429 - DNA, 15 bp, Homo sapiens
ctgaagttctgagcc

SEQ ID NO: 2073430 - DNA, 16 bp, Homo sapiens
ctgaataatttcttac

SEQ ID NO: 2073431 - DNA, 17 bp, Homo sapiens
ctgaatataggaagcat

SEQ ID NO: 2073432 - DNA, 14 bp, Homo sapiens
ctgaatattttgta

SEQ ID NO: 2073433 - DNA, 16 bp, Homo sapiens
ctgaatggtccagggt

SEQ ID NO: 2073434 - DNA, 18 bp, Homo sapiens
ctgaatggtccagggttg

SEQ ID NO: 2073435 - DNA, 16 bp, Homo sapiens
ctgaatgtttattcct

SEQ ID NO: 2073436 - DNA, 22 bp, Homo sapiens
ctgaattattttgttgtgattt

SEQ ID NO: 2073437 - DNA, 15 bp, Homo sapiens
ctgaatttattgccg

SEQ ID NO: 2073438 - DNA, 20 bp, Homo sapiens
ctgaatttcaggcattttgt

SEQ ID NO: 2073439 - DNA, 15 bp, Homo sapiens
ctgaatttgggcctc

SEQ ID NO: 2073440 - DNA, 22 bp, Homo sapiens
ctgaatttgtaagcaacttgct

SEQ ID NO: 2073441 - DNA, 16 bp, Homo sapiens
ctgaattttaaatgtt

SEQ ID NO: 2073442 - DNA, 11 bp, Homo sapiens
ctgaattttta

SEQ ID NO: 2073443 - DNA, 18 bp, Homo sapiens
ctgaatttttaaacaagt

SEQ ID NO: 2073444 - DNA, 14 bp, Homo sapiens
ctgacaagaagctc

SEQ ID NO: 2073445 - DNA, 18 bp, Homo sapiens
ctgacacacagctctgtc

SEQ ID NO: 2073446 - DNA, 20 bp, Homo sapiens
ctgacacacagctctgtcct

SEQ ID NO: 2073447 - DNA, 13 bp, Homo sapiens
ctgacacaggaaa

SEQ ID NO: 2073448 - DNA, 15 bp, Homo sapiens
ctgacacaggccagc

SEQ ID NO: 2073449 - DNA, 20 bp, Homo sapiens
ctgacacaggccagccccat

SEQ ID NO: 2073450 - DNA, 20 bp, Homo sapiens
ctgacaccgtccctcagtga

SEQ ID NO: 2073451 - DNA, 19 bp, Homo sapiens
ctgacacctcactgaggaa

SEQ ID NO: 2073452 - DNA, 18 bp, Homo sapiens
ctgacactaccttatcag

SEQ ID NO: 2073453 - DNA, 14 bp, Homo sapiens
ctgacagaaggact

SEQ ID NO: 2073454 - DNA, 12 bp, Homo sapiens
ctgacagacaca

SEQ ID NO: 2073455 - DNA, 16 bp, Homo sapiens
ctgacagacacaggcc

SEQ ID NO: 2073456 - DNA, 22 bp, Homo sapiens
ctgacaggatgtggcactgctt

SEQ ID NO: 2073457 - DNA, 18 bp, Homo sapiens
ctgacaggcaatgctggc

SEQ ID NO: 2073458 - DNA, 21 bp, Homo sapiens
ctgacaggttcccagcagctg

SEQ ID NO: 2073459 - DNA, 14 bp, Homo sapiens
ctgacatggctttg

SEQ ID NO: 2073460 - DNA, 22 bp, Homo sapiens
ctgaccacgctttctagctgtt

SEQ ID NO: 2073461 - DNA, 21 bp, Homo sapiens
ctgaccagcctccatgctgcc

SEQ ID NO: 2073462 - DNA, 17 bp, Homo sapiens
ctgacccaagaggtggg

SEQ ID NO: 2073463 - DNA, 11 bp, Homo sapiens
ctgacccactg

SEQ ID NO: 2073464 - DNA, 16 bp, Homo sapiens
ctgacccagagtggag

SEQ ID NO: 2073465 - DNA, 23 bp, Homo sapiens
ctgacccagagtggagtctgagt

SEQ ID NO: 2073466 - DNA, 15 bp, Homo sapiens
ctgacccagtccctg

SEQ ID NO: 2073467 - DNA, 17 bp, Homo sapiens
ctgacccagtccctggg

SEQ ID NO: 2073468 - DNA, 20 bp, Homo sapiens
ctgaccccaaagagcctgga

SEQ ID NO: 2073469 - DNA, 16 bp, Homo sapiens
ctgaccccctcccctg

SEQ ID NO: 2073470 - DNA, 18 bp, Homo sapiens
ctgaccctccaccgcaga

SEQ ID NO: 2073471 - DNA, 20 bp, Homo sapiens
ctgaccctcctccactccac

SEQ ID NO: 2073472 - DNA, 21 bp, Homo sapiens
ctgaccctggagcggctctcc

SEQ ID NO: 2073473 - DNA, 14 bp, Homo sapiens
ctgacccttccaga

SEQ ID NO: 2073474 - DNA, 17 bp, Homo sapiens
ctgacccttccagacat

SEQ ID NO: 2073475 - DNA, 14 bp, Homo sapiens
ctgaccggcacctg

SEQ ID NO: 2073476 - DNA, 20 bp, Homo sapiens
ctgacctcaccggcatgctg

SEQ ID NO: 2073477 - DNA, 23 bp, Homo sapiens
ctgacctcaccggcatgctggcc

SEQ ID NO: 2073478 - DNA, 13 bp, Homo sapiens
ctgacctcccagc

SEQ ID NO: 2073479 - DNA, 17 bp, Homo sapiens
ctgacctcccagcccta

SEQ ID NO: 2073480 - DNA, 18 bp, Homo sapiens
ctgacctgcctctcacac

SEQ ID NO: 2073481 - DNA, 12 bp, Homo sapiens
ctgacctgtttt

SEQ ID NO: 2073482 - DNA, 19 bp, Homo sapiens
ctgacctgtttttgtgttt

SEQ ID NO: 2073483 - DNA, 21 bp, Homo sapiens
ctgacctttgtcatctttctt

SEQ ID NO: 2073484 - DNA, 22 bp, Homo sapiens
ctgacggaagccaacttggctt

SEQ ID NO: 2073485 - DNA, 23 bp, Homo sapiens
ctgacggaagccaacttggcttt

SEQ ID NO: 2073486 - DNA, 15 bp, Homo sapiens
ctgactcacaagaag

SEQ ID NO: 2073487 - DNA, 17 bp, Homo sapiens
ctgactcacaagaagac

SEQ ID NO: 2073488 - DNA, 21 bp, Homo sapiens
ctgactcacaagaagaccaga

SEQ ID NO: 2073489 - DNA, 20 bp, Homo sapiens
ctgactccagagtctgagcc

SEQ ID NO: 2073490 - DNA, 21 bp, Homo sapiens
ctgactccagtgagctggaat

SEQ ID NO: 2073491 - DNA, 16 bp, Homo sapiens
ctgactccctgtgggg

SEQ ID NO: 2073492 - DNA, 21 bp, Homo sapiens
ctgactccctgtgggggtggc

SEQ ID NO: 2073493 - DNA, 14 bp, Homo sapiens
ctgactctctgtga

SEQ ID NO: 2073494 - DNA, 12 bp, Homo sapiens
ctgactcttgcc

SEQ ID NO: 2073495 - DNA, 17 bp, Homo sapiens
ctgactcttgcctttcc

SEQ ID NO: 2073496 - DNA, 14 bp, Homo sapiens
ctgactgacacagg

SEQ ID NO: 2073497 - DNA, 16 bp, Homo sapiens
ctgactgacacaggcc

SEQ ID NO: 2073498 - DNA, 18 bp, Homo sapiens
ctgactgacacaggccag

SEQ ID NO: 2073499 - DNA, 18 bp, Homo sapiens
ctgactgtgttcagtgcc

SEQ ID NO: 2073500 - DNA, 15 bp, Homo sapiens
ctgacttctaagtaa

SEQ ID NO: 2073501 - DNA, 15 bp, Homo sapiens
ctgactttgctcttt

SEQ ID NO: 2073502 - DNA, 16 bp, Homo sapiens
ctgactttgctctttc

SEQ ID NO: 2073503 - DNA, 12 bp, Homo sapiens
ctgagaaagact

SEQ ID NO: 2073504 - DNA, 23 bp, Homo sapiens
ctgagaaagactattcaaacagt

SEQ ID NO: 2073505 - DNA, 16 bp, Homo sapiens
ctgagaacctggcctt

SEQ ID NO: 2073506 - DNA, 17 bp, Homo sapiens
ctgagaacctggccttc

SEQ ID NO: 2073507 - DNA, 12 bp, Homo sapiens
ctgagaagaagc

SEQ ID NO: 2073508 - DNA, 17 bp, Homo sapiens
ctgagaagaagctgagg

SEQ ID NO: 2073509 - DNA, 16 bp, Homo sapiens
ctgagaagtgtatata

SEQ ID NO: 2073510 - DNA, 22 bp, Homo sapiens
ctgagaccagttgggagcactg

SEQ ID NO: 2073511 - DNA, 15 bp, Homo sapiens
ctgagacggcagaga

SEQ ID NO: 2073512 - DNA, 17 bp, Homo sapiens
ctgagactccagaatct

SEQ ID NO: 2073513 - DNA, 20 bp, Homo sapiens
ctgagactggcacttagccc

SEQ ID NO: 2073514 - DNA, 21 bp, Homo sapiens
ctgagactttcagtgcactgt

SEQ ID NO: 2073515 - DNA, 20 bp, Homo sapiens
ctgagagacccaaggaggaa

SEQ ID NO: 2073516 - DNA, 18 bp, Homo sapiens
ctgagagacttttaatca

SEQ ID NO: 2073517 - DNA, 22 bp, Homo sapiens
ctgagagcagatggtcctccat

SEQ ID NO: 2073518 - DNA, 12 bp, Homo sapiens
ctgagagccctg

SEQ ID NO: 2073519 - DNA, 14 bp, Homo sapiens
ctgagagccctgct

SEQ ID NO: 2073520 - DNA, 20 bp, Homo sapiens
ctgagagccctgctgtggga

SEQ ID NO: 2073521 - DNA, 22 bp, Homo sapiens
ctgagaggacttttctttgtgg

SEQ ID NO: 2073522 - DNA, 13 bp, Homo sapiens
ctgagaggccctg

SEQ ID NO: 2073523 - DNA, 15 bp, Homo sapiens
ctgagaggccctgga

SEQ ID NO: 2073524 - DNA, 16 bp, Homo sapiens
ctgagaggccctggat

SEQ ID NO: 2073525 - DNA, 23 bp, Homo sapiens
ctgagccaaacacactgtaaata

SEQ ID NO: 2073526 - DNA, 15 bp, Homo sapiens
ctgagcccagccacc

SEQ ID NO: 2073527 - DNA, 16 bp, Homo sapiens
ctgagcccagccacct

SEQ ID NO: 2073528 - DNA, 11 bp, Homo sapiens
ctgagcccagg

SEQ ID NO: 2073529 - DNA, 13 bp, Homo sapiens
ctgagcccaggcc

SEQ ID NO: 2073530 - DNA, 15 bp, Homo sapiens
ctgagcccagggagg

SEQ ID NO: 2073531 - DNA, 17 bp, Homo sapiens
ctgagcccagggaggcc

SEQ ID NO: 2073532 - DNA, 17 bp, Homo sapiens
ctgagcccccggctagt

SEQ ID NO: 2073533 - DNA, 11 bp, Homo sapiens
ctgagccctgg

SEQ ID NO: 2073534 - DNA, 16 bp, Homo sapiens
ctgagcctgacctttc

SEQ ID NO: 2073535 - DNA, 12 bp, Homo sapiens
ctgagcctgccg

SEQ ID NO: 2073536 - DNA, 13 bp, Homo sapiens
ctgagcctgccga

SEQ ID NO: 2073537 - DNA, 12 bp, Homo sapiens
ctgagccttcag

SEQ ID NO: 2073538 - DNA, 17 bp, Homo sapiens
ctgagccttcagtcttg

SEQ ID NO: 2073539 - DNA, 16 bp, Homo sapiens
ctgagccttgtaattc

SEQ ID NO: 2073540 - DNA, 20 bp, Homo sapiens
ctgagctcacaaggcagcaa

SEQ ID NO: 2073541 - DNA, 22 bp, Homo sapiens
ctgagctcacaaggcagcaagg

SEQ ID NO: 2073542 - DNA, 23 bp, Homo sapiens
ctgagctcacaaggcagcaaggc

SEQ ID NO: 2073543 - DNA, 14 bp, Homo sapiens
ctgagctcaggctg

SEQ ID NO: 2073544 - DNA, 18 bp, Homo sapiens
ctgagctcaggctgagcc

SEQ ID NO: 2073545 - DNA, 22 bp, Homo sapiens
ctgagctcaggctgagcccagc

SEQ ID NO: 2073546 - DNA, 14 bp, Homo sapiens
ctgagctctgagag

SEQ ID NO: 2073547 - DNA, 16 bp, Homo sapiens
ctgagctctgagaggc

SEQ ID NO: 2073548 - DNA, 17 bp, Homo sapiens
ctgagctctgagaggcc

SEQ ID NO: 2073549 - DNA, 20 bp, Homo sapiens
ctgagctctgagaggccctg

SEQ ID NO: 2073550 - DNA, 22 bp, Homo sapiens
ctgagctctgagaggccctgga

SEQ ID NO: 2073551 - DNA, 23 bp, Homo sapiens
ctgagctggcattggtctgctga

SEQ ID NO: 2073552 - DNA, 12 bp, Homo sapiens
ctgagctggggc

SEQ ID NO: 2073553 - DNA, 13 bp, Homo sapiens
ctgagctggggcc

SEQ ID NO: 2073554 - DNA, 16 bp, Homo sapiens
ctgagctggggccaca

SEQ ID NO: 2073555 - DNA, 17 bp, Homo sapiens
ctgagcttagccttgtg

SEQ ID NO: 2073556 - DNA, 21 bp, Homo sapiens
ctgagcttagccttgtgccct

SEQ ID NO: 2073557 - DNA, 14 bp, Homo sapiens
ctgagcttggccct

SEQ ID NO: 2073558 - DNA, 20 bp, Homo sapiens
ctgagcttttcatggaagtg

SEQ ID NO: 2073559 - DNA, 13 bp, Homo sapiens
ctgaggaagaagg

SEQ ID NO: 2073560 - DNA, 17 bp, Homo sapiens
ctgaggaatccagaccc

SEQ ID NO: 2073561 - DNA, 21 bp, Homo sapiens
ctgaggacatggagagagact

SEQ ID NO: 2073562 - DNA, 14 bp, Homo sapiens
ctgaggaccagcca

SEQ ID NO: 2073563 - DNA, 16 bp, Homo sapiens
ctgaggactccctcca

SEQ ID NO: 2073564 - DNA, 15 bp, Homo sapiens
ctgaggactggagac

SEQ ID NO: 2073565 - DNA, 11 bp, Homo sapiens
ctgaggagaaa

SEQ ID NO: 2073566 - DNA, 14 bp, Homo sapiens
ctgaggagtagctg

SEQ ID NO: 2073567 - DNA, 19 bp, Homo sapiens
ctgaggagtagctgagagg

SEQ ID NO: 2073568 - DNA, 20 bp, Homo sapiens
ctgaggagtagctgagagga

SEQ ID NO: 2073569 - DNA, 21 bp, Homo sapiens
ctgaggagtattaagaatgca

SEQ ID NO: 2073570 - DNA, 22 bp, Homo sapiens
ctgaggagtattaagaatgcag

SEQ ID NO: 2073571 - DNA, 16 bp, Homo sapiens
ctgaggagtctgaggt

SEQ ID NO: 2073572 - DNA, 17 bp, Homo sapiens
ctgaggagtctgaggtc

SEQ ID NO: 2073573 - DNA, 20 bp, Homo sapiens
ctgaggagtctgaggtcctg

SEQ ID NO: 2073574 - DNA, 19 bp, Homo sapiens
ctgaggatcctcacaggag

SEQ ID NO: 2073575 - DNA, 22 bp, Homo sapiens
ctgaggatcctcacaggagcag

SEQ ID NO: 2073576 - DNA, 23 bp, Homo sapiens
ctgaggatcctcacaggagcaga

SEQ ID NO: 2073577 - DNA, 14 bp, Homo sapiens
ctgaggatgacaga

SEQ ID NO: 2073578 - DNA, 14 bp, Homo sapiens
ctgaggatttcaag

SEQ ID NO: 2073579 - DNA, 14 bp, Homo sapiens
ctgaggcagacagc

SEQ ID NO: 2073580 - DNA, 17 bp, Homo sapiens
ctgaggcagacagcagc

SEQ ID NO: 2073581 - DNA, 11 bp, Homo sapiens
ctgaggcagga

SEQ ID NO: 2073582 - DNA, 14 bp, Homo sapiens
ctgaggccagcctg

SEQ ID NO: 2073583 - DNA, 17 bp, Homo sapiens
ctgaggccagcctggcc

SEQ ID NO: 2073584 - DNA, 18 bp, Homo sapiens
ctgaggccagcctggcct

SEQ ID NO: 2073585 - DNA, 23 bp, Homo sapiens
ctgaggccagcctggcctcctgc

SEQ ID NO: 2073586 - DNA, 19 bp, Homo sapiens
ctgaggcctaaaagtaaac

SEQ ID NO: 2073587 - DNA, 17 bp, Homo sapiens
ctgaggcctcatccctc

SEQ ID NO: 2073588 - DNA, 13 bp, Homo sapiens
ctgaggctcaaga

SEQ ID NO: 2073589 - DNA, 18 bp, Homo sapiens
ctgaggctcaagaggccc

SEQ ID NO: 2073590 - DNA, 19 bp, Homo sapiens
ctgaggctcaagaggccca

SEQ ID NO: 2073591 - DNA, 20 bp, Homo sapiens
ctgaggctcctgtgctactt

SEQ ID NO: 2073592 - DNA, 22 bp, Homo sapiens
ctgaggctctgacccagtgaga

SEQ ID NO: 2073593 - DNA, 20 bp, Homo sapiens
ctgaggctctttctgggcca

SEQ ID NO: 2073594 - DNA, 14 bp, Homo sapiens
ctgaggcttccaga

SEQ ID NO: 2073595 - DNA, 11 bp, Homo sapiens
ctgagggagag

SEQ ID NO: 2073596 - DNA, 12 bp, Homo sapiens
ctgagggagaga

SEQ ID NO: 2073597 - DNA, 16 bp, Homo sapiens
ctgagggagagactct

SEQ ID NO: 2073598 - DNA, 12 bp, Homo sapiens
ctgagggcagtt

SEQ ID NO: 2073599 - DNA, 19 bp, Homo sapiens
ctgagggcagttcgcagcc

SEQ ID NO: 2073600 - DNA, 21 bp, Homo sapiens
ctgagggcattaaaaatagta

SEQ ID NO: 2073601 - DNA, 14 bp, Homo sapiens
ctgagggccacact

SEQ ID NO: 2073602 - DNA, 15 bp, Homo sapiens
ctgagggccacacta

SEQ ID NO: 2073603 - DNA, 18 bp, Homo sapiens
ctgagggtccccacctgg

SEQ ID NO: 2073604 - DNA, 19 bp, Homo sapiens
ctgagggtccccacctggg

SEQ ID NO: 2073605 - DNA, 20 bp, Homo sapiens
ctgagggtccccacctggga

SEQ ID NO: 2073606 - DNA, 19 bp, Homo sapiens
ctgagggtggagactaagc

SEQ ID NO: 2073607 - DNA, 15 bp, Homo sapiens
ctgaggtcctgagca

SEQ ID NO: 2073608 - DNA, 16 bp, Homo sapiens
ctgaggtcctgagcac

SEQ ID NO: 2073609 - DNA, 15 bp, Homo sapiens
ctgaggtgcccagga

SEQ ID NO: 2073610 - DNA, 19 bp, Homo sapiens
ctgagtaaattggaaacat

SEQ ID NO: 2073611 - DNA, 17 bp, Homo sapiens
ctgagtcaactggagca

SEQ ID NO: 2073612 - DNA, 16 bp, Homo sapiens
ctgagtcaagttgttc

SEQ ID NO: 2073613 - DNA, 17 bp, Homo sapiens
ctgagtcaggacttgaa

SEQ ID NO: 2073614 - DNA, 20 bp, Homo sapiens
ctgagtcatgatctccctgc

SEQ ID NO: 2073615 - DNA, 19 bp, Homo sapiens
ctgagtccctccatgcaaa

SEQ ID NO: 2073616 - DNA, 16 bp, Homo sapiens
ctgagtccgggaggca

SEQ ID NO: 2073617 - DNA, 18 bp, Homo sapiens
ctgagtcctgtctctgcc

SEQ ID NO: 2073618 - DNA, 21 bp, Homo sapiens
ctgagtcctgtctctgcctgc

SEQ ID NO: 2073619 - DNA, 18 bp, Homo sapiens
ctcctacagcactccacc

SEQ ID NO: 2073620 - DNA, 20 bp, Homo sapiens
ctcctacagcactccacctt

SEQ ID NO: 2073621 - DNA, 16 bp, Homo sapiens
ctcctacctcagccta

SEQ ID NO: 2073622 - DNA, 16 bp, Homo sapiens
ctcctactttacactc

SEQ ID NO: 2073623 - DNA, 16 bp, Homo sapiens
ctcctagaggtgggca

SEQ ID NO: 2073624 - DNA, 17 bp, Homo sapiens
ctcctagaggtgggcag

SEQ ID NO: 2073625 - DNA, 21 bp, Homo sapiens
ctcctagaggtgggcagctgg

SEQ ID NO: 2073626 - DNA, 23 bp, Homo sapiens
ctcctagaggtgggcagctgggc

SEQ ID NO: 2073627 - DNA, 14 bp, Homo sapiens
ctcctaggagaagc

SEQ ID NO: 2073628 - DNA, 16 bp, Homo sapiens
ctcctatcttctccat

SEQ ID NO: 2073629 - DNA, 22 bp, Homo sapiens
ctcctatggaaaagggtcttct

SEQ ID NO: 2073630 - DNA, 15 bp, Homo sapiens
ctcctatttatgaaa

SEQ ID NO: 2073631 - DNA, 15 bp, Homo sapiens
ctcctcacccccagc

SEQ ID NO: 2073632 - DNA, 20 bp, Homo sapiens
ctcctcacccccagctttgc

SEQ ID NO: 2073633 - DNA, 17 bp, Homo sapiens
ctcctcactgccccacc

SEQ ID NO: 2073634 - DNA, 13 bp, Homo sapiens
ctcctccacagtg

SEQ ID NO: 2073635 - DNA, 20 bp, Homo sapiens
ctcctccacagtgctgcttc

SEQ ID NO: 2073636 - DNA, 19 bp, Homo sapiens
ctcctccagggccacgtgc

SEQ ID NO: 2073637 - DNA, 22 bp, Homo sapiens
ctcctccagggccacgtgccag

SEQ ID NO: 2073638 - DNA, 20 bp, Homo sapiens
ctcctcccacaatctgggac

SEQ ID NO: 2073639 - DNA, 12 bp, Homo sapiens
ctccttggagga

SEQ ID NO: 2073640 - DNA, 19 bp, Homo sapiens
ctccttgggctcctggctg

SEQ ID NO: 2073641 - DNA, 14 bp, Homo sapiens
ctccttggtgcctg

SEQ ID NO: 2073642 - DNA, 18 bp, Homo sapiens
ctccttgtggtttatgtc

SEQ ID NO: 2073643 - DNA, 16 bp, Homo sapiens
ctcctttagcgcccag

SEQ ID NO: 2073644 - DNA, 15 bp, Homo sapiens
ctcctttattgcagt

SEQ ID NO: 2073645 - DNA, 17 bp, Homo sapiens
ctcctttcacaaccttc

SEQ ID NO: 2073646 - DNA, 17 bp, Homo sapiens
ctcctttctccagccag

SEQ ID NO: 2073647 - DNA, 19 bp, Homo sapiens
ctcctttctccagccagca

SEQ ID NO: 2073648 - DNA, 21 bp, Homo sapiens
ctcctttctccagccagcaat

SEQ ID NO: 2073649 - DNA, 23 bp, Homo sapiens
ctcctttctctatcccaagccaa

SEQ ID NO: 2073650 - DNA, 21 bp, Homo sapiens
ctcctttgcattccatgattt

SEQ ID NO: 2073651 - DNA, 11 bp, Homo sapiens
ctcctttgcct

SEQ ID NO: 2073652 - DNA, 17 bp, Homo sapiens
ctccttttgtccccagg

SEQ ID NO: 2073653 - DNA, 19 bp, Homo sapiens
ctcgaaccaaggcagcctc

SEQ ID NO: 2073654 - DNA, 23 bp, Homo sapiens
ctcgaaccaaggcagcctccaga

SEQ ID NO: 2073655 - DNA, 14 bp, Homo sapiens
ctcgaactggctgc

SEQ ID NO: 2073656 - DNA, 17 bp, Homo sapiens
ctcccatggccttccct

SEQ ID NO: 2073657 - DNA, 21 bp, Homo sapiens
ctcccatgttgcatgcctatg

SEQ ID NO: 2073658 - DNA, 12 bp, Homo sapiens
ctccccaaaaac

SEQ ID NO: 2073659 - DNA, 16 bp, Homo sapiens
ctccccacacgtgctc

SEQ ID NO: 2073660 - DNA, 23 bp, Homo sapiens
ctccccacacgtgctcgcagcct

SEQ ID NO: 2073661 - DNA, 13 bp, Homo sapiens
ctccccacagtcc

SEQ ID NO: 2073662 - DNA, 22 bp, Homo sapiens
ctccccacagtcctcacagcct

SEQ ID NO: 2073663 - DNA, 15 bp, Homo sapiens
ctccccaccttcccc

SEQ ID NO: 2073664 - DNA, 16 bp, Homo sapiens
ctccccacgagtcacc

SEQ ID NO: 2073665 - DNA, 22 bp, Homo sapiens
ctccccacgagtcacctgcaag

SEQ ID NO: 2073666 - DNA, 12 bp, Homo sapiens
ctccccactcta

SEQ ID NO: 2073667 - DNA, 13 bp, Homo sapiens
ctccccactctag

SEQ ID NO: 2073668 - DNA, 22 bp, Homo sapiens
ctccccagcaagtgagagctgg

SEQ ID NO: 2073669 - DNA, 14 bp, Homo sapiens
ctccccagcccttt

SEQ ID NO: 2073670 - DNA, 21 bp, Homo sapiens
ctccccaggccaggccaccag

SEQ ID NO: 2073671 - DNA, 15 bp, Homo sapiens
ctccccaggcctcca

SEQ ID NO: 2073672 - DNA, 17 bp, Homo sapiens
ctccccaggcctccagc

SEQ ID NO: 2073673 - DNA, 14 bp, Homo sapiens
ctccccatcccatg

SEQ ID NO: 2073674 - DNA, 21 bp, Homo sapiens
ctccccattagagtcagcctt

SEQ ID NO: 2073675 - DNA, 15 bp, Homo sapiens
ctccccattcacaga

SEQ ID NO: 2073676 - DNA, 19 bp, Homo sapiens
ctcccccaccccctcccca

SEQ ID NO: 2073677 - DNA, 16 bp, Homo sapiens
ctcccccacctgacaa

SEQ ID NO: 2073678 - DNA, 14 bp, Homo sapiens
ctccccccactgca

SEQ ID NO: 2073679 - DNA, 19 bp, Homo sapiens
ctcccccgacactgctgca

SEQ ID NO: 2073680 - DNA, 12 bp, Homo sapiens
ctccccctcaga

SEQ ID NO: 2073681 - DNA, 16 bp, Homo sapiens
ctccccctgctgctca

SEQ ID NO: 2073682 - DNA, 23 bp, Homo sapiens
ctccccctgggctctgccccagc

SEQ ID NO: 2073683 - DNA, 22 bp, Homo sapiens
ctcatatgcgtcccaagcagcc

SEQ ID NO: 2073684 - DNA, 21 bp, Homo sapiens
ctcatatgctatgttagaagt

SEQ ID NO: 2073685 - DNA, 20 bp, Homo sapiens
ctcatatgtagccctcatga

SEQ ID NO: 2073686 - DNA, 12 bp, Homo sapiens
ctcatattttgt

SEQ ID NO: 2073687 - DNA, 16 bp, Homo sapiens
ctcatattttgtatat

SEQ ID NO: 2073688 - DNA, 14 bp, Homo sapiens
ctcatcaacaaaga

SEQ ID NO: 2073689 - DNA, 15 bp, Homo sapiens
ctcatcactggatga

SEQ ID NO: 2073690 - DNA, 24 bp, Homo sapiens
ctcatcagtgtcctcttgctcaaa

SEQ ID NO: 2073691 - DNA, 20 bp, Homo sapiens
ctcatcccctcgtcctgtcc

SEQ ID NO: 2073692 - DNA, 14 bp, Homo sapiens
ctcatccgaggcag

SEQ ID NO: 2073693 - DNA, 17 bp, Homo sapiens
ctcatccgaggcagggt

SEQ ID NO: 2073694 - DNA, 14 bp, Homo sapiens
ctcatcctccttct

SEQ ID NO: 2073695 - DNA, 15 bp, Homo sapiens
ctcatcctgtgtggg

SEQ ID NO: 2073696 - DNA, 19 bp, Homo sapiens
ctcatcctgtgtggggagg

SEQ ID NO: 2073697 - DNA, 19 bp, Homo sapiens
ctcatctactcattgtctc

SEQ ID NO: 2073698 - DNA, 12 bp, Homo sapiens
ctcatctcactg

SEQ ID NO: 2073699 - DNA, 18 bp, Homo sapiens
ctcatctcagtgaagaat

SEQ ID NO: 2073700 - DNA, 12 bp, Homo sapiens
ctcatgaacctc

SEQ ID NO: 2073701 - DNA, 19 bp, Homo sapiens
ctcatgaccctcctgtcca

SEQ ID NO: 2073702 - DNA, 20 bp, Homo sapiens
ctcatgaccctcctgtccag

SEQ ID NO: 2073703 - DNA, 21 bp, Homo sapiens
ctcatgaccctcctgtccagc

SEQ ID NO: 2073704 - DNA, 22 bp, Homo sapiens
ctcatgaccctcctgtccagca

SEQ ID NO: 2073705 - DNA, 14 bp, Homo sapiens
ctcatgccacacct

SEQ ID NO: 2073706 - DNA, 17 bp, Homo sapiens
ctcatgccacaccttct

SEQ ID NO: 2073707 - DNA, 21 bp, Homo sapiens
ctcatgcctgcctgataccct

SEQ ID NO: 2073708 - DNA, 14 bp, Homo sapiens
ctcatgcctggccc

SEQ ID NO: 2073709 - DNA, 23 bp, Homo sapiens
ctcatgcctggcccccctccagg

SEQ ID NO: 2073710 - DNA, 18 bp, Homo sapiens
ctcatgctgacttgcaga

SEQ ID NO: 2073711 - DNA, 17 bp, Homo sapiens
ctcatgtacattggtct

SEQ ID NO: 2073712 - DNA, 15 bp, Homo sapiens
ctcatgtctcagcct

SEQ ID NO: 2073713 - DNA, 14 bp, Homo sapiens
ctcatgtgatcctt

SEQ ID NO: 2073714 - DNA, 18 bp, Homo sapiens
ctcattccaacagtgagt

SEQ ID NO: 2073715 - DNA, 12 bp, Homo sapiens
ctcattccccag

SEQ ID NO: 2073716 - DNA, 14 bp, Homo sapiens
ctcattccccaggt

SEQ ID NO: 2073717 - DNA, 12 bp, Homo sapiens
ctcattcccctc

SEQ ID NO: 2073718 - DNA, 16 bp, Homo sapiens
ctcattcgcctgtggg

SEQ ID NO: 2073719 - DNA, 14 bp, Homo sapiens
ctcattctctttct

SEQ ID NO: 2073720 - DNA, 17 bp, Homo sapiens
ctcattctctttctttt

SEQ ID NO: 2073721 - DNA, 23 bp, Homo sapiens
ctcattctctttctttttctgtc

SEQ ID NO: 2073722 - DNA, 21 bp, Homo sapiens
ctcattctgttgcccaggctg

SEQ ID NO: 2073723 - DNA, 23 bp, Homo sapiens
ctcattctgttgcccaggctggc

SEQ ID NO: 2073724 - DNA, 12 bp, Homo sapiens
ctcattcttctg

SEQ ID NO: 2073725 - DNA, 12 bp, Homo sapiens
ctcattgtctca

SEQ ID NO: 2073726 - DNA, 13 bp, Homo sapiens
ctcatttaatcct

SEQ ID NO: 2073727 - DNA, 13 bp, Homo sapiens
ctcatttcatctc

SEQ ID NO: 2073728 - DNA, 16 bp, Homo sapiens
ctcatttctaaaagaa

SEQ ID NO: 2073729 - DNA, 21 bp, Homo sapiens
ctcatttgtcacacactttgg

SEQ ID NO: 2073730 - DNA, 22 bp, Homo sapiens
ctcattttaggcctcctctctg

SEQ ID NO: 2073731 - DNA, 18 bp, Homo sapiens
ctccaaacaccggcagaa

SEQ ID NO: 2073732 - DNA, 14 bp, Homo sapiens
ctccaaaggggctg

SEQ ID NO: 2073733 - DNA, 18 bp, Homo sapiens
ctccaaaggggctgctgg

SEQ ID NO: 2073734 - DNA, 12 bp, Homo sapiens
ctccaaatgatt

SEQ ID NO: 2073735 - DNA, 18 bp, Homo sapiens
ctccaacaataaagagct

SEQ ID NO: 2073736 - DNA, 20 bp, Homo sapiens
ctccaacaataaagagctca

SEQ ID NO: 2073737 - DNA, 21 bp, Homo sapiens
ctccaacaccacctctccaga

SEQ ID NO: 2073738 - DNA, 22 bp, Homo sapiens
ctccaacagcttgaccagacct

SEQ ID NO: 2073739 - DNA, 20 bp, Homo sapiens
ctccaacgttaaaagacagt

SEQ ID NO: 2073740 - DNA, 20 bp, Homo sapiens
ctccaagaatacagaaaatg

SEQ ID NO: 2073741 - DNA, 21 bp, Homo sapiens
ctccaagaatacagaaaatgc

SEQ ID NO: 2073742 - DNA, 18 bp, Homo sapiens
ctccaagatttcagaagc

SEQ ID NO: 2073743 - DNA, 14 bp, Homo sapiens
ctccaagctccatc

SEQ ID NO: 2073744 - DNA, 19 bp, Homo sapiens
ctccaagctccatctccac

SEQ ID NO: 2073745 - DNA, 15 bp, Homo sapiens
ctccaaggaccaggt

SEQ ID NO: 2073746 - DNA, 22 bp, Homo sapiens
ctccaatcccaccaaccctcag

SEQ ID NO: 2073747 - DNA, 21 bp, Homo sapiens
ctccaattccacagtctctgg

SEQ ID NO: 2073748 - DNA, 14 bp, Homo sapiens
ctccaattgtaaaa

SEQ ID NO: 2073749 - DNA, 13 bp, Homo sapiens
ctccacagtgctg

SEQ ID NO: 2073750 - DNA, 15 bp, Homo sapiens
ctccacagtgctgct

SEQ ID NO: 2073751 - DNA, 21 bp, Homo sapiens
ctccacagttcgacctgcggc

SEQ ID NO: 2073752 - DNA, 21 bp, Homo sapiens
ctccacatccaccccactgga

SEQ ID NO: 2073753 - DNA, 20 bp, Homo sapiens
ctccacattaagtggctttt

SEQ ID NO: 2073754 - DNA, 12 bp, Homo sapiens
ctccaccaaccc

SEQ ID NO: 2073755 - DNA, 13 bp, Homo sapiens
ctccaccacccaa

SEQ ID NO: 2073756 - DNA, 14 bp, Homo sapiens
ctccacccactgtc

SEQ ID NO: 2073757 - DNA, 19 bp, Homo sapiens
ctccaccctgagcctgacc

SEQ ID NO: 2073758 - DNA, 18 bp, Homo sapiens
ctccacgcctcctggcca

SEQ ID NO: 2073759 - DNA, 19 bp, Homo sapiens
ctccacgcctcctggccag

SEQ ID NO: 2073760 - DNA, 22 bp, Homo sapiens
ctccacggtcagatttgctgtt

SEQ ID NO: 2073761 - DNA, 19 bp, Homo sapiens
ctccacggtgcgtggctgt

SEQ ID NO: 2073762 - DNA, 20 bp, Homo sapiens
ctccacggtgcgtggctgtg

SEQ ID NO: 2073763 - DNA, 17 bp, Homo sapiens
ctccactaaatgagctc

SEQ ID NO: 2073764 - DNA, 17 bp, Homo sapiens
ctccactcactccagcc

SEQ ID NO: 2073765 - DNA, 17 bp, Homo sapiens
ctccactcccccacctg

SEQ ID NO: 2073766 - DNA, 21 bp, Homo sapiens
ctccactcccccacctgacaa

SEQ ID NO: 2073767 - DNA, 20 bp, Homo sapiens
ctccactctccttcgtgtct

SEQ ID NO: 2073768 - DNA, 14 bp, Homo sapiens
ctccactggatgga

SEQ ID NO: 2073769 - DNA, 16 bp, Homo sapiens
ctccactggatggagg

SEQ ID NO: 2073770 - DNA, 9 bp, Homo sapiens
ctccactgt

SEQ ID NO: 2073771 - DNA, 19 bp, Homo sapiens
ctccagaatctgctgttgc

SEQ ID NO: 2073772 - DNA, 21 bp, Homo sapiens
ctccagacagatacagcccca

SEQ ID NO: 2073773 - DNA, 17 bp, Homo sapiens
ctccagacccaccacac

SEQ ID NO: 2073774 - DNA, 20 bp, Homo sapiens
ctccagacccctggcttttc

SEQ ID NO: 2073775 - DNA, 15 bp, Homo sapiens
ctccagacccctgtg

SEQ ID NO: 2073776 - DNA, 19 bp, Homo sapiens
ctccagacccctgtggcag

SEQ ID NO: 2073777 - DNA, 13 bp, Homo sapiens
ctccagaccctgc

SEQ ID NO: 2073778 - DNA, 20 bp, Homo sapiens
ctccagagacaggaaagaat

SEQ ID NO: 2073779 - DNA, 19 bp, Homo sapiens
ctccagagccagcctggga

SEQ ID NO: 2073780 - DNA, 21 bp, Homo sapiens
ctccagagccagcctgggact

SEQ ID NO: 2073781 - DNA, 14 bp, Homo sapiens
ctccagagggacag

SEQ ID NO: 2073782 - DNA, 12 bp, Homo sapiens
ctccagagtctg

SEQ ID NO: 2073783 - DNA, 23 bp, Homo sapiens
ctccagagtctgagcccccggct

SEQ ID NO: 2073784 - DNA, 21 bp, Homo sapiens
ctccagagtgtgcagactgat

SEQ ID NO: 2073785 - DNA, 17 bp, Homo sapiens
ctccagatctgcactgg

SEQ ID NO: 2073786 - DNA, 17 bp, Homo sapiens
ctccagcatccagcctg

SEQ ID NO: 2073787 - DNA, 16 bp, Homo sapiens
ctccagcatcctgctt

SEQ ID NO: 2073788 - DNA, 11 bp, Homo sapiens
ctccagccagc

SEQ ID NO: 2073789 - DNA, 12 bp, Homo sapiens
ctccagccagca

SEQ ID NO: 2073790 - DNA, 15 bp, Homo sapiens
ctccagccagcgcct

SEQ ID NO: 2073791 - DNA, 17 bp, Homo sapiens
ctccagccagcgcctcc

SEQ ID NO: 2073792 - DNA, 22 bp, Homo sapiens
ctccagccagcgcctccctcca

SEQ ID NO: 2073793 - DNA, 23 bp, Homo sapiens
ctccagccagcgcctccctccac

SEQ ID NO: 2073794 - DNA, 21 bp, Homo sapiens
ctccagccatcaagagactga

SEQ ID NO: 2073795 - DNA, 20 bp, Homo sapiens
ctccagcccacacccctcca

SEQ ID NO: 2073796 - DNA, 12 bp, Homo sapiens
ctccagcctctc

SEQ ID NO: 2073797 - DNA, 14 bp, Homo sapiens
ctccagcctctccc

SEQ ID NO: 2073798 - DNA, 13 bp, Homo sapiens
ctatgattttcta

SEQ ID NO: 2073799 - DNA, 14 bp, Homo sapiens
ctatgattttctat

SEQ ID NO: 2073800 - DNA, 17 bp, Homo sapiens
ctatgcaaatgcctcca

SEQ ID NO: 2073801 - DNA, 14 bp, Homo sapiens
ctatgcaattttta

SEQ ID NO: 2073802 - DNA, 15 bp, Homo sapiens
ctatgcaatttttaa

SEQ ID NO: 2073803 - DNA, 22 bp, Homo sapiens
ctatgcacatatggactctgca

SEQ ID NO: 2073804 - DNA, 23 bp, Homo sapiens
ctatgcagtattgccacaatgcc

SEQ ID NO: 2073805 - DNA, 14 bp, Homo sapiens
ctatgccaagccat

SEQ ID NO: 2073806 - DNA, 20 bp, Homo sapiens
ctatgccagctcagtcccat

SEQ ID NO: 2073807 - DNA, 14 bp, Homo sapiens
ctatgctatttctg

SEQ ID NO: 2073808 - DNA, 17 bp, Homo sapiens
ctatgctatttctggcc

SEQ ID NO: 2073809 - DNA, 11 bp, Homo sapiens
ctatggagagc

SEQ ID NO: 2073810 - DNA, 15 bp, Homo sapiens
ctatggagagccctg

SEQ ID NO: 2073811 - DNA, 18 bp, Homo sapiens
ctatggagagccctggga

SEQ ID NO: 2073812 - DNA, 19 bp, Homo sapiens
ctatggagagccctgggac

SEQ ID NO: 2073813 - DNA, 21 bp, Homo sapiens
ctatggagagccctgggaccg

SEQ ID NO: 2073814 - DNA, 19 bp, Homo sapiens
ctatggagcctggcacagg

SEQ ID NO: 2073815 - DNA, 23 bp, Homo sapiens
ctatggagggcagagtgggctgc

SEQ ID NO: 2073816 - DNA, 10 bp, Homo sapiens
ctatggatgt

SEQ ID NO: 2073817 - DNA, 11 bp, Homo sapiens
ctatggatgtg

SEQ ID NO: 2073818 - DNA, 17 bp, Homo sapiens
ctatggcagtccagcca

SEQ ID NO: 2073819 - DNA, 19 bp, Homo sapiens
ctatggcagtccagccagc

SEQ ID NO: 2073820 - DNA, 20 bp, Homo sapiens
ctatggcagtccagccagct

SEQ ID NO: 2073821 - DNA, 21 bp, Homo sapiens
ctatggctgtatttttagaga

SEQ ID NO: 2073822 - DNA, 22 bp, Homo sapiens
ctatgggactcaatgcactgac

SEQ ID NO: 2073823 - DNA, 23 bp, Homo sapiens
ctatgggactcaatgcactgaca

SEQ ID NO: 2073824 - DNA, 19 bp, Homo sapiens
ctatggtatgctggccagc

SEQ ID NO: 2073825 - DNA, 15 bp, Homo sapiens
ctatggtcagttgag

SEQ ID NO: 2073826 - DNA, 23 bp, Homo sapiens
ctatggttcccaataaaagtgac

SEQ ID NO: 2073827 - DNA, 22 bp, Homo sapiens
ctatgtatggaatacagtgtta

SEQ ID NO: 2073828 - DNA, 17 bp, Homo sapiens
ctatgtcaatttgtata

SEQ ID NO: 2073829 - DNA, 20 bp, Homo sapiens
ctatgtcaatttgtatatca

SEQ ID NO: 2073830 - DNA, 16 bp, Homo sapiens
ctatgtcatttcattt

SEQ ID NO: 2073831 - DNA, 16 bp, Homo sapiens
ctatgtcccttgctgt

SEQ ID NO: 2073832 - DNA, 14 bp, Homo sapiens
ctatgtcctaagga

SEQ ID NO: 2073833 - DNA, 15 bp, Homo sapiens
ctatgtcctaaggac

SEQ ID NO: 2073834 - DNA, 18 bp, Homo sapiens
ctatgtcctaaggacaca

SEQ ID NO: 2073835 - DNA, 15 bp, Homo sapiens
ctatgtgatgttaac

SEQ ID NO: 2073836 - DNA, 17 bp, Homo sapiens
ctatgtgtcatgatttc

SEQ ID NO: 2073837 - DNA, 21 bp, Homo sapiens
ctatgtgtcatgatttcaatg

SEQ ID NO: 2073838 - DNA, 13 bp, Homo sapiens
ctatgttccctcc

SEQ ID NO: 2073839 - DNA, 14 bp, Homo sapiens
ctatgttccctcca

SEQ ID NO: 2073840 - DNA, 18 bp, Homo sapiens
ctatgttgcccaggcagg

SEQ ID NO: 2073841 - DNA, 21 bp, Homo sapiens
ctatgttgcccaggcaggtct

SEQ ID NO: 2073842 - DNA, 16 bp, Homo sapiens
ctatgttgtgatcctt

SEQ ID NO: 2073843 - DNA, 22 bp, Homo sapiens
ctattaagggaaaggaaaagaa

SEQ ID NO: 2073844 - DNA, 17 bp, Homo sapiens
ctattaccatgagaaga

SEQ ID NO: 2073845 - DNA, 15 bp, Homo sapiens
ctattagatgtttta

SEQ ID NO: 2073846 - DNA, 15 bp, Homo sapiens
ctattataatttaat

SEQ ID NO: 2073847 - DNA, 17 bp, Homo sapiens
ctattataatttaatgc

SEQ ID NO: 2073848 - DNA, 21 bp, Homo sapiens
ctattataatttaatgcatgt

SEQ ID NO: 2073849 - DNA, 14 bp, Homo sapiens
ctattatctgtgct

SEQ ID NO: 2073850 - DNA, 18 bp, Homo sapiens
ctattcaaacagtctcag

SEQ ID NO: 2073851 - DNA, 23 bp, Homo sapiens
ctattcaaacagtctcaggaaat

SEQ ID NO: 2073852 - DNA, 23 bp, Homo sapiens
ctattcaaggtggccaaattatt

SEQ ID NO: 2073853 - DNA, 15 bp, Homo sapiens
ctattcagacaagca

SEQ ID NO: 2073854 - DNA, 17 bp, Homo sapiens
ctattcagacaagcaac

SEQ ID NO: 2073855 - DNA, 14 bp, Homo sapiens
ctattcataataaa

SEQ ID NO: 2073856 - DNA, 17 bp, Homo sapiens
ctattcataataaacta

SEQ ID NO: 2073857 - DNA, 22 bp, Homo sapiens
ctcaacccccatttctatttat

SEQ ID NO: 2073858 - DNA, 16 bp, Homo sapiens
ctcaagaggcccaggg

SEQ ID NO: 2073859 - DNA, 17 bp, Homo sapiens
ctcaagatgacagctct

SEQ ID NO: 2073860 - DNA, 18 bp, Homo sapiens
ctcaagatgacagctctt

SEQ ID NO: 2073861 - DNA, 16 bp, Homo sapiens
ctcaagcagtcctccc

SEQ ID NO: 2073862 - DNA, 17 bp, Homo sapiens
ctcaagctgcatctaga

SEQ ID NO: 2073863 - DNA, 14 bp, Homo sapiens
ctcaagctgcgttt

SEQ ID NO: 2073864 - DNA, 21 bp, Homo sapiens
ctcaagtcctcttttctgaga

SEQ ID NO: 2073865 - DNA, 18 bp, Homo sapiens
ctcaagtttttcagaaag

SEQ ID NO: 2073866 - DNA, 18 bp, Homo sapiens
ctcaatattcctgaatga

SEQ ID NO: 2073867 - DNA, 14 bp, Homo sapiens
ctcaatcactgctc

SEQ ID NO: 2073868 - DNA, 13 bp, Homo sapiens
ctcaatcagtgca

SEQ ID NO: 2073869 - DNA, 15 bp, Homo sapiens
ctcaatcagtgcagt

SEQ ID NO: 2073870 - DNA, 16 bp, Homo sapiens
ctcaatcagtgcagtg

SEQ ID NO: 2073871 - DNA, 20 bp, Homo sapiens
ctcaatcagtgcagtgatac

SEQ ID NO: 2073872 - DNA, 13 bp, Homo sapiens
ctcaatgcactga

SEQ ID NO: 2073873 - DNA, 20 bp, Homo sapiens
ctcaatgcattgtcttgtgg

SEQ ID NO: 2073874 - DNA, 13 bp, Homo sapiens
ctcaatgccctgc

SEQ ID NO: 2073875 - DNA, 14 bp, Homo sapiens
ctcaatgcttttct

SEQ ID NO: 2073876 - DNA, 11 bp, Homo sapiens
ctcaatgtgaa

SEQ ID NO: 2073877 - DNA, 20 bp, Homo sapiens
ctcaatgtgaatcagaccct

SEQ ID NO: 2073878 - DNA, 21 bp, Homo sapiens
ctcaatgtgaatcagacccta

SEQ ID NO: 2073879 - DNA, 15 bp, Homo sapiens
ctcacaaggcagcaa

SEQ ID NO: 2073880 - DNA, 14 bp, Homo sapiens
ctcacaattgtaaa

SEQ ID NO: 2073881 - DNA, 13 bp, Homo sapiens
ctcacacccagag

SEQ ID NO: 2073882 - DNA, 14 bp, Homo sapiens
ctcacacccagagg

SEQ ID NO: 2073883 - DNA, 22 bp, Homo sapiens
ctcacaccctaataagtccaca

SEQ ID NO: 2073884 - DNA, 22 bp, Homo sapiens
ctcacacttgggcgctctgccc

SEQ ID NO: 2073885 - DNA, 13 bp, Homo sapiens
ctcacagaagaat

SEQ ID NO: 2073886 - DNA, 13 bp, Homo sapiens
ctcacagcctctc

SEQ ID NO: 2073887 - DNA, 15 bp, Homo sapiens
ctcacaggagcagac

SEQ ID NO: 2073888 - DNA, 14 bp, Homo sapiens
ctcacagtgaccct

SEQ ID NO: 2073889 - DNA, 19 bp, Homo sapiens
ctcacagtgacccttccca

SEQ ID NO: 2073890 - DNA, 18 bp, Homo sapiens
ctcacagttcctcgccct

SEQ ID NO: 2073891 - DNA, 17 bp, Homo sapiens
ctcacatgccgccccca

SEQ ID NO: 2073892 - DNA, 13 bp, Homo sapiens
ctcaccaataact

SEQ ID NO: 2073893 - DNA, 18 bp, Homo sapiens
ctcaccaataacttcaga

SEQ ID NO: 2073894 - DNA, 20 bp, Homo sapiens
ctcaccaataacttcagaga

SEQ ID NO: 2073895 - DNA, 23 bp, Homo sapiens
ctcaccaataacttcagagaagt

SEQ ID NO: 2073896 - DNA, 19 bp, Homo sapiens
ctcaccagctgctgctctg

SEQ ID NO: 2073897 - DNA, 13 bp, Homo sapiens
ctcaccagggtcc

SEQ ID NO: 2073898 - DNA, 19 bp, Homo sapiens
ctcacccccagctttgcta

SEQ ID NO: 2073899 - DNA, 16 bp, Homo sapiens
ctcacccccaggtgtt

SEQ ID NO: 2073900 - DNA, 15 bp, Homo sapiens
ctcaccccctcccac

SEQ ID NO: 2073901 - DNA, 22 bp, Homo sapiens
ctcaccccctcccacccccagc

SEQ ID NO: 2073902 - DNA, 23 bp, Homo sapiens
ctcaccccctcccacccccagcc

SEQ ID NO: 2073903 - DNA, 16 bp, Homo sapiens
ctcaccccgtctgggg

SEQ ID NO: 2073904 - DNA, 21 bp, Homo sapiens
ctcaccctcataccatctgct

SEQ ID NO: 2073905 - DNA, 11 bp, Homo sapiens
ctcacctcctc

SEQ ID NO: 2073906 - DNA, 14 bp, Homo sapiens
ctcacctctctcta

SEQ ID NO: 2073907 - DNA, 16 bp, Homo sapiens
ctcacctctctctaag

SEQ ID NO: 2073908 - DNA, 12 bp, Homo sapiens
ctcacctctgcc

SEQ ID NO: 2073909 - DNA, 16 bp, Homo sapiens
ctcacctctgcctcaa

SEQ ID NO: 2073910 - DNA, 18 bp, Homo sapiens
ctcacctctgcctcaatg

SEQ ID NO: 2073911 - DNA, 16 bp, Homo sapiens
ctcacctgggcctttc

SEQ ID NO: 2073912 - DNA, 21 bp, Homo sapiens
ctcacctgggcctttcctgtg

SEQ ID NO: 2073913 - DNA, 22 bp, Homo sapiens
ctcacctgggcctttcctgtgc

SEQ ID NO: 2073914 - DNA, 23 bp, Homo sapiens
ctcacctttgcaaagttacagat

SEQ ID NO: 2073915 - DNA, 14 bp, Homo sapiens
ctcacgactcttcc

SEQ ID NO: 2073916 - DNA, 17 bp, Homo sapiens
ctcacgcccagcctcct

SEQ ID NO: 2073917 - DNA, 20 bp, Homo sapiens
ctcacgcctgtaatcccagc

SEQ ID NO: 2073918 - DNA, 22 bp, Homo sapiens
ctcacgcctgtaatcccagcag

SEQ ID NO: 2073919 - DNA, 17 bp, Homo sapiens
ctcacgctcccccgcag

SEQ ID NO: 2073920 - DNA, 21 bp, Homo sapiens
ctcactatgttgcccaggcag

SEQ ID NO: 2073921 - DNA, 23 bp, Homo sapiens
ctcactatgttgcccaggcaggt

SEQ ID NO: 2073922 - DNA, 16 bp, Homo sapiens
ctcactcactcattcc

SEQ ID NO: 2073923 - DNA, 14 bp, Homo sapiens
ctcactccacactg

SEQ ID NO: 2073924 - DNA, 16 bp, Homo sapiens
ctcactccacactggc

SEQ ID NO: 2073925 - DNA, 21 bp, Homo sapiens
ctactcctacctcagcctaga

SEQ ID NO: 2073926 - DNA, 16 bp, Homo sapiens
ctactcctgtgctctg

SEQ ID NO: 2073927 - DNA, 22 bp, Homo sapiens
ctactcgggaggctgaggcagg

SEQ ID NO: 2073928 - DNA, 21 bp, Homo sapiens
ctactcgggaggctgaggcgg

SEQ ID NO: 2073929 - DNA, 22 bp, Homo sapiens
ctactctcaggatcaagaaagt

SEQ ID NO: 2073930 - DNA, 23 bp, Homo sapiens
ctactctcttgccagcattttca

SEQ ID NO: 2073931 - DNA, 14 bp, Homo sapiens
ctactctgtccagg

SEQ ID NO: 2073932 - DNA, 17 bp, Homo sapiens
ctactctgtccaggcca

SEQ ID NO: 2073933 - DNA, 13 bp, Homo sapiens
ctactctgtgcca

SEQ ID NO: 2073934 - DNA, 20 bp, Homo sapiens
ctactctgtgccagagcctg

SEQ ID NO: 2073935 - DNA, 13 bp, Homo sapiens
ctactctgtgtca

SEQ ID NO: 2073936 - DNA, 16 bp, Homo sapiens
ctactctgtgtcaggt

SEQ ID NO: 2073937 - DNA, 21 bp, Homo sapiens
ctactctgtgtcaggtggggc

SEQ ID NO: 2073938 - DNA, 12 bp, Homo sapiens
ctactgaattta

SEQ ID NO: 2073939 - DNA, 17 bp, Homo sapiens
ctactgataaagaaaga

SEQ ID NO: 2073940 - DNA, 19 bp, Homo sapiens
ctactgctgcaaagtgcaa

SEQ ID NO: 2073941 - DNA, 12 bp, Homo sapiens
ctactggcagct

SEQ ID NO: 2073942 - DNA, 15 bp, Homo sapiens
ctactggcagctcct

SEQ ID NO: 2073943 - DNA, 20 bp, Homo sapiens
ctactggcattaattattaa

SEQ ID NO: 2073944 - DNA, 12 bp, Homo sapiens
ctactgtaatta

SEQ ID NO: 2073945 - DNA, 19 bp, Homo sapiens
ctactgtaattaagtgcaa

SEQ ID NO: 2073946 - DNA, 20 bp, Homo sapiens
ctactgtcctacccaccctc

SEQ ID NO: 2073947 - DNA, 15 bp, Homo sapiens
ctactgtggaaaaat

SEQ ID NO: 2073948 - DNA, 17 bp, Homo sapiens
ctactgtggaaaaatat

SEQ ID NO: 2073949 - DNA, 13 bp, Homo sapiens
ctacttaagagaa

SEQ ID NO: 2073950 - DNA, 17 bp, Homo sapiens
ctacttagcatgtccct

SEQ ID NO: 2073951 - DNA, 17 bp, Homo sapiens
ctacttcattttcagag

SEQ ID NO: 2073952 - DNA, 20 bp, Homo sapiens
ctacttcctgtgacttcagc

SEQ ID NO: 2073953 - DNA, 19 bp, Homo sapiens
ctacttgaatactctcaca

SEQ ID NO: 2073954 - DNA, 15 bp, Homo sapiens
ctacttgtaatttct

SEQ ID NO: 2073955 - DNA, 23 bp, Homo sapiens
ctacttgttacctttcccatgct

SEQ ID NO: 2073956 - DNA, 14 bp, Homo sapiens
ctactttacactct

SEQ ID NO: 2073957 - DNA, 15 bp, Homo sapiens
ctactttagccactg

SEQ ID NO: 2073958 - DNA, 21 bp, Homo sapiens
ctactttgatatgactgtttt

SEQ ID NO: 2073959 - DNA, 20 bp, Homo sapiens
ctacttttgtaccagtgtga

SEQ ID NO: 2073960 - DNA, 15 bp, Homo sapiens
ctactttttatactc

SEQ ID NO: 2073961 - DNA, 16 bp, Homo sapiens
ctagaaaccagtatgg

SEQ ID NO: 2073962 - DNA, 17 bp, Homo sapiens
ctagaaaccagtatgga

SEQ ID NO: 2073963 - DNA, 22 bp, Homo sapiens
ctagaaaccagtatggaaggga

SEQ ID NO: 2073964 - DNA, 14 bp, Homo sapiens
ctagaaagaaaaga

SEQ ID NO: 2073965 - DNA, 20 bp, Homo sapiens
ctagaaagctctgcatgtgt

SEQ ID NO: 2073966 - DNA, 17 bp, Homo sapiens
ctagaaatatgatttta

SEQ ID NO: 2073967 - DNA, 20 bp, Homo sapiens
ctagaacacccactggccag

SEQ ID NO: 2073968 - DNA, 16 bp, Homo sapiens
ctagaaccaagcttca

SEQ ID NO: 2073969 - DNA, 18 bp, Homo sapiens
ctagaacctagaagggct

SEQ ID NO: 2073970 - DNA, 22 bp, Homo sapiens
cgctcaggacccaggccctcca

SEQ ID NO: 2073971 - DNA, 16 bp, Homo sapiens
cgctccccactctgct

SEQ ID NO: 2073972 - DNA, 14 bp, Homo sapiens
cgctcctgtctgcc

SEQ ID NO: 2073973 - DNA, 21 bp, Homo sapiens
cgctcctgtctgccagccagc

SEQ ID NO: 2073974 - DNA, 13 bp, Homo sapiens
cgctcctttacct

SEQ ID NO: 2073975 - DNA, 17 bp, Homo sapiens
cgctctcctttctttct

SEQ ID NO: 2073976 - DNA, 20 bp, Homo sapiens
cgctctgccctccctggcct

SEQ ID NO: 2073977 - DNA, 15 bp, Homo sapiens
cgctctgctggcctg

SEQ ID NO: 2073978 - DNA, 17 bp, Homo sapiens
cctggaggacctgagcc

SEQ ID NO: 2073979 - DNA, 22 bp, Homo sapiens
cctggaggacctgagcctgccg

SEQ ID NO: 2073980 - DNA, 18 bp, Homo sapiens
cctggaggatccctccat

SEQ ID NO: 2073981 - DNA, 13 bp, Homo sapiens
cctggagggaggc

SEQ ID NO: 2073982 - DNA, 22 bp, Homo sapiens
cctggagggctagaacctggag

SEQ ID NO: 2073983 - DNA, 23 bp, Homo sapiens
cctggagggctagaacctggaga

SEQ ID NO: 2073984 - DNA, 18 bp, Homo sapiens
cctggaggggctgaatgt

SEQ ID NO: 2073985 - DNA, 21 bp, Homo sapiens
cctggagtcccctgggcctgg

SEQ ID NO: 2073986 - DNA, 23 bp, Homo sapiens
cctggagtcccgtccctgcccag

SEQ ID NO: 2073987 - DNA, 17 bp, Homo sapiens
cctggagtctcttggtg

SEQ ID NO: 2073988 - DNA, 14 bp, Homo sapiens
cctggatcagcgtg

SEQ ID NO: 2073989 - DNA, 19 bp, Homo sapiens
cctggatcagcgtggcctt

SEQ ID NO: 2073990 - DNA, 21 bp, Homo sapiens
cctggatgggcattgggctga

SEQ ID NO: 2073991 - DNA, 22 bp, Homo sapiens
cctggatgtcccctgtcccacc

SEQ ID NO: 2073992 - DNA, 17 bp, Homo sapiens
cctggatgtgcccacag

SEQ ID NO: 2073993 - DNA, 21 bp, Homo sapiens
cctggatgtgtggggcatggt

SEQ ID NO: 2073994 - DNA, 14 bp, Homo sapiens
cctggatgttgctg

SEQ ID NO: 2073995 - DNA, 13 bp, Homo sapiens
cctggcacacatc

SEQ ID NO: 2073996 - DNA, 15 bp, Homo sapiens
cctggcacacatcag

SEQ ID NO: 2073997 - DNA, 16 bp, Homo sapiens
cctggcacaggactga

SEQ ID NO: 2073998 - DNA, 24 bp, Homo sapiens
cctggcacaggactgattctggga

SEQ ID NO: 2073999 - DNA, 17 bp, Homo sapiens
cctggcacagggcagtg

SEQ ID NO: 2074000 - DNA, 22 bp, Homo sapiens
cctggcacccggcccctgctgg

SEQ ID NO: 2074001 - DNA, 15 bp, Homo sapiens
cctggcaggaagtct

SEQ ID NO: 2074002 - DNA, 21 bp, Homo sapiens
cctggcaggttagaacctaga

SEQ ID NO: 2074003 - DNA, 17 bp, Homo sapiens
cctggcatgtcagagcc

SEQ ID NO: 2074004 - DNA, 22 bp, Homo sapiens
cctggcatgtcagagccaggct

SEQ ID NO: 2074005 - DNA, 19 bp, Homo sapiens
cctggccattttcttgcct

SEQ ID NO: 2074006 - DNA, 18 bp, Homo sapiens
cctggcccatagaaacat

SEQ ID NO: 2074007 - DNA, 22 bp, Homo sapiens
cctggcccatagaaacatgaca

SEQ ID NO: 2074008 - DNA, 11 bp, Homo sapiens
cctggccccag

SEQ ID NO: 2074009 - DNA, 20 bp, Homo sapiens
cctggccccatgtctctcag

SEQ ID NO: 2074010 - DNA, 16 bp, Homo sapiens
cctggcccccctccag

SEQ ID NO: 2074011 - DNA, 22 bp, Homo sapiens
cctggccccgggctctggccac

SEQ ID NO: 2074012 - DNA, 21 bp, Homo sapiens
cctggcccctccagaccctgc

SEQ ID NO: 2074013 - DNA, 22 bp, Homo sapiens
cctggcccctccagaccctgcc

SEQ ID NO: 2074014 - DNA, 23 bp, Homo sapiens
cctggcccctccagaccctgcct

SEQ ID NO: 2074015 - DNA, 22 bp, Homo sapiens
cctggccccttctcctctgggg

SEQ ID NO: 2074016 - DNA, 15 bp, Homo sapiens
cctggccctcttctt

SEQ ID NO: 2074017 - DNA, 15 bp, Homo sapiens
cctggccgcctccag

SEQ ID NO: 2074018 - DNA, 16 bp, Homo sapiens
cctggccgcctccagg

SEQ ID NO: 2074019 - DNA, 19 bp, Homo sapiens
cctggccggcaaccccagt

SEQ ID NO: 2074020 - DNA, 13 bp, Homo sapiens
cctggccggctcc

SEQ ID NO: 2074021 - DNA, 20 bp, Homo sapiens
cctggccggggcccctcacc

SEQ ID NO: 2074022 - DNA, 16 bp, Homo sapiens
cctggcctcaagcaat

SEQ ID NO: 2074023 - DNA, 13 bp, Homo sapiens
cctggcctcactg

SEQ ID NO: 2074024 - DNA, 16 bp, Homo sapiens
cctggcctcactggct

SEQ ID NO: 2074025 - DNA, 18 bp, Homo sapiens
cctggcctcactggctgg

SEQ ID NO: 2074026 - DNA, 21 bp, Homo sapiens
cctggcctcactggctggggc

SEQ ID NO: 2074027 - DNA, 22 bp, Homo sapiens
cctggcctcactggctggggca

SEQ ID NO: 2074028 - DNA, 16 bp, Homo sapiens
cctggcctcctgcctc

SEQ ID NO: 2074029 - DNA, 21 bp, Homo sapiens
cctggcctcctgcctctactg

SEQ ID NO: 2074030 - DNA, 13 bp, Homo sapiens
cctggcctgagct

SEQ ID NO: 2074031 - DNA, 17 bp, Homo sapiens
cctggcctgagctgggg

SEQ ID NO: 2074032 - DNA, 22 bp, Homo sapiens
cctggcctgagctggggccaca

SEQ ID NO: 2074033 - DNA, 15 bp, Homo sapiens
cctggcctgctggga

SEQ ID NO: 2074034 - DNA, 15 bp, Homo sapiens
cctggcctggcacac

SEQ ID NO: 2074035 - DNA, 21 bp, Homo sapiens
cctggcctgtggagagaaagc

SEQ ID NO: 2074036 - DNA, 15 bp, Homo sapiens
cctggcggggcagga

SEQ ID NO: 2074037 - DNA, 16 bp, Homo sapiens
cctggcggggcaggag

SEQ ID NO: 2074038 - DNA, 22 bp, Homo sapiens
cctggcggggcaggaggcctgg

SEQ ID NO: 2074039 - DNA, 17 bp, Homo sapiens
cctggctcccacaggcc

SEQ ID NO: 2074040 - DNA, 16 bp, Homo sapiens
cctggctccccacgag

SEQ ID NO: 2074041 - DNA, 21 bp, Homo sapiens
cctggctccgtccaggagcct

SEQ ID NO: 2074042 - DNA, 22 bp, Homo sapiens
cctggctctgcaatgggcactg

SEQ ID NO: 2074043 - DNA, 13 bp, Homo sapiens
cctggctgccagg

SEQ ID NO: 2074044 - DNA, 18 bp, Homo sapiens
cctggctgccaggcgttg

SEQ ID NO: 2074045 - DNA, 23 bp, Homo sapiens
cctggctgtggaggcctgatgct

SEQ ID NO: 2074046 - DNA, 19 bp, Homo sapiens
cctggcttcccatccccag

SEQ ID NO: 2074047 - DNA, 22 bp, Homo sapiens
cctggcttcccatccccagcga

SEQ ID NO: 2074048 - DNA, 23 bp, Homo sapiens
cctggcttcccatccccagcgat

SEQ ID NO: 2074049 - DNA, 13 bp, Homo sapiens
cctggcttctaga

SEQ ID NO: 2074050 - DNA, 13 bp, Homo sapiens
cctggcttctgga

SEQ ID NO: 2074051 - DNA, 15 bp, Homo sapiens
cctggcttctggagc

SEQ ID NO: 2074052 - DNA, 20 bp, Homo sapiens
cctggcttctggagcccttg

SEQ ID NO: 2074053 - DNA, 21 bp, Homo sapiens
cctggcttctggagcccttgg

SEQ ID NO: 2074054 - DNA, 16 bp, Homo sapiens
cctggcttgctccagg

SEQ ID NO: 2074055 - DNA, 19 bp, Homo sapiens
cctggcttgctccagggtc

SEQ ID NO: 2074056 - DNA, 19 bp, Homo sapiens
cctggcttgcttgccgagc

SEQ ID NO: 2074057 - DNA, 18 bp, Homo sapiens
cctggcttgtaactccac

SEQ ID NO: 2074058 - DNA, 20 bp, Homo sapiens
cctggcttgtaactccacca

SEQ ID NO: 2074059 - DNA, 16 bp, Homo sapiens
cctggcttttcactgc

SEQ ID NO: 2074060 - DNA, 17 bp, Homo sapiens
cctggcttttcactgct

SEQ ID NO: 2074061 - DNA, 20 bp, Homo sapiens
cctggcttttcactgctggc

SEQ ID NO: 2074062 - DNA, 21 bp, Homo sapiens
cctggcttttcactgctggct

SEQ ID NO: 2074063 - DNA, 24 bp, Homo sapiens
cctggcttttcactgctggctgcc

SEQ ID NO: 2074064 - DNA, 18 bp, Homo sapiens
cctgggaaaggacccacc

SEQ ID NO: 2074065 - DNA, 19 bp, Homo sapiens
cctgggaaaggggttgtca

SEQ ID NO: 2074066 - DNA, 16 bp, Homo sapiens
cctgggaactcatcct

SEQ ID NO: 2074067 - DNA, 12 bp, Homo sapiens
cctgggaagggg

SEQ ID NO: 2074068 - DNA, 15 bp, Homo sapiens
cctgggaccagggca

SEQ ID NO: 2074069 - DNA, 12 bp, Homo sapiens
cctgggacccag

SEQ ID NO: 2074070 - DNA, 14 bp, Homo sapiens
cctgggacccagct

SEQ ID NO: 2074071 - DNA, 18 bp, Homo sapiens
cctgggacccagctactc

SEQ ID NO: 2074072 - DNA, 16 bp, Homo sapiens
cctgggactcccagtg

SEQ ID NO: 2074073 - DNA, 18 bp, Homo sapiens
cctgggagaacctcaggc

SEQ ID NO: 2074074 - DNA, 13 bp, Homo sapiens
cctgggaggcttt

SEQ ID NO: 2074075 - DNA, 18 bp, Homo sapiens
cctgggatgggaccaggg

SEQ ID NO: 2074076 - DNA, 23 bp, Homo sapiens
cctgggattcaggaaaaggcctg

SEQ ID NO: 2074077 - DNA, 22 bp, Homo sapiens
cctgggccaaaagggcagccag

SEQ ID NO: 2074078 - DNA, 23 bp, Homo sapiens
cctgggccaaaagggcagccagg

SEQ ID NO: 2074079 - DNA, 14 bp, Homo sapiens
cctgggcccaggct

SEQ ID NO: 2074080 - DNA, 16 bp, Homo sapiens
cctgggcccaggctct

SEQ ID NO: 2074081 - DNA, 12 bp, Homo sapiens
cctgggcccctc

SEQ ID NO: 2074082 - DNA, 15 bp, Homo sapiens
cctgggcccctccac

SEQ ID NO: 2074083 - DNA, 18 bp, Homo sapiens
cctgggcccctccacgcc

SEQ ID NO: 2074084 - DNA, 14 bp, Homo sapiens
cctgggccctgggg

SEQ ID NO: 2074085 - DNA, 17 bp, Homo sapiens
cctgggcctatggagag

SEQ ID NO: 2074086 - DNA, 18 bp, Homo sapiens
cctgggcctatggagagc

SEQ ID NO: 2074087 - DNA, 14 bp, Homo sapiens
cctgggcctcagtt

SEQ ID NO: 2074088 - DNA, 13 bp, Homo sapiens
cctgggcctgctg

SEQ ID NO: 2074089 - DNA, 14 bp, Homo sapiens
cctgggcctgctgc

SEQ ID NO: 2074090 - DNA, 16 bp, Homo sapiens
cctgggcctgctgctg

SEQ ID NO: 2074091 - DNA, 17 bp, Homo sapiens
cctgggcctgctgctga

SEQ ID NO: 2074092 - DNA, 18 bp, Homo sapiens
cctgggcctgctgctgag

SEQ ID NO: 2074093 - DNA, 20 bp, Homo sapiens
cctgggcctgctgctgagaa

SEQ ID NO: 2074094 - DNA, 15 bp, Homo sapiens
cctttgtgtaataaa

SEQ ID NO: 2074095 - DNA, 16 bp, Homo sapiens
cctttgtgtaataaaa

SEQ ID NO: 2074096 - DNA, 20 bp, Homo sapiens
cctttgttattatcctgcat

SEQ ID NO: 2074097 - DNA, 13 bp, Homo sapiens
ccttttaaaagaa

SEQ ID NO: 2074098 - DNA, 15 bp, Homo sapiens
ccttttacccctgca

SEQ ID NO: 2074099 - DNA, 17 bp, Homo sapiens
ccttttattctgtacct

SEQ ID NO: 2074100 - DNA, 15 bp, Homo sapiens
ccttttcactacacc

SEQ ID NO: 2074101 - DNA, 20 bp, Homo sapiens
ccttttccaggagttctgaa

SEQ ID NO: 2074102 - DNA, 13 bp, Homo sapiens
ccttttcctccag

SEQ ID NO: 2074103 - DNA, 19 bp, Homo sapiens
ccttttcttccttctttct

SEQ ID NO: 2074104 - DNA, 16 bp, Homo sapiens
ccttttgatggggaga

SEQ ID NO: 2074105 - DNA, 18 bp, Homo sapiens
ccttttgatggggagaaa

SEQ ID NO: 2074106 - DNA, 19 bp, Homo sapiens
ccttttgatggggagaaag

SEQ ID NO: 2074107 - DNA, 18 bp, Homo sapiens
ccttttgcataagattaa

SEQ ID NO: 2074108 - DNA, 14 bp, Homo sapiens
ccttttgtccccag

SEQ ID NO: 2074109 - DNA, 20 bp, Homo sapiens
ccttttgtccccagggcccc

SEQ ID NO: 2074110 - DNA, 14 bp, Homo sapiens
cctttttctacctt

SEQ ID NO: 2074111 - DNA, 20 bp, Homo sapiens
ccttttttaaaagtaaatgt

SEQ ID NO: 2074112 - DNA, 19 bp, Homo sapiens
cctttttttagtaaatcct

SEQ ID NO: 2074113 - DNA, 20 bp, Homo sapiens
cgaaaacgttgacccctttc

SEQ ID NO: 2074114 - DNA, 21 bp, Homo sapiens
cgaaaccagttaagaatggaa

SEQ ID NO: 2074115 - DNA, 19 bp, Homo sapiens
cgaaacctgtccataaagt

SEQ ID NO: 2074116 - DNA, 22 bp, Homo sapiens
cgaaagggacttggaagctccg

SEQ ID NO: 2074117 - DNA, 22 bp, Homo sapiens
cgaaagtttcttggtctcagct

SEQ ID NO: 2074118 - DNA, 22 bp, Homo sapiens
cgaaccaaggcagcctccagag

SEQ ID NO: 2074119 - DNA, 16 bp, Homo sapiens
cgaacccacctgctga

SEQ ID NO: 2074120 - DNA, 12 bp, Homo sapiens
cgaactggctgc

SEQ ID NO: 2074121 - DNA, 17 bp, Homo sapiens
cgaagcccttccagtgg

SEQ ID NO: 2074122 - DNA, 17 bp, Homo sapiens
cgaagctaacagggaag

SEQ ID NO: 2074123 - DNA, 16 bp, Homo sapiens
cgaaggggccccgggg

SEQ ID NO: 2074124 - DNA, 19 bp, Homo sapiens
cgaaggggccccggggctg

SEQ ID NO: 2074125 - DNA, 13 bp, Homo sapiens
cgaaggggccctg

SEQ ID NO: 2074126 - DNA, 14 bp, Homo sapiens
cgaataaatgttca

SEQ ID NO: 2074127 - DNA, 19 bp, Homo sapiens
cgaataaatgttcaaactg

SEQ ID NO: 2074128 - DNA, 13 bp, Homo sapiens
cgaatagctggga

SEQ ID NO: 2074129 - DNA, 23 bp, Homo sapiens
cgaatggggcgatcaagtccaga

SEQ ID NO: 2074130 - DNA, 14 bp, Homo sapiens
cgaattaatagctt

SEQ ID NO: 2074131 - DNA, 23 bp, Homo sapiens
cgaatttggtgtggctgtattca

SEQ ID NO: 2074132 - DNA, 22 bp, Homo sapiens
cgacaaagcatcattgtaaatt

SEQ ID NO: 2074133 - DNA, 19 bp, Homo sapiens
cgacaaagggaaggctgct

SEQ ID NO: 2074134 - DNA, 16 bp, Homo sapiens
cgacactgctgcacca

SEQ ID NO: 2074135 - DNA, 12 bp, Homo sapiens
cgacagcctggc

SEQ ID NO: 2074136 - DNA, 13 bp, Homo sapiens
cgacagcctggca

SEQ ID NO: 2074137 - DNA, 14 bp, Homo sapiens
cgaccacctgccca

SEQ ID NO: 2074138 - DNA, 18 bp, Homo sapiens
cgaccatgtgtagattgc

SEQ ID NO: 2074139 - DNA, 15 bp, Homo sapiens
cgacctcagccttcc

SEQ ID NO: 2074140 - DNA, 19 bp, Homo sapiens
cgacctcgtcctccccctg

SEQ ID NO: 2074141 - DNA, 23 bp, Homo sapiens
cgacctcgtcctccccctgccag

SEQ ID NO: 2074142 - DNA, 11 bp, Homo sapiens
cgactcaggat

SEQ ID NO: 2074143 - DNA, 12 bp, Homo sapiens
cgactcagggac

SEQ ID NO: 2074144 - DNA, 13 bp, Homo sapiens
cgactcagggacc

SEQ ID NO: 2074145 - DNA, 13 bp, Homo sapiens
cgactccagccag

SEQ ID NO: 2074146 - DNA, 15 bp, Homo sapiens
cgactccagccagcg

SEQ ID NO: 2074147 - DNA, 20 bp, Homo sapiens
cgactgcacagcggcccctg

SEQ ID NO: 2074148 - DNA, 22 bp, Homo sapiens
cgacttttctaaagctctgaac

SEQ ID NO: 2074149 - DNA, 15 bp, Homo sapiens
cgagaaaaggagaaa

SEQ ID NO: 2074150 - DNA, 15 bp, Homo sapiens
cgagaccagcctggc

SEQ ID NO: 2074151 - DNA, 17 bp, Homo sapiens
cgagaccagcctggcca

SEQ ID NO: 2074152 - DNA, 16 bp, Homo sapiens
cgagaccatcctggcc

SEQ ID NO: 2074153 - DNA, 16 bp, Homo sapiens
cgagacggctggacct

SEQ ID NO: 2074154 - DNA, 14 bp, Homo sapiens
cgagagcctgctcc

SEQ ID NO: 2074155 - DNA, 14 bp, Homo sapiens
cgagaggcagagaa

SEQ ID NO: 2074156 - DNA, 15 bp, Homo sapiens
cgagaggcagagaaa

SEQ ID NO: 2074157 - DNA, 14 bp, Homo sapiens
cgagaggtccctgc

SEQ ID NO: 2074158 - DNA, 17 bp, Homo sapiens
cgagatcacgccactgc

SEQ ID NO: 2074159 - DNA, 17 bp, Homo sapiens
cgagatcgctggcagag

SEQ ID NO: 2074160 - DNA, 18 bp, Homo sapiens
cgagatcgctggcagaga

SEQ ID NO: 2074161 - DNA, 14 bp, Homo sapiens
cgagcaaccgtggc

SEQ ID NO: 2074162 - DNA, 16 bp, Homo sapiens
cgagcaaccgtggccc

SEQ ID NO: 2074163 - DNA, 22 bp, Homo sapiens
cgagcaaccgtggcccttcctg

SEQ ID NO: 2074164 - DNA, 12 bp, Homo sapiens
cgagcacccacg

SEQ ID NO: 2074165 - DNA, 16 bp, Homo sapiens
cgagcactggccagag

SEQ ID NO: 2074166 - DNA, 19 bp, Homo sapiens
cgagcactggccagagagg

SEQ ID NO: 2074167 - DNA, 11 bp, Homo sapiens
cgagcagctga

SEQ ID NO: 2074168 - DNA, 18 bp, Homo sapiens
cgagcaggctactgtcag

SEQ ID NO: 2074169 - DNA, 18 bp, Homo sapiens
cgagccctggtggcagtg

SEQ ID NO: 2074170 - DNA, 14 bp, Homo sapiens
cgagccgggcctgg

SEQ ID NO: 2074171 - DNA, 14 bp, Homo sapiens
cgagcctaatgaaa

SEQ ID NO: 2074172 - DNA, 13 bp, Homo sapiens
cgagcgccctgca

SEQ ID NO: 2074173 - DNA, 15 bp, Homo sapiens
cgagcgccctgcaga

SEQ ID NO: 2074174 - DNA, 16 bp, Homo sapiens
cgagcgccctgcagac

SEQ ID NO: 2074175 - DNA, 16 bp, Homo sapiens
cgaggacagggaggtg

SEQ ID NO: 2074176 - DNA, 16 bp, Homo sapiens
cgaggcaccggcgctg

SEQ ID NO: 2074177 - DNA, 20 bp, Homo sapiens
cgaggcaccggcgctgcagg

SEQ ID NO: 2074178 - DNA, 21 bp, Homo sapiens
cgaggcaccggcgctgcaggt

SEQ ID NO: 2074179 - DNA, 10 bp, Homo sapiens
cgaggctctt

SEQ ID NO: 2074180 - DNA, 22 bp, Homo sapiens
cgaggctgcccactatggtcat

SEQ ID NO: 2074181 - DNA, 15 bp, Homo sapiens
cgagggcctgacagg

SEQ ID NO: 2074182 - DNA, 14 bp, Homo sapiens
cgaggtagagtttg

SEQ ID NO: 2074183 - DNA, 20 bp, Homo sapiens
cgaggtagagtttgaaggag

SEQ ID NO: 2074184 - DNA, 15 bp, Homo sapiens
cgaggtcaacagaga

SEQ ID NO: 2074185 - DNA, 16 bp, Homo sapiens
cgaggtcaacagagaa

SEQ ID NO: 2074186 - DNA, 18 bp, Homo sapiens
cgaggtgcggccaccacc

SEQ ID NO: 2074187 - DNA, 20 bp, Homo sapiens
cgaggtggatcacagaggct

SEQ ID NO: 2074188 - DNA, 16 bp, Homo sapiens
cgaggtgtcaccctgc

SEQ ID NO: 2074189 - DNA, 19 bp, Homo sapiens
cgaggtgtcaccctgcaga

SEQ ID NO: 2074190 - DNA, 20 bp, Homo sapiens
cgagtctcttctccactgga

SEQ ID NO: 2074191 - DNA, 14 bp, Homo sapiens
cgagtgccaggact

SEQ ID NO: 2074192 - DNA, 14 bp, Homo sapiens
cgatcaagtccaga

SEQ ID NO: 2074193 - DNA, 21 bp, Homo sapiens
cgatcctggattcactcactc

SEQ ID NO: 2074194 - DNA, 19 bp, Homo sapiens
cgatcggggcactgcaggg

SEQ ID NO: 2074195 - DNA, 23 bp, Homo sapiens
cgatgaatttggagactctgtgg

SEQ ID NO: 2074196 - DNA, 13 bp, Homo sapiens
cgatgacagtgct

SEQ ID NO: 2074197 - DNA, 17 bp, Homo sapiens
cgatgtggccctggcct

SEQ ID NO: 2074198 - DNA, 22 bp, Homo sapiens
cgatgtggccctggcctgctgg

SEQ ID NO: 2074199 - DNA, 18 bp, Homo sapiens
cgattagactggacagct

SEQ ID NO: 2074200 - DNA, 15 bp, Homo sapiens
cgattatttatttct

SEQ ID NO: 2074201 - DNA, 17 bp, Homo sapiens
cgattatttatttctgt

SEQ ID NO: 2074202 - DNA, 18 bp, Homo sapiens
cgattccctctcccaggc

SEQ ID NO: 2074203 - DNA, 23 bp, Homo sapiens
cgattccctctcccaggccccat

SEQ ID NO: 2074204 - DNA, 13 bp, Homo sapiens
cgattcttctgct

SEQ ID NO: 2074205 - DNA, 17 bp, Homo sapiens
cgattcttgtgcctcag

SEQ ID NO: 2074206 - DNA, 19 bp, Homo sapiens
cgcaacccgtgccaagtcc

SEQ ID NO: 2074207 - DNA, 16 bp, Homo sapiens
cgcaacccttgctgct

SEQ ID NO: 2074208 - DNA, 17 bp, Homo sapiens
cgctctgctggcctggc

SEQ ID NO: 2074209 - DNA, 18 bp, Homo sapiens
cgctctgctggcctggcc

SEQ ID NO: 2074210 - DNA, 21 bp, Homo sapiens
cgctcttggcaggtactcagc

SEQ ID NO: 2074211 - DNA, 14 bp, Homo sapiens
cgctcttggtccct

SEQ ID NO: 2074212 - DNA, 16 bp, Homo sapiens
cgctcttggtccctgg

SEQ ID NO: 2074213 - DNA, 14 bp, Homo sapiens
cgctgcaccacggc

SEQ ID NO: 2074214 - DNA, 15 bp, Homo sapiens
cgctgccaggacacc

SEQ ID NO: 2074215 - DNA, 17 bp, Homo sapiens
cgctgccaggacacctg

SEQ ID NO: 2074216 - DNA, 18 bp, Homo sapiens
cgctgccgcaccccagag

SEQ ID NO: 2074217 - DNA, 20 bp, Homo sapiens
cgctgccgcaccccagagtg

SEQ ID NO: 2074218 - DNA, 21 bp, Homo sapiens
cgctgccgcaccccagagtgt

SEQ ID NO: 2074219 - DNA, 15 bp, Homo sapiens
cgctgccgctgcacc

SEQ ID NO: 2074220 - DNA, 16 bp, Homo sapiens
cgctgccgctgcacca

SEQ ID NO: 2074221 - DNA, 15 bp, Homo sapiens
cgctgctagagaagg

SEQ ID NO: 2074222 - DNA, 16 bp, Homo sapiens
cgctgctagagaaggg

SEQ ID NO: 2074223 - DNA, 13 bp, Homo sapiens
cgctgctcaacct

SEQ ID NO: 2074224 - DNA, 18 bp, Homo sapiens
cgctgctcaacctctctc

SEQ ID NO: 2074225 - DNA, 19 bp, Homo sapiens
cgctgctctagctggcagg

SEQ ID NO: 2074226 - DNA, 11 bp, Homo sapiens
cgctgctgcta

SEQ ID NO: 2074227 - DNA, 15 bp, Homo sapiens
cgctggacaacccag

SEQ ID NO: 2074228 - DNA, 23 bp, Homo sapiens
cgctggaccttgaactgggtact

SEQ ID NO: 2074229 - DNA, 17 bp, Homo sapiens
cgctggagtgcagtgag

SEQ ID NO: 2074230 - DNA, 18 bp, Homo sapiens
cgctggagtgcagtgagc

SEQ ID NO: 2074231 - DNA, 13 bp, Homo sapiens
cgctggcagagaa

SEQ ID NO: 2074232 - DNA, 14 bp, Homo sapiens
cgctggctcaggaa

SEQ ID NO: 2074233 - DNA, 15 bp, Homo sapiens
cgctggctcaggaag

SEQ ID NO: 2074234 - DNA, 16 bp, Homo sapiens
cgctggctcaggaaga

SEQ ID NO: 2074235 - DNA, 21 bp, Homo sapiens
cgctgggaggaacctgaacct

SEQ ID NO: 2074236 - DNA, 21 bp, Homo sapiens
cgctgggatttcttcgctgct

SEQ ID NO: 2074237 - DNA, 16 bp, Homo sapiens
cgctggtggaccacag

SEQ ID NO: 2074238 - DNA, 21 bp, Homo sapiens
cgctggtggaccacaggcatc

SEQ ID NO: 2074239 - DNA, 23 bp, Homo sapiens
cgctgtcctctcgagcccagatg

SEQ ID NO: 2074240 - DNA, 14 bp, Homo sapiens
cgctgtcctgctgt

SEQ ID NO: 2074241 - DNA, 16 bp, Homo sapiens
cgctgtcctgctgtgt

SEQ ID NO: 2074242 - DNA, 18 bp, Homo sapiens
cgctgtcgccccaggccc

SEQ ID NO: 2074243 - DNA, 21 bp, Homo sapiens
cgctgtgaaaatgaggaggat

SEQ ID NO: 2074244 - DNA, 16 bp, Homo sapiens
cgctgtgagcccctgg

SEQ ID NO: 2074245 - DNA, 19 bp, Homo sapiens
cgctgtgagcccctggtcc

SEQ ID NO: 2074246 - DNA, 20 bp, Homo sapiens
cgctgtggctcctgccttga

SEQ ID NO: 2074247 - DNA, 14 bp, Homo sapiens
cgctgttcacccac

SEQ ID NO: 2074248 - DNA, 13 bp, Homo sapiens
cgcttcacccctg

SEQ ID NO: 2074249 - DNA, 12 bp, Homo sapiens
cgcttccagacc

SEQ ID NO: 2074250 - DNA, 15 bp, Homo sapiens
cgcttccagaccacc

SEQ ID NO: 2074251 - DNA, 16 bp, Homo sapiens
cgcttccagaccacct

SEQ ID NO: 2074252 - DNA, 19 bp, Homo sapiens
cgcttccagaccacctgcc

SEQ ID NO: 2074253 - DNA, 14 bp, Homo sapiens
cgcttccccacaga

SEQ ID NO: 2074254 - DNA, 13 bp, Homo sapiens
cgcttctcctcca

SEQ ID NO: 2074255 - DNA, 14 bp, Homo sapiens
cgcttctcctccag

SEQ ID NO: 2074256 - DNA, 12 bp, Homo sapiens
cgcttctgactg

SEQ ID NO: 2074257 - DNA, 13 bp, Homo sapiens
cgcttgagcccag

SEQ ID NO: 2074258 - DNA, 14 bp, Homo sapiens
cgcttgagcccagg

SEQ ID NO: 2074259 - DNA, 15 bp, Homo sapiens
cgcttgagcccagga

SEQ ID NO: 2074260 - DNA, 17 bp, Homo sapiens
cgcttgagcccaggagt

SEQ ID NO: 2074261 - DNA, 16 bp, Homo sapiens
cgcttgcttctgcagc

SEQ ID NO: 2074262 - DNA, 22 bp, Homo sapiens
cgcttgcttctgcagcaactcc

SEQ ID NO: 2074263 - DNA, 17 bp, Homo sapiens
cgcttgtccagcgccta

SEQ ID NO: 2074264 - DNA, 20 bp, Homo sapiens
cgcttgtccagcgcctagtg

SEQ ID NO: 2074265 - DNA, 20 bp, Homo sapiens
cgctttcatgaacacagcct

SEQ ID NO: 2074266 - DNA, 16 bp, Homo sapiens
cgctttctagctgttg

SEQ ID NO: 2074267 - DNA, 15 bp, Homo sapiens
cggaaaccttgcagc

SEQ ID NO: 2074268 - DNA, 14 bp, Homo sapiens
cggaaagactgaaa

SEQ ID NO: 2074269 - DNA, 16 bp, Homo sapiens
cggaaagactgaaaga

SEQ ID NO: 2074270 - DNA, 20 bp, Homo sapiens
cggaagcagtgccttccata

SEQ ID NO: 2074271 - DNA, 22 bp, Homo sapiens
cggaagccgtctgactccagag

SEQ ID NO: 2074272 - DNA, 20 bp, Homo sapiens
cggaagcctttttccccaaa

SEQ ID NO: 2074273 - DNA, 16 bp, Homo sapiens
cggaagggggaagtct

SEQ ID NO: 2074274 - DNA, 21 bp, Homo sapiens
cggaagggttggtgggctggc

SEQ ID NO: 2074275 - DNA, 22 bp, Homo sapiens
cggaatcctgtcgattagactg

SEQ ID NO: 2074276 - DNA, 16 bp, Homo sapiens
cggacagccacggcca

SEQ ID NO: 2074277 - DNA, 21 bp, Homo sapiens
cggacagccacggccaggcca

SEQ ID NO: 2074278 - DNA, 20 bp, Homo sapiens
cggaccaagatgggcacatg

SEQ ID NO: 2074279 - DNA, 14 bp, Homo sapiens
cggacctttcagct

SEQ ID NO: 2074280 - DNA, 15 bp, Homo sapiens
cggacgtcctgctgg

SEQ ID NO: 2074281 - DNA, 16 bp, Homo sapiens
cggacgtcctgctggc

SEQ ID NO: 2074282 - DNA, 21 bp, Homo sapiens
cggacgtcctgctggcacctc

SEQ ID NO: 2074283 - DNA, 16 bp, Homo sapiens
cggacgtttccatcag

SEQ ID NO: 2074284 - DNA, 15 bp, Homo sapiens
cggagaattgcctct

SEQ ID NO: 2074285 - DNA, 17 bp, Homo sapiens
cggagacggagtcccac

SEQ ID NO: 2074286 - DNA, 20 bp, Homo sapiens
cggagacggagtcccacctt

SEQ ID NO: 2074287 - DNA, 17 bp, Homo sapiens
cggagagtacagtgagc

SEQ ID NO: 2074288 - DNA, 18 bp, Homo sapiens
cggagagtacagtgagcc

SEQ ID NO: 2074289 - DNA, 16 bp, Homo sapiens
cggagcacagccctgg

SEQ ID NO: 2074290 - DNA, 17 bp, Homo sapiens
cggagccggcacctaca

SEQ ID NO: 2074291 - DNA, 20 bp, Homo sapiens
cggagcctcatccgaggcag

SEQ ID NO: 2074292 - DNA, 13 bp, Homo sapiens
cggaggagaccag

SEQ ID NO: 2074293 - DNA, 16 bp, Homo sapiens
cggaggagaccagctc

SEQ ID NO: 2074294 - DNA, 22 bp, Homo sapiens
cggaggagaccagctcagaggc

SEQ ID NO: 2074295 - DNA, 22 bp, Homo sapiens
cggaggctgggcccctgggatg

SEQ ID NO: 2074296 - DNA, 19 bp, Homo sapiens
cggaggtggtggaggagga

SEQ ID NO: 2074297 - DNA, 16 bp, Homo sapiens
cggagtaatcaggcag

SEQ ID NO: 2074298 - DNA, 17 bp, Homo sapiens
cggagtaatcaggcagc

SEQ ID NO: 2074299 - DNA, 21 bp, Homo sapiens
cggagtcccaccttggctgca

SEQ ID NO: 2074300 - DNA, 18 bp, Homo sapiens
cggagtgagttttttagt

SEQ ID NO: 2074301 - DNA, 13 bp, Homo sapiens
cggatttgacaaa

SEQ ID NO: 2074302 - DNA, 23 bp, Homo sapiens
cggatttgacaaaataacatttg

SEQ ID NO: 2074303 - DNA, 21 bp, Homo sapiens
cggcaaccccagttctgctcc

SEQ ID NO: 2074304 - DNA, 19 bp, Homo sapiens
cggcacattggcagtgtgt

SEQ ID NO: 2074305 - DNA, 16 bp, Homo sapiens
cggcaccccctgcagc

SEQ ID NO: 2074306 - DNA, 17 bp, Homo sapiens
cggcaccccctgcagct

SEQ ID NO: 2074307 - DNA, 20 bp, Homo sapiens
cggcaccccctgcagcttgt

SEQ ID NO: 2074308 - DNA, 21 bp, Homo sapiens
cggcacctacatccccaggtc

SEQ ID NO: 2074309 - DNA, 22 bp, Homo sapiens
cggcacctgcgagaggtccctg

SEQ ID NO: 2074310 - DNA, 19 bp, Homo sapiens
cggcacctgggccctgggg

SEQ ID NO: 2074311 - DNA, 16 bp, Homo sapiens
cggcaggagcaggaac

SEQ ID NO: 2074312 - DNA, 20 bp, Homo sapiens
cggcaggagcaggaacagag

SEQ ID NO: 2074313 - DNA, 23 bp, Homo sapiens
cggcaggagcaggaacagagact

SEQ ID NO: 2074314 - DNA, 15 bp, Homo sapiens
cggcaggctgggttc

SEQ ID NO: 2074315 - DNA, 11 bp, Homo sapiens
cggcatgctgg

SEQ ID NO: 2074316 - DNA, 13 bp, Homo sapiens
cggcatgctggcc

SEQ ID NO: 2074317 - DNA, 14 bp, Homo sapiens
cggcatgctggcct

SEQ ID NO: 2074318 - DNA, 11 bp, Homo sapiens
cggccaccctc

SEQ ID NO: 2074319 - DNA, 24 bp, Homo sapiens
cggccaggccagagggagtgacag

SEQ ID NO: 2074320 - DNA, 15 bp, Homo sapiens
cggccagggcctggt

SEQ ID NO: 2074321 - DNA, 16 bp, Homo sapiens
cggccagggcctggtg

SEQ ID NO: 2074322 - DNA, 18 bp, Homo sapiens
cggccagggcctggtgtg

SEQ ID NO: 2074323 - DNA, 23 bp, Homo sapiens
cggccccatcagaggctggggga

SEQ ID NO: 2074324 - DNA, 23 bp, Homo sapiens
cggccccccctcttttggccttg

SEQ ID NO: 2074325 - DNA, 12 bp, Homo sapiens
ccttatcttgaa

SEQ ID NO: 2074326 - DNA, 19 bp, Homo sapiens
ccttatgtaattattttct

SEQ ID NO: 2074327 - DNA, 13 bp, Homo sapiens
ccttatgtattat

SEQ ID NO: 2074328 - DNA, 20 bp, Homo sapiens
ccttatgtattattttctat

SEQ ID NO: 2074329 - DNA, 15 bp, Homo sapiens
ccttattgtacctct

SEQ ID NO: 2074330 - DNA, 22 bp, Homo sapiens
ccttatttatcaacatcttttt

SEQ ID NO: 2074331 - DNA, 24 bp, Homo sapiens
ccttcaactgaaaagactcagtgt

SEQ ID NO: 2074332 - DNA, 14 bp, Homo sapiens
ccttcaagcaccct

SEQ ID NO: 2074333 - DNA, 23 bp, Homo sapiens
ccttcaagcaccctgttccctct

SEQ ID NO: 2074334 - DNA, 23 bp, Homo sapiens
ccttcaagccagcaacacagagc

SEQ ID NO: 2074335 - DNA, 17 bp, Homo sapiens
ccttcaagttagctcag

SEQ ID NO: 2074336 - DNA, 13 bp, Homo sapiens
ccttgcacctgca

SEQ ID NO: 2074337 - DNA, 10 bp, Homo sapiens
ccttgcagca

SEQ ID NO: 2074338 - DNA, 18 bp, Homo sapiens
ccttgccaagctttcttc

SEQ ID NO: 2074339 - DNA, 13 bp, Homo sapiens
ccttgccagacat

SEQ ID NO: 2074340 - DNA, 11 bp, Homo sapiens
ccttgcccaga

SEQ ID NO: 2074341 - DNA, 13 bp, Homo sapiens
ccttgcccagggc

SEQ ID NO: 2074342 - DNA, 16 bp, Homo sapiens
ccttgcccagggctca

SEQ ID NO: 2074343 - DNA, 18 bp, Homo sapiens
ccttgcccagggctcagc

SEQ ID NO: 2074344 - DNA, 20 bp, Homo sapiens
ccttgcccccatccctcgga

SEQ ID NO: 2074345 - DNA, 16 bp, Homo sapiens
ccttgcccgccagcct

SEQ ID NO: 2074346 - DNA, 12 bp, Homo sapiens
ccttgccctgac

SEQ ID NO: 2074347 - DNA, 13 bp, Homo sapiens
ccttgccctgacc

SEQ ID NO: 2074348 - DNA, 23 bp, Homo sapiens
ccttgccctgacctcccagccct

SEQ ID NO: 2074349 - DNA, 16 bp, Homo sapiens
ccttgcccttgccctg

SEQ ID NO: 2074350 - DNA, 22 bp, Homo sapiens
ccttgctcaccaagctgttcca

SEQ ID NO: 2074351 - DNA, 20 bp, Homo sapiens
ccttgctcagtgcctcctgg

SEQ ID NO: 2074352 - DNA, 21 bp, Homo sapiens
ccttgctcctccttctgctgc

SEQ ID NO: 2074353 - DNA, 17 bp, Homo sapiens
ccttgctcttctttctg

SEQ ID NO: 2074354 - DNA, 14 bp, Homo sapiens
ccttgctttgctgt

SEQ ID NO: 2074355 - DNA, 22 bp, Homo sapiens
ccttgctttgggctttgcaggc

SEQ ID NO: 2074356 - DNA, 18 bp, Homo sapiens
ccttggactcctcccaca

SEQ ID NO: 2074357 - DNA, 13 bp, Homo sapiens
ccttggacttgag

SEQ ID NO: 2074358 - DNA, 15 bp, Homo sapiens
ccttggacttgagga

SEQ ID NO: 2074359 - DNA, 17 bp, Homo sapiens
ccttggagagcagctgg

SEQ ID NO: 2074360 - DNA, 13 bp, Homo sapiens
ccttggagcagaa

SEQ ID NO: 2074361 - DNA, 15 bp, Homo sapiens
ccttggaggacagtg

SEQ ID NO: 2074362 - DNA, 17 bp, Homo sapiens
ccttggaggacagtggg

SEQ ID NO: 2074363 - DNA, 18 bp, Homo sapiens
ccttggaggacagtggga

SEQ ID NO: 2074364 - DNA, 17 bp, Homo sapiens
ccttggaggagggctgt

SEQ ID NO: 2074365 - DNA, 18 bp, Homo sapiens
ccttggataatgctgttg

SEQ ID NO: 2074366 - DNA, 22 bp, Homo sapiens
ccttggataatgctgttgcctc

SEQ ID NO: 2074367 - DNA, 23 bp, Homo sapiens
ccttggataatgctgttgcctca

SEQ ID NO: 2074368 - DNA, 22 bp, Homo sapiens
ccttggctcaagtcctcttttc

SEQ ID NO: 2074369 - DNA, 12 bp, Homo sapiens
ccttggctgcag

SEQ ID NO: 2074370 - DNA, 13 bp, Homo sapiens
ccttggctgcagg

SEQ ID NO: 2074371 - DNA, 11 bp, Homo sapiens
ccttgggagag

SEQ ID NO: 2074372 - DNA, 22 bp, Homo sapiens
ccttgggagtcattaccacgcc

SEQ ID NO: 2074373 - DNA, 23 bp, Homo sapiens
ccttgggcatccacccagtgctg

SEQ ID NO: 2074374 - DNA, 14 bp, Homo sapiens
ccttgggctcctgg

SEQ ID NO: 2074375 - DNA, 17 bp, Homo sapiens
ccttgggctcctggctg

SEQ ID NO: 2074376 - DNA, 20 bp, Homo sapiens
ccttgggctcctggctgcca

SEQ ID NO: 2074377 - DNA, 18 bp, Homo sapiens
ccttggggattcttccat

SEQ ID NO: 2074378 - DNA, 11 bp, Homo sapiens
ccttggggcac

SEQ ID NO: 2074379 - DNA, 17 bp, Homo sapiens
ccttggggcctggcttg

SEQ ID NO: 2074380 - DNA, 21 bp, Homo sapiens
ccttggggtaagccagagcct

SEQ ID NO: 2074381 - DNA, 16 bp, Homo sapiens
ccttggtctgctggtg

SEQ ID NO: 2074382 - DNA, 17 bp, Homo sapiens
ccttggtgtccacctgg

SEQ ID NO: 2074383 - DNA, 21 bp, Homo sapiens
ccttggtttggacacagtgtt

SEQ ID NO: 2074384 - DNA, 16 bp, Homo sapiens
ccttgtaattctaaat

SEQ ID NO: 2074385 - DNA, 14 bp, Homo sapiens
ccttgtatttaaat

SEQ ID NO: 2074386 - DNA, 16 bp, Homo sapiens
ccttgtatttaaatat

SEQ ID NO: 2074387 - DNA, 18 bp, Homo sapiens
ccttgtcaggacccaggc

SEQ ID NO: 2074388 - DNA, 15 bp, Homo sapiens
ccttgtcctctcccg

SEQ ID NO: 2074389 - DNA, 21 bp, Homo sapiens
ccttgtcctgccagctgcctt

SEQ ID NO: 2074390 - DNA, 13 bp, Homo sapiens
ccttgtctctcat

SEQ ID NO: 2074391 - DNA, 20 bp, Homo sapiens
ccttgtctggggaccctgta

SEQ ID NO: 2074392 - DNA, 12 bp, Homo sapiens
ccttgtgaggat

SEQ ID NO: 2074393 - DNA, 14 bp, Homo sapiens
ccttgtgccctgcc

SEQ ID NO: 2074394 - DNA, 16 bp, Homo sapiens
ccttgtgccctgcccc

SEQ ID NO: 2074395 - DNA, 15 bp, Homo sapiens
ccttgtgtcagagct

SEQ ID NO: 2074396 - DNA, 21 bp, Homo sapiens
ccttgtgtcagagctgggagt

SEQ ID NO: 2074397 - DNA, 18 bp, Homo sapiens
ccttgtgtgcatttctgt

SEQ ID NO: 2074398 - DNA, 14 bp, Homo sapiens
ccttgtgtttctgt

SEQ ID NO: 2074399 - DNA, 13 bp, Homo sapiens
ccttgttgcatga

SEQ ID NO: 2074400 - DNA, 16 bp, Homo sapiens
ccttgtttggggcagg

SEQ ID NO: 2074401 - DNA, 19 bp, Homo sapiens
ccttgtttggggcaggagt

SEQ ID NO: 2074402 - DNA, 19 bp, Homo sapiens
ccttgttttattcaaagac

SEQ ID NO: 2074403 - DNA, 15 bp, Homo sapiens
cctttaaagacttaa

SEQ ID NO: 2074404 - DNA, 20 bp, Homo sapiens
cctttaaagacttaagatta

SEQ ID NO: 2074405 - DNA, 15 bp, Homo sapiens
cctttaagtcctctc

SEQ ID NO: 2074406 - DNA, 15 bp, Homo sapiens
cctttaggcagcctg

SEQ ID NO: 2074407 - DNA, 19 bp, Homo sapiens
cctttatatttagtgaact

SEQ ID NO: 2074408 - DNA, 23 bp, Homo sapiens
cctttatccctgaggtcacctgg

SEQ ID NO: 2074409 - DNA, 13 bp, Homo sapiens
cctttattgtgat

SEQ ID NO: 2074410 - DNA, 15 bp, Homo sapiens
cctttcacaaccttc

SEQ ID NO: 2074411 - DNA, 12 bp, Homo sapiens
cctttcagctgt

SEQ ID NO: 2074412 - DNA, 20 bp, Homo sapiens
cctttcagggaatttcagga

SEQ ID NO: 2074413 - DNA, 17 bp, Homo sapiens
cctttcatccccacctt

SEQ ID NO: 2074414 - DNA, 16 bp, Homo sapiens
cctttccacctgcttt

SEQ ID NO: 2074415 - DNA, 20 bp, Homo sapiens
cctttcccatgatccagaac

SEQ ID NO: 2074416 - DNA, 21 bp, Homo sapiens
cctttcccatgatccagaact

SEQ ID NO: 2074417 - DNA, 13 bp, Homo sapiens
cctttccccagac

SEQ ID NO: 2074418 - DNA, 16 bp, Homo sapiens
cctttccccagacaca

SEQ ID NO: 2074419 - DNA, 14 bp, Homo sapiens
cctttcccccaccc

SEQ ID NO: 2074420 - DNA, 21 bp, Homo sapiens
cctttcccccaccccagagtt

SEQ ID NO: 2074421 - DNA, 22 bp, Homo sapiens
cctttcccccaccccagagttg

SEQ ID NO: 2074422 - DNA, 14 bp, Homo sapiens
cctttccgctgtcg

SEQ ID NO: 2074423 - DNA, 13 bp, Homo sapiens
cctttcctcccca

SEQ ID NO: 2074424 - DNA, 14 bp, Homo sapiens
cctttcctctgcag

SEQ ID NO: 2074425 - DNA, 19 bp, Homo sapiens
cctttcctctgcagcactt

SEQ ID NO: 2074426 - DNA, 21 bp, Homo sapiens
cctttcctctgcagcacttta

SEQ ID NO: 2074427 - DNA, 16 bp, Homo sapiens
cctttcctgggggatg

SEQ ID NO: 2074428 - DNA, 17 bp, Homo sapiens
cctttcctgtgccaacc

SEQ ID NO: 2074429 - DNA, 20 bp, Homo sapiens
cctttcctgtgccaacctga

SEQ ID NO: 2074430 - DNA, 21 bp, Homo sapiens
cctttccttccttccctggct

SEQ ID NO: 2074431 - DNA, 15 bp, Homo sapiens
cctttctccagccag

SEQ ID NO: 2074432 - DNA, 17 bp, Homo sapiens
cctttctctgagagaga

SEQ ID NO: 2074433 - DNA, 21 bp, Homo sapiens
cctttcttatttgcaataaaa

SEQ ID NO: 2074434 - DNA, 14 bp, Homo sapiens
cctttgaatcctct

SEQ ID NO: 2074435 - DNA, 20 bp, Homo sapiens
cctttgaatcctctctctgt

SEQ ID NO: 2074436 - DNA, 17 bp, Homo sapiens
cctttgagaaagaaata

SEQ ID NO: 2074437 - DNA, 19 bp, Homo sapiens
cctttgaggcaaaggccag

SEQ ID NO: 2074438 - DNA, 18 bp, Homo sapiens
cctttgcactgagggcca

SEQ ID NO: 2074439 - DNA, 21 bp, Homo sapiens
cctttgcattccatgatttta

SEQ ID NO: 2074440 - DNA, 17 bp, Homo sapiens
cctttgccccaaggctg

SEQ ID NO: 2074441 - DNA, 22 bp, Homo sapiens
cctttgcctaggaggccttctc

SEQ ID NO: 2074442 - DNA, 20 bp, Homo sapiens
cctttggaaaaatcttgggc

SEQ ID NO: 2074443 - DNA, 14 bp, Homo sapiens
cctttggtgcagag

SEQ ID NO: 2074444 - DNA, 17 bp, Homo sapiens
cctttggtgcagaggtt

SEQ ID NO: 2074445 - DNA, 23 bp, Homo sapiens
cctttgtcatctttcttctattt

SEQ ID NO: 2074446 - DNA, 15 bp, Homo sapiens
cctgggggctagcag

SEQ ID NO: 2074447 - DNA, 15 bp, Homo sapiens
cctgggggtggcagg

SEQ ID NO: 2074448 - DNA, 17 bp, Homo sapiens
cctgggggtggcaggca

SEQ ID NO: 2074449 - DNA, 22 bp, Homo sapiens
cctggggtccttgctgcaggcc

SEQ ID NO: 2074450 - DNA, 18 bp, Homo sapiens
cctggggtgacccggcac

SEQ ID NO: 2074451 - DNA, 16 bp, Homo sapiens
cctgggtgacttcagg

SEQ ID NO: 2074452 - DNA, 20 bp, Homo sapiens
cctgggtgagaatcctgcct

SEQ ID NO: 2074453 - DNA, 18 bp, Homo sapiens
cctgggtgccattcccag

SEQ ID NO: 2074454 - DNA, 14 bp, Homo sapiens
cctgggtggctact

SEQ ID NO: 2074455 - DNA, 22 bp, Homo sapiens
cctgggtggctactctgtgcca

SEQ ID NO: 2074456 - DNA, 15 bp, Homo sapiens
cctgggtgggcagga

SEQ ID NO: 2074457 - DNA, 15 bp, Homo sapiens
cctgggtggggctgc

SEQ ID NO: 2074458 - DNA, 23 bp, Homo sapiens
cctgggtggggctgctcctccag

SEQ ID NO: 2074459 - DNA, 23 bp, Homo sapiens
cctgggtggtatagggcgtttgg

SEQ ID NO: 2074460 - DNA, 16 bp, Homo sapiens
cctgggttttctaact

SEQ ID NO: 2074461 - DNA, 17 bp, Homo sapiens
cctgggttttctaactg

SEQ ID NO: 2074462 - DNA, 22 bp, Homo sapiens
cctgggttttctaactgtaaat

SEQ ID NO: 2074463 - DNA, 18 bp, Homo sapiens
cctggtaagcagaggctt

SEQ ID NO: 2074464 - DNA, 18 bp, Homo sapiens
cctggtactgcacatttt

SEQ ID NO: 2074465 - DNA, 22 bp, Homo sapiens
cctggtcacaggactctgcctc

SEQ ID NO: 2074466 - DNA, 15 bp, Homo sapiens
cctggtccctcgtcc

SEQ ID NO: 2074467 - DNA, 23 bp, Homo sapiens
cctggtcctgagggtccccacct

SEQ ID NO: 2074468 - DNA, 19 bp, Homo sapiens
cctggtccttccaggcccc

SEQ ID NO: 2074469 - DNA, 22 bp, Homo sapiens
cctggtctgtgctgccctgctc

SEQ ID NO: 2074470 - DNA, 18 bp, Homo sapiens
cctggtgaggcccagcct

SEQ ID NO: 2074471 - DNA, 14 bp, Homo sapiens
cctggtgatcacgt

SEQ ID NO: 2074472 - DNA, 19 bp, Homo sapiens
cctggtgcactggccccac

SEQ ID NO: 2074473 - DNA, 18 bp, Homo sapiens
cctggtgctgccacactt

SEQ ID NO: 2074474 - DNA, 21 bp, Homo sapiens
cctggtgctgccacacttcag

SEQ ID NO: 2074475 - DNA, 14 bp, Homo sapiens
cctggtggacagtc

SEQ ID NO: 2074476 - DNA, 19 bp, Homo sapiens
cctggtggacagtcctggg

SEQ ID NO: 2074477 - DNA, 17 bp, Homo sapiens
cctggtggcaccagatg

SEQ ID NO: 2074478 - DNA, 23 bp, Homo sapiens
cctggtggcaccagatgcaacct

SEQ ID NO: 2074479 - DNA, 13 bp, Homo sapiens
cctggtggcagct

SEQ ID NO: 2074480 - DNA, 14 bp, Homo sapiens
cctggtggcagctg

SEQ ID NO: 2074481 - DNA, 16 bp, Homo sapiens
cctggtggcagctgcg

SEQ ID NO: 2074482 - DNA, 17 bp, Homo sapiens
cctggtggcagctgcgg

SEQ ID NO: 2074483 - DNA, 15 bp, Homo sapiens
cctggtggcagtggg

SEQ ID NO: 2074484 - DNA, 19 bp, Homo sapiens
cctggtggcagtgggagct

SEQ ID NO: 2074485 - DNA, 20 bp, Homo sapiens
cctggtggcagtgggagctg

SEQ ID NO: 2074486 - DNA, 22 bp, Homo sapiens
cctggtggccatgtcgcctgcc

SEQ ID NO: 2074487 - DNA, 20 bp, Homo sapiens
cctggtgggcctcctctgtc

SEQ ID NO: 2074488 - DNA, 23 bp, Homo sapiens
cctgtaaatagttttaaatatga

SEQ ID NO: 2074489 - DNA, 18 bp, Homo sapiens
cctgtaacacaagccaca

SEQ ID NO: 2074490 - DNA, 23 bp, Homo sapiens
cctgtaacacaagccacagaagc

SEQ ID NO: 2074491 - DNA, 20 bp, Homo sapiens
cctgtaatcatataataaat

SEQ ID NO: 2074492 - DNA, 14 bp, Homo sapiens
cctgtaatcccagc

SEQ ID NO: 2074493 - DNA, 15 bp, Homo sapiens
cctgtaatcccagca

SEQ ID NO: 2074494 - DNA, 16 bp, Homo sapiens
cctgtaatcccagcag

SEQ ID NO: 2074495 - DNA, 15 bp, Homo sapiens
cctgtaatcccagct

SEQ ID NO: 2074496 - DNA, 21 bp, Homo sapiens
cctgtaatcccagctacacct

SEQ ID NO: 2074497 - DNA, 18 bp, Homo sapiens
cctgtaatcccagctact

SEQ ID NO: 2074498 - DNA, 15 bp, Homo sapiens
cctgtacccagctcc

SEQ ID NO: 2074499 - DNA, 16 bp, Homo sapiens
cctgtacccagctcct

SEQ ID NO: 2074500 - DNA, 17 bp, Homo sapiens
cctgtacccagctcctt

SEQ ID NO: 2074501 - DNA, 14 bp, Homo sapiens
cctgtaccccagca

SEQ ID NO: 2074502 - DNA, 18 bp, Homo sapiens
cctgtacgaacccctccc

SEQ ID NO: 2074503 - DNA, 14 bp, Homo sapiens
cctgtactcaggag

SEQ ID NO: 2074504 - DNA, 21 bp, Homo sapiens
cctgtactcaggaggctgagg

SEQ ID NO: 2074505 - DNA, 22 bp, Homo sapiens
cctgtactcaggaggctgaggg

SEQ ID NO: 2074506 - DNA, 13 bp, Homo sapiens
cctgtactgcctg

SEQ ID NO: 2074507 - DNA, 15 bp, Homo sapiens
cctgtactgcctgct

SEQ ID NO: 2074508 - DNA, 16 bp, Homo sapiens
cctgtactgcctgctt

SEQ ID NO: 2074509 - DNA, 19 bp, Homo sapiens
cctgtactgggttattttt

SEQ ID NO: 2074510 - DNA, 14 bp, Homo sapiens
cctgtagagtcact

SEQ ID NO: 2074511 - DNA, 17 bp, Homo sapiens
cctgtagagtcactgac

SEQ ID NO: 2074512 - DNA, 16 bp, Homo sapiens
cctgtagctctgcctc

SEQ ID NO: 2074513 - DNA, 20 bp, Homo sapiens
cctgtagctctgcctccctc

SEQ ID NO: 2074514 - DNA, 13 bp, Homo sapiens
cctgtaggttgct

SEQ ID NO: 2074515 - DNA, 18 bp, Homo sapiens
cctgtagtcccagccact

SEQ ID NO: 2074516 - DNA, 13 bp, Homo sapiens
cctgtagtcctag

SEQ ID NO: 2074517 - DNA, 14 bp, Homo sapiens
cctgtagttaggaa

SEQ ID NO: 2074518 - DNA, 15 bp, Homo sapiens
cctgtagttaggaaa

SEQ ID NO: 2074519 - DNA, 17 bp, Homo sapiens
cctgtagttaggaaata

SEQ ID NO: 2074520 - DNA, 23 bp, Homo sapiens
cctgtagttaggaaataaaacct

SEQ ID NO: 2074521 - DNA, 18 bp, Homo sapiens
cctgtagttgcgtggact

SEQ ID NO: 2074522 - DNA, 17 bp, Homo sapiens
cctgtatattatggtgt

SEQ ID NO: 2074523 - DNA, 19 bp, Homo sapiens
cctgtatattatggtgtaa

SEQ ID NO: 2074524 - DNA, 23 bp, Homo sapiens
cctgtatattatggtgtaatgca

SEQ ID NO: 2074525 - DNA, 16 bp, Homo sapiens
cctgtatgtctccagt

SEQ ID NO: 2074526 - DNA, 22 bp, Homo sapiens
cctgtatttgttcccaagagca

SEQ ID NO: 2074527 - DNA, 12 bp, Homo sapiens
cctgtcaccctg

SEQ ID NO: 2074528 - DNA, 16 bp, Homo sapiens
cctgtcaccctggccc

SEQ ID NO: 2074529 - DNA, 20 bp, Homo sapiens
cctgtcaccctggccccaac

SEQ ID NO: 2074530 - DNA, 13 bp, Homo sapiens
cctgtcagaggct

SEQ ID NO: 2074531 - DNA, 17 bp, Homo sapiens
cctgtcagtttcatgga

SEQ ID NO: 2074532 - DNA, 22 bp, Homo sapiens
cctgtcattcccaccaccctga

SEQ ID NO: 2074533 - DNA, 15 bp, Homo sapiens
cctgtccataaagta

SEQ ID NO: 2074534 - DNA, 14 bp, Homo sapiens
cctgtcccagaggt

SEQ ID NO: 2074535 - DNA, 23 bp, Homo sapiens
cctgtcccagaggttatctgcct

SEQ ID NO: 2074536 - DNA, 15 bp, Homo sapiens
cctgtcccccaaggt

SEQ ID NO: 2074537 - DNA, 15 bp, Homo sapiens
cctcgaggcaccggc

SEQ ID NO: 2074538 - DNA, 19 bp, Homo sapiens
cctcgaggctcttccatcc

SEQ ID NO: 2074539 - DNA, 23 bp, Homo sapiens
cctcgcaacccgtgccaagtcca

SEQ ID NO: 2074540 - DNA, 22 bp, Homo sapiens
cctcgcaggtctcagcccggga

SEQ ID NO: 2074541 - DNA, 14 bp, Homo sapiens
cctcgcctctccca

SEQ ID NO: 2074542 - DNA, 19 bp, Homo sapiens
cctcgcctgggcccaggct

SEQ ID NO: 2074543 - DNA, 17 bp, Homo sapiens
cctcgctccccactctg

SEQ ID NO: 2074544 - DNA, 22 bp, Homo sapiens
cctcgctccccactctgctctg

SEQ ID NO: 2074545 - DNA, 15 bp, Homo sapiens
cctcgctgctgctac

SEQ ID NO: 2074546 - DNA, 16 bp, Homo sapiens
cctcgctgtcctgctg

SEQ ID NO: 2074547 - DNA, 17 bp, Homo sapiens
cctcgctgtcctgctgt

SEQ ID NO: 2074548 - DNA, 19 bp, Homo sapiens
cctcgctgtcctgctgtgt

SEQ ID NO: 2074549 - DNA, 16 bp, Homo sapiens
cctcggagcctcatcc

SEQ ID NO: 2074550 - DNA, 22 bp, Homo sapiens
cctcggtggccatgcttcttgc

SEQ ID NO: 2074551 - DNA, 15 bp, Homo sapiens
cctcgtaccagccag

SEQ ID NO: 2074552 - DNA, 14 bp, Homo sapiens
cctcgtccacaggg

SEQ ID NO: 2074553 - DNA, 19 bp, Homo sapiens
cctcgtcctccccctgcca

SEQ ID NO: 2074554 - DNA, 14 bp, Homo sapiens
cctcgtcctgtccc

SEQ ID NO: 2074555 - DNA, 16 bp, Homo sapiens
cctcgtcctgtcccag

SEQ ID NO: 2074556 - DNA, 17 bp, Homo sapiens
cctcgtggacacctgcc

SEQ ID NO: 2074557 - DNA, 14 bp, Homo sapiens
cctctaagccactc

SEQ ID NO: 2074558 - DNA, 12 bp, Homo sapiens
cctctagaacac

SEQ ID NO: 2074559 - DNA, 16 bp, Homo sapiens
cctctagaacacccac

SEQ ID NO: 2074560 - DNA, 14 bp, Homo sapiens
cctctagtgccctc

SEQ ID NO: 2074561 - DNA, 13 bp, Homo sapiens
cctctatttctct

SEQ ID NO: 2074562 - DNA, 17 bp, Homo sapiens
cctctcaagctagccag

SEQ ID NO: 2074563 - DNA, 16 bp, Homo sapiens
cctctccagccttctc

SEQ ID NO: 2074564 - DNA, 11 bp, Homo sapiens
cctctccaggc

SEQ ID NO: 2074565 - DNA, 13 bp, Homo sapiens
cctctccaggcac

SEQ ID NO: 2074566 - DNA, 14 bp, Homo sapiens
cctctccaggcacc

SEQ ID NO: 2074567 - DNA, 15 bp, Homo sapiens
cctctccatgcccaa

SEQ ID NO: 2074568 - DNA, 16 bp, Homo sapiens
cctctccatgcccaac

SEQ ID NO: 2074569 - DNA, 18 bp, Homo sapiens
cctctccatgcccaacct

SEQ ID NO: 2074570 - DNA, 14 bp, Homo sapiens
cctctcccaggccc

SEQ ID NO: 2074571 - DNA, 15 bp, Homo sapiens
cctctcccaggcccc

SEQ ID NO: 2074572 - DNA, 16 bp, Homo sapiens
cctctcccaggcccca

SEQ ID NO: 2074573 - DNA, 17 bp, Homo sapiens
cctctcccaggccccat

SEQ ID NO: 2074574 - DNA, 16 bp, Homo sapiens
cctctcccccgcccaa

SEQ ID NO: 2074575 - DNA, 12 bp, Homo sapiens
cctctcccggct

SEQ ID NO: 2074576 - DNA, 14 bp, Homo sapiens
cctctcccggctgc

SEQ ID NO: 2074577 - DNA, 22 bp, Homo sapiens
cctctcccggctgcctgccgcc

SEQ ID NO: 2074578 - DNA, 14 bp, Homo sapiens
cctctcctgcctac

SEQ ID NO: 2074579 - DNA, 16 bp, Homo sapiens
cctctcctgcctactc

SEQ ID NO: 2074580 - DNA, 14 bp, Homo sapiens
cctctccttgggct

SEQ ID NO: 2074581 - DNA, 18 bp, Homo sapiens
cctctccttgggctcctg

SEQ ID NO: 2074582 - DNA, 20 bp, Homo sapiens
cctctccttgggctcctggc

SEQ ID NO: 2074583 - DNA, 23 bp, Homo sapiens
cctctccttgggctcctggctgc

SEQ ID NO: 2074584 - DNA, 14 bp, Homo sapiens
cctctcgagcccag

SEQ ID NO: 2074585 - DNA, 22 bp, Homo sapiens
cctcttgggcatgctcagccct

SEQ ID NO: 2074586 - DNA, 18 bp, Homo sapiens
cctctttgcctgtgtgag

SEQ ID NO: 2074587 - DNA, 22 bp, Homo sapiens
cctctttgtcagtctgggtgtc

SEQ ID NO: 2074588 - DNA, 14 bp, Homo sapiens
cctgaaaaactgat

SEQ ID NO: 2074589 - DNA, 20 bp, Homo sapiens
cctgaaaaactgatcaaaaa

SEQ ID NO: 2074590 - DNA, 13 bp, Homo sapiens
cctgaaaacccag

SEQ ID NO: 2074591 - DNA, 13 bp, Homo sapiens
cctgaaagtgaca

SEQ ID NO: 2074592 - DNA, 23 bp, Homo sapiens
cctgaaagtgacagagacccaga

SEQ ID NO: 2074593 - DNA, 15 bp, Homo sapiens
cctgaacaagaattg

SEQ ID NO: 2074594 - DNA, 17 bp, Homo sapiens
cctgaacaagaattgga

SEQ ID NO: 2074595 - DNA, 15 bp, Homo sapiens
cctgaacatctgtgt

SEQ ID NO: 2074596 - DNA, 20 bp, Homo sapiens
cctgaacatctgtgtgtgtc

SEQ ID NO: 2074597 - DNA, 15 bp, Homo sapiens
cctgaaccccatggg

SEQ ID NO: 2074598 - DNA, 21 bp, Homo sapiens
cctgaagactcattcttctgt

SEQ ID NO: 2074599 - DNA, 13 bp, Homo sapiens
cctgaagccagat

SEQ ID NO: 2074600 - DNA, 21 bp, Homo sapiens
cctgaagcctctgccctgcct

SEQ ID NO: 2074601 - DNA, 18 bp, Homo sapiens
cctgaagggtgacatccc

SEQ ID NO: 2074602 - DNA, 22 bp, Homo sapiens
cctgaagggtgacatcccagga

SEQ ID NO: 2074603 - DNA, 17 bp, Homo sapiens
cctgaagtcacacagtg

SEQ ID NO: 2074604 - DNA, 16 bp, Homo sapiens
cctgaatattaatccc

SEQ ID NO: 2074605 - DNA, 18 bp, Homo sapiens
cctgaatccatcaggact

SEQ ID NO: 2074606 - DNA, 19 bp, Homo sapiens
cctgaatccatcaggactt

SEQ ID NO: 2074607 - DNA, 13 bp, Homo sapiens
cctgaatgaaata

SEQ ID NO: 2074608 - DNA, 14 bp, Homo sapiens
cctgacaagcactg

SEQ ID NO: 2074609 - DNA, 17 bp, Homo sapiens
cctgacaatggcagcta

SEQ ID NO: 2074610 - DNA, 21 bp, Homo sapiens
cctgacaccgtccctcagtga

SEQ ID NO: 2074611 - DNA, 20 bp, Homo sapiens
cctgacagatgtcagccgag

SEQ ID NO: 2074612 - DNA, 21 bp, Homo sapiens
cctgacaggttcccagcagct

SEQ ID NO: 2074613 - DNA, 21 bp, Homo sapiens
cctgacattaagacacacctc

SEQ ID NO: 2074614 - DNA, 15 bp, Homo sapiens
cctgaccctccctac

SEQ ID NO: 2074615 - DNA, 16 bp, Homo sapiens
cctgaccctccctacc

SEQ ID NO: 2074616 - DNA, 17 bp, Homo sapiens
cctgaccctccctacct

SEQ ID NO: 2074617 - DNA, 12 bp, Homo sapiens
cctgacctccca

SEQ ID NO: 2074618 - DNA, 14 bp, Homo sapiens
cctgacctcccagc

SEQ ID NO: 2074619 - DNA, 13 bp, Homo sapiens
cctgacctgaggc

SEQ ID NO: 2074620 - DNA, 16 bp, Homo sapiens
cctgactccagtgagc

SEQ ID NO: 2074621 - DNA, 13 bp, Homo sapiens
cctgactcctcta

SEQ ID NO: 2074622 - DNA, 17 bp, Homo sapiens
cctgactctctgtgacc

SEQ ID NO: 2074623 - DNA, 20 bp, Homo sapiens
cctgactgacacaggccagc

SEQ ID NO: 2074624 - DNA, 23 bp, Homo sapiens
cctgactgacacaggccagcccc

SEQ ID NO: 2074625 - DNA, 20 bp, Homo sapiens
cctgactgtgttcagtgcct

SEQ ID NO: 2074626 - DNA, 14 bp, Homo sapiens
cctgagaaggcgag

SEQ ID NO: 2074627 - DNA, 22 bp, Homo sapiens
cctgagaataagaaagtttcac

SEQ ID NO: 2074628 - DNA, 22 bp, Homo sapiens
cctgagaccagttgggagcact

SEQ ID NO: 2074629 - DNA, 23 bp, Homo sapiens
cctgagactccagaatctgctgt

SEQ ID NO: 2074630 - DNA, 12 bp, Homo sapiens
cctgagcactgc

SEQ ID NO: 2074631 - DNA, 14 bp, Homo sapiens
cctgagcactgcca

SEQ ID NO: 2074632 - DNA, 23 bp, Homo sapiens
cctgagcattcaggcagcactga

SEQ ID NO: 2074633 - DNA, 13 bp, Homo sapiens
cctgagcccaggg

SEQ ID NO: 2074634 - DNA, 16 bp, Homo sapiens
cctgagcccagggagg

SEQ ID NO: 2074635 - DNA, 18 bp, Homo sapiens
cctgagcctgacctttct

SEQ ID NO: 2074636 - DNA, 12 bp, Homo sapiens
cctgagcctgcc

SEQ ID NO: 2074637 - DNA, 13 bp, Homo sapiens
cctgagcctgccg

SEQ ID NO: 2074638 - DNA, 17 bp, Homo sapiens
cctgagcctgccgagca

SEQ ID NO: 2074639 - DNA, 16 bp, Homo sapiens
cctagccacctcccac

SEQ ID NO: 2074640 - DNA, 13 bp, Homo sapiens
cctagccctctca

SEQ ID NO: 2074641 - DNA, 15 bp, Homo sapiens
cctagccgacctcag

SEQ ID NO: 2074642 - DNA, 16 bp, Homo sapiens
cctagccgacctcagc

SEQ ID NO: 2074643 - DNA, 20 bp, Homo sapiens
cctagccgacctcagccttc

SEQ ID NO: 2074644 - DNA, 18 bp, Homo sapiens
cctagcgctctcttccag

SEQ ID NO: 2074645 - DNA, 17 bp, Homo sapiens
cctaggaattcccagcc

SEQ ID NO: 2074646 - DNA, 15 bp, Homo sapiens
cctaggacctcaggc

SEQ ID NO: 2074647 - DNA, 17 bp, Homo sapiens
cctaggagaagcagcct

SEQ ID NO: 2074648 - DNA, 21 bp, Homo sapiens
cctaggagaagcagcctccta

SEQ ID NO: 2074649 - DNA, 15 bp, Homo sapiens
cctaggaggaccccg

SEQ ID NO: 2074650 - DNA, 20 bp, Homo sapiens
cctaggagttgagtacagtg

SEQ ID NO: 2074651 - DNA, 22 bp, Homo sapiens
cctaggagttgagtacagtgag

SEQ ID NO: 2074652 - DNA, 16 bp, Homo sapiens
cctaggattcctcccc

SEQ ID NO: 2074653 - DNA, 15 bp, Homo sapiens
cctaggccactcctc

SEQ ID NO: 2074654 - DNA, 17 bp, Homo sapiens
cctaggccactcctcca

SEQ ID NO: 2074655 - DNA, 18 bp, Homo sapiens
cctaggccactcctccaa

SEQ ID NO: 2074656 - DNA, 19 bp, Homo sapiens
cctaggccactcctccaaa

SEQ ID NO: 2074657 - DNA, 20 bp, Homo sapiens
cctaggccactcctccaaag

SEQ ID NO: 2074658 - DNA, 21 bp, Homo sapiens
cctaggggtccacgggaagcc

SEQ ID NO: 2074659 - DNA, 13 bp, Homo sapiens
cctaggtgacaga

SEQ ID NO: 2074660 - DNA, 18 bp, Homo sapiens
cctaggtgacagagtgag

SEQ ID NO: 2074661 - DNA, 14 bp, Homo sapiens
cctaggtgctggat

SEQ ID NO: 2074662 - DNA, 15 bp, Homo sapiens
cctaggtgctggatg

SEQ ID NO: 2074663 - DNA, 17 bp, Homo sapiens
cctagtactctctgctc

SEQ ID NO: 2074664 - DNA, 18 bp, Homo sapiens
cctagtactctctgctct

SEQ ID NO: 2074665 - DNA, 17 bp, Homo sapiens
cctagtggggtctccct

SEQ ID NO: 2074666 - DNA, 20 bp, Homo sapiens
cctagtggggtctccctctc

SEQ ID NO: 2074667 - DNA, 23 bp, Homo sapiens
cctagtggggtctccctctcctg

SEQ ID NO: 2074668 - DNA, 16 bp, Homo sapiens
cctagttccccgtgaa

SEQ ID NO: 2074669 - DNA, 15 bp, Homo sapiens
cctagtttgacctca

SEQ ID NO: 2074670 - DNA, 18 bp, Homo sapiens
cctagttttctcctccca

SEQ ID NO: 2074671 - DNA, 19 bp, Homo sapiens
cctagttttctcctcccag

SEQ ID NO: 2074672 - DNA, 20 bp, Homo sapiens
cctagttttctcctcccagg

SEQ ID NO: 2074673 - DNA, 23 bp, Homo sapiens
  misc_feature (5)..(5): n is a, c, g or t
  misc_feature (12)..(12): n is a, c, g or t
cctanccccccnacccccagtgt

SEQ ID NO: 2074674 - DNA, 19 bp, Homo sapiens
cctataatgtgtgtatgtg

SEQ ID NO: 2074675 - DNA, 18 bp, Homo sapiens
cctatacctgtgtttctt

SEQ ID NO: 2074676 - DNA, 21 bp, Homo sapiens
cctatagagagggggctctcc

SEQ ID NO: 2074677 - DNA, 18 bp, Homo sapiens
cctatagtcccagctact

SEQ ID NO: 2074678 - DNA, 14 bp, Homo sapiens
cctatatgtagtat

SEQ ID NO: 2074679 - DNA, 13 bp, Homo sapiens
cctatcaaaacat

SEQ ID NO: 2074680 - DNA, 16 bp, Homo sapiens
cctatcaaaacatatc

SEQ ID NO: 2074681 - DNA, 15 bp, Homo sapiens
cctatcacccaggct

SEQ ID NO: 2074682 - DNA, 16 bp, Homo sapiens
cctatccacccagccc

SEQ ID NO: 2074683 - DNA, 21 bp, Homo sapiens
cctatccacccagcccattct

SEQ ID NO: 2074684 - DNA, 17 bp, Homo sapiens
cctatccttccagtggc

SEQ ID NO: 2074685 - DNA, 18 bp, Homo sapiens
cctatccttggagagcag

SEQ ID NO: 2074686 - DNA, 20 bp, Homo sapiens
cctatccttggagagcagct

SEQ ID NO: 2074687 - DNA, 22 bp, Homo sapiens
cctatccttggagagcagctgg

SEQ ID NO: 2074688 - DNA, 23 bp, Homo sapiens
cctatccttggagagcagctggc

SEQ ID NO: 2074689 - DNA, 14 bp, Homo sapiens
cctatcttctccat

SEQ ID NO: 2074690 - DNA, 17 bp, Homo sapiens
cctatgacttgggcacc

SEQ ID NO: 2074691 - DNA, 13 bp, Homo sapiens
cctatgatcccag

SEQ ID NO: 2074692 - DNA, 15 bp, Homo sapiens
cctatgatcccagca

SEQ ID NO: 2074693 - DNA, 21 bp, Homo sapiens
cctatgcatggtgtagatgcc

SEQ ID NO: 2074694 - DNA, 14 bp, Homo sapiens
cctatggagagccc

SEQ ID NO: 2074695 - DNA, 16 bp, Homo sapiens
cctatggagagccctg

SEQ ID NO: 2074696 - DNA, 17 bp, Homo sapiens
cctatggagagccctgg

SEQ ID NO: 2074697 - DNA, 19 bp, Homo sapiens
cctatgtcaatttgtatat

SEQ ID NO: 2074698 - DNA, 18 bp, Homo sapiens
cctatgtcatttcatttc

SEQ ID NO: 2074699 - DNA, 23 bp, Homo sapiens
cctatgtcctaaggacacactaa

SEQ ID NO: 2074700 - DNA, 17 bp, Homo sapiens
cctattaaaacacagct

SEQ ID NO: 2074701 - DNA, 19 bp, Homo sapiens
cctattatttccgggtgga

SEQ ID NO: 2074702 - DNA, 16 bp, Homo sapiens
cctattctcaccagga

SEQ ID NO: 2074703 - DNA, 19 bp, Homo sapiens
cctattgtgcaatgtaaat

SEQ ID NO: 2074704 - DNA, 14 bp, Homo sapiens
cctattttaaaacc

SEQ ID NO: 2074705 - DNA, 19 bp, Homo sapiens
cctattttaaaaccatgca

SEQ ID NO: 2074706 - DNA, 20 bp, Homo sapiens
cctattttaaaaccatgcag

SEQ ID NO: 2074707 - DNA, 21 bp, Homo sapiens
cctattttaaaaccatgcagc

SEQ ID NO: 2074708 - DNA, 14 bp, Homo sapiens
cctatttttcagaa

SEQ ID NO: 2074709 - DNA, 20 bp, Homo sapiens
cctcaaaaagatttccccat

SEQ ID NO: 2074710 - DNA, 16 bp, Homo sapiens
cctcaaacatggaaga

SEQ ID NO: 2074711 - DNA, 19 bp, Homo sapiens
cctcaaatgacccaaagac

SEQ ID NO: 2074712 - DNA, 17 bp, Homo sapiens
cctcaaatgtcagagct

SEQ ID NO: 2074713 - DNA, 15 bp, Homo sapiens
cctcaagaacacctt

SEQ ID NO: 2074714 - DNA, 17 bp, Homo sapiens
cctcaagatgaaggcaa

SEQ ID NO: 2074715 - DNA, 23 bp, Homo sapiens
cctcaagtgattctcctgcctca

SEQ ID NO: 2074716 - DNA, 20 bp, Homo sapiens
cctcaatgtgaatcagaccc

SEQ ID NO: 2074717 - DNA, 19 bp, Homo sapiens
cctcacagcctctccctta

SEQ ID NO: 2074718 - DNA, 14 bp, Homo sapiens
cctcacaggagcag

SEQ ID NO: 2074719 - DNA, 16 bp, Homo sapiens
cctcacaggagcagac

SEQ ID NO: 2074720 - DNA, 19 bp, Homo sapiens
cctcacaggagcagacaga

SEQ ID NO: 2074721 - DNA, 18 bp, Homo sapiens
cctcacagtgacccttcc

SEQ ID NO: 2074722 - DNA, 12 bp, Homo sapiens
cctcaccaataa

SEQ ID NO: 2074723 - DNA, 24 bp, Homo sapiens
cctcaccaataacttcagagaagt

SEQ ID NO: 2074724 - DNA, 17 bp, Homo sapiens
cctcacccccagctttg

SEQ ID NO: 2074725 - DNA, 19 bp, Homo sapiens
cctcacccccagctttgct

SEQ ID NO: 2074726 - DNA, 21 bp, Homo sapiens
cctcagccaaacacagagcgg

SEQ ID NO: 2074727 - DNA, 16 bp, Homo sapiens
cctcagccatgaggag

SEQ ID NO: 2074728 - DNA, 16 bp, Homo sapiens
cctcagccctcagaac

SEQ ID NO: 2074729 - DNA, 16 bp, Homo sapiens
cctcagcccttgcccc

SEQ ID NO: 2074730 - DNA, 14 bp, Homo sapiens
cctcagcctagacc

SEQ ID NO: 2074731 - DNA, 16 bp, Homo sapiens
cctcagcctagaccct

SEQ ID NO: 2074732 - DNA, 11 bp, Homo sapiens
cctcagcctcc

SEQ ID NO: 2074733 - DNA, 17 bp, Homo sapiens
cctcagcctcccagagt

SEQ ID NO: 2074734 - DNA, 22 bp, Homo sapiens
cctcagcctcctaagcagctgg

SEQ ID NO: 2074735 - DNA, 12 bp, Homo sapiens
cctcagcctgtg

SEQ ID NO: 2074736 - DNA, 22 bp, Homo sapiens
cctcagccttccccttgcccag

SEQ ID NO: 2074737 - DNA, 23 bp, Homo sapiens
cctcagccttggataatgctgtt

SEQ ID NO: 2074738 - DNA, 11 bp, Homo sapiens
cctcagctcag

SEQ ID NO: 2074739 - DNA, 16 bp, Homo sapiens
cctcagctcagcctcc

SEQ ID NO: 2074740 - DNA, 18 bp, Homo sapiens
cctcagctgcacattcct

SEQ ID NO: 2074741 - DNA, 13 bp, Homo sapiens
cctcagctgccaa

SEQ ID NO: 2074742 - DNA, 13 bp, Homo sapiens
cctcagctgctcg

SEQ ID NO: 2074743 - DNA, 16 bp, Homo sapiens
cctcaggccagtgcca

SEQ ID NO: 2074744 - DNA, 18 bp, Homo sapiens
cctcaggccagtgccagg

SEQ ID NO: 2074745 - DNA, 20 bp, Homo sapiens
cctcaggcggggaggaggag

SEQ ID NO: 2074746 - DNA, 16 bp, Homo sapiens
cctcaggcttccttgg

SEQ ID NO: 2074747 - DNA, 22 bp, Homo sapiens
cctcagggacagagacacctgc

SEQ ID NO: 2074748 - DNA, 24 bp, Homo sapiens
cctcagggacagagacacctgcac

SEQ ID NO: 2074749 - DNA, 23 bp, Homo sapiens
cctcagggatcttgcattcccag

SEQ ID NO: 2074750 - DNA, 19 bp, Homo sapiens
cctcaggtagtactgggaa

SEQ ID NO: 2074751 - DNA, 17 bp, Homo sapiens
cctcaggtgatccaccc

SEQ ID NO: 2074752 - DNA, 22 bp, Homo sapiens
cctcaggtgatccacccacctc

SEQ ID NO: 2074753 - DNA, 14 bp, Homo sapiens
cctcagtcctggaa

SEQ ID NO: 2074754 - DNA, 16 bp, Homo sapiens
cctcagtgccacttga

SEQ ID NO: 2074755 - DNA, 19 bp, Homo sapiens
cctcagtgccacttgacat

SEQ ID NO: 2074756 - DNA, 11 bp, Homo sapiens
cctcagtgctc

SEQ ID NO: 2074757 - DNA, 12 bp, Homo sapiens
cctcagtgtcat

SEQ ID NO: 2074758 - DNA, 16 bp, Homo sapiens
cctcagttcaacctgg

SEQ ID NO: 2074759 - DNA, 22 bp, Homo sapiens
cctcagttcaacctggtggcac

SEQ ID NO: 2074760 - DNA, 23 bp, Homo sapiens
cctcagttcaacctggtggcacc

SEQ ID NO: 2074761 - DNA, 21 bp, Homo sapiens
cctcatcccctcgtcctgtcc

SEQ ID NO: 2074762 - DNA, 23 bp, Homo sapiens
cctcatcccctcgtcctgtccca

SEQ ID NO: 2074763 - DNA, 11 bp, Homo sapiens
cctcatctcct

SEQ ID NO: 2074764 - DNA, 14 bp, Homo sapiens
cctcatctccttta

SEQ ID NO: 2074765 - DNA, 22 bp, Homo sapiens
cctcatcttgccccctcatctc

SEQ ID NO: 2074766 - DNA, 19 bp, Homo sapiens
cctcatgacagccagagcc

SEQ ID NO: 2074767 - DNA, 17 bp, Homo sapiens
cctcatgaccctcctgt

SEQ ID NO: 2074768 - DNA, 15 bp, Homo sapiens
cctcatgccacacct

SEQ ID NO: 2074769 - DNA, 17 bp, Homo sapiens
cctcatgcctggccccc

SEQ ID NO: 2074770 - DNA, 22 bp, Homo sapiens
cctcatgcctggcccccctcca

SEQ ID NO: 2074771 - DNA, 23 bp, Homo sapiens
cctcatgcctggcccccctccag

SEQ ID NO: 2074772 - DNA, 16 bp, Homo sapiens
cctcatttatccctca

SEQ ID NO: 2074773 - DNA, 19 bp, Homo sapiens
cctcatttatccctcaacc

SEQ ID NO: 2074774 - DNA, 14 bp, Homo sapiens
cctccaaactcctg

SEQ ID NO: 2074775 - DNA, 19 bp, Homo sapiens
cctccaaactcctgcctgt

SEQ ID NO: 2074776 - DNA, 20 bp, Homo sapiens
cctccaaactcctgcctgtg

SEQ ID NO: 2074777 - DNA, 18 bp, Homo sapiens
cctccaaagccccacctt

SEQ ID NO: 2074778 - DNA, 18 bp, Homo sapiens
cctccaacaataaagagc

SEQ ID NO: 2074779 - DNA, 17 bp, Homo sapiens
cctccaagccattcact

SEQ ID NO: 2074780 - DNA, 22 bp, Homo sapiens
cctccaatcccaccaaccctca

SEQ ID NO: 2074781 - DNA, 22 bp, Homo sapiens
cctccaattccacagtctctgg

SEQ ID NO: 2074782 - DNA, 16 bp, Homo sapiens
cctccacagtgctgct

SEQ ID NO: 2074783 - DNA, 14 bp, Homo sapiens
cctccaccccagga

SEQ ID NO: 2074784 - DNA, 15 bp, Homo sapiens
cctccaccccaggac

SEQ ID NO: 2074785 - DNA, 18 bp, Homo sapiens
cctccaccgcagaaggaa

SEQ ID NO: 2074786 - DNA, 14 bp, Homo sapiens
cctccacctcttca

SEQ ID NO: 2074787 - DNA, 23 bp, Homo sapiens
cctccacctcttcaccccccact

SEQ ID NO: 2074788 - DNA, 22 bp, Homo sapiens
cctccacgggggcggcaggctg

SEQ ID NO: 2074789 - DNA, 17 bp, Homo sapiens
cctccagacagatacag

SEQ ID NO: 2074790 - DNA, 16 bp, Homo sapiens
cctccagacccctgtg

SEQ ID NO: 2074791 - DNA, 14 bp, Homo sapiens
cctccagaccctgc

SEQ ID NO: 2074792 - DNA, 18 bp, Homo sapiens
cctccagaccctgcctga

SEQ ID NO: 2074793 - DNA, 19 bp, Homo sapiens
cctccagaccctgcctgag

SEQ ID NO: 2074794 - DNA, 21 bp, Homo sapiens
cctccagctggaattgctgct

SEQ ID NO: 2074795 - DNA, 17 bp, Homo sapiens
cctccagctttcctgta

SEQ ID NO: 2074796 - DNA, 13 bp, Homo sapiens
cctccaggagcct

SEQ ID NO: 2074797 - DNA, 22 bp, Homo sapiens
cctccaggcatgctggcctccc

SEQ ID NO: 2074798 - DNA, 17 bp, Homo sapiens
cctccagggccacgtgc

SEQ ID NO: 2074799 - DNA, 16 bp, Homo sapiens
cctccatgctgcctcc

SEQ ID NO: 2074800 - DNA, 15 bp, Homo sapiens
cctccatgtggcccc

SEQ ID NO: 2074801 - DNA, 23 bp, Homo sapiens
cctccatgtggccccaggtgcca

SEQ ID NO: 2074802 - DNA, 15 bp, Homo sapiens
cctccattctgacca

SEQ ID NO: 2074803 - DNA, 20 bp, Homo sapiens
cctccatttctctccaggaa

SEQ ID NO: 2074804 - DNA, 19 bp, Homo sapiens
cctcccaacagagctgggc

SEQ ID NO: 2074805 - DNA, 13 bp, Homo sapiens
cctcccaacccag

SEQ ID NO: 2074806 - DNA, 13 bp, Homo sapiens
cctcccaacctca

SEQ ID NO: 2074807 - DNA, 19 bp, Homo sapiens
cctcccaaggactttccag

SEQ ID NO: 2074808 - DNA, 14 bp, Homo sapiens
cctcccacagcctg

SEQ ID NO: 2074809 - DNA, 21 bp, Homo sapiens
cctcccaccatgcgctgctca

SEQ ID NO: 2074810 - DNA, 19 bp, Homo sapiens
cctcccaccccactccagc

SEQ ID NO: 2074811 - DNA, 21 bp, Homo sapiens
cctcccaccccactccagccc

SEQ ID NO: 2074812 - DNA, 15 bp, Homo sapiens
cctcccacccccagc

SEQ ID NO: 2074813 - DNA, 17 bp, Homo sapiens
cctcccacctcagcctc

SEQ ID NO: 2074814 - DNA, 14 bp, Homo sapiens
cctcccagagtgct

SEQ ID NO: 2074815 - DNA, 18 bp, Homo sapiens
cctcccagagtgctagga

SEQ ID NO: 2074816 - DNA, 14 bp, Homo sapiens
cctcccaggcgccc

SEQ ID NO: 2074817 - DNA, 12 bp, Homo sapiens
cctcccatggcc

SEQ ID NO: 2074818 - DNA, 18 bp, Homo sapiens
cctcccatggccttccct

SEQ ID NO: 2074819 - DNA, 19 bp, Homo sapiens
cctcccatggccttccctc

SEQ ID NO: 2074820 - DNA, 19 bp, Homo sapiens
cctcccatgttgcatgcct

SEQ ID NO: 2074821 - DNA, 19 bp, Homo sapiens
cctccccaaacccatcaga

SEQ ID NO: 2074822 - DNA, 20 bp, Homo sapiens
cctccccaaacccatcagac

SEQ ID NO: 2074823 - DNA, 23 bp, Homo sapiens
cctccccaaacccatcagacagg

SEQ ID NO: 2074824 - DNA, 18 bp, Homo sapiens
cctccccacacctcccta

SEQ ID NO: 2074825 - DNA, 13 bp, Homo sapiens
cctccccacagtc

SEQ ID NO: 2074826 - DNA, 16 bp, Homo sapiens
cctccccaccttcccc

SEQ ID NO: 2074827 - DNA, 14 bp, Homo sapiens
cctccccaggggag

SEQ ID NO: 2074828 - DNA, 21 bp, Homo sapiens
cctccccattagagtcagcct

SEQ ID NO: 2074829 - DNA, 17 bp, Homo sapiens
cctccccattcacagag

SEQ ID NO: 2074830 - DNA, 21 bp, Homo sapiens
cctccccattcagacacttca

SEQ ID NO: 2074831 - DNA, 23 bp, Homo sapiens
cctcccccacaaataatgaacag

SEQ ID NO: 2074832 - DNA, 17 bp, Homo sapiens
cctccccccagcccctc

SEQ ID NO: 2074833 - DNA, 17 bp, Homo sapiens
cctccccctgccagtgc

SEQ ID NO: 2074834 - DNA, 21 bp, Homo sapiens
cctccccgcaccccccaagct

SEQ ID NO: 2074835 - DNA, 18 bp, Homo sapiens
cctcccctatccacccag

SEQ ID NO: 2074836 - DNA, 15 bp, Homo sapiens
cctcccctgccaggg

SEQ ID NO: 2074837 - DNA, 20 bp, Homo sapiens
cctcccctgcccccatccca

SEQ ID NO: 2074838 - DNA, 19 bp, Homo sapiens
cctcccctgtcttctctca

SEQ ID NO: 2074839 - DNA, 20 bp, Homo sapiens
cctcccgaatagctgggact

SEQ ID NO: 2074840 - DNA, 21 bp, Homo sapiens
cctcccgaatagctgggacta

SEQ ID NO: 2074841 - DNA, 21 bp, Homo sapiens
cctcccgagtagctgggacta

SEQ ID NO: 2074842 - DNA, 19 bp, Homo sapiens
ccgtctggggttcagcccc

SEQ ID NO: 2074843 - DNA, 22 bp, Homo sapiens
ccgtctggggttcagcccctcc

SEQ ID NO: 2074844 - DNA, 23 bp, Homo sapiens
ccgtctggggttcagcccctcct

SEQ ID NO: 2074845 - DNA, 12 bp, Homo sapiens
ccgtctgttttt

SEQ ID NO: 2074846 - DNA, 14 bp, Homo sapiens
ccgtcttcagccta

SEQ ID NO: 2074847 - DNA, 14 bp, Homo sapiens
ccgtgaagcagtgc

SEQ ID NO: 2074848 - DNA, 23 bp, Homo sapiens
ccgtgaagcagtgcctcgaggca

SEQ ID NO: 2074849 - DNA, 14 bp, Homo sapiens
ccgtgaagggcacc

SEQ ID NO: 2074850 - DNA, 20 bp, Homo sapiens
ccgtgaatgcttacctgtga

SEQ ID NO: 2074851 - DNA, 17 bp, Homo sapiens
ccgtgatgctcaggctt

SEQ ID NO: 2074852 - DNA, 16 bp, Homo sapiens
ccgtgatttggaagag

SEQ ID NO: 2074853 - DNA, 22 bp, Homo sapiens
ccgtgatttggaagagaggcac

SEQ ID NO: 2074854 - DNA, 18 bp, Homo sapiens
ccgtgcagcttctgtcct

SEQ ID NO: 2074855 - DNA, 16 bp, Homo sapiens
ccgtgcagtacaggca

SEQ ID NO: 2074856 - DNA, 12 bp, Homo sapiens
ccgtgcccaggg

SEQ ID NO: 2074857 - DNA, 20 bp, Homo sapiens
ccgtgcccaggggcccacag

SEQ ID NO: 2074858 - DNA, 15 bp, Homo sapiens
ccgtgccccgcctcc

SEQ ID NO: 2074859 - DNA, 16 bp, Homo sapiens
ccgtgccttcagctct

SEQ ID NO: 2074860 - DNA, 23 bp, Homo sapiens
ccgtgcctttctctggctccaga

SEQ ID NO: 2074861 - DNA, 11 bp, Homo sapiens
ccgtgctgggc

SEQ ID NO: 2074862 - DNA, 15 bp, Homo sapiens
ccgtggaccttcctg

SEQ ID NO: 2074863 - DNA, 11 bp, Homo sapiens
ccgtggaggct

SEQ ID NO: 2074864 - DNA, 12 bp, Homo sapiens
ccgtggaggctg

SEQ ID NO: 2074865 - DNA, 11 bp, Homo sapiens
ccgtggagggt

SEQ ID NO: 2074866 - DNA, 19 bp, Homo sapiens
ccgtggcccttcctggaca

SEQ ID NO: 2074867 - DNA, 20 bp, Homo sapiens
ccgtggcccttcctggacag

SEQ ID NO: 2074868 - DNA, 12 bp, Homo sapiens
ccgtggtctttg

SEQ ID NO: 2074869 - DNA, 14 bp, Homo sapiens
ccgtggtctttgaa

SEQ ID NO: 2074870 - DNA, 15 bp, Homo sapiens
ccgtggtctttgaat

SEQ ID NO: 2074871 - DNA, 23 bp, Homo sapiens
ccgtggtctttgaataaagtctg

SEQ ID NO: 2074872 - DNA, 15 bp, Homo sapiens
ccgtgtcccaaggag

SEQ ID NO: 2074873 - DNA, 22 bp, Homo sapiens
ccgttactctccaacctggaca

SEQ ID NO: 2074874 - DNA, 15 bp, Homo sapiens
ccgtttatgggcctt

SEQ ID NO: 2074875 - DNA, 14 bp, Homo sapiens
ccgtttttcaagaa

SEQ ID NO: 2074876 - DNA, 21 bp, Homo sapiens
cctaaaaacatttactgacca

SEQ ID NO: 2074877 - DNA, 20 bp, Homo sapiens
cctaaaaataagctttattt

SEQ ID NO: 2074878 - DNA, 23 bp, Homo sapiens
cctaaacagatataaatggctgg

SEQ ID NO: 2074879 - DNA, 20 bp, Homo sapiens
cctaaacccccgctccagat

SEQ ID NO: 2074880 - DNA, 11 bp, Homo sapiens
cctaaactgta

SEQ ID NO: 2074881 - DNA, 12 bp, Homo sapiens
cctaaagaaaaa

SEQ ID NO: 2074882 - DNA, 13 bp, Homo sapiens
cctaaatccaaag

SEQ ID NO: 2074883 - DNA, 14 bp, Homo sapiens
cctaaatgacctca

SEQ ID NO: 2074884 - DNA, 18 bp, Homo sapiens
cctaaatgacctcagcaa

SEQ ID NO: 2074885 - DNA, 14 bp, Homo sapiens
cctaaatttcagta

SEQ ID NO: 2074886 - DNA, 13 bp, Homo sapiens
cctaagaagctct

SEQ ID NO: 2074887 - DNA, 17 bp, Homo sapiens
cctaagaagtccccagg

SEQ ID NO: 2074888 - DNA, 15 bp, Homo sapiens
cctaagagagcacct

SEQ ID NO: 2074889 - DNA, 19 bp, Homo sapiens
cctaagaggcgacttcctc

SEQ ID NO: 2074890 - DNA, 22 bp, Homo sapiens
cctaagcagtgcttgtaaacca

SEQ ID NO: 2074891 - DNA, 23 bp, Homo sapiens
cctaaggatctctcaggagcaca

SEQ ID NO: 2074892 - DNA, 15 bp, Homo sapiens
cctaagtggctgctg

SEQ ID NO: 2074893 - DNA, 22 bp, Homo sapiens
cctaagtgggaagtgaagcccc

SEQ ID NO: 2074894 - DNA, 13 bp, Homo sapiens
cctaataaagaga

SEQ ID NO: 2074895 - DNA, 21 bp, Homo sapiens
cctaataagtttgatcaaatc

SEQ ID NO: 2074896 - DNA, 18 bp, Homo sapiens
cctaatctcatacctctg

SEQ ID NO: 2074897 - DNA, 23 bp, Homo sapiens
cctaattagggcatcctgcccct

SEQ ID NO: 2074898 - DNA, 13 bp, Homo sapiens
cctaattgaaatt

SEQ ID NO: 2074899 - DNA, 14 bp, Homo sapiens
cctaattgaaattt

SEQ ID NO: 2074900 - DNA, 17 bp, Homo sapiens
cctacacccttggactt

SEQ ID NO: 2074901 - DNA, 15 bp, Homo sapiens
cctacagtggctgtc

SEQ ID NO: 2074902 - DNA, 19 bp, Homo sapiens
cctacatcttcagctccca

SEQ ID NO: 2074903 - DNA, 16 bp, Homo sapiens
cctacattccctggcc

SEQ ID NO: 2074904 - DNA, 15 bp, Homo sapiens
cctaccaatgcatgc

SEQ ID NO: 2074905 - DNA, 22 bp, Homo sapiens
cctaccaatgcatgcagccact

SEQ ID NO: 2074906 - DNA, 17 bp, Homo sapiens
cctaccaccttccctct

SEQ ID NO: 2074907 - DNA, 15 bp, Homo sapiens
cctaccatgctgctt

SEQ ID NO: 2074908 - DNA, 18 bp, Homo sapiens
cctacccaccctcctttc

SEQ ID NO: 2074909 - DNA, 16 bp, Homo sapiens
cctacccactctttgc

SEQ ID NO: 2074910 - DNA, 17 bp, Homo sapiens
cctacccactctttgct

SEQ ID NO: 2074911 - DNA, 20 bp, Homo sapiens
cctacccactctttgctaca

SEQ ID NO: 2074912 - DNA, 22 bp, Homo sapiens
cctacccagagattgcttctca

SEQ ID NO: 2074913 - DNA, 14 bp, Homo sapiens
cctaccccaccacg

SEQ ID NO: 2074914 - DNA, 20 bp, Homo sapiens
cctacccccagcctgacaaa

SEQ ID NO: 2074915 - DNA, 21 bp, Homo sapiens
cctaccccctgaaagtgacag

SEQ ID NO: 2074916 - DNA, 22 bp, Homo sapiens
cctacccttgtaccccatccct

SEQ ID NO: 2074917 - DNA, 17 bp, Homo sapiens
cctaccgagtctcttct

SEQ ID NO: 2074918 - DNA, 21 bp, Homo sapiens
cctaccgagtctcttctccac

SEQ ID NO: 2074919 - DNA, 23 bp, Homo sapiens
cctaccgagtctcttctccactg

SEQ ID NO: 2074920 - DNA, 12 bp, Homo sapiens
cctacctcagcc

SEQ ID NO: 2074921 - DNA, 13 bp, Homo sapiens
cctacctcagcct

SEQ ID NO: 2074922 - DNA, 14 bp, Homo sapiens
cctacctgctgctg

SEQ ID NO: 2074923 - DNA, 12 bp, Homo sapiens
cctacctggtaa

SEQ ID NO: 2074924 - DNA, 16 bp, Homo sapiens
cctacctgtgcctgac

SEQ ID NO: 2074925 - DNA, 20 bp, Homo sapiens
cctacgtcaaacatgaagtg

SEQ ID NO: 2074926 - DNA, 16 bp, Homo sapiens
cctactcacacaggca

SEQ ID NO: 2074927 - DNA, 22 bp, Homo sapiens
cctactcacacaggcatttcct

SEQ ID NO: 2074928 - DNA, 13 bp, Homo sapiens
cctactgaatgct

SEQ ID NO: 2074929 - DNA, 23 bp, Homo sapiens
cctactgccacccgcttcctgtt

SEQ ID NO: 2074930 - DNA, 20 bp, Homo sapiens
cctacttcattttcagagtg

SEQ ID NO: 2074931 - DNA, 21 bp, Homo sapiens
cctacttcattttcagagtga

SEQ ID NO: 2074932 - DNA, 13 bp, Homo sapiens
cctacttcctgtg

SEQ ID NO: 2074933 - DNA, 22 bp, Homo sapiens
cctacttcttttgctcttagct

SEQ ID NO: 2074934 - DNA, 16 bp, Homo sapiens
cctacttgtaatttct

SEQ ID NO: 2074935 - DNA, 16 bp, Homo sapiens
cctactttagccactg

SEQ ID NO: 2074936 - DNA, 13 bp, Homo sapiens
cctacttttcaag

SEQ ID NO: 2074937 - DNA, 19 bp, Homo sapiens
cctagaaccaagcttcaga

SEQ ID NO: 2074938 - DNA, 20 bp, Homo sapiens
cctagaaccaagcttcagag

SEQ ID NO: 2074939 - DNA, 23 bp, Homo sapiens
cccgtctggggttcagcccctcc

SEQ ID NO: 2074940 - DNA, 12 bp, Homo sapiens
cccgtcttcagc

SEQ ID NO: 2074941 - DNA, 14 bp, Homo sapiens
cccgtgaagcagtg

SEQ ID NO: 2074942 - DNA, 18 bp, Homo sapiens
cccgtgaagcagtgcctc

SEQ ID NO: 2074943 - DNA, 18 bp, Homo sapiens
cccgtgcagtacaggcaa

SEQ ID NO: 2074944 - DNA, 13 bp, Homo sapiens
cccgtggaggctg

SEQ ID NO: 2074945 - DNA, 17 bp, Homo sapiens
cccgtggaggctgctcg

SEQ ID NO: 2074946 - DNA, 13 bp, Homo sapiens
cccgtggtctttg

SEQ ID NO: 2074947 - DNA, 19 bp, Homo sapiens
cccgtggtctttgaataaa

SEQ ID NO: 2074948 - DNA, 14 bp, Homo sapiens
cccgtgtcctgcct

SEQ ID NO: 2074949 - DNA, 19 bp, Homo sapiens
cccgttctgctggcctgga

SEQ ID NO: 2074950 - DNA, 15 bp, Homo sapiens
ccctaaccaaatgct

SEQ ID NO: 2074951 - DNA, 22 bp, Homo sapiens
ccctaacgggggtgcggcagga

SEQ ID NO: 2074952 - DNA, 17 bp, Homo sapiens
ccctaagaaaccccagg

SEQ ID NO: 2074953 - DNA, 13 bp, Homo sapiens
ccctacatcttca

SEQ ID NO: 2074954 - DNA, 15 bp, Homo sapiens
ccctacatcttcagc

SEQ ID NO: 2074955 - DNA, 21 bp, Homo sapiens
ccctacatcttcagctcccat

SEQ ID NO: 2074956 - DNA, 24 bp, Homo sapiens
ccctacatcttcagctcccatagc

SEQ ID NO: 2074957 - DNA, 12 bp, Homo sapiens
ccctacccactc

SEQ ID NO: 2074958 - DNA, 18 bp, Homo sapiens
ccctacccactctttgct

SEQ ID NO: 2074959 - DNA, 14 bp, Homo sapiens
ccctactgagaaac

SEQ ID NO: 2074960 - DNA, 22 bp, Homo sapiens
ccctagatctttctattccaaa

SEQ ID NO: 2074961 - DNA, 22 bp, Homo sapiens
ccctagctgggcaaacccttct

SEQ ID NO: 2074962 - DNA, 12 bp, Homo sapiens
ccctatcaaaac

SEQ ID NO: 2074963 - DNA, 16 bp, Homo sapiens
ccctatggatgtgggg

SEQ ID NO: 2074964 - DNA, 22 bp, Homo sapiens
ccctcaatccccaagctggcag

SEQ ID NO: 2074965 - DNA, 13 bp, Homo sapiens
ccctcaccccaag

SEQ ID NO: 2074966 - DNA, 17 bp, Homo sapiens
ccctcacctgggccttt

SEQ ID NO: 2074967 - DNA, 23 bp, Homo sapiens
ccctcactctgtcagccagccgc

SEQ ID NO: 2074968 - DNA, 17 bp, Homo sapiens
ccctcactgctggggag

SEQ ID NO: 2074969 - DNA, 13 bp, Homo sapiens
ccctcagagccac

SEQ ID NO: 2074970 - DNA, 22 bp, Homo sapiens
ccctcagggatcttgcattccc

SEQ ID NO: 2074971 - DNA, 13 bp, Homo sapiens
ccctcagtgatac

SEQ ID NO: 2074972 - DNA, 23 bp, Homo sapiens
ccctcagtttttcggtgggacag

SEQ ID NO: 2074973 - DNA, 19 bp, Homo sapiens
ccctcataccatctgctgc

SEQ ID NO: 2074974 - DNA, 18 bp, Homo sapiens
ccctcatggagaaacatc

SEQ ID NO: 2074975 - DNA, 14 bp, Homo sapiens
ccctccaccccagg

SEQ ID NO: 2074976 - DNA, 22 bp, Homo sapiens
ccctccagaccctgcctgagcc

SEQ ID NO: 2074977 - DNA, 13 bp, Homo sapiens
ccctccagctcca

SEQ ID NO: 2074978 - DNA, 14 bp, Homo sapiens
ccctccagctccag

SEQ ID NO: 2074979 - DNA, 16 bp, Homo sapiens
ccctcccaacctcaat

SEQ ID NO: 2074980 - DNA, 13 bp, Homo sapiens
ccctcccaccatg

SEQ ID NO: 2074981 - DNA, 15 bp, Homo sapiens
ccctcccacccccag

SEQ ID NO: 2074982 - DNA, 16 bp, Homo sapiens
ccctcccacccccagc

SEQ ID NO: 2074983 - DNA, 17 bp, Homo sapiens
ccctcccacccccagcc

SEQ ID NO: 2074984 - DNA, 12 bp, Homo sapiens
ccctcccagatc

SEQ ID NO: 2074985 - DNA, 13 bp, Homo sapiens
ccctccccagccc

SEQ ID NO: 2074986 - DNA, 12 bp, Homo sapiens
ccctccccaggg

SEQ ID NO: 2074987 - DNA, 14 bp, Homo sapiens
ccctcccctccccc

SEQ ID NO: 2074988 - DNA, 18 bp, Homo sapiens
ccctcctagctccaccct

SEQ ID NO: 2074989 - DNA, 13 bp, Homo sapiens
ccctcctcacccc

SEQ ID NO: 2074990 - DNA, 16 bp, Homo sapiens
ccctcctccactccac

SEQ ID NO: 2074991 - DNA, 14 bp, Homo sapiens
ccctcctccccttc

SEQ ID NO: 2074992 - DNA, 11 bp, Homo sapiens
ccctcctctgc

SEQ ID NO: 2074993 - DNA, 12 bp, Homo sapiens
ccctcctctgcc

SEQ ID NO: 2074994 - DNA, 15 bp, Homo sapiens
ccctcctctggccca

SEQ ID NO: 2074995 - DNA, 11 bp, Homo sapiens
ccctccttcca

SEQ ID NO: 2074996 - DNA, 22 bp, Homo sapiens
ccctcgaaccaaggcagcctcc

SEQ ID NO: 2074997 - DNA, 16 bp, Homo sapiens
ccctcgtcctgtccca

SEQ ID NO: 2074998 - DNA, 17 bp, Homo sapiens
ccctcgtggacacctgc

SEQ ID NO: 2074999 - DNA, 12 bp, Homo sapiens
ccctctcctgcc

SEQ ID NO: 2075000 - DNA, 12 bp, Homo sapiens
ccctctcctggg

SEQ ID NO: 2075001 - DNA, 13 bp, Homo sapiens
ccctctcttccct

SEQ ID NO: 2075002 - DNA, 15 bp, Homo sapiens
ccctctcttccctat

SEQ ID NO: 2075003 - DNA, 17 bp, Homo sapiens
ccctctcttccctatta

SEQ ID NO: 2075004 - DNA, 14 bp, Homo sapiens
ccctctcttgcctt

SEQ ID NO: 2075005 - DNA, 13 bp, Homo sapiens
ccctctgccctgt

SEQ ID NO: 2075006 - DNA, 14 bp, Homo sapiens
ccctctgccctgta

SEQ ID NO: 2075007 - DNA, 21 bp, Homo sapiens
ccctctgcgtcccccagccct

SEQ ID NO: 2075008 - DNA, 16 bp, Homo sapiens
ccctctggccctgcct

SEQ ID NO: 2075009 - DNA, 15 bp, Homo sapiens
ccctctgggcagctg

SEQ ID NO: 2075010 - DNA, 20 bp, Homo sapiens
ccctctgtcatcactccctg

SEQ ID NO: 2075011 - DNA, 19 bp, Homo sapiens
ccctctgtgtcctctcccc

SEQ ID NO: 2075012 - DNA, 14 bp, Homo sapiens
ccctcttccttccc

SEQ ID NO: 2075013 - DNA, 16 bp, Homo sapiens
ccctcttccttccccc

SEQ ID NO: 2075014 - DNA, 17 bp, Homo sapiens
ccctcttccttccccca

SEQ ID NO: 2075015 - DNA, 15 bp, Homo sapiens
ccctctttctacatt

SEQ ID NO: 2075016 - DNA, 22 bp, Homo sapiens
ccctctttctacattctcatct

SEQ ID NO: 2075017 - DNA, 21 bp, Homo sapiens
ccctctttgcctgtgtgagca

SEQ ID NO: 2075018 - DNA, 22 bp, Homo sapiens
ccctctttgtgtacttcagtct

SEQ ID NO: 2075019 - DNA, 15 bp, Homo sapiens
ccctcttttggcctt

SEQ ID NO: 2075020 - DNA, 15 bp, Homo sapiens
ccctgaaaaactgat

SEQ ID NO: 2075021 - DNA, 15 bp, Homo sapiens
ccctgaaaacccaga

SEQ ID NO: 2075022 - DNA, 19 bp, Homo sapiens
ccctgaaaacgaaggggcc

SEQ ID NO: 2075023 - DNA, 20 bp, Homo sapiens
ccctgaaagtgacagagacc

SEQ ID NO: 2075024 - DNA, 14 bp, Homo sapiens
ccctgaacatctgt

SEQ ID NO: 2075025 - DNA, 15 bp, Homo sapiens
ccctgaagatttcag

SEQ ID NO: 2075026 - DNA, 19 bp, Homo sapiens
ccctgaagatttcagaggc

SEQ ID NO: 2075027 - DNA, 11 bp, Homo sapiens
ccctgacctcc

SEQ ID NO: 2075028 - DNA, 19 bp, Homo sapiens
ccctgacctcccagcccta

SEQ ID NO: 2075029 - DNA, 21 bp, Homo sapiens
ccctgacctcccagccctatg

SEQ ID NO: 2075030 - DNA, 17 bp, Homo sapiens
ccctgacctccctctaa

SEQ ID NO: 2075031 - DNA, 18 bp, Homo sapiens
ccctgagaaacccaccag

SEQ ID NO: 2075032 - DNA, 22 bp, Homo sapiens
ccctgagaaacccaccagccta

SEQ ID NO: 2075033 - DNA, 10 bp, Homo sapiens
ccctgagact

SEQ ID NO: 2075034 - DNA, 14 bp, Homo sapiens
ccctgagactccag

SEQ ID NO: 2075035 - DNA, 15 bp, Homo sapiens
ccctgagactccaga

SEQ ID NO: 2075036 - DNA, 14 bp, Homo sapiens
ccctgagcaggatt

SEQ ID NO: 2075037 - DNA, 18 bp, Homo sapiens
ccctgagcctgacctttc

SEQ ID NO: 2075038 - DNA, 15 bp, Homo sapiens
ccctgagctcaggct

SEQ ID NO: 2075039 - DNA, 19 bp, Homo sapiens
ccctgagctcaggctgagc

SEQ ID NO: 2075040 - DNA, 12 bp, Homo sapiens
ccctgagctcgg

SEQ ID NO: 2075041 - DNA, 22 bp, Homo sapiens
ccctgagctcggtggacccagg

SEQ ID NO: 2075042 - DNA, 13 bp, Homo sapiens
ccctgagctttgg

SEQ ID NO: 2075043 - DNA, 21 bp, Homo sapiens
ccctgaggagtctgaggtcct

SEQ ID NO: 2075044 - DNA, 19 bp, Homo sapiens
ccctgagtcaactggagca

SEQ ID NO: 2075045 - DNA, 16 bp, Homo sapiens
ccctgagtcaccagga

SEQ ID NO: 2075046 - DNA, 20 bp, Homo sapiens
ccctgatcaagtcaccggag

SEQ ID NO: 2075047 - DNA, 20 bp, Homo sapiens
ccctgcacagatatttccat

SEQ ID NO: 2075048 - DNA, 23 bp, Homo sapiens
ccctgcaccagcccttccctgct

SEQ ID NO: 2075049 - DNA, 13 bp, Homo sapiens
ccctgcaccctgg

SEQ ID NO: 2075050 - DNA, 14 bp, Homo sapiens
ccctgcaccctgga

SEQ ID NO: 2075051 - DNA, 16 bp, Homo sapiens
ccctgcaccctggaaa

SEQ ID NO: 2075052 - DNA, 18 bp, Homo sapiens
ccctgcaccctggaaagg

SEQ ID NO: 2075053 - DNA, 17 bp, Homo sapiens
ccctgcagaccctgccc

SEQ ID NO: 2075054 - DNA, 21 bp, Homo sapiens
ccctgcagagctatggtgagg

SEQ ID NO: 2075055 - DNA, 20 bp, Homo sapiens
ccctgcagcttgtagccagc

SEQ ID NO: 2075056 - DNA, 22 bp, Homo sapiens
ccctgcagcttgtagccagccg

SEQ ID NO: 2075057 - DNA, 15 bp, Homo sapiens
ccgtaggcagcctct

SEQ ID NO: 2075058 - DNA, 14 bp, Homo sapiens
ccgtagttccctga

SEQ ID NO: 2075059 - DNA, 16 bp, Homo sapiens
ccgtagttccctgaaa

SEQ ID NO: 2075060 - DNA, 22 bp, Homo sapiens
ccgtagttccctgaaaacccag

SEQ ID NO: 2075061 - DNA, 18 bp, Homo sapiens
ccgtataggatgtcagac

SEQ ID NO: 2075062 - DNA, 17 bp, Homo sapiens
ccgtcagccacacctgt

SEQ ID NO: 2075063 - DNA, 21 bp, Homo sapiens
ccgtcatggcttaatgtttat

SEQ ID NO: 2075064 - DNA, 17 bp, Homo sapiens
ccgtcatgttcctcaaa

SEQ ID NO: 2075065 - DNA, 17 bp, Homo sapiens
ccgtccacccaggctgc

SEQ ID NO: 2075066 - DNA, 16 bp, Homo sapiens
ccgtccaggagcctgg

SEQ ID NO: 2075067 - DNA, 16 bp, Homo sapiens
ccgtccatggcaccag

SEQ ID NO: 2075068 - DNA, 20 bp, Homo sapiens
ccgtccatggcaccagcccc

SEQ ID NO: 2075069 - DNA, 16 bp, Homo sapiens
ccgtctccctaaaata

SEQ ID NO: 2075070 - DNA, 17 bp, Homo sapiens
ccgtctggggttcagcc

SEQ ID NO: 2075071 - DNA, 21 bp, Homo sapiens
ttctgcagcaactcccacgac

SEQ ID NO: 2075072 - DNA, 20 bp, Homo sapiens
ttctgcagtagtctctgtgc

SEQ ID NO: 2075073 - DNA, 16 bp, Homo sapiens
ttctgcctgcccaggc

SEQ ID NO: 2075074 - DNA, 17 bp, Homo sapiens
ttctgcctgcccaggcc

SEQ ID NO: 2075075 - DNA, 15 bp, Homo sapiens
ttctgctacctcact

SEQ ID NO: 2075076 - DNA, 13 bp, Homo sapiens
ttctgctcctctc

SEQ ID NO: 2075077 - DNA, 15 bp, Homo sapiens
ttctgctcctctcca

SEQ ID NO: 2075078 - DNA, 14 bp, Homo sapiens
ttctgctgcccctg

SEQ ID NO: 2075079 - DNA, 13 bp, Homo sapiens
ttctgctggataa

SEQ ID NO: 2075080 - DNA, 21 bp, Homo sapiens
ttctgctggataaaatgaggt

SEQ ID NO: 2075081 - DNA, 12 bp, Homo sapiens
ttctgctggcct

SEQ ID NO: 2075082 - DNA, 14 bp, Homo sapiens
ttctgctggcctgg

SEQ ID NO: 2075083 - DNA, 14 bp, Homo sapiens
ttctgcttcagcct

SEQ ID NO: 2075084 - DNA, 12 bp, Homo sapiens
ttctgcttctcc

SEQ ID NO: 2075085 - DNA, 21 bp, Homo sapiens
ttctggaaaaaaaatatatat

SEQ ID NO: 2075086 - DNA, 18 bp, Homo sapiens
ttctggaaaagaggagtt

SEQ ID NO: 2075087 - DNA, 10 bp, Homo sapiens
ttctggaaat

SEQ ID NO: 2075088 - DNA, 19 bp, Homo sapiens
ttctggaaattttgtccat

SEQ ID NO: 2075089 - DNA, 22 bp, Homo sapiens
ttctggaatgtaatcaatgttt

SEQ ID NO: 2075090 - DNA, 22 bp, Homo sapiens
ttctggaccagatcctactctt

SEQ ID NO: 2075091 - DNA, 23 bp, Homo sapiens
ttctggattttcccctgaagact

SEQ ID NO: 2075092 - DNA, 17 bp, Homo sapiens
ttctggctcctccttcc

SEQ ID NO: 2075093 - DNA, 15 bp, Homo sapiens
ttctggctgaaaaag

SEQ ID NO: 2075094 - DNA, 19 bp, Homo sapiens
ttctggctgaacactggca

SEQ ID NO: 2075095 - DNA, 20 bp, Homo sapiens
ttctggcttccttctctcaa

SEQ ID NO: 2075096 - DNA, 14 bp, Homo sapiens
ttctggggaggaag

SEQ ID NO: 2075097 - DNA, 16 bp, Homo sapiens
ttctgggtggctcctg

SEQ ID NO: 2075098 - DNA, 18 bp, Homo sapiens
ttctgggtggctcctgcc

SEQ ID NO: 2075099 - DNA, 19 bp, Homo sapiens
ttctgggtggctcctgcca

SEQ ID NO: 2075100 - DNA, 21 bp, Homo sapiens
ttctgggtggctcctgccact

SEQ ID NO: 2075101 - DNA, 21 bp, Homo sapiens
ttctggtatgaacttgaggac

SEQ ID NO: 2075102 - DNA, 15 bp, Homo sapiens
ttctggtcttcactg

SEQ ID NO: 2075103 - DNA, 17 bp, Homo sapiens
ttctggtcttcactgcc

SEQ ID NO: 2075104 - DNA, 15 bp, Homo sapiens
ttctgtaaaatttgt

SEQ ID NO: 2075105 - DNA, 20 bp, Homo sapiens
ttctgtaaactcaaaactta

SEQ ID NO: 2075106 - DNA, 16 bp, Homo sapiens
ttctgtaggttctgtg

SEQ ID NO: 2075107 - DNA, 17 bp, Homo sapiens
ttctgtcacgtgaaata

SEQ ID NO: 2075108 - DNA, 12 bp, Homo sapiens
ttctgtccagga

SEQ ID NO: 2075109 - DNA, 17 bp, Homo sapiens
ttctgtcctactctgtg

SEQ ID NO: 2075110 - DNA, 13 bp, Homo sapiens
ttctgtgaagaat

SEQ ID NO: 2075111 - DNA, 16 bp, Homo sapiens
ttctgtggctcacaga

SEQ ID NO: 2075112 - DNA, 24 bp, Homo sapiens
ttctgttgatcccacttcactgtg

SEQ ID NO: 2075113 - DNA, 16 bp, Homo sapiens
ttctgttgtaatagtc

SEQ ID NO: 2075114 - DNA, 20 bp, Homo sapiens
ttctgtttctattctctcct

SEQ ID NO: 2075115 - DNA, 16 bp, Homo sapiens
ttcttaaaggcctgga

SEQ ID NO: 2075116 - DNA, 19 bp, Homo sapiens
ttcttaaaggcctggaacc

SEQ ID NO: 2075117 - DNA, 19 bp, Homo sapiens
ttcttaaataagaaacttt

SEQ ID NO: 2075118 - DNA, 19 bp, Homo sapiens
ttcttaagatttctcctga

SEQ ID NO: 2075119 - DNA, 22 bp, Homo sapiens
ttcttaaggattgtgatatttt

SEQ ID NO: 2075120 - DNA, 20 bp, Homo sapiens
ttcttaatgctttcctccct

SEQ ID NO: 2075121 - DNA, 14 bp, Homo sapiens
ttcttacagcacat

SEQ ID NO: 2075122 - DNA, 16 bp, Homo sapiens
ttcttacataattttt

SEQ ID NO: 2075123 - DNA, 18 bp, Homo sapiens
ttcttaccgagaaaagga

SEQ ID NO: 2075124 - DNA, 15 bp, Homo sapiens
ttcttactaaacatt

SEQ ID NO: 2075125 - DNA, 18 bp, Homo sapiens
ttcttactaaacattttg

SEQ ID NO: 2075126 - DNA, 22 bp, Homo sapiens
ttcttattcatgctttctcctt

SEQ ID NO: 2075127 - DNA, 17 bp, Homo sapiens
ttcttatttgcaataaa

SEQ ID NO: 2075128 - DNA, 20 bp, Homo sapiens
ttcttatttgtttggtcact

SEQ ID NO: 2075129 - DNA, 16 bp, Homo sapiens
ttcttattttgtaata

SEQ ID NO: 2075130 - DNA, 17 bp, Homo sapiens
ttcttattttgtaataa

SEQ ID NO: 2075131 - DNA, 21 bp, Homo sapiens
ttcttattttgtaataaactc

SEQ ID NO: 2075132 - DNA, 22 bp, Homo sapiens
ttcttattttgtaataaactct

SEQ ID NO: 2075133 - DNA, 14 bp, Homo sapiens
ttcttcagccacct

SEQ ID NO: 2075134 - DNA, 18 bp, Homo sapiens
ttcttcatctgtgactcc

SEQ ID NO: 2075135 - DNA, 14 bp, Homo sapiens
ttcttcatcttgac

SEQ ID NO: 2075136 - DNA, 21 bp, Homo sapiens
ttcttcattcaatacaagtgt

SEQ ID NO: 2075137 - DNA, 15 bp, Homo sapiens
ttcttcccatttgta

SEQ ID NO: 2075138 - DNA, 21 bp, Homo sapiens
ttcttcccatttgtaatgtat

SEQ ID NO: 2075139 - DNA, 20 bp, Homo sapiens
ttcttccccaggtccttcct

SEQ ID NO: 2075140 - DNA, 16 bp, Homo sapiens
ttcttccgtcacatat

SEQ ID NO: 2075141 - DNA, 15 bp, Homo sapiens
ttcttcctcactatg

SEQ ID NO: 2075142 - DNA, 20 bp, Homo sapiens
ttcttctacaaccagagccc

SEQ ID NO: 2075143 - DNA, 21 bp, Homo sapiens
ttcttctacaaccagagcccc

SEQ ID NO: 2075144 - DNA, 13 bp, Homo sapiens
ttcttcttcagaa

SEQ ID NO: 2075145 - DNA, 15 bp, Homo sapiens
ttcttgaaagctgtg

SEQ ID NO: 2075146 - DNA, 16 bp, Homo sapiens
ttcttgagtagatctg

SEQ ID NO: 2075147 - DNA, 15 bp, Homo sapiens
ttcttgatgtcatgt

SEQ ID NO: 2075148 - DNA, 19 bp, Homo sapiens
ttcttggaaaaaaattaca

SEQ ID NO: 2075149 - DNA, 15 bp, Homo sapiens
ttcttggagaacttt

SEQ ID NO: 2075150 - DNA, 15 bp, Homo sapiens
ttcttggcttctggg

SEQ ID NO: 2075151 - DNA, 23 bp, Homo sapiens
ttcttgtgcatgtttactttatt

SEQ ID NO: 2075152 - DNA, 22 bp, Homo sapiens
ttcttgtgccatagtcacatgg

SEQ ID NO: 2075153 - DNA, 17 bp, Homo sapiens
ttcttgtgtcctgatga

SEQ ID NO: 2075154 - DNA, 22 bp, Homo sapiens
ttcttgttcatccaaggaacct

SEQ ID NO: 2075155 - DNA, 14 bp, Homo sapiens
ttctttaaatcaaa

SEQ ID NO: 2075156 - DNA, 16 bp, Homo sapiens
ttctttagctgtcact

SEQ ID NO: 2075157 - DNA, 21 bp, Homo sapiens
ttctttcctctccaattgtaa

SEQ ID NO: 2075158 - DNA, 22 bp, Homo sapiens
ttctttcctctccaattgtaaa

SEQ ID NO: 2075159 - DNA, 14 bp, Homo sapiens
ttctttctcttccc

SEQ ID NO: 2075160 - DNA, 12 bp, Homo sapiens
ttctttctgtta

SEQ ID NO: 2075161 - DNA, 14 bp, Homo sapiens
ttctttgtaaaggt

SEQ ID NO: 2075162 - DNA, 12 bp, Homo sapiens
ttctttgtgtag

SEQ ID NO: 2075163 - DNA, 16 bp, Homo sapiens
ttctttttctggaaat

SEQ ID NO: 2075164 - DNA, 17 bp, Homo sapiens
ttctttttctgtctctc

SEQ ID NO: 2075165 - DNA, 18 bp, Homo sapiens
ttgaaaacataatctgca

SEQ ID NO: 2075166 - DNA, 16 bp, Homo sapiens
ttgaaaagactccaaa

SEQ ID NO: 2075167 - DNA, 18 bp, Homo sapiens
ttgaaaagactccaaaga

SEQ ID NO: 2075168 - DNA, 15 bp, Homo sapiens
ttgaaaattatttta

SEQ ID NO: 2075169 - DNA, 20 bp, Homo sapiens
ttgaaaattcaaaaagtgtt

SEQ ID NO: 2075170 - DNA, 21 bp, Homo sapiens
ttgaaaattcaaaaagtgttt

SEQ ID NO: 2075171 - DNA, 18 bp, Homo sapiens
ttgaaactagaagtcaaa

SEQ ID NO: 2075172 - DNA, 23 bp, Homo sapiens
ttgaaactgagatgtgaacacat

SEQ ID NO: 2075173 - DNA, 17 bp, Homo sapiens
ttgaaagagaaccagtt

SEQ ID NO: 2075174 - DNA, 14 bp, Homo sapiens
ttgaaagagatggc

SEQ ID NO: 2075175 - DNA, 21 bp, Homo sapiens
ttgaaaggggttgtgaagagg

SEQ ID NO: 2075176 - DNA, 19 bp, Homo sapiens
ttgaaatataatgcaaacc

SEQ ID NO: 2075177 - DNA, 23 bp, Homo sapiens
ttgaaattatgtatgtttacata

SEQ ID NO: 2075178 - DNA, 15 bp, Homo sapiens
ttgaaattcccccac

SEQ ID NO: 2075179 - DNA, 21 bp, Homo sapiens
ttgaactgttctggcctcaga

SEQ ID NO: 2075180 - DNA, 20 bp, Homo sapiens
ttgaagaagagtttgcaaat

SEQ ID NO: 2075181 - DNA, 18 bp, Homo sapiens
ttgaagagagatatatct

SEQ ID NO: 2075182 - DNA, 20 bp, Homo sapiens
ttgaagagagatatatctga

SEQ ID NO: 2075183 - DNA, 20 bp, Homo sapiens
ttgaagatcgttagtatcta

SEQ ID NO: 2075184 - DNA, 15 bp, Homo sapiens
ttgaagcagttgtgt

SEQ ID NO: 2075185 - DNA, 13 bp, Homo sapiens
ttgaagccactga

SEQ ID NO: 2075186 - DNA, 20 bp, Homo sapiens
ttgaaggaacagtgctgttc

SEQ ID NO: 2075187 - DNA, 20 bp, Homo sapiens
ttcgtgtagtggaagagcag

SEQ ID NO: 2075188 - DNA, 18 bp, Homo sapiens
ttctaaaaattgtgatca

SEQ ID NO: 2075189 - DNA, 16 bp, Homo sapiens
ttctaaagctttctga

SEQ ID NO: 2075190 - DNA, 12 bp, Homo sapiens
ttctaaatgaat

SEQ ID NO: 2075191 - DNA, 21 bp, Homo sapiens
ttctaaatgaatgtttacact

SEQ ID NO: 2075192 - DNA, 14 bp, Homo sapiens
ttctaaatgctggt

SEQ ID NO: 2075193 - DNA, 18 bp, Homo sapiens
ttctaaatgctggtctag

SEQ ID NO: 2075194 - DNA, 15 bp, Homo sapiens
ttctaactccagtga

SEQ ID NO: 2075195 - DNA, 17 bp, Homo sapiens
ttctaactgtaaatcac

SEQ ID NO: 2075196 - DNA, 18 bp, Homo sapiens
ttctaactgtaaatcact

SEQ ID NO: 2075197 - DNA, 20 bp, Homo sapiens
ttctaactgtaaatcacttg

SEQ ID NO: 2075198 - DNA, 23 bp, Homo sapiens
ttctaactgtaaatcacttgtaa

SEQ ID NO: 2075199 - DNA, 16 bp, Homo sapiens
ttctaagattgtacat

SEQ ID NO: 2075200 - DNA, 17 bp, Homo sapiens
ttctaagattgtacata

SEQ ID NO: 2075201 - DNA, 16 bp, Homo sapiens
ttctaagtaaaaccac

SEQ ID NO: 2075202 - DNA, 19 bp, Homo sapiens
ttctaagtaaaaccacagc

SEQ ID NO: 2075203 - DNA, 13 bp, Homo sapiens
ttctaatgtcttc

SEQ ID NO: 2075204 - DNA, 16 bp, Homo sapiens
ttctaatgtcttcatt

SEQ ID NO: 2075205 - DNA, 23 bp, Homo sapiens
ttctaatgtgtgaatcagagcac

SEQ ID NO: 2075206 - DNA, 14 bp, Homo sapiens
ttctacaaccagag

SEQ ID NO: 2075207 - DNA, 17 bp, Homo sapiens
ttctacaaccagagccc

SEQ ID NO: 2075208 - DNA, 23 bp, Homo sapiens
ttctacaaccagagccccccaca

SEQ ID NO: 2075209 - DNA, 15 bp, Homo sapiens
ttctacaagcatatt

SEQ ID NO: 2075210 - DNA, 16 bp, Homo sapiens
ttctacaagcatattt

SEQ ID NO: 2075211 - DNA, 19 bp, Homo sapiens
ttctacaagcatatttgag

SEQ ID NO: 2075212 - DNA, 13 bp, Homo sapiens
ttctacacagtaa

SEQ ID NO: 2075213 - DNA, 22 bp, Homo sapiens
ttctacacagtgggaactctga

SEQ ID NO: 2075214 - DNA, 22 bp, Homo sapiens
ttctacacctgttgcacctcag

SEQ ID NO: 2075215 - DNA, 15 bp, Homo sapiens
ttctacatactatgg

SEQ ID NO: 2075216 - DNA, 19 bp, Homo sapiens
ttctacatagtaactctta

SEQ ID NO: 2075217 - DNA, 20 bp, Homo sapiens
ttctacccagcgagccctgg

SEQ ID NO: 2075218 - DNA, 21 bp, Homo sapiens
ttctacctgtgttcattctta

SEQ ID NO: 2075219 - DNA, 22 bp, Homo sapiens
ttctacgtataaatatgaaatg

SEQ ID NO: 2075220 - DNA, 15 bp, Homo sapiens
ttctactcatatata

SEQ ID NO: 2075221 - DNA, 18 bp, Homo sapiens
ttctactcatatatatct

SEQ ID NO: 2075222 - DNA, 15 bp, Homo sapiens
ttctagactttctgt

SEQ ID NO: 2075223 - DNA, 14 bp, Homo sapiens
ttctagcagagtga

SEQ ID NO: 2075224 - DNA, 18 bp, Homo sapiens
ttctagctagaaatatga

SEQ ID NO: 2075225 - DNA, 19 bp, Homo sapiens
ttctagctagaaatatgat

SEQ ID NO: 2075226 - DNA, 20 bp, Homo sapiens
ttctagctgttgagctgttt

SEQ ID NO: 2075227 - DNA, 22 bp, Homo sapiens
ttctaggaaacccaaggaacaa

SEQ ID NO: 2075228 - DNA, 14 bp, Homo sapiens
ttctaggtaggaaa

SEQ ID NO: 2075229 - DNA, 18 bp, Homo sapiens
ttctaggtaggaaatgtg

SEQ ID NO: 2075230 - DNA, 19 bp, Homo sapiens
ttctagttagcaggaaata

SEQ ID NO: 2075231 - DNA, 14 bp, Homo sapiens
ttctagttgaaaat

SEQ ID NO: 2075232 - DNA, 15 bp, Homo sapiens
ttctatagccaaaaa

SEQ ID NO: 2075233 - DNA, 22 bp, Homo sapiens
ttctatagctcttctatttaaa

SEQ ID NO: 2075234 - DNA, 17 bp, Homo sapiens
ttctatcaggaaaacaa

SEQ ID NO: 2075235 - DNA, 23 bp, Homo sapiens
ttctatcaggaaaacaaatcact

SEQ ID NO: 2075236 - DNA, 17 bp, Homo sapiens
ttctattgtttattctt

SEQ ID NO: 2075237 - DNA, 16 bp, Homo sapiens
ttctatttaaaaaata

SEQ ID NO: 2075238 - DNA, 16 bp, Homo sapiens
ttctatttttcttcta

SEQ ID NO: 2075239 - DNA, 19 bp, Homo sapiens
ttctatttttcttctaaaa

SEQ ID NO: 2075240 - DNA, 22 bp, Homo sapiens
ttctcaacaaagcacagtgtta

SEQ ID NO: 2075241 - DNA, 19 bp, Homo sapiens
ttctcaatcactgctcccc

SEQ ID NO: 2075242 - DNA, 23 bp, Homo sapiens
ttctcaattgtatagttatattt

SEQ ID NO: 2075243 - DNA, 15 bp, Homo sapiens
ttctcactaaatctt

SEQ ID NO: 2075244 - DNA, 17 bp, Homo sapiens
ttctcactgtctcctgg

SEQ ID NO: 2075245 - DNA, 16 bp, Homo sapiens
ttctcagaacagctga

SEQ ID NO: 2075246 - DNA, 12 bp, Homo sapiens
ttctcagctccg

SEQ ID NO: 2075247 - DNA, 23 bp, Homo sapiens
ttctcaggacacaggcctgtgta

SEQ ID NO: 2075248 - DNA, 22 bp, Homo sapiens
ttctcagtcagtaattgccaaa

SEQ ID NO: 2075249 - DNA, 22 bp, Homo sapiens
ttctcagtgctctcctacccca

SEQ ID NO: 2075250 - DNA, 15 bp, Homo sapiens
ttctcagtttgtata

SEQ ID NO: 2075251 - DNA, 20 bp, Homo sapiens
ttctcatgttgaagccactg

SEQ ID NO: 2075252 - DNA, 20 bp, Homo sapiens
ttctcattccaacagtgagt

SEQ ID NO: 2075253 - DNA, 23 bp, Homo sapiens
ttctcattttttaaaaaagctta

SEQ ID NO: 2075254 - DNA, 14 bp, Homo sapiens
ttctccaaatgaga

SEQ ID NO: 2075255 - DNA, 23 bp, Homo sapiens
ttctccaaatgattttcatcaat

SEQ ID NO: 2075256 - DNA, 12 bp, Homo sapiens
ttctccactgga

SEQ ID NO: 2075257 - DNA, 14 bp, Homo sapiens
ttctccagccagca

SEQ ID NO: 2075258 - DNA, 17 bp, Homo sapiens
ttctccagcccacaccc

SEQ ID NO: 2075259 - DNA, 20 bp, Homo sapiens
ttctcccccgacactgctgc

SEQ ID NO: 2075260 - DNA, 21 bp, Homo sapiens
ttctccctcacccccaggtgt

SEQ ID NO: 2075261 - DNA, 16 bp, Homo sapiens
ttctccggggtctgtg

SEQ ID NO: 2075262 - DNA, 19 bp, Homo sapiens
ttctccggggtctgtgctg

SEQ ID NO: 2075263 - DNA, 20 bp, Homo sapiens
ttctccggggtctgtgctgt

SEQ ID NO: 2075264 - DNA, 23 bp, Homo sapiens
ttctccggggtctgtgctgtgcc

SEQ ID NO: 2075265 - DNA, 14 bp, Homo sapiens
ttctcctaggagaa

SEQ ID NO: 2075266 - DNA, 17 bp, Homo sapiens
ttctcctccattgctgt

SEQ ID NO: 2075267 - DNA, 22 bp, Homo sapiens
ttctcctgtgaccccaccttga

SEQ ID NO: 2075268 - DNA, 13 bp, Homo sapiens
ttctccttggagg

SEQ ID NO: 2075269 - DNA, 18 bp, Homo sapiens
ttctccttggaggacagt

SEQ ID NO: 2075270 - DNA, 17 bp, Homo sapiens
ttctctacccatctccc

SEQ ID NO: 2075271 - DNA, 20 bp, Homo sapiens
ttctctagctgatcagaatt

SEQ ID NO: 2075272 - DNA, 15 bp, Homo sapiens
ttctctccaggctgt

SEQ ID NO: 2075273 - DNA, 19 bp, Homo sapiens
ttctctccaggctgtttct

SEQ ID NO: 2075274 - DNA, 19 bp, Homo sapiens
tgtgactttttagccagtg

SEQ ID NO: 2075275 - DNA, 14 bp, Homo sapiens
tgtgagaatcaaaa

SEQ ID NO: 2075276 - DNA, 21 bp, Homo sapiens
tgtgagattactttgtcccgc

SEQ ID NO: 2075277 - DNA, 18 bp, Homo sapiens
tgtgagcatctctgtgta

SEQ ID NO: 2075278 - DNA, 19 bp, Homo sapiens
tgtgagcatctctgtgtac

SEQ ID NO: 2075279 - DNA, 16 bp, Homo sapiens
tgtgagccaaagagaa

SEQ ID NO: 2075280 - DNA, 22 bp, Homo sapiens
tgtgagccaaagagaaaagatt

SEQ ID NO: 2075281 - DNA, 21 bp, Homo sapiens
tgtgagcccctggtcctgagg

SEQ ID NO: 2075282 - DNA, 14 bp, Homo sapiens
tgtgagcttctaca

SEQ ID NO: 2075283 - DNA, 12 bp, Homo sapiens
tgtgaggcaggg

SEQ ID NO: 2075284 - DNA, 14 bp, Homo sapiens
tgtgaggcctggcc

SEQ ID NO: 2075285 - DNA, 13 bp, Homo sapiens
tgtggccagagct

SEQ ID NO: 2075286 - DNA, 20 bp, Homo sapiens
tgtggccagggtgagagctg

SEQ ID NO: 2075287 - DNA, 15 bp, Homo sapiens
tgtggccatatttat

SEQ ID NO: 2075288 - DNA, 19 bp, Homo sapiens
tgtggccatatttatagaa

SEQ ID NO: 2075289 - DNA, 14 bp, Homo sapiens
tgtggccccagccc

SEQ ID NO: 2075290 - DNA, 22 bp, Homo sapiens
tgtggcccctgaacaagaattg

SEQ ID NO: 2075291 - DNA, 12 bp, Homo sapiens
tgtggccctggc

SEQ ID NO: 2075292 - DNA, 18 bp, Homo sapiens
tgtggcctcacttccctg

SEQ ID NO: 2075293 - DNA, 18 bp, Homo sapiens
ttaatactcacctcctcc

SEQ ID NO: 2075294 - DNA, 18 bp, Homo sapiens
ttaatagcttttattgta

SEQ ID NO: 2075295 - DNA, 22 bp, Homo sapiens
ttactaagccacaagaaatttg

SEQ ID NO: 2075296 - DNA, 13 bp, Homo sapiens
ttactacagttgt

SEQ ID NO: 2075297 - DNA, 17 bp, Homo sapiens
ttactactattctgtta

SEQ ID NO: 2075298 - DNA, 13 bp, Homo sapiens
ttactactgtgga

SEQ ID NO: 2075299 - DNA, 20 bp, Homo sapiens
ttactacttcttggaaaaaa

SEQ ID NO: 2075300 - DNA, 12 bp, Homo sapiens
ttataaaaagtt

SEQ ID NO: 2075301 - DNA, 22 bp, Homo sapiens
ttataaaaccatcaaaaatatt

SEQ ID NO: 2075302 - DNA, 17 bp, Homo sapiens
ttataaaattattttta

SEQ ID NO: 2075303 - DNA, 14 bp, Homo sapiens
ttataaataaacat

SEQ ID NO: 2075304 - DNA, 16 bp, Homo sapiens
ttataaataaatgcca

SEQ ID NO: 2075305 - DNA, 17 bp, Homo sapiens
ttataaataaatgccaa

SEQ ID NO: 2075306 - DNA, 17 bp, Homo sapiens
ttataactcatcataaa

SEQ ID NO: 2075307 - DNA, 18 bp, Homo sapiens
ttataactcatcataaaa

SEQ ID NO: 2075308 - DNA, 21 bp, Homo sapiens
ttataactcatcataaaataa

SEQ ID NO: 2075309 - DNA, 15 bp, Homo sapiens
ttataagaagaggaa

SEQ ID NO: 2075310 - DNA, 23 bp, Homo sapiens
ttataagcaaatttcaaaagaca

SEQ ID NO: 2075311 - DNA, 17 bp, Homo sapiens
ttataagcccaaatggc

SEQ ID NO: 2075312 - DNA, 21 bp, Homo sapiens
ttataagcccaaatggctctg

SEQ ID NO: 2075313 - DNA, 14 bp, Homo sapiens
ttataataatgttc

SEQ ID NO: 2075314 - DNA, 21 bp, Homo sapiens
ttataatgtggatttcctatt

SEQ ID NO: 2075315 - DNA, 18 bp, Homo sapiens
ttatacaccattgttcct

SEQ ID NO: 2075316 - DNA, 16 bp, Homo sapiens
ttatacatatcagaaa

SEQ ID NO: 2075317 - DNA, 17 bp, Homo sapiens
ttatacatatcagaaaa

SEQ ID NO: 2075318 - DNA, 18 bp, Homo sapiens
ttatacatatcagaaaag

SEQ ID NO: 2075319 - DNA, 22 bp, Homo sapiens
ttatactctagaacatgcacat

SEQ ID NO: 2075320 - DNA, 14 bp, Homo sapiens
ttatagaaagttca

SEQ ID NO: 2075321 - DNA, 19 bp, Homo sapiens
ttatagagggccaagactt

SEQ ID NO: 2075322 - DNA, 17 bp, Homo sapiens
ttatagcaatgtaacat

SEQ ID NO: 2075323 - DNA, 16 bp, Homo sapiens
ttatagctcagtttat

SEQ ID NO: 2075324 - DNA, 15 bp, Homo sapiens
ttatagtatatctgg

SEQ ID NO: 2075325 - DNA, 22 bp, Homo sapiens
ttatagtcatttattttaaaaa

SEQ ID NO: 2075326 - DNA, 16 bp, Homo sapiens
ttatagtttgtacatg

SEQ ID NO: 2075327 - DNA, 15 bp, Homo sapiens
ttatatatatatgta

SEQ ID NO: 2075328 - DNA, 14 bp, Homo sapiens
ttatatatcataaa

SEQ ID NO: 2075329 - DNA, 17 bp, Homo sapiens
ttatatatcataaagta

SEQ ID NO: 2075330 - DNA, 14 bp, Homo sapiens
ttatatatgaagta

SEQ ID NO: 2075331 - DNA, 17 bp, Homo sapiens
ttatatatgtatttata

SEQ ID NO: 2075332 - DNA, 11 bp, Homo sapiens
ttatatattgt

SEQ ID NO: 2075333 - DNA, 18 bp, Homo sapiens
ttatatattgtattaagg

SEQ ID NO: 2075334 - DNA, 15 bp, Homo sapiens
ttatatcagcctgag

SEQ ID NO: 2075335 - DNA, 16 bp, Homo sapiens
ttatatcagcctgagt

SEQ ID NO: 2075336 - DNA, 17 bp, Homo sapiens
ttatatctaatttatac

SEQ ID NO: 2075337 - DNA, 19 bp, Homo sapiens
ttatatctaatttatacaa

SEQ ID NO: 2075338 - DNA, 20 bp, Homo sapiens
ttatatctaatttatacaaa

SEQ ID NO: 2075339 - DNA, 22 bp, Homo sapiens
ttatatctaatttatacaaaat

SEQ ID NO: 2075340 - DNA, 22 bp, Homo sapiens
ttatatgacaatcctgaagaaa

SEQ ID NO: 2075341 - DNA, 13 bp, Homo sapiens
ttatatggaaatt

SEQ ID NO: 2075342 - DNA, 15 bp, Homo sapiens
ttatattaaaatatg

SEQ ID NO: 2075343 - DNA, 19 bp, Homo sapiens
ttatattagagtgccctta

SEQ ID NO: 2075344 - DNA, 21 bp, Homo sapiens
ttatattccatatattagcat

SEQ ID NO: 2075345 - DNA, 22 bp, Homo sapiens
ttatattgtatattctggaaaa

SEQ ID NO: 2075346 - DNA, 18 bp, Homo sapiens
ttatatttagttatagtt

SEQ ID NO: 2075347 - DNA, 19 bp, Homo sapiens
ttatatttagttatagttt

SEQ ID NO: 2075348 - DNA, 19 bp, Homo sapiens
ttatatttggaaagagacc

SEQ ID NO: 2075349 - DNA, 15 bp, Homo sapiens
ttatcacttttctgt

SEQ ID NO: 2075350 - DNA, 14 bp, Homo sapiens
ttatcagccatgtt

SEQ ID NO: 2075351 - DNA, 21 bp, Homo sapiens
ttatcagtcataactaaataa

SEQ ID NO: 2075352 - DNA, 21 bp, Homo sapiens
ttatcatctcgaccacttttc

SEQ ID NO: 2075353 - DNA, 16 bp, Homo sapiens
ttatcatgctgtcttt

SEQ ID NO: 2075354 - DNA, 22 bp, Homo sapiens
ttatccaaggtgtaactctaat

SEQ ID NO: 2075355 - DNA, 14 bp, Homo sapiens
ttatccaatcctca

SEQ ID NO: 2075356 - DNA, 18 bp, Homo sapiens
ttatccaggactctgtca

SEQ ID NO: 2075357 - DNA, 21 bp, Homo sapiens
ttatcctgctagctgtagaaa

SEQ ID NO: 2075358 - DNA, 23 bp, Homo sapiens
ttatccttaggaaaatgcttctg

SEQ ID NO: 2075359 - DNA, 16 bp, Homo sapiens
ttatcgggagcagtgt

SEQ ID NO: 2075360 - DNA, 23 bp, Homo sapiens
ttatcgggagcagtgtcttccat

SEQ ID NO: 2075361 - DNA, 21 bp, Homo sapiens
ttatctaagttaatttaaagt

SEQ ID NO: 2075362 - DNA, 20 bp, Homo sapiens
ttatctaatacctctgtgtg

SEQ ID NO: 2075363 - DNA, 15 bp, Homo sapiens
ttatctctatttaat

SEQ ID NO: 2075364 - DNA, 18 bp, Homo sapiens
ttatctgagttttattga

SEQ ID NO: 2075365 - DNA, 11 bp, Homo sapiens
ttatctgtgtt

SEQ ID NO: 2075366 - DNA, 11 bp, Homo sapiens
ttatcttgaaa

SEQ ID NO: 2075367 - DNA, 17 bp, Homo sapiens
ttatcttggactgacat

SEQ ID NO: 2075368 - DNA, 16 bp, Homo sapiens
ttatcttgtctctggg

SEQ ID NO: 2075369 - DNA, 17 bp, Homo sapiens
ttatgaaaaagaagaat

SEQ ID NO: 2075370 - DNA, 19 bp, Homo sapiens
ttatgaaaaagaagaatct

SEQ ID NO: 2075371 - DNA, 14 bp, Homo sapiens
ttatgacagttata

SEQ ID NO: 2075372 - DNA, 16 bp, Homo sapiens
ttatgacatcacttgt

SEQ ID NO: 2075373 - DNA, 13 bp, Homo sapiens
ttatgagtttttg

SEQ ID NO: 2075374 - DNA, 20 bp, Homo sapiens
ttatgatttaaaaaataaat

SEQ ID NO: 2075375 - DNA, 22 bp, Homo sapiens
ttatgcaaggaaggaaagaaag

SEQ ID NO: 2075376 - DNA, 14 bp, Homo sapiens
ttatgctgagtatg

SEQ ID NO: 2075377 - DNA, 22 bp, Homo sapiens
ttatggaagattttaaattcac

SEQ ID NO: 2075378 - DNA, 17 bp, Homo sapiens
ttatggagtgtcaccag

SEQ ID NO: 2075379 - DNA, 21 bp, Homo sapiens
ttatggcaagtgatatcacct

SEQ ID NO: 2075380 - DNA, 13 bp, Homo sapiens
ttatggcatgatt

SEQ ID NO: 2075381 - DNA, 23 bp, Homo sapiens
ttatgggaaccccttcatcctct

SEQ ID NO: 2075382 - DNA, 14 bp, Homo sapiens
ttatggtgaaatta

SEQ ID NO: 2075383 - DNA, 15 bp, Homo sapiens
ttatggtgtaatgca

SEQ ID NO: 2075384 - DNA, 17 bp, Homo sapiens
ttatggtgtaatgcaca

SEQ ID NO: 2075385 - DNA, 12 bp, Homo sapiens
ttatgtagaaat

SEQ ID NO: 2075386 - DNA, 17 bp, Homo sapiens
ttatgtatatagatgtg

SEQ ID NO: 2075387 - DNA, 19 bp, Homo sapiens
ttatgtattattttctata

SEQ ID NO: 2075388 - DNA, 23 bp, Homo sapiens
ttatgtattattttctatagctc

SEQ ID NO: 2075389 - DNA, 17 bp, Homo sapiens
ttatgtcatcatacatg

SEQ ID NO: 2075390 - DNA, 17 bp, Homo sapiens
ttatgtctatttaagcc

SEQ ID NO: 2075391 - DNA, 23 bp, Homo sapiens
ttatgtgaatgatctctctgaat

SEQ ID NO: 2075392 - DNA, 16 bp, Homo sapiens
ttatgtgacaaccttt

SEQ ID NO: 2075393 - DNA, 20 bp, Homo sapiens
ttatgtgtgcatgtgtgtat

SEQ ID NO: 2075394 - DNA, 21 bp, Homo sapiens
ttatgtgtgcatgtgtgtata

SEQ ID NO: 2075395 - DNA, 15 bp, Homo sapiens
ttatgttacatctgt

SEQ ID NO: 2075396 - DNA, 21 bp, Homo sapiens
ttatgttgttcaaatgcattt

SEQ ID NO: 2075397 - DNA, 22 bp, Homo sapiens
ttattaaataaatattttacag

SEQ ID NO: 2075398 - DNA, 21 bp, Homo sapiens
ttattaacgggcatgtattat

SEQ ID NO: 2075399 - DNA, 15 bp, Homo sapiens
ttattaatattgtgc

SEQ ID NO: 2075400 - DNA, 14 bp, Homo sapiens
ttattaattcatta

SEQ ID NO: 2075401 - DNA, 15 bp, Homo sapiens
ttattaattcattaa

SEQ ID NO: 2075402 - DNA, 12 bp, Homo sapiens
ttattacctctg

SEQ ID NO: 2075403 - DNA, 20 bp, Homo sapiens
ttattagtaagaaaacatca

SEQ ID NO: 2075404 - DNA, 14 bp, Homo sapiens
ttattcaaatgaag

SEQ ID NO: 2075405 - DNA, 17 bp, Homo sapiens
ttattcaagacaccaaa

SEQ ID NO: 2075406 - DNA, 13 bp, Homo sapiens
ttattcactgtaa

SEQ ID NO: 2075407 - DNA, 17 bp, Homo sapiens
ttattcatgccatctgt

SEQ ID NO: 2075408 - DNA, 22 bp, Homo sapiens
ttattcatgccatctgttttca

SEQ ID NO: 2075409 - DNA, 17 bp, Homo sapiens
ttattcatttaaaatga

SEQ ID NO: 2075410 - DNA, 14 bp, Homo sapiens
ttattcatttgagt

SEQ ID NO: 2075411 - DNA, 20 bp, Homo sapiens
ttattcctgataataattga

SEQ ID NO: 2075412 - DNA, 21 bp, Homo sapiens
ttattcctgataataattgat

SEQ ID NO: 2075413 - DNA, 13 bp, Homo sapiens
ttattctcctccc

SEQ ID NO: 2075414 - DNA, 13 bp, Homo sapiens
ttattgaagaaac

SEQ ID NO: 2075415 - DNA, 16 bp, Homo sapiens
ttattgaatcttaatt

SEQ ID NO: 2075416 - DNA, 22 bp, Homo sapiens
ttattgacaataatttcaggtt

SEQ ID NO: 2075417 - DNA, 19 bp, Homo sapiens
ttattgagaattttaaatt

SEQ ID NO: 2075418 - DNA, 18 bp, Homo sapiens
ttattgatttttgtaata

SEQ ID NO: 2075419 - DNA, 12 bp, Homo sapiens
ttattgctgttg

SEQ ID NO: 2075420 - DNA, 22 bp, Homo sapiens
ttattggaagtgttcaagaaat

SEQ ID NO: 2075421 - DNA, 12 bp, Homo sapiens
ttattggccact

SEQ ID NO: 2075422 - DNA, 19 bp, Homo sapiens
ttattgtacagctgtttaa

SEQ ID NO: 2075423 - DNA, 23 bp, Homo sapiens
ttattgtgttgccttagcacttc

SEQ ID NO: 2075424 - DNA, 17 bp, Homo sapiens
ttattgtttaaaatcat

SEQ ID NO: 2075425 - DNA, 17 bp, Homo sapiens
ttatttaaaaaactaaa

SEQ ID NO: 2075426 - DNA, 11 bp, Homo sapiens
ttatttaaatg

SEQ ID NO: 2075427 - DNA, 16 bp, Homo sapiens
ttatttaatgttatgt

SEQ ID NO: 2075428 - DNA, 21 bp, Homo sapiens
ttatttactgagcttctctgt

SEQ ID NO: 2075429 - DNA, 16 bp, Homo sapiens
ttatttatatatgaag

SEQ ID NO: 2075430 - DNA, 14 bp, Homo sapiens
ttatttatcagtga

SEQ ID NO: 2075431 - DNA, 22 bp, Homo sapiens
ttatttatggcttataaatgtg

SEQ ID NO: 2075432 - DNA, 15 bp, Homo sapiens
ttatttccaaaataa

SEQ ID NO: 2075433 - DNA, 12 bp, Homo sapiens
ttatttctgtaa

SEQ ID NO: 2075434 - DNA, 12 bp, Homo sapiens
ttatttctgtca

SEQ ID NO: 2075435 - DNA, 14 bp, Homo sapiens
ttatttgacaaaat

SEQ ID NO: 2075436 - DNA, 11 bp, Homo sapiens
ttatttgcaat

SEQ ID NO: 2075437 - DNA, 18 bp, Homo sapiens
ttatttgcagagacagga

SEQ ID NO: 2075438 - DNA, 17 bp, Homo sapiens
ttatttgtaatagatgt

SEQ ID NO: 2075439 - DNA, 16 bp, Homo sapiens
ttatttgtgtaataga

SEQ ID NO: 2075440 - DNA, 12 bp, Homo sapiens
ttatttgttgag

SEQ ID NO: 2075441 - DNA, 14 bp, Homo sapiens
ttatttgttgagag

SEQ ID NO: 2075442 - DNA, 14 bp, Homo sapiens
ttattttaaacaaa

SEQ ID NO: 2075443 - DNA, 24 bp, Homo sapiens
ttattttaatattttgtattttca

SEQ ID NO: 2075444 - DNA, 12 bp, Homo sapiens
ttattttcagta

SEQ ID NO: 2075445 - DNA, 15 bp, Homo sapiens
ttattttccaataaa

SEQ ID NO: 2075446 - DNA, 15 bp, Homo sapiens
ttattttctttttgt

SEQ ID NO: 2075447 - DNA, 17 bp, Homo sapiens
ttattttgtaataaact

SEQ ID NO: 2075448 - DNA, 18 bp, Homo sapiens
ttattttgtattacatct

SEQ ID NO: 2075449 - DNA, 19 bp, Homo sapiens
ttattttgttacactaaag

SEQ ID NO: 2075450 - DNA, 22 bp, Homo sapiens
ttatttttctaaggttctcata

SEQ ID NO: 2075451 - DNA, 11 bp, Homo sapiens
ttatttttgaa

SEQ ID NO: 2075452 - DNA, 17 bp, Homo sapiens
ttatttttgtgtttcta

SEQ ID NO: 2075453 - DNA, 17 bp, Homo sapiens
ttattttttaaaataat

SEQ ID NO: 2075454 - DNA, 14 bp, Homo sapiens
ttattttttaatta

SEQ ID NO: 2075455 - DNA, 14 bp, Homo sapiens
ttattttttctaca

SEQ ID NO: 2075456 - DNA, 14 bp, Homo sapiens
ttcaaaaaaacact

SEQ ID NO: 2075457 - DNA, 18 bp, Homo sapiens
ttcaaaaaaacactagtt

SEQ ID NO: 2075458 - DNA, 17 bp, Homo sapiens
ttcaaaaagtgtttatt

SEQ ID NO: 2075459 - DNA, 20 bp, Homo sapiens
ttcaaaaattgtgtttagat

SEQ ID NO: 2075460 - DNA, 22 bp, Homo sapiens
ttcaaaacaaccatcctgctca

SEQ ID NO: 2075461 - DNA, 18 bp, Homo sapiens
ttcaaaacattgtgccat

SEQ ID NO: 2075462 - DNA, 11 bp, Homo sapiens
ttcaaaataaa

SEQ ID NO: 2075463 - DNA, 14 bp, Homo sapiens
ttcaaacaagaatg

SEQ ID NO: 2075464 - DNA, 18 bp, Homo sapiens
ttcaaacagtctcaggaa

SEQ ID NO: 2075465 - DNA, 19 bp, Homo sapiens
ttcaaaccatttaattcat

SEQ ID NO: 2075466 - DNA, 20 bp, Homo sapiens
ttcaaaccatttaattcata

SEQ ID NO: 2075467 - DNA, 21 bp, Homo sapiens
ttcaaaccatttaattcataa

SEQ ID NO: 2075468 - DNA, 23 bp, Homo sapiens
ttcaaagagactaatagagacac

SEQ ID NO: 2075469 - DNA, 16 bp, Homo sapiens
ttcaaagcttgaagat

SEQ ID NO: 2075470 - DNA, 11 bp, Homo sapiens
ttcaaatgtca

SEQ ID NO: 2075471 - DNA, 15 bp, Homo sapiens
ttcaacaattctaaa

SEQ ID NO: 2075472 - DNA, 16 bp, Homo sapiens
ttcaaccagcattcat

SEQ ID NO: 2075473 - DNA, 16 bp, Homo sapiens
ttcaaccagcatttta

SEQ ID NO: 2075474 - DNA, 21 bp, Homo sapiens
ttcaaccagcattttactact

SEQ ID NO: 2075475 - DNA, 18 bp, Homo sapiens
ttcaaccgcttgccatat

SEQ ID NO: 2075476 - DNA, 22 bp, Homo sapiens
ttcaacctggtggcaccagatg

SEQ ID NO: 2075477 - DNA, 20 bp, Homo sapiens
ttcaacgcagccctgctttg

SEQ ID NO: 2075478 - DNA, 14 bp, Homo sapiens
ttcaactgaaaaga

SEQ ID NO: 2075479 - DNA, 17 bp, Homo sapiens
ttcaacttaaatcactg

SEQ ID NO: 2075480 - DNA, 17 bp, Homo sapiens
ttcaagaaaaaataaat

SEQ ID NO: 2075481 - DNA, 16 bp, Homo sapiens
ttcaagaaaactggaa

SEQ ID NO: 2075482 - DNA, 17 bp, Homo sapiens
ttcaagaaaactggaaa

SEQ ID NO: 2075483 - DNA, 22 bp, Homo sapiens
ttcaagaaagcttcaaactgca

SEQ ID NO: 2075484 - DNA, 13 bp, Homo sapiens
ttcaagacttgat

SEQ ID NO: 2075485 - DNA, 14 bp, Homo sapiens
ttcaagacttgata

SEQ ID NO: 2075486 - DNA, 14 bp, Homo sapiens
ttcaagagaagaaa

SEQ ID NO: 2075487 - DNA, 16 bp, Homo sapiens
ttcaagagaagaaaaa

SEQ ID NO: 2075488 - DNA, 21 bp, Homo sapiens
ttcaagcaccctgttccctct

SEQ ID NO: 2075489 - DNA, 16 bp, Homo sapiens
ttcaagcacctgcaga

SEQ ID NO: 2075490 - DNA, 14 bp, Homo sapiens
ttcaagcctgtggg

SEQ ID NO: 2075491 - DNA, 15 bp, Homo sapiens
ttcaagcctgtggga

SEQ ID NO: 2075492 - DNA, 20 bp, Homo sapiens
ttcaagcctgtgggagtaga

SEQ ID NO: 2075493 - DNA, 21 bp, Homo sapiens
ttcaagcgattcttctgcttc

SEQ ID NO: 2075494 - DNA, 16 bp, Homo sapiens
ttcaagggaagaaaca

SEQ ID NO: 2075495 - DNA, 18 bp, Homo sapiens
ttcaaggtggccaaatta

SEQ ID NO: 2075496 - DNA, 22 bp, Homo sapiens
ttcaaggtggccaaattatttg

SEQ ID NO: 2075497 - DNA, 17 bp, Homo sapiens
ttcaagtgcctcttgtt

SEQ ID NO: 2075498 - DNA, 21 bp, Homo sapiens
ttcaagtgttgctcttggaaa

SEQ ID NO: 2075499 - DNA, 12 bp, Homo sapiens
ttcaataaagta

SEQ ID NO: 2075500 - DNA, 18 bp, Homo sapiens
ttcaataaatgtctgttg

SEQ ID NO: 2075501 - DNA, 19 bp, Homo sapiens
ttcaataaatgtctgttga

SEQ ID NO: 2075502 - DNA, 13 bp, Homo sapiens
ttcaatatgaagg

SEQ ID NO: 2075503 - DNA, 12 bp, Homo sapiens
ttcaatgcaaag

SEQ ID NO: 2075504 - DNA, 17 bp, Homo sapiens
ttcaatgcaaagtaaaa

SEQ ID NO: 2075505 - DNA, 20 bp, Homo sapiens
ttcaatggtttgcaaggaag

SEQ ID NO: 2075506 - DNA, 22 bp, Homo sapiens
ttcaatggtttgcaaggaagcc

SEQ ID NO: 2075507 - DNA, 20 bp, Homo sapiens
ttcaatgtttttaaaaatct

SEQ ID NO: 2075508 - DNA, 16 bp, Homo sapiens
ttcaattatttcaatg

SEQ ID NO: 2075509 - DNA, 14 bp, Homo sapiens
ttcaattcctgggc

SEQ ID NO: 2075510 - DNA, 18 bp, Homo sapiens
ttcaattctcatttgtca

SEQ ID NO: 2075511 - DNA, 15 bp, Homo sapiens
ttcaatttaaaggtt

SEQ ID NO: 2075512 - DNA, 17 bp, Homo sapiens
ttcaatttaattcttat

SEQ ID NO: 2075513 - DNA, 20 bp, Homo sapiens
ttcaatttaattcttatttc

SEQ ID NO: 2075514 - DNA, 17 bp, Homo sapiens
ttcaatttccaagagct

SEQ ID NO: 2075515 - DNA, 21 bp, Homo sapiens
ttcacaaccttctgtggctca

SEQ ID NO: 2075516 - DNA, 20 bp, Homo sapiens
ttcacaactaggacctcata

SEQ ID NO: 2075517 - DNA, 23 bp, Homo sapiens
ttcacaattccatttccagttca

SEQ ID NO: 2075518 - DNA, 21 bp, Homo sapiens
ttcacacacaggcaactgagg

SEQ ID NO: 2075519 - DNA, 14 bp, Homo sapiens
ttcacacacccctc

SEQ ID NO: 2075520 - DNA, 11 bp, Homo sapiens
ttcacacctta

SEQ ID NO: 2075521 - DNA, 22 bp, Homo sapiens
ttcacagtgtttcgacagctga

SEQ ID NO: 2075522 - DNA, 23 bp, Homo sapiens
ttcacagttggctggatgaaatt

SEQ ID NO: 2075523 - DNA, 13 bp, Homo sapiens
ttcacagtttttc

SEQ ID NO: 2075524 - DNA, 15 bp, Homo sapiens
ttcacatccaatgca

SEQ ID NO: 2075525 - DNA, 23 bp, Homo sapiens
ttcaccaaatgatgccacttccc

SEQ ID NO: 2075526 - DNA, 17 bp, Homo sapiens
ttcaccagagcccatgc

SEQ ID NO: 2075527 - DNA, 18 bp, Homo sapiens
ttcaccagatttgctaat

SEQ ID NO: 2075528 - DNA, 23 bp, Homo sapiens
ttcaccccccactcaccagtgtc

SEQ ID NO: 2075529 - DNA, 14 bp, Homo sapiens
ttcacccctgcact

SEQ ID NO: 2075530 - DNA, 22 bp, Homo sapiens
ttcacctgtttttaagctgttt

SEQ ID NO: 2075531 - DNA, 16 bp, Homo sapiens
ttcacctttggtgcag

SEQ ID NO: 2075532 - DNA, 22 bp, Homo sapiens
ttcacgcaacttgaaattatat

SEQ ID NO: 2075533 - DNA, 18 bp, Homo sapiens
ttcactataaatggtgtt

SEQ ID NO: 2075534 - DNA, 12 bp, Homo sapiens
ttcactcagcca

SEQ ID NO: 2075535 - DNA, 13 bp, Homo sapiens
ttcactgctggct

SEQ ID NO: 2075536 - DNA, 18 bp, Homo sapiens
ttcactgctggctgcctt

SEQ ID NO: 2075537 - DNA, 19 bp, Homo sapiens
ttcactgctggctgcctta

SEQ ID NO: 2075538 - DNA, 13 bp, Homo sapiens
ttcactgtaagtt

SEQ ID NO: 2075539 - DNA, 15 bp, Homo sapiens
ttcactgtagaatga

SEQ ID NO: 2075540 - DNA, 21 bp, Homo sapiens
ttcactgtgttggccaggctg

SEQ ID NO: 2075541 - DNA, 21 bp, Homo sapiens
ttcactgttgaaaattatttt

SEQ ID NO: 2075542 - DNA, 15 bp, Homo sapiens
tgcttaaaatatgta

SEQ ID NO: 2075543 - DNA, 12 bp, Homo sapiens
tgcttaaattat

SEQ ID NO: 2075544 - DNA, 16 bp, Homo sapiens
tgcttacagtgactgt

SEQ ID NO: 2075545 - DNA, 15 bp, Homo sapiens
tgcttacccttcacc

SEQ ID NO: 2075546 - DNA, 15 bp, Homo sapiens
tgcttagaaagttat

SEQ ID NO: 2075547 - DNA, 18 bp, Homo sapiens
tgcttagaaagttattgt

SEQ ID NO: 2075548 - DNA, 21 bp, Homo sapiens
tgcttagatgagggtgactgt

SEQ ID NO: 2075549 - DNA, 14 bp, Homo sapiens
tgcttagcctcctg

SEQ ID NO: 2075550 - DNA, 15 bp, Homo sapiens
tgcttagcctcctga

SEQ ID NO: 2075551 - DNA, 23 bp, Homo sapiens
tgcttaggatgtttttcatgaaa

SEQ ID NO: 2075552 - DNA, 16 bp, Homo sapiens
tgcttattctatccac

SEQ ID NO: 2075553 - DNA, 13 bp, Homo sapiens
tgcttatttatat

SEQ ID NO: 2075554 - DNA, 19 bp, Homo sapiens
tgcttatttatattcagag

SEQ ID NO: 2075555 - DNA, 15 bp, Homo sapiens
tgcttattttaaaat

SEQ ID NO: 2075556 - DNA, 22 bp, Homo sapiens
tgcttcaagtgttgctcttgga

SEQ ID NO: 2075557 - DNA, 13 bp, Homo sapiens
tgcttcagcctcc

SEQ ID NO: 2075558 - DNA, 17 bp, Homo sapiens
tgcttcagcctgaggct

SEQ ID NO: 2075559 - DNA, 16 bp, Homo sapiens
tgcttcagtggagaat

SEQ ID NO: 2075560 - DNA, 18 bp, Homo sapiens
tgcttcagtggagaatta

SEQ ID NO: 2075561 - DNA, 15 bp, Homo sapiens
tgcttcccagagaag

SEQ ID NO: 2075562 - DNA, 19 bp, Homo sapiens
tgcttcctaggccccagag

SEQ ID NO: 2075563 - DNA, 15 bp, Homo sapiens
tgcttctagtatttt

SEQ ID NO: 2075564 - DNA, 16 bp, Homo sapiens
tgcttctctacagact

SEQ ID NO: 2075565 - DNA, 14 bp, Homo sapiens
tgcttctgaactca

SEQ ID NO: 2075566 - DNA, 14 bp, Homo sapiens
tgcttctgcagcaa

SEQ ID NO: 2075567 - DNA, 16 bp, Homo sapiens
tgcttctgcagcaact

SEQ ID NO: 2075568 - DNA, 22 bp, Homo sapiens
tgcttcttcaagcacctgcaga

SEQ ID NO: 2075569 - DNA, 18 bp, Homo sapiens
tgcttcttcatcttgaca

SEQ ID NO: 2075570 - DNA, 20 bp, Homo sapiens
tgcttcttcatcttgacatg

SEQ ID NO: 2075571 - DNA, 20 bp, Homo sapiens
tgcttgaggaggggcacctg

SEQ ID NO: 2075572 - DNA, 21 bp, Homo sapiens
tgcttgaggaggggcacctgc

SEQ ID NO: 2075573 - DNA, 23 bp, Homo sapiens
tgcttgccaccaccagatgagaa

SEQ ID NO: 2075574 - DNA, 16 bp, Homo sapiens
tgcttgcccccatgtg

SEQ ID NO: 2075575 - DNA, 20 bp, Homo sapiens
tgcttgccgagcctaatgaa

SEQ ID NO: 2075576 - DNA, 22 bp, Homo sapiens
tgcttgctggtactaagaggct

SEQ ID NO: 2075577 - DNA, 12 bp, Homo sapiens
tgcttggcagag

SEQ ID NO: 2075578 - DNA, 19 bp, Homo sapiens
tgcttggtggggctcgtgg

SEQ ID NO: 2075579 - DNA, 22 bp, Homo sapiens
tgcttggtggggctcgtggcct

SEQ ID NO: 2075580 - DNA, 17 bp, Homo sapiens
tgcttgtccctgcccag

SEQ ID NO: 2075581 - DNA, 17 bp, Homo sapiens
tgcttgtcctgctctct

SEQ ID NO: 2075582 - DNA, 20 bp, Homo sapiens
tgcttgtcctgctctcttca

SEQ ID NO: 2075583 - DNA, 22 bp, Homo sapiens
tgcttgtcctgctctcttcagg

SEQ ID NO: 2075584 - DNA, 23 bp, Homo sapiens
tgcttgtcctgctctcttcagga

SEQ ID NO: 2075585 - DNA, 15 bp, Homo sapiens
tgcttgttgtcaagt

SEQ ID NO: 2075586 - DNA, 20 bp, Homo sapiens
tgcttgttgtcaagtataaa

SEQ ID NO: 2075587 - DNA, 21 bp, Homo sapiens
tgctttaaagtacctgtagtg

SEQ ID NO: 2075588 - DNA, 17 bp, Homo sapiens
tgctttaaatctatcta

SEQ ID NO: 2075589 - DNA, 15 bp, Homo sapiens
tgctttacctttaaa

SEQ ID NO: 2075590 - DNA, 18 bp, Homo sapiens
tgctttacctttattaat

SEQ ID NO: 2075591 - DNA, 20 bp, Homo sapiens
tgctttacctttattaatga

SEQ ID NO: 2075592 - DNA, 15 bp, Homo sapiens
tgctttatttatggc

SEQ ID NO: 2075593 - DNA, 17 bp, Homo sapiens
tgctttcaacttaaatc

SEQ ID NO: 2075594 - DNA, 13 bp, Homo sapiens
tgctttcaggtct

SEQ ID NO: 2075595 - DNA, 14 bp, Homo sapiens
tgctttcctccctg

SEQ ID NO: 2075596 - DNA, 14 bp, Homo sapiens
tgctttccttttct

SEQ ID NO: 2075597 - DNA, 18 bp, Homo sapiens
tgctttgactcacctgtt

SEQ ID NO: 2075598 - DNA, 16 bp, Homo sapiens
tgctttgggctgccct

SEQ ID NO: 2075599 - DNA, 18 bp, Homo sapiens
tgctttgggctgccctgg

SEQ ID NO: 2075600 - DNA, 19 bp, Homo sapiens
tggacagctgtgcctcgct

SEQ ID NO: 2075601 - DNA, 12 bp, Homo sapiens
tggacagcttgt

SEQ ID NO: 2075602 - DNA, 13 bp, Homo sapiens
tggacagcttgtg

SEQ ID NO: 2075603 - DNA, 23 bp, Homo sapiens
tggacaggcatgttctctgagga

SEQ ID NO: 2075604 - DNA, 17 bp, Homo sapiens
tggacagtcctgggaga

SEQ ID NO: 2075605 - DNA, 21 bp, Homo sapiens
tggacatcacagcagaatgaa

SEQ ID NO: 2075606 - DNA, 21 bp, Homo sapiens
tggacatgatttagggaagca

SEQ ID NO: 2075607 - DNA, 17 bp, Homo sapiens
tggacatggtctcctct

SEQ ID NO: 2075608 - DNA, 15 bp, Homo sapiens
tggacattgtctgcg

SEQ ID NO: 2075609 - DNA, 19 bp, Homo sapiens
tggacatttgccttgctgg

SEQ ID NO: 2075610 - DNA, 22 bp, Homo sapiens
tggacatttgccttgctggacg

SEQ ID NO: 2075611 - DNA, 21 bp, Homo sapiens
tggaccaaccctgtttcctga

SEQ ID NO: 2075612 - DNA, 13 bp, Homo sapiens
tggaccacaggca

SEQ ID NO: 2075613 - DNA, 17 bp, Homo sapiens
tggaccaccagccccag

SEQ ID NO: 2075614 - DNA, 19 bp, Homo sapiens
tggaccaccagccccagca

SEQ ID NO: 2075615 - DNA, 19 bp, Homo sapiens
tggaccaggacaggaccag

SEQ ID NO: 2075616 - DNA, 22 bp, Homo sapiens
tggacccacgaacgctcttagc

SEQ ID NO: 2075617 - DNA, 14 bp, Homo sapiens
tggacccgctctgg

SEQ ID NO: 2075618 - DNA, 16 bp, Homo sapiens
tggaccctccacttca

SEQ ID NO: 2075619 - DNA, 17 bp, Homo sapiens
tggaccctcgcagcagg

SEQ ID NO: 2075620 - DNA, 16 bp, Homo sapiens
tggaccgcttcccaga

SEQ ID NO: 2075621 - DNA, 17 bp, Homo sapiens
tggaccgcttcccagag

SEQ ID NO: 2075622 - DNA, 17 bp, Homo sapiens
tggaccgggtgggcctg

SEQ ID NO: 2075623 - DNA, 19 bp, Homo sapiens
tggacctatgtcctaagga

SEQ ID NO: 2075624 - DNA, 22 bp, Homo sapiens
tggacctatgtcctaaggacac

SEQ ID NO: 2075625 - DNA, 13 bp, Homo sapiens
tggacctgaagga

SEQ ID NO: 2075626 - DNA, 17 bp, Homo sapiens
tggacgttcggggcatg

SEQ ID NO: 2075627 - DNA, 22 bp, Homo sapiens
tggactaaccccaacgcacagg

SEQ ID NO: 2075628 - DNA, 22 bp, Homo sapiens
tggactctaagctggagctctt

SEQ ID NO: 2075629 - DNA, 23 bp, Homo sapiens
tggactctaagctggagctcttg

SEQ ID NO: 2075630 - DNA, 16 bp, Homo sapiens
tggactctgcacatga

SEQ ID NO: 2075631 - DNA, 17 bp, Homo sapiens
tggactctgcacatgaa

SEQ ID NO: 2075632 - DNA, 17 bp, Homo sapiens
tggactctgcacatgtc

SEQ ID NO: 2075633 - DNA, 11 bp, Homo sapiens
tggactgacta

SEQ ID NO: 2075634 - DNA, 23 bp, Homo sapiens
tggactgggttttgtctctgcat

SEQ ID NO: 2075635 - DNA, 17 bp, Homo sapiens
tggacttgttcgtgccc

SEQ ID NO: 2075636 - DNA, 15 bp, Homo sapiens
tggagaaaatgaaga

SEQ ID NO: 2075637 - DNA, 16 bp, Homo sapiens
tggagaaaccctgtct

SEQ ID NO: 2075638 - DNA, 17 bp, Homo sapiens
tggagaaattatttaat

SEQ ID NO: 2075639 - DNA, 19 bp, Homo sapiens
tggagaaattatttaataa

SEQ ID NO: 2075640 - DNA, 22 bp, Homo sapiens
tggagaactgggatttgaaccc

SEQ ID NO: 2075641 - DNA, 17 bp, Homo sapiens
tggagaagaccctcccc

SEQ ID NO: 2075642 - DNA, 13 bp, Homo sapiens
tggagaagcagtg

SEQ ID NO: 2075643 - DNA, 13 bp, Homo sapiens
tggagaaggaagg

SEQ ID NO: 2075644 - DNA, 14 bp, Homo sapiens
tggagaattatata

SEQ ID NO: 2075645 - DNA, 14 bp, Homo sapiens
tggagactctgtgg

SEQ ID NO: 2075646 - DNA, 14 bp, Homo sapiens
tggagactgtctca

SEQ ID NO: 2075647 - DNA, 22 bp, Homo sapiens
tggagacttcaggttgttctgt

SEQ ID NO: 2075648 - DNA, 11 bp, Homo sapiens
tggagagaagt

SEQ ID NO: 2075649 - DNA, 12 bp, Homo sapiens
tggagagagggg

SEQ ID NO: 2075650 - DNA, 13 bp, Homo sapiens
tggagagagggga

SEQ ID NO: 2075651 - DNA, 19 bp, Homo sapiens
tggagagccagaacctgga

SEQ ID NO: 2075652 - DNA, 15 bp, Homo sapiens
tggagagccctggga

SEQ ID NO: 2075653 - DNA, 18 bp, Homo sapiens
tggagagccctgggaccg

SEQ ID NO: 2075654 - DNA, 20 bp, Homo sapiens
tggagagctagaacctggag

SEQ ID NO: 2075655 - DNA, 21 bp, Homo sapiens
tggagagctagaacctggaga

SEQ ID NO: 2075656 - DNA, 23 bp, Homo sapiens
tggagaggagggatgctgcctga

SEQ ID NO: 2075657 - DNA, 19 bp, Homo sapiens
tggagatatttatgggggg

SEQ ID NO: 2075658 - DNA, 15 bp, Homo sapiens
tggagcaagaaggaa

SEQ ID NO: 2075659 - DNA, 21 bp, Homo sapiens
tggagcaagtgacatgccatc

SEQ ID NO: 2075660 - DNA, 11 bp, Homo sapiens
tggagcatctg

SEQ ID NO: 2075661 - DNA, 15 bp, Homo sapiens
tggagcatctgactc

SEQ ID NO: 2075662 - DNA, 16 bp, Homo sapiens
tggagcatctgactca

SEQ ID NO: 2075663 - DNA, 17 bp, Homo sapiens
tggagccaagggttcag

SEQ ID NO: 2075664 - DNA, 15 bp, Homo sapiens
tgggcacccccagcc

SEQ ID NO: 2075665 - DNA, 17 bp, Homo sapiens
tgggcacccccagcctg

SEQ ID NO: 2075666 - DNA, 22 bp, Homo sapiens
tgggcacccccagcctgggcct

SEQ ID NO: 2075667 - DNA, 23 bp, Homo sapiens
tgggcacccccagcctgggccta

SEQ ID NO: 2075668 - DNA, 15 bp, Homo sapiens
tgggcactgggatga

SEQ ID NO: 2075669 - DNA, 19 bp, Homo sapiens
tgggcagaagggagaagga

SEQ ID NO: 2075670 - DNA, 16 bp, Homo sapiens
tgggcagcaccctccc

SEQ ID NO: 2075671 - DNA, 14 bp, Homo sapiens
tgggcagggctggg

SEQ ID NO: 2075672 - DNA, 22 bp, Homo sapiens
tgggcagtgcctcctgggacca

SEQ ID NO: 2075673 - DNA, 16 bp, Homo sapiens
tgggcatccacccagt

SEQ ID NO: 2075674 - DNA, 18 bp, Homo sapiens
tgggcatccacccagtgc

SEQ ID NO: 2075675 - DNA, 19 bp, Homo sapiens
tgggcatccacccagtgct

SEQ ID NO: 2075676 - DNA, 23 bp, Homo sapiens
tgggcatccacccagtgctgcca

SEQ ID NO: 2075677 - DNA, 22 bp, Homo sapiens
tgggcatctcgtgccagggcag

SEQ ID NO: 2075678 - DNA, 23 bp, Homo sapiens
tgggcatctcgtgccagggcagg

SEQ ID NO: 2075679 - DNA, 13 bp, Homo sapiens
tgggcattgggct

SEQ ID NO: 2075680 - DNA, 19 bp, Homo sapiens
tgggcattgggctgacacc

SEQ ID NO: 2075681 - DNA, 17 bp, Homo sapiens
tgggccaaaagggcagc

SEQ ID NO: 2075682 - DNA, 22 bp, Homo sapiens
tgggccaaaagggcagccaggg

SEQ ID NO: 2075683 - DNA, 16 bp, Homo sapiens
tgggccaactcacctg

SEQ ID NO: 2075684 - DNA, 15 bp, Homo sapiens
tgggccagcctcagc

SEQ ID NO: 2075685 - DNA, 16 bp, Homo sapiens
tgggccagcctcagct

SEQ ID NO: 2075686 - DNA, 17 bp, Homo sapiens
tgggccagcctcagctc

SEQ ID NO: 2075687 - DNA, 22 bp, Homo sapiens
tgggccagcctcagctcagcct

SEQ ID NO: 2075688 - DNA, 19 bp, Homo sapiens
tgggccagctgtcgcatct

SEQ ID NO: 2075689 - DNA, 17 bp, Homo sapiens
tgggcccacagagatgc

SEQ ID NO: 2075690 - DNA, 13 bp, Homo sapiens
tgggcccaggctc

SEQ ID NO: 2075691 - DNA, 18 bp, Homo sapiens
tggggtcagccagggcca

SEQ ID NO: 2075692 - DNA, 17 bp, Homo sapiens
tggggtggagggtcgcc

SEQ ID NO: 2075693 - DNA, 13 bp, Homo sapiens
tggggtgggcagg

SEQ ID NO: 2075694 - DNA, 12 bp, Homo sapiens
tggggtggggca

SEQ ID NO: 2075695 - DNA, 13 bp, Homo sapiens
tggggtggggcag

SEQ ID NO: 2075696 - DNA, 14 bp, Homo sapiens
tggggttcccccag

SEQ ID NO: 2075697 - DNA, 23 bp, Homo sapiens
tgggtaacagggagactgcatct

SEQ ID NO: 2075698 - DNA, 14 bp, Homo sapiens
tgggtaactgtcaa

SEQ ID NO: 2075699 - DNA, 15 bp, Homo sapiens
tgggtacaagagcca

SEQ ID NO: 2075700 - DNA, 22 bp, Homo sapiens
tgggtacccagactctaaatat

SEQ ID NO: 2075701 - DNA, 20 bp, Homo sapiens
tgggtactactgctgcaaag

SEQ ID NO: 2075702 - DNA, 20 bp, Homo sapiens
tgggtacttgtggacacagc

SEQ ID NO: 2075703 - DNA, 12 bp, Homo sapiens
tgggtccaggaa

SEQ ID NO: 2075704 - DNA, 20 bp, Homo sapiens
tgggtccaggaaggcagctg

SEQ ID NO: 2075705 - DNA, 21 bp, Homo sapiens
tgggtccaggaaggcagctgc

SEQ ID NO: 2075706 - DNA, 22 bp, Homo sapiens
tgggtccaggaaggcagctgct

SEQ ID NO: 2075707 - DNA, 20 bp, Homo sapiens
tgggtccctcggagctgcca

SEQ ID NO: 2075708 - DNA, 21 bp, Homo sapiens
tgggtcctgcaatctccaggg

SEQ ID NO: 2075709 - DNA, 22 bp, Homo sapiens
tgggtcctgcaatctccagggc

SEQ ID NO: 2075710 - DNA, 23 bp, Homo sapiens
tgggtcctgcaatctccagggct

SEQ ID NO: 2075711 - DNA, 21 bp, Homo sapiens
tgggtcgccctaccctcactc

SEQ ID NO: 2075712 - DNA, 23 bp, Homo sapiens
tgggtctaaggggttggttgagg

SEQ ID NO: 2075713 - DNA, 14 bp, Homo sapiens
tgggtctggggagg

SEQ ID NO: 2075714 - DNA, 16 bp, Homo sapiens
tgggtctggggaggga

SEQ ID NO: 2075715 - DNA, 22 bp, Homo sapiens
tgggtcttgttttttttttcca

SEQ ID NO: 2075716 - DNA, 15 bp, Homo sapiens
tgggtgaatgtgtga

SEQ ID NO: 2075717 - DNA, 17 bp, Homo sapiens
tgggtgacagagcaaga

SEQ ID NO: 2075718 - DNA, 15 bp, Homo sapiens
tgggtgctggaggat

SEQ ID NO: 2075719 - DNA, 14 bp, Homo sapiens
tgggtggatgcctg

SEQ ID NO: 2075720 - DNA, 16 bp, Homo sapiens
tgggtggcacctcctg

SEQ ID NO: 2075721 - DNA, 15 bp, Homo sapiens
tgggtggcctcggga

SEQ ID NO: 2075722 - DNA, 19 bp, Homo sapiens
tgggtggctactctgtgcc

SEQ ID NO: 2075723 - DNA, 16 bp, Homo sapiens
tgggtggctcctgcca

SEQ ID NO: 2075724 - DNA, 19 bp, Homo sapiens
tgggtggctcctgccactg

SEQ ID NO: 2075725 - DNA, 15 bp, Homo sapiens
tgggtggtggatctg

SEQ ID NO: 2075726 - DNA, 22 bp, Homo sapiens
tgggtgtaacaggtctcctctt

SEQ ID NO: 2075727 - DNA, 21 bp, Homo sapiens
tgggtgtcaagagggtctgag

SEQ ID NO: 2075728 - DNA, 22 bp, Homo sapiens
tgggtgttgaccactccagaga

SEQ ID NO: 2075729 - DNA, 23 bp, Homo sapiens
tgggttcattccccggccctccg

SEQ ID NO: 2075730 - DNA, 17 bp, Homo sapiens
tgggttctttggaagga

SEQ ID NO: 2075731 - DNA, 16 bp, Homo sapiens
tgggttggtgcttcta

SEQ ID NO: 2075732 - DNA, 11 bp, Homo sapiens
tgggtttactc

SEQ ID NO: 2075733 - DNA, 17 bp, Homo sapiens
tgggttttctaactgta

SEQ ID NO: 2075734 - DNA, 19 bp, Homo sapiens
tgggttttctaactgtaaa

SEQ ID NO: 2075735 - DNA, 20 bp, Homo sapiens
tgggttttctaactgtaaat

SEQ ID NO: 2075736 - DNA, 22 bp, Homo sapiens
tgggttttctaactgtaaatca

SEQ ID NO: 2075737 - DNA, 14 bp, Homo sapiens
tgggttttcttccc

SEQ ID NO: 2075738 - DNA, 14 bp, Homo sapiens
tgggttttgtctct

SEQ ID NO: 2075739 - DNA, 15 bp, Homo sapiens
tgggtttttgttacc

SEQ ID NO: 2075740 - DNA, 21 bp, Homo sapiens
tggtaaactatttgtctttca

SEQ ID NO: 2075741 - DNA, 21 bp, Homo sapiens
tggtaacatcctttctattga

SEQ ID NO: 2075742 - DNA, 22 bp, Homo sapiens
tggtaagaagccgggaacagac

SEQ ID NO: 2075743 - DNA, 13 bp, Homo sapiens
tggtaagcagagg

SEQ ID NO: 2075744 - DNA, 13 bp, Homo sapiens
tggtaagctctgg

SEQ ID NO: 2075745 - DNA, 15 bp, Homo sapiens
tggtaagctctggct

SEQ ID NO: 2075746 - DNA, 22 bp, Homo sapiens
tggtaatttaagattccagaga

SEQ ID NO: 2075747 - DNA, 16 bp, Homo sapiens
tggtacatggccagtg

SEQ ID NO: 2075748 - DNA, 18 bp, Homo sapiens
tggtacggagatgtttca

SEQ ID NO: 2075749 - DNA, 18 bp, Homo sapiens
tggtactgcacattttgt

SEQ ID NO: 2075750 - DNA, 16 bp, Homo sapiens
tggtagaagccagtac

SEQ ID NO: 2075751 - DNA, 19 bp, Homo sapiens
tggtagcagataaagacag

SEQ ID NO: 2075752 - DNA, 16 bp, Homo sapiens
tggtaggaaagcaccg

SEQ ID NO: 2075753 - DNA, 20 bp, Homo sapiens
tggtaggcttatcaaaatct

SEQ ID NO: 2075754 - DNA, 18 bp, Homo sapiens
tggtatgatcacggctca

SEQ ID NO: 2075755 - DNA, 19 bp, Homo sapiens
tggtatgctggccagcacc

SEQ ID NO: 2075756 - DNA, 21 bp, Homo sapiens
tggtatgtagcccggccaggg

SEQ ID NO: 2075757 - DNA, 23 bp, Homo sapiens
tggtcaatacacataagaccgtg

SEQ ID NO: 2075758 - DNA, 20 bp, Homo sapiens
tggtcacaggactctgcctc

SEQ ID NO: 2075759 - DNA, 16 bp, Homo sapiens
tggtcaccatgaaact

SEQ ID NO: 2075760 - DNA, 18 bp, Homo sapiens
tggtcaggcccactgcag

SEQ ID NO: 2075761 - DNA, 17 bp, Homo sapiens
tggtcagtgtggagagg

SEQ ID NO: 2075762 - DNA, 21 bp, Homo sapiens
tggtcagttgtacgtaatgta

SEQ ID NO: 2075763 - DNA, 16 bp, Homo sapiens
tggtcatctttttctc

SEQ ID NO: 2075764 - DNA, 14 bp, Homo sapiens
tggtccagcctggt

SEQ ID NO: 2075765 - DNA, 12 bp, Homo sapiens
tggtccagctct

SEQ ID NO: 2075766 - DNA, 15 bp, Homo sapiens
tggtccagcttgctc

SEQ ID NO: 2075767 - DNA, 23 bp, Homo sapiens
tggtcccacatccctgggcctgc

SEQ ID NO: 2075768 - DNA, 16 bp, Homo sapiens
tggtcctccatttcaa

SEQ ID NO: 2075769 - DNA, 21 bp, Homo sapiens
tggtcctgagtcttggcctgc

SEQ ID NO: 2075770 - DNA, 11 bp, Homo sapiens
tggtcctgggg

SEQ ID NO: 2075771 - DNA, 16 bp, Homo sapiens
tggtcctggggctctg

SEQ ID NO: 2075772 - DNA, 13 bp, Homo sapiens
tggtcctgtcacc

SEQ ID NO: 2075773 - DNA, 16 bp, Homo sapiens
tggtcctgtcaccctg

SEQ ID NO: 2075774 - DNA, 21 bp, Homo sapiens
tggtcctgtcaccctggcccc

SEQ ID NO: 2075775 - DNA, 23 bp, Homo sapiens
tggtccttccaggcccccaccac

SEQ ID NO: 2075776 - DNA, 20 bp, Homo sapiens
tggtccttctcgtttgctct

SEQ ID NO: 2075777 - DNA, 16 bp, Homo sapiens
tggtcggcaagagtga

SEQ ID NO: 2075778 - DNA, 15 bp, Homo sapiens
tggtctaggagctgt

SEQ ID NO: 2075779 - DNA, 22 bp, Homo sapiens
tggtctaggagctgtctccagg

SEQ ID NO: 2075780 - DNA, 16 bp, Homo sapiens
tggtctcaaactcttg

SEQ ID NO: 2075781 - DNA, 13 bp, Homo sapiens
tgtagcctgtgca

SEQ ID NO: 2075782 - DNA, 17 bp, Homo sapiens
tgtagccttgcccggat

SEQ ID NO: 2075783 - DNA, 23 bp, Homo sapiens
tgtagctcccgagctactctctt

SEQ ID NO: 2075784 - DNA, 16 bp, Homo sapiens
tgtagctcctctgctg

SEQ ID NO: 2075785 - DNA, 21 bp, Homo sapiens
tgtagctctatggggggaggg

SEQ ID NO: 2075786 - DNA, 14 bp, Homo sapiens
tgtagctggtttcc

SEQ ID NO: 2075787 - DNA, 20 bp, Homo sapiens
tgtagctgtgacctgctgag

SEQ ID NO: 2075788 - DNA, 22 bp, Homo sapiens
tgtagctgtgacctgctgagct

SEQ ID NO: 2075789 - DNA, 11 bp, Homo sapiens
tgtaggagaat

SEQ ID NO: 2075790 - DNA, 12 bp, Homo sapiens
tgtagggctgga

SEQ ID NO: 2075791 - DNA, 18 bp, Homo sapiens
tgtagggtaaggtgcctt

SEQ ID NO: 2075792 - DNA, 20 bp, Homo sapiens
tgtaggtattaaagatgtgt

SEQ ID NO: 2075793 - DNA, 21 bp, Homo sapiens
tgtaggtcaatgaaatatttg

SEQ ID NO: 2075794 - DNA, 19 bp, Homo sapiens
tgtaggtgtctgcacccag

SEQ ID NO: 2075795 - DNA, 18 bp, Homo sapiens
tgtagtatggcctgtgtc

SEQ ID NO: 2075796 - DNA, 15 bp, Homo sapiens
tgtagtcccagccac

SEQ ID NO: 2075797 - DNA, 23 bp, Homo sapiens
tgtagtcctagccactcaggagg

SEQ ID NO: 2075798 - DNA, 17 bp, Homo sapiens
tgtagtgagaaactgat

SEQ ID NO: 2075799 - DNA, 15 bp, Homo sapiens
tgtagtggaagagca

SEQ ID NO: 2075800 - DNA, 18 bp, Homo sapiens
tgtagtggaagagcagcc

SEQ ID NO: 2075801 - DNA, 21 bp, Homo sapiens
tgtagtggaagagcagcctga

SEQ ID NO: 2075802 - DNA, 15 bp, Homo sapiens
tgtagtgtgtcagag

SEQ ID NO: 2075803 - DNA, 20 bp, Homo sapiens
tgtataaaatgcaaaataaa

SEQ ID NO: 2075804 - DNA, 20 bp, Homo sapiens
tgtataaacattaaatgtct

SEQ ID NO: 2075805 - DNA, 13 bp, Homo sapiens
tgtataaagaaca

SEQ ID NO: 2075806 - DNA, 21 bp, Homo sapiens
tgtataaataataaagaactc

SEQ ID NO: 2075807 - DNA, 12 bp, Homo sapiens
tgtataaatgta

SEQ ID NO: 2075808 - DNA, 18 bp, Homo sapiens
tgtataaatgtatataca

SEQ ID NO: 2075809 - DNA, 21 bp, Homo sapiens
tgtataaatgtatatacacat

SEQ ID NO: 2075810 - DNA, 18 bp, Homo sapiens
tgtataacttcttaaaag

SEQ ID NO: 2075811 - DNA, 22 bp, Homo sapiens
tgtataagattagaatgaaaat

SEQ ID NO: 2075812 - DNA, 21 bp, Homo sapiens
tgtataagtgcacacagaaat

SEQ ID NO: 2075813 - DNA, 22 bp, Homo sapiens
tgtataagtgcacacagaaata

SEQ ID NO: 2075814 - DNA, 11 bp, Homo sapiens
tgtataatggg

SEQ ID NO: 2075815 - DNA, 17 bp, Homo sapiens
tgtatacacacatatac

SEQ ID NO: 2075816 - DNA, 19 bp, Homo sapiens
tgtatacacacatatacat

SEQ ID NO: 2075817 - DNA, 23 bp, Homo sapiens
tgtatacacacatatacatatat

SEQ ID NO: 2075818 - DNA, 17 bp, Homo sapiens
tgtatacagattctagc

SEQ ID NO: 2075819 - DNA, 16 bp, Homo sapiens
tgtatacattttgtta

SEQ ID NO: 2075820 - DNA, 18 bp, Homo sapiens
tgtatagatgcaagatat

SEQ ID NO: 2075821 - DNA, 20 bp, Homo sapiens
tgtatagatgcaagatattt

SEQ ID NO: 2075822 - DNA, 24 bp, Homo sapiens
tgtatagtgtaaaataagaatgat

SEQ ID NO: 2075823 - DNA, 20 bp, Homo sapiens
tgtatagttaggatagcatt

SEQ ID NO: 2075824 - DNA, 21 bp, Homo sapiens
tgtatagttttataaaactca

SEQ ID NO: 2075825 - DNA, 23 bp, Homo sapiens
tgtatagttttataaaactcagt

SEQ ID NO: 2075826 - DNA, 17 bp, Homo sapiens
tgtatatacaataacat

SEQ ID NO: 2075827 - DNA, 17 bp, Homo sapiens
tgtatatacacatatac

SEQ ID NO: 2075828 - DNA, 19 bp, Homo sapiens
tgtatatacacatatacct

SEQ ID NO: 2075829 - DNA, 12 bp, Homo sapiens
tgtatatacata

SEQ ID NO: 2075830 - DNA, 13 bp, Homo sapiens
tgtatatacatat

SEQ ID NO: 2075831 - DNA, 12 bp, Homo sapiens
tgtatatagttt

SEQ ID NO: 2075832 - DNA, 14 bp, Homo sapiens
tgtatatatatata

SEQ ID NO: 2075833 - DNA, 17 bp, Homo sapiens
tgtatatatatatgtgt

SEQ ID NO: 2075834 - DNA, 12 bp, Homo sapiens
tgtatatatgtg

SEQ ID NO: 2075835 - DNA, 13 bp, Homo sapiens
tgtatatatgtgt

SEQ ID NO: 2075836 - DNA, 23 bp, Homo sapiens
tgtatatatgtgtatatatacat

SEQ ID NO: 2075837 - DNA, 15 bp, Homo sapiens
tgtatatatgtgtgt

SEQ ID NO: 2075838 - DNA, 13 bp, Homo sapiens
tgtatatgatcta

SEQ ID NO: 2075839 - DNA, 16 bp, Homo sapiens
tgtatatgtatatcta

SEQ ID NO: 2075840 - DNA, 14 bp, Homo sapiens
tgtatatgttgtaa

SEQ ID NO: 2075841 - DNA, 19 bp, Homo sapiens
tgtatattaaggtgtggct

SEQ ID NO: 2075842 - DNA, 23 bp, Homo sapiens
tgtatattatggaagattttaaa

SEQ ID NO: 2075843 - DNA, 22 bp, Homo sapiens
tgtatattccaccattcacatt

SEQ ID NO: 2075844 - DNA, 16 bp, Homo sapiens
tgtatcatagaaatgt

SEQ ID NO: 2075845 - DNA, 19 bp, Homo sapiens
tgtatccagtgatgtgctg

SEQ ID NO: 2075846 - DNA, 15 bp, Homo sapiens
tgtatcccatgagcc

SEQ ID NO: 2075847 - DNA, 22 bp, Homo sapiens
tgtatcccccccctgtatagtt

SEQ ID NO: 2075848 - DNA, 18 bp, Homo sapiens
tgtatctatgcattttct

SEQ ID NO: 2075849 - DNA, 12 bp, Homo sapiens
tgtatctcctcc

SEQ ID NO: 2075850 - DNA, 22 bp, Homo sapiens
tgtatctctgaagcatgtttca

SEQ ID NO: 2075851 - DNA, 12 bp, Homo sapiens
tgtatgctggac

SEQ ID NO: 2075852 - DNA, 23 bp, Homo sapiens
tgtatggaaataaatgtatcata

SEQ ID NO: 2075853 - DNA, 16 bp, Homo sapiens
tgtatggaatacagtg

SEQ ID NO: 2075854 - DNA, 23 bp, Homo sapiens
tgtatgtatacacacatatacat

SEQ ID NO: 2075855 - DNA, 13 bp, Homo sapiens
tgtatgtgtgtgg

SEQ ID NO: 2075856 - DNA, 23 bp, Homo sapiens
tgtatgtgtgtggtgtgtgtgct

SEQ ID NO: 2075857 - DNA, 19 bp, Homo sapiens
tgtatgttcagaagaaatt

SEQ ID NO: 2075858 - DNA, 11 bp, Homo sapiens
tgtatgtttac

SEQ ID NO: 2075859 - DNA, 16 bp, Homo sapiens
tgtatgtttacatatc

SEQ ID NO: 2075860 - DNA, 16 bp, Homo sapiens
tgtattatcacatcaa

SEQ ID NO: 2075861 - DNA, 16 bp, Homo sapiens
tgtattattttctata

SEQ ID NO: 2075862 - DNA, 17 bp, Homo sapiens
tgtattcacacacccct

SEQ ID NO: 2075863 - DNA, 22 bp, Homo sapiens
tgtattcagatcgtattaatta

SEQ ID NO: 2075864 - DNA, 17 bp, Homo sapiens
tgtattctggctgcaag

SEQ ID NO: 2075865 - DNA, 14 bp, Homo sapiens
tgtatttataaata

SEQ ID NO: 2075866 - DNA, 21 bp, Homo sapiens
tgtatttataaatatatttaa

SEQ ID NO: 2075867 - DNA, 21 bp, Homo sapiens
tgtatttatattttgtgctat

SEQ ID NO: 2075868 - DNA, 17 bp, Homo sapiens
tgtatttattgtcatta

SEQ ID NO: 2075869 - DNA, 18 bp, Homo sapiens
tgtatttgttaatggttt

SEQ ID NO: 2075870 - DNA, 13 bp, Homo sapiens
tgtattttcaact

SEQ ID NO: 2075871 - DNA, 14 bp, Homo sapiens
tgtattttcaactt

SEQ ID NO: 2075872 - DNA, 20 bp, Homo sapiens
tgtattttcttcccatttgt

SEQ ID NO: 2075873 - DNA, 15 bp, Homo sapiens
tgtatttttgtttaa

SEQ ID NO: 2075874 - DNA, 16 bp, Homo sapiens
tgtattttttaaagct

SEQ ID NO: 2075875 - DNA, 22 bp, Homo sapiens
tgtattttttcctgtaagacaa

SEQ ID NO: 2075876 - DNA, 14 bp, Homo sapiens
tgtcaaaaaaaaaa

SEQ ID NO: 2075877 - DNA, 23 bp, Homo sapiens
tgtcaaaaatgtcttgggtaggc

SEQ ID NO: 2075878 - DNA, 22 bp, Homo sapiens
tgtcaaatgtcattatgtagaa

SEQ ID NO: 2075879 - DNA, 14 bp, Homo sapiens
tgctctcatcagaa

SEQ ID NO: 2075880 - DNA, 15 bp, Homo sapiens
tgctctcccctgccc

SEQ ID NO: 2075881 - DNA, 16 bp, Homo sapiens
tgctctcccctgccct

SEQ ID NO: 2075882 - DNA, 13 bp, Homo sapiens
tgctctctgcagc

SEQ ID NO: 2075883 - DNA, 14 bp, Homo sapiens
tgctctctgcagcc

SEQ ID NO: 2075884 - DNA, 20 bp, Homo sapiens
tgctctctgcagccagccca

SEQ ID NO: 2075885 - DNA, 21 bp, Homo sapiens
tgctctctgcagccagcccag

SEQ ID NO: 2075886 - DNA, 12 bp, Homo sapiens
tgctctcttcag

SEQ ID NO: 2075887 - DNA, 17 bp, Homo sapiens
tgctctgaggcttccag

SEQ ID NO: 2075888 - DNA, 20 bp, Homo sapiens
tgctctgaggcttccagaga

SEQ ID NO: 2075889 - DNA, 16 bp, Homo sapiens
tgctctgcaggcacct

SEQ ID NO: 2075890 - DNA, 20 bp, Homo sapiens
tgctctgcaggcaccttagt

SEQ ID NO: 2075891 - DNA, 20 bp, Homo sapiens
tgctctgccccttgggcatc

SEQ ID NO: 2075892 - DNA, 14 bp, Homo sapiens
tgctctggacaggc

SEQ ID NO: 2075893 - DNA, 15 bp, Homo sapiens
tgctctggacaggca

SEQ ID NO: 2075894 - DNA, 17 bp, Homo sapiens
tgctctggacaggcatg

SEQ ID NO: 2075895 - DNA, 22 bp, Homo sapiens
tgctctggcggcttcctgtcca

SEQ ID NO: 2075896 - DNA, 23 bp, Homo sapiens
tgctctggcggcttcctgtccac

SEQ ID NO: 2075897 - DNA, 12 bp, Homo sapiens
tgctcttagctg

SEQ ID NO: 2075898 - DNA, 18 bp, Homo sapiens
tgctcttagctgtctgct

SEQ ID NO: 2075899 - DNA, 15 bp, Homo sapiens
tgctcttccaaagct

SEQ ID NO: 2075900 - DNA, 22 bp, Homo sapiens
tgctcttctacgtataaatatg

SEQ ID NO: 2075901 - DNA, 12 bp, Homo sapiens
tgctcttgcctg

SEQ ID NO: 2075902 - DNA, 17 bp, Homo sapiens
tgctgaaacaacaaata

SEQ ID NO: 2075903 - DNA, 19 bp, Homo sapiens
tgctgaaacacctcccagg

SEQ ID NO: 2075904 - DNA, 23 bp, Homo sapiens
tgctgaaggaataaattgctcct

SEQ ID NO: 2075905 - DNA, 15 bp, Homo sapiens
tgctgaagttctgag

SEQ ID NO: 2075906 - DNA, 17 bp, Homo sapiens
tgctgaagttctgagcc

SEQ ID NO: 2075907 - DNA, 13 bp, Homo sapiens
tgctgaatgaatc

SEQ ID NO: 2075908 - DNA, 17 bp, Homo sapiens
tgctgaatttcaggcat

SEQ ID NO: 2075909 - DNA, 20 bp, Homo sapiens
tgctgacaggatgtggcact

SEQ ID NO: 2075910 - DNA, 22 bp, Homo sapiens
tgctgacaggatgtggcactgc

SEQ ID NO: 2075911 - DNA, 16 bp, Homo sapiens
tgctgactgtactcct

SEQ ID NO: 2075912 - DNA, 19 bp, Homo sapiens
tgctgactgtactcctccc

SEQ ID NO: 2075913 - DNA, 20 bp, Homo sapiens
tgctgagaacctggccttca

SEQ ID NO: 2075914 - DNA, 18 bp, Homo sapiens
tgctgagagacccaagga

SEQ ID NO: 2075915 - DNA, 19 bp, Homo sapiens
tgctgagcaccctctccgg

SEQ ID NO: 2075916 - DNA, 12 bp, Homo sapiens
tgctgagccact

SEQ ID NO: 2075917 - DNA, 13 bp, Homo sapiens
tgctgagccactc

SEQ ID NO: 2075918 - DNA, 14 bp, Homo sapiens
tgctgagctctgag

SEQ ID NO: 2075919 - DNA, 14 bp, Homo sapiens
tgctgagcttagcc

SEQ ID NO: 2075920 - DNA, 18 bp, Homo sapiens
tgctgagcttagccttgt

SEQ ID NO: 2075921 - DNA, 23 bp, Homo sapiens
tgctgagcttagccttgtgccct

SEQ ID NO: 2075922 - DNA, 18 bp, Homo sapiens
tgctgaggactccctcca

SEQ ID NO: 2075923 - DNA, 22 bp, Homo sapiens
tgctgaggactccctccatgtg

SEQ ID NO: 2075924 - DNA, 18 bp, Homo sapiens
tgctgatcaatgaaatgc

SEQ ID NO: 2075925 - DNA, 17 bp, Homo sapiens
tgctgattctcccgttc

SEQ ID NO: 2075926 - DNA, 16 bp, Homo sapiens
tgctgcaaagtgcaaa

SEQ ID NO: 2075927 - DNA, 15 bp, Homo sapiens
tgctgcaccagagtg

SEQ ID NO: 2075928 - DNA, 16 bp, Homo sapiens
tgctgcaccagagtga

SEQ ID NO: 2075929 - DNA, 15 bp, Homo sapiens
tgctgcatgcctggt

SEQ ID NO: 2075930 - DNA, 15 bp, Homo sapiens
tgctgccacacttca

SEQ ID NO: 2075931 - DNA, 16 bp, Homo sapiens
tgctgccacacttcag

SEQ ID NO: 2075932 - DNA, 13 bp, Homo sapiens
tgctgccatccag

SEQ ID NO: 2075933 - DNA, 22 bp, Homo sapiens
tgctgccatccaggttcagctt

SEQ ID NO: 2075934 - DNA, 13 bp, Homo sapiens
tgctgccatgcca

SEQ ID NO: 2075935 - DNA, 15 bp, Homo sapiens
tgctgccatgccact

SEQ ID NO: 2075936 - DNA, 21 bp, Homo sapiens
tgctgccatgccactgccagg

SEQ ID NO: 2075937 - DNA, 22 bp, Homo sapiens
tgctgccatgccactgccaggc

SEQ ID NO: 2075938 - DNA, 23 bp, Homo sapiens
tgctgccatgccactgccaggca

SEQ ID NO: 2075939 - DNA, 14 bp, Homo sapiens
tgctgcccagcctc

SEQ ID NO: 2075940 - DNA, 13 bp, Homo sapiens
tgccctgccttca

SEQ ID NO: 2075941 - DNA, 23 bp, Homo sapiens
tgccctgcgaagtggctctcagg

SEQ ID NO: 2075942 - DNA, 17 bp, Homo sapiens
tgccctgctctggggat

SEQ ID NO: 2075943 - DNA, 16 bp, Homo sapiens
tgccctggtgctgcca

SEQ ID NO: 2075944 - DNA, 17 bp, Homo sapiens
tgccctggtgctgccac

SEQ ID NO: 2075945 - DNA, 12 bp, Homo sapiens
tgccctgtcctc

SEQ ID NO: 2075946 - DNA, 14 bp, Homo sapiens
tgcccttaaaataa

SEQ ID NO: 2075947 - DNA, 21 bp, Homo sapiens
tgcccttaaaataatgattta

SEQ ID NO: 2075948 - DNA, 15 bp, Homo sapiens
tgcccttcgctgcca

SEQ ID NO: 2075949 - DNA, 13 bp, Homo sapiens
tgcccttgccctg

SEQ ID NO: 2075950 - DNA, 17 bp, Homo sapiens
tgcccttgccctgacct

SEQ ID NO: 2075951 - DNA, 19 bp, Homo sapiens
tgcccttgccctgacctcc

SEQ ID NO: 2075952 - DNA, 23 bp, Homo sapiens
tgcccttgtttggggcaggagta

SEQ ID NO: 2075953 - DNA, 22 bp, Homo sapiens
tgccgaccagagccccacacgg

SEQ ID NO: 2075954 - DNA, 15 bp, Homo sapiens
tgccgacctcgtcct

SEQ ID NO: 2075955 - DNA, 22 bp, Homo sapiens
tgccgacctcgtcctccccctg

SEQ ID NO: 2075956 - DNA, 19 bp, Homo sapiens
tgccgagcaaccgtggccc

SEQ ID NO: 2075957 - DNA, 16 bp, Homo sapiens
tgccgcaaggccctgt

SEQ ID NO: 2075958 - DNA, 19 bp, Homo sapiens
tgccgcaaggccctgtccc

SEQ ID NO: 2075959 - DNA, 22 bp, Homo sapiens
tgccgcaatggccatgtgggga

SEQ ID NO: 2075960 - DNA, 16 bp, Homo sapiens
tgccgcctcaatgtgg

SEQ ID NO: 2075961 - DNA, 17 bp, Homo sapiens
tgccgcctcccagcctg

SEQ ID NO: 2075962 - DNA, 14 bp, Homo sapiens
tgccgcctgtgccc

SEQ ID NO: 2075963 - DNA, 15 bp, Homo sapiens
tgccgctgcaccacg

SEQ ID NO: 2075964 - DNA, 18 bp, Homo sapiens
tgccgctgccgctgcacc

SEQ ID NO: 2075965 - DNA, 15 bp, Homo sapiens
tgcctaaatccaaag

SEQ ID NO: 2075966 - DNA, 17 bp, Homo sapiens
tgcctaaatccaaagaa

SEQ ID NO: 2075967 - DNA, 14 bp, Homo sapiens
tgcctaagtggctg

SEQ ID NO: 2075968 - DNA, 15 bp, Homo sapiens
tgcctaatggagaag

SEQ ID NO: 2075969 - DNA, 14 bp, Homo sapiens
tgcctacagataat

SEQ ID NO: 2075970 - DNA, 17 bp, Homo sapiens
tgcctacattccctggc

SEQ ID NO: 2075971 - DNA, 17 bp, Homo sapiens
tgcctaggaattcccag

SEQ ID NO: 2075972 - DNA, 21 bp, Homo sapiens
tgcctaggaggccttctcgca

SEQ ID NO: 2075973 - DNA, 13 bp, Homo sapiens
tgcctaggccaaa

SEQ ID NO: 2075974 - DNA, 14 bp, Homo sapiens
tgcctatccatcct

SEQ ID NO: 2075975 - DNA, 16 bp, Homo sapiens
tgcctatccatcctgc

SEQ ID NO: 2075976 - DNA, 19 bp, Homo sapiens
tgcctatttattcattcag

SEQ ID NO: 2075977 - DNA, 12 bp, Homo sapiens
tgcctcaaataa

SEQ ID NO: 2075978 - DNA, 17 bp, Homo sapiens
tgcctcaagaacacctt

SEQ ID NO: 2075979 - DNA, 23 bp, Homo sapiens
tgcctcaatgtgaccaggggtga

SEQ ID NO: 2075980 - DNA, 12 bp, Homo sapiens
tgcctcagcctc

SEQ ID NO: 2075981 - DNA, 14 bp, Homo sapiens
tgcctcagcctccc

SEQ ID NO: 2075982 - DNA, 22 bp, Homo sapiens
tgcctcagctgctcgcacagat

SEQ ID NO: 2075983 - DNA, 14 bp, Homo sapiens
tgcctcagtttccc

SEQ ID NO: 2075984 - DNA, 15 bp, Homo sapiens
tgcctcatgccacac

SEQ ID NO: 2075985 - DNA, 17 bp, Homo sapiens
tgcctcatgccacacct

SEQ ID NO: 2075986 - DNA, 15 bp, Homo sapiens
tgcctcatgctgact

SEQ ID NO: 2075987 - DNA, 21 bp, Homo sapiens
tgcctcatttttttccttgca

SEQ ID NO: 2075988 - DNA, 11 bp, Homo sapiens
tgcctccaccg

SEQ ID NO: 2075989 - DNA, 12 bp, Homo sapiens
tgcctcccagcc

SEQ ID NO: 2075990 - DNA, 15 bp, Homo sapiens
tgcctcccagccctg

SEQ ID NO: 2075991 - DNA, 14 bp, Homo sapiens
tgcctccctttctg

SEQ ID NO: 2075992 - DNA, 16 bp, Homo sapiens
tgcctcctcttcaact

SEQ ID NO: 2075993 - DNA, 18 bp, Homo sapiens
tgcctcgaactggctgca

SEQ ID NO: 2075994 - DNA, 19 bp, Homo sapiens
tgcctcgaactggctgcaa

SEQ ID NO: 2075995 - DNA, 15 bp, Homo sapiens
tgcctcgaggcaccg

SEQ ID NO: 2075996 - DNA, 17 bp, Homo sapiens
tgcctcgaggcaccggc

SEQ ID NO: 2075997 - DNA, 16 bp, Homo sapiens
tgcctctactgggaag

SEQ ID NO: 2075998 - DNA, 13 bp, Homo sapiens
tgcctctgaaact

SEQ ID NO: 2075999 - DNA, 12 bp, Homo sapiens
tgcctctgaggc

SEQ ID NO: 2076000 - DNA, 15 bp, Homo sapiens
tgcctctgaggccag

SEQ ID NO: 2076001 - DNA, 23 bp, Homo sapiens
tgcctctgaggccagcctggcct

SEQ ID NO: 2076002 - DNA, 21 bp, Homo sapiens
tgcctctgatatgggactgag

SEQ ID NO: 2076003 - DNA, 15 bp, Homo sapiens
tgcctctgcctctga

SEQ ID NO: 2076004 - DNA, 20 bp, Homo sapiens
tgcctcttggcagcccttga

SEQ ID NO: 2076005 - DNA, 14 bp, Homo sapiens
tgcctcttgttgca

SEQ ID NO: 2076006 - DNA, 15 bp, Homo sapiens
tgcctcttgttgcag

SEQ ID NO: 2076007 - DNA, 21 bp, Homo sapiens
tgctatcaaaataaattgaaa

SEQ ID NO: 2076008 - DNA, 19 bp, Homo sapiens
tgctatccagctattttta

SEQ ID NO: 2076009 - DNA, 22 bp, Homo sapiens
tgctatcgcaccactgtgtatt

SEQ ID NO: 2076010 - DNA, 22 bp, Homo sapiens
tgctattatgtaacatccagaa

SEQ ID NO: 2076011 - DNA, 23 bp, Homo sapiens
tgctattatgtaacatccagaag

SEQ ID NO: 2076012 - DNA, 13 bp, Homo sapiens
tgctattctgtgt

SEQ ID NO: 2076013 - DNA, 15 bp, Homo sapiens
tgctattctgtgttg

SEQ ID NO: 2076014 - DNA, 13 bp, Homo sapiens
tgctattgaaatt

SEQ ID NO: 2076015 - DNA, 13 bp, Homo sapiens
tgctattgaactg

SEQ ID NO: 2076016 - DNA, 15 bp, Homo sapiens
tgctattgaactgag

SEQ ID NO: 2076017 - DNA, 15 bp, Homo sapiens
tgctatttctggcct

SEQ ID NO: 2076018 - DNA, 16 bp, Homo sapiens
tgctatttctggcctc

SEQ ID NO: 2076019 - DNA, 19 bp, Homo sapiens
tgctatttgagcatgcaca

SEQ ID NO: 2076020 - DNA, 15 bp, Homo sapiens
tgctcaaaaatctgt

SEQ ID NO: 2076021 - DNA, 15 bp, Homo sapiens
tgctcaaatcattta

SEQ ID NO: 2076022 - DNA, 21 bp, Homo sapiens
tgctcaaatctattcagacaa

SEQ ID NO: 2076023 - DNA, 14 bp, Homo sapiens
tgctcaaccactgt

SEQ ID NO: 2076024 - DNA, 14 bp, Homo sapiens
tgctcaagaagaca

SEQ ID NO: 2076025 - DNA, 17 bp, Homo sapiens
tgctcacatatctgtca

SEQ ID NO: 2076026 - DNA, 20 bp, Homo sapiens
tgctcacgactcttcctgca

SEQ ID NO: 2076027 - DNA, 21 bp, Homo sapiens
tgctcacgactcttcctgcaa

SEQ ID NO: 2076028 - DNA, 16 bp, Homo sapiens
tgctcacgctcccccg

SEQ ID NO: 2076029 - DNA, 14 bp, Homo sapiens
tgctcactcaggac

SEQ ID NO: 2076030 - DNA, 13 bp, Homo sapiens
tgctcagacagaa

SEQ ID NO: 2076031 - DNA, 21 bp, Homo sapiens
tgctcagaggggccccggtcc

SEQ ID NO: 2076032 - DNA, 22 bp, Homo sapiens
tgctcagccctgactggtgcta

SEQ ID NO: 2076033 - DNA, 17 bp, Homo sapiens
tgctcagtgcctcctgg

SEQ ID NO: 2076034 - DNA, 16 bp, Homo sapiens
tgctcataacatcttt

SEQ ID NO: 2076035 - DNA, 10 bp, Homo sapiens
tgctccagag

SEQ ID NO: 2076036 - DNA, 23 bp, Homo sapiens
tgctccagagagaggatgcagag

SEQ ID NO: 2076037 - DNA, 13 bp, Homo sapiens
tgctccagggtct

SEQ ID NO: 2076038 - DNA, 16 bp, Homo sapiens
tgctccagggtcttgg

SEQ ID NO: 2076039 - DNA, 13 bp, Homo sapiens
tgctcccagcagc

SEQ ID NO: 2076040 - DNA, 20 bp, Homo sapiens
tgctcccagcagccctaagg

SEQ ID NO: 2076041 - DNA, 21 bp, Homo sapiens
tgctcccatctcctgatttct

SEQ ID NO: 2076042 - DNA, 21 bp, Homo sapiens
tgctcccccaccccctcccca

SEQ ID NO: 2076043 - DNA, 16 bp, Homo sapiens
tgctcctccagggcca

SEQ ID NO: 2076044 - DNA, 19 bp, Homo sapiens
tgctcctccttggtgcctg

SEQ ID NO: 2076045 - DNA, 11 bp, Homo sapiens
tgctcctctcc

SEQ ID NO: 2076046 - DNA, 18 bp, Homo sapiens
tgctcctctccccagcaa

SEQ ID NO: 2076047 - DNA, 14 bp, Homo sapiens
tgctcgaagaacaa

SEQ ID NO: 2076048 - DNA, 15 bp, Homo sapiens
tgctcgcagcctggc

SEQ ID NO: 2076049 - DNA, 20 bp, Homo sapiens
tgctcggggtgcacaggagg

SEQ ID NO: 2076050 - DNA, 16 bp, Homo sapiens
tgctcgtgtgatttcc

SEQ ID NO: 2076051 - DNA, 15 bp, Homo sapiens
tgctctagccaggag

SEQ ID NO: 2076052 - DNA, 12 bp, Homo sapiens
tgctctagctgg

SEQ ID NO: 2076053 - DNA, 14 bp, Homo sapiens
tgctctagctggca

SEQ ID NO: 2076054 - DNA, 15 bp, Homo sapiens
tgctctagtcttgct

SEQ ID NO: 2076055 - DNA, 21 bp, Homo sapiens
tgctctagtcttgctttgctg

SEQ ID NO: 2076056 - DNA, 22 bp, Homo sapiens
tgctctagtcttgctttgctgt

SEQ ID NO: 2076057 - DNA, 23 bp, Homo sapiens
tgctctagtcttgctttgctgtc

SEQ ID NO: 2076058 - DNA, 13 bp, Homo sapiens
tgctctcagcctc

SEQ ID NO: 2076059 - DNA, 15 bp, Homo sapiens
tgctctcagcctccc

SEQ ID NO: 2076060 - DNA, 14 bp, Homo sapiens
tgaatttcctatct

SEQ ID NO: 2076061 - DNA, 23 bp, Homo sapiens
tgaatttcttcactgttgaaaat

SEQ ID NO: 2076062 - DNA, 17 bp, Homo sapiens
tgaatttggagactctg

SEQ ID NO: 2076063 - DNA, 20 bp, Homo sapiens
tgaatttggcctgcactaat

SEQ ID NO: 2076064 - DNA, 21 bp, Homo sapiens
tgaatttggcctgcactaatt

SEQ ID NO: 2076065 - DNA, 17 bp, Homo sapiens
tgaattttaaatgttca

SEQ ID NO: 2076066 - DNA, 16 bp, Homo sapiens
tgaattttatcagcca

SEQ ID NO: 2076067 - DNA, 14 bp, Homo sapiens
tgaattttgttgct

SEQ ID NO: 2076068 - DNA, 17 bp, Homo sapiens
tgaatttttaaacaagt

SEQ ID NO: 2076069 - DNA, 21 bp, Homo sapiens
tgaatttttaaacaagtattt

SEQ ID NO: 2076070 - DNA, 20 bp, Homo sapiens
tgaatttttttttcctagcc

SEQ ID NO: 2076071 - DNA, 14 bp, Homo sapiens
tgacaaaataacat

SEQ ID NO: 2076072 - DNA, 20 bp, Homo sapiens
tgacaaaatatataatggtt

SEQ ID NO: 2076073 - DNA, 16 bp, Homo sapiens
tgacaaagttacaaat

SEQ ID NO: 2076074 - DNA, 18 bp, Homo sapiens
tgacaaattgtaactaca

SEQ ID NO: 2076075 - DNA, 22 bp, Homo sapiens
tgacaacagaagcttcagaagt

SEQ ID NO: 2076076 - DNA, 16 bp, Homo sapiens
tgacaacagactgaat

SEQ ID NO: 2076077 - DNA, 16 bp, Homo sapiens
tgacaacctttgtgta

SEQ ID NO: 2076078 - DNA, 18 bp, Homo sapiens
tgacaacctttgtgtaat

SEQ ID NO: 2076079 - DNA, 22 bp, Homo sapiens
tgacaacctttgtgtaataaaa

SEQ ID NO: 2076080 - DNA, 15 bp, Homo sapiens
tgacaagataaagga

SEQ ID NO: 2076081 - DNA, 19 bp, Homo sapiens
tgacaagatggaaaataaa

SEQ ID NO: 2076082 - DNA, 22 bp, Homo sapiens
tgacaagctcctggtcttgaga

SEQ ID NO: 2076083 - DNA, 16 bp, Homo sapiens
tgacaaggtagacatg

SEQ ID NO: 2076084 - DNA, 15 bp, Homo sapiens
tgacaagtcacaccc

SEQ ID NO: 2076085 - DNA, 13 bp, Homo sapiens
tgacaagtggagg

SEQ ID NO: 2076086 - DNA, 14 bp, Homo sapiens
tgacaataaatgtg

SEQ ID NO: 2076087 - DNA, 17 bp, Homo sapiens
tgacaatactgctgcct

SEQ ID NO: 2076088 - DNA, 22 bp, Homo sapiens
tgacaatactgctgccttaccc

SEQ ID NO: 2076089 - DNA, 16 bp, Homo sapiens
tgacaatatgatttta

SEQ ID NO: 2076090 - DNA, 20 bp, Homo sapiens
tgacaatatgattttaaatt

SEQ ID NO: 2076091 - DNA, 19 bp, Homo sapiens
tgacacacagcactctcta

SEQ ID NO: 2076092 - DNA, 13 bp, Homo sapiens
tgacacacagcag

SEQ ID NO: 2076093 - DNA, 20 bp, Homo sapiens
tgacacacagctctgtcctg

SEQ ID NO: 2076094 - DNA, 16 bp, Homo sapiens
tgacacaggaaaccaa

SEQ ID NO: 2076095 - DNA, 21 bp, Homo sapiens
tgacacatatgcaccttgtgt

SEQ ID NO: 2076096 - DNA, 22 bp, Homo sapiens
tgacacatatgcaccttgtgtc

SEQ ID NO: 2076097 - DNA, 17 bp, Homo sapiens
tgacacccaagagggct

SEQ ID NO: 2076098 - DNA, 20 bp, Homo sapiens
tgacacctaccatgctgctt

SEQ ID NO: 2076099 - DNA, 18 bp, Homo sapiens
tgacacggtgaaatccag

SEQ ID NO: 2076100 - DNA, 20 bp, Homo sapiens
tgacactaccttatcaggca

SEQ ID NO: 2076101 - DNA, 22 bp, Homo sapiens
tgacactctagtgacttcctgg

SEQ ID NO: 2076102 - DNA, 20 bp, Homo sapiens
tgacactttgccagaaagca

SEQ ID NO: 2076103 - DNA, 16 bp, Homo sapiens
tgacagaatgctgttt

SEQ ID NO: 2076104 - DNA, 15 bp, Homo sapiens
tgacagaggcagccc

SEQ ID NO: 2076105 - DNA, 17 bp, Homo sapiens
tgacagaggcagcccca

SEQ ID NO: 2076106 - DNA, 17 bp, Homo sapiens
tgacagagtgagactct

SEQ ID NO: 2076107 - DNA, 14 bp, Homo sapiens
tgacagcaggtggg

SEQ ID NO: 2076108 - DNA, 12 bp, Homo sapiens
tgacagccagag

SEQ ID NO: 2076109 - DNA, 18 bp, Homo sapiens
tgacagctgtccctgtca

SEQ ID NO: 2076110 - DNA, 20 bp, Homo sapiens
tgacagctgtccctgtcacc

SEQ ID NO: 2076111 - DNA, 16 bp, Homo sapiens
tgacagggcacaccgg

SEQ ID NO: 2076112 - DNA, 20 bp, Homo sapiens
tgacagtagtcccctccgta

SEQ ID NO: 2076113 - DNA, 12 bp, Homo sapiens
tgacagtatatt

SEQ ID NO: 2076114 - DNA, 21 bp, Homo sapiens
tgacagtcccttgctgacatg

SEQ ID NO: 2076115 - DNA, 22 bp, Homo sapiens
tgacagtccgtcaaaacagatt

SEQ ID NO: 2076116 - DNA, 16 bp, Homo sapiens
tgacagtgctctaggc

SEQ ID NO: 2076117 - DNA, 19 bp, Homo sapiens
tgacagtgctctaggctgc

SEQ ID NO: 2076118 - DNA, 21 bp, Homo sapiens
tgacagttactcttcagtttt

SEQ ID NO: 2076119 - DNA, 17 bp, Homo sapiens
tgacataacactataaa

SEQ ID NO: 2076120 - DNA, 13 bp, Homo sapiens
tgacatcacttgt

SEQ ID NO: 2076121 - DNA, 16 bp, Homo sapiens
tgacatcacttgtaca

SEQ ID NO: 2076122 - DNA, 18 bp, Homo sapiens
tgacatcacttgtacaaa

SEQ ID NO: 2076123 - DNA, 23 bp, Homo sapiens
tgacatcacttgtacaaaataaa

SEQ ID NO: 2076124 - DNA, 14 bp, Homo sapiens
tgacatcccaggag

SEQ ID NO: 2076125 - DNA, 17 bp, Homo sapiens
tgacatcttatttactt

SEQ ID NO: 2076126 - DNA, 13 bp, Homo sapiens
tgacatgcactga

SEQ ID NO: 2076127 - DNA, 16 bp, Homo sapiens
tgacatgccaccctct

SEQ ID NO: 2076128 - DNA, 19 bp, Homo sapiens
tgacatgccaccctctcca

SEQ ID NO: 2076129 - DNA, 14 bp, Homo sapiens
tgacatgtgcctgt

SEQ ID NO: 2076130 - DNA, 19 bp, Homo sapiens
tgacatgttatatattttt

SEQ ID NO: 2076131 - DNA, 11 bp, Homo sapiens
tgacattcctt

SEQ ID NO: 2076132 - DNA, 20 bp, Homo sapiens
tgacattccttgtcaccagc

SEQ ID NO: 2076133 - DNA, 21 bp, Homo sapiens
tgacattccttgtcaccagca

SEQ ID NO: 2076134 - DNA, 18 bp, Homo sapiens
tgacattgtagagcttct

SEQ ID NO: 2076135 - DNA, 19 bp, Homo sapiens
tgacatttgacagtgtggg

SEQ ID NO: 2076136 - DNA, 15 bp, Homo sapiens
tgaccaaaagttaca

SEQ ID NO: 2076137 - DNA, 22 bp, Homo sapiens
tgaccaaaagttacatgtttgc

SEQ ID NO: 2076138 - DNA, 23 bp, Homo sapiens
tgaccaaaagttacatgtttgca

SEQ ID NO: 2076139 - DNA, 23 bp, Homo sapiens
tgaccaacaggctgttctgcact

SEQ ID NO: 2076140 - DNA, 16 bp, Homo sapiens
tgaccaacatggagaa

SEQ ID NO: 2076141 - DNA, 18 bp, Homo sapiens
tgaccaacatggagaaac

SEQ ID NO: 2076142 - DNA, 18 bp, Homo sapiens
tgaccaagagagaaagaa

SEQ ID NO: 2076143 - DNA, 15 bp, Homo sapiens
tgaccaagatactta

SEQ ID NO: 2076144 - DNA, 18 bp, Homo sapiens
tgaccaagatgatcacat

SEQ ID NO: 2076145 - DNA, 13 bp, Homo sapiens
tgaccaagttata

SEQ ID NO: 2076146 - DNA, 21 bp, Homo sapiens
tgaccacacgctgtctcttga

SEQ ID NO: 2076147 - DNA, 21 bp, Homo sapiens
tgaccacgctttctagctgtt

SEQ ID NO: 2076148 - DNA, 14 bp, Homo sapiens
tgaccacgggcctc

SEQ ID NO: 2076149 - DNA, 16 bp, Homo sapiens
tgaccacgggcctcag

SEQ ID NO: 2076150 - DNA, 18 bp, Homo sapiens
tgaccacgggcctcagtt

SEQ ID NO: 2076151 - DNA, 16 bp, Homo sapiens
tgaccactccagagaa

SEQ ID NO: 2076152 - DNA, 17 bp, Homo sapiens
tgaccactccagagaag

SEQ ID NO: 2076153 - DNA, 22 bp, Homo sapiens
tgaccagaaaacaaatcttcaa

SEQ ID NO: 2076154 - DNA, 19 bp, Homo sapiens
tgaccagacctagacctgg

SEQ ID NO: 2076155 - DNA, 20 bp, Homo sapiens
tgaccagacctagacctggg

SEQ ID NO: 2076156 - DNA, 22 bp, Homo sapiens
tgaccagacctagacctgggcc

SEQ ID NO: 2076157 - DNA, 21 bp, Homo sapiens
tgaccagcctccatgctgcct

SEQ ID NO: 2076158 - DNA, 22 bp, Homo sapiens
tgaccagcctccatgctgcctc

SEQ ID NO: 2076159 - DNA, 23 bp, Homo sapiens
tgaccagcctccatgctgcctcc

SEQ ID NO: 2076160 - DNA, 20 bp, Homo sapiens
tgaccaggctcacaactgtt

SEQ ID NO: 2076161 - DNA, 21 bp, Homo sapiens
tgaccaggctcacaactgttt

SEQ ID NO: 2076162 - DNA, 17 bp, Homo sapiens
tgacccaatgctcctgg

SEQ ID NO: 2076163 - DNA, 14 bp, Homo sapiens
tgacccacagcctc

SEQ ID NO: 2076164 - DNA, 17 bp, Homo sapiens
tatttagattgttaaaa

SEQ ID NO: 2076165 - DNA, 19 bp, Homo sapiens
tatttagattgttaaaata

SEQ ID NO: 2076166 - DNA, 22 bp, Homo sapiens
tatttagattgttaaaataact

SEQ ID NO: 2076167 - DNA, 17 bp, Homo sapiens
tatttataaatatattt

SEQ ID NO: 2076168 - DNA, 19 bp, Homo sapiens
tatttataaatatatttaa

SEQ ID NO: 2076169 - DNA, 17 bp, Homo sapiens
tatttataagcagattt

SEQ ID NO: 2076170 - DNA, 16 bp, Homo sapiens
tatttatagtcattta

SEQ ID NO: 2076171 - DNA, 13 bp, Homo sapiens
tatttatatatga

SEQ ID NO: 2076172 - DNA, 16 bp, Homo sapiens
tatttatatatgtatt

SEQ ID NO: 2076173 - DNA, 19 bp, Homo sapiens
tatttatatatttataact

SEQ ID NO: 2076174 - DNA, 15 bp, Homo sapiens
tatttatatatttga

SEQ ID NO: 2076175 - DNA, 16 bp, Homo sapiens
tatttatatatttgaa

SEQ ID NO: 2076176 - DNA, 17 bp, Homo sapiens
tatttatatatttgaat

SEQ ID NO: 2076177 - DNA, 14 bp, Homo sapiens
tatttatatgttaa

SEQ ID NO: 2076178 - DNA, 15 bp, Homo sapiens
tatttatattagagt

SEQ ID NO: 2076179 - DNA, 16 bp, Homo sapiens
tatttatatttggaaa

SEQ ID NO: 2076180 - DNA, 21 bp, Homo sapiens
tatttatatttggaaagagac

SEQ ID NO: 2076181 - DNA, 17 bp, Homo sapiens
tatttatctctatttaa

SEQ ID NO: 2076182 - DNA, 22 bp, Homo sapiens
tatttatgaatgtgcatttctt

SEQ ID NO: 2076183 - DNA, 18 bp, Homo sapiens
tatttatgcttaaaatat

SEQ ID NO: 2076184 - DNA, 20 bp, Homo sapiens
tatttatgcttaaaatatgt

SEQ ID NO: 2076185 - DNA, 20 bp, Homo sapiens
tatttatggcttataaatgt

SEQ ID NO: 2076186 - DNA, 21 bp, Homo sapiens
tatttatgtctatttaagcct

SEQ ID NO: 2076187 - DNA, 14 bp, Homo sapiens
tatttattactatg

SEQ ID NO: 2076188 - DNA, 19 bp, Homo sapiens
tatttattattttcacctg

SEQ ID NO: 2076189 - DNA, 15 bp, Homo sapiens
tatttattcactgta

SEQ ID NO: 2076190 - DNA, 24 bp, Homo sapiens
tatttattcagcttcatttgtgtc

SEQ ID NO: 2076191 - DNA, 17 bp, Homo sapiens
tatttattgtcattact

SEQ ID NO: 2076192 - DNA, 21 bp, Homo sapiens
tatttattgtcattactgcct

SEQ ID NO: 2076193 - DNA, 23 bp, Homo sapiens
tatttattgtcattactgccttt

SEQ ID NO: 2076194 - DNA, 11 bp, Homo sapiens
tatttatttaa

SEQ ID NO: 2076195 - DNA, 13 bp, Homo sapiens
tatttatttactg

SEQ ID NO: 2076196 - DNA, 13 bp, Homo sapiens
tatttatttctgt

SEQ ID NO: 2076197 - DNA, 11 bp, Homo sapiens
tatttcaaatg

SEQ ID NO: 2076198 - DNA, 14 bp, Homo sapiens
tatttcaatgggac

SEQ ID NO: 2076199 - DNA, 16 bp, Homo sapiens
tatttcaatgttagcc

SEQ ID NO: 2076200 - DNA, 22 bp, Homo sapiens
tatttcaatttccaagagctga

SEQ ID NO: 2076201 - DNA, 17 bp, Homo sapiens
tatttcatgattcacaa

SEQ ID NO: 2076202 - DNA, 15 bp, Homo sapiens
tatttcattctctta

SEQ ID NO: 2076203 - DNA, 13 bp, Homo sapiens
tatttcatttctt

SEQ ID NO: 2076204 - DNA, 18 bp, Homo sapiens
tatttcattttttgcatc

SEQ ID NO: 2076205 - DNA, 19 bp, Homo sapiens
tatttccaaaataaaatga

SEQ ID NO: 2076206 - DNA, 16 bp, Homo sapiens
tatttccacataaagg

SEQ ID NO: 2076207 - DNA, 22 bp, Homo sapiens
tatttccccaggggaaaatgaa

SEQ ID NO: 2076208 - DNA, 18 bp, Homo sapiens
tccagagagtcctctgga

SEQ ID NO: 2076209 - DNA, 16 bp, Homo sapiens
tccagagagtggctcc

SEQ ID NO: 2076210 - DNA, 17 bp, Homo sapiens
tccagagagtggctcct

SEQ ID NO: 2076211 - DNA, 10 bp, Homo sapiens
tccagagcca

SEQ ID NO: 2076212 - DNA, 16 bp, Homo sapiens
tccagagccagcctgg

SEQ ID NO: 2076213 - DNA, 20 bp, Homo sapiens
tccagaggctattattttca

SEQ ID NO: 2076214 - DNA, 16 bp, Homo sapiens
tccagagggacagggt

SEQ ID NO: 2076215 - DNA, 14 bp, Homo sapiens
tccagagtctgagc

SEQ ID NO: 2076216 - DNA, 17 bp, Homo sapiens
tccagagtctgagcccc

SEQ ID NO: 2076217 - DNA, 15 bp, Homo sapiens
tccagatctgcactg

SEQ ID NO: 2076218 - DNA, 14 bp, Homo sapiens
tccagatgccttcc

SEQ ID NO: 2076219 - DNA, 13 bp, Homo sapiens
tccagcagctgcg

SEQ ID NO: 2076220 - DNA, 15 bp, Homo sapiens
tccagcagctgcggg

SEQ ID NO: 2076221 - DNA, 23 bp, Homo sapiens
tccagcagctgcgggtctgaagg

SEQ ID NO: 2076222 - DNA, 18 bp, Homo sapiens
tccagcatccagcctgtg

SEQ ID NO: 2076223 - DNA, 19 bp, Homo sapiens
tccagcatccagcctgtgt

SEQ ID NO: 2076224 - DNA, 21 bp, Homo sapiens
tccagcatttgccattcctgg

SEQ ID NO: 2076225 - DNA, 18 bp, Homo sapiens
tccagccagcgcctccct

SEQ ID NO: 2076226 - DNA, 21 bp, Homo sapiens
tccagccagcgcctccctcca

SEQ ID NO: 2076227 - DNA, 13 bp, Homo sapiens
tccagcccacacc

SEQ ID NO: 2076228 - DNA, 18 bp, Homo sapiens
tccagcccacacccctcc

SEQ ID NO: 2076229 - DNA, 22 bp, Homo sapiens
tccagcccacacccctccaaag

SEQ ID NO: 2076230 - DNA, 15 bp, Homo sapiens
tccagcctctcccgg

SEQ ID NO: 2076231 - DNA, 21 bp, Homo sapiens
tccagcctctcccggctgcct

SEQ ID NO: 2076232 - DNA, 23 bp, Homo sapiens
tccagcctctcccggctgcctgc

SEQ ID NO: 2076233 - DNA, 17 bp, Homo sapiens
tccagcctgggcgacag

SEQ ID NO: 2076234 - DNA, 20 bp, Homo sapiens
tccagcctgggcgacagagc

SEQ ID NO: 2076235 - DNA, 13 bp, Homo sapiens
tccagcctgtgtg

SEQ ID NO: 2076236 - DNA, 22 bp, Homo sapiens
tccagcgcctgccctccctggg

SEQ ID NO: 2076237 - DNA, 22 bp, Homo sapiens
tccagctagccaactcctcctt

SEQ ID NO: 2076238 - DNA, 20 bp, Homo sapiens
tccagctagtgacccacatg

SEQ ID NO: 2076239 - DNA, 14 bp, Homo sapiens
tccagctcaccagc

SEQ ID NO: 2076240 - DNA, 11 bp, Homo sapiens
tccagctcttg

SEQ ID NO: 2076241 - DNA, 15 bp, Homo sapiens
tccagctcttggccc

SEQ ID NO: 2076242 - DNA, 22 bp, Homo sapiens
tcagtgtaccgcgtctaccctg

SEQ ID NO: 2076243 - DNA, 22 bp, Homo sapiens
tcagtgtatggaaataaatgta

SEQ ID NO: 2076244 - DNA, 16 bp, Homo sapiens
tcagttactcagccct

SEQ ID NO: 2076245 - DNA, 19 bp, Homo sapiens
tcagttactcagccctggg

SEQ ID NO: 2076246 - DNA, 18 bp, Homo sapiens
tcagttatattctttaaa

SEQ ID NO: 2076247 - DNA, 20 bp, Homo sapiens
tcagttcccggagcacagcc

SEQ ID NO: 2076248 - DNA, 22 bp, Homo sapiens
tcagttcccggagcacagccct

SEQ ID NO: 2076249 - DNA, 16 bp, Homo sapiens
tcagttcctctttgca

SEQ ID NO: 2076250 - DNA, 18 bp, Homo sapiens
tcagttcctctttgcatg

SEQ ID NO: 2076251 - DNA, 13 bp, Homo sapiens
tcagttggagaaa

SEQ ID NO: 2076252 - DNA, 22 bp, Homo sapiens
tcagttggagaaaatgaagaaa

SEQ ID NO: 2076253 - DNA, 20 bp, Homo sapiens
tcagttgtacgtaatgtatt

SEQ ID NO: 2076254 - DNA, 18 bp, Homo sapiens
tcagtttctccatcagct

SEQ ID NO: 2076255 - DNA, 18 bp, Homo sapiens
tcagtttgtcctgtagag

SEQ ID NO: 2076256 - DNA, 13 bp, Homo sapiens
tcagttttaacta

SEQ ID NO: 2076257 - DNA, 14 bp, Homo sapiens
tcagttttatcttt

SEQ ID NO: 2076258 - DNA, 23 bp, Homo sapiens
tcagtttttcggtgggacagccc

SEQ ID NO: 2076259 - DNA, 12 bp, Homo sapiens
tcataaaataaa

SEQ ID NO: 2076260 - DNA, 15 bp, Homo sapiens
tcataaacagcattt

SEQ ID NO: 2076261 - DNA, 14 bp, Homo sapiens
tcataaactgtgtg

SEQ ID NO: 2076262 - DNA, 15 bp, Homo sapiens
tcataaactgtgtgc

SEQ ID NO: 2076263 - DNA, 16 bp, Homo sapiens
tcataaactgtgtgca

SEQ ID NO: 2076264 - DNA, 14 bp, Homo sapiens
tcataacctagcct

SEQ ID NO: 2076265 - DNA, 15 bp, Homo sapiens
tcataacttgctgaa

SEQ ID NO: 2076266 - DNA, 23 bp, Homo sapiens
tcataaggcatatacaaataaac

SEQ ID NO: 2076267 - DNA, 19 bp, Homo sapiens
tcataaggcctgccctccc

SEQ ID NO: 2076268 - DNA, 13 bp, Homo sapiens
tcataataaacta

SEQ ID NO: 2076269 - DNA, 12 bp, Homo sapiens
tcataattagaa

SEQ ID NO: 2076270 - DNA, 13 bp, Homo sapiens
tcataattagaac

SEQ ID NO: 2076271 - DNA, 14 bp, Homo sapiens
tcataattagaaca

SEQ ID NO: 2076272 - DNA, 15 bp, Homo sapiens
tcataattagaacaa

SEQ ID NO: 2076273 - DNA, 17 bp, Homo sapiens
tcataattagaacaata

SEQ ID NO: 2076274 - DNA, 12 bp, Homo sapiens
tcataattttca

SEQ ID NO: 2076275 - DNA, 14 bp, Homo sapiens
tcataattttcaag

SEQ ID NO: 2076276 - DNA, 13 bp, Homo sapiens
tcatacaaaactg

SEQ ID NO: 2076277 - DNA, 15 bp, Homo sapiens
tcataccatctgctg

SEQ ID NO: 2076278 - DNA, 17 bp, Homo sapiens
tcataccatctgctgcc

SEQ ID NO: 2076279 - DNA, 22 bp, Homo sapiens
tcatactggggtgcgagagagg

SEQ ID NO: 2076280 - DNA, 15 bp, Homo sapiens
tcatacttggacagt

SEQ ID NO: 2076281 - DNA, 23 bp, Homo sapiens
tcatagaaatgtaacttttgtaa

SEQ ID NO: 2076282 - DNA, 12 bp, Homo sapiens
tcatagctgaga

SEQ ID NO: 2076283 - DNA, 17 bp, Homo sapiens
tcatagctgagattcct

SEQ ID NO: 2076284 - DNA, 16 bp, Homo sapiens
tcataggttgccaata

SEQ ID NO: 2076285 - DNA, 20 bp, Homo sapiens
tcataggttgccaataatac

SEQ ID NO: 2076286 - DNA, 19 bp, Homo sapiens
tcatagtatggtggctggg

SEQ ID NO: 2076287 - DNA, 17 bp, Homo sapiens
tcagcaaggtgtgaatg

SEQ ID NO: 2076288 - DNA, 14 bp, Homo sapiens
tcagcacaccccaa

SEQ ID NO: 2076289 - DNA, 13 bp, Homo sapiens
tcagcaccctggg

SEQ ID NO: 2076290 - DNA, 17 bp, Homo sapiens
tcagcaccctgggtgcc

SEQ ID NO: 2076291 - DNA, 11 bp, Homo sapiens
tcagcactgaa

SEQ ID NO: 2076292 - DNA, 20 bp, Homo sapiens
tcagcactgatttcacaaca

SEQ ID NO: 2076293 - DNA, 12 bp, Homo sapiens
tcagcagccccc

SEQ ID NO: 2076294 - DNA, 14 bp, Homo sapiens
tcagcagccctcct

SEQ ID NO: 2076295 - DNA, 17 bp, Homo sapiens
tcagcagccctcctcac

SEQ ID NO: 2076296 - DNA, 18 bp, Homo sapiens
tcagcagccctcctcacc

SEQ ID NO: 2076297 - DNA, 13 bp, Homo sapiens
tcagcaggcccta

SEQ ID NO: 2076298 - DNA, 16 bp, Homo sapiens
tcagcatcctggcacc

SEQ ID NO: 2076299 - DNA, 17 bp, Homo sapiens
tcagcattctcactcct

SEQ ID NO: 2076300 - DNA, 16 bp, Homo sapiens
tcagcatttaataaat

SEQ ID NO: 2076301 - DNA, 21 bp, Homo sapiens
tcagccaacgagtaatttatt

SEQ ID NO: 2076302 - DNA, 14 bp, Homo sapiens
tcagccacacctgt

SEQ ID NO: 2076303 - DNA, 15 bp, Homo sapiens
tcagccagccgccct

SEQ ID NO: 2076304 - DNA, 17 bp, Homo sapiens
tcagccagccgccctgg

SEQ ID NO: 2076305 - DNA, 20 bp, Homo sapiens
tcagccataaagtgccagtt

SEQ ID NO: 2076306 - DNA, 21 bp, Homo sapiens
tcagccatgaggagttgctgt

SEQ ID NO: 2076307 - DNA, 14 bp, Homo sapiens
tcagcccctcctct

SEQ ID NO: 2076308 - DNA, 16 bp, Homo sapiens
tcagcccctcctctgc

SEQ ID NO: 2076309 - DNA, 17 bp, Homo sapiens
tcagcccctcctctgcc

SEQ ID NO: 2076310 - DNA, 18 bp, Homo sapiens
tcagcccctcctctgcca

SEQ ID NO: 2076311 - DNA, 22 bp, Homo sapiens
tcagcccctcctctgccacctc

SEQ ID NO: 2076312 - DNA, 23 bp, Homo sapiens
tcagcccctcctctgccacctcc

SEQ ID NO: 2076313 - DNA, 18 bp, Homo sapiens
tcagccctccctgcccct

SEQ ID NO: 2076314 - DNA, 18 bp, Homo sapiens
tcagccctgggccccacc

SEQ ID NO: 2076315 - DNA, 21 bp, Homo sapiens
tcagccctgggccccaccacc

SEQ ID NO: 2076316 - DNA, 18 bp, Homo sapiens
tcagccgagccgggcctg

SEQ ID NO: 2076317 - DNA, 18 bp, Homo sapiens
tcagccgcagacaagtaa

SEQ ID NO: 2076318 - DNA, 18 bp, Homo sapiens
tcagcctagccgacctca

SEQ ID NO: 2076319 - DNA, 23 bp, Homo sapiens
tcagcctagccgacctcagcctt

SEQ ID NO: 2076320 - DNA, 14 bp, Homo sapiens
tcagcctcccaaag

SEQ ID NO: 2076321 - DNA, 19 bp, Homo sapiens
tcagcctcccaaagtgctg

SEQ ID NO: 2076322 - DNA, 21 bp, Homo sapiens
tcagcctcccaaagtgctggg

SEQ ID NO: 2076323 - DNA, 19 bp, Homo sapiens
tcagcctcccaaccccagg

SEQ ID NO: 2076324 - DNA, 14 bp, Homo sapiens
tcagcctcccagag

SEQ ID NO: 2076325 - DNA, 19 bp, Homo sapiens
tcagcctccccctgctgct

SEQ ID NO: 2076326 - DNA, 21 bp, Homo sapiens
tcagcctccccctgctgctca

SEQ ID NO: 2076327 - DNA, 21 bp, Homo sapiens
tcagcctcccgaatagctggg

SEQ ID NO: 2076328 - DNA, 22 bp, Homo sapiens
tcagcctcccgaatagctggga

SEQ ID NO: 2076329 - DNA, 13 bp, Homo sapiens
tcagcctcctcag

SEQ ID NO: 2076330 - DNA, 14 bp, Homo sapiens
tcagcctggtgggc

SEQ ID NO: 2076331 - DNA, 16 bp, Homo sapiens
tcagcctgtgctgccc

SEQ ID NO: 2076332 - DNA, 22 bp, Homo sapiens
tcagccttccccctcccagggc

SEQ ID NO: 2076333 - DNA, 17 bp, Homo sapiens
tcagccttgaaaaacaa

SEQ ID NO: 2076334 - DNA, 22 bp, Homo sapiens
tcagccttggataatgctgttg

SEQ ID NO: 2076335 - DNA, 13 bp, Homo sapiens
tcagcgccctgga

SEQ ID NO: 2076336 - DNA, 14 bp, Homo sapiens
tcagcggggacagc

SEQ ID NO: 2076337 - DNA, 15 bp, Homo sapiens
tcagcggggacagct

SEQ ID NO: 2076338 - DNA, 16 bp, Homo sapiens
tcagcggggacagctc

SEQ ID NO: 2076339 - DNA, 21 bp, Homo sapiens
tcagcggggacagctccttct

SEQ ID NO: 2076340 - DNA, 16 bp, Homo sapiens
tcagcgtgcttagcct

SEQ ID NO: 2076341 - DNA, 17 bp, Homo sapiens
tcagcgtggccttgttc

SEQ ID NO: 2076342 - DNA, 18 bp, Homo sapiens
tcagctaaagcccaacct

SEQ ID NO: 2076343 - DNA, 17 bp, Homo sapiens
tcagctcagcctccccc

SEQ ID NO: 2076344 - DNA, 18 bp, Homo sapiens
tcagctccactttcagtg

SEQ ID NO: 2076345 - DNA, 23 bp, Homo sapiens
tcagctccagctcaccagcccca

SEQ ID NO: 2076346 - DNA, 24 bp, Homo sapiens
tcagctccagctcaccagccccag

SEQ ID NO: 2076347 - DNA, 12 bp, Homo sapiens
tcagctcccata

SEQ ID NO: 2076348 - DNA, 20 bp, Homo sapiens
tcagctcccatagcgctggc

SEQ ID NO: 2076349 - DNA, 17 bp, Homo sapiens
tcagctcccctcggaga

SEQ ID NO: 2076350 - DNA, 22 bp, Homo sapiens
tcagctcccctcggagaagagc

SEQ ID NO: 2076351 - DNA, 19 bp, Homo sapiens
tcagctcccttcccctgcc

SEQ ID NO: 2076352 - DNA, 21 bp, Homo sapiens
tcagctcccttcccctgcctg

SEQ ID NO: 2076353 - DNA, 22 bp, Homo sapiens
tcagctgcacattcctggcccc

SEQ ID NO: 2076354 - DNA, 16 bp, Homo sapiens
tcagctgccaagcact

SEQ ID NO: 2076355 - DNA, 16 bp, Homo sapiens
tcagctgctgaaacaa

SEQ ID NO: 2076356 - DNA, 16 bp, Homo sapiens
tcagctgtttgtcata

SEQ ID NO: 2076357 - DNA, 16 bp, Homo sapiens
tcagcttatgggatcc

SEQ ID NO: 2076358 - DNA, 18 bp, Homo sapiens
tcagcttcatttgtgtca

SEQ ID NO: 2076359 - DNA, 18 bp, Homo sapiens
tcagctttcagagccagt

SEQ ID NO: 2076360 - DNA, 16 bp, Homo sapiens
tcagcttttaataaaa

SEQ ID NO: 2076361 - DNA, 17 bp, Homo sapiens
tcaggaaaaggcctggg

SEQ ID NO: 2076362 - DNA, 20 bp, Homo sapiens
tcaggaagaaaccccaagca

SEQ ID NO: 2076363 - DNA, 15 bp, Homo sapiens
tcaggaagagaagga

SEQ ID NO: 2076364 - DNA, 20 bp, Homo sapiens
tcaggaagagaaggagcaga

SEQ ID NO: 2076365 - DNA, 15 bp, Homo sapiens
tcaggacacaggcct

SEQ ID NO: 2076366 - DNA, 19 bp, Homo sapiens
tcaggacacaggcctgtgt

SEQ ID NO: 2076367 - DNA, 13 bp, Homo sapiens
tcaggacactaat

SEQ ID NO: 2076368 - DNA, 16 bp, Homo sapiens
tcaggacatggggcat

SEQ ID NO: 2076369 - DNA, 22 bp, Homo sapiens
tcaggacatggggcatagaaac

SEQ ID NO: 2076370 - DNA, 14 bp, Homo sapiens
tcaggacccaggcc

SEQ ID NO: 2076371 - DNA, 19 bp, Homo sapiens
tcaggacccaggccctcca

SEQ ID NO: 2076372 - DNA, 20 bp, Homo sapiens
tcaggacccaggccgcctgc

SEQ ID NO: 2076373 - DNA, 22 bp, Homo sapiens
tcaggacccaggccgcctgcca

SEQ ID NO: 2076374 - DNA, 14 bp, Homo sapiens
tcaggacctggctt

SEQ ID NO: 2076375 - DNA, 15 bp, Homo sapiens
tcaggacctggcttg

SEQ ID NO: 2076376 - DNA, 12 bp, Homo sapiens
tcaggactggct

SEQ ID NO: 2076377 - DNA, 13 bp, Homo sapiens
tcaggactggctc

SEQ ID NO: 2076378 - DNA, 15 bp, Homo sapiens
tcaggactggctcac

SEQ ID NO: 2076379 - DNA, 20 bp, Homo sapiens
tcaggagagagttgaaccta

SEQ ID NO: 2076380 - DNA, 15 bp, Homo sapiens
tcaggagaggggcag

SEQ ID NO: 2076381 - DNA, 11 bp, Homo sapiens
tcaggagcaca

SEQ ID NO: 2076382 - DNA, 21 bp, Homo sapiens
tcaggagcttgcaagaagcag

SEQ ID NO: 2076383 - DNA, 15 bp, Homo sapiens
tcaggaggccctggt

SEQ ID NO: 2076384 - DNA, 18 bp, Homo sapiens
tcaggaggcgcagcccga

SEQ ID NO: 2076385 - DNA, 19 bp, Homo sapiens
tcaggaggcgcagcccgaa

SEQ ID NO: 2076386 - DNA, 18 bp, Homo sapiens
tcaggaggctgaggggag

SEQ ID NO: 2076387 - DNA, 20 bp, Homo sapiens
tcaggagggtccccagctgg

SEQ ID NO: 2076388 - DNA, 12 bp, Homo sapiens
tcaggagttcct

SEQ ID NO: 2076389 - DNA, 16 bp, Homo sapiens
tcaggatcaagaaagt

SEQ ID NO: 2076390 - DNA, 17 bp, Homo sapiens
tcaggcacaggcaggaa

SEQ ID NO: 2076391 - DNA, 20 bp, Homo sapiens
tcaggcacaggcaggaagag

SEQ ID NO: 2076392 - DNA, 23 bp, Homo sapiens
tcaggcacaggcaggaagagaga

SEQ ID NO: 2076393 - DNA, 15 bp, Homo sapiens
tcaggcactggtggc

SEQ ID NO: 2076394 - DNA, 16 bp, Homo sapiens
tcaggcactggtggca

SEQ ID NO: 2076395 - DNA, 15 bp, Homo sapiens
tcaggcagacaagag

SEQ ID NO: 2076396 - DNA, 19 bp, Homo sapiens
tcaggcagaggatgttctg

SEQ ID NO: 2076397 - DNA, 22 bp, Homo sapiens
tcaggcagaggatgttctggac

SEQ ID NO: 2076398 - DNA, 14 bp, Homo sapiens
tcaggcagcactga

SEQ ID NO: 2076399 - DNA, 23 bp, Homo sapiens
tcaggcaggcacctagcaattcc

SEQ ID NO: 2076400 - DNA, 19 bp, Homo sapiens
tcaggccagtgccaggaca

SEQ ID NO: 2076401 - DNA, 20 bp, Homo sapiens
tcaggccagtgccaggacag

SEQ ID NO: 2076402 - DNA, 20 bp, Homo sapiens
tcaggcccggcatgcgggcc

SEQ ID NO: 2076403 - DNA, 21 bp, Homo sapiens
tcaggcccggctaactctggc

SEQ ID NO: 2076404 - DNA, 19 bp, Homo sapiens
tcaggcccttattttcaag

SEQ ID NO: 2076405 - DNA, 18 bp, Homo sapiens
tcaggcctataaccccag

SEQ ID NO: 2076406 - DNA, 20 bp, Homo sapiens
tcaggcggggtgctgtggtg

SEQ ID NO: 2076407 - DNA, 15 bp, Homo sapiens
tcaggctcttctcct

SEQ ID NO: 2076408 - DNA, 21 bp, Homo sapiens
tcaggctcttctcctttcaca

SEQ ID NO: 2076409 - DNA, 14 bp, Homo sapiens
tcaggctgagccca

SEQ ID NO: 2076410 - DNA, 22 bp, Homo sapiens
tcaggctgctgctctgccttca

SEQ ID NO: 2076411 - DNA, 15 bp, Homo sapiens
tcaggcttccttggc

SEQ ID NO: 2076412 - DNA, 20 bp, Homo sapiens
tcaggcttctttcaaagtgt

SEQ ID NO: 2076413 - DNA, 16 bp, Homo sapiens
tcaggcttgaaatgca

SEQ ID NO: 2076414 - DNA, 16 bp, Homo sapiens
tcagggaagcaggcag

SEQ ID NO: 2076415 - DNA, 18 bp, Homo sapiens
tcagggacagagacacct

SEQ ID NO: 2076416 - DNA, 23 bp, Homo sapiens
tcagggacagagacacctgcacc

SEQ ID NO: 2076417 - DNA, 21 bp, Homo sapiens
tcagggccagaaggagggcag

SEQ ID NO: 2076418 - DNA, 23 bp, Homo sapiens
tcagggccagaaggagggcagag

SEQ ID NO: 2076419 - DNA, 16 bp, Homo sapiens
tcagggccccagcact

SEQ ID NO: 2076420 - DNA, 12 bp, Homo sapiens
tcagggctggag

SEQ ID NO: 2076421 - DNA, 20 bp, Homo sapiens
tcaggggggttgtgaggcct

SEQ ID NO: 2076422 - DNA, 17 bp, Homo sapiens
tcaggggtggagaagtg

SEQ ID NO: 2076423 - DNA, 18 bp, Homo sapiens
tcagggtatcccagaccc

SEQ ID NO: 2076424 - DNA, 13 bp, Homo sapiens
tcagggtgggcca

SEQ ID NO: 2076425 - DNA, 21 bp, Homo sapiens
tcagggtgggccactctcccc

SEQ ID NO: 2076426 - DNA, 18 bp, Homo sapiens
tcagggttggcccctgcc

SEQ ID NO: 2076427 - DNA, 13 bp, Homo sapiens
tcaggtaacaggc

SEQ ID NO: 2076428 - DNA, 15 bp, Homo sapiens
tcaggtaacaggcag

SEQ ID NO: 2076429 - DNA, 23 bp, Homo sapiens
tcaggtaggcccttgtcctgcca

SEQ ID NO: 2076430 - DNA, 12 bp, Homo sapiens
tcaggtccctgc

SEQ ID NO: 2076431 - DNA, 17 bp, Homo sapiens
tcaggtgaaaatgttca

SEQ ID NO: 2076432 - DNA, 16 bp, Homo sapiens
tcaggtgatccaccca

SEQ ID NO: 2076433 - DNA, 11 bp, Homo sapiens
tcaggtgccac

SEQ ID NO: 2076434 - DNA, 19 bp, Homo sapiens
tcaggtgccactccctgag

SEQ ID NO: 2076435 - DNA, 20 bp, Homo sapiens
tcaggtgccactccctgagc

SEQ ID NO: 2076436 - DNA, 20 bp, Homo sapiens
tcaggtgctgccatccaggt

SEQ ID NO: 2076437 - DNA, 20 bp, Homo sapiens
tcaggtggggcagcttgagg

SEQ ID NO: 2076438 - DNA, 22 bp, Homo sapiens
tcaggtgtccctgcacttgcag

SEQ ID NO: 2076439 - DNA, 14 bp, Homo sapiens
tcaggttccatccc

SEQ ID NO: 2076440 - DNA, 18 bp, Homo sapiens
tcaggttcttagtgtcac

SEQ ID NO: 2076441 - DNA, 13 bp, Homo sapiens
tcaggttgacagt

SEQ ID NO: 2076442 - DNA, 14 bp, Homo sapiens
tcaggttgttctgt

SEQ ID NO: 2076443 - DNA, 15 bp, Homo sapiens
tcaggttgttctgta

SEQ ID NO: 2076444 - DNA, 13 bp, Homo sapiens
tcaggttttgtaa

SEQ ID NO: 2076445 - DNA, 16 bp, Homo sapiens
tcagtaaataatgaaa

SEQ ID NO: 2076446 - DNA, 17 bp, Homo sapiens
tcagtaagtatctggag

SEQ ID NO: 2076447 - DNA, 18 bp, Homo sapiens
tcagtaatttagaaatca

SEQ ID NO: 2076448 - DNA, 20 bp, Homo sapiens
tcagtaggtccaagggccat

SEQ ID NO: 2076449 - DNA, 21 bp, Homo sapiens
tcagtagtttgagaccagcct

SEQ ID NO: 2076450 - DNA, 23 bp, Homo sapiens
tcagtattaatactaaaatatgt

SEQ ID NO: 2076451 - DNA, 23 bp, Homo sapiens
tcagtcagttcccggagcacagc

SEQ ID NO: 2076452 - DNA, 14 bp, Homo sapiens
tcagtccagatgcc

SEQ ID NO: 2076453 - DNA, 20 bp, Homo sapiens
tcagtccagatgccttcctg

SEQ ID NO: 2076454 - DNA, 21 bp, Homo sapiens
tcagtccagatgccttcctgt

SEQ ID NO: 2076455 - DNA, 16 bp, Homo sapiens
tcagtcggtgtgtaat

SEQ ID NO: 2076456 - DNA, 18 bp, Homo sapiens
tcagtctcagaatgtcat

SEQ ID NO: 2076457 - DNA, 14 bp, Homo sapiens
tcagtctcaggagc

SEQ ID NO: 2076458 - DNA, 24 bp, Homo sapiens
tcagtctgattcccaagctctgct

SEQ ID NO: 2076459 - DNA, 12 bp, Homo sapiens
tcagtcttggag

SEQ ID NO: 2076460 - DNA, 22 bp, Homo sapiens
tcagtctttcttagtgcctgtg

SEQ ID NO: 2076461 - DNA, 14 bp, Homo sapiens
tcagtgagacacag

SEQ ID NO: 2076462 - DNA, 15 bp, Homo sapiens
tcagtgccacttgac

SEQ ID NO: 2076463 - DNA, 20 bp, Homo sapiens
tcagtgccacttgacattcc

SEQ ID NO: 2076464 - DNA, 9 bp, Homo sapiens
tcagtgccc

SEQ ID NO: 2076465 - DNA, 13 bp, Homo sapiens
tcagtgcctcctg

SEQ ID NO: 2076466 - DNA, 15 bp, Homo sapiens
tcagtggcagctgct

SEQ ID NO: 2076467 - DNA, 16 bp, Homo sapiens
tcagtggcagctgctt

SEQ ID NO: 2076468 - DNA, 23 bp, Homo sapiens
tcagtgggaacgtgactgcccca

SEQ ID NO: 2076469 - DNA, 19 bp, Homo sapiens
tataatggtttactgctgt

SEQ ID NO: 2076470 - DNA, 21 bp, Homo sapiens
tataatggtttactgctgtca

SEQ ID NO: 2076471 - DNA, 22 bp, Homo sapiens
tataatgtggatttcctatttt

SEQ ID NO: 2076472 - DNA, 15 bp, Homo sapiens
tataatgtgtgtatg

SEQ ID NO: 2076473 - DNA, 17 bp, Homo sapiens
tataatgtgtgtatgtg

SEQ ID NO: 2076474 - DNA, 19 bp, Homo sapiens
tataatgtgtgtatgtgta

SEQ ID NO: 2076475 - DNA, 22 bp, Homo sapiens
tataatgtgtgtatgtgtattt

SEQ ID NO: 2076476 - DNA, 19 bp, Homo sapiens
tataatgttgttatttaaa

SEQ ID NO: 2076477 - DNA, 19 bp, Homo sapiens
tataattatcggaagcagt

SEQ ID NO: 2076478 - DNA, 13 bp, Homo sapiens
tataattccctat

SEQ ID NO: 2076479 - DNA, 14 bp, Homo sapiens
tataattgggattt

SEQ ID NO: 2076480 - DNA, 15 bp, Homo sapiens
tataatttaacagtg

SEQ ID NO: 2076481 - DNA, 18 bp, Homo sapiens
tatacaaaagcaagactt

SEQ ID NO: 2076482 - DNA, 20 bp, Homo sapiens
tatacaaaataatttaacta

SEQ ID NO: 2076483 - DNA, 17 bp, Homo sapiens
tatacaaataaacttgt

SEQ ID NO: 2076484 - DNA, 22 bp, Homo sapiens
tatacaaatatatttaattgtg

SEQ ID NO: 2076485 - DNA, 13 bp, Homo sapiens
tatacaacaatgt

SEQ ID NO: 2076486 - DNA, 15 bp, Homo sapiens
tatacaataacataa

SEQ ID NO: 2076487 - DNA, 19 bp, Homo sapiens
tatacaatatataaaaata

SEQ ID NO: 2076488 - DNA, 15 bp, Homo sapiens
tatacacaacattta

SEQ ID NO: 2076489 - DNA, 21 bp, Homo sapiens
tatacacacaaaaattaacaa

SEQ ID NO: 2076490 - DNA, 18 bp, Homo sapiens
tatacacacatatacata

SEQ ID NO: 2076491 - DNA, 12 bp, Homo sapiens
tatacacataca

SEQ ID NO: 2076492 - DNA, 15 bp, Homo sapiens
tatacacatatacct

SEQ ID NO: 2076493 - DNA, 23 bp, Homo sapiens
tatacagaactgaattaagttat

SEQ ID NO: 2076494 - DNA, 20 bp, Homo sapiens
tatacatacacttgtataaa

SEQ ID NO: 2076495 - DNA, 17 bp, Homo sapiens
tatacatatcagaaaag

SEQ ID NO: 2076496 - DNA, 19 bp, Homo sapiens
tatacatatcagaaaagta

SEQ ID NO: 2076497 - DNA, 23 bp, Homo sapiens
tatacatatgtagactatataca

SEQ ID NO: 2076498 - DNA, 11 bp, Homo sapiens
tatacatatta

SEQ ID NO: 2076499 - DNA, 20 bp, Homo sapiens
tatacatattataaataaat

SEQ ID NO: 2076500 - DNA, 21 bp, Homo sapiens
tatacatattataaataaatg

SEQ ID NO: 2076501 - DNA, 14 bp, Homo sapiens
tatacatcaccttt

SEQ ID NO: 2076502 - DNA, 14 bp, Homo sapiens
tatacatgtgtgta

SEQ ID NO: 2076503 - DNA, 15 bp, Homo sapiens
tatacatgtgtgtat

SEQ ID NO: 2076504 - DNA, 17 bp, Homo sapiens
tatacatgtgtgtatat

SEQ ID NO: 2076505 - DNA, 20 bp, Homo sapiens
tatacatgtgtgtatatatg

SEQ ID NO: 2076506 - DNA, 16 bp, Homo sapiens
tatacattctttatct

SEQ ID NO: 2076507 - DNA, 22 bp, Homo sapiens
tatacattttgttatagaatac

SEQ ID NO: 2076508 - DNA, 19 bp, Homo sapiens
tataccagagacctgaggc

SEQ ID NO: 2076509 - DNA, 19 bp, Homo sapiens
tatacctataatgtgtgta

SEQ ID NO: 2076510 - DNA, 12 bp, Homo sapiens
tatacctgtgtt

SEQ ID NO: 2076511 - DNA, 16 bp, Homo sapiens
tatactaaaaaatgtc

SEQ ID NO: 2076512 - DNA, 16 bp, Homo sapiens
tatactccatacataa

SEQ ID NO: 2076513 - DNA, 16 bp, Homo sapiens
tatactgtacttaata

SEQ ID NO: 2076514 - DNA, 14 bp, Homo sapiens
tatacttcactcac

SEQ ID NO: 2076515 - DNA, 13 bp, Homo sapiens
tatagaaagctgt

SEQ ID NO: 2076516 - DNA, 14 bp, Homo sapiens
tatagaaagctgtt

SEQ ID NO: 2076517 - DNA, 21 bp, Homo sapiens
tatagaatatttattacctct

SEQ ID NO: 2076518 - DNA, 16 bp, Homo sapiens
tatagacaaataataa

SEQ ID NO: 2076519 - DNA, 22 bp, Homo sapiens
tatagagatgtttttaaaagtt

SEQ ID NO: 2076520 - DNA, 22 bp, Homo sapiens
tatagatgcaagatatttatat

SEQ ID NO: 2076521 - DNA, 11 bp, Homo sapiens
tatagatgtgc

SEQ ID NO: 2076522 - DNA, 17 bp, Homo sapiens
tatagatttgtatttta

SEQ ID NO: 2076523 - DNA, 17 bp, Homo sapiens
tatagcaatgtaacatt

SEQ ID NO: 2076524 - DNA, 20 bp, Homo sapiens
tatagcagcaaaaatataaa

SEQ ID NO: 2076525 - DNA, 17 bp, Homo sapiens
tatagcattgaacattt

SEQ ID NO: 2076526 - DNA, 18 bp, Homo sapiens
tatagccaaaaatagcta

SEQ ID NO: 2076527 - DNA, 11 bp, Homo sapiens
tatagctatta

SEQ ID NO: 2076528 - DNA, 14 bp, Homo sapiens
tatagctattactg

SEQ ID NO: 2076529 - DNA, 20 bp, Homo sapiens
tatagctcttctatttaaaa

SEQ ID NO: 2076530 - DNA, 15 bp, Homo sapiens
tataggatcatttgt

SEQ ID NO: 2076531 - DNA, 20 bp, Homo sapiens
tataggtgctacaaaaacac

SEQ ID NO: 2076532 - DNA, 23 bp, Homo sapiens
tataggtgctacaaaaacacagc

SEQ ID NO: 2076533 - DNA, 17 bp, Homo sapiens
tataggttactcataag

SEQ ID NO: 2076534 - DNA, 22 bp, Homo sapiens
tataggttgtgcaaattaacag

SEQ ID NO: 2076535 - DNA, 22 bp, Homo sapiens
tatagtaactactttttatact

SEQ ID NO: 2076536 - DNA, 20 bp, Homo sapiens
tatagtagtcaattagtaca

SEQ ID NO: 2076537 - DNA, 16 bp, Homo sapiens
tatagtataccataca

SEQ ID NO: 2076538 - DNA, 15 bp, Homo sapiens
tatagtatatttata

SEQ ID NO: 2076539 - DNA, 17 bp, Homo sapiens
tatagtatatttatact

SEQ ID NO: 2076540 - DNA, 18 bp, Homo sapiens
tatagtatatttatactc

SEQ ID NO: 2076541 - DNA, 13 bp, Homo sapiens
tatagtcatttat

SEQ ID NO: 2076542 - DNA, 21 bp, Homo sapiens
tatagtcatttattttaaaaa

SEQ ID NO: 2076543 - DNA, 18 bp, Homo sapiens
tatagtgtaaaataagaa

SEQ ID NO: 2076544 - DNA, 17 bp, Homo sapiens
tatagttaggatagcat

SEQ ID NO: 2076545 - DNA, 18 bp, Homo sapiens
tatagttaggatagcatt

SEQ ID NO: 2076546 - DNA, 20 bp, Homo sapiens
tatataaaaagaaaagataa

SEQ ID NO: 2076547 - DNA, 14 bp, Homo sapiens
tatataatactaaa

SEQ ID NO: 2076548 - DNA, 15 bp, Homo sapiens
tatataatactaaag

SEQ ID NO: 2076549 - DNA, 20 bp, Homo sapiens
tatataatggtttactgctg

SEQ ID NO: 2076550 - DNA, 22 bp, Homo sapiens
tatataatggtttactgctgtc

SEQ ID NO: 2076551 - DNA, 16 bp, Homo sapiens
tatatacacatacata

SEQ ID NO: 2076552 - DNA, 18 bp, Homo sapiens
tatatacacatacataca

SEQ ID NO: 2076553 - DNA, 22 bp, Homo sapiens
tatatacacatacatacacata

SEQ ID NO: 2076554 - DNA, 23 bp, Homo sapiens
tatatacatacacttgtataaat

SEQ ID NO: 2076555 - DNA, 15 bp, Homo sapiens
tatatacatatatat

SEQ ID NO: 2076556 - DNA, 13 bp, Homo sapiens
tatatacatatta

SEQ ID NO: 2076557 - DNA, 14 bp, Homo sapiens
tatatacatattat

SEQ ID NO: 2076558 - DNA, 21 bp, Homo sapiens
tatatacatattataaataaa

SEQ ID NO: 2076559 - DNA, 13 bp, Homo sapiens
tatcaggcacagg

SEQ ID NO: 2076560 - DNA, 17 bp, Homo sapiens
tatcaggcacaggcagg

SEQ ID NO: 2076561 - DNA, 15 bp, Homo sapiens
tatcagtgacagagt

SEQ ID NO: 2076562 - DNA, 15 bp, Homo sapiens
tatcagttaacatta

SEQ ID NO: 2076563 - DNA, 15 bp, Homo sapiens
tatcagttactcagc

SEQ ID NO: 2076564 - DNA, 17 bp, Homo sapiens
tatcagttactcagccc

SEQ ID NO: 2076565 - DNA, 11 bp, Homo sapiens
tatcataaagt

SEQ ID NO: 2076566 - DNA, 15 bp, Homo sapiens
tatcatagaaatgta

SEQ ID NO: 2076567 - DNA, 23 bp, Homo sapiens
tatcatcagtgtagaacctaatt

SEQ ID NO: 2076568 - DNA, 20 bp, Homo sapiens
tatcatgaaacacttctcat

SEQ ID NO: 2076569 - DNA, 23 bp, Homo sapiens
tatcatgaaacacttctcatcat

SEQ ID NO: 2076570 - DNA, 22 bp, Homo sapiens
tatcatgctttaaagtgtaata

SEQ ID NO: 2076571 - DNA, 23 bp, Homo sapiens
tatcatgctttaaagtgtaataa

SEQ ID NO: 2076572 - DNA, 21 bp, Homo sapiens
tatcattaatgtaggtttaga

SEQ ID NO: 2076573 - DNA, 18 bp, Homo sapiens
tatccaattaaaattaag

SEQ ID NO: 2076574 - DNA, 21 bp, Homo sapiens
tatccaattatgtgacaacct

SEQ ID NO: 2076575 - DNA, 21 bp, Homo sapiens
tatccacagaaacattttcat

SEQ ID NO: 2076576 - DNA, 22 bp, Homo sapiens
tatccacagactccctcccctg

SEQ ID NO: 2076577 - DNA, 12 bp, Homo sapiens
tatccacccagc

SEQ ID NO: 2076578 - DNA, 20 bp, Homo sapiens
tatccacccagcccattctc

SEQ ID NO: 2076579 - DNA, 15 bp, Homo sapiens
tatccactttgcaca

SEQ ID NO: 2076580 - DNA, 21 bp, Homo sapiens
tatccagtgatgtgctggagc

SEQ ID NO: 2076581 - DNA, 16 bp, Homo sapiens
tatcccaaacttcgga

SEQ ID NO: 2076582 - DNA, 19 bp, Homo sapiens
tatcccaaacttcggaaac

SEQ ID NO: 2076583 - DNA, 14 bp, Homo sapiens
tatcccagaaatta

SEQ ID NO: 2076584 - DNA, 11 bp, Homo sapiens
tatcctcaggg

SEQ ID NO: 2076585 - DNA, 16 bp, Homo sapiens
tatcctgaaatttcag

SEQ ID NO: 2076586 - DNA, 15 bp, Homo sapiens
tatcctgcattttac

SEQ ID NO: 2076587 - DNA, 23 bp, Homo sapiens
tatcctgttaggggaaaatagta

SEQ ID NO: 2076588 - DNA, 21 bp, Homo sapiens
tatccttaggaaaatgcttct

SEQ ID NO: 2076589 - DNA, 22 bp, Homo sapiens
tatccttaggaaaatgcttctg

SEQ ID NO: 2076590 - DNA, 23 bp, Homo sapiens
tatccttaggaaaatgcttctgt

SEQ ID NO: 2076591 - DNA, 16 bp, Homo sapiens
tatccttggagagcag

SEQ ID NO: 2076592 - DNA, 17 bp, Homo sapiens
tatccttggagagcagc

SEQ ID NO: 2076593 - DNA, 22 bp, Homo sapiens
tattaaaatgattgtaaaatag

SEQ ID NO: 2076594 - DNA, 12 bp, Homo sapiens
tattaaaggctt

SEQ ID NO: 2076595 - DNA, 22 bp, Homo sapiens
tattaaatgtatatgtcattta

SEQ ID NO: 2076596 - DNA, 18 bp, Homo sapiens
tattaacaaattatgtta

SEQ ID NO: 2076597 - DNA, 13 bp, Homo sapiens
tattaactttttt

SEQ ID NO: 2076598 - DNA, 14 bp, Homo sapiens
tattaataaatttt

SEQ ID NO: 2076599 - DNA, 15 bp, Homo sapiens
tattaataaatttta

SEQ ID NO: 2076600 - DNA, 20 bp, Homo sapiens
tattaatattcattgtataa

SEQ ID NO: 2076601 - DNA, 13 bp, Homo sapiens
tattaatgaactg

SEQ ID NO: 2076602 - DNA, 15 bp, Homo sapiens
tattaatgaactgtg

SEQ ID NO: 2076603 - DNA, 13 bp, Homo sapiens
tattacactgtat

SEQ ID NO: 2076604 - DNA, 21 bp, Homo sapiens
tattacactgtatttgtatct

SEQ ID NO: 2076605 - DNA, 16 bp, Homo sapiens
tattacatctaatgct

SEQ ID NO: 2076606 - DNA, 16 bp, Homo sapiens
tattacatggcagtgt

SEQ ID NO: 2076607 - DNA, 19 bp, Homo sapiens
tattaccaaaaaagtattt

SEQ ID NO: 2076608 - DNA, 19 bp, Homo sapiens
tattacctctgatacctca

SEQ ID NO: 2076609 - DNA, 22 bp, Homo sapiens
tattactatgactgctccccag

SEQ ID NO: 2076610 - DNA, 12 bp, Homo sapiens
tattacttgaac

SEQ ID NO: 2076611 - DNA, 14 bp, Homo sapiens
tattacttgaactt

SEQ ID NO: 2076612 - DNA, 14 bp, Homo sapiens
tattacttgttgca

SEQ ID NO: 2076613 - DNA, 21 bp, Homo sapiens
tattacttgtttgtaagattt

SEQ ID NO: 2076614 - DNA, 16 bp, Homo sapiens
tattagagtgccctta

SEQ ID NO: 2076615 - DNA, 15 bp, Homo sapiens
tattagcaactgtgc

SEQ ID NO: 2076616 - DNA, 14 bp, Homo sapiens
tattagctgtaaat

SEQ ID NO: 2076617 - DNA, 17 bp, Homo sapiens
tattaggggtaatatat

SEQ ID NO: 2076618 - DNA, 18 bp, Homo sapiens
tattaggggtaatatatt

SEQ ID NO: 2076619 - DNA, 15 bp, Homo sapiens
tattagttaatatta

SEQ ID NO: 2076620 - DNA, 20 bp, Homo sapiens
tattagttttctttgtaaag

SEQ ID NO: 2076621 - DNA, 21 bp, Homo sapiens
tattagttttctttgtaaagg

SEQ ID NO: 2076622 - DNA, 14 bp, Homo sapiens
tattataaataaat

SEQ ID NO: 2076623 - DNA, 15 bp, Homo sapiens
tattataacttaaaa

SEQ ID NO: 2076624 - DNA, 21 bp, Homo sapiens
tattataataatgttctctgg

SEQ ID NO: 2076625 - DNA, 15 bp, Homo sapiens
tattatcaacaatag

SEQ ID NO: 2076626 - DNA, 14 bp, Homo sapiens
tattatcacatcaa

SEQ ID NO: 2076627 - DNA, 20 bp, Homo sapiens
tattatgaggctattaaaag

SEQ ID NO: 2076628 - DNA, 12 bp, Homo sapiens
tattatgctacc

SEQ ID NO: 2076629 - DNA, 18 bp, Homo sapiens
tattatgtaacatccaga

SEQ ID NO: 2076630 - DNA, 19 bp, Homo sapiens
tattatgtaacatccagaa

SEQ ID NO: 2076631 - DNA, 13 bp, Homo sapiens
tattatgtgttca

SEQ ID NO: 2076632 - DNA, 14 bp, Homo sapiens
tattatgttgttca

SEQ ID NO: 2076633 - DNA, 22 bp, Homo sapiens
gttctttttaaaaagttgcaca

SEQ ID NO: 2076634 - DNA, 21 bp, Homo sapiens
gttcttttttgttacagctat

SEQ ID NO: 2076635 - DNA, 16 bp, Homo sapiens
gttgaaaaatctagtt

SEQ ID NO: 2076636 - DNA, 22 bp, Homo sapiens
gttgaaaagactccaaagaaat

SEQ ID NO: 2076637 - DNA, 22 bp, Homo sapiens
gttgaaaataaagtgtatattt

SEQ ID NO: 2076638 - DNA, 23 bp, Homo sapiens
gttgaagcaaatcgaatgaaatt

SEQ ID NO: 2076639 - DNA, 17 bp, Homo sapiens
gttgaccactccagaga

SEQ ID NO: 2076640 - DNA, 14 bp, Homo sapiens
gttgacccctttcc

SEQ ID NO: 2076641 - DNA, 21 bp, Homo sapiens
gttgactcaagtttttacaaa

SEQ ID NO: 2076642 - DNA, 23 bp, Homo sapiens
gttgagaacaaaaattgggtttt

SEQ ID NO: 2076643 - DNA, 22 bp, Homo sapiens
gttgagaggggagggcaggagg

SEQ ID NO: 2076644 - DNA, 15 bp, Homo sapiens
gttgagagtgtgacc

SEQ ID NO: 2076645 - DNA, 17 bp, Homo sapiens
gttgagagtgtgaccaa

SEQ ID NO: 2076646 - DNA, 17 bp, Homo sapiens
gttgagggaacagacag

SEQ ID NO: 2076647 - DNA, 22 bp, Homo sapiens
gttgagggaacagacaggagaa

SEQ ID NO: 2076648 - DNA, 17 bp, Homo sapiens
gttgaggggctcctgga

SEQ ID NO: 2076649 - DNA, 14 bp, Homo sapiens
gttgagtctcctct

SEQ ID NO: 2076650 - DNA, 18 bp, Homo sapiens
gttgataaattccactgg

SEQ ID NO: 2076651 - DNA, 23 bp, Homo sapiens
gttgatgatctttgcagacaggc

SEQ ID NO: 2076652 - DNA, 13 bp, Homo sapiens
gttgcaaccactg

SEQ ID NO: 2076653 - DNA, 16 bp, Homo sapiens
gttgcaaggccgctgt

SEQ ID NO: 2076654 - DNA, 16 bp, Homo sapiens
gttgcacagctatgaa

SEQ ID NO: 2076655 - DNA, 17 bp, Homo sapiens
gttgcaccatctgcttg

SEQ ID NO: 2076656 - DNA, 19 bp, Homo sapiens
gttgcaccatctgcttggt

SEQ ID NO: 2076657 - DNA, 22 bp, Homo sapiens
gttgcagatctttttgtgaaat

SEQ ID NO: 2076658 - DNA, 16 bp, Homo sapiens
gttgcagtgagctgag

SEQ ID NO: 2076659 - DNA, 12 bp, Homo sapiens
gttgccatttct

SEQ ID NO: 2076660 - DNA, 19 bp, Homo sapiens
gttgcccaggcaggtcttg

SEQ ID NO: 2076661 - DNA, 12 bp, Homo sapiens
gttgcccaggct

SEQ ID NO: 2076662 - DNA, 13 bp, Homo sapiens
gttgcccaggctg

SEQ ID NO: 2076663 - DNA, 17 bp, Homo sapiens
gttgcccaggctgctct

SEQ ID NO: 2076664 - DNA, 18 bp, Homo sapiens
gttgcccaggctggcctg

SEQ ID NO: 2076665 - DNA, 14 bp, Homo sapiens
gttgccccttcccc

SEQ ID NO: 2076666 - DNA, 19 bp, Homo sapiens
gttgctcttggaaagctga

SEQ ID NO: 2076667 - DNA, 20 bp, Homo sapiens
gttgctgagttcctgtgggt

SEQ ID NO: 2076668 - DNA, 19 bp, Homo sapiens
gttgctgtcataagaatga

SEQ ID NO: 2076669 - DNA, 22 bp, Homo sapiens
gttgcttagatgagggtgactg

SEQ ID NO: 2076670 - DNA, 17 bp, Homo sapiens
gttgcttatttccctca

SEQ ID NO: 2076671 - DNA, 15 bp, Homo sapiens
gttggaaaagaatac

SEQ ID NO: 2076672 - DNA, 16 bp, Homo sapiens
gttggaaagcaggtgg

SEQ ID NO: 2076673 - DNA, 13 bp, Homo sapiens
gttggaaccgtgt

SEQ ID NO: 2076674 - DNA, 20 bp, Homo sapiens
gttggaatcacctggagggc

SEQ ID NO: 2076675 - DNA, 22 bp, Homo sapiens
gttggaatgaattaaataaacc

SEQ ID NO: 2076676 - DNA, 17 bp, Homo sapiens
gttggacacactgtaaa

SEQ ID NO: 2076677 - DNA, 14 bp, Homo sapiens
gttggacagctgct

SEQ ID NO: 2076678 - DNA, 21 bp, Homo sapiens
gttggaccagaggaagcccct

SEQ ID NO: 2076679 - DNA, 15 bp, Homo sapiens
gttggacccgctctg

SEQ ID NO: 2076680 - DNA, 17 bp, Homo sapiens
gttggacccgctctgga

SEQ ID NO: 2076681 - DNA, 13 bp, Homo sapiens
gttggagccactc

SEQ ID NO: 2076682 - DNA, 13 bp, Homo sapiens
gttggatgggaag

SEQ ID NO: 2076683 - DNA, 23 bp, Homo sapiens
gttggatgggaagatggtagcag

SEQ ID NO: 2076684 - DNA, 14 bp, Homo sapiens
gttggcagagaagg

SEQ ID NO: 2076685 - DNA, 14 bp, Homo sapiens
gttggcccctgccc

SEQ ID NO: 2076686 - DNA, 20 bp, Homo sapiens
gttggcccctgcccggctgc

SEQ ID NO: 2076687 - DNA, 23 bp, Homo sapiens
gttggcctcgcctgggcccaggc

SEQ ID NO: 2076688 - DNA, 14 bp, Homo sapiens
gttggctcaggcag

SEQ ID NO: 2076689 - DNA, 16 bp, Homo sapiens
gttggctcaggcagac

SEQ ID NO: 2076690 - DNA, 12 bp, Homo sapiens
gttggctggggg

SEQ ID NO: 2076691 - DNA, 19 bp, Homo sapiens
gttggctgggggcctcagt

SEQ ID NO: 2076692 - DNA, 19 bp, Homo sapiens
gttggctgtgtgacagaat

SEQ ID NO: 2076693 - DNA, 15 bp, Homo sapiens
gttgggagcactgga

SEQ ID NO: 2076694 - DNA, 15 bp, Homo sapiens
gttgggatttatatc

SEQ ID NO: 2076695 - DNA, 17 bp, Homo sapiens
gttgggctggtgtcacc

SEQ ID NO: 2076696 - DNA, 16 bp, Homo sapiens
gttggggtggggcagg

SEQ ID NO: 2076697 - DNA, 14 bp, Homo sapiens
gttggtgactgaaa

SEQ ID NO: 2076698 - DNA, 18 bp, Homo sapiens
gttggtgggctggcccag

SEQ ID NO: 2076699 - DNA, 12 bp, Homo sapiens
gttgtaaataaa

SEQ ID NO: 2076700 - DNA, 16 bp, Homo sapiens
gttgtaaataaaagta

SEQ ID NO: 2076701 - DNA, 14 bp, Homo sapiens
gttgtaaatattta

SEQ ID NO: 2076702 - DNA, 17 bp, Homo sapiens
gttgtaaatgaccaaga

SEQ ID NO: 2076703 - DNA, 18 bp, Homo sapiens
gttgtaaatgctcgtgtg

SEQ ID NO: 2076704 - DNA, 20 bp, Homo sapiens
gttgtaaatgctcgtgtgat

SEQ ID NO: 2076705 - DNA, 15 bp, Homo sapiens
gttgtaatagtccat

SEQ ID NO: 2076706 - DNA, 16 bp, Homo sapiens
gttgtaatagtccatg

SEQ ID NO: 2076707 - DNA, 12 bp, Homo sapiens
gttgtactgtat

SEQ ID NO: 2076708 - DNA, 15 bp, Homo sapiens
gttgtatacttcatt

SEQ ID NO: 2076709 - DNA, 16 bp, Homo sapiens
gttgtcaagagagagt

SEQ ID NO: 2076710 - DNA, 13 bp, Homo sapiens
gttgtgaggcctg

SEQ ID NO: 2076711 - DNA, 14 bp, Homo sapiens
gttgtgaggcctgg

SEQ ID NO: 2076712 - DNA, 21 bp, Homo sapiens
gttgtgatagctaacatttta

SEQ ID NO: 2076713 - DNA, 20 bp, Homo sapiens
gttgtgattttgtacagaat

SEQ ID NO: 2076714 - DNA, 22 bp, Homo sapiens
gttgtgattttgtacagaattt

SEQ ID NO: 2076715 - DNA, 17 bp, Homo sapiens
gttgtgcaaattaacag

SEQ ID NO: 2076716 - DNA, 19 bp, Homo sapiens
gttgtggaaagcctctgct

SEQ ID NO: 2076717 - DNA, 21 bp, Homo sapiens
gttgttaaacacgtgtctata

SEQ ID NO: 2076718 - DNA, 16 bp, Homo sapiens
gttgttaatgaaaatg

SEQ ID NO: 2076719 - DNA, 17 bp, Homo sapiens
gttgttaatgaaaatgt

SEQ ID NO: 2076720 - DNA, 18 bp, Homo sapiens
gttgttaatgaaaatgtc

SEQ ID NO: 2076721 - DNA, 13 bp, Homo sapiens
gttgttaatgttg

SEQ ID NO: 2076722 - DNA, 15 bp, Homo sapiens
gttgttactgattct

SEQ ID NO: 2076723 - DNA, 14 bp, Homo sapiens
gttgttcccacaca

SEQ ID NO: 2076724 - DNA, 22 bp, Homo sapiens
gttgttgccaactaagccctcg

SEQ ID NO: 2076725 - DNA, 19 bp, Homo sapiens
gttgttttttgaaaacatg

SEQ ID NO: 2076726 - DNA, 19 bp, Homo sapiens
gtttaaaaaaagtatatat

SEQ ID NO: 2076727 - DNA, 14 bp, Homo sapiens
gtttaaaaaataca

SEQ ID NO: 2076728 - DNA, 15 bp, Homo sapiens
gtttaaaaaatacac

SEQ ID NO: 2076729 - DNA, 13 bp, Homo sapiens
gtttaaataaagt

SEQ ID NO: 2076730 - DNA, 15 bp, Homo sapiens
gtttaaataaagtat

SEQ ID NO: 2076731 - DNA, 23 bp, Homo sapiens
gtttaactttgggcccagaaact

SEQ ID NO: 2076732 - DNA, 17 bp, Homo sapiens
gtttaatatttaaacag

SEQ ID NO: 2076733 - DNA, 16 bp, Homo sapiens
gtttacaaaaggcagc

SEQ ID NO: 2076734 - DNA, 20 bp, Homo sapiens
gtttacaaaaggcagccctt

SEQ ID NO: 2076735 - DNA, 16 bp, Homo sapiens
gtttacaagtgtatat

SEQ ID NO: 2076736 - DNA, 23 bp, Homo sapiens
gtttacaagtgtatatcagaaaa

SEQ ID NO: 2076737 - DNA, 17 bp, Homo sapiens
gtttacaggtggacaca

SEQ ID NO: 2076738 - DNA, 19 bp, Homo sapiens
gtttacagtaaataaattg

SEQ ID NO: 2076739 - DNA, 13 bp, Homo sapiens
gtttactatttta

SEQ ID NO: 2076740 - DNA, 14 bp, Homo sapiens
gtttactgctgtca

SEQ ID NO: 2076741 - DNA, 22 bp, Homo sapiens
gtttagatcccatgtcacctca

SEQ ID NO: 2076742 - DNA, 20 bp, Homo sapiens
gtttagtttctagaggcctc

SEQ ID NO: 2076743 - DNA, 18 bp, Homo sapiens
gtttatcattgggagaag

SEQ ID NO: 2076744 - DNA, 18 bp, Homo sapiens
gtttatgaaaaagaagaa

SEQ ID NO: 2076745 - DNA, 13 bp, Homo sapiens
gtttatgtctaaa

SEQ ID NO: 2076746 - DNA, 17 bp, Homo sapiens
gtttattaatgcctctc

SEQ ID NO: 2076747 - DNA, 14 bp, Homo sapiens
gtttatttatcagt

SEQ ID NO: 2076748 - DNA, 16 bp, Homo sapiens
gtttatttatcagtga

SEQ ID NO: 2076749 - DNA, 15 bp, Homo sapiens
gtttatttattcact

SEQ ID NO: 2076750 - DNA, 21 bp, Homo sapiens
tccatgcctgagggtggagac

SEQ ID NO: 2076751 - DNA, 15 bp, Homo sapiens
tccatggaggaggtg

SEQ ID NO: 2076752 - DNA, 21 bp, Homo sapiens
tccatggccaccccgtgccac

SEQ ID NO: 2076753 - DNA, 23 bp, Homo sapiens
tccatgtattcacacacccctca

SEQ ID NO: 2076754 - DNA, 14 bp, Homo sapiens
tccatgtccctgta

SEQ ID NO: 2076755 - DNA, 18 bp, Homo sapiens
tccatgtcctatgtgtga

SEQ ID NO: 2076756 - DNA, 21 bp, Homo sapiens
tccatgtgcttccctaggctg

SEQ ID NO: 2076757 - DNA, 22 bp, Homo sapiens
tccatgtgcttccctaggctga

SEQ ID NO: 2076758 - DNA, 21 bp, Homo sapiens
tccatgtggccccaggtgcca

SEQ ID NO: 2076759 - DNA, 19 bp, Homo sapiens
tccatgttagtttttactt

SEQ ID NO: 2076760 - DNA, 13 bp, Homo sapiens
tccatgtttgtaa

SEQ ID NO: 2076761 - DNA, 18 bp, Homo sapiens
tccattaaaacaatttat

SEQ ID NO: 2076762 - DNA, 20 bp, Homo sapiens
tccattgcatgtattgtaaa

SEQ ID NO: 2076763 - DNA, 14 bp, Homo sapiens
tccattgctgttgt

SEQ ID NO: 2076764 - DNA, 20 bp, Homo sapiens
tccatttcaactccagaagt

SEQ ID NO: 2076765 - DNA, 21 bp, Homo sapiens
tccatttcagtttgtttactt

SEQ ID NO: 2076766 - DNA, 21 bp, Homo sapiens
tccatttcatctatttctgag

SEQ ID NO: 2076767 - DNA, 23 bp, Homo sapiens
tccatttcatctatttctgagaa

SEQ ID NO: 2076768 - DNA, 19 bp, Homo sapiens
tccatttctcaatcagtgc

SEQ ID NO: 2076769 - DNA, 18 bp, Homo sapiens
tccatttttactaaagca

SEQ ID NO: 2076770 - DNA, 21 bp, Homo sapiens
tccatttttactaaagcagtg

SEQ ID NO: 2076771 - DNA, 14 bp, Homo sapiens
tcccaaagtgctgg

SEQ ID NO: 2076772 - DNA, 15 bp, Homo sapiens
tcccaaagtgctggg

SEQ ID NO: 2076773 - DNA, 22 bp, Homo sapiens
tcccaacccaattcaggactgg

SEQ ID NO: 2076774 - DNA, 23 bp, Homo sapiens
tcccaaccccagggcccccacag

SEQ ID NO: 2076775 - DNA, 14 bp, Homo sapiens
tcccaactgctctg

SEQ ID NO: 2076776 - DNA, 13 bp, Homo sapiens
tcccaagaaatgc

SEQ ID NO: 2076777 - DNA, 12 bp, Homo sapiens
tcccaaggaaag

SEQ ID NO: 2076778 - DNA, 13 bp, Homo sapiens
tcccaaggaaagc

SEQ ID NO: 2076779 - DNA, 22 bp, Homo sapiens
tcccaaggaaagccccagcact

SEQ ID NO: 2076780 - DNA, 20 bp, Homo sapiens
tcccaaggtgctaggattac

SEQ ID NO: 2076781 - DNA, 17 bp, Homo sapiens
tcccaataaagctggac

SEQ ID NO: 2076782 - DNA, 14 bp, Homo sapiens
tcccaatcagcact

SEQ ID NO: 2076783 - DNA, 17 bp, Homo sapiens
tcccaatcagcactgaa

SEQ ID NO: 2076784 - DNA, 18 bp, Homo sapiens
tcccaatcagcactgaaa

SEQ ID NO: 2076785 - DNA, 20 bp, Homo sapiens
tcccaatgcacatccattcc

SEQ ID NO: 2076786 - DNA, 13 bp, Homo sapiens
tcccaattcattt

SEQ ID NO: 2076787 - DNA, 17 bp, Homo sapiens
tcccacaggcccttcct

SEQ ID NO: 2076788 - DNA, 11 bp, Homo sapiens
tcccacagtgg

SEQ ID NO: 2076789 - DNA, 13 bp, Homo sapiens
tcccacatccctg

SEQ ID NO: 2076790 - DNA, 14 bp, Homo sapiens
tcccacatccctgg

SEQ ID NO: 2076791 - DNA, 15 bp, Homo sapiens
tcccacatccctggg

SEQ ID NO: 2076792 - DNA, 17 bp, Homo sapiens
tcccacatccctgggcc

SEQ ID NO: 2076793 - DNA, 18 bp, Homo sapiens
tcccacatccctgggcct

SEQ ID NO: 2076794 - DNA, 20 bp, Homo sapiens
tcccacatccctgggcctgc

SEQ ID NO: 2076795 - DNA, 19 bp, Homo sapiens
tcccaccaaccctcagagc

SEQ ID NO: 2076796 - DNA, 20 bp, Homo sapiens
tcccaccaactctgcactcc

SEQ ID NO: 2076797 - DNA, 13 bp, Homo sapiens
tcccaccagcatg

SEQ ID NO: 2076798 - DNA, 14 bp, Homo sapiens
tcccaccagcatgt

SEQ ID NO: 2076799 - DNA, 19 bp, Homo sapiens
tcccacccaacagctcaga

SEQ ID NO: 2076800 - DNA, 19 bp, Homo sapiens
tcccacccaattcaaaaca

SEQ ID NO: 2076801 - DNA, 18 bp, Homo sapiens
tcccacccacatgtgaca

SEQ ID NO: 2076802 - DNA, 16 bp, Homo sapiens
tcccaccccaccccct

SEQ ID NO: 2076803 - DNA, 18 bp, Homo sapiens
tcccaccccacccccttc

SEQ ID NO: 2076804 - DNA, 14 bp, Homo sapiens
tcccaccccactcc

SEQ ID NO: 2076805 - DNA, 15 bp, Homo sapiens
tcccaccccactcca

SEQ ID NO: 2076806 - DNA, 21 bp, Homo sapiens
tcccaccccactccagccctg

SEQ ID NO: 2076807 - DNA, 13 bp, Homo sapiens
tcccacccccagc

SEQ ID NO: 2076808 - DNA, 23 bp, Homo sapiens
tcccacccccagccccgactcca

SEQ ID NO: 2076809 - DNA, 19 bp, Homo sapiens
tcccaccccggcctccact

SEQ ID NO: 2076810 - DNA, 16 bp, Homo sapiens
tcccaccttggctgca

SEQ ID NO: 2076811 - DNA, 17 bp, Homo sapiens
tcccaccttggctgcag

SEQ ID NO: 2076812 - DNA, 22 bp, Homo sapiens
tcccacgactgttgtacaagct

SEQ ID NO: 2076813 - DNA, 16 bp, Homo sapiens
tcccacgatgtcaagg

SEQ ID NO: 2076814 - DNA, 18 bp, Homo sapiens
tcccactaagctttctcc

SEQ ID NO: 2076815 - DNA, 20 bp, Homo sapiens
tcccactaagctttctcctt

SEQ ID NO: 2076816 - DNA, 16 bp, Homo sapiens
tcccactatggtggga

SEQ ID NO: 2076817 - DNA, 23 bp, Homo sapiens
tcccactcatgttgttcccacac

SEQ ID NO: 2076818 - DNA, 14 bp, Homo sapiens
tcccacttcactgt

SEQ ID NO: 2076819 - DNA, 16 bp, Homo sapiens
tcccagaaccacactg

SEQ ID NO: 2076820 - DNA, 13 bp, Homo sapiens
tcccagaagggag

SEQ ID NO: 2076821 - DNA, 18 bp, Homo sapiens
tcccagagaagctcattt

SEQ ID NO: 2076822 - DNA, 18 bp, Homo sapiens
tcccagagacaggaaaat

SEQ ID NO: 2076823 - DNA, 21 bp, Homo sapiens
tcccagagcttattggccact

SEQ ID NO: 2076824 - DNA, 23 bp, Homo sapiens
tcccagagcttattggccactgg

SEQ ID NO: 2076825 - DNA, 15 bp, Homo sapiens
tcccagagcttccca

SEQ ID NO: 2076826 - DNA, 22 bp, Homo sapiens
tcccagaggccaggaatctgcc

SEQ ID NO: 2076827 - DNA, 24 bp, Homo sapiens
tcccagaggttatctgcctggcct

SEQ ID NO: 2076828 - DNA, 20 bp, Homo sapiens
tcccagagtcagaggagaag

SEQ ID NO: 2076829 - DNA, 16 bp, Homo sapiens
tcccagagtgctagga

SEQ ID NO: 2076830 - DNA, 19 bp, Homo sapiens
tcccagatcctctgctgac

SEQ ID NO: 2076831 - DNA, 16 bp, Homo sapiens
tcccagcactttggga

SEQ ID NO: 2076832 - DNA, 19 bp, Homo sapiens
tcccagcactttgggaggc

SEQ ID NO: 2076833 - DNA, 22 bp, Homo sapiens
tcccagcacttttggaggccaa

SEQ ID NO: 2076834 - DNA, 17 bp, Homo sapiens
tcccagcagaagaggga

SEQ ID NO: 2076835 - DNA, 13 bp, Homo sapiens
tcccagcagccct

SEQ ID NO: 2076836 - DNA, 18 bp, Homo sapiens
tcccagcagccctaagga

SEQ ID NO: 2076837 - DNA, 16 bp, Homo sapiens
tcccagccctgccagg

SEQ ID NO: 2076838 - DNA, 17 bp, Homo sapiens
tcccagccctgccagga

SEQ ID NO: 2076839 - DNA, 18 bp, Homo sapiens
tcccagctacacctgagg

SEQ ID NO: 2076840 - DNA, 14 bp, Homo sapiens
tcccagctactcag

SEQ ID NO: 2076841 - DNA, 21 bp, Homo sapiens
tcccagctactcagaagcctg

SEQ ID NO: 2076842 - DNA, 23 bp, Homo sapiens
tcccagctactcagaagcctgag

SEQ ID NO: 2076843 - DNA, 16 bp, Homo sapiens
tcccagctacttggga

SEQ ID NO: 2076844 - DNA, 19 bp, Homo sapiens
tcccagctacttgggaggc

SEQ ID NO: 2076845 - DNA, 19 bp, Homo sapiens
tcccagctctccctctggc

SEQ ID NO: 2076846 - DNA, 22 bp, Homo sapiens
tcccaggagacagttcaagaaa

SEQ ID NO: 2076847 - DNA, 15 bp, Homo sapiens
tcccaggaggggcct

SEQ ID NO: 2076848 - DNA, 22 bp, Homo sapiens
tcccaggagtggaggaggcctg

SEQ ID NO: 2076849 - DNA, 12 bp, Homo sapiens
tcccaggccagg

SEQ ID NO: 2076850 - DNA, 11 bp, Homo sapiens
tcccaggcccc

SEQ ID NO: 2076851 - DNA, 18 bp, Homo sapiens
tcccaggcttcaccctga

SEQ ID NO: 2076852 - DNA, 17 bp, Homo sapiens
tcccaggggctccacct

SEQ ID NO: 2076853 - DNA, 12 bp, Homo sapiens
tcccataagcta

SEQ ID NO: 2076854 - DNA, 22 bp, Homo sapiens
tcccatcactggagcaccaggc

SEQ ID NO: 2076855 - DNA, 18 bp, Homo sapiens
tcccatctaagctgcagc

SEQ ID NO: 2076856 - DNA, 23 bp, Homo sapiens
tcccatctaagctgcagcttcct

SEQ ID NO: 2076857 - DNA, 15 bp, Homo sapiens
tcccatctgctcctc

SEQ ID NO: 2076858 - DNA, 15 bp, Homo sapiens
tcccatgagcctcag

SEQ ID NO: 2076859 - DNA, 16 bp, Homo sapiens
tcccatgagcctcagc

SEQ ID NO: 2076860 - DNA, 15 bp, Homo sapiens
tcccatgatccagaa

SEQ ID NO: 2076861 - DNA, 16 bp, Homo sapiens
tcccatgatccagaac

SEQ ID NO: 2076862 - DNA, 18 bp, Homo sapiens
tcccatgatgccgctctt

SEQ ID NO: 2076863 - DNA, 12 bp, Homo sapiens
tcccatgccctg

SEQ ID NO: 2076864 - DNA, 16 bp, Homo sapiens
tcccatgcctgcaacc

SEQ ID NO: 2076865 - DNA, 13 bp, Homo sapiens
tcccatggccttc

SEQ ID NO: 2076866 - DNA, 18 bp, Homo sapiens
tcctcctgaagcctctgc

SEQ ID NO: 2076867 - DNA, 12 bp, Homo sapiens
tcctcctgatgg

SEQ ID NO: 2076868 - DNA, 23 bp, Homo sapiens
tcctcctgatggccaagagcatc

SEQ ID NO: 2076869 - DNA, 18 bp, Homo sapiens
tcctccttcccctgtggt

SEQ ID NO: 2076870 - DNA, 16 bp, Homo sapiens
tcctccttggtgcctg

SEQ ID NO: 2076871 - DNA, 14 bp, Homo sapiens
tcctcgcctaggcc

SEQ ID NO: 2076872 - DNA, 19 bp, Homo sapiens
tcctcggatcaccgagagt

SEQ ID NO: 2076873 - DNA, 19 bp, Homo sapiens
tcctcggccccctccatcg

SEQ ID NO: 2076874 - DNA, 15 bp, Homo sapiens
tcctcggtactccca

SEQ ID NO: 2076875 - DNA, 15 bp, Homo sapiens
tcctcgtcccctgcc

SEQ ID NO: 2076876 - DNA, 19 bp, Homo sapiens
tcctctacttaatgagata

SEQ ID NO: 2076877 - DNA, 19 bp, Homo sapiens
tcctctagctacactattg

SEQ ID NO: 2076878 - DNA, 22 bp, Homo sapiens
tcctctcaagctagccagaggg

SEQ ID NO: 2076879 - DNA, 18 bp, Homo sapiens
tcctctccaattgtaaaa

SEQ ID NO: 2076880 - DNA, 15 bp, Homo sapiens
tcctctccactgcct

SEQ ID NO: 2076881 - DNA, 17 bp, Homo sapiens
tcctctccagccttctc

SEQ ID NO: 2076882 - DNA, 24 bp, Homo sapiens
tcctctccagccttctctctctgg

SEQ ID NO: 2076883 - DNA, 12 bp, Homo sapiens
tcctctccaggc

SEQ ID NO: 2076884 - DNA, 14 bp, Homo sapiens
tcctctccaggcac

SEQ ID NO: 2076885 - DNA, 12 bp, Homo sapiens
tcctctccccag

SEQ ID NO: 2076886 - DNA, 16 bp, Homo sapiens
tcctctctctgtgtta

SEQ ID NO: 2076887 - DNA, 14 bp, Homo sapiens
tcctctctgagact

SEQ ID NO: 2076888 - DNA, 14 bp, Homo sapiens
tcctctgcagcact

SEQ ID NO: 2076889 - DNA, 23 bp, Homo sapiens
tcctctgccacctcccctatcca

SEQ ID NO: 2076890 - DNA, 17 bp, Homo sapiens
tcctctggatggcacca

SEQ ID NO: 2076891 - DNA, 19 bp, Homo sapiens
tcctctggatggcaccaga

SEQ ID NO: 2076892 - DNA, 13 bp, Homo sapiens
tcctctggcccag

SEQ ID NO: 2076893 - DNA, 15 bp, Homo sapiens
tcctctggcccagcc

SEQ ID NO: 2076894 - DNA, 23 bp, Homo sapiens
tcctctggctggctaactggaag

SEQ ID NO: 2076895 - DNA, 14 bp, Homo sapiens
tcctctgtccaggg

SEQ ID NO: 2076896 - DNA, 14 bp, Homo sapiens
tcctctgtctctgc

SEQ ID NO: 2076897 - DNA, 20 bp, Homo sapiens
tcctcttaaaaaataaaaac

SEQ ID NO: 2076898 - DNA, 13 bp, Homo sapiens
tcctcttatttgc

SEQ ID NO: 2076899 - DNA, 21 bp, Homo sapiens
tcctcttggtgtcgtttccct

SEQ ID NO: 2076900 - DNA, 18 bp, Homo sapiens
tcctgaaagaaacagtta

SEQ ID NO: 2076901 - DNA, 14 bp, Homo sapiens
tcctgaaatttcag

SEQ ID NO: 2076902 - DNA, 20 bp, Homo sapiens
tcctgaagaaaccacaggtt

SEQ ID NO: 2076903 - DNA, 21 bp, Homo sapiens
tcctgaagccagatccaccct

SEQ ID NO: 2076904 - DNA, 16 bp, Homo sapiens
tcctgaatattaatcc

SEQ ID NO: 2076905 - DNA, 19 bp, Homo sapiens
tcctgaatgaaatatcaga

SEQ ID NO: 2076906 - DNA, 20 bp, Homo sapiens
tcctgacctcctcctgccct

SEQ ID NO: 2076907 - DNA, 21 bp, Homo sapiens
tcctgactccagtgagctgga

SEQ ID NO: 2076908 - DNA, 14 bp, Homo sapiens
tcctgactgacaca

SEQ ID NO: 2076909 - DNA, 16 bp, Homo sapiens
tcctgactgacacagg

SEQ ID NO: 2076910 - DNA, 16 bp, Homo sapiens
tcctgagaaggcgagg

SEQ ID NO: 2076911 - DNA, 17 bp, Homo sapiens
tcctgagaaggcgagga

SEQ ID NO: 2076912 - DNA, 23 bp, Homo sapiens
tcctgagaaggcgaggagagtgg

SEQ ID NO: 2076913 - DNA, 13 bp, Homo sapiens
tcctgagcactgc

SEQ ID NO: 2076914 - DNA, 18 bp, Homo sapiens
tcctgagcactgccagga

SEQ ID NO: 2076915 - DNA, 13 bp, Homo sapiens
tcctgagtagctg

SEQ ID NO: 2076916 - DNA, 18 bp, Homo sapiens
tcctgataaacattaaac

SEQ ID NO: 2076917 - DNA, 18 bp, Homo sapiens
tcctgatggtacaggaaa

SEQ ID NO: 2076918 - DNA, 22 bp, Homo sapiens
tcctgatgtgccagaacttcga

SEQ ID NO: 2076919 - DNA, 17 bp, Homo sapiens
tcctgatttcagggaaa

SEQ ID NO: 2076920 - DNA, 19 bp, Homo sapiens
tcctgcaatctccagggct

SEQ ID NO: 2076921 - DNA, 21 bp, Homo sapiens
tcctgcactgacccacagcct

SEQ ID NO: 2076922 - DNA, 20 bp, Homo sapiens
tcctgcagaggaccacagtg

SEQ ID NO: 2076923 - DNA, 15 bp, Homo sapiens
tcctgcagcctcctc

SEQ ID NO: 2076924 - DNA, 18 bp, Homo sapiens
tcctgcagcctcctcctg

SEQ ID NO: 2076925 - DNA, 20 bp, Homo sapiens
tcctgcaggaacgagcactg

SEQ ID NO: 2076926 - DNA, 12 bp, Homo sapiens
tcctgcatttta

SEQ ID NO: 2076927 - DNA, 14 bp, Homo sapiens
tcctgccaccagtc

SEQ ID NO: 2076928 - DNA, 16 bp, Homo sapiens
tcctgccaccagtcac

SEQ ID NO: 2076929 - DNA, 17 bp, Homo sapiens
tcctgccaccagtcact

SEQ ID NO: 2076930 - DNA, 14 bp, Homo sapiens
tcctgccagctgcc

SEQ ID NO: 2076931 - DNA, 12 bp, Homo sapiens
tcctgcccagga

SEQ ID NO: 2076932 - DNA, 13 bp, Homo sapiens
tcctgcccaggag

SEQ ID NO: 2076933 - DNA, 18 bp, Homo sapiens
tcctgcccaggagagcca

SEQ ID NO: 2076934 - DNA, 19 bp, Homo sapiens
tcctgcccaggagagccag

SEQ ID NO: 2076935 - DNA, 22 bp, Homo sapiens
tcctgcccaggagagccagccc

SEQ ID NO: 2076936 - DNA, 19 bp, Homo sapiens
tcctgcccccgacagccca

SEQ ID NO: 2076937 - DNA, 14 bp, Homo sapiens
tcctgcccctcgcc

SEQ ID NO: 2076938 - DNA, 15 bp, Homo sapiens
tcctgcccctcgcct

SEQ ID NO: 2076939 - DNA, 14 bp, Homo sapiens
tcctgccctcccct

SEQ ID NO: 2076940 - DNA, 16 bp, Homo sapiens
tcctgcctacatccca

SEQ ID NO: 2076941 - DNA, 21 bp, Homo sapiens
tcctgcctacattccctggcc

SEQ ID NO: 2076942 - DNA, 14 bp, Homo sapiens
tcctgcctcagcct

SEQ ID NO: 2076943 - DNA, 12 bp, Homo sapiens
tcctgcgggctt

SEQ ID NO: 2076944 - DNA, 20 bp, Homo sapiens
tcctgcgggcttttccccgg

SEQ ID NO: 2076945 - DNA, 23 bp, Homo sapiens
tcctgcgggcttttccccggtcc

SEQ ID NO: 2076946 - DNA, 21 bp, Homo sapiens
tcctgcgggttttaatttatt

SEQ ID NO: 2076947 - DNA, 17 bp, Homo sapiens
tcctgctagctgtagaa

SEQ ID NO: 2076948 - DNA, 17 bp, Homo sapiens
tcctgctctcttcagga

SEQ ID NO: 2076949 - DNA, 21 bp, Homo sapiens
tcctgctctcttcaggaggcc

SEQ ID NO: 2076950 - DNA, 18 bp, Homo sapiens
tcctgctgaaacacctcc

SEQ ID NO: 2076951 - DNA, 12 bp, Homo sapiens
tcctgctgctgt

SEQ ID NO: 2076952 - DNA, 21 bp, Homo sapiens
tcctgctgctgtaactgctga

SEQ ID NO: 2076953 - DNA, 12 bp, Homo sapiens
tcctgctggcac

SEQ ID NO: 2076954 - DNA, 22 bp, Homo sapiens
tcctgctgtgtgaattcccagg

SEQ ID NO: 2076955 - DNA, 21 bp, Homo sapiens
tcctggaatcaaggaatcctg

SEQ ID NO: 2076956 - DNA, 16 bp, Homo sapiens
tcctggaatgaagcat

SEQ ID NO: 2076957 - DNA, 15 bp, Homo sapiens
tcctggacagctgtg

SEQ ID NO: 2076958 - DNA, 15 bp, Homo sapiens
tcctggacctgagtc

SEQ ID NO: 2076959 - DNA, 14 bp, Homo sapiens
tcctggcacccggc

SEQ ID NO: 2076960 - DNA, 20 bp, Homo sapiens
tcctggcacccggcccctgc

SEQ ID NO: 2076961 - DNA, 16 bp, Homo sapiens
tcctggcatgacactc

SEQ ID NO: 2076962 - DNA, 10 bp, Homo sapiens
tcctggccag

SEQ ID NO: 2076963 - DNA, 19 bp, Homo sapiens
tcctggccattttcttgcc

SEQ ID NO: 2076964 - DNA, 20 bp, Homo sapiens
tcctggccattttcttgcct

SEQ ID NO: 2076965 - DNA, 21 bp, Homo sapiens
tcctggccattttcttgcctg

SEQ ID NO: 2076966 - DNA, 22 bp, Homo sapiens
tcctggccattttcttgcctga

SEQ ID NO: 2076967 - DNA, 15 bp, Homo sapiens
tcctggccccagccc

SEQ ID NO: 2076968 - DNA, 17 bp, Homo sapiens
tcctggccccagccccc

SEQ ID NO: 2076969 - DNA, 14 bp, Homo sapiens
tcctggccccgggc

SEQ ID NO: 2076970 - DNA, 20 bp, Homo sapiens
tcctggccccgggctctggc

SEQ ID NO: 2076971 - DNA, 22 bp, Homo sapiens
tcctggcctcactggctggggc

SEQ ID NO: 2076972 - DNA, 14 bp, Homo sapiens
tcctggctgctctc

SEQ ID NO: 2076973 - DNA, 20 bp, Homo sapiens
tcctggctgctctcatgcct

SEQ ID NO: 2076974 - DNA, 21 bp, Homo sapiens
tcctggcttcccatccccagc

SEQ ID NO: 2076975 - DNA, 22 bp, Homo sapiens
tcctggcttcccatccccagcg

SEQ ID NO: 2076976 - DNA, 20 bp, Homo sapiens
tcctggcttctagatctgga

SEQ ID NO: 2076977 - DNA, 18 bp, Homo sapiens
tcctgggagtgagctggt

SEQ ID NO: 2076978 - DNA, 19 bp, Homo sapiens
tcctgggcccgctttgcct

SEQ ID NO: 2076979 - DNA, 23 bp, Homo sapiens
tctcccattctcatatgtagccc

SEQ ID NO: 2076980 - DNA, 12 bp, Homo sapiens
tctccccactga

SEQ ID NO: 2076981 - DNA, 23 bp, Homo sapiens
tctccccagcaagtgagagctgg

SEQ ID NO: 2076982 - DNA, 12 bp, Homo sapiens
tctccccaggcc

SEQ ID NO: 2076983 - DNA, 13 bp, Homo sapiens
tctccccaggcct

SEQ ID NO: 2076984 - DNA, 14 bp, Homo sapiens
tctccccaggcctc

SEQ ID NO: 2076985 - DNA, 20 bp, Homo sapiens
tctcccccatcccccactgc

SEQ ID NO: 2076986 - DNA, 14 bp, Homo sapiens
tctccccctgggct

SEQ ID NO: 2076987 - DNA, 15 bp, Homo sapiens
tctcccctccctctt

SEQ ID NO: 2076988 - DNA, 16 bp, Homo sapiens
tctcccctctgccctg

SEQ ID NO: 2076989 - DNA, 18 bp, Homo sapiens
tctcccgcaccaggccgg

SEQ ID NO: 2076990 - DNA, 13 bp, Homo sapiens
tctccctaaaata

SEQ ID NO: 2076991 - DNA, 14 bp, Homo sapiens
tctccctaaaataa

SEQ ID NO: 2076992 - DNA, 16 bp, Homo sapiens
tctccctaaaataaaa

SEQ ID NO: 2076993 - DNA, 18 bp, Homo sapiens
tctccctaaaataaaaac

SEQ ID NO: 2076994 - DNA, 21 bp, Homo sapiens
tctccctaaaataaaaaccag

SEQ ID NO: 2076995 - DNA, 19 bp, Homo sapiens
tctccctcacccccaggtg

SEQ ID NO: 2076996 - DNA, 16 bp, Homo sapiens
tctccctccagctgga

SEQ ID NO: 2076997 - DNA, 17 bp, Homo sapiens
tctccctctcctgccta

SEQ ID NO: 2076998 - DNA, 12 bp, Homo sapiens
tctccctctggc

SEQ ID NO: 2076999 - DNA, 15 bp, Homo sapiens
tctccctctggccct

SEQ ID NO: 2077000 - DNA, 20 bp, Homo sapiens
tctccctctggccctgcctt

SEQ ID NO: 2077001 - DNA, 13 bp, Homo sapiens
tctcccttttaaa

SEQ ID NO: 2077002 - DNA, 23 bp, Homo sapiens
tctccgaccagacaccttgacag

SEQ ID NO: 2077003 - DNA, 17 bp, Homo sapiens
tctccggggtctgtgct

SEQ ID NO: 2077004 - DNA, 15 bp, Homo sapiens
tctccgggtgtggcc

SEQ ID NO: 2077005 - DNA, 17 bp, Homo sapiens
tctccgggtgtggcctc

SEQ ID NO: 2077006 - DNA, 16 bp, Homo sapiens
tctcctaccccacctc

SEQ ID NO: 2077007 - DNA, 14 bp, Homo sapiens
tctcctcagactgc

SEQ ID NO: 2077008 - DNA, 15 bp, Homo sapiens
tctcctcctatttat

SEQ ID NO: 2077009 - DNA, 13 bp, Homo sapiens
tctcctctctgag

SEQ ID NO: 2077010 - DNA, 22 bp, Homo sapiens
tctcctcttaaaaaataaaaac

SEQ ID NO: 2077011 - DNA, 16 bp, Homo sapiens
tctcctcttgccactg

SEQ ID NO: 2077012 - DNA, 17 bp, Homo sapiens
tctcctcttgccactgc

SEQ ID NO: 2077013 - DNA, 21 bp, Homo sapiens
tctcctgactccagtgagctg

SEQ ID NO: 2077014 - DNA, 11 bp, Homo sapiens
tctcctgccta

SEQ ID NO: 2077015 - DNA, 17 bp, Homo sapiens
tctcctgcctactcacg

SEQ ID NO: 2077016 - DNA, 15 bp, Homo sapiens
tctcctgcctcagcc

SEQ ID NO: 2077017 - DNA, 19 bp, Homo sapiens
tctcctgcctcagcctccc

SEQ ID NO: 2077018 - DNA, 22 bp, Homo sapiens
tctcctgcctcagcctcccaaa

SEQ ID NO: 2077019 - DNA, 20 bp, Homo sapiens
tctcctgcctgtagcagtga

SEQ ID NO: 2077020 - DNA, 18 bp, Homo sapiens
tctcctgggggtggcagg

SEQ ID NO: 2077021 - DNA, 20 bp, Homo sapiens
tctcctgggggtggcaggca

SEQ ID NO: 2077022 - DNA, 19 bp, Homo sapiens
tctcctgtataaccccacc

SEQ ID NO: 2077023 - DNA, 22 bp, Homo sapiens
tctcctgtataaccccaccttg

SEQ ID NO: 2077024 - DNA, 15 bp, Homo sapiens
tctcctgtgcccctc

SEQ ID NO: 2077025 - DNA, 17 bp, Homo sapiens
tctccttactctgagcc

SEQ ID NO: 2077026 - DNA, 20 bp, Homo sapiens
tctccttactctgagcccag

SEQ ID NO: 2077027 - DNA, 21 bp, Homo sapiens
tctccttactctgagcccagg

SEQ ID NO: 2077028 - DNA, 20 bp, Homo sapiens
tctccttcgtgtctctccca

SEQ ID NO: 2077029 - DNA, 15 bp, Homo sapiens
tctccttcttccctg

SEQ ID NO: 2077030 - DNA, 12 bp, Homo sapiens
tctccttggagg

SEQ ID NO: 2077031 - DNA, 14 bp, Homo sapiens
tctccttggaggac

SEQ ID NO: 2077032 - DNA, 19 bp, Homo sapiens
tctccttgggctcctggct

SEQ ID NO: 2077033 - DNA, 15 bp, Homo sapiens
tctcctttattgctc

SEQ ID NO: 2077034 - DNA, 17 bp, Homo sapiens
tctcctttattgctcct

SEQ ID NO: 2077035 - DNA, 16 bp, Homo sapiens
tctcctttcacaacct

SEQ ID NO: 2077036 - DNA, 19 bp, Homo sapiens
tctcctttgcactgagggc

SEQ ID NO: 2077037 - DNA, 21 bp, Homo sapiens
tctcctttgcactgagggcca

SEQ ID NO: 2077038 - DNA, 23 bp, Homo sapiens
tctcctttgcactgagggccaca

SEQ ID NO: 2077039 - DNA, 14 bp, Homo sapiens
tctcgagcgccctg

SEQ ID NO: 2077040 - DNA, 16 bp, Homo sapiens
tctcgagcgccctgca

SEQ ID NO: 2077041 - DNA, 19 bp, Homo sapiens
tctcgcattttctctagct

SEQ ID NO: 2077042 - DNA, 21 bp, Homo sapiens
tctcggcaactaagcagtccc

SEQ ID NO: 2077043 - DNA, 15 bp, Homo sapiens
tctcgggaaattatt

SEQ ID NO: 2077044 - DNA, 20 bp, Homo sapiens
tctcggggcccttggggcct

SEQ ID NO: 2077045 - DNA, 21 bp, Homo sapiens
tctcggggcgacccctcagtg

SEQ ID NO: 2077046 - DNA, 14 bp, Homo sapiens
tctcgggtgcattt

SEQ ID NO: 2077047 - DNA, 13 bp, Homo sapiens
tctctaagccaca

SEQ ID NO: 2077048 - DNA, 17 bp, Homo sapiens
tctctaagccacagctt

SEQ ID NO: 2077049 - DNA, 15 bp, Homo sapiens
tctctacccatctcc

SEQ ID NO: 2077050 - DNA, 14 bp, Homo sapiens
tctctactctggaa

SEQ ID NO: 2077051 - DNA, 14 bp, Homo sapiens
tctctagagaacat

SEQ ID NO: 2077052 - DNA, 20 bp, Homo sapiens
tctctagctgatcagaattt

SEQ ID NO: 2077053 - DNA, 22 bp, Homo sapiens
tctctagctttaggggaccatg

SEQ ID NO: 2077054 - DNA, 17 bp, Homo sapiens
tctctatttaatattta

SEQ ID NO: 2077055 - DNA, 14 bp, Homo sapiens
tctctcaggagcac

SEQ ID NO: 2077056 - DNA, 17 bp, Homo sapiens
tctctcaggagcacagg

SEQ ID NO: 2077057 - DNA, 19 bp, Homo sapiens
tctctcaggagcacaggca

SEQ ID NO: 2077058 - DNA, 21 bp, Homo sapiens
tctctcaggagcacaggcagc

SEQ ID NO: 2077059 - DNA, 12 bp, Homo sapiens
tctctcatgaac

SEQ ID NO: 2077060 - DNA, 16 bp, Homo sapiens
tctctccatcctcaaa

SEQ ID NO: 2077061 - DNA, 21 bp, Homo sapiens
tctctcccaccccggcctcca

SEQ ID NO: 2077062 - DNA, 16 bp, Homo sapiens
tctctcctcagactgc

SEQ ID NO: 2077063 - DNA, 22 bp, Homo sapiens
tctctcctgtataaccccacct

SEQ ID NO: 2077064 - DNA, 19 bp, Homo sapiens
tctctccttcttccctgtt

SEQ ID NO: 2077065 - DNA, 15 bp, Homo sapiens
tctctccttgttctg

SEQ ID NO: 2077066 - DNA, 19 bp, Homo sapiens
tctctcgggccccccacac

SEQ ID NO: 2077067 - DNA, 15 bp, Homo sapiens
tctctcggttccacg

SEQ ID NO: 2077068 - DNA, 18 bp, Homo sapiens
tctctcggttccacgtcc

SEQ ID NO: 2077069 - DNA, 19 bp, Homo sapiens
tctctctaaaaataaaatg

SEQ ID NO: 2077070 - DNA, 19 bp, Homo sapiens
tctctctactcctacctca

SEQ ID NO: 2077071 - DNA, 17 bp, Homo sapiens
tctctctatatatacat

SEQ ID NO: 2077072 - DNA, 14 bp, Homo sapiens
tctctctctacaaa

SEQ ID NO: 2077073 - DNA, 11 bp, Homo sapiens
tctctctctgg

SEQ ID NO: 2077074 - DNA, 12 bp, Homo sapiens
tctctctctggt

SEQ ID NO: 2077075 - DNA, 15 bp, Homo sapiens
tctctctggggccct

SEQ ID NO: 2077076 - DNA, 21 bp, Homo sapiens
tctctctggggccctgggcct

SEQ ID NO: 2077077 - DNA, 13 bp, Homo sapiens
tctctgaagcatg

SEQ ID NO: 2077078 - DNA, 16 bp, Homo sapiens
tctctgactcttgcct

SEQ ID NO: 2077079 - DNA, 16 bp, Homo sapiens
tctctgagagagatga

SEQ ID NO: 2077080 - DNA, 22 bp, Homo sapiens
tctctgagatgcccctctgcct

SEQ ID NO: 2077081 - DNA, 18 bp, Homo sapiens
tctctgcagccagcccag

SEQ ID NO: 2077082 - DNA, 20 bp, Homo sapiens
tctctgcagccagcccagcc

SEQ ID NO: 2077083 - DNA, 18 bp, Homo sapiens
tctctgcagtatttataa

SEQ ID NO: 2077084 - DNA, 21 bp, Homo sapiens
tctctgcctatttattggggt

SEQ ID NO: 2077085 - DNA, 21 bp, Homo sapiens
tctctgcgtgcagggacaaag

SEQ ID NO: 2077086 - DNA, 13 bp, Homo sapiens
tctctgctccaga

SEQ ID NO: 2077087 - DNA, 20 bp, Homo sapiens
tctctgctctagccaggagt

SEQ ID NO: 2077088 - DNA, 17 bp, Homo sapiens
tctctgcttacccttca

SEQ ID NO: 2077089 - DNA, 22 bp, Homo sapiens
tctctgcttactaatgtgcccc

SEQ ID NO: 2077090 - DNA, 19 bp, Homo sapiens
tctctggcccttcttgcct

SEQ ID NO: 2077091 - DNA, 17 bp, Homo sapiens
tctctggccttttccta

SEQ ID NO: 2077092 - DNA, 13 bp, Homo sapiens
tctctggctccag

SEQ ID NO: 2077093 - DNA, 18 bp, Homo sapiens
tctctggggccctgggcc

SEQ ID NO: 2077094 - DNA, 23 bp, Homo sapiens
tctctggggccctgggcctcagt

SEQ ID NO: 2077095 - DNA, 24 bp, Homo sapiens
tctctgggtaggtgttgaaaatga

SEQ ID NO: 2077096 - DNA, 15 bp, Homo sapiens
tctctgtataaacat

SEQ ID NO: 2077097 - DNA, 22 bp, Homo sapiens
tctctgtataaacattaaatgt

SEQ ID NO: 2077098 - DNA, 16 bp, Homo sapiens
tctctgtataatctat

SEQ ID NO: 2077099 - DNA, 22 bp, Homo sapiens
tctctgtgaacgatttagaaag

SEQ ID NO: 2077100 - DNA, 18 bp, Homo sapiens
tctctgtgacctgccccg

SEQ ID NO: 2077101 - DNA, 18 bp, Homo sapiens
tctctgtgcccctgtaaa

SEQ ID NO: 2077102 - DNA, 11 bp, Homo sapiens
tctctgtgctt

SEQ ID NO: 2077103 - DNA, 16 bp, Homo sapiens
tctctgtgctttgact

SEQ ID NO: 2077104 - DNA, 18 bp, Homo sapiens
tctctgtgtgcacaaata

SEQ ID NO: 2077105 - DNA, 13 bp, Homo sapiens
tctctgttcattt

SEQ ID NO: 2077106 - DNA, 16 bp, Homo sapiens
tctctgttcatttcct

SEQ ID NO: 2077107 - DNA, 17 bp, Homo sapiens
tctcttatagaatattt

SEQ ID NO: 2077108 - DNA, 18 bp, Homo sapiens
tctcttatagaatattta

SEQ ID NO: 2077109 - DNA, 21 bp, Homo sapiens
tctcttatatagtattcattt

SEQ ID NO: 2077110 - DNA, 17 bp, Homo sapiens
tctcttcactcccaata

SEQ ID NO: 2077111 - DNA, 16 bp, Homo sapiens
tctcttcaggttctta

SEQ ID NO: 2077112 - DNA, 12 bp, Homo sapiens
tctcttccctat

SEQ ID NO: 2077113 - DNA, 11 bp, Homo sapiens
tctcttcctac

SEQ ID NO: 2077114 - DNA, 12 bp, Homo sapiens
tctcttcctctg

SEQ ID NO: 2077115 - DNA, 16 bp, Homo sapiens
tctcttcctctgttct

SEQ ID NO: 2077116 - DNA, 11 bp, Homo sapiens
tctcttctcca

SEQ ID NO: 2077117 - DNA, 14 bp, Homo sapiens
tctcttctccactg

SEQ ID NO: 2077118 - DNA, 16 bp, Homo sapiens
tctcttctccactgga

SEQ ID NO: 2077119 - DNA, 21 bp, Homo sapiens
tctcttctctattcctgaccc

SEQ ID NO: 2077120 - DNA, 16 bp, Homo sapiens
tctcttgtcatataaa

SEQ ID NO: 2077121 - DNA, 17 bp, Homo sapiens
tctctttaatcttcagt

SEQ ID NO: 2077122 - DNA, 14 bp, Homo sapiens
tctctttcttattt

SEQ ID NO: 2077123 - DNA, 22 bp, Homo sapiens
tctcttttgaatccatgcttgg

SEQ ID NO: 2077124 - DNA, 16 bp, Homo sapiens
tctgaaaaacattcca

SEQ ID NO: 2077125 - DNA, 14 bp, Homo sapiens
tctgaaaactggaa

SEQ ID NO: 2077126 - DNA, 14 bp, Homo sapiens
tctgaaagacagaa

SEQ ID NO: 2077127 - DNA, 21 bp, Homo sapiens
tctgaaagacagaatgtcacc

SEQ ID NO: 2077128 - DNA, 13 bp, Homo sapiens
tctgaaagcacag

SEQ ID NO: 2077129 - DNA, 23 bp, Homo sapiens
tctgaaagcacaggagacactgt

SEQ ID NO: 2077130 - DNA, 15 bp, Homo sapiens
tctgaacaaacactg

SEQ ID NO: 2077131 - DNA, 21 bp, Homo sapiens
tctgaacacatactagaaagc

SEQ ID NO: 2077132 - DNA, 15 bp, Homo sapiens
tctgaaccactttgc

SEQ ID NO: 2077133 - DNA, 16 bp, Homo sapiens
tctgaaccactttgcc

SEQ ID NO: 2077134 - DNA, 17 bp, Homo sapiens
tctgaaccactttgcct

SEQ ID NO: 2077135 - DNA, 21 bp, Homo sapiens
tctgaacccttgtgcttggtg

SEQ ID NO: 2077136 - DNA, 22 bp, Homo sapiens
tctgaacccttgtgcttggtgg

SEQ ID NO: 2077137 - DNA, 15 bp, Homo sapiens
tctgaactcaagctg

SEQ ID NO: 2077138 - DNA, 15 bp, Homo sapiens
tctgaagatctcaga

SEQ ID NO: 2077139 - DNA, 15 bp, Homo sapiens
tctgaagcatgtttc

SEQ ID NO: 2077140 - DNA, 20 bp, Homo sapiens
tctgaagctattgatgtttc

SEQ ID NO: 2077141 - DNA, 20 bp, Homo sapiens
tctgaagcttcactcactgt

SEQ ID NO: 2077142 - DNA, 15 bp, Homo sapiens
tctgaatattttgta

SEQ ID NO: 2077143 - DNA, 22 bp, Homo sapiens
tctgaatctgataggaaaagaa

SEQ ID NO: 2077144 - DNA, 13 bp, Homo sapiens
tctgaatggtcca

SEQ ID NO: 2077145 - DNA, 17 bp, Homo sapiens
tctgaatttttaaacaa

SEQ ID NO: 2077146 - DNA, 19 bp, Homo sapiens
tctgacaagataaaggaag

SEQ ID NO: 2077147 - DNA, 20 bp, Homo sapiens
tctgacaagggctgacctgc

SEQ ID NO: 2077148 - DNA, 12 bp, Homo sapiens
tctgacacacag

SEQ ID NO: 2077149 - DNA, 14 bp, Homo sapiens
tctgacacacagct

SEQ ID NO: 2077150 - DNA, 16 bp, Homo sapiens
tctgacacacagctct

SEQ ID NO: 2077151 - DNA, 17 bp, Homo sapiens
tctgacattctgattcg

SEQ ID NO: 2077152 - DNA, 14 bp, Homo sapiens
tctgaccatttcag

SEQ ID NO: 2077153 - DNA, 22 bp, Homo sapiens
tctgacccaagaggtggggacc

SEQ ID NO: 2077154 - DNA, 13 bp, Homo sapiens
tctgacccactgc

SEQ ID NO: 2077155 - DNA, 14 bp, Homo sapiens
tctgacctgcaggc

SEQ ID NO: 2077156 - DNA, 16 bp, Homo sapiens
tctgacctgcaggcca

SEQ ID NO: 2077157 - DNA, 19 bp, Homo sapiens
tctgacctgcaggccaaga

SEQ ID NO: 2077158 - DNA, 17 bp, Homo sapiens
tctgactccagagtctg

SEQ ID NO: 2077159 - DNA, 20 bp, Homo sapiens
tctgactccagagtctgagc

SEQ ID NO: 2077160 - DNA, 15 bp, Homo sapiens
tctgactcttgcctt

SEQ ID NO: 2077161 - DNA, 14 bp, Homo sapiens
tctgacttcctctg

SEQ ID NO: 2077162 - DNA, 17 bp, Homo sapiens
tctgacttctcccatct

SEQ ID NO: 2077163 - DNA, 22 bp, Homo sapiens
tctgactttaattgtgtgtctt

SEQ ID NO: 2077164 - DNA, 22 bp, Homo sapiens
tctgagaaaagaacgtatttta

SEQ ID NO: 2077165 - DNA, 16 bp, Homo sapiens
tctgagaagtgtatat

SEQ ID NO: 2077166 - DNA, 20 bp, Homo sapiens
tctgagaatgcccaactctt

SEQ ID NO: 2077167 - DNA, 22 bp, Homo sapiens
tctgagactctcttaggagcag

SEQ ID NO: 2077168 - DNA, 14 bp, Homo sapiens
tctgagaggccctg

SEQ ID NO: 2077169 - DNA, 17 bp, Homo sapiens
tctgagaggccctggat

SEQ ID NO: 2077170 - DNA, 20 bp, Homo sapiens
tctgagagttggctcaggca

SEQ ID NO: 2077171 - DNA, 22 bp, Homo sapiens
tctgagagttggctcaggcaga

SEQ ID NO: 2077172 - DNA, 17 bp, Homo sapiens
tctgagatctccctcca

SEQ ID NO: 2077173 - DNA, 16 bp, Homo sapiens
tctgagcaagagctgg

SEQ ID NO: 2077174 - DNA, 17 bp, Homo sapiens
tctgagcaagagctggc

SEQ ID NO: 2077175 - DNA, 14 bp, Homo sapiens
tctgagcaccccct

SEQ ID NO: 2077176 - DNA, 15 bp, Homo sapiens
tctgagcaccccctc

SEQ ID NO: 2077177 - DNA, 20 bp, Homo sapiens
tctgagcaccccctcattcc

SEQ ID NO: 2077178 - DNA, 21 bp, Homo sapiens
tctgagcaccccctcattccc

SEQ ID NO: 2077179 - DNA, 22 bp, Homo sapiens
tctgagcaccccctcattcccc

SEQ ID NO: 2077180 - DNA, 22 bp, Homo sapiens
tctgagcagtcagggtgggaag

SEQ ID NO: 2077181 - DNA, 14 bp, Homo sapiens
tctgagcccaggcc

SEQ ID NO: 2077182 - DNA, 20 bp, Homo sapiens
tctgagccctggtgtgtttc

SEQ ID NO: 2077183 - DNA, 18 bp, Homo sapiens
tctgagcttttcatggaa

SEQ ID NO: 2077184 - DNA, 18 bp, Homo sapiens
tctgaggaatccagaccc

SEQ ID NO: 2077185 - DNA, 18 bp, Homo sapiens
tctgaggccagcctggcc

SEQ ID NO: 2077186 - DNA, 18 bp, Homo sapiens
tctgaggccccaggccct

SEQ ID NO: 2077187 - DNA, 21 bp, Homo sapiens
tctgaggccccttaactcatc

SEQ ID NO: 2077188 - DNA, 12 bp, Homo sapiens
tctgaggcctca

SEQ ID NO: 2077189 - DNA, 21 bp, Homo sapiens
tctgaggcctcatccctcgga

SEQ ID NO: 2077190 - DNA, 21 bp, Homo sapiens
tctgaggcgccccaacccgtg

SEQ ID NO: 2077191 - DNA, 17 bp, Homo sapiens
tctgagggagaggctgt

SEQ ID NO: 2077192 - DNA, 15 bp, Homo sapiens
tctgaggtcctgagc

SEQ ID NO: 2077193 - DNA, 20 bp, Homo sapiens
tctgaggtcctgagcactgc

SEQ ID NO: 2077194 - DNA, 14 bp, Homo sapiens
tctgagtcctgtct

SEQ ID NO: 2077195 - DNA, 16 bp, Homo sapiens
tctgagtcctgtctct

SEQ ID NO: 2077196 - DNA, 19 bp, Homo sapiens
tctgataaaattgtgatgt

SEQ ID NO: 2077197 - DNA, 15 bp, Homo sapiens
tctgatatgggactg

SEQ ID NO: 2077198 - DNA, 13 bp, Homo sapiens
tctgattatcagg

SEQ ID NO: 2077199 - DNA, 13 bp, Homo sapiens
tctgattcaaaag

SEQ ID NO: 2077200 - DNA, 13 bp, Homo sapiens
tctgattccactt

SEQ ID NO: 2077201 - DNA, 19 bp, Homo sapiens
tctgattcccaagctctgc

SEQ ID NO: 2077202 - DNA, 19 bp, Homo sapiens
tctgattcgaatgacactg

SEQ ID NO: 2077203 - DNA, 20 bp, Homo sapiens
tctgattcgaatgacactgt

SEQ ID NO: 2077204 - DNA, 17 bp, Homo sapiens
tctgattggctcaccca

SEQ ID NO: 2077205 - DNA, 20 bp, Homo sapiens
tctgatttaatgttttctgc

SEQ ID NO: 2077206 - DNA, 19 bp, Homo sapiens
tctgcaactagccaaggct

SEQ ID NO: 2077207 - DNA, 23 bp, Homo sapiens
tctgcacatgaatcccacccaca

SEQ ID NO: 2077208 - DNA, 17 bp, Homo sapiens
tctgcacatgtcttgta

SEQ ID NO: 2077209 - DNA, 19 bp, Homo sapiens
tctgcacatgtcttgtaca

SEQ ID NO: 2077210 - DNA, 20 bp, Homo sapiens
tctgcacatgtcttgtacat

SEQ ID NO: 2077211 - DNA, 22 bp, Homo sapiens
tctgcacatgtcttgtacatgt

SEQ ID NO: 2077212 - DNA, 15 bp, Homo sapiens
tctgcagcaactccc

SEQ ID NO: 2077213 - DNA, 23 bp, Homo sapiens
tctgcagcactttaaccctctct

SEQ ID NO: 2077214 - DNA, 13 bp, Homo sapiens
tctgcagggagca

SEQ ID NO: 2077215 - DNA, 16 bp, Homo sapiens
tctgcagggagcaact

SEQ ID NO: 2077216 - DNA, 19 bp, Homo sapiens
tctgcagggggtgtgtctg

SEQ ID NO: 2077217 - DNA, 18 bp, Homo sapiens
tctgcagtagtctctgtg

SEQ ID NO: 2077218 - DNA, 19 bp, Homo sapiens
tctgcagtagtctctgtgc

SEQ ID NO: 2077219 - DNA, 19 bp, Homo sapiens
tctgcataaacttcatctt

SEQ ID NO: 2077220 - DNA, 19 bp, Homo sapiens
tctgcatcagctgctgaaa

SEQ ID NO: 2077221 - DNA, 21 bp, Homo sapiens
tctgcatcagctgctgaaaca

SEQ ID NO: 2077222 - DNA, 16 bp, Homo sapiens
tctgcatctcattgta

SEQ ID NO: 2077223 - DNA, 15 bp, Homo sapiens
tctgcattccccgct

SEQ ID NO: 2077224 - DNA, 19 bp, Homo sapiens
tctgcattccccgctgccc

SEQ ID NO: 2077225 - DNA, 16 bp, Homo sapiens
tctgcattctagtact

SEQ ID NO: 2077226 - DNA, 20 bp, Homo sapiens
tctgcatttataaatgtgtg

SEQ ID NO: 2077227 - DNA, 23 bp, Homo sapiens
tctgcatttataaatgtgtggtg

SEQ ID NO: 2077228 - DNA, 19 bp, Homo sapiens
tctgccacagagagtcctt

SEQ ID NO: 2077229 - DNA, 10 bp, Homo sapiens
tctgccacca

SEQ ID NO: 2077230 - DNA, 14 bp, Homo sapiens
tctgccacctcccc

SEQ ID NO: 2077231 - DNA, 23 bp, Homo sapiens
tctgccacctcccctatccaccc

SEQ ID NO: 2077232 - DNA, 13 bp, Homo sapiens
tctgccagccaca

SEQ ID NO: 2077233 - DNA, 17 bp, Homo sapiens
tctgccagccagcagcc

SEQ ID NO: 2077234 - DNA, 12 bp, Homo sapiens
tctgccccaagc

SEQ ID NO: 2077235 - DNA, 13 bp, Homo sapiens
tctgccccaagca

SEQ ID NO: 2077236 - DNA, 19 bp, Homo sapiens
tctgccccaagcagccagc

SEQ ID NO: 2077237 - DNA, 14 bp, Homo sapiens
tctgccccaagggg

SEQ ID NO: 2077238 - DNA, 15 bp, Homo sapiens
tctgccccagaggcc

SEQ ID NO: 2077239 - DNA, 14 bp, Homo sapiens
tctgccccagctct

SEQ ID NO: 2077240 - DNA, 16 bp, Homo sapiens
tctgccccagctctgg

SEQ ID NO: 2077241 - DNA, 17 bp, Homo sapiens
tctgccccagctctggc

SEQ ID NO: 2077242 - DNA, 16 bp, Homo sapiens
tctgccccagtagtca

SEQ ID NO: 2077243 - DNA, 19 bp, Homo sapiens
tctgcccccagcctctgtc

SEQ ID NO: 2077244 - DNA, 19 bp, Homo sapiens
tctgccccttgggcatcca

SEQ ID NO: 2077245 - DNA, 22 bp, Homo sapiens
tctgccccttgggcatccaccc

SEQ ID NO: 2077246 - DNA, 14 bp, Homo sapiens
tctgcccgcagagc

SEQ ID NO: 2077247 - DNA, 16 bp, Homo sapiens
tctgccctccctggcc

SEQ ID NO: 2077248 - DNA, 18 bp, Homo sapiens
tctgccctccctggcctc

SEQ ID NO: 2077249 - DNA, 20 bp, Homo sapiens
tctgccctgcctccctttct

SEQ ID NO: 2077250 - DNA, 16 bp, Homo sapiens
tctgcctcaatgtgaa

SEQ ID NO: 2077251 - DNA, 15 bp, Homo sapiens
tctgcctctgacaca

SEQ ID NO: 2077252 - DNA, 23 bp, Homo sapiens
tctgcctctgacacacagctctg

SEQ ID NO: 2077253 - DNA, 20 bp, Homo sapiens
tctgcctgaagtcacacagt

SEQ ID NO: 2077254 - DNA, 14 bp, Homo sapiens
tctgcctggcctgg

SEQ ID NO: 2077255 - DNA, 15 bp, Homo sapiens
tctgcctggcctggc

SEQ ID NO: 2077256 - DNA, 18 bp, Homo sapiens
tctgcctggcctggctcc

SEQ ID NO: 2077257 - DNA, 19 bp, Homo sapiens
tctgcctggcctggctccc

SEQ ID NO: 2077258 - DNA, 12 bp, Homo sapiens
tctgcctgggcc

SEQ ID NO: 2077259 - DNA, 14 bp, Homo sapiens
tctgcctgggcctg

SEQ ID NO: 2077260 - DNA, 15 bp, Homo sapiens
tctgcctgggcctgt

SEQ ID NO: 2077261 - DNA, 21 bp, Homo sapiens
tctgcctgggcctgtgcagca

SEQ ID NO: 2077262 - DNA, 14 bp, Homo sapiens
tctgcctgtctccc

SEQ ID NO: 2077263 - DNA, 14 bp, Homo sapiens
tctgcctgtggcct

SEQ ID NO: 2077264 - DNA, 13 bp, Homo sapiens
tctgcctttttta

SEQ ID NO: 2077265 - DNA, 17 bp, Homo sapiens
tctgcggccttccaccg

SEQ ID NO: 2077266 - DNA, 15 bp, Homo sapiens
tctgcgtcccccagc

SEQ ID NO: 2077267 - DNA, 21 bp, Homo sapiens
tctgcgtcccccagccctcag

SEQ ID NO: 2077268 - DNA, 19 bp, Homo sapiens
tctgcgtctctgctttaaa

SEQ ID NO: 2077269 - DNA, 20 bp, Homo sapiens
tctgcgtctctgctttaaag

SEQ ID NO: 2077270 - DNA, 19 bp, Homo sapiens
tctgcgtgctttatttatg

SEQ ID NO: 2077271 - DNA, 19 bp, Homo sapiens
tctgctcacatatctgtca

SEQ ID NO: 2077272 - DNA, 22 bp, Homo sapiens
tctgctcagacagaacccctac

SEQ ID NO: 2077273 - DNA, 19 bp, Homo sapiens
tctgctcaggaattgaaga

SEQ ID NO: 2077274 - DNA, 22 bp, Homo sapiens
tctgctcagtaatttgaggaca

SEQ ID NO: 2077275 - DNA, 13 bp, Homo sapiens
tctgctccagaga

SEQ ID NO: 2077276 - DNA, 12 bp, Homo sapiens
tctgctcctctc

SEQ ID NO: 2077277 - DNA, 21 bp, Homo sapiens
tctgctcctctccccagcaag

SEQ ID NO: 2077278 - DNA, 15 bp, Homo sapiens
tctgctctagccagg

SEQ ID NO: 2077279 - DNA, 13 bp, Homo sapiens
tctgctctgatgc

SEQ ID NO: 2077280 - DNA, 21 bp, Homo sapiens
tctgctgccccgcttccccac

SEQ ID NO: 2077281 - DNA, 13 bp, Homo sapiens
tctgctgcccctg

SEQ ID NO: 2077282 - DNA, 17 bp, Homo sapiens
tctgctgcccctgcagt

SEQ ID NO: 2077283 - DNA, 16 bp, Homo sapiens
tctgctggataaaatg

SEQ ID NO: 2077284 - DNA, 18 bp, Homo sapiens
tctgctggataaaatgag

SEQ ID NO: 2077285 - DNA, 14 bp, Homo sapiens
tctgctggcctgga

SEQ ID NO: 2077286 - DNA, 15 bp, Homo sapiens
tctgctggcctggat

SEQ ID NO: 2077287 - DNA, 17 bp, Homo sapiens
tctgctggcctggatct

SEQ ID NO: 2077288 - DNA, 16 bp, Homo sapiens
tctgctggcctggccg

SEQ ID NO: 2077289 - DNA, 13 bp, Homo sapiens
tctgctggtcact

SEQ ID NO: 2077290 - DNA, 17 bp, Homo sapiens
tctgctggttttaacaa

SEQ ID NO: 2077291 - DNA, 15 bp, Homo sapiens
tctgcttctccctgg

SEQ ID NO: 2077292 - DNA, 16 bp, Homo sapiens
tctgcttcttcatctt

SEQ ID NO: 2077293 - DNA, 11 bp, Homo sapiens
tctgcttgcat

SEQ ID NO: 2077294 - DNA, 20 bp, Homo sapiens
tctgcttgcatcacttgggg

SEQ ID NO: 2077295 - DNA, 21 bp, Homo sapiens
tctggaaaaaaaatatatata

SEQ ID NO: 2077296 - DNA, 19 bp, Homo sapiens
tctggaaaactcaggattc

SEQ ID NO: 2077297 - DNA, 20 bp, Homo sapiens
tctggaaaactcaggattct

SEQ ID NO: 2077298 - DNA, 13 bp, Homo sapiens
tctggaaaagagg

SEQ ID NO: 2077299 - DNA, 15 bp, Homo sapiens
tctggaaaagcactt

SEQ ID NO: 2077300 - DNA, 13 bp, Homo sapiens
tctggaaagggca

SEQ ID NO: 2077301 - DNA, 12 bp, Homo sapiens
tctggaaatctg

SEQ ID NO: 2077302 - DNA, 17 bp, Homo sapiens
tctggaaattttgtcca

SEQ ID NO: 2077303 - DNA, 13 bp, Homo sapiens
tctggaagctgag

SEQ ID NO: 2077304 - DNA, 16 bp, Homo sapiens
tctggaagctgagcag

SEQ ID NO: 2077305 - DNA, 17 bp, Homo sapiens
tctggaagctgagcagg

SEQ ID NO: 2077306 - DNA, 16 bp, Homo sapiens
tctggaaggctggctg

SEQ ID NO: 2077307 - DNA, 18 bp, Homo sapiens
tctggaaggctggctgag

SEQ ID NO: 2077308 - DNA, 19 bp, Homo sapiens
tctggaaggctggctgagt

SEQ ID NO: 2077309 - DNA, 14 bp, Homo sapiens
tctggaatacatga

SEQ ID NO: 2077310 - DNA, 15 bp, Homo sapiens
tctggaatgtaatca

SEQ ID NO: 2077311 - DNA, 18 bp, Homo sapiens
tctggaatgtaatcaatg

SEQ ID NO: 2077312 - DNA, 12 bp, Homo sapiens
tctggacaagcc

SEQ ID NO: 2077313 - DNA, 21 bp, Homo sapiens
tctggacaagccaacttgtaa

SEQ ID NO: 2077314 - DNA, 17 bp, Homo sapiens
tctggacctccccctct

SEQ ID NO: 2077315 - DNA, 15 bp, Homo sapiens
tctggactcctctgt

SEQ ID NO: 2077316 - DNA, 18 bp, Homo sapiens
tctggactcctctgtcca

SEQ ID NO: 2077317 - DNA, 22 bp, Homo sapiens
tctggactcctctgtccaggca

SEQ ID NO: 2077318 - DNA, 16 bp, Homo sapiens
tctggagaagcagtga

SEQ ID NO: 2077319 - DNA, 22 bp, Homo sapiens
tctggagaagcagtgagccgca

SEQ ID NO: 2077320 - DNA, 17 bp, Homo sapiens
tcttaaacaaatgtatg

SEQ ID NO: 2077321 - DNA, 23 bp, Homo sapiens
tcttgcaggaaggactatgaaaa

SEQ ID NO: 2077322 - DNA, 23 bp, Homo sapiens
tcttgcatggcaaggactgcagg

SEQ ID NO: 2077323 - DNA, 16 bp, Homo sapiens
tcttgccactgcctct

SEQ ID NO: 2077324 - DNA, 12 bp, Homo sapiens
tcttgccagcca

SEQ ID NO: 2077325 - DNA, 13 bp, Homo sapiens
tcttgcctaggcc

SEQ ID NO: 2077326 - DNA, 16 bp, Homo sapiens
tcttgcctaggccaaa

SEQ ID NO: 2077327 - DNA, 18 bp, Homo sapiens
tcttgcctgaatccatca

SEQ ID NO: 2077328 - DNA, 14 bp, Homo sapiens
tcttgcctgaggct

SEQ ID NO: 2077329 - DNA, 16 bp, Homo sapiens
tcttgctatttgagca

SEQ ID NO: 2077330 - DNA, 12 bp, Homo sapiens
tcttgctctgct

SEQ ID NO: 2077331 - DNA, 13 bp, Homo sapiens
tcttgctgagcac

SEQ ID NO: 2077332 - DNA, 22 bp, Homo sapiens
tcttgctgtaactcagacattc

SEQ ID NO: 2077333 - DNA, 19 bp, Homo sapiens
tcttggaaaaaaattacaa

SEQ ID NO: 2077334 - DNA, 14 bp, Homo sapiens
tcttggacctctgc

SEQ ID NO: 2077335 - DNA, 16 bp, Homo sapiens
tcttggacctctgctc

SEQ ID NO: 2077336 - DNA, 21 bp, Homo sapiens
tcttggcagcttaacattgac

SEQ ID NO: 2077337 - DNA, 16 bp, Homo sapiens
tcttgggaactccact

SEQ ID NO: 2077338 - DNA, 21 bp, Homo sapiens
tcttgggctactggcagctcc

SEQ ID NO: 2077339 - DNA, 16 bp, Homo sapiens
tcttgggtaggcggga

SEQ ID NO: 2077340 - DNA, 14 bp, Homo sapiens
tcttggtaagaagc

SEQ ID NO: 2077341 - DNA, 22 bp, Homo sapiens
tcttgtacagttaactctccca

SEQ ID NO: 2077342 - DNA, 13 bp, Homo sapiens
tcttgtcagaatt

SEQ ID NO: 2077343 - DNA, 21 bp, Homo sapiens
tcttgtcagaattggcctcag

SEQ ID NO: 2077344 - DNA, 23 bp, Homo sapiens
tcttgtccatgtggttcttcaaa

SEQ ID NO: 2077345 - DNA, 23 bp, Homo sapiens
tcttgtcccctcttgacccatct

SEQ ID NO: 2077346 - DNA, 13 bp, Homo sapiens
tcttgtctccact

SEQ ID NO: 2077347 - DNA, 15 bp, Homo sapiens
tcttgtctctgggct

SEQ ID NO: 2077348 - DNA, 14 bp, Homo sapiens
tcttgtgcatgttt

SEQ ID NO: 2077349 - DNA, 14 bp, Homo sapiens
tcttgtgcctcagc

SEQ ID NO: 2077350 - DNA, 15 bp, Homo sapiens
tcttgtgctcacgct

SEQ ID NO: 2077351 - DNA, 21 bp, Homo sapiens
tcttgtgcttttcctatttgt

SEQ ID NO: 2077352 - DNA, 14 bp, Homo sapiens
tcttgtttcaattc

SEQ ID NO: 2077353 - DNA, 21 bp, Homo sapiens
tcttgttttttttttccactt

SEQ ID NO: 2077354 - DNA, 12 bp, Homo sapiens
tctttaaaagaa

SEQ ID NO: 2077355 - DNA, 13 bp, Homo sapiens
tctttaaatcaaa

SEQ ID NO: 2077356 - DNA, 14 bp, Homo sapiens
tctttaaatcaaaa

SEQ ID NO: 2077357 - DNA, 21 bp, Homo sapiens
tctttaaatcaaaagctgctt

SEQ ID NO: 2077358 - DNA, 22 bp, Homo sapiens
tctttaaatttttatcttactt

SEQ ID NO: 2077359 - DNA, 15 bp, Homo sapiens
tctttaagtattgtt

SEQ ID NO: 2077360 - DNA, 18 bp, Homo sapiens
tctttaagtattgtttta

SEQ ID NO: 2077361 - DNA, 15 bp, Homo sapiens
tctttaatcttcagt

SEQ ID NO: 2077362 - DNA, 13 bp, Homo sapiens
tctttacctgaga

SEQ ID NO: 2077363 - DNA, 16 bp, Homo sapiens
tctttacctgagacca

SEQ ID NO: 2077364 - DNA, 20 bp, Homo sapiens
tctttactcccttcctggcc

SEQ ID NO: 2077365 - DNA, 21 bp, Homo sapiens
tctttactcccttcctggcct

SEQ ID NO: 2077366 - DNA, 22 bp, Homo sapiens
tctttactcccttcctggcctc

SEQ ID NO: 2077367 - DNA, 16 bp, Homo sapiens
tctttaggtgcctcct

SEQ ID NO: 2077368 - DNA, 17 bp, Homo sapiens
tctttaggtgcctcctg

SEQ ID NO: 2077369 - DNA, 19 bp, Homo sapiens
tctttaggtgcctcctgtc

SEQ ID NO: 2077370 - DNA, 16 bp, Homo sapiens
tctttcctccaaactc

SEQ ID NO: 2077371 - DNA, 11 bp, Homo sapiens
tctttcctctt

SEQ ID NO: 2077372 - DNA, 22 bp, Homo sapiens
tctttcctcttccccttgccct

SEQ ID NO: 2077373 - DNA, 18 bp, Homo sapiens
tctttcctgttgttgtta

SEQ ID NO: 2077374 - DNA, 14 bp, Homo sapiens
tctttccttgtctc

SEQ ID NO: 2077375 - DNA, 18 bp, Homo sapiens
tctttctaatgtgtgaat

SEQ ID NO: 2077376 - DNA, 16 bp, Homo sapiens
tctttctacatagtta

SEQ ID NO: 2077377 - DNA, 22 bp, Homo sapiens
tctttctattcataataaacta

SEQ ID NO: 2077378 - DNA, 21 bp, Homo sapiens
tctttctctccttcttccctg

SEQ ID NO: 2077379 - DNA, 15 bp, Homo sapiens
tctttcttactattg

SEQ ID NO: 2077380 - DNA, 17 bp, Homo sapiens
tctttcttattttgtaa

SEQ ID NO: 2077381 - DNA, 18 bp, Homo sapiens
tctttcttattttgtaat

SEQ ID NO: 2077382 - DNA, 12 bp, Homo sapiens
tctttctttgga

SEQ ID NO: 2077383 - DNA, 22 bp, Homo sapiens
tctttcttttgattcttcctaa

SEQ ID NO: 2077384 - DNA, 14 bp, Homo sapiens
tctttctttttctg

SEQ ID NO: 2077385 - DNA, 15 bp, Homo sapiens
tctttctttttctgg

SEQ ID NO: 2077386 - DNA, 23 bp, Homo sapiens
tctttctttttctggaaattttg

SEQ ID NO: 2077387 - DNA, 15 bp, Homo sapiens
tctttctttttctgt

SEQ ID NO: 2077388 - DNA, 18 bp, Homo sapiens
tctttctttttctgtctc

SEQ ID NO: 2077389 - DNA, 19 bp, Homo sapiens
tctttctttttctgtctct

SEQ ID NO: 2077390 - DNA, 13 bp, Homo sapiens
tctttgaaaagaa

SEQ ID NO: 2077391 - DNA, 10 bp, Homo sapiens
tctttgaata

SEQ ID NO: 2077392 - DNA, 15 bp, Homo sapiens
tctttgaataaagtc

SEQ ID NO: 2077393 - DNA, 19 bp, Homo sapiens
tctttgaatttcctatctg

SEQ ID NO: 2077394 - DNA, 19 bp, Homo sapiens
tctttgacgggaggcctca

SEQ ID NO: 2077395 - DNA, 20 bp, Homo sapiens
tctttgacgggaggcctcag

SEQ ID NO: 2077396 - DNA, 21 bp, Homo sapiens
tctttgacgggaggcctcagt

SEQ ID NO: 2077397 - DNA, 21 bp, Homo sapiens
tctttgagaaaggattaagat

SEQ ID NO: 2077398 - DNA, 12 bp, Homo sapiens
tctttgatggac

SEQ ID NO: 2077399 - DNA, 17 bp, Homo sapiens
tctttgattcagacagc

SEQ ID NO: 2077400 - DNA, 13 bp, Homo sapiens
tctttgcacatgt

SEQ ID NO: 2077401 - DNA, 15 bp, Homo sapiens
tctttgcacatgtga

SEQ ID NO: 2077402 - DNA, 18 bp, Homo sapiens
tctttgcacatgtgacca

SEQ ID NO: 2077403 - DNA, 13 bp, Homo sapiens
tctttgcagacag

SEQ ID NO: 2077404 - DNA, 13 bp, Homo sapiens
tctttgcagagcc

SEQ ID NO: 2077405 - DNA, 15 bp, Homo sapiens
tctttgcatggaatt

SEQ ID NO: 2077406 - DNA, 15 bp, Homo sapiens
tctttgcctgtgtga

SEQ ID NO: 2077407 - DNA, 17 bp, Homo sapiens
tctttggaaggagtgag

SEQ ID NO: 2077408 - DNA, 12 bp, Homo sapiens
tctttggaatga

SEQ ID NO: 2077409 - DNA, 18 bp, Homo sapiens
tctttggggtcagccagg

SEQ ID NO: 2077410 - DNA, 20 bp, Homo sapiens
tctttgtgacaggaaagccc

SEQ ID NO: 2077411 - DNA, 14 bp, Homo sapiens
tctttgtggcttcc

SEQ ID NO: 2077412 - DNA, 19 bp, Homo sapiens
tctttgttcagttgactta

SEQ ID NO: 2077413 - DNA, 16 bp, Homo sapiens
tcttttagttttagtt

SEQ ID NO: 2077414 - DNA, 16 bp, Homo sapiens
tcttttcattgaacag

SEQ ID NO: 2077415 - DNA, 15 bp, Homo sapiens
tcttttccctctcta

SEQ ID NO: 2077416 - DNA, 19 bp, Homo sapiens
tcttttgaatccatgcttg

SEQ ID NO: 2077417 - DNA, 12 bp, Homo sapiens
tcttttggcctt

SEQ ID NO: 2077418 - DNA, 14 bp, Homo sapiens
tctttttaagctta

SEQ ID NO: 2077419 - DNA, 14 bp, Homo sapiens
tctttttcaaaaat

SEQ ID NO: 2077420 - DNA, 19 bp, Homo sapiens
tcttttttaaaagagatgt

SEQ ID NO: 2077421 - DNA, 16 bp, Homo sapiens
tgaaaaaaaagtttca

SEQ ID NO: 2077422 - DNA, 18 bp, Homo sapiens
tgaaaaacattccaggaa

SEQ ID NO: 2077423 - DNA, 18 bp, Homo sapiens
tgaaaaactcttctactt

SEQ ID NO: 2077424 - DNA, 22 bp, Homo sapiens
tgaaaaactgatcaaaaataaa

SEQ ID NO: 2077425 - DNA, 13 bp, Homo sapiens
tgaaaaagaagaa

SEQ ID NO: 2077426 - DNA, 16 bp, Homo sapiens
tgaaaaatatgtgctt

SEQ ID NO: 2077427 - DNA, 20 bp, Homo sapiens
tgaaaaatatgtgcttgaaa

SEQ ID NO: 2077428 - DNA, 14 bp, Homo sapiens
tgaaaaatggtccc

SEQ ID NO: 2077429 - DNA, 12 bp, Homo sapiens
tgaaaaatgtca

SEQ ID NO: 2077430 - DNA, 18 bp, Homo sapiens
tgaaaacagatgcccccg

SEQ ID NO: 2077431 - DNA, 23 bp, Homo sapiens
tgaaaacatggtagaattggaga

SEQ ID NO: 2077432 - DNA, 23 bp, Homo sapiens
tgaaaacccagagaggaatcaga

SEQ ID NO: 2077433 - DNA, 14 bp, Homo sapiens
tgaaaactatttta

SEQ ID NO: 2077434 - DNA, 14 bp, Homo sapiens
tgaaaactggaata

SEQ ID NO: 2077435 - DNA, 14 bp, Homo sapiens
tgaaaactgtaaat

SEQ ID NO: 2077436 - DNA, 16 bp, Homo sapiens
tgaacttgaggacaca

SEQ ID NO: 2077437 - DNA, 19 bp, Homo sapiens
tgaacttgaggacacatgt

SEQ ID NO: 2077438 - DNA, 15 bp, Homo sapiens
tgaagaaaaaataca

SEQ ID NO: 2077439 - DNA, 17 bp, Homo sapiens
tgaagaaaaaatacatt

SEQ ID NO: 2077440 - DNA, 18 bp, Homo sapiens
tgaagaaaaaatacattt

SEQ ID NO: 2077441 - DNA, 17 bp, Homo sapiens
tgaagaaaactccttta

SEQ ID NO: 2077442 - DNA, 19 bp, Homo sapiens
tgaagaaagggaggcccag

SEQ ID NO: 2077443 - DNA, 20 bp, Homo sapiens
tgaagaaagggaggcccagc

SEQ ID NO: 2077444 - DNA, 13 bp, Homo sapiens
tgaagaaatggaa

SEQ ID NO: 2077445 - DNA, 15 bp, Homo sapiens
tgaagaacagtaact

SEQ ID NO: 2077446 - DNA, 13 bp, Homo sapiens
tgaagaatgttaa

SEQ ID NO: 2077447 - DNA, 21 bp, Homo sapiens
tgaagacaaaccactgtacat

SEQ ID NO: 2077448 - DNA, 19 bp, Homo sapiens
tgaagacccagtgtaaaga

SEQ ID NO: 2077449 - DNA, 20 bp, Homo sapiens
tgaagacccagtgtaaagaa

SEQ ID NO: 2077450 - DNA, 23 bp, Homo sapiens
tgaagacccagtgtaaagaataa

SEQ ID NO: 2077451 - DNA, 22 bp, Homo sapiens
tgaagactatctttgaagccag

SEQ ID NO: 2077452 - DNA, 13 bp, Homo sapiens
tgaagagaagctg

SEQ ID NO: 2077453 - DNA, 17 bp, Homo sapiens
tgaagagaagctgagaa

SEQ ID NO: 2077454 - DNA, 19 bp, Homo sapiens
tgaagagaagctgagaaga

SEQ ID NO: 2077455 - DNA, 22 bp, Homo sapiens
tgaagagaagctgagaagaagc

SEQ ID NO: 2077456 - DNA, 21 bp, Homo sapiens
tgaagagagatatatctgaaa

SEQ ID NO: 2077457 - DNA, 19 bp, Homo sapiens
tgaagaggcaagagacaga

SEQ ID NO: 2077458 - DNA, 21 bp, Homo sapiens
tgaagaggcaagagacagaat

SEQ ID NO: 2077459 - DNA, 17 bp, Homo sapiens
tgaagagggagaaggga

SEQ ID NO: 2077460 - DNA, 17 bp, Homo sapiens
tgaagagtgagagggca

SEQ ID NO: 2077461 - DNA, 15 bp, Homo sapiens
tgaagattctcctgt

SEQ ID NO: 2077462 - DNA, 13 bp, Homo sapiens
tgaagatttcaga

SEQ ID NO: 2077463 - DNA, 20 bp, Homo sapiens
tgaagatttcagaggctgca

SEQ ID NO: 2077464 - DNA, 18 bp, Homo sapiens
tgaagcaaagcaccagct

SEQ ID NO: 2077465 - DNA, 16 bp, Homo sapiens
tgaagcatgtttcatg

SEQ ID NO: 2077466 - DNA, 11 bp, Homo sapiens
tgaagccagat

SEQ ID NO: 2077467 - DNA, 19 bp, Homo sapiens
tgaagccagatccacccta

SEQ ID NO: 2077468 - DNA, 17 bp, Homo sapiens
tgaagcccatgctttcc

SEQ ID NO: 2077469 - DNA, 22 bp, Homo sapiens
tgaagccccttgtcctctcccg

SEQ ID NO: 2077470 - DNA, 17 bp, Homo sapiens
tgaagcccgtgtcctgc

SEQ ID NO: 2077471 - DNA, 19 bp, Homo sapiens
tgaagcccgtgtcctgcct

SEQ ID NO: 2077472 - DNA, 20 bp, Homo sapiens
tgaagcccgtgtcctgcctt

SEQ ID NO: 2077473 - DNA, 15 bp, Homo sapiens
tgaagcctatttatt

SEQ ID NO: 2077474 - DNA, 22 bp, Homo sapiens
tgaagcctctgccctgcctccc

SEQ ID NO: 2077475 - DNA, 14 bp, Homo sapiens
tgaagcctgtgcca

SEQ ID NO: 2077476 - DNA, 23 bp, Homo sapiens
tgaagctattgatgtttccagaa

SEQ ID NO: 2077477 - DNA, 13 bp, Homo sapiens
tgaagctgtaccc

SEQ ID NO: 2077478 - DNA, 21 bp, Homo sapiens
tgaaggaacagtgctgttctg

SEQ ID NO: 2077479 - DNA, 19 bp, Homo sapiens
tgaaggaatagccagagag

SEQ ID NO: 2077480 - DNA, 19 bp, Homo sapiens
tgaaggaatagcccgagga

SEQ ID NO: 2077481 - DNA, 13 bp, Homo sapiens
tgaaggagaaagg

SEQ ID NO: 2077482 - DNA, 14 bp, Homo sapiens
tgaaggagaaagga

SEQ ID NO: 2077483 - DNA, 18 bp, Homo sapiens
tgaaggagaaaggagccg

SEQ ID NO: 2077484 - DNA, 18 bp, Homo sapiens
tgaaggaggtgagagaag

SEQ ID NO: 2077485 - DNA, 14 bp, Homo sapiens
tgaaggcagtctga

SEQ ID NO: 2077486 - DNA, 18 bp, Homo sapiens
tgaaggcagtctgaaccc

SEQ ID NO: 2077487 - DNA, 19 bp, Homo sapiens
tgaaggcgtgcaaggggct

SEQ ID NO: 2077488 - DNA, 21 bp, Homo sapiens
tgaagggaaaggatattttct

SEQ ID NO: 2077489 - DNA, 20 bp, Homo sapiens
tgaagggaccttgaagggta

SEQ ID NO: 2077490 - DNA, 17 bp, Homo sapiens
tgaagggcttcttctta

SEQ ID NO: 2077491 - DNA, 19 bp, Homo sapiens
tgaagggcttcttcttata

SEQ ID NO: 2077492 - DNA, 16 bp, Homo sapiens
tgaagggtgacatccc

SEQ ID NO: 2077493 - DNA, 15 bp, Homo sapiens
tgaaggtcttgcctg

SEQ ID NO: 2077494 - DNA, 19 bp, Homo sapiens
tgaagtaaaggattgatca

SEQ ID NO: 2077495 - DNA, 23 bp, Homo sapiens
tgaagtaagttctgaaaactgtt

SEQ ID NO: 2077496 - DNA, 14 bp, Homo sapiens
tgaagtcacacagt

SEQ ID NO: 2077497 - DNA, 14 bp, Homo sapiens
tgaagtccctgttc

SEQ ID NO: 2077498 - DNA, 15 bp, Homo sapiens
tgaagtccctgttct

SEQ ID NO: 2077499 - DNA, 16 bp, Homo sapiens
tgaagtcgttgtgagg

SEQ ID NO: 2077500 - DNA, 14 bp, Homo sapiens
tgaagtgcttgcag

SEQ ID NO: 2077501 - DNA, 22 bp, Homo sapiens
tgaagttacacaattaattgtc

SEQ ID NO: 2077502 - DNA, 18 bp, Homo sapiens
tgaagttcatggtgatca

SEQ ID NO: 2077503 - DNA, 13 bp, Homo sapiens
tgaagttctgagc

SEQ ID NO: 2077504 - DNA, 14 bp, Homo sapiens
tgaagtttctgtag

SEQ ID NO: 2077505 - DNA, 19 bp, Homo sapiens
tgaataaaaaacatttgta

SEQ ID NO: 2077506 - DNA, 22 bp, Homo sapiens
tgaataaaaaacatttgtacat

SEQ ID NO: 2077507 - DNA, 14 bp, Homo sapiens
tgaataaaaaccct

SEQ ID NO: 2077508 - DNA, 15 bp, Homo sapiens
tgaataaagacacct

SEQ ID NO: 2077509 - DNA, 16 bp, Homo sapiens
tgaataaagacaccta

SEQ ID NO: 2077510 - DNA, 18 bp, Homo sapiens
tgaataaagtctgagtgg

SEQ ID NO: 2077511 - DNA, 23 bp, Homo sapiens
tgaataattttctggcactggtt

SEQ ID NO: 2077512 - DNA, 18 bp, Homo sapiens
tgaatacccccagagacc

SEQ ID NO: 2077513 - DNA, 19 bp, Homo sapiens
tgaatacccccagagacct

SEQ ID NO: 2077514 - DNA, 13 bp, Homo sapiens
tgaatactctcac

SEQ ID NO: 2077515 - DNA, 15 bp, Homo sapiens
tgaatacttggaagt

SEQ ID NO: 2077516 - DNA, 13 bp, Homo sapiens
tgaatagatgtga

SEQ ID NO: 2077517 - DNA, 15 bp, Homo sapiens
tgaatataaacacta

SEQ ID NO: 2077518 - DNA, 20 bp, Homo sapiens
tgaatatctgccccagtagt

SEQ ID NO: 2077519 - DNA, 14 bp, Homo sapiens
tgaatattaatccc

SEQ ID NO: 2077520 - DNA, 22 bp, Homo sapiens
tgaatatttcaaaataaactgg

SEQ ID NO: 2077521 - DNA, 16 bp, Homo sapiens
tgaatcagaccctacc

SEQ ID NO: 2077522 - DNA, 17 bp, Homo sapiens
tgaatccatgcttgggt

SEQ ID NO: 2077523 - DNA, 20 bp, Homo sapiens
tgaatcccacccacatgtga

SEQ ID NO: 2077524 - DNA, 22 bp, Homo sapiens
tgaatcctaagggctggtctct

SEQ ID NO: 2077525 - DNA, 17 bp, Homo sapiens
tgaatctgataggaaaa

SEQ ID NO: 2077526 - DNA, 18 bp, Homo sapiens
tgaatctgataggaaaag

SEQ ID NO: 2077527 - DNA, 20 bp, Homo sapiens
tgaatctgcagggagcaact

SEQ ID NO: 2077528 - DNA, 13 bp, Homo sapiens
tgaatctgttact

SEQ ID NO: 2077529 - DNA, 17 bp, Homo sapiens
tgaatctgttactgaaa

SEQ ID NO: 2077530 - DNA, 19 bp, Homo sapiens
tgaatctgttactgaaatg

SEQ ID NO: 2077531 - DNA, 15 bp, Homo sapiens
tgaatcttactcctt

SEQ ID NO: 2077532 - DNA, 17 bp, Homo sapiens
tgaatgacaacagaagc

SEQ ID NO: 2077533 - DNA, 16 bp, Homo sapiens
tgaatgacatatttta

SEQ ID NO: 2077534 - DNA, 17 bp, Homo sapiens
tgaatgaggtcccaggc

SEQ ID NO: 2077535 - DNA, 22 bp, Homo sapiens
tgaatgaggtcccaggcagaga

SEQ ID NO: 2077536 - DNA, 19 bp, Homo sapiens
tgaatgatttccaaagaga

SEQ ID NO: 2077537 - DNA, 17 bp, Homo sapiens
tgaatgcctcaatgtga

SEQ ID NO: 2077538 - DNA, 18 bp, Homo sapiens
tgaatgctttttgaatgt

SEQ ID NO: 2077539 - DNA, 17 bp, Homo sapiens
tgaatggcctgccttga

SEQ ID NO: 2077540 - DNA, 13 bp, Homo sapiens
tgaatggtatgga

SEQ ID NO: 2077541 - DNA, 15 bp, Homo sapiens
tgaatggtccagggt

SEQ ID NO: 2077542 - DNA, 20 bp, Homo sapiens
tgagactataactgtcatct

SEQ ID NO: 2077543 - DNA, 21 bp, Homo sapiens
tgagactccagaatctgctgt

SEQ ID NO: 2077544 - DNA, 23 bp, Homo sapiens
tgagactctcttaggagcagagc

SEQ ID NO: 2077545 - DNA, 13 bp, Homo sapiens
tgagactctgtct

SEQ ID NO: 2077546 - DNA, 16 bp, Homo sapiens
tgagactgacacctca

SEQ ID NO: 2077547 - DNA, 23 bp, Homo sapiens
tgagactgcgggatggtcctggg

SEQ ID NO: 2077548 - DNA, 15 bp, Homo sapiens
tgagacttagataat

SEQ ID NO: 2077549 - DNA, 12 bp, Homo sapiens
tgagacttccaa

SEQ ID NO: 2077550 - DNA, 17 bp, Homo sapiens
tgagagaaaaagtgccc

SEQ ID NO: 2077551 - DNA, 17 bp, Homo sapiens
tgagagaagccacgctg

SEQ ID NO: 2077552 - DNA, 21 bp, Homo sapiens
tgagagaatcacacaagtttg

SEQ ID NO: 2077553 - DNA, 19 bp, Homo sapiens
tgagagacattaactcatt

SEQ ID NO: 2077554 - DNA, 14 bp, Homo sapiens
tgagagctgggtgt

SEQ ID NO: 2077555 - DNA, 20 bp, Homo sapiens
tgagaggaagatgaagagaa

SEQ ID NO: 2077556 - DNA, 13 bp, Homo sapiens
tgagaggccctgg

SEQ ID NO: 2077557 - DNA, 17 bp, Homo sapiens
tgagaggccctggatca

SEQ ID NO: 2077558 - DNA, 19 bp, Homo sapiens
tgagaggggaacagactgg

SEQ ID NO: 2077559 - DNA, 15 bp, Homo sapiens
tgagaggtgctgcag

SEQ ID NO: 2077560 - DNA, 19 bp, Homo sapiens
tgagagtatattatgtatt

SEQ ID NO: 2077561 - DNA, 19 bp, Homo sapiens
tgagagtctgaaagacaga

SEQ ID NO: 2077562 - DNA, 14 bp, Homo sapiens
tgagagttccagat

SEQ ID NO: 2077563 - DNA, 14 bp, Homo sapiens
tgagagttggctca

SEQ ID NO: 2077564 - DNA, 19 bp, Homo sapiens
tgagatagtagcatacatt

SEQ ID NO: 2077565 - DNA, 20 bp, Homo sapiens
tgagatatacaaatatattt

SEQ ID NO: 2077566 - DNA, 20 bp, Homo sapiens
tgagatatttattgtttatt

SEQ ID NO: 2077567 - DNA, 21 bp, Homo sapiens
tgagatctaagcctttccata

SEQ ID NO: 2077568 - DNA, 13 bp, Homo sapiens
tgagatgtgaaca

SEQ ID NO: 2077569 - DNA, 18 bp, Homo sapiens
tgagatgtgaacacatca

SEQ ID NO: 2077570 - DNA, 19 bp, Homo sapiens
tgagatgtgaacacatcag

SEQ ID NO: 2077571 - DNA, 24 bp, Homo sapiens
tgagatgtgaacacatcagcttgc

SEQ ID NO: 2077572 - DNA, 19 bp, Homo sapiens
tgagattacagaggaagtt

SEQ ID NO: 2077573 - DNA, 14 bp, Homo sapiens
tgagatttctttta

SEQ ID NO: 2077574 - DNA, 15 bp, Homo sapiens
tgagatttgccagca

SEQ ID NO: 2077575 - DNA, 17 bp, Homo sapiens
tgagcaagatcttgtct

SEQ ID NO: 2077576 - DNA, 16 bp, Homo sapiens
tgagcaattcatttca

SEQ ID NO: 2077577 - DNA, 23 bp, Homo sapiens
tgagcacatgcgtatatgtgcgt

SEQ ID NO: 2077578 - DNA, 14 bp, Homo sapiens
tgagcactgccagg

SEQ ID NO: 2077579 - DNA, 15 bp, Homo sapiens
tgagcactgccagga

SEQ ID NO: 2077580 - DNA, 13 bp, Homo sapiens
tgagcactgtagg

SEQ ID NO: 2077581 - DNA, 19 bp, Homo sapiens
tgagcaggcccgacagaga

SEQ ID NO: 2077582 - DNA, 20 bp, Homo sapiens
tgagcaggcccgacagagag

SEQ ID NO: 2077583 - DNA, 23 bp, Homo sapiens
tgagcaggcccgacagagagatg

SEQ ID NO: 2077584 - DNA, 12 bp, Homo sapiens
tgagcagggccg

SEQ ID NO: 2077585 - DNA, 14 bp, Homo sapiens
tgagcagggccggg

SEQ ID NO: 2077586 - DNA, 12 bp, Homo sapiens
tgagcagggctc

SEQ ID NO: 2077587 - DNA, 15 bp, Homo sapiens
tgagcataatgctcc

SEQ ID NO: 2077588 - DNA, 21 bp, Homo sapiens
tgagcatctctgtgtacccac

SEQ ID NO: 2077589 - DNA, 23 bp, Homo sapiens
tgagcatctctgtgtacccactc

SEQ ID NO: 2077590 - DNA, 17 bp, Homo sapiens
tgagcatgcacagctgc

SEQ ID NO: 2077591 - DNA, 18 bp, Homo sapiens
tgagcatgggtgtgccct

SEQ ID NO: 2077592 - DNA, 11 bp, Homo sapiens
tgagcattcag

SEQ ID NO: 2077593 - DNA, 15 bp, Homo sapiens
tgagccaaagagaaa

SEQ ID NO: 2077594 - DNA, 17 bp, Homo sapiens
tgagccacagaccacct

SEQ ID NO: 2077595 - DNA, 18 bp, Homo sapiens
tgagccactgcaccgggc

SEQ ID NO: 2077596 - DNA, 23 bp, Homo sapiens
tgagccactgcaccgggccacag

SEQ ID NO: 2077597 - DNA, 21 bp, Homo sapiens
tgagccaggtaatgagggact

SEQ ID NO: 2077598 - DNA, 16 bp, Homo sapiens
tgagccattttttaaa

SEQ ID NO: 2077599 - DNA, 21 bp, Homo sapiens
tgagcccagccacctcccaag

SEQ ID NO: 2077600 - DNA, 22 bp, Homo sapiens
tgagcccaggagctgagtcacc

SEQ ID NO: 2077601 - DNA, 12 bp, Homo sapiens
tgagcccaggcc

SEQ ID NO: 2077602 - DNA, 13 bp, Homo sapiens
tgagcccaggccg

SEQ ID NO: 2077603 - DNA, 11 bp, Homo sapiens
tgagcccaggg

SEQ ID NO: 2077604 - DNA, 17 bp, Homo sapiens
tgagcccagggaggccg

SEQ ID NO: 2077605 - DNA, 21 bp, Homo sapiens
tgagccgagatcacgccactg

SEQ ID NO: 2077606 - DNA, 17 bp, Homo sapiens
tgagccgcatcttctcc

SEQ ID NO: 2077607 - DNA, 21 bp, Homo sapiens
tgagccgcatcttctccatct

SEQ ID NO: 2077608 - DNA, 21 bp, Homo sapiens
tgagccgctgtgagcccctgg

SEQ ID NO: 2077609 - DNA, 13 bp, Homo sapiens
tgagcctcagcat

SEQ ID NO: 2077610 - DNA, 15 bp, Homo sapiens
tgagcctcagcatcc

SEQ ID NO: 2077611 - DNA, 22 bp, Homo sapiens
tgagcctcagcatcctggcacc

SEQ ID NO: 2077612 - DNA, 16 bp, Homo sapiens
tgagcctgacctttct

SEQ ID NO: 2077613 - DNA, 22 bp, Homo sapiens
tgagcctggcccatagaaacat

SEQ ID NO: 2077614 - DNA, 19 bp, Homo sapiens
tgagcctgtcacgtggtca

SEQ ID NO: 2077615 - DNA, 16 bp, Homo sapiens
tgagccttttcttata

SEQ ID NO: 2077616 - DNA, 23 bp, Homo sapiens
tgagcggacagaatgatgccaaa

SEQ ID NO: 2077617 - DNA, 21 bp, Homo sapiens
tgagctatgattatgccactg

SEQ ID NO: 2077618 - DNA, 23 bp, Homo sapiens
tgagctatgattatgccactgct

SEQ ID NO: 2077619 - DNA, 23 bp, Homo sapiens
tgagctcacaaggcagcaaggcc

SEQ ID NO: 2077620 - DNA, 18 bp, Homo sapiens
tgagctcagacccccact

SEQ ID NO: 2077621 - DNA, 19 bp, Homo sapiens
tgagctcagacccccactc

SEQ ID NO: 2077622 - DNA, 20 bp, Homo sapiens
tgagctcagacccccactct

SEQ ID NO: 2077623 - DNA, 22 bp, Homo sapiens
tgagctcagacccccactctca

SEQ ID NO: 2077624 - DNA, 13 bp, Homo sapiens
tgagctcaggctg

SEQ ID NO: 2077625 - DNA, 17 bp, Homo sapiens
tgagctcaggctgagcc

SEQ ID NO: 2077626 - DNA, 17 bp, Homo sapiens
tgagctcccccttccca

SEQ ID NO: 2077627 - DNA, 12 bp, Homo sapiens
tgagctcctgcg

SEQ ID NO: 2077628 - DNA, 14 bp, Homo sapiens
tgagctcggtggac

SEQ ID NO: 2077629 - DNA, 21 bp, Homo sapiens
tgagctcggtggacccaggga

SEQ ID NO: 2077630 - DNA, 20 bp, Homo sapiens
tgagctctgaacaaacactg

SEQ ID NO: 2077631 - DNA, 15 bp, Homo sapiens
tgagctctgagaggc

SEQ ID NO: 2077632 - DNA, 21 bp, Homo sapiens
tgagctctgagaggccctgga

SEQ ID NO: 2077633 - DNA, 12 bp, Homo sapiens
tgagctcttcat

SEQ ID NO: 2077634 - DNA, 16 bp, Homo sapiens
tgagctcttcatgttt

SEQ ID NO: 2077635 - DNA, 16 bp, Homo sapiens
tgagctgaagacaaac

SEQ ID NO: 2077636 - DNA, 15 bp, Homo sapiens
tgagctgcagaaacg

SEQ ID NO: 2077637 - DNA, 21 bp, Homo sapiens
tgagctgggcaccacaggctg

SEQ ID NO: 2077638 - DNA, 15 bp, Homo sapiens
tgagctggggccaca

SEQ ID NO: 2077639 - DNA, 23 bp, Homo sapiens
tgagctgtatatatatatgtgtg

SEQ ID NO: 2077640 - DNA, 20 bp, Homo sapiens
tgagcttagccttgtgccct

SEQ ID NO: 2077641 - DNA, 15 bp, Homo sapiens
tgagcttatcatgct

SEQ ID NO: 2077642 - DNA, 22 bp, Homo sapiens
tgagtgattgacacacagcact

SEQ ID NO: 2077643 - DNA, 13 bp, Homo sapiens
tgagtgcaacaag

SEQ ID NO: 2077644 - DNA, 15 bp, Homo sapiens
tgagtggcagccatg

SEQ ID NO: 2077645 - DNA, 21 bp, Homo sapiens
tgagtggcttgtgattctggg

SEQ ID NO: 2077646 - DNA, 22 bp, Homo sapiens
tgagttacttgtctgaggcctc

SEQ ID NO: 2077647 - DNA, 14 bp, Homo sapiens
tgagttattttaat

SEQ ID NO: 2077648 - DNA, 20 bp, Homo sapiens
tgagttggacacactgtaaa

SEQ ID NO: 2077649 - DNA, 23 bp, Homo sapiens
tgagttgttttcagactcagact

SEQ ID NO: 2077650 - DNA, 21 bp, Homo sapiens
tgagttgttttggtgcctgcc

SEQ ID NO: 2077651 - DNA, 17 bp, Homo sapiens
tgagtttaagtctctga

SEQ ID NO: 2077652 - DNA, 18 bp, Homo sapiens
tgagttttattgagaatt

SEQ ID NO: 2077653 - DNA, 19 bp, Homo sapiens
tgagtttttatggggctga

SEQ ID NO: 2077654 - DNA, 13 bp, Homo sapiens
tgagtttttgata

SEQ ID NO: 2077655 - DNA, 21 bp, Homo sapiens
tgataaacattaaacactgta

SEQ ID NO: 2077656 - DNA, 19 bp, Homo sapiens
tgataaagattttttaata

SEQ ID NO: 2077657 - DNA, 20 bp, Homo sapiens
tgataaagattttttaataa

SEQ ID NO: 2077658 - DNA, 23 bp, Homo sapiens
tgataacaagcaaggatatcaga

SEQ ID NO: 2077659 - DNA, 19 bp, Homo sapiens
tgataactgcaattttaat

SEQ ID NO: 2077660 - DNA, 12 bp, Homo sapiens
tgataagtggaa

SEQ ID NO: 2077661 - DNA, 23 bp, Homo sapiens
gttatagaatacttttttctagt

SEQ ID NO: 2077662 - DNA, 14 bp, Homo sapiens
gttatatattgtat

SEQ ID NO: 2077663 - DNA, 16 bp, Homo sapiens
gttatatattgtatta

SEQ ID NO: 2077664 - DNA, 23 bp, Homo sapiens
gttatatattgtattaagggcat

SEQ ID NO: 2077665 - DNA, 15 bp, Homo sapiens
gttatatttgctgat

SEQ ID NO: 2077666 - DNA, 13 bp, Homo sapiens
gttatcctgctag

SEQ ID NO: 2077667 - DNA, 16 bp, Homo sapiens
gttatctgcctggcct

SEQ ID NO: 2077668 - DNA, 21 bp, Homo sapiens
gttatctgcctggcctggctc

SEQ ID NO: 2077669 - DNA, 20 bp, Homo sapiens
gttatgagggtcagggcagt

SEQ ID NO: 2077670 - DNA, 18 bp, Homo sapiens
gttatgtatatagatgtg

SEQ ID NO: 2077671 - DNA, 20 bp, Homo sapiens
gttattaacgggcatgtatt

SEQ ID NO: 2077672 - DNA, 13 bp, Homo sapiens
gttattgtgttgc

SEQ ID NO: 2077673 - DNA, 13 bp, Homo sapiens
gttatttaaagaa

SEQ ID NO: 2077674 - DNA, 11 bp, Homo sapiens
gttatttaaat

SEQ ID NO: 2077675 - DNA, 19 bp, Homo sapiens
gttattttaggagacagtc

SEQ ID NO: 2077676 - DNA, 17 bp, Homo sapiens
gttatttttgtccctgc

SEQ ID NO: 2077677 - DNA, 18 bp, Homo sapiens
gttatttttgtccctgct

SEQ ID NO: 2077678 - DNA, 13 bp, Homo sapiens
gttcaagcctgtg

SEQ ID NO: 2077679 - DNA, 18 bp, Homo sapiens
gttcaagcgattcttctg

SEQ ID NO: 2077680 - DNA, 19 bp, Homo sapiens
gttcaagcgattcttctgc

SEQ ID NO: 2077681 - DNA, 18 bp, Homo sapiens
gttcaatgcaaagtaaaa

SEQ ID NO: 2077682 - DNA, 13 bp, Homo sapiens
gttcaccttatgt

SEQ ID NO: 2077683 - DNA, 16 bp, Homo sapiens
gttcaccttatgtatt

SEQ ID NO: 2077684 - DNA, 18 bp, Homo sapiens
gttcaccttatgtattat

SEQ ID NO: 2077685 - DNA, 15 bp, Homo sapiens
gttcactagagctgg

SEQ ID NO: 2077686 - DNA, 17 bp, Homo sapiens
gttcagcccctcctctg

SEQ ID NO: 2077687 - DNA, 18 bp, Homo sapiens
gttcagcccctcctctgc

SEQ ID NO: 2077688 - DNA, 19 bp, Homo sapiens
gttcagcccctcctctgcc

SEQ ID NO: 2077689 - DNA, 20 bp, Homo sapiens
gttcagcccctcctctgcca

SEQ ID NO: 2077690 - DNA, 18 bp, Homo sapiens
gttcagctccagctcacc

SEQ ID NO: 2077691 - DNA, 12 bp, Homo sapiens
gttcaggagctg

SEQ ID NO: 2077692 - DNA, 13 bp, Homo sapiens
gttcaggagctga

SEQ ID NO: 2077693 - DNA, 15 bp, Homo sapiens
gttcaggagtcccaa

SEQ ID NO: 2077694 - DNA, 16 bp, Homo sapiens
gttcagggaagcaggc

SEQ ID NO: 2077695 - DNA, 19 bp, Homo sapiens
gttcagggttggcccctgc

SEQ ID NO: 2077696 - DNA, 17 bp, Homo sapiens
gttcatagggtctcttc

SEQ ID NO: 2077697 - DNA, 18 bp, Homo sapiens
gttcatagggtctcttca

SEQ ID NO: 2077698 - DNA, 17 bp, Homo sapiens
gttcatcgtataacaca

SEQ ID NO: 2077699 - DNA, 12 bp, Homo sapiens
gttcatgagaat

SEQ ID NO: 2077700 - DNA, 22 bp, Homo sapiens
gttcatggcagatgtaggaggg

SEQ ID NO: 2077701 - DNA, 15 bp, Homo sapiens
gttcatgtttgtaaa

SEQ ID NO: 2077702 - DNA, 20 bp, Homo sapiens
gttcattcttaccgagaaaa

SEQ ID NO: 2077703 - DNA, 22 bp, Homo sapiens
gttcattcttaccgagaaaagg

SEQ ID NO: 2077704 - DNA, 17 bp, Homo sapiens
gttcattttagtgactg

SEQ ID NO: 2077705 - DNA, 14 bp, Homo sapiens
gttccaacagacag

SEQ ID NO: 2077706 - DNA, 19 bp, Homo sapiens
gttccacttctctagagaa

SEQ ID NO: 2077707 - DNA, 18 bp, Homo sapiens
gttccagctgcctgggag

SEQ ID NO: 2077708 - DNA, 23 bp, Homo sapiens
gttccaggagcacacggccctgc

SEQ ID NO: 2077709 - DNA, 15 bp, Homo sapiens
gttccatgcctgagg

SEQ ID NO: 2077710 - DNA, 17 bp, Homo sapiens
gttccatgcctgagggt

SEQ ID NO: 2077711 - DNA, 14 bp, Homo sapiens
gttcccaataaaag

SEQ ID NO: 2077712 - DNA, 15 bp, Homo sapiens
gttcccaataaaagt

SEQ ID NO: 2077713 - DNA, 16 bp, Homo sapiens
gttcccaataaaagtg

SEQ ID NO: 2077714 - DNA, 17 bp, Homo sapiens
gttcccctgttcactct

SEQ ID NO: 2077715 - DNA, 17 bp, Homo sapiens
gttccccttggcttcct

SEQ ID NO: 2077716 - DNA, 15 bp, Homo sapiens
gttcccggagcacag

SEQ ID NO: 2077717 - DNA, 19 bp, Homo sapiens
gttcccggagcacagccct

SEQ ID NO: 2077718 - DNA, 21 bp, Homo sapiens
gttcccggagcacagccctgg

SEQ ID NO: 2077719 - DNA, 13 bp, Homo sapiens
gtgtgagtcacca

SEQ ID NO: 2077720 - DNA, 18 bp, Homo sapiens
gtgtgagtcaccaagccc

SEQ ID NO: 2077721 - DNA, 20 bp, Homo sapiens
gtgtgagtcaccaagcccag

SEQ ID NO: 2077722 - DNA, 17 bp, Homo sapiens
gtgtgatgaactttctc

SEQ ID NO: 2077723 - DNA, 22 bp, Homo sapiens
gtgtgatgaactttctcttcat

SEQ ID NO: 2077724 - DNA, 22 bp, Homo sapiens
gtgtgcaccttaccaactttct

SEQ ID NO: 2077725 - DNA, 15 bp, Homo sapiens
gtgtgcatgtatgtg

SEQ ID NO: 2077726 - DNA, 11 bp, Homo sapiens
gtgtgcatgtg

SEQ ID NO: 2077727 - DNA, 14 bp, Homo sapiens
gtgtgcctgcagcc

SEQ ID NO: 2077728 - DNA, 16 bp, Homo sapiens
gtgtgcctgcagcccc

SEQ ID NO: 2077729 - DNA, 18 bp, Homo sapiens
gtgtgcctgcagccccgc

SEQ ID NO: 2077730 - DNA, 15 bp, Homo sapiens
gtgtgcctgccctgg

SEQ ID NO: 2077731 - DNA, 13 bp, Homo sapiens
gtgtgcctgtggc

SEQ ID NO: 2077732 - DNA, 15 bp, Homo sapiens
gtgtgcgtgtgtgca

SEQ ID NO: 2077733 - DNA, 22 bp, Homo sapiens
gtgtgctctgatcatccactgt

SEQ ID NO: 2077734 - DNA, 15 bp, Homo sapiens
gtgtggcctcagccc

SEQ ID NO: 2077735 - DNA, 17 bp, Homo sapiens
gtgtggcctcagccctc

SEQ ID NO: 2077736 - DNA, 14 bp, Homo sapiens
gtgtggctgtattc

SEQ ID NO: 2077737 - DNA, 13 bp, Homo sapiens
gtgtggctgtctg

SEQ ID NO: 2077738 - DNA, 16 bp, Homo sapiens
gtgtgggaaagggacc

SEQ ID NO: 2077739 - DNA, 16 bp, Homo sapiens
gtgtgggaagggagag

SEQ ID NO: 2077740 - DNA, 14 bp, Homo sapiens
gtgtggggaggcag

SEQ ID NO: 2077741 - DNA, 15 bp, Homo sapiens
gtgtggggaggcagc

SEQ ID NO: 2077742 - DNA, 13 bp, Homo sapiens
gtgtggggcatgg

SEQ ID NO: 2077743 - DNA, 18 bp, Homo sapiens
gtgtgggtctggggaggg

SEQ ID NO: 2077744 - DNA, 23 bp, Homo sapiens
gtgtggtgggttctttggaagga

SEQ ID NO: 2077745 - DNA, 23 bp, Homo sapiens
gtgtgtatatatgtgtatatata

SEQ ID NO: 2077746 - DNA, 18 bp, Homo sapiens
gtgtgtatgggtgtgtgt

SEQ ID NO: 2077747 - DNA, 18 bp, Homo sapiens
gtgtgtatgtatgtgtgt

SEQ ID NO: 2077748 - DNA, 20 bp, Homo sapiens
gtgtgtcacactgagctggg

SEQ ID NO: 2077749 - DNA, 13 bp, Homo sapiens
gtgtgtctgaaga

SEQ ID NO: 2077750 - DNA, 22 bp, Homo sapiens
gtgtgtctgttcacttttcctc

SEQ ID NO: 2077751 - DNA, 14 bp, Homo sapiens
gtgtgtcttctatt

SEQ ID NO: 2077752 - DNA, 13 bp, Homo sapiens
gtgtgtgcatgtg

SEQ ID NO: 2077753 - DNA, 21 bp, Homo sapiens
gtgtgtgcgcctacaggagtg

SEQ ID NO: 2077754 - DNA, 18 bp, Homo sapiens
gtgtgtggtgtgtgtgct

SEQ ID NO: 2077755 - DNA, 15 bp, Homo sapiens
gtgtgtgtatatata

SEQ ID NO: 2077756 - DNA, 15 bp, Homo sapiens
gtgtgtgtatgtata

SEQ ID NO: 2077757 - DNA, 12 bp, Homo sapiens
gtgtgtgtgtgt

SEQ ID NO: 2077758 - DNA, 14 bp, Homo sapiens
gtgtgttatttaaa

SEQ ID NO: 2077759 - DNA, 19 bp, Homo sapiens
gtgttaaatgaaattgtaa

SEQ ID NO: 2077760 - DNA, 16 bp, Homo sapiens
gtgttacaaggcactt

SEQ ID NO: 2077761 - DNA, 23 bp, Homo sapiens
gtgttacccagtaactcatctgt

SEQ ID NO: 2077762 - DNA, 16 bp, Homo sapiens
gtgttactaaagtcac

SEQ ID NO: 2077763 - DNA, 21 bp, Homo sapiens
gtgttaggaggctgcatgctc

SEQ ID NO: 2077764 - DNA, 14 bp, Homo sapiens
gtgttagtgtgtgt

SEQ ID NO: 2077765 - DNA, 15 bp, Homo sapiens
gtgttattatttggc

SEQ ID NO: 2077766 - DNA, 14 bp, Homo sapiens
gtgttcaagaaata

SEQ ID NO: 2077767 - DNA, 15 bp, Homo sapiens
gtgttcaagaaataa

SEQ ID NO: 2077768 - DNA, 20 bp, Homo sapiens
gtgttcacactgtaaacatt

SEQ ID NO: 2077769 - DNA, 18 bp, Homo sapiens
gtgttccagctgcctggg

SEQ ID NO: 2077770 - DNA, 19 bp, Homo sapiens
gtgttccccatctgggtcc

SEQ ID NO: 2077771 - DNA, 23 bp, Homo sapiens
gtgttccctgagaaacccaccag

SEQ ID NO: 2077772 - DNA, 14 bp, Homo sapiens
gtgttctgtttccc

SEQ ID NO: 2077773 - DNA, 14 bp, Homo sapiens
gtgttgccatttct

SEQ ID NO: 2077774 - DNA, 19 bp, Homo sapiens
gtgttgccatttctctgct

SEQ ID NO: 2077775 - DNA, 22 bp, Homo sapiens
gtgttgccttagcacttctttc

SEQ ID NO: 2077776 - DNA, 18 bp, Homo sapiens
gtgttgcgtgtcgtgggt

SEQ ID NO: 2077777 - DNA, 17 bp, Homo sapiens
gtgttgtctgtgcagct

SEQ ID NO: 2077778 - DNA, 16 bp, Homo sapiens
gtgtttacaaaaggca

SEQ ID NO: 2077779 - DNA, 15 bp, Homo sapiens
gtgtttagttgcaga

SEQ ID NO: 2077780 - DNA, 14 bp, Homo sapiens
gtgtttcttgcctc

SEQ ID NO: 2077781 - DNA, 15 bp, Homo sapiens
gtgttttaattccaa

SEQ ID NO: 2077782 - DNA, 15 bp, Homo sapiens
gtgtttttaactcaa

SEQ ID NO: 2077783 - DNA, 23 bp, Homo sapiens
gtgttttttcactttagctatgt

SEQ ID NO: 2077784 - DNA, 14 bp, Homo sapiens
gttaaaaaaaagcc

SEQ ID NO: 2077785 - DNA, 13 bp, Homo sapiens
gttaaaagacagt

SEQ ID NO: 2077786 - DNA, 14 bp, Homo sapiens
gttaaaagacagtg

SEQ ID NO: 2077787 - DNA, 21 bp, Homo sapiens
gttaaaataactagtgttgct

SEQ ID NO: 2077788 - DNA, 17 bp, Homo sapiens
gttaaaatataaattaa

SEQ ID NO: 2077789 - DNA, 21 bp, Homo sapiens
gttaaaatataaattaagact

SEQ ID NO: 2077790 - DNA, 15 bp, Homo sapiens
gttaaaattccatcc

SEQ ID NO: 2077791 - DNA, 13 bp, Homo sapiens
gttaaatatttac

SEQ ID NO: 2077792 - DNA, 19 bp, Homo sapiens
gttaacactacttaaaagt

SEQ ID NO: 2077793 - DNA, 23 bp, Homo sapiens
gttaacccatttttgagccaagc

SEQ ID NO: 2077794 - DNA, 17 bp, Homo sapiens
gttaacctcagtgtcat

SEQ ID NO: 2077795 - DNA, 15 bp, Homo sapiens
gttaactctcccagg

SEQ ID NO: 2077796 - DNA, 18 bp, Homo sapiens
gttaagaatggaagaaaa

SEQ ID NO: 2077797 - DNA, 16 bp, Homo sapiens
gttaagacttgacagt

SEQ ID NO: 2077798 - DNA, 14 bp, Homo sapiens
gttaagcaaaggaa

SEQ ID NO: 2077799 - DNA, 18 bp, Homo sapiens
gttaagcagcctttctgt

SEQ ID NO: 2077800 - DNA, 21 bp, Homo sapiens
gttaataataagataatgatg

SEQ ID NO: 2077801 - DNA, 14 bp, Homo sapiens
gttaatcttcatgg

SEQ ID NO: 2077802 - DNA, 18 bp, Homo sapiens
gttaatgatagctactgt

SEQ ID NO: 2077803 - DNA, 15 bp, Homo sapiens
gttaatgctttctga

SEQ ID NO: 2077804 - DNA, 23 bp, Homo sapiens
gttaatgttgggatttatatcta

SEQ ID NO: 2077805 - DNA, 21 bp, Homo sapiens
gttaattaaactgaagaagga

SEQ ID NO: 2077806 - DNA, 21 bp, Homo sapiens
gttaattcagcactgatttca

SEQ ID NO: 2077807 - DNA, 19 bp, Homo sapiens
gttaattgattaaaatctg

SEQ ID NO: 2077808 - DNA, 23 bp, Homo sapiens
gttaatttaaagttgtttgtgcc

SEQ ID NO: 2077809 - DNA, 14 bp, Homo sapiens
gttacagggcccag

SEQ ID NO: 2077810 - DNA, 19 bp, Homo sapiens
gttacagggcccaggtgag

SEQ ID NO: 2077811 - DNA, 16 bp, Homo sapiens
gttacaggtgtactat

SEQ ID NO: 2077812 - DNA, 17 bp, Homo sapiens
gttacatcacagtgttt

SEQ ID NO: 2077813 - DNA, 14 bp, Homo sapiens
gttacattaatgtt

SEQ ID NO: 2077814 - DNA, 13 bp, Homo sapiens
gttaccaaagcaa

SEQ ID NO: 2077815 - DNA, 19 bp, Homo sapiens
gttaccaaagcaatatttc

SEQ ID NO: 2077816 - DNA, 23 bp, Homo sapiens
gttaccattttggggtacccact

SEQ ID NO: 2077817 - DNA, 13 bp, Homo sapiens
gttaccgaggacc

SEQ ID NO: 2077818 - DNA, 17 bp, Homo sapiens
gttacctcctataaact

SEQ ID NO: 2077819 - DNA, 17 bp, Homo sapiens
gttacctttcccatgct

SEQ ID NO: 2077820 - DNA, 17 bp, Homo sapiens
gttactctccaacctgg

SEQ ID NO: 2077821 - DNA, 15 bp, Homo sapiens
gttactgttgcactg

SEQ ID NO: 2077822 - DNA, 17 bp, Homo sapiens
gttacttacctaaacag

SEQ ID NO: 2077823 - DNA, 13 bp, Homo sapiens
gttagccctcagt

SEQ ID NO: 2077824 - DNA, 11 bp, Homo sapiens
gttagctgagc

SEQ ID NO: 2077825 - DNA, 11 bp, Homo sapiens
gttagctggag

SEQ ID NO: 2077826 - DNA, 17 bp, Homo sapiens
gttaggaaataaaacct

SEQ ID NO: 2077827 - DNA, 18 bp, Homo sapiens
gttaggaaataaaacctt

SEQ ID NO: 2077828 - DNA, 20 bp, Homo sapiens
gttaggaggctgcatgctct

SEQ ID NO: 2077829 - DNA, 15 bp, Homo sapiens
gttaggatttaacag

SEQ ID NO: 2077830 - DNA, 16 bp, Homo sapiens
gttaggttataagaaa

SEQ ID NO: 2077831 - DNA, 17 bp, Homo sapiens
gttagtatctaacatgt

SEQ ID NO: 2077832 - DNA, 22 bp, Homo sapiens
gttagtgacaaaattggccaga

SEQ ID NO: 2077833 - DNA, 17 bp, Homo sapiens
gttagtgtgttgtctgt

SEQ ID NO: 2077834 - DNA, 16 bp, Homo sapiens
gttagtttctttggga

SEQ ID NO: 2077835 - DNA, 17 bp, Homo sapiens
gttataaatcaatgtca

SEQ ID NO: 2077836 - DNA, 21 bp, Homo sapiens
gtcctgtagttgcgtggactc

SEQ ID NO: 2077837 - DNA, 23 bp, Homo sapiens
gtcctgtagttgcgtggactctg

SEQ ID NO: 2077838 - DNA, 19 bp, Homo sapiens
gtcctgtcaccctggcccc

SEQ ID NO: 2077839 - DNA, 11 bp, Homo sapiens
gtcctgtccca

SEQ ID NO: 2077840 - DNA, 12 bp, Homo sapiens
gtcctgtcccag

SEQ ID NO: 2077841 - DNA, 14 bp, Homo sapiens
gtcctgtcccagag

SEQ ID NO: 2077842 - DNA, 16 bp, Homo sapiens
gtcctgtcccagaggt

SEQ ID NO: 2077843 - DNA, 19 bp, Homo sapiens
gtcctgtggtgacaggccc

SEQ ID NO: 2077844 - DNA, 15 bp, Homo sapiens
gtccttactcctgtg

SEQ ID NO: 2077845 - DNA, 22 bp, Homo sapiens
gtccttactcctgtgggagcct

SEQ ID NO: 2077846 - DNA, 14 bp, Homo sapiens
gtccttcagagctc

SEQ ID NO: 2077847 - DNA, 17 bp, Homo sapiens
gtccttcctgtgccctg

SEQ ID NO: 2077848 - DNA, 23 bp, Homo sapiens
gtccttcctttaggtctggttgt

SEQ ID NO: 2077849 - DNA, 15 bp, Homo sapiens
gtccttgcacctgca

SEQ ID NO: 2077850 - DNA, 15 bp, Homo sapiens
gtccttggggcacag

SEQ ID NO: 2077851 - DNA, 16 bp, Homo sapiens
gtccttggggcacagt

SEQ ID NO: 2077852 - DNA, 14 bp, Homo sapiens
gtcctttaggcagc

SEQ ID NO: 2077853 - DNA, 15 bp, Homo sapiens
gtcgagtcaaaatgt

SEQ ID NO: 2077854 - DNA, 13 bp, Homo sapiens
gtcgattagactg

SEQ ID NO: 2077855 - DNA, 19 bp, Homo sapiens
gtcgcaggatccgctgcca

SEQ ID NO: 2077856 - DNA, 16 bp, Homo sapiens
gtcgccacacccggct

SEQ ID NO: 2077857 - DNA, 23 bp, Homo sapiens
gtcgccccaggccctccctgact

SEQ ID NO: 2077858 - DNA, 18 bp, Homo sapiens
gtcgggagttcgagacca

SEQ ID NO: 2077859 - DNA, 20 bp, Homo sapiens
gtcgtagccaaggtgggctg

SEQ ID NO: 2077860 - DNA, 22 bp, Homo sapiens
gtcgtggaattaaatcacggat

SEQ ID NO: 2077861 - DNA, 19 bp, Homo sapiens
gtcgtggagagctaggagc

SEQ ID NO: 2077862 - DNA, 15 bp, Homo sapiens
gtcgtggcagataat

SEQ ID NO: 2077863 - DNA, 23 bp, Homo sapiens
gtcgtggcagataatcagcctct

SEQ ID NO: 2077864 - DNA, 14 bp, Homo sapiens
gtcgtgggtgtgtg

SEQ ID NO: 2077865 - DNA, 16 bp, Homo sapiens
gtcgtgtttacaaaag

SEQ ID NO: 2077866 - DNA, 11 bp, Homo sapiens
gtctaaagttt

SEQ ID NO: 2077867 - DNA, 19 bp, Homo sapiens
gtctaatgatattttatgc

SEQ ID NO: 2077868 - DNA, 13 bp, Homo sapiens
gtctaccctggga

SEQ ID NO: 2077869 - DNA, 13 bp, Homo sapiens
gtctagaaaccag

SEQ ID NO: 2077870 - DNA, 19 bp, Homo sapiens
gtctagcagagcaggggca

SEQ ID NO: 2077871 - DNA, 12 bp, Homo sapiens
gtctagggagag

SEQ ID NO: 2077872 - DNA, 22 bp, Homo sapiens
gtctataatggaaacatttaca

SEQ ID NO: 2077873 - DNA, 18 bp, Homo sapiens
gtctatagagaaaaactt

SEQ ID NO: 2077874 - DNA, 22 bp, Homo sapiens
gtctatcaaccccagacactgg

SEQ ID NO: 2077875 - DNA, 14 bp, Homo sapiens
gtctatgggactca

SEQ ID NO: 2077876 - DNA, 22 bp, Homo sapiens
gtctatgggactcaatgcactg

SEQ ID NO: 2077877 - DNA, 17 bp, Homo sapiens
gtctattctgagccttg

SEQ ID NO: 2077878 - DNA, 12 bp, Homo sapiens
gtctatttaagc

SEQ ID NO: 2077879 - DNA, 16 bp, Homo sapiens
gtctatttaagcctca

SEQ ID NO: 2077880 - DNA, 14 bp, Homo sapiens
gtctcaaaaaaaca

SEQ ID NO: 2077881 - DNA, 17 bp, Homo sapiens
gtctcaactactcagct

SEQ ID NO: 2077882 - DNA, 15 bp, Homo sapiens
gtctcaagagggcac

SEQ ID NO: 2077883 - DNA, 12 bp, Homo sapiens
gtctcactatgt

SEQ ID NO: 2077884 - DNA, 18 bp, Homo sapiens
gtctcactatgttgccca

SEQ ID NO: 2077885 - DNA, 21 bp, Homo sapiens
gtctcactatgttgcccaggc

SEQ ID NO: 2077886 - DNA, 22 bp, Homo sapiens
gtctcactatgttgcccaggct

SEQ ID NO: 2077887 - DNA, 19 bp, Homo sapiens
gtctcactctgtcgcccag

SEQ ID NO: 2077888 - DNA, 22 bp, Homo sapiens
gtctcactgttgcccaggctgg

SEQ ID NO: 2077889 - DNA, 23 bp, Homo sapiens
gtctcactgttgcccaggctggc

SEQ ID NO: 2077890 - DNA, 15 bp, Homo sapiens
gtctcagcctcctca

SEQ ID NO: 2077891 - DNA, 20 bp, Homo sapiens
gtctcagcttcatttccgtg

SEQ ID NO: 2077892 - DNA, 15 bp, Homo sapiens
gtctcaggttctgtg

SEQ ID NO: 2077893 - DNA, 19 bp, Homo sapiens
gtctcattctgttgcccag

SEQ ID NO: 2077894 - DNA, 22 bp, Homo sapiens
gtctccactaaatgagctcctg

SEQ ID NO: 2077895 - DNA, 19 bp, Homo sapiens
gtctccagtggttgctgtt

SEQ ID NO: 2077896 - DNA, 20 bp, Homo sapiens
gtctccagtggttgctgttg

SEQ ID NO: 2077897 - DNA, 16 bp, Homo sapiens
gtctccatcaacactg

SEQ ID NO: 2077898 - DNA, 15 bp, Homo sapiens
gtctcccattctcat

SEQ ID NO: 2077899 - DNA, 14 bp, Homo sapiens
gtctccctccagct

SEQ ID NO: 2077900 - DNA, 14 bp, Homo sapiens
gtctccctctcctg

SEQ ID NO: 2077901 - DNA, 18 bp, Homo sapiens
gtctccctctcctgccta

SEQ ID NO: 2077902 - DNA, 21 bp, Homo sapiens
gtctccctctcctgcctactc

SEQ ID NO: 2077903 - DNA, 22 bp, Homo sapiens
gtctccctctcctgcctactca

SEQ ID NO: 2077904 - DNA, 16 bp, Homo sapiens
gtctccgcacttggaa

SEQ ID NO: 2077905 - DNA, 21 bp, Homo sapiens
gtctcctacctgctgctgcta

SEQ ID NO: 2077906 - DNA, 13 bp, Homo sapiens
gtctcctctctga

SEQ ID NO: 2077907 - DNA, 14 bp, Homo sapiens
gtctcctcttaaaa

SEQ ID NO: 2077908 - DNA, 19 bp, Homo sapiens
gtctccttactctgagccc

SEQ ID NO: 2077909 - DNA, 20 bp, Homo sapiens
gtctccttactctgagccca

SEQ ID NO: 2077910 - DNA, 15 bp, Homo sapiens
gtctcgagcgccctg

SEQ ID NO: 2077911 - DNA, 22 bp, Homo sapiens
gtctctaagccaactttaattg

SEQ ID NO: 2077912 - DNA, 16 bp, Homo sapiens
gtctctagccactttg

SEQ ID NO: 2077913 - DNA, 20 bp, Homo sapiens
gtctctagccgggccatgct

SEQ ID NO: 2077914 - DNA, 16 bp, Homo sapiens
gtctctcatgaacctc

SEQ ID NO: 2077915 - DNA, 23 bp, Homo sapiens
gtctctccactgctctcagcctc

SEQ ID NO: 2077916 - DNA, 14 bp, Homo sapiens
gtctctcccacccc

SEQ ID NO: 2077917 - DNA, 15 bp, Homo sapiens
gtctctctctctcta

SEQ ID NO: 2077918 - DNA, 20 bp, Homo sapiens
gtctctcttgctttgttctt

SEQ ID NO: 2077919 - DNA, 12 bp, Homo sapiens
gtctctctttct

SEQ ID NO: 2077920 - DNA, 13 bp, Homo sapiens
gtctctgcatctc

SEQ ID NO: 2077921 - DNA, 17 bp, Homo sapiens
gtctctgctcttgcctg

SEQ ID NO: 2077922 - DNA, 18 bp, Homo sapiens
gtctctgctcttgcctgc

SEQ ID NO: 2077923 - DNA, 21 bp, Homo sapiens
gtctctggcagagaaggatgt

SEQ ID NO: 2077924 - DNA, 17 bp, Homo sapiens
gtctctgtataatctat

SEQ ID NO: 2077925 - DNA, 17 bp, Homo sapiens
gtctctgtccctcactg

SEQ ID NO: 2077926 - DNA, 14 bp, Homo sapiens
gtctctgtgctttg

SEQ ID NO: 2077927 - DNA, 22 bp, Homo sapiens
gtgcatggcttggggagcagag

SEQ ID NO: 2077928 - DNA, 16 bp, Homo sapiens
gtgcatgttgccatga

SEQ ID NO: 2077929 - DNA, 13 bp, Homo sapiens
gtgcatttctgtc

SEQ ID NO: 2077930 - DNA, 18 bp, Homo sapiens
gtgcatttgagagaagcc

SEQ ID NO: 2077931 - DNA, 19 bp, Homo sapiens
gtgcatttgagagaagcca

SEQ ID NO: 2077932 - DNA, 17 bp, Homo sapiens
gtgcattttcccagata

SEQ ID NO: 2077933 - DNA, 20 bp, Homo sapiens
gtgccaagtccaggtcctgg

SEQ ID NO: 2077934 - DNA, 19 bp, Homo sapiens
gtgccaatatgtattgtaa

SEQ ID NO: 2077935 - DNA, 10 bp, Homo sapiens
gtgccacaga

SEQ ID NO: 2077936 - DNA, 14 bp, Homo sapiens
gtgccaccaataaa

SEQ ID NO: 2077937 - DNA, 21 bp, Homo sapiens
gtgccaccaataaaaatccta

SEQ ID NO: 2077938 - DNA, 21 bp, Homo sapiens
gtgccacccgtaggcagcctc

SEQ ID NO: 2077939 - DNA, 22 bp, Homo sapiens
gtgccacttcttaaaggcctgg

SEQ ID NO: 2077940 - DNA, 12 bp, Homo sapiens
gtgccagctcag

SEQ ID NO: 2077941 - DNA, 13 bp, Homo sapiens
gtgccagctcagg

SEQ ID NO: 2077942 - DNA, 19 bp, Homo sapiens
gtgccaggacagctggctg

SEQ ID NO: 2077943 - DNA, 20 bp, Homo sapiens
gtgccaggacagctggctgc

SEQ ID NO: 2077944 - DNA, 22 bp, Homo sapiens
gtgccaggacagctggctgctg

SEQ ID NO: 2077945 - DNA, 23 bp, Homo sapiens
gtgccaggacagctggctgctga

SEQ ID NO: 2077946 - DNA, 17 bp, Homo sapiens
gtgccaggactccccag

SEQ ID NO: 2077947 - DNA, 21 bp, Homo sapiens
gtgccaggactccccaggcca

SEQ ID NO: 2077948 - DNA, 23 bp, Homo sapiens
gtgccaggactccccaggccagg

SEQ ID NO: 2077949 - DNA, 17 bp, Homo sapiens
gtgccaggcccggggct

SEQ ID NO: 2077950 - DNA, 20 bp, Homo sapiens
gtgccagggcaggctacccc

SEQ ID NO: 2077951 - DNA, 22 bp, Homo sapiens
gtgccaggtttttggtctgacc

SEQ ID NO: 2077952 - DNA, 18 bp, Homo sapiens
gtgccagtcttgtgtctg

SEQ ID NO: 2077953 - DNA, 23 bp, Homo sapiens
gtgccatagagtttaacacaagt

SEQ ID NO: 2077954 - DNA, 15 bp, Homo sapiens
gtgccatgtggagtg

SEQ ID NO: 2077955 - DNA, 16 bp, Homo sapiens
gtgccattcccagcgt

SEQ ID NO: 2077956 - DNA, 16 bp, Homo sapiens
gtgccattttaataaa

SEQ ID NO: 2077957 - DNA, 20 bp, Homo sapiens
gtgcccacatcccaggcttc

SEQ ID NO: 2077958 - DNA, 17 bp, Homo sapiens
gtgcccacgtgtgcaga

SEQ ID NO: 2077959 - DNA, 12 bp, Homo sapiens
gtgcccaggaga

SEQ ID NO: 2077960 - DNA, 13 bp, Homo sapiens
gtgccccatgtcc

SEQ ID NO: 2077961 - DNA, 14 bp, Homo sapiens
gtgcccccacccag

SEQ ID NO: 2077962 - DNA, 14 bp, Homo sapiens
gtgcccccatcttt

SEQ ID NO: 2077963 - DNA, 17 bp, Homo sapiens
gtgccccttaagggttg

SEQ ID NO: 2077964 - DNA, 20 bp, Homo sapiens
gtgcccgccctgcccctgcc

SEQ ID NO: 2077965 - DNA, 21 bp, Homo sapiens
gtgccctctgctccccagtgc

SEQ ID NO: 2077966 - DNA, 19 bp, Homo sapiens
gtgccctctggatcctgct

SEQ ID NO: 2077967 - DNA, 19 bp, Homo sapiens
gtgccctgcccccatctcc

SEQ ID NO: 2077968 - DNA, 17 bp, Homo sapiens
gtgcctaatggagaaga

SEQ ID NO: 2077969 - DNA, 16 bp, Homo sapiens
gtgcctatttattcat

SEQ ID NO: 2077970 - DNA, 20 bp, Homo sapiens
gtgcctatttattcattcag

SEQ ID NO: 2077971 - DNA, 16 bp, Homo sapiens
gtgcctatttattggg

SEQ ID NO: 2077972 - DNA, 14 bp, Homo sapiens
gtgcctcctgggac

SEQ ID NO: 2077973 - DNA, 14 bp, Homo sapiens
gtgcctcctgtctt

SEQ ID NO: 2077974 - DNA, 14 bp, Homo sapiens
gtgcctcgaggcac

SEQ ID NO: 2077975 - DNA, 16 bp, Homo sapiens
gtgcctcgaggcaccg

SEQ ID NO: 2077976 - DNA, 19 bp, Homo sapiens
gtgcctcgctccccactct

SEQ ID NO: 2077977 - DNA, 20 bp, Homo sapiens
gtgcctcgctccccactctg

SEQ ID NO: 2077978 - DNA, 15 bp, Homo sapiens
gtgcctctgcctgtc

SEQ ID NO: 2077979 - DNA, 15 bp, Homo sapiens
gtgcctcttgttgca

SEQ ID NO: 2077980 - DNA, 13 bp, Homo sapiens
gtgcctgagctgg

SEQ ID NO: 2077981 - DNA, 15 bp, Homo sapiens
gtgcctgagctgggg

SEQ ID NO: 2077982 - DNA, 17 bp, Homo sapiens
gtgcctgagctggggcc

SEQ ID NO: 2077983 - DNA, 17 bp, Homo sapiens
gtgcctgctagagcaac

SEQ ID NO: 2077984 - DNA, 15 bp, Homo sapiens
gtgcctggcctggca

SEQ ID NO: 2077985 - DNA, 18 bp, Homo sapiens
gtgcctgggtggggctgc

SEQ ID NO: 2077986 - DNA, 20 bp, Homo sapiens
gtgcctgggtggggctgctc

SEQ ID NO: 2077987 - DNA, 21 bp, Homo sapiens
gtgcctgggtggggctgctcc

SEQ ID NO: 2077988 - DNA, 14 bp, Homo sapiens
gtgccttacctcct

SEQ ID NO: 2077989 - DNA, 19 bp, Homo sapiens
gtgccttacctcctgccca

SEQ ID NO: 2077990 - DNA, 20 bp, Homo sapiens
gtgccttacctcctgcccag

SEQ ID NO: 2077991 - DNA, 21 bp, Homo sapiens
gtgccttacctcctgcccagg

SEQ ID NO: 2077992 - DNA, 15 bp, Homo sapiens
gtgccttcagctcta

SEQ ID NO: 2077993 - DNA, 14 bp, Homo sapiens
gtgccttcatttgg

SEQ ID NO: 2077994 - DNA, 15 bp, Homo sapiens
gtgccttccataatt

SEQ ID NO: 2077995 - DNA, 17 bp, Homo sapiens
gtgccttccataattat

SEQ ID NO: 2077996 - DNA, 23 bp, Homo sapiens
gtgccttcttattctcactccac

SEQ ID NO: 2077997 - DNA, 13 bp, Homo sapiens
gtgccttggagca

SEQ ID NO: 2077998 - DNA, 14 bp, Homo sapiens
gtgccttggagcag

SEQ ID NO: 2077999 - DNA, 13 bp, Homo sapiens
gtgcctttctctg

SEQ ID NO: 2078000 - DNA, 22 bp, Homo sapiens
gtgcctttctctggctccagaa

SEQ ID NO: 2078001 - DNA, 23 bp, Homo sapiens
gtgcctttctctggctccagaat

SEQ ID NO: 2078002 - DNA, 20 bp, Homo sapiens
gtgcgacttcacaaaatgca

SEQ ID NO: 2078003 - DNA, 17 bp, Homo sapiens
gtgcgcaacaacaagga

SEQ ID NO: 2078004 - DNA, 20 bp, Homo sapiens
gtgcgctcattttaggcctc

SEQ ID NO: 2078005 - DNA, 13 bp, Homo sapiens
gtgcggcaggagc

SEQ ID NO: 2078006 - DNA, 14 bp, Homo sapiens
gtgcggccaccacc

SEQ ID NO: 2078007 - DNA, 22 bp, Homo sapiens
gtgcgtgttagtgtgtgtgcat

SEQ ID NO: 2078008 - DNA, 20 bp, Homo sapiens
gtgctaagaaagcaagccaa

SEQ ID NO: 2078009 - DNA, 12 bp, Homo sapiens
gtgctacctgca

SEQ ID NO: 2078010 - DNA, 13 bp, Homo sapiens
gtgctatatatat

SEQ ID NO: 2078011 - DNA, 20 bp, Homo sapiens
gtgctatatatataaatatt

SEQ ID NO: 2078012 - DNA, 17 bp, Homo sapiens
gtgctcacgctcccccg

SEQ ID NO: 2078013 - DNA, 14 bp, Homo sapiens
gtgctcctccttgg

SEQ ID NO: 2078014 - DNA, 18 bp, Homo sapiens
gtgctcgcagcctggcgg

SEQ ID NO: 2078015 - DNA, 15 bp, Homo sapiens
gtgctcggcagtcat

SEQ ID NO: 2078016 - DNA, 16 bp, Homo sapiens
gtgctctgatcatcca

SEQ ID NO: 2078017 - DNA, 18 bp, Homo sapiens
gtgctctggacaggcatg

SEQ ID NO: 2078018 - DNA, 11 bp, Homo sapiens
gtgctctggcg

SEQ ID NO: 2078019 - DNA, 14 bp, Homo sapiens
gtgctctggcggct

SEQ ID NO: 2078020 - DNA, 22 bp, Homo sapiens
gtgctctggcggcttcctgtcc

SEQ ID NO: 2078021 - DNA, 23 bp, Homo sapiens
gtgctctggcggcttcctgtcca

SEQ ID NO: 2078022 - DNA, 24 bp, Homo sapiens
gtgctctggcggcttcctgtccac

SEQ ID NO: 2078023 - DNA, 20 bp, Homo sapiens
gtgctgatcgtgctaaattt

SEQ ID NO: 2078024 - DNA, 22 bp, Homo sapiens
gtgctgatcgtgctaaattttc

SEQ ID NO: 2078025 - DNA, 13 bp, Homo sapiens
gtgctgcaaggaa

SEQ ID NO: 2078026 - DNA, 15 bp, Homo sapiens
gtgctgccatccagg

SEQ ID NO: 2078027 - DNA, 17 bp, Homo sapiens
gtgctgccatgccactg

SEQ ID NO: 2078028 - DNA, 18 bp, Homo sapiens
gtgctgcccgtcttcagc

SEQ ID NO: 2078029 - DNA, 12 bp, Homo sapiens
gtgctgccctgc

SEQ ID NO: 2078030 - DNA, 17 bp, Homo sapiens
gtgctgccctgctctgg

SEQ ID NO: 2078031 - DNA, 19 bp, Homo sapiens
gtgctgccctgctctgggg

SEQ ID NO: 2078032 - DNA, 13 bp, Homo sapiens
gtgctggagctgg

SEQ ID NO: 2078033 - DNA, 20 bp, Homo sapiens
gtgctggaggattttccagt

SEQ ID NO: 2078034 - DNA, 18 bp, Homo sapiens
gtgctgtacccttccacc

SEQ ID NO: 2078035 - DNA, 21 bp, Homo sapiens
gtgctgtacccttccacctcc

SEQ ID NO: 2078036 - DNA, 12 bp, Homo sapiens
gtgctgtgcctg

SEQ ID NO: 2078037 - DNA, 13 bp, Homo sapiens
gtgctgtgcctgc

SEQ ID NO: 2078038 - DNA, 15 bp, Homo sapiens
gtgctgtgcctgcta

SEQ ID NO: 2078039 - DNA, 16 bp, Homo sapiens
gtgctgtggccagggt

SEQ ID NO: 2078040 - DNA, 13 bp, Homo sapiens
gtgctgtgggcag

SEQ ID NO: 2078041 - DNA, 15 bp, Homo sapiens
gtgctgtgggcagca

SEQ ID NO: 2078042 - DNA, 19 bp, Homo sapiens
gtgctgtgggcagcaccct

SEQ ID NO: 2078043 - DNA, 20 bp, Homo sapiens
gtgctgtgggcagcaccctc

SEQ ID NO: 2078044 - DNA, 12 bp, Homo sapiens
gtgctgtttgag

SEQ ID NO: 2078045 - DNA, 20 bp, Homo sapiens
gtgctgtttgagatgtgatg

SEQ ID NO: 2078046 - DNA, 22 bp, Homo sapiens
gtgctgtttgagggattttatt

SEQ ID NO: 2078047 - DNA, 14 bp, Homo sapiens
gtgcttagaaagtt

SEQ ID NO: 2078048 - DNA, 21 bp, Homo sapiens
gtgcttatcccatagccagga

SEQ ID NO: 2078049 - DNA, 16 bp, Homo sapiens
gtgcttcaacattctt

SEQ ID NO: 2078050 - DNA, 21 bp, Homo sapiens
gtgcttccctaggctgagctg

SEQ ID NO: 2078051 - DNA, 21 bp, Homo sapiens
gtgcttgccaccaccagatga

SEQ ID NO: 2078052 - DNA, 15 bp, Homo sapiens
gtgctttatttatgg

SEQ ID NO: 2078053 - DNA, 15 bp, Homo sapiens
gtggaaagcctctgc

SEQ ID NO: 2078054 - DNA, 23 bp, Homo sapiens
gtggaaagcctctgctgccatgg

SEQ ID NO: 2078055 - DNA, 20 bp, Homo sapiens
gtggaaatgagcgaaatcat

SEQ ID NO: 2078056 - DNA, 23 bp, Homo sapiens
gtggaactacattagtacacagc

SEQ ID NO: 2078057 - DNA, 14 bp, Homo sapiens
gtggaagagcagcc

SEQ ID NO: 2078058 - DNA, 14 bp, Homo sapiens
gtggaagccctcct

SEQ ID NO: 2078059 - DNA, 14 bp, Homo sapiens
gtggacacagctct

SEQ ID NO: 2078060 - DNA, 18 bp, Homo sapiens
gtggacacagctcttctc

SEQ ID NO: 2078061 - DNA, 22 bp, Homo sapiens
gtggacacagctcttctccagg

SEQ ID NO: 2078062 - DNA, 15 bp, Homo sapiens
gtggacaccaggagt

SEQ ID NO: 2078063 - DNA, 18 bp, Homo sapiens
gtggacacctgccctgcc

SEQ ID NO: 2078064 - DNA, 12 bp, Homo sapiens
gtggacaggact

SEQ ID NO: 2078065 - DNA, 13 bp, Homo sapiens
gtggacagtcctg

SEQ ID NO: 2078066 - DNA, 13 bp, Homo sapiens
gtggaccaggaca

SEQ ID NO: 2078067 - DNA, 14 bp, Homo sapiens
gtggaccaggacag

SEQ ID NO: 2078068 - DNA, 14 bp, Homo sapiens
gtggaccttcctgc

SEQ ID NO: 2078069 - DNA, 14 bp, Homo sapiens
gtggactctgcaca

SEQ ID NO: 2078070 - DNA, 22 bp, Homo sapiens
gtggagagaaagccaaggctgc

SEQ ID NO: 2078071 - DNA, 20 bp, Homo sapiens
gtggagaggggtgcacccac

SEQ ID NO: 2078072 - DNA, 16 bp, Homo sapiens
gtggaggaagatccaa

SEQ ID NO: 2078073 - DNA, 23 bp, Homo sapiens
gtggaggagctcaggacactaat

SEQ ID NO: 2078074 - DNA, 12 bp, Homo sapiens
gtggaggaggag

SEQ ID NO: 2078075 - DNA, 11 bp, Homo sapiens
gtggaggcctg

SEQ ID NO: 2078076 - DNA, 12 bp, Homo sapiens
gtggaggcctga

SEQ ID NO: 2078077 - DNA, 21 bp, Homo sapiens
gtggaggtgaagtccctgttc

SEQ ID NO: 2078078 - DNA, 16 bp, Homo sapiens
gtggaggttgcagtga

SEQ ID NO: 2078079 - DNA, 19 bp, Homo sapiens
gtggaggttgcagtgagct

SEQ ID NO: 2078080 - DNA, 21 bp, Homo sapiens
gtggagtctcattctgttgcc

SEQ ID NO: 2078081 - DNA, 19 bp, Homo sapiens
gtggagttgacatttgaca

SEQ ID NO: 2078082 - DNA, 20 bp, Homo sapiens
gtggagtttgacattgtatg

SEQ ID NO: 2078083 - DNA, 23 bp, Homo sapiens
gtggatctccaaggaccaggtta

SEQ ID NO: 2078084 - DNA, 14 bp, Homo sapiens
gtggatctggggac

SEQ ID NO: 2078085 - DNA, 17 bp, Homo sapiens
gtggatctgtccaagga

SEQ ID NO: 2078086 - DNA, 18 bp, Homo sapiens
gtggatctgtccaaggaa

SEQ ID NO: 2078087 - DNA, 19 bp, Homo sapiens
gtggatgctccagggcagc

SEQ ID NO: 2078088 - DNA, 21 bp, Homo sapiens
gtggatgctccagggcagcct

SEQ ID NO: 2078089 - DNA, 16 bp, Homo sapiens
gtggatggaggagaaa

SEQ ID NO: 2078090 - DNA, 18 bp, Homo sapiens
gtggatggatggacagaa

SEQ ID NO: 2078091 - DNA, 17 bp, Homo sapiens
gtggattatttcatttt

SEQ ID NO: 2078092 - DNA, 18 bp, Homo sapiens
gtggatttcctattttaa

SEQ ID NO: 2078093 - DNA, 19 bp, Homo sapiens
gtggatttcctattttaaa

SEQ ID NO: 2078094 - DNA, 23 bp, Homo sapiens
gtggatttcctattttaaaacca

SEQ ID NO: 2078095 - DNA, 15 bp, Homo sapiens
gtggattttcctgaa

SEQ ID NO: 2078096 - DNA, 16 bp, Homo sapiens
gtggcaaatataaaac

SEQ ID NO: 2078097 - DNA, 13 bp, Homo sapiens
gtggcaagggggc

SEQ ID NO: 2078098 - DNA, 22 bp, Homo sapiens
gtggcacagacttctggaaggc

SEQ ID NO: 2078099 - DNA, 14 bp, Homo sapiens
gtggcacctcctga

SEQ ID NO: 2078100 - DNA, 15 bp, Homo sapiens
gtggcacctcctgag

SEQ ID NO: 2078101 - DNA, 14 bp, Homo sapiens
gtggcagaaaagag

SEQ ID NO: 2078102 - DNA, 24 bp, Homo sapiens
gtggcagaaaagaggagaccctgg

SEQ ID NO: 2078103 - DNA, 20 bp, Homo sapiens
gtggcagataatcagcctct

SEQ ID NO: 2078104 - DNA, 23 bp, Homo sapiens
gtggcagataatcagcctcttaa

SEQ ID NO: 2078105 - DNA, 17 bp, Homo sapiens
gtggcagctgcggtcca

SEQ ID NO: 2078106 - DNA, 14 bp, Homo sapiens
gtggcagctgtccc

SEQ ID NO: 2078107 - DNA, 22 bp, Homo sapiens
gtggcagctgtcccctctccct

SEQ ID NO: 2078108 - DNA, 13 bp, Homo sapiens
gtggcaggaccag

SEQ ID NO: 2078109 - DNA, 15 bp, Homo sapiens
gtggcagtgggagct

SEQ ID NO: 2078110 - DNA, 21 bp, Homo sapiens
gtggcagtgggagctgcctgt

SEQ ID NO: 2078111 - DNA, 18 bp, Homo sapiens
gtggcagttacagggccc

SEQ ID NO: 2078112 - DNA, 22 bp, Homo sapiens
gtggcatcgtagaagagatgtg

SEQ ID NO: 2078113 - DNA, 19 bp, Homo sapiens
gtggccaaattatttgtgt

SEQ ID NO: 2078114 - DNA, 17 bp, Homo sapiens
gtggccaatccaggtgg

SEQ ID NO: 2078115 - DNA, 21 bp, Homo sapiens
gtggccagcgagggcgtgtct

SEQ ID NO: 2078116 - DNA, 16 bp, Homo sapiens
gtggccatccctgggc

SEQ ID NO: 2078117 - DNA, 15 bp, Homo sapiens
gtggccatgcttctt

SEQ ID NO: 2078118 - DNA, 22 bp, Homo sapiens
gtggcccaagcctggtctcctc

SEQ ID NO: 2078119 - DNA, 15 bp, Homo sapiens
gtggccccaggtgcc

SEQ ID NO: 2078120 - DNA, 16 bp, Homo sapiens
gtggccccaggtgcca

SEQ ID NO: 2078121 - DNA, 16 bp, Homo sapiens
gtggccccctgtgcca

SEQ ID NO: 2078122 - DNA, 19 bp, Homo sapiens
gtggccccctgtgccagct

SEQ ID NO: 2078123 - DNA, 16 bp, Homo sapiens
gtggcccgacagcctg

SEQ ID NO: 2078124 - DNA, 19 bp, Homo sapiens
gtggcccgacagcctggca

SEQ ID NO: 2078125 - DNA, 14 bp, Homo sapiens
gtggcccttcctgg

SEQ ID NO: 2078126 - DNA, 21 bp, Homo sapiens
gtggccgcaagcgcagggagg

SEQ ID NO: 2078127 - DNA, 12 bp, Homo sapiens
gtggcctcagcc

SEQ ID NO: 2078128 - DNA, 16 bp, Homo sapiens
gtggcctcagccctca

SEQ ID NO: 2078129 - DNA, 22 bp, Homo sapiens
gtggcctgcggccgggctgccc

SEQ ID NO: 2078130 - DNA, 16 bp, Homo sapiens
gtggcctgtgtccagc

SEQ ID NO: 2078131 - DNA, 17 bp, Homo sapiens
gtggcctgtgtccagca

SEQ ID NO: 2078132 - DNA, 15 bp, Homo sapiens
gtggccttgcccgcc

SEQ ID NO: 2078133 - DNA, 15 bp, Homo sapiens
gtggctactctgtgc

SEQ ID NO: 2078134 - DNA, 16 bp, Homo sapiens
gtggctactctgtgcc

SEQ ID NO: 2078135 - DNA, 23 bp, Homo sapiens
gtggctactctgtgccagagcct

SEQ ID NO: 2078136 - DNA, 17 bp, Homo sapiens
gtggctagtcagagaga

SEQ ID NO: 2078137 - DNA, 19 bp, Homo sapiens
gtggctagtcagagagagt

SEQ ID NO: 2078138 - DNA, 22 bp, Homo sapiens
gtggctcatggcgtaatgggcc

SEQ ID NO: 2078139 - DNA, 11 bp, Homo sapiens
gtggctcctgc

SEQ ID NO: 2078140 - DNA, 13 bp, Homo sapiens
gtggctcctgcca

SEQ ID NO: 2078141 - DNA, 15 bp, Homo sapiens
gtggctcctgccact

SEQ ID NO: 2078142 - DNA, 17 bp, Homo sapiens
gtggctcctgccactga

SEQ ID NO: 2078143 - DNA, 13 bp, Homo sapiens
gtggctcctgcct

SEQ ID NO: 2078144 - DNA, 14 bp, Homo sapiens
gtggctcctgcctt

SEQ ID NO: 2078145 - DNA, 16 bp, Homo sapiens
gtggctcctgccttga

SEQ ID NO: 2078146 - DNA, 20 bp, Homo sapiens
gtggctcttctaacctcagc

SEQ ID NO: 2078147 - DNA, 12 bp, Homo sapiens
gtggctgtggca

SEQ ID NO: 2078148 - DNA, 22 bp, Homo sapiens
gtggcttaaaacaacactcaca

SEQ ID NO: 2078149 - DNA, 15 bp, Homo sapiens
gtggcttacaaattc

SEQ ID NO: 2078150 - DNA, 18 bp, Homo sapiens
gtggcttcccgctcagcc

SEQ ID NO: 2078151 - DNA, 21 bp, Homo sapiens
gtggcttgtgattctgggatg

SEQ ID NO: 2078152 - DNA, 19 bp, Homo sapiens
gtggctttaggagcagtgg

SEQ ID NO: 2078153 - DNA, 14 bp, Homo sapiens
gtgggaactggagg

SEQ ID NO: 2078154 - DNA, 14 bp, Homo sapiens
gtgggaagaaagaa

SEQ ID NO: 2078155 - DNA, 15 bp, Homo sapiens
gtgggaagcttgctg

SEQ ID NO: 2078156 - DNA, 22 bp, Homo sapiens
gtgggaagcttgctggcttctg

SEQ ID NO: 2078157 - DNA, 14 bp, Homo sapiens
gtgggaagggagag

SEQ ID NO: 2078158 - DNA, 16 bp, Homo sapiens
gtgggaagtgaagccc

SEQ ID NO: 2078159 - DNA, 22 bp, Homo sapiens
gtgggacccatagatcttctga

SEQ ID NO: 2078160 - DNA, 13 bp, Homo sapiens
gtgggagcctcgc

SEQ ID NO: 2078161 - DNA, 19 bp, Homo sapiens
gtgggagggagcagacagg

SEQ ID NO: 2078162 - DNA, 14 bp, Homo sapiens
gtgggatggaggag

SEQ ID NO: 2078163 - DNA, 14 bp, Homo sapiens
gtgggcagaggctg

SEQ ID NO: 2078164 - DNA, 17 bp, Homo sapiens
gtgggcagcaccctccc

SEQ ID NO: 2078165 - DNA, 14 bp, Homo sapiens
gtgggcagctgggc

SEQ ID NO: 2078166 - DNA, 16 bp, Homo sapiens
gtgggcagctgggccc

SEQ ID NO: 2078167 - DNA, 13 bp, Homo sapiens
gtgggcagggctg

SEQ ID NO: 2078168 - DNA, 19 bp, Homo sapiens
gtgggccactctcccctcc

SEQ ID NO: 2078169 - DNA, 18 bp, Homo sapiens
gtgggccaggacaggccc

SEQ ID NO: 2078170 - DNA, 16 bp, Homo sapiens
gtgggcctggcctgag

SEQ ID NO: 2078171 - DNA, 17 bp, Homo sapiens
gtgggcctggcctgagc

SEQ ID NO: 2078172 - DNA, 20 bp, Homo sapiens
gtgggcctggcctgagctgg

SEQ ID NO: 2078173 - DNA, 14 bp, Homo sapiens
gtgggctgagccct

SEQ ID NO: 2078174 - DNA, 15 bp, Homo sapiens
gtgggctgagccctg

SEQ ID NO: 2078175 - DNA, 15 bp, Homo sapiens
gtgggctgcatctgg

SEQ ID NO: 2078176 - DNA, 13 bp, Homo sapiens
gtgggctggccca

SEQ ID NO: 2078177 - DNA, 14 bp, Homo sapiens
gtggggagacctgg

SEQ ID NO: 2078178 - DNA, 13 bp, Homo sapiens
gtggggaggcagc

SEQ ID NO: 2078179 - DNA, 22 bp, Homo sapiens
gtggggaggcagctccaacagc

SEQ ID NO: 2078180 - DNA, 13 bp, Homo sapiens
gtggggagggaga

SEQ ID NO: 2078181 - DNA, 19 bp, Homo sapiens
gtggggcaatggggagagg

SEQ ID NO: 2078182 - DNA, 13 bp, Homo sapiens
gtggggcagcttg

SEQ ID NO: 2078183 - DNA, 13 bp, Homo sapiens
gtggggccccaga

SEQ ID NO: 2078184 - DNA, 14 bp, Homo sapiens
gtggggccccagag

SEQ ID NO: 2078185 - DNA, 15 bp, Homo sapiens
gtggggcctagatcc

SEQ ID NO: 2078186 - DNA, 14 bp, Homo sapiens
gtggggctgctcct

SEQ ID NO: 2078187 - DNA, 14 bp, Homo sapiens
gtgggggagggagg

SEQ ID NO: 2078188 - DNA, 14 bp, Homo sapiens
gtgggggcggctgt

SEQ ID NO: 2078189 - DNA, 18 bp, Homo sapiens
gtggggtacatttctctg

SEQ ID NO: 2078190 - DNA, 22 bp, Homo sapiens
gtggggtacatttctctgagca

SEQ ID NO: 2078191 - DNA, 14 bp, Homo sapiens
gtggggtctccctc

SEQ ID NO: 2078192 - DNA, 19 bp, Homo sapiens
gtgggtatttcctgctaca

SEQ ID NO: 2078193 - DNA, 18 bp, Homo sapiens
gtgggtccaggaaggcag

SEQ ID NO: 2078194 - DNA, 17 bp, Homo sapiens
gtgggtggatcacctga

SEQ ID NO: 2078195 - DNA, 17 bp, Homo sapiens
gtgggttatcagttaac

SEQ ID NO: 2078196 - DNA, 16 bp, Homo sapiens
gtgggttttcttccca

SEQ ID NO: 2078197 - DNA, 13 bp, Homo sapiens
gtggtaccagctc

SEQ ID NO: 2078198 - DNA, 14 bp, Homo sapiens
gtggtaccagctca

SEQ ID NO: 2078199 - DNA, 16 bp, Homo sapiens
gtggtaccagctcact

SEQ ID NO: 2078200 - DNA, 15 bp, Homo sapiens
gtggtcctgagacct

SEQ ID NO: 2078201 - DNA, 19 bp, Homo sapiens
gtggtcttcaaattgtctt

SEQ ID NO: 2078202 - DNA, 23 bp, Homo sapiens
gtggtcttcaaattgtcttttgt

SEQ ID NO: 2078203 - DNA, 15 bp, Homo sapiens
gtggtctttgaataa

SEQ ID NO: 2078204 - DNA, 19 bp, Homo sapiens
gtggtctttgaataaagtc

SEQ ID NO: 2078205 - DNA, 15 bp, Homo sapiens
gtggtgaagaaaact

SEQ ID NO: 2078206 - DNA, 14 bp, Homo sapiens
gtggtgacctctgc

SEQ ID NO: 2078207 - DNA, 14 bp, Homo sapiens
gtggtggaggagga

SEQ ID NO: 2078208 - DNA, 15 bp, Homo sapiens
gtggtggaggaggag

SEQ ID NO: 2078209 - DNA, 23 bp, Homo sapiens
gtggtggcatacgcctgtagtcc

SEQ ID NO: 2078210 - DNA, 18 bp, Homo sapiens
gtggtgggacagggaccc

SEQ ID NO: 2078211 - DNA, 14 bp, Homo sapiens
gtggtgtgtgtgct

SEQ ID NO: 2078212 - DNA, 22 bp, Homo sapiens
gtggttgttgccaactaagccc

SEQ ID NO: 2078213 - DNA, 23 bp, Homo sapiens
gtgtaaaacgagaatccacccat

SEQ ID NO: 2078214 - DNA, 17 bp, Homo sapiens
gtgtaacaggtctcctc

SEQ ID NO: 2078215 - DNA, 19 bp, Homo sapiens
gtgtaacaggtctcctctt

SEQ ID NO: 2078216 - DNA, 18 bp, Homo sapiens
gtgtaatgcacaatttag

SEQ ID NO: 2078217 - DNA, 21 bp, Homo sapiens
gtgtaatgcacaatttagaaa

SEQ ID NO: 2078218 - DNA, 18 bp, Homo sapiens
gtgtaattgagaaggaaa

SEQ ID NO: 2078219 - DNA, 11 bp, Homo sapiens
gtgtaattttt

SEQ ID NO: 2078220 - DNA, 18 bp, Homo sapiens
gtgtacagaattctgcta

SEQ ID NO: 2078221 - DNA, 20 bp, Homo sapiens
gtgtaccgcgtctaccctgg

SEQ ID NO: 2078222 - DNA, 22 bp, Homo sapiens
gtgtaccgcgtctaccctggga

SEQ ID NO: 2078223 - DNA, 17 bp, Homo sapiens
gtgtacgtatcatttct

SEQ ID NO: 2078224 - DNA, 19 bp, Homo sapiens
gtgtactccgaaacaagta

SEQ ID NO: 2078225 - DNA, 13 bp, Homo sapiens
gtgtactgataaa

SEQ ID NO: 2078226 - DNA, 14 bp, Homo sapiens
gtgtactgctttca

SEQ ID NO: 2078227 - DNA, 23 bp, Homo sapiens
gtgtagatagttaaaagactgca

SEQ ID NO: 2078228 - DNA, 16 bp, Homo sapiens
gtgtagcaactacagt

SEQ ID NO: 2078229 - DNA, 16 bp, Homo sapiens
gtgtagccttgcccgg

SEQ ID NO: 2078230 - DNA, 17 bp, Homo sapiens
gtgtagccttgcccgga

SEQ ID NO: 2078231 - DNA, 20 bp, Homo sapiens
gtgtagctcctctgctgctc

SEQ ID NO: 2078232 - DNA, 17 bp, Homo sapiens
gtgtagctctgtccact

SEQ ID NO: 2078233 - DNA, 20 bp, Homo sapiens
gtgtagctgtgacctgctga

SEQ ID NO: 2078234 - DNA, 17 bp, Homo sapiens
gtgtataagtgcacaca

SEQ ID NO: 2078235 - DNA, 13 bp, Homo sapiens
gtgtatatataca

SEQ ID NO: 2078236 - DNA, 12 bp, Homo sapiens
gtgtatatatat

SEQ ID NO: 2078237 - DNA, 13 bp, Homo sapiens
gtgtatatcagaa

SEQ ID NO: 2078238 - DNA, 17 bp, Homo sapiens
gtgtatatgtatgtgtg

SEQ ID NO: 2078239 - DNA, 19 bp, Homo sapiens
gtgtatgctactacaaaaa

SEQ ID NO: 2078240 - DNA, 11 bp, Homo sapiens
gtgtatgtgta

SEQ ID NO: 2078241 - DNA, 20 bp, Homo sapiens
gtgtcaagagggtctgagga

SEQ ID NO: 2078242 - DNA, 10 bp, Homo sapiens
gtgtcacagt

SEQ ID NO: 2078243 - DNA, 14 bp, Homo sapiens
gtgtcacctgaaga

SEQ ID NO: 2078244 - DNA, 12 bp, Homo sapiens
gtgtcagcatgc

SEQ ID NO: 2078245 - DNA, 13 bp, Homo sapiens
gtgtccacctggc

SEQ ID NO: 2078246 - DNA, 20 bp, Homo sapiens
gtgtccagaccattgtcttc

SEQ ID NO: 2078247 - DNA, 12 bp, Homo sapiens
gtgtccagcaca

SEQ ID NO: 2078248 - DNA, 17 bp, Homo sapiens
gtgtccagcacagaagg

SEQ ID NO: 2078249 - DNA, 15 bp, Homo sapiens
gtgtccagcagctgc

SEQ ID NO: 2078250 - DNA, 13 bp, Homo sapiens
gtgtcccctcact

SEQ ID NO: 2078251 - DNA, 23 bp, Homo sapiens
gtgtcccctcactctgtcagcca

SEQ ID NO: 2078252 - DNA, 13 bp, Homo sapiens
gtgtccctgcact

SEQ ID NO: 2078253 - DNA, 16 bp, Homo sapiens
gtgtccctgcacttgc

SEQ ID NO: 2078254 - DNA, 23 bp, Homo sapiens
gtgtccctgcacttgcagactct

SEQ ID NO: 2078255 - DNA, 12 bp, Homo sapiens
gtgtcctctccc

SEQ ID NO: 2078256 - DNA, 23 bp, Homo sapiens
gtgtcctctcccctctgccctgt

SEQ ID NO: 2078257 - DNA, 13 bp, Homo sapiens
gtgtcctgccttg

SEQ ID NO: 2078258 - DNA, 14 bp, Homo sapiens
gtgtcctgccttga

SEQ ID NO: 2078259 - DNA, 21 bp, Homo sapiens
gtgtcctgccttgatgaagcc

SEQ ID NO: 2078260 - DNA, 17 bp, Homo sapiens
gtgtccttgcacctgca

SEQ ID NO: 2078261 - DNA, 19 bp, Homo sapiens
gtgtccttgcacctgcatc

SEQ ID NO: 2078262 - DNA, 22 bp, Homo sapiens
gtgtctctggaacccaggacct

SEQ ID NO: 2078263 - DNA, 14 bp, Homo sapiens
gtgtctgcacccag

SEQ ID NO: 2078264 - DNA, 20 bp, Homo sapiens
gtgtctgcattgttattgtg

SEQ ID NO: 2078265 - DNA, 16 bp, Homo sapiens
gtgtctgtctttgtgg

SEQ ID NO: 2078266 - DNA, 12 bp, Homo sapiens
gtgtcttccata

SEQ ID NO: 2078267 - DNA, 15 bp, Homo sapiens
gtgtcttccataatg

SEQ ID NO: 2078268 - DNA, 13 bp, Homo sapiens
gtgtctttatcag

SEQ ID NO: 2078269 - DNA, 18 bp, Homo sapiens
gtgtcttttataaaaagt

SEQ ID NO: 2078270 - DNA, 17 bp, Homo sapiens
gtgtcttttccactcct

SEQ ID NO: 2078271 - DNA, 21 bp, Homo sapiens
gtgtcttttctgtagagcata

SEQ ID NO: 2078272 - DNA, 18 bp, Homo sapiens
gtgtcttttttcactaca

SEQ ID NO: 2078273 - DNA, 18 bp, Homo sapiens
gtgtgaaagtcagatgcc

SEQ ID NO: 2078274 - DNA, 18 bp, Homo sapiens
gtgtgaaggtcttgcctg

SEQ ID NO: 2078275 - DNA, 17 bp, Homo sapiens
gtgtgaagttacacaat

SEQ ID NO: 2078276 - DNA, 23 bp, Homo sapiens
gtgtgactctcttggattattta

SEQ ID NO: 2078277 - DNA, 17 bp, Homo sapiens
gtgtgagcatctctgtg

SEQ ID NO: 2078278 - DNA, 18 bp, Homo sapiens
gtgtgagcatctctgtgt

SEQ ID NO: 2078279 - DNA, 22 bp, Homo sapiens
gggccccaaacgggctgccctg

SEQ ID NO: 2078280 - DNA, 18 bp, Homo sapiens
gggccccagaaggcaggg

SEQ ID NO: 2078281 - DNA, 18 bp, Homo sapiens
gggccccagatctgcctg

SEQ ID NO: 2078282 - DNA, 20 bp, Homo sapiens
gggccccagatctgcctggg

SEQ ID NO: 2078283 - DNA, 23 bp, Homo sapiens
gggccccagatctgcctgggcct

SEQ ID NO: 2078284 - DNA, 12 bp, Homo sapiens
gggccccatgct

SEQ ID NO: 2078285 - DNA, 14 bp, Homo sapiens
gggccccccacacg

SEQ ID NO: 2078286 - DNA, 19 bp, Homo sapiens
gggcccccctccttgctct

SEQ ID NO: 2078287 - DNA, 18 bp, Homo sapiens
gggccccggggctggcaa

SEQ ID NO: 2078288 - DNA, 18 bp, Homo sapiens
gggcccctccacgcctcc

SEQ ID NO: 2078289 - DNA, 14 bp, Homo sapiens
gggctgggcccaca

SEQ ID NO: 2078290 - DNA, 17 bp, Homo sapiens
gggctggggtttattta

SEQ ID NO: 2078291 - DNA, 14 bp, Homo sapiens
gggctgtctgtcac

SEQ ID NO: 2078292 - DNA, 14 bp, Homo sapiens
gggcttcagtggca

SEQ ID NO: 2078293 - DNA, 15 bp, Homo sapiens
gggcttcagtggcag

SEQ ID NO: 2078294 - DNA, 19 bp, Homo sapiens
gggcttcagtggcagctgc

SEQ ID NO: 2078295 - DNA, 20 bp, Homo sapiens
gggcttcagtggcagctgct

SEQ ID NO: 2078296 - DNA, 18 bp, Homo sapiens
gggcttctgtccaaggca

SEQ ID NO: 2078297 - DNA, 16 bp, Homo sapiens
gggcttgcaagaggag

SEQ ID NO: 2078298 - DNA, 18 bp, Homo sapiens
gggcttggacttcctggg

SEQ ID NO: 2078299 - DNA, 21 bp, Homo sapiens
gggcttggacttcctggggcc

SEQ ID NO: 2078300 - DNA, 23 bp, Homo sapiens
gggctttaacaaaacaagaaaga

SEQ ID NO: 2078301 - DNA, 20 bp, Homo sapiens
ggggaacagagcgggcctct

SEQ ID NO: 2078302 - DNA, 20 bp, Homo sapiens
ggggaacccagccctggggt

SEQ ID NO: 2078303 - DNA, 12 bp, Homo sapiens
ggggaacgcaga

SEQ ID NO: 2078304 - DNA, 13 bp, Homo sapiens
ggggaagccctgg

SEQ ID NO: 2078305 - DNA, 23 bp, Homo sapiens
ggggaagtgctccccacacgtgc

SEQ ID NO: 2078306 - DNA, 22 bp, Homo sapiens
ggggaatgtttgcctctgcctc

SEQ ID NO: 2078307 - DNA, 15 bp, Homo sapiens
ggggaattcatctct

SEQ ID NO: 2078308 - DNA, 14 bp, Homo sapiens
ggggacagctcctt

SEQ ID NO: 2078309 - DNA, 17 bp, Homo sapiens
ggggacgcgcacacaca

SEQ ID NO: 2078310 - DNA, 10 bp, Homo sapiens
ggggagaaag

SEQ ID NO: 2078311 - DNA, 19 bp, Homo sapiens
ggggagaaataaattttgt

SEQ ID NO: 2078312 - DNA, 22 bp, Homo sapiens
ggggagcagagtataggatgga

SEQ ID NO: 2078313 - DNA, 11 bp, Homo sapiens
ggggaggaagg

SEQ ID NO: 2078314 - DNA, 12 bp, Homo sapiens
ggggaggaaggg

SEQ ID NO: 2078315 - DNA, 20 bp, Homo sapiens
ggggaggaagggccaggaga

SEQ ID NO: 2078316 - DNA, 16 bp, Homo sapiens
ggggaggaggagctgc

SEQ ID NO: 2078317 - DNA, 20 bp, Homo sapiens
ggggaggcagctccaacagc

SEQ ID NO: 2078318 - DNA, 14 bp, Homo sapiens
ggggagggagagca

SEQ ID NO: 2078319 - DNA, 20 bp, Homo sapiens
ggggaggggcctagggagcc

SEQ ID NO: 2078320 - DNA, 12 bp, Homo sapiens
ggggagggggac

SEQ ID NO: 2078321 - DNA, 18 bp, Homo sapiens
ggggagggtggggcaatg

SEQ ID NO: 2078322 - DNA, 13 bp, Homo sapiens
ggggaggtgcctg

SEQ ID NO: 2078323 - DNA, 15 bp, Homo sapiens
ggggattgggaggga

SEQ ID NO: 2078324 - DNA, 15 bp, Homo sapiens
ggggcacaccactgc

SEQ ID NO: 2078325 - DNA, 18 bp, Homo sapiens
ggggcacaccactgccct

SEQ ID NO: 2078326 - DNA, 19 bp, Homo sapiens
ggggcacaccactgccctg

SEQ ID NO: 2078327 - DNA, 22 bp, Homo sapiens
ggggcacaccactgccctgcct

SEQ ID NO: 2078328 - DNA, 13 bp, Homo sapiens
ggggcacctgcca

SEQ ID NO: 2078329 - DNA, 13 bp, Homo sapiens
ggggcacctggga

SEQ ID NO: 2078330 - DNA, 19 bp, Homo sapiens
ggggcacgcctgcccagcc

SEQ ID NO: 2078331 - DNA, 13 bp, Homo sapiens
ggggcagaacagc

SEQ ID NO: 2078332 - DNA, 22 bp, Homo sapiens
ggggcagagggcagaggctgga

SEQ ID NO: 2078333 - DNA, 20 bp, Homo sapiens
ggggcagaggggcagccgct

SEQ ID NO: 2078334 - DNA, 21 bp, Homo sapiens
ggggcagccaaacccatgagg

SEQ ID NO: 2078335 - DNA, 20 bp, Homo sapiens
ggggcaggagtagctgagct

SEQ ID NO: 2078336 - DNA, 13 bp, Homo sapiens
ggggcaggcctgg

SEQ ID NO: 2078337 - DNA, 18 bp, Homo sapiens
ggggcagtgactggcagg

SEQ ID NO: 2078338 - DNA, 22 bp, Homo sapiens
ggggcatagaaactgaggagta

SEQ ID NO: 2078339 - DNA, 13 bp, Homo sapiens
ggggccagacaca

SEQ ID NO: 2078340 - DNA, 15 bp, Homo sapiens
ggggccagacacaga

SEQ ID NO: 2078341 - DNA, 18 bp, Homo sapiens
ggggccagtgagggctgg

SEQ ID NO: 2078342 - DNA, 22 bp, Homo sapiens
ggggcccacagacagatcccat

SEQ ID NO: 2078343 - DNA, 14 bp, Homo sapiens
ggggccccagatct

SEQ ID NO: 2078344 - DNA, 23 bp, Homo sapiens
ggggccccagatctgcctgggcc

SEQ ID NO: 2078345 - DNA, 18 bp, Homo sapiens
ggggcccttggggcctgg

SEQ ID NO: 2078346 - DNA, 17 bp, Homo sapiens
ggggccgggcaggtcct

SEQ ID NO: 2078347 - DNA, 23 bp, Homo sapiens
ggggccgggcaggtcctgcccat

SEQ ID NO: 2078348 - DNA, 23 bp, Homo sapiens
ggggcctgcccagtgcacttgct

SEQ ID NO: 2078349 - DNA, 12 bp, Homo sapiens
ggggcctggaga

SEQ ID NO: 2078350 - DNA, 13 bp, Homo sapiens
ggggcctggagag

SEQ ID NO: 2078351 - DNA, 22 bp, Homo sapiens
ggggcctggctggctgagggca

SEQ ID NO: 2078352 - DNA, 14 bp, Homo sapiens
ggggcctggcttgc

SEQ ID NO: 2078353 - DNA, 14 bp, Homo sapiens
ggggcctgtactgc

SEQ ID NO: 2078354 - DNA, 21 bp, Homo sapiens
ggggcgctcaggacccaggcc

SEQ ID NO: 2078355 - DNA, 24 bp, Homo sapiens
ggggcgctcaggacccaggccctc

SEQ ID NO: 2078356 - DNA, 15 bp, Homo sapiens
ggggctagcagaagt

SEQ ID NO: 2078357 - DNA, 19 bp, Homo sapiens
ggggctccatggaggaggt

SEQ ID NO: 2078358 - DNA, 22 bp, Homo sapiens
ggggctcctttctccagccagc

SEQ ID NO: 2078359 - DNA, 17 bp, Homo sapiens
ggggctcgccccaccca

SEQ ID NO: 2078360 - DNA, 24 bp, Homo sapiens
ggggctctccaaaggggctgctgg

SEQ ID NO: 2078361 - DNA, 23 bp, Homo sapiens
ggggctgctcatcacccagtcct

SEQ ID NO: 2078362 - DNA, 15 bp, Homo sapiens
ggggctgctggggca

SEQ ID NO: 2078363 - DNA, 18 bp, Homo sapiens
ggggctggcaagcaggga

SEQ ID NO: 2078364 - DNA, 17 bp, Homo sapiens
ggggcttgcaagaggag

SEQ ID NO: 2078365 - DNA, 15 bp, Homo sapiens
ggggctttctggaga

SEQ ID NO: 2078366 - DNA, 16 bp, Homo sapiens
gggggagccaacagca

SEQ ID NO: 2078367 - DNA, 18 bp, Homo sapiens
gggggagccaacagcagc

SEQ ID NO: 2078368 - DNA, 15 bp, Homo sapiens
gggggatgggccagg

SEQ ID NO: 2078369 - DNA, 11 bp, Homo sapiens
gggggcagagg

SEQ ID NO: 2078370 - DNA, 12 bp, Homo sapiens
gggggcagaggg

SEQ ID NO: 2078371 - DNA, 13 bp, Homo sapiens
gggggcagagggc

SEQ ID NO: 2078372 - DNA, 12 bp, Homo sapiens
gggggccgggca

SEQ ID NO: 2078373 - DNA, 23 bp, Homo sapiens
gggggccgggcaggtcctgccca

SEQ ID NO: 2078374 - DNA, 13 bp, Homo sapiens
gggggcctggctg

SEQ ID NO: 2078375 - DNA, 17 bp, Homo sapiens
gggggcctggctggctg

SEQ ID NO: 2078376 - DNA, 12 bp, Homo sapiens
gggggcgctcag

SEQ ID NO: 2078377 - DNA, 20 bp, Homo sapiens
gggggtgatgagggcagcag

SEQ ID NO: 2078378 - DNA, 14 bp, Homo sapiens
gggggtgcggcagg

SEQ ID NO: 2078379 - DNA, 10 bp, Homo sapiens
gggggtggca

SEQ ID NO: 2078380 - DNA, 13 bp, Homo sapiens
gggggttggatgg

SEQ ID NO: 2078381 - DNA, 24 bp, Homo sapiens
gggggtttttactccagtggtgaa

SEQ ID NO: 2078382 - DNA, 22 bp, Homo sapiens
ggggtaaaattccttagcttag

SEQ ID NO: 2078383 - DNA, 15 bp, Homo sapiens
ggggtccatttgggt

SEQ ID NO: 2078384 - DNA, 23 bp, Homo sapiens
ggggtccccatcatcccagctgc

SEQ ID NO: 2078385 - DNA, 20 bp, Homo sapiens
ggggtctccctctcctgcct

SEQ ID NO: 2078386 - DNA, 18 bp, Homo sapiens
ggggtctgtatatacatt

SEQ ID NO: 2078387 - DNA, 15 bp, Homo sapiens
ggggtgcacaggagg

SEQ ID NO: 2078388 - DNA, 22 bp, Homo sapiens
ggggtgcgagagaggtgggcag

SEQ ID NO: 2078389 - DNA, 16 bp, Homo sapiens
ggggtgggcagggctg

SEQ ID NO: 2078390 - DNA, 12 bp, Homo sapiens
ggggtggggcag

SEQ ID NO: 2078391 - DNA, 17 bp, Homo sapiens
ggggtgggggtggggag

SEQ ID NO: 2078392 - DNA, 22 bp, Homo sapiens
ggggtgtctggaagctgagcag

SEQ ID NO: 2078393 - DNA, 17 bp, Homo sapiens
ggggttcagcccctcct

SEQ ID NO: 2078394 - DNA, 22 bp, Homo sapiens
ggggttcagcccctcctctgcc

SEQ ID NO: 2078395 - DNA, 22 bp, Homo sapiens
gggtaaaattccttagcttaga

SEQ ID NO: 2078396 - DNA, 13 bp, Homo sapiens
gggtaaactgtgg

SEQ ID NO: 2078397 - DNA, 17 bp, Homo sapiens
gggtaagccagagcctg

SEQ ID NO: 2078398 - DNA, 18 bp, Homo sapiens
ggtagcccagcactgtga

SEQ ID NO: 2078399 - DNA, 20 bp, Homo sapiens
ggtagcgagctgctctgcta

SEQ ID NO: 2078400 - DNA, 15 bp, Homo sapiens
ggtaggccaagctga

SEQ ID NO: 2078401 - DNA, 16 bp, Homo sapiens
ggtaggccaagctgaa

SEQ ID NO: 2078402 - DNA, 16 bp, Homo sapiens
ggtaggcccttgtcct

SEQ ID NO: 2078403 - DNA, 17 bp, Homo sapiens
ggtaggggagggtgggg

SEQ ID NO: 2078404 - DNA, 23 bp, Homo sapiens
ggtagtactcctgcaaaatttta

SEQ ID NO: 2078405 - DNA, 17 bp, Homo sapiens
ggtataatggttgactg

SEQ ID NO: 2078406 - DNA, 18 bp, Homo sapiens
ggtatatttgtgtatgtg

SEQ ID NO: 2078407 - DNA, 14 bp, Homo sapiens
ggtatcaggtgctg

SEQ ID NO: 2078408 - DNA, 19 bp, Homo sapiens
ggtatcaggtgctgccatc

SEQ ID NO: 2078409 - DNA, 14 bp, Homo sapiens
ggtatctccaggat

SEQ ID NO: 2078410 - DNA, 16 bp, Homo sapiens
ggtatgaacttgagga

SEQ ID NO: 2078411 - DNA, 20 bp, Homo sapiens
ggtatgaacttgaggacaca

SEQ ID NO: 2078412 - DNA, 14 bp, Homo sapiens
ggtatgagctgagg

SEQ ID NO: 2078413 - DNA, 13 bp, Homo sapiens
ggtatgctggcca

SEQ ID NO: 2078414 - DNA, 17 bp, Homo sapiens
ggtatgctggccagcac

SEQ ID NO: 2078415 - DNA, 11 bp, Homo sapiens
ggtattaaact

SEQ ID NO: 2078416 - DNA, 18 bp, Homo sapiens
ggtattccttttgtgtac

SEQ ID NO: 2078417 - DNA, 12 bp, Homo sapiens
ggtcaccaccct

SEQ ID NO: 2078418 - DNA, 21 bp, Homo sapiens
ggtcactcttcctgcaaggac

SEQ ID NO: 2078419 - DNA, 17 bp, Homo sapiens
ggtcactggagtagttg

SEQ ID NO: 2078420 - DNA, 14 bp, Homo sapiens
ggtcactgggttct

SEQ ID NO: 2078421 - DNA, 16 bp, Homo sapiens
ggtcagagcctgcagt

SEQ ID NO: 2078422 - DNA, 13 bp, Homo sapiens
ggtcaggctccat

SEQ ID NO: 2078423 - DNA, 15 bp, Homo sapiens
ggtcagtgtggagag

SEQ ID NO: 2078424 - DNA, 21 bp, Homo sapiens
ggtcatcgattcaaactgctc

SEQ ID NO: 2078425 - DNA, 15 bp, Homo sapiens
ggtcatgtaacaggt

SEQ ID NO: 2078426 - DNA, 13 bp, Homo sapiens
ggtcatgtgtgca

SEQ ID NO: 2078427 - DNA, 15 bp, Homo sapiens
ggtcatgtgtgcatg

SEQ ID NO: 2078428 - DNA, 15 bp, Homo sapiens
ggtcattttctattc

SEQ ID NO: 2078429 - DNA, 16 bp, Homo sapiens
ggtccacccagcaaag

SEQ ID NO: 2078430 - DNA, 16 bp, Homo sapiens
ggtccacccaggagcc

SEQ ID NO: 2078431 - DNA, 12 bp, Homo sapiens
ggtccagctctt

SEQ ID NO: 2078432 - DNA, 21 bp, Homo sapiens
ggtccagctcttggcccctgt

SEQ ID NO: 2078433 - DNA, 13 bp, Homo sapiens
ggtccagggttga

SEQ ID NO: 2078434 - DNA, 13 bp, Homo sapiens
ggtcccacactgg

SEQ ID NO: 2078435 - DNA, 14 bp, Homo sapiens
ggtcccactcagtc

SEQ ID NO: 2078436 - DNA, 16 bp, Homo sapiens
ggtccccacctgggac

SEQ ID NO: 2078437 - DNA, 13 bp, Homo sapiens
ggtccccagctcc

SEQ ID NO: 2078438 - DNA, 14 bp, Homo sapiens
ggtccccagctccc

SEQ ID NO: 2078439 - DNA, 20 bp, Homo sapiens
ggtccccagctccccaggac

SEQ ID NO: 2078440 - DNA, 21 bp, Homo sapiens
ggtccctcctttggaccctgt

SEQ ID NO: 2078441 - DNA, 22 bp, Homo sapiens
ggtccctgataacaacctggag

SEQ ID NO: 2078442 - DNA, 14 bp, Homo sapiens
ggtccgcaccagct

SEQ ID NO: 2078443 - DNA, 16 bp, Homo sapiens
ggtccgcaccagctgc

SEQ ID NO: 2078444 - DNA, 18 bp, Homo sapiens
ggtccgccacgaggagct

SEQ ID NO: 2078445 - DNA, 13 bp, Homo sapiens
ggtcctagcccag

SEQ ID NO: 2078446 - DNA, 14 bp, Homo sapiens
ggtcctcagagaat

SEQ ID NO: 2078447 - DNA, 21 bp, Homo sapiens
ggtcctcagagaatttctacc

SEQ ID NO: 2078448 - DNA, 21 bp, Homo sapiens
ggtcctctgatacccagagca

SEQ ID NO: 2078449 - DNA, 13 bp, Homo sapiens
ggtcctgagacct

SEQ ID NO: 2078450 - DNA, 23 bp, Homo sapiens
ggtcctgagcactgccaggaggg

SEQ ID NO: 2078451 - DNA, 17 bp, Homo sapiens
ggtcctgagggtcccca

SEQ ID NO: 2078452 - DNA, 23 bp, Homo sapiens
ggtcctgagtcttggcctgcctc

SEQ ID NO: 2078453 - DNA, 16 bp, Homo sapiens
ggtcctgagtggctga

SEQ ID NO: 2078454 - DNA, 19 bp, Homo sapiens
ggtcctgcaatctccaggg

SEQ ID NO: 2078455 - DNA, 20 bp, Homo sapiens
ggtcctgcccatgtgtcccc

SEQ ID NO: 2078456 - DNA, 12 bp, Homo sapiens
ggtcctggggcc

SEQ ID NO: 2078457 - DNA, 14 bp, Homo sapiens
ggtcctggggcctc

SEQ ID NO: 2078458 - DNA, 22 bp, Homo sapiens
ggtcctggggctctgtgcaggg

SEQ ID NO: 2078459 - DNA, 16 bp, Homo sapiens
ggtcctgtcaccctgg

SEQ ID NO: 2078460 - DNA, 20 bp, Homo sapiens
ggtcctgtcaccctggcccc

SEQ ID NO: 2078461 - DNA, 21 bp, Homo sapiens
ggtccttcaagttagctcagg

SEQ ID NO: 2078462 - DNA, 16 bp, Homo sapiens
ggtccttccaggcccc

SEQ ID NO: 2078463 - DNA, 15 bp, Homo sapiens
ggtccttgctgcagg

SEQ ID NO: 2078464 - DNA, 20 bp, Homo sapiens
ggtccttggtgtgaccctct

SEQ ID NO: 2078465 - DNA, 13 bp, Homo sapiens
ggtcgccacaccc

SEQ ID NO: 2078466 - DNA, 16 bp, Homo sapiens
ggtcgccacacccggc

SEQ ID NO: 2078467 - DNA, 12 bp, Homo sapiens
ggtcgcccagga

SEQ ID NO: 2078468 - DNA, 14 bp, Homo sapiens
ggtcgcccaggaga

SEQ ID NO: 2078469 - DNA, 18 bp, Homo sapiens
ggtcgccctaccctcact

SEQ ID NO: 2078470 - DNA, 19 bp, Homo sapiens
ggtcggcaagagtgagact

SEQ ID NO: 2078471 - DNA, 23 bp, Homo sapiens
ggtcggtttggtttgttgtaaat

SEQ ID NO: 2078472 - DNA, 23 bp, Homo sapiens
ggtctcactctgtcgcccagtct

SEQ ID NO: 2078473 - DNA, 20 bp, Homo sapiens
ggtctcacttataccaaagg

SEQ ID NO: 2078474 - DNA, 22 bp, Homo sapiens
ggtctcagcttcatttccgtga

SEQ ID NO: 2078475 - DNA, 15 bp, Homo sapiens
ggtctcaggttcttt

SEQ ID NO: 2078476 - DNA, 17 bp, Homo sapiens
ggtctccctctcctgcc

SEQ ID NO: 2078477 - DNA, 18 bp, Homo sapiens
ggtctccctctcctgcct

SEQ ID NO: 2078478 - DNA, 19 bp, Homo sapiens
ggtctccctctcctgccta

SEQ ID NO: 2078479 - DNA, 17 bp, Homo sapiens
ggtctctggcagagaag

SEQ ID NO: 2078480 - DNA, 22 bp, Homo sapiens
ggtctgaaggaatagccagaga

SEQ ID NO: 2078481 - DNA, 16 bp, Homo sapiens
ggtctgacccactgct

SEQ ID NO: 2078482 - DNA, 17 bp, Homo sapiens
ggtctgagcaccccctc

SEQ ID NO: 2078483 - DNA, 18 bp, Homo sapiens
ggtctgagcaccccctca

SEQ ID NO: 2078484 - DNA, 15 bp, Homo sapiens
ggtctgagccacagc

SEQ ID NO: 2078485 - DNA, 16 bp, Homo sapiens
ggtctgagccctggtg

SEQ ID NO: 2078486 - DNA, 12 bp, Homo sapiens
ggtctgccctgg

SEQ ID NO: 2078487 - DNA, 13 bp, Homo sapiens
ggtctgccctggg

SEQ ID NO: 2078488 - DNA, 22 bp, Homo sapiens
ggtctggagaagcagtgagccg

SEQ ID NO: 2078489 - DNA, 11 bp, Homo sapiens
ggtctggggag

SEQ ID NO: 2078490 - DNA, 24 bp, Homo sapiens
ggtctggttgttgcaccatctgct

SEQ ID NO: 2078491 - DNA, 15 bp, Homo sapiens
ggtctgtcccaccag

SEQ ID NO: 2078492 - DNA, 20 bp, Homo sapiens
ggtctgtgctgtgcctgcta

SEQ ID NO: 2078493 - DNA, 14 bp, Homo sapiens
ggtcttcagccatc

SEQ ID NO: 2078494 - DNA, 18 bp, Homo sapiens
ggtcttggccgactcagg

SEQ ID NO: 2078495 - DNA, 21 bp, Homo sapiens
ggtcttgggctactggcagct

SEQ ID NO: 2078496 - DNA, 15 bp, Homo sapiens
ggtctttgaataaag

SEQ ID NO: 2078497 - DNA, 18 bp, Homo sapiens
ggtctttgaataaagtct

SEQ ID NO: 2078498 - DNA, 19 bp, Homo sapiens
ggtctttgaataaagtctg

SEQ ID NO: 2078499 - DNA, 20 bp, Homo sapiens
ggtctttgaataaagtctga

SEQ ID NO: 2078500 - DNA, 10 bp, Homo sapiens
ggtgaaatta

SEQ ID NO: 2078501 - DNA, 16 bp, Homo sapiens
ggtgaagaaaactcct

SEQ ID NO: 2078502 - DNA, 14 bp, Homo sapiens
ggtgaagtccctgt

SEQ ID NO: 2078503 - DNA, 19 bp, Homo sapiens
ggtgaatgtgtgaaggtct

SEQ ID NO: 2078504 - DNA, 15 bp, Homo sapiens
ggtgacagtggagga

SEQ ID NO: 2078505 - DNA, 17 bp, Homo sapiens
ggtgaccccagggcaca

SEQ ID NO: 2078506 - DNA, 23 bp, Homo sapiens
ggtgaccccagggcacaggagct

SEQ ID NO: 2078507 - DNA, 14 bp, Homo sapiens
ggtgacctctgcct

SEQ ID NO: 2078508 - DNA, 21 bp, Homo sapiens
ggtgacctctgcctgaagtca

SEQ ID NO: 2078509 - DNA, 15 bp, Homo sapiens
ggtgactgaacgagg

SEQ ID NO: 2078510 - DNA, 13 bp, Homo sapiens
ggtgagaaattta

SEQ ID NO: 2078511 - DNA, 15 bp, Homo sapiens
ggtgagaccacctct

SEQ ID NO: 2078512 - DNA, 14 bp, Homo sapiens
ggtgataagtggaa

SEQ ID NO: 2078513 - DNA, 18 bp, Homo sapiens
ggtgataagtggaaaaaa

SEQ ID NO: 2078514 - DNA, 21 bp, Homo sapiens
ggttatattttactactgtgg

SEQ ID NO: 2078515 - DNA, 18 bp, Homo sapiens
ggttatctgcctggcctg

SEQ ID NO: 2078516 - DNA, 21 bp, Homo sapiens
ggttatctgcctggcctggct

SEQ ID NO: 2078517 - DNA, 20 bp, Homo sapiens
ggttattgaaaatatgatgt

SEQ ID NO: 2078518 - DNA, 22 bp, Homo sapiens
ggttcaagcgattcttctgctt

SEQ ID NO: 2078519 - DNA, 18 bp, Homo sapiens
ggttcaattccctgaagg

SEQ ID NO: 2078520 - DNA, 18 bp, Homo sapiens
ggttcactagagctggga

SEQ ID NO: 2078521 - DNA, 16 bp, Homo sapiens
ggttcagagactcagg

SEQ ID NO: 2078522 - DNA, 19 bp, Homo sapiens
ggttcagcccctcctctgc

SEQ ID NO: 2078523 - DNA, 18 bp, Homo sapiens
ggttcagggttggcccct

SEQ ID NO: 2078524 - DNA, 23 bp, Homo sapiens
ggttccaagaaagatccaccctc

SEQ ID NO: 2078525 - DNA, 13 bp, Homo sapiens
ggttccatgcctg

SEQ ID NO: 2078526 - DNA, 16 bp, Homo sapiens
ggttccatgcctgagg

SEQ ID NO: 2078527 - DNA, 18 bp, Homo sapiens
ggttcccaataaaagtga

SEQ ID NO: 2078528 - DNA, 13 bp, Homo sapiens
ggttcccagcagc

SEQ ID NO: 2078529 - DNA, 15 bp, Homo sapiens
ggttcccagcagctg

SEQ ID NO: 2078530 - DNA, 23 bp, Homo sapiens
ggttcccattttcgctttcctct

SEQ ID NO: 2078531 - DNA, 16 bp, Homo sapiens
ggttccctctgagaat

SEQ ID NO: 2078532 - DNA, 16 bp, Homo sapiens
ggttcctaagcctgtt

SEQ ID NO: 2078533 - DNA, 22 bp, Homo sapiens
ggttcctcgcaggtctcagccc

SEQ ID NO: 2078534 - DNA, 15 bp, Homo sapiens
ggttccttccctggg

SEQ ID NO: 2078535 - DNA, 23 bp, Homo sapiens
ggttctagtctcctttgcactga

SEQ ID NO: 2078536 - DNA, 17 bp, Homo sapiens
ggttctctccaggaagg

SEQ ID NO: 2078537 - DNA, 16 bp, Homo sapiens
ggttcttagtgtcact

SEQ ID NO: 2078538 - DNA, 16 bp, Homo sapiens
ggttcttgatgtcatg

SEQ ID NO: 2078539 - DNA, 15 bp, Homo sapiens
ggttctttggaagga

SEQ ID NO: 2078540 - DNA, 18 bp, Homo sapiens
ggttgaggggctcctgga

SEQ ID NO: 2078541 - DNA, 19 bp, Homo sapiens
ggttgaggtggaagccctc

SEQ ID NO: 2078542 - DNA, 14 bp, Homo sapiens
ggttgatcacactc

SEQ ID NO: 2078543 - DNA, 13 bp, Homo sapiens
ggttgcagggagc

SEQ ID NO: 2078544 - DNA, 11 bp, Homo sapiens
ggttgcagtga

SEQ ID NO: 2078545 - DNA, 14 bp, Homo sapiens
ggttgccaggacga

SEQ ID NO: 2078546 - DNA, 22 bp, Homo sapiens
ggttgctgttgatgaggcctct

SEQ ID NO: 2078547 - DNA, 21 bp, Homo sapiens
ggttgcttatttccctcatct

SEQ ID NO: 2078548 - DNA, 21 bp, Homo sapiens
ggttggccgtggtccagctct

SEQ ID NO: 2078549 - DNA, 23 bp, Homo sapiens
ggttggccgtggtccagctcttg

SEQ ID NO: 2078550 - DNA, 14 bp, Homo sapiens
ggttgggctggtgt

SEQ ID NO: 2078551 - DNA, 14 bp, Homo sapiens
ggttggtgggctgg

SEQ ID NO: 2078552 - DNA, 13 bp, Homo sapiens
ggttgtcaatatt

SEQ ID NO: 2078553 - DNA, 13 bp, Homo sapiens
ggttgtgaggcct

SEQ ID NO: 2078554 - DNA, 19 bp, Homo sapiens
ggtttaatgttttggccaa

SEQ ID NO: 2078555 - DNA, 14 bp, Homo sapiens
ggtttacatgaaca

SEQ ID NO: 2078556 - DNA, 15 bp, Homo sapiens
ggtttacccagtggg

SEQ ID NO: 2078557 - DNA, 18 bp, Homo sapiens
ggtttactgctgtcattg

SEQ ID NO: 2078558 - DNA, 14 bp, Homo sapiens
ggtttccaggaaga

SEQ ID NO: 2078559 - DNA, 21 bp, Homo sapiens
ggtttctcagaatccaaagat

SEQ ID NO: 2078560 - DNA, 13 bp, Homo sapiens
ggtttctgaaaat

SEQ ID NO: 2078561 - DNA, 23 bp, Homo sapiens
ggtttctgacccaagaggtgggg

SEQ ID NO: 2078562 - DNA, 18 bp, Homo sapiens
ggtttgaatataaacact

SEQ ID NO: 2078563 - DNA, 14 bp, Homo sapiens
ggtttgcaaggaag

SEQ ID NO: 2078564 - DNA, 13 bp, Homo sapiens
ggtttgccagtga

SEQ ID NO: 2078565 - DNA, 20 bp, Homo sapiens
ggtttgccagtgaagacttc

SEQ ID NO: 2078566 - DNA, 17 bp, Homo sapiens
ggtttggggagaaataa

SEQ ID NO: 2078567 - DNA, 13 bp, Homo sapiens
ggtttggggctgc

SEQ ID NO: 2078568 - DNA, 13 bp, Homo sapiens
ggtttgtatattg

SEQ ID NO: 2078569 - DNA, 22 bp, Homo sapiens
ggttttattctgacttcctctg

SEQ ID NO: 2078570 - DNA, 21 bp, Homo sapiens
ggttttctaactgtaaatcac

SEQ ID NO: 2078571 - DNA, 22 bp, Homo sapiens
ggttttctaactgtaaatcact

SEQ ID NO: 2078572 - DNA, 11 bp, Homo sapiens
ggttttgtaca

SEQ ID NO: 2078573 - DNA, 16 bp, Homo sapiens
ggtttttggctctttc

SEQ ID NO: 2078574 - DNA, 21 bp, Homo sapiens
gtaaaaagattatatatcata

SEQ ID NO: 2078575 - DNA, 15 bp, Homo sapiens
gtaaaaatgatttca

SEQ ID NO: 2078576 - DNA, 11 bp, Homo sapiens
gtaaaacattt

SEQ ID NO: 2078577 - DNA, 20 bp, Homo sapiens
gtaaaacatttattttgaca

SEQ ID NO: 2078578 - DNA, 15 bp, Homo sapiens
gtaaaaccacagcag

SEQ ID NO: 2078579 - DNA, 16 bp, Homo sapiens
gtaaaaccacagcagt

SEQ ID NO: 2078580 - DNA, 21 bp, Homo sapiens
gtaaaactacacatccctaat

SEQ ID NO: 2078581 - DNA, 17 bp, Homo sapiens
gtaaaagataacaagat

SEQ ID NO: 2078582 - DNA, 14 bp, Homo sapiens
gtaaaataaaatta

SEQ ID NO: 2078583 - DNA, 11 bp, Homo sapiens
gtaaaatgcag

SEQ ID NO: 2078584 - DNA, 19 bp, Homo sapiens
gtaaaatgcagtccagaat

SEQ ID NO: 2078585 - DNA, 18 bp, Homo sapiens
gtaaaatttgtttagaag

SEQ ID NO: 2078586 - DNA, 16 bp, Homo sapiens
gtaaacaaaaatttca

SEQ ID NO: 2078587 - DNA, 11 bp, Homo sapiens
gtaaacagaag

SEQ ID NO: 2078588 - DNA, 14 bp, Homo sapiens
gtaaacagtgcctg

SEQ ID NO: 2078589 - DNA, 20 bp, Homo sapiens
gtaaacagtgcctgctgaat

SEQ ID NO: 2078590 - DNA, 21 bp, Homo sapiens
gtaaacatagatagtgcttta

SEQ ID NO: 2078591 - DNA, 22 bp, Homo sapiens
gtaaacatgtgttttaattcca

SEQ ID NO: 2078592 - DNA, 22 bp, Homo sapiens
gtaaactatcttggtgaatttt

SEQ ID NO: 2078593 - DNA, 21 bp, Homo sapiens
gtaaactcaaaacttaacata

SEQ ID NO: 2078594 - DNA, 21 bp, Homo sapiens
gtaaactgtatcaaatctgta

SEQ ID NO: 2078595 - DNA, 16 bp, Homo sapiens
gtaaagaataaatgaa

SEQ ID NO: 2078596 - DNA, 18 bp, Homo sapiens
gtaaagaataaatgaatc

SEQ ID NO: 2078597 - DNA, 11 bp, Homo sapiens
gtaaagagtgg

SEQ ID NO: 2078598 - DNA, 19 bp, Homo sapiens
gtaaagatgtcaataggaa

SEQ ID NO: 2078599 - DNA, 18 bp, Homo sapiens
gtaaagtgataatttctg

SEQ ID NO: 2078600 - DNA, 23 bp, Homo sapiens
gtaaagtgataatttctggaatt

SEQ ID NO: 2078601 - DNA, 16 bp, Homo sapiens
gtaaagtttaaaaaat

SEQ ID NO: 2078602 - DNA, 15 bp, Homo sapiens
gtaaagtttatttca

SEQ ID NO: 2078603 - DNA, 20 bp, Homo sapiens
gtaaatacaaaataaaatta

SEQ ID NO: 2078604 - DNA, 21 bp, Homo sapiens
gtaaatacaaaataaaattat

SEQ ID NO: 2078605 - DNA, 16 bp, Homo sapiens
gtaaatacatgtgtgg

SEQ ID NO: 2078606 - DNA, 22 bp, Homo sapiens
gtaaatacatgtgtggatgtgt

SEQ ID NO: 2078607 - DNA, 14 bp, Homo sapiens
gtaaatagttttaa

SEQ ID NO: 2078608 - DNA, 19 bp, Homo sapiens
gtaaatagttttaaatatg

SEQ ID NO: 2078609 - DNA, 21 bp, Homo sapiens
gtaaatagttttaaatatgaa

SEQ ID NO: 2078610 - DNA, 23 bp, Homo sapiens
gtaaatatgactcctttctctat

SEQ ID NO: 2078611 - DNA, 14 bp, Homo sapiens
gtaaatattttaaa

SEQ ID NO: 2078612 - DNA, 18 bp, Homo sapiens
gtaaatcacttgtaaata

SEQ ID NO: 2078613 - DNA, 21 bp, Homo sapiens
gtaaatcacttgtaaataaat

SEQ ID NO: 2078614 - DNA, 24 bp, Homo sapiens
gtaaatcacttgtaaataaataga

SEQ ID NO: 2078615 - DNA, 16 bp, Homo sapiens
gtaaatccacagccaa

SEQ ID NO: 2078616 - DNA, 22 bp, Homo sapiens
gtaaatccttatttatatatca

SEQ ID NO: 2078617 - DNA, 16 bp, Homo sapiens
gtaaatcctttttctt

SEQ ID NO: 2078618 - DNA, 16 bp, Homo sapiens
gtaaatgaccaagaaa

SEQ ID NO: 2078619 - DNA, 22 bp, Homo sapiens
gtaaatggagcttgtacatatt

SEQ ID NO: 2078620 - DNA, 17 bp, Homo sapiens
gtaaatgggcagtgcct

SEQ ID NO: 2078621 - DNA, 12 bp, Homo sapiens
gtaaatgtattt

SEQ ID NO: 2078622 - DNA, 13 bp, Homo sapiens
gtaaattggaaac

SEQ ID NO: 2078623 - DNA, 15 bp, Homo sapiens
gtaaattggaaacat

SEQ ID NO: 2078624 - DNA, 22 bp, Homo sapiens
gtaaatttaaagaagtcataaa

SEQ ID NO: 2078625 - DNA, 19 bp, Homo sapiens
gtaaatttagcatatcaat

SEQ ID NO: 2078626 - DNA, 17 bp, Homo sapiens
gtaccccatcccttcct

SEQ ID NO: 2078627 - DNA, 19 bp, Homo sapiens
gtacccccgtggtctttga

SEQ ID NO: 2078628 - DNA, 18 bp, Homo sapiens
gtaccgcgtctaccctgg

SEQ ID NO: 2078629 - DNA, 16 bp, Homo sapiens
gtacctatggctgcct

SEQ ID NO: 2078630 - DNA, 16 bp, Homo sapiens
gtacctatgtgacaga

SEQ ID NO: 2078631 - DNA, 17 bp, Homo sapiens
gtacctcagtttctcct

SEQ ID NO: 2078632 - DNA, 21 bp, Homo sapiens
gtacctgggaaaggacccacc

SEQ ID NO: 2078633 - DNA, 21 bp, Homo sapiens
gtaccttcagaataagcttcc

SEQ ID NO: 2078634 - DNA, 18 bp, Homo sapiens
gtcaacggccctgtttat

SEQ ID NO: 2078635 - DNA, 19 bp, Homo sapiens
gtcaacggccctgtttata

SEQ ID NO: 2078636 - DNA, 20 bp, Homo sapiens
gtcaactggagcaagaagga

SEQ ID NO: 2078637 - DNA, 15 bp, Homo sapiens
gtcaactggctggcc

SEQ ID NO: 2078638 - DNA, 18 bp, Homo sapiens
gtcaagagggtctgagga

SEQ ID NO: 2078639 - DNA, 16 bp, Homo sapiens
gtcaagtataaagtca

SEQ ID NO: 2078640 - DNA, 14 bp, Homo sapiens
gtcaatattaaata

SEQ ID NO: 2078641 - DNA, 22 bp, Homo sapiens
gtcaatattaaatacagacact

SEQ ID NO: 2078642 - DNA, 21 bp, Homo sapiens
gtcaatgaaatatttgcttat

SEQ ID NO: 2078643 - DNA, 22 bp, Homo sapiens
gtcaatgaaatatttgcttatt

SEQ ID NO: 2078644 - DNA, 22 bp, Homo sapiens
gtcaatttccctgactcctcta

SEQ ID NO: 2078645 - DNA, 16 bp, Homo sapiens
gtcacacagacacaca

SEQ ID NO: 2078646 - DNA, 14 bp, Homo sapiens
gtcacacagggcag

SEQ ID NO: 2078647 - DNA, 17 bp, Homo sapiens
gtccatggcaccagccc

SEQ ID NO: 2078648 - DNA, 23 bp, Homo sapiens
gtccatgtattcacacacccctc

SEQ ID NO: 2078649 - DNA, 15 bp, Homo sapiens
gtcccaacttgtaaa

SEQ ID NO: 2078650 - DNA, 23 bp, Homo sapiens
gtcccaaggaaagccccagcact

SEQ ID NO: 2078651 - DNA, 15 bp, Homo sapiens
gtcccaaggagctga

SEQ ID NO: 2078652 - DNA, 17 bp, Homo sapiens
gtcccacatccctgggc

SEQ ID NO: 2078653 - DNA, 22 bp, Homo sapiens
gtcccacatccctgggcctgct

SEQ ID NO: 2078654 - DNA, 22 bp, Homo sapiens
gtcccaccaactctgcactcca

SEQ ID NO: 2078655 - DNA, 23 bp, Homo sapiens
gtcccaccaactctgcactccat

SEQ ID NO: 2078656 - DNA, 13 bp, Homo sapiens
gtcccacctcttc

SEQ ID NO: 2078657 - DNA, 19 bp, Homo sapiens
gtcccacctcttctcttcc

SEQ ID NO: 2078658 - DNA, 23 bp, Homo sapiens
gtcccacctcttctcttcctgta

SEQ ID NO: 2078659 - DNA, 19 bp, Homo sapiens
gtcccaccttggctgcagg

SEQ ID NO: 2078660 - DNA, 20 bp, Homo sapiens
gtcccaccttggctgcaggg

SEQ ID NO: 2078661 - DNA, 20 bp, Homo sapiens
gtcccacgaatttgctgggg

SEQ ID NO: 2078662 - DNA, 14 bp, Homo sapiens
gtcccactcagtcc

SEQ ID NO: 2078663 - DNA, 22 bp, Homo sapiens
gtcccagaaaaagcatcatggc

SEQ ID NO: 2078664 - DNA, 18 bp, Homo sapiens
gtcccagaaccacactgt

SEQ ID NO: 2078665 - DNA, 19 bp, Homo sapiens
gtcccagaaccacactgtt

SEQ ID NO: 2078666 - DNA, 21 bp, Homo sapiens
gtcccagaggttatctgcctg

SEQ ID NO: 2078667 - DNA, 24 bp, Homo sapiens
gtcccagaggttatctgcctggcc

SEQ ID NO: 2078668 - DNA, 14 bp, Homo sapiens
gtcccatctgctcc

SEQ ID NO: 2078669 - DNA, 14 bp, Homo sapiens
gtcccatttccttg

SEQ ID NO: 2078670 - DNA, 17 bp, Homo sapiens
gtcccatttccttggag

SEQ ID NO: 2078671 - DNA, 20 bp, Homo sapiens
gtcccatttccttggaggcc

SEQ ID NO: 2078672 - DNA, 14 bp, Homo sapiens
gtccccacctggga

SEQ ID NO: 2078673 - DNA, 14 bp, Homo sapiens
gtccccagcccttc

SEQ ID NO: 2078674 - DNA, 14 bp, Homo sapiens
gtccccagctcccc

SEQ ID NO: 2078675 - DNA, 19 bp, Homo sapiens
gtccccagtttgcagaaaa

SEQ ID NO: 2078676 - DNA, 15 bp, Homo sapiens
gtccccatcatccca

SEQ ID NO: 2078677 - DNA, 22 bp, Homo sapiens
gtcccccaaggttttggagtca

SEQ ID NO: 2078678 - DNA, 15 bp, Homo sapiens
gtcccccctcactcc

SEQ ID NO: 2078679 - DNA, 21 bp, Homo sapiens
gtcccccttggaggagggctg

SEQ ID NO: 2078680 - DNA, 15 bp, Homo sapiens
gtccccgtgccccgc

SEQ ID NO: 2078681 - DNA, 22 bp, Homo sapiens
gtccccgtgccccgcctccccg

SEQ ID NO: 2078682 - DNA, 15 bp, Homo sapiens
gtcccctcactctgt

SEQ ID NO: 2078683 - DNA, 17 bp, Homo sapiens
gtcccctctcccctcat

SEQ ID NO: 2078684 - DNA, 12 bp, Homo sapiens
gtcccctgtccc

SEQ ID NO: 2078685 - DNA, 21 bp, Homo sapiens
gtcccgtgcagcttctgtcct

SEQ ID NO: 2078686 - DNA, 15 bp, Homo sapiens
gtccctaaagaaaaa

SEQ ID NO: 2078687 - DNA, 16 bp, Homo sapiens
gtccctacacccctcc

SEQ ID NO: 2078688 - DNA, 23 bp, Homo sapiens
gtccctacccactctttgctaca

SEQ ID NO: 2078689 - DNA, 21 bp, Homo sapiens
gtccctaccgagtctcttctc

SEQ ID NO: 2078690 - DNA, 23 bp, Homo sapiens
gtccctaccgagtctcttctcca

SEQ ID NO: 2078691 - DNA, 16 bp, Homo sapiens
gtccctcactgccttc

SEQ ID NO: 2078692 - DNA, 21 bp, Homo sapiens
gtccctcccatctctacccca

SEQ ID NO: 2078693 - DNA, 16 bp, Homo sapiens
gtccctcggagctgcc

SEQ ID NO: 2078694 - DNA, 22 bp, Homo sapiens
gtccctcggagctgccagccgg

SEQ ID NO: 2078695 - DNA, 15 bp, Homo sapiens
gtccctcgtccacag

SEQ ID NO: 2078696 - DNA, 20 bp, Homo sapiens
gtccctctttgcctgtgtga

SEQ ID NO: 2078697 - DNA, 20 bp, Homo sapiens
gtccctgactctctgtgacc

SEQ ID NO: 2078698 - DNA, 17 bp, Homo sapiens
gtccctgccacactcag

SEQ ID NO: 2078699 - DNA, 16 bp, Homo sapiens
gtccctgctcctccca

SEQ ID NO: 2078700 - DNA, 15 bp, Homo sapiens
gtccctggtaataag

SEQ ID NO: 2078701 - DNA, 22 bp, Homo sapiens
gtccctggtccctcgtccacag

SEQ ID NO: 2078702 - DNA, 16 bp, Homo sapiens
gtccctgttctcagct

SEQ ID NO: 2078703 - DNA, 18 bp, Homo sapiens
gtccctgtttcaaactga

SEQ ID NO: 2078704 - DNA, 17 bp, Homo sapiens
gtcccttgagacctcag

SEQ ID NO: 2078705 - DNA, 18 bp, Homo sapiens
gtcccttgctgacatggc

SEQ ID NO: 2078706 - DNA, 23 bp, Homo sapiens
gtcccttggaaagttcagccaga

SEQ ID NO: 2078707 - DNA, 20 bp, Homo sapiens
gtccgaaaccagttaagaat

SEQ ID NO: 2078708 - DNA, 21 bp, Homo sapiens
gtccgaaagggacttggaagc

SEQ ID NO: 2078709 - DNA, 22 bp, Homo sapiens
gtccgcaagttcagggaagcag

SEQ ID NO: 2078710 - DNA, 15 bp, Homo sapiens
gtccgcaccagctgc

SEQ ID NO: 2078711 - DNA, 19 bp, Homo sapiens
gtccgcaccagctgctctg

SEQ ID NO: 2078712 - DNA, 20 bp, Homo sapiens
gtccgcaccagctgctctgc

SEQ ID NO: 2078713 - DNA, 14 bp, Homo sapiens
gtccgtttactcca

SEQ ID NO: 2078714 - DNA, 19 bp, Homo sapiens
gtcctagagctcctgtccc

SEQ ID NO: 2078715 - DNA, 19 bp, Homo sapiens
gtcctagccactcaggagg

SEQ ID NO: 2078716 - DNA, 16 bp, Homo sapiens
gtcctatcgactttat

SEQ ID NO: 2078717 - DNA, 13 bp, Homo sapiens
gtcctatgtgtga

SEQ ID NO: 2078718 - DNA, 22 bp, Homo sapiens
gtcctccaacaataaagagctc

SEQ ID NO: 2078719 - DNA, 15 bp, Homo sapiens
gtcctccagcttccc

SEQ ID NO: 2078720 - DNA, 19 bp, Homo sapiens
gtcctccatttcaactcca

SEQ ID NO: 2078721 - DNA, 16 bp, Homo sapiens
gtcctcccatcccctg

SEQ ID NO: 2078722 - DNA, 18 bp, Homo sapiens
gtcctcccatcccctgga

SEQ ID NO: 2078723 - DNA, 20 bp, Homo sapiens
gtcctcccatcccctggact

SEQ ID NO: 2078724 - DNA, 17 bp, Homo sapiens
gtcctccccctgccagt

SEQ ID NO: 2078725 - DNA, 19 bp, Homo sapiens
gtcctccccctgccagtgc

SEQ ID NO: 2078726 - DNA, 13 bp, Homo sapiens
gtcctcccgggag

SEQ ID NO: 2078727 - DNA, 17 bp, Homo sapiens
gtcctcgtagccatctc

SEQ ID NO: 2078728 - DNA, 13 bp, Homo sapiens
gtcctctcccctc

SEQ ID NO: 2078729 - DNA, 21 bp, Homo sapiens
gtcctctcccctctgccctgt

SEQ ID NO: 2078730 - DNA, 23 bp, Homo sapiens
gtcctctcccgcgggcctggaca

SEQ ID NO: 2078731 - DNA, 16 bp, Homo sapiens
gtcctctcgagcccag

SEQ ID NO: 2078732 - DNA, 20 bp, Homo sapiens
gtcctctcttctctattcct

SEQ ID NO: 2078733 - DNA, 20 bp, Homo sapiens
gtcctctttacatgaaacta

SEQ ID NO: 2078734 - DNA, 14 bp, Homo sapiens
gtcctcttttctga

SEQ ID NO: 2078735 - DNA, 15 bp, Homo sapiens
gtcctgacgccctgc

SEQ ID NO: 2078736 - DNA, 17 bp, Homo sapiens
gtcctgacgccctgcgt

SEQ ID NO: 2078737 - DNA, 20 bp, Homo sapiens
gtcctgagcactgccaggag

SEQ ID NO: 2078738 - DNA, 21 bp, Homo sapiens
gtcctgagcactgccaggagg

SEQ ID NO: 2078739 - DNA, 22 bp, Homo sapiens
gtcctgagcactgccaggaggg

SEQ ID NO: 2078740 - DNA, 18 bp, Homo sapiens
gtcctgagggtccccacc

SEQ ID NO: 2078741 - DNA, 21 bp, Homo sapiens
gtcctgagggtccccacctgg

SEQ ID NO: 2078742 - DNA, 21 bp, Homo sapiens
gctcctaaacccccgctccag

SEQ ID NO: 2078743 - DNA, 14 bp, Homo sapiens
gctcctcacatagc

SEQ ID NO: 2078744 - DNA, 11 bp, Homo sapiens
gctcctccagg

SEQ ID NO: 2078745 - DNA, 15 bp, Homo sapiens
gctcctccagggcca

SEQ ID NO: 2078746 - DNA, 17 bp, Homo sapiens
gctcctcccctcttgag

SEQ ID NO: 2078747 - DNA, 13 bp, Homo sapiens
gctcctctccagg

SEQ ID NO: 2078748 - DNA, 16 bp, Homo sapiens
gctcctctccaggcac

SEQ ID NO: 2078749 - DNA, 15 bp, Homo sapiens
gctcctctccccagc

SEQ ID NO: 2078750 - DNA, 19 bp, Homo sapiens
gctcctctccccagcaagt

SEQ ID NO: 2078751 - DNA, 14 bp, Homo sapiens
gctcctctgctgct

SEQ ID NO: 2078752 - DNA, 16 bp, Homo sapiens
gctcctctgctgctcc

SEQ ID NO: 2078753 - DNA, 17 bp, Homo sapiens
gctcctctgctgctccc

SEQ ID NO: 2078754 - DNA, 13 bp, Homo sapiens
gctcctctgtctc

SEQ ID NO: 2078755 - DNA, 20 bp, Homo sapiens
gctcctcttaccgtagcctc

SEQ ID NO: 2078756 - DNA, 13 bp, Homo sapiens
gctcctgccactg

SEQ ID NO: 2078757 - DNA, 14 bp, Homo sapiens
gctcctgccactga

SEQ ID NO: 2078758 - DNA, 18 bp, Homo sapiens
gctcctggaaaggctcag

SEQ ID NO: 2078759 - DNA, 22 bp, Homo sapiens
gctcctggaaaggctcagtctc

SEQ ID NO: 2078760 - DNA, 12 bp, Homo sapiens
gctcctggctgc

SEQ ID NO: 2078761 - DNA, 23 bp, Homo sapiens
gctcctgggggttctttcttcct

SEQ ID NO: 2078762 - DNA, 13 bp, Homo sapiens
gctcctgtcccta

SEQ ID NO: 2078763 - DNA, 22 bp, Homo sapiens
gctcctgtcctcccatcccctg

SEQ ID NO: 2078764 - DNA, 20 bp, Homo sapiens
gctcctgtctgccagccagc

SEQ ID NO: 2078765 - DNA, 21 bp, Homo sapiens
gctcctgtgctactttgcctt

SEQ ID NO: 2078766 - DNA, 15 bp, Homo sapiens
gctccttctgtccta

SEQ ID NO: 2078767 - DNA, 15 bp, Homo sapiens
gctccttgactcctt

SEQ ID NO: 2078768 - DNA, 18 bp, Homo sapiens
gctccttgggtcctgcaa

SEQ ID NO: 2078769 - DNA, 17 bp, Homo sapiens
gctcctttctccagcca

SEQ ID NO: 2078770 - DNA, 14 bp, Homo sapiens
gctccttttgtccc

SEQ ID NO: 2078771 - DNA, 22 bp, Homo sapiens
gctccttttgtccccagggccc

SEQ ID NO: 2078772 - DNA, 23 bp, Homo sapiens
gctcgcagcctggcggggcagga

SEQ ID NO: 2078773 - DNA, 13 bp, Homo sapiens
gctcgccccaccc

SEQ ID NO: 2078774 - DNA, 15 bp, Homo sapiens
gctcgccccacccag

SEQ ID NO: 2078775 - DNA, 18 bp, Homo sapiens
gctcggtggacccaggga

SEQ ID NO: 2078776 - DNA, 19 bp, Homo sapiens
gctcgtccccaagtgacct

SEQ ID NO: 2078777 - DNA, 22 bp, Homo sapiens
gctctacagctaatcagcattc

SEQ ID NO: 2078778 - DNA, 15 bp, Homo sapiens
gctctacttcttttt

SEQ ID NO: 2078779 - DNA, 18 bp, Homo sapiens
gctctagccaggagtctg

SEQ ID NO: 2078780 - DNA, 21 bp, Homo sapiens
gctctagcctgggcaacaaca

SEQ ID NO: 2078781 - DNA, 13 bp, Homo sapiens
gctctagctggca

SEQ ID NO: 2078782 - DNA, 16 bp, Homo sapiens
gctctagctggcagga

SEQ ID NO: 2078783 - DNA, 19 bp, Homo sapiens
gctctagttttcagccttg

SEQ ID NO: 2078784 - DNA, 11 bp, Homo sapiens
gctctcagaag

SEQ ID NO: 2078785 - DNA, 12 bp, Homo sapiens
gctctcagcctc

SEQ ID NO: 2078786 - DNA, 13 bp, Homo sapiens
gctctcagcctcc

SEQ ID NO: 2078787 - DNA, 17 bp, Homo sapiens
gctctcagcctcccaac

SEQ ID NO: 2078788 - DNA, 23 bp, Homo sapiens
gctctcagcctcccaaccccagg

SEQ ID NO: 2078789 - DNA, 19 bp, Homo sapiens
gctctcaggggccagtgag

SEQ ID NO: 2078790 - DNA, 20 bp, Homo sapiens
gctctcaggggccagtgagg

SEQ ID NO: 2078791 - DNA, 12 bp, Homo sapiens
gctctcatgcct

SEQ ID NO: 2078792 - DNA, 14 bp, Homo sapiens
gctctccacctcag

SEQ ID NO: 2078793 - DNA, 15 bp, Homo sapiens
gctctccacctcagc

SEQ ID NO: 2078794 - DNA, 17 bp, Homo sapiens
gctctccacctcagcct

SEQ ID NO: 2078795 - DNA, 13 bp, Homo sapiens
gctctccaccttg

SEQ ID NO: 2078796 - DNA, 15 bp, Homo sapiens
gctctccctctggcc

SEQ ID NO: 2078797 - DNA, 17 bp, Homo sapiens
gctctccctctggccct

SEQ ID NO: 2078798 - DNA, 23 bp, Homo sapiens
gctctccctctggccctgccttc

SEQ ID NO: 2078799 - DNA, 19 bp, Homo sapiens
gctctcctcagaagaaaga

SEQ ID NO: 2078800 - DNA, 15 bp, Homo sapiens
gctctcctcttgcca

SEQ ID NO: 2078801 - DNA, 22 bp, Homo sapiens
gctctcctgagaggtgctgcag

SEQ ID NO: 2078802 - DNA, 20 bp, Homo sapiens
gctctcctgcctacatccca

SEQ ID NO: 2078803 - DNA, 12 bp, Homo sapiens
gctctcctgggg

SEQ ID NO: 2078804 - DNA, 23 bp, Homo sapiens
gctctctctacccggcccagaga

SEQ ID NO: 2078805 - DNA, 13 bp, Homo sapiens
gctctctgcagcc

SEQ ID NO: 2078806 - DNA, 11 bp, Homo sapiens
gctctctgtat

SEQ ID NO: 2078807 - DNA, 12 bp, Homo sapiens
gctctcttcagg

SEQ ID NO: 2078808 - DNA, 16 bp, Homo sapiens
gctctcttcaggaggc

SEQ ID NO: 2078809 - DNA, 13 bp, Homo sapiens
gctctgaaatctt

SEQ ID NO: 2078810 - DNA, 22 bp, Homo sapiens
gctctgaagtcacatcacagga

SEQ ID NO: 2078811 - DNA, 17 bp, Homo sapiens
gctctgaatattttgta

SEQ ID NO: 2078812 - DNA, 15 bp, Homo sapiens
gctctgaatctgata

SEQ ID NO: 2078813 - DNA, 23 bp, Homo sapiens
gctctgaatctgataggaaaaga

SEQ ID NO: 2078814 - DNA, 16 bp, Homo sapiens
gctctgacagccctgc

SEQ ID NO: 2078815 - DNA, 10 bp, Homo sapiens
gctctgaggc

SEQ ID NO: 2078816 - DNA, 23 bp, Homo sapiens
gctctgaggcgccccaacccgtg

SEQ ID NO: 2078817 - DNA, 17 bp, Homo sapiens
gctctgatcatccactg

SEQ ID NO: 2078818 - DNA, 20 bp, Homo sapiens
gctctgatcatccactgtgc

SEQ ID NO: 2078819 - DNA, 22 bp, Homo sapiens
gctctgatcatccactgtgcca

SEQ ID NO: 2078820 - DNA, 23 bp, Homo sapiens
gctctgcaatgggcactgggatg

SEQ ID NO: 2078821 - DNA, 15 bp, Homo sapiens
gctctgcaggcacct

SEQ ID NO: 2078822 - DNA, 16 bp, Homo sapiens
gctctgcccactgtga

SEQ ID NO: 2078823 - DNA, 18 bp, Homo sapiens
gctctgccccaagccccc

SEQ ID NO: 2078824 - DNA, 15 bp, Homo sapiens
gctctgccccagctc

SEQ ID NO: 2078825 - DNA, 22 bp, Homo sapiens
gctctgccccttgggcatccac

SEQ ID NO: 2078826 - DNA, 17 bp, Homo sapiens
gctctgccctccctggc

SEQ ID NO: 2078827 - DNA, 23 bp, Homo sapiens
gctctgcctccctctccatatct

SEQ ID NO: 2078828 - DNA, 23 bp, Homo sapiens
gctctgcctggaggatccctcca

SEQ ID NO: 2078829 - DNA, 19 bp, Homo sapiens
gctctgctcctctccccag

SEQ ID NO: 2078830 - DNA, 18 bp, Homo sapiens
gctctgctgacagacaca

SEQ ID NO: 2078831 - DNA, 19 bp, Homo sapiens
gctctgctgacagacacag

SEQ ID NO: 2078832 - DNA, 20 bp, Homo sapiens
gctctgctgacagacacagg

SEQ ID NO: 2078833 - DNA, 23 bp, Homo sapiens
gctctgctgacagacacaggccc

SEQ ID NO: 2078834 - DNA, 17 bp, Homo sapiens
gctctgctggcctggcc

SEQ ID NO: 2078835 - DNA, 14 bp, Homo sapiens
gctctggaagagag

SEQ ID NO: 2078836 - DNA, 21 bp, Homo sapiens
gctctggacaggcatgttctc

SEQ ID NO: 2078837 - DNA, 11 bp, Homo sapiens
gctctggacca

SEQ ID NO: 2078838 - DNA, 12 bp, Homo sapiens
gctctggccacc

SEQ ID NO: 2078839 - DNA, 18 bp, Homo sapiens
gctctggccaccctggcc

SEQ ID NO: 2078840 - DNA, 21 bp, Homo sapiens
gctctggccaccctggcccgc

SEQ ID NO: 2078841 - DNA, 15 bp, Homo sapiens
gctctggccccaggc

SEQ ID NO: 2078842 - DNA, 17 bp, Homo sapiens
gctctggcggcttcctg

SEQ ID NO: 2078843 - DNA, 23 bp, Homo sapiens
ggccttacctcccctgccagggc

SEQ ID NO: 2078844 - DNA, 21 bp, Homo sapiens
ggccttccccttttgcctggc

SEQ ID NO: 2078845 - DNA, 15 bp, Homo sapiens
ggccttccctcccca

SEQ ID NO: 2078846 - DNA, 12 bp, Homo sapiens
ggccttctctga

SEQ ID NO: 2078847 - DNA, 20 bp, Homo sapiens
ggccttgtcaggacccaggc

SEQ ID NO: 2078848 - DNA, 13 bp, Homo sapiens
ggccttgttctgt

SEQ ID NO: 2078849 - DNA, 13 bp, Homo sapiens
ggcctttcctgtg

SEQ ID NO: 2078850 - DNA, 19 bp, Homo sapiens
ggcgacctgcacgcactgc

SEQ ID NO: 2078851 - DNA, 15 bp, Homo sapiens
ggcgagtgccaggac

SEQ ID NO: 2078852 - DNA, 14 bp, Homo sapiens
ggcgcaagcctgta

SEQ ID NO: 2078853 - DNA, 21 bp, Homo sapiens
ggcgcacctatcacccaggct

SEQ ID NO: 2078854 - DNA, 11 bp, Homo sapiens
ggcgcaggagg

SEQ ID NO: 2078855 - DNA, 15 bp, Homo sapiens
ggcgccaactgctga

SEQ ID NO: 2078856 - DNA, 20 bp, Homo sapiens
ggcgcccattcgtctgtccc

SEQ ID NO: 2078857 - DNA, 16 bp, Homo sapiens
ggcgccccaacccgtg

SEQ ID NO: 2078858 - DNA, 23 bp, Homo sapiens
ggcgccccaacccgtggaggctg

SEQ ID NO: 2078859 - DNA, 16 bp, Homo sapiens
ggcgcgggaggcacca

SEQ ID NO: 2078860 - DNA, 18 bp, Homo sapiens
ggcgcgggaggcaccagc

SEQ ID NO: 2078861 - DNA, 19 bp, Homo sapiens
ggcgcgggaggcaccagct

SEQ ID NO: 2078862 - DNA, 11 bp, Homo sapiens
ggcgctcagga

SEQ ID NO: 2078863 - DNA, 18 bp, Homo sapiens
ggcgctcaggacccaggc

SEQ ID NO: 2078864 - DNA, 21 bp, Homo sapiens
ggcgctcaggacccaggccct

SEQ ID NO: 2078865 - DNA, 17 bp, Homo sapiens
ggcgctgtggctcctgc

SEQ ID NO: 2078866 - DNA, 18 bp, Homo sapiens
ggcgctgtggctcctgcc

SEQ ID NO: 2078867 - DNA, 19 bp, Homo sapiens
ggcggaaaccttgcagcat

SEQ ID NO: 2078868 - DNA, 15 bp, Homo sapiens
ggcggaaggggacgc

SEQ ID NO: 2078869 - DNA, 21 bp, Homo sapiens
ggcggagagtacagtgagcca

SEQ ID NO: 2078870 - DNA, 11 bp, Homo sapiens
ggcggaggcgg

SEQ ID NO: 2078871 - DNA, 18 bp, Homo sapiens
ggcggcacattggcagtg

SEQ ID NO: 2078872 - DNA, 18 bp, Homo sapiens
ggcggcagggtgggggag

SEQ ID NO: 2078873 - DNA, 14 bp, Homo sapiens
ggcggcgcagaggg

SEQ ID NO: 2078874 - DNA, 16 bp, Homo sapiens
ggcggcgcagagggaa

SEQ ID NO: 2078875 - DNA, 20 bp, Homo sapiens
ggcggctactcagcagccct

SEQ ID NO: 2078876 - DNA, 22 bp, Homo sapiens
ggcggctactcagcagccctcc

SEQ ID NO: 2078877 - DNA, 21 bp, Homo sapiens
ggcggcttcctgtccactctc

SEQ ID NO: 2078878 - DNA, 16 bp, Homo sapiens
ggcgggagatggaccc

SEQ ID NO: 2078879 - DNA, 12 bp, Homo sapiens
ggcggggcagga

SEQ ID NO: 2078880 - DNA, 13 bp, Homo sapiens
ggcggggcaggag

SEQ ID NO: 2078881 - DNA, 22 bp, Homo sapiens
ggcggggcaggaggcctggcct

SEQ ID NO: 2078882 - DNA, 14 bp, Homo sapiens
ggcgggggagccaa

SEQ ID NO: 2078883 - DNA, 18 bp, Homo sapiens
ggcgggggagccaacagc

SEQ ID NO: 2078884 - DNA, 18 bp, Homo sapiens
ggcggtcatgtgtgcatg

SEQ ID NO: 2078885 - DNA, 17 bp, Homo sapiens
ggcggtttccaggaaga

SEQ ID NO: 2078886 - DNA, 15 bp, Homo sapiens
ggcgtaatgggcctg

SEQ ID NO: 2078887 - DNA, 17 bp, Homo sapiens
ggcgtgactcacccaag

SEQ ID NO: 2078888 - DNA, 16 bp, Homo sapiens
ggcgtggtggcgggca

SEQ ID NO: 2078889 - DNA, 14 bp, Homo sapiens
ggcgttctgctgcc

SEQ ID NO: 2078890 - DNA, 16 bp, Homo sapiens
ggcgttgcaggccagg

SEQ ID NO: 2078891 - DNA, 19 bp, Homo sapiens
ggctaagagctagcgctgc

SEQ ID NO: 2078892 - DNA, 20 bp, Homo sapiens
ggctaagagctagcgctgcc

SEQ ID NO: 2078893 - DNA, 20 bp, Homo sapiens
ggctaagtgatcctcccacc

SEQ ID NO: 2078894 - DNA, 19 bp, Homo sapiens
ggctaccccccctcctgct

SEQ ID NO: 2078895 - DNA, 15 bp, Homo sapiens
ggctactcagcagcc

SEQ ID NO: 2078896 - DNA, 20 bp, Homo sapiens
ggctactcagcagccctcct

SEQ ID NO: 2078897 - DNA, 21 bp, Homo sapiens
ggctactcagcagccctcctc

SEQ ID NO: 2078898 - DNA, 15 bp, Homo sapiens
ggctactctgtgcca

SEQ ID NO: 2078899 - DNA, 22 bp, Homo sapiens
ggctactctgtgccagagcctg

SEQ ID NO: 2078900 - DNA, 13 bp, Homo sapiens
ggctactggcagc

SEQ ID NO: 2078901 - DNA, 17 bp, Homo sapiens
ggctactggcagctcct

SEQ ID NO: 2078902 - DNA, 18 bp, Homo sapiens
ggctacttcggggctggg

SEQ ID NO: 2078903 - DNA, 22 bp, Homo sapiens
ggctagaacctggagagctaga

SEQ ID NO: 2078904 - DNA, 16 bp, Homo sapiens
ggctagaacctggagg

SEQ ID NO: 2078905 - DNA, 13 bp, Homo sapiens
ggctagaatctgg

SEQ ID NO: 2078906 - DNA, 14 bp, Homo sapiens
ggctagaatctgga

SEQ ID NO: 2078907 - DNA, 16 bp, Homo sapiens
ggctagaatctggaga

SEQ ID NO: 2078908 - DNA, 20 bp, Homo sapiens
ggctagagtgcagtggcatg

SEQ ID NO: 2078909 - DNA, 18 bp, Homo sapiens
ggctagtcagagagagtg

SEQ ID NO: 2078910 - DNA, 21 bp, Homo sapiens
ggctagtgtgagtggcagcca

SEQ ID NO: 2078911 - DNA, 19 bp, Homo sapiens
ggctatgggggcactgagg

SEQ ID NO: 2078912 - DNA, 19 bp, Homo sapiens
ggctatgtatggaatacag

SEQ ID NO: 2078913 - DNA, 15 bp, Homo sapiens
ggctatttgttcaga

SEQ ID NO: 2078914 - DNA, 15 bp, Homo sapiens
ggctcaagaggccca

SEQ ID NO: 2078915 - DNA, 21 bp, Homo sapiens
ggctcaagaggcccagggagc

SEQ ID NO: 2078916 - DNA, 19 bp, Homo sapiens
ggctcacccctctcccccg

SEQ ID NO: 2078917 - DNA, 21 bp, Homo sapiens
ggctcacgcctatgatcccag

SEQ ID NO: 2078918 - DNA, 16 bp, Homo sapiens
ggctcactgcagcctc

SEQ ID NO: 2078919 - DNA, 13 bp, Homo sapiens
ggctcagcctggt

SEQ ID NO: 2078920 - DNA, 21 bp, Homo sapiens
ggctcagcggggacagctcct

SEQ ID NO: 2078921 - DNA, 14 bp, Homo sapiens
ggctcaggcaagcc

SEQ ID NO: 2078922 - DNA, 12 bp, Homo sapiens
gctattgttgtg

SEQ ID NO: 2078923 - DNA, 16 bp, Homo sapiens
gctatttaaaagtata

SEQ ID NO: 2078924 - DNA, 14 bp, Homo sapiens
gctatttgaagtgt

SEQ ID NO: 2078925 - DNA, 14 bp, Homo sapiens
gctatttgagcatg

SEQ ID NO: 2078926 - DNA, 20 bp, Homo sapiens
gctatttgttgtttttaaca

SEQ ID NO: 2078927 - DNA, 23 bp, Homo sapiens
gctattttatattacactacaca

SEQ ID NO: 2078928 - DNA, 19 bp, Homo sapiens
gctattttatttgtattca

SEQ ID NO: 2078929 - DNA, 14 bp, Homo sapiens
gctcaaatctattc

SEQ ID NO: 2078930 - DNA, 17 bp, Homo sapiens
gctcaaatctattcaga

SEQ ID NO: 2078931 - DNA, 20 bp, Homo sapiens
gctcaaatctattcagacaa

SEQ ID NO: 2078932 - DNA, 22 bp, Homo sapiens
gctcaaatctattcagacaagc

SEQ ID NO: 2078933 - DNA, 23 bp, Homo sapiens
gctcaaatctattcagacaagca

SEQ ID NO: 2078934 - DNA, 16 bp, Homo sapiens
gctcaacaataaaaca

SEQ ID NO: 2078935 - DNA, 15 bp, Homo sapiens
gctcaaccactgtgg

SEQ ID NO: 2078936 - DNA, 16 bp, Homo sapiens
gctcaaccactgtggc

SEQ ID NO: 2078937 - DNA, 22 bp, Homo sapiens
gctcaaccactgtggcgttctg

SEQ ID NO: 2078938 - DNA, 15 bp, Homo sapiens
gctcaacctctctcc

SEQ ID NO: 2078939 - DNA, 20 bp, Homo sapiens
gctcaacctctctccttctg

SEQ ID NO: 2078940 - DNA, 17 bp, Homo sapiens
gctcaagaatcctctgg

SEQ ID NO: 2078941 - DNA, 18 bp, Homo sapiens
gctcaagaatcctctggg

SEQ ID NO: 2078942 - DNA, 21 bp, Homo sapiens
gctcaagaatcctctggggtt

SEQ ID NO: 2078943 - DNA, 13 bp, Homo sapiens
gctcaagaggccc

SEQ ID NO: 2078944 - DNA, 18 bp, Homo sapiens
gctcaagatgacagctct

SEQ ID NO: 2078945 - DNA, 19 bp, Homo sapiens
gctcaagcaggaagttcaa

SEQ ID NO: 2078946 - DNA, 19 bp, Homo sapiens
gctcaatattcctgaatga

SEQ ID NO: 2078947 - DNA, 14 bp, Homo sapiens
gctcaatcctctaa

SEQ ID NO: 2078948 - DNA, 16 bp, Homo sapiens
gctcaatcctctaagc

SEQ ID NO: 2078949 - DNA, 21 bp, Homo sapiens
gctcaatgcattgtcttgtgg

SEQ ID NO: 2078950 - DNA, 23 bp, Homo sapiens
gctcaatgcattgtcttgtggag

SEQ ID NO: 2078951 - DNA, 14 bp, Homo sapiens
gctcacaaaccatg

SEQ ID NO: 2078952 - DNA, 15 bp, Homo sapiens
gctcacaagcccagg

SEQ ID NO: 2078953 - DNA, 14 bp, Homo sapiens
gctcacaaggcagc

SEQ ID NO: 2078954 - DNA, 15 bp, Homo sapiens
gctcacaaggcagca

SEQ ID NO: 2078955 - DNA, 21 bp, Homo sapiens
gctcacacggggtattttagg

SEQ ID NO: 2078956 - DNA, 19 bp, Homo sapiens
gctcacagttcctcgccct

SEQ ID NO: 2078957 - DNA, 16 bp, Homo sapiens
gctcacatatctgtca

SEQ ID NO: 2078958 - DNA, 18 bp, Homo sapiens
gctcaccaagctgttcca

SEQ ID NO: 2078959 - DNA, 18 bp, Homo sapiens
gctcaccagccccagtgc

SEQ ID NO: 2078960 - DNA, 20 bp, Homo sapiens
gctcaccagccccagtgccc

SEQ ID NO: 2078961 - DNA, 21 bp, Homo sapiens
gctcacgcctgtaatcccagc

SEQ ID NO: 2078962 - DNA, 11 bp, Homo sapiens
gctcactcagg

SEQ ID NO: 2078963 - DNA, 13 bp, Homo sapiens
gctcactcaggac

SEQ ID NO: 2078964 - DNA, 12 bp, Homo sapiens
gctcactgcagc

SEQ ID NO: 2078965 - DNA, 15 bp, Homo sapiens
gctcactgcagcctc

SEQ ID NO: 2078966 - DNA, 17 bp, Homo sapiens
gctcagaatagatctga

SEQ ID NO: 2078967 - DNA, 15 bp, Homo sapiens
gctcagacccccact

SEQ ID NO: 2078968 - DNA, 16 bp, Homo sapiens
gctcagaggggccccg

SEQ ID NO: 2078969 - DNA, 21 bp, Homo sapiens
gctcagccatcccgtcttctc

SEQ ID NO: 2078970 - DNA, 18 bp, Homo sapiens
gctcagccctccctgccc

SEQ ID NO: 2078971 - DNA, 19 bp, Homo sapiens
gctcagccgtgcactccct

SEQ ID NO: 2078972 - DNA, 19 bp, Homo sapiens
gctcagcggggacagctcc

SEQ ID NO: 2078973 - DNA, 20 bp, Homo sapiens
gctcagctactgatttttgt

SEQ ID NO: 2078974 - DNA, 20 bp, Homo sapiens
gctcaggaagaaaccccaag

SEQ ID NO: 2078975 - DNA, 22 bp, Homo sapiens
gctcaggaagaaaccccaagca

SEQ ID NO: 2078976 - DNA, 17 bp, Homo sapiens
gctcaggaattgaagat

SEQ ID NO: 2078977 - DNA, 13 bp, Homo sapiens
gctcaggacccag

SEQ ID NO: 2078978 - DNA, 16 bp, Homo sapiens
gctcaggacccaggcc

SEQ ID NO: 2078979 - DNA, 18 bp, Homo sapiens
gctcaggacccaggccct

SEQ ID NO: 2078980 - DNA, 19 bp, Homo sapiens
gctcaggacccaggccctc

SEQ ID NO: 2078981 - DNA, 19 bp, Homo sapiens
gctcaggaggcgaataaat

SEQ ID NO: 2078982 - DNA, 13 bp, Homo sapiens
gctcaggaggctt

SEQ ID NO: 2078983 - DNA, 17 bp, Homo sapiens
gctcaggaggcttggaa

SEQ ID NO: 2078984 - DNA, 13 bp, Homo sapiens
gctcaggcaagcc

SEQ ID NO: 2078985 - DNA, 16 bp, Homo sapiens
gctcaggcaagcccct

SEQ ID NO: 2078986 - DNA, 17 bp, Homo sapiens
gctcaggcaagcccctc

SEQ ID NO: 2078987 - DNA, 19 bp, Homo sapiens
gctcaggcaagcccctcag

SEQ ID NO: 2078988 - DNA, 21 bp, Homo sapiens
gctcaggcaagcccctcagcc

SEQ ID NO: 2078989 - DNA, 14 bp, Homo sapiens
gctcaggctgagcc

SEQ ID NO: 2078990 - DNA, 17 bp, Homo sapiens
gctcaggtgactggagc

SEQ ID NO: 2078991 - DNA, 18 bp, Homo sapiens
gctcaggtgactggagcc

SEQ ID NO: 2078992 - DNA, 13 bp, Homo sapiens
gctcaggtgcaag

SEQ ID NO: 2078993 - DNA, 12 bp, Homo sapiens
gctcagtcccat

SEQ ID NO: 2078994 - DNA, 16 bp, Homo sapiens
gctcagtgcctcctgg

SEQ ID NO: 2078995 - DNA, 17 bp, Homo sapiens
gctcatcacccagtcct

SEQ ID NO: 2078996 - DNA, 18 bp, Homo sapiens
gctcatcacccagtcctg

SEQ ID NO: 2078997 - DNA, 19 bp, Homo sapiens
gctcatcacccagtcctgg

SEQ ID NO: 2078998 - DNA, 20 bp, Homo sapiens
gctcatcacccagtcctggc

SEQ ID NO: 2078999 - DNA, 21 bp, Homo sapiens
gctcatcacccagtcctggcc

SEQ ID NO: 2079000 - DNA, 21 bp, Homo sapiens
gctccaacagcttgaccagac

SEQ ID NO: 2079001 - DNA, 22 bp, Homo sapiens
gctccaacagcttgaccagacc

SEQ ID NO: 2079002 - DNA, 13 bp, Homo sapiens
gctccaagagaat

SEQ ID NO: 2079003 - DNA, 14 bp, Homo sapiens
gctccacctgttca

SEQ ID NO: 2079004 - DNA, 21 bp, Homo sapiens
gctccagatctgcactgggtg

SEQ ID NO: 2079005 - DNA, 20 bp, Homo sapiens
gctccagcatccagcctgtg

SEQ ID NO: 2079006 - DNA, 12 bp, Homo sapiens
gctccaggctcc

SEQ ID NO: 2079007 - DNA, 16 bp, Homo sapiens
gctccagggcagcctc

SEQ ID NO: 2079008 - DNA, 14 bp, Homo sapiens
gctccagggtcttg

SEQ ID NO: 2079009 - DNA, 16 bp, Homo sapiens
gctccaggtccggagg

SEQ ID NO: 2079010 - DNA, 20 bp, Homo sapiens
gctccaggtccggaggggtt

SEQ ID NO: 2079011 - DNA, 23 bp, Homo sapiens
gctccagtttccaagttcctgca

SEQ ID NO: 2079012 - DNA, 15 bp, Homo sapiens
gctccatggaggagg

SEQ ID NO: 2079013 - DNA, 11 bp, Homo sapiens
gctccatgggg

SEQ ID NO: 2079014 - DNA, 14 bp, Homo sapiens
gctccatggggaag

SEQ ID NO: 2079015 - DNA, 12 bp, Homo sapiens
gctcccagcagc

SEQ ID NO: 2079016 - DNA, 20 bp, Homo sapiens
gctcccatagcgctggctca

SEQ ID NO: 2079017 - DNA, 22 bp, Homo sapiens
gctcccatagcgctggctcagg

SEQ ID NO: 2079018 - DNA, 23 bp, Homo sapiens
gctcccatagcgctggctcagga

SEQ ID NO: 2079019 - DNA, 21 bp, Homo sapiens
gctccccacgagtcacctgca

SEQ ID NO: 2079020 - DNA, 14 bp, Homo sapiens
gctccccactctgc

SEQ ID NO: 2079021 - DNA, 17 bp, Homo sapiens
gctccccactctgctct

SEQ ID NO: 2079022 - DNA, 18 bp, Homo sapiens
gctccccactctgctctg

SEQ ID NO: 2079023 - DNA, 14 bp, Homo sapiens
gctccccagccctg

SEQ ID NO: 2079024 - DNA, 21 bp, Homo sapiens
gctccccaggactcaccctca

SEQ ID NO: 2079025 - DNA, 15 bp, Homo sapiens
gctcccccaccccct

SEQ ID NO: 2079026 - DNA, 20 bp, Homo sapiens
gctcccccaccccctcccca

SEQ ID NO: 2079027 - DNA, 12 bp, Homo sapiens
gctccccctgct

SEQ ID NO: 2079028 - DNA, 15 bp, Homo sapiens
gctcccctcggagaa

SEQ ID NO: 2079029 - DNA, 14 bp, Homo sapiens
gctcccgagctact

SEQ ID NO: 2079030 - DNA, 12 bp, Homo sapiens
gccctcaggcca

SEQ ID NO: 2079031 - DNA, 13 bp, Homo sapiens
gccctcaggccag

SEQ ID NO: 2079032 - DNA, 18 bp, Homo sapiens
gccctcaggccagtgcca

SEQ ID NO: 2079033 - DNA, 21 bp, Homo sapiens
gccctcaggccagtgccagga

SEQ ID NO: 2079034 - DNA, 22 bp, Homo sapiens
gccctcaggccagtgccaggac

SEQ ID NO: 2079035 - DNA, 21 bp, Homo sapiens
gccctcatgataatctgggca

SEQ ID NO: 2079036 - DNA, 16 bp, Homo sapiens
gccctcccacctccgc

SEQ ID NO: 2079037 - DNA, 24 bp, Homo sapiens
gccctcccagcaagtttcaccttg

SEQ ID NO: 2079038 - DNA, 21 bp, Homo sapiens
gccctcccatgttgcatgcct

SEQ ID NO: 2079039 - DNA, 17 bp, Homo sapiens
gccctccccatcccatg

SEQ ID NO: 2079040 - DNA, 15 bp, Homo sapiens
gccctcccccttccc

SEQ ID NO: 2079041 - DNA, 20 bp, Homo sapiens
gccctcccccttccccttct

SEQ ID NO: 2079042 - DNA, 22 bp, Homo sapiens
gccctccctgactccctgtggg

SEQ ID NO: 2079043 - DNA, 15 bp, Homo sapiens
gccctccctgcccct

SEQ ID NO: 2079044 - DNA, 21 bp, Homo sapiens
gccctccctgcccctcccttc

SEQ ID NO: 2079045 - DNA, 20 bp, Homo sapiens
gccctccctggggtccttgc

SEQ ID NO: 2079046 - DNA, 14 bp, Homo sapiens
gccctccctgtcct

SEQ ID NO: 2079047 - DNA, 18 bp, Homo sapiens
gccctccctgtcctcctc

SEQ ID NO: 2079048 - DNA, 13 bp, Homo sapiens
gccctcctcaccc

SEQ ID NO: 2079049 - DNA, 21 bp, Homo sapiens
gccctcctcaccccgtctggg

SEQ ID NO: 2079050 - DNA, 20 bp, Homo sapiens
gccctcgaaccaaggcagcc

SEQ ID NO: 2079051 - DNA, 16 bp, Homo sapiens
gccctctccttcctta

SEQ ID NO: 2079052 - DNA, 19 bp, Homo sapiens
gccctctgcgtcccccagc

SEQ ID NO: 2079053 - DNA, 16 bp, Homo sapiens
gccctctggatcctgc

SEQ ID NO: 2079054 - DNA, 20 bp, Homo sapiens
gccctctggatcctgctgtg

SEQ ID NO: 2079055 - DNA, 22 bp, Homo sapiens
gccctctggatcctgctgtggc

SEQ ID NO: 2079056 - DNA, 17 bp, Homo sapiens
gccctgagctcaggctg

SEQ ID NO: 2079057 - DNA, 20 bp, Homo sapiens
gcctccccacatatggcaca

SEQ ID NO: 2079058 - DNA, 21 bp, Homo sapiens
gcctccccacatatggcacaa

SEQ ID NO: 2079059 - DNA, 17 bp, Homo sapiens
gcctccccccagcccct

SEQ ID NO: 2079060 - DNA, 20 bp, Homo sapiens
gcctccccccgctggggagc

SEQ ID NO: 2079061 - DNA, 14 bp, Homo sapiens
gcctccccctcaga

SEQ ID NO: 2079062 - DNA, 22 bp, Homo sapiens
gcctccccctcagatgatctct

SEQ ID NO: 2079063 - DNA, 16 bp, Homo sapiens
gcctccccctgctgct

SEQ ID NO: 2079064 - DNA, 18 bp, Homo sapiens
gcctccccgaaacaggct

SEQ ID NO: 2079065 - DNA, 23 bp, Homo sapiens
gcctcccgaatagctgggactac

SEQ ID NO: 2079066 - DNA, 15 bp, Homo sapiens
gcctcccgagtagct

SEQ ID NO: 2079067 - DNA, 17 bp, Homo sapiens
gcctcccgagtagctgg

SEQ ID NO: 2079068 - DNA, 18 bp, Homo sapiens
gcctcccgagtagctggg

SEQ ID NO: 2079069 - DNA, 19 bp, Homo sapiens
gcctcccgagtagctggga

SEQ ID NO: 2079070 - DNA, 21 bp, Homo sapiens
gcctcccgagtagctgggact

SEQ ID NO: 2079071 - DNA, 13 bp, Homo sapiens
gcctccctcaacc

SEQ ID NO: 2079072 - DNA, 14 bp, Homo sapiens
gcctccctcaaccc

SEQ ID NO: 2079073 - DNA, 19 bp, Homo sapiens
gcctccctccaccccagga

SEQ ID NO: 2079074 - DNA, 21 bp, Homo sapiens
gcctccctccaccccaggacg

SEQ ID NO: 2079075 - DNA, 21 bp, Homo sapiens
gcctccctctccatatctcct

SEQ ID NO: 2079076 - DNA, 12 bp, Homo sapiens
gcctccctctga

SEQ ID NO: 2079077 - DNA, 14 bp, Homo sapiens
gcctccctctgacc

SEQ ID NO: 2079078 - DNA, 21 bp, Homo sapiens
gcctccctctgacctgcaggc

SEQ ID NO: 2079079 - DNA, 16 bp, Homo sapiens
gcctccctggtccctt

SEQ ID NO: 2079080 - DNA, 20 bp, Homo sapiens
gcctccgtcaggagagacgc

SEQ ID NO: 2079081 - DNA, 19 bp, Homo sapiens
gcctccgtttatgggcctt

SEQ ID NO: 2079082 - DNA, 18 bp, Homo sapiens
gcctcctaagcagctggg

SEQ ID NO: 2079083 - DNA, 19 bp, Homo sapiens
gcctcctaagcagctggga

SEQ ID NO: 2079084 - DNA, 16 bp, Homo sapiens
gcctcctcacccccag

SEQ ID NO: 2079085 - DNA, 18 bp, Homo sapiens
gcctcctcacccccagct

SEQ ID NO: 2079086 - DNA, 21 bp, Homo sapiens
gcctcctcacccccagctttg

SEQ ID NO: 2079087 - DNA, 21 bp, Homo sapiens
gcctcctgacctgaggctcct

SEQ ID NO: 2079088 - DNA, 12 bp, Homo sapiens
gcctcctggcca

SEQ ID NO: 2079089 - DNA, 15 bp, Homo sapiens
gcctcctggccagac

SEQ ID NO: 2079090 - DNA, 17 bp, Homo sapiens
gcctccttatttatcaa

SEQ ID NO: 2079091 - DNA, 21 bp, Homo sapiens
gcctccttttgctgtttggat

SEQ ID NO: 2079092 - DNA, 17 bp, Homo sapiens
gcctcgaactggctgca

SEQ ID NO: 2079093 - DNA, 23 bp, Homo sapiens
gcctcgaggcaccggcgctgcag

SEQ ID NO: 2079094 - DNA, 12 bp, Homo sapiens
gcctcgcaaccc

SEQ ID NO: 2079095 - DNA, 20 bp, Homo sapiens
gcctcgcaacccgtgccaag

SEQ ID NO: 2079096 - DNA, 23 bp, Homo sapiens
gcctcgcaacccgtgccaagtcc

SEQ ID NO: 2079097 - DNA, 14 bp, Homo sapiens
gcctcgcctgggcc

SEQ ID NO: 2079098 - DNA, 17 bp, Homo sapiens
gcctcgcctgggcccag

SEQ ID NO: 2079099 - DNA, 20 bp, Homo sapiens
gcctcgcctgggcccaggct

SEQ ID NO: 2079100 - DNA, 18 bp, Homo sapiens
gcctcgctccccactctg

SEQ ID NO: 2079101 - DNA, 22 bp, Homo sapiens
gcctcgggacacctgccctgcc

SEQ ID NO: 2079102 - DNA, 15 bp, Homo sapiens
gcctcgtaccagcca

SEQ ID NO: 2079103 - DNA, 17 bp, Homo sapiens
gcctctagaacacccac

SEQ ID NO: 2079104 - DNA, 19 bp, Homo sapiens
gcctctagaacacccactg

SEQ ID NO: 2079105 - DNA, 21 bp, Homo sapiens
gcctctagaacacccactggc

SEQ ID NO: 2079106 - DNA, 23 bp, Homo sapiens
gcctctagaacacccactggcca

SEQ ID NO: 2079107 - DNA, 18 bp, Homo sapiens
gcctctcccgcaccaggc

SEQ ID NO: 2079108 - DNA, 15 bp, Homo sapiens
gcctctcccggctgc

SEQ ID NO: 2079109 - DNA, 18 bp, Homo sapiens
gcctctcccggctgcctg

SEQ ID NO: 2079110 - DNA, 14 bp, Homo sapiens
gcctctctcaggag

SEQ ID NO: 2079111 - DNA, 13 bp, Homo sapiens
gcctctctgctcc

SEQ ID NO: 2079112 - DNA, 16 bp, Homo sapiens
gcctctgacacacagc

SEQ ID NO: 2079113 - DNA, 17 bp, Homo sapiens
gcctctgacacacagct

SEQ ID NO: 2079114 - DNA, 19 bp, Homo sapiens
gcctctgacacacagctct

SEQ ID NO: 2079115 - DNA, 13 bp, Homo sapiens
gcctctgaggcca

SEQ ID NO: 2079116 - DNA, 18 bp, Homo sapiens
gcctctgaggccagcctg

SEQ ID NO: 2079117 - DNA, 19 bp, Homo sapiens
gcctctgaggccagcctgg

SEQ ID NO: 2079118 - DNA, 22 bp, Homo sapiens
gcctctgaggccagcctggcct

SEQ ID NO: 2079119 - DNA, 23 bp, Homo sapiens
gcctctgaggccagcctggcctc

SEQ ID NO: 2079120 - DNA, 19 bp, Homo sapiens
gcctctgatatgggactga

SEQ ID NO: 2079121 - DNA, 23 bp, Homo sapiens
gcctctgatatgggactgagcct

SEQ ID NO: 2079122 - DNA, 15 bp, Homo sapiens
gcctctgcattcagg

SEQ ID NO: 2079123 - DNA, 19 bp, Homo sapiens
gcctctgccccaaggggcc

SEQ ID NO: 2079124 - DNA, 14 bp, Homo sapiens
gcctctgcccgcag

SEQ ID NO: 2079125 - DNA, 17 bp, Homo sapiens
gcctctgcccgcagagc

SEQ ID NO: 2079126 - DNA, 22 bp, Homo sapiens
gcctctgcccgcagagcccacg

SEQ ID NO: 2079127 - DNA, 16 bp, Homo sapiens
gcctctgccctgcctc

SEQ ID NO: 2079128 - DNA, 17 bp, Homo sapiens
gcctctgccctgcctcc

SEQ ID NO: 2079129 - DNA, 13 bp, Homo sapiens
gcctctgcctccc

SEQ ID NO: 2079130 - DNA, 17 bp, Homo sapiens
gcctctggaaagcaaag

SEQ ID NO: 2079131 - DNA, 15 bp, Homo sapiens
gcctctggccaggca

SEQ ID NO: 2079132 - DNA, 22 bp, Homo sapiens
gcctcttaaagctgcctgtagt

SEQ ID NO: 2079133 - DNA, 13 bp, Homo sapiens
gcctcttccaccc

SEQ ID NO: 2079134 - DNA, 14 bp, Homo sapiens
gcctcttccaccca

SEQ ID NO: 2079135 - DNA, 14 bp, Homo sapiens
gcctcttccctcag

SEQ ID NO: 2079136 - DNA, 22 bp, Homo sapiens
gcctcttcctccctcattccac

SEQ ID NO: 2079137 - DNA, 20 bp, Homo sapiens
gcctcttcttcttcagaaga

SEQ ID NO: 2079138 - DNA, 19 bp, Homo sapiens
gcctcttggacctctgctc

SEQ ID NO: 2079139 - DNA, 13 bp, Homo sapiens
gcctcttgttgca

SEQ ID NO: 2079140 - DNA, 16 bp, Homo sapiens
gcctcttgttgcagag

SEQ ID NO: 2079141 - DNA, 20 bp, Homo sapiens
gcctctttctgtgcttctct

SEQ ID NO: 2079142 - DNA, 12 bp, Homo sapiens
gcctcttttctc

SEQ ID NO: 2079143 - DNA, 15 bp, Homo sapiens
gcctgaagtcacaca

SEQ ID NO: 2079144 - DNA, 16 bp, Homo sapiens
gcctgaagtcacacag

SEQ ID NO: 2079145 - DNA, 18 bp, Homo sapiens
gcctgaagtcacacagtg

SEQ ID NO: 2079146 - DNA, 23 bp, Homo sapiens
gcctgacaggttcccagcagctg

SEQ ID NO: 2079147 - DNA, 13 bp, Homo sapiens
gcctgagcccagg

SEQ ID NO: 2079148 - DNA, 17 bp, Homo sapiens
gcctgagcccaggagct

SEQ ID NO: 2079149 - DNA, 16 bp, Homo sapiens
gcctgagctggggcca

SEQ ID NO: 2079150 - DNA, 19 bp, Homo sapiens
gcctgagctggggccacaa

SEQ ID NO: 2079151 - DNA, 23 bp, Homo sapiens
gcctgagctggggcctggagagg

SEQ ID NO: 2079152 - DNA, 19 bp, Homo sapiens
gcctgaggctcaagaggcc

SEQ ID NO: 2079153 - DNA, 15 bp, Homo sapiens
gcctgaggctgagac

SEQ ID NO: 2079154 - DNA, 14 bp, Homo sapiens
gcctgagggtggag

SEQ ID NO: 2079155 - DNA, 12 bp, Homo sapiens
gcctgatgacag

SEQ ID NO: 2079156 - DNA, 17 bp, Homo sapiens
gcctgatgacagagcga

SEQ ID NO: 2079157 - DNA, 20 bp, Homo sapiens
gcctgcatcatgacaaagtt

SEQ ID NO: 2079158 - DNA, 17 bp, Homo sapiens
gcctgccagggcccctg

SEQ ID NO: 2079159 - DNA, 13 bp, Homo sapiens
gcctgccataccg

SEQ ID NO: 2079160 - DNA, 19 bp, Homo sapiens
gcctgccataccgctgggg

SEQ ID NO: 2079161 - DNA, 12 bp, Homo sapiens
gcctgcccaggc

SEQ ID NO: 2079162 - DNA, 13 bp, Homo sapiens
gcctgcccaggcc

SEQ ID NO: 2079163 - DNA, 14 bp, Homo sapiens
gcctgcccaggccc

SEQ ID NO: 2079164 - DNA, 17 bp, Homo sapiens
gcctgcccaggcccctg

SEQ ID NO: 2079165 - DNA, 20 bp, Homo sapiens
gcctgcccaggcccctgcca

SEQ ID NO: 2079166 - DNA, 18 bp, Homo sapiens
gcctgccctggagggagg

SEQ ID NO: 2079167 - DNA, 16 bp, Homo sapiens
gcctgccgagcaaccg

SEQ ID NO: 2079168 - DNA, 20 bp, Homo sapiens
gcctgccgagcaaccgtggc

SEQ ID NO: 2079169 - DNA, 15 bp, Homo sapiens
gcctgcctcagctgc

SEQ ID NO: 2079170 - DNA, 23 bp, Homo sapiens
gcctgcctcagctgctcgcacag

SEQ ID NO: 2079171 - DNA, 14 bp, Homo sapiens
gcctgcctcccagc

SEQ ID NO: 2079172 - DNA, 23 bp, Homo sapiens
gcctgcctcccagccctgccagg

SEQ ID NO: 2079173 - DNA, 17 bp, Homo sapiens
gcctgcctgataccctg

SEQ ID NO: 2079174 - DNA, 20 bp, Homo sapiens
gcctgcctgataccctgctt

SEQ ID NO: 2079175 - DNA, 23 bp, Homo sapiens
gcctgccttgaagccactgaagc

SEQ ID NO: 2079176 - DNA, 21 bp, Homo sapiens
gcctgcggcccagaagtttcc

SEQ ID NO: 2079177 - DNA, 18 bp, Homo sapiens
gcctgctagagcaacccc

SEQ ID NO: 2079178 - DNA, 16 bp, Homo sapiens
gcctgctcccagcagc

SEQ ID NO: 2079179 - DNA, 17 bp, Homo sapiens
gcctgctcccagcagcc

SEQ ID NO: 2079180 - DNA, 13 bp, Homo sapiens
gcctgctgctgag

SEQ ID NO: 2079181 - DNA, 22 bp, Homo sapiens
gcctgctgggaaccccgcagcc

SEQ ID NO: 2079182 - DNA, 18 bp, Homo sapiens
gcctgctgggctctccac

SEQ ID NO: 2079183 - DNA, 24 bp, Homo sapiens
gcctgctgggctctccacctcagc

SEQ ID NO: 2079184 - DNA, 17 bp, Homo sapiens
gcctgcttttccaggat

SEQ ID NO: 2079185 - DNA, 22 bp, Homo sapiens
gcctgcttttccaggatcctgc

SEQ ID NO: 2079186 - DNA, 21 bp, Homo sapiens
gcctggaaccagggaggagag

SEQ ID NO: 2079187 - DNA, 20 bp, Homo sapiens
gcctggacatttgccttgct

SEQ ID NO: 2079188 - DNA, 20 bp, Homo sapiens
gcctggaccgcttcccagag

SEQ ID NO: 2079189 - DNA, 23 bp, Homo sapiens
gcctggaccgcttcccagaggcc

SEQ ID NO: 2079190 - DNA, 23 bp, Homo sapiens
gcctggactctaagctggagctc

SEQ ID NO: 2079191 - DNA, 14 bp, Homo sapiens
gcctggagaggggc

SEQ ID NO: 2079192 - DNA, 17 bp, Homo sapiens
gcctggaggacctgagc

SEQ ID NO: 2079193 - DNA, 22 bp, Homo sapiens
gcctggaggacctgagcctgcc

SEQ ID NO: 2079194 - DNA, 15 bp, Homo sapiens
gcctggcaaggcctc

SEQ ID NO: 2079195 - DNA, 16 bp, Homo sapiens
gcctggcacacatcag

SEQ ID NO: 2079196 - DNA, 17 bp, Homo sapiens
gcctggcacaggactga

SEQ ID NO: 2079197 - DNA, 13 bp, Homo sapiens
gcctggcacaggg

SEQ ID NO: 2079198 - DNA, 22 bp, Homo sapiens
gcctggcagccgtgccttcagc

SEQ ID NO: 2079199 - DNA, 13 bp, Homo sapiens
gcctggccaggca

SEQ ID NO: 2079200 - DNA, 15 bp, Homo sapiens
gcctggccaggcacc

SEQ ID NO: 2079201 - DNA, 17 bp, Homo sapiens
gcctggcccccctccag

SEQ ID NO: 2079202 - DNA, 19 bp, Homo sapiens
gcctggcccccctccaggc

SEQ ID NO: 2079203 - DNA, 16 bp, Homo sapiens
gcctggccccttctcc

SEQ ID NO: 2079204 - DNA, 11 bp, Homo sapiens
gcctggcctga

SEQ ID NO: 2079205 - DNA, 12 bp, Homo sapiens
gcctggcctgag

SEQ ID NO: 2079206 - DNA, 18 bp, Homo sapiens
gcctggcctgagctgggg

SEQ ID NO: 2079207 - DNA, 13 bp, Homo sapiens
gcctggcctggca

SEQ ID NO: 2079208 - DNA, 15 bp, Homo sapiens
gcctggcctggctcc

SEQ ID NO: 2079209 - DNA, 19 bp, Homo sapiens
gcctggccttgtcaggacc

SEQ ID NO: 2079210 - DNA, 20 bp, Homo sapiens
gcctggcggggcaggaggcc

SEQ ID NO: 2079211 - DNA, 22 bp, Homo sapiens
gcctggcggggcaggaggcctg

SEQ ID NO: 2079212 - DNA, 12 bp, Homo sapiens
gcctggctcccc

SEQ ID NO: 2079213 - DNA, 13 bp, Homo sapiens
gcctggctcccca

SEQ ID NO: 2079214 - DNA, 22 bp, Homo sapiens
gcctggctccccacgagtcacc

SEQ ID NO: 2079215 - DNA, 23 bp, Homo sapiens
gcctggctccccacgagtcacct

SEQ ID NO: 2079216 - DNA, 12 bp, Homo sapiens
gcctggctggct

SEQ ID NO: 2079217 - DNA, 17 bp, Homo sapiens
gcctggctggctgaggg

SEQ ID NO: 2079218 - DNA, 24 bp, Homo sapiens
gcctggctgtggaggcctgatgct

SEQ ID NO: 2079219 - DNA, 14 bp, Homo sapiens
gcctggcttctgga

SEQ ID NO: 2079220 - DNA, 23 bp, Homo sapiens
gcctggcttctggagcccttggg

SEQ ID NO: 2079221 - DNA, 16 bp, Homo sapiens
gcctggcttgctccag

SEQ ID NO: 2079222 - DNA, 18 bp, Homo sapiens
gcctggcttgctccaggg

SEQ ID NO: 2079223 - DNA, 21 bp, Homo sapiens
gcctggcttgctccagggtct

SEQ ID NO: 2079224 - DNA, 15 bp, Homo sapiens
gcctgggaaaggaaa

SEQ ID NO: 2079225 - DNA, 17 bp, Homo sapiens
gcctgggaaaggaaaac

SEQ ID NO: 2079226 - DNA, 22 bp, Homo sapiens
gcctgggaaaggaaaaccaggg

SEQ ID NO: 2079227 - DNA, 16 bp, Homo sapiens
gcctgggaaatttcta

SEQ ID NO: 2079228 - DNA, 15 bp, Homo sapiens
gcctgggacccagct

SEQ ID NO: 2079229 - DNA, 17 bp, Homo sapiens
gcctgggactcccagtg

SEQ ID NO: 2079230 - DNA, 16 bp, Homo sapiens
gcctgggcaacagagc

SEQ ID NO: 2079231 - DNA, 19 bp, Homo sapiens
gcctgggcaacagagcaag

SEQ ID NO: 2079232 - DNA, 12 bp, Homo sapiens
gcctgggcaaga

SEQ ID NO: 2079233 - DNA, 19 bp, Homo sapiens
gcctgggcagcatagcaag

SEQ ID NO: 2079234 - DNA, 15 bp, Homo sapiens
gcctgggcccaggct

SEQ ID NO: 2079235 - DNA, 19 bp, Homo sapiens
gcctgggcccaggctctgg

SEQ ID NO: 2079236 - DNA, 21 bp, Homo sapiens
gcctgggcccaggctctggga

SEQ ID NO: 2079237 - DNA, 22 bp, Homo sapiens
gcctgggcccaggctctgggaa

SEQ ID NO: 2079238 - DNA, 14 bp, Homo sapiens
gcctgggcctgctt

SEQ ID NO: 2079239 - DNA, 17 bp, Homo sapiens
gcctgggcctgcttttc

SEQ ID NO: 2079240 - DNA, 14 bp, Homo sapiens
gcctgggcctgtgc

SEQ ID NO: 2079241 - DNA, 15 bp, Homo sapiens
gcctgggcctgtgca

SEQ ID NO: 2079242 - DNA, 20 bp, Homo sapiens
gcctgggcctgtgcagcagc

SEQ ID NO: 2079243 - DNA, 21 bp, Homo sapiens
gcctgggcctgtgcagcagcc

SEQ ID NO: 2079244 - DNA, 14 bp, Homo sapiens
gcctggggattggg

SEQ ID NO: 2079245 - DNA, 21 bp, Homo sapiens
gcctggggctctaacgcctga

SEQ ID NO: 2079246 - DNA, 23 bp, Homo sapiens
gcctggggctctaacgcctgagc

SEQ ID NO: 2079247 - DNA, 15 bp, Homo sapiens
gcctgggggcagtga

SEQ ID NO: 2079248 - DNA, 19 bp, Homo sapiens
gcctgggggcagtgactgg

SEQ ID NO: 2079249 - DNA, 13 bp, Homo sapiens
gcctgggggcctg

SEQ ID NO: 2079250 - DNA, 20 bp, Homo sapiens
gcctgggtggcagagtgaga

SEQ ID NO: 2079251 - DNA, 22 bp, Homo sapiens
gcctgggttttctaactgtaaa

SEQ ID NO: 2079252 - DNA, 16 bp, Homo sapiens
gcctggtctcctccca

SEQ ID NO: 2079253 - DNA, 17 bp, Homo sapiens
gcctggtggcagctgcg

SEQ ID NO: 2079254 - DNA, 18 bp, Homo sapiens
gcctggtggcagctgcgg

SEQ ID NO: 2079255 - DNA, 21 bp, Homo sapiens
gcctggtggcagctgcggtcc

SEQ ID NO: 2079256 - DNA, 18 bp, Homo sapiens
gcctggtgggccacgtgt

SEQ ID NO: 2079257 - DNA, 18 bp, Homo sapiens
gcctgtaatcccagcact

SEQ ID NO: 2079258 - DNA, 18 bp, Homo sapiens
gcctgtaatcccagcagt

SEQ ID NO: 2079259 - DNA, 16 bp, Homo sapiens
gcctgtaatcccagct

SEQ ID NO: 2079260 - DNA, 11 bp, Homo sapiens
gcctgtactgc

SEQ ID NO: 2079261 - DNA, 18 bp, Homo sapiens
gcgcagcgcgtgcacagc

SEQ ID NO: 2079262 - DNA, 20 bp, Homo sapiens
gcgcagggaggatgccacag

SEQ ID NO: 2079263 - DNA, 22 bp, Homo sapiens
gcgcagtgcttctctacagact

SEQ ID NO: 2079264 - DNA, 22 bp, Homo sapiens
gcgcatgtaatcccagctactc

SEQ ID NO: 2079265 - DNA, 21 bp, Homo sapiens
gcgccactacactccagcctg

SEQ ID NO: 2079266 - DNA, 24 bp, Homo sapiens
gcgccactacactccagcctgagc

SEQ ID NO: 2079267 - DNA, 19 bp, Homo sapiens
gcgcccattcgtctgtccc

SEQ ID NO: 2079268 - DNA, 21 bp, Homo sapiens
gcgccccaacccgtggaggct

SEQ ID NO: 2079269 - DNA, 14 bp, Homo sapiens
gcgccctgcagacc

SEQ ID NO: 2079270 - DNA, 16 bp, Homo sapiens
gcgccctgcagaccct

SEQ ID NO: 2079271 - DNA, 20 bp, Homo sapiens
gcgcctacaggagtgagcac

SEQ ID NO: 2079272 - DNA, 20 bp, Homo sapiens
gcgcctagtggggtctccct

SEQ ID NO: 2079273 - DNA, 21 bp, Homo sapiens
gcgcctagtggggtctccctc

SEQ ID NO: 2079274 - DNA, 16 bp, Homo sapiens
gcgcctccctccaccc

SEQ ID NO: 2079275 - DNA, 21 bp, Homo sapiens
gcgcctccctccaccccagga

SEQ ID NO: 2079276 - DNA, 23 bp, Homo sapiens
gcgcctccctccaccccaggacg

SEQ ID NO: 2079277 - DNA, 16 bp, Homo sapiens
gcgcctgtagtcccag

SEQ ID NO: 2079278 - DNA, 22 bp, Homo sapiens
gcgcctgtgctgaggactccct

SEQ ID NO: 2079279 - DNA, 21 bp, Homo sapiens
gcgcgcatgtaatcccagcta

SEQ ID NO: 2079280 - DNA, 22 bp, Homo sapiens
gcgcgcatgtaatcccagctac

SEQ ID NO: 2079281 - DNA, 23 bp, Homo sapiens
gcgcgcatgtaatcccagctact

SEQ ID NO: 2079282 - DNA, 22 bp, Homo sapiens
gcgcgggaggcaccagctctgt

SEQ ID NO: 2079283 - DNA, 13 bp, Homo sapiens
gcgcgtctgcccc

SEQ ID NO: 2079284 - DNA, 15 bp, Homo sapiens
gcgctaacccccagc

SEQ ID NO: 2079285 - DNA, 13 bp, Homo sapiens
gcgctacccactt

SEQ ID NO: 2079286 - DNA, 16 bp, Homo sapiens
gcgctacccacttcta

SEQ ID NO: 2079287 - DNA, 14 bp, Homo sapiens
gcgctatcttcaca

SEQ ID NO: 2079288 - DNA, 18 bp, Homo sapiens
gcgctcaggacccaggcc

SEQ ID NO: 2079289 - DNA, 15 bp, Homo sapiens
gcgctctcttccaga

SEQ ID NO: 2079290 - DNA, 17 bp, Homo sapiens
gcgctcttggtccctgg

SEQ ID NO: 2079291 - DNA, 22 bp, Homo sapiens
gcgctgcaggtacttcctcctg

SEQ ID NO: 2079292 - DNA, 17 bp, Homo sapiens
gcgctgccgcaccccag

SEQ ID NO: 2079293 - DNA, 21 bp, Homo sapiens
gcgctgctcaacctctctcct

SEQ ID NO: 2079294 - DNA, 11 bp, Homo sapiens
gcgctggctca

SEQ ID NO: 2079295 - DNA, 17 bp, Homo sapiens
gcgctgtggctcctgcc

SEQ ID NO: 2079296 - DNA, 20 bp, Homo sapiens
gcgctgtggctcctgccttg

SEQ ID NO: 2079297 - DNA, 16 bp, Homo sapiens
gcggaaaccttgcagc

SEQ ID NO: 2079298 - DNA, 16 bp, Homo sapiens
gcggaaaggagatggg

SEQ ID NO: 2079299 - DNA, 19 bp, Homo sapiens
gcggaatgaaccacatctt

SEQ ID NO: 2079300 - DNA, 13 bp, Homo sapiens
gcggacagccacg

SEQ ID NO: 2079301 - DNA, 19 bp, Homo sapiens
gcggagacggagtcccacc

SEQ ID NO: 2079302 - DNA, 15 bp, Homo sapiens
gcggagagtacagtg

SEQ ID NO: 2079303 - DNA, 16 bp, Homo sapiens
gcggagagtacagtga

SEQ ID NO: 2079304 - DNA, 19 bp, Homo sapiens
gcggagcttgcagtgagcc

SEQ ID NO: 2079305 - DNA, 17 bp, Homo sapiens
gcggaggagaccagctc

SEQ ID NO: 2079306 - DNA, 13 bp, Homo sapiens
gcggaggagctcc

SEQ ID NO: 2079307 - DNA, 18 bp, Homo sapiens
gcggaggcggctccaggt

SEQ ID NO: 2079308 - DNA, 16 bp, Homo sapiens
gcggaggttgcaggga

SEQ ID NO: 2079309 - DNA, 17 bp, Homo sapiens
gcggcaggagcaggaac

SEQ ID NO: 2079310 - DNA, 14 bp, Homo sapiens
gcggcagggtgggg

SEQ ID NO: 2079311 - DNA, 13 bp, Homo sapiens
gcggccaccaccc

SEQ ID NO: 2079312 - DNA, 16 bp, Homo sapiens
gcggccgcattccctg

SEQ ID NO: 2079313 - DNA, 18 bp, Homo sapiens
gcggccgcattccctgag

SEQ ID NO: 2079314 - DNA, 12 bp, Homo sapiens
gcggccgggctg

SEQ ID NO: 2079315 - DNA, 14 bp, Homo sapiens
gcggccgggctgcc

SEQ ID NO: 2079316 - DNA, 23 bp, Homo sapiens
gcggcctatgacttgggcacccc

SEQ ID NO: 2079317 - DNA, 13 bp, Homo sapiens
gcggcggccctca

SEQ ID NO: 2079318 - DNA, 22 bp, Homo sapiens
gcggcggtggactgcgctggac

SEQ ID NO: 2079319 - DNA, 13 bp, Homo sapiens
gcggctactcagc

SEQ ID NO: 2079320 - DNA, 19 bp, Homo sapiens
gcggctactcagcagccct

SEQ ID NO: 2079321 - DNA, 20 bp, Homo sapiens
gcggctactcagcagccctc

SEQ ID NO: 2079322 - DNA, 22 bp, Homo sapiens
gcggctgagtcatgatctccct

SEQ ID NO: 2079323 - DNA, 23 bp, Homo sapiens
gcggctgagtcatgatctccctg

SEQ ID NO: 2079324 - DNA, 21 bp, Homo sapiens
gcggctgtgggggaggtccct

SEQ ID NO: 2079325 - DNA, 22 bp, Homo sapiens
gcggcttcctgtccactctcgg

SEQ ID NO: 2079326 - DNA, 14 bp, Homo sapiens
gcggcttggccgcc

SEQ ID NO: 2079327 - DNA, 13 bp, Homo sapiens
gcgggaaggaggg

SEQ ID NO: 2079328 - DNA, 15 bp, Homo sapiens
gcgggcagcccagcc

SEQ ID NO: 2079329 - DNA, 18 bp, Homo sapiens
gcgggcctcttccctcag

SEQ ID NO: 2079330 - DNA, 15 bp, Homo sapiens
gcgggcggaggcggc

SEQ ID NO: 2079331 - DNA, 18 bp, Homo sapiens
gcgggcggaggcggctcc

SEQ ID NO: 2079332 - DNA, 15 bp, Homo sapiens
gcgggctgtgcctta

SEQ ID NO: 2079333 - DNA, 14 bp, Homo sapiens
gcggggacagctcc

SEQ ID NO: 2079334 - DNA, 18 bp, Homo sapiens
gcggggacagctccttct

SEQ ID NO: 2079335 - DNA, 19 bp, Homo sapiens
gcggggacagctccttctg

SEQ ID NO: 2079336 - DNA, 23 bp, Homo sapiens
gcggggacagctccttctgtcct

SEQ ID NO: 2079337 - DNA, 20 bp, Homo sapiens
gcggggaggaggagctgccg

SEQ ID NO: 2079338 - DNA, 21 bp, Homo sapiens
gcggggcaggaggcctggcct

SEQ ID NO: 2079339 - DNA, 13 bp, Homo sapiens
gcggggctatgcc

SEQ ID NO: 2079340 - DNA, 14 bp, Homo sapiens
gcggggcttctggg

SEQ ID NO: 2079341 - DNA, 22 bp, Homo sapiens
gcggggcttctgggtggctcct

SEQ ID NO: 2079342 - DNA, 16 bp, Homo sapiens
gcgggggagctggaaa

SEQ ID NO: 2079343 - DNA, 18 bp, Homo sapiens
gcgggtagatgccggcag

SEQ ID NO: 2079344 - DNA, 15 bp, Homo sapiens
gcggtcatgtgtgca

SEQ ID NO: 2079345 - DNA, 22 bp, Homo sapiens
gcggtcatgtgtgcatgtgagc

SEQ ID NO: 2079346 - DNA, 20 bp, Homo sapiens
gcggtccacccaggagcccc

SEQ ID NO: 2079347 - DNA, 12 bp, Homo sapiens
gcggtgctctgg

SEQ ID NO: 2079348 - DNA, 21 bp, Homo sapiens
gcggtgctctggcggcttcct

SEQ ID NO: 2079349 - DNA, 18 bp, Homo sapiens
gcggtggaaggcccgagg

SEQ ID NO: 2079350 - DNA, 18 bp, Homo sapiens
gcggtggactgcgctgga

SEQ ID NO: 2079351 - DNA, 14 bp, Homo sapiens
gcggtggtgccaga

SEQ ID NO: 2079352 - DNA, 17 bp, Homo sapiens
gcggtggtgccagaggt

SEQ ID NO: 2079353 - DNA, 12 bp, Homo sapiens
gcggttcaggaa

SEQ ID NO: 2079354 - DNA, 16 bp, Homo sapiens
gcgtccctagcagtga

SEQ ID NO: 2079355 - DNA, 14 bp, Homo sapiens
gcgtctaccctggg

SEQ ID NO: 2079356 - DNA, 22 bp, Homo sapiens
gcgtctctctttctccctcacc

SEQ ID NO: 2079357 - DNA, 13 bp, Homo sapiens
gcgtctgccccac

SEQ ID NO: 2079358 - DNA, 17 bp, Homo sapiens
gcgtctgccccaccctc

SEQ ID NO: 2079359 - DNA, 16 bp, Homo sapiens
gcgtcttgtattttct

SEQ ID NO: 2079360 - DNA, 16 bp, Homo sapiens
gcgtgactcacccaag

SEQ ID NO: 2079361 - DNA, 15 bp, Homo sapiens
gcgtgagccactgca

SEQ ID NO: 2079362 - DNA, 16 bp, Homo sapiens
gcgtgagccactgcac

SEQ ID NO: 2079363 - DNA, 18 bp, Homo sapiens
gcgtgcaaggggctcagc

SEQ ID NO: 2079364 - DNA, 14 bp, Homo sapiens
gcgtgcacacacca

SEQ ID NO: 2079365 - DNA, 22 bp, Homo sapiens
gcgtgcacatatgggtgctggc

SEQ ID NO: 2079366 - DNA, 11 bp, Homo sapiens
gcgtgcagatg

SEQ ID NO: 2079367 - DNA, 14 bp, Homo sapiens
gcgtgctacctgca

SEQ ID NO: 2079368 - DNA, 13 bp, Homo sapiens
gcgtggactctgc

SEQ ID NO: 2079369 - DNA, 13 bp, Homo sapiens
gcgtggctgtggc

SEQ ID NO: 2079370 - DNA, 18 bp, Homo sapiens
gcgtggctgtggcacaga

SEQ ID NO: 2079371 - DNA, 19 bp, Homo sapiens
gcgtggctgtggcacagac

SEQ ID NO: 2079372 - DNA, 13 bp, Homo sapiens
gcgtgtgcacgtg

SEQ ID NO: 2079373 - DNA, 16 bp, Homo sapiens
gcgtgtgcgtgcgtgt

SEQ ID NO: 2079374 - DNA, 19 bp, Homo sapiens
gcgtgttagtgtgtgtgca

SEQ ID NO: 2079375 - DNA, 21 bp, Homo sapiens
gcgtgttagtgtgtgtgcatg

SEQ ID NO: 2079376 - DNA, 17 bp, Homo sapiens
gcgttacaacagtaaca

SEQ ID NO: 2079377 - DNA, 15 bp, Homo sapiens
gcctgtactgcctgc

SEQ ID NO: 2079378 - DNA, 16 bp, Homo sapiens
gcctgtactgcctgct

SEQ ID NO: 2079379 - DNA, 17 bp, Homo sapiens
gcctgtactgcctgctt

SEQ ID NO: 2079380 - DNA, 20 bp, Homo sapiens
gcctgtagccccagtgacag

SEQ ID NO: 2079381 - DNA, 14 bp, Homo sapiens
gcctgtagttagga

SEQ ID NO: 2079382 - DNA, 23 bp, Homo sapiens
gcctgtagttaggaaataaaacc

SEQ ID NO: 2079383 - DNA, 18 bp, Homo sapiens
gcctgtcagtttcatgga

SEQ ID NO: 2079384 - DNA, 14 bp, Homo sapiens
gcctgtcctgcctc

SEQ ID NO: 2079385 - DNA, 15 bp, Homo sapiens
gcctgtcctgcctct

SEQ ID NO: 2079386 - DNA, 20 bp, Homo sapiens
gcctgtcctggtacagcagg

SEQ ID NO: 2079387 - DNA, 21 bp, Homo sapiens
gcctgtcctggtacagcaggg

SEQ ID NO: 2079388 - DNA, 19 bp, Homo sapiens
gcctgtctttcagcattca

SEQ ID NO: 2079389 - DNA, 15 bp, Homo sapiens
gcctgtgaacccagg

SEQ ID NO: 2079390 - DNA, 16 bp, Homo sapiens
gcctgtgaacccagga

SEQ ID NO: 2079391 - DNA, 22 bp, Homo sapiens
gcctgtgaataaaaaccctgta

SEQ ID NO: 2079392 - DNA, 18 bp, Homo sapiens
gcctgtgattaacttgct

SEQ ID NO: 2079393 - DNA, 19 bp, Homo sapiens
gcctgtgattaacttgctt

SEQ ID NO: 2079394 - DNA, 17 bp, Homo sapiens
gcctgtgcagcagccca

SEQ ID NO: 2079395 - DNA, 19 bp, Homo sapiens
gcctgtgcagcagcccagc

SEQ ID NO: 2079396 - DNA, 16 bp, Homo sapiens
gcctgtgccacctgca

SEQ ID NO: 2079397 - DNA, 19 bp, Homo sapiens
gcctgtgctgaggactccc

SEQ ID NO: 2079398 - DNA, 12 bp, Homo sapiens
gcctgtggcaga

SEQ ID NO: 2079399 - DNA, 15 bp, Homo sapiens
gcctgtggcaggcct

SEQ ID NO: 2079400 - DNA, 15 bp, Homo sapiens
gcctgtgtagctgtg

SEQ ID NO: 2079401 - DNA, 22 bp, Homo sapiens
gcctgtgtagctgtgacctgct

SEQ ID NO: 2079402 - DNA, 14 bp, Homo sapiens
gcctgtgtccagca

SEQ ID NO: 2079403 - DNA, 17 bp, Homo sapiens
gcctgtgtccagcagct

SEQ ID NO: 2079404 - DNA, 16 bp, Homo sapiens
gcctgtgtgagcatct

SEQ ID NO: 2079405 - DNA, 16 bp, Homo sapiens
gcctgttcagctccag

SEQ ID NO: 2079406 - DNA, 20 bp, Homo sapiens
gcctgttcagctccagctca

SEQ ID NO: 2079407 - DNA, 19 bp, Homo sapiens
gcctgttcccattcttgca

SEQ ID NO: 2079408 - DNA, 21 bp, Homo sapiens
gcctgttggacccgctctgga

SEQ ID NO: 2079409 - DNA, 16 bp, Homo sapiens
gccttaaagaaagtcg

SEQ ID NO: 2079410 - DNA, 13 bp, Homo sapiens
gccttaaattttt

SEQ ID NO: 2079411 - DNA, 20 bp, Homo sapiens
gccttaatctggaaggcccc

SEQ ID NO: 2079412 - DNA, 17 bp, Homo sapiens
gccttaattttcagtat

SEQ ID NO: 2079413 - DNA, 16 bp, Homo sapiens
gccttacctcccctgc

SEQ ID NO: 2079414 - DNA, 20 bp, Homo sapiens
gccttacctcccctgccagg

SEQ ID NO: 2079415 - DNA, 21 bp, Homo sapiens
gccttacctcccctgccaggg

SEQ ID NO: 2079416 - DNA, 15 bp, Homo sapiens
gccttacctcctgcc

SEQ ID NO: 2079417 - DNA, 20 bp, Homo sapiens
gccttacctcctgcccagga

SEQ ID NO: 2079418 - DNA, 18 bp, Homo sapiens
gccttagaagtcacacag

SEQ ID NO: 2079419 - DNA, 17 bp, Homo sapiens
gccttcacaaccagcca

SEQ ID NO: 2079420 - DNA, 21 bp, Homo sapiens
gccttcacaaccagccacaca

SEQ ID NO: 2079421 - DNA, 23 bp, Homo sapiens
gccttcacaaccagccacacaga

SEQ ID NO: 2079422 - DNA, 20 bp, Homo sapiens
gccttcactccggtgtgcct

SEQ ID NO: 2079423 - DNA, 14 bp, Homo sapiens
gccttccataatta

SEQ ID NO: 2079424 - DNA, 15 bp, Homo sapiens
gccttccataattat

SEQ ID NO: 2079425 - DNA, 16 bp, Homo sapiens
gccttccataattatg

SEQ ID NO: 2079426 - DNA, 18 bp, Homo sapiens
gccttccccctcccaggg

SEQ ID NO: 2079427 - DNA, 16 bp, Homo sapiens
gccttccccttgccca

SEQ ID NO: 2079428 - DNA, 22 bp, Homo sapiens
gccttccccttttgcctggctg

SEQ ID NO: 2079429 - DNA, 24 bp, Homo sapiens
gccttccccttttgcctggctgtg

SEQ ID NO: 2079430 - DNA, 16 bp, Homo sapiens
gccttcctcctccaca

SEQ ID NO: 2079431 - DNA, 20 bp, Homo sapiens
gccttcctcctccacagtgc

SEQ ID NO: 2079432 - DNA, 22 bp, Homo sapiens
gccttcgcggtggaaggcccga

SEQ ID NO: 2079433 - DNA, 16 bp, Homo sapiens
gccttctctgaaggac

SEQ ID NO: 2079434 - DNA, 15 bp, Homo sapiens
gccttcttcacccag

SEQ ID NO: 2079435 - DNA, 17 bp, Homo sapiens
gccttcttcacccagct

SEQ ID NO: 2079436 - DNA, 23 bp, Homo sapiens
gccttcttcggggaactcctgga

SEQ ID NO: 2079437 - DNA, 21 bp, Homo sapiens
gccttgagagaaaaagtgccc

SEQ ID NO: 2079438 - DNA, 14 bp, Homo sapiens
gccttgatgaagcc

SEQ ID NO: 2079439 - DNA, 18 bp, Homo sapiens
gccttgatgaagcccgtg

SEQ ID NO: 2079440 - DNA, 15 bp, Homo sapiens
gccttgatgaagcct

SEQ ID NO: 2079441 - DNA, 17 bp, Homo sapiens
gccttgatgaagcctgt

SEQ ID NO: 2079442 - DNA, 20 bp, Homo sapiens
gccttgatgaagcctgtgcc

SEQ ID NO: 2079443 - DNA, 22 bp, Homo sapiens
gccttgatgaagcctgtgccac

SEQ ID NO: 2079444 - DNA, 23 bp, Homo sapiens
gccttgatgaagcctgtgccacc

SEQ ID NO: 2079445 - DNA, 22 bp, Homo sapiens
gccttgcccagagatgcctcca

SEQ ID NO: 2079446 - DNA, 16 bp, Homo sapiens
gccttgcccgccagcc

SEQ ID NO: 2079447 - DNA, 18 bp, Homo sapiens
gccttgcccgccagcctc

SEQ ID NO: 2079448 - DNA, 18 bp, Homo sapiens
gccttggagcagaaagcc

SEQ ID NO: 2079449 - DNA, 21 bp, Homo sapiens
gccttggataatgctgttgcc

SEQ ID NO: 2079450 - DNA, 16 bp, Homo sapiens
gccttggtgtccacct

SEQ ID NO: 2079451 - DNA, 18 bp, Homo sapiens
gccttggtgtccacctgg

SEQ ID NO: 2079452 - DNA, 14 bp, Homo sapiens
gccttgtcaggacc

SEQ ID NO: 2079453 - DNA, 16 bp, Homo sapiens
gccttgtcaggaccca

SEQ ID NO: 2079454 - DNA, 20 bp, Homo sapiens
gccttgtcaggacccaggcc

SEQ ID NO: 2079455 - DNA, 15 bp, Homo sapiens
gccttgtgccctgcc

SEQ ID NO: 2079456 - DNA, 16 bp, Homo sapiens
gccttgtgccctgccc

SEQ ID NO: 2079457 - DNA, 17 bp, Homo sapiens
gccttgtgccctgcccc

SEQ ID NO: 2079458 - DNA, 22 bp, Homo sapiens
gccttgtgtcagagctgggagt

SEQ ID NO: 2079459 - DNA, 21 bp, Homo sapiens
gcctttcccaccgccctccct

SEQ ID NO: 2079460 - DNA, 19 bp, Homo sapiens
gcctttcctgtgccaacct

SEQ ID NO: 2079461 - DNA, 15 bp, Homo sapiens
gcctttggaagaaac

SEQ ID NO: 2079462 - DNA, 19 bp, Homo sapiens
gcctttgggaggcagcatc

SEQ ID NO: 2079463 - DNA, 14 bp, Homo sapiens
gccttttaaaagaa

SEQ ID NO: 2079464 - DNA, 15 bp, Homo sapiens
gccttttaaaagaaa

SEQ ID NO: 2079465 - DNA, 22 bp, Homo sapiens
gccttttcacgggaactctcca

SEQ ID NO: 2079466 - DNA, 23 bp, Homo sapiens
gcctttttcacaattccatttcc

SEQ ID NO: 2079467 - DNA, 19 bp, Homo sapiens
gccttttttcacagcccgg

SEQ ID NO: 2079468 - DNA, 23 bp, Homo sapiens
gcgaaaaaaaaaaatgcactgtg

SEQ ID NO: 2079469 - DNA, 21 bp, Homo sapiens
gcgaacatgcctgattttaaa

SEQ ID NO: 2079470 - DNA, 11 bp, Homo sapiens
gcgaataaatg

SEQ ID NO: 2079471 - DNA, 12 bp, Homo sapiens
gcgaataaatgt

SEQ ID NO: 2079472 - DNA, 15 bp, Homo sapiens
gcgaataaatgttca

SEQ ID NO: 2079473 - DNA, 19 bp, Homo sapiens
gcgacagagcgagagtctg

SEQ ID NO: 2079474 - DNA, 21 bp, Homo sapiens
gcgactctatagactctagga

SEQ ID NO: 2079475 - DNA, 15 bp, Homo sapiens
gcgagaggcagagaa

SEQ ID NO: 2079476 - DNA, 16 bp, Homo sapiens
gcgagaggcagagaaa

SEQ ID NO: 2079477 - DNA, 18 bp, Homo sapiens
gcgagaggtccctgctta

SEQ ID NO: 2079478 - DNA, 13 bp, Homo sapiens
gcgagcatttccc

SEQ ID NO: 2079479 - DNA, 13 bp, Homo sapiens
gcgagctgctctg

SEQ ID NO: 2079480 - DNA, 16 bp, Homo sapiens
gcgaggtcaacagaga

SEQ ID NO: 2079481 - DNA, 18 bp, Homo sapiens
gcgaggtcaacagagaag

SEQ ID NO: 2079482 - DNA, 16 bp, Homo sapiens
gcgaggtgcggccacc

SEQ ID NO: 2079483 - DNA, 15 bp, Homo sapiens
gcgagtgccaggact

SEQ ID NO: 2079484 - DNA, 21 bp, Homo sapiens
gcgataaaactaaatatatgt

SEQ ID NO: 2079485 - DNA, 15 bp, Homo sapiens
gcgatggtctcagaa

SEQ ID NO: 2079486 - DNA, 19 bp, Homo sapiens
gcgattccctctcccaggc

SEQ ID NO: 2079487 - DNA, 23 bp, Homo sapiens
gcgattcttctgcttcagcctcc

SEQ ID NO: 2079488 - DNA, 18 bp, Homo sapiens
gcgattcttgtgcctcag

SEQ ID NO: 2079489 - DNA, 19 bp, Homo sapiens
gcgattcttgtgcctcagc

SEQ ID NO: 2079490 - DNA, 22 bp, Homo sapiens
gcgcaagcctgtaatcccagct

SEQ ID NO: 2079491 - DNA, 17 bp, Homo sapiens
gcgcacaaggctgacca

SEQ ID NO: 2079492 - DNA, 11 bp, Homo sapiens
gcgcacacaca

SEQ ID NO: 2079493 - DNA, 22 bp, Homo sapiens
gccccatcttggtcctgtcacc

SEQ ID NO: 2079494 - DNA, 14 bp, Homo sapiens
gccccatgacctcc

SEQ ID NO: 2079495 - DNA, 17 bp, Homo sapiens
gccccatgacctccagc

SEQ ID NO: 2079496 - DNA, 14 bp, Homo sapiens
gccccatgctctgc

SEQ ID NO: 2079497 - DNA, 15 bp, Homo sapiens
gccccatgctctgcc

SEQ ID NO: 2079498 - DNA, 14 bp, Homo sapiens
gccccattctgcct

SEQ ID NO: 2079499 - DNA, 15 bp, Homo sapiens
gccccattctgcctg

SEQ ID NO: 2079500 - DNA, 17 bp, Homo sapiens
gccccattctgcctgcc

SEQ ID NO: 2079501 - DNA, 20 bp, Homo sapiens
gccccattctgcctgcccag

SEQ ID NO: 2079502 - DNA, 13 bp, Homo sapiens
gcccccaagcctc

SEQ ID NO: 2079503 - DNA, 21 bp, Homo sapiens
gcccccaccactaggactctg

SEQ ID NO: 2079504 - DNA, 21 bp, Homo sapiens
gcccccactttcctacaaaat

SEQ ID NO: 2079505 - DNA, 16 bp, Homo sapiens
gcccccaggtgccagt

SEQ ID NO: 2079506 - DNA, 18 bp, Homo sapiens
gcccccatcccacatgat

SEQ ID NO: 2079507 - DNA, 16 bp, Homo sapiens
gcccccatctccccag

SEQ ID NO: 2079508 - DNA, 17 bp, Homo sapiens
gcccccatctccccagg

SEQ ID NO: 2079509 - DNA, 18 bp, Homo sapiens
gcccccatctccccaggc

SEQ ID NO: 2079510 - DNA, 23 bp, Homo sapiens
gcccccatctccccaggcctcca

SEQ ID NO: 2079511 - DNA, 16 bp, Homo sapiens
gccccccctcttttgg

SEQ ID NO: 2079512 - DNA, 13 bp, Homo sapiens
gccccccgcagca

SEQ ID NO: 2079513 - DNA, 14 bp, Homo sapiens
gccccccgcagcac

SEQ ID NO: 2079514 - DNA, 15 bp, Homo sapiens
gccccccgcagcacc

SEQ ID NO: 2079515 - DNA, 14 bp, Homo sapiens
gcccccctccaggc

SEQ ID NO: 2079516 - DNA, 17 bp, Homo sapiens
gcccccgacagcccagc

SEQ ID NO: 2079517 - DNA, 21 bp, Homo sapiens
gcccccgctggctcctccagg

SEQ ID NO: 2079518 - DNA, 21 bp, Homo sapiens
gccccctggtggacagtcctg

SEQ ID NO: 2079519 - DNA, 15 bp, Homo sapiens
gccccctgtgccagc

SEQ ID NO: 2079520 - DNA, 20 bp, Homo sapiens
gccccctgtgccagctcagg

SEQ ID NO: 2079521 - DNA, 12 bp, Homo sapiens
gccccgactcca

SEQ ID NO: 2079522 - DNA, 14 bp, Homo sapiens
gccccgactccagc

SEQ ID NO: 2079523 - DNA, 20 bp, Homo sapiens
gcagctgggacccctcccaa

SEQ ID NO: 2079524 - DNA, 12 bp, Homo sapiens
gcagctgggact

SEQ ID NO: 2079525 - DNA, 17 bp, Homo sapiens
gcagctgggccccacct

SEQ ID NO: 2079526 - DNA, 22 bp, Homo sapiens
gcagctgggccccatgctctgc

SEQ ID NO: 2079527 - DNA, 12 bp, Homo sapiens
gcagctgggccg

SEQ ID NO: 2079528 - DNA, 17 bp, Homo sapiens
gcagctgggccggccag

SEQ ID NO: 2079529 - DNA, 20 bp, Homo sapiens
gcagctgggccggccagcct

SEQ ID NO: 2079530 - DNA, 18 bp, Homo sapiens
gcagctgtagctcccgag

SEQ ID NO: 2079531 - DNA, 13 bp, Homo sapiens
gcagcttcagttg

SEQ ID NO: 2079532 - DNA, 17 bp, Homo sapiens
gcagcttcatcaatttt

SEQ ID NO: 2079533 - DNA, 18 bp, Homo sapiens
gcagcttcatcaattttt

SEQ ID NO: 2079534 - DNA, 14 bp, Homo sapiens
gcagcttctgtcct

SEQ ID NO: 2079535 - DNA, 13 bp, Homo sapiens
gcagcttgagcct

SEQ ID NO: 2079536 - DNA, 14 bp, Homo sapiens
gcagcttgagcctg

SEQ ID NO: 2079537 - DNA, 16 bp, Homo sapiens
gcagcttgagggttgg

SEQ ID NO: 2079538 - DNA, 16 bp, Homo sapiens
gcaggaacagagactc

SEQ ID NO: 2079539 - DNA, 17 bp, Homo sapiens
gcaggaacctgtactgg

SEQ ID NO: 2079540 - DNA, 16 bp, Homo sapiens
gcaggaacgagcactg

SEQ ID NO: 2079541 - DNA, 20 bp, Homo sapiens
gcaggaacgagcactggcca

SEQ ID NO: 2079542 - DNA, 23 bp, Homo sapiens
gcaggaacgagcactggccagag

SEQ ID NO: 2079543 - DNA, 14 bp, Homo sapiens
gcaggaactcccag

SEQ ID NO: 2079544 - DNA, 16 bp, Homo sapiens
gcaggaactcccagca

SEQ ID NO: 2079545 - DNA, 14 bp, Homo sapiens
gcaggaagagagag

SEQ ID NO: 2079546 - DNA, 21 bp, Homo sapiens
gcaggaagagagagagagagg

SEQ ID NO: 2079547 - DNA, 15 bp, Homo sapiens
gcaggaagccaggct

SEQ ID NO: 2079548 - DNA, 20 bp, Homo sapiens
gcaggaagccaggctgagtg

SEQ ID NO: 2079549 - DNA, 22 bp, Homo sapiens
gcaggacacatcccggcctctt

SEQ ID NO: 2079550 - DNA, 23 bp, Homo sapiens
gcaggacacatcccggcctcttc

SEQ ID NO: 2079551 - DNA, 15 bp, Homo sapiens
gcaggacaggagaca

SEQ ID NO: 2079552 - DNA, 23 bp, Homo sapiens
gcaggactcggaattctcgggaa

SEQ ID NO: 2079553 - DNA, 14 bp, Homo sapiens
gcaggagcaggaac

SEQ ID NO: 2079554 - DNA, 17 bp, Homo sapiens
gcaggagcaggaacaga

SEQ ID NO: 2079555 - DNA, 21 bp, Homo sapiens
gcaggagcaggaacagagact

SEQ ID NO: 2079556 - DNA, 13 bp, Homo sapiens
gcaggaggcctgg

SEQ ID NO: 2079557 - DNA, 14 bp, Homo sapiens
gcaggaggcctggc

SEQ ID NO: 2079558 - DNA, 14 bp, Homo sapiens
gcaggagtagctga

SEQ ID NO: 2079559 - DNA, 19 bp, Homo sapiens
gcaggagtggccggggaag

SEQ ID NO: 2079560 - DNA, 12 bp, Homo sapiens
gcaggatctcag

SEQ ID NO: 2079561 - DNA, 14 bp, Homo sapiens
gcaggcacaggaca

SEQ ID NO: 2079562 - DNA, 14 bp, Homo sapiens
gcaggcagagcggg

SEQ ID NO: 2079563 - DNA, 17 bp, Homo sapiens
gcaggcagagcggggag

SEQ ID NO: 2079564 - DNA, 12 bp, Homo sapiens
gcaggcagggct

SEQ ID NO: 2079565 - DNA, 15 bp, Homo sapiens
gcaggcagggctctc

SEQ ID NO: 2079566 - DNA, 12 bp, Homo sapiens
gcaggcatgccg

SEQ ID NO: 2079567 - DNA, 20 bp, Homo sapiens
gcaggccaggttatgcctca

SEQ ID NO: 2079568 - DNA, 17 bp, Homo sapiens
gcaggcccgacagagag

SEQ ID NO: 2079569 - DNA, 19 bp, Homo sapiens
gcaggcccgacagagagat

SEQ ID NO: 2079570 - DNA, 21 bp, Homo sapiens
gcaggcccgacagagagatga

SEQ ID NO: 2079571 - DNA, 20 bp, Homo sapiens
gcaggcctaggacctcaggc

SEQ ID NO: 2079572 - DNA, 19 bp, Homo sapiens
gcaggcctgggacccagct

SEQ ID NO: 2079573 - DNA, 13 bp, Homo sapiens
gcaggctccccct

SEQ ID NO: 2079574 - DNA, 11 bp, Homo sapiens
gcaggctctgg

SEQ ID NO: 2079575 - DNA, 14 bp, Homo sapiens
gcaggctctgggct

SEQ ID NO: 2079576 - DNA, 13 bp, Homo sapiens
gcagggaaacagc

SEQ ID NO: 2079577 - DNA, 15 bp, Homo sapiens
gcagggaaagctcca

SEQ ID NO: 2079578 - DNA, 17 bp, Homo sapiens
gcagggaaagctccacg

SEQ ID NO: 2079579 - DNA, 22 bp, Homo sapiens
gcagggaaaggctctgaaagcc

SEQ ID NO: 2079580 - DNA, 21 bp, Homo sapiens
gcagggaagtcttacttaaaa

SEQ ID NO: 2079581 - DNA, 21 bp, Homo sapiens
gcagggacaaagaggccttta

SEQ ID NO: 2079582 - DNA, 22 bp, Homo sapiens
gcagggagaggagtgactgagc

SEQ ID NO: 2079583 - DNA, 21 bp, Homo sapiens
gcagggagcatggctgtgagg

SEQ ID NO: 2079584 - DNA, 16 bp, Homo sapiens
gcagggagctgggctt

SEQ ID NO: 2079585 - DNA, 17 bp, Homo sapiens
gcagggagctgggcttc

SEQ ID NO: 2079586 - DNA, 16 bp, Homo sapiens
gcagggaggatgccac

SEQ ID NO: 2079587 - DNA, 13 bp, Homo sapiens
gcagggaggggac

SEQ ID NO: 2079588 - DNA, 14 bp, Homo sapiens
gcagggaggggact

SEQ ID NO: 2079589 - DNA, 22 bp, Homo sapiens
gcagggatgtcacgtcttgaaa

SEQ ID NO: 2079590 - DNA, 13 bp, Homo sapiens
gcagggccgggga

SEQ ID NO: 2079591 - DNA, 22 bp, Homo sapiens
gcagggccggggaactggccaa

SEQ ID NO: 2079592 - DNA, 14 bp, Homo sapiens
gcagggctcagcgg

SEQ ID NO: 2079593 - DNA, 15 bp, Homo sapiens
gcagggctctcctgg

SEQ ID NO: 2079594 - DNA, 18 bp, Homo sapiens
gcagggctctcctggctt

SEQ ID NO: 2079595 - DNA, 16 bp, Homo sapiens
gcagggctctgcccca

SEQ ID NO: 2079596 - DNA, 12 bp, Homo sapiens
gcagggctggga

SEQ ID NO: 2079597 - DNA, 19 bp, Homo sapiens
gcaggggtccttggtgtga

SEQ ID NO: 2079598 - DNA, 16 bp, Homo sapiens
gcagggtcaggagagg

SEQ ID NO: 2079599 - DNA, 17 bp, Homo sapiens
gcagggtcaggagaggg

SEQ ID NO: 2079600 - DNA, 18 bp, Homo sapiens
gcagggtctcactctgtc

SEQ ID NO: 2079601 - DNA, 20 bp, Homo sapiens
gcagggtgggggagggaggt

SEQ ID NO: 2079602 - DNA, 20 bp, Homo sapiens
gcaggtagatcgcttgagcc

SEQ ID NO: 2079603 - DNA, 21 bp, Homo sapiens
gcaggtcctgcccatgtgtcc

SEQ ID NO: 2079604 - DNA, 15 bp, Homo sapiens
gcaggtctctggcag

SEQ ID NO: 2079605 - DNA, 14 bp, Homo sapiens
gcaggtgcaagaga

SEQ ID NO: 2079606 - DNA, 19 bp, Homo sapiens
gcaggtgcaagagacagag

SEQ ID NO: 2079607 - DNA, 20 bp, Homo sapiens
gcaggtgcaagagacagagc

SEQ ID NO: 2079608 - DNA, 21 bp, Homo sapiens
gcaggtgcaagagacagagcc

SEQ ID NO: 2079609 - DNA, 17 bp, Homo sapiens
gcaggtggcatctctaa

SEQ ID NO: 2079610 - DNA, 16 bp, Homo sapiens
gcaggttgaggggctc

SEQ ID NO: 2079611 - DNA, 19 bp, Homo sapiens
gcaggttgaggggctcctg

SEQ ID NO: 2079612 - DNA, 21 bp, Homo sapiens
gcaggttgaggggctcctgga

SEQ ID NO: 2079613 - DNA, 22 bp, Homo sapiens
gcaggttgaggggctcctggaa

SEQ ID NO: 2079614 - DNA, 18 bp, Homo sapiens
gcagtaaactttctctgc

SEQ ID NO: 2079615 - DNA, 19 bp, Homo sapiens
gcagtaaatccacagccaa

SEQ ID NO: 2079616 - DNA, 15 bp, Homo sapiens
gcagtaagtcttttt

SEQ ID NO: 2079617 - DNA, 18 bp, Homo sapiens
gcagtaagtcttttttga

SEQ ID NO: 2079618 - DNA, 22 bp, Homo sapiens
gcagtacctgggaaaggaccca

SEQ ID NO: 2079619 - DNA, 12 bp, Homo sapiens
gcagtagtctct

SEQ ID NO: 2079620 - DNA, 15 bp, Homo sapiens
gcagtatctctctgc

SEQ ID NO: 2079621 - DNA, 13 bp, Homo sapiens
gcagtatgaatga

SEQ ID NO: 2079622 - DNA, 18 bp, Homo sapiens
gcagtatgaatgatgttt

SEQ ID NO: 2079623 - DNA, 21 bp, Homo sapiens
gcagtattccatgggatgtta

SEQ ID NO: 2079624 - DNA, 20 bp, Homo sapiens
gcagtcacactgttactcca

SEQ ID NO: 2079625 - DNA, 21 bp, Homo sapiens
gcagtccagaataagtgctgt

SEQ ID NO: 2079626 - DNA, 13 bp, Homo sapiens
gcagtccagccag

SEQ ID NO: 2079627 - DNA, 18 bp, Homo sapiens
gcagtccagccagctcct

SEQ ID NO: 2079628 - DNA, 14 bp, Homo sapiens
gcagtccccagccc

SEQ ID NO: 2079629 - DNA, 19 bp, Homo sapiens
gcagtccccagcccttctg

SEQ ID NO: 2079630 - DNA, 22 bp, Homo sapiens
gcagtccccagcccttctgcct

SEQ ID NO: 2079631 - DNA, 17 bp, Homo sapiens
gcagtcccgtggagggt

SEQ ID NO: 2079632 - DNA, 18 bp, Homo sapiens
gcagtcccgtggagggta

SEQ ID NO: 2079633 - DNA, 20 bp, Homo sapiens
gcagtcccgtggagggtagg

SEQ ID NO: 2079634 - DNA, 15 bp, Homo sapiens
gcagtctcagaaagc

SEQ ID NO: 2079635 - DNA, 18 bp, Homo sapiens
gcagtctcgggtggctag

SEQ ID NO: 2079636 - DNA, 19 bp, Homo sapiens
gcagtctgaacccttgtgc

SEQ ID NO: 2079637 - DNA, 18 bp, Homo sapiens
gcagtctggcctgggcga

SEQ ID NO: 2079638 - DNA, 16 bp, Homo sapiens
gcagtgaaaaatatgt

SEQ ID NO: 2079639 - DNA, 23 bp, Homo sapiens
gcagtgaacacactcagcagccc

SEQ ID NO: 2079640 - DNA, 16 bp, Homo sapiens
gccagagaagataatg

SEQ ID NO: 2079641 - DNA, 19 bp, Homo sapiens
gccagagaggagcacctga

SEQ ID NO: 2079642 - DNA, 19 bp, Homo sapiens
gccagagagggcccagctg

SEQ ID NO: 2079643 - DNA, 21 bp, Homo sapiens
gccagagcccaagtgccatcc

SEQ ID NO: 2079644 - DNA, 23 bp, Homo sapiens
gccagagcccaagtgccatccca

SEQ ID NO: 2079645 - DNA, 12 bp, Homo sapiens
gccagagcctgg

SEQ ID NO: 2079646 - DNA, 16 bp, Homo sapiens
gccagagcctggggca

SEQ ID NO: 2079647 - DNA, 15 bp, Homo sapiens
gccagagctttgttt

SEQ ID NO: 2079648 - DNA, 12 bp, Homo sapiens
gccagaggacaa

SEQ ID NO: 2079649 - DNA, 20 bp, Homo sapiens
gccagagggagtgacagagg

SEQ ID NO: 2079650 - DNA, 22 bp, Homo sapiens
gccagagggagtgacagaggca

SEQ ID NO: 2079651 - DNA, 15 bp, Homo sapiens
gccagatccacccta

SEQ ID NO: 2079652 - DNA, 16 bp, Homo sapiens
gccagatgcaccagcc

SEQ ID NO: 2079653 - DNA, 17 bp, Homo sapiens
gccagcaaaccaggact

SEQ ID NO: 2079654 - DNA, 21 bp, Homo sapiens
gccagcaatgatgtccagaag

SEQ ID NO: 2079655 - DNA, 21 bp, Homo sapiens
gccagcaccctctcctggggg

SEQ ID NO: 2079656 - DNA, 19 bp, Homo sapiens
gccagcagccagctctcag

SEQ ID NO: 2079657 - DNA, 21 bp, Homo sapiens
gccagcagccagctctcagcc

SEQ ID NO: 2079658 - DNA, 21 bp, Homo sapiens
gccagcattttcacattttgc

SEQ ID NO: 2079659 - DNA, 12 bp, Homo sapiens
gccagccagcag

SEQ ID NO: 2079660 - DNA, 14 bp, Homo sapiens
gccagccagcagcc

SEQ ID NO: 2079661 - DNA, 22 bp, Homo sapiens
gccagccagtcttgcctaggcc

SEQ ID NO: 2079662 - DNA, 10 bp, Homo sapiens
gccagcccta

SEQ ID NO: 2079663 - DNA, 18 bp, Homo sapiens
gccagccctacatcttca

SEQ ID NO: 2079664 - DNA, 22 bp, Homo sapiens
gccagccctacatcttcagctc

SEQ ID NO: 2079665 - DNA, 23 bp, Homo sapiens
gccagccctacatcttcagctcc

SEQ ID NO: 2079666 - DNA, 14 bp, Homo sapiens
gccagccctccctg

SEQ ID NO: 2079667 - DNA, 21 bp, Homo sapiens
gccagccctccctgtcctcct

SEQ ID NO: 2079668 - DNA, 22 bp, Homo sapiens
gccagccctccctgtcctcctc

SEQ ID NO: 2079669 - DNA, 18 bp, Homo sapiens
gccagccctgcctggagg

SEQ ID NO: 2079670 - DNA, 20 bp, Homo sapiens
gccagccctgcctggaggac

SEQ ID NO: 2079671 - DNA, 23 bp, Homo sapiens
gccagccctgcctggaggacctg

SEQ ID NO: 2079672 - DNA, 17 bp, Homo sapiens
gccagccgccctgggct

SEQ ID NO: 2079673 - DNA, 15 bp, Homo sapiens
gccagccggtgcctg

SEQ ID NO: 2079674 - DNA, 17 bp, Homo sapiens
gccagccggtgcctggc

SEQ ID NO: 2079675 - DNA, 20 bp, Homo sapiens
gccagccgtgatgctcaggc

SEQ ID NO: 2079676 - DNA, 14 bp, Homo sapiens
gccagcctcagtgc

SEQ ID NO: 2079677 - DNA, 16 bp, Homo sapiens
gccagcctcagtgcca

SEQ ID NO: 2079678 - DNA, 19 bp, Homo sapiens
gccagcctgctccttccca

SEQ ID NO: 2079679 - DNA, 11 bp, Homo sapiens
gccagcctggc

SEQ ID NO: 2079680 - DNA, 12 bp, Homo sapiens
gccagcctggcc

SEQ ID NO: 2079681 - DNA, 17 bp, Homo sapiens
gccagcctggcctcctg

SEQ ID NO: 2079682 - DNA, 17 bp, Homo sapiens
gccagcctggcttctgg

SEQ ID NO: 2079683 - DNA, 19 bp, Homo sapiens
gccagcctggcttctggag

SEQ ID NO: 2079684 - DNA, 20 bp, Homo sapiens
gccagcctggcttctggagc

SEQ ID NO: 2079685 - DNA, 21 bp, Homo sapiens
gccagcctggcttctggagcc

SEQ ID NO: 2079686 - DNA, 12 bp, Homo sapiens
gccagcctggga

SEQ ID NO: 2079687 - DNA, 13 bp, Homo sapiens
gccagcctgggac

SEQ ID NO: 2079688 - DNA, 15 bp, Homo sapiens
gccagcctgggactc

SEQ ID NO: 2079689 - DNA, 19 bp, Homo sapiens
gccagccttgcactgtggg

SEQ ID NO: 2079690 - DNA, 20 bp, Homo sapiens
gccagccttgcactgtgggg

SEQ ID NO: 2079691 - DNA, 16 bp, Homo sapiens
gccagcgcctccctcc

SEQ ID NO: 2079692 - DNA, 21 bp, Homo sapiens
gccagcgcctccctccacccc

SEQ ID NO: 2079693 - DNA, 22 bp, Homo sapiens
gccagcgcctccctccacccca

SEQ ID NO: 2079694 - DNA, 21 bp, Homo sapiens
gccagctcaggtgactggagc

SEQ ID NO: 2079695 - DNA, 21 bp, Homo sapiens
gccagctctagttttcagcct

SEQ ID NO: 2079696 - DNA, 12 bp, Homo sapiens
gccagctggtgc

SEQ ID NO: 2079697 - DNA, 21 bp, Homo sapiens
gccagctggtgctgcaaggaa

SEQ ID NO: 2079698 - DNA, 23 bp, Homo sapiens
gccagcttcctgtgggccaggag

SEQ ID NO: 2079699 - DNA, 10 bp, Homo sapiens
gccaggacac

SEQ ID NO: 2079700 - DNA, 13 bp, Homo sapiens
gccaggacacctg

SEQ ID NO: 2079701 - DNA, 17 bp, Homo sapiens
gccaggacacctgcccc

SEQ ID NO: 2079702 - DNA, 18 bp, Homo sapiens
gccaggacacctgcccca

SEQ ID NO: 2079703 - DNA, 20 bp, Homo sapiens
gccaggacacctgccccagc

SEQ ID NO: 2079704 - DNA, 14 bp, Homo sapiens
gccaggacagctgg

SEQ ID NO: 2079705 - DNA, 14 bp, Homo sapiens
gccaggacaggccc

SEQ ID NO: 2079706 - DNA, 21 bp, Homo sapiens
gccaggactccccaggccagg

SEQ ID NO: 2079707 - DNA, 22 bp, Homo sapiens
gccaggactccccaggccaggc

SEQ ID NO: 2079708 - DNA, 12 bp, Homo sapiens
gccaggagagag

SEQ ID NO: 2079709 - DNA, 19 bp, Homo sapiens
gccatattctgttggccag

SEQ ID NO: 2079710 - DNA, 20 bp, Homo sapiens
gccatattctgttggccagt

SEQ ID NO: 2079711 - DNA, 15 bp, Homo sapiens
gccatcaagagactg

SEQ ID NO: 2079712 - DNA, 21 bp, Homo sapiens
gccatcacaaggggaacgcag

SEQ ID NO: 2079713 - DNA, 23 bp, Homo sapiens
gccatcagggtgggccactctcc

SEQ ID NO: 2079714 - DNA, 18 bp, Homo sapiens
gccatcatgtgcctggaa

SEQ ID NO: 2079715 - DNA, 14 bp, Homo sapiens
gccatccaggttca

SEQ ID NO: 2079716 - DNA, 19 bp, Homo sapiens
gccatccaggttcagcttg

SEQ ID NO: 2079717 - DNA, 12 bp, Homo sapiens
gccatccctggg

SEQ ID NO: 2079718 - DNA, 14 bp, Homo sapiens
gccatccctgggcc

SEQ ID NO: 2079719 - DNA, 21 bp, Homo sapiens
gccatccctgggcccctccac

SEQ ID NO: 2079720 - DNA, 19 bp, Homo sapiens
gccatccgggacgcttcca

SEQ ID NO: 2079721 - DNA, 22 bp, Homo sapiens
gccatccgggacgcttccagac

SEQ ID NO: 2079722 - DNA, 23 bp, Homo sapiens
gccatccttcaccagagcccatg

SEQ ID NO: 2079723 - DNA, 16 bp, Homo sapiens
gccatctccaccctga

SEQ ID NO: 2079724 - DNA, 12 bp, Homo sapiens
gccatgccactg

SEQ ID NO: 2079725 - DNA, 13 bp, Homo sapiens
gccatgccactgc

SEQ ID NO: 2079726 - DNA, 16 bp, Homo sapiens
gccatgccactgccag

SEQ ID NO: 2079727 - DNA, 18 bp, Homo sapiens
gccatgccactgccaggc

SEQ ID NO: 2079728 - DNA, 14 bp, Homo sapiens
gccatgctgaaggg

SEQ ID NO: 2079729 - DNA, 19 bp, Homo sapiens
gccatgcttcttgcccctt

SEQ ID NO: 2079730 - DNA, 20 bp, Homo sapiens
gccatgcttcttgccccttg

SEQ ID NO: 2079731 - DNA, 23 bp, Homo sapiens
gccatgcttcttgccccttgggc

SEQ ID NO: 2079732 - DNA, 13 bp, Homo sapiens
gccatggagttgt

SEQ ID NO: 2079733 - DNA, 22 bp, Homo sapiens
gccatggcgtgtccctctcgga

SEQ ID NO: 2079734 - DNA, 15 bp, Homo sapiens
gccatggctcaggca

SEQ ID NO: 2079735 - DNA, 20 bp, Homo sapiens
gccatggctcaggcaagccc

SEQ ID NO: 2079736 - DNA, 21 bp, Homo sapiens
gccatggctcaggcaagcccc

SEQ ID NO: 2079737 - DNA, 23 bp, Homo sapiens
gccatggctcaggcaagcccctc

SEQ ID NO: 2079738 - DNA, 13 bp, Homo sapiens
gccatgggcctgc

SEQ ID NO: 2079739 - DNA, 16 bp, Homo sapiens
gccatgggcctgggcc

SEQ ID NO: 2079740 - DNA, 21 bp, Homo sapiens
gccatgggcctgggcctgctt

SEQ ID NO: 2079741 - DNA, 14 bp, Homo sapiens
gccatgtgccaggt

SEQ ID NO: 2079742 - DNA, 18 bp, Homo sapiens
gccatgttggccaggctg

SEQ ID NO: 2079743 - DNA, 19 bp, Homo sapiens
gccatgttggccaggctgg

SEQ ID NO: 2079744 - DNA, 18 bp, Homo sapiens
gccatgtttggttgtaaa

SEQ ID NO: 2079745 - DNA, 20 bp, Homo sapiens
gccatgtttggttgtaaatg

SEQ ID NO: 2079746 - DNA, 13 bp, Homo sapiens
gccattaccatgg

SEQ ID NO: 2079747 - DNA, 16 bp, Homo sapiens
gccattaccatggaga

SEQ ID NO: 2079748 - DNA, 18 bp, Homo sapiens
gccattaccatggagaca

SEQ ID NO: 2079749 - DNA, 14 bp, Homo sapiens
gccattccaacagc

SEQ ID NO: 2079750 - DNA, 13 bp, Homo sapiens
gccattcccagcg

SEQ ID NO: 2079751 - DNA, 22 bp, Homo sapiens
gccatttcattgagggaaaaca

SEQ ID NO: 2079752 - DNA, 20 bp, Homo sapiens
gccatttgtatttgtattcc

SEQ ID NO: 2079753 - DNA, 13 bp, Homo sapiens
gccattttaataa

SEQ ID NO: 2079754 - DNA, 16 bp, Homo sapiens
gccattttcttgcctg

SEQ ID NO: 2079755 - DNA, 17 bp, Homo sapiens
gccattttcttgcctga

SEQ ID NO: 2079756 - DNA, 20 bp, Homo sapiens
gccattttcttgcctgaggc

SEQ ID NO: 2079757 - DNA, 22 bp, Homo sapiens
gccattttcttgcctgaggctc

SEQ ID NO: 2079758 - DNA, 21 bp, Homo sapiens
gcccaaagagaaatcacaggg

SEQ ID NO: 2079759 - DNA, 17 bp, Homo sapiens
gcccaaagtctgtgtga

SEQ ID NO: 2079760 - DNA, 15 bp, Homo sapiens
gcccaaatggctctg

SEQ ID NO: 2079761 - DNA, 19 bp, Homo sapiens
gcccaaccctgcccacttc

SEQ ID NO: 2079762 - DNA, 20 bp, Homo sapiens
gcccaaccctgcccacttca

SEQ ID NO: 2079763 - DNA, 19 bp, Homo sapiens
gcccaagaggtctgagccc

SEQ ID NO: 2079764 - DNA, 22 bp, Homo sapiens
gcccaagcctggtctcctccca

SEQ ID NO: 2079765 - DNA, 18 bp, Homo sapiens
gcccaagtgccatcccac

SEQ ID NO: 2079766 - DNA, 20 bp, Homo sapiens
gcccaagtgccatcccacat

SEQ ID NO: 2079767 - DNA, 18 bp, Homo sapiens
gcccaatattataatttt

SEQ ID NO: 2079768 - DNA, 12 bp, Homo sapiens
gcccacacccct

SEQ ID NO: 2079769 - DNA, 13 bp, Homo sapiens
gcccacacccctc

SEQ ID NO: 2079770 - DNA, 13 bp, Homo sapiens
gcccacagagcct

SEQ ID NO: 2079771 - DNA, 14 bp, Homo sapiens
gcccacagagcctg

SEQ ID NO: 2079772 - DNA, 17 bp, Homo sapiens
gcccacagctcccaccc

SEQ ID NO: 2079773 - DNA, 19 bp, Homo sapiens
gcccacagggaccaagaag

SEQ ID NO: 2079774 - DNA, 20 bp, Homo sapiens
gcccacatagtgatggttcc

SEQ ID NO: 2079775 - DNA, 17 bp, Homo sapiens
gcccaccttggctcaag

SEQ ID NO: 2079776 - DNA, 21 bp, Homo sapiens
gcccacgcccgactagcaggc

SEQ ID NO: 2079777 - DNA, 21 bp, Homo sapiens
gcccacgctggagtgcagtga

SEQ ID NO: 2079778 - DNA, 13 bp, Homo sapiens
gcccacttctgcc

SEQ ID NO: 2079779 - DNA, 17 bp, Homo sapiens
gcccagaaaacctccag

SEQ ID NO: 2079780 - DNA, 11 bp, Homo sapiens
gattttgcaca

SEQ ID NO: 2079781 - DNA, 12 bp, Homo sapiens
gattttgcacaa

SEQ ID NO: 2079782 - DNA, 15 bp, Homo sapiens
gattttgtacagaat

SEQ ID NO: 2079783 - DNA, 18 bp, Homo sapiens
gattttgtacagaatttt

SEQ ID NO: 2079784 - DNA, 14 bp, Homo sapiens
gatttttgggctcc

SEQ ID NO: 2079785 - DNA, 21 bp, Homo sapiens
gatttttgttttccactgtgc

SEQ ID NO: 2079786 - DNA, 18 bp, Homo sapiens
gattttttccttcaaagt

SEQ ID NO: 2079787 - DNA, 21 bp, Homo sapiens
gattttttccttcaaagttta

SEQ ID NO: 2079788 - DNA, 21 bp, Homo sapiens
gattttttttgtaacttcaaa

SEQ ID NO: 2079789 - DNA, 14 bp, Homo sapiens
gcaaaaaagaaaac

SEQ ID NO: 2079790 - DNA, 18 bp, Homo sapiens
gcaaaaaagaaaaccttt

SEQ ID NO: 2079791 - DNA, 23 bp, Homo sapiens
gcaaaaatagtttggatatgtaa

SEQ ID NO: 2079792 - DNA, 11 bp, Homo sapiens
gcaaaaatata

SEQ ID NO: 2079793 - DNA, 13 bp, Homo sapiens
gcaaaaatataaa

SEQ ID NO: 2079794 - DNA, 16 bp, Homo sapiens
gcaaaaatataaaata

SEQ ID NO: 2079795 - DNA, 18 bp, Homo sapiens
gcaaaacacgcaagggca

SEQ ID NO: 2079796 - DNA, 21 bp, Homo sapiens
gcaaaaccactagaactctcc

SEQ ID NO: 2079797 - DNA, 17 bp, Homo sapiens
gcaaaaccccatctcta

SEQ ID NO: 2079798 - DNA, 15 bp, Homo sapiens
gcaaaagaagaagtt

SEQ ID NO: 2079799 - DNA, 16 bp, Homo sapiens
gcaaaagactaattta

SEQ ID NO: 2079800 - DNA, 13 bp, Homo sapiens
gcaaaagtggggc

SEQ ID NO: 2079801 - DNA, 17 bp, Homo sapiens
gcaaaattataagaaga

SEQ ID NO: 2079802 - DNA, 10 bp, Homo sapiens
gcaaaatttc

SEQ ID NO: 2079803 - DNA, 13 bp, Homo sapiens
gcaaacatttctt

SEQ ID NO: 2079804 - DNA, 23 bp, Homo sapiens
gcaaaccatttcaaatggcagca

SEQ ID NO: 2079805 - DNA, 19 bp, Homo sapiens
gcaaactcactgctcaaga

SEQ ID NO: 2079806 - DNA, 15 bp, Homo sapiens
gcaaagaactgcccc

SEQ ID NO: 2079807 - DNA, 16 bp, Homo sapiens
gcaaagaactgcccca

SEQ ID NO: 2079808 - DNA, 16 bp, Homo sapiens
gcaaagatatctcatc

SEQ ID NO: 2079809 - DNA, 20 bp, Homo sapiens
gcaaagcctgttcatggcag

SEQ ID NO: 2079810 - DNA, 15 bp, Homo sapiens
gcaaaggaaaccaaa

SEQ ID NO: 2079811 - DNA, 16 bp, Homo sapiens
gcaaaggaaaccaaag

SEQ ID NO: 2079812 - DNA, 18 bp, Homo sapiens
gcaaaggaaaccaaagga

SEQ ID NO: 2079813 - DNA, 22 bp, Homo sapiens
gcaaagggctgaaagccatttg

SEQ ID NO: 2079814 - DNA, 14 bp, Homo sapiens
gcaaagtctaaagt

SEQ ID NO: 2079815 - DNA, 12 bp, Homo sapiens
cttaatgtttat

SEQ ID NO: 2079816 - DNA, 14 bp, Homo sapiens
cttaattttcagta

SEQ ID NO: 2079817 - DNA, 23 bp, Homo sapiens
cttaattttgtattttttcctgt

SEQ ID NO: 2079818 - DNA, 22 bp, Homo sapiens
cttacaaaaacaagacacccaa

SEQ ID NO: 2079819 - DNA, 23 bp, Homo sapiens
cttacacttggagcccgtgcagt

SEQ ID NO: 2079820 - DNA, 13 bp, Homo sapiens
cttacagtggagt

SEQ ID NO: 2079821 - DNA, 21 bp, Homo sapiens
cttacattagcagtttgcttt

SEQ ID NO: 2079822 - DNA, 22 bp, Homo sapiens
cttacattagcagtttgctttg

SEQ ID NO: 2079823 - DNA, 15 bp, Homo sapiens
cttacattgtgaaac

SEQ ID NO: 2079824 - DNA, 13 bp, Homo sapiens
cttacattttccc

SEQ ID NO: 2079825 - DNA, 17 bp, Homo sapiens
cttacatttttacaata

SEQ ID NO: 2079826 - DNA, 22 bp, Homo sapiens
cttacatttttacaataaataa

SEQ ID NO: 2079827 - DNA, 19 bp, Homo sapiens
cttaccaggcaccaaaaga

SEQ ID NO: 2079828 - DNA, 21 bp, Homo sapiens
cttacccggagaaggccgctg

SEQ ID NO: 2079829 - DNA, 15 bp, Homo sapiens
cttaccgtagcctcc

SEQ ID NO: 2079830 - DNA, 16 bp, Homo sapiens
cttaccgtagcctccg

SEQ ID NO: 2079831 - DNA, 21 bp, Homo sapiens
cttacctaaacagatataaat

SEQ ID NO: 2079832 - DNA, 18 bp, Homo sapiens
cttacctcccctgccagg

SEQ ID NO: 2079833 - DNA, 14 bp, Homo sapiens
cttacctcctgccc

SEQ ID NO: 2079834 - DNA, 16 bp, Homo sapiens
cttacctcctgcccag

SEQ ID NO: 2079835 - DNA, 20 bp, Homo sapiens
cttacctcctgcccaggaga

SEQ ID NO: 2079836 - DNA, 13 bp, Homo sapiens
cttacctgacaca

SEQ ID NO: 2079837 - DNA, 11 bp, Homo sapiens
cttacctgacg

SEQ ID NO: 2079838 - DNA, 12 bp, Homo sapiens
cttacctgacgg

SEQ ID NO: 2079839 - DNA, 16 bp, Homo sapiens
cttaccttcaataaag

SEQ ID NO: 2079840 - DNA, 18 bp, Homo sapiens
cttaccttcaataaagta

SEQ ID NO: 2079841 - DNA, 21 bp, Homo sapiens
cttactaaacattttgttatt

SEQ ID NO: 2079842 - DNA, 17 bp, Homo sapiens
cttactaatgtgcccca

SEQ ID NO: 2079843 - DNA, 16 bp, Homo sapiens
cttactacttcttgga

SEQ ID NO: 2079844 - DNA, 22 bp, Homo sapiens
cttactacttcttggaaaaaaa

SEQ ID NO: 2079845 - DNA, 18 bp, Homo sapiens
cttactcacctctctcta

SEQ ID NO: 2079846 - DNA, 15 bp, Homo sapiens
cttactcctgtggga

SEQ ID NO: 2079847 - DNA, 19 bp, Homo sapiens
cttactctgagcccaggcc

SEQ ID NO: 2079848 - DNA, 21 bp, Homo sapiens
cttactctgagcccaggccgt

SEQ ID NO: 2079849 - DNA, 19 bp, Homo sapiens
cttacttggaactgaaggg

SEQ ID NO: 2079850 - DNA, 17 bp, Homo sapiens
cttagaaattgcatttc

SEQ ID NO: 2079851 - DNA, 17 bp, Homo sapiens
cttagaagtcacacagt

SEQ ID NO: 2079852 - DNA, 20 bp, Homo sapiens
cttagaagtggaccaggaca

SEQ ID NO: 2079853 - DNA, 21 bp, Homo sapiens
cttagaagtggaccaggacag

SEQ ID NO: 2079854 - DNA, 17 bp, Homo sapiens
cttagaataaaattgta

SEQ ID NO: 2079855 - DNA, 20 bp, Homo sapiens
cttagaataaaattgtaaaa

SEQ ID NO: 2079856 - DNA, 14 bp, Homo sapiens
cttagacctcagcc

SEQ ID NO: 2079857 - DNA, 15 bp, Homo sapiens
cttagacctcagcct

SEQ ID NO: 2079858 - DNA, 19 bp, Homo sapiens
cttagatgagggtgactgt

SEQ ID NO: 2079859 - DNA, 16 bp, Homo sapiens
cttagattagctctgg

SEQ ID NO: 2079860 - DNA, 21 bp, Homo sapiens
cttagattagctctggaccag

SEQ ID NO: 2079861 - DNA, 18 bp, Homo sapiens
cttagccgtccatggcac

SEQ ID NO: 2079862 - DNA, 22 bp, Homo sapiens
cttagccgtccatggcaccagc

SEQ ID NO: 2079863 - DNA, 17 bp, Homo sapiens
cttagcctcctgacctg

SEQ ID NO: 2079864 - DNA, 17 bp, Homo sapiens
cttagcctggagcacct

SEQ ID NO: 2079865 - DNA, 14 bp, Homo sapiens
cttagccttgtgcc

SEQ ID NO: 2079866 - DNA, 16 bp, Homo sapiens
cttagccttgtgccct

SEQ ID NO: 2079867 - DNA, 17 bp, Homo sapiens
cttagccttgtgccctg

SEQ ID NO: 2079868 - DNA, 19 bp, Homo sapiens
cttagcttagacctcagcc

SEQ ID NO: 2079869 - DNA, 19 bp, Homo sapiens
cttagctttccacaggagg

SEQ ID NO: 2079870 - DNA, 22 bp, Homo sapiens
cttaggaagagaaaccagggag

SEQ ID NO: 2079871 - DNA, 18 bp, Homo sapiens
cttaggagcagagctctg

SEQ ID NO: 2079872 - DNA, 17 bp, Homo sapiens
cttaggcattatttaat

SEQ ID NO: 2079873 - DNA, 17 bp, Homo sapiens
cttaggtgccaggctgt

SEQ ID NO: 2079874 - DNA, 13 bp, Homo sapiens
cttagtatctcat

SEQ ID NO: 2079875 - DNA, 22 bp, Homo sapiens
cttagtatctcatcaacaaaga

SEQ ID NO: 2079876 - DNA, 22 bp, Homo sapiens
cttagtccgcaagttcagggaa

SEQ ID NO: 2079877 - DNA, 22 bp, Homo sapiens
cttagtgcggacaagttttaat

SEQ ID NO: 2079878 - DNA, 13 bp, Homo sapiens
cttagtggctttt

SEQ ID NO: 2079879 - DNA, 22 bp, Homo sapiens
cttataaatgtgtattctggct

SEQ ID NO: 2079880 - DNA, 23 bp, Homo sapiens
cttataaatgtgtattctggctg

SEQ ID NO: 2079881 - DNA, 18 bp, Homo sapiens
cttataagaattaatctt

SEQ ID NO: 2079882 - DNA, 13 bp, Homo sapiens
cttataagcccag

SEQ ID NO: 2079883 - DNA, 22 bp, Homo sapiens
cttataagtgggagctaaataa

SEQ ID NO: 2079884 - DNA, 14 bp, Homo sapiens
cttataccaaaggg

SEQ ID NO: 2079885 - DNA, 16 bp, Homo sapiens
cttatacgagtaatat

SEQ ID NO: 2079886 - DNA, 20 bp, Homo sapiens
cttatagaatatttattacc

SEQ ID NO: 2079887 - DNA, 18 bp, Homo sapiens
cttatatagtttactatt

SEQ ID NO: 2079888 - DNA, 21 bp, Homo sapiens
cttatatcatcagcatacctt

SEQ ID NO: 2079889 - DNA, 18 bp, Homo sapiens
cttatatgtgtattgcta

SEQ ID NO: 2079890 - DNA, 15 bp, Homo sapiens
cttatccaggactct

SEQ ID NO: 2079891 - DNA, 12 bp, Homo sapiens
cttatgaaatgg

SEQ ID NO: 2079892 - DNA, 17 bp, Homo sapiens
cttatgaaatgggcttt

SEQ ID NO: 2079893 - DNA, 22 bp, Homo sapiens
cttatgacatcacttgtacaaa

SEQ ID NO: 2079894 - DNA, 13 bp, Homo sapiens
cttatgagatggg

SEQ ID NO: 2079895 - DNA, 18 bp, Homo sapiens
cttatgtttgaagagaaa

SEQ ID NO: 2079896 - DNA, 13 bp, Homo sapiens
cttattgcccacg

SEQ ID NO: 2079897 - DNA, 13 bp, Homo sapiens
cttattgtacctc

SEQ ID NO: 2079898 - DNA, 18 bp, Homo sapiens
cttattgtacctctctta

SEQ ID NO: 2079899 - DNA, 23 bp, Homo sapiens
cttatttacctataaaatgagat

SEQ ID NO: 2079900 - DNA, 22 bp, Homo sapiens
cttatttacttgtagaaatctg

SEQ ID NO: 2079901 - DNA, 15 bp, Homo sapiens
cttatttatatatga

SEQ ID NO: 2079902 - DNA, 19 bp, Homo sapiens
cttatttatatatgaagta

SEQ ID NO: 2079903 - DNA, 23 bp, Homo sapiens
cttatttatattcagagatgtac

SEQ ID NO: 2079904 - DNA, 14 bp, Homo sapiens
cttatttcatttct

SEQ ID NO: 2079905 - DNA, 16 bp, Homo sapiens
cttatttccctcatct

SEQ ID NO: 2079906 - DNA, 11 bp, Homo sapiens
cttatttgagt

SEQ ID NO: 2079907 - DNA, 13 bp, Homo sapiens
cttatttgagtga

SEQ ID NO: 2079908 - DNA, 23 bp, Homo sapiens
cttatttgctgccacacctgagc

SEQ ID NO: 2079909 - DNA, 20 bp, Homo sapiens
cttatttgtttggtcactgc

SEQ ID NO: 2079910 - DNA, 15 bp, Homo sapiens
cttattttcaagaaa

SEQ ID NO: 2079911 - DNA, 12 bp, Homo sapiens
cttattttccaa

SEQ ID NO: 2079912 - DNA, 17 bp, Homo sapiens
cttattttccaataaaa

SEQ ID NO: 2079913 - DNA, 16 bp, Homo sapiens
cttattttgtaataaa

SEQ ID NO: 2079914 - DNA, 17 bp, Homo sapiens
cttattttgtaataaac

SEQ ID NO: 2079915 - DNA, 19 bp, Homo sapiens
cttattttgtaataaactc

SEQ ID NO: 2079916 - DNA, 15 bp, Homo sapiens
cttcaaagtttaata

SEQ ID NO: 2079917 - DNA, 16 bp, Homo sapiens
cttcaaatccatccag

SEQ ID NO: 2079918 - DNA, 20 bp, Homo sapiens
cttcaacaattctaaaatga

SEQ ID NO: 2079919 - DNA, 18 bp, Homo sapiens
cttcaagggaagaaacac

SEQ ID NO: 2079920 - DNA, 18 bp, Homo sapiens
cttcacaaccagccacac

SEQ ID NO: 2079921 - DNA, 23 bp, Homo sapiens
cttcacaaccagccacacagagc

SEQ ID NO: 2079922 - DNA, 21 bp, Homo sapiens
cttcacactgcaagagccttg

SEQ ID NO: 2079923 - DNA, 14 bp, Homo sapiens
cttcaccagagccc

SEQ ID NO: 2079924 - DNA, 13 bp, Homo sapiens
cttcacccctgca

SEQ ID NO: 2079925 - DNA, 18 bp, Homo sapiens
cttcacctttggtgcaga

SEQ ID NO: 2079926 - DNA, 22 bp, Homo sapiens
cttcacctttggtgcagaggtt

SEQ ID NO: 2079927 - DNA, 16 bp, Homo sapiens
cttcactattcctagg

SEQ ID NO: 2079928 - DNA, 13 bp, Homo sapiens
cttcactcagcca

SEQ ID NO: 2079929 - DNA, 15 bp, Homo sapiens
cttcactcagccaca

SEQ ID NO: 2079930 - DNA, 22 bp, Homo sapiens
cttcactccggtgtgcctgcag

SEQ ID NO: 2079931 - DNA, 22 bp, Homo sapiens
cttcactgtgaggggaaggcct

SEQ ID NO: 2079932 - DNA, 19 bp, Homo sapiens
cttcactgttgaaaattat

SEQ ID NO: 2079933 - DNA, 14 bp, Homo sapiens
cttcagaacagagg

SEQ ID NO: 2079934 - DNA, 16 bp, Homo sapiens
cttcagaacagaggca

SEQ ID NO: 2079935 - DNA, 23 bp, Homo sapiens
cttcagaacagaggcatttaaaa

SEQ ID NO: 2079936 - DNA, 15 bp, Homo sapiens
cttcagaacatgctg

SEQ ID NO: 2079937 - DNA, 16 bp, Homo sapiens
cttcagaacatgctgg

SEQ ID NO: 2079938 - DNA, 19 bp, Homo sapiens
cttcagaacatgctggata

SEQ ID NO: 2079939 - DNA, 12 bp, Homo sapiens
cttcagagaagt

SEQ ID NO: 2079940 - DNA, 12 bp, Homo sapiens
cttcagagccta

SEQ ID NO: 2079941 - DNA, 16 bp, Homo sapiens
cttcagagcctagcca

SEQ ID NO: 2079942 - DNA, 17 bp, Homo sapiens
cttcagagcctagccac

SEQ ID NO: 2079943 - DNA, 23 bp, Homo sapiens
cttcagagcctagccacctccca

SEQ ID NO: 2079944 - DNA, 11 bp, Homo sapiens
cttcagagctc

SEQ ID NO: 2079945 - DNA, 21 bp, Homo sapiens
cttcagagctcttcaagctgt

SEQ ID NO: 2079946 - DNA, 19 bp, Homo sapiens
cttcagagtagagggcttg

SEQ ID NO: 2079947 - DNA, 15 bp, Homo sapiens
cttcagatcagtgct

SEQ ID NO: 2079948 - DNA, 17 bp, Homo sapiens
cttcagatcagtgcttg

SEQ ID NO: 2079949 - DNA, 18 bp, Homo sapiens
cttcagatttgtgttata

SEQ ID NO: 2079950 - DNA, 17 bp, Homo sapiens
cttcagccacctctctt

SEQ ID NO: 2079951 - DNA, 14 bp, Homo sapiens
cttcagccatcaac

SEQ ID NO: 2079952 - DNA, 13 bp, Homo sapiens
cttcagcctagcc

SEQ ID NO: 2079953 - DNA, 23 bp, Homo sapiens
cttcagcctagccgacctcagcc

SEQ ID NO: 2079954 - DNA, 20 bp, Homo sapiens
cttcagcctccccaccttct

SEQ ID NO: 2079955 - DNA, 13 bp, Homo sapiens
cttcagctcccat

SEQ ID NO: 2079956 - DNA, 15 bp, Homo sapiens
cttcagctcccatag

SEQ ID NO: 2079957 - DNA, 15 bp, Homo sapiens
cttcaggctcttctc

SEQ ID NO: 2079958 - DNA, 23 bp, Homo sapiens
cttcagggccagaaggagggcag

SEQ ID NO: 2079959 - DNA, 19 bp, Homo sapiens
cttcagggtgagtgaatgg

SEQ ID NO: 2079960 - DNA, 13 bp, Homo sapiens
cttcaggtgcttt

SEQ ID NO: 2079961 - DNA, 18 bp, Homo sapiens
cttcaggttgttctgtat

SEQ ID NO: 2079962 - DNA, 16 bp, Homo sapiens
cttcagtcctggtctg

SEQ ID NO: 2079963 - DNA, 22 bp, Homo sapiens
cttcagtcctggtctgctcagg

SEQ ID NO: 2079964 - DNA, 11 bp, Homo sapiens
cttcagtgccc

SEQ ID NO: 2079965 - DNA, 14 bp, Homo sapiens
cttcagtggcagct

SEQ ID NO: 2079966 - DNA, 15 bp, Homo sapiens
cttcagtggcagctg

SEQ ID NO: 2079967 - DNA, 18 bp, Homo sapiens
cttcagtggcagctgctt

SEQ ID NO: 2079968 - DNA, 13 bp, Homo sapiens
cttcagtgggaga

SEQ ID NO: 2079969 - DNA, 15 bp, Homo sapiens
cttcagtgggagaaa

SEQ ID NO: 2079970 - DNA, 18 bp, Homo sapiens
cttcagtgggagaaaaca

SEQ ID NO: 2079971 - DNA, 14 bp, Homo sapiens
cttcagttgttttc

SEQ ID NO: 2079972 - DNA, 18 bp, Homo sapiens
cttcatagcagattttaa

SEQ ID NO: 2079973 - DNA, 20 bp, Homo sapiens
cttcatcaatttttatacat

SEQ ID NO: 2079974 - DNA, 21 bp, Homo sapiens
cttcatcaatttttatacata

SEQ ID NO: 2079975 - DNA, 13 bp, Homo sapiens
cttcatccctttc

SEQ ID NO: 2079976 - DNA, 14 bp, Homo sapiens
cttcatccctttcc

SEQ ID NO: 2079977 - DNA, 16 bp, Homo sapiens
cttcatccctttccag

SEQ ID NO: 2079978 - DNA, 14 bp, Homo sapiens
cttcatgcctcagt

SEQ ID NO: 2079979 - DNA, 15 bp, Homo sapiens
cttcatgcctcagtt

SEQ ID NO: 2079980 - DNA, 16 bp, Homo sapiens
cttcatgcctcagttt

SEQ ID NO: 2079981 - DNA, 19 bp, Homo sapiens
cttcatgcctcagtttccc

SEQ ID NO: 2079982 - DNA, 20 bp, Homo sapiens
cttcatgcctcagtttcccc

SEQ ID NO: 2079983 - DNA, 15 bp, Homo sapiens
cttcatgctcagccc

SEQ ID NO: 2079984 - DNA, 19 bp, Homo sapiens
cttcatgctcagccctgac

SEQ ID NO: 2079985 - DNA, 14 bp, Homo sapiens
cttcatggaactca

SEQ ID NO: 2079986 - DNA, 21 bp, Homo sapiens
cttcatggaactcagctgtct

SEQ ID NO: 2079987 - DNA, 18 bp, Homo sapiens
cttcatggaccaagaatg

SEQ ID NO: 2079988 - DNA, 22 bp, Homo sapiens
cttcatggaccaagaatgagct

SEQ ID NO: 2079989 - DNA, 20 bp, Homo sapiens
cttcattcttgaaagctgtg

SEQ ID NO: 2079990 - DNA, 21 bp, Homo sapiens
cttcattcttgaaagctgtgg

SEQ ID NO: 2079991 - DNA, 17 bp, Homo sapiens
cttcatttcattgtatg

SEQ ID NO: 2079992 - DNA, 18 bp, Homo sapiens
cttcatttcattgtatga

SEQ ID NO: 2079993 - DNA, 18 bp, Homo sapiens
cttcatttgggatgctac

SEQ ID NO: 2079994 - DNA, 24 bp, Homo sapiens
cttcatttgggatgctactctagt

SEQ ID NO: 2079995 - DNA, 13 bp, Homo sapiens
cttcatttgtgtc

SEQ ID NO: 2079996 - DNA, 18 bp, Homo sapiens
cttcatttgtgtcaatgg

SEQ ID NO: 2079997 - DNA, 14 bp, Homo sapiens
cttcattttcagag

SEQ ID NO: 2079998 - DNA, 17 bp, Homo sapiens
cttcattttcagagtga

SEQ ID NO: 2079999 - DNA, 13 bp, Homo sapiens
cttccaaagcaca

SEQ ID NO: 2080000 - DNA, 13 bp, Homo sapiens
cttccaaccccag

SEQ ID NO: 2080001 - DNA, 19 bp, Homo sapiens
cttccaaccccagctggcc

SEQ ID NO: 2080002 - DNA, 16 bp, Homo sapiens
cttccaagcaaaggtg

SEQ ID NO: 2080003 - DNA, 21 bp, Homo sapiens
cttccacccattcccccatgt

SEQ ID NO: 2080004 - DNA, 15 bp, Homo sapiens
cttccacctcctaga

SEQ ID NO: 2080005 - DNA, 14 bp, Homo sapiens
cttccactggctcc

SEQ ID NO: 2080006 - DNA, 18 bp, Homo sapiens
cttccagaagatgccctc

SEQ ID NO: 2080007 - DNA, 15 bp, Homo sapiens
cttccagaccacctg

SEQ ID NO: 2080008 - DNA, 21 bp, Homo sapiens
cttccagaccacctgccagcc

SEQ ID NO: 2080009 - DNA, 23 bp, Homo sapiens
cttccagaccacctgccagccat

SEQ ID NO: 2080010 - DNA, 18 bp, Homo sapiens
cttccagagcctaagaaa

SEQ ID NO: 2080011 - DNA, 22 bp, Homo sapiens
cttccagctagtgacccacatg

SEQ ID NO: 2080012 - DNA, 23 bp, Homo sapiens
cttccaggctcttcctggacctg

SEQ ID NO: 2080013 - DNA, 19 bp, Homo sapiens
cttccaggtatctccagga

SEQ ID NO: 2080014 - DNA, 20 bp, Homo sapiens
cttccaggtatctccaggat

SEQ ID NO: 2080015 - DNA, 15 bp, Homo sapiens
cttccagtgcatgtt

SEQ ID NO: 2080016 - DNA, 16 bp, Homo sapiens
cttccagtgcatgttg

SEQ ID NO: 2080017 - DNA, 20 bp, Homo sapiens
cttccagtggtaccagctca

SEQ ID NO: 2080018 - DNA, 12 bp, Homo sapiens
cttccagtgttg

SEQ ID NO: 2080019 - DNA, 23 bp, Homo sapiens
cttccagtgttggctgtgtgaca

SEQ ID NO: 2080020 - DNA, 14 bp, Homo sapiens
cttccagtttgctt

SEQ ID NO: 2080021 - DNA, 21 bp, Homo sapiens
cttccataatctggactcctc

SEQ ID NO: 2080022 - DNA, 17 bp, Homo sapiens
cttccatgagaacagca

SEQ ID NO: 2080023 - DNA, 15 bp, Homo sapiens
cttccatgtcgcctc

SEQ ID NO: 2080024 - DNA, 16 bp, Homo sapiens
cttccatgtcgcctct

SEQ ID NO: 2080025 - DNA, 19 bp, Homo sapiens
cttccatgtcgcctctgca

SEQ ID NO: 2080026 - DNA, 20 bp, Homo sapiens
cttccatgtcgcctctgcat

SEQ ID NO: 2080027 - DNA, 20 bp, Homo sapiens
cttcccaatcagcactgaaa

SEQ ID NO: 2080028 - DNA, 14 bp, Homo sapiens
cttcccactggagg

SEQ ID NO: 2080029 - DNA, 15 bp, Homo sapiens
cttcccactggaggt

SEQ ID NO: 2080030 - DNA, 21 bp, Homo sapiens
gatctgtttttaaaaatcata

SEQ ID NO: 2080031 - DNA, 14 bp, Homo sapiens
gatcttcagagcag

SEQ ID NO: 2080032 - DNA, 14 bp, Homo sapiens
gatcttctgaaatg

SEQ ID NO: 2080033 - DNA, 18 bp, Homo sapiens
gatcttctgaaatgaaac

SEQ ID NO: 2080034 - DNA, 19 bp, Homo sapiens
gatcttgagatttctttta

SEQ ID NO: 2080035 - DNA, 16 bp, Homo sapiens
gatcttgttaatgcat

SEQ ID NO: 2080036 - DNA, 14 bp, Homo sapiens
gatctttaaaatac

SEQ ID NO: 2080037 - DNA, 11 bp, Homo sapiens
gatctttcagg

SEQ ID NO: 2080038 - DNA, 12 bp, Homo sapiens
gatctttcagga

SEQ ID NO: 2080039 - DNA, 20 bp, Homo sapiens
gatcttttaaaaaggcagta

SEQ ID NO: 2080040 - DNA, 13 bp, Homo sapiens
gatgaactttctc

SEQ ID NO: 2080041 - DNA, 17 bp, Homo sapiens
gatgaagcctgtgccac

SEQ ID NO: 2080042 - DNA, 21 bp, Homo sapiens
gatgaagcctgtgccacctgc

SEQ ID NO: 2080043 - DNA, 21 bp, Homo sapiens
gatgaaggcgtgcaaggggct

SEQ ID NO: 2080044 - DNA, 23 bp, Homo sapiens
gatgaaggcgtgcaaggggctca

SEQ ID NO: 2080045 - DNA, 19 bp, Homo sapiens
gatgaatgaggtcccaggc

SEQ ID NO: 2080046 - DNA, 14 bp, Homo sapiens
gatgacagagcgag

SEQ ID NO: 2080047 - DNA, 12 bp, Homo sapiens
gatgacagtgct

SEQ ID NO: 2080048 - DNA, 14 bp, Homo sapiens
gatgaccaggacta

SEQ ID NO: 2080049 - DNA, 18 bp, Homo sapiens
gatgactaaaatatttat

SEQ ID NO: 2080050 - DNA, 18 bp, Homo sapiens
gatgactcccttaaaata

SEQ ID NO: 2080051 - DNA, 22 bp, Homo sapiens
gatgagaaaggttgaagcacca

SEQ ID NO: 2080052 - DNA, 15 bp, Homo sapiens
gatgagaggcagagg

SEQ ID NO: 2080053 - DNA, 21 bp, Homo sapiens
gatgagatttgccagcacagg

SEQ ID NO: 2080054 - DNA, 13 bp, Homo sapiens
gatgagccgctgt

SEQ ID NO: 2080055 - DNA, 13 bp, Homo sapiens
gatgaggcagagg

SEQ ID NO: 2080056 - DNA, 17 bp, Homo sapiens
gatgttctggacctccc

SEQ ID NO: 2080057 - DNA, 16 bp, Homo sapiens
gatgtttccagaaaat

SEQ ID NO: 2080058 - DNA, 17 bp, Homo sapiens
gatgtttccagaaaata

SEQ ID NO: 2080059 - DNA, 22 bp, Homo sapiens
gatgtttccagaaaatataaat

SEQ ID NO: 2080060 - DNA, 17 bp, Homo sapiens
gatgtttgttgctagga

SEQ ID NO: 2080061 - DNA, 20 bp, Homo sapiens
gatgttttgtcccatttcct

SEQ ID NO: 2080062 - DNA, 21 bp, Homo sapiens
gatgtttttaaaagtttcaat

SEQ ID NO: 2080063 - DNA, 14 bp, Homo sapiens
gattaaacacctga

SEQ ID NO: 2080064 - DNA, 18 bp, Homo sapiens
gattaaacacctgacaca

SEQ ID NO: 2080065 - DNA, 16 bp, Homo sapiens
gattaaaggaaggaaa

SEQ ID NO: 2080066 - DNA, 16 bp, Homo sapiens
gattaatgttttgtac

SEQ ID NO: 2080067 - DNA, 21 bp, Homo sapiens
gattaattttaacttaaattt

SEQ ID NO: 2080068 - DNA, 23 bp, Homo sapiens
gattacaggccttttgactcttt

SEQ ID NO: 2080069 - DNA, 20 bp, Homo sapiens
gattacctcctgtgtggaag

SEQ ID NO: 2080070 - DNA, 20 bp, Homo sapiens
gattactttaaaataaaaaa

SEQ ID NO: 2080071 - DNA, 18 bp, Homo sapiens
gattagactggacagctt

SEQ ID NO: 2080072 - DNA, 17 bp, Homo sapiens
gattagggagagaagat

SEQ ID NO: 2080073 - DNA, 17 bp, Homo sapiens
gattagtattcaggcac

SEQ ID NO: 2080074 - DNA, 13 bp, Homo sapiens
gattatatatcat

SEQ ID NO: 2080075 - DNA, 20 bp, Homo sapiens
gattatatatcataaagtat

SEQ ID NO: 2080076 - DNA, 21 bp, Homo sapiens
gattatatatcataaagtatg

SEQ ID NO: 2080077 - DNA, 13 bp, Homo sapiens
gattatatgacaa

SEQ ID NO: 2080078 - DNA, 16 bp, Homo sapiens
gattatattataataa

SEQ ID NO: 2080079 - DNA, 13 bp, Homo sapiens
gattattcattta

SEQ ID NO: 2080080 - DNA, 19 bp, Homo sapiens
gattattcatttaaaatga

SEQ ID NO: 2080081 - DNA, 20 bp, Homo sapiens
gattattcatttaaaatgat

SEQ ID NO: 2080082 - DNA, 21 bp, Homo sapiens
gattattcatttaaaatgatt

SEQ ID NO: 2080083 - DNA, 22 bp, Homo sapiens
gattattcatttaaaatgatta

SEQ ID NO: 2080084 - DNA, 18 bp, Homo sapiens
gattatttatttctgtaa

SEQ ID NO: 2080085 - DNA, 21 bp, Homo sapiens
gattatttgttatttgtacag

SEQ ID NO: 2080086 - DNA, 20 bp, Homo sapiens
gattattttagtctgtcatc

SEQ ID NO: 2080087 - DNA, 14 bp, Homo sapiens
gattattttcatta

SEQ ID NO: 2080088 - DNA, 23 bp, Homo sapiens
ttgagctgtatatatatatgtgt

SEQ ID NO: 2080089 - DNA, 11 bp, Homo sapiens
ttgaggacaca

SEQ ID NO: 2080090 - DNA, 15 bp, Homo sapiens
ttgaggacacatgtc

SEQ ID NO: 2080091 - DNA, 23 bp, Homo sapiens
ttgaggaggggcacctgccaccg

SEQ ID NO: 2080092 - DNA, 15 bp, Homo sapiens
ttgaggattttgagt

SEQ ID NO: 2080093 - DNA, 17 bp, Homo sapiens
ttgaggattttgagtat

SEQ ID NO: 2080094 - DNA, 19 bp, Homo sapiens
ttgaggcctgccctcaggg

SEQ ID NO: 2080095 - DNA, 18 bp, Homo sapiens
ttgagggaaaacataata

SEQ ID NO: 2080096 - DNA, 16 bp, Homo sapiens
ttgaggggctcctgga

SEQ ID NO: 2080097 - DNA, 13 bp, Homo sapiens
ttgagggttgggc

SEQ ID NO: 2080098 - DNA, 19 bp, Homo sapiens
ttgaggtggaagccctcct

SEQ ID NO: 2080099 - DNA, 23 bp, Homo sapiens
ttgagtaaataacaactccctga

SEQ ID NO: 2080100 - DNA, 23 bp, Homo sapiens
ttgagtactagaatttgtatttt

SEQ ID NO: 2080101 - DNA, 17 bp, Homo sapiens
ttgagtctcaggccctg

SEQ ID NO: 2080102 - DNA, 17 bp, Homo sapiens
ttgagtctcctctctga

SEQ ID NO: 2080103 - DNA, 12 bp, Homo sapiens
ttgagtgattat

SEQ ID NO: 2080104 - DNA, 16 bp, Homo sapiens
ttgagtgcaacaagag

SEQ ID NO: 2080105 - DNA, 17 bp, Homo sapiens
ttgagttggacacactg

SEQ ID NO: 2080106 - DNA, 17 bp, Homo sapiens
ttgagttttgactgctt

SEQ ID NO: 2080107 - DNA, 15 bp, Homo sapiens
ttgatactaagcatt

SEQ ID NO: 2080108 - DNA, 16 bp, Homo sapiens
ttgatactgcaataaa

SEQ ID NO: 2080109 - DNA, 21 bp, Homo sapiens
ttgatatacttttttcttatt

SEQ ID NO: 2080110 - DNA, 15 bp, Homo sapiens
ttgatatagaaagct

SEQ ID NO: 2080111 - DNA, 21 bp, Homo sapiens
ttgatatgaaaaatatgatat

SEQ ID NO: 2080112 - DNA, 13 bp, Homo sapiens
ttgatatgagtat

SEQ ID NO: 2080113 - DNA, 17 bp, Homo sapiens
ttgatcaaattcatttt

SEQ ID NO: 2080114 - DNA, 20 bp, Homo sapiens
ttgatcacagtggcgagagg

SEQ ID NO: 2080115 - DNA, 15 bp, Homo sapiens
ttgatcccacttcac

SEQ ID NO: 2080116 - DNA, 23 bp, Homo sapiens
ttgatcccacttcactgtgaggg

SEQ ID NO: 2080117 - DNA, 15 bp, Homo sapiens
ttgatgaaggagttt

SEQ ID NO: 2080118 - DNA, 18 bp, Homo sapiens
ttgatgaccaatctctgt

SEQ ID NO: 2080119 - DNA, 20 bp, Homo sapiens
ttgatgaccaatctctgtga

SEQ ID NO: 2080120 - DNA, 22 bp, Homo sapiens
ttgatgaccaatctctgtgact

SEQ ID NO: 2080121 - DNA, 17 bp, Homo sapiens
ttgatgacccccaacca

SEQ ID NO: 2080122 - DNA, 14 bp, Homo sapiens
ttgatgaggcctct

SEQ ID NO: 2080123 - DNA, 15 bp, Homo sapiens
ttgatgcatttccac

SEQ ID NO: 2080124 - DNA, 14 bp, Homo sapiens
ttgatggggagaaa

SEQ ID NO: 2080125 - DNA, 11 bp, Homo sapiens
ttgatgtacat

SEQ ID NO: 2080126 - DNA, 16 bp, Homo sapiens
ttgatgtttccagaaa

SEQ ID NO: 2080127 - DNA, 18 bp, Homo sapiens
ttgatgtttccagaaaat

SEQ ID NO: 2080128 - DNA, 20 bp, Homo sapiens
ttgattacataatcaaagct

SEQ ID NO: 2080129 - DNA, 14 bp, Homo sapiens
ttgatttaatatct

SEQ ID NO: 2080130 - DNA, 19 bp, Homo sapiens
ttgatttttgtaataaaag

SEQ ID NO: 2080131 - DNA, 15 bp, Homo sapiens
ttgcaaaatttccag

SEQ ID NO: 2080132 - DNA, 22 bp, Homo sapiens
ttgcaaaatttccagtaccttt

SEQ ID NO: 2080133 - DNA, 12 bp, Homo sapiens
ttgcaaacttta

SEQ ID NO: 2080134 - DNA, 18 bp, Homo sapiens
ttgcaaagttacagatgc

SEQ ID NO: 2080135 - DNA, 12 bp, Homo sapiens
ttgcaaggaagc

SEQ ID NO: 2080136 - DNA, 17 bp, Homo sapiens
ttgcaaggccgctgttc

SEQ ID NO: 2080137 - DNA, 15 bp, Homo sapiens
ttgcaataaaatagt

SEQ ID NO: 2080138 - DNA, 22 bp, Homo sapiens
ttgcaataaaatagtattgaaa

SEQ ID NO: 2080139 - DNA, 17 bp, Homo sapiens
ttgcaattattctaatt

SEQ ID NO: 2080140 - DNA, 17 bp, Homo sapiens
ttcacttctttgcagag

SEQ ID NO: 2080141 - DNA, 20 bp, Homo sapiens
ttcacttctttgcagagcct

SEQ ID NO: 2080142 - DNA, 22 bp, Homo sapiens
ttcactttaaagtctttccgtc

SEQ ID NO: 2080143 - DNA, 23 bp, Homo sapiens
ttcagaaaacccttttctacagt

SEQ ID NO: 2080144 - DNA, 13 bp, Homo sapiens
ttcagaaagcatt

SEQ ID NO: 2080145 - DNA, 20 bp, Homo sapiens
ttcagacaagcaacaggttt

SEQ ID NO: 2080146 - DNA, 21 bp, Homo sapiens
ttcagacaagcaacaggtttt

SEQ ID NO: 2080147 - DNA, 13 bp, Homo sapiens
ttcagacctgaca

SEQ ID NO: 2080148 - DNA, 13 bp, Homo sapiens
ttcagactcagac

SEQ ID NO: 2080149 - DNA, 14 bp, Homo sapiens
ttcagactcagact

SEQ ID NO: 2080150 - DNA, 18 bp, Homo sapiens
ttcagacttttatcaaaa

SEQ ID NO: 2080151 - DNA, 15 bp, Homo sapiens
ttcagagactcaggg

SEQ ID NO: 2080152 - DNA, 21 bp, Homo sapiens
ttcagagactcagggccccag

SEQ ID NO: 2080153 - DNA, 19 bp, Homo sapiens
ttcagagagctaaattaca

SEQ ID NO: 2080154 - DNA, 22 bp, Homo sapiens
ttcagagccagtgaaggagcca

SEQ ID NO: 2080155 - DNA, 15 bp, Homo sapiens
ttcagagcctagcca

SEQ ID NO: 2080156 - DNA, 18 bp, Homo sapiens
ttcagagcctagccacct

SEQ ID NO: 2080157 - DNA, 19 bp, Homo sapiens
ttcagagcctagccacctc

SEQ ID NO: 2080158 - DNA, 23 bp, Homo sapiens
ttcagattccacacaaaatgtca

SEQ ID NO: 2080159 - DNA, 13 bp, Homo sapiens
ttcagcaccctgg

SEQ ID NO: 2080160 - DNA, 22 bp, Homo sapiens
ttcagcaccctgggtgccattc

SEQ ID NO: 2080161 - DNA, 16 bp, Homo sapiens
ttcagcattaggcttt

SEQ ID NO: 2080162 - DNA, 10 bp, Homo sapiens
ttcagcccag

SEQ ID NO: 2080163 - DNA, 20 bp, Homo sapiens
ttcagcccatatttcatcgt

SEQ ID NO: 2080164 - DNA, 19 bp, Homo sapiens
ttcagcccctagtgctatt

SEQ ID NO: 2080165 - DNA, 13 bp, Homo sapiens
ttcagcccctcct

SEQ ID NO: 2080166 - DNA, 17 bp, Homo sapiens
ttcagcccctcctctgc

SEQ ID NO: 2080167 - DNA, 15 bp, Homo sapiens
ttcagctccagctca

SEQ ID NO: 2080168 - DNA, 18 bp, Homo sapiens
ttcagctctctgtataaa

SEQ ID NO: 2080169 - DNA, 21 bp, Homo sapiens
ttcagctctctgtataaacat

SEQ ID NO: 2080170 - DNA, 20 bp, Homo sapiens
ttcagctgtgaacatggact

SEQ ID NO: 2080171 - DNA, 14 bp, Homo sapiens
ttcagcttcatttg

SEQ ID NO: 2080172 - DNA, 17 bp, Homo sapiens
ttcaggaaaaggcctgg

SEQ ID NO: 2080173 - DNA, 18 bp, Homo sapiens
ttcaggaaaaggcctggg

SEQ ID NO: 2080174 - DNA, 13 bp, Homo sapiens
ttcaggaaaattg

SEQ ID NO: 2080175 - DNA, 14 bp, Homo sapiens
ttcaggactggctc

SEQ ID NO: 2080176 - DNA, 17 bp, Homo sapiens
ttcaggagtcccaagga

SEQ ID NO: 2080177 - DNA, 17 bp, Homo sapiens
ttcaggatactctgtca

SEQ ID NO: 2080178 - DNA, 21 bp, Homo sapiens
ttcaggatactctgtcagatg

SEQ ID NO: 2080179 - DNA, 14 bp, Homo sapiens
ttcaggcactgaga

SEQ ID NO: 2080180 - DNA, 18 bp, Homo sapiens
ttcagggaagcaggcaga

SEQ ID NO: 2080181 - DNA, 13 bp, Homo sapiens
ttcagggccagaa

SEQ ID NO: 2080182 - DNA, 22 bp, Homo sapiens
ttcagggttggcccctgcccgg

SEQ ID NO: 2080183 - DNA, 16 bp, Homo sapiens
ttcaggtaacaggcag

SEQ ID NO: 2080184 - DNA, 15 bp, Homo sapiens
ttcaggtaggccctt

SEQ ID NO: 2080185 - DNA, 21 bp, Homo sapiens
ttcaggtaggcccttgtcctg

SEQ ID NO: 2080186 - DNA, 22 bp, Homo sapiens
ttcaggtaggcccttgtcctgc

SEQ ID NO: 2080187 - DNA, 15 bp, Homo sapiens
ttcaggtgaaaatgt

SEQ ID NO: 2080188 - DNA, 18 bp, Homo sapiens
ttcaggtggagagcacta

SEQ ID NO: 2080189 - DNA, 20 bp, Homo sapiens
ttcaggtggagagcactaga

SEQ ID NO: 2080190 - DNA, 17 bp, Homo sapiens
ttcagtaaataatgaaa

SEQ ID NO: 2080191 - DNA, 18 bp, Homo sapiens
ttcagtataaattgtcgt

SEQ ID NO: 2080192 - DNA, 17 bp, Homo sapiens
ttcagtattttggagaa

SEQ ID NO: 2080193 - DNA, 18 bp, Homo sapiens
ttcagtattttggagaaa

SEQ ID NO: 2080194 - DNA, 22 bp, Homo sapiens
ttcagtccgcctggccggctcc

SEQ ID NO: 2080195 - DNA, 15 bp, Homo sapiens
ttcagtcctggtctg

SEQ ID NO: 2080196 - DNA, 19 bp, Homo sapiens
ttcagtgctgtggcctggg

SEQ ID NO: 2080197 - DNA, 14 bp, Homo sapiens
ttcagtggcagctg

SEQ ID NO: 2080198 - DNA, 16 bp, Homo sapiens
ttcagtggtcctgtca

SEQ ID NO: 2080199 - DNA, 20 bp, Homo sapiens
ttcagtgtatggaaataaat

SEQ ID NO: 2080200 - DNA, 20 bp, Homo sapiens
ttcagttgaattcatgtgaa

SEQ ID NO: 2080201 - DNA, 17 bp, Homo sapiens
ttcagttttatctttaa

SEQ ID NO: 2080202 - DNA, 19 bp, Homo sapiens
ttcataaacaacttaatgt

SEQ ID NO: 2080203 - DNA, 15 bp, Homo sapiens
ttcataaagaattgt

SEQ ID NO: 2080204 - DNA, 16 bp, Homo sapiens
ttcataaggcctgccc

SEQ ID NO: 2080205 - DNA, 19 bp, Homo sapiens
ttcataaggcctgccctcc

SEQ ID NO: 2080206 - DNA, 14 bp, Homo sapiens
ttcataataaacta

SEQ ID NO: 2080207 - DNA, 15 bp, Homo sapiens
ttcataattagaaca

SEQ ID NO: 2080208 - DNA, 17 bp, Homo sapiens
ttcataattagaacaat

SEQ ID NO: 2080209 - DNA, 21 bp, Homo sapiens
ttcataattagaacaatagct

SEQ ID NO: 2080210 - DNA, 19 bp, Homo sapiens
ttcataggcggtcatgtgt

SEQ ID NO: 2080211 - DNA, 22 bp, Homo sapiens
ttcataggcggtcatgtgtgca

SEQ ID NO: 2080212 - DNA, 19 bp, Homo sapiens
ttcatagggtctcttcagg

SEQ ID NO: 2080213 - DNA, 14 bp, Homo sapiens
ttcatataaagtat

SEQ ID NO: 2080214 - DNA, 18 bp, Homo sapiens
ttcatatatgaggacttg

SEQ ID NO: 2080215 - DNA, 21 bp, Homo sapiens
ttcatatatgaggacttgtgt

SEQ ID NO: 2080216 - DNA, 20 bp, Homo sapiens
ttcatatgtaccatgtacat

SEQ ID NO: 2080217 - DNA, 12 bp, Homo sapiens
ttcatattgtgc

SEQ ID NO: 2080218 - DNA, 12 bp, Homo sapiens
ttcatcaattta

SEQ ID NO: 2080219 - DNA, 13 bp, Homo sapiens
ttcatcaattttt

SEQ ID NO: 2080220 - DNA, 14 bp, Homo sapiens
ttcatcaattttta

SEQ ID NO: 2080221 - DNA, 16 bp, Homo sapiens
ttcatcaatttttata

SEQ ID NO: 2080222 - DNA, 22 bp, Homo sapiens
ttcatcaatttttatacatatc

SEQ ID NO: 2080223 - DNA, 19 bp, Homo sapiens
ttcatcatatgaatgttct

SEQ ID NO: 2080224 - DNA, 14 bp, Homo sapiens
ttcatcatttttta

SEQ ID NO: 2080225 - DNA, 22 bp, Homo sapiens
ttcatctatggcagtccagcca

SEQ ID NO: 2080226 - DNA, 18 bp, Homo sapiens
ttcatctatttctgagaa

SEQ ID NO: 2080227 - DNA, 12 bp, Homo sapiens
ttcatctcattt

SEQ ID NO: 2080228 - DNA, 17 bp, Homo sapiens
ttcatctgctgctgaaa

SEQ ID NO: 2080229 - DNA, 17 bp, Homo sapiens
ttcatgaacttggctgt

SEQ ID NO: 2080230 - DNA, 23 bp, Homo sapiens
ttcatgacttttccatgtatcta

SEQ ID NO: 2080231 - DNA, 19 bp, Homo sapiens
ttcatgccatctgttttca

SEQ ID NO: 2080232 - DNA, 15 bp, Homo sapiens
ttcatgcctcagttt

SEQ ID NO: 2080233 - DNA, 14 bp, Homo sapiens
ttcatgctttctcc

SEQ ID NO: 2080234 - DNA, 15 bp, Homo sapiens
ttcatggattattta

SEQ ID NO: 2080235 - DNA, 23 bp, Homo sapiens
ttcatggcagatgtaggagggac

SEQ ID NO: 2080236 - DNA, 21 bp, Homo sapiens
ttcatggcctttgataaatgt

SEQ ID NO: 2080237 - DNA, 13 bp, Homo sapiens
ttcatgtaataaa

SEQ ID NO: 2080238 - DNA, 16 bp, Homo sapiens
ttcatgtaataaatct

SEQ ID NO: 2080239 - DNA, 15 bp, Homo sapiens
ttcattaaagcattt

SEQ ID NO: 2080240 - DNA, 14 bp, Homo sapiens
ttcattagctgtga

SEQ ID NO: 2080241 - DNA, 14 bp, Homo sapiens
ttcattatctcaaa

SEQ ID NO: 2080242 - DNA, 13 bp, Homo sapiens
ttcattctcctgc

SEQ ID NO: 2080243 - DNA, 15 bp, Homo sapiens
ttcattctcctgcct

SEQ ID NO: 2080244 - DNA, 13 bp, Homo sapiens
ttcattgaccaag

SEQ ID NO: 2080245 - DNA, 13 bp, Homo sapiens
ttcattgtataaa

SEQ ID NO: 2080246 - DNA, 14 bp, Homo sapiens
ttcattgtatgatg

SEQ ID NO: 2080247 - DNA, 16 bp, Homo sapiens
ttcattgtatgatgtg

SEQ ID NO: 2080248 - DNA, 13 bp, Homo sapiens
ttcatttaaaatg

SEQ ID NO: 2080249 - DNA, 17 bp, Homo sapiens
ttcatttaaaatgatta

SEQ ID NO: 2080250 - DNA, 15 bp, Homo sapiens
ttcatttcaactgtt

SEQ ID NO: 2080251 - DNA, 16 bp, Homo sapiens
ttcatttcctccgtca

SEQ ID NO: 2080252 - DNA, 15 bp, Homo sapiens
ttcatttggtgctgg

SEQ ID NO: 2080253 - DNA, 18 bp, Homo sapiens
ttcattttaacatctgag

SEQ ID NO: 2080254 - DNA, 15 bp, Homo sapiens
ttccaaaataaaatg

SEQ ID NO: 2080255 - DNA, 19 bp, Homo sapiens
ttccaaagcacattgaaag

SEQ ID NO: 2080256 - DNA, 19 bp, Homo sapiens
ttccaaagttttgaagtca

SEQ ID NO: 2080257 - DNA, 13 bp, Homo sapiens
tcactctggcctc

SEQ ID NO: 2080258 - DNA, 22 bp, Homo sapiens
tcactctgtcgcccagtctgga

SEQ ID NO: 2080259 - DNA, 17 bp, Homo sapiens
tcactcttatgaaatgg

SEQ ID NO: 2080260 - DNA, 21 bp, Homo sapiens
tcactcttattgcccacgctg

SEQ ID NO: 2080261 - DNA, 18 bp, Homo sapiens
tcactcttcctgcaagga

SEQ ID NO: 2080262 - DNA, 22 bp, Homo sapiens
tcactgaatgcctcaatgtgac

SEQ ID NO: 2080263 - DNA, 18 bp, Homo sapiens
tcactgattgggtgccat

SEQ ID NO: 2080264 - DNA, 18 bp, Homo sapiens
tcactgcaacctcttcct

SEQ ID NO: 2080265 - DNA, 17 bp, Homo sapiens
tcactgccatgcctcaa

SEQ ID NO: 2080266 - DNA, 18 bp, Homo sapiens
tcactgccccaccagcca

SEQ ID NO: 2080267 - DNA, 19 bp, Homo sapiens
tcactgccccaccagccac

SEQ ID NO: 2080268 - DNA, 22 bp, Homo sapiens
tcactgccccaccagccacctc

SEQ ID NO: 2080269 - DNA, 23 bp, Homo sapiens
tcactgccccaccagccacctct

SEQ ID NO: 2080270 - DNA, 14 bp, Homo sapiens
tcactgctggctgc

SEQ ID NO: 2080271 - DNA, 18 bp, Homo sapiens
tcactgctggctgcctta

SEQ ID NO: 2080272 - DNA, 18 bp, Homo sapiens
tcactgctggggagtccc

SEQ ID NO: 2080273 - DNA, 17 bp, Homo sapiens
tcactggagcaccaggc

SEQ ID NO: 2080274 - DNA, 11 bp, Homo sapiens
tcactggagcc

SEQ ID NO: 2080275 - DNA, 22 bp, Homo sapiens
tcactggagttacattaatgtt

SEQ ID NO: 2080276 - DNA, 19 bp, Homo sapiens
tcactggatgaagattctc

SEQ ID NO: 2080277 - DNA, 15 bp, Homo sapiens
tcactgggctaccgt

SEQ ID NO: 2080278 - DNA, 16 bp, Homo sapiens
tcactggggtcctggg

SEQ ID NO: 2080279 - DNA, 20 bp, Homo sapiens
tcactggggtcctggggcct

SEQ ID NO: 2080280 - DNA, 21 bp, Homo sapiens
tcactgtagaatgatttcatg

SEQ ID NO: 2080281 - DNA, 18 bp, Homo sapiens
tcactgtccctcaaatga

SEQ ID NO: 2080282 - DNA, 20 bp, Homo sapiens
tcactgtgaggggaaggcct

SEQ ID NO: 2080283 - DNA, 21 bp, Homo sapiens
tcactgtgttggccaggctgg

SEQ ID NO: 2080284 - DNA, 20 bp, Homo sapiens
tcacttagggataacactgt

SEQ ID NO: 2080285 - DNA, 13 bp, Homo sapiens
tcacttataccaa

SEQ ID NO: 2080286 - DNA, 22 bp, Homo sapiens
tcacttccagtgttggctgtgt

SEQ ID NO: 2080287 - DNA, 18 bp, Homo sapiens
tcacttccctgggaactc

SEQ ID NO: 2080288 - DNA, 19 bp, Homo sapiens
tcacttctttgcagagcct

SEQ ID NO: 2080289 - DNA, 16 bp, Homo sapiens
tcacttgaactcggga

SEQ ID NO: 2080290 - DNA, 13 bp, Homo sapiens
tcacttgtaaata

SEQ ID NO: 2080291 - DNA, 17 bp, Homo sapiens
tcacttgtaaataaata

SEQ ID NO: 2080292 - DNA, 18 bp, Homo sapiens
tcacttgtaaataaatag

SEQ ID NO: 2080293 - DNA, 19 bp, Homo sapiens
tcacttgtaaataaataga

SEQ ID NO: 2080294 - DNA, 22 bp, Homo sapiens
tcacttgtaaataaatagattt

SEQ ID NO: 2080295 - DNA, 16 bp, Homo sapiens
tcacttgtacaaaata

SEQ ID NO: 2080296 - DNA, 17 bp, Homo sapiens
tcacttgtacaaaataa

SEQ ID NO: 2080297 - DNA, 15 bp, Homo sapiens
tcactttaattctca

SEQ ID NO: 2080298 - DNA, 16 bp, Homo sapiens
tcactttaattctcat

SEQ ID NO: 2080299 - DNA, 18 bp, Homo sapiens
tcactttaattctcatgt

SEQ ID NO: 2080300 - DNA, 20 bp, Homo sapiens
tcactttaattctcatgtga

SEQ ID NO: 2080301 - DNA, 22 bp, Homo sapiens
tcactttaattctcatgtgatc

SEQ ID NO: 2080302 - DNA, 18 bp, Homo sapiens
tcactttagctatgtgga

SEQ ID NO: 2080303 - DNA, 13 bp, Homo sapiens
tcacttttcagtg

SEQ ID NO: 2080304 - DNA, 17 bp, Homo sapiens
tcagaaaagaaaaccat

SEQ ID NO: 2080305 - DNA, 17 bp, Homo sapiens
tcagaaaagtagaatta

SEQ ID NO: 2080306 - DNA, 18 bp, Homo sapiens
tcagaaaccaaacagttt

SEQ ID NO: 2080307 - DNA, 17 bp, Homo sapiens
tcagaaagcattacatt

SEQ ID NO: 2080308 - DNA, 19 bp, Homo sapiens
tcagaaagggagggctctg

SEQ ID NO: 2080309 - DNA, 14 bp, Homo sapiens
tcagaacagcagac

SEQ ID NO: 2080310 - DNA, 17 bp, Homo sapiens
tcagaacatcctccaat

SEQ ID NO: 2080311 - DNA, 12 bp, Homo sapiens
tcagaagataac

SEQ ID NO: 2080312 - DNA, 21 bp, Homo sapiens
tcagaagccccatttgcacag

SEQ ID NO: 2080313 - DNA, 16 bp, Homo sapiens
tcagaagcctgggggc

SEQ ID NO: 2080314 - DNA, 20 bp, Homo sapiens
tcagaagcctgggggcctgg

SEQ ID NO: 2080315 - DNA, 22 bp, Homo sapiens
tcagaagcctgggggcctggct

SEQ ID NO: 2080316 - DNA, 18 bp, Homo sapiens
tcagaaggctggggccag

SEQ ID NO: 2080317 - DNA, 13 bp, Homo sapiens
tcagaagtgcaaa

SEQ ID NO: 2080318 - DNA, 16 bp, Homo sapiens
aaccaagccgtggctt

SEQ ID NO: 2080319 - DNA, 18 bp, Homo sapiens
aaccaagccgtggcttcc

SEQ ID NO: 2080320 - DNA, 21 bp, Homo sapiens
aaccaagcttcagagcctagc

SEQ ID NO: 2080321 - DNA, 15 bp, Homo sapiens
aaccaatatttgtag

SEQ ID NO: 2080322 - DNA, 14 bp, Homo sapiens
aaccacaactgaca

SEQ ID NO: 2080323 - DNA, 15 bp, Homo sapiens
aaccacacacctcac

SEQ ID NO: 2080324 - DNA, 22 bp, Homo sapiens
aaccacatcttgctctgctgac

SEQ ID NO: 2080325 - DNA, 21 bp, Homo sapiens
aaccaccacacccagcccact

SEQ ID NO: 2080326 - DNA, 19 bp, Homo sapiens
aaccacctaatcaggctga

SEQ ID NO: 2080327 - DNA, 19 bp, Homo sapiens
aaccactcaaattaatctt

SEQ ID NO: 2080328 - DNA, 15 bp, Homo sapiens
aaccactgtacatat

SEQ ID NO: 2080329 - DNA, 16 bp, Homo sapiens
aaccactgtacatata

SEQ ID NO: 2080330 - DNA, 23 bp, Homo sapiens
aaccactgtggcgttctgctgcc

SEQ ID NO: 2080331 - DNA, 14 bp, Homo sapiens
aaccagaatcataa

SEQ ID NO: 2080332 - DNA, 18 bp, Homo sapiens
aaccagaatcataatttt

SEQ ID NO: 2080333 - DNA, 10 bp, Homo sapiens
aaccagagcc

SEQ ID NO: 2080334 - DNA, 12 bp, Homo sapiens
aaccagcagaaa

SEQ ID NO: 2080335 - DNA, 12 bp, Homo sapiens
aaccagcattca

SEQ ID NO: 2080336 - DNA, 17 bp, Homo sapiens
aaccagccacacagagc

SEQ ID NO: 2080337 - DNA, 13 bp, Homo sapiens
aaccagggaggag

SEQ ID NO: 2080338 - DNA, 23 bp, Homo sapiens
aaccagggtgcatggcttgggga

SEQ ID NO: 2080339 - DNA, 15 bp, Homo sapiens
aaccagtacttctaa

SEQ ID NO: 2080340 - DNA, 16 bp, Homo sapiens
aaccagtacttctaag

SEQ ID NO: 2080341 - DNA, 17 bp, Homo sapiens
aaccagtttagatttca

SEQ ID NO: 2080342 - DNA, 13 bp, Homo sapiens
aaccataaacttc

SEQ ID NO: 2080343 - DNA, 18 bp, Homo sapiens
aaccataaacttcatggt

SEQ ID NO: 2080344 - DNA, 20 bp, Homo sapiens
aaccatccatctgtggaaat

SEQ ID NO: 2080345 - DNA, 22 bp, Homo sapiens
aaccatccctgatgtctgtctg

SEQ ID NO: 2080346 - DNA, 18 bp, Homo sapiens
aaccatgcagcttcatca

SEQ ID NO: 2080347 - DNA, 12 bp, Homo sapiens
aaccatgtagtt

SEQ ID NO: 2080348 - DNA, 15 bp, Homo sapiens
aaccatttaattcat

SEQ ID NO: 2080349 - DNA, 23 bp, Homo sapiens
aaccatttaattcataattagaa

SEQ ID NO: 2080350 - DNA, 22 bp, Homo sapiens
aacccaaataaatgtgtaaatg

SEQ ID NO: 2080351 - DNA, 21 bp, Homo sapiens
aacccaaatgtccaatataaa

SEQ ID NO: 2080352 - DNA, 21 bp, Homo sapiens
aacccactgtgcttacagtga

SEQ ID NO: 2080353 - DNA, 17 bp, Homo sapiens
aacccagcaacagaaaa

SEQ ID NO: 2080354 - DNA, 23 bp, Homo sapiens
aacccagcaacagaaaaatggag

SEQ ID NO: 2080355 - DNA, 20 bp, Homo sapiens
aacccagctcccttcttccc

SEQ ID NO: 2080356 - DNA, 19 bp, Homo sapiens
aacccatcagaaggagaag

SEQ ID NO: 2080357 - DNA, 17 bp, Homo sapiens
aaccccaacgcacagga

SEQ ID NO: 2080358 - DNA, 18 bp, Homo sapiens
aaccccaacgcacaggaa

SEQ ID NO: 2080359 - DNA, 19 bp, Homo sapiens
aaccccaacgcacaggaaa

SEQ ID NO: 2080360 - DNA, 14 bp, Homo sapiens
aaccccaagcagca

SEQ ID NO: 2080361 - DNA, 15 bp, Homo sapiens
aaccccagacactgg

SEQ ID NO: 2080362 - DNA, 13 bp, Homo sapiens
aaccccagactca

SEQ ID NO: 2080363 - DNA, 13 bp, Homo sapiens
aaccccagctggc

SEQ ID NO: 2080364 - DNA, 23 bp, Homo sapiens
aaccccagctggcctctagaaca

SEQ ID NO: 2080365 - DNA, 16 bp, Homo sapiens
aaccccaggcatccca

SEQ ID NO: 2080366 - DNA, 18 bp, Homo sapiens
aaccccaggcatcccatc

SEQ ID NO: 2080367 - DNA, 12 bp, Homo sapiens
aaccccagttct

SEQ ID NO: 2080368 - DNA, 13 bp, Homo sapiens
aaccccagttctg

SEQ ID NO: 2080369 - DNA, 18 bp, Homo sapiens
aaccccagttctgctcct

SEQ ID NO: 2080370 - DNA, 23 bp, Homo sapiens
aaccccagttctgctcctctcca

SEQ ID NO: 2080371 - DNA, 11 bp, Homo sapiens
aacccccaccg

SEQ ID NO: 2080372 - DNA, 21 bp, Homo sapiens
aacccccaccgaagagccctg

SEQ ID NO: 2080373 - DNA, 16 bp, Homo sapiens
aacccccagtgccaca

SEQ ID NO: 2080374 - DNA, 17 bp, Homo sapiens
aaccccgcggtgctctg

SEQ ID NO: 2080375 - DNA, 18 bp, Homo sapiens
aaccccgcggtgctctgg

SEQ ID NO: 2080376 - DNA, 20 bp, Homo sapiens
aaccccgcggtgctctggcg

SEQ ID NO: 2080377 - DNA, 22 bp, Homo sapiens
aaccccgcggtgctctggcggc

SEQ ID NO: 2080378 - DNA, 21 bp, Homo sapiens
aacccctacatgaaacagaaa

SEQ ID NO: 2080379 - DNA, 13 bp, Homo sapiens
aacccctgtaccc

SEQ ID NO: 2080380 - DNA, 21 bp, Homo sapiens
aacccctgtacccagctcctt

SEQ ID NO: 2080381 - DNA, 15 bp, Homo sapiens
aacccgactgtgaaa

SEQ ID NO: 2080382 - DNA, 16 bp, Homo sapiens
aaccctcagccttgaa

SEQ ID NO: 2080383 - DNA, 13 bp, Homo sapiens
aaccctctcttcc

SEQ ID NO: 2080384 - DNA, 15 bp, Homo sapiens
aaccctctcttccct

SEQ ID NO: 2080385 - DNA, 16 bp, Homo sapiens
aaccctgctttttgac

SEQ ID NO: 2080386 - DNA, 16 bp, Homo sapiens
aaccctgttttatact

SEQ ID NO: 2080387 - DNA, 20 bp, Homo sapiens
aaccctgttttatactgtac

SEQ ID NO: 2080388 - DNA, 23 bp, Homo sapiens
aaccctgttttatactgtactta

SEQ ID NO: 2080389 - DNA, 14 bp, Homo sapiens
aacccttgctgctg

SEQ ID NO: 2080390 - DNA, 21 bp, Homo sapiens
aacccttggagccaatggaga

SEQ ID NO: 2080391 - DNA, 18 bp, Homo sapiens
aaccgtggcccttcctgg

SEQ ID NO: 2080392 - DNA, 13 bp, Homo sapiens
aaccgtttttcaa

SEQ ID NO: 2080393 - DNA, 18 bp, Homo sapiens
aacctaaagaggaaaagt

SEQ ID NO: 2080394 - DNA, 13 bp, Homo sapiens
aacctaagcaaaa

SEQ ID NO: 2080395 - DNA, 13 bp, Homo sapiens
aacctaattgaaa

SEQ ID NO: 2080396 - DNA, 20 bp, Homo sapiens
aacctaccaccccttcctgt

SEQ ID NO: 2080397 - DNA, 15 bp, Homo sapiens
aacctactagacaat

SEQ ID NO: 2080398 - DNA, 19 bp, Homo sapiens
aacctagaacttcaaaatg

SEQ ID NO: 2080399 - DNA, 20 bp, Homo sapiens
aacctagaacttcaaaatgt

SEQ ID NO: 2080400 - DNA, 16 bp, Homo sapiens
aacctatatgatttat

SEQ ID NO: 2080401 - DNA, 15 bp, Homo sapiens
aacctcaatgccctg

SEQ ID NO: 2080402 - DNA, 16 bp, Homo sapiens
aacctcaatgccctgc

SEQ ID NO: 2080403 - DNA, 18 bp, Homo sapiens
aacctcaatgccctgcca

SEQ ID NO: 2080404 - DNA, 14 bp, Homo sapiens
aacctcagggacaa

SEQ ID NO: 2080405 - DNA, 18 bp, Homo sapiens
aacctcagtaatttagaa

SEQ ID NO: 2080406 - DNA, 13 bp, Homo sapiens
aacctcagtgtca

SEQ ID NO: 2080407 - DNA, 18 bp, Homo sapiens
aacctcagtgtcatttat

SEQ ID NO: 2080408 - DNA, 19 bp, Homo sapiens
aacctcagtgtcatttatg

SEQ ID NO: 2080409 - DNA, 14 bp, Homo sapiens
aacctcagtttcct

SEQ ID NO: 2080410 - DNA, 14 bp, Homo sapiens
aacctcattcccca

SEQ ID NO: 2080411 - DNA, 17 bp, Homo sapiens
aacctccgcctcttggg

SEQ ID NO: 2080412 - DNA, 16 bp, Homo sapiens
aacctccgtgctgggc

SEQ ID NO: 2080413 - DNA, 14 bp, Homo sapiens
aacctcctgggcta

SEQ ID NO: 2080414 - DNA, 21 bp, Homo sapiens
aacctcctgttagctgttatt

SEQ ID NO: 2080415 - DNA, 14 bp, Homo sapiens
aacctctatatgtt

SEQ ID NO: 2080416 - DNA, 17 bp, Homo sapiens
aacctgaattattccaa

SEQ ID NO: 2080417 - DNA, 23 bp, Homo sapiens
aacctgacagatgtcagccgagc

SEQ ID NO: 2080418 - DNA, 22 bp, Homo sapiens
aacctgaggatgcaacaaatat

SEQ ID NO: 2080419 - DNA, 19 bp, Homo sapiens
aacctgcctgtgcatgacc

SEQ ID NO: 2080420 - DNA, 18 bp, Homo sapiens
aacctggagatgatgatg

SEQ ID NO: 2080421 - DNA, 22 bp, Homo sapiens
aacctggagggctagaatctgg

SEQ ID NO: 2080422 - DNA, 19 bp, Homo sapiens
aacctggcaagctagaacc

SEQ ID NO: 2080423 - DNA, 23 bp, Homo sapiens
aacctggtcacaggactctgcct

SEQ ID NO: 2080424 - DNA, 22 bp, Homo sapiens
aacctggtttttgtatatttat

SEQ ID NO: 2080425 - DNA, 15 bp, Homo sapiens
aaccttaaggactta

SEQ ID NO: 2080426 - DNA, 15 bp, Homo sapiens
aaccttacttaaagc

SEQ ID NO: 2080427 - DNA, 16 bp, Homo sapiens
aaccttattgtacctc

SEQ ID NO: 2080428 - DNA, 17 bp, Homo sapiens
aaccttattgtacctct

SEQ ID NO: 2080429 - DNA, 18 bp, Homo sapiens
aaccttattgtacctctc

SEQ ID NO: 2080430 - DNA, 19 bp, Homo sapiens
aaccttattgtacctctct

SEQ ID NO: 2080431 - DNA, 22 bp, Homo sapiens
aaccttcatgatgaattacttc

SEQ ID NO: 2080432 - DNA, 14 bp, Homo sapiens
aaccttccctccaa

SEQ ID NO: 2080433 - DNA, 11 bp, Homo sapiens
aaccttgcagc

SEQ ID NO: 2080434 - DNA, 12 bp, Homo sapiens
aaccttgcagca

SEQ ID NO: 2080435 - DNA, 11 bp, Homo sapiens
aacctttccct

SEQ ID NO: 2080436 - DNA, 20 bp, Homo sapiens
aacctttccctcaccccctc

SEQ ID NO: 2080437 - DNA, 22 bp, Homo sapiens
aacctttccctcaccccctccc

SEQ ID NO: 2080438 - DNA, 22 bp, Homo sapiens
aacctttccgctgtcgccccag

SEQ ID NO: 2080439 - DNA, 16 bp, Homo sapiens
aacctttcttcaccaa

SEQ ID NO: 2080440 - DNA, 13 bp, Homo sapiens
aacctttgtgtaa

SEQ ID NO: 2080441 - DNA, 21 bp, Homo sapiens
aacgaacccactgtgcttaca

SEQ ID NO: 2080442 - DNA, 23 bp, Homo sapiens
aacgaaggggccccggggctggc

SEQ ID NO: 2080443 - DNA, 23 bp, Homo sapiens
aacgacaaagccaaactctgcca

SEQ ID NO: 2080444 - DNA, 19 bp, Homo sapiens
aacgactccgagaacaaca

SEQ ID NO: 2080445 - DNA, 19 bp, Homo sapiens
aacgagcactggccagaga

SEQ ID NO: 2080446 - DNA, 12 bp, Homo sapiens
aacgagggataa

SEQ ID NO: 2080447 - DNA, 13 bp, Homo sapiens
aacgatttagaaa

SEQ ID NO: 2080448 - DNA, 20 bp, Homo sapiens
aacgcaaagggctgaaagcc

SEQ ID NO: 2080449 - DNA, 19 bp, Homo sapiens
aacgcactttataaaagca

SEQ ID NO: 2080450 - DNA, 15 bp, Homo sapiens
aacgcagacactgag

SEQ ID NO: 2080451 - DNA, 20 bp, Homo sapiens
aacgcaggcccccaggtgcc

SEQ ID NO: 2080452 - DNA, 21 bp, Homo sapiens
aacgggaccccctggccctgc

SEQ ID NO: 2080453 - DNA, 23 bp, Homo sapiens
aacggtgcatccacgcacacatg

SEQ ID NO: 2080454 - DNA, 19 bp, Homo sapiens
aacgtacttaactgtgtga

SEQ ID NO: 2080455 - DNA, 14 bp, Homo sapiens
aacgtcatctcagg

SEQ ID NO: 2080456 - DNA, 18 bp, Homo sapiens
aacgtgggtatttcctgc

SEQ ID NO: 2080457 - DNA, 12 bp, Homo sapiens
aacgttgacccc

SEQ ID NO: 2080458 - DNA, 18 bp, Homo sapiens
aacgttgacccctttccc

SEQ ID NO: 2080459 - DNA, 23 bp, Homo sapiens
aacgttgacccctttcccccacc

SEQ ID NO: 2080460 - DNA, 13 bp, Homo sapiens
aactaaatatatg

SEQ ID NO: 2080461 - DNA, 13 bp, Homo sapiens
aactaacaaccaa

SEQ ID NO: 2080462 - DNA, 18 bp, Homo sapiens
aactaagcagtccctgag

SEQ ID NO: 2080463 - DNA, 23 bp, Homo sapiens
aactaagttttttacttccacag

SEQ ID NO: 2080464 - DNA, 16 bp, Homo sapiens
aactaatttaaaccag

SEQ ID NO: 2080465 - DNA, 17 bp, Homo sapiens
aactaatttaaaccagc

SEQ ID NO: 2080466 - DNA, 19 bp, Homo sapiens
aactacactaataaatgcc

SEQ ID NO: 2080467 - DNA, 22 bp, Homo sapiens
aactaccgttcccaaattggtg

SEQ ID NO: 2080468 - DNA, 18 bp, Homo sapiens
aactactaaagtgcctac

SEQ ID NO: 2080469 - DNA, 23 bp, Homo sapiens
aactactgtaattaagtgcaatt

SEQ ID NO: 2080470 - DNA, 16 bp, Homo sapiens
aactactttttatact

SEQ ID NO: 2080471 - DNA, 16 bp, Homo sapiens
aactagaaatctgcca

SEQ ID NO: 2080472 - DNA, 19 bp, Homo sapiens
aactagaatttattcaatt

SEQ ID NO: 2080473 - DNA, 17 bp, Homo sapiens
aactagatactgttgat

SEQ ID NO: 2080474 - DNA, 23 bp, Homo sapiens
aactagatcaaggagcccagaaa

SEQ ID NO: 2080475 - DNA, 23 bp, Homo sapiens
aactagatctcctatttttcaga

SEQ ID NO: 2080476 - DNA, 15 bp, Homo sapiens
aactaggaagtggct

SEQ ID NO: 2080477 - DNA, 17 bp, Homo sapiens
aactaggccatttgtat

SEQ ID NO: 2080478 - DNA, 19 bp, Homo sapiens
aactaggccatttgtattt

SEQ ID NO: 2080479 - DNA, 14 bp, Homo sapiens
aactagtttccagt

SEQ ID NO: 2080480 - DNA, 16 bp, Homo sapiens
aactataaactactgt

SEQ ID NO: 2080481 - DNA, 16 bp, Homo sapiens
aactatattttcttta

SEQ ID NO: 2080482 - DNA, 19 bp, Homo sapiens
aactatcaatatttaagtt

SEQ ID NO: 2080483 - DNA, 21 bp, Homo sapiens
aactatcctgcgggttttaat

SEQ ID NO: 2080484 - DNA, 17 bp, Homo sapiens
aactatgaactacaaag

SEQ ID NO: 2080485 - DNA, 16 bp, Homo sapiens
aactattaaagtgcca

SEQ ID NO: 2080486 - DNA, 22 bp, Homo sapiens
aactattattaataaattttaa

SEQ ID NO: 2080487 - DNA, 23 bp, Homo sapiens
aactattattaataaattttaac

SEQ ID NO: 2080488 - DNA, 12 bp, Homo sapiens
aactattgaatt

SEQ ID NO: 2080489 - DNA, 12 bp, Homo sapiens
aactattttaaa

SEQ ID NO: 2080490 - DNA, 16 bp, Homo sapiens
aactatttttgaggaa

SEQ ID NO: 2080491 - DNA, 16 bp, Homo sapiens
aactcaaaatatttgt

SEQ ID NO: 2080492 - DNA, 12 bp, Homo sapiens
aactcaagctgc

SEQ ID NO: 2080493 - DNA, 21 bp, Homo sapiens
aactcaatattttccatgaaa

SEQ ID NO: 2080494 - DNA, 22 bp, Homo sapiens
aactcacgatgaaattgaacct

SEQ ID NO: 2080495 - DNA, 19 bp, Homo sapiens
aactcagagcccctccctg

SEQ ID NO: 2080496 - DNA, 22 bp, Homo sapiens
aactcatcctgtgtggggaggc

SEQ ID NO: 2080497 - DNA, 20 bp, Homo sapiens
aactccagtctcctgacatt

SEQ ID NO: 2080498 - DNA, 22 bp, Homo sapiens
aactcccagcaacacaagctgg

SEQ ID NO: 2080499 - DNA, 19 bp, Homo sapiens
aactccctgaacctcagtt

SEQ ID NO: 2080500 - DNA, 21 bp, Homo sapiens
aactccctgaacctcagtttc

SEQ ID NO: 2080501 - DNA, 21 bp, Homo sapiens
aactcctgattttgtagttaa

SEQ ID NO: 2080502 - DNA, 12 bp, Homo sapiens
aactcctgcctg

SEQ ID NO: 2080503 - DNA, 20 bp, Homo sapiens
aactccttttgctgtctttc

SEQ ID NO: 2080504 - DNA, 23 bp, Homo sapiens
aactcgaagcccttccagtggta

SEQ ID NO: 2080505 - DNA, 21 bp, Homo sapiens
aactctaattcccattttgca

SEQ ID NO: 2080506 - DNA, 22 bp, Homo sapiens
aactctaccctggtaggaaagc

SEQ ID NO: 2080507 - DNA, 22 bp, Homo sapiens
aactctatagttattgttttat

SEQ ID NO: 2080508 - DNA, 22 bp, Homo sapiens
aactctctccaccctatatgta

SEQ ID NO: 2080509 - DNA, 15 bp, Homo sapiens
aactctgacaagggc

SEQ ID NO: 2080510 - DNA, 19 bp, Homo sapiens
aactctgacaagggctgac

SEQ ID NO: 2080511 - DNA, 16 bp, Homo sapiens
aactctggcttccagg

SEQ ID NO: 2080512 - DNA, 17 bp, Homo sapiens
aactctggcttccaggt

SEQ ID NO: 2080513 - DNA, 21 bp, Homo sapiens
aactctgggctgctacccaga

SEQ ID NO: 2080514 - DNA, 22 bp, Homo sapiens
aactctgggctgctacccagaa

SEQ ID NO: 2080515 - DNA, 16 bp, Homo sapiens
aactcttccatttatt

SEQ ID NO: 2080516 - DNA, 15 bp, Homo sapiens
aactcttctactttc

SEQ ID NO: 2080517 - DNA, 16 bp, Homo sapiens
aactgaaaactgtaaa

SEQ ID NO: 2080518 - DNA, 17 bp, Homo sapiens
aactgaaaactgtaaat

SEQ ID NO: 2080519 - DNA, 12 bp, Homo sapiens
aactgaaaagac

SEQ ID NO: 2080520 - DNA, 15 bp, Homo sapiens
aactgaacgtcctgc

SEQ ID NO: 2080521 - DNA, 20 bp, Homo sapiens
aactgaagaaggatatattt

SEQ ID NO: 2080522 - DNA, 13 bp, Homo sapiens
aactgaagagaca

SEQ ID NO: 2080523 - DNA, 14 bp, Homo sapiens
aactgaagagacag

SEQ ID NO: 2080524 - DNA, 15 bp, Homo sapiens
aactgaagagacagt

SEQ ID NO: 2080525 - DNA, 20 bp, Homo sapiens
aactgaatgtttattccttg

SEQ ID NO: 2080526 - DNA, 17 bp, Homo sapiens
aactgacaacctgtgca

SEQ ID NO: 2080527 - DNA, 11 bp, Homo sapiens
aactgacacag

SEQ ID NO: 2080528 - DNA, 14 bp, Homo sapiens
aactgacacaggaa

SEQ ID NO: 2080529 - DNA, 19 bp, Homo sapiens
aactgaccagcctccatgc

SEQ ID NO: 2080530 - DNA, 18 bp, Homo sapiens
aactgagaaatgaatgct

SEQ ID NO: 2080531 - DNA, 20 bp, Homo sapiens
aactgagatgtgaacacatc

SEQ ID NO: 2080532 - DNA, 23 bp, Homo sapiens
aactgagatgtgaacacatcagc

SEQ ID NO: 2080533 - DNA, 21 bp, Homo sapiens
aactgagccaaacacactgta

SEQ ID NO: 2080534 - DNA, 22 bp, Homo sapiens
aactgagccaaacacactgtaa

SEQ ID NO: 2080535 - DNA, 23 bp, Homo sapiens
aactgagccaaacacactgtaaa

SEQ ID NO: 2080536 - DNA, 10 bp, Homo sapiens
aactgagcct

SEQ ID NO: 2080537 - DNA, 11 bp, Homo sapiens
aactgagccta

SEQ ID NO: 2080538 - DNA, 13 bp, Homo sapiens
aactgagcctagc

SEQ ID NO: 2080539 - DNA, 13 bp, Homo sapiens
aactgaggaattt

SEQ ID NO: 2080540 - DNA, 12 bp, Homo sapiens
aactgaggcaga

SEQ ID NO: 2080541 - DNA, 20 bp, Homo sapiens
aactgaggtcactgggttct

SEQ ID NO: 2080542 - DNA, 22 bp, Homo sapiens
aactgatggaccgggtgggcct

SEQ ID NO: 2080543 - DNA, 17 bp, Homo sapiens
aactgattagtattcag

SEQ ID NO: 2080544 - DNA, 17 bp, Homo sapiens
aactgattcacatctca

SEQ ID NO: 2080545 - DNA, 14 bp, Homo sapiens
aactgatttctcac

SEQ ID NO: 2080546 - DNA, 18 bp, Homo sapiens
aactgcaaagtgaagttg

SEQ ID NO: 2080547 - DNA, 17 bp, Homo sapiens
aactgcacacacagctc

SEQ ID NO: 2080548 - DNA, 12 bp, Homo sapiens
aactgccaagaa

SEQ ID NO: 2080549 - DNA, 14 bp, Homo sapiens
aactgcgtgccagt

SEQ ID NO: 2080550 - DNA, 22 bp, Homo sapiens
aactgcgtgccagtgtccccac

SEQ ID NO: 2080551 - DNA, 15 bp, Homo sapiens
aactgctgagccact

SEQ ID NO: 2080552 - DNA, 19 bp, Homo sapiens
aactgctgatcaatgaaat

SEQ ID NO: 2080553 - DNA, 21 bp, Homo sapiens
aactggaataagaagcaaata

SEQ ID NO: 2080554 - DNA, 18 bp, Homo sapiens
aactggagcaagaaggaa

SEQ ID NO: 2080555 - DNA, 11 bp, Homo sapiens
aactggctggc

SEQ ID NO: 2080556 - DNA, 13 bp, Homo sapiens
aactggctggcca

SEQ ID NO: 2080557 - DNA, 22 bp, Homo sapiens
aactggctgtttgatagcagaa

SEQ ID NO: 2080558 - DNA, 19 bp, Homo sapiens
aactggggagttataaaaa

SEQ ID NO: 2080559 - DNA, 20 bp, Homo sapiens
aactggggagttataaaaat

SEQ ID NO: 2080560 - DNA, 19 bp, Homo sapiens
aactggggtattaactttt

SEQ ID NO: 2080561 - DNA, 18 bp, Homo sapiens
aactgggtaatgaaacaa

SEQ ID NO: 2080562 - DNA, 16 bp, Homo sapiens
aactgggtacttgtgg

SEQ ID NO: 2080563 - DNA, 21 bp, Homo sapiens
aactgggtacttgtggacaca

SEQ ID NO: 2080564 - DNA, 22 bp, Homo sapiens
aactggtccactcagggctgcc

SEQ ID NO: 2080565 - DNA, 21 bp, Homo sapiens
aactggtttgttgcagccaaa

SEQ ID NO: 2080566 - DNA, 10 bp, Homo sapiens
aactgtaaat

SEQ ID NO: 2080567 - DNA, 21 bp, Homo sapiens
aactgtaaatatgtttgtgcc

SEQ ID NO: 2080568 - DNA, 19 bp, Homo sapiens
aactgtaaatcacttgtaa

SEQ ID NO: 2080569 - DNA, 22 bp, Homo sapiens
aactgtaaatcacttgtaaata

SEQ ID NO: 2080570 - DNA, 23 bp, Homo sapiens
aactgtaaatcacttgtaaataa

SEQ ID NO: 2080571 - DNA, 17 bp, Homo sapiens
aactgtatcaaatctgt

SEQ ID NO: 2080572 - DNA, 14 bp, Homo sapiens
aactgtatgtcaga

SEQ ID NO: 2080573 - DNA, 11 bp, Homo sapiens
aactgtgacag

SEQ ID NO: 2080574 - DNA, 19 bp, Homo sapiens
aactgtgatggggtgggca

SEQ ID NO: 2080575 - DNA, 21 bp, Homo sapiens
aactgtgatggggtgggcagg

SEQ ID NO: 2080576 - DNA, 22 bp, Homo sapiens
aactgtgatggggtgggcaggg

SEQ ID NO: 2080577 - DNA, 23 bp, Homo sapiens
aactgtgatggggtgggcagggc

SEQ ID NO: 2080578 - DNA, 14 bp, Homo sapiens
aactgtgtgaacgc

SEQ ID NO: 2080579 - DNA, 14 bp, Homo sapiens
aactgtgtgaagaa

SEQ ID NO: 2080580 - DNA, 15 bp, Homo sapiens
aactgtgtgaagaaa

SEQ ID NO: 2080581 - DNA, 21 bp, Homo sapiens
aactgttctggcctcagacca

SEQ ID NO: 2080582 - DNA, 16 bp, Homo sapiens
aactgtttttgaagaa

SEQ ID NO: 2080583 - DNA, 13 bp, Homo sapiens
aacttaaaatatt

SEQ ID NO: 2080584 - DNA, 15 bp, Homo sapiens
aacttaaacaatttc

SEQ ID NO: 2080585 - DNA, 15 bp, Homo sapiens
aacttaaataaatgt

SEQ ID NO: 2080586 - DNA, 19 bp, Homo sapiens
aacttaaataaatgtcatt

SEQ ID NO: 2080587 - DNA, 14 bp, Homo sapiens
aacttaaatcactg

SEQ ID NO: 2080588 - DNA, 16 bp, Homo sapiens
aacttaacatatttac

SEQ ID NO: 2080589 - DNA, 17 bp, Homo sapiens
aacttaacattctgtaa

SEQ ID NO: 2080590 - DNA, 19 bp, Homo sapiens
aacttacacttggagcccg

SEQ ID NO: 2080591 - DNA, 18 bp, Homo sapiens
aacttagaataaaattgt

SEQ ID NO: 2080592 - DNA, 21 bp, Homo sapiens
aacttagaataaaattgtaaa

SEQ ID NO: 2080593 - DNA, 23 bp, Homo sapiens
aacttagtgcggacaagttttaa

SEQ ID NO: 2080594 - DNA, 13 bp, Homo sapiens
aacttcaagaagt

SEQ ID NO: 2080595 - DNA, 22 bp, Homo sapiens
aacttcagagggaaagtaaata

SEQ ID NO: 2080596 - DNA, 13 bp, Homo sapiens
aacttcagcacca

SEQ ID NO: 2080597 - DNA, 14 bp, Homo sapiens
aacttcatttgatg

SEQ ID NO: 2080598 - DNA, 20 bp, Homo sapiens
aacttcgaccctttctctga

SEQ ID NO: 2080599 - DNA, 17 bp, Homo sapiens
aacttgaggacacatgt

SEQ ID NO: 2080600 - DNA, 22 bp, Homo sapiens
aacttgagggtaataaacttag

SEQ ID NO: 2080601 - DNA, 22 bp, Homo sapiens
aacttgcttagtatggttctca

SEQ ID NO: 2080602 - DNA, 22 bp, Homo sapiens
aacttggaaaaagaaagaaaca

SEQ ID NO: 2080603 - DNA, 13 bp, Homo sapiens
aacttggagtttc

SEQ ID NO: 2080604 - DNA, 14 bp, Homo sapiens
aacttggagtttca

SEQ ID NO: 2080605 - DNA, 22 bp, Homo sapiens
aacttggttttgctacataatt

SEQ ID NO: 2080606 - DNA, 14 bp, Homo sapiens
aacttgtaaataca

SEQ ID NO: 2080607 - DNA, 18 bp, Homo sapiens
aacttgtaaatgctgtca

SEQ ID NO: 2080608 - DNA, 13 bp, Homo sapiens
aacttgtatattc

SEQ ID NO: 2080609 - DNA, 14 bp, Homo sapiens
aagagagaaagaag

SEQ ID NO: 2080610 - DNA, 21 bp, Homo sapiens
aagagagaaagaagtaggcat

SEQ ID NO: 2080611 - DNA, 11 bp, Homo sapiens
aagagagaaat

SEQ ID NO: 2080612 - DNA, 13 bp, Homo sapiens
aagagagaaatct

SEQ ID NO: 2080613 - DNA, 19 bp, Homo sapiens
aagagagacattgcctcca

SEQ ID NO: 2080614 - DNA, 20 bp, Homo sapiens
aagagagatatatctgaaaa

SEQ ID NO: 2080615 - DNA, 12 bp, Homo sapiens
aagagaggcacc

SEQ ID NO: 2080616 - DNA, 17 bp, Homo sapiens
aagagaggcacctgctg

SEQ ID NO: 2080617 - DNA, 18 bp, Homo sapiens
aagagaggcacctgctgg

SEQ ID NO: 2080618 - DNA, 14 bp, Homo sapiens
aagagatacattcc

SEQ ID NO: 2080619 - DNA, 22 bp, Homo sapiens
aagagatcaggaagagaaggag

SEQ ID NO: 2080620 - DNA, 18 bp, Homo sapiens
aagagatgggcttgtttt

SEQ ID NO: 2080621 - DNA, 21 bp, Homo sapiens
aagagatgtggcaaagtgctg

SEQ ID NO: 2080622 - DNA, 16 bp, Homo sapiens
aagagatttcaacata

SEQ ID NO: 2080623 - DNA, 18 bp, Homo sapiens
aagagatttcaacatatc

SEQ ID NO: 2080624 - DNA, 21 bp, Homo sapiens
aagagcacattcttaaaggaa

SEQ ID NO: 2080625 - DNA, 23 bp, Homo sapiens
aagagcaggcacatggaggagct

SEQ ID NO: 2080626 - DNA, 19 bp, Homo sapiens
aagagcatcatgcctctga

SEQ ID NO: 2080627 - DNA, 23 bp, Homo sapiens
aagagcatcatgcctctgaggcc

SEQ ID NO: 2080628 - DNA, 22 bp, Homo sapiens
aagagccctgagctcaggctga

SEQ ID NO: 2080629 - DNA, 15 bp, Homo sapiens
aagagcctgactgtg

SEQ ID NO: 2080630 - DNA, 14 bp, Homo sapiens
aagagcctggagaa

SEQ ID NO: 2080631 - DNA, 21 bp, Homo sapiens
aagagccttggtgtccacctg

SEQ ID NO: 2080632 - DNA, 22 bp, Homo sapiens
aagagccttggtgtccacctgg

SEQ ID NO: 2080633 - DNA, 21 bp, Homo sapiens
aagagctcttcggtttctgag

SEQ ID NO: 2080634 - DNA, 11 bp, Homo sapiens
aagagctgagg

SEQ ID NO: 2080635 - DNA, 21 bp, Homo sapiens
aagagctgatgtgagtgtgtg

SEQ ID NO: 2080636 - DNA, 22 bp, Homo sapiens
aagagctgatgtgagtgtgtgt

SEQ ID NO: 2080637 - DNA, 17 bp, Homo sapiens
aagaggactgagactgg

SEQ ID NO: 2080638 - DNA, 15 bp, Homo sapiens
aagaggcaagagaca

SEQ ID NO: 2080639 - DNA, 21 bp, Homo sapiens
aagaggcaagagacagaatga

SEQ ID NO: 2080640 - DNA, 12 bp, Homo sapiens
aagaggcccagg

SEQ ID NO: 2080641 - DNA, 14 bp, Homo sapiens
aagaggcccaggga

SEQ ID NO: 2080642 - DNA, 14 bp, Homo sapiens
aagaggctgaggca

SEQ ID NO: 2080643 - DNA, 23 bp, Homo sapiens
aagagggaagaaagagaaggagc

SEQ ID NO: 2080644 - DNA, 14 bp, Homo sapiens
aagagggcctgtgg

SEQ ID NO: 2080645 - DNA, 21 bp, Homo sapiens
aagaggtatttatctttactt

SEQ ID NO: 2080646 - DNA, 16 bp, Homo sapiens
aagaggtgaccccagg

SEQ ID NO: 2080647 - DNA, 12 bp, Homo sapiens
aagaggtgggga

SEQ ID NO: 2080648 - DNA, 21 bp, Homo sapiens
aagagtagcaagttctagaga

SEQ ID NO: 2080649 - DNA, 23 bp, Homo sapiens
aagagtagcaagttctagagaag

SEQ ID NO: 2080650 - DNA, 14 bp, Homo sapiens
aagagtgcattttc

SEQ ID NO: 2080651 - DNA, 19 bp, Homo sapiens
aagagttattcaaatgaag

SEQ ID NO: 2080652 - DNA, 20 bp, Homo sapiens
aagagttattcaaatgaagg

SEQ ID NO: 2080653 - DNA, 21 bp, Homo sapiens
aagagttctttaggtgcctcc

SEQ ID NO: 2080654 - DNA, 22 bp, Homo sapiens
aagagttctttaggtgcctcct

SEQ ID NO: 2080655 - DNA, 19 bp, Homo sapiens
aagataaaatatcctcagg

SEQ ID NO: 2080656 - DNA, 17 bp, Homo sapiens
aagataaagccagaagc

SEQ ID NO: 2080657 - DNA, 20 bp, Homo sapiens
aagataatgttctttaatgt

SEQ ID NO: 2080658 - DNA, 12 bp, Homo sapiens
aagataattata

SEQ ID NO: 2080659 - DNA, 16 bp, Homo sapiens
aagatacactcctgct

SEQ ID NO: 2080660 - DNA, 17 bp, Homo sapiens
aagatacactcctgctg

SEQ ID NO: 2080661 - DNA, 21 bp, Homo sapiens
aagataggtttgagttcaaat

SEQ ID NO: 2080662 - DNA, 23 bp, Homo sapiens
aagataggtttgagttcaaattt

SEQ ID NO: 2080663 - DNA, 15 bp, Homo sapiens
aagatatattttgag

SEQ ID NO: 2080664 - DNA, 22 bp, Homo sapiens
aagatatcagagctcttaatgt

SEQ ID NO: 2080665 - DNA, 13 bp, Homo sapiens
aagatatttatat

SEQ ID NO: 2080666 - DNA, 15 bp, Homo sapiens
aagatatttatatat

SEQ ID NO: 2080667 - DNA, 15 bp, Homo sapiens
aagatccaccctcaa

SEQ ID NO: 2080668 - DNA, 23 bp, Homo sapiens
aagatccaccctcaaatgtcaga

SEQ ID NO: 2080669 - DNA, 19 bp, Homo sapiens
aagatctcagataaagtga

SEQ ID NO: 2080670 - DNA, 24 bp, Homo sapiens
aagatcttgtctccactaaatgag

SEQ ID NO: 2080671 - DNA, 12 bp, Homo sapiens
aagatcttttaa

SEQ ID NO: 2080672 - DNA, 23 bp, Homo sapiens
aagatgaaaaatggtcccttctt

SEQ ID NO: 2080673 - DNA, 17 bp, Homo sapiens
aagatgaagagaagctg

SEQ ID NO: 2080674 - DNA, 18 bp, Homo sapiens
aagatgaagagaagctga

SEQ ID NO: 2080675 - DNA, 14 bp, Homo sapiens
aagatgacagctct

SEQ ID NO: 2080676 - DNA, 15 bp, Homo sapiens
aagatgacagctctt

SEQ ID NO: 2080677 - DNA, 18 bp, Homo sapiens
aagatgagagaactggag

SEQ ID NO: 2080678 - DNA, 15 bp, Homo sapiens
aagatggatgtgctt

SEQ ID NO: 2080679 - DNA, 17 bp, Homo sapiens
aagatggctgactttgc

SEQ ID NO: 2080680 - DNA, 20 bp, Homo sapiens
aagatggctgtgcctctgcc

SEQ ID NO: 2080681 - DNA, 21 bp, Homo sapiens
aagatggctgtgcctctgcct

SEQ ID NO: 2080682 - DNA, 19 bp, Homo sapiens
aagatgggcacatgaggag

SEQ ID NO: 2080683 - DNA, 22 bp, Homo sapiens
aagatgggcacatgaggagggt

SEQ ID NO: 2080684 - DNA, 15 bp, Homo sapiens
aagatgtaaggaatt

SEQ ID NO: 2080685 - DNA, 21 bp, Homo sapiens
aagatgtaaggaattgaagat

SEQ ID NO: 2080686 - DNA, 16 bp, Homo sapiens
aagatgtttgtcagat

SEQ ID NO: 2080687 - DNA, 13 bp, Homo sapiens
aagattaaaggaa

SEQ ID NO: 2080688 - DNA, 21 bp, Homo sapiens
aagattaaattatatctgagg

SEQ ID NO: 2080689 - DNA, 18 bp, Homo sapiens
aagattatattataataa

SEQ ID NO: 2080690 - DNA, 19 bp, Homo sapiens
aagattatattataataat

SEQ ID NO: 2080691 - DNA, 14 bp, Homo sapiens
aagattcaaagaga

SEQ ID NO: 2080692 - DNA, 19 bp, Homo sapiens
aagattcccagagacagga

SEQ ID NO: 2080693 - DNA, 17 bp, Homo sapiens
aagattctcctgtgcta

SEQ ID NO: 2080694 - DNA, 16 bp, Homo sapiens
aagattgcttaaaata

SEQ ID NO: 2080695 - DNA, 22 bp, Homo sapiens
aagattggacatggtctcctct

SEQ ID NO: 2080696 - DNA, 12 bp, Homo sapiens
aagattgtaatt

SEQ ID NO: 2080697 - DNA, 13 bp, Homo sapiens
aagattgtacata

SEQ ID NO: 2080698 - DNA, 14 bp, Homo sapiens
aagatttaacacta

SEQ ID NO: 2080699 - DNA, 17 bp, Homo sapiens
aagatttaagtaatttt

SEQ ID NO: 2080700 - DNA, 22 bp, Homo sapiens
aagatttaccttttctgttgta

SEQ ID NO: 2080701 - DNA, 21 bp, Homo sapiens
aagatttgttttgtcaagtgt

SEQ ID NO: 2080702 - DNA, 13 bp, Homo sapiens
aagattttttaat

SEQ ID NO: 2080703 - DNA, 16 bp, Homo sapiens
aagattttttaataat

SEQ ID NO: 2080704 - DNA, 21 bp, Homo sapiens
aagcaaaattataagaagagg

SEQ ID NO: 2080705 - DNA, 17 bp, Homo sapiens
aagcaaagcaccagctt

SEQ ID NO: 2080706 - DNA, 17 bp, Homo sapiens
aagcaaagccacatttt

SEQ ID NO: 2080707 - DNA, 16 bp, Homo sapiens
aagcaaaggaaaccaa

SEQ ID NO: 2080708 - DNA, 16 bp, Homo sapiens
aagcaaataaatatca

SEQ ID NO: 2080709 - DNA, 18 bp, Homo sapiens
aagcaaatcgaatgaaat

SEQ ID NO: 2080710 - DNA, 21 bp, Homo sapiens
aagcaacattttatttaagaa

SEQ ID NO: 2080711 - DNA, 19 bp, Homo sapiens
aagcaacctcagtaattta

SEQ ID NO: 2080712 - DNA, 20 bp, Homo sapiens
aagcaacctcagtaatttag

SEQ ID NO: 2080713 - DNA, 15 bp, Homo sapiens
aagcaacttgcttct

SEQ ID NO: 2080714 - DNA, 18 bp, Homo sapiens
aagcaagacgtcctggaa

SEQ ID NO: 2080715 - DNA, 23 bp, Homo sapiens
aagcaagacgtcctggaatgaag

SEQ ID NO: 2080716 - DNA, 20 bp, Homo sapiens
aagcaagggctccagcatcc

SEQ ID NO: 2080717 - DNA, 12 bp, Homo sapiens
aagcaataatta

SEQ ID NO: 2080718 - DNA, 22 bp, Homo sapiens
aagcaatgggcactggtatttg

SEQ ID NO: 2080719 - DNA, 16 bp, Homo sapiens
aagcaattgccctgta

SEQ ID NO: 2080720 - DNA, 14 bp, Homo sapiens
aagcacaggagaca

SEQ ID NO: 2080721 - DNA, 20 bp, Homo sapiens
aagcacagtctgatgacaca

SEQ ID NO: 2080722 - DNA, 13 bp, Homo sapiens
aagcacagtgtta

SEQ ID NO: 2080723 - DNA, 15 bp, Homo sapiens
aagcacatgtttatt

SEQ ID NO: 2080724 - DNA, 13 bp, Homo sapiens
aagcaccaaattc

SEQ ID NO: 2080725 - DNA, 14 bp, Homo sapiens
aagcaccctgttcc

SEQ ID NO: 2080726 - DNA, 18 bp, Homo sapiens
aagcaccgcagcatgtgg

SEQ ID NO: 2080727 - DNA, 15 bp, Homo sapiens
aagcacctcctgcct

SEQ ID NO: 2080728 - DNA, 20 bp, Homo sapiens
aagcacctgccgacctcgtc

SEQ ID NO: 2080729 - DNA, 16 bp, Homo sapiens
aagcaccttagctggc

SEQ ID NO: 2080730 - DNA, 21 bp, Homo sapiens
aagcactcccttaggcattat

SEQ ID NO: 2080731 - DNA, 20 bp, Homo sapiens
aagcactcgagaccatcctg

SEQ ID NO: 2080732 - DNA, 19 bp, Homo sapiens
aagcactgctaggcgagtg

SEQ ID NO: 2080733 - DNA, 22 bp, Homo sapiens
aagcactgtttaactgggagtg

SEQ ID NO: 2080734 - DNA, 17 bp, Homo sapiens
aagcagacgcagcagct

SEQ ID NO: 2080735 - DNA, 14 bp, Homo sapiens
aagcagaggctttg

SEQ ID NO: 2080736 - DNA, 18 bp, Homo sapiens
aagcagcagctaggactg

SEQ ID NO: 2080737 - DNA, 13 bp, Homo sapiens
aagcagcattcag

SEQ ID NO: 2080738 - DNA, 11 bp, Homo sapiens
aagcagccagc

SEQ ID NO: 2080739 - DNA, 13 bp, Homo sapiens
aagcagccagcca

SEQ ID NO: 2080740 - DNA, 22 bp, Homo sapiens
aagcagccagccagtcttgcct

SEQ ID NO: 2080741 - DNA, 12 bp, Homo sapiens
aagcagcctcct

SEQ ID NO: 2080742 - DNA, 15 bp, Homo sapiens
aagcagcctttctgt

SEQ ID NO: 2080743 - DNA, 21 bp, Homo sapiens
aagcagcctttctgtggagag

SEQ ID NO: 2080744 - DNA, 11 bp, Homo sapiens
aagcagctggg

SEQ ID NO: 2080745 - DNA, 20 bp, Homo sapiens
aagcaggcagagcggggagg

SEQ ID NO: 2080746 - DNA, 22 bp, Homo sapiens
aagcagggacaccccccgcccc

SEQ ID NO: 2080747 - DNA, 15 bp, Homo sapiens
aagcaggttcttgat

SEQ ID NO: 2080748 - DNA, 18 bp, Homo sapiens
aagcagtgccttccataa

SEQ ID NO: 2080749 - DNA, 20 bp, Homo sapiens
aagcagtgccttccataatt

SEQ ID NO: 2080750 - DNA, 16 bp, Homo sapiens
aagcagtgcttgtaaa

SEQ ID NO: 2080751 - DNA, 19 bp, Homo sapiens
aagcatatgcctacttgta

SEQ ID NO: 2080752 - DNA, 19 bp, Homo sapiens
aacttgtatattccaccat

SEQ ID NO: 2080753 - DNA, 17 bp, Homo sapiens
aacttgtgctgagaata

SEQ ID NO: 2080754 - DNA, 16 bp, Homo sapiens
aacttgttcacaggtt

SEQ ID NO: 2080755 - DNA, 19 bp, Homo sapiens
aactttaaagcgtttgcac

SEQ ID NO: 2080756 - DNA, 22 bp, Homo sapiens
aactttagagtagcatgagaga

SEQ ID NO: 2080757 - DNA, 17 bp, Homo sapiens
aactttccatctgcttg

SEQ ID NO: 2080758 - DNA, 15 bp, Homo sapiens
aactttgaagttagc

SEQ ID NO: 2080759 - DNA, 22 bp, Homo sapiens
aactttgtacagtggagaaata

SEQ ID NO: 2080760 - DNA, 23 bp, Homo sapiens
aactttgtacagtggagaaatat

SEQ ID NO: 2080761 - DNA, 14 bp, Homo sapiens
aagaaaaaatacat

SEQ ID NO: 2080762 - DNA, 20 bp, Homo sapiens
aagaaaaacaaactcgtttt

SEQ ID NO: 2080763 - DNA, 16 bp, Homo sapiens
aagaaaaaggctggct

SEQ ID NO: 2080764 - DNA, 20 bp, Homo sapiens
aagaaaactaacaaccaacc

SEQ ID NO: 2080765 - DNA, 14 bp, Homo sapiens
aagaaaagaccctg

SEQ ID NO: 2080766 - DNA, 13 bp, Homo sapiens
aagaaaaggcatg

SEQ ID NO: 2080767 - DNA, 19 bp, Homo sapiens
aagaaaatacataagacca

SEQ ID NO: 2080768 - DNA, 16 bp, Homo sapiens
aagaaacaaggttttc

SEQ ID NO: 2080769 - DNA, 11 bp, Homo sapiens
aagaaacccaa

SEQ ID NO: 2080770 - DNA, 23 bp, Homo sapiens
aagaaaccccaagcagcattcag

SEQ ID NO: 2080771 - DNA, 17 bp, Homo sapiens
aagaaactatacatcat

SEQ ID NO: 2080772 - DNA, 11 bp, Homo sapiens
aagaaactttc

SEQ ID NO: 2080773 - DNA, 16 bp, Homo sapiens
aagaaagaacggaaga

SEQ ID NO: 2080774 - DNA, 13 bp, Homo sapiens
aagaaagaaggaa

SEQ ID NO: 2080775 - DNA, 17 bp, Homo sapiens
aagaaagagaaggagcc

SEQ ID NO: 2080776 - DNA, 18 bp, Homo sapiens
aagaaagcacctgttttt

SEQ ID NO: 2080777 - DNA, 16 bp, Homo sapiens
aagaaagcatagacat

SEQ ID NO: 2080778 - DNA, 20 bp, Homo sapiens
aagaaagggaaactggctga

SEQ ID NO: 2080779 - DNA, 19 bp, Homo sapiens
aagaaagttaggttataag

SEQ ID NO: 2080780 - DNA, 13 bp, Homo sapiens
aagaaatccctgt

SEQ ID NO: 2080781 - DNA, 19 bp, Homo sapiens
aagaacaacaacaacaata

SEQ ID NO: 2080782 - DNA, 18 bp, Homo sapiens
aagaacatccaaggagaa

SEQ ID NO: 2080783 - DNA, 16 bp, Homo sapiens
aagaacgtcattttgg

SEQ ID NO: 2080784 - DNA, 18 bp, Homo sapiens
aagaactgccccatctcc

SEQ ID NO: 2080785 - DNA, 20 bp, Homo sapiens
aagaacttgatatatttcat

SEQ ID NO: 2080786 - DNA, 11 bp, Homo sapiens
aagaagagaca

SEQ ID NO: 2080787 - DNA, 19 bp, Homo sapiens
aagaagccacagacctagg

SEQ ID NO: 2080788 - DNA, 17 bp, Homo sapiens
aagaagccgggaacaga

SEQ ID NO: 2080789 - DNA, 14 bp, Homo sapiens
aagaagctgaggat

SEQ ID NO: 2080790 - DNA, 19 bp, Homo sapiens
aagaaggaaaaattccagg

SEQ ID NO: 2080791 - DNA, 20 bp, Homo sapiens
aagaaggcacaggtgtaaat

SEQ ID NO: 2080792 - DNA, 22 bp, Homo sapiens
aagaagggctagaacctggagg

SEQ ID NO: 2080793 - DNA, 14 bp, Homo sapiens
aagaagtaaaagct

SEQ ID NO: 2080794 - DNA, 17 bp, Homo sapiens
aagaagtaaatttgtcc

SEQ ID NO: 2080795 - DNA, 15 bp, Homo sapiens
aagaagtaggcatga

SEQ ID NO: 2080796 - DNA, 20 bp, Homo sapiens
aagaagtaggggaagacatg

SEQ ID NO: 2080797 - DNA, 15 bp, Homo sapiens
aagaagtcataaaca

SEQ ID NO: 2080798 - DNA, 15 bp, Homo sapiens
aagaagtttcatcat

SEQ ID NO: 2080799 - DNA, 18 bp, Homo sapiens
aagaagtttcatcatttt

SEQ ID NO: 2080800 - DNA, 22 bp, Homo sapiens
aagaagtttctggagcaagaga

SEQ ID NO: 2080801 - DNA, 12 bp, Homo sapiens
aagaataaagtc

SEQ ID NO: 2080802 - DNA, 12 bp, Homo sapiens
aagaataaatga

SEQ ID NO: 2080803 - DNA, 21 bp, Homo sapiens
aagaataatatgctgccaaat

SEQ ID NO: 2080804 - DNA, 16 bp, Homo sapiens
aagaatacaaacatat

SEQ ID NO: 2080805 - DNA, 18 bp, Homo sapiens
aagaatacaaacatattt

SEQ ID NO: 2080806 - DNA, 17 bp, Homo sapiens
aagaatacttctcattt

SEQ ID NO: 2080807 - DNA, 22 bp, Homo sapiens
aagaatacttctcattttttaa

SEQ ID NO: 2080808 - DNA, 14 bp, Homo sapiens
aagaataggtcatt

SEQ ID NO: 2080809 - DNA, 15 bp, Homo sapiens
aagaatattcaaatg

SEQ ID NO: 2080810 - DNA, 17 bp, Homo sapiens
aagaatattcagagaat

SEQ ID NO: 2080811 - DNA, 21 bp, Homo sapiens
aagaatcacaataattttcta

SEQ ID NO: 2080812 - DNA, 20 bp, Homo sapiens
aagaatctagataggtgctt

SEQ ID NO: 2080813 - DNA, 12 bp, Homo sapiens
aagaatctcatc

SEQ ID NO: 2080814 - DNA, 21 bp, Homo sapiens
aagaatgagaaggagtcagaa

SEQ ID NO: 2080815 - DNA, 22 bp, Homo sapiens
aagaatgcagattcctgggcct

SEQ ID NO: 2080816 - DNA, 18 bp, Homo sapiens
aagaatgctggttttcct

SEQ ID NO: 2080817 - DNA, 13 bp, Homo sapiens
aagaatgcttaat

SEQ ID NO: 2080818 - DNA, 17 bp, Homo sapiens
aagaatgcttaatcaga

SEQ ID NO: 2080819 - DNA, 12 bp, Homo sapiens
aagaatgttaag

SEQ ID NO: 2080820 - DNA, 17 bp, Homo sapiens
aagaattatttttgtgt

SEQ ID NO: 2080821 - DNA, 22 bp, Homo sapiens
aagaattatttttgtgtttcta

SEQ ID NO: 2080822 - DNA, 13 bp, Homo sapiens
aagaattcctgaa

SEQ ID NO: 2080823 - DNA, 14 bp, Homo sapiens
aagaattgtccatg

SEQ ID NO: 2080824 - DNA, 20 bp, Homo sapiens
aagaatttcttggtaagaag

SEQ ID NO: 2080825 - DNA, 17 bp, Homo sapiens
aagacaaaccactgtac

SEQ ID NO: 2080826 - DNA, 14 bp, Homo sapiens
aagacacattccta

SEQ ID NO: 2080827 - DNA, 14 bp, Homo sapiens
aagacaccaaattc

SEQ ID NO: 2080828 - DNA, 12 bp, Homo sapiens
aagacagaatgt

SEQ ID NO: 2080829 - DNA, 17 bp, Homo sapiens
aagacagaatgtcacca

SEQ ID NO: 2080830 - DNA, 19 bp, Homo sapiens
aagacaggtctagactttc

SEQ ID NO: 2080831 - DNA, 17 bp, Homo sapiens
aagacagtggatcatga

SEQ ID NO: 2080832 - DNA, 18 bp, Homo sapiens
aagacatgaatgcacact

SEQ ID NO: 2080833 - DNA, 14 bp, Homo sapiens
aagacatgcagcct

SEQ ID NO: 2080834 - DNA, 19 bp, Homo sapiens
aagacatggagactcctgc

SEQ ID NO: 2080835 - DNA, 16 bp, Homo sapiens
aagacatgttgtaaat

SEQ ID NO: 2080836 - DNA, 19 bp, Homo sapiens
aagacatgttgtaaattag

SEQ ID NO: 2080837 - DNA, 17 bp, Homo sapiens
aagaccacaaaaattga

SEQ ID NO: 2080838 - DNA, 12 bp, Homo sapiens
aagaccagtcca

SEQ ID NO: 2080839 - DNA, 17 bp, Homo sapiens
aagacccagcaggaagc

SEQ ID NO: 2080840 - DNA, 15 bp, Homo sapiens
aagaccctgagactc

SEQ ID NO: 2080841 - DNA, 16 bp, Homo sapiens
aagaccgaattttatt

SEQ ID NO: 2080842 - DNA, 17 bp, Homo sapiens
aagacctaaatgacctc

SEQ ID NO: 2080843 - DNA, 13 bp, Homo sapiens
aagacctctgtga

SEQ ID NO: 2080844 - DNA, 21 bp, Homo sapiens
aagaccttctccaaatgagat

SEQ ID NO: 2080845 - DNA, 20 bp, Homo sapiens
aagaccttctccccattctg

SEQ ID NO: 2080846 - DNA, 21 bp, Homo sapiens
aagacgacggcttcaggcccg

SEQ ID NO: 2080847 - DNA, 18 bp, Homo sapiens
aagacgtgaatgtctcag

SEQ ID NO: 2080848 - DNA, 22 bp, Homo sapiens
aagactatcttactatttcaca

SEQ ID NO: 2080849 - DNA, 16 bp, Homo sapiens
aagactattaagagca

SEQ ID NO: 2080850 - DNA, 17 bp, Homo sapiens
aagactcattccctaga

SEQ ID NO: 2080851 - DNA, 17 bp, Homo sapiens
aagactcattcttctgt

SEQ ID NO: 2080852 - DNA, 12 bp, Homo sapiens
aagactgaaaga

SEQ ID NO: 2080853 - DNA, 13 bp, Homo sapiens
aagactgcagctg

SEQ ID NO: 2080854 - DNA, 15 bp, Homo sapiens
aagactgtggctgct

SEQ ID NO: 2080855 - DNA, 18 bp, Homo sapiens
aagactgtggctgctagc

SEQ ID NO: 2080856 - DNA, 13 bp, Homo sapiens
aagacttaagatt

SEQ ID NO: 2080857 - DNA, 14 bp, Homo sapiens
aagacttaagatta

SEQ ID NO: 2080858 - DNA, 15 bp, Homo sapiens
aagacttaagattaa

SEQ ID NO: 2080859 - DNA, 20 bp, Homo sapiens
aagacttcagtcctggtctg

SEQ ID NO: 2080860 - DNA, 20 bp, Homo sapiens
aagacttctctttgcctcaa

SEQ ID NO: 2080861 - DNA, 17 bp, Homo sapiens
aagagaaaaaccaatga

SEQ ID NO: 2080862 - DNA, 19 bp, Homo sapiens
aagagaaaaaccaatgatt

SEQ ID NO: 2080863 - DNA, 12 bp, Homo sapiens
aagagaaaagat

SEQ ID NO: 2080864 - DNA, 12 bp, Homo sapiens
aagagaaatttt

SEQ ID NO: 2080865 - DNA, 22 bp, Homo sapiens
aagagaagaaaaaattaagaga

SEQ ID NO: 2080866 - DNA, 17 bp, Homo sapiens
aagagaagcaaagtggg

SEQ ID NO: 2080867 - DNA, 17 bp, Homo sapiens
aagagaagctgagaaga

SEQ ID NO: 2080868 - DNA, 11 bp, Homo sapiens
aagagaattca

SEQ ID NO: 2080869 - DNA, 18 bp, Homo sapiens
aagagacttaagaaagct

SEQ ID NO: 2080870 - DNA, 17 bp, Homo sapiens
aatccaacccatgatga

SEQ ID NO: 2080871 - DNA, 13 bp, Homo sapiens
aatccactctcag

SEQ ID NO: 2080872 - DNA, 16 bp, Homo sapiens
aatccaggtgggagag

SEQ ID NO: 2080873 - DNA, 19 bp, Homo sapiens
aatccagtgtgcacccctc

SEQ ID NO: 2080874 - DNA, 22 bp, Homo sapiens
aatccatgttagtttttacttt

SEQ ID NO: 2080875 - DNA, 18 bp, Homo sapiens
aatcccacccacatgtga

SEQ ID NO: 2080876 - DNA, 20 bp, Homo sapiens
aatcccattcataactttca

SEQ ID NO: 2080877 - DNA, 13 bp, Homo sapiens
aatccctgtttaa

SEQ ID NO: 2080878 - DNA, 21 bp, Homo sapiens
aatcccttaatatcctaaaca

SEQ ID NO: 2080879 - DNA, 21 bp, Homo sapiens
aatcctattaaaacacagctt

SEQ ID NO: 2080880 - DNA, 24 bp, Homo sapiens
aatcctattaaaacacagctttac

SEQ ID NO: 2080881 - DNA, 20 bp, Homo sapiens
aatcctcaggatttcattga

SEQ ID NO: 2080882 - DNA, 18 bp, Homo sapiens
aatcctctctctgtgtta

SEQ ID NO: 2080883 - DNA, 22 bp, Homo sapiens
aatcctgaagaaaccacaggtt

SEQ ID NO: 2080884 - DNA, 11 bp, Homo sapiens
aatcctgcctc

SEQ ID NO: 2080885 - DNA, 14 bp, Homo sapiens
aatcctgcctctcc

SEQ ID NO: 2080886 - DNA, 22 bp, Homo sapiens
aatcctgtatattatggtgtaa

SEQ ID NO: 2080887 - DNA, 20 bp, Homo sapiens
aatcctgtcgattagactgg

SEQ ID NO: 2080888 - DNA, 21 bp, Homo sapiens
aatcctgtcgattagactgga

SEQ ID NO: 2080889 - DNA, 15 bp, Homo sapiens
aatccttatttatat

SEQ ID NO: 2080890 - DNA, 17 bp, Homo sapiens
aatccttgcttatgaca

SEQ ID NO: 2080891 - DNA, 13 bp, Homo sapiens
aatcctttactgt

SEQ ID NO: 2080892 - DNA, 16 bp, Homo sapiens
aatcgaaatgaattta

SEQ ID NO: 2080893 - DNA, 16 bp, Homo sapiens
aatcgacctcactgtc

SEQ ID NO: 2080894 - DNA, 15 bp, Homo sapiens
aatcggttcatcaat

SEQ ID NO: 2080895 - DNA, 17 bp, Homo sapiens
aatcgttatgtgtgtat

SEQ ID NO: 2080896 - DNA, 18 bp, Homo sapiens
aatcgttatgtgtgtata

SEQ ID NO: 2080897 - DNA, 13 bp, Homo sapiens
aatctaactacaa

SEQ ID NO: 2080898 - DNA, 19 bp, Homo sapiens
aatctaatattaaaaatat

SEQ ID NO: 2080899 - DNA, 17 bp, Homo sapiens
aatctaatgtaagaaaa

SEQ ID NO: 2080900 - DNA, 20 bp, Homo sapiens
aatctagatcaattaattct

SEQ ID NO: 2080901 - DNA, 21 bp, Homo sapiens
aatctagttttttttgtaaac

SEQ ID NO: 2080902 - DNA, 23 bp, Homo sapiens
aatctagttttttttgtaaactg

SEQ ID NO: 2080903 - DNA, 19 bp, Homo sapiens
aatctattcagacaagcaa

SEQ ID NO: 2080904 - DNA, 23 bp, Homo sapiens
aatctcataggttgccaataata

SEQ ID NO: 2080905 - DNA, 17 bp, Homo sapiens
aatctcatctcagtgaa

SEQ ID NO: 2080906 - DNA, 11 bp, Homo sapiens
aatctcattcc

SEQ ID NO: 2080907 - DNA, 23 bp, Homo sapiens
aatctgacactaccttatcaggc

SEQ ID NO: 2080908 - DNA, 19 bp, Homo sapiens
aatctgagcctaaatctaa

SEQ ID NO: 2080909 - DNA, 21 bp, Homo sapiens
aatctgatttaatgttttctg

SEQ ID NO: 2080910 - DNA, 22 bp, Homo sapiens
aatctgatttaatgttttctgc

SEQ ID NO: 2080911 - DNA, 18 bp, Homo sapiens
aatctgcagggagcaact

SEQ ID NO: 2080912 - DNA, 19 bp, Homo sapiens
aatctgctcagcaggccct

SEQ ID NO: 2080913 - DNA, 21 bp, Homo sapiens
aatctgctgttgccatagccc

SEQ ID NO: 2080914 - DNA, 21 bp, Homo sapiens
aatctggaaatctgttttgta

SEQ ID NO: 2080915 - DNA, 17 bp, Homo sapiens
aatctggactcctctgt

SEQ ID NO: 2080916 - DNA, 20 bp, Homo sapiens
aatctggactcctctgtcca

SEQ ID NO: 2080917 - DNA, 15 bp, Homo sapiens
aatctgggactttca

SEQ ID NO: 2080918 - DNA, 17 bp, Homo sapiens
aatctgggcatctcgtg

SEQ ID NO: 2080919 - DNA, 22 bp, Homo sapiens
aatctgtagggctggacctatg

SEQ ID NO: 2080920 - DNA, 23 bp, Homo sapiens
aatctgtgaattaaaaaagctca

SEQ ID NO: 2080921 - DNA, 14 bp, Homo sapiens
aatctgtgtgaagt

SEQ ID NO: 2080922 - DNA, 15 bp, Homo sapiens
aatctgttactgaaa

SEQ ID NO: 2080923 - DNA, 17 bp, Homo sapiens
aatctgttactgaaatg

SEQ ID NO: 2080924 - DNA, 15 bp, Homo sapiens
aatctgtttttctaa

SEQ ID NO: 2080925 - DNA, 20 bp, Homo sapiens
aatcttcagttttatcttta

SEQ ID NO: 2080926 - DNA, 19 bp, Homo sapiens
aatcttggttgatgccaaa

SEQ ID NO: 2080927 - DNA, 13 bp, Homo sapiens
aatcttgtatttg

SEQ ID NO: 2080928 - DNA, 21 bp, Homo sapiens
aatctttctttacctgagacc

SEQ ID NO: 2080929 - DNA, 17 bp, Homo sapiens
aatgaaaaattctcagt

SEQ ID NO: 2080930 - DNA, 15 bp, Homo sapiens
aatgaaaaggaagtt

SEQ ID NO: 2080931 - DNA, 11 bp, Homo sapiens
aatgaaaataa

SEQ ID NO: 2080932 - DNA, 15 bp, Homo sapiens
aatgaaaataagtga

SEQ ID NO: 2080933 - DNA, 15 bp, Homo sapiens
aatgaaaatgtaact

SEQ ID NO: 2080934 - DNA, 20 bp, Homo sapiens
aatgaaaattgtatgttaag

SEQ ID NO: 2080935 - DNA, 23 bp, Homo sapiens
aatgaaacaaagagttcaagaaa

SEQ ID NO: 2080936 - DNA, 12 bp, Homo sapiens
aatgaaaccaaa

SEQ ID NO: 2080937 - DNA, 21 bp, Homo sapiens
aatgaaatcctgcttcagtgt

SEQ ID NO: 2080938 - DNA, 19 bp, Homo sapiens
aatgaaatgctctcctttc

SEQ ID NO: 2080939 - DNA, 17 bp, Homo sapiens
aatgaaattactacaaa

SEQ ID NO: 2080940 - DNA, 12 bp, Homo sapiens
aatgaacagaac

SEQ ID NO: 2080941 - DNA, 22 bp, Homo sapiens
aatgaacagaacatagacagaa

SEQ ID NO: 2080942 - DNA, 14 bp, Homo sapiens
aatgaactgtgaca

SEQ ID NO: 2080943 - DNA, 21 bp, Homo sapiens
aatgaactgtgacaggaagcc

SEQ ID NO: 2080944 - DNA, 22 bp, Homo sapiens
aatgaagaaaaaggctggctga

SEQ ID NO: 2080945 - DNA, 21 bp, Homo sapiens
aatgaagaaagggaggcccag

SEQ ID NO: 2080946 - DNA, 21 bp, Homo sapiens
aatgaagacccagtgtaaaga

SEQ ID NO: 2080947 - DNA, 17 bp, Homo sapiens
aatgaaggaaaacctca

SEQ ID NO: 2080948 - DNA, 21 bp, Homo sapiens
aatgaaggttaggatttaaca

SEQ ID NO: 2080949 - DNA, 16 bp, Homo sapiens
aatgaagttattcttg

SEQ ID NO: 2080950 - DNA, 21 bp, Homo sapiens
aatgaatatctgctttaatat

SEQ ID NO: 2080951 - DNA, 23 bp, Homo sapiens
aatgaatgtttacactctttgta

SEQ ID NO: 2080952 - DNA, 14 bp, Homo sapiens
aatgacaacagaag

SEQ ID NO: 2080953 - DNA, 23 bp, Homo sapiens
aatgacaaggggagggccaggat

SEQ ID NO: 2080954 - DNA, 11 bp, Homo sapiens
aatgacactgt

SEQ ID NO: 2080955 - DNA, 14 bp, Homo sapiens
aatgacagaatgct

SEQ ID NO: 2080956 - DNA, 21 bp, Homo sapiens
aatgacagaatgctgttttaa

SEQ ID NO: 2080957 - DNA, 21 bp, Homo sapiens
aatgacagccgctgatgtctg

SEQ ID NO: 2080958 - DNA, 16 bp, Homo sapiens
aatgaccaagaaaaag

SEQ ID NO: 2080959 - DNA, 19 bp, Homo sapiens
aatgaccaagaaaaagaaa

SEQ ID NO: 2080960 - DNA, 16 bp, Homo sapiens
aatgacccaaagacca

SEQ ID NO: 2080961 - DNA, 14 bp, Homo sapiens
aatgacctcagcaa

SEQ ID NO: 2080962 - DNA, 15 bp, Homo sapiens
aatgacctcagcaaa

SEQ ID NO: 2080963 - DNA, 17 bp, Homo sapiens
aatgactataaacatta

SEQ ID NO: 2080964 - DNA, 16 bp, Homo sapiens
aatgagacttgctctc

SEQ ID NO: 2080965 - DNA, 17 bp, Homo sapiens
aatgagatcccgcctct

SEQ ID NO: 2080966 - DNA, 12 bp, Homo sapiens
aatgagctcctg

SEQ ID NO: 2080967 - DNA, 14 bp, Homo sapiens
aatgaggacatgtt

SEQ ID NO: 2080968 - DNA, 17 bp, Homo sapiens
aatgaggaggattgctt

SEQ ID NO: 2080969 - DNA, 14 bp, Homo sapiens
aatgagggccaaga

SEQ ID NO: 2080970 - DNA, 16 bp, Homo sapiens
aatgaggtcccaggca

SEQ ID NO: 2080971 - DNA, 20 bp, Homo sapiens
aatgagtctgcataaacttc

SEQ ID NO: 2080972 - DNA, 21 bp, Homo sapiens
aatgagttcaactttgaggga

SEQ ID NO: 2080973 - DNA, 15 bp, Homo sapiens
aatgataagcaggaa

SEQ ID NO: 2080974 - DNA, 18 bp, Homo sapiens
aatgatatccagtaagca

SEQ ID NO: 2080975 - DNA, 16 bp, Homo sapiens
aatgatcataagtcta

SEQ ID NO: 2080976 - DNA, 22 bp, Homo sapiens
aatgatctctctgaatcctaag

SEQ ID NO: 2080977 - DNA, 20 bp, Homo sapiens
aatgatgattaaacacctga

SEQ ID NO: 2080978 - DNA, 18 bp, Homo sapiens
aatgtatcttatttatat

SEQ ID NO: 2080979 - DNA, 19 bp, Homo sapiens
aatgtatcttatttatata

SEQ ID NO: 2080980 - DNA, 22 bp, Homo sapiens
aatgtatcttatttatatatga

SEQ ID NO: 2080981 - DNA, 19 bp, Homo sapiens
aatgtatgtgaaagtgtaa

SEQ ID NO: 2080982 - DNA, 18 bp, Homo sapiens
aatgtattgaacttggaa

SEQ ID NO: 2080983 - DNA, 21 bp, Homo sapiens
aatgtatttatatgttaattt

SEQ ID NO: 2080984 - DNA, 20 bp, Homo sapiens
aatgtcaccaccttcccagc

SEQ ID NO: 2080985 - DNA, 19 bp, Homo sapiens
aatgtcagaaaccagttat

SEQ ID NO: 2080986 - DNA, 23 bp, Homo sapiens
aatgtcagaaactcgatgaatgt

SEQ ID NO: 2080987 - DNA, 13 bp, Homo sapiens
aatgtcagagcta

SEQ ID NO: 2080988 - DNA, 22 bp, Homo sapiens
aatgtcagcttaaaattggtaa

SEQ ID NO: 2080989 - DNA, 19 bp, Homo sapiens
aatgtcattaaaataaata

SEQ ID NO: 2080990 - DNA, 18 bp, Homo sapiens
aatgtcattatgtagaaa

SEQ ID NO: 2080991 - DNA, 22 bp, Homo sapiens
aatgtcctgtggtgacaggccc

SEQ ID NO: 2080992 - DNA, 21 bp, Homo sapiens
aatgtcttcatttcattgtat

SEQ ID NO: 2080993 - DNA, 16 bp, Homo sapiens
aatgtgaagggtgggg

SEQ ID NO: 2080994 - DNA, 23 bp, Homo sapiens
aatgtgaatcagaccctacccca

SEQ ID NO: 2080995 - DNA, 12 bp, Homo sapiens
aatgtgcaaatt

SEQ ID NO: 2080996 - DNA, 21 bp, Homo sapiens
aatgtggcccctgaacaagaa

SEQ ID NO: 2080997 - DNA, 13 bp, Homo sapiens
aatgtgtaaatgt

SEQ ID NO: 2080998 - DNA, 22 bp, Homo sapiens
aatgtgtgaaggtcttgcctga

SEQ ID NO: 2080999 - DNA, 21 bp, Homo sapiens
aatgtgtgtatgtgtatttat

SEQ ID NO: 2081000 - DNA, 21 bp, Homo sapiens
aatgtgtgtctgaagactatc

SEQ ID NO: 2081001 - DNA, 14 bp, Homo sapiens
aatgttaaagtcag

SEQ ID NO: 2081002 - DNA, 21 bp, Homo sapiens
aatgttatttgttattttcag

SEQ ID NO: 2081003 - DNA, 19 bp, Homo sapiens
aatgttattttttaattat

SEQ ID NO: 2081004 - DNA, 14 bp, Homo sapiens
aatgttccctgcac

SEQ ID NO: 2081005 - DNA, 16 bp, Homo sapiens
aatgttcgtattctat

SEQ ID NO: 2081006 - DNA, 17 bp, Homo sapiens
aatgttgaaatcttaaa

SEQ ID NO: 2081007 - DNA, 17 bp, Homo sapiens
aatgttgggatttatat

SEQ ID NO: 2081008 - DNA, 18 bp, Homo sapiens
aatgttgggatttatatc

SEQ ID NO: 2081009 - DNA, 19 bp, Homo sapiens
aatgttgggatttatatct

SEQ ID NO: 2081010 - DNA, 21 bp, Homo sapiens
aatgttgggatttatatctat

SEQ ID NO: 2081011 - DNA, 12 bp, Homo sapiens
aatgttgtccag

SEQ ID NO: 2081012 - DNA, 18 bp, Homo sapiens
aatgttgttatgctatta

SEQ ID NO: 2081013 - DNA, 23 bp, Homo sapiens
aatgtttacactctttgtaagag

SEQ ID NO: 2081014 - DNA, 15 bp, Homo sapiens
aatgtttattccttg

SEQ ID NO: 2081015 - DNA, 14 bp, Homo sapiens
aatgtttcactatg

SEQ ID NO: 2081016 - DNA, 20 bp, Homo sapiens
aatgtttccaacctggagta

SEQ ID NO: 2081017 - DNA, 15 bp, Homo sapiens
aatgtttctgcagta

SEQ ID NO: 2081018 - DNA, 23 bp, Homo sapiens
aatgtttcttctaggttctaaaa

SEQ ID NO: 2081019 - DNA, 22 bp, Homo sapiens
aatgtttgaactgccaagaaaa

SEQ ID NO: 2081020 - DNA, 13 bp, Homo sapiens
aatgtttgattta

SEQ ID NO: 2081021 - DNA, 16 bp, Homo sapiens
aatgtttgcctctgcc

SEQ ID NO: 2081022 - DNA, 23 bp, Homo sapiens
aatgtttgggcagaagggagaag

SEQ ID NO: 2081023 - DNA, 23 bp, Homo sapiens
aatgttttacaagaattgtccat

SEQ ID NO: 2081024 - DNA, 12 bp, Homo sapiens
aatgttttgtac

SEQ ID NO: 2081025 - DNA, 17 bp, Homo sapiens
aatgttttgtacaatta

SEQ ID NO: 2081026 - DNA, 20 bp, Homo sapiens
aattaaaaaggaaagaaaac

SEQ ID NO: 2081027 - DNA, 20 bp, Homo sapiens
aattaaaatatatataaata

SEQ ID NO: 2081028 - DNA, 22 bp, Homo sapiens
aattaaaatatatataaatata

SEQ ID NO: 2081029 - DNA, 15 bp, Homo sapiens
aattaaaatctggaa

SEQ ID NO: 2081030 - DNA, 17 bp, Homo sapiens
aattaaaatctggaaat

SEQ ID NO: 2081031 - DNA, 23 bp, Homo sapiens
aattaaaccctgccccacttctc

SEQ ID NO: 2081032 - DNA, 18 bp, Homo sapiens
aattaactgggtaatgaa

SEQ ID NO: 2081033 - DNA, 12 bp, Homo sapiens
aattaagttatt

SEQ ID NO: 2081034 - DNA, 14 bp, Homo sapiens
aattaatagctttt

SEQ ID NO: 2081035 - DNA, 15 bp, Homo sapiens
aattaatatgttcat

SEQ ID NO: 2081036 - DNA, 20 bp, Homo sapiens
aattaatatgttcattaaat

SEQ ID NO: 2081037 - DNA, 19 bp, Homo sapiens
aattaatcgaaatgaattt

SEQ ID NO: 2081038 - DNA, 20 bp, Homo sapiens
aattaatgtgtgtctgaaga

SEQ ID NO: 2081039 - DNA, 21 bp, Homo sapiens
aattaatgtgtgtctgaagac

SEQ ID NO: 2081040 - DNA, 23 bp, Homo sapiens
aattacaattgtcatttataaaa

SEQ ID NO: 2081041 - DNA, 24 bp, Homo sapiens
aattactaaattgtatacattttg

SEQ ID NO: 2081042 - DNA, 15 bp, Homo sapiens
aattactacaaaatt

SEQ ID NO: 2081043 - DNA, 16 bp, Homo sapiens
aattactacaaaattt

SEQ ID NO: 2081044 - DNA, 19 bp, Homo sapiens
aattagaaacaccattcat

SEQ ID NO: 2081045 - DNA, 18 bp, Homo sapiens
aattagaaattggctgga

SEQ ID NO: 2081046 - DNA, 13 bp, Homo sapiens
aattagaacaata

SEQ ID NO: 2081047 - DNA, 19 bp, Homo sapiens
aattagaacaatagctatt

SEQ ID NO: 2081048 - DNA, 12 bp, Homo sapiens
aattagcaattg

SEQ ID NO: 2081049 - DNA, 16 bp, Homo sapiens
aattagctgtgtgaaa

SEQ ID NO: 2081050 - DNA, 19 bp, Homo sapiens
aattaggaggctcaacaat

SEQ ID NO: 2081051 - DNA, 17 bp, Homo sapiens
aattaggggttgctaag

SEQ ID NO: 2081052 - DNA, 20 bp, Homo sapiens
aattaggggttgctaagaag

SEQ ID NO: 2081053 - DNA, 16 bp, Homo sapiens
aattaggttaacattg

SEQ ID NO: 2081054 - DNA, 16 bp, Homo sapiens
aattaggttttgtaca

SEQ ID NO: 2081055 - DNA, 17 bp, Homo sapiens
aattagtaattgtcaat

SEQ ID NO: 2081056 - DNA, 16 bp, Homo sapiens
aattagtacagtagct

SEQ ID NO: 2081057 - DNA, 23 bp, Homo sapiens
aattagtacagtagcttaaataa

SEQ ID NO: 2081058 - DNA, 15 bp, Homo sapiens
aattagtgaagttct

SEQ ID NO: 2081059 - DNA, 17 bp, Homo sapiens
aattataacttaaaata

SEQ ID NO: 2081060 - DNA, 23 bp, Homo sapiens
aattataacttaaaatattttat

SEQ ID NO: 2081061 - DNA, 15 bp, Homo sapiens
aattataagatgtca

SEQ ID NO: 2081062 - DNA, 20 bp, Homo sapiens
aattatataggttgtgcaaa

SEQ ID NO: 2081063 - DNA, 11 bp, Homo sapiens
aattatatcta

SEQ ID NO: 2081064 - DNA, 19 bp, Homo sapiens
aattatatctaatttatac

SEQ ID NO: 2081065 - DNA, 12 bp, Homo sapiens
aattatatctgt

SEQ ID NO: 2081066 - DNA, 21 bp, Homo sapiens
aattatatctgtggtcttcaa

SEQ ID NO: 2081067 - DNA, 20 bp, Homo sapiens
aattatcggaagcagtgcct

SEQ ID NO: 2081068 - DNA, 15 bp, Homo sapiens
aattatgacagttat

SEQ ID NO: 2081069 - DNA, 18 bp, Homo sapiens
aattatgcactggccacc

SEQ ID NO: 2081070 - DNA, 14 bp, Homo sapiens
aattatggtgaaat

SEQ ID NO: 2081071 - DNA, 15 bp, Homo sapiens
aattatggtgaaatt

SEQ ID NO: 2081072 - DNA, 18 bp, Homo sapiens
aattatgtatgtttacat

SEQ ID NO: 2081073 - DNA, 21 bp, Homo sapiens
aattatgtatgtttacatatc

SEQ ID NO: 2081074 - DNA, 12 bp, Homo sapiens
aattatgtgaca

SEQ ID NO: 2081075 - DNA, 13 bp, Homo sapiens
aattatgtgacaa

SEQ ID NO: 2081076 - DNA, 19 bp, Homo sapiens
aattatgtgacaacctttg

SEQ ID NO: 2081077 - DNA, 20 bp, Homo sapiens
aattatgtgacaacctttgt

SEQ ID NO: 2081078 - DNA, 11 bp, Homo sapiens
aattattattt

SEQ ID NO: 2081079 - DNA, 18 bp, Homo sapiens
aattattatttatatatg

SEQ ID NO: 2081080 - DNA, 14 bp, Homo sapiens
aattatttgtgtaa

SEQ ID NO: 2081081 - DNA, 18 bp, Homo sapiens
aattcaaagctctattaa

SEQ ID NO: 2081082 - DNA, 22 bp, Homo sapiens
aattcaaagctgtgtgtttgga

SEQ ID NO: 2081083 - DNA, 13 bp, Homo sapiens
aattcaattcaaa

SEQ ID NO: 2081084 - DNA, 13 bp, Homo sapiens
aattcactcccac

SEQ ID NO: 2081085 - DNA, 19 bp, Homo sapiens
aattcacttcattgaccaa

SEQ ID NO: 2081086 - DNA, 15 bp, Homo sapiens
aattcaggactggct

SEQ ID NO: 2081087 - DNA, 21 bp, Homo sapiens
aattcaggtgaaaatgttcat

SEQ ID NO: 2081088 - DNA, 15 bp, Homo sapiens
aatttccagtacctt

SEQ ID NO: 2081089 - DNA, 20 bp, Homo sapiens
aatttccagtacctttgtca

SEQ ID NO: 2081090 - DNA, 13 bp, Homo sapiens
aatttcccagaag

SEQ ID NO: 2081091 - DNA, 15 bp, Homo sapiens
aatttcctatctgta

SEQ ID NO: 2081092 - DNA, 19 bp, Homo sapiens
aatttctttttttaaattg

SEQ ID NO: 2081093 - DNA, 19 bp, Homo sapiens
aatttgaaaataattgttc

SEQ ID NO: 2081094 - DNA, 13 bp, Homo sapiens
aatttgaggacaa

SEQ ID NO: 2081095 - DNA, 15 bp, Homo sapiens
aatttgatttctatt

SEQ ID NO: 2081096 - DNA, 20 bp, Homo sapiens
aatttggatttacgactgaa

SEQ ID NO: 2081097 - DNA, 23 bp, Homo sapiens
aatttggatttacgactgaagaa

SEQ ID NO: 2081098 - DNA, 18 bp, Homo sapiens
aatttgggggacttacat

SEQ ID NO: 2081099 - DNA, 22 bp, Homo sapiens
aatttggttctaatagaactca

SEQ ID NO: 2081100 - DNA, 13 bp, Homo sapiens
aatttgtatatca

SEQ ID NO: 2081101 - DNA, 12 bp, Homo sapiens
aatttgtatctg

SEQ ID NO: 2081102 - DNA, 14 bp, Homo sapiens
aatttgtatctgaa

SEQ ID NO: 2081103 - DNA, 17 bp, Homo sapiens
aatttgtatctgaagga

SEQ ID NO: 2081104 - DNA, 22 bp, Homo sapiens
aatttgtccaatggctgtaaac

SEQ ID NO: 2081105 - DNA, 23 bp, Homo sapiens
aatttgtccaatggctgtaaact

SEQ ID NO: 2081106 - DNA, 13 bp, Homo sapiens
aatttgtgtagat

SEQ ID NO: 2081107 - DNA, 18 bp, Homo sapiens
aatttgttgaaattatgt

SEQ ID NO: 2081108 - DNA, 17 bp, Homo sapiens
aatttgtttttcttatc

SEQ ID NO: 2081109 - DNA, 14 bp, Homo sapiens
aattttaacatttt

SEQ ID NO: 2081110 - DNA, 22 bp, Homo sapiens
aattttaagtgctttgtaatgg

SEQ ID NO: 2081111 - DNA, 19 bp, Homo sapiens
aattttacaattatggaaa

SEQ ID NO: 2081112 - DNA, 21 bp, Homo sapiens
aattttacttttgttctgtat

SEQ ID NO: 2081113 - DNA, 12 bp, Homo sapiens
aattttattcct

SEQ ID NO: 2081114 - DNA, 20 bp, Homo sapiens
aattttcaagagaagaaaaa

SEQ ID NO: 2081115 - DNA, 14 bp, Homo sapiens
acactggtgactgc

SEQ ID NO: 2081116 - DNA, 18 bp, Homo sapiens
acactgtaaatatccaca

SEQ ID NO: 2081117 - DNA, 14 bp, Homo sapiens
acactgtaatctta

SEQ ID NO: 2081118 - DNA, 15 bp, Homo sapiens
acactgtatgactct

SEQ ID NO: 2081119 - DNA, 19 bp, Homo sapiens
acactgtatgactctcctc

SEQ ID NO: 2081120 - DNA, 19 bp, Homo sapiens
acactgtccccacagcagg

SEQ ID NO: 2081121 - DNA, 15 bp, Homo sapiens
acactgtgctataaa

SEQ ID NO: 2081122 - DNA, 18 bp, Homo sapiens
acactgtgtactgcagtt

SEQ ID NO: 2081123 - DNA, 18 bp, Homo sapiens
acacttatggggacagca

SEQ ID NO: 2081124 - DNA, 18 bp, Homo sapiens
acacttcatggaccaaga

SEQ ID NO: 2081125 - DNA, 14 bp, Homo sapiens
acacttccataatc

SEQ ID NO: 2081126 - DNA, 16 bp, Homo sapiens
acacttctcaggacac

SEQ ID NO: 2081127 - DNA, 23 bp, Homo sapiens
acacttctcaggacacaggcctg

SEQ ID NO: 2081128 - DNA, 24 bp, Homo sapiens
acacttctcaggacacaggcctgt

SEQ ID NO: 2081129 - DNA, 19 bp, Homo sapiens
acacttctcatcatattgt

SEQ ID NO: 2081130 - DNA, 21 bp, Homo sapiens
acacttcttgaaacagcctgg

SEQ ID NO: 2081131 - DNA, 15 bp, Homo sapiens
acacttggagcccgt

SEQ ID NO: 2081132 - DNA, 14 bp, Homo sapiens
acacttgtatgcta

SEQ ID NO: 2081133 - DNA, 14 bp, Homo sapiens
acacttgtttcttg

SEQ ID NO: 2081134 - DNA, 15 bp, Homo sapiens
acacttgtttcttgt

SEQ ID NO: 2081135 - DNA, 19 bp, Homo sapiens
acagaaaacaaaagagaga

SEQ ID NO: 2081136 - DNA, 20 bp, Homo sapiens
acagaaaacaaaagagagaa

SEQ ID NO: 2081137 - DNA, 17 bp, Homo sapiens
acagaaatatatataca

SEQ ID NO: 2081138 - DNA, 18 bp, Homo sapiens
acagaaatatatatacat

SEQ ID NO: 2081139 - DNA, 22 bp, Homo sapiens
acagaaatatatatacatatgt

SEQ ID NO: 2081140 - DNA, 12 bp, Homo sapiens
acagaacactgt

SEQ ID NO: 2081141 - DNA, 14 bp, Homo sapiens
acagaacactgtct

SEQ ID NO: 2081142 - DNA, 12 bp, Homo sapiens
acagaagaaaca

SEQ ID NO: 2081143 - DNA, 18 bp, Homo sapiens
acagaagcttcagaagtt

SEQ ID NO: 2081144 - DNA, 18 bp, Homo sapiens
acagaaggaatctgtgca

SEQ ID NO: 2081145 - DNA, 19 bp, Homo sapiens
acagaaggaatctgtgcag

SEQ ID NO: 2081146 - DNA, 22 bp, Homo sapiens
acagaaggaatctgtgcagatg

SEQ ID NO: 2081147 - DNA, 21 bp, Homo sapiens
acagaatacaagccactacct

SEQ ID NO: 2081148 - DNA, 16 bp, Homo sapiens
acagaatcttgtattt

SEQ ID NO: 2081149 - DNA, 22 bp, Homo sapiens
acagaatgatatccagtaagca

SEQ ID NO: 2081150 - DNA, 17 bp, Homo sapiens
acagaatgctgttttaa

SEQ ID NO: 2081151 - DNA, 18 bp, Homo sapiens
acagaatgctgttttaaa

SEQ ID NO: 2081152 - DNA, 16 bp, Homo sapiens
acagaatgtcaccagt

SEQ ID NO: 2081153 - DNA, 17 bp, Homo sapiens
acagaattctgctacct

SEQ ID NO: 2081154 - DNA, 14 bp, Homo sapiens
acagacaggagaaa

SEQ ID NO: 2081155 - DNA, 19 bp, Homo sapiens
acagaccacctgcttctga

SEQ ID NO: 2081156 - DNA, 23 bp, Homo sapiens
acagaccacctgcttctgaactc

SEQ ID NO: 2081157 - DNA, 12 bp, Homo sapiens
acagacccacac

SEQ ID NO: 2081158 - DNA, 18 bp, Homo sapiens
acagaccccttggctttt

SEQ ID NO: 2081159 - DNA, 15 bp, Homo sapiens
acagacgtatgctta

SEQ ID NO: 2081160 - DNA, 20 bp, Homo sapiens
acagacgtatgcttatttta

SEQ ID NO: 2081161 - DNA, 17 bp, Homo sapiens
acagacgtctcaagact

SEQ ID NO: 2081162 - DNA, 21 bp, Homo sapiens
acagacgtctcaagactgaaa

SEQ ID NO: 2081163 - DNA, 19 bp, Homo sapiens
acagactccctcccctgcc

SEQ ID NO: 2081164 - DNA, 11 bp, Homo sapiens
acagactgcaa

SEQ ID NO: 2081165 - DNA, 23 bp, Homo sapiens
acagactgcaagaggctcctgtc

SEQ ID NO: 2081166 - DNA, 23 bp, Homo sapiens
acagactgcgatttgtcccaggt

SEQ ID NO: 2081167 - DNA, 19 bp, Homo sapiens
acaggtctcctcttaaaaa

SEQ ID NO: 2081168 - DNA, 22 bp, Homo sapiens
acaggtgcaagccactatgtcc

SEQ ID NO: 2081169 - DNA, 15 bp, Homo sapiens
acaggtggcaggacc

SEQ ID NO: 2081170 - DNA, 16 bp, Homo sapiens
acaggtggcaggacca

SEQ ID NO: 2081171 - DNA, 16 bp, Homo sapiens
acaggtgtaaatatag

SEQ ID NO: 2081172 - DNA, 24 bp, Homo sapiens
acaggtgtactatggctgtatttt

SEQ ID NO: 2081173 - DNA, 23 bp, Homo sapiens
acaggtgtgagtcaccaagccca

SEQ ID NO: 2081174 - DNA, 16 bp, Homo sapiens
acaggtgtggtgtaat

SEQ ID NO: 2081175 - DNA, 18 bp, Homo sapiens
acaggtgtggtgtaattt

SEQ ID NO: 2081176 - DNA, 21 bp, Homo sapiens
acaggtgtggtgtaatttata

SEQ ID NO: 2081177 - DNA, 14 bp, Homo sapiens
acaggtgtttatac

SEQ ID NO: 2081178 - DNA, 14 bp, Homo sapiens
acaggttttataat

SEQ ID NO: 2081179 - DNA, 20 bp, Homo sapiens
acagtaaaaacttgtactat

SEQ ID NO: 2081180 - DNA, 16 bp, Homo sapiens
acagtaaagtttaaaa

SEQ ID NO: 2081181 - DNA, 22 bp, Homo sapiens
acagtaaagtttaaaaaataca

SEQ ID NO: 2081182 - DNA, 23 bp, Homo sapiens
acagtaaagtttaaaaaatacac

SEQ ID NO: 2081183 - DNA, 13 bp, Homo sapiens
acagtaaataaat

SEQ ID NO: 2081184 - DNA, 15 bp, Homo sapiens
acagtaaataaattg

SEQ ID NO: 2081185 - DNA, 18 bp, Homo sapiens
acagtaaataaattgttt

SEQ ID NO: 2081186 - DNA, 14 bp, Homo sapiens
acagtaacacatct

SEQ ID NO: 2081187 - DNA, 14 bp, Homo sapiens
acagtactatgtaa

SEQ ID NO: 2081188 - DNA, 20 bp, Homo sapiens
acagtactatgtaaatttaa

SEQ ID NO: 2081189 - DNA, 17 bp, Homo sapiens
acagtagcttaaataaa

SEQ ID NO: 2081190 - DNA, 20 bp, Homo sapiens
acagtagcttaaataaattc

SEQ ID NO: 2081191 - DNA, 17 bp, Homo sapiens
acagtattacttctgct

SEQ ID NO: 2081192 - DNA, 18 bp, Homo sapiens
acagtattctcagtgctc

SEQ ID NO: 2081193 - DNA, 16 bp, Homo sapiens
acagtcaaaacagaga

SEQ ID NO: 2081194 - DNA, 17 bp, Homo sapiens
acagtcaaaacagagat

SEQ ID NO: 2081195 - DNA, 17 bp, Homo sapiens
acagtccctaaagaaaa

SEQ ID NO: 2081196 - DNA, 17 bp, Homo sapiens
acagtccgtcaaaacag

SEQ ID NO: 2081197 - DNA, 12 bp, Homo sapiens
acagtctaaagc

SEQ ID NO: 2081198 - DNA, 22 bp, Homo sapiens
acagtctagattagaagtgttt

SEQ ID NO: 2081199 - DNA, 14 bp, Homo sapiens
acagtctcaggaaa

SEQ ID NO: 2081200 - DNA, 17 bp, Homo sapiens
acagtctcagtccagat

SEQ ID NO: 2081201 - DNA, 14 bp, Homo sapiens
acagtctctttaat

SEQ ID NO: 2081202 - DNA, 16 bp, Homo sapiens
acagtgacccttccca

SEQ ID NO: 2081203 - DNA, 21 bp, Homo sapiens
acatctaatgtctcttcctct

SEQ ID NO: 2081204 - DNA, 19 bp, Homo sapiens
acatctattataaaaccat

SEQ ID NO: 2081205 - DNA, 12 bp, Homo sapiens
acatctcatttt

SEQ ID NO: 2081206 - DNA, 16 bp, Homo sapiens
acatctcgagccccct

SEQ ID NO: 2081207 - DNA, 13 bp, Homo sapiens
acatctctgcagt

SEQ ID NO: 2081208 - DNA, 20 bp, Homo sapiens
acatctctttgatgtcatat

SEQ ID NO: 2081209 - DNA, 21 bp, Homo sapiens
acatctgcagctctttcttct

SEQ ID NO: 2081210 - DNA, 21 bp, Homo sapiens
acatctgggaggctggtctcc

SEQ ID NO: 2081211 - DNA, 17 bp, Homo sapiens
acatctgtgtctctgga

SEQ ID NO: 2081212 - DNA, 16 bp, Homo sapiens
acatctgttttaaatt

SEQ ID NO: 2081213 - DNA, 13 bp, Homo sapiens
acatcttctcagt

SEQ ID NO: 2081214 - DNA, 12 bp, Homo sapiens
acatcttctctc

SEQ ID NO: 2081215 - DNA, 14 bp, Homo sapiens
acatcttgctctgc

SEQ ID NO: 2081216 - DNA, 21 bp, Homo sapiens
acatcttgctctgctgacaga

SEQ ID NO: 2081217 - DNA, 22 bp, Homo sapiens
acatcttggtatgtggccatat

SEQ ID NO: 2081218 - DNA, 15 bp, Homo sapiens
acatctttaagtatt

SEQ ID NO: 2081219 - DNA, 18 bp, Homo sapiens
acatctttttcctccctt

SEQ ID NO: 2081220 - DNA, 22 bp, Homo sapiens
acatgaacacagctgctgaaga

SEQ ID NO: 2081221 - DNA, 23 bp, Homo sapiens
acatgaacacagctgctgaagag

SEQ ID NO: 2081222 - DNA, 13 bp, Homo sapiens
acatgaagaagct

SEQ ID NO: 2081223 - DNA, 23 bp, Homo sapiens
acatgaatcccacccacatgtga

SEQ ID NO: 2081224 - DNA, 13 bp, Homo sapiens
acatgacaatgca

SEQ ID NO: 2081225 - DNA, 15 bp, Homo sapiens
acatgaccagaaaac

SEQ ID NO: 2081226 - DNA, 20 bp, Homo sapiens
acatgaccagaaaacaaatc

SEQ ID NO: 2081227 - DNA, 16 bp, Homo sapiens
acatgacgtaaaattt

SEQ ID NO: 2081228 - DNA, 14 bp, Homo sapiens
acatgagaaatgtg

SEQ ID NO: 2081229 - DNA, 16 bp, Homo sapiens
acatgatactattcag

SEQ ID NO: 2081230 - DNA, 22 bp, Homo sapiens
acatgatttagggaagcaggga

SEQ ID NO: 2081231 - DNA, 14 bp, Homo sapiens
acatgcacatttat

SEQ ID NO: 2081232 - DNA, 16 bp, Homo sapiens
acatgcactatgagga

SEQ ID NO: 2081233 - DNA, 19 bp, Homo sapiens
acatgcactgacccttcca

SEQ ID NO: 2081234 - DNA, 18 bp, Homo sapiens
acatgcacttggctgcat

SEQ ID NO: 2081235 - DNA, 18 bp, Homo sapiens
acatgccaccctctccat

SEQ ID NO: 2081236 - DNA, 17 bp, Homo sapiens
acatgccatttgtactg

SEQ ID NO: 2081237 - DNA, 16 bp, Homo sapiens
acatgctgtgctcttt

SEQ ID NO: 2081238 - DNA, 17 bp, Homo sapiens
acatgctgtgctctttg

SEQ ID NO: 2081239 - DNA, 23 bp, Homo sapiens
acatgctgtgctctttgaagaga

SEQ ID NO: 2081240 - DNA, 17 bp, Homo sapiens
acatggagactcctgcc

SEQ ID NO: 2081241 - DNA, 21 bp, Homo sapiens
acatggagactcctgccctgt

SEQ ID NO: 2081242 - DNA, 18 bp, Homo sapiens
acatggcctatgcacata

SEQ ID NO: 2081243 - DNA, 20 bp, Homo sapiens
acatggcctatgcacatatg

SEQ ID NO: 2081244 - DNA, 22 bp, Homo sapiens
acatggctatcctagagaggct

SEQ ID NO: 2081245 - DNA, 22 bp, Homo sapiens
acatgggaaaggaggcatgcct

SEQ ID NO: 2081246 - DNA, 23 bp, Homo sapiens
acatgtcaccgtggaccttcctg

SEQ ID NO: 2081247 - DNA, 13 bp, Homo sapiens
acatgtcttgtac

SEQ ID NO: 2081248 - DNA, 16 bp, Homo sapiens
acatgtcttgtacatg

SEQ ID NO: 2081249 - DNA, 16 bp, Homo sapiens
acatgtgcacatgcac

SEQ ID NO: 2081250 - DNA, 15 bp, Homo sapiens
acatgtggtgggaca

SEQ ID NO: 2081251 - DNA, 23 bp, Homo sapiens
acatgtggtgggacagggaccca

SEQ ID NO: 2081252 - DNA, 20 bp, Homo sapiens
acatgtgtagcctgtgcatg

SEQ ID NO: 2081253 - DNA, 16 bp, Homo sapiens
acatgtgtctgtgtgg

SEQ ID NO: 2081254 - DNA, 13 bp, Homo sapiens
acatgtgtgtata

SEQ ID NO: 2081255 - DNA, 22 bp, Homo sapiens
acatgtgtgtatatatgtgtat

SEQ ID NO: 2081256 - DNA, 23 bp, Homo sapiens
acatgtgtgtatatatgtgtata

SEQ ID NO: 2081257 - DNA, 19 bp, Homo sapiens
acatgttatccacaagcaa

SEQ ID NO: 2081258 - DNA, 14 bp, Homo sapiens
acatgttatttgta

SEQ ID NO: 2081259 - DNA, 14 bp, Homo sapiens
acatgttgtaaatt

SEQ ID NO: 2081260 - DNA, 21 bp, Homo sapiens
acatgttgtaaattaggaggc

SEQ ID NO: 2081261 - DNA, 16 bp, Homo sapiens
acatgtttaaattgta

SEQ ID NO: 2081262 - DNA, 17 bp, Homo sapiens
acatgtttaaattgtaa

SEQ ID NO: 2081263 - DNA, 23 bp, Homo sapiens
acatgtttaaattgtaaatttta

SEQ ID NO: 2081264 - DNA, 13 bp, Homo sapiens
acatgtttcacaa

SEQ ID NO: 2081265 - DNA, 21 bp, Homo sapiens
acatgtttgcacctttctagt

SEQ ID NO: 2081266 - DNA, 22 bp, Homo sapiens
acatgtttgcacctttctagtt

SEQ ID NO: 2081267 - DNA, 14 bp, Homo sapiens
acattaaatgtctt

SEQ ID NO: 2081268 - DNA, 22 bp, Homo sapiens
acattaatgttaattcagcact

SEQ ID NO: 2081269 - DNA, 15 bp, Homo sapiens
acattaattagattt

SEQ ID NO: 2081270 - DNA, 16 bp, Homo sapiens
acattaattctactaa

SEQ ID NO: 2081271 - DNA, 15 bp, Homo sapiens
acattacttgcacaa

SEQ ID NO: 2081272 - DNA, 19 bp, Homo sapiens
acattacttgcacaagctt

SEQ ID NO: 2081273 - DNA, 18 bp, Homo sapiens
acattaggaacagagtat

SEQ ID NO: 2081274 - DNA, 13 bp, Homo sapiens
acattatcattca

SEQ ID NO: 2081275 - DNA, 23 bp, Homo sapiens
acattatcattcaaaacaaccat

SEQ ID NO: 2081276 - DNA, 13 bp, Homo sapiens
acattatcttagt

SEQ ID NO: 2081277 - DNA, 13 bp, Homo sapiens
acattatttgcat

SEQ ID NO: 2081278 - DNA, 17 bp, Homo sapiens
acattcccatctgtcac

SEQ ID NO: 2081279 - DNA, 15 bp, Homo sapiens
acattccctatcaaa

SEQ ID NO: 2081280 - DNA, 20 bp, Homo sapiens
acattccctatcaaaacata

SEQ ID NO: 2081281 - DNA, 20 bp, Homo sapiens
acattccctgcatccaatct

SEQ ID NO: 2081282 - DNA, 13 bp, Homo sapiens
acattccctggcc

SEQ ID NO: 2081283 - DNA, 16 bp, Homo sapiens
acattccctggcctgg

SEQ ID NO: 2081284 - DNA, 15 bp, Homo sapiens
acattcctcagctgc

SEQ ID NO: 2081285 - DNA, 16 bp, Homo sapiens
acattcctcagctgcc

SEQ ID NO: 2081286 - DNA, 17 bp, Homo sapiens
acattcctcagctgcca

SEQ ID NO: 2081287 - DNA, 19 bp, Homo sapiens
acattcctcagctgccaag

SEQ ID NO: 2081288 - DNA, 23 bp, Homo sapiens
acattttatttattagctgtaaa

SEQ ID NO: 2081289 - DNA, 12 bp, Homo sapiens
acattttcattt

SEQ ID NO: 2081290 - DNA, 17 bp, Homo sapiens
acattttctcctaggag

SEQ ID NO: 2081291 - DNA, 21 bp, Homo sapiens
acattttctttctttttctgg

SEQ ID NO: 2081292 - DNA, 20 bp, Homo sapiens
acattttgtacaaagatatg

SEQ ID NO: 2081293 - DNA, 12 bp, Homo sapiens
acatttttacaa

SEQ ID NO: 2081294 - DNA, 21 bp, Homo sapiens
acatttttatttagttgaaaa

SEQ ID NO: 2081295 - DNA, 14 bp, Homo sapiens
accaaaagaagtaa

SEQ ID NO: 2081296 - DNA, 21 bp, Homo sapiens
accaaaatttctttttttaaa

SEQ ID NO: 2081297 - DNA, 17 bp, Homo sapiens
accaaagcaatatttcc

SEQ ID NO: 2081298 - DNA, 20 bp, Homo sapiens
accaaaggaatcgtttcaaa

SEQ ID NO: 2081299 - DNA, 17 bp, Homo sapiens
accaaaggacattatgt

SEQ ID NO: 2081300 - DNA, 21 bp, Homo sapiens
accaaagggaaaactcttcat

SEQ ID NO: 2081301 - DNA, 17 bp, Homo sapiens
accaaatataaacttgt

SEQ ID NO: 2081302 - DNA, 21 bp, Homo sapiens
accaaatataaacttgtgtat

SEQ ID NO: 2081303 - DNA, 15 bp, Homo sapiens
accaacacccctccc

SEQ ID NO: 2081304 - DNA, 23 bp, Homo sapiens
accaacatggagaaaccctgtct

SEQ ID NO: 2081305 - DNA, 15 bp, Homo sapiens
accaaccaaccacaa

SEQ ID NO: 2081306 - DNA, 16 bp, Homo sapiens
accaaccctgtttcct

SEQ ID NO: 2081307 - DNA, 14 bp, Homo sapiens
accaactctgcact

SEQ ID NO: 2081308 - DNA, 15 bp, Homo sapiens
accaactctgcactc

SEQ ID NO: 2081309 - DNA, 22 bp, Homo sapiens
accaactctgcactccatggcc

SEQ ID NO: 2081310 - DNA, 13 bp, Homo sapiens
accaactttctgt

SEQ ID NO: 2081311 - DNA, 18 bp, Homo sapiens
accaactttctgtaaact

SEQ ID NO: 2081312 - DNA, 16 bp, Homo sapiens
accaagaaaaagaaaa

SEQ ID NO: 2081313 - DNA, 21 bp, Homo sapiens
accaagaattacaagtagaat

SEQ ID NO: 2081314 - DNA, 15 bp, Homo sapiens
accaagagagaaaga

SEQ ID NO: 2081315 - DNA, 19 bp, Homo sapiens
accaagagcacattcttaa

SEQ ID NO: 2081316 - DNA, 14 bp, Homo sapiens
accaagagtattcc

SEQ ID NO: 2081317 - DNA, 16 bp, Homo sapiens
accaagatgatcacat

SEQ ID NO: 2081318 - DNA, 16 bp, Homo sapiens
accaagatgggcacat

SEQ ID NO: 2081319 - DNA, 22 bp, Homo sapiens
accaagatgggcacatgaggag

SEQ ID NO: 2081320 - DNA, 19 bp, Homo sapiens
accaagctcacagttcctc

SEQ ID NO: 2081321 - DNA, 23 bp, Homo sapiens
accaagcttcagagcctagccac

SEQ ID NO: 2081322 - DNA, 24 bp, Homo sapiens
accaagcttcagagcctagccacc

SEQ ID NO: 2081323 - DNA, 13 bp, Homo sapiens
accaaggcagcct

SEQ ID NO: 2081324 - DNA, 20 bp, Homo sapiens
accaaggcagcctccagagc

SEQ ID NO: 2081325 - DNA, 18 bp, Homo sapiens
accaagttacttgaaaaa

SEQ ID NO: 2081326 - DNA, 12 bp, Homo sapiens
accaataacttc

SEQ ID NO: 2081327 - DNA, 20 bp, Homo sapiens
accaataacttcagagaagt

SEQ ID NO: 2081328 - DNA, 20 bp, Homo sapiens
accaatagtccccatcagca

SEQ ID NO: 2081329 - DNA, 11 bp, Homo sapiens
accaatatttg

SEQ ID NO: 2081330 - DNA, 13 bp, Homo sapiens
accaatatttgta

SEQ ID NO: 2081331 - DNA, 16 bp, Homo sapiens
accaatatttgtagaa

SEQ ID NO: 2081332 - DNA, 13 bp, Homo sapiens
accaatctctgtg

SEQ ID NO: 2081333 - DNA, 12 bp, Homo sapiens
accaatgattca

SEQ ID NO: 2081334 - DNA, 20 bp, Homo sapiens
accaatgcatgcagccactg

SEQ ID NO: 2081335 - DNA, 18 bp, Homo sapiens
accaatgcttttatcaaa

SEQ ID NO: 2081336 - DNA, 15 bp, Homo sapiens
accaattgctttgtc

SEQ ID NO: 2081337 - DNA, 16 bp, Homo sapiens
accaattggttaatct

SEQ ID NO: 2081338 - DNA, 14 bp, Homo sapiens
accacaaaaatgaa

SEQ ID NO: 2081339 - DNA, 14 bp, Homo sapiens
accacaaaaattga

SEQ ID NO: 2081340 - DNA, 15 bp, Homo sapiens
accacaactgacaca

SEQ ID NO: 2081341 - DNA, 16 bp, Homo sapiens
accacaactgacacag

SEQ ID NO: 2081342 - DNA, 19 bp, Homo sapiens
accacaactgacacaggaa

SEQ ID NO: 2081343 - DNA, 20 bp, Homo sapiens
accacacccagcccacttct

SEQ ID NO: 2081344 - DNA, 20 bp, Homo sapiens
accacactccccgcctgtcc

SEQ ID NO: 2081345 - DNA, 17 bp, Homo sapiens
accacactgttgagttg

SEQ ID NO: 2081346 - DNA, 19 bp, Homo sapiens
accacactttgagaacctg

SEQ ID NO: 2081347 - DNA, 21 bp, Homo sapiens
accacagcggaggagctccgc

SEQ ID NO: 2081348 - DNA, 13 bp, Homo sapiens
accacagcgtccc

SEQ ID NO: 2081349 - DNA, 21 bp, Homo sapiens
accacaggcatctacacagcc

SEQ ID NO: 2081350 - DNA, 22 bp, Homo sapiens
accacaggcatctacacagcct

SEQ ID NO: 2081351 - DNA, 16 bp, Homo sapiens
accacaggcccttggg

SEQ ID NO: 2081352 - DNA, 15 bp, Homo sapiens
accacagtgggtggc

SEQ ID NO: 2081353 - DNA, 21 bp, Homo sapiens
accacagtgggtggcacctcc

SEQ ID NO: 2081354 - DNA, 12 bp, Homo sapiens
accacagtgtct

SEQ ID NO: 2081355 - DNA, 24 bp, Homo sapiens
accacatcttgctctgctgacaga

SEQ ID NO: 2081356 - DNA, 16 bp, Homo sapiens
accaccagatgagaag

SEQ ID NO: 2081357 - DNA, 15 bp, Homo sapiens
accaccccttcctgt

SEQ ID NO: 2081358 - DNA, 14 bp, Homo sapiens
accaccctcccacc

SEQ ID NO: 2081359 - DNA, 16 bp, Homo sapiens
accacctcactcctgt

SEQ ID NO: 2081360 - DNA, 15 bp, Homo sapiens
accacctctcaatat

SEQ ID NO: 2081361 - DNA, 12 bp, Homo sapiens
accacctgccag

SEQ ID NO: 2081362 - DNA, 14 bp, Homo sapiens
accacctgccagcc

SEQ ID NO: 2081363 - DNA, 16 bp, Homo sapiens
accacctgccagccat

SEQ ID NO: 2081364 - DNA, 13 bp, Homo sapiens
accaccttcccag

SEQ ID NO: 2081365 - DNA, 15 bp, Homo sapiens
accaccttcccagct

SEQ ID NO: 2081366 - DNA, 12 bp, Homo sapiens
accaccttccct

SEQ ID NO: 2081367 - DNA, 18 bp, Homo sapiens
accaccttccctctttct

SEQ ID NO: 2081368 - DNA, 17 bp, Homo sapiens
accaccttggactcctc

SEQ ID NO: 2081369 - DNA, 18 bp, Homo sapiens
accacggaaaagagcgca

SEQ ID NO: 2081370 - DNA, 21 bp, Homo sapiens
accacggacgtttccatcagg

SEQ ID NO: 2081371 - DNA, 15 bp, Homo sapiens
accacggctggatac

SEQ ID NO: 2081372 - DNA, 20 bp, Homo sapiens
accacgggcctcagtttccc

SEQ ID NO: 2081373 - DNA, 17 bp, Homo sapiens
accacgtctgccaggcc

SEQ ID NO: 2081374 - DNA, 18 bp, Homo sapiens
accacgtctgccaggccc

SEQ ID NO: 2081375 - DNA, 19 bp, Homo sapiens
accacgtctgccaggccca

SEQ ID NO: 2081376 - DNA, 13 bp, Homo sapiens
accactagaactc

SEQ ID NO: 2081377 - DNA, 21 bp, Homo sapiens
accactagggtcctggccctc

SEQ ID NO: 2081378 - DNA, 12 bp, Homo sapiens
accactccattc

SEQ ID NO: 2081379 - DNA, 13 bp, Homo sapiens
accactctggcag

SEQ ID NO: 2081380 - DNA, 21 bp, Homo sapiens
accatgcagcttcatcaattt

SEQ ID NO: 2081381 - DNA, 19 bp, Homo sapiens
accatgccaggctaatttt

SEQ ID NO: 2081382 - DNA, 20 bp, Homo sapiens
accatgccaggctaattttt

SEQ ID NO: 2081383 - DNA, 14 bp, Homo sapiens
accatgcgctgctc

SEQ ID NO: 2081384 - DNA, 22 bp, Homo sapiens
accatgctgctttttggcacag

SEQ ID NO: 2081385 - DNA, 21 bp, Homo sapiens
accatgctggcggcgcagagg

SEQ ID NO: 2081386 - DNA, 13 bp, Homo sapiens
accatggacacat

SEQ ID NO: 2081387 - DNA, 18 bp, Homo sapiens
accatggacacattttct

SEQ ID NO: 2081388 - DNA, 17 bp, Homo sapiens
accatggacggccccgt

SEQ ID NO: 2081389 - DNA, 14 bp, Homo sapiens
accatggaggcagg

SEQ ID NO: 2081390 - DNA, 19 bp, Homo sapiens
accatgtaacaaccagaga

SEQ ID NO: 2081391 - DNA, 12 bp, Homo sapiens
accatgtagttt

SEQ ID NO: 2081392 - DNA, 16 bp, Homo sapiens
accatgtagttttaac

SEQ ID NO: 2081393 - DNA, 12 bp, Homo sapiens
accatgtttgag

SEQ ID NO: 2081394 - DNA, 14 bp, Homo sapiens
accattaagaaatg

SEQ ID NO: 2081395 - DNA, 19 bp, Homo sapiens
acctcagacaatccactct

SEQ ID NO: 2081396 - DNA, 22 bp, Homo sapiens
acctcagacaatccactctcag

SEQ ID NO: 2081397 - DNA, 14 bp, Homo sapiens
acctcagccaaaca

SEQ ID NO: 2081398 - DNA, 23 bp, Homo sapiens
acctcagccatgaggagttgctg

SEQ ID NO: 2081399 - DNA, 15 bp, Homo sapiens
acctcagcctagacc

SEQ ID NO: 2081400 - DNA, 16 bp, Homo sapiens
acctcagcctgtgctg

SEQ ID NO: 2081401 - DNA, 18 bp, Homo sapiens
acctcaggcttccttggc

SEQ ID NO: 2081402 - DNA, 19 bp, Homo sapiens
acctcagggacaacatttt

SEQ ID NO: 2081403 - DNA, 23 bp, Homo sapiens
acctcagtttcctcatctgcaga

SEQ ID NO: 2081404 - DNA, 20 bp, Homo sapiens
acctcatatcttcctcatca

SEQ ID NO: 2081405 - DNA, 20 bp, Homo sapiens
acctcatctacaagcatttg

SEQ ID NO: 2081406 - DNA, 15 bp, Homo sapiens
acctcatgacagcca

SEQ ID NO: 2081407 - DNA, 16 bp, Homo sapiens
acctcatgacagccag

SEQ ID NO: 2081408 - DNA, 17 bp, Homo sapiens
acctcatgacagccaga

SEQ ID NO: 2081409 - DNA, 18 bp, Homo sapiens
acctcatgacagccagag

SEQ ID NO: 2081410 - DNA, 19 bp, Homo sapiens
acctcatgacagccagagc

SEQ ID NO: 2081411 - DNA, 18 bp, Homo sapiens
acctccacagtagcattt

SEQ ID NO: 2081412 - DNA, 18 bp, Homo sapiens
acctccacccactgtccg

SEQ ID NO: 2081413 - DNA, 22 bp, Homo sapiens
acctccacccactgtccgcctc

SEQ ID NO: 2081414 - DNA, 18 bp, Homo sapiens
acctccacctcctgagtt

SEQ ID NO: 2081415 - DNA, 17 bp, Homo sapiens
acctccagctttcctgt

SEQ ID NO: 2081416 - DNA, 22 bp, Homo sapiens
acctcccaaggactttccagtg

SEQ ID NO: 2081417 - DNA, 14 bp, Homo sapiens
acctcccaccccac

SEQ ID NO: 2081418 - DNA, 21 bp, Homo sapiens
acctcccaccccactccagcc

SEQ ID NO: 2081419 - DNA, 22 bp, Homo sapiens
acctcccaccccactccagccc

SEQ ID NO: 2081420 - DNA, 23 bp, Homo sapiens
acctcccaccccactccagccct

SEQ ID NO: 2081421 - DNA, 19 bp, Homo sapiens
acctcccagccctatggat

SEQ ID NO: 2081422 - DNA, 20 bp, Homo sapiens
acctcccaggggctccacct

SEQ ID NO: 2081423 - DNA, 18 bp, Homo sapiens
acctccccccactgcagg

SEQ ID NO: 2081424 - DNA, 22 bp, Homo sapiens
acctccccccactgcaggcccc

SEQ ID NO: 2081425 - DNA, 20 bp, Homo sapiens
acctccccgcagagctccct

SEQ ID NO: 2081426 - DNA, 17 bp, Homo sapiens
acctcccctatccaccc

SEQ ID NO: 2081427 - DNA, 19 bp, Homo sapiens
acctcccctatccacccag

SEQ ID NO: 2081428 - DNA, 14 bp, Homo sapiens
acctcccctgccag

SEQ ID NO: 2081429 - DNA, 16 bp, Homo sapiens
acctcccctgccaggg

SEQ ID NO: 2081430 - DNA, 19 bp, Homo sapiens
acctcccctgccagggctc

SEQ ID NO: 2081431 - DNA, 15 bp, Homo sapiens
acctccctgaaccat

SEQ ID NO: 2081432 - DNA, 20 bp, Homo sapiens
acctccgcctcttgggttca

SEQ ID NO: 2081433 - DNA, 15 bp, Homo sapiens
acctccggggagagc

SEQ ID NO: 2081434 - DNA, 22 bp, Homo sapiens
acctccggggagagcagagggt

SEQ ID NO: 2081435 - DNA, 16 bp, Homo sapiens
acctccgtgctgggct

SEQ ID NO: 2081436 - DNA, 19 bp, Homo sapiens
acctcctagaggtgggcag

SEQ ID NO: 2081437 - DNA, 20 bp, Homo sapiens
acctcctccactcactccag

SEQ ID NO: 2081438 - DNA, 16 bp, Homo sapiens
acctcctcctgccctc

SEQ ID NO: 2081439 - DNA, 19 bp, Homo sapiens
acctcctgagaaggcgagg

SEQ ID NO: 2081440 - DNA, 12 bp, Homo sapiens
acctcctgccca

SEQ ID NO: 2081441 - DNA, 15 bp, Homo sapiens
acctcctgcccagga

SEQ ID NO: 2081442 - DNA, 17 bp, Homo sapiens
acctcctgcccaggaga

SEQ ID NO: 2081443 - DNA, 13 bp, Homo sapiens
acctcctgcctcg

SEQ ID NO: 2081444 - DNA, 18 bp, Homo sapiens
acctccttgctttgctgt

SEQ ID NO: 2081445 - DNA, 21 bp, Homo sapiens
acctcgtcctccccctgccag

SEQ ID NO: 2081446 - DNA, 18 bp, Homo sapiens
acctctcatcagtgtcct

SEQ ID NO: 2081447 - DNA, 19 bp, Homo sapiens
acctctctaagccacagct

SEQ ID NO: 2081448 - DNA, 20 bp, Homo sapiens
acctctctctaagtttagaa

SEQ ID NO: 2081449 - DNA, 13 bp, Homo sapiens
acctctgatacct

SEQ ID NO: 2081450 - DNA, 12 bp, Homo sapiens
acctctgatccc

SEQ ID NO: 2081451 - DNA, 13 bp, Homo sapiens
acctctgcctcaa

SEQ ID NO: 2081452 - DNA, 20 bp, Homo sapiens
acctctgcctgaagtcacac

SEQ ID NO: 2081453 - DNA, 17 bp, Homo sapiens
acctctggatccctgga

SEQ ID NO: 2081454 - DNA, 12 bp, Homo sapiens
acctctgggctt

SEQ ID NO: 2081455 - DNA, 13 bp, Homo sapiens
acctctgtaattt

SEQ ID NO: 2081456 - DNA, 23 bp, Homo sapiens
acctctgtaatttttcagctctc

SEQ ID NO: 2081457 - DNA, 12 bp, Homo sapiens
acctctgtgtgc

SEQ ID NO: 2081458 - DNA, 15 bp, Homo sapiens
acctcttcacccccc

SEQ ID NO: 2081459 - DNA, 15 bp, Homo sapiens
acctcttctatgcaa

SEQ ID NO: 2081460 - DNA, 23 bp, Homo sapiens
acctcttctatgcaagccttgct

SEQ ID NO: 2081461 - DNA, 16 bp, Homo sapiens
acctcttctcttcctg

SEQ ID NO: 2081462 - DNA, 17 bp, Homo sapiens
acctcttctcttcctgt

SEQ ID NO: 2081463 - DNA, 22 bp, Homo sapiens
acctctttattttttgattgaa

SEQ ID NO: 2081464 - DNA, 19 bp, Homo sapiens
acctgaaaaaaagtttaca

SEQ ID NO: 2081465 - DNA, 18 bp, Homo sapiens
acctgaaccccatgggct

SEQ ID NO: 2081466 - DNA, 20 bp, Homo sapiens
acctgaagggtgacatccca

SEQ ID NO: 2081467 - DNA, 16 bp, Homo sapiens
acctgacaatggcagc

SEQ ID NO: 2081468 - DNA, 12 bp, Homo sapiens
acctgacacaag

SEQ ID NO: 2081469 - DNA, 15 bp, Homo sapiens
acctgacacaagagg

SEQ ID NO: 2081470 - DNA, 19 bp, Homo sapiens
acctgacaccgtccctcag

SEQ ID NO: 2081471 - DNA, 17 bp, Homo sapiens
acctgaccggcacctgc

SEQ ID NO: 2081472 - DNA, 17 bp, Homo sapiens
acctgacggacgtcctg

SEQ ID NO: 2081473 - DNA, 18 bp, Homo sapiens
acctgagcattcaggcag

SEQ ID NO: 2081474 - DNA, 13 bp, Homo sapiens
acctgagcctgcc

SEQ ID NO: 2081475 - DNA, 14 bp, Homo sapiens
acctgagcctgccg

SEQ ID NO: 2081476 - DNA, 21 bp, Homo sapiens
acctgagcctgccgagcaacc

SEQ ID NO: 2081477 - DNA, 19 bp, Homo sapiens
acctgagctagaagctgga

SEQ ID NO: 2081478 - DNA, 20 bp, Homo sapiens
acctgagctagaagctggag

SEQ ID NO: 2081479 - DNA, 19 bp, Homo sapiens
acctgaggctcctgtgcta

SEQ ID NO: 2081480 - DNA, 18 bp, Homo sapiens
acctgagtctgctatatt

SEQ ID NO: 2081481 - DNA, 15 bp, Homo sapiens
acctgatcacctctg

SEQ ID NO: 2081482 - DNA, 17 bp, Homo sapiens
acctgatgccccttccc

SEQ ID NO: 2081483 - DNA, 21 bp, Homo sapiens
acctgatgccccttccccaag

SEQ ID NO: 2081484 - DNA, 15 bp, Homo sapiens
acctgcaaaaaatag

SEQ ID NO: 2081485 - DNA, 18 bp, Homo sapiens
acctgcaagccccagggc

SEQ ID NO: 2081486 - DNA, 15 bp, Homo sapiens
acctgcaagtgcccg

SEQ ID NO: 2081487 - DNA, 19 bp, Homo sapiens
acctgcacctccccccact

SEQ ID NO: 2081488 - DNA, 19 bp, Homo sapiens
acctgcaggccaagagcag

SEQ ID NO: 2081489 - DNA, 16 bp, Homo sapiens
acctgcagttcctgag

SEQ ID NO: 2081490 - DNA, 13 bp, Homo sapiens
acctgccacttcc

SEQ ID NO: 2081491 - DNA, 12 bp, Homo sapiens
acctgccagcca

SEQ ID NO: 2081492 - DNA, 15 bp, Homo sapiens
acctgccagccatca

SEQ ID NO: 2081493 - DNA, 14 bp, Homo sapiens
acctgccagcctgg

SEQ ID NO: 2081494 - DNA, 18 bp, Homo sapiens
acctgccagcctggcttc

SEQ ID NO: 2081495 - DNA, 15 bp, Homo sapiens
acctgccatttgcac

SEQ ID NO: 2081496 - DNA, 18 bp, Homo sapiens
acctgccatttgcaccct

SEQ ID NO: 2081497 - DNA, 13 bp, Homo sapiens
acctgcccaacct

SEQ ID NO: 2081498 - DNA, 21 bp, Homo sapiens
acctgcccaacctgctctcct

SEQ ID NO: 2081499 - DNA, 12 bp, Homo sapiens
acctgccccagc

SEQ ID NO: 2081500 - DNA, 23 bp, Homo sapiens
acctgccccgcccagctgcacct

SEQ ID NO: 2081501 - DNA, 14 bp, Homo sapiens
acctgccctctctc

SEQ ID NO: 2081502 - DNA, 13 bp, Homo sapiens
acctgccctgccc

SEQ ID NO: 2081503 - DNA, 12 bp, Homo sapiens
acgaaatgttat

SEQ ID NO: 2081504 - DNA, 14 bp, Homo sapiens
acgaacccacctgc

SEQ ID NO: 2081505 - DNA, 20 bp, Homo sapiens
acgaacccactgtgcttaca

SEQ ID NO: 2081506 - DNA, 21 bp, Homo sapiens
acgaacccactgtgcttacag

SEQ ID NO: 2081507 - DNA, 16 bp, Homo sapiens
acgaacccctcccctc

SEQ ID NO: 2081508 - DNA, 17 bp, Homo sapiens
acgaacggaagggttgg

SEQ ID NO: 2081509 - DNA, 16 bp, Homo sapiens
acgactcttcctgcaa

SEQ ID NO: 2081510 - DNA, 18 bp, Homo sapiens
acgagcactggccagaga

SEQ ID NO: 2081511 - DNA, 19 bp, Homo sapiens
acgagcaggctactgtcag

SEQ ID NO: 2081512 - DNA, 20 bp, Homo sapiens
acgagcaggctactgtcagc

SEQ ID NO: 2081513 - DNA, 18 bp, Homo sapiens
acgaggagcttccagtgc

SEQ ID NO: 2081514 - DNA, 22 bp, Homo sapiens
acgagggatgggatttcatgta

SEQ ID NO: 2081515 - DNA, 18 bp, Homo sapiens
acgagtaagatattattt

SEQ ID NO: 2081516 - DNA, 23 bp, Homo sapiens
acgagtaagatattatttaaatg

SEQ ID NO: 2081517 - DNA, 12 bp, Homo sapiens
acgagtcacctg

SEQ ID NO: 2081518 - DNA, 13 bp, Homo sapiens
acgagtcacctgc

SEQ ID NO: 2081519 - DNA, 17 bp, Homo sapiens
acgagtcacctgcaagc

SEQ ID NO: 2081520 - DNA, 18 bp, Homo sapiens
acgattatttatttctgt

SEQ ID NO: 2081521 - DNA, 21 bp, Homo sapiens
acgcaagggagaagaaatcca

SEQ ID NO: 2081522 - DNA, 20 bp, Homo sapiens
acgcaagggcatcaggcact

SEQ ID NO: 2081523 - DNA, 21 bp, Homo sapiens
acgcaagggcatcaggcactg

SEQ ID NO: 2081524 - DNA, 15 bp, Homo sapiens
acgcacagccaagga

SEQ ID NO: 2081525 - DNA, 13 bp, Homo sapiens
acgcacctccatc

SEQ ID NO: 2081526 - DNA, 19 bp, Homo sapiens
acgcacgcaacccttgctg

SEQ ID NO: 2081527 - DNA, 20 bp, Homo sapiens
acgcacgcaacccttgctgc

SEQ ID NO: 2081528 - DNA, 21 bp, Homo sapiens
acgcagaggcggaaaccttgc

SEQ ID NO: 2081529 - DNA, 12 bp, Homo sapiens
acgcagcagctg

SEQ ID NO: 2081530 - DNA, 21 bp, Homo sapiens
acgcagcagctgggacccctc

SEQ ID NO: 2081531 - DNA, 12 bp, Homo sapiens
acgcagccctgc

SEQ ID NO: 2081532 - DNA, 22 bp, Homo sapiens
acgcagccctgggggccagctg

SEQ ID NO: 2081533 - DNA, 19 bp, Homo sapiens
acgcaggcccccaggtgcc

SEQ ID NO: 2081534 - DNA, 22 bp, Homo sapiens
acgccaaagtgcagcccttcct

SEQ ID NO: 2081535 - DNA, 17 bp, Homo sapiens
acgccactcatttcatc

SEQ ID NO: 2081536 - DNA, 20 bp, Homo sapiens
acgccactcatttcatctca

SEQ ID NO: 2081537 - DNA, 20 bp, Homo sapiens
acgccactgcactccagcct

SEQ ID NO: 2081538 - DNA, 14 bp, Homo sapiens
acgcccagcctcct

SEQ ID NO: 2081539 - DNA, 22 bp, Homo sapiens
acgccccgaacctcacctgacc

SEQ ID NO: 2081540 - DNA, 13 bp, Homo sapiens
acgccctattttt

SEQ ID NO: 2081541 - DNA, 19 bp, Homo sapiens
acgccctgcgttggagcca

SEQ ID NO: 2081542 - DNA, 14 bp, Homo sapiens
acgcctcctggcca

SEQ ID NO: 2081543 - DNA, 20 bp, Homo sapiens
acgcctcttttccctctcta

SEQ ID NO: 2081544 - DNA, 15 bp, Homo sapiens
acgcctgagcccagg

SEQ ID NO: 2081545 - DNA, 16 bp, Homo sapiens
acgcctgagcccaggg

SEQ ID NO: 2081546 - DNA, 18 bp, Homo sapiens
acgcctgagcccagggag

SEQ ID NO: 2081547 - DNA, 20 bp, Homo sapiens
acgcctgagcccagggaggc

SEQ ID NO: 2081548 - DNA, 16 bp, Homo sapiens
acgcctgtaatcccag

SEQ ID NO: 2081549 - DNA, 17 bp, Homo sapiens
acgcctgtaatcccagc

SEQ ID NO: 2081550 - DNA, 19 bp, Homo sapiens
acgcctgtaatcccagcag

SEQ ID NO: 2081551 - DNA, 21 bp, Homo sapiens
acgctcccccgcagtccccag

SEQ ID NO: 2081552 - DNA, 22 bp, Homo sapiens
acgctctcctttctttctaact

SEQ ID NO: 2081553 - DNA, 20 bp, Homo sapiens
acgctctctgtctggctgta

SEQ ID NO: 2081554 - DNA, 13 bp, Homo sapiens
acgctctggacat

SEQ ID NO: 2081555 - DNA, 12 bp, Homo sapiens
acgctcttagct

SEQ ID NO: 2081556 - DNA, 22 bp, Homo sapiens
acgctgccgctgccgctgcacc

SEQ ID NO: 2081557 - DNA, 21 bp, Homo sapiens
acgctgtcctctcgagcccag

SEQ ID NO: 2081558 - DNA, 20 bp, Homo sapiens
acgcttaacctttccgctgt

SEQ ID NO: 2081559 - DNA, 19 bp, Homo sapiens
acgcttttgggaaaactgg

SEQ ID NO: 2081560 - DNA, 17 bp, Homo sapiens
acgctttttgaaaaagc

SEQ ID NO: 2081561 - DNA, 15 bp, Homo sapiens
acggaatagttggct

SEQ ID NO: 2081562 - DNA, 21 bp, Homo sapiens
acggagcctggagggatgcca

SEQ ID NO: 2081563 - DNA, 20 bp, Homo sapiens
acggcacctgggccctgggg

SEQ ID NO: 2081564 - DNA, 23 bp, Homo sapiens
acggcacctgggccctggggcct

SEQ ID NO: 2081565 - DNA, 11 bp, Homo sapiens
acggccaccct

SEQ ID NO: 2081566 - DNA, 18 bp, Homo sapiens
acggccaccctccttccc

SEQ ID NO: 2081567 - DNA, 23 bp, Homo sapiens
acggccctgccccatcctgggcc

SEQ ID NO: 2081568 - DNA, 11 bp, Homo sapiens
acggccctgtt

SEQ ID NO: 2081569 - DNA, 15 bp, Homo sapiens
acggctcactgcagc

SEQ ID NO: 2081570 - DNA, 18 bp, Homo sapiens
acggctcactgcagcctc

SEQ ID NO: 2081571 - DNA, 15 bp, Homo sapiens
acgggaagcaacctc

SEQ ID NO: 2081572 - DNA, 16 bp, Homo sapiens
acgggcagtagctgtg

SEQ ID NO: 2081573 - DNA, 16 bp, Homo sapiens
acgggcctcagtttcc

SEQ ID NO: 2081574 - DNA, 20 bp, Homo sapiens
acgggctcagcagccagagg

SEQ ID NO: 2081575 - DNA, 14 bp, Homo sapiens
acgggctgccctgc

SEQ ID NO: 2081576 - DNA, 20 bp, Homo sapiens
acgggggtgcggcaggagca

SEQ ID NO: 2081577 - DNA, 23 bp, Homo sapiens
acgggtctcacttataccaaagg

SEQ ID NO: 2081578 - DNA, 18 bp, Homo sapiens
acggtcctttaggcagcc

SEQ ID NO: 2081579 - DNA, 19 bp, Homo sapiens
acggtcctttaggcagcct

SEQ ID NO: 2081580 - DNA, 13 bp, Homo sapiens
acggtgaaatcca

SEQ ID NO: 2081581 - DNA, 14 bp, Homo sapiens
acggtgaaatccag

SEQ ID NO: 2081582 - DNA, 15 bp, Homo sapiens
acggtgaaatccagg

SEQ ID NO: 2081583 - DNA, 16 bp, Homo sapiens
acggtgaaatccaggt

SEQ ID NO: 2081584 - DNA, 18 bp, Homo sapiens
acggtgaaatccaggtct

SEQ ID NO: 2081585 - DNA, 18 bp, Homo sapiens
acggtgcgtggctgtggc

SEQ ID NO: 2081586 - DNA, 13 bp, Homo sapiens
acggtgttgcaga

SEQ ID NO: 2081587 - DNA, 15 bp, Homo sapiens
acggttgcttcacct

SEQ ID NO: 2081588 - DNA, 21 bp, Homo sapiens
acggttgcttcaccttggagc

SEQ ID NO: 2081589 - DNA, 18 bp, Homo sapiens
acgtaaccacggaaaaga

SEQ ID NO: 2081590 - DNA, 18 bp, Homo sapiens
acgtacaccatatgcaag

SEQ ID NO: 2081591 - DNA, 16 bp, Homo sapiens
acgtacttaactgtgt

SEQ ID NO: 2081592 - DNA, 23 bp, Homo sapiens
acgtacttaactgtgtgaagaaa

SEQ ID NO: 2081593 - DNA, 12 bp, Homo sapiens
acgtatcatttc

SEQ ID NO: 2081594 - DNA, 16 bp, Homo sapiens
acgtatttaatagcaa

SEQ ID NO: 2081595 - DNA, 22 bp, Homo sapiens
acgtatttatatttggaaagag

SEQ ID NO: 2081596 - DNA, 18 bp, Homo sapiens
acgtcatcggaggctggg

SEQ ID NO: 2081597 - DNA, 12 bp, Homo sapiens
acgtcatctcag

SEQ ID NO: 2081598 - DNA, 15 bp, Homo sapiens
acgtcctgctggcac

SEQ ID NO: 2081599 - DNA, 15 bp, Homo sapiens
acgtcctggaatgaa

SEQ ID NO: 2081600 - DNA, 15 bp, Homo sapiens
acgtctgccaggccc

SEQ ID NO: 2081601 - DNA, 18 bp, Homo sapiens
acgtctgccaggcccatc

SEQ ID NO: 2081602 - DNA, 18 bp, Homo sapiens
acgtctggtgttctcaat

SEQ ID NO: 2081603 - DNA, 13 bp, Homo sapiens
acgtcttgctatt

SEQ ID NO: 2081604 - DNA, 16 bp, Homo sapiens
acgtgaagccacagga

SEQ ID NO: 2081605 - DNA, 14 bp, Homo sapiens
acgtgactgcccca

SEQ ID NO: 2081606 - DNA, 20 bp, Homo sapiens
acgtgactgccccaactcct

SEQ ID NO: 2081607 - DNA, 22 bp, Homo sapiens
acgtgagccaggtaatgaggga

SEQ ID NO: 2081608 - DNA, 16 bp, Homo sapiens
acgtgccagctctagt

SEQ ID NO: 2081609 - DNA, 16 bp, Homo sapiens
acgtgctcgcagcctg

SEQ ID NO: 2081610 - DNA, 17 bp, Homo sapiens
acgtgctcgcagcctgg

SEQ ID NO: 2081611 - DNA, 16 bp, Homo sapiens
acgtgggagacaagaa

SEQ ID NO: 2081612 - DNA, 19 bp, Homo sapiens
acgtgtgcagactgtggct

SEQ ID NO: 2081613 - DNA, 14 bp, Homo sapiens
actaaaatatgtct

SEQ ID NO: 2081614 - DNA, 13 bp, Homo sapiens
actaaagagacat

SEQ ID NO: 2081615 - DNA, 19 bp, Homo sapiens
actaaagatatcagagctc

SEQ ID NO: 2081616 - DNA, 19 bp, Homo sapiens
actaaagcagtgttttcac

SEQ ID NO: 2081617 - DNA, 18 bp, Homo sapiens
actaaagtgtctattagt

SEQ ID NO: 2081618 - DNA, 14 bp, Homo sapiens
actaaatctctaat

SEQ ID NO: 2081619 - DNA, 16 bp, Homo sapiens
actaaatgagctcctg

SEQ ID NO: 2081620 - DNA, 13 bp, Homo sapiens
actaaatggttgt

SEQ ID NO: 2081621 - DNA, 17 bp, Homo sapiens
actaacactcagaagcc

SEQ ID NO: 2081622 - DNA, 17 bp, Homo sapiens
actaacataaaatctgt

SEQ ID NO: 2081623 - DNA, 12 bp, Homo sapiens
actaaccacgct

SEQ ID NO: 2081624 - DNA, 23 bp, Homo sapiens
actaagccctcgaaccaaggcag

SEQ ID NO: 2081625 - DNA, 22 bp, Homo sapiens
actaagccctgtcgagacactt

SEQ ID NO: 2081626 - DNA, 14 bp, Homo sapiens
actaatagagacac

SEQ ID NO: 2081627 - DNA, 21 bp, Homo sapiens
actaatagagacacagagatg

SEQ ID NO: 2081628 - DNA, 19 bp, Homo sapiens
actaatcgaactatgaact

SEQ ID NO: 2081629 - DNA, 23 bp, Homo sapiens
actaatgctaagaaatgctgaaa

SEQ ID NO: 2081630 - DNA, 12 bp, Homo sapiens
actaatttaaac

SEQ ID NO: 2081631 - DNA, 13 bp, Homo sapiens
actacaaaatttg

SEQ ID NO: 2081632 - DNA, 14 bp, Homo sapiens
actacaaaatttga

SEQ ID NO: 2081633 - DNA, 22 bp, Homo sapiens
actacaagtttataagcccaaa

SEQ ID NO: 2081634 - DNA, 17 bp, Homo sapiens
actacaatttaaagcaa

SEQ ID NO: 2081635 - DNA, 20 bp, Homo sapiens
actacacatccctaatgtgt

SEQ ID NO: 2081636 - DNA, 23 bp, Homo sapiens
actacaccatgtttgagctcaga

SEQ ID NO: 2081637 - DNA, 14 bp, Homo sapiens
actacactaataaa

SEQ ID NO: 2081638 - DNA, 15 bp, Homo sapiens
actacagccagaagc

SEQ ID NO: 2081639 - DNA, 11 bp, Homo sapiens
actacaggcac

SEQ ID NO: 2081640 - DNA, 16 bp, Homo sapiens
actacagtctaaagct

SEQ ID NO: 2081641 - DNA, 21 bp, Homo sapiens
actaccaagaggccctgtctg

SEQ ID NO: 2081642 - DNA, 21 bp, Homo sapiens
actaccagctaactccagtct

SEQ ID NO: 2081643 - DNA, 20 bp, Homo sapiens
actacctttgtccaggcctg

SEQ ID NO: 2081644 - DNA, 18 bp, Homo sapiens
actacggaatagttggct

SEQ ID NO: 2081645 - DNA, 15 bp, Homo sapiens
actactattctgtta

SEQ ID NO: 2081646 - DNA, 14 bp, Homo sapiens
actactgctgcaaa

SEQ ID NO: 2081647 - DNA, 17 bp, Homo sapiens
actactgctgcaaagtg

SEQ ID NO: 2081648 - DNA, 22 bp, Homo sapiens
actactgctgcaaagtgcaaat

SEQ ID NO: 2081649 - DNA, 14 bp, Homo sapiens
actactgtaaatgt

SEQ ID NO: 2081650 - DNA, 16 bp, Homo sapiens
actactgtaaatgtat

SEQ ID NO: 2081651 - DNA, 11 bp, Homo sapiens
actactgtaat

SEQ ID NO: 2081652 - DNA, 19 bp, Homo sapiens
actactgtggaaaaatatt

SEQ ID NO: 2081653 - DNA, 16 bp, Homo sapiens
actactttttatactc

SEQ ID NO: 2081654 - DNA, 16 bp, Homo sapiens
actagaaagctctgca

SEQ ID NO: 2081655 - DNA, 14 bp, Homo sapiens
actagaacctggag

SEQ ID NO: 2081656 - DNA, 15 bp, Homo sapiens
actagaacctggagg

SEQ ID NO: 2081657 - DNA, 15 bp, Homo sapiens
actagaactctccat

SEQ ID NO: 2081658 - DNA, 23 bp, Homo sapiens
actagaagaaagggcaagaagga

SEQ ID NO: 2081659 - DNA, 18 bp, Homo sapiens
actagaatttgtattttg

SEQ ID NO: 2081660 - DNA, 20 bp, Homo sapiens
actagaatttgtattttgct

SEQ ID NO: 2081661 - DNA, 19 bp, Homo sapiens
actagagacctctcaacag

SEQ ID NO: 2081662 - DNA, 12 bp, Homo sapiens
actagagctggg

SEQ ID NO: 2081663 - DNA, 22 bp, Homo sapiens
actagagctgggaaacagggag

SEQ ID NO: 2081664 - DNA, 14 bp, Homo sapiens
actagaggtgagaa

SEQ ID NO: 2081665 - DNA, 11 bp, Homo sapiens
actagatctcc

SEQ ID NO: 2081666 - DNA, 16 bp, Homo sapiens
actagatctcctgtaa

SEQ ID NO: 2081667 - DNA, 16 bp, Homo sapiens
actagccaaggctagt

SEQ ID NO: 2081668 - DNA, 15 bp, Homo sapiens
actagcctctccagg

SEQ ID NO: 2081669 - DNA, 15 bp, Homo sapiens
actagcctgtgatta

SEQ ID NO: 2081670 - DNA, 23 bp, Homo sapiens
actagctagaagtgggccaggac

SEQ ID NO: 2081671 - DNA, 14 bp, Homo sapiens
actaggacctcata

SEQ ID NO: 2081672 - DNA, 22 bp, Homo sapiens
actaggacctcatatcttcctc

SEQ ID NO: 2081673 - DNA, 16 bp, Homo sapiens
actaggactctgaggc

SEQ ID NO: 2081674 - DNA, 17 bp, Homo sapiens
actaggactctgaggct

SEQ ID NO: 2081675 - DNA, 23 bp, Homo sapiens
actaggaggttccggtgtctgga

SEQ ID NO: 2081676 - DNA, 16 bp, Homo sapiens
actaggccatttgtat

SEQ ID NO: 2081677 - DNA, 16 bp, Homo sapiens
actaggttcaattccc

SEQ ID NO: 2081678 - DNA, 21 bp, Homo sapiens
actaggttcaattccctgaag

SEQ ID NO: 2081679 - DNA, 22 bp, Homo sapiens
actagtaatgggccaattaaaa

SEQ ID NO: 2081680 - DNA, 20 bp, Homo sapiens
actagtcatagaaatacctc

SEQ ID NO: 2081681 - DNA, 21 bp, Homo sapiens
actagttgaacatctcacttt

SEQ ID NO: 2081682 - DNA, 17 bp, Homo sapiens
actagttgatgaaggag

SEQ ID NO: 2081683 - DNA, 14 bp, Homo sapiens
actagtttccagtg

SEQ ID NO: 2081684 - DNA, 15 bp, Homo sapiens
actagtttccagtgg

SEQ ID NO: 2081685 - DNA, 17 bp, Homo sapiens
actagtttccagtggat

SEQ ID NO: 2081686 - DNA, 19 bp, Homo sapiens
actataaactactgtaatt

SEQ ID NO: 2081687 - DNA, 23 bp, Homo sapiens
actataaccatcagttactggtt

SEQ ID NO: 2081688 - DNA, 15 bp, Homo sapiens
actataatgtgatga

SEQ ID NO: 2081689 - DNA, 13 bp, Homo sapiens
actatacaacaat

SEQ ID NO: 2081690 - DNA, 18 bp, Homo sapiens
actatatacatgtgtgta

SEQ ID NO: 2081691 - DNA, 16 bp, Homo sapiens
actatatagagatgtt

SEQ ID NO: 2081692 - DNA, 18 bp, Homo sapiens
actatatagagatgtttt

SEQ ID NO: 2081693 - DNA, 20 bp, Homo sapiens
actatattttagatgcaatg

SEQ ID NO: 2081694 - DNA, 14 bp, Homo sapiens
actatcaaactgaa

SEQ ID NO: 2081695 - DNA, 14 bp, Homo sapiens
actatcacatacaa

SEQ ID NO: 2081696 - DNA, 22 bp, Homo sapiens
actatcagtttgtcctgtagag

SEQ ID NO: 2081697 - DNA, 21 bp, Homo sapiens
actatctcttgtcatataaac

SEQ ID NO: 2081698 - DNA, 20 bp, Homo sapiens
actatcttactatttcacaa

SEQ ID NO: 2081699 - DNA, 16 bp, Homo sapiens
actatctttctgataa

SEQ ID NO: 2081700 - DNA, 18 bp, Homo sapiens
actatgaactacaaagct

SEQ ID NO: 2081701 - DNA, 20 bp, Homo sapiens
actcaaccatcaatggaaac

SEQ ID NO: 2081702 - DNA, 14 bp, Homo sapiens
actcaagaggctga

SEQ ID NO: 2081703 - DNA, 15 bp, Homo sapiens
actcaagaggctgag

SEQ ID NO: 2081704 - DNA, 13 bp, Homo sapiens
actcaagctgcgt

SEQ ID NO: 2081705 - DNA, 17 bp, Homo sapiens
actcaagggtccagaag

SEQ ID NO: 2081706 - DNA, 19 bp, Homo sapiens
actcaagtttttacaaaat

SEQ ID NO: 2081707 - DNA, 14 bp, Homo sapiens
actcaataaaagaa

SEQ ID NO: 2081708 - DNA, 20 bp, Homo sapiens
actcaatatgtgatttttgt

SEQ ID NO: 2081709 - DNA, 22 bp, Homo sapiens
actcaatattttccatgaaaat

SEQ ID NO: 2081710 - DNA, 23 bp, Homo sapiens
actcaatctccccttgcactaaa

SEQ ID NO: 2081711 - DNA, 14 bp, Homo sapiens
actcaatgcactga

SEQ ID NO: 2081712 - DNA, 14 bp, Homo sapiens
actcacaagaagac

SEQ ID NO: 2081713 - DNA, 16 bp, Homo sapiens
actcacaagaagacca

SEQ ID NO: 2081714 - DNA, 13 bp, Homo sapiens
actcacacaggca

SEQ ID NO: 2081715 - DNA, 22 bp, Homo sapiens
actcacacaggcatttcctggg

SEQ ID NO: 2081716 - DNA, 15 bp, Homo sapiens
actcaccagggtccg

SEQ ID NO: 2081717 - DNA, 21 bp, Homo sapiens
actcaccagggtccgcaccag

SEQ ID NO: 2081718 - DNA, 19 bp, Homo sapiens
actcaccagtgtcccctcc

SEQ ID NO: 2081719 - DNA, 23 bp, Homo sapiens
actcaccagtgtcccctccactg

SEQ ID NO: 2081720 - DNA, 17 bp, Homo sapiens
actcacccatgtgccaa

SEQ ID NO: 2081721 - DNA, 21 bp, Homo sapiens
actcacccatgtgccaaggtg

SEQ ID NO: 2081722 - DNA, 12 bp, Homo sapiens
actcacctctct

SEQ ID NO: 2081723 - DNA, 11 bp, Homo sapiens
actcacctctg

SEQ ID NO: 2081724 - DNA, 15 bp, Homo sapiens
actcacctctgcctc

SEQ ID NO: 2081725 - DNA, 22 bp, Homo sapiens
actcactgctcaagaagacatg

SEQ ID NO: 2081726 - DNA, 14 bp, Homo sapiens
actcactgtcaatg

SEQ ID NO: 2081727 - DNA, 13 bp, Homo sapiens
actcacttcaatg

SEQ ID NO: 2081728 - DNA, 19 bp, Homo sapiens
actcagaaaagaaaaccat

SEQ ID NO: 2081729 - DNA, 14 bp, Homo sapiens
actcagaagacact

SEQ ID NO: 2081730 - DNA, 15 bp, Homo sapiens
actcagaagacactg

SEQ ID NO: 2081731 - DNA, 17 bp, Homo sapiens
actcagaagacactgat

SEQ ID NO: 2081732 - DNA, 18 bp, Homo sapiens
actcagaagacactgatg

SEQ ID NO: 2081733 - DNA, 15 bp, Homo sapiens
actcagaatgctcta

SEQ ID NO: 2081734 - DNA, 11 bp, Homo sapiens
actcagagcag

SEQ ID NO: 2081735 - DNA, 14 bp, Homo sapiens
actcagcagccctc

SEQ ID NO: 2081736 - DNA, 15 bp, Homo sapiens
actcagcagccctcc

SEQ ID NO: 2081737 - DNA, 18 bp, Homo sapiens
actcagcagccctcctca

SEQ ID NO: 2081738 - DNA, 23 bp, Homo sapiens
actcagcagccctcctcaccccg

SEQ ID NO: 2081739 - DNA, 15 bp, Homo sapiens
actcagccacacccc

SEQ ID NO: 2081740 - DNA, 13 bp, Homo sapiens
actcagccctggg

SEQ ID NO: 2081741 - DNA, 15 bp, Homo sapiens
actcagccctgggcc

SEQ ID NO: 2081742 - DNA, 22 bp, Homo sapiens
actcagctccagaataccttct

SEQ ID NO: 2081743 - DNA, 19 bp, Homo sapiens
actcaggaggctgaggcag

SEQ ID NO: 2081744 - DNA, 13 bp, Homo sapiens
actcaggattctc

SEQ ID NO: 2081745 - DNA, 13 bp, Homo sapiens
actcagggcccca

SEQ ID NO: 2081746 - DNA, 15 bp, Homo sapiens
actcagggccccagc

SEQ ID NO: 2081747 - DNA, 16 bp, Homo sapiens
actcagggctgccact

SEQ ID NO: 2081748 - DNA, 19 bp, Homo sapiens
actcagtccatagcagaga

SEQ ID NO: 2081749 - DNA, 15 bp, Homo sapiens
actcagtgaggccgc

SEQ ID NO: 2081750 - DNA, 22 bp, Homo sapiens
actcagtttgtcagactttaaa

SEQ ID NO: 2081751 - DNA, 22 bp, Homo sapiens
actcagttttaactagaattta

SEQ ID NO: 2081752 - DNA, 14 bp, Homo sapiens
actcatcataaaat

SEQ ID NO: 2081753 - DNA, 19 bp, Homo sapiens
actcatcctgtgtggggag

SEQ ID NO: 2081754 - DNA, 20 bp, Homo sapiens
actcatcctgtgtggggagg

SEQ ID NO: 2081755 - DNA, 13 bp, Homo sapiens
actcatgtacatt

SEQ ID NO: 2081756 - DNA, 13 bp, Homo sapiens
actcattagactg

SEQ ID NO: 2081757 - DNA, 14 bp, Homo sapiens
actcattagactgg

SEQ ID NO: 2081758 - DNA, 15 bp, Homo sapiens
actcattccttcact

SEQ ID NO: 2081759 - DNA, 15 bp, Homo sapiens
actcattcttctgta

SEQ ID NO: 2081760 - DNA, 12 bp, Homo sapiens
actcatttcatc

SEQ ID NO: 2081761 - DNA, 17 bp, Homo sapiens
actcatttcatctcatt

SEQ ID NO: 2081762 - DNA, 21 bp, Homo sapiens
actccaaacctcctgttagct

SEQ ID NO: 2081763 - DNA, 18 bp, Homo sapiens
actccaaagaaatgtaag

SEQ ID NO: 2081764 - DNA, 14 bp, Homo sapiens
actccaagcttcaa

SEQ ID NO: 2081765 - DNA, 22 bp, Homo sapiens
actccaagggtttctgacccaa

SEQ ID NO: 2081766 - DNA, 16 bp, Homo sapiens
actccactctccttcg

SEQ ID NO: 2081767 - DNA, 15 bp, Homo sapiens
actccagacccctgg

SEQ ID NO: 2081768 - DNA, 12 bp, Homo sapiens
actccagagaag

SEQ ID NO: 2081769 - DNA, 16 bp, Homo sapiens
actccagagtctgagc

SEQ ID NO: 2081770 - DNA, 17 bp, Homo sapiens
actccagagtctgagcc

SEQ ID NO: 2081771 - DNA, 19 bp, Homo sapiens
actccagccagcgcctccc

SEQ ID NO: 2081772 - DNA, 22 bp, Homo sapiens
actccagccagcgcctccctcc

SEQ ID NO: 2081773 - DNA, 10 bp, Homo sapiens
actccagccc

SEQ ID NO: 2081774 - DNA, 12 bp, Homo sapiens
actccagccctg

SEQ ID NO: 2081775 - DNA, 14 bp, Homo sapiens
actccagcctgagc

SEQ ID NO: 2081776 - DNA, 14 bp, Homo sapiens
actccagcctgggc

SEQ ID NO: 2081777 - DNA, 18 bp, Homo sapiens
actccagcctgggcgaca

SEQ ID NO: 2081778 - DNA, 18 bp, Homo sapiens
actccaggaaaactgttt

SEQ ID NO: 2081779 - DNA, 16 bp, Homo sapiens
actccagtgagctgga

SEQ ID NO: 2081780 - DNA, 13 bp, Homo sapiens
actccatggccac

SEQ ID NO: 2081781 - DNA, 17 bp, Homo sapiens
actccatggccaccccg

SEQ ID NO: 2081782 - DNA, 17 bp, Homo sapiens
actgagcttctctgtga

SEQ ID NO: 2081783 - DNA, 19 bp, Homo sapiens
actgaggagtagctgagag

SEQ ID NO: 2081784 - DNA, 15 bp, Homo sapiens
actgaggcagacagc

SEQ ID NO: 2081785 - DNA, 17 bp, Homo sapiens
actgaggtcactgggtt

SEQ ID NO: 2081786 - DNA, 12 bp, Homo sapiens
actgagtgactc

SEQ ID NO: 2081787 - DNA, 13 bp, Homo sapiens
actgagtggcttg

SEQ ID NO: 2081788 - DNA, 17 bp, Homo sapiens
actgatagtgtccaaat

SEQ ID NO: 2081789 - DNA, 16 bp, Homo sapiens
actgatcaaaaataaa

SEQ ID NO: 2081790 - DNA, 21 bp, Homo sapiens
actgatcaaaaataaactagt

SEQ ID NO: 2081791 - DNA, 17 bp, Homo sapiens
actgatgacaaacccag

SEQ ID NO: 2081792 - DNA, 20 bp, Homo sapiens
actgatgcgaaaacttgaat

SEQ ID NO: 2081793 - DNA, 12 bp, Homo sapiens
actgatgggcaa

SEQ ID NO: 2081794 - DNA, 23 bp, Homo sapiens
actgatgggcaacccccagcctg

SEQ ID NO: 2081795 - DNA, 21 bp, Homo sapiens
actgatgttacatcacagtgt

SEQ ID NO: 2081796 - DNA, 15 bp, Homo sapiens
actgattagtattca

SEQ ID NO: 2081797 - DNA, 20 bp, Homo sapiens
actgattgttttagagacta

SEQ ID NO: 2081798 - DNA, 20 bp, Homo sapiens
actgatttcacaacagatca

SEQ ID NO: 2081799 - DNA, 16 bp, Homo sapiens
actgatttggagatat

SEQ ID NO: 2081800 - DNA, 14 bp, Homo sapiens
actgatttttgtga

SEQ ID NO: 2081801 - DNA, 13 bp, Homo sapiens
actgcaacctccg

SEQ ID NO: 2081802 - DNA, 16 bp, Homo sapiens
actgcaacctccgcct

SEQ ID NO: 2081803 - DNA, 15 bp, Homo sapiens
actgcaagagccttg

SEQ ID NO: 2081804 - DNA, 17 bp, Homo sapiens
actgcaagagccttggt

SEQ ID NO: 2081805 - DNA, 18 bp, Homo sapiens
actgcaagagccttggtg

SEQ ID NO: 2081806 - DNA, 18 bp, Homo sapiens
actgcaagaggctcctgt

SEQ ID NO: 2081807 - DNA, 16 bp, Homo sapiens
actgcacacacagctc

SEQ ID NO: 2081808 - DNA, 18 bp, Homo sapiens
actgcacacacagctcct

SEQ ID NO: 2081809 - DNA, 20 bp, Homo sapiens
actgcacagcggcccctgca

SEQ ID NO: 2081810 - DNA, 22 bp, Homo sapiens
actgcacagcggcccctgcatc

SEQ ID NO: 2081811 - DNA, 16 bp, Homo sapiens
actgcacagtgcatct

SEQ ID NO: 2081812 - DNA, 18 bp, Homo sapiens
actgcacagtgcatctca

SEQ ID NO: 2081813 - DNA, 22 bp, Homo sapiens
actgcacagtgcatctcagccc

SEQ ID NO: 2081814 - DNA, 19 bp, Homo sapiens
actgcactccagcctgggc

SEQ ID NO: 2081815 - DNA, 12 bp, Homo sapiens
actgcagctgct

SEQ ID NO: 2081816 - DNA, 13 bp, Homo sapiens
actgcagctgctg

SEQ ID NO: 2081817 - DNA, 17 bp, Homo sapiens
actgcagggactgccag

SEQ ID NO: 2081818 - DNA, 22 bp, Homo sapiens
actgcagtccgcagtctggcct

SEQ ID NO: 2081819 - DNA, 18 bp, Homo sapiens
actgcatatcggaggtgg

SEQ ID NO: 2081820 - DNA, 17 bp, Homo sapiens
actgcatctcaaaaaaa

SEQ ID NO: 2081821 - DNA, 16 bp, Homo sapiens
actgcattagaaatta

SEQ ID NO: 2081822 - DNA, 13 bp, Homo sapiens
actgcattctttt

SEQ ID NO: 2081823 - DNA, 15 bp, Homo sapiens
actgccaaaacaatg

SEQ ID NO: 2081824 - DNA, 20 bp, Homo sapiens
actgccaagaaaaggcatgg

SEQ ID NO: 2081825 - DNA, 19 bp, Homo sapiens
actgccacaccctccccat

SEQ ID NO: 2081826 - DNA, 14 bp, Homo sapiens
actgccaggaggga

SEQ ID NO: 2081827 - DNA, 21 bp, Homo sapiens
actgccaggagggacaaagga

SEQ ID NO: 2081828 - DNA, 17 bp, Homo sapiens
actgccaggcacctggc

SEQ ID NO: 2081829 - DNA, 19 bp, Homo sapiens
actgccaggcacctggcct

SEQ ID NO: 2081830 - DNA, 19 bp, Homo sapiens
actgcccaggcctgcctgt

SEQ ID NO: 2081831 - DNA, 16 bp, Homo sapiens
actgcccagtttcttt

SEQ ID NO: 2081832 - DNA, 17 bp, Homo sapiens
actgccccaccagccac

SEQ ID NO: 2081833 - DNA, 20 bp, Homo sapiens
actgccccaccagccacctc

SEQ ID NO: 2081834 - DNA, 14 bp, Homo sapiens
actgccccatctcc

SEQ ID NO: 2081835 - DNA, 13 bp, Homo sapiens
actgccctgcctg

SEQ ID NO: 2081836 - DNA, 16 bp, Homo sapiens
actgccctgcctgccc

SEQ ID NO: 2081837 - DNA, 18 bp, Homo sapiens
actgccctgcctgcccac

SEQ ID NO: 2081838 - DNA, 19 bp, Homo sapiens
actgcctagaaaatgcaaa

SEQ ID NO: 2081839 - DNA, 14 bp, Homo sapiens
actgcctgcttggg

SEQ ID NO: 2081840 - DNA, 20 bp, Homo sapiens
actgccttaatgagaacatt

SEQ ID NO: 2081841 - DNA, 12 bp, Homo sapiens
actgccttccag

SEQ ID NO: 2081842 - DNA, 17 bp, Homo sapiens
actgccttccaggagca

SEQ ID NO: 2081843 - DNA, 12 bp, Homo sapiens
actgcctttgga

SEQ ID NO: 2081844 - DNA, 20 bp, Homo sapiens
actgcggaaaaggaaggaaa

SEQ ID NO: 2081845 - DNA, 15 bp, Homo sapiens
actgcgtagagcctg

SEQ ID NO: 2081846 - DNA, 20 bp, Homo sapiens
actgctaaatactgtacata

SEQ ID NO: 2081847 - DNA, 22 bp, Homo sapiens
actgctaaatactgtacataga

SEQ ID NO: 2081848 - DNA, 23 bp, Homo sapiens
actgctaggcgagtgccaggact

SEQ ID NO: 2081849 - DNA, 16 bp, Homo sapiens
actgctcaagaagaca

SEQ ID NO: 2081850 - DNA, 19 bp, Homo sapiens
actgctcatcattccttga

SEQ ID NO: 2081851 - DNA, 23 bp, Homo sapiens
actgctcatcattccttgagaaa

SEQ ID NO: 2081852 - DNA, 14 bp, Homo sapiens
actgctctcagcct

SEQ ID NO: 2081853 - DNA, 20 bp, Homo sapiens
actgctctcagcctcccaac

SEQ ID NO: 2081854 - DNA, 21 bp, Homo sapiens
actgctctgaatattttgtaa

SEQ ID NO: 2081855 - DNA, 12 bp, Homo sapiens
actgctgagcca

SEQ ID NO: 2081856 - DNA, 15 bp, Homo sapiens
actgctgagccactc

SEQ ID NO: 2081857 - DNA, 13 bp, Homo sapiens
actgctgcaaagt

SEQ ID NO: 2081858 - DNA, 15 bp, Homo sapiens
actgctgcaaagtgc

SEQ ID NO: 2081859 - DNA, 16 bp, Homo sapiens
actgctgcaaagtgca

SEQ ID NO: 2081860 - DNA, 20 bp, Homo sapiens
actgctgcaaagtgcaaata

SEQ ID NO: 2081861 - DNA, 14 bp, Homo sapiens
actgctggctgcct

SEQ ID NO: 2081862 - DNA, 13 bp, Homo sapiens
actgctgggactg

SEQ ID NO: 2081863 - DNA, 19 bp, Homo sapiens
actgctgggactggccagg

SEQ ID NO: 2081864 - DNA, 12 bp, Homo sapiens
actgctggggag

SEQ ID NO: 2081865 - DNA, 16 bp, Homo sapiens
actgctggggagtccc

SEQ ID NO: 2081866 - DNA, 22 bp, Homo sapiens
actgctgtaaataaatgcttta

SEQ ID NO: 2081867 - DNA, 15 bp, Homo sapiens
actgctgtcattgtc

SEQ ID NO: 2081868 - DNA, 21 bp, Homo sapiens
actgctgtcattgtccatgcc

SEQ ID NO: 2081869 - DNA, 21 bp, Homo sapiens
actgcttgaggaggggcacct

SEQ ID NO: 2081870 - DNA, 15 bp, Homo sapiens
actgctttccagcct

SEQ ID NO: 2081871 - DNA, 20 bp, Homo sapiens
actggaaaataaattttgaa

SEQ ID NO: 2081872 - DNA, 15 bp, Homo sapiens
actggaacagcccat

SEQ ID NO: 2081873 - DNA, 15 bp, Homo sapiens
actggaagcacagct

SEQ ID NO: 2081874 - DNA, 23 bp, Homo sapiens
actggaataagaagcaaataaat

SEQ ID NO: 2081875 - DNA, 17 bp, Homo sapiens
actggaatcctttcagc

SEQ ID NO: 2081876 - DNA, 12 bp, Homo sapiens
actggacagctt

SEQ ID NO: 2081877 - DNA, 14 bp, Homo sapiens
actggacagcttgt

SEQ ID NO: 2081878 - DNA, 15 bp, Homo sapiens
actggacagcttgtg

SEQ ID NO: 2081879 - DNA, 21 bp, Homo sapiens
actggacatcacagcagaatg

SEQ ID NO: 2081880 - DNA, 16 bp, Homo sapiens
actggaccactgggca

SEQ ID NO: 2081881 - DNA, 21 bp, Homo sapiens
actggaccactgggcaatgat

SEQ ID NO: 2081882 - DNA, 16 bp, Homo sapiens
actggaccccgcctcc

SEQ ID NO: 2081883 - DNA, 20 bp, Homo sapiens
actggaccccgcctcccagc

SEQ ID NO: 2081884 - DNA, 17 bp, Homo sapiens
actggacgcccagctga

SEQ ID NO: 2081885 - DNA, 15 bp, Homo sapiens
actggactgggtttt

SEQ ID NO: 2081886 - DNA, 22 bp, Homo sapiens
actggacttgagcttggcagct

SEQ ID NO: 2081887 - DNA, 17 bp, Homo sapiens
actggagaggctagaac

SEQ ID NO: 2081888 - DNA, 13 bp, Homo sapiens
actggagcactga

SEQ ID NO: 2081889 - DNA, 16 bp, Homo sapiens
actggagcatctgact

SEQ ID NO: 2081890 - DNA, 18 bp, Homo sapiens
actggagcatctgactca

SEQ ID NO: 2081891 - DNA, 20 bp, Homo sapiens
actggaggtcacattcagga

SEQ ID NO: 2081892 - DNA, 23 bp, Homo sapiens
actggaggtcacattcaggaaga

SEQ ID NO: 2081893 - DNA, 16 bp, Homo sapiens
actggagtagttgcta

SEQ ID NO: 2081894 - DNA, 14 bp, Homo sapiens
actggagttacatt

SEQ ID NO: 2081895 - DNA, 16 bp, Homo sapiens
actggagttacattaa

SEQ ID NO: 2081896 - DNA, 13 bp, Homo sapiens
actggcaatattt

SEQ ID NO: 2081897 - DNA, 13 bp, Homo sapiens
actggcacagttt

SEQ ID NO: 2081898 - DNA, 20 bp, Homo sapiens
actggcacgtttgtgagaag

SEQ ID NO: 2081899 - DNA, 18 bp, Homo sapiens
actggcattaattattaa

SEQ ID NO: 2081900 - DNA, 20 bp, Homo sapiens
actggcattaattattaata

SEQ ID NO: 2081901 - DNA, 18 bp, Homo sapiens
actggccaagctgaggtg

SEQ ID NO: 2081902 - DNA, 12 bp, Homo sapiens
actggccagaga

SEQ ID NO: 2081903 - DNA, 21 bp, Homo sapiens
actggccagagagggcccagc

SEQ ID NO: 2081904 - DNA, 23 bp, Homo sapiens
actggccagagagggcccagctg

SEQ ID NO: 2081905 - DNA, 19 bp, Homo sapiens
actggccagtcctagagct

SEQ ID NO: 2081906 - DNA, 22 bp, Homo sapiens
actggccagtcctagagctcct

SEQ ID NO: 2081907 - DNA, 22 bp, Homo sapiens
actggcctcaaagcaagcattc

SEQ ID NO: 2081908 - DNA, 21 bp, Homo sapiens
actggctcacccctctccccc

SEQ ID NO: 2081909 - DNA, 9 bp, Homo sapiens
actggctga

SEQ ID NO: 2081910 - DNA, 11 bp, Homo sapiens
actggctgggg

SEQ ID NO: 2081911 - DNA, 13 bp, Homo sapiens
actggctggggca

SEQ ID NO: 2081912 - DNA, 14 bp, Homo sapiens
actggctggggcag

SEQ ID NO: 2081913 - DNA, 16 bp, Homo sapiens
actggctggggcagag

SEQ ID NO: 2081914 - DNA, 19 bp, Homo sapiens
actggggagttataaaaat

SEQ ID NO: 2081915 - DNA, 16 bp, Homo sapiens
actggggatgtgggag

SEQ ID NO: 2081916 - DNA, 17 bp, Homo sapiens
actggggatgtgggagg

SEQ ID NO: 2081917 - DNA, 12 bp, Homo sapiens
actgggtacaag

SEQ ID NO: 2081918 - DNA, 18 bp, Homo sapiens
actgggtacttgtggaca

SEQ ID NO: 2081919 - DNA, 15 bp, Homo sapiens
actgggtctcactcc

SEQ ID NO: 2081920 - DNA, 16 bp, Homo sapiens
actgggttctagaacc

SEQ ID NO: 2081921 - DNA, 15 bp, Homo sapiens
actgggttgtccagg

SEQ ID NO: 2081922 - DNA, 14 bp, Homo sapiens
actggtcctgtgtg

SEQ ID NO: 2081923 - DNA, 15 bp, Homo sapiens
actggtcctgtgtgc

SEQ ID NO: 2081924 - DNA, 20 bp, Homo sapiens
actggtcctgtgtgcagtga

SEQ ID NO: 2081925 - DNA, 21 bp, Homo sapiens
actggtgactgcgatcttcag

SEQ ID NO: 2081926 - DNA, 22 bp, Homo sapiens
actggtggcccgacagcctggc

SEQ ID NO: 2081927 - DNA, 23 bp, Homo sapiens
actggtggcccgacagcctggca

SEQ ID NO: 2081928 - DNA, 18 bp, Homo sapiens
actggttcaagagacact

SEQ ID NO: 2081929 - DNA, 22 bp, Homo sapiens
actggtttatccacccacaaca

SEQ ID NO: 2081930 - DNA, 22 bp, Homo sapiens
actggtttctcagaatccaaag

SEQ ID NO: 2081931 - DNA, 23 bp, Homo sapiens
actggtttctcagaatccaaaga

SEQ ID NO: 2081932 - DNA, 17 bp, Homo sapiens
actggtttgaagaatgt

SEQ ID NO: 2081933 - DNA, 20 bp, Homo sapiens
actggtttgaagaatgttaa

SEQ ID NO: 2081934 - DNA, 16 bp, Homo sapiens
actgtaaaatgaaatt

SEQ ID NO: 2081935 - DNA, 14 bp, Homo sapiens
actgtaaacccctg

SEQ ID NO: 2081936 - DNA, 12 bp, Homo sapiens
actgtaaataca

SEQ ID NO: 2081937 - DNA, 18 bp, Homo sapiens
actgtaaatcacttgtaa

SEQ ID NO: 2081938 - DNA, 21 bp, Homo sapiens
actgtaaatcacttgtaaata

SEQ ID NO: 2081939 - DNA, 21 bp, Homo sapiens
actgtaagactcattccctag

SEQ ID NO: 2081940 - DNA, 17 bp, Homo sapiens
actgtaatcttaaaagt

SEQ ID NO: 2081941 - DNA, 20 bp, Homo sapiens
actgtaattggtgacaatgt

SEQ ID NO: 2081942 - DNA, 18 bp, Homo sapiens
actgtaattttgtttgta

SEQ ID NO: 2081943 - DNA, 20 bp, Homo sapiens
actgtaattttgtttgtaat

SEQ ID NO: 2081944 - DNA, 20 bp, Homo sapiens
actgtacatagatgtatcat

SEQ ID NO: 2081945 - DNA, 12 bp, Homo sapiens
actgtacatgtg

SEQ ID NO: 2081946 - DNA, 18 bp, Homo sapiens
actgtacttaataaattc

SEQ ID NO: 2081947 - DNA, 20 bp, Homo sapiens
actgtagaatgatttcatgc

SEQ ID NO: 2081948 - DNA, 21 bp, Homo sapiens
actgtaggcagggaaccttaa

SEQ ID NO: 2081949 - DNA, 14 bp, Homo sapiens
actgtatttgtatc

SEQ ID NO: 2081950 - DNA, 15 bp, Homo sapiens
actgtcaccctccac

SEQ ID NO: 2081951 - DNA, 13 bp, Homo sapiens
actgtcagagctg

SEQ ID NO: 2081952 - DNA, 23 bp, Homo sapiens
actttacaggaggttgtggatgc

SEQ ID NO: 2081953 - DNA, 12 bp, Homo sapiens
actttagctatg

SEQ ID NO: 2081954 - DNA, 14 bp, Homo sapiens
actttataaaagca

SEQ ID NO: 2081955 - DNA, 15 bp, Homo sapiens
actttatacagaact

SEQ ID NO: 2081956 - DNA, 13 bp, Homo sapiens
actttatcacatt

SEQ ID NO: 2081957 - DNA, 21 bp, Homo sapiens
actttatcacattatttgcat

SEQ ID NO: 2081958 - DNA, 19 bp, Homo sapiens
actttatccaatcctcagg

SEQ ID NO: 2081959 - DNA, 23 bp, Homo sapiens
actttatctaatacctctgtgtg

SEQ ID NO: 2081960 - DNA, 18 bp, Homo sapiens
actttcaggtactaaata

SEQ ID NO: 2081961 - DNA, 18 bp, Homo sapiens
actttcctacaaaatgga

SEQ ID NO: 2081962 - DNA, 14 bp, Homo sapiens
actttcgggagggt

SEQ ID NO: 2081963 - DNA, 17 bp, Homo sapiens
actttctacacctgttg

SEQ ID NO: 2081964 - DNA, 19 bp, Homo sapiens
actttctgttgccacaacc

SEQ ID NO: 2081965 - DNA, 22 bp, Homo sapiens
actttctttctcactaaatctt

SEQ ID NO: 2081966 - DNA, 19 bp, Homo sapiens
actttcttttctggaatgt

SEQ ID NO: 2081967 - DNA, 17 bp, Homo sapiens
actttgaagttagcttt

SEQ ID NO: 2081968 - DNA, 18 bp, Homo sapiens
actttgatctctgcttac

SEQ ID NO: 2081969 - DNA, 17 bp, Homo sapiens
actttggaatgactata

SEQ ID NO: 2081970 - DNA, 19 bp, Homo sapiens
actttgggaggccaaggtg

SEQ ID NO: 2081971 - DNA, 19 bp, Homo sapiens
actttgggaggctgaggcg

SEQ ID NO: 2081972 - DNA, 14 bp, Homo sapiens
actttgtgcctttg

SEQ ID NO: 2081973 - DNA, 21 bp, Homo sapiens
actttgttgccttatcttgaa

SEQ ID NO: 2081974 - DNA, 21 bp, Homo sapiens
acttttcagaattgaaggaga

SEQ ID NO: 2081975 - DNA, 12 bp, Homo sapiens
acttttcagtga

SEQ ID NO: 2081976 - DNA, 17 bp, Homo sapiens
acttttccatgtatcta

SEQ ID NO: 2081977 - DNA, 19 bp, Homo sapiens
acttttcctttgaatcctc

SEQ ID NO: 2081978 - DNA, 15 bp, Homo sapiens
acttttctaaagctc

SEQ ID NO: 2081979 - DNA, 21 bp, Homo sapiens
acttttggtttttatatttct

SEQ ID NO: 2081980 - DNA, 17 bp, Homo sapiens
acttttgtcttcctcac

SEQ ID NO: 2081981 - DNA, 18 bp, Homo sapiens
actttttagtcttttact

SEQ ID NO: 2081982 - DNA, 21 bp, Homo sapiens
actttttatactccatacata

SEQ ID NO: 2081983 - DNA, 17 bp, Homo sapiens
actttttctgagctttt

SEQ ID NO: 2081984 - DNA, 15 bp, Homo sapiens
acttttttagaatga

SEQ ID NO: 2081985 - DNA, 15 bp, Homo sapiens
acttttttatttaaa

SEQ ID NO: 2081986 - DNA, 23 bp, Homo sapiens
acttttttgctatccagctattt

SEQ ID NO: 2081987 - DNA, 14 bp, Homo sapiens
actttttttctgat

SEQ ID NO: 2081988 - DNA, 21 bp, Homo sapiens
acttttttttttttttttaaa

SEQ ID NO: 2081989 - DNA, 13 bp, Homo sapiens
agaaaaaataaat

SEQ ID NO: 2081990 - DNA, 14 bp, Homo sapiens
agaaaaaataaatg

SEQ ID NO: 2081991 - DNA, 16 bp, Homo sapiens
agaaaaaataaatgga

SEQ ID NO: 2081992 - DNA, 11 bp, Homo sapiens
agaaaaaatac

SEQ ID NO: 2081993 - DNA, 16 bp, Homo sapiens
agaaattcctgtagca

SEQ ID NO: 2081994 - DNA, 20 bp, Homo sapiens
agaaattcctgtagcatctt

SEQ ID NO: 2081995 - DNA, 23 bp, Homo sapiens
agaaattcctgtagcatcttctg

SEQ ID NO: 2081996 - DNA, 23 bp, Homo sapiens
agaaattctgtcatagaaagtgc

SEQ ID NO: 2081997 - DNA, 13 bp, Homo sapiens
agaaatttaaact

SEQ ID NO: 2081998 - DNA, 20 bp, Homo sapiens
agaaattttactgacagaaa

SEQ ID NO: 2081999 - DNA, 20 bp, Homo sapiens
agaacaaacacctccccagc

SEQ ID NO: 2082000 - DNA, 19 bp, Homo sapiens
agaacaaggtagtttttac

SEQ ID NO: 2082001 - DNA, 19 bp, Homo sapiens
agaacaagtcacagctgca

SEQ ID NO: 2082002 - DNA, 16 bp, Homo sapiens
agaacaatagctattg

SEQ ID NO: 2082003 - DNA, 19 bp, Homo sapiens
agaacaatagctattgcat

SEQ ID NO: 2082004 - DNA, 16 bp, Homo sapiens
agaacacccactggcc

SEQ ID NO: 2082005 - DNA, 18 bp, Homo sapiens
agaacacccactggccag

SEQ ID NO: 2082006 - DNA, 11 bp, Homo sapiens
agaacaccttt

SEQ ID NO: 2082007 - DNA, 18 bp, Homo sapiens
agaacagacgttaccaat

SEQ ID NO: 2082008 - DNA, 18 bp, Homo sapiens
agaacagaggcatttaaa

SEQ ID NO: 2082009 - DNA, 18 bp, Homo sapiens
agaacagcagactcagct

SEQ ID NO: 2082010 - DNA, 13 bp, Homo sapiens
agaacagcagagg

SEQ ID NO: 2082011 - DNA, 17 bp, Homo sapiens
agaacagtttgtacaga

SEQ ID NO: 2082012 - DNA, 14 bp, Homo sapiens
agaacataaagcaa

SEQ ID NO: 2082013 - DNA, 16 bp, Homo sapiens
agaacataaagcaaat

SEQ ID NO: 2082014 - DNA, 19 bp, Homo sapiens
agaacatagacagaagaaa

SEQ ID NO: 2082015 - DNA, 18 bp, Homo sapiens
agaacatccaaggagaaa

SEQ ID NO: 2082016 - DNA, 21 bp, Homo sapiens
agaacatgagtttatgggaat

SEQ ID NO: 2082017 - DNA, 17 bp, Homo sapiens
agaacatttacacattc

SEQ ID NO: 2082018 - DNA, 18 bp, Homo sapiens
agaacatttacacattct

SEQ ID NO: 2082019 - DNA, 21 bp, Homo sapiens
agaaccaagcttcagagccta

SEQ ID NO: 2082020 - DNA, 23 bp, Homo sapiens
agaaccaagcttcagagcctagc

SEQ ID NO: 2082021 - DNA, 13 bp, Homo sapiens
agaaccacactgt

SEQ ID NO: 2082022 - DNA, 17 bp, Homo sapiens
agaaccacttggctgct

SEQ ID NO: 2082023 - DNA, 19 bp, Homo sapiens
agaaccacttggctgctca

SEQ ID NO: 2082024 - DNA, 19 bp, Homo sapiens
agaaccagagggttgtact

SEQ ID NO: 2082025 - DNA, 12 bp, Homo sapiens
agaacctcaggc

SEQ ID NO: 2082026 - DNA, 22 bp, Homo sapiens
agaacctggccttcagtgtacc

SEQ ID NO: 2082027 - DNA, 13 bp, Homo sapiens
agaacggaagaag

SEQ ID NO: 2082028 - DNA, 22 bp, Homo sapiens
agaacgtattggtccagcttgc

SEQ ID NO: 2082029 - DNA, 18 bp, Homo sapiens
agaactagaacctggagg

SEQ ID NO: 2082030 - DNA, 21 bp, Homo sapiens
agaactccttattttgtatta

SEQ ID NO: 2082031 - DNA, 23 bp, Homo sapiens
agaactcgaagcccttccagtgg

SEQ ID NO: 2082032 - DNA, 18 bp, Homo sapiens
agaactgaacgtcctgca

SEQ ID NO: 2082033 - DNA, 20 bp, Homo sapiens
agaactgaggtcactgggtt

SEQ ID NO: 2082034 - DNA, 19 bp, Homo sapiens
agaactgtatgtcagacat

SEQ ID NO: 2082035 - DNA, 12 bp, Homo sapiens
agaacttaaaaa

SEQ ID NO: 2082036 - DNA, 19 bp, Homo sapiens
agaactttccatctgcttg

SEQ ID NO: 2082037 - DNA, 16 bp, Homo sapiens
agaactttgaaggaca

SEQ ID NO: 2082038 - DNA, 17 bp, Homo sapiens
agaagaaaaaattaaga

SEQ ID NO: 2082039 - DNA, 16 bp, Homo sapiens
agaagaaagaacggaa

SEQ ID NO: 2082040 - DNA, 16 bp, Homo sapiens
agaagaaagaggtgac

SEQ ID NO: 2082041 - DNA, 18 bp, Homo sapiens
agaagaaatgacattttg

SEQ ID NO: 2082042 - DNA, 13 bp, Homo sapiens
agaagaacatcca

SEQ ID NO: 2082043 - DNA, 13 bp, Homo sapiens
agaagaagctgag

SEQ ID NO: 2082044 - DNA, 15 bp, Homo sapiens
agaagaatataaata

SEQ ID NO: 2082045 - DNA, 15 bp, Homo sapiens
agaagaatattcagg

SEQ ID NO: 2082046 - DNA, 19 bp, Homo sapiens
agaagaatccgagtgtttg

SEQ ID NO: 2082047 - DNA, 20 bp, Homo sapiens
agaagaattgaacccaggag

SEQ ID NO: 2082048 - DNA, 23 bp, Homo sapiens
agaagaattttcagaccccagcg

SEQ ID NO: 2082049 - DNA, 13 bp, Homo sapiens
agaagacactgat

SEQ ID NO: 2082050 - DNA, 21 bp, Homo sapiens
agaagacactgatgggcaacc

SEQ ID NO: 2082051 - DNA, 20 bp, Homo sapiens
agaagacatggagactcctg

SEQ ID NO: 2082052 - DNA, 22 bp, Homo sapiens
agaagacatggagactcctgcc

SEQ ID NO: 2082053 - DNA, 22 bp, Homo sapiens
agaagaccaaagcattgcctgc

SEQ ID NO: 2082054 - DNA, 22 bp, Homo sapiens
agaagagagtccatatttcaat

SEQ ID NO: 2082055 - DNA, 17 bp, Homo sapiens
agaagagatcaggaaga

SEQ ID NO: 2082056 - DNA, 22 bp, Homo sapiens
agaagagatgggcttgttttct

SEQ ID NO: 2082057 - DNA, 13 bp, Homo sapiens
agaagagctgttc

SEQ ID NO: 2082058 - DNA, 20 bp, Homo sapiens
agaagagctgttcacagcca

SEQ ID NO: 2082059 - DNA, 16 bp, Homo sapiens
agaagagggcctgtgg

SEQ ID NO: 2082060 - DNA, 13 bp, Homo sapiens
agaagcaggttct

SEQ ID NO: 2082061 - DNA, 19 bp, Homo sapiens
agaagcattttgtaagttg

SEQ ID NO: 2082062 - DNA, 15 bp, Homo sapiens
agaagccctgctggg

SEQ ID NO: 2082063 - DNA, 16 bp, Homo sapiens
agaagccggctcttca

SEQ ID NO: 2082064 - DNA, 18 bp, Homo sapiens
agaagccgggaacagaca

SEQ ID NO: 2082065 - DNA, 19 bp, Homo sapiens
agaagcctttgggaagggg

SEQ ID NO: 2082066 - DNA, 18 bp, Homo sapiens
agaagcgctcatctggct

SEQ ID NO: 2082067 - DNA, 13 bp, Homo sapiens
agaagctcattta

SEQ ID NO: 2082068 - DNA, 15 bp, Homo sapiens
agaagctcccagatg

SEQ ID NO: 2082069 - DNA, 21 bp, Homo sapiens
agaagctgaggatcctcacag

SEQ ID NO: 2082070 - DNA, 13 bp, Homo sapiens
agaagctggagga

SEQ ID NO: 2082071 - DNA, 16 bp, Homo sapiens
agaagctggaggacta

SEQ ID NO: 2082072 - DNA, 14 bp, Homo sapiens
agaaggaaaaagaa

SEQ ID NO: 2082073 - DNA, 15 bp, Homo sapiens
agaaggaaggaggca

SEQ ID NO: 2082074 - DNA, 20 bp, Homo sapiens
agaaggaaggcagggaggag

SEQ ID NO: 2082075 - DNA, 20 bp, Homo sapiens
agaaggacacctccttcctc

SEQ ID NO: 2082076 - DNA, 15 bp, Homo sapiens
agaaggacattttct

SEQ ID NO: 2082077 - DNA, 15 bp, Homo sapiens
agaaggagaaggaag

SEQ ID NO: 2082078 - DNA, 21 bp, Homo sapiens
agaaggagggcagagccatgg

SEQ ID NO: 2082079 - DNA, 15 bp, Homo sapiens
agaaggatggcatct

SEQ ID NO: 2082080 - DNA, 20 bp, Homo sapiens
agaaggcccataccttctgg

SEQ ID NO: 2082081 - DNA, 22 bp, Homo sapiens
agaaggccgctgccccagcccc

SEQ ID NO: 2082082 - DNA, 16 bp, Homo sapiens
agaaggctggggccag

SEQ ID NO: 2082083 - DNA, 17 bp, Homo sapiens
agaaggctggggccagt

SEQ ID NO: 2082084 - DNA, 12 bp, Homo sapiens
agaagggaaatt

SEQ ID NO: 2082085 - DNA, 20 bp, Homo sapiens
agaagggaaattcacactgt

SEQ ID NO: 2082086 - DNA, 22 bp, Homo sapiens
agaagggaaattcacactgtgc

SEQ ID NO: 2082087 - DNA, 14 bp, Homo sapiens
agaagggagaagga

SEQ ID NO: 2082088 - DNA, 21 bp, Homo sapiens
agaagggagttgctcactcag

SEQ ID NO: 2082089 - DNA, 22 bp, Homo sapiens
agaagggagttgctcactcagg

SEQ ID NO: 2082090 - DNA, 16 bp, Homo sapiens
agaagggccagcccta

SEQ ID NO: 2082091 - DNA, 17 bp, Homo sapiens
agaagggccagccctac

SEQ ID NO: 2082092 - DNA, 21 bp, Homo sapiens
agaaggtccttaatgatccgt

SEQ ID NO: 2082093 - DNA, 22 bp, Homo sapiens
agaaggtttggtccagcctggt

SEQ ID NO: 2082094 - DNA, 15 bp, Homo sapiens
agaagtaaaagcaaa

SEQ ID NO: 2082095 - DNA, 22 bp, Homo sapiens
agaagtaaaagcaaaaaagaaa

SEQ ID NO: 2082096 - DNA, 18 bp, Homo sapiens
agaagtacgtttttgcat

SEQ ID NO: 2082097 - DNA, 14 bp, Homo sapiens
agaagtatccaatt

SEQ ID NO: 2082098 - DNA, 17 bp, Homo sapiens
agaagtatccaattatg

SEQ ID NO: 2082099 - DNA, 22 bp, Homo sapiens
agaagtatccaattatgtgaca

SEQ ID NO: 2082100 - DNA, 22 bp, Homo sapiens
agaagtcagcccgaatgcctgt

SEQ ID NO: 2082101 - DNA, 13 bp, Homo sapiens
agaagtcatgaag

SEQ ID NO: 2082102 - DNA, 13 bp, Homo sapiens
agaagtccctccc

SEQ ID NO: 2082103 - DNA, 18 bp, Homo sapiens
agaagtgagggctgggca

SEQ ID NO: 2082104 - DNA, 21 bp, Homo sapiens
agaagtgagggctgggcagct

SEQ ID NO: 2082105 - DNA, 17 bp, Homo sapiens
agaagtggaccaggaca

SEQ ID NO: 2082106 - DNA, 18 bp, Homo sapiens
agaagtggaccaggacag

SEQ ID NO: 2082107 - DNA, 23 bp, Homo sapiens
agaagtggaccaggacaggacca

SEQ ID NO: 2082108 - DNA, 12 bp, Homo sapiens
agaagtgtatat

SEQ ID NO: 2082109 - DNA, 19 bp, Homo sapiens
agaatcagtcttgcagctg

SEQ ID NO: 2082110 - DNA, 17 bp, Homo sapiens
agaatcataattttcaa

SEQ ID NO: 2082111 - DNA, 22 bp, Homo sapiens
agaatccacccatcctaccaat

SEQ ID NO: 2082112 - DNA, 18 bp, Homo sapiens
agaatcccactttctata

SEQ ID NO: 2082113 - DNA, 21 bp, Homo sapiens
agaatcctaggctccacccca

SEQ ID NO: 2082114 - DNA, 17 bp, Homo sapiens
agaatcgacctcactgt

SEQ ID NO: 2082115 - DNA, 19 bp, Homo sapiens
agaatctagataggtgctt

SEQ ID NO: 2082116 - DNA, 21 bp, Homo sapiens
agaatctagataggtgctttt

SEQ ID NO: 2082117 - DNA, 16 bp, Homo sapiens
agaatctgaagctatt

SEQ ID NO: 2082118 - DNA, 17 bp, Homo sapiens
agaatctgctgttgcca

SEQ ID NO: 2082119 - DNA, 19 bp, Homo sapiens
agaatctggctcctgtttc

SEQ ID NO: 2082120 - DNA, 13 bp, Homo sapiens
agaatctgtgtga

SEQ ID NO: 2082121 - DNA, 16 bp, Homo sapiens
agaatgaaaactcatt

SEQ ID NO: 2082122 - DNA, 16 bp, Homo sapiens
agaatgaagacctaaa

SEQ ID NO: 2082123 - DNA, 15 bp, Homo sapiens
agaatgagctggttt

SEQ ID NO: 2082124 - DNA, 21 bp, Homo sapiens
agaatgagggaaattgctatt

SEQ ID NO: 2082125 - DNA, 16 bp, Homo sapiens
agaatgatttttagat

SEQ ID NO: 2082126 - DNA, 17 bp, Homo sapiens
agaatgcccaactcttc

SEQ ID NO: 2082127 - DNA, 13 bp, Homo sapiens
agaatggcagctg

SEQ ID NO: 2082128 - DNA, 15 bp, Homo sapiens
agaatggcagctgga

SEQ ID NO: 2082129 - DNA, 15 bp, Homo sapiens
agaatgggtttactc

SEQ ID NO: 2082130 - DNA, 15 bp, Homo sapiens
agaatggtagcacta

SEQ ID NO: 2082131 - DNA, 21 bp, Homo sapiens
agaatggttgccttaaagaaa

SEQ ID NO: 2082132 - DNA, 12 bp, Homo sapiens
agaatgtaaagc

SEQ ID NO: 2082133 - DNA, 16 bp, Homo sapiens
agaatgtaaagcttgt

SEQ ID NO: 2082134 - DNA, 23 bp, Homo sapiens
agaatgttactttggaatgacta

SEQ ID NO: 2082135 - DNA, 15 bp, Homo sapiens
agaattatatctaat

SEQ ID NO: 2082136 - DNA, 17 bp, Homo sapiens
agaattatatctaattt

SEQ ID NO: 2082137 - DNA, 18 bp, Homo sapiens
agaattatatctaattta

SEQ ID NO: 2082138 - DNA, 22 bp, Homo sapiens
agaattatatctaatttataca

SEQ ID NO: 2082139 - DNA, 23 bp, Homo sapiens
agaattatatctaatttatacaa

SEQ ID NO: 2082140 - DNA, 14 bp, Homo sapiens
agaattatttttgt

SEQ ID NO: 2082141 - DNA, 16 bp, Homo sapiens
agaattatttttgtgt

SEQ ID NO: 2082142 - DNA, 15 bp, Homo sapiens
agaattcccagctgt

SEQ ID NO: 2082143 - DNA, 15 bp, Homo sapiens
agaattctagaaaat

SEQ ID NO: 2082144 - DNA, 13 bp, Homo sapiens
agaattctgctac

SEQ ID NO: 2082145 - DNA, 18 bp, Homo sapiens
agaattgaacccaggagg

SEQ ID NO: 2082146 - DNA, 14 bp, Homo sapiens
agaattgagtgttt

SEQ ID NO: 2082147 - DNA, 17 bp, Homo sapiens
agaattgagtgtttaaa

SEQ ID NO: 2082148 - DNA, 21 bp, Homo sapiens
agaattggagagtaaaaactg

SEQ ID NO: 2082149 - DNA, 15 bp, Homo sapiens
agaattgtatcattt

SEQ ID NO: 2082150 - DNA, 13 bp, Homo sapiens
agaatttattcaa

SEQ ID NO: 2082151 - DNA, 21 bp, Homo sapiens
agaatttctttgtcattcaag

SEQ ID NO: 2082152 - DNA, 15 bp, Homo sapiens
agaatttgtattttg

SEQ ID NO: 2082153 - DNA, 21 bp, Homo sapiens
agaattttaagtgctttgtaa

SEQ ID NO: 2082154 - DNA, 17 bp, Homo sapiens
agaattttagaagagat

SEQ ID NO: 2082155 - DNA, 22 bp, Homo sapiens
agaattttcctaaaaataagct

SEQ ID NO: 2082156 - DNA, 14 bp, Homo sapiens
agaatttttaatga

SEQ ID NO: 2082157 - DNA, 20 bp, Homo sapiens
agaatttttaatgacttttt

SEQ ID NO: 2082158 - DNA, 21 bp, Homo sapiens
agacaaaacttcctgtttgtg

SEQ ID NO: 2082159 - DNA, 19 bp, Homo sapiens
agacaaacacctcccagga

SEQ ID NO: 2082160 - DNA, 18 bp, Homo sapiens
agacaaaccactgtacat

SEQ ID NO: 2082161 - DNA, 21 bp, Homo sapiens
agacaaaccactgtacatata

SEQ ID NO: 2082162 - DNA, 12 bp, Homo sapiens
agacaaagcaaa

SEQ ID NO: 2082163 - DNA, 18 bp, Homo sapiens
agacaaaggttttcctct

SEQ ID NO: 2082164 - DNA, 15 bp, Homo sapiens
agacaacagaagtca

SEQ ID NO: 2082165 - DNA, 18 bp, Homo sapiens
agacaagaaatccctgtt

SEQ ID NO: 2082166 - DNA, 13 bp, Homo sapiens
agacaagagctgc

SEQ ID NO: 2082167 - DNA, 15 bp, Homo sapiens
agacaagccctggca

SEQ ID NO: 2082168 - DNA, 14 bp, Homo sapiens
agacaataaaacat

SEQ ID NO: 2082169 - DNA, 15 bp, Homo sapiens
agacaataaaacatt

SEQ ID NO: 2082170 - DNA, 18 bp, Homo sapiens
agacaatatgaacaaact

SEQ ID NO: 2082171 - DNA, 14 bp, Homo sapiens
agacaatccactct

SEQ ID NO: 2082172 - DNA, 12 bp, Homo sapiens
agacacagactg

SEQ ID NO: 2082173 - DNA, 22 bp, Homo sapiens
agacacagagtggagccctcag

SEQ ID NO: 2082174 - DNA, 13 bp, Homo sapiens
agacacaggcccg

SEQ ID NO: 2082175 - DNA, 16 bp, Homo sapiens
agacacaggcccggct

SEQ ID NO: 2082176 - DNA, 19 bp, Homo sapiens
agacacaggcccggctcca

SEQ ID NO: 2082177 - DNA, 20 bp, Homo sapiens
agacacaggcccggctccag

SEQ ID NO: 2082178 - DNA, 21 bp, Homo sapiens
agacacaggcccggctccagg

SEQ ID NO: 2082179 - DNA, 23 bp, Homo sapiens
agacacaggcccggctccaggct

SEQ ID NO: 2082180 - DNA, 23 bp, Homo sapiens
agacacattcctagttccccgtg

SEQ ID NO: 2082181 - DNA, 21 bp, Homo sapiens
agacaccatcttttgtgagat

SEQ ID NO: 2082182 - DNA, 20 bp, Homo sapiens
agacacctgcacctcccccc

SEQ ID NO: 2082183 - DNA, 19 bp, Homo sapiens
agacaccttgacagggcac

SEQ ID NO: 2082184 - DNA, 14 bp, Homo sapiens
agacaccttttgta

SEQ ID NO: 2082185 - DNA, 13 bp, Homo sapiens
agacactgcttgg

SEQ ID NO: 2082186 - DNA, 12 bp, Homo sapiens
agacactggttt

SEQ ID NO: 2082187 - DNA, 16 bp, Homo sapiens
agacagaaacagagag

SEQ ID NO: 2082188 - DNA, 17 bp, Homo sapiens
agacagaaacagagaga

SEQ ID NO: 2082189 - DNA, 12 bp, Homo sapiens
agacagaagaaa

SEQ ID NO: 2082190 - DNA, 15 bp, Homo sapiens
agacagaagaaacaa

SEQ ID NO: 2082191 - DNA, 20 bp, Homo sapiens
agacagaccccttggctttt

SEQ ID NO: 2082192 - DNA, 14 bp, Homo sapiens
agacagagaaatgt

SEQ ID NO: 2082193 - DNA, 19 bp, Homo sapiens
agacagagaaatgtgaagg

SEQ ID NO: 2082194 - DNA, 21 bp, Homo sapiens
agacagagaaatgtgaagggt

SEQ ID NO: 2082195 - DNA, 20 bp, Homo sapiens
agacagagcccccaagcctc

SEQ ID NO: 2082196 - DNA, 11 bp, Homo sapiens
agacagagtct

SEQ ID NO: 2082197 - DNA, 19 bp, Homo sapiens
agacagagtctcactgttg

SEQ ID NO: 2082198 - DNA, 23 bp, Homo sapiens
agacagagtctcactgttgccca

SEQ ID NO: 2082199 - DNA, 17 bp, Homo sapiens
agacagcacttggctcc

SEQ ID NO: 2082200 - DNA, 12 bp, Homo sapiens
agacagcagctc

SEQ ID NO: 2082201 - DNA, 19 bp, Homo sapiens
agacagctgacagatacat

SEQ ID NO: 2082202 - DNA, 17 bp, Homo sapiens
agacatttttatttagt

SEQ ID NO: 2082203 - DNA, 17 bp, Homo sapiens
agaccaaggcgggagca

SEQ ID NO: 2082204 - DNA, 12 bp, Homo sapiens
agaccacctctc

SEQ ID NO: 2082205 - DNA, 12 bp, Homo sapiens
agaccacctgcc

SEQ ID NO: 2082206 - DNA, 13 bp, Homo sapiens
agaccacctgcca

SEQ ID NO: 2082207 - DNA, 20 bp, Homo sapiens
agaccacctgccagccatca

SEQ ID NO: 2082208 - DNA, 21 bp, Homo sapiens
agaccacctgcttctgaactc

SEQ ID NO: 2082209 - DNA, 18 bp, Homo sapiens
agaccactgtcctggctg

SEQ ID NO: 2082210 - DNA, 17 bp, Homo sapiens
agaccagactgtggaga

SEQ ID NO: 2082211 - DNA, 12 bp, Homo sapiens
agaccagcctgg

SEQ ID NO: 2082212 - DNA, 14 bp, Homo sapiens
agaccagcctggcc

SEQ ID NO: 2082213 - DNA, 11 bp, Homo sapiens
agaccagctca

SEQ ID NO: 2082214 - DNA, 13 bp, Homo sapiens
agaccagctcaga

SEQ ID NO: 2082215 - DNA, 14 bp, Homo sapiens
agaccagctcagag

SEQ ID NO: 2082216 - DNA, 20 bp, Homo sapiens
agaccagctcagaggcccag

SEQ ID NO: 2082217 - DNA, 13 bp, Homo sapiens
agaccagtactgg

SEQ ID NO: 2082218 - DNA, 19 bp, Homo sapiens
agaccagttgggagcactg

SEQ ID NO: 2082219 - DNA, 20 bp, Homo sapiens
agaccagttgggagcactgg

SEQ ID NO: 2082220 - DNA, 13 bp, Homo sapiens
agaccataatgtt

SEQ ID NO: 2082221 - DNA, 14 bp, Homo sapiens
agaccatcctggcc

SEQ ID NO: 2082222 - DNA, 15 bp, Homo sapiens
agaccatttaacatg

SEQ ID NO: 2082223 - DNA, 18 bp, Homo sapiens
agaccatttaacatgcaa

SEQ ID NO: 2082224 - DNA, 13 bp, Homo sapiens
agacccagatctc

SEQ ID NO: 2082225 - DNA, 13 bp, Homo sapiens
agacccagcagga

SEQ ID NO: 2082226 - DNA, 20 bp, Homo sapiens
agacccagcaggaagccagg

SEQ ID NO: 2082227 - DNA, 22 bp, Homo sapiens
agacccagtgtaaagaataaat

SEQ ID NO: 2082228 - DNA, 23 bp, Homo sapiens
agacccagtgtaaagaataaatg

SEQ ID NO: 2082229 - DNA, 13 bp, Homo sapiens
agaccccatctct

SEQ ID NO: 2082230 - DNA, 23 bp, Homo sapiens
agacccccccccccaacagaaca

SEQ ID NO: 2082231 - DNA, 21 bp, Homo sapiens
agacccctggcttttcactgc

SEQ ID NO: 2082232 - DNA, 16 bp, Homo sapiens
agacccctgtggcaga

SEQ ID NO: 2082233 - DNA, 18 bp, Homo sapiens
agaccccttcctttcctc

SEQ ID NO: 2082234 - DNA, 19 bp, Homo sapiens
agaccccttcctttcctct

SEQ ID NO: 2082235 - DNA, 21 bp, Homo sapiens
agaccctcactgctggggagt

SEQ ID NO: 2082236 - DNA, 11 bp, Homo sapiens
agaccctgaga

SEQ ID NO: 2082237 - DNA, 13 bp, Homo sapiens
agaccctgagact

SEQ ID NO: 2082238 - DNA, 18 bp, Homo sapiens
agaccctgagactccaga

SEQ ID NO: 2082239 - DNA, 18 bp, Homo sapiens
agaccctgcctgagccca

SEQ ID NO: 2082240 - DNA, 22 bp, Homo sapiens
agaccctggaattcagcaccct

SEQ ID NO: 2082241 - DNA, 13 bp, Homo sapiens
agaccctgtctct

SEQ ID NO: 2082242 - DNA, 16 bp, Homo sapiens
agacccttgcattaga

SEQ ID NO: 2082243 - DNA, 19 bp, Homo sapiens
agaccgcttcacccctgca

SEQ ID NO: 2082244 - DNA, 21 bp, Homo sapiens
agaccgcttcacccctgcact

SEQ ID NO: 2082245 - DNA, 15 bp, Homo sapiens
agaccgggggccaga

SEQ ID NO: 2082246 - DNA, 20 bp, Homo sapiens
agaccgggggccagacacag

SEQ ID NO: 2082247 - DNA, 23 bp, Homo sapiens
agacctaaatgacctcagcaaat

SEQ ID NO: 2082248 - DNA, 14 bp, Homo sapiens
agacctagacctgg

SEQ ID NO: 2082249 - DNA, 17 bp, Homo sapiens
agacctagacctgggcc

SEQ ID NO: 2082250 - DNA, 14 bp, Homo sapiens
agacctcagccatg

SEQ ID NO: 2082251 - DNA, 18 bp, Homo sapiens
agacctcagccatgagga

SEQ ID NO: 2082252 - DNA, 15 bp, Homo sapiens
agacctcagcctgtg

SEQ ID NO: 2082253 - DNA, 13 bp, Homo sapiens
agacctctgatcc

SEQ ID NO: 2082254 - DNA, 13 bp, Homo sapiens
agacctgaagaat

SEQ ID NO: 2082255 - DNA, 22 bp, Homo sapiens
agacctgacaccgtccctcagt

SEQ ID NO: 2082256 - DNA, 16 bp, Homo sapiens
agacctgggccaaaag

SEQ ID NO: 2082257 - DNA, 13 bp, Homo sapiens
agacctgtaatca

SEQ ID NO: 2082258 - DNA, 18 bp, Homo sapiens
agaccttctccaaatgag

SEQ ID NO: 2082259 - DNA, 17 bp, Homo sapiens
agaccttgcgaccatgt

SEQ ID NO: 2082260 - DNA, 16 bp, Homo sapiens
agaccttttctctccc

SEQ ID NO: 2082261 - DNA, 17 bp, Homo sapiens
agaccttttctctccca

SEQ ID NO: 2082262 - DNA, 19 bp, Homo sapiens
agaccttttctctcccata

SEQ ID NO: 2082263 - DNA, 21 bp, Homo sapiens
agacgcagccctgggggccag

SEQ ID NO: 2082264 - DNA, 23 bp, Homo sapiens
agacgcagccctgggggccagct

SEQ ID NO: 2082265 - DNA, 19 bp, Homo sapiens
agacggagtcccaccttgg

SEQ ID NO: 2082266 - DNA, 15 bp, Homo sapiens
agacggtgctcgctt

SEQ ID NO: 2082267 - DNA, 23 bp, Homo sapiens
agacggtgctcgcttctcctcca

SEQ ID NO: 2082268 - DNA, 16 bp, Homo sapiens
agacgtatgcttattt

SEQ ID NO: 2082269 - DNA, 18 bp, Homo sapiens
agacgtatgcttatttta

SEQ ID NO: 2082270 - DNA, 17 bp, Homo sapiens
agacgtcctggaatgaa

SEQ ID NO: 2082271 - DNA, 17 bp, Homo sapiens
agacgtgaatgtctcag

SEQ ID NO: 2082272 - DNA, 16 bp, Homo sapiens
agactaatagagacac

SEQ ID NO: 2082273 - DNA, 20 bp, Homo sapiens
agactaatagagacacagag

SEQ ID NO: 2082274 - DNA, 14 bp, Homo sapiens
agactaattaaaat

SEQ ID NO: 2082275 - DNA, 20 bp, Homo sapiens
agactaattaaaatctggaa

SEQ ID NO: 2082276 - DNA, 15 bp, Homo sapiens
agactaatttaaaaa

SEQ ID NO: 2082277 - DNA, 20 bp, Homo sapiens
agactatatacatgtgtgta

SEQ ID NO: 2082278 - DNA, 21 bp, Homo sapiens
agactatatacatgtgtgtat

SEQ ID NO: 2082279 - DNA, 15 bp, Homo sapiens
agactattcaaacag

SEQ ID NO: 2082280 - DNA, 20 bp, Homo sapiens
agactattcaaacagtctca

SEQ ID NO: 2082281 - DNA, 15 bp, Homo sapiens
agactcacctctgcc

SEQ ID NO: 2082282 - DNA, 16 bp, Homo sapiens
agactcacctctgcct

SEQ ID NO: 2082283 - DNA, 19 bp, Homo sapiens
agactcacctctgcctcaa

SEQ ID NO: 2082284 - DNA, 11 bp, Homo sapiens
agactcagctc

SEQ ID NO: 2082285 - DNA, 15 bp, Homo sapiens
agactcagctccaga

SEQ ID NO: 2082286 - DNA, 20 bp, Homo sapiens
agactcagctctgacattct

SEQ ID NO: 2082287 - DNA, 18 bp, Homo sapiens
agactcagggccccagca

SEQ ID NO: 2082288 - DNA, 20 bp, Homo sapiens
agactcagggccccagcact

SEQ ID NO: 2082289 - DNA, 13 bp, Homo sapiens
agactcagtgttc

SEQ ID NO: 2082290 - DNA, 12 bp, Homo sapiens
agactcagtttg

SEQ ID NO: 2082291 - DNA, 17 bp, Homo sapiens
agactcattcttctgta

SEQ ID NO: 2082292 - DNA, 12 bp, Homo sapiens
agactccaaaga

SEQ ID NO: 2082293 - DNA, 19 bp, Homo sapiens
agactccagaatctgctgt

SEQ ID NO: 2082294 - DNA, 22 bp, Homo sapiens
agactccagaatctgctgttgc

SEQ ID NO: 2082295 - DNA, 15 bp, Homo sapiens
agactcctgcttctt

SEQ ID NO: 2082296 - DNA, 16 bp, Homo sapiens
agactcctttcctctg

SEQ ID NO: 2082297 - DNA, 13 bp, Homo sapiens
agactctaaatat

SEQ ID NO: 2082298 - DNA, 19 bp, Homo sapiens
agactctacagaggccatg

SEQ ID NO: 2082299 - DNA, 15 bp, Homo sapiens
agactctggaagccc

SEQ ID NO: 2082300 - DNA, 21 bp, Homo sapiens
agactctgggtccctcggagc

SEQ ID NO: 2082301 - DNA, 17 bp, Homo sapiens
agactgaaagcagcagc

SEQ ID NO: 2082302 - DNA, 17 bp, Homo sapiens
agactggaagcacagct

SEQ ID NO: 2082303 - DNA, 15 bp, Homo sapiens
agactggacagcttg

SEQ ID NO: 2082304 - DNA, 14 bp, Homo sapiens
agactggagcatct

SEQ ID NO: 2082305 - DNA, 15 bp, Homo sapiens
agactggagcatctg

SEQ ID NO: 2082306 - DNA, 16 bp, Homo sapiens
agactggagtgaggct

SEQ ID NO: 2082307 - DNA, 19 bp, Homo sapiens
agactggagtgaggcttcc

SEQ ID NO: 2082308 - DNA, 20 bp, Homo sapiens
agactggcacagttttctga

SEQ ID NO: 2082309 - DNA, 16 bp, Homo sapiens
agactgggctagggag

SEQ ID NO: 2082310 - DNA, 18 bp, Homo sapiens
agactggtcctgtgtgca

SEQ ID NO: 2082311 - DNA, 11 bp, Homo sapiens
agactgtggct

SEQ ID NO: 2082312 - DNA, 18 bp, Homo sapiens
agactgttaaatgaaacc

SEQ ID NO: 2082313 - DNA, 15 bp, Homo sapiens
agacttaagaaagct

SEQ ID NO: 2082314 - DNA, 16 bp, Homo sapiens
agacttacttattctt

SEQ ID NO: 2082315 - DNA, 19 bp, Homo sapiens
agacttagtatattttctt

SEQ ID NO: 2082316 - DNA, 15 bp, Homo sapiens
agacttcacactgca

SEQ ID NO: 2082317 - DNA, 14 bp, Homo sapiens
agacttcaggttgt

SEQ ID NO: 2082318 - DNA, 16 bp, Homo sapiens
agacttcagtcctggt

SEQ ID NO: 2082319 - DNA, 20 bp, Homo sapiens
agacttccaaacctgacaga

SEQ ID NO: 2082320 - DNA, 19 bp, Homo sapiens
agacttccctgaatgtatt

SEQ ID NO: 2082321 - DNA, 17 bp, Homo sapiens
agacttctctttcttat

SEQ ID NO: 2082322 - DNA, 19 bp, Homo sapiens
agacttctctttgcctcaa

SEQ ID NO: 2082323 - DNA, 20 bp, Homo sapiens
agacttctctttgcctcaaa

SEQ ID NO: 2082324 - DNA, 16 bp, Homo sapiens
agacttctggaaggct

SEQ ID NO: 2082325 - DNA, 21 bp, Homo sapiens
agacttctggaaggctggctg

SEQ ID NO: 2082326 - DNA, 22 bp, Homo sapiens
agacttctggaaggctggctga

SEQ ID NO: 2082327 - DNA, 19 bp, Homo sapiens
agacttgacaacatcccac

SEQ ID NO: 2082328 - DNA, 20 bp, Homo sapiens
agacttgacaacatcccaca

SEQ ID NO: 2082329 - DNA, 15 bp, Homo sapiens
agacttgacagtgga

SEQ ID NO: 2082330 - DNA, 19 bp, Homo sapiens
agacttggcaacagaagca

SEQ ID NO: 2082331 - DNA, 18 bp, Homo sapiens
agacttgtatgaaagatg

SEQ ID NO: 2082332 - DNA, 10 bp, Homo sapiens
agactttaaa

SEQ ID NO: 2082333 - DNA, 14 bp, Homo sapiens
agactttaaagaat

SEQ ID NO: 2082334 - DNA, 17 bp, Homo sapiens
agactttctacacctgt

SEQ ID NO: 2082335 - DNA, 18 bp, Homo sapiens
agacttttaatcagacaa

SEQ ID NO: 2082336 - DNA, 18 bp, Homo sapiens
agacttttatcaaaatcc

SEQ ID NO: 2082337 - DNA, 13 bp, Homo sapiens
agagaaaaagaaa

SEQ ID NO: 2082338 - DNA, 20 bp, Homo sapiens
agagaaaacttatttgagtg

SEQ ID NO: 2082339 - DNA, 18 bp, Homo sapiens
agagaaacatttatggaa

SEQ ID NO: 2082340 - DNA, 23 bp, Homo sapiens
agagaaagaaagggaaactggct

SEQ ID NO: 2082341 - DNA, 16 bp, Homo sapiens
agagaaagaagagaca

SEQ ID NO: 2082342 - DNA, 18 bp, Homo sapiens
agagaaagtacttctcca

SEQ ID NO: 2082343 - DNA, 17 bp, Homo sapiens
agagaaagtgacctatt

SEQ ID NO: 2082344 - DNA, 13 bp, Homo sapiens
agagaaatggcaa

SEQ ID NO: 2082345 - DNA, 18 bp, Homo sapiens
agagaaatgtgaagggtg

SEQ ID NO: 2082346 - DNA, 16 bp, Homo sapiens
agagaacatttctaga

SEQ ID NO: 2082347 - DNA, 20 bp, Homo sapiens
agagaagctaaaacctgagc

SEQ ID NO: 2082348 - DNA, 17 bp, Homo sapiens
agagaagctcatttagt

SEQ ID NO: 2082349 - DNA, 16 bp, Homo sapiens
agagaagctgagaaga

SEQ ID NO: 2082350 - DNA, 14 bp, Homo sapiens
agagaaggagatca

SEQ ID NO: 2082351 - DNA, 17 bp, Homo sapiens
agagaaggagatcaggg

SEQ ID NO: 2082352 - DNA, 13 bp, Homo sapiens
agagaaggagcag

SEQ ID NO: 2082353 - DNA, 22 bp, Homo sapiens
agagaaggcccataccttctgg

SEQ ID NO: 2082354 - DNA, 14 bp, Homo sapiens
agagaaggcttcct

SEQ ID NO: 2082355 - DNA, 15 bp, Homo sapiens
agagaaggcttcctc

SEQ ID NO: 2082356 - DNA, 19 bp, Homo sapiens
agagaagtcagttggagaa

SEQ ID NO: 2082357 - DNA, 22 bp, Homo sapiens
agagaagtcagttggagaaaat

SEQ ID NO: 2082358 - DNA, 15 bp, Homo sapiens
agagaatcagggcag

SEQ ID NO: 2082359 - DNA, 19 bp, Homo sapiens
agagaatctgaagctattg

SEQ ID NO: 2082360 - DNA, 22 bp, Homo sapiens
agagaatctgaagctattgatg

SEQ ID NO: 2082361 - DNA, 16 bp, Homo sapiens
agagaattcactttac

SEQ ID NO: 2082362 - DNA, 20 bp, Homo sapiens
agagacaaacacctcccagg

SEQ ID NO: 2082363 - DNA, 15 bp, Homo sapiens
agagacaataaaaca

SEQ ID NO: 2082364 - DNA, 17 bp, Homo sapiens
agagacaataaaacatt

SEQ ID NO: 2082365 - DNA, 16 bp, Homo sapiens
agagacacctgcacct

SEQ ID NO: 2082366 - DNA, 19 bp, Homo sapiens
agagacacctgcacctccc

SEQ ID NO: 2082367 - DNA, 20 bp, Homo sapiens
agagacactcccagggacaa

SEQ ID NO: 2082368 - DNA, 21 bp, Homo sapiens
agagacagaaacagagagaga

SEQ ID NO: 2082369 - DNA, 15 bp, Homo sapiens
agagacagagagaga

SEQ ID NO: 2082370 - DNA, 21 bp, Homo sapiens
agagacaggaaaatcctctgg

SEQ ID NO: 2082371 - DNA, 14 bp, Homo sapiens
agagacaggagggc

SEQ ID NO: 2082372 - DNA, 15 bp, Homo sapiens
agagacaggagggca

SEQ ID NO: 2082373 - DNA, 15 bp, Homo sapiens
agagacaggcccaag

SEQ ID NO: 2082374 - DNA, 22 bp, Homo sapiens
agagacagttatttatagtcat

SEQ ID NO: 2082375 - DNA, 23 bp, Homo sapiens
agagacattaactcattagactg

SEQ ID NO: 2082376 - DNA, 16 bp, Homo sapiens
agagacccaaggagga

SEQ ID NO: 2082377 - DNA, 19 bp, Homo sapiens
agagaccccttcctttcct

SEQ ID NO: 2082378 - DNA, 22 bp, Homo sapiens
agagaccctcactgctggggag

SEQ ID NO: 2082379 - DNA, 15 bp, Homo sapiens
agagacgcagccctg

SEQ ID NO: 2082380 - DNA, 15 bp, Homo sapiens
agagactcaaagaga

SEQ ID NO: 2082381 - DNA, 19 bp, Homo sapiens
agagactcaaagagactcc

SEQ ID NO: 2082382 - DNA, 20 bp, Homo sapiens
agagactcagggccccagca

SEQ ID NO: 2082383 - DNA, 18 bp, Homo sapiens
agagactctggaagcccc

SEQ ID NO: 2082384 - DNA, 22 bp, Homo sapiens
agagactctggcctccacagtt

SEQ ID NO: 2082385 - DNA, 13 bp, Homo sapiens
agagactgaaagc

SEQ ID NO: 2082386 - DNA, 16 bp, Homo sapiens
agagactgaaagcagc

SEQ ID NO: 2082387 - DNA, 23 bp, Homo sapiens
agagactgaaagcagcagctagg

SEQ ID NO: 2082388 - DNA, 14 bp, Homo sapiens
agagactggagcat

SEQ ID NO: 2082389 - DNA, 17 bp, Homo sapiens
agagactggagcatctg

SEQ ID NO: 2082390 - DNA, 19 bp, Homo sapiens
agagacttttaatcagaca

SEQ ID NO: 2082391 - DNA, 21 bp, Homo sapiens
agagagaaaacttatttgagt

SEQ ID NO: 2082392 - DNA, 21 bp, Homo sapiens
agagagaaagaagtaggcatg

SEQ ID NO: 2082393 - DNA, 13 bp, Homo sapiens
agagagacagaga

SEQ ID NO: 2082394 - DNA, 21 bp, Homo sapiens
agagagacagagacagagaga

SEQ ID NO: 2082395 - DNA, 17 bp, Homo sapiens
agagagactcaaagaga

SEQ ID NO: 2082396 - DNA, 15 bp, Homo sapiens
agagagagagagagg

SEQ ID NO: 2082397 - DNA, 12 bp, Homo sapiens
agagagagaggt

SEQ ID NO: 2082398 - DNA, 15 bp, Homo sapiens
agagagaggttctgg

SEQ ID NO: 2082399 - DNA, 14 bp, Homo sapiens
agagagagtgtttg

SEQ ID NO: 2082400 - DNA, 14 bp, Homo sapiens
agagaggaatcaga

SEQ ID NO: 2082401 - DNA, 13 bp, Homo sapiens
agagaggagcacc

SEQ ID NO: 2082402 - DNA, 17 bp, Homo sapiens
agagaggcacctgctgg

SEQ ID NO: 2082403 - DNA, 11 bp, Homo sapiens
agagaggcatg

SEQ ID NO: 2082404 - DNA, 23 bp, Homo sapiens
agagaggcgcgtctgccccaccc

SEQ ID NO: 2082405 - DNA, 20 bp, Homo sapiens
agagagggccatgcaattca

SEQ ID NO: 2082406 - DNA, 13 bp, Homo sapiens
agagagggcccag

SEQ ID NO: 2082407 - DNA, 13 bp, Homo sapiens
agtggacattcaa

SEQ ID NO: 2082408 - DNA, 13 bp, Homo sapiens
agtggaccaggac

SEQ ID NO: 2082409 - DNA, 18 bp, Homo sapiens
agtggactgaatgtgcct

SEQ ID NO: 2082410 - DNA, 22 bp, Homo sapiens
agtggactggcctcaaagcaag

SEQ ID NO: 2082411 - DNA, 14 bp, Homo sapiens
agtggagaaatatt

SEQ ID NO: 2082412 - DNA, 18 bp, Homo sapiens
agtggagagtgttcctgt

SEQ ID NO: 2082413 - DNA, 13 bp, Homo sapiens
agtggagcttttg

SEQ ID NO: 2082414 - DNA, 14 bp, Homo sapiens
agtggagtctgagt

SEQ ID NO: 2082415 - DNA, 18 bp, Homo sapiens
agtggagtctgagtctga

SEQ ID NO: 2082416 - DNA, 23 bp, Homo sapiens
agtggagtctgagtctgagtcct

SEQ ID NO: 2082417 - DNA, 12 bp, Homo sapiens
agtggatctcaa

SEQ ID NO: 2082418 - DNA, 18 bp, Homo sapiens
agtggatctccaaggacc

SEQ ID NO: 2082419 - DNA, 20 bp, Homo sapiens
agtggatggaggagaaataa

SEQ ID NO: 2082420 - DNA, 16 bp, Homo sapiens
agtggattttcctgaa

SEQ ID NO: 2082421 - DNA, 15 bp, Homo sapiens
agtggcacggagaga

SEQ ID NO: 2082422 - DNA, 23 bp, Homo sapiens
agtggcagccatgcctcatgcca

SEQ ID NO: 2082423 - DNA, 12 bp, Homo sapiens
agtggcagctgc

SEQ ID NO: 2082424 - DNA, 15 bp, Homo sapiens
agtggcccagaattg

SEQ ID NO: 2082425 - DNA, 18 bp, Homo sapiens
agtggcgagaggagagga

SEQ ID NO: 2082426 - DNA, 24 bp, Homo sapiens
agtggcttgtgattctgggatgga

SEQ ID NO: 2082427 - DNA, 21 bp, Homo sapiens
agtggcttttttcctcctgtg

SEQ ID NO: 2082428 - DNA, 18 bp, Homo sapiens
agtgggaactctgacaag

SEQ ID NO: 2082429 - DNA, 15 bp, Homo sapiens
agtgggacaaaccag

SEQ ID NO: 2082430 - DNA, 21 bp, Homo sapiens
agtgggacccatagatcttct

SEQ ID NO: 2082431 - DNA, 23 bp, Homo sapiens
agtgggacccatagatcttctga

SEQ ID NO: 2082432 - DNA, 14 bp, Homo sapiens
agtgggagaaaaca

SEQ ID NO: 2082433 - DNA, 15 bp, Homo sapiens
agtgggagctgcctg

SEQ ID NO: 2082434 - DNA, 22 bp, Homo sapiens
agtgggagggtaccagcagaaa

SEQ ID NO: 2082435 - DNA, 13 bp, Homo sapiens
agtgggccaggac

SEQ ID NO: 2082436 - DNA, 15 bp, Homo sapiens
agtgggctgcctggg

SEQ ID NO: 2082437 - DNA, 17 bp, Homo sapiens
agtggggctaaatgaag

SEQ ID NO: 2082438 - DNA, 19 bp, Homo sapiens
agtgggggccgctggccca

SEQ ID NO: 2082439 - DNA, 22 bp, Homo sapiens
agtggggtctccctctcctgcc

SEQ ID NO: 2082440 - DNA, 23 bp, Homo sapiens
agtggggtctccctctcctgcct

SEQ ID NO: 2082441 - DNA, 19 bp, Homo sapiens
agtggggttgcaaccactg

SEQ ID NO: 2082442 - DNA, 14 bp, Homo sapiens
agtgggtggcacct

SEQ ID NO: 2082443 - DNA, 22 bp, Homo sapiens
agtgggttcactagagctggga

SEQ ID NO: 2082444 - DNA, 22 bp, Homo sapiens
agtggtcgcttactttgagtga

SEQ ID NO: 2082445 - DNA, 14 bp, Homo sapiens
agtggttgttgcca

SEQ ID NO: 2082446 - DNA, 22 bp, Homo sapiens
agtggtttgatggtgacttcct

SEQ ID NO: 2082447 - DNA, 17 bp, Homo sapiens
agtgtaaagaataaatg

SEQ ID NO: 2082448 - DNA, 19 bp, Homo sapiens
agtgtaaagaataaatgaa

SEQ ID NO: 2082449 - DNA, 21 bp, Homo sapiens
agtgtaaatcctttttcttta

SEQ ID NO: 2082450 - DNA, 19 bp, Homo sapiens
agtgtaacactgcaagaag

SEQ ID NO: 2082451 - DNA, 15 bp, Homo sapiens
agtgtaataatatga

SEQ ID NO: 2082452 - DNA, 15 bp, Homo sapiens
agtgtactgctttca

SEQ ID NO: 2082453 - DNA, 16 bp, Homo sapiens
agtgtactgctttcaa

SEQ ID NO: 2082454 - DNA, 19 bp, Homo sapiens
agtgtagcatcctaaagat

SEQ ID NO: 2082455 - DNA, 13 bp, Homo sapiens
agtgtagccttgc

SEQ ID NO: 2082456 - DNA, 18 bp, Homo sapiens
agtgtccccaaagactac

SEQ ID NO: 2082457 - DNA, 13 bp, Homo sapiens
agtgtcccctcca

SEQ ID NO: 2082458 - DNA, 14 bp, Homo sapiens
agtgtctaaaaaca

SEQ ID NO: 2082459 - DNA, 16 bp, Homo sapiens
agtgtctggcacacag

SEQ ID NO: 2082460 - DNA, 17 bp, Homo sapiens
agtgtcttaattaaaag

SEQ ID NO: 2082461 - DNA, 15 bp, Homo sapiens
agtgtcttccataat

SEQ ID NO: 2082462 - DNA, 19 bp, Homo sapiens
agtgtcttcctagtatatt

SEQ ID NO: 2082463 - DNA, 17 bp, Homo sapiens
agtgtgaccaaaagtta

SEQ ID NO: 2082464 - DNA, 14 bp, Homo sapiens
agtgtgaccaggca

SEQ ID NO: 2082465 - DNA, 21 bp, Homo sapiens
agtgtgagcagtgagttacag

SEQ ID NO: 2082466 - DNA, 14 bp, Homo sapiens
agtgtgagtggcag

SEQ ID NO: 2082467 - DNA, 15 bp, Homo sapiens
agtgtgagtggcagc

SEQ ID NO: 2082468 - DNA, 17 bp, Homo sapiens
agtgtgagtggcagcca

SEQ ID NO: 2082469 - DNA, 20 bp, Homo sapiens
agtgtgagtggcagccatgc

SEQ ID NO: 2082470 - DNA, 22 bp, Homo sapiens
agtgtgcacccctccccattca

SEQ ID NO: 2082471 - DNA, 20 bp, Homo sapiens
agtgtgggagtgcagagaaa

SEQ ID NO: 2082472 - DNA, 11 bp, Homo sapiens
agtgtgtaaag

SEQ ID NO: 2082473 - DNA, 18 bp, Homo sapiens
agtgtgtgtgcatgtgtg

SEQ ID NO: 2082474 - DNA, 20 bp, Homo sapiens
agtgtgtgtgcatgtgtgtg

SEQ ID NO: 2082475 - DNA, 23 bp, Homo sapiens
agtgtgtgtgtctgttgagtgca

SEQ ID NO: 2082476 - DNA, 17 bp, Homo sapiens
agtgtgttgtctgtgca

SEQ ID NO: 2082477 - DNA, 20 bp, Homo sapiens
agtgtgttgtctgtgcagct

SEQ ID NO: 2082478 - DNA, 20 bp, Homo sapiens
agtgtgtttccttcagtgca

SEQ ID NO: 2082479 - DNA, 23 bp, Homo sapiens
agtgttatcagtcataactaaat

SEQ ID NO: 2082480 - DNA, 17 bp, Homo sapiens
agtgttattatttggca

SEQ ID NO: 2082481 - DNA, 21 bp, Homo sapiens
agtgttcattttagtgactgt

SEQ ID NO: 2082482 - DNA, 17 bp, Homo sapiens
agtgttccagctgcctg

SEQ ID NO: 2082483 - DNA, 18 bp, Homo sapiens
agtgttccctgagaaacc

SEQ ID NO: 2082484 - DNA, 21 bp, Homo sapiens
agtgttgaagaagagtttgca

SEQ ID NO: 2082485 - DNA, 14 bp, Homo sapiens
agtgttggctgtgt

SEQ ID NO: 2082486 - DNA, 16 bp, Homo sapiens
agtgtttagaagagcc

SEQ ID NO: 2082487 - DNA, 20 bp, Homo sapiens
agtgtttagaagagcctgac

SEQ ID NO: 2082488 - DNA, 19 bp, Homo sapiens
agtgtttatttttcatatt

SEQ ID NO: 2082489 - DNA, 17 bp, Homo sapiens
agtgttttcacctcata

SEQ ID NO: 2082490 - DNA, 13 bp, Homo sapiens
agtgttttctggg

SEQ ID NO: 2082491 - DNA, 15 bp, Homo sapiens
agtgttttctgggat

SEQ ID NO: 2082492 - DNA, 22 bp, Homo sapiens
agttaaaagtgttgattacata

SEQ ID NO: 2082493 - DNA, 14 bp, Homo sapiens
agttaactttcaga

SEQ ID NO: 2082494 - DNA, 21 bp, Homo sapiens
agttaagcagcctttctgtgg

SEQ ID NO: 2082495 - DNA, 14 bp, Homo sapiens
agttaagtatttac

SEQ ID NO: 2082496 - DNA, 19 bp, Homo sapiens
agttaagtatttacagatg

SEQ ID NO: 2082497 - DNA, 17 bp, Homo sapiens
agttacagggcccaggt

SEQ ID NO: 2082498 - DNA, 14 bp, Homo sapiens
agttactcagccct

SEQ ID NO: 2082499 - DNA, 15 bp, Homo sapiens
agttactcagccctg

SEQ ID NO: 2082500 - DNA, 16 bp, Homo sapiens
agttactcagccctgg

SEQ ID NO: 2082501 - DNA, 18 bp, Homo sapiens
agttactcagccctgggc

SEQ ID NO: 2082502 - DNA, 14 bp, Homo sapiens
agttactggtttca

SEQ ID NO: 2082503 - DNA, 19 bp, Homo sapiens
agttacttgtctgaggcct

SEQ ID NO: 2082504 - DNA, 20 bp, Homo sapiens
agttacttgtctgaggcctc

SEQ ID NO: 2082505 - DNA, 17 bp, Homo sapiens
agttagagaatatattt

SEQ ID NO: 2082506 - DNA, 19 bp, Homo sapiens
agttagagaatatattttt

SEQ ID NO: 2082507 - DNA, 12 bp, Homo sapiens
agttagccctca

SEQ ID NO: 2082508 - DNA, 19 bp, Homo sapiens
agttagctcaggaggcttg

SEQ ID NO: 2082509 - DNA, 18 bp, Homo sapiens
agttagctgctttaaatc

SEQ ID NO: 2082510 - DNA, 12 bp, Homo sapiens
agttaggaaata

SEQ ID NO: 2082511 - DNA, 13 bp, Homo sapiens
agttaggaaataa

SEQ ID NO: 2082512 - DNA, 17 bp, Homo sapiens
agttaggaaataaaacc

SEQ ID NO: 2082513 - DNA, 20 bp, Homo sapiens
agttaggaaataaaaccttt

SEQ ID NO: 2082514 - DNA, 21 bp, Homo sapiens
agttaggaaataaaacctttc

SEQ ID NO: 2082515 - DNA, 22 bp, Homo sapiens
agttaggaaataaaacctttca

SEQ ID NO: 2082516 - DNA, 18 bp, Homo sapiens
agttaggatagcattttt

SEQ ID NO: 2082517 - DNA, 19 bp, Homo sapiens
agttaggttataagaaaca

SEQ ID NO: 2082518 - DNA, 21 bp, Homo sapiens
agttagtgtgttgtctgtgca

SEQ ID NO: 2082519 - DNA, 13 bp, Homo sapiens
agttataaaaata

SEQ ID NO: 2082520 - DNA, 15 bp, Homo sapiens
agttataaaaataca

SEQ ID NO: 2082521 - DNA, 13 bp, Homo sapiens
agttatagtttca

SEQ ID NO: 2082522 - DNA, 15 bp, Homo sapiens
agttatagtttcaga

SEQ ID NO: 2082523 - DNA, 16 bp, Homo sapiens
agttatagtttgcttt

SEQ ID NO: 2082524 - DNA, 17 bp, Homo sapiens
agttatattgaatatat

SEQ ID NO: 2082525 - DNA, 19 bp, Homo sapiens
agttatatttactttaaaa

SEQ ID NO: 2082526 - DNA, 22 bp, Homo sapiens
agttatctaagttaatttaaag

SEQ ID NO: 2082527 - DNA, 21 bp, Homo sapiens
agttatgagggtcagggcagt

SEQ ID NO: 2082528 - DNA, 23 bp, Homo sapiens
agttatgccgtataggatgtcag

SEQ ID NO: 2082529 - DNA, 16 bp, Homo sapiens
agttattaatcttatg

SEQ ID NO: 2082530 - DNA, 15 bp, Homo sapiens
agttattcaaatgaa

SEQ ID NO: 2082531 - DNA, 22 bp, Homo sapiens
agttattgatttttgtaataaa

SEQ ID NO: 2082532 - DNA, 22 bp, Homo sapiens
agttattgtgttgccttagcac

SEQ ID NO: 2082533 - DNA, 12 bp, Homo sapiens
agttatttaaat

SEQ ID NO: 2082534 - DNA, 17 bp, Homo sapiens
agttatttacttgaaag

SEQ ID NO: 2082535 - DNA, 19 bp, Homo sapiens
agttatttacttgaaagat

SEQ ID NO: 2082536 - DNA, 20 bp, Homo sapiens
agttatttacttgaaagatg

SEQ ID NO: 2082537 - DNA, 11 bp, Homo sapiens
agttattttaa

SEQ ID NO: 2082538 - DNA, 22 bp, Homo sapiens
agttattttaaaaaaattcatc

SEQ ID NO: 2082539 - DNA, 19 bp, Homo sapiens
agttattttaattatcttt

SEQ ID NO: 2082540 - DNA, 23 bp, Homo sapiens
agttcaaagaagtcatggcccaa

SEQ ID NO: 2082541 - DNA, 17 bp, Homo sapiens
agttcaaatcctcacca

SEQ ID NO: 2082542 - DNA, 18 bp, Homo sapiens
agttcaaattttgcattg

SEQ ID NO: 2082543 - DNA, 13 bp, Homo sapiens
agttcaacatgtt

SEQ ID NO: 2082544 - DNA, 20 bp, Homo sapiens
agttcaacctggtggcacca

SEQ ID NO: 2082545 - DNA, 22 bp, Homo sapiens
agttcaacctggtggcaccaga

SEQ ID NO: 2082546 - DNA, 16 bp, Homo sapiens
agttcaagaccagcct

SEQ ID NO: 2082547 - DNA, 18 bp, Homo sapiens
agttcaatggctgcgaaa

SEQ ID NO: 2082548 - DNA, 22 bp, Homo sapiens
agttcacttctttgcagagcct

SEQ ID NO: 2082549 - DNA, 12 bp, Homo sapiens
agttcagccaga

SEQ ID NO: 2082550 - DNA, 20 bp, Homo sapiens
agttcaggagtcccaaggaa

SEQ ID NO: 2082551 - DNA, 21 bp, Homo sapiens
agttcaggagtcccaaggaaa

SEQ ID NO: 2082552 - DNA, 18 bp, Homo sapiens
agttcagggaagcaggca

SEQ ID NO: 2082553 - DNA, 19 bp, Homo sapiens
agttcatcccagccccaat

SEQ ID NO: 2082554 - DNA, 20 bp, Homo sapiens
agttcatcccagccccaatt

SEQ ID NO: 2082555 - DNA, 19 bp, Homo sapiens
agttccatcaggtcccccc

SEQ ID NO: 2082556 - DNA, 23 bp, Homo sapiens
agttccatcaggtcccccccagg

SEQ ID NO: 2082557 - DNA, 15 bp, Homo sapiens
agttcccatgttaaa

SEQ ID NO: 2082558 - DNA, 17 bp, Homo sapiens
agttccctacttcctgt

SEQ ID NO: 2082559 - DNA, 22 bp, Homo sapiens
agttccctgaacatctgtgtgt

SEQ ID NO: 2082560 - DNA, 15 bp, Homo sapiens
agttcctcgccctgg

SEQ ID NO: 2082561 - DNA, 20 bp, Homo sapiens
agttcctgagtaccttctac

SEQ ID NO: 2082562 - DNA, 15 bp, Homo sapiens
agttcctgcactcca

SEQ ID NO: 2082563 - DNA, 15 bp, Homo sapiens
agttccttataagaa

SEQ ID NO: 2082564 - DNA, 18 bp, Homo sapiens
agttccttataagaatta

SEQ ID NO: 2082565 - DNA, 20 bp, Homo sapiens
agttccttgatctgtatata

SEQ ID NO: 2082566 - DNA, 21 bp, Homo sapiens
agttcgagaccagcctggcca

SEQ ID NO: 2082567 - DNA, 18 bp, Homo sapiens
agttcgcagccaccctga

SEQ ID NO: 2082568 - DNA, 15 bp, Homo sapiens
agttctacaagcata

SEQ ID NO: 2082569 - DNA, 20 bp, Homo sapiens
agttctagagaagaggctgg

SEQ ID NO: 2082570 - DNA, 17 bp, Homo sapiens
agttctcaatcactgct

SEQ ID NO: 2082571 - DNA, 15 bp, Homo sapiens
agttctcaatgtgaa

SEQ ID NO: 2082572 - DNA, 23 bp, Homo sapiens
agttctcaattattggcctgcta

SEQ ID NO: 2082573 - DNA, 13 bp, Homo sapiens
agttctgaaaact

SEQ ID NO: 2082574 - DNA, 22 bp, Homo sapiens
agttctgaaaactgtttatggt

SEQ ID NO: 2082575 - DNA, 14 bp, Homo sapiens
agttctgagtgttt

SEQ ID NO: 2082576 - DNA, 14 bp, Homo sapiens
agttctgctcctct

SEQ ID NO: 2082577 - DNA, 19 bp, Homo sapiens
agttctgctcctctccagg

SEQ ID NO: 2082578 - DNA, 21 bp, Homo sapiens
agttcttggtgactgtcccac

SEQ ID NO: 2082579 - DNA, 14 bp, Homo sapiens
agttcttgtgccat

SEQ ID NO: 2082580 - DNA, 16 bp, Homo sapiens
agttgaaaaatctagt

SEQ ID NO: 2082581 - DNA, 14 bp, Homo sapiens
agttgaaaagactc

SEQ ID NO: 2082582 - DNA, 21 bp, Homo sapiens
agttgaaaagactccaaagaa

SEQ ID NO: 2082583 - DNA, 22 bp, Homo sapiens
agttgaaaagactccaaagaaa

SEQ ID NO: 2082584 - DNA, 19 bp, Homo sapiens
agttgaaaataaagtgtat

SEQ ID NO: 2082585 - DNA, 13 bp, Homo sapiens
agttgaacatctc

SEQ ID NO: 2082586 - DNA, 14 bp, Homo sapiens
agttgaagcaaatc

SEQ ID NO: 2082587 - DNA, 21 bp, Homo sapiens
agttgaatgacaacagaagct

SEQ ID NO: 2082588 - DNA, 15 bp, Homo sapiens
agttgaatggggcgg

SEQ ID NO: 2082589 - DNA, 22 bp, Homo sapiens
agttgaccgttttcatcctggc

SEQ ID NO: 2082590 - DNA, 18 bp, Homo sapiens
agttgacgcatcctgcag

SEQ ID NO: 2082591 - DNA, 20 bp, Homo sapiens
agttgagtcgtcatcacttt

SEQ ID NO: 2082592 - DNA, 17 bp, Homo sapiens
agttgataaagattttt

SEQ ID NO: 2082593 - DNA, 23 bp, Homo sapiens
agttgataaagattttttaataa

SEQ ID NO: 2082594 - DNA, 23 bp, Homo sapiens
agttgatgaccaatctctgtgac

SEQ ID NO: 2082595 - DNA, 15 bp, Homo sapiens
agttgattctgaatc

SEQ ID NO: 2082596 - DNA, 17 bp, Homo sapiens
agttgcaataaaatagt

SEQ ID NO: 2082597 - DNA, 17 bp, Homo sapiens
agttgcagactcagttt

SEQ ID NO: 2082598 - DNA, 18 bp, Homo sapiens
agttgcagactcagtttg

SEQ ID NO: 2082599 - DNA, 23 bp, Homo sapiens
agttgcagactcagtttgtcaga

SEQ ID NO: 2082600 - DNA, 20 bp, Homo sapiens
agttgcgtggactctgcaca

SEQ ID NO: 2082601 - DNA, 14 bp, Homo sapiens
agttgctcactcag

SEQ ID NO: 2082602 - DNA, 17 bp, Homo sapiens
agttgctcactcaggac

SEQ ID NO: 2082603 - DNA, 14 bp, Homo sapiens
agttgctgtcataa

SEQ ID NO: 2082604 - DNA, 16 bp, Homo sapiens
agttggaaagttggaa

SEQ ID NO: 2082605 - DNA, 20 bp, Homo sapiens
agttggagaaaatgaagaaa

SEQ ID NO: 2082606 - DNA, 14 bp, Homo sapiens
agttggcagaaagg

SEQ ID NO: 2082607 - DNA, 14 bp, Homo sapiens
agttggcagagaag

SEQ ID NO: 2082608 - DNA, 19 bp, Homo sapiens
agttggcagagaaggcctc

SEQ ID NO: 2082609 - DNA, 21 bp, Homo sapiens
agttggcagagaaggcctctt

SEQ ID NO: 2082610 - DNA, 16 bp, Homo sapiens
agttggctcaggcaga

SEQ ID NO: 2082611 - DNA, 13 bp, Homo sapiens
agttgggcttcct

SEQ ID NO: 2082612 - DNA, 21 bp, Homo sapiens
agttgggtggatgcctggtgg

SEQ ID NO: 2082613 - DNA, 17 bp, Homo sapiens
agttgtacgtaatgtat

SEQ ID NO: 2082614 - DNA, 20 bp, Homo sapiens
agttgtccatattttcacag

SEQ ID NO: 2082615 - DNA, 20 bp, Homo sapiens
agttgtctattctgagcctt

SEQ ID NO: 2082616 - DNA, 22 bp, Homo sapiens
agttgtgccttttatagctatt

SEQ ID NO: 2082617 - DNA, 20 bp, Homo sapiens
agttgtggaaagcctctgct

SEQ ID NO: 2082618 - DNA, 19 bp, Homo sapiens
agttgttcacatatatgta

SEQ ID NO: 2082619 - DNA, 19 bp, Homo sapiens
agttgttccttaagtcaga

SEQ ID NO: 2082620 - DNA, 15 bp, Homo sapiens
agttgtttcattgac

SEQ ID NO: 2082621 - DNA, 19 bp, Homo sapiens
agttgtttcattgactatc

SEQ ID NO: 2082622 - DNA, 15 bp, Homo sapiens
agtttaaaaaataca

SEQ ID NO: 2082623 - DNA, 12 bp, Homo sapiens
agtttaacacaa

SEQ ID NO: 2082624 - DNA, 19 bp, Homo sapiens
agtttaactttgggcccag

SEQ ID NO: 2082625 - DNA, 16 bp, Homo sapiens
agtttacaagtgtata

SEQ ID NO: 2082626 - DNA, 19 bp, Homo sapiens
agtttacaagtgtatatca

SEQ ID NO: 2082627 - DNA, 22 bp, Homo sapiens
agtttacagtaaataaattgtt

SEQ ID NO: 2082628 - DNA, 18 bp, Homo sapiens
agtttacttcctaaattt

SEQ ID NO: 2082629 - DNA, 15 bp, Homo sapiens
agtttagaacagagg

SEQ ID NO: 2082630 - DNA, 21 bp, Homo sapiens
agtttagaggaaaaaaatgac

SEQ ID NO: 2082631 - DNA, 15 bp, Homo sapiens
agtttataagcccaa

SEQ ID NO: 2082632 - DNA, 16 bp, Homo sapiens
agtttataagcccaaa

SEQ ID NO: 2082633 - DNA, 15 bp, Homo sapiens
agtttatatttaact

SEQ ID NO: 2082634 - DNA, 16 bp, Homo sapiens
agtttatatttaactc

SEQ ID NO: 2082635 - DNA, 18 bp, Homo sapiens
agtttatatttaactctc

SEQ ID NO: 2082636 - DNA, 21 bp, Homo sapiens
agtttatgtctaaagagcttt

SEQ ID NO: 2082637 - DNA, 13 bp, Homo sapiens
agtttatttgttg

SEQ ID NO: 2082638 - DNA, 20 bp, Homo sapiens
ataatggtttactgctgtca

SEQ ID NO: 2082639 - DNA, 19 bp, Homo sapiens
ataatgtgcaaattttgca

SEQ ID NO: 2082640 - DNA, 23 bp, Homo sapiens
ataatgtggatttcctattttaa

SEQ ID NO: 2082641 - DNA, 12 bp, Homo sapiens
ataatgtgtgta

SEQ ID NO: 2082642 - DNA, 18 bp, Homo sapiens
ataatgtgtgtatgtgta

SEQ ID NO: 2082643 - DNA, 16 bp, Homo sapiens
ataatgttctttaatg

SEQ ID NO: 2082644 - DNA, 14 bp, Homo sapiens
ataatgtttgctat

SEQ ID NO: 2082645 - DNA, 15 bp, Homo sapiens
ataattaaaaaccac

SEQ ID NO: 2082646 - DNA, 23 bp, Homo sapiens
ataattaggatctatgcaatttt

SEQ ID NO: 2082647 - DNA, 16 bp, Homo sapiens
ataattataatatact

SEQ ID NO: 2082648 - DNA, 16 bp, Homo sapiens
ataattatcggaagca

SEQ ID NO: 2082649 - DNA, 14 bp, Homo sapiens
ataattcttgtata

SEQ ID NO: 2082650 - DNA, 15 bp, Homo sapiens
ataattgtgtacaaa

SEQ ID NO: 2082651 - DNA, 17 bp, Homo sapiens
ataattgtgtacaaagt

SEQ ID NO: 2082652 - DNA, 19 bp, Homo sapiens
ataattgtgtacaaagtag

SEQ ID NO: 2082653 - DNA, 20 bp, Homo sapiens
ataatttagtttcatataaa

SEQ ID NO: 2082654 - DNA, 11 bp, Homo sapiens
ataatttcatc

SEQ ID NO: 2082655 - DNA, 18 bp, Homo sapiens
ataatttcttactaaaca

SEQ ID NO: 2082656 - DNA, 22 bp, Homo sapiens
ataatttgtacatatgtaaaat

SEQ ID NO: 2082657 - DNA, 12 bp, Homo sapiens
ataatttgttgt

SEQ ID NO: 2082658 - DNA, 14 bp, Homo sapiens
ataatttgttgtac

SEQ ID NO: 2082659 - DNA, 15 bp, Homo sapiens
ataattttatgaatg

SEQ ID NO: 2082660 - DNA, 19 bp, Homo sapiens
ataattttatgaatgtctt

SEQ ID NO: 2082661 - DNA, 14 bp, Homo sapiens
ataattttcctcct

SEQ ID NO: 2082662 - DNA, 22 bp, Homo sapiens
ataattttcttcatgcaatgac

SEQ ID NO: 2082663 - DNA, 15 bp, Homo sapiens
ataattttgcagcag

SEQ ID NO: 2082664 - DNA, 16 bp, Homo sapiens
ataattttttattcaa

SEQ ID NO: 2082665 - DNA, 22 bp, Homo sapiens
atacaaaaacatacttcaaaaa

SEQ ID NO: 2082666 - DNA, 15 bp, Homo sapiens
atacaaaataattta

SEQ ID NO: 2082667 - DNA, 16 bp, Homo sapiens
atacaaacaagcacag

SEQ ID NO: 2082668 - DNA, 16 bp, Homo sapiens
atacaaacatgtggca

SEQ ID NO: 2082669 - DNA, 23 bp, Homo sapiens
atacaaatatatttaattgtgtc

SEQ ID NO: 2082670 - DNA, 13 bp, Homo sapiens
atacaacaagaac

SEQ ID NO: 2082671 - DNA, 17 bp, Homo sapiens
atacaacaagaacaaca

SEQ ID NO: 2082672 - DNA, 14 bp, Homo sapiens
atacaatttgcact

SEQ ID NO: 2082673 - DNA, 15 bp, Homo sapiens
atacaatttgcactg

SEQ ID NO: 2082674 - DNA, 15 bp, Homo sapiens
atacacaacacacac

SEQ ID NO: 2082675 - DNA, 14 bp, Homo sapiens
atacacaacattta

SEQ ID NO: 2082676 - DNA, 11 bp, Homo sapiens
atacacacata

SEQ ID NO: 2082677 - DNA, 12 bp, Homo sapiens
atacacacatat

SEQ ID NO: 2082678 - DNA, 14 bp, Homo sapiens
atacacacatatac

SEQ ID NO: 2082679 - DNA, 17 bp, Homo sapiens
atacacacatatacata

SEQ ID NO: 2082680 - DNA, 20 bp, Homo sapiens
atacacacatatacatatat

SEQ ID NO: 2082681 - DNA, 22 bp, Homo sapiens
atacacacatatacatatatat

SEQ ID NO: 2082682 - DNA, 18 bp, Homo sapiens
atacacactcaaatcaag

SEQ ID NO: 2082683 - DNA, 16 bp, Homo sapiens
atacacagatgattaa

SEQ ID NO: 2082684 - DNA, 18 bp, Homo sapiens
atacacatacatacacat

SEQ ID NO: 2082685 - DNA, 21 bp, Homo sapiens
atacaccacctcactcctgtt

SEQ ID NO: 2082686 - DNA, 18 bp, Homo sapiens
atacacttgtataaatgt

SEQ ID NO: 2082687 - DNA, 23 bp, Homo sapiens
atacagaaagatggatgtgcttt

SEQ ID NO: 2082688 - DNA, 20 bp, Homo sapiens
atacagaactgaattaagtt

SEQ ID NO: 2082689 - DNA, 19 bp, Homo sapiens
atacagacactaagttata

SEQ ID NO: 2082690 - DNA, 23 bp, Homo sapiens
atacagacactaagttatagtat

SEQ ID NO: 2082691 - DNA, 15 bp, Homo sapiens
atacagaggtaacta

SEQ ID NO: 2082692 - DNA, 21 bp, Homo sapiens
atacagccccaaaccagggtg

SEQ ID NO: 2082693 - DNA, 14 bp, Homo sapiens
atacaggaaaagct

SEQ ID NO: 2082694 - DNA, 20 bp, Homo sapiens
atacaggaaaagctgctgac

SEQ ID NO: 2082695 - DNA, 18 bp, Homo sapiens
atacagtccctaaagaaa

SEQ ID NO: 2082696 - DNA, 14 bp, Homo sapiens
atacagtgttattt

SEQ ID NO: 2082697 - DNA, 17 bp, Homo sapiens
atacataacttgatata

SEQ ID NO: 2082698 - DNA, 19 bp, Homo sapiens
atacatacacttgtataaa

SEQ ID NO: 2082699 - DNA, 16 bp, Homo sapiens
atacatacatacatat

SEQ ID NO: 2082700 - DNA, 12 bp, Homo sapiens
atacatacatat

SEQ ID NO: 2082701 - DNA, 14 bp, Homo sapiens
atacatacatatat

SEQ ID NO: 2082702 - DNA, 18 bp, Homo sapiens
atacatagtcacaaaaat

SEQ ID NO: 2082703 - DNA, 20 bp, Homo sapiens
atacatatatatctgataaa

SEQ ID NO: 2082704 - DNA, 15 bp, Homo sapiens
atacatatcagaaaa

SEQ ID NO: 2082705 - DNA, 17 bp, Homo sapiens
atacatatcagaaaagt

SEQ ID NO: 2082706 - DNA, 18 bp, Homo sapiens
atacatatcagaaaagta

SEQ ID NO: 2082707 - DNA, 22 bp, Homo sapiens
atacatatcagaaaagtagaat

SEQ ID NO: 2082708 - DNA, 20 bp, Homo sapiens
atacatattataaataaatg

SEQ ID NO: 2082709 - DNA, 23 bp, Homo sapiens
atacatcctgctttccctcccca

SEQ ID NO: 2082710 - DNA, 16 bp, Homo sapiens
atacatgactcagcat

SEQ ID NO: 2082711 - DNA, 18 bp, Homo sapiens
atacatgctaagagaagt

SEQ ID NO: 2082712 - DNA, 22 bp, Homo sapiens
atacatgctaagagaagtagaa

SEQ ID NO: 2082713 - DNA, 15 bp, Homo sapiens
atacatgctgctaat

SEQ ID NO: 2082714 - DNA, 13 bp, Homo sapiens
atacatgtatagt

SEQ ID NO: 2082715 - DNA, 21 bp, Homo sapiens
atacatgtgtgtatatatgtg

SEQ ID NO: 2082716 - DNA, 22 bp, Homo sapiens
atacatgtgtgtatatatgtgt

SEQ ID NO: 2082717 - DNA, 16 bp, Homo sapiens
atacattttatatctg

SEQ ID NO: 2082718 - DNA, 20 bp, Homo sapiens
ataccaatgcttttatcaaa

SEQ ID NO: 2082719 - DNA, 19 bp, Homo sapiens
ataccagagacctgaggca

SEQ ID NO: 2082720 - DNA, 20 bp, Homo sapiens
ataccagtgaaccaaagaga

SEQ ID NO: 2082721 - DNA, 12 bp, Homo sapiens
ataccagtgtgg

SEQ ID NO: 2082722 - DNA, 17 bp, Homo sapiens
ataccatacattatcat

SEQ ID NO: 2082723 - DNA, 22 bp, Homo sapiens
ataccatctgctgccccgcttc

SEQ ID NO: 2082724 - DNA, 19 bp, Homo sapiens
atacccagtgtttggggtg

SEQ ID NO: 2082725 - DNA, 18 bp, Homo sapiens
atacccatagcttccatg

SEQ ID NO: 2082726 - DNA, 17 bp, Homo sapiens
ataccccaagtccacct

SEQ ID NO: 2082727 - DNA, 22 bp, Homo sapiens
atacccctgcctgggttttcta

SEQ ID NO: 2082728 - DNA, 12 bp, Homo sapiens
ataccctccccc

SEQ ID NO: 2082729 - DNA, 21 bp, Homo sapiens
atacccttctttaaatcaaaa

SEQ ID NO: 2082730 - DNA, 24 bp, Homo sapiens
atacccttctttaaatcaaaagct

SEQ ID NO: 2082731 - DNA, 19 bp, Homo sapiens
atacctactgactgatgac

SEQ ID NO: 2082732 - DNA, 16 bp, Homo sapiens
atacctataatgtgtg

SEQ ID NO: 2082733 - DNA, 15 bp, Homo sapiens
atacctcaacctatg

SEQ ID NO: 2082734 - DNA, 16 bp, Homo sapiens
atacctctgtgtgctc

SEQ ID NO: 2082735 - DNA, 20 bp, Homo sapiens
atacctgtgtttcttgcctc

SEQ ID NO: 2082736 - DNA, 17 bp, Homo sapiens
atacctttggaaaaatc

SEQ ID NO: 2082737 - DNA, 21 bp, Homo sapiens
atacgcctgtagtcctagcca

SEQ ID NO: 2082738 - DNA, 13 bp, Homo sapiens
atactaaaatatg

SEQ ID NO: 2082739 - DNA, 16 bp, Homo sapiens
atactaaaatatgtct

SEQ ID NO: 2082740 - DNA, 14 bp, Homo sapiens
atactaaagtgtct

SEQ ID NO: 2082741 - DNA, 13 bp, Homo sapiens
atactactgtaaa

SEQ ID NO: 2082742 - DNA, 14 bp, Homo sapiens
atactactgtaaat

SEQ ID NO: 2082743 - DNA, 16 bp, Homo sapiens
atactactgtaaatgt

SEQ ID NO: 2082744 - DNA, 17 bp, Homo sapiens
atactactgtaaatgta

SEQ ID NO: 2082745 - DNA, 17 bp, Homo sapiens
atactatacaacaatgt

SEQ ID NO: 2082746 - DNA, 15 bp, Homo sapiens
atactatatgataaa

SEQ ID NO: 2082747 - DNA, 15 bp, Homo sapiens
atactcacctcctcc

SEQ ID NO: 2082748 - DNA, 22 bp, Homo sapiens
atactcacctcctcccagactt

SEQ ID NO: 2082749 - DNA, 20 bp, Homo sapiens
atactctagaacatgcacat

SEQ ID NO: 2082750 - DNA, 21 bp, Homo sapiens
atactctagaacatgcacatt

SEQ ID NO: 2082751 - DNA, 22 bp, Homo sapiens
atactctagaacatgcacattt

SEQ ID NO: 2082752 - DNA, 14 bp, Homo sapiens
agtttctcttttca

SEQ ID NO: 2082753 - DNA, 18 bp, Homo sapiens
agtttcttggtctcagct

SEQ ID NO: 2082754 - DNA, 21 bp, Homo sapiens
agtttgaaggaggtgagggat

SEQ ID NO: 2082755 - DNA, 19 bp, Homo sapiens
agtttgagacaagccctgg

SEQ ID NO: 2082756 - DNA, 20 bp, Homo sapiens
agtttgagacaagccctggc

SEQ ID NO: 2082757 - DNA, 19 bp, Homo sapiens
agtttgagaccagcctggc

SEQ ID NO: 2082758 - DNA, 17 bp, Homo sapiens
agtttgatattaaagga

SEQ ID NO: 2082759 - DNA, 16 bp, Homo sapiens
agtttgatttaatatc

SEQ ID NO: 2082760 - DNA, 13 bp, Homo sapiens
agtttgcagaaaa

SEQ ID NO: 2082761 - DNA, 20 bp, Homo sapiens
agtttgcagaaaagcacctg

SEQ ID NO: 2082762 - DNA, 15 bp, Homo sapiens
agtttgctttgccct

SEQ ID NO: 2082763 - DNA, 17 bp, Homo sapiens
agtttggatatgtaaaa

SEQ ID NO: 2082764 - DNA, 20 bp, Homo sapiens
agtttggatatgtaaaacat

SEQ ID NO: 2082765 - DNA, 22 bp, Homo sapiens
agtttggatatgtaaaacattt

SEQ ID NO: 2082766 - DNA, 16 bp, Homo sapiens
agtttggcaatagttt

SEQ ID NO: 2082767 - DNA, 17 bp, Homo sapiens
agtttggcaatagtttg

SEQ ID NO: 2082768 - DNA, 19 bp, Homo sapiens
agtttgggccactgcactc

SEQ ID NO: 2082769 - DNA, 20 bp, Homo sapiens
agtttgggggttttgctgtt

SEQ ID NO: 2082770 - DNA, 22 bp, Homo sapiens
agtttgtacagacgtatgctta

SEQ ID NO: 2082771 - DNA, 23 bp, Homo sapiens
agtttgtacagacgtatgcttat

SEQ ID NO: 2082772 - DNA, 15 bp, Homo sapiens
agtttgtacatgcat

SEQ ID NO: 2082773 - DNA, 17 bp, Homo sapiens
agtttgtataacttctt

SEQ ID NO: 2082774 - DNA, 19 bp, Homo sapiens
agtttgtggtaaaaagatt

SEQ ID NO: 2082775 - DNA, 13 bp, Homo sapiens
agtttgtgtgtct

SEQ ID NO: 2082776 - DNA, 15 bp, Homo sapiens
agtttgttctccggg

SEQ ID NO: 2082777 - DNA, 13 bp, Homo sapiens
agtttgtttactt

SEQ ID NO: 2082778 - DNA, 12 bp, Homo sapiens
agttttaaatat

SEQ ID NO: 2082779 - DNA, 14 bp, Homo sapiens
agttttaaatatga

SEQ ID NO: 2082780 - DNA, 15 bp, Homo sapiens
agttttaaatatgaa

SEQ ID NO: 2082781 - DNA, 18 bp, Homo sapiens
agttttaactagaattta

SEQ ID NO: 2082782 - DNA, 21 bp, Homo sapiens
agttttagttgcagaaacatt

SEQ ID NO: 2082783 - DNA, 15 bp, Homo sapiens
agttttatcattttc

SEQ ID NO: 2082784 - DNA, 20 bp, Homo sapiens
agttttatcattttcaaaat

SEQ ID NO: 2082785 - DNA, 13 bp, Homo sapiens
agttttatggcat

SEQ ID NO: 2082786 - DNA, 21 bp, Homo sapiens
agttttattgagaattttaaa

SEQ ID NO: 2082787 - DNA, 14 bp, Homo sapiens
agttttctgagaaa

SEQ ID NO: 2082788 - DNA, 14 bp, Homo sapiens
agttttgatgaaat

SEQ ID NO: 2082789 - DNA, 16 bp, Homo sapiens
agttttgcatttatgg

SEQ ID NO: 2082790 - DNA, 19 bp, Homo sapiens
agttttgccagaacagttt

SEQ ID NO: 2082791 - DNA, 22 bp, Homo sapiens
agttttgtaaataagtgaaaat

SEQ ID NO: 2082792 - DNA, 11 bp, Homo sapiens
agttttgtata

SEQ ID NO: 2082793 - DNA, 13 bp, Homo sapiens
agttttgtataaa

SEQ ID NO: 2082794 - DNA, 15 bp, Homo sapiens
agttttgtataaata

SEQ ID NO: 2082795 - DNA, 23 bp, Homo sapiens
agtttttacctaccacagtgtct

SEQ ID NO: 2082796 - DNA, 17 bp, Homo sapiens
ataaaaaaacaatcatt

SEQ ID NO: 2082797 - DNA, 19 bp, Homo sapiens
ataaaaaaacaatcatttg

SEQ ID NO: 2082798 - DNA, 13 bp, Homo sapiens
ataaaaaaataca

SEQ ID NO: 2082799 - DNA, 14 bp, Homo sapiens
ataaaaaaatacag

SEQ ID NO: 2082800 - DNA, 13 bp, Homo sapiens
ataaaaaccagaa

SEQ ID NO: 2082801 - DNA, 17 bp, Homo sapiens
ataaaaaccagaatcat

SEQ ID NO: 2082802 - DNA, 13 bp, Homo sapiens
ataaaaaccctgt

SEQ ID NO: 2082803 - DNA, 23 bp, Homo sapiens
ataaaaagactattaagagcaat

SEQ ID NO: 2082804 - DNA, 10 bp, Homo sapiens
ataaaaagtt

SEQ ID NO: 2082805 - DNA, 13 bp, Homo sapiens
ataaaaataaatt

SEQ ID NO: 2082806 - DNA, 15 bp, Homo sapiens
ataaaaataccttaa

SEQ ID NO: 2082807 - DNA, 19 bp, Homo sapiens
ataaaaataccttaaatct

SEQ ID NO: 2082808 - DNA, 19 bp, Homo sapiens
ataaaaatcatggcaacat

SEQ ID NO: 2082809 - DNA, 16 bp, Homo sapiens
ataaaaatgatctaaa

SEQ ID NO: 2082810 - DNA, 17 bp, Homo sapiens
ataaaactcagttaaaa

SEQ ID NO: 2082811 - DNA, 18 bp, Homo sapiens
ataaaactcagttaaaat

SEQ ID NO: 2082812 - DNA, 19 bp, Homo sapiens
ataaaactcagttaaaatg

SEQ ID NO: 2082813 - DNA, 15 bp, Homo sapiens
ataaaactgctttgt

SEQ ID NO: 2082814 - DNA, 14 bp, Homo sapiens
ataaaacttatgct

SEQ ID NO: 2082815 - DNA, 18 bp, Homo sapiens
ataaaagtactgaagacc

SEQ ID NO: 2082816 - DNA, 17 bp, Homo sapiens
ataaaatactctagcct

SEQ ID NO: 2082817 - DNA, 18 bp, Homo sapiens
ataaaatgaggacatgtt

SEQ ID NO: 2082818 - DNA, 15 bp, Homo sapiens
ataaaatgatgtatg

SEQ ID NO: 2082819 - DNA, 16 bp, Homo sapiens
ataaaattatggtgaa

SEQ ID NO: 2082820 - DNA, 12 bp, Homo sapiens
ataaaattgtga

SEQ ID NO: 2082821 - DNA, 13 bp, Homo sapiens
ataaaattttcaa

SEQ ID NO: 2082822 - DNA, 19 bp, Homo sapiens
ataaacaacttaatgttct

SEQ ID NO: 2082823 - DNA, 17 bp, Homo sapiens
ataaacattaaacactg

SEQ ID NO: 2082824 - DNA, 16 bp, Homo sapiens
ataaacattaaatgtc

SEQ ID NO: 2082825 - DNA, 20 bp, Homo sapiens
ataaaccaaaggacattatg

SEQ ID NO: 2082826 - DNA, 21 bp, Homo sapiens
ataaaccaaaggacattatgt

SEQ ID NO: 2082827 - DNA, 14 bp, Homo sapiens
ataaacctggagat

SEQ ID NO: 2082828 - DNA, 15 bp, Homo sapiens
ataaacctggagatg

SEQ ID NO: 2082829 - DNA, 16 bp, Homo sapiens
ataaacctggagatga

SEQ ID NO: 2082830 - DNA, 13 bp, Homo sapiens
ataaactactgta

SEQ ID NO: 2082831 - DNA, 14 bp, Homo sapiens
ataaactactgtaa

SEQ ID NO: 2082832 - DNA, 22 bp, Homo sapiens
ataaactagatactgttgatct

SEQ ID NO: 2082833 - DNA, 14 bp, Homo sapiens
ataaactagatctc

SEQ ID NO: 2082834 - DNA, 14 bp, Homo sapiens
ataaactagtttcc

SEQ ID NO: 2082835 - DNA, 14 bp, Homo sapiens
ataaactatcagtt

SEQ ID NO: 2082836 - DNA, 15 bp, Homo sapiens
ataaactctaaacat

SEQ ID NO: 2082837 - DNA, 16 bp, Homo sapiens
ataaactgaaaaatgt

SEQ ID NO: 2082838 - DNA, 23 bp, Homo sapiens
ataaactggggagttataaaaat

SEQ ID NO: 2082839 - DNA, 14 bp, Homo sapiens
ataaacttagaata

SEQ ID NO: 2082840 - DNA, 21 bp, Homo sapiens
ataaacttagaataaaattgt

SEQ ID NO: 2082841 - DNA, 11 bp, Homo sapiens
ataaacttcag

SEQ ID NO: 2082842 - DNA, 15 bp, Homo sapiens
ataaacttcagcacc

SEQ ID NO: 2082843 - DNA, 15 bp, Homo sapiens
ataaagaacaaggta

SEQ ID NO: 2082844 - DNA, 21 bp, Homo sapiens
ataaagaactccttattttgt

SEQ ID NO: 2082845 - DNA, 20 bp, Homo sapiens
ataaagacagctgacagata

SEQ ID NO: 2082846 - DNA, 11 bp, Homo sapiens
ataaagatgat

SEQ ID NO: 2082847 - DNA, 14 bp, Homo sapiens
ataaagatgatcta

SEQ ID NO: 2082848 - DNA, 23 bp, Homo sapiens
ataaagatgatctactcagaaat

SEQ ID NO: 2082849 - DNA, 15 bp, Homo sapiens
ataaagatggctatt

SEQ ID NO: 2082850 - DNA, 18 bp, Homo sapiens
ataaagatggctgacttt

SEQ ID NO: 2082851 - DNA, 21 bp, Homo sapiens
ataaagatgtcaaatatctca

SEQ ID NO: 2082852 - DNA, 23 bp, Homo sapiens
ataaagatgtcaaatatctcaga

SEQ ID NO: 2082853 - DNA, 16 bp, Homo sapiens
ataaagattttttaat

SEQ ID NO: 2082854 - DNA, 22 bp, Homo sapiens
atactctccctgacatttctaa

SEQ ID NO: 2082855 - DNA, 14 bp, Homo sapiens
atactggaagtttt

SEQ ID NO: 2082856 - DNA, 16 bp, Homo sapiens
atactggaagttttgc

SEQ ID NO: 2082857 - DNA, 18 bp, Homo sapiens
atactggaagttttgcat

SEQ ID NO: 2082858 - DNA, 19 bp, Homo sapiens
atactgggtacaagagcca

SEQ ID NO: 2082859 - DNA, 21 bp, Homo sapiens
atactgtcggttttttttaaa

SEQ ID NO: 2082860 - DNA, 22 bp, Homo sapiens
atacttagcaaagttttacctg

SEQ ID NO: 2082861 - DNA, 10 bp, Homo sapiens
atacttgagc

SEQ ID NO: 2082862 - DNA, 14 bp, Homo sapiens
atactttttttcac

SEQ ID NO: 2082863 - DNA, 15 bp, Homo sapiens
atagaaaagatgaga

SEQ ID NO: 2082864 - DNA, 20 bp, Homo sapiens
atagaaaagatgagaggcag

SEQ ID NO: 2082865 - DNA, 21 bp, Homo sapiens
atagaaacatgacactgacct

SEQ ID NO: 2082866 - DNA, 14 bp, Homo sapiens
atagaaagcaataa

SEQ ID NO: 2082867 - DNA, 19 bp, Homo sapiens
atagaaagtgccagaaagt

SEQ ID NO: 2082868 - DNA, 21 bp, Homo sapiens
atagaactcagttttaactag

SEQ ID NO: 2082869 - DNA, 20 bp, Homo sapiens
atagaagaatacaaacatat

SEQ ID NO: 2082870 - DNA, 13 bp, Homo sapiens
atagaagctgtag

SEQ ID NO: 2082871 - DNA, 16 bp, Homo sapiens
atagaagctgtagtag

SEQ ID NO: 2082872 - DNA, 13 bp, Homo sapiens
atagaatactttt

SEQ ID NO: 2082873 - DNA, 19 bp, Homo sapiens
atagaatatttattacctc

SEQ ID NO: 2082874 - DNA, 16 bp, Homo sapiens
atagaatgttactttg

SEQ ID NO: 2082875 - DNA, 14 bp, Homo sapiens
atagaatttccaat

SEQ ID NO: 2082876 - DNA, 14 bp, Homo sapiens
atagacacatcaaa

SEQ ID NO: 2082877 - DNA, 19 bp, Homo sapiens
atagacagaagaaacaagg

SEQ ID NO: 2082878 - DNA, 18 bp, Homo sapiens
atagacagtgctgccctg

SEQ ID NO: 2082879 - DNA, 21 bp, Homo sapiens
atagactgtacttattttcca

SEQ ID NO: 2082880 - DNA, 14 bp, Homo sapiens
atagagagagacca

SEQ ID NO: 2082881 - DNA, 20 bp, Homo sapiens
atagagatatttttgtacgt

SEQ ID NO: 2082882 - DNA, 21 bp, Homo sapiens
atagagcacctagtccagtga

SEQ ID NO: 2082883 - DNA, 13 bp, Homo sapiens
atagagttcatcc

SEQ ID NO: 2082884 - DNA, 19 bp, Homo sapiens
atagatcctaggtgctgga

SEQ ID NO: 2082885 - DNA, 12 bp, Homo sapiens
atagatcttctg

SEQ ID NO: 2082886 - DNA, 13 bp, Homo sapiens
atagatcttctga

SEQ ID NO: 2082887 - DNA, 15 bp, Homo sapiens
atagatgaatactaa

SEQ ID NO: 2082888 - DNA, 13 bp, Homo sapiens
atagatggaccag

SEQ ID NO: 2082889 - DNA, 12 bp, Homo sapiens
atagatgtttga

SEQ ID NO: 2082890 - DNA, 19 bp, Homo sapiens
atagatttgattatttcct

SEQ ID NO: 2082891 - DNA, 15 bp, Homo sapiens
atagcaaaagaagaa

SEQ ID NO: 2082892 - DNA, 17 bp, Homo sapiens
atagcaaaagaagaagt

SEQ ID NO: 2082893 - DNA, 14 bp, Homo sapiens
atagcaaagaattg

SEQ ID NO: 2082894 - DNA, 14 bp, Homo sapiens
atagcacaggctaa

SEQ ID NO: 2082895 - DNA, 20 bp, Homo sapiens
atagcagaagaaaaagttgc

SEQ ID NO: 2082896 - DNA, 22 bp, Homo sapiens
atagcagattttaattttgaat

SEQ ID NO: 2082897 - DNA, 19 bp, Homo sapiens
atagcagcaaaaatataaa

SEQ ID NO: 2082898 - DNA, 20 bp, Homo sapiens
atagcagcaaaaatataaaa

SEQ ID NO: 2082899 - DNA, 14 bp, Homo sapiens
atagcatctgctct

SEQ ID NO: 2082900 - DNA, 18 bp, Homo sapiens
atagcatttttgatttat

SEQ ID NO: 2082901 - DNA, 13 bp, Homo sapiens
atagccaaaaata

SEQ ID NO: 2082902 - DNA, 16 bp, Homo sapiens
atagccagagaggagc

SEQ ID NO: 2082903 - DNA, 17 bp, Homo sapiens
atagcgctggctcagga

SEQ ID NO: 2082904 - DNA, 18 bp, Homo sapiens
atagcgctggctcaggaa

SEQ ID NO: 2082905 - DNA, 19 bp, Homo sapiens
atagcgctggctcaggaag

SEQ ID NO: 2082906 - DNA, 20 bp, Homo sapiens
atagcgtgggttatcagtta

SEQ ID NO: 2082907 - DNA, 13 bp, Homo sapiens
atagctaaatacc

SEQ ID NO: 2082908 - DNA, 23 bp, Homo sapiens
atagctaacattttaaataaaag

SEQ ID NO: 2082909 - DNA, 14 bp, Homo sapiens
atagctacccaaaa

SEQ ID NO: 2082910 - DNA, 17 bp, Homo sapiens
atagctattgcatgtaa

SEQ ID NO: 2082911 - DNA, 20 bp, Homo sapiens
atagctattgcatgtaaaat

SEQ ID NO: 2082912 - DNA, 18 bp, Homo sapiens
atagctatttttatggaa

SEQ ID NO: 2082913 - DNA, 19 bp, Homo sapiens
atagctcaggtgtccctgc

SEQ ID NO: 2082914 - DNA, 20 bp, Homo sapiens
atagctcaggtgtccctgca

SEQ ID NO: 2082915 - DNA, 21 bp, Homo sapiens
atagctcaggtgtccctgcac

SEQ ID NO: 2082916 - DNA, 22 bp, Homo sapiens
atagctcagtttatccaaggtg

SEQ ID NO: 2082917 - DNA, 19 bp, Homo sapiens
atagctcttctatttaaaa

SEQ ID NO: 2082918 - DNA, 19 bp, Homo sapiens
atagctgacatctcctcta

SEQ ID NO: 2082919 - DNA, 17 bp, Homo sapiens
atagctgagattcctgg

SEQ ID NO: 2082920 - DNA, 24 bp, Homo sapiens
atagctgggaacccgactgtgaaa

SEQ ID NO: 2082921 - DNA, 21 bp, Homo sapiens
atagctttattttttaagtat

SEQ ID NO: 2082922 - DNA, 14 bp, Homo sapiens
atagcttttattgt

SEQ ID NO: 2082923 - DNA, 17 bp, Homo sapiens
atagcttttattgtata

SEQ ID NO: 2082924 - DNA, 18 bp, Homo sapiens
ataggaaaagtacattta

SEQ ID NO: 2082925 - DNA, 19 bp, Homo sapiens
ataggatataaaacacatc

SEQ ID NO: 2082926 - DNA, 22 bp, Homo sapiens
ataggatataaaacacatcaag

SEQ ID NO: 2082927 - DNA, 19 bp, Homo sapiens
ataggatgtcagacaatac

SEQ ID NO: 2082928 - DNA, 16 bp, Homo sapiens
ataggatttatttaaa

SEQ ID NO: 2082929 - DNA, 21 bp, Homo sapiens
ataggccctggatgtgcccac

SEQ ID NO: 2082930 - DNA, 21 bp, Homo sapiens
atagggtctcttcaggttctt

SEQ ID NO: 2082931 - DNA, 18 bp, Homo sapiens
ataggtagaatgtaaagc

SEQ ID NO: 2082932 - DNA, 21 bp, Homo sapiens
ataggtcacatatgtctgtat

SEQ ID NO: 2082933 - DNA, 23 bp, Homo sapiens
ataggtgctacaaaaacacagca

SEQ ID NO: 2082934 - DNA, 16 bp, Homo sapiens
ataggttttgatttat

SEQ ID NO: 2082935 - DNA, 21 bp, Homo sapiens
atagtaactactttttatact

SEQ ID NO: 2082936 - DNA, 13 bp, Homo sapiens
atagtaactctta

SEQ ID NO: 2082937 - DNA, 22 bp, Homo sapiens
atagtaataggatacaatgtat

SEQ ID NO: 2082938 - DNA, 17 bp, Homo sapiens
atagtaccaatcatttt

SEQ ID NO: 2082939 - DNA, 16 bp, Homo sapiens
atagtagcagagtcat

SEQ ID NO: 2082940 - DNA, 14 bp, Homo sapiens
atagtagtcaatta

SEQ ID NO: 2082941 - DNA, 19 bp, Homo sapiens
atagtagtcaattagtaca

SEQ ID NO: 2082942 - DNA, 15 bp, Homo sapiens
atagtatatctggac

SEQ ID NO: 2082943 - DNA, 18 bp, Homo sapiens
atagtatatttatactct

SEQ ID NO: 2082944 - DNA, 18 bp, Homo sapiens
atagtatggtggctgggt

SEQ ID NO: 2082945 - DNA, 19 bp, Homo sapiens
atagtcaaaccataaactt

SEQ ID NO: 2082946 - DNA, 15 bp, Homo sapiens
atagtcacaaaaatg

SEQ ID NO: 2082947 - DNA, 21 bp, Homo sapiens
atagtcacaaaaatggtggtt

SEQ ID NO: 2082948 - DNA, 13 bp, Homo sapiens
atagtccaatatt

SEQ ID NO: 2082949 - DNA, 21 bp, Homo sapiens
atagtccccatcagcaccatg

SEQ ID NO: 2082950 - DNA, 22 bp, Homo sapiens
atagtgctatatatataaatat

SEQ ID NO: 2082951 - DNA, 20 bp, Homo sapiens
atagtgctttattttgttaa

SEQ ID NO: 2082952 - DNA, 17 bp, Homo sapiens
atagttatttacttgaa

SEQ ID NO: 2082953 - DNA, 19 bp, Homo sapiens
atagttatttacttgaaag

SEQ ID NO: 2082954 - DNA, 21 bp, Homo sapiens
atagttctatcaggaaaacaa

SEQ ID NO: 2082955 - DNA, 21 bp, Homo sapiens
atagttctccagttgtatgga

SEQ ID NO: 2082956 - DNA, 13 bp, Homo sapiens
atagtttattgac

SEQ ID NO: 2082957 - DNA, 21 bp, Homo sapiens
atagtttcagatatatatcat

SEQ ID NO: 2082958 - DNA, 13 bp, Homo sapiens
atagttttaaata

SEQ ID NO: 2082959 - DNA, 15 bp, Homo sapiens
atagttttaaatatg

SEQ ID NO: 2082960 - DNA, 21 bp, Homo sapiens
atagttttaaatatgaacaaa

SEQ ID NO: 2082961 - DNA, 17 bp, Homo sapiens
atataaaaagaaaagat

SEQ ID NO: 2082962 - DNA, 20 bp, Homo sapiens
atataaaaagaaaagataaa

SEQ ID NO: 2082963 - DNA, 22 bp, Homo sapiens
atataaaaagaaaagataaaga

SEQ ID NO: 2082964 - DNA, 13 bp, Homo sapiens
atataaaacacat

SEQ ID NO: 2082965 - DNA, 13 bp, Homo sapiens
atataaacttgtg

SEQ ID NO: 2082966 - DNA, 19 bp, Homo sapiens
atatgaaaaatatgatatt

SEQ ID NO: 2082967 - DNA, 22 bp, Homo sapiens
atatgaaatgataaagatgtca

SEQ ID NO: 2082968 - DNA, 19 bp, Homo sapiens
atatgaaatgtttcactat

SEQ ID NO: 2082969 - DNA, 21 bp, Homo sapiens
atatgaagtaagttctgaaaa

SEQ ID NO: 2082970 - DNA, 23 bp, Homo sapiens
atatgacaatcctgaagaaacca

SEQ ID NO: 2082971 - DNA, 14 bp, Homo sapiens
atatgacagctgtc

SEQ ID NO: 2082972 - DNA, 20 bp, Homo sapiens
accccagttctgctcctctc

SEQ ID NO: 2082973 - DNA, 21 bp, Homo sapiens
accccagttctgctcctctcc

SEQ ID NO: 2082974 - DNA, 23 bp, Homo sapiens
accccatcacctactcacacagg

SEQ ID NO: 2082975 - DNA, 14 bp, Homo sapiens
accccatcccttcc

SEQ ID NO: 2082976 - DNA, 16 bp, Homo sapiens
accccatctctcttcc

SEQ ID NO: 2082977 - DNA, 13 bp, Homo sapiens
accccatgggctt

SEQ ID NO: 2082978 - DNA, 18 bp, Homo sapiens
acccccaccgaagagccc

SEQ ID NO: 2082979 - DNA, 20 bp, Homo sapiens
acccccaccgaagagccctg

SEQ ID NO: 2082980 - DNA, 18 bp, Homo sapiens
acccccactctcattccc

SEQ ID NO: 2082981 - DNA, 14 bp, Homo sapiens
acccccagcccaca

SEQ ID NO: 2082982 - DNA, 20 bp, Homo sapiens
acccccagccccgactccag

SEQ ID NO: 2082983 - DNA, 23 bp, Homo sapiens
acccccagccccgactccagcca

SEQ ID NO: 2082984 - DNA, 12 bp, Homo sapiens
acccccagcctg

SEQ ID NO: 2082985 - DNA, 13 bp, Homo sapiens
acccccagcctgg

SEQ ID NO: 2082986 - DNA, 16 bp, Homo sapiens
acccccagtgccacag

SEQ ID NO: 2082987 - DNA, 17 bp, Homo sapiens
acccccagtgccacaga

SEQ ID NO: 2082988 - DNA, 20 bp, Homo sapiens
acccccagtgtggctgtctg

SEQ ID NO: 2082989 - DNA, 18 bp, Homo sapiens
acccccatttctatttat

SEQ ID NO: 2082990 - DNA, 19 bp, Homo sapiens
acccccgccacggccaccc

SEQ ID NO: 2082991 - DNA, 15 bp, Homo sapiens
accccctcattcccc

SEQ ID NO: 2082992 - DNA, 16 bp, Homo sapiens
accccctcattgttta

SEQ ID NO: 2082993 - DNA, 13 bp, Homo sapiens
accccctccagct

SEQ ID NO: 2082994 - DNA, 18 bp, Homo sapiens
accccctccagctccagt

SEQ ID NO: 2082995 - DNA, 13 bp, Homo sapiens
accccctcccacc

SEQ ID NO: 2082996 - DNA, 16 bp, Homo sapiens
accccctcccaccccc

SEQ ID NO: 2082997 - DNA, 17 bp, Homo sapiens
accccctcccaccccca

SEQ ID NO: 2082998 - DNA, 23 bp, Homo sapiens
accccctgaaagtgacagagacc

SEQ ID NO: 2082999 - DNA, 15 bp, Homo sapiens
accccctgcagcttg

SEQ ID NO: 2083000 - DNA, 16 bp, Homo sapiens
accccctggccctgcc

SEQ ID NO: 2083001 - DNA, 17 bp, Homo sapiens
accccctggccctgcct

SEQ ID NO: 2083002 - DNA, 18 bp, Homo sapiens
accccgaccacctgccca

SEQ ID NO: 2083003 - DNA, 12 bp, Homo sapiens
accccgcagccc

SEQ ID NO: 2083004 - DNA, 13 bp, Homo sapiens
accccgcagcccg

SEQ ID NO: 2083005 - DNA, 14 bp, Homo sapiens
accccgcagcccgt

SEQ ID NO: 2083006 - DNA, 22 bp, Homo sapiens
accccgcctcccagccccaggg

SEQ ID NO: 2083007 - DNA, 15 bp, Homo sapiens
accccggatcgagga

SEQ ID NO: 2083008 - DNA, 19 bp, Homo sapiens
accccggatcgaggacaag

SEQ ID NO: 2083009 - DNA, 22 bp, Homo sapiens
acccctaaagagatactttgat

SEQ ID NO: 2083010 - DNA, 11 bp, Homo sapiens
acccctaacct

SEQ ID NO: 2083011 - DNA, 22 bp, Homo sapiens
acccctcagtgctcggcagtca

SEQ ID NO: 2083012 - DNA, 20 bp, Homo sapiens
acccctccaaagccccacct

SEQ ID NO: 2083013 - DNA, 16 bp, Homo sapiens
acccctccatgtgggc

SEQ ID NO: 2083014 - DNA, 16 bp, Homo sapiens
acccctcccaacctca

SEQ ID NO: 2083015 - DNA, 15 bp, Homo sapiens
acccctccccattca

SEQ ID NO: 2083016 - DNA, 22 bp, Homo sapiens
acccctccccattcacagagcc

SEQ ID NO: 2083017 - DNA, 13 bp, Homo sapiens
acccctcccctcc

SEQ ID NO: 2083018 - DNA, 15 bp, Homo sapiens
acccctcccctcccc

SEQ ID NO: 2083019 - DNA, 12 bp, Homo sapiens
acccctgcacca

SEQ ID NO: 2083020 - DNA, 17 bp, Homo sapiens
acccctggcttttcact

SEQ ID NO: 2083021 - DNA, 18 bp, Homo sapiens
acccctggcttttcactg

SEQ ID NO: 2083022 - DNA, 12 bp, Homo sapiens
acccctgtaccc

SEQ ID NO: 2083023 - DNA, 18 bp, Homo sapiens
acccctgtacccagctcc

SEQ ID NO: 2083024 - DNA, 14 bp, Homo sapiens
acccctgtggcaga

SEQ ID NO: 2083025 - DNA, 18 bp, Homo sapiens
acccctgtggcagaccgg

SEQ ID NO: 2083026 - DNA, 12 bp, Homo sapiens
accccttccttt

SEQ ID NO: 2083027 - DNA, 19 bp, Homo sapiens
accccttcgctcctgtgtc

SEQ ID NO: 2083028 - DNA, 16 bp, Homo sapiens
accccttgaagccttt

SEQ ID NO: 2083029 - DNA, 12 bp, Homo sapiens
acccctttcccc

SEQ ID NO: 2083030 - DNA, 17 bp, Homo sapiens
acccctttcccccaccc

SEQ ID NO: 2083031 - DNA, 14 bp, Homo sapiens
acccgagcccagct

SEQ ID NO: 2083032 - DNA, 23 bp, Homo sapiens
acccgagcccagctacattcctc

SEQ ID NO: 2083033 - DNA, 14 bp, Homo sapiens
acccgaggctgccc

SEQ ID NO: 2083034 - DNA, 24 bp, Homo sapiens
acccgaggctgcccactatggtca

SEQ ID NO: 2083035 - DNA, 13 bp, Homo sapiens
acccgctctggac

SEQ ID NO: 2083036 - DNA, 15 bp, Homo sapiens
acccgctctggacca

SEQ ID NO: 2083037 - DNA, 13 bp, Homo sapiens
acccggaaagact

SEQ ID NO: 2083038 - DNA, 22 bp, Homo sapiens
acccggcaggctagaacctggc

SEQ ID NO: 2083039 - DNA, 14 bp, Homo sapiens
acccggcccctgct

SEQ ID NO: 2083040 - DNA, 15 bp, Homo sapiens
acccggcccctgctg

SEQ ID NO: 2083041 - DNA, 16 bp, Homo sapiens
acccggcccctgctgg

SEQ ID NO: 2083042 - DNA, 17 bp, Homo sapiens
acccggcccctgctggt

SEQ ID NO: 2083043 - DNA, 19 bp, Homo sapiens
acccggctccccctgcttc

SEQ ID NO: 2083044 - DNA, 23 bp, Homo sapiens
acccgtacccccgtggtctttga

SEQ ID NO: 2083045 - DNA, 15 bp, Homo sapiens
acccgtaggcagcct

SEQ ID NO: 2083046 - DNA, 19 bp, Homo sapiens
acccgtaggcagcctctct

SEQ ID NO: 2083047 - DNA, 22 bp, Homo sapiens
acccgtgccaagtccaggtcct

SEQ ID NO: 2083048 - DNA, 13 bp, Homo sapiens
acccgtggaggct

SEQ ID NO: 2083049 - DNA, 13 bp, Homo sapiens
acccgttcaactt

SEQ ID NO: 2083050 - DNA, 15 bp, Homo sapiens
accctaccccaccac

SEQ ID NO: 2083051 - DNA, 16 bp, Homo sapiens
accctacctgtgcctg

SEQ ID NO: 2083052 - DNA, 21 bp, Homo sapiens
accctacttcattttcagagt

SEQ ID NO: 2083053 - DNA, 13 bp, Homo sapiens
accctatccctgt

SEQ ID NO: 2083054 - DNA, 22 bp, Homo sapiens
accctatctgtgattcccccaa

SEQ ID NO: 2083055 - DNA, 15 bp, Homo sapiens
accctcaaatgtcag

SEQ ID NO: 2083056 - DNA, 21 bp, Homo sapiens
accctcaaatgtcagagctat

SEQ ID NO: 2083057 - DNA, 17 bp, Homo sapiens
accctcactgctgggga

SEQ ID NO: 2083058 - DNA, 23 bp, Homo sapiens
accctcataccatctgctgcccc

SEQ ID NO: 2083059 - DNA, 20 bp, Homo sapiens
accctccaccgcagaaggaa

SEQ ID NO: 2083060 - DNA, 10 bp, Homo sapiens
accctccccc

SEQ ID NO: 2083061 - DNA, 15 bp, Homo sapiens
accctcccccgcagc

SEQ ID NO: 2083062 - DNA, 15 bp, Homo sapiens
accctccctacctga

SEQ ID NO: 2083063 - DNA, 14 bp, Homo sapiens
accctcctccactc

SEQ ID NO: 2083064 - DNA, 21 bp, Homo sapiens
accctcctttcaccacatgtg

SEQ ID NO: 2083065 - DNA, 15 bp, Homo sapiens
accctcgcagcaggt

SEQ ID NO: 2083066 - DNA, 23 bp, Homo sapiens
accctcgcagcaggtgcaagaga

SEQ ID NO: 2083067 - DNA, 15 bp, Homo sapiens
accctcgtggacacc

SEQ ID NO: 2083068 - DNA, 14 bp, Homo sapiens
accctctcttccct

SEQ ID NO: 2083069 - DNA, 21 bp, Homo sapiens
accctctgaatggtccagggt

SEQ ID NO: 2083070 - DNA, 22 bp, Homo sapiens
accctctgaatggtccagggtt

SEQ ID NO: 2083071 - DNA, 21 bp, Homo sapiens
accctctgggcagctgtcatg

SEQ ID NO: 2083072 - DNA, 17 bp, Homo sapiens
accctgaagatttcaga

SEQ ID NO: 2083073 - DNA, 22 bp, Homo sapiens
accctgaatggttccatgcctg

SEQ ID NO: 2083074 - DNA, 19 bp, Homo sapiens
accctgaggagtctgaggt

SEQ ID NO: 2083075 - DNA, 18 bp, Homo sapiens
accctgaggcctctggaa

SEQ ID NO: 2083076 - DNA, 13 bp, Homo sapiens
accctgcagagca

SEQ ID NO: 2083077 - DNA, 14 bp, Homo sapiens
accctgcagagcac

SEQ ID NO: 2083078 - DNA, 13 bp, Homo sapiens
accctgcagagct

SEQ ID NO: 2083079 - DNA, 14 bp, Homo sapiens
accctgcccatacc

SEQ ID NO: 2083080 - DNA, 19 bp, Homo sapiens
accctgcccatacccctgc

SEQ ID NO: 2083081 - DNA, 16 bp, Homo sapiens
atatttgtgtatgtgt

SEQ ID NO: 2083082 - DNA, 21 bp, Homo sapiens
atatttgttaaatatttacat

SEQ ID NO: 2083083 - DNA, 16 bp, Homo sapiens
atattttaaagaattg

SEQ ID NO: 2083084 - DNA, 20 bp, Homo sapiens
atattttaaagaattgtgtc

SEQ ID NO: 2083085 - DNA, 23 bp, Homo sapiens
atattttacattcttggaaagtc

SEQ ID NO: 2083086 - DNA, 16 bp, Homo sapiens
atattttatgatttaa

SEQ ID NO: 2083087 - DNA, 17 bp, Homo sapiens
atattttatgatttaaa

SEQ ID NO: 2083088 - DNA, 18 bp, Homo sapiens
atattttccctctcttgc

SEQ ID NO: 2083089 - DNA, 23 bp, Homo sapiens
atattttcttccaagcaaaggtg

SEQ ID NO: 2083090 - DNA, 15 bp, Homo sapiens
atcccagacccctct

SEQ ID NO: 2083091 - DNA, 23 bp, Homo sapiens
atcccagagcccagggcatccca

SEQ ID NO: 2083092 - DNA, 19 bp, Homo sapiens
atcccagagcttcccagga

SEQ ID NO: 2083093 - DNA, 19 bp, Homo sapiens
atcccagcactttgggagg

SEQ ID NO: 2083094 - DNA, 23 bp, Homo sapiens
atcccagccctttgggaggctga

SEQ ID NO: 2083095 - DNA, 19 bp, Homo sapiens
atcccagctacatgggagc

SEQ ID NO: 2083096 - DNA, 18 bp, Homo sapiens
atcccagctactcaggag

SEQ ID NO: 2083097 - DNA, 20 bp, Homo sapiens
atcccagctactcaggaggc

SEQ ID NO: 2083098 - DNA, 13 bp, Homo sapiens
atcccaggagggg

SEQ ID NO: 2083099 - DNA, 15 bp, Homo sapiens
atcccaggaggggcc

SEQ ID NO: 2083100 - DNA, 13 bp, Homo sapiens
atcccaggccagg

SEQ ID NO: 2083101 - DNA, 18 bp, Homo sapiens
atcccatctaagctgcag

SEQ ID NO: 2083102 - DNA, 16 bp, Homo sapiens
atcccatgagcctcag

SEQ ID NO: 2083103 - DNA, 17 bp, Homo sapiens
atcccatgagcctcagc

SEQ ID NO: 2083104 - DNA, 18 bp, Homo sapiens
atcccatgagcctcagca

SEQ ID NO: 2083105 - DNA, 17 bp, Homo sapiens
atcccattgccctggtt

SEQ ID NO: 2083106 - DNA, 18 bp, Homo sapiens
atccccaagctggcagct

SEQ ID NO: 2083107 - DNA, 22 bp, Homo sapiens
atccccaggtctctccactgct

SEQ ID NO: 2083108 - DNA, 12 bp, Homo sapiens
atcccccagcct

SEQ ID NO: 2083109 - DNA, 20 bp, Homo sapiens
atcccctcgtcctgtcccag

SEQ ID NO: 2083110 - DNA, 23 bp, Homo sapiens
atcccctcgtcctgtcccagagg

SEQ ID NO: 2083111 - DNA, 18 bp, Homo sapiens
atcccctggactgggagg

SEQ ID NO: 2083112 - DNA, 13 bp, Homo sapiens
atcccctttcctc

SEQ ID NO: 2083113 - DNA, 14 bp, Homo sapiens
atcccgctcctgct

SEQ ID NO: 2083114 - DNA, 14 bp, Homo sapiens
atcccggcctcttc

SEQ ID NO: 2083115 - DNA, 15 bp, Homo sapiens
atccctaacatcatg

SEQ ID NO: 2083116 - DNA, 16 bp, Homo sapiens
atccctgggcctgctg

SEQ ID NO: 2083117 - DNA, 18 bp, Homo sapiens
atccctgggcctgctgct

SEQ ID NO: 2083118 - DNA, 21 bp, Homo sapiens
atccctgggcctgctgctgag

SEQ ID NO: 2083119 - DNA, 15 bp, Homo sapiens
atccctgtttaatat

SEQ ID NO: 2083120 - DNA, 22 bp, Homo sapiens
atccctgtttaatatttaaaca

SEQ ID NO: 2083121 - DNA, 12 bp, Homo sapiens
atccgaggcagg

SEQ ID NO: 2083122 - DNA, 13 bp, Homo sapiens
atccgaggcaggg

SEQ ID NO: 2083123 - DNA, 13 bp, Homo sapiens
atccgcagcccag

SEQ ID NO: 2083124 - DNA, 17 bp, Homo sapiens
atccgcctgcagaggac

SEQ ID NO: 2083125 - DNA, 13 bp, Homo sapiens
atccgctgccacc

SEQ ID NO: 2083126 - DNA, 23 bp, Homo sapiens
atccgctgccaccacgtctgcca

SEQ ID NO: 2083127 - DNA, 14 bp, Homo sapiens
atccgggacgcttc

SEQ ID NO: 2083128 - DNA, 17 bp, Homo sapiens
atccgggacgcttccag

SEQ ID NO: 2083129 - DNA, 16 bp, Homo sapiens
atccgtagttccctga

SEQ ID NO: 2083130 - DNA, 14 bp, Homo sapiens
atcctaccaatgca

SEQ ID NO: 2083131 - DNA, 18 bp, Homo sapiens
atcctaccaatgcatgca

SEQ ID NO: 2083132 - DNA, 20 bp, Homo sapiens
atcctagaaccaagcttcag

SEQ ID NO: 2083133 - DNA, 23 bp, Homo sapiens
atcctagaaccaagcttcagagc

SEQ ID NO: 2083134 - DNA, 18 bp, Homo sapiens
atcctaggcttaaatgca

SEQ ID NO: 2083135 - DNA, 12 bp, Homo sapiens
atcctaggtgct

SEQ ID NO: 2083136 - DNA, 21 bp, Homo sapiens
atcctatggtttctccatcca

SEQ ID NO: 2083137 - DNA, 20 bp, Homo sapiens
atcctattctcaccaggaag

SEQ ID NO: 2083138 - DNA, 18 bp, Homo sapiens
atcctcaaacatggaaga

SEQ ID NO: 2083139 - DNA, 20 bp, Homo sapiens
atcctcaacaacaaaccaaa

SEQ ID NO: 2083140 - DNA, 14 bp, Homo sapiens
atcctcacaggagc

SEQ ID NO: 2083141 - DNA, 22 bp, Homo sapiens
atcctcaccatccacagcaaga

SEQ ID NO: 2083142 - DNA, 20 bp, Homo sapiens
atcctcaggatttcattgac

SEQ ID NO: 2083143 - DNA, 20 bp, Homo sapiens
atcctcaggtagtactggga

SEQ ID NO: 2083144 - DNA, 23 bp, Homo sapiens
atcctccaacttcatttgatgct

SEQ ID NO: 2083145 - DNA, 15 bp, Homo sapiens
atcctcccacctcag

SEQ ID NO: 2083146 - DNA, 14 bp, Homo sapiens
atcctctggctggc

SEQ ID NO: 2083147 - DNA, 21 bp, Homo sapiens
atcctctggggttcatctagg

SEQ ID NO: 2083148 - DNA, 19 bp, Homo sapiens
atcctgataaacattaaac

SEQ ID NO: 2083149 - DNA, 17 bp, Homo sapiens
atcctgcagcctcctcc

SEQ ID NO: 2083150 - DNA, 19 bp, Homo sapiens
atcctgcaggaacgagcac

SEQ ID NO: 2083151 - DNA, 23 bp, Homo sapiens
atcctgcaggaacgagcactggc

SEQ ID NO: 2083152 - DNA, 18 bp, Homo sapiens
atcctgcctctccccaaa

SEQ ID NO: 2083153 - DNA, 14 bp, Homo sapiens
atcctgctgctgtg

SEQ ID NO: 2083154 - DNA, 18 bp, Homo sapiens
atcctgctgtggcctcac

SEQ ID NO: 2083155 - DNA, 17 bp, Homo sapiens
atcctgctttccctccc

SEQ ID NO: 2083156 - DNA, 18 bp, Homo sapiens
atcctgctttccctcccc

SEQ ID NO: 2083157 - DNA, 17 bp, Homo sapiens
atcctggcacccggccc

SEQ ID NO: 2083158 - DNA, 21 bp, Homo sapiens
atcctggcacccggcccctgc

SEQ ID NO: 2083159 - DNA, 23 bp, Homo sapiens
atcctggcacccggcccctgctg

SEQ ID NO: 2083160 - DNA, 11 bp, Homo sapiens
atcctggcctc

SEQ ID NO: 2083161 - DNA, 15 bp, Homo sapiens
atcctggcctccttt

SEQ ID NO: 2083162 - DNA, 23 bp, Homo sapiens
atcctgtctttaaggaaaaaaag

SEQ ID NO: 2083163 - DNA, 16 bp, Homo sapiens
atcctgtgtggggagg

SEQ ID NO: 2083164 - DNA, 17 bp, Homo sapiens
atcctgtgtggggaggc

SEQ ID NO: 2083165 - DNA, 19 bp, Homo sapiens
atcctgtgtggggaggcag

SEQ ID NO: 2083166 - DNA, 22 bp, Homo sapiens
atccttccagtggctcgctccc

SEQ ID NO: 2083167 - DNA, 13 bp, Homo sapiens
atccttctgcctt

SEQ ID NO: 2083168 - DNA, 16 bp, Homo sapiens
atccttggagagcagc

SEQ ID NO: 2083169 - DNA, 24 bp, Homo sapiens
atccttggagagcagctggctctc

SEQ ID NO: 2083170 - DNA, 17 bp, Homo sapiens
atcctttgagaatgtga

SEQ ID NO: 2083171 - DNA, 16 bp, Homo sapiens
atccttttttaaaagt

SEQ ID NO: 2083172 - DNA, 13 bp, Homo sapiens
atcgaacaaactg

SEQ ID NO: 2083173 - DNA, 18 bp, Homo sapiens
atcgaacaaactgatgcg

SEQ ID NO: 2083174 - DNA, 13 bp, Homo sapiens
atcgaatgaaatt

SEQ ID NO: 2083175 - DNA, 19 bp, Homo sapiens
atcgactttatacagaact

SEQ ID NO: 2083176 - DNA, 20 bp, Homo sapiens
atcgcaccactgtgtattta

SEQ ID NO: 2083177 - DNA, 18 bp, Homo sapiens
atcgcaccttttatacca

SEQ ID NO: 2083178 - DNA, 23 bp, Homo sapiens
atcgcgccactacactccagcct

SEQ ID NO: 2083179 - DNA, 15 bp, Homo sapiens
atcgcttgagcccag

SEQ ID NO: 2083180 - DNA, 17 bp, Homo sapiens
atcgctttgtactttgt

SEQ ID NO: 2083181 - DNA, 17 bp, Homo sapiens
atcggagcgaagcagag

SEQ ID NO: 2083182 - DNA, 21 bp, Homo sapiens
atcggatctggggctctggga

SEQ ID NO: 2083183 - DNA, 20 bp, Homo sapiens
atcggcccacagctcccacc

SEQ ID NO: 2083184 - DNA, 17 bp, Homo sapiens
atcggggcactgcaggg

SEQ ID NO: 2083185 - DNA, 13 bp, Homo sapiens
atcgtccttcctc

SEQ ID NO: 2083186 - DNA, 16 bp, Homo sapiens
atcgtccttcctctca

SEQ ID NO: 2083187 - DNA, 23 bp, Homo sapiens
atcgtctcctttgacatttcctt

SEQ ID NO: 2083188 - DNA, 14 bp, Homo sapiens
atcgtgacaacact

SEQ ID NO: 2083189 - DNA, 15 bp, Homo sapiens
atcgtgacaacactt

SEQ ID NO: 2083190 - DNA, 18 bp, Homo sapiens
atcgtgacccttcagggc

SEQ ID NO: 2083191 - DNA, 20 bp, Homo sapiens
atcgtgacccttcagggcca

SEQ ID NO: 2083192 - DNA, 22 bp, Homo sapiens
atcgtgacccttcagggccaga

SEQ ID NO: 2083193 - DNA, 20 bp, Homo sapiens
atcgtttattgcttaatccc

SEQ ID NO: 2083194 - DNA, 19 bp, Homo sapiens
atctaaagccagtggcagt

SEQ ID NO: 2083195 - DNA, 16 bp, Homo sapiens
atctaagcctttccat

SEQ ID NO: 2083196 - DNA, 22 bp, Homo sapiens
atctaatacctctgtgtgctcc

SEQ ID NO: 2083197 - DNA, 14 bp, Homo sapiens
atctaatattaaaa

SEQ ID NO: 2083198 - DNA, 21 bp, Homo sapiens
atctaatcaggttgttaatgt

SEQ ID NO: 2083199 - DNA, 12 bp, Homo sapiens
atctaatttata

SEQ ID NO: 2083200 - DNA, 17 bp, Homo sapiens
atctaatttatacaaaa

SEQ ID NO: 2083201 - DNA, 22 bp, Homo sapiens
atctaatttatacaaaataatt

SEQ ID NO: 2083202 - DNA, 15 bp, Homo sapiens
atgaagcccaagtga

SEQ ID NO: 2083203 - DNA, 20 bp, Homo sapiens
atgaagcccgtgtcctgcct

SEQ ID NO: 2083204 - DNA, 15 bp, Homo sapiens
atgaagcctgtgcca

SEQ ID NO: 2083205 - DNA, 17 bp, Homo sapiens
atgaagcctgtgccacc

SEQ ID NO: 2083206 - DNA, 23 bp, Homo sapiens
atgaagcctgtgccacctgcaag

SEQ ID NO: 2083207 - DNA, 16 bp, Homo sapiens
atgaagctctggccaa

SEQ ID NO: 2083208 - DNA, 20 bp, Homo sapiens
atgaaggactattaattcca

SEQ ID NO: 2083209 - DNA, 19 bp, Homo sapiens
atgaaggagttttttttaa

SEQ ID NO: 2083210 - DNA, 16 bp, Homo sapiens
atgaaggttaggattt

SEQ ID NO: 2083211 - DNA, 20 bp, Homo sapiens
atgaaggttaggatttaaca

SEQ ID NO: 2083212 - DNA, 17 bp, Homo sapiens
atgaaggtttctgaaaa

SEQ ID NO: 2083213 - DNA, 16 bp, Homo sapiens
atgaatatctgcttta

SEQ ID NO: 2083214 - DNA, 17 bp, Homo sapiens
atgaatatttcaaaata

SEQ ID NO: 2083215 - DNA, 21 bp, Homo sapiens
atgaatcccacccacatgtga

SEQ ID NO: 2083216 - DNA, 16 bp, Homo sapiens
atgaatcttttccact

SEQ ID NO: 2083217 - DNA, 19 bp, Homo sapiens
atgaatgaggtcccaggca

SEQ ID NO: 2083218 - DNA, 20 bp, Homo sapiens
atgaatgaggtcccaggcag

SEQ ID NO: 2083219 - DNA, 13 bp, Homo sapiens
atgaatgctgacc

SEQ ID NO: 2083220 - DNA, 21 bp, Homo sapiens
atgaatggtatggaactctct

SEQ ID NO: 2083221 - DNA, 18 bp, Homo sapiens
atgaatgtgttgatttga

SEQ ID NO: 2083222 - DNA, 11 bp, Homo sapiens
atgaatgttta

SEQ ID NO: 2083223 - DNA, 14 bp, Homo sapiens
atgaattaaataaa

SEQ ID NO: 2083224 - DNA, 18 bp, Homo sapiens
atgaattctctctaaaaa

SEQ ID NO: 2083225 - DNA, 14 bp, Homo sapiens
atgaatttatctga

SEQ ID NO: 2083226 - DNA, 20 bp, Homo sapiens
atgaatttggagactctgtg

SEQ ID NO: 2083227 - DNA, 21 bp, Homo sapiens
atgaatttggagactctgtgg

SEQ ID NO: 2083228 - DNA, 21 bp, Homo sapiens
atgaattttatcagccatgtt

SEQ ID NO: 2083229 - DNA, 16 bp, Homo sapiens
atgacaaagttacaaa

SEQ ID NO: 2083230 - DNA, 22 bp, Homo sapiens
atgacacggtaggccaagctga

SEQ ID NO: 2083231 - DNA, 12 bp, Homo sapiens
atgacagtgaat

SEQ ID NO: 2083232 - DNA, 20 bp, Homo sapiens
atgacatattttatcttgtt

SEQ ID NO: 2083233 - DNA, 18 bp, Homo sapiens
atgacatcacttgtacaa

SEQ ID NO: 2083234 - DNA, 19 bp, Homo sapiens
atgacatcacttgtacaaa

SEQ ID NO: 2083235 - DNA, 20 bp, Homo sapiens
atgacatcacttgtacaaaa

SEQ ID NO: 2083236 - DNA, 20 bp, Homo sapiens
atgacatgccaccctctcca

SEQ ID NO: 2083237 - DNA, 13 bp, Homo sapiens
atgacatttttga

SEQ ID NO: 2083238 - DNA, 22 bp, Homo sapiens
atgaccaagaaaaagaaaaaaa

SEQ ID NO: 2083239 - DNA, 12 bp, Homo sapiens
atgaccaagaat

SEQ ID NO: 2083240 - DNA, 21 bp, Homo sapiens
atgaccacgggcctcagtttc

SEQ ID NO: 2083241 - DNA, 19 bp, Homo sapiens
atgacctccagctttcctg

SEQ ID NO: 2083242 - DNA, 21 bp, Homo sapiens
atgacctccagctttcctgta

SEQ ID NO: 2083243 - DNA, 18 bp, Homo sapiens
atgaccttagtccgcaag

SEQ ID NO: 2083244 - DNA, 15 bp, Homo sapiens
atgactagaggcagg

SEQ ID NO: 2083245 - DNA, 16 bp, Homo sapiens
atgacttctgccccag

SEQ ID NO: 2083246 - DNA, 18 bp, Homo sapiens
atgacttgggcaccccca

SEQ ID NO: 2083247 - DNA, 20 bp, Homo sapiens
atgacttttccatgtatcta

SEQ ID NO: 2083248 - DNA, 21 bp, Homo sapiens
atgactttttttctgattcaa

SEQ ID NO: 2083249 - DNA, 23 bp, Homo sapiens
atgagaaactttgatctctgctt

SEQ ID NO: 2083250 - DNA, 21 bp, Homo sapiens
atgagaaaggttgaagcacca

SEQ ID NO: 2083251 - DNA, 22 bp, Homo sapiens
atgagaaaggttgaagcaccaa

SEQ ID NO: 2083252 - DNA, 13 bp, Homo sapiens
atgagaaatgtga

SEQ ID NO: 2083253 - DNA, 17 bp, Homo sapiens
atgagaacaagtcacag

SEQ ID NO: 2083254 - DNA, 23 bp, Homo sapiens
atgagaacaagtcacagctgcag

SEQ ID NO: 2083255 - DNA, 21 bp, Homo sapiens
atgagaagagggcctgtggga

SEQ ID NO: 2083256 - DNA, 17 bp, Homo sapiens
atgagaagttaagcagc

SEQ ID NO: 2083257 - DNA, 18 bp, Homo sapiens
atgagaagttaagcagcc

SEQ ID NO: 2083258 - DNA, 19 bp, Homo sapiens
atgagaagttaagcagcct

SEQ ID NO: 2083259 - DNA, 11 bp, Homo sapiens
atgagaatcta

SEQ ID NO: 2083260 - DNA, 23 bp, Homo sapiens
atgagacttccaaacctgacaga

SEQ ID NO: 2083261 - DNA, 13 bp, Homo sapiens
atgagatccttta

SEQ ID NO: 2083262 - DNA, 20 bp, Homo sapiens
atgagattccctctcctccc

SEQ ID NO: 2083263 - DNA, 18 bp, Homo sapiens
atgagattgttttatcat

SEQ ID NO: 2083264 - DNA, 16 bp, Homo sapiens
atgagcagtcacactg

SEQ ID NO: 2083265 - DNA, 22 bp, Homo sapiens
atgagctcctcttcctggcttc

SEQ ID NO: 2083266 - DNA, 15 bp, Homo sapiens
atgagctctgaacaa

SEQ ID NO: 2083267 - DNA, 16 bp, Homo sapiens
atgagctctgaacaaa

SEQ ID NO: 2083268 - DNA, 19 bp, Homo sapiens
atgagctctgaacaaacac

SEQ ID NO: 2083269 - DNA, 16 bp, Homo sapiens
atgagctcttcatgtt

SEQ ID NO: 2083270 - DNA, 12 bp, Homo sapiens
atgagctgaggg

SEQ ID NO: 2083271 - DNA, 13 bp, Homo sapiens
atgagctgagggg

SEQ ID NO: 2083272 - DNA, 14 bp, Homo sapiens
atgagctgtatctg

SEQ ID NO: 2083273 - DNA, 15 bp, Homo sapiens
atgaggaacctcaaa

SEQ ID NO: 2083274 - DNA, 15 bp, Homo sapiens
atgaggactcatata

SEQ ID NO: 2083275 - DNA, 21 bp, Homo sapiens
atgaggcctcttggacctctg

SEQ ID NO: 2083276 - DNA, 22 bp, Homo sapiens
atgaggcctcttggacctctgc

SEQ ID NO: 2083277 - DNA, 19 bp, Homo sapiens
atgaggcctttccccagtg

SEQ ID NO: 2083278 - DNA, 20 bp, Homo sapiens
atgaggcctttccccagtgt

SEQ ID NO: 2083279 - DNA, 14 bp, Homo sapiens
atgagggactggaa

SEQ ID NO: 2083280 - DNA, 22 bp, Homo sapiens
atgagggagggggcgctcagga

SEQ ID NO: 2083281 - DNA, 15 bp, Homo sapiens
atgagggcagcagcc

SEQ ID NO: 2083282 - DNA, 20 bp, Homo sapiens
atgagggcagcagccagccc

SEQ ID NO: 2083283 - DNA, 22 bp, Homo sapiens
atgagggcagcagccagccctg

SEQ ID NO: 2083284 - DNA, 16 bp, Homo sapiens
atgagggtcagggcag

SEQ ID NO: 2083285 - DNA, 17 bp, Homo sapiens
atgagggtttcattgtg

SEQ ID NO: 2083286 - DNA, 20 bp, Homo sapiens
atgaggtcagagcctgcagt

SEQ ID NO: 2083287 - DNA, 17 bp, Homo sapiens
atgaggtcccaggcaga

SEQ ID NO: 2083288 - DNA, 18 bp, Homo sapiens
atgaggtcccaggcagag

SEQ ID NO: 2083289 - DNA, 19 bp, Homo sapiens
atgaggtcccaggcagaga

SEQ ID NO: 2083290 - DNA, 15 bp, Homo sapiens
atgaggtctgaaatg

SEQ ID NO: 2083291 - DNA, 17 bp, Homo sapiens
atgaggtctgaaatgga

SEQ ID NO: 2083292 - DNA, 22 bp, Homo sapiens
atgaggttcaactgttgattgc

SEQ ID NO: 2083293 - DNA, 14 bp, Homo sapiens
atgagtacctcaaa

SEQ ID NO: 2083294 - DNA, 21 bp, Homo sapiens
atgagtatacaatatataaaa

SEQ ID NO: 2083295 - DNA, 21 bp, Homo sapiens
atgagtctacctgagcattca

SEQ ID NO: 2083296 - DNA, 17 bp, Homo sapiens
atgagtctgcataaact

SEQ ID NO: 2083297 - DNA, 19 bp, Homo sapiens
atgagtgattgacacacag

SEQ ID NO: 2083298 - DNA, 12 bp, Homo sapiens
atgagtggatgg

SEQ ID NO: 2083299 - DNA, 19 bp, Homo sapiens
atgagtggatggatggaca

SEQ ID NO: 2083300 - DNA, 19 bp, Homo sapiens
atgagttgttttcagactc

SEQ ID NO: 2083301 - DNA, 23 bp, Homo sapiens
atgagttgttttcagactcagac

SEQ ID NO: 2083302 - DNA, 14 bp, Homo sapiens
atgagtttgcttat

SEQ ID NO: 2083303 - DNA, 20 bp, Homo sapiens
atgagtttttgatagcttta

SEQ ID NO: 2083304 - DNA, 18 bp, Homo sapiens
atgataaatatttatgct

SEQ ID NO: 2083305 - DNA, 15 bp, Homo sapiens
atgataatgaacaga

SEQ ID NO: 2083306 - DNA, 12 bp, Homo sapiens
atgatattttat

SEQ ID NO: 2083307 - DNA, 20 bp, Homo sapiens
atgatattttgtctcctacc

SEQ ID NO: 2083308 - DNA, 15 bp, Homo sapiens
atgatcacagtgact

SEQ ID NO: 2083309 - DNA, 22 bp, Homo sapiens
atgatcactaatactaattcat

SEQ ID NO: 2083310 - DNA, 17 bp, Homo sapiens
atgatccaagtatttta

SEQ ID NO: 2083311 - DNA, 15 bp, Homo sapiens
atgatccttgtttta

SEQ ID NO: 2083312 - DNA, 14 bp, Homo sapiens
atgatcgtgcctat

SEQ ID NO: 2083313 - DNA, 18 bp, Homo sapiens
atggatggaaatatgttc

SEQ ID NO: 2083314 - DNA, 24 bp, Homo sapiens
atggatggaaatatgttctaacag

SEQ ID NO: 2083315 - DNA, 12 bp, Homo sapiens
atggattattta

SEQ ID NO: 2083316 - DNA, 13 bp, Homo sapiens
atggattctaaaa

SEQ ID NO: 2083317 - DNA, 18 bp, Homo sapiens
atggattctaaaatgcct

SEQ ID NO: 2083318 - DNA, 14 bp, Homo sapiens
atggatttgaagca

SEQ ID NO: 2083319 - DNA, 21 bp, Homo sapiens
atggcaaagcggttgcttctg

SEQ ID NO: 2083320 - DNA, 19 bp, Homo sapiens
atggcaaggactgcaggga

SEQ ID NO: 2083321 - DNA, 14 bp, Homo sapiens
atggcaagtgatat

SEQ ID NO: 2083322 - DNA, 14 bp, Homo sapiens
atggcaccagcccc

SEQ ID NO: 2083323 - DNA, 20 bp, Homo sapiens
atggcaccagccccctggat

SEQ ID NO: 2083324 - DNA, 22 bp, Homo sapiens
atggcaccagccccctggatgg

SEQ ID NO: 2083325 - DNA, 19 bp, Homo sapiens
atggcagatgtaggaggga

SEQ ID NO: 2083326 - DNA, 20 bp, Homo sapiens
atggcagatgtaggagggac

SEQ ID NO: 2083327 - DNA, 21 bp, Homo sapiens
atggcagatgtaggagggact

SEQ ID NO: 2083328 - DNA, 14 bp, Homo sapiens
atggcagtccagcc

SEQ ID NO: 2083329 - DNA, 19 bp, Homo sapiens
atggcatgatttatatatg

SEQ ID NO: 2083330 - DNA, 20 bp, Homo sapiens
atggcatgatttatatatgg

SEQ ID NO: 2083331 - DNA, 23 bp, Homo sapiens
atggcatgatttatatatggcat

SEQ ID NO: 2083332 - DNA, 15 bp, Homo sapiens
atggccaagagcatc

SEQ ID NO: 2083333 - DNA, 21 bp, Homo sapiens
atggccaagggggtggacgca

SEQ ID NO: 2083334 - DNA, 22 bp, Homo sapiens
atggccaggtggccactccaga

SEQ ID NO: 2083335 - DNA, 18 bp, Homo sapiens
atggcccttcccactgga

SEQ ID NO: 2083336 - DNA, 18 bp, Homo sapiens
atggcctatgcacatatg

SEQ ID NO: 2083337 - DNA, 20 bp, Homo sapiens
atggcctattatattaaaat

SEQ ID NO: 2083338 - DNA, 19 bp, Homo sapiens
atggcctgccttgaagcca

SEQ ID NO: 2083339 - DNA, 14 bp, Homo sapiens
atggccttccctcc

SEQ ID NO: 2083340 - DNA, 18 bp, Homo sapiens
atggcctttgataaatgt

SEQ ID NO: 2083341 - DNA, 18 bp, Homo sapiens
atggcgattccctctcac

SEQ ID NO: 2083342 - DNA, 15 bp, Homo sapiens
atggcgcgggaggca

SEQ ID NO: 2083343 - DNA, 19 bp, Homo sapiens
atggcgctattgcactcca

SEQ ID NO: 2083344 - DNA, 15 bp, Homo sapiens
atggctataaatata

SEQ ID NO: 2083345 - DNA, 16 bp, Homo sapiens
atggctataaatatat

SEQ ID NO: 2083346 - DNA, 19 bp, Homo sapiens
atggctataggtgctacaa

SEQ ID NO: 2083347 - DNA, 21 bp, Homo sapiens
atggctataggtgctacaaaa

SEQ ID NO: 2083348 - DNA, 14 bp, Homo sapiens
atggctatatggca

SEQ ID NO: 2083349 - DNA, 19 bp, Homo sapiens
atggctatatggcaagaaa

SEQ ID NO: 2083350 - DNA, 13 bp, Homo sapiens
atggctattttat

SEQ ID NO: 2083351 - DNA, 20 bp, Homo sapiens
atggctgataattttaaatt

SEQ ID NO: 2083352 - DNA, 17 bp, Homo sapiens
atggctgtaaactataa

SEQ ID NO: 2083353 - DNA, 15 bp, Homo sapiens
atggctgtgaggatg

SEQ ID NO: 2083354 - DNA, 16 bp, Homo sapiens
atggctgtgcctctgc

SEQ ID NO: 2083355 - DNA, 17 bp, Homo sapiens
atggctgtgcctctgcc

SEQ ID NO: 2083356 - DNA, 16 bp, Homo sapiens
atggcttaatgtttat

SEQ ID NO: 2083357 - DNA, 21 bp, Homo sapiens
atggcttaatgtttattcctg

SEQ ID NO: 2083358 - DNA, 21 bp, Homo sapiens
atggcttataaatgtgtattc

SEQ ID NO: 2083359 - DNA, 13 bp, Homo sapiens
atggcttggggag

SEQ ID NO: 2083360 - DNA, 14 bp, Homo sapiens
atggcttggggagc

SEQ ID NO: 2083361 - DNA, 23 bp, Homo sapiens
atgggaacctagtactctctgct

SEQ ID NO: 2083362 - DNA, 22 bp, Homo sapiens
atgggaagatggtagcagataa

SEQ ID NO: 2083363 - DNA, 12 bp, Homo sapiens
atgggaagccat

SEQ ID NO: 2083364 - DNA, 22 bp, Homo sapiens
atgggaagccatattcacacct

SEQ ID NO: 2083365 - DNA, 22 bp, Homo sapiens
atgggacaaagttccaaaatgc

SEQ ID NO: 2083366 - DNA, 22 bp, Homo sapiens
atgggacatcaaatttgccacc

SEQ ID NO: 2083367 - DNA, 11 bp, Homo sapiens
atgggaccagg

SEQ ID NO: 2083368 - DNA, 13 bp, Homo sapiens
atgggaccaggga

SEQ ID NO: 2083369 - DNA, 15 bp, Homo sapiens
atgggagagtagatg

SEQ ID NO: 2083370 - DNA, 15 bp, Homo sapiens
atgggagatggtcag

SEQ ID NO: 2083371 - DNA, 16 bp, Homo sapiens
atgggagggagggaga

SEQ ID NO: 2083372 - DNA, 14 bp, Homo sapiens
atgggcattgggct

SEQ ID NO: 2083373 - DNA, 19 bp, Homo sapiens
atgggcattgggctgacac

SEQ ID NO: 2083374 - DNA, 21 bp, Homo sapiens
atgggcattgggctgacacct

SEQ ID NO: 2083375 - DNA, 17 bp, Homo sapiens
atgggccaattaaaata

SEQ ID NO: 2083376 - DNA, 12 bp, Homo sapiens
atgggccttgct

SEQ ID NO: 2083377 - DNA, 22 bp, Homo sapiens
atgggccttgctttgggctttg

SEQ ID NO: 2083378 - DNA, 21 bp, Homo sapiens
atgggctagtgtgagtggcag

SEQ ID NO: 2083379 - DNA, 22 bp, Homo sapiens
atgggcttggacttcctggggc

SEQ ID NO: 2083380 - DNA, 18 bp, Homo sapiens
atgggcttgttttcttgc

SEQ ID NO: 2083381 - DNA, 19 bp, Homo sapiens
atggggctgaacggggaga

SEQ ID NO: 2083382 - DNA, 20 bp, Homo sapiens
atggggctgcgggacagagg

SEQ ID NO: 2083383 - DNA, 18 bp, Homo sapiens
atgggggatgggccaggg

SEQ ID NO: 2083384 - DNA, 20 bp, Homo sapiens
atggggggaggggggagggc

SEQ ID NO: 2083385 - DNA, 15 bp, Homo sapiens
atggggtggaaggca

SEQ ID NO: 2083386 - DNA, 18 bp, Homo sapiens
atggggtgggcagggctg

SEQ ID NO: 2083387 - DNA, 19 bp, Homo sapiens
atggggtgggcagggctgg

SEQ ID NO: 2083388 - DNA, 18 bp, Homo sapiens
atgggtaatataaagtgt

SEQ ID NO: 2083389 - DNA, 13 bp, Homo sapiens
atgggtgtgccct

SEQ ID NO: 2083390 - DNA, 13 bp, Homo sapiens
atgggtgtgtgtt

SEQ ID NO: 2083391 - DNA, 19 bp, Homo sapiens
atgggtgtgtgtttgtgtg

SEQ ID NO: 2083392 - DNA, 16 bp, Homo sapiens
atgggttggtgcttct

SEQ ID NO: 2083393 - DNA, 17 bp, Homo sapiens
atggtaagactgtaatt

SEQ ID NO: 2083394 - DNA, 23 bp, Homo sapiens
atggtatgctggccagcaccctc

SEQ ID NO: 2083395 - DNA, 20 bp, Homo sapiens
atggtattttcgtgcatttg

SEQ ID NO: 2083396 - DNA, 17 bp, Homo sapiens
atggtcccacatccctg

SEQ ID NO: 2083397 - DNA, 23 bp, Homo sapiens
atggtcccacatccctgggcctg

SEQ ID NO: 2083398 - DNA, 22 bp, Homo sapiens
atggtccgccacgaggagcttc

SEQ ID NO: 2083399 - DNA, 14 bp, Homo sapiens
atggtcctggggct

SEQ ID NO: 2083400 - DNA, 17 bp, Homo sapiens
atggtcctggggctctg

SEQ ID NO: 2083401 - DNA, 14 bp, Homo sapiens
atggtctaaaaata

SEQ ID NO: 2083402 - DNA, 23 bp, Homo sapiens
atggtctctcgggccccccacac

SEQ ID NO: 2083403 - DNA, 12 bp, Homo sapiens
atggtgaaaatg

SEQ ID NO: 2083404 - DNA, 24 bp, Homo sapiens
atggtgaaaccccgtctctactaa

SEQ ID NO: 2083405 - DNA, 13 bp, Homo sapiens
atggtgacacaca

SEQ ID NO: 2083406 - DNA, 14 bp, Homo sapiens
atggtgacacacag

SEQ ID NO: 2083407 - DNA, 23 bp, Homo sapiens
atggtgacttcctcgcctctccc

SEQ ID NO: 2083408 - DNA, 15 bp, Homo sapiens
atggtggctgggttg

SEQ ID NO: 2083409 - DNA, 19 bp, Homo sapiens
atggtgggaaccctcccca

SEQ ID NO: 2083410 - DNA, 22 bp, Homo sapiens
atggtggtaaacattctctcag

SEQ ID NO: 2083411 - DNA, 12 bp, Homo sapiens
atggtgtaatgc

SEQ ID NO: 2083412 - DNA, 13 bp, Homo sapiens
atggtgtaatgca

SEQ ID NO: 2083413 - DNA, 15 bp, Homo sapiens
atggtgttgtatact

SEQ ID NO: 2083414 - DNA, 18 bp, Homo sapiens
atggttccatgcctgagg

SEQ ID NO: 2083415 - DNA, 18 bp, Homo sapiens
atggttcccaataaaagt

SEQ ID NO: 2083416 - DNA, 13 bp, Homo sapiens
atggttccttccc

SEQ ID NO: 2083417 - DNA, 19 bp, Homo sapiens
atggttccttccctgggaa

SEQ ID NO: 2083418 - DNA, 17 bp, Homo sapiens
atggttctcagatcttg

SEQ ID NO: 2083419 - DNA, 23 bp, Homo sapiens
atggttgccaggacgaattgaga

SEQ ID NO: 2083420 - DNA, 17 bp, Homo sapiens
atggttgccttaaagaa

SEQ ID NO: 2083421 - DNA, 23 bp, Homo sapiens
atggtttacatgaacacagctgc

SEQ ID NO: 2083422 - DNA, 14 bp, Homo sapiens
atggtttactgctg

SEQ ID NO: 2083423 - DNA, 17 bp, Homo sapiens
atggtttactgctgtca

SEQ ID NO: 2083424 - DNA, 20 bp, Homo sapiens
atggtttctgcgtgctttat

SEQ ID NO: 2083425 - DNA, 22 bp, Homo sapiens
atggtttgactcccgaacatca

SEQ ID NO: 2083426 - DNA, 21 bp, Homo sapiens
atggttttctccaagagctac

SEQ ID NO: 2083427 - DNA, 12 bp, Homo sapiens
atgtaaaatgca

SEQ ID NO: 2083428 - DNA, 13 bp, Homo sapiens
atgtaaaatgcag

SEQ ID NO: 2083429 - DNA, 14 bp, Homo sapiens
atgtaaacaggaga

SEQ ID NO: 2083430 - DNA, 16 bp, Homo sapiens
atgtaaagcttgtctg

SEQ ID NO: 2083431 - DNA, 13 bp, Homo sapiens
atgtaaatatttt

SEQ ID NO: 2083432 - DNA, 13 bp, Homo sapiens
atgtaacaaccag

SEQ ID NO: 2083433 - DNA, 14 bp, Homo sapiens
atgtaacaaccaga

SEQ ID NO: 2083434 - DNA, 13 bp, Homo sapiens
atgtaacattaat

SEQ ID NO: 2083435 - DNA, 22 bp, Homo sapiens
atgtaacccaaatgtccaatat

SEQ ID NO: 2083436 - DNA, 18 bp, Homo sapiens
atgtaactaggccatttg

SEQ ID NO: 2083437 - DNA, 15 bp, Homo sapiens
atgtaaggaattgaa

SEQ ID NO: 2083438 - DNA, 12 bp, Homo sapiens
atgtaataaatc

SEQ ID NO: 2083439 - DNA, 15 bp, Homo sapiens
atgtaataaatctga

SEQ ID NO: 2083440 - DNA, 15 bp, Homo sapiens
atgtaatcaatgttt

SEQ ID NO: 2083441 - DNA, 17 bp, Homo sapiens
atgtaatcccagctact

SEQ ID NO: 2083442 - DNA, 15 bp, Homo sapiens
atgtaattgaataaa

SEQ ID NO: 2083443 - DNA, 18 bp, Homo sapiens
atgtacactggatatgtt

SEQ ID NO: 2083444 - DNA, 13 bp, Homo sapiens
atgtacagcatgc

SEQ ID NO: 2083445 - DNA, 15 bp, Homo sapiens
atgtaccagtgtact

SEQ ID NO: 2083446 - DNA, 13 bp, Homo sapiens
atgtaccatcaat

SEQ ID NO: 2083447 - DNA, 15 bp, Homo sapiens
atgtaccatgtacat

SEQ ID NO: 2083448 - DNA, 17 bp, Homo sapiens
atgtaccatgttaaaga

SEQ ID NO: 2083449 - DNA, 20 bp, Homo sapiens
atgtacccaccgggccactc

SEQ ID NO: 2083450 - DNA, 15 bp, Homo sapiens
atgtaccttgaccat

SEQ ID NO: 2083451 - DNA, 14 bp, Homo sapiens
atgtactgagattt

SEQ ID NO: 2083452 - DNA, 18 bp, Homo sapiens
atgtactgagccttgtaa

SEQ ID NO: 2083453 - DNA, 12 bp, Homo sapiens
atgtagaaagct

SEQ ID NO: 2083454 - DNA, 17 bp, Homo sapiens
atgtagactatatacat

SEQ ID NO: 2083455 - DNA, 23 bp, Homo sapiens
atgtagactatatacatgtgtgt

SEQ ID NO: 2083456 - DNA, 17 bp, Homo sapiens
atgtagcccggccaggg

SEQ ID NO: 2083457 - DNA, 12 bp, Homo sapiens
atgtaggaggga

SEQ ID NO: 2083458 - DNA, 21 bp, Homo sapiens
atgtaggtgtctgcacccagg

SEQ ID NO: 2083459 - DNA, 19 bp, Homo sapiens
atgtagtataaagaaaagt

SEQ ID NO: 2083460 - DNA, 13 bp, Homo sapiens
atgtagttttaac

SEQ ID NO: 2083461 - DNA, 17 bp, Homo sapiens
atgtataaagaacaagg

SEQ ID NO: 2083462 - DNA, 23 bp, Homo sapiens
atgtataatatttttaattaaat

SEQ ID NO: 2083463 - DNA, 13 bp, Homo sapiens
atgtatacacaca

SEQ ID NO: 2083464 - DNA, 17 bp, Homo sapiens
atgtatacacacatata

SEQ ID NO: 2083465 - DNA, 18 bp, Homo sapiens
atgtatacacacatatac

SEQ ID NO: 2083466 - DNA, 20 bp, Homo sapiens
atgtatacacacatatacat

SEQ ID NO: 2083467 - DNA, 16 bp, Homo sapiens
atgtatagtaaatcac

SEQ ID NO: 2083468 - DNA, 18 bp, Homo sapiens
atgtatatacacatatac

SEQ ID NO: 2083469 - DNA, 16 bp, Homo sapiens
atgtatatagatgtgc

SEQ ID NO: 2083470 - DNA, 17 bp, Homo sapiens
atctgcttggttggctg

SEQ ID NO: 2083471 - DNA, 16 bp, Homo sapiens
atctgcttgtattttc

SEQ ID NO: 2083472 - DNA, 13 bp, Homo sapiens
atctggctcctgt

SEQ ID NO: 2083473 - DNA, 16 bp, Homo sapiens
atctgggaccctttcc

SEQ ID NO: 2083474 - DNA, 23 bp, Homo sapiens
atctgggaccctttccttccttc

SEQ ID NO: 2083475 - DNA, 13 bp, Homo sapiens
atctgggaggctg

SEQ ID NO: 2083476 - DNA, 20 bp, Homo sapiens
atctgggaggtctccactga

SEQ ID NO: 2083477 - DNA, 18 bp, Homo sapiens
atctgggtccttgcaccc

SEQ ID NO: 2083478 - DNA, 22 bp, Homo sapiens
atctggttagataatgaatgat

SEQ ID NO: 2083479 - DNA, 15 bp, Homo sapiens
atctgtacgtaagaa

SEQ ID NO: 2083480 - DNA, 12 bp, Homo sapiens
atctgtactgta

SEQ ID NO: 2083481 - DNA, 18 bp, Homo sapiens
atctgtagggctggacct

SEQ ID NO: 2083482 - DNA, 20 bp, Homo sapiens
atctgtatatacaataacat

SEQ ID NO: 2083483 - DNA, 22 bp, Homo sapiens
atctgtatttaatggtttttat

SEQ ID NO: 2083484 - DNA, 18 bp, Homo sapiens
atctgtcacacaaggctg

SEQ ID NO: 2083485 - DNA, 17 bp, Homo sapiens
atctgtcatctctctgg

SEQ ID NO: 2083486 - DNA, 22 bp, Homo sapiens
atctgtcatttgagcagggctc

SEQ ID NO: 2083487 - DNA, 15 bp, Homo sapiens
atctgtcccctctcc

SEQ ID NO: 2083488 - DNA, 19 bp, Homo sapiens
atctgtcttgccagccaga

SEQ ID NO: 2083489 - DNA, 19 bp, Homo sapiens
atctgtgaggtgctgatga

SEQ ID NO: 2083490 - DNA, 17 bp, Homo sapiens
atctgtgataattttct

SEQ ID NO: 2083491 - DNA, 21 bp, Homo sapiens
atctgtgtaacctccacagta

SEQ ID NO: 2083492 - DNA, 22 bp, Homo sapiens
atctgtgtaacctccacagtag

SEQ ID NO: 2083493 - DNA, 16 bp, Homo sapiens
atctgtgtctctggaa

SEQ ID NO: 2083494 - DNA, 19 bp, Homo sapiens
atctgtgtgtgtcccccta

SEQ ID NO: 2083495 - DNA, 13 bp, Homo sapiens
atctgttttcaac

SEQ ID NO: 2083496 - DNA, 20 bp, Homo sapiens
atctgttttgtatatgatct

SEQ ID NO: 2083497 - DNA, 17 bp, Homo sapiens
atgtatatatatatagt

SEQ ID NO: 2083498 - DNA, 13 bp, Homo sapiens
atgtatatgtata

SEQ ID NO: 2083499 - DNA, 18 bp, Homo sapiens
atgtatatgtatatctat

SEQ ID NO: 2083500 - DNA, 20 bp, Homo sapiens
atgtatatgtcatttatttt

SEQ ID NO: 2083501 - DNA, 16 bp, Homo sapiens
atgtatatgtgttcat

SEQ ID NO: 2083502 - DNA, 16 bp, Homo sapiens
atgtatcattaatgta

SEQ ID NO: 2083503 - DNA, 18 bp, Homo sapiens
atgtatggaatacagtgt

SEQ ID NO: 2083504 - DNA, 21 bp, Homo sapiens
atgtatggaatacagtgttat

SEQ ID NO: 2083505 - DNA, 22 bp, Homo sapiens
atgtatgtgaaagtgtaaaata

SEQ ID NO: 2083506 - DNA, 18 bp, Homo sapiens
atgtatgtgcacatgtgt

SEQ ID NO: 2083507 - DNA, 14 bp, Homo sapiens
atgtatgtgtgtgg

SEQ ID NO: 2083508 - DNA, 13 bp, Homo sapiens
atgtatgtttaca

SEQ ID NO: 2083509 - DNA, 14 bp, Homo sapiens
atgtatgtttacat

SEQ ID NO: 2083510 - DNA, 16 bp, Homo sapiens
atgtattaatattcat

SEQ ID NO: 2083511 - DNA, 14 bp, Homo sapiens
atgtattatcacat

SEQ ID NO: 2083512 - DNA, 23 bp, Homo sapiens
atgtattattttctatagctctt

SEQ ID NO: 2083513 - DNA, 20 bp, Homo sapiens
atgtattgtaaacagaagga

SEQ ID NO: 2083514 - DNA, 19 bp, Homo sapiens
atgtattgtaaacatgtgt

SEQ ID NO: 2083515 - DNA, 21 bp, Homo sapiens
atgtattgtaaacatgtgttt

SEQ ID NO: 2083516 - DNA, 14 bp, Homo sapiens
atgtatttatattt

SEQ ID NO: 2083517 - DNA, 14 bp, Homo sapiens
atgtcaaacaaata

SEQ ID NO: 2083518 - DNA, 17 bp, Homo sapiens
atgtcaaggactcctgt

SEQ ID NO: 2083519 - DNA, 14 bp, Homo sapiens
atgtcaatttgtat

SEQ ID NO: 2083520 - DNA, 16 bp, Homo sapiens
atgtcaatttgtatat

SEQ ID NO: 2083521 - DNA, 21 bp, Homo sapiens
atgtcacacttgtttcttgtt

SEQ ID NO: 2083522 - DNA, 17 bp, Homo sapiens
atgtcacaggcaggtcc

SEQ ID NO: 2083523 - DNA, 17 bp, Homo sapiens
atgtcacataatgaatg

SEQ ID NO: 2083524 - DNA, 20 bp, Homo sapiens
atgtcacataatgaatgcta

SEQ ID NO: 2083525 - DNA, 13 bp, Homo sapiens
atgtcaccacctt

SEQ ID NO: 2083526 - DNA, 18 bp, Homo sapiens
atgtcaccaccttcccag

SEQ ID NO: 2083527 - DNA, 23 bp, Homo sapiens
atgtcaccaccttcccagctctc

SEQ ID NO: 2083528 - DNA, 20 bp, Homo sapiens
atgtcaccgtggaccttcct

SEQ ID NO: 2083529 - DNA, 21 bp, Homo sapiens
atgtcaccgtggaccttcctg

SEQ ID NO: 2083530 - DNA, 21 bp, Homo sapiens
atgtcacctcagctgatatta

SEQ ID NO: 2083531 - DNA, 21 bp, Homo sapiens
atgtcagaaactcgatgaatg

SEQ ID NO: 2083532 - DNA, 23 bp, Homo sapiens
atgtcagccgagccgggcctggg

SEQ ID NO: 2083533 - DNA, 12 bp, Homo sapiens
atgtcagccttg

SEQ ID NO: 2083534 - DNA, 14 bp, Homo sapiens
atgtcagccttgca

SEQ ID NO: 2083535 - DNA, 19 bp, Homo sapiens
atgtcaggaacagaaggat

SEQ ID NO: 2083536 - DNA, 20 bp, Homo sapiens
atgtcaggaacagaaggatg

SEQ ID NO: 2083537 - DNA, 16 bp, Homo sapiens
atgtcagtctggttta

SEQ ID NO: 2083538 - DNA, 22 bp, Homo sapiens
atgtcatcaaatattaccaaaa

SEQ ID NO: 2083539 - DNA, 15 bp, Homo sapiens
atgtcattaatgtgt

SEQ ID NO: 2083540 - DNA, 17 bp, Homo sapiens
atgtcattaatgtgttg

SEQ ID NO: 2083541 - DNA, 16 bp, Homo sapiens
atgtcattatgtagaa

SEQ ID NO: 2083542 - DNA, 23 bp, Homo sapiens
atgtcattatgtagaaatattat

SEQ ID NO: 2083543 - DNA, 18 bp, Homo sapiens
atgtcatttcatttccta

SEQ ID NO: 2083544 - DNA, 21 bp, Homo sapiens
atgtccagaagaatattcagg

SEQ ID NO: 2083545 - DNA, 22 bp, Homo sapiens
atgtccagctagccaactcctc

SEQ ID NO: 2083546 - DNA, 17 bp, Homo sapiens
atgtcccatctgctcct

SEQ ID NO: 2083547 - DNA, 20 bp, Homo sapiens
atgtcccatctgctcctccc

SEQ ID NO: 2083548 - DNA, 15 bp, Homo sapiens
atgtcccctgtccca

SEQ ID NO: 2083549 - DNA, 20 bp, Homo sapiens
atgtcccttttcctaagtca

SEQ ID NO: 2083550 - DNA, 19 bp, Homo sapiens
atgtccgttccaggagcac

SEQ ID NO: 2083551 - DNA, 21 bp, Homo sapiens
atgtccgttccaggagcacac

SEQ ID NO: 2083552 - DNA, 15 bp, Homo sapiens
atgtcctatgtgtga

SEQ ID NO: 2083553 - DNA, 13 bp, Homo sapiens
atgtctaaagagc

SEQ ID NO: 2083554 - DNA, 15 bp, Homo sapiens
atgtctatagagaaa

SEQ ID NO: 2083555 - DNA, 14 bp, Homo sapiens
atgtctatttaagc

SEQ ID NO: 2083556 - DNA, 13 bp, Homo sapiens
atgtctctcagaa

SEQ ID NO: 2083557 - DNA, 21 bp, Homo sapiens
atgtctctcagaattcttcag

SEQ ID NO: 2083558 - DNA, 20 bp, Homo sapiens
atgtctcttcctctgttcta

SEQ ID NO: 2083559 - DNA, 18 bp, Homo sapiens
atgtcttcatttcattgt

SEQ ID NO: 2083560 - DNA, 13 bp, Homo sapiens
atgtcttggacac

SEQ ID NO: 2083561 - DNA, 19 bp, Homo sapiens
atgtcttggacactgtaca

SEQ ID NO: 2083562 - DNA, 19 bp, Homo sapiens
atgtcttgggtaggcggga

SEQ ID NO: 2083563 - DNA, 14 bp, Homo sapiens
atgtcttgtacatg

SEQ ID NO: 2083564 - DNA, 16 bp, Homo sapiens
atgtgtgcctgtggca

SEQ ID NO: 2083565 - DNA, 18 bp, Homo sapiens
atgtgtgcctgtggcaga

SEQ ID NO: 2083566 - DNA, 15 bp, Homo sapiens
atgtgtggatgtgta

SEQ ID NO: 2083567 - DNA, 14 bp, Homo sapiens
atgtgtgggaaagg

SEQ ID NO: 2083568 - DNA, 20 bp, Homo sapiens
atgtgtggtgctaactgtat

SEQ ID NO: 2083569 - DNA, 16 bp, Homo sapiens
atgtgtgtatatgtat

SEQ ID NO: 2083570 - DNA, 22 bp, Homo sapiens
atgtgtgtatatgtatgtgtgt

SEQ ID NO: 2083571 - DNA, 13 bp, Homo sapiens
atgtgtgtctcac

SEQ ID NO: 2083572 - DNA, 11 bp, Homo sapiens
atgtgtgtggt

SEQ ID NO: 2083573 - DNA, 13 bp, Homo sapiens
atgtgtgtgtatg

SEQ ID NO: 2083574 - DNA, 15 bp, Homo sapiens
atgtgtgtgtatgct

SEQ ID NO: 2083575 - DNA, 14 bp, Homo sapiens
atgtgtgtgtctgt

SEQ ID NO: 2083576 - DNA, 15 bp, Homo sapiens
atgtgtgtttaaata

SEQ ID NO: 2083577 - DNA, 20 bp, Homo sapiens
atgtgttaaacatgctaaat

SEQ ID NO: 2083578 - DNA, 23 bp, Homo sapiens
atgtgttcaaggaccacatgtgt

SEQ ID NO: 2083579 - DNA, 17 bp, Homo sapiens
atgtgtttactttatgt

SEQ ID NO: 2083580 - DNA, 14 bp, Homo sapiens
atgtgttttctgaa

SEQ ID NO: 2083581 - DNA, 15 bp, Homo sapiens
atgttaaaaaaataa

SEQ ID NO: 2083582 - DNA, 18 bp, Homo sapiens
atgttaaatcccattcat

SEQ ID NO: 2083583 - DNA, 22 bp, Homo sapiens
atgttaactattattaataaat

SEQ ID NO: 2083584 - DNA, 13 bp, Homo sapiens
atgttaagctctt

SEQ ID NO: 2083585 - DNA, 15 bp, Homo sapiens
atgttaagctcttta

SEQ ID NO: 2083586 - DNA, 15 bp, Homo sapiens
atgttaagttacttc

SEQ ID NO: 2083587 - DNA, 23 bp, Homo sapiens
atgttaagttacttcactttaat

SEQ ID NO: 2083588 - DNA, 14 bp, Homo sapiens
atgttaattaaact

SEQ ID NO: 2083589 - DNA, 16 bp, Homo sapiens
atgttaattaaactga

SEQ ID NO: 2083590 - DNA, 23 bp, Homo sapiens
atgttaattcagcactgatttca

SEQ ID NO: 2083591 - DNA, 14 bp, Homo sapiens
atgttaatttgtta

SEQ ID NO: 2083592 - DNA, 17 bp, Homo sapiens
atgttacactaagggtg

SEQ ID NO: 2083593 - DNA, 17 bp, Homo sapiens
atgttacatcacagtgt

SEQ ID NO: 2083594 - DNA, 14 bp, Homo sapiens
atgttacattgttt

SEQ ID NO: 2083595 - DNA, 15 bp, Homo sapiens
atgttaccaaagcaa

SEQ ID NO: 2083596 - DNA, 23 bp, Homo sapiens
atgttaccaaagcaatatttccc

SEQ ID NO: 2083597 - DNA, 21 bp, Homo sapiens
atgttacctcctataaactta

SEQ ID NO: 2083598 - DNA, 19 bp, Homo sapiens
atgttaggaaaatttcaca

SEQ ID NO: 2083599 - DNA, 16 bp, Homo sapiens
atgttagggtgctctg

SEQ ID NO: 2083600 - DNA, 17 bp, Homo sapiens
atgttatatattttttg

SEQ ID NO: 2083601 - DNA, 20 bp, Homo sapiens
atgttatttatatattggta

SEQ ID NO: 2083602 - DNA, 22 bp, Homo sapiens
atgttatttgttattttcagta

SEQ ID NO: 2083603 - DNA, 17 bp, Homo sapiens
atgttcacgcaacttga

SEQ ID NO: 2083604 - DNA, 19 bp, Homo sapiens
atgttcacgcaacttgaaa

SEQ ID NO: 2083605 - DNA, 16 bp, Homo sapiens
atgttcagaagaaatt

SEQ ID NO: 2083606 - DNA, 23 bp, Homo sapiens
atgttcagaaggttgctctagat

SEQ ID NO: 2083607 - DNA, 15 bp, Homo sapiens
atgttcattaaattt

SEQ ID NO: 2083608 - DNA, 19 bp, Homo sapiens
atgttccaataaaacttta

SEQ ID NO: 2083609 - DNA, 14 bp, Homo sapiens
atgttccctgcacc

SEQ ID NO: 2083610 - DNA, 19 bp, Homo sapiens
atgttccctgcaccctgga

SEQ ID NO: 2083611 - DNA, 15 bp, Homo sapiens
atgttcctagtgaaa

SEQ ID NO: 2083612 - DNA, 18 bp, Homo sapiens
atgttctgaataatttct

SEQ ID NO: 2083613 - DNA, 23 bp, Homo sapiens
atgttctggctttacattttatt

SEQ ID NO: 2083614 - DNA, 13 bp, Homo sapiens
atgttctgggaca

SEQ ID NO: 2083615 - DNA, 14 bp, Homo sapiens
atgttctgggacac

SEQ ID NO: 2083616 - DNA, 21 bp, Homo sapiens
atgttctgtcacgtgaaatat

SEQ ID NO: 2083617 - DNA, 13 bp, Homo sapiens
atgttctgttgta

SEQ ID NO: 2083618 - DNA, 18 bp, Homo sapiens
atgttcttttttgttaca

SEQ ID NO: 2083619 - DNA, 22 bp, Homo sapiens
atgttgaatgcccacaggcaaa

SEQ ID NO: 2083620 - DNA, 13 bp, Homo sapiens
atgttgagctgag

SEQ ID NO: 2083621 - DNA, 21 bp, Homo sapiens
atgttgagtgttcattttagt

SEQ ID NO: 2083622 - DNA, 21 bp, Homo sapiens
atgttgccatgaggcctttcc

SEQ ID NO: 2083623 - DNA, 19 bp, Homo sapiens
atgttgctggactgtcata

SEQ ID NO: 2083624 - DNA, 14 bp, Homo sapiens
atgttgggatttat

SEQ ID NO: 2083625 - DNA, 21 bp, Homo sapiens
atgttgggatttatatctata

SEQ ID NO: 2083626 - DNA, 21 bp, Homo sapiens
atgttgtgattaacatcatca

SEQ ID NO: 2083627 - DNA, 13 bp, Homo sapiens
atgttgttaaaca

SEQ ID NO: 2083628 - DNA, 21 bp, Homo sapiens
attaaatgtatatgtcattta

SEQ ID NO: 2083629 - DNA, 17 bp, Homo sapiens
attaaatttctggattt

SEQ ID NO: 2083630 - DNA, 21 bp, Homo sapiens
attaacattgggaaatcttat

SEQ ID NO: 2083631 - DNA, 11 bp, Homo sapiens
attaacctaga

SEQ ID NO: 2083632 - DNA, 17 bp, Homo sapiens
attaactcattagactg

SEQ ID NO: 2083633 - DNA, 17 bp, Homo sapiens
attaacttaaaagattc

SEQ ID NO: 2083634 - DNA, 17 bp, Homo sapiens
attaagataaatagagt

SEQ ID NO: 2083635 - DNA, 16 bp, Homo sapiens
attaagatacactcct

SEQ ID NO: 2083636 - DNA, 20 bp, Homo sapiens
attaagattgaggcctgccc

SEQ ID NO: 2083637 - DNA, 13 bp, Homo sapiens
attaagatttcca

SEQ ID NO: 2083638 - DNA, 14 bp, Homo sapiens
attaagccaaacat

SEQ ID NO: 2083639 - DNA, 15 bp, Homo sapiens
attaaggtgatgtga

SEQ ID NO: 2083640 - DNA, 17 bp, Homo sapiens
attaaggtgatgtgatt

SEQ ID NO: 2083641 - DNA, 22 bp, Homo sapiens
attaaggtttgccctgcctgca

SEQ ID NO: 2083642 - DNA, 18 bp, Homo sapiens
attaagtggctttttaac

SEQ ID NO: 2083643 - DNA, 19 bp, Homo sapiens
attaagttctcaatgtgaa

SEQ ID NO: 2083644 - DNA, 17 bp, Homo sapiens
attaataaacgaagata

SEQ ID NO: 2083645 - DNA, 18 bp, Homo sapiens
attaatagcttttattgt

SEQ ID NO: 2083646 - DNA, 14 bp, Homo sapiens
attaatatcttgct

SEQ ID NO: 2083647 - DNA, 19 bp, Homo sapiens
attaatatgttcattaaat

SEQ ID NO: 2083648 - DNA, 19 bp, Homo sapiens
attaatattcattgtataa

SEQ ID NO: 2083649 - DNA, 12 bp, Homo sapiens
attaatattcct

SEQ ID NO: 2083650 - DNA, 18 bp, Homo sapiens
attaatattgtgcttaaa

SEQ ID NO: 2083651 - DNA, 14 bp, Homo sapiens
attaatcttaattt

SEQ ID NO: 2083652 - DNA, 18 bp, Homo sapiens
attaatctttctttacct

SEQ ID NO: 2083653 - DNA, 18 bp, Homo sapiens
attaatgcctctcccgca

SEQ ID NO: 2083654 - DNA, 15 bp, Homo sapiens
attaatggtctaaaa

SEQ ID NO: 2083655 - DNA, 13 bp, Homo sapiens
attaatgttaatt

SEQ ID NO: 2083656 - DNA, 15 bp, Homo sapiens
attaattagattttc

SEQ ID NO: 2083657 - DNA, 13 bp, Homo sapiens
attaattatctga

SEQ ID NO: 2083658 - DNA, 23 bp, Homo sapiens
attaattccaagattaaaagttc

SEQ ID NO: 2083659 - DNA, 13 bp, Homo sapiens
attaatttatggt

SEQ ID NO: 2083660 - DNA, 21 bp, Homo sapiens
attaatttatggtttctgcgt

SEQ ID NO: 2083661 - DNA, 12 bp, Homo sapiens
attaatttgtgt

SEQ ID NO: 2083662 - DNA, 12 bp, Homo sapiens
attaatttgttt

SEQ ID NO: 2083663 - DNA, 17 bp, Homo sapiens
attacaaaatgaagttt

SEQ ID NO: 2083664 - DNA, 18 bp, Homo sapiens
attacactgtatttgtat

SEQ ID NO: 2083665 - DNA, 19 bp, Homo sapiens
attacactgtatttgtatc

SEQ ID NO: 2083666 - DNA, 21 bp, Homo sapiens
attacagatgggcaaattaag

SEQ ID NO: 2083667 - DNA, 20 bp, Homo sapiens
attacaggccttttgactct

SEQ ID NO: 2083668 - DNA, 16 bp, Homo sapiens
attacaggtgtgaacc

SEQ ID NO: 2083669 - DNA, 17 bp, Homo sapiens
attacatcatcctcctt

SEQ ID NO: 2083670 - DNA, 15 bp, Homo sapiens
attacatttatacat

SEQ ID NO: 2083671 - DNA, 18 bp, Homo sapiens
attaccaaaaatcttggg

SEQ ID NO: 2083672 - DNA, 13 bp, Homo sapiens
attaccatggaga

SEQ ID NO: 2083673 - DNA, 22 bp, Homo sapiens
attaccccctcattgtttatta

SEQ ID NO: 2083674 - DNA, 19 bp, Homo sapiens
attacctcctgtgtggaag

SEQ ID NO: 2083675 - DNA, 13 bp, Homo sapiens
attacgtgagcca

SEQ ID NO: 2083676 - DNA, 20 bp, Homo sapiens
attactacaaaatttgaaat

SEQ ID NO: 2083677 - DNA, 22 bp, Homo sapiens
attactgaaaacaaaatatctg

SEQ ID NO: 2083678 - DNA, 24 bp, Homo sapiens
attactgcctttggaagaaacagg

SEQ ID NO: 2083679 - DNA, 15 bp, Homo sapiens
attacttatttttga

SEQ ID NO: 2083680 - DNA, 14 bp, Homo sapiens
attacttcagggct

SEQ ID NO: 2083681 - DNA, 13 bp, Homo sapiens
attacttctgcta

SEQ ID NO: 2083682 - DNA, 15 bp, Homo sapiens
attactttaatactc

SEQ ID NO: 2083683 - DNA, 22 bp, Homo sapiens
attactttaatactcacctcct

SEQ ID NO: 2083684 - DNA, 15 bp, Homo sapiens
attactttgtcccgc

SEQ ID NO: 2083685 - DNA, 18 bp, Homo sapiens
attagaacaatagctatt

SEQ ID NO: 2083686 - DNA, 19 bp, Homo sapiens
attagaacaggcaagtgaa

SEQ ID NO: 2083687 - DNA, 20 bp, Homo sapiens
attagaagtgttaacttagc

SEQ ID NO: 2083688 - DNA, 14 bp, Homo sapiens
attagaatgaaaat

SEQ ID NO: 2083689 - DNA, 20 bp, Homo sapiens
attattcatatgcttcccag

SEQ ID NO: 2083690 - DNA, 19 bp, Homo sapiens
attattcatttaaaatgat

SEQ ID NO: 2083691 - DNA, 13 bp, Homo sapiens
attattcctccag

SEQ ID NO: 2083692 - DNA, 17 bp, Homo sapiens
attattctaattttata

SEQ ID NO: 2083693 - DNA, 12 bp, Homo sapiens
attattcttcag

SEQ ID NO: 2083694 - DNA, 23 bp, Homo sapiens
attattgtgtgttatttaaatga

SEQ ID NO: 2083695 - DNA, 21 bp, Homo sapiens
attatttaataaaaaaacaat

SEQ ID NO: 2083696 - DNA, 12 bp, Homo sapiens
attatttaatgt

SEQ ID NO: 2083697 - DNA, 21 bp, Homo sapiens
attatttacaatgcagaattt

SEQ ID NO: 2083698 - DNA, 17 bp, Homo sapiens
attatttatttaataac

SEQ ID NO: 2083699 - DNA, 14 bp, Homo sapiens
attatttatttctg

SEQ ID NO: 2083700 - DNA, 22 bp, Homo sapiens
attatttcaaccgcttgccata

SEQ ID NO: 2083701 - DNA, 21 bp, Homo sapiens
attatttggcatgcttaaata

SEQ ID NO: 2083702 - DNA, 15 bp, Homo sapiens
attatttgtgtaata

SEQ ID NO: 2083703 - DNA, 17 bp, Homo sapiens
attattttctatagctc

SEQ ID NO: 2083704 - DNA, 19 bp, Homo sapiens
attattttctatagctctt

SEQ ID NO: 2083705 - DNA, 22 bp, Homo sapiens
attatttttatacaccattgtt

SEQ ID NO: 2083706 - DNA, 17 bp, Homo sapiens
attatttttgtgtttct

SEQ ID NO: 2083707 - DNA, 11 bp, Homo sapiens
attcaaaacat

SEQ ID NO: 2083708 - DNA, 22 bp, Homo sapiens
attcaaaagctctctttggaat

SEQ ID NO: 2083709 - DNA, 16 bp, Homo sapiens
attcaaacagtctcag

SEQ ID NO: 2083710 - DNA, 22 bp, Homo sapiens
attcaaacagtctcaggaaatc

SEQ ID NO: 2083711 - DNA, 14 bp, Homo sapiens
attcaaaccattta

SEQ ID NO: 2083712 - DNA, 14 bp, Homo sapiens
attcaaagagacta

SEQ ID NO: 2083713 - DNA, 17 bp, Homo sapiens
attcaaagctctattaa

SEQ ID NO: 2083714 - DNA, 15 bp, Homo sapiens
attcaacacattact

SEQ ID NO: 2083715 - DNA, 16 bp, Homo sapiens
attcaacacattactt

SEQ ID NO: 2083716 - DNA, 19 bp, Homo sapiens
attcaacacattacttgca

SEQ ID NO: 2083717 - DNA, 19 bp, Homo sapiens
attcaaccactgtaaaatg

SEQ ID NO: 2083718 - DNA, 22 bp, Homo sapiens
attcaaccactgtaaaatgaaa

SEQ ID NO: 2083719 - DNA, 15 bp, Homo sapiens
attcaagaaacagaa

SEQ ID NO: 2083720 - DNA, 20 bp, Homo sapiens
attcaaggagatataaaatc

SEQ ID NO: 2083721 - DNA, 14 bp, Homo sapiens
attcaagttattgt

SEQ ID NO: 2083722 - DNA, 16 bp, Homo sapiens
attcaagttattgtac

SEQ ID NO: 2083723 - DNA, 21 bp, Homo sapiens
attcaataaaaaaaagaaatg

SEQ ID NO: 2083724 - DNA, 22 bp, Homo sapiens
attcaataaaaaaaagaaatga

SEQ ID NO: 2083725 - DNA, 12 bp, Homo sapiens
attcaataaagc

SEQ ID NO: 2083726 - DNA, 13 bp, Homo sapiens
attcaataaagct

SEQ ID NO: 2083727 - DNA, 16 bp, Homo sapiens
attcaattcaaagctg

SEQ ID NO: 2083728 - DNA, 16 bp, Homo sapiens
attcaattcctctggg

SEQ ID NO: 2083729 - DNA, 22 bp, Homo sapiens
attcaatttaattcttatttct

SEQ ID NO: 2083730 - DNA, 17 bp, Homo sapiens
attcacaactaggacct

SEQ ID NO: 2083731 - DNA, 18 bp, Homo sapiens
attcacaactaggacctc

SEQ ID NO: 2083732 - DNA, 19 bp, Homo sapiens
attcacaactaggacctca

SEQ ID NO: 2083733 - DNA, 13 bp, Homo sapiens
attcacaatagaa

SEQ ID NO: 2083734 - DNA, 22 bp, Homo sapiens
attcacaatgaaatgctctcct

SEQ ID NO: 2083735 - DNA, 14 bp, Homo sapiens
attcacacacccct

SEQ ID NO: 2083736 - DNA, 20 bp, Homo sapiens
attcacacctcacgctctgg

SEQ ID NO: 2083737 - DNA, 18 bp, Homo sapiens
attcacactgtgcgtttt

SEQ ID NO: 2083738 - DNA, 14 bp, Homo sapiens
attcacagagcctt

SEQ ID NO: 2083739 - DNA, 23 bp, Homo sapiens
attcacatcactgattgggtgcc

SEQ ID NO: 2083740 - DNA, 21 bp, Homo sapiens
attcacatccaatgcatagtt

SEQ ID NO: 2083741 - DNA, 16 bp, Homo sapiens
attcacatttgatgta

SEQ ID NO: 2083742 - DNA, 23 bp, Homo sapiens
attcaccttccagtgtctcggag

SEQ ID NO: 2083743 - DNA, 12 bp, Homo sapiens
attcactcccac

SEQ ID NO: 2083744 - DNA, 14 bp, Homo sapiens
attcactgtaagtt

SEQ ID NO: 2083745 - DNA, 15 bp, Homo sapiens
attcactgtaagttt

SEQ ID NO: 2083746 - DNA, 19 bp, Homo sapiens
caaactgatggaccgggtg

SEQ ID NO: 2083747 - DNA, 18 bp, Homo sapiens
caaactgcacacacagct

SEQ ID NO: 2083748 - DNA, 22 bp, Homo sapiens
caaactgcacacacagctcctc

SEQ ID NO: 2083749 - DNA, 16 bp, Homo sapiens
caaactgtgccctgcc

SEQ ID NO: 2083750 - DNA, 18 bp, Homo sapiens
caaactgtgccctgcctt

SEQ ID NO: 2083751 - DNA, 20 bp, Homo sapiens
caaactgttcaagaaataat

SEQ ID NO: 2083752 - DNA, 19 bp, Homo sapiens
caaacttgtatctgaagac

SEQ ID NO: 2083753 - DNA, 12 bp, Homo sapiens
caaactttattt

SEQ ID NO: 2083754 - DNA, 21 bp, Homo sapiens
caaagaaaaaaatatatttta

SEQ ID NO: 2083755 - DNA, 13 bp, Homo sapiens
caaagaaataaaa

SEQ ID NO: 2083756 - DNA, 15 bp, Homo sapiens
caaagaactgcccca

SEQ ID NO: 2083757 - DNA, 19 bp, Homo sapiens
caaagaaggaaaaggcagg

SEQ ID NO: 2083758 - DNA, 14 bp, Homo sapiens
caaagaaggcacag

SEQ ID NO: 2083759 - DNA, 21 bp, Homo sapiens
caaagaatactagaatggtag

SEQ ID NO: 2083760 - DNA, 19 bp, Homo sapiens
caaagacttagtatatttt

SEQ ID NO: 2083761 - DNA, 20 bp, Homo sapiens
caaagacttagtatattttc

SEQ ID NO: 2083762 - DNA, 19 bp, Homo sapiens
caaagagaaaaagaaatgc

SEQ ID NO: 2083763 - DNA, 15 bp, Homo sapiens
caaagagaaaactta

SEQ ID NO: 2083764 - DNA, 23 bp, Homo sapiens
caaagagaaaagattaaaattag

SEQ ID NO: 2083765 - DNA, 20 bp, Homo sapiens
caaagagaaatcacaggggc

SEQ ID NO: 2083766 - DNA, 17 bp, Homo sapiens
caaagagactggagcat

SEQ ID NO: 2083767 - DNA, 16 bp, Homo sapiens
caaagagcctggagaa

SEQ ID NO: 2083768 - DNA, 17 bp, Homo sapiens
caaagagcctggagaag

SEQ ID NO: 2083769 - DNA, 16 bp, Homo sapiens
caaagaggtatttatc

SEQ ID NO: 2083770 - DNA, 15 bp, Homo sapiens
caaagagttcaagaa

SEQ ID NO: 2083771 - DNA, 16 bp, Homo sapiens
caaagagttcaagaaa

SEQ ID NO: 2083772 - DNA, 23 bp, Homo sapiens
caaagatatatacacaggatcct

SEQ ID NO: 2083773 - DNA, 17 bp, Homo sapiens
caaagatatctcatctc

SEQ ID NO: 2083774 - DNA, 23 bp, Homo sapiens
caaagatgagctctgaacaaaca

SEQ ID NO: 2083775 - DNA, 22 bp, Homo sapiens
caaagcaaaagaagtaaaagct

SEQ ID NO: 2083776 - DNA, 23 bp, Homo sapiens
caaagcaagcattcagaagaaaa

SEQ ID NO: 2083777 - DNA, 13 bp, Homo sapiens
caaagcaagggct

SEQ ID NO: 2083778 - DNA, 14 bp, Homo sapiens
caaagcaagggctc

SEQ ID NO: 2083779 - DNA, 17 bp, Homo sapiens
caaagcaagggctccag

SEQ ID NO: 2083780 - DNA, 13 bp, Homo sapiens
caaagcaatattt

SEQ ID NO: 2083781 - DNA, 19 bp, Homo sapiens
caaagcacagtgttaaatg

SEQ ID NO: 2083782 - DNA, 17 bp, Homo sapiens
caaagcacattgaaaga

SEQ ID NO: 2083783 - DNA, 18 bp, Homo sapiens
caaagcacattgaaagag

SEQ ID NO: 2083784 - DNA, 18 bp, Homo sapiens
caaagccaaactctgcca

SEQ ID NO: 2083785 - DNA, 22 bp, Homo sapiens
caaagccaaactctgccagcca

SEQ ID NO: 2083786 - DNA, 21 bp, Homo sapiens
caaagccaaagctaggcctgg

SEQ ID NO: 2083787 - DNA, 14 bp, Homo sapiens
caaagccacatttt

SEQ ID NO: 2083788 - DNA, 22 bp, Homo sapiens
caaagccccacctttaagtcct

SEQ ID NO: 2083789 - DNA, 23 bp, Homo sapiens
caaagccccttgctctcccctgc

SEQ ID NO: 2083790 - DNA, 22 bp, Homo sapiens
caaagcctgttcatggcagatg

SEQ ID NO: 2083791 - DNA, 20 bp, Homo sapiens
caaagcgagatcccatctct

SEQ ID NO: 2083792 - DNA, 16 bp, Homo sapiens
caaagctaggcctggc

SEQ ID NO: 2083793 - DNA, 21 bp, Homo sapiens
caaagctcaagatgacagctc

SEQ ID NO: 2083794 - DNA, 23 bp, Homo sapiens
caaagctcaagatgacagctctt

SEQ ID NO: 2083795 - DNA, 18 bp, Homo sapiens
caaagcttctatcccagg

SEQ ID NO: 2083796 - DNA, 22 bp, Homo sapiens
caaaggaatctccagttttcag

SEQ ID NO: 2083797 - DNA, 20 bp, Homo sapiens
caaaggacattatgtgtgca

SEQ ID NO: 2083798 - DNA, 16 bp, Homo sapiens
caaaggagtagaaaga

SEQ ID NO: 2083799 - DNA, 20 bp, Homo sapiens
caaaggccctaccagaggga

SEQ ID NO: 2083800 - DNA, 23 bp, Homo sapiens
caaagggaaggctgctgtgtagc

SEQ ID NO: 2083801 - DNA, 18 bp, Homo sapiens
caaagggcagtaaagttt

SEQ ID NO: 2083802 - DNA, 17 bp, Homo sapiens
caaagggctgaaagcca

SEQ ID NO: 2083803 - DNA, 18 bp, Homo sapiens
caaaggggagaagggcca

SEQ ID NO: 2083804 - DNA, 22 bp, Homo sapiens
caaaggggagaagggccagccc

SEQ ID NO: 2083805 - DNA, 11 bp, Homo sapiens
caaaggggctg

SEQ ID NO: 2083806 - DNA, 19 bp, Homo sapiens
caaaggggctgctggggca

SEQ ID NO: 2083807 - DNA, 20 bp, Homo sapiens
caaaggggctgctggggcat

SEQ ID NO: 2083808 - DNA, 16 bp, Homo sapiens
caaagggtatcaggtg

SEQ ID NO: 2083809 - DNA, 20 bp, Homo sapiens
caaagggtatcaggtgctgc

SEQ ID NO: 2083810 - DNA, 23 bp, Homo sapiens
caaagggtatcaggtgctgccat

SEQ ID NO: 2083811 - DNA, 21 bp, Homo sapiens
caaagtaaaacttgctgcctg

SEQ ID NO: 2083812 - DNA, 15 bp, Homo sapiens
caaagtagagaagta

SEQ ID NO: 2083813 - DNA, 17 bp, Homo sapiens
caaagtctaaagtttac

SEQ ID NO: 2083814 - DNA, 19 bp, Homo sapiens
caaagtctaaagtttacag

SEQ ID NO: 2083815 - DNA, 16 bp, Homo sapiens
caaagtgcaaatactc

SEQ ID NO: 2083816 - DNA, 19 bp, Homo sapiens
caaagtgcaaatactccaa

SEQ ID NO: 2083817 - DNA, 23 bp, Homo sapiens
caaagtgcagcccttcctcctga

SEQ ID NO: 2083818 - DNA, 13 bp, Homo sapiens
caaagtgctggga

SEQ ID NO: 2083819 - DNA, 19 bp, Homo sapiens
caaagtgctgggattacaa

SEQ ID NO: 2083820 - DNA, 14 bp, Homo sapiens
caaagtgctgtacc

SEQ ID NO: 2083821 - DNA, 21 bp, Homo sapiens
caaagtgctgtacccttccac

SEQ ID NO: 2083822 - DNA, 21 bp, Homo sapiens
caaagtgttttctcagaacag

SEQ ID NO: 2083823 - DNA, 22 bp, Homo sapiens
caaagttattccccatcttcca

SEQ ID NO: 2083824 - DNA, 22 bp, Homo sapiens
caaagttccctacttcctgtga

SEQ ID NO: 2083825 - DNA, 16 bp, Homo sapiens
caaataaaacctcagg

SEQ ID NO: 2083826 - DNA, 18 bp, Homo sapiens
caaataaatgtgtaaatg

SEQ ID NO: 2083827 - DNA, 18 bp, Homo sapiens
caaataagcatctgtgta

SEQ ID NO: 2083828 - DNA, 14 bp, Homo sapiens
caagagaagaaaaa

SEQ ID NO: 2083829 - DNA, 21 bp, Homo sapiens
caagagacagagcccccaagc

SEQ ID NO: 2083830 - DNA, 12 bp, Homo sapiens
caagagactgag

SEQ ID NO: 2083831 - DNA, 15 bp, Homo sapiens
caagagactgagtca

SEQ ID NO: 2083832 - DNA, 17 bp, Homo sapiens
caagagagaaagaagta

SEQ ID NO: 2083833 - DNA, 14 bp, Homo sapiens
caagagagggcaag

SEQ ID NO: 2083834 - DNA, 13 bp, Homo sapiens
caagagcaaaatg

SEQ ID NO: 2083835 - DNA, 14 bp, Homo sapiens
caagagcaaaatga

SEQ ID NO: 2083836 - DNA, 16 bp, Homo sapiens
caagagcagaggcagc

SEQ ID NO: 2083837 - DNA, 19 bp, Homo sapiens
caagagcatcatgcctctg

SEQ ID NO: 2083838 - DNA, 22 bp, Homo sapiens
caagagcatcatgcctctgagg

SEQ ID NO: 2083839 - DNA, 18 bp, Homo sapiens
caagagcgaaactccgtc

SEQ ID NO: 2083840 - DNA, 19 bp, Homo sapiens
caagagctacataatttag

SEQ ID NO: 2083841 - DNA, 15 bp, Homo sapiens
caagaggaagagaga

SEQ ID NO: 2083842 - DNA, 15 bp, Homo sapiens
caagaggactgagac

SEQ ID NO: 2083843 - DNA, 14 bp, Homo sapiens
caagaggcccaggg

SEQ ID NO: 2083844 - DNA, 18 bp, Homo sapiens
caagaggcccagggagca

SEQ ID NO: 2083845 - DNA, 18 bp, Homo sapiens
caagagggcactggtggc

SEQ ID NO: 2083846 - DNA, 12 bp, Homo sapiens
caagagggtctg

SEQ ID NO: 2083847 - DNA, 22 bp, Homo sapiens
caagagtggactgaatgtgcct

SEQ ID NO: 2083848 - DNA, 23 bp, Homo sapiens
caagagttctttaggtgcctcct

SEQ ID NO: 2083849 - DNA, 18 bp, Homo sapiens
caagatcttgtctccact

SEQ ID NO: 2083850 - DNA, 13 bp, Homo sapiens
caaggccctgtcc

SEQ ID NO: 2083851 - DNA, 15 bp, Homo sapiens
caaggccctgtccca

SEQ ID NO: 2083852 - DNA, 19 bp, Homo sapiens
caaggcgggagcatctctt

SEQ ID NO: 2083853 - DNA, 20 bp, Homo sapiens
caaggctgaccaagagagaa

SEQ ID NO: 2083854 - DNA, 21 bp, Homo sapiens
caaggctgctcagaggggccc

SEQ ID NO: 2083855 - DNA, 17 bp, Homo sapiens
caaggcttaaaagagta

SEQ ID NO: 2083856 - DNA, 20 bp, Homo sapiens
caagggagaagaaatccata

SEQ ID NO: 2083857 - DNA, 19 bp, Homo sapiens
caagggcatcaggcactgg

SEQ ID NO: 2083858 - DNA, 20 bp, Homo sapiens
caagggcatcaggcactggt

SEQ ID NO: 2083859 - DNA, 23 bp, Homo sapiens
caagggcatcaggcactggtggc

SEQ ID NO: 2083860 - DNA, 20 bp, Homo sapiens
caagggccatgctgaaggga

SEQ ID NO: 2083861 - DNA, 15 bp, Homo sapiens
caaggggaacgcaga

SEQ ID NO: 2083862 - DNA, 15 bp, Homo sapiens
caaggggacttgtgc

SEQ ID NO: 2083863 - DNA, 22 bp, Homo sapiens
caaggggcccacaaaggggaga

SEQ ID NO: 2083864 - DNA, 21 bp, Homo sapiens
caagggggtgtcatctgagga

SEQ ID NO: 2083865 - DNA, 18 bp, Homo sapiens
caagggtatgggaagcca

SEQ ID NO: 2083866 - DNA, 14 bp, Homo sapiens
caagggtccagaag

SEQ ID NO: 2083867 - DNA, 17 bp, Homo sapiens
caagggtctagggagag

SEQ ID NO: 2083868 - DNA, 20 bp, Homo sapiens
caagggttcagagactcagg

SEQ ID NO: 2083869 - DNA, 16 bp, Homo sapiens
caaggtcaaagttctg

SEQ ID NO: 2083870 - DNA, 16 bp, Homo sapiens
caaggtcggtaagttg

SEQ ID NO: 2083871 - DNA, 17 bp, Homo sapiens
caaggtggccaaattat

SEQ ID NO: 2083872 - DNA, 16 bp, Homo sapiens
caaggtgggctgagcc

SEQ ID NO: 2083873 - DNA, 21 bp, Homo sapiens
caaggtgggctgagccctggc

SEQ ID NO: 2083874 - DNA, 22 bp, Homo sapiens
caaggtggggggatcacaaggt

SEQ ID NO: 2083875 - DNA, 19 bp, Homo sapiens
caaggttactcagcagcag

SEQ ID NO: 2083876 - DNA, 21 bp, Homo sapiens
caaggttactcagcagcagag

SEQ ID NO: 2083877 - DNA, 19 bp, Homo sapiens
caaggttccctctgagaat

SEQ ID NO: 2083878 - DNA, 12 bp, Homo sapiens
caagtaatcact

SEQ ID NO: 2083879 - DNA, 14 bp, Homo sapiens
caagtactgctgta

SEQ ID NO: 2083880 - DNA, 16 bp, Homo sapiens
caagtatgaataaaga

SEQ ID NO: 2083881 - DNA, 20 bp, Homo sapiens
caagtattttatctgtgttg

SEQ ID NO: 2083882 - DNA, 15 bp, Homo sapiens
caagtcacagctgca

SEQ ID NO: 2083883 - DNA, 17 bp, Homo sapiens
caagtcacagctgcagc

SEQ ID NO: 2083884 - DNA, 18 bp, Homo sapiens
caagtcacagctgcagct

SEQ ID NO: 2083885 - DNA, 23 bp, Homo sapiens
caagtcacagctgcagctgggcc

SEQ ID NO: 2083886 - DNA, 18 bp, Homo sapiens
caagtccaacctgcctgt

SEQ ID NO: 2083887 - DNA, 16 bp, Homo sapiens
caagtccaggtcctgg

SEQ ID NO: 2083888 - DNA, 18 bp, Homo sapiens
caagtcctgtgaatttct

SEQ ID NO: 2083889 - DNA, 12 bp, Homo sapiens
caagtctagaaa

SEQ ID NO: 2083890 - DNA, 13 bp, Homo sapiens
caagtctggatct

SEQ ID NO: 2083891 - DNA, 14 bp, Homo sapiens
caagtcttccctga

SEQ ID NO: 2083892 - DNA, 14 bp, Homo sapiens
caagtgagagctgg

SEQ ID NO: 2083893 - DNA, 17 bp, Homo sapiens
caagtgagagctgggtg

SEQ ID NO: 2083894 - DNA, 18 bp, Homo sapiens
caagtgagagctgggtgt

SEQ ID NO: 2083895 - DNA, 16 bp, Homo sapiens
caagtgatatatgtat

SEQ ID NO: 2083896 - DNA, 17 bp, Homo sapiens
caagtgattctcctgcc

SEQ ID NO: 2083897 - DNA, 22 bp, Homo sapiens
caagtgattctcctgcctcagc

SEQ ID NO: 2083898 - DNA, 20 bp, Homo sapiens
caagtgccagtcttgtgtct

SEQ ID NO: 2083899 - DNA, 16 bp, Homo sapiens
caagtgcccgccctgc

SEQ ID NO: 2083900 - DNA, 18 bp, Homo sapiens
caagtgcccgccctgccc

SEQ ID NO: 2083901 - DNA, 20 bp, Homo sapiens
caagtgcccgccctgcccct

SEQ ID NO: 2083902 - DNA, 23 bp, Homo sapiens
caagtgcccgccctgcccctgcc

SEQ ID NO: 2083903 - DNA, 16 bp, Homo sapiens
caagtgggggtcgaga

SEQ ID NO: 2083904 - DNA, 22 bp, Homo sapiens
caagtgtggtagggacttaaaa

SEQ ID NO: 2083905 - DNA, 13 bp, Homo sapiens
caagttagctcag

SEQ ID NO: 2083906 - DNA, 14 bp, Homo sapiens
caagttatattgaa

SEQ ID NO: 2083907 - DNA, 20 bp, Homo sapiens
caagttatattgaatatatc

SEQ ID NO: 2083908 - DNA, 12 bp, Homo sapiens
caagttattgta

SEQ ID NO: 2083909 - DNA, 17 bp, Homo sapiens
caagttcaatctgtttt

SEQ ID NO: 2083910 - DNA, 14 bp, Homo sapiens
caagttcagggaag

SEQ ID NO: 2083911 - DNA, 13 bp, Homo sapiens
caagttccagctg

SEQ ID NO: 2083912 - DNA, 18 bp, Homo sapiens
caagttcctgcactccag

SEQ ID NO: 2083913 - DNA, 18 bp, Homo sapiens
caagttctagagaagagg

SEQ ID NO: 2083914 - DNA, 15 bp, Homo sapiens
caagttgagaacaaa

SEQ ID NO: 2083915 - DNA, 21 bp, Homo sapiens
caagttgttccttaagtcaga

SEQ ID NO: 2083916 - DNA, 22 bp, Homo sapiens
caagttgttccttaagtcagaa

SEQ ID NO: 2083917 - DNA, 23 bp, Homo sapiens
caagtttataagcccaaatggct

SEQ ID NO: 2083918 - DNA, 21 bp, Homo sapiens
caagtttcccgccaggaggtc

SEQ ID NO: 2083919 - DNA, 22 bp, Homo sapiens
caagtttctagctagaaatatg

SEQ ID NO: 2083920 - DNA, 19 bp, Homo sapiens
caataaaaaaaagaaatga

SEQ ID NO: 2083921 - DNA, 18 bp, Homo sapiens
caataaaagtgactctca

SEQ ID NO: 2083922 - DNA, 15 bp, Homo sapiens
caataaaattttcaa

SEQ ID NO: 2083923 - DNA, 20 bp, Homo sapiens
caataaaattttcaaacttt

SEQ ID NO: 2083924 - DNA, 17 bp, Homo sapiens
caataaacatagcttgt

SEQ ID NO: 2083925 - DNA, 14 bp, Homo sapiens
caataaagagctca

SEQ ID NO: 2083926 - DNA, 17 bp, Homo sapiens
caataaagctggacaag

SEQ ID NO: 2083927 - DNA, 11 bp, Homo sapiens
caataaagtat

SEQ ID NO: 2083928 - DNA, 16 bp, Homo sapiens
caataaagtatctaca

SEQ ID NO: 2083929 - DNA, 16 bp, Homo sapiens
caataaatgctgaatg

SEQ ID NO: 2083930 - DNA, 20 bp, Homo sapiens
caataaatgctgaatgaatc

SEQ ID NO: 2083931 - DNA, 14 bp, Homo sapiens
caataaatgtctgt

SEQ ID NO: 2083932 - DNA, 16 bp, Homo sapiens
caataaatgtctgttg

SEQ ID NO: 2083933 - DNA, 13 bp, Homo sapiens
caataacaacaat

SEQ ID NO: 2083934 - DNA, 15 bp, Homo sapiens
caataacaacaatgg

SEQ ID NO: 2083935 - DNA, 15 bp, Homo sapiens
caataacgtttaagc

SEQ ID NO: 2083936 - DNA, 23 bp, Homo sapiens
caataacgtttaagccaaaacaa

SEQ ID NO: 2083937 - DNA, 17 bp, Homo sapiens
caataagttccatgtta

SEQ ID NO: 2083938 - DNA, 20 bp, Homo sapiens
caataattaggatctatgca

SEQ ID NO: 2083939 - DNA, 23 bp, Homo sapiens
caataattaggatctatgcaatt

SEQ ID NO: 2083940 - DNA, 14 bp, Homo sapiens
caataattttctac

SEQ ID NO: 2083941 - DNA, 14 bp, Homo sapiens
caatacaacaagaa

SEQ ID NO: 2083942 - DNA, 22 bp, Homo sapiens
caatacacataagaccgtgtcc

SEQ ID NO: 2083943 - DNA, 17 bp, Homo sapiens
caataccagatcactca

SEQ ID NO: 2083944 - DNA, 14 bp, Homo sapiens
caatactactgtaa

SEQ ID NO: 2083945 - DNA, 19 bp, Homo sapiens
caatactactgtaaatgta

SEQ ID NO: 2083946 - DNA, 14 bp, Homo sapiens
caatacttcatgat

SEQ ID NO: 2083947 - DNA, 23 bp, Homo sapiens
caatagaaactcaccatgtaaaa

SEQ ID NO: 2083948 - DNA, 15 bp, Homo sapiens
cacacatggatgcac

SEQ ID NO: 2083949 - DNA, 19 bp, Homo sapiens
cacacatgtcctatccaaa

SEQ ID NO: 2083950 - DNA, 17 bp, Homo sapiens
cacaccactgccctgcc

SEQ ID NO: 2083951 - DNA, 19 bp, Homo sapiens
cacaccactgccctgcctg

SEQ ID NO: 2083952 - DNA, 20 bp, Homo sapiens
cacaccactgccctgcctgc

SEQ ID NO: 2083953 - DNA, 22 bp, Homo sapiens
cacaccagagcccaccttggct

SEQ ID NO: 2083954 - DNA, 20 bp, Homo sapiens
cacacccagcccacttctgc

SEQ ID NO: 2083955 - DNA, 13 bp, Homo sapiens
cacaccccaaggg

SEQ ID NO: 2083956 - DNA, 19 bp, Homo sapiens
cacaccccatctctcttcc

SEQ ID NO: 2083957 - DNA, 14 bp, Homo sapiens
cacaccctgtttta

SEQ ID NO: 2083958 - DNA, 14 bp, Homo sapiens
cacacctcacgctc

SEQ ID NO: 2083959 - DNA, 16 bp, Homo sapiens
cacacctcacgctctg

SEQ ID NO: 2083960 - DNA, 14 bp, Homo sapiens
cacacctccctgaa

SEQ ID NO: 2083961 - DNA, 14 bp, Homo sapiens
cacacctctgggct

SEQ ID NO: 2083962 - DNA, 14 bp, Homo sapiens
cacacgccaatgca

SEQ ID NO: 2083963 - DNA, 12 bp, Homo sapiens
cacacgcctgta

SEQ ID NO: 2083964 - DNA, 17 bp, Homo sapiens
cacacggccctgcccca

SEQ ID NO: 2083965 - DNA, 21 bp, Homo sapiens
cacacgggaagatcatttctt

SEQ ID NO: 2083966 - DNA, 22 bp, Homo sapiens
cacacgtatttatatttggaaa

SEQ ID NO: 2083967 - DNA, 22 bp, Homo sapiens
cacacgtgctcgcagcctggcg

SEQ ID NO: 2083968 - DNA, 17 bp, Homo sapiens
cacactattaccatgag

SEQ ID NO: 2083969 - DNA, 15 bp, Homo sapiens
cacactcagcagccc

SEQ ID NO: 2083970 - DNA, 16 bp, Homo sapiens
cacactccccgcctgt

SEQ ID NO: 2083971 - DNA, 19 bp, Homo sapiens
cacactccccgcctgtcct

SEQ ID NO: 2083972 - DNA, 16 bp, Homo sapiens
cacactgcaagagcct

SEQ ID NO: 2083973 - DNA, 19 bp, Homo sapiens
cacactgcaagagccttgg

SEQ ID NO: 2083974 - DNA, 10 bp, Homo sapiens
cacactgtaa

SEQ ID NO: 2083975 - DNA, 17 bp, Homo sapiens
cacactgtaaacccctg

SEQ ID NO: 2083976 - DNA, 21 bp, Homo sapiens
cacactgtaaatatccacaga

SEQ ID NO: 2083977 - DNA, 22 bp, Homo sapiens
cacactgtaaatatccacagac

SEQ ID NO: 2083978 - DNA, 23 bp, Homo sapiens
cacactgtagcattacagtgggt

SEQ ID NO: 2083979 - DNA, 15 bp, Homo sapiens
cacactgtcagagct

SEQ ID NO: 2083980 - DNA, 22 bp, Homo sapiens
cacactgtcagagctgttggcc

SEQ ID NO: 2083981 - DNA, 18 bp, Homo sapiens
cacactgttactccacag

SEQ ID NO: 2083982 - DNA, 19 bp, Homo sapiens
cacactgttactccacagc

SEQ ID NO: 2083983 - DNA, 23 bp, Homo sapiens
cacacttctcaggacacaggcct

SEQ ID NO: 2083984 - DNA, 21 bp, Homo sapiens
cacagaaacacaatattttgt

SEQ ID NO: 2083985 - DNA, 14 bp, Homo sapiens
cacagacccacaca

SEQ ID NO: 2083986 - DNA, 16 bp, Homo sapiens
cacagacccacacatg

SEQ ID NO: 2083987 - DNA, 17 bp, Homo sapiens
cacagacttctggaagg

SEQ ID NO: 2083988 - DNA, 18 bp, Homo sapiens
cacagacttctggaaggc

SEQ ID NO: 2083989 - DNA, 20 bp, Homo sapiens
cacagagatatgcacacaca

SEQ ID NO: 2083990 - DNA, 21 bp, Homo sapiens
cacagagcactaggttcaatt

SEQ ID NO: 2083991 - DNA, 23 bp, Homo sapiens
cacagagcctgaatttgtaagca

SEQ ID NO: 2083992 - DNA, 20 bp, Homo sapiens
cacagagcctgcctcagctg

SEQ ID NO: 2083993 - DNA, 20 bp, Homo sapiens
cacagagctggcgactgcag

SEQ ID NO: 2083994 - DNA, 22 bp, Homo sapiens
cacagagctggcgactgcagct

SEQ ID NO: 2083995 - DNA, 15 bp, Homo sapiens
cacagaggaagagca

SEQ ID NO: 2083996 - DNA, 17 bp, Homo sapiens
cacagaggaagagcagg

SEQ ID NO: 2083997 - DNA, 19 bp, Homo sapiens
cacagagtggagccctcag

SEQ ID NO: 2083998 - DNA, 19 bp, Homo sapiens
cacagataactgaaaatta

SEQ ID NO: 2083999 - DNA, 22 bp, Homo sapiens
cacagataactgaaaattattt

SEQ ID NO: 2084000 - DNA, 14 bp, Homo sapiens
cacagatacatggg

SEQ ID NO: 2084001 - DNA, 18 bp, Homo sapiens
cacagatatacacatgga

SEQ ID NO: 2084002 - DNA, 22 bp, Homo sapiens
cacagatatacacatggatgca

SEQ ID NO: 2084003 - DNA, 14 bp, Homo sapiens
cacagatatgcaca

SEQ ID NO: 2084004 - DNA, 14 bp, Homo sapiens
cacagatatttcca

SEQ ID NO: 2084005 - DNA, 20 bp, Homo sapiens
cacagatatttccatttctt

SEQ ID NO: 2084006 - DNA, 18 bp, Homo sapiens
cacagatgcacacacaga

SEQ ID NO: 2084007 - DNA, 20 bp, Homo sapiens
cacagatgggtattaaactt

SEQ ID NO: 2084008 - DNA, 20 bp, Homo sapiens
cacagatggtcacacagaga

SEQ ID NO: 2084009 - DNA, 22 bp, Homo sapiens
cacagatgtgggctttgatttc

SEQ ID NO: 2084010 - DNA, 19 bp, Homo sapiens
cacagattacttcagggct

SEQ ID NO: 2084011 - DNA, 22 bp, Homo sapiens
cacagatttttgggctccactc

SEQ ID NO: 2084012 - DNA, 22 bp, Homo sapiens
cacagcaagccggccccccctc

SEQ ID NO: 2084013 - DNA, 15 bp, Homo sapiens
cacagcacccaggct

SEQ ID NO: 2084014 - DNA, 16 bp, Homo sapiens
cacagcacccaggctc

SEQ ID NO: 2084015 - DNA, 22 bp, Homo sapiens
cacagcacccaggctccatggg

SEQ ID NO: 2084016 - DNA, 20 bp, Homo sapiens
cacagcagaatgaagaccta

SEQ ID NO: 2084017 - DNA, 11 bp, Homo sapiens
cacagcagccc

SEQ ID NO: 2084018 - DNA, 16 bp, Homo sapiens
cacagcagctgaacag

SEQ ID NO: 2084019 - DNA, 15 bp, Homo sapiens
cacagccaacaaaca

SEQ ID NO: 2084020 - DNA, 19 bp, Homo sapiens
cacagcccaaagaaggaaa

SEQ ID NO: 2084021 - DNA, 18 bp, Homo sapiens
cacagccccacagcaccc

SEQ ID NO: 2084022 - DNA, 19 bp, Homo sapiens
cacagccccacagcaccca

SEQ ID NO: 2084023 - DNA, 11 bp, Homo sapiens
cacagccctgg

SEQ ID NO: 2084024 - DNA, 15 bp, Homo sapiens
cacagccctgggagg

SEQ ID NO: 2084025 - DNA, 14 bp, Homo sapiens
cacagccgcagcct

SEQ ID NO: 2084026 - DNA, 14 bp, Homo sapiens
cacagcctctccct

SEQ ID NO: 2084027 - DNA, 20 bp, Homo sapiens
cacagcctgggaccagggca

SEQ ID NO: 2084028 - DNA, 16 bp, Homo sapiens
cacagcgcgggcggag

SEQ ID NO: 2084029 - DNA, 14 bp, Homo sapiens
cacagcggcccctg

SEQ ID NO: 2084030 - DNA, 15 bp, Homo sapiens
cacagcgtccctagc

SEQ ID NO: 2084031 - DNA, 22 bp, Homo sapiens
cacagctatgaaggctgtacac

SEQ ID NO: 2084032 - DNA, 17 bp, Homo sapiens
cacagctcccaccccac

SEQ ID NO: 2084033 - DNA, 19 bp, Homo sapiens
cacagctcccaccccaccc

SEQ ID NO: 2084034 - DNA, 22 bp, Homo sapiens
cacagctcctcttaccgtagcc

SEQ ID NO: 2084035 - DNA, 20 bp, Homo sapiens
cacagctctccggtctctct

SEQ ID NO: 2084036 - DNA, 11 bp, Homo sapiens
cacagctctgt

SEQ ID NO: 2084037 - DNA, 14 bp, Homo sapiens
cacagctctgtcct

SEQ ID NO: 2084038 - DNA, 16 bp, Homo sapiens
cacagctctgtcctgg

SEQ ID NO: 2084039 - DNA, 19 bp, Homo sapiens
cacagctctgtcctgggag

SEQ ID NO: 2084040 - DNA, 20 bp, Homo sapiens
cacagctctgtcctgggagt

SEQ ID NO: 2084041 - DNA, 14 bp, Homo sapiens
cacagctcttctcc

SEQ ID NO: 2084042 - DNA, 19 bp, Homo sapiens
cacagctcttctccaggct

SEQ ID NO: 2084043 - DNA, 20 bp, Homo sapiens
cacagctcttctccaggctg

SEQ ID NO: 2084044 - DNA, 18 bp, Homo sapiens
cacagctgagagactttt

SEQ ID NO: 2084045 - DNA, 18 bp, Homo sapiens
cacagctgcagctgggcc

SEQ ID NO: 2084046 - DNA, 22 bp, Homo sapiens
cacagctgcttgtcctgctctc

SEQ ID NO: 2084047 - DNA, 15 bp, Homo sapiens
cacaggactctgcct

SEQ ID NO: 2084048 - DNA, 13 bp, Homo sapiens
cacaggagcagac

SEQ ID NO: 2084049 - DNA, 14 bp, Homo sapiens
cacaggagcagaca

SEQ ID NO: 2084050 - DNA, 20 bp, Homo sapiens
cacaggagcagacagagaaa

SEQ ID NO: 2084051 - DNA, 21 bp, Homo sapiens
cacaggagcagacagagaaat

SEQ ID NO: 2084052 - DNA, 15 bp, Homo sapiens
cacaggagctacctg

SEQ ID NO: 2084053 - DNA, 18 bp, Homo sapiens
cacaggagctacctgtgt

SEQ ID NO: 2084054 - DNA, 20 bp, Homo sapiens
cacaggagctacctgtgtgg

SEQ ID NO: 2084055 - DNA, 22 bp, Homo sapiens
cacaggagggggtcgtggagag

SEQ ID NO: 2084056 - DNA, 23 bp, Homo sapiens
cacaggatcctattctcaccagg

SEQ ID NO: 2084057 - DNA, 24 bp, Homo sapiens
cacaggatcctattctcaccagga

SEQ ID NO: 2084058 - DNA, 16 bp, Homo sapiens
cacaggcaaaatcctt

SEQ ID NO: 2084059 - DNA, 18 bp, Homo sapiens
cacaggcaactgaggcag

SEQ ID NO: 2084060 - DNA, 19 bp, Homo sapiens
cacaggcaactgaggcaga

SEQ ID NO: 2084061 - DNA, 11 bp, Homo sapiens
cacaggcaggt

SEQ ID NO: 2084062 - DNA, 16 bp, Homo sapiens
cacttttcctccctca

SEQ ID NO: 2084063 - DNA, 16 bp, Homo sapiens
cagaaaaactctggga

SEQ ID NO: 2084064 - DNA, 13 bp, Homo sapiens
cagaaaacctcca

SEQ ID NO: 2084065 - DNA, 16 bp, Homo sapiens
cagaaaagcacctgcc

SEQ ID NO: 2084066 - DNA, 19 bp, Homo sapiens
cagaaaagcacctgccgac

SEQ ID NO: 2084067 - DNA, 17 bp, Homo sapiens
cagaaaagggaagttgt

SEQ ID NO: 2084068 - DNA, 16 bp, Homo sapiens
cagaaaagtagaatta

SEQ ID NO: 2084069 - DNA, 12 bp, Homo sapiens
cagaaaagtgct

SEQ ID NO: 2084070 - DNA, 14 bp, Homo sapiens
cagaaaatataaat

SEQ ID NO: 2084071 - DNA, 18 bp, Homo sapiens
cagaaaatataaatgcat

SEQ ID NO: 2084072 - DNA, 19 bp, Homo sapiens
cagaaaatgaacacagcag

SEQ ID NO: 2084073 - DNA, 19 bp, Homo sapiens
cagaaaatgtgtcagcatg

SEQ ID NO: 2084074 - DNA, 16 bp, Homo sapiens
cagaaacagagagaga

SEQ ID NO: 2084075 - DNA, 19 bp, Homo sapiens
cagaaacagggacaaagaa

SEQ ID NO: 2084076 - DNA, 13 bp, Homo sapiens
cagaaaccagtta

SEQ ID NO: 2084077 - DNA, 17 bp, Homo sapiens
cagaaactccttttgct

SEQ ID NO: 2084078 - DNA, 23 bp, Homo sapiens
cagaaactccttttgctgtcttt

SEQ ID NO: 2084079 - DNA, 20 bp, Homo sapiens
cagaaactcgatgaatgtgt

SEQ ID NO: 2084080 - DNA, 16 bp, Homo sapiens
cagaaagcaacagtta

SEQ ID NO: 2084081 - DNA, 13 bp, Homo sapiens
cagaaagccttcc

SEQ ID NO: 2084082 - DNA, 21 bp, Homo sapiens
cagaaaggatgttttgtccca

SEQ ID NO: 2084083 - DNA, 17 bp, Homo sapiens
cagaaagggagggctct

SEQ ID NO: 2084084 - DNA, 20 bp, Homo sapiens
cagaaataatctgacactac

SEQ ID NO: 2084085 - DNA, 18 bp, Homo sapiens
cagaaatatatatacata

SEQ ID NO: 2084086 - DNA, 19 bp, Homo sapiens
cagaaatatatatacatat

SEQ ID NO: 2084087 - DNA, 20 bp, Homo sapiens
cagaaatatatatacatatg

SEQ ID NO: 2084088 - DNA, 15 bp, Homo sapiens
cagaaatatgtggtt

SEQ ID NO: 2084089 - DNA, 14 bp, Homo sapiens
cagaaattccttcc

SEQ ID NO: 2084090 - DNA, 16 bp, Homo sapiens
cagaaattccttccca

SEQ ID NO: 2084091 - DNA, 11 bp, Homo sapiens
cagaacactgt

SEQ ID NO: 2084092 - DNA, 15 bp, Homo sapiens
cagaacagaggcatt

SEQ ID NO: 2084093 - DNA, 21 bp, Homo sapiens
cagaacagcagaggttctttt

SEQ ID NO: 2084094 - DNA, 13 bp, Homo sapiens
cagaacagctgaa

SEQ ID NO: 2084095 - DNA, 16 bp, Homo sapiens
cagaacagtttgtaca

SEQ ID NO: 2084096 - DNA, 19 bp, Homo sapiens
cagaacatagacagaagaa

SEQ ID NO: 2084097 - DNA, 14 bp, Homo sapiens
cagaacatcctcca

SEQ ID NO: 2084098 - DNA, 16 bp, Homo sapiens
cagaacatgtgggagg

SEQ ID NO: 2084099 - DNA, 14 bp, Homo sapiens
cagaaccagagggt

SEQ ID NO: 2084100 - DNA, 18 bp, Homo sapiens
cagaactgaacgtcctgc

SEQ ID NO: 2084101 - DNA, 21 bp, Homo sapiens
cagaactgaattaagttattg

SEQ ID NO: 2084102 - DNA, 23 bp, Homo sapiens
cagaactgaggtcactgggttct

SEQ ID NO: 2084103 - DNA, 17 bp, Homo sapiens
cagaactgcttactagc

SEQ ID NO: 2084104 - DNA, 15 bp, Homo sapiens
cagaagaaaaagttg

SEQ ID NO: 2084105 - DNA, 14 bp, Homo sapiens
cagaagaaacaagg

SEQ ID NO: 2084106 - DNA, 20 bp, Homo sapiens
cagaagaatattcaggactt

SEQ ID NO: 2084107 - DNA, 21 bp, Homo sapiens
cagaagaattgaacccaggag

SEQ ID NO: 2084108 - DNA, 22 bp, Homo sapiens
cagaagaattgaacccaggagg

SEQ ID NO: 2084109 - DNA, 21 bp, Homo sapiens
cagaagacactgatgggcaac

SEQ ID NO: 2084110 - DNA, 20 bp, Homo sapiens
cagaagagatgggcttgttt

SEQ ID NO: 2084111 - DNA, 14 bp, Homo sapiens
cagaagagggaggc

SEQ ID NO: 2084112 - DNA, 16 bp, Homo sapiens
cagaagatgccctcca

SEQ ID NO: 2084113 - DNA, 15 bp, Homo sapiens
cagaagccaggagca

SEQ ID NO: 2084114 - DNA, 16 bp, Homo sapiens
cagaagccaggagcaa

SEQ ID NO: 2084115 - DNA, 11 bp, Homo sapiens
cagaagcccca

SEQ ID NO: 2084116 - DNA, 12 bp, Homo sapiens
cagaagcttcca

SEQ ID NO: 2084117 - DNA, 15 bp, Homo sapiens
cagaaggaaggagga

SEQ ID NO: 2084118 - DNA, 20 bp, Homo sapiens
cagaaggaaggcagggagga

SEQ ID NO: 2084119 - DNA, 21 bp, Homo sapiens
cagaaggaagggcatccttct

SEQ ID NO: 2084120 - DNA, 16 bp, Homo sapiens
cagaaggagaaggaaa

SEQ ID NO: 2084121 - DNA, 18 bp, Homo sapiens
cagaaggagaaggaagga

SEQ ID NO: 2084122 - DNA, 20 bp, Homo sapiens
cagaaggagaaggaaggaga

SEQ ID NO: 2084123 - DNA, 17 bp, Homo sapiens
cagaaggatgaatgagg

SEQ ID NO: 2084124 - DNA, 14 bp, Homo sapiens
cagaaggccaagaa

SEQ ID NO: 2084125 - DNA, 18 bp, Homo sapiens
cagaaggccaagaatcaa

SEQ ID NO: 2084126 - DNA, 19 bp, Homo sapiens
cagaaggctggggccagtg

SEQ ID NO: 2084127 - DNA, 19 bp, Homo sapiens
cagaagggagttgctcact

SEQ ID NO: 2084128 - DNA, 21 bp, Homo sapiens
cagaagggagttgctcactca

SEQ ID NO: 2084129 - DNA, 20 bp, Homo sapiens
cagaaggggcacgcctgccc

SEQ ID NO: 2084130 - DNA, 21 bp, Homo sapiens
cagaagtaaagtttatttcat

SEQ ID NO: 2084131 - DNA, 22 bp, Homo sapiens
cagaagtaaagtttatttcatg

SEQ ID NO: 2084132 - DNA, 22 bp, Homo sapiens
cagaagtcagcccgaatgcctg

SEQ ID NO: 2084133 - DNA, 21 bp, Homo sapiens
cagaagtccctcccatctcta

SEQ ID NO: 2084134 - DNA, 15 bp, Homo sapiens
cagaagtttctcagc

SEQ ID NO: 2084135 - DNA, 22 bp, Homo sapiens
cagaataaagttctgagtgttt

SEQ ID NO: 2084136 - DNA, 16 bp, Homo sapiens
cagaatacaagccact

SEQ ID NO: 2084137 - DNA, 23 bp, Homo sapiens
cagaataccttcttcgctgctag

SEQ ID NO: 2084138 - DNA, 21 bp, Homo sapiens
cagaatatttatccttcacca

SEQ ID NO: 2084139 - DNA, 18 bp, Homo sapiens
cagaatcataattttcaa

SEQ ID NO: 2084140 - DNA, 18 bp, Homo sapiens
cagaatccaaagatcaca

SEQ ID NO: 2084141 - DNA, 16 bp, Homo sapiens
cagaatctgctgttgc

SEQ ID NO: 2084142 - DNA, 17 bp, Homo sapiens
cagagacgcaagggaga

SEQ ID NO: 2084143 - DNA, 21 bp, Homo sapiens
cagagactcagggccccagca

SEQ ID NO: 2084144 - DNA, 13 bp, Homo sapiens
cagagactctgga

SEQ ID NO: 2084145 - DNA, 18 bp, Homo sapiens
cagagactctggaagccc

SEQ ID NO: 2084146 - DNA, 14 bp, Homo sapiens
cagagacttgggga

SEQ ID NO: 2084147 - DNA, 20 bp, Homo sapiens
cagagacttggggaccagag

SEQ ID NO: 2084148 - DNA, 15 bp, Homo sapiens
cagagagacagaccg

SEQ ID NO: 2084149 - DNA, 14 bp, Homo sapiens
cagagagagacaga

SEQ ID NO: 2084150 - DNA, 20 bp, Homo sapiens
cagagagaggatgcagaggg

SEQ ID NO: 2084151 - DNA, 13 bp, Homo sapiens
cagagagatgaag

SEQ ID NO: 2084152 - DNA, 13 bp, Homo sapiens
cagagagccctgg

SEQ ID NO: 2084153 - DNA, 12 bp, Homo sapiens
cagagaggagca

SEQ ID NO: 2084154 - DNA, 16 bp, Homo sapiens
cagagaggagcacctg

SEQ ID NO: 2084155 - DNA, 17 bp, Homo sapiens
cagagaggagcacctga

SEQ ID NO: 2084156 - DNA, 22 bp, Homo sapiens
cagagagggcccagctgtagcc

SEQ ID NO: 2084157 - DNA, 16 bp, Homo sapiens
cagagagtcctctgga

SEQ ID NO: 2084158 - DNA, 19 bp, Homo sapiens
cagagagtcctctggatgg

SEQ ID NO: 2084159 - DNA, 16 bp, Homo sapiens
cagagagtcctttggg

SEQ ID NO: 2084160 - DNA, 14 bp, Homo sapiens
cagagagtggctcc

SEQ ID NO: 2084161 - DNA, 18 bp, Homo sapiens
cagagagtggctcctccc

SEQ ID NO: 2084162 - DNA, 15 bp, Homo sapiens
cagagatctgggagg

SEQ ID NO: 2084163 - DNA, 22 bp, Homo sapiens
cagagatgcatgcgcaggctca

SEQ ID NO: 2084164 - DNA, 16 bp, Homo sapiens
cagagatgcctccacc

SEQ ID NO: 2084165 - DNA, 19 bp, Homo sapiens
cagagcaaatgagggaggg

SEQ ID NO: 2084166 - DNA, 17 bp, Homo sapiens
cagagcacacaggtaca

SEQ ID NO: 2084167 - DNA, 13 bp, Homo sapiens
cagagcagagagc

SEQ ID NO: 2084168 - DNA, 18 bp, Homo sapiens
cagagcaggccacgctca

SEQ ID NO: 2084169 - DNA, 22 bp, Homo sapiens
cagagcaggccacgctcaggcc

SEQ ID NO: 2084170 - DNA, 15 bp, Homo sapiens
cagagcaggggcagg

SEQ ID NO: 2084171 - DNA, 22 bp, Homo sapiens
cagagcattacgtgagccaggt

SEQ ID NO: 2084172 - DNA, 16 bp, Homo sapiens
cagagccaccagggca

SEQ ID NO: 2084173 - DNA, 22 bp, Homo sapiens
cagagccacccctaaagagata

SEQ ID NO: 2084174 - DNA, 16 bp, Homo sapiens
cagagccagcctggga

SEQ ID NO: 2084175 - DNA, 18 bp, Homo sapiens
cagagccagcctgggact

SEQ ID NO: 2084176 - DNA, 17 bp, Homo sapiens
cagagccaggctctgcc

SEQ ID NO: 2084177 - DNA, 18 bp, Homo sapiens
cagagccaggctctgcct

SEQ ID NO: 2084178 - DNA, 20 bp, Homo sapiens
cagagccaggctctgcctgg

SEQ ID NO: 2084179 - DNA, 15 bp, Homo sapiens
cagagcccaagtgcc

SEQ ID NO: 2084180 - DNA, 14 bp, Homo sapiens
caaatgctaaatgc

SEQ ID NO: 2084181 - DNA, 12 bp, Homo sapiens
caaatggctctg

SEQ ID NO: 2084182 - DNA, 18 bp, Homo sapiens
caaatggctctgtgaaat

SEQ ID NO: 2084183 - DNA, 18 bp, Homo sapiens
caaatgggtgatatcctg

SEQ ID NO: 2084184 - DNA, 22 bp, Homo sapiens
caaatgggtgatatcctgaaaa

SEQ ID NO: 2084185 - DNA, 21 bp, Homo sapiens
caaatgtaattgaataaagtt

SEQ ID NO: 2084186 - DNA, 23 bp, Homo sapiens
caaatgtagtatggcctgtgtca

SEQ ID NO: 2084187 - DNA, 21 bp, Homo sapiens
caaattagaaacaccattcat

SEQ ID NO: 2084188 - DNA, 20 bp, Homo sapiens
caaattaggttttgtacaat

SEQ ID NO: 2084189 - DNA, 15 bp, Homo sapiens
caaattatttgtgta

SEQ ID NO: 2084190 - DNA, 16 bp, Homo sapiens
caaattatttgtgtaa

SEQ ID NO: 2084191 - DNA, 20 bp, Homo sapiens
caaattatttgtgtaataga

SEQ ID NO: 2084192 - DNA, 23 bp, Homo sapiens
caaattattttaatattttgtat

SEQ ID NO: 2084193 - DNA, 21 bp, Homo sapiens
caaattcaaggagatataaaa

SEQ ID NO: 2084194 - DNA, 19 bp, Homo sapiens
caaattcatgtacagcatg

SEQ ID NO: 2084195 - DNA, 15 bp, Homo sapiens
caaattccatgtccc

SEQ ID NO: 2084196 - DNA, 22 bp, Homo sapiens
caaattgctcctaagcttcaaa

SEQ ID NO: 2084197 - DNA, 17 bp, Homo sapiens
caaattggacagaagat

SEQ ID NO: 2084198 - DNA, 15 bp, Homo sapiens
caaattggtgtttct

SEQ ID NO: 2084199 - DNA, 17 bp, Homo sapiens
caaattggtgtttctga

SEQ ID NO: 2084200 - DNA, 20 bp, Homo sapiens
caaattgtaactacactaat

SEQ ID NO: 2084201 - DNA, 22 bp, Homo sapiens
caaattgtcttttgtcatgtgg

SEQ ID NO: 2084202 - DNA, 15 bp, Homo sapiens
caaattttgcattgt

SEQ ID NO: 2084203 - DNA, 17 bp, Homo sapiens
caaattttgcatttagt

SEQ ID NO: 2084204 - DNA, 13 bp, Homo sapiens
caaattttggcca

SEQ ID NO: 2084205 - DNA, 15 bp, Homo sapiens
caaattttggccaaa

SEQ ID NO: 2084206 - DNA, 16 bp, Homo sapiens
caacaaaatatttaat

SEQ ID NO: 2084207 - DNA, 13 bp, Homo sapiens
caacaaagaaata

SEQ ID NO: 2084208 - DNA, 15 bp, Homo sapiens
caacaacaaaccaaa

SEQ ID NO: 2084209 - DNA, 14 bp, Homo sapiens
caacaacaacaata

SEQ ID NO: 2084210 - DNA, 12 bp, Homo sapiens
caacaacaataa

SEQ ID NO: 2084211 - DNA, 12 bp, Homo sapiens
caacaacaatac

SEQ ID NO: 2084212 - DNA, 12 bp, Homo sapiens
caacaagaacaa

SEQ ID NO: 2084213 - DNA, 17 bp, Homo sapiens
caacaagaacaacaaca

SEQ ID NO: 2084214 - DNA, 14 bp, Homo sapiens
caacaagagtttat

SEQ ID NO: 2084215 - DNA, 13 bp, Homo sapiens
caacaaggaccct

SEQ ID NO: 2084216 - DNA, 16 bp, Homo sapiens
caacaaggaccctgtt

SEQ ID NO: 2084217 - DNA, 13 bp, Homo sapiens
caacaagtaactt

SEQ ID NO: 2084218 - DNA, 13 bp, Homo sapiens
caacaagttgcct

SEQ ID NO: 2084219 - DNA, 14 bp, Homo sapiens
caacaataaagagc

SEQ ID NO: 2084220 - DNA, 16 bp, Homo sapiens
caacaatacaacaaga

SEQ ID NO: 2084221 - DNA, 20 bp, Homo sapiens
caacaatacaacaagaacaa

SEQ ID NO: 2084222 - DNA, 13 bp, Homo sapiens
caacaattctaaa

SEQ ID NO: 2084223 - DNA, 23 bp, Homo sapiens
caacacattacttgcacaagctt

SEQ ID NO: 2084224 - DNA, 14 bp, Homo sapiens
caacaccttcttgg

SEQ ID NO: 2084225 - DNA, 17 bp, Homo sapiens
caacaccttcttggctt

SEQ ID NO: 2084226 - DNA, 14 bp, Homo sapiens
caacactcttcttg

SEQ ID NO: 2084227 - DNA, 22 bp, Homo sapiens
caacactgaagtgcttgcagat

SEQ ID NO: 2084228 - DNA, 14 bp, Homo sapiens
caacagaaaaatgg

SEQ ID NO: 2084229 - DNA, 12 bp, Homo sapiens
caacagaagcag

SEQ ID NO: 2084230 - DNA, 16 bp, Homo sapiens
caacagaagcttcaga

SEQ ID NO: 2084231 - DNA, 15 bp, Homo sapiens
caacagaagcttcca

SEQ ID NO: 2084232 - DNA, 23 bp, Homo sapiens
caacagagtgagaccctgtctct

SEQ ID NO: 2084233 - DNA, 14 bp, Homo sapiens
caacagcttgacca

SEQ ID NO: 2084234 - DNA, 18 bp, Homo sapiens
caacagcttgaccagacc

SEQ ID NO: 2084235 - DNA, 19 bp, Homo sapiens
caacagcttgaccagacct

SEQ ID NO: 2084236 - DNA, 22 bp, Homo sapiens
caacaggaatctcagagacagg

SEQ ID NO: 2084237 - DNA, 13 bp, Homo sapiens
caacaggttttat

SEQ ID NO: 2084238 - DNA, 21 bp, Homo sapiens
caacaggttttcaccatagcc

SEQ ID NO: 2084239 - DNA, 15 bp, Homo sapiens
caacagtagcaggga

SEQ ID NO: 2084240 - DNA, 18 bp, Homo sapiens
caacagtcaaaacagaga

SEQ ID NO: 2084241 - DNA, 12 bp, Homo sapiens
caacagtgagtc

SEQ ID NO: 2084242 - DNA, 16 bp, Homo sapiens
caacagttcaaagaag

SEQ ID NO: 2084243 - DNA, 21 bp, Homo sapiens
caacatacccttctttaaatc

SEQ ID NO: 2084244 - DNA, 23 bp, Homo sapiens
caacatacccttctttaaatcaa

SEQ ID NO: 2084245 - DNA, 17 bp, Homo sapiens
caacatcccacagtggc

SEQ ID NO: 2084246 - DNA, 15 bp, Homo sapiens
caacatcccattgcc

SEQ ID NO: 2084247 - DNA, 18 bp, Homo sapiens
caacatcccattgccctg

SEQ ID NO: 2084248 - DNA, 19 bp, Homo sapiens
caacatcccattgccctgg

SEQ ID NO: 2084249 - DNA, 23 bp, Homo sapiens
caacatctaagcctgttgagact

SEQ ID NO: 2084250 - DNA, 19 bp, Homo sapiens
caacatctcgagccccctg

SEQ ID NO: 2084251 - DNA, 13 bp, Homo sapiens
caacatcttctct

SEQ ID NO: 2084252 - DNA, 19 bp, Homo sapiens
caacatctttttcctccct

SEQ ID NO: 2084253 - DNA, 20 bp, Homo sapiens
caacatgtagctgagtttaa

SEQ ID NO: 2084254 - DNA, 13 bp, Homo sapiens
caacatgtataat

SEQ ID NO: 2084255 - DNA, 18 bp, Homo sapiens
caacatgtataatatttt

SEQ ID NO: 2084256 - DNA, 22 bp, Homo sapiens
caacatgttatttgtaatagat

SEQ ID NO: 2084257 - DNA, 17 bp, Homo sapiens
caacattcaaagcagca

SEQ ID NO: 2084258 - DNA, 14 bp, Homo sapiens
caacattctttgca

SEQ ID NO: 2084259 - DNA, 22 bp, Homo sapiens
caacatttatttcaaactattg

SEQ ID NO: 2084260 - DNA, 14 bp, Homo sapiens
caacatttccgaag

SEQ ID NO: 2084261 - DNA, 22 bp, Homo sapiens
caacatttctatagccaaaaat

SEQ ID NO: 2084262 - DNA, 12 bp, Homo sapiens
caacattttatt

SEQ ID NO: 2084263 - DNA, 16 bp, Homo sapiens
caaccaaccaaccaac

SEQ ID NO: 2084264 - DNA, 16 bp, Homo sapiens
caaccaatgtagaaag

SEQ ID NO: 2084265 - DNA, 14 bp, Homo sapiens
caaccacacacctc

SEQ ID NO: 2084266 - DNA, 20 bp, Homo sapiens
caaccacacacctcaccaga

SEQ ID NO: 2084267 - DNA, 22 bp, Homo sapiens
caaccactgtggcgttctgctg

SEQ ID NO: 2084268 - DNA, 20 bp, Homo sapiens
cagagcccaccttggctcaa

SEQ ID NO: 2084269 - DNA, 22 bp, Homo sapiens
cagagcccagggcatcccatgg

SEQ ID NO: 2084270 - DNA, 13 bp, Homo sapiens
cagagccccacac

SEQ ID NO: 2084271 - DNA, 16 bp, Homo sapiens
cagagccccacacgga

SEQ ID NO: 2084272 - DNA, 14 bp, Homo sapiens
cagagcccccaagc

SEQ ID NO: 2084273 - DNA, 16 bp, Homo sapiens
cagagcccccaagcct

SEQ ID NO: 2084274 - DNA, 22 bp, Homo sapiens
cagagcccccaagcctctgccc

SEQ ID NO: 2084275 - DNA, 21 bp, Homo sapiens
cagagcccccaaggactctgg

SEQ ID NO: 2084276 - DNA, 17 bp, Homo sapiens
cagagcccctccctgct

SEQ ID NO: 2084277 - DNA, 23 bp, Homo sapiens
cagagccctgtgaggctgggtcc

SEQ ID NO: 2084278 - DNA, 19 bp, Homo sapiens
cagagccggggcactttca

SEQ ID NO: 2084279 - DNA, 21 bp, Homo sapiens
cagagccggggcactttcaga

SEQ ID NO: 2084280 - DNA, 19 bp, Homo sapiens
cagagcctagccacctccc

SEQ ID NO: 2084281 - DNA, 22 bp, Homo sapiens
cagagcctagccacctcccacc

SEQ ID NO: 2084282 - DNA, 11 bp, Homo sapiens
cagagcctggg

SEQ ID NO: 2084283 - DNA, 12 bp, Homo sapiens
cagagcctgggg

SEQ ID NO: 2084284 - DNA, 13 bp, Homo sapiens
cagagcctggggc

SEQ ID NO: 2084285 - DNA, 24 bp, Homo sapiens
cagagcctggggcatcccagagcc

SEQ ID NO: 2084286 - DNA, 17 bp, Homo sapiens
cagagcctgtctttcag

SEQ ID NO: 2084287 - DNA, 22 bp, Homo sapiens
cagagccttcacaaccagccac

SEQ ID NO: 2084288 - DNA, 21 bp, Homo sapiens
cagagccttctcctgcctaca

SEQ ID NO: 2084289 - DNA, 20 bp, Homo sapiens
cagagcctttttcacaattc

SEQ ID NO: 2084290 - DNA, 20 bp, Homo sapiens
cagagcgagagtctgtctca

SEQ ID NO: 2084291 - DNA, 13 bp, Homo sapiens
cagagcggggagg

SEQ ID NO: 2084292 - DNA, 19 bp, Homo sapiens
cagagcggggaggtgcctg

SEQ ID NO: 2084293 - DNA, 17 bp, Homo sapiens
cagagctcccttcctga

SEQ ID NO: 2084294 - DNA, 12 bp, Homo sapiens
cagagctgaccc

SEQ ID NO: 2084295 - DNA, 20 bp, Homo sapiens
cagagctgatggagaaggaa

SEQ ID NO: 2084296 - DNA, 21 bp, Homo sapiens
cagagctggaaggcagggcag

SEQ ID NO: 2084297 - DNA, 13 bp, Homo sapiens
cagagctgggagg

SEQ ID NO: 2084298 - DNA, 21 bp, Homo sapiens
cagagctgttggcctcgcctg

SEQ ID NO: 2084299 - DNA, 22 bp, Homo sapiens
cagagctgttggcctcgcctgg

SEQ ID NO: 2084300 - DNA, 13 bp, Homo sapiens
cagagcttcccag

SEQ ID NO: 2084301 - DNA, 14 bp, Homo sapiens
cagaggaagagcag

SEQ ID NO: 2084302 - DNA, 15 bp, Homo sapiens
cagaggaagagcagg

SEQ ID NO: 2084303 - DNA, 15 bp, Homo sapiens
cagaggaagcccctt

SEQ ID NO: 2084304 - DNA, 19 bp, Homo sapiens
cagaggaatctacctgtgg

SEQ ID NO: 2084305 - DNA, 20 bp, Homo sapiens
cagaggaatctacctgtggt

SEQ ID NO: 2084306 - DNA, 20 bp, Homo sapiens
cagaggacaaggaagtgggg

SEQ ID NO: 2084307 - DNA, 19 bp, Homo sapiens
cagaggagtccagggcggg

SEQ ID NO: 2084308 - DNA, 16 bp, Homo sapiens
cagaggattgaggctt

SEQ ID NO: 2084309 - DNA, 22 bp, Homo sapiens
cagaggcagccccattctgcct

SEQ ID NO: 2084310 - DNA, 17 bp, Homo sapiens
cagaggcagctgtgtgg

SEQ ID NO: 2084311 - DNA, 23 bp, Homo sapiens
cagaggcagctgtgtgggctgca

SEQ ID NO: 2084312 - DNA, 21 bp, Homo sapiens
cagaggccatgggcctcctgt

SEQ ID NO: 2084313 - DNA, 13 bp, Homo sapiens
cagaggccctgga

SEQ ID NO: 2084314 - DNA, 18 bp, Homo sapiens
cagaggcggaaaccttgc

SEQ ID NO: 2084315 - DNA, 20 bp, Homo sapiens
cagaggcggaaaccttgcag

SEQ ID NO: 2084316 - DNA, 17 bp, Homo sapiens
cagaggctaagatgaga

SEQ ID NO: 2084317 - DNA, 20 bp, Homo sapiens
cagaggctattattttcact

SEQ ID NO: 2084318 - DNA, 14 bp, Homo sapiens
cagaggctgcagga

SEQ ID NO: 2084319 - DNA, 17 bp, Homo sapiens
cagaggctggaggcagg

SEQ ID NO: 2084320 - DNA, 19 bp, Homo sapiens
cagaggctggaggcagggc

SEQ ID NO: 2084321 - DNA, 20 bp, Homo sapiens
cagaggcttcttcagatcag

SEQ ID NO: 2084322 - DNA, 23 bp, Homo sapiens
cagagggaaagtaaatatttcag

SEQ ID NO: 2084323 - DNA, 17 bp, Homo sapiens
cagagggacagggtgga

SEQ ID NO: 2084324 - DNA, 18 bp, Homo sapiens
cagagggaccaaattgct

SEQ ID NO: 2084325 - DNA, 20 bp, Homo sapiens
cagagggaccaaattgcttc

SEQ ID NO: 2084326 - DNA, 22 bp, Homo sapiens
cagagggaccaaattgcttcta

SEQ ID NO: 2084327 - DNA, 23 bp, Homo sapiens
cagagggaccaaattgcttctag

SEQ ID NO: 2084328 - DNA, 23 bp, Homo sapiens
cagagggagtgacagaggcagcc

SEQ ID NO: 2084329 - DNA, 19 bp, Homo sapiens
cagagggccaagagagaca

SEQ ID NO: 2084330 - DNA, 15 bp, Homo sapiens
cagagggcccaggca

SEQ ID NO: 2084331 - DNA, 22 bp, Homo sapiens
cagagggcccaggcaggccacc

SEQ ID NO: 2084332 - DNA, 13 bp, Homo sapiens
cagagggctaggg

SEQ ID NO: 2084333 - DNA, 14 bp, Homo sapiens
cagaggggcagccg

SEQ ID NO: 2084334 - DNA, 23 bp, Homo sapiens
cagaggggccccggtcctggccc

SEQ ID NO: 2084335 - DNA, 19 bp, Homo sapiens
cagaggggctttctggaga

SEQ ID NO: 2084336 - DNA, 21 bp, Homo sapiens
cagaggggtaggcagagcctt

SEQ ID NO: 2084337 - DNA, 18 bp, Homo sapiens
cagaggggtgctgctcct

SEQ ID NO: 2084338 - DNA, 18 bp, Homo sapiens
cagagggtagggcagcag

SEQ ID NO: 2084339 - DNA, 14 bp, Homo sapiens
cagcccggcctgct

SEQ ID NO: 2084340 - DNA, 15 bp, Homo sapiens
cagcccggcgccacc

SEQ ID NO: 2084341 - DNA, 19 bp, Homo sapiens
cagcccgtgaagcagtgcc

SEQ ID NO: 2084342 - DNA, 20 bp, Homo sapiens
cagcccgtgaagcagtgcct

SEQ ID NO: 2084343 - DNA, 18 bp, Homo sapiens
cagccctaaggatctctc

SEQ ID NO: 2084344 - DNA, 20 bp, Homo sapiens
cagccctaaggatctctcag

SEQ ID NO: 2084345 - DNA, 21 bp, Homo sapiens
cagccctaaggatctctcagg

SEQ ID NO: 2084346 - DNA, 22 bp, Homo sapiens
cagccctaaggatctctcagga

SEQ ID NO: 2084347 - DNA, 20 bp, Homo sapiens
cagccctacatcttcagctc

SEQ ID NO: 2084348 - DNA, 23 bp, Homo sapiens
cagccctacatcttcagctccca

SEQ ID NO: 2084349 - DNA, 13 bp, Homo sapiens
cagccctcaggcc

SEQ ID NO: 2084350 - DNA, 16 bp, Homo sapiens
cagccctcaggccagt

SEQ ID NO: 2084351 - DNA, 17 bp, Homo sapiens
cagccctcaggccagtg

SEQ ID NO: 2084352 - DNA, 19 bp, Homo sapiens
cagccctcaggccagtgcc

SEQ ID NO: 2084353 - DNA, 21 bp, Homo sapiens
cagccctcaggccagtgccag

SEQ ID NO: 2084354 - DNA, 13 bp, Homo sapiens
cagccctccctgc

SEQ ID NO: 2084355 - DNA, 13 bp, Homo sapiens
cagccctccctgt

SEQ ID NO: 2084356 - DNA, 20 bp, Homo sapiens
cagccctccctgtcctcctc

SEQ ID NO: 2084357 - DNA, 22 bp, Homo sapiens
cagccctcctcaccccgtctgg

SEQ ID NO: 2084358 - DNA, 12 bp, Homo sapiens
cagccctgccag

SEQ ID NO: 2084359 - DNA, 15 bp, Homo sapiens
cagccctgcctggag

SEQ ID NO: 2084360 - DNA, 19 bp, Homo sapiens
cagccctgctttgggctgc

SEQ ID NO: 2084361 - DNA, 21 bp, Homo sapiens
cagccctgctttgggctgccc

SEQ ID NO: 2084362 - DNA, 16 bp, Homo sapiens
cagccctggctctgca

SEQ ID NO: 2084363 - DNA, 11 bp, Homo sapiens
cagccctgggc

SEQ ID NO: 2084364 - DNA, 19 bp, Homo sapiens
cagccctgggccccaccac

SEQ ID NO: 2084365 - DNA, 20 bp, Homo sapiens
cagccctgggggccagctgg

SEQ ID NO: 2084366 - DNA, 22 bp, Homo sapiens
cagccctgtcccctgaaaaact

SEQ ID NO: 2084367 - DNA, 15 bp, Homo sapiens
cagcccttagcaggg

SEQ ID NO: 2084368 - DNA, 16 bp, Homo sapiens
cagcccttagcaggga

SEQ ID NO: 2084369 - DNA, 15 bp, Homo sapiens
cagcccttccctgct

SEQ ID NO: 2084370 - DNA, 22 bp, Homo sapiens
cagcccttcctcctgaagcctc

SEQ ID NO: 2084371 - DNA, 23 bp, Homo sapiens
cagcccttcctcctgaagcctct

SEQ ID NO: 2084372 - DNA, 12 bp, Homo sapiens
cagcccttctgc

SEQ ID NO: 2084373 - DNA, 15 bp, Homo sapiens
cagcccttctgcctt

SEQ ID NO: 2084374 - DNA, 18 bp, Homo sapiens
cagcccttctgcctttct

SEQ ID NO: 2084375 - DNA, 22 bp, Homo sapiens
cagccctttgcaggcccagcag

SEQ ID NO: 2084376 - DNA, 12 bp, Homo sapiens
cagccgagccgg

SEQ ID NO: 2084377 - DNA, 17 bp, Homo sapiens
cagccgagccgggcctg

SEQ ID NO: 2084378 - DNA, 19 bp, Homo sapiens
cagccgcagcctccctctg

SEQ ID NO: 2084379 - DNA, 18 bp, Homo sapiens
cagccgccatcagcccaa

SEQ ID NO: 2084380 - DNA, 14 bp, Homo sapiens
cagccgccctgggc

SEQ ID NO: 2084381 - DNA, 18 bp, Homo sapiens
cagccgccgggcaggcct

SEQ ID NO: 2084382 - DNA, 15 bp, Homo sapiens
cagccgctaggagag

SEQ ID NO: 2084383 - DNA, 18 bp, Homo sapiens
cagccgcttctgactgct

SEQ ID NO: 2084384 - DNA, 18 bp, Homo sapiens
cagccgggtacctcagtt

SEQ ID NO: 2084385 - DNA, 20 bp, Homo sapiens
cagccgggtacctcagtttc

SEQ ID NO: 2084386 - DNA, 22 bp, Homo sapiens
cagccgggtacctcagtttctc

SEQ ID NO: 2084387 - DNA, 17 bp, Homo sapiens
cagccggtacctgggaa

SEQ ID NO: 2084388 - DNA, 15 bp, Homo sapiens
cagccggtgcctggc

SEQ ID NO: 2084389 - DNA, 18 bp, Homo sapiens
cagccgtcagccaaatgt

SEQ ID NO: 2084390 - DNA, 15 bp, Homo sapiens
cagccgtgcactccc

SEQ ID NO: 2084391 - DNA, 14 bp, Homo sapiens
cagccgtgccttca

SEQ ID NO: 2084392 - DNA, 18 bp, Homo sapiens
cagccgtgccttcagctc

SEQ ID NO: 2084393 - DNA, 23 bp, Homo sapiens
cagcctaagaagctctggcccca

SEQ ID NO: 2084394 - DNA, 21 bp, Homo sapiens
cactaaggccgtgtctctgag

SEQ ID NO: 2084395 - DNA, 23 bp, Homo sapiens
cactaagtagaataaagaaaaac

SEQ ID NO: 2084396 - DNA, 19 bp, Homo sapiens
cactacactccagcctgag

SEQ ID NO: 2084397 - DNA, 19 bp, Homo sapiens
cactacatgtggtttatag

SEQ ID NO: 2084398 - DNA, 21 bp, Homo sapiens
cactacccggccggagccgcc

SEQ ID NO: 2084399 - DNA, 19 bp, Homo sapiens
cactaccttctgacctccc

SEQ ID NO: 2084400 - DNA, 23 bp, Homo sapiens
cactacggaatagttggctagga

SEQ ID NO: 2084401 - DNA, 17 bp, Homo sapiens
cactactcacagtctct

SEQ ID NO: 2084402 - DNA, 20 bp, Homo sapiens
cactactgtgtagactcctg

SEQ ID NO: 2084403 - DNA, 14 bp, Homo sapiens
cactagagctggga

SEQ ID NO: 2084404 - DNA, 15 bp, Homo sapiens
cactagagctgggaa

SEQ ID NO: 2084405 - DNA, 12 bp, Homo sapiens
cactagcagctg

SEQ ID NO: 2084406 - DNA, 15 bp, Homo sapiens
cactagcagctgcag

SEQ ID NO: 2084407 - DNA, 18 bp, Homo sapiens
cactaggactctgaggct

SEQ ID NO: 2084408 - DNA, 20 bp, Homo sapiens
cactagggcagggacaggat

SEQ ID NO: 2084409 - DNA, 17 bp, Homo sapiens
cactagttttgtgccag

SEQ ID NO: 2084410 - DNA, 14 bp, Homo sapiens
cactatctttctga

SEQ ID NO: 2084411 - DNA, 20 bp, Homo sapiens
cactatggtatgctggccag

SEQ ID NO: 2084412 - DNA, 17 bp, Homo sapiens
cactatggtatttgagt

SEQ ID NO: 2084413 - DNA, 18 bp, Homo sapiens
cactatgttgcccaggca

SEQ ID NO: 2084414 - DNA, 19 bp, Homo sapiens
cactatgttgcccaggcag

SEQ ID NO: 2084415 - DNA, 19 bp, Homo sapiens
cactatgttgcccaggctg

SEQ ID NO: 2084416 - DNA, 15 bp, Homo sapiens
cactattagagaaac

SEQ ID NO: 2084417 - DNA, 16 bp, Homo sapiens
cactattgcattgttc

SEQ ID NO: 2084418 - DNA, 13 bp, Homo sapiens
cactcaaacaatc

SEQ ID NO: 2084419 - DNA, 16 bp, Homo sapiens
cactcaaattaatctt

SEQ ID NO: 2084420 - DNA, 15 bp, Homo sapiens
cactcaacaataaag

SEQ ID NO: 2084421 - DNA, 17 bp, Homo sapiens
cactcaatatgtgattt

SEQ ID NO: 2084422 - DNA, 19 bp, Homo sapiens
cactcacatgccgccccca

SEQ ID NO: 2084423 - DNA, 19 bp, Homo sapiens
cactcacatttattctgct

SEQ ID NO: 2084424 - DNA, 22 bp, Homo sapiens
cactcacccatgtgccaaggtg

SEQ ID NO: 2084425 - DNA, 15 bp, Homo sapiens
cactcactcactcat

SEQ ID NO: 2084426 - DNA, 17 bp, Homo sapiens
cactcagaagacactga

SEQ ID NO: 2084427 - DNA, 18 bp, Homo sapiens
cactcagaagacactgat

SEQ ID NO: 2084428 - DNA, 14 bp, Homo sapiens
cactcagaagcctg

SEQ ID NO: 2084429 - DNA, 12 bp, Homo sapiens
cactcagcagcc

SEQ ID NO: 2084430 - DNA, 13 bp, Homo sapiens
cactcagcagccc

SEQ ID NO: 2084431 - DNA, 15 bp, Homo sapiens
cactcagcagccccc

SEQ ID NO: 2084432 - DNA, 12 bp, Homo sapiens
cactcagccaca

SEQ ID NO: 2084433 - DNA, 14 bp, Homo sapiens
cactcagccacacc

SEQ ID NO: 2084434 - DNA, 19 bp, Homo sapiens
cactcaggaggctgaggca

SEQ ID NO: 2084435 - DNA, 20 bp, Homo sapiens
cactcatgttgttcccacac

SEQ ID NO: 2084436 - DNA, 21 bp, Homo sapiens
cactcatgttgttcccacaca

SEQ ID NO: 2084437 - DNA, 12 bp, Homo sapiens
cactcatttcat

SEQ ID NO: 2084438 - DNA, 14 bp, Homo sapiens
cactccacactggc

SEQ ID NO: 2084439 - DNA, 14 bp, Homo sapiens
cactccaccaccca

SEQ ID NO: 2084440 - DNA, 15 bp, Homo sapiens
cactccaccacccaa

SEQ ID NO: 2084441 - DNA, 16 bp, Homo sapiens
cactccacctccaccc

SEQ ID NO: 2084442 - DNA, 17 bp, Homo sapiens
cactccagacccctggc

SEQ ID NO: 2084443 - DNA, 12 bp, Homo sapiens
cactccagccct

SEQ ID NO: 2084444 - DNA, 16 bp, Homo sapiens
cactccagccctgtcc

SEQ ID NO: 2084445 - DNA, 15 bp, Homo sapiens
cactccagcctgagc

SEQ ID NO: 2084446 - DNA, 13 bp, Homo sapiens
cactccagcctgg

SEQ ID NO: 2084447 - DNA, 14 bp, Homo sapiens
cactccagcctggg

SEQ ID NO: 2084448 - DNA, 23 bp, Homo sapiens
cactccagcctgggcgacagagc

SEQ ID NO: 2084449 - DNA, 23 bp, Homo sapiens
cactccatggccaccccgtgcca

SEQ ID NO: 2084450 - DNA, 13 bp, Homo sapiens
cactccattccca

SEQ ID NO: 2084451 - DNA, 14 bp, Homo sapiens
cactcccagggaca

SEQ ID NO: 2084452 - DNA, 22 bp, Homo sapiens
cactccctaaccaaatgctgtc

SEQ ID NO: 2084453 - DNA, 11 bp, Homo sapiens
cactccctccc

SEQ ID NO: 2084454 - DNA, 17 bp, Homo sapiens
cactccggtgtgcctgc

SEQ ID NO: 2084455 - DNA, 21 bp, Homo sapiens
cactccggtgtgcctgcagcc

SEQ ID NO: 2084456 - DNA, 23 bp, Homo sapiens
cactcctctgtctctgctcttgc

SEQ ID NO: 2084457 - DNA, 12 bp, Homo sapiens
cactcctgctgt

SEQ ID NO: 2084458 - DNA, 20 bp, Homo sapiens
cactcctgtcccgccttcct

SEQ ID NO: 2084459 - DNA, 14 bp, Homo sapiens
cactccttcctgcc

SEQ ID NO: 2084460 - DNA, 17 bp, Homo sapiens
cactccttcctgcccca

SEQ ID NO: 2084461 - DNA, 17 bp, Homo sapiens
cactcgagaccatcctg

SEQ ID NO: 2084462 - DNA, 20 bp, Homo sapiens
cactcgagaccatcctggcc

SEQ ID NO: 2084463 - DNA, 15 bp, Homo sapiens
cactcgcagtcgcag

SEQ ID NO: 2084464 - DNA, 19 bp, Homo sapiens
cactctagtgacttcctgg

SEQ ID NO: 2084465 - DNA, 22 bp, Homo sapiens
cactctagtgacttcctggtga

SEQ ID NO: 2084466 - DNA, 17 bp, Homo sapiens
cactctcattccccagg

SEQ ID NO: 2084467 - DNA, 16 bp, Homo sapiens
cactctcccctccctc

SEQ ID NO: 2084468 - DNA, 23 bp, Homo sapiens
cactctccttcgtgtctctccca

SEQ ID NO: 2084469 - DNA, 23 bp, Homo sapiens
cactctcggggcccttggggcct

SEQ ID NO: 2084470 - DNA, 14 bp, Homo sapiens
cactctctaaatct

SEQ ID NO: 2084471 - DNA, 16 bp, Homo sapiens
cactctctgtacaaaa

SEQ ID NO: 2084472 - DNA, 20 bp, Homo sapiens
cactctctgtacaaaaacaa

SEQ ID NO: 2084473 - DNA, 12 bp, Homo sapiens
cactctgctctg

SEQ ID NO: 2084474 - DNA, 16 bp, Homo sapiens
cactctgctctgatgc

SEQ ID NO: 2084475 - DNA, 12 bp, Homo sapiens
cactctgtcagc

SEQ ID NO: 2084476 - DNA, 19 bp, Homo sapiens
cactctgtcgcccagtctg

SEQ ID NO: 2084477 - DNA, 21 bp, Homo sapiens
cactcttattgcccacgctgg

SEQ ID NO: 2084478 - DNA, 11 bp, Homo sapiens
cactcttccaa

SEQ ID NO: 2084479 - DNA, 14 bp, Homo sapiens
cactctttgctaca

SEQ ID NO: 2084480 - DNA, 16 bp, Homo sapiens
cactctttgctacaat

SEQ ID NO: 2084481 - DNA, 15 bp, Homo sapiens
cactctttgtaagag

SEQ ID NO: 2084482 - DNA, 12 bp, Homo sapiens
cactgaaaacat

SEQ ID NO: 2084483 - DNA, 21 bp, Homo sapiens
caggagcacacggccctgccc

SEQ ID NO: 2084484 - DNA, 23 bp, Homo sapiens
caggagcacacggccctgcccca

SEQ ID NO: 2084485 - DNA, 13 bp, Homo sapiens
caggagcagacag

SEQ ID NO: 2084486 - DNA, 17 bp, Homo sapiens
caggagcagacagagaa

SEQ ID NO: 2084487 - DNA, 24 bp, Homo sapiens
caggagcaggaacagagactctgg

SEQ ID NO: 2084488 - DNA, 15 bp, Homo sapiens
caggagcccagaggg

SEQ ID NO: 2084489 - DNA, 11 bp, Homo sapiens
caggagcctgg

SEQ ID NO: 2084490 - DNA, 18 bp, Homo sapiens
caggagctgagtcacctc

SEQ ID NO: 2084491 - DNA, 19 bp, Homo sapiens
caggagctgagtcacctcc

SEQ ID NO: 2084492 - DNA, 14 bp, Homo sapiens
caggagctggagga

SEQ ID NO: 2084493 - DNA, 23 bp, Homo sapiens
caggaggaatcatgtcaggcctg

SEQ ID NO: 2084494 - DNA, 19 bp, Homo sapiens
caggaggattgatggtgct

SEQ ID NO: 2084495 - DNA, 14 bp, Homo sapiens
caggaggcctggcc

SEQ ID NO: 2084496 - DNA, 15 bp, Homo sapiens
caggaggcctggcct

SEQ ID NO: 2084497 - DNA, 16 bp, Homo sapiens
caggaggcgaataaat

SEQ ID NO: 2084498 - DNA, 19 bp, Homo sapiens
caggaggcgaataaatgtt

SEQ ID NO: 2084499 - DNA, 16 bp, Homo sapiens
caggaggctgaggcag

SEQ ID NO: 2084500 - DNA, 17 bp, Homo sapiens
caggaggctgaggcagg

SEQ ID NO: 2084501 - DNA, 15 bp, Homo sapiens
caggaggctgagggg

SEQ ID NO: 2084502 - DNA, 21 bp, Homo sapiens
caggaggcttggaaagcatca

SEQ ID NO: 2084503 - DNA, 18 bp, Homo sapiens
caggagggacaaaggagc

SEQ ID NO: 2084504 - DNA, 21 bp, Homo sapiens
caggagggacaaaggagcctg

SEQ ID NO: 2084505 - DNA, 23 bp, Homo sapiens
caggagggacaaaggagcctgtg

SEQ ID NO: 2084506 - DNA, 16 bp, Homo sapiens
caggagggcaagggcc

SEQ ID NO: 2084507 - DNA, 17 bp, Homo sapiens
caggagggcaagggcca

SEQ ID NO: 2084508 - DNA, 16 bp, Homo sapiens
caggaggggcctctga

SEQ ID NO: 2084509 - DNA, 18 bp, Homo sapiens
caggagggggtcgtggag

SEQ ID NO: 2084510 - DNA, 20 bp, Homo sapiens
caggagggtccccagctggt

SEQ ID NO: 2084511 - DNA, 16 bp, Homo sapiens
caggaggtcctcctct

SEQ ID NO: 2084512 - DNA, 20 bp, Homo sapiens
caggaggtggaggttgcagt

SEQ ID NO: 2084513 - DNA, 18 bp, Homo sapiens
caggaggtggctatggcc

SEQ ID NO: 2084514 - DNA, 23 bp, Homo sapiens
caggagtatcttacctgtaaagt

SEQ ID NO: 2084515 - DNA, 17 bp, Homo sapiens
caggagtcccaaggaaa

SEQ ID NO: 2084516 - DNA, 15 bp, Homo sapiens
caggagtccctggta

SEQ ID NO: 2084517 - DNA, 14 bp, Homo sapiens
caggagtctgtgct

SEQ ID NO: 2084518 - DNA, 15 bp, Homo sapiens
caggagtctgtgctc

SEQ ID NO: 2084519 - DNA, 22 bp, Homo sapiens
caggagttcaagaccagcctgg

SEQ ID NO: 2084520 - DNA, 19 bp, Homo sapiens
caggagttcgaggctgcag

SEQ ID NO: 2084521 - DNA, 20 bp, Homo sapiens
caggagtttgagacaagccc

SEQ ID NO: 2084522 - DNA, 21 bp, Homo sapiens
caggagtttgagacaagccct

SEQ ID NO: 2084523 - DNA, 20 bp, Homo sapiens
caggagtttgaggctgcagc

SEQ ID NO: 2084524 - DNA, 22 bp, Homo sapiens
caggagtttgtgtgtcttttat

SEQ ID NO: 2084525 - DNA, 16 bp, Homo sapiens
catagcgctggctcag

SEQ ID NO: 2084526 - DNA, 17 bp, Homo sapiens
catagcgctggctcagg

SEQ ID NO: 2084527 - DNA, 21 bp, Homo sapiens
catagctacccaaaagagaaa

SEQ ID NO: 2084528 - DNA, 22 bp, Homo sapiens
catagctacccaaaagagaaaa

SEQ ID NO: 2084529 - DNA, 17 bp, Homo sapiens
cataggcggtcatgtgt

SEQ ID NO: 2084530 - DNA, 17 bp, Homo sapiens
catagggtctcttcagg

SEQ ID NO: 2084531 - DNA, 20 bp, Homo sapiens
catagtaagaccccatctct

SEQ ID NO: 2084532 - DNA, 16 bp, Homo sapiens
catagtatggtggctg

SEQ ID NO: 2084533 - DNA, 18 bp, Homo sapiens
catagtatggtggctggg

SEQ ID NO: 2084534 - DNA, 18 bp, Homo sapiens
catagtgcacacttgtat

SEQ ID NO: 2084535 - DNA, 18 bp, Homo sapiens
catagttatttacttgaa

SEQ ID NO: 2084536 - DNA, 23 bp, Homo sapiens
catagttatttacttgaaagatg

SEQ ID NO: 2084537 - DNA, 15 bp, Homo sapiens
catataatgttgtta

SEQ ID NO: 2084538 - DNA, 18 bp, Homo sapiens
catataatgttgttattt

SEQ ID NO: 2084539 - DNA, 15 bp, Homo sapiens
catatacaaaagcaa

SEQ ID NO: 2084540 - DNA, 15 bp, Homo sapiens
catatacatatatat

SEQ ID NO: 2084541 - DNA, 18 bp, Homo sapiens
catatacatatatatata

SEQ ID NO: 2084542 - DNA, 18 bp, Homo sapiens
catatacctataatgtgt

SEQ ID NO: 2084543 - DNA, 19 bp, Homo sapiens
catatatatatacacatac

SEQ ID NO: 2084544 - DNA, 23 bp, Homo sapiens
catatatatatacacatacatac

SEQ ID NO: 2084545 - DNA, 17 bp, Homo sapiens
catatatatctatctta

SEQ ID NO: 2084546 - DNA, 12 bp, Homo sapiens
catatatatctg

SEQ ID NO: 2084547 - DNA, 19 bp, Homo sapiens
catatatatgccttatgta

SEQ ID NO: 2084548 - DNA, 14 bp, Homo sapiens
catatatgtatatg

SEQ ID NO: 2084549 - DNA, 12 bp, Homo sapiens
catatattcatg

SEQ ID NO: 2084550 - DNA, 20 bp, Homo sapiens
catatattcatgtaataaat

SEQ ID NO: 2084551 - DNA, 14 bp, Homo sapiens
catatcagacctct

SEQ ID NO: 2084552 - DNA, 21 bp, Homo sapiens
catatcctttgccccaaggct

SEQ ID NO: 2084553 - DNA, 18 bp, Homo sapiens
catatcggaggtggtgga

SEQ ID NO: 2084554 - DNA, 22 bp, Homo sapiens
catatgaaaaaaatgcatttta

SEQ ID NO: 2084555 - DNA, 16 bp, Homo sapiens
catatgcaccttgtgt

SEQ ID NO: 2084556 - DNA, 21 bp, Homo sapiens
catatgcgtcccaagcagccg

SEQ ID NO: 2084557 - DNA, 13 bp, Homo sapiens
catatgctatgtt

SEQ ID NO: 2084558 - DNA, 18 bp, Homo sapiens
catatggactctgcacat

SEQ ID NO: 2084559 - DNA, 15 bp, Homo sapiens
catatgggtgctggc

SEQ ID NO: 2084560 - DNA, 13 bp, Homo sapiens
catatgtagccct

SEQ ID NO: 2084561 - DNA, 15 bp, Homo sapiens
catatgtagccctca

SEQ ID NO: 2084562 - DNA, 20 bp, Homo sapiens
catatgtctgcttctgtcca

SEQ ID NO: 2084563 - DNA, 18 bp, Homo sapiens
catattaaaggcttttgg

SEQ ID NO: 2084564 - DNA, 18 bp, Homo sapiens
catattataaataaatgc

SEQ ID NO: 2084565 - DNA, 20 bp, Homo sapiens
catattataaataaatgcca

SEQ ID NO: 2084566 - DNA, 17 bp, Homo sapiens
catattctgttggccag

SEQ ID NO: 2084567 - DNA, 22 bp, Homo sapiens
catattcttggagaactttcca

SEQ ID NO: 2084568 - DNA, 17 bp, Homo sapiens
catattgggtaatgttt

SEQ ID NO: 2084569 - DNA, 13 bp, Homo sapiens
catattgtgccaa

SEQ ID NO: 2084570 - DNA, 21 bp, Homo sapiens
catattgtgccaatatgtatt

SEQ ID NO: 2084571 - DNA, 14 bp, Homo sapiens
catatttaaagaca

SEQ ID NO: 2084572 - DNA, 19 bp, Homo sapiens
catatttatattgtatatt

SEQ ID NO: 2084573 - DNA, 21 bp, Homo sapiens
catatttatattgtatattct

SEQ ID NO: 2084574 - DNA, 14 bp, Homo sapiens
catcaaatgctgta

SEQ ID NO: 2084575 - DNA, 16 bp, Homo sapiens
catcaacaaagaaata

SEQ ID NO: 2084576 - DNA, 15 bp, Homo sapiens
catcaagcatgcaat

SEQ ID NO: 2084577 - DNA, 21 bp, Homo sapiens
catcaatttttatacatatca

SEQ ID NO: 2084578 - DNA, 24 bp, Homo sapiens
catcaatttttatacatatcagaa

SEQ ID NO: 2084579 - DNA, 14 bp, Homo sapiens
catcacagcagaat

SEQ ID NO: 2084580 - DNA, 15 bp, Homo sapiens
catcacccagtcctg

SEQ ID NO: 2084581 - DNA, 16 bp, Homo sapiens
catcacccagtcctgg

SEQ ID NO: 2084582 - DNA, 17 bp, Homo sapiens
catcacccagtcctggc

SEQ ID NO: 2084583 - DNA, 19 bp, Homo sapiens
catcacccagtcctggcca

SEQ ID NO: 2084584 - DNA, 20 bp, Homo sapiens
catcaccccctaccccagaa

SEQ ID NO: 2084585 - DNA, 15 bp, Homo sapiens
catcaccctctgggc

SEQ ID NO: 2084586 - DNA, 20 bp, Homo sapiens
catcaccctctgggcagctg

SEQ ID NO: 2084587 - DNA, 19 bp, Homo sapiens
catcaccgacgcgtctcct

SEQ ID NO: 2084588 - DNA, 14 bp, Homo sapiens
catcactccctgga

SEQ ID NO: 2084589 - DNA, 14 bp, Homo sapiens
catcacttgtacaa

SEQ ID NO: 2084590 - DNA, 18 bp, Homo sapiens
catcagaaagggagggct

SEQ ID NO: 2084591 - DNA, 24 bp, Homo sapiens
catcagaaagggagggctctgagg

SEQ ID NO: 2084592 - DNA, 14 bp, Homo sapiens
catcagaaggagaa

SEQ ID NO: 2084593 - DNA, 22 bp, Homo sapiens
catcagcagcccatggcctctg

SEQ ID NO: 2084594 - DNA, 17 bp, Homo sapiens
catcagcatacctttat

SEQ ID NO: 2084595 - DNA, 18 bp, Homo sapiens
catcagcatacctttatt

SEQ ID NO: 2084596 - DNA, 11 bp, Homo sapiens
catcagctccc

SEQ ID NO: 2084597 - DNA, 12 bp, Homo sapiens
catcagctccct

SEQ ID NO: 2084598 - DNA, 15 bp, Homo sapiens
catcaggacttggga

SEQ ID NO: 2084599 - DNA, 13 bp, Homo sapiens
catcaggcactgg

SEQ ID NO: 2084600 - DNA, 16 bp, Homo sapiens
catcaggcactggtgg

SEQ ID NO: 2084601 - DNA, 17 bp, Homo sapiens
catcaggcactggtggc

SEQ ID NO: 2084602 - DNA, 14 bp, Homo sapiens
catcagggcttgat

SEQ ID NO: 2084603 - DNA, 12 bp, Homo sapiens
catcagggtggg

SEQ ID NO: 2084604 - DNA, 13 bp, Homo sapiens
catcagggtgggc

SEQ ID NO: 2084605 - DNA, 22 bp, Homo sapiens
catcagggtgggccactctccc

SEQ ID NO: 2084606 - DNA, 17 bp, Homo sapiens
catcaggttccatcccg

SEQ ID NO: 2084607 - DNA, 20 bp, Homo sapiens
catcagtattaatactaaaa

SEQ ID NO: 2084608 - DNA, 13 bp, Homo sapiens
catcagttactgg

SEQ ID NO: 2084609 - DNA, 23 bp, Homo sapiens
catcagttactggtttcagttga

SEQ ID NO: 2084610 - DNA, 14 bp, Homo sapiens
catcataaaataaa

SEQ ID NO: 2084611 - DNA, 22 bp, Homo sapiens
catcataaaataaagtatatat

SEQ ID NO: 2084612 - DNA, 19 bp, Homo sapiens
catcataaggaagttatta

SEQ ID NO: 2084613 - DNA, 20 bp, Homo sapiens
catcatatgacatgccaccc

SEQ ID NO: 2084614 - DNA, 21 bp, Homo sapiens
catcatatgacatgccaccct

SEQ ID NO: 2084615 - DNA, 22 bp, Homo sapiens
catcatatgacatgccaccctc

SEQ ID NO: 2084616 - DNA, 15 bp, Homo sapiens
catcatcccagctgc

SEQ ID NO: 2084617 - DNA, 13 bp, Homo sapiens
catcatcctcctt

SEQ ID NO: 2084618 - DNA, 14 bp, Homo sapiens
catcatgcctctga

SEQ ID NO: 2084619 - DNA, 21 bp, Homo sapiens
catcatgcttacaaaaaagaa

SEQ ID NO: 2084620 - DNA, 13 bp, Homo sapiens
catcatgtctggc

SEQ ID NO: 2084621 - DNA, 13 bp, Homo sapiens
catcattgtatat

SEQ ID NO: 2084622 - DNA, 22 bp, Homo sapiens
catccaaggaacctaattgaaa

SEQ ID NO: 2084623 - DNA, 17 bp, Homo sapiens
catccacccagtgctgc

SEQ ID NO: 2084624 - DNA, 18 bp, Homo sapiens
catccacccagtgctgcc

SEQ ID NO: 2084625 - DNA, 17 bp, Homo sapiens
catccacgcacacatgg

SEQ ID NO: 2084626 - DNA, 22 bp, Homo sapiens
catccacgcacacatggacaca

SEQ ID NO: 2084627 - DNA, 21 bp, Homo sapiens
catccagtttgttctccgggt

SEQ ID NO: 2084628 - DNA, 15 bp, Homo sapiens
catccatagtgcact

SEQ ID NO: 2084629 - DNA, 16 bp, Homo sapiens
caggccccatgacctc

SEQ ID NO: 2084630 - DNA, 18 bp, Homo sapiens
caggccccatgacctcca

SEQ ID NO: 2084631 - DNA, 15 bp, Homo sapiens
caggcccccaccact

SEQ ID NO: 2084632 - DNA, 17 bp, Homo sapiens
caggcccccacctggct

SEQ ID NO: 2084633 - DNA, 19 bp, Homo sapiens
caggcccccacctggctca

SEQ ID NO: 2084634 - DNA, 20 bp, Homo sapiens
caggcccccaggtgccagtt

SEQ ID NO: 2084635 - DNA, 22 bp, Homo sapiens
caggccccccgcagcaccctgc

SEQ ID NO: 2084636 - DNA, 22 bp, Homo sapiens
caggccccgcttgtccagcgcc

SEQ ID NO: 2084637 - DNA, 16 bp, Homo sapiens
caggcccctgaggact

SEQ ID NO: 2084638 - DNA, 20 bp, Homo sapiens
caggcccctgccaccctggg

SEQ ID NO: 2084639 - DNA, 21 bp, Homo sapiens
caggcccggcccagcctaggc

SEQ ID NO: 2084640 - DNA, 19 bp, Homo sapiens
caggcccggctccaggctc

SEQ ID NO: 2084641 - DNA, 21 bp, Homo sapiens
caggcccggctccaggctcct

SEQ ID NO: 2084642 - DNA, 14 bp, Homo sapiens
caggcccggggctg

SEQ ID NO: 2084643 - DNA, 23 bp, Homo sapiens
caggcccggggggaccaggatga

SEQ ID NO: 2084644 - DNA, 14 bp, Homo sapiens
caggccctccatgg

SEQ ID NO: 2084645 - DNA, 16 bp, Homo sapiens
caggccctccatgggc

SEQ ID NO: 2084646 - DNA, 21 bp, Homo sapiens
caggcccttattttcaagaaa

SEQ ID NO: 2084647 - DNA, 15 bp, Homo sapiens
caggcccttcctctc

SEQ ID NO: 2084648 - DNA, 19 bp, Homo sapiens
caggcccttcctctccact

SEQ ID NO: 2084649 - DNA, 23 bp, Homo sapiens
caggcccttcctctccactgcct

SEQ ID NO: 2084650 - DNA, 21 bp, Homo sapiens
caggcccttggggttccccca

SEQ ID NO: 2084651 - DNA, 14 bp, Homo sapiens
caggccgaggcagg

SEQ ID NO: 2084652 - DNA, 16 bp, Homo sapiens
caggccgaggcaggtg

SEQ ID NO: 2084653 - DNA, 21 bp, Homo sapiens
caggccgggcttgggccctgc

SEQ ID NO: 2084654 - DNA, 22 bp, Homo sapiens
caggccggtgtgggctgtgtcg

SEQ ID NO: 2084655 - DNA, 19 bp, Homo sapiens
caggcctaatctcatacct

SEQ ID NO: 2084656 - DNA, 13 bp, Homo sapiens
caggcctaggacc

SEQ ID NO: 2084657 - DNA, 19 bp, Homo sapiens
caggcctaggacctcaggc

SEQ ID NO: 2084658 - DNA, 13 bp, Homo sapiens
caggcctccagcc

SEQ ID NO: 2084659 - DNA, 18 bp, Homo sapiens
caggcctccagcctctcc

SEQ ID NO: 2084660 - DNA, 12 bp, Homo sapiens
caggcctctgtg

SEQ ID NO: 2084661 - DNA, 13 bp, Homo sapiens
caggcctctgtgt

SEQ ID NO: 2084662 - DNA, 22 bp, Homo sapiens
caggcctctgtgtccttccctg

SEQ ID NO: 2084663 - DNA, 20 bp, Homo sapiens
caggcctgcctgttcccatt

SEQ ID NO: 2084664 - DNA, 14 bp, Homo sapiens
catgtgttgaaaaa

SEQ ID NO: 2084665 - DNA, 18 bp, Homo sapiens
catgtgtttactttatgt

SEQ ID NO: 2084666 - DNA, 14 bp, Homo sapiens
catgttatatattt

SEQ ID NO: 2084667 - DNA, 17 bp, Homo sapiens
catgttccctttaaaat

SEQ ID NO: 2084668 - DNA, 19 bp, Homo sapiens
catgttgaagccactgcct

SEQ ID NO: 2084669 - DNA, 18 bp, Homo sapiens
catgttgccatgaggcct

SEQ ID NO: 2084670 - DNA, 19 bp, Homo sapiens
catgttggccaggctggtc

SEQ ID NO: 2084671 - DNA, 19 bp, Homo sapiens
catgtttaaattgtaaatt

SEQ ID NO: 2084672 - DNA, 9 bp, Homo sapiens
catgtttac

SEQ ID NO: 2084673 - DNA, 16 bp, Homo sapiens
catgtttcatgttttg

SEQ ID NO: 2084674 - DNA, 16 bp, Homo sapiens
catgtttgagctcaga

SEQ ID NO: 2084675 - DNA, 13 bp, Homo sapiens
catgtttgtaaaa

SEQ ID NO: 2084676 - DNA, 23 bp, Homo sapiens
catgttttgtgactatatagaga

SEQ ID NO: 2084677 - DNA, 15 bp, Homo sapiens
cattaactcattaga

SEQ ID NO: 2084678 - DNA, 17 bp, Homo sapiens
cattaacttagcatgtg

SEQ ID NO: 2084679 - DNA, 18 bp, Homo sapiens
cattaagacacacctctg

SEQ ID NO: 2084680 - DNA, 16 bp, Homo sapiens
cattaatatttgctga

SEQ ID NO: 2084681 - DNA, 18 bp, Homo sapiens
cattaatcaatcatctgt

SEQ ID NO: 2084682 - DNA, 17 bp, Homo sapiens
cattaatcaccaaagta

SEQ ID NO: 2084683 - DNA, 14 bp, Homo sapiens
cattaatgtgttgg

SEQ ID NO: 2084684 - DNA, 21 bp, Homo sapiens
cattaatgttaattcagcact

SEQ ID NO: 2084685 - DNA, 23 bp, Homo sapiens
cattaatgttaattcagcactga

SEQ ID NO: 2084686 - DNA, 19 bp, Homo sapiens
cattaattattattgctgt

SEQ ID NO: 2084687 - DNA, 21 bp, Homo sapiens
cattaattattattgctgttg

SEQ ID NO: 2084688 - DNA, 13 bp, Homo sapiens
cattacaatggaa

SEQ ID NO: 2084689 - DNA, 21 bp, Homo sapiens
cattacagtgggtgcccccct

SEQ ID NO: 2084690 - DNA, 17 bp, Homo sapiens
cattacatggctgtggt

SEQ ID NO: 2084691 - DNA, 15 bp, Homo sapiens
cattacatgtttaaa

SEQ ID NO: 2084692 - DNA, 19 bp, Homo sapiens
cattacatgtttaaattgt

SEQ ID NO: 2084693 - DNA, 21 bp, Homo sapiens
cattactgcctttggaagaaa

SEQ ID NO: 2084694 - DNA, 20 bp, Homo sapiens
cattagactggaacttgaac

SEQ ID NO: 2084695 - DNA, 21 bp, Homo sapiens
cattagtacacagcaccagaa

SEQ ID NO: 2084696 - DNA, 11 bp, Homo sapiens
cattagtatcc

SEQ ID NO: 2084697 - DNA, 19 bp, Homo sapiens
cattatagattttcatgtt

SEQ ID NO: 2084698 - DNA, 16 bp, Homo sapiens
cattatcgggagcagt

SEQ ID NO: 2084699 - DNA, 20 bp, Homo sapiens
cattatcgggagcagtgtct

SEQ ID NO: 2084700 - DNA, 21 bp, Homo sapiens
cattatcgggagcagtgtctt

SEQ ID NO: 2084701 - DNA, 12 bp, Homo sapiens
cattatctcaaa

SEQ ID NO: 2084702 - DNA, 13 bp, Homo sapiens
cattatctcaaaa

SEQ ID NO: 2084703 - DNA, 14 bp, Homo sapiens
cattatgcagctga

SEQ ID NO: 2084704 - DNA, 11 bp, Homo sapiens
cattatgtgtg

SEQ ID NO: 2084705 - DNA, 12 bp, Homo sapiens
cattatgtgtgc

SEQ ID NO: 2084706 - DNA, 20 bp, Homo sapiens
cattatgtgtgcatgtgtgt

SEQ ID NO: 2084707 - DNA, 22 bp, Homo sapiens
cattatgtgtgcatgtgtgtat

SEQ ID NO: 2084708 - DNA, 16 bp, Homo sapiens
cattatgttagagagg

SEQ ID NO: 2084709 - DNA, 22 bp, Homo sapiens
cattatttattcagcttcattt

SEQ ID NO: 2084710 - DNA, 23 bp, Homo sapiens
cattcaaatgggtgatatcctga

SEQ ID NO: 2084711 - DNA, 15 bp, Homo sapiens
cattcaagcctgtga

SEQ ID NO: 2084712 - DNA, 17 bp, Homo sapiens
cattcaagcctgtgaat

SEQ ID NO: 2084713 - DNA, 17 bp, Homo sapiens
cattcacacagggctct

SEQ ID NO: 2084714 - DNA, 20 bp, Homo sapiens
cattcacatttgatgtacat

SEQ ID NO: 2084715 - DNA, 22 bp, Homo sapiens
cattcaccaaatgatgccactt

SEQ ID NO: 2084716 - DNA, 17 bp, Homo sapiens
cattcagaagaaaaaga

SEQ ID NO: 2084717 - DNA, 20 bp, Homo sapiens
cattcagcacaccccaaggg

SEQ ID NO: 2084718 - DNA, 20 bp, Homo sapiens
cattcaggaaaactgacaga

SEQ ID NO: 2084719 - DNA, 20 bp, Homo sapiens
cattcagtgagacacagagt

SEQ ID NO: 2084720 - DNA, 20 bp, Homo sapiens
cattcatccagttgcaataa

SEQ ID NO: 2084721 - DNA, 22 bp, Homo sapiens
cattcatccagttgcaataaaa

SEQ ID NO: 2084722 - DNA, 23 bp, Homo sapiens
cattcatccagttgcaataaaat

SEQ ID NO: 2084723 - DNA, 13 bp, Homo sapiens
cattcatctcatt

SEQ ID NO: 2084724 - DNA, 21 bp, Homo sapiens
cattcatgccaaagcaaaaga

SEQ ID NO: 2084725 - DNA, 17 bp, Homo sapiens
cattcatttttgttgtt

SEQ ID NO: 2084726 - DNA, 23 bp, Homo sapiens
cattccaacagctcaagtcttcc

SEQ ID NO: 2084727 - DNA, 16 bp, Homo sapiens
cattccaacagtgagt

SEQ ID NO: 2084728 - DNA, 16 bp, Homo sapiens
cattccatgattttac

SEQ ID NO: 2084729 - DNA, 19 bp, Homo sapiens
cattccatgattttacaga

SEQ ID NO: 2084730 - DNA, 12 bp, Homo sapiens
cattcccagcgt

SEQ ID NO: 2084731 - DNA, 23 bp, Homo sapiens
cattccccaggtggctgacccag

SEQ ID NO: 2084732 - DNA, 20 bp, Homo sapiens
cattcccccatgtggctgaa

SEQ ID NO: 2084733 - DNA, 21 bp, Homo sapiens
cattcccccatgtggctgaag

SEQ ID NO: 2084734 - DNA, 17 bp, Homo sapiens
cattccccgctgcccaa

SEQ ID NO: 2084735 - DNA, 16 bp, Homo sapiens
cattccctatcaaaac

SEQ ID NO: 2084736 - DNA, 24 bp, Homo sapiens
cattccctatcaaaacatatcaat

SEQ ID NO: 2084737 - DNA, 14 bp, Homo sapiens
cattccctggcctg

SEQ ID NO: 2084738 - DNA, 17 bp, Homo sapiens
cattcctagagagcaga

SEQ ID NO: 2084739 - DNA, 22 bp, Homo sapiens
cattcctagagagcagaaataa

SEQ ID NO: 2084740 - DNA, 23 bp, Homo sapiens
cattcctagagagcagaaataaa

SEQ ID NO: 2084741 - DNA, 12 bp, Homo sapiens
cattcctcagct

SEQ ID NO: 2084742 - DNA, 16 bp, Homo sapiens
cattcctcagggacag

SEQ ID NO: 2084743 - DNA, 17 bp, Homo sapiens
cattccttgtcaccagc

SEQ ID NO: 2084744 - DNA, 19 bp, Homo sapiens
cattcgcctgtgggaagag

SEQ ID NO: 2084745 - DNA, 14 bp, Homo sapiens
cattcggaccctgc

SEQ ID NO: 2084746 - DNA, 23 bp, Homo sapiens
cattcggtacttacccggagaag

SEQ ID NO: 2084747 - DNA, 16 bp, Homo sapiens
cattcgtctgtcccag

SEQ ID NO: 2084748 - DNA, 16 bp, Homo sapiens
cattctcacaattgta

SEQ ID NO: 2084749 - DNA, 14 bp, Homo sapiens
cattctcactccta

SEQ ID NO: 2084750 - DNA, 15 bp, Homo sapiens
cattctcctgtgccc

SEQ ID NO: 2084751 - DNA, 12 bp, Homo sapiens
cattctgcctgc

SEQ ID NO: 2084752 - DNA, 17 bp, Homo sapiens
cattctgcctgcccagg

SEQ ID NO: 2084753 - DNA, 15 bp, Homo sapiens
cattctgtcttgaag

SEQ ID NO: 2084754 - DNA, 16 bp, Homo sapiens
cattctgttgcccagg

SEQ ID NO: 2084755 - DNA, 18 bp, Homo sapiens
cattcttcagtgcctagc

SEQ ID NO: 2084756 - DNA, 20 bp, Homo sapiens
cattctttcccctcagagct

SEQ ID NO: 2084757 - DNA, 22 bp, Homo sapiens
cattctttcccctcagagctct

SEQ ID NO: 2084758 - DNA, 16 bp, Homo sapiens
cattgaaagagaacca

SEQ ID NO: 2084759 - DNA, 15 bp, Homo sapiens
cattgaacagcaaag

SEQ ID NO: 2084760 - DNA, 15 bp, Homo sapiens
cattgactgaactgc

SEQ ID NO: 2084761 - DNA, 14 bp, Homo sapiens
cattgagatctcca

SEQ ID NO: 2084762 - DNA, 23 bp, Homo sapiens
cattgagtttaagtctctgactc

SEQ ID NO: 2084763 - DNA, 17 bp, Homo sapiens
cattgatatgaaaaata

SEQ ID NO: 2084764 - DNA, 17 bp, Homo sapiens
cattgcaaagtgcgctc

SEQ ID NO: 2084765 - DNA, 22 bp, Homo sapiens
cattgcatcacctctgtaattt

SEQ ID NO: 2084766 - DNA, 17 bp, Homo sapiens
cattgcatgtattgtaa

SEQ ID NO: 2084767 - DNA, 12 bp, Homo sapiens
cattgccctggt

SEQ ID NO: 2084768 - DNA, 14 bp, Homo sapiens
cattgcctccacct

SEQ ID NO: 2084769 - DNA, 17 bp, Homo sapiens
ccatggcctctggccag

SEQ ID NO: 2084770 - DNA, 15 bp, Homo sapiens
ccatggccttccctc

SEQ ID NO: 2084771 - DNA, 17 bp, Homo sapiens
ccatggctcaggcaagc

SEQ ID NO: 2084772 - DNA, 15 bp, Homo sapiens
ccatgggatgttaag

SEQ ID NO: 2084773 - DNA, 12 bp, Homo sapiens
ccatgggcctgc

SEQ ID NO: 2084774 - DNA, 13 bp, Homo sapiens
ccatgggcctgct

SEQ ID NO: 2084775 - DNA, 14 bp, Homo sapiens
ccatgggcctgggc

SEQ ID NO: 2084776 - DNA, 15 bp, Homo sapiens
ccatgggcctgggcc

SEQ ID NO: 2084777 - DNA, 18 bp, Homo sapiens
ccatgggcctgggcctgc

SEQ ID NO: 2084778 - DNA, 20 bp, Homo sapiens
ccatgggctagtgtgagtgg

SEQ ID NO: 2084779 - DNA, 11 bp, Homo sapiens
ccatgggcttg

SEQ ID NO: 2084780 - DNA, 13 bp, Homo sapiens
ccatggggctgcg

SEQ ID NO: 2084781 - DNA, 22 bp, Homo sapiens
ccatggtctctcgggcccccca

SEQ ID NO: 2084782 - DNA, 14 bp, Homo sapiens
ccatggtggaaggg

SEQ ID NO: 2084783 - DNA, 20 bp, Homo sapiens
ccatgtagaataaatgaaga

SEQ ID NO: 2084784 - DNA, 18 bp, Homo sapiens
ccatgtattcacacaccc

SEQ ID NO: 2084785 - DNA, 19 bp, Homo sapiens
ccatgtattcacacacccc

SEQ ID NO: 2084786 - DNA, 22 bp, Homo sapiens
ccatgtcctaggggccgaggga

SEQ ID NO: 2084787 - DNA, 19 bp, Homo sapiens
ccatgtcgcctctgcattc

SEQ ID NO: 2084788 - DNA, 17 bp, Homo sapiens
ccatgtcgcctgccccc

SEQ ID NO: 2084789 - DNA, 16 bp, Homo sapiens
ccatgtctctcagaat

SEQ ID NO: 2084790 - DNA, 15 bp, Homo sapiens
ccatgtctttctcca

SEQ ID NO: 2084791 - DNA, 22 bp, Homo sapiens
ccatgtgcatggaaatgtcctc

SEQ ID NO: 2084792 - DNA, 15 bp, Homo sapiens
ccatgtggagtggac

SEQ ID NO: 2084793 - DNA, 16 bp, Homo sapiens
ccatgtgtagattgcg

SEQ ID NO: 2084794 - DNA, 12 bp, Homo sapiens
ccatgtgtcccc

SEQ ID NO: 2084795 - DNA, 15 bp, Homo sapiens
ccatgtgtcccctca

SEQ ID NO: 2084796 - DNA, 13 bp, Homo sapiens
ccatgtgtgctgt

SEQ ID NO: 2084797 - DNA, 17 bp, Homo sapiens
ccatgttaattaaactg

SEQ ID NO: 2084798 - DNA, 15 bp, Homo sapiens
ccatgttgcatgcct

SEQ ID NO: 2084799 - DNA, 16 bp, Homo sapiens
ccatgttggccaggct

SEQ ID NO: 2084800 - DNA, 17 bp, Homo sapiens
ccatgttggccaggctg

SEQ ID NO: 2084801 - DNA, 18 bp, Homo sapiens
ccatgtttagattccagg

SEQ ID NO: 2084802 - DNA, 22 bp, Homo sapiens
ccatgtttggttgtaaatgctc

SEQ ID NO: 2084803 - DNA, 14 bp, Homo sapiens
ccatgtttgtaaaa

SEQ ID NO: 2084804 - DNA, 12 bp, Homo sapiens
ccattacatgtt

SEQ ID NO: 2084805 - DNA, 14 bp, Homo sapiens
ccattaccatggag

SEQ ID NO: 2084806 - DNA, 23 bp, Homo sapiens
ccattactctgcggtggtgccag

SEQ ID NO: 2084807 - DNA, 18 bp, Homo sapiens
ccattacttgtataaata

SEQ ID NO: 2084808 - DNA, 19 bp, Homo sapiens
ccattacttgtataaatac

SEQ ID NO: 2084809 - DNA, 17 bp, Homo sapiens
ccattatgaagaagaga

SEQ ID NO: 2084810 - DNA, 16 bp, Homo sapiens
ccattcacagagcctt

SEQ ID NO: 2084811 - DNA, 14 bp, Homo sapiens
ccattcacttcccc

SEQ ID NO: 2084812 - DNA, 21 bp, Homo sapiens
ccattcccaagaaatgctttg

SEQ ID NO: 2084813 - DNA, 17 bp, Homo sapiens
ccattcccccatgtggc

SEQ ID NO: 2084814 - DNA, 13 bp, Homo sapiens
ccattcctcaggg

SEQ ID NO: 2084815 - DNA, 16 bp, Homo sapiens
ccattctgaccatttc

SEQ ID NO: 2084816 - DNA, 18 bp, Homo sapiens
ccattctgcctgcccagg

SEQ ID NO: 2084817 - DNA, 19 bp, Homo sapiens
ccattctgcctgcccaggc

SEQ ID NO: 2084818 - DNA, 15 bp, Homo sapiens
ccattcttgtcctgg

SEQ ID NO: 2084819 - DNA, 16 bp, Homo sapiens
ccattgacctcagctg

SEQ ID NO: 2084820 - DNA, 21 bp, Homo sapiens
ccattgacctcagctgcacat

SEQ ID NO: 2084821 - DNA, 14 bp, Homo sapiens
ccattggttctcct

SEQ ID NO: 2084822 - DNA, 14 bp, Homo sapiens
cccaggccctccct

SEQ ID NO: 2084823 - DNA, 13 bp, Homo sapiens
cccaggccgcctg

SEQ ID NO: 2084824 - DNA, 13 bp, Homo sapiens
cccaggccgttcc

SEQ ID NO: 2084825 - DNA, 21 bp, Homo sapiens
cccaggccgttccccttggct

SEQ ID NO: 2084826 - DNA, 14 bp, Homo sapiens
cccaggcctccagc

SEQ ID NO: 2084827 - DNA, 13 bp, Homo sapiens
cccaggcctctgt

SEQ ID NO: 2084828 - DNA, 16 bp, Homo sapiens
cccaggcctgcctgtt

SEQ ID NO: 2084829 - DNA, 14 bp, Homo sapiens
cccaggctccatgg

SEQ ID NO: 2084830 - DNA, 16 bp, Homo sapiens
cccaggctccatgggg

SEQ ID NO: 2084831 - DNA, 14 bp, Homo sapiens
cccaggctctggga

SEQ ID NO: 2084832 - DNA, 20 bp, Homo sapiens
cccaggctctgggaaggggt

SEQ ID NO: 2084833 - DNA, 19 bp, Homo sapiens
cccaggctgcactgcagtg

SEQ ID NO: 2084834 - DNA, 19 bp, Homo sapiens
cccaggctggagtgcagtg

SEQ ID NO: 2084835 - DNA, 17 bp, Homo sapiens
cccaggctggcgtgcag

SEQ ID NO: 2084836 - DNA, 20 bp, Homo sapiens
cccaggctggcgtgcagtgg

SEQ ID NO: 2084837 - DNA, 19 bp, Homo sapiens
cccaggcttgtcactagca

SEQ ID NO: 2084838 - DNA, 21 bp, Homo sapiens
cccagggaagtttctgggtgc

SEQ ID NO: 2084839 - DNA, 15 bp, Homo sapiens
cccagggaagttttg

SEQ ID NO: 2084840 - DNA, 19 bp, Homo sapiens
cccagggagcaatgggagg

SEQ ID NO: 2084841 - DNA, 11 bp, Homo sapiens
cccagggcaca

SEQ ID NO: 2084842 - DNA, 22 bp, Homo sapiens
cccagggcacaggagctacctg

SEQ ID NO: 2084843 - DNA, 17 bp, Homo sapiens
cccagggccagggccct

SEQ ID NO: 2084844 - DNA, 22 bp, Homo sapiens
cccagggcccctccctctgccc

SEQ ID NO: 2084845 - DNA, 12 bp, Homo sapiens
cccagggcccta

SEQ ID NO: 2084846 - DNA, 14 bp, Homo sapiens
cccagggcctgggg

SEQ ID NO: 2084847 - DNA, 15 bp, Homo sapiens
cccagggctaccctc

SEQ ID NO: 2084848 - DNA, 21 bp, Homo sapiens
cccagggctaccctcccccag

SEQ ID NO: 2084849 - DNA, 15 bp, Homo sapiens
cccagggctcagcct

SEQ ID NO: 2084850 - DNA, 17 bp, Homo sapiens
cccagggctcagcctgg

SEQ ID NO: 2084851 - DNA, 15 bp, Homo sapiens
cccaggggagagggt

SEQ ID NO: 2084852 - DNA, 15 bp, Homo sapiens
cccaggtctctccac

SEQ ID NO: 2084853 - DNA, 19 bp, Homo sapiens
cccaggtctctccactgct

SEQ ID NO: 2084854 - DNA, 19 bp, Homo sapiens
cccaggtgagctgaagaca

SEQ ID NO: 2084855 - DNA, 17 bp, Homo sapiens
cccaggtgccaccaata

SEQ ID NO: 2084856 - DNA, 20 bp, Homo sapiens
cccaggtgccaccaataaaa

SEQ ID NO: 2084857 - DNA, 21 bp, Homo sapiens
cccaggtggattttgtggagg

SEQ ID NO: 2084858 - DNA, 17 bp, Homo sapiens
cccaggttggcctggtg

SEQ ID NO: 2084859 - DNA, 17 bp, Homo sapiens
cccagtcattctgggaa

SEQ ID NO: 2084860 - DNA, 14 bp, Homo sapiens
cccagtcctggcca

SEQ ID NO: 2084861 - DNA, 15 bp, Homo sapiens
cccagtcctggccat

SEQ ID NO: 2084862 - DNA, 16 bp, Homo sapiens
cccagtcgagccctgc

SEQ ID NO: 2084863 - DNA, 10 bp, Homo sapiens
cccagtctgg

SEQ ID NO: 2084864 - DNA, 15 bp, Homo sapiens
cccagtgcccacagg

SEQ ID NO: 2084865 - DNA, 21 bp, Homo sapiens
cccagtgcccacaggatcagt

SEQ ID NO: 2084866 - DNA, 13 bp, Homo sapiens
cccagtgctgcca

SEQ ID NO: 2084867 - DNA, 18 bp, Homo sapiens
cccagtgctgccatgcca

SEQ ID NO: 2084868 - DNA, 22 bp, Homo sapiens
cccagtgctgccatgccactgc

SEQ ID NO: 2084869 - DNA, 22 bp, Homo sapiens
cccagtgcttctccaacactga

SEQ ID NO: 2084870 - DNA, 16 bp, Homo sapiens
cccagtgggacagagg

SEQ ID NO: 2084871 - DNA, 19 bp, Homo sapiens
cccagtgtaaagaataaat

SEQ ID NO: 2084872 - DNA, 15 bp, Homo sapiens
cccagttctgctcct

SEQ ID NO: 2084873 - DNA, 16 bp, Homo sapiens
cccagttctgctcctc

SEQ ID NO: 2084874 - DNA, 21 bp, Homo sapiens
cccagttctgctcctctccag

SEQ ID NO: 2084875 - DNA, 15 bp, Homo sapiens
cccagtttgcagaaa

SEQ ID NO: 2084876 - DNA, 21 bp, Homo sapiens
cccataatagttagccctcag

SEQ ID NO: 2084877 - DNA, 22 bp, Homo sapiens
cccataattttttttttccttt

SEQ ID NO: 2084878 - DNA, 23 bp, Homo sapiens
cccataattttttttttcctttt

SEQ ID NO: 2084879 - DNA, 15 bp, Homo sapiens
cccataccatcactg

SEQ ID NO: 2084880 - DNA, 17 bp, Homo sapiens
cccatacccctgcctgg

SEQ ID NO: 2084881 - DNA, 21 bp, Homo sapiens
cccatacccctgcctgggttt

SEQ ID NO: 2084882 - DNA, 17 bp, Homo sapiens
cccatagaaacatgaca

SEQ ID NO: 2084883 - DNA, 19 bp, Homo sapiens
cccatagaaacatgacact

SEQ ID NO: 2084884 - DNA, 21 bp, Homo sapiens
cccatagaaacatgacactga

SEQ ID NO: 2084885 - DNA, 16 bp, Homo sapiens
cccatagatcttctga

SEQ ID NO: 2084886 - DNA, 17 bp, Homo sapiens
cccatagatcttctgaa

SEQ ID NO: 2084887 - DNA, 13 bp, Homo sapiens
cccatagcgctgg

SEQ ID NO: 2084888 - DNA, 21 bp, Homo sapiens
cccatagcgctggctcaggaa

SEQ ID NO: 2084889 - DNA, 13 bp, Homo sapiens
cccatagcttcca

SEQ ID NO: 2084890 - DNA, 11 bp, Homo sapiens
cccaataaagc

SEQ ID NO: 2084891 - DNA, 15 bp, Homo sapiens
cccaatattataatt

SEQ ID NO: 2084892 - DNA, 17 bp, Homo sapiens
cccaatattataatttt

SEQ ID NO: 2084893 - DNA, 15 bp, Homo sapiens
cccaatcagcactga

SEQ ID NO: 2084894 - DNA, 17 bp, Homo sapiens
cccaatcagcactgaaa

SEQ ID NO: 2084895 - DNA, 13 bp, Homo sapiens
cccaatcatttgc

SEQ ID NO: 2084896 - DNA, 17 bp, Homo sapiens
cccaatcttgacacggt

SEQ ID NO: 2084897 - DNA, 16 bp, Homo sapiens
cccaatgcctataaaa

SEQ ID NO: 2084898 - DNA, 14 bp, Homo sapiens
cccaatgctcctgg

SEQ ID NO: 2084899 - DNA, 13 bp, Homo sapiens
cccaattcatttc

SEQ ID NO: 2084900 - DNA, 18 bp, Homo sapiens
cccaattttgcagggagc

SEQ ID NO: 2084901 - DNA, 20 bp, Homo sapiens
cccacaaaggggagaagggc

SEQ ID NO: 2084902 - DNA, 20 bp, Homo sapiens
cccacaaataatgaacagca

SEQ ID NO: 2084903 - DNA, 20 bp, Homo sapiens
cccacaagccttactcacct

SEQ ID NO: 2084904 - DNA, 11 bp, Homo sapiens
cccacacatgt

SEQ ID NO: 2084905 - DNA, 21 bp, Homo sapiens
cccacacatgtttacagaact

SEQ ID NO: 2084906 - DNA, 18 bp, Homo sapiens
cccacacctccctactcc

SEQ ID NO: 2084907 - DNA, 18 bp, Homo sapiens
cccacacgtgctcgcagc

SEQ ID NO: 2084908 - DNA, 20 bp, Homo sapiens
cccacacgtgctcgcagcct

SEQ ID NO: 2084909 - DNA, 22 bp, Homo sapiens
cccacacgtgctcgcagcctgg

SEQ ID NO: 2084910 - DNA, 14 bp, Homo sapiens
cccacagaactgct

SEQ ID NO: 2084911 - DNA, 16 bp, Homo sapiens
cccacagagcctgaat

SEQ ID NO: 2084912 - DNA, 19 bp, Homo sapiens
cccacagcacccaggctcc

SEQ ID NO: 2084913 - DNA, 17 bp, Homo sapiens
cccacagcctctgcctg

SEQ ID NO: 2084914 - DNA, 14 bp, Homo sapiens
cccacagcctctgg

SEQ ID NO: 2084915 - DNA, 12 bp, Homo sapiens
cccacagctccc

SEQ ID NO: 2084916 - DNA, 14 bp, Homo sapiens
cccacagctcccac

SEQ ID NO: 2084917 - DNA, 20 bp, Homo sapiens
cccacagctcccaccccacc

SEQ ID NO: 2084918 - DNA, 13 bp, Homo sapiens
cccacaggatcag

SEQ ID NO: 2084919 - DNA, 15 bp, Homo sapiens
cccacatccctgggc

SEQ ID NO: 2084920 - DNA, 16 bp, Homo sapiens
cccacatccctgggcc

SEQ ID NO: 2084921 - DNA, 18 bp, Homo sapiens
cccacatccctgggcctg

SEQ ID NO: 2084922 - DNA, 18 bp, Homo sapiens
cccacatgaggacatgat

SEQ ID NO: 2084923 - DNA, 16 bp, Homo sapiens
cccacatgtgacacat

SEQ ID NO: 2084924 - DNA, 18 bp, Homo sapiens
cccacattcggaccctgc

SEQ ID NO: 2084925 - DNA, 19 bp, Homo sapiens
cccacattcggaccctgcc

SEQ ID NO: 2084926 - DNA, 21 bp, Homo sapiens
cccacatttacctcgaggctc

SEQ ID NO: 2084927 - DNA, 14 bp, Homo sapiens
cccaccaactctgc

SEQ ID NO: 2084928 - DNA, 13 bp, Homo sapiens
cccaccaccctcc

SEQ ID NO: 2084929 - DNA, 21 bp, Homo sapiens
cccaccacctaggccactcct

SEQ ID NO: 2084930 - DNA, 20 bp, Homo sapiens
cccaccaccttggactcctc

SEQ ID NO: 2084931 - DNA, 22 bp, Homo sapiens
cccaccaccttggactcctccc

SEQ ID NO: 2084932 - DNA, 23 bp, Homo sapiens
cccaccaccttggactcctccca

SEQ ID NO: 2084933 - DNA, 20 bp, Homo sapiens
cccaccacgatgtggccctg

SEQ ID NO: 2084934 - DNA, 17 bp, Homo sapiens
cccaccagcatgtcact

SEQ ID NO: 2084935 - DNA, 12 bp, Homo sapiens
cccaccagccac

SEQ ID NO: 2084936 - DNA, 11 bp, Homo sapiens
cccaccagcct

SEQ ID NO: 2084937 - DNA, 13 bp, Homo sapiens
cccacccatcttc

SEQ ID NO: 2084938 - DNA, 20 bp, Homo sapiens
cccaccccactccagccctg

SEQ ID NO: 2084939 - DNA, 13 bp, Homo sapiens
cccacccccagcc

SEQ ID NO: 2084940 - DNA, 19 bp, Homo sapiens
cccacccccttcagtgccc

SEQ ID NO: 2084941 - DNA, 15 bp, Homo sapiens
cccaccgaagagccc

SEQ ID NO: 2084942 - DNA, 20 bp, Homo sapiens
cccaccgaagagccctgagc

SEQ ID NO: 2084943 - DNA, 21 bp, Homo sapiens
cccaccgaagagccctgagct

SEQ ID NO: 2084944 - DNA, 16 bp, Homo sapiens
cccaccgggagcctcc

SEQ ID NO: 2084945 - DNA, 21 bp, Homo sapiens
cccaccgggagcctccccctc

SEQ ID NO: 2084946 - DNA, 12 bp, Homo sapiens
ccctgcagcctg

SEQ ID NO: 2084947 - DNA, 13 bp, Homo sapiens
ccctgcagcctgg

SEQ ID NO: 2084948 - DNA, 18 bp, Homo sapiens
ccctgccaccctggggag

SEQ ID NO: 2084949 - DNA, 13 bp, Homo sapiens
ccctgccacctgt

SEQ ID NO: 2084950 - DNA, 14 bp, Homo sapiens
ccctgccacctgtc

SEQ ID NO: 2084951 - DNA, 15 bp, Homo sapiens
ccctgccacctgtct

SEQ ID NO: 2084952 - DNA, 13 bp, Homo sapiens
ccctgccagggct

SEQ ID NO: 2084953 - DNA, 16 bp, Homo sapiens
ccctgccagggctcgg

SEQ ID NO: 2084954 - DNA, 21 bp, Homo sapiens
ccctgccagggctcgggcgct

SEQ ID NO: 2084955 - DNA, 15 bp, Homo sapiens
ccctgccagtgcctt

SEQ ID NO: 2084956 - DNA, 20 bp, Homo sapiens
ccctgcccacttcagcccag

SEQ ID NO: 2084957 - DNA, 21 bp, Homo sapiens
ccctgcccacttcagcccagc

SEQ ID NO: 2084958 - DNA, 15 bp, Homo sapiens
ccctgcccatacccc

SEQ ID NO: 2084959 - DNA, 18 bp, Homo sapiens
ccctgccccaacccccac

SEQ ID NO: 2084960 - DNA, 19 bp, Homo sapiens
ccctgccccaacccccacc

SEQ ID NO: 2084961 - DNA, 20 bp, Homo sapiens
ccctgccccatcctgggcct

SEQ ID NO: 2084962 - DNA, 13 bp, Homo sapiens
ccctgcccccatc

SEQ ID NO: 2084963 - DNA, 19 bp, Homo sapiens
ccctgcccccatctcccca

SEQ ID NO: 2084964 - DNA, 22 bp, Homo sapiens
ccctgcccccatctccccaggc

SEQ ID NO: 2084965 - DNA, 19 bp, Homo sapiens
ccctgcccctcccttcaac

SEQ ID NO: 2084966 - DNA, 15 bp, Homo sapiens
ccctgcccctcttcc

SEQ ID NO: 2084967 - DNA, 11 bp, Homo sapiens
ccctgccctct

SEQ ID NO: 2084968 - DNA, 14 bp, Homo sapiens
ccctgccgcctcaa

SEQ ID NO: 2084969 - DNA, 21 bp, Homo sapiens
ccctgcctgagcccaggagct

SEQ ID NO: 2084970 - DNA, 10 bp, Homo sapiens
ccctgcctgg

SEQ ID NO: 2084971 - DNA, 12 bp, Homo sapiens
ccctgcctggag

SEQ ID NO: 2084972 - DNA, 14 bp, Homo sapiens
ccctgcctggagga

SEQ ID NO: 2084973 - DNA, 15 bp, Homo sapiens
ccctgcctggaggac

SEQ ID NO: 2084974 - DNA, 23 bp, Homo sapiens
ccctgcctggaggacctgagcct

SEQ ID NO: 2084975 - DNA, 24 bp, Homo sapiens
ccctgcctggaggacctgagcctg

SEQ ID NO: 2084976 - DNA, 19 bp, Homo sapiens
ccctgcgaaggggccctgg

SEQ ID NO: 2084977 - DNA, 21 bp, Homo sapiens
ccctgcgaaggggccctggtc

SEQ ID NO: 2084978 - DNA, 21 bp, Homo sapiens
ccctgcgaagtggctctcagg

SEQ ID NO: 2084979 - DNA, 12 bp, Homo sapiens
ccctgcggagcc

SEQ ID NO: 2084980 - DNA, 18 bp, Homo sapiens
ccctgcgttggagccact

SEQ ID NO: 2084981 - DNA, 22 bp, Homo sapiens
ccctgcgttggagccactcctg

SEQ ID NO: 2084982 - DNA, 9 bp, Homo sapiens
ccctgctcc

SEQ ID NO: 2084983 - DNA, 14 bp, Homo sapiens
ccctgctcctccca

SEQ ID NO: 2084984 - DNA, 16 bp, Homo sapiens
ccctgctcctcccaac

SEQ ID NO: 2084985 - DNA, 20 bp, Homo sapiens
ccctgctgccgcctcccagc

SEQ ID NO: 2084986 - DNA, 12 bp, Homo sapiens
ccctgctgctca

SEQ ID NO: 2084987 - DNA, 15 bp, Homo sapiens
ccctgctgctcatcc

SEQ ID NO: 2084988 - DNA, 16 bp, Homo sapiens
ccctgcttacctgacg

SEQ ID NO: 2084989 - DNA, 16 bp, Homo sapiens
ccctgcttctcagccc

SEQ ID NO: 2084990 - DNA, 20 bp, Homo sapiens
ccctgctttgggctgccctg

SEQ ID NO: 2084991 - DNA, 19 bp, Homo sapiens
ccctggaaaggggagttga

SEQ ID NO: 2084992 - DNA, 9 bp, Homo sapiens
ccctggaat

SEQ ID NO: 2084993 - DNA, 18 bp, Homo sapiens
ccctggaattcagcaccc

SEQ ID NO: 2084994 - DNA, 22 bp, Homo sapiens
ccctggaattcagcaccctggg

SEQ ID NO: 2084995 - DNA, 23 bp, Homo sapiens
ccctggaattcagcaccctgggt

SEQ ID NO: 2084996 - DNA, 17 bp, Homo sapiens
ccctggacaagcagagg

SEQ ID NO: 2084997 - DNA, 17 bp, Homo sapiens
ccctggaccaccagccc

SEQ ID NO: 2084998 - DNA, 20 bp, Homo sapiens
ccctggaccaccagccccag

SEQ ID NO: 2084999 - DNA, 14 bp, Homo sapiens
ccctggactgggag

SEQ ID NO: 2085000 - DNA, 13 bp, Homo sapiens
ccctggagagaag

SEQ ID NO: 2085001 - DNA, 20 bp, Homo sapiens
ccctggagcggctctcctga

SEQ ID NO: 2085002 - DNA, 19 bp, Homo sapiens
ccctggagtcccctgggcc

SEQ ID NO: 2085003 - DNA, 22 bp, Homo sapiens
ccctggagtcccctgggcctgg

SEQ ID NO: 2085004 - DNA, 13 bp, Homo sapiens
ccctggatgtccc

SEQ ID NO: 2085005 - DNA, 18 bp, Homo sapiens
ccctggatgtcccctgtc

SEQ ID NO: 2085006 - DNA, 22 bp, Homo sapiens
ccctggatgtcccctgtcccac

SEQ ID NO: 2085007 - DNA, 18 bp, Homo sapiens
ccctggatgtgcccacag

SEQ ID NO: 2085008 - DNA, 19 bp, Homo sapiens
ccctggatgtgcccacagg

SEQ ID NO: 2085009 - DNA, 13 bp, Homo sapiens
ccctggatgtgtg

SEQ ID NO: 2085010 - DNA, 21 bp, Homo sapiens
ccctggatgtgtggggcatgg

SEQ ID NO: 2085011 - DNA, 16 bp, Homo sapiens
ccctggcccgcccctc

SEQ ID NO: 2085012 - DNA, 20 bp, Homo sapiens
ccctggcccgcccctcgctg

SEQ ID NO: 2085013 - DNA, 11 bp, Homo sapiens
ccctggcctca

SEQ ID NO: 2085014 - DNA, 22 bp, Homo sapiens
ccctggcctgctgggctctcca

SEQ ID NO: 2085015 - DNA, 22 bp, Homo sapiens
ccctggcctgtggagagaaagc

SEQ ID NO: 2085016 - DNA, 19 bp, Homo sapiens
ccctggctctcagaaggta

SEQ ID NO: 2085017 - DNA, 19 bp, Homo sapiens
ccctggctgaccccaaaga

SEQ ID NO: 2085018 - DNA, 13 bp, Homo sapiens
ccctggcttttca

SEQ ID NO: 2085019 - DNA, 17 bp, Homo sapiens
ccctggcttttcactgc

SEQ ID NO: 2085020 - DNA, 18 bp, Homo sapiens
ccctggcttttcactgct

SEQ ID NO: 2085021 - DNA, 17 bp, Homo sapiens
ccctgggaactcatcct

SEQ ID NO: 2085022 - DNA, 21 bp, Homo sapiens
ccctgggcatcttctggcttg

SEQ ID NO: 2085023 - DNA, 20 bp, Homo sapiens
ccctgggccccaccacctag

SEQ ID NO: 2085024 - DNA, 18 bp, Homo sapiens
ccctgggcccctccacgc

SEQ ID NO: 2085025 - DNA, 19 bp, Homo sapiens
ccctgggcccctccacgcc

SEQ ID NO: 2085026 - DNA, 15 bp, Homo sapiens
ccctgggcctgctgc

SEQ ID NO: 2085027 - DNA, 20 bp, Homo sapiens
ccctgggcctgctgctgaga

SEQ ID NO: 2085028 - DNA, 23 bp, Homo sapiens
ccctgggcctggaccgcttccca

SEQ ID NO: 2085029 - DNA, 24 bp, Homo sapiens
ccctgggcctggaccgcttcccag

SEQ ID NO: 2085030 - DNA, 16 bp, Homo sapiens
ccctgggctctgcccc

SEQ ID NO: 2085031 - DNA, 12 bp, Homo sapiens
ccctggggcctg

SEQ ID NO: 2085032 - DNA, 17 bp, Homo sapiens
ccctggggcctgtactg

SEQ ID NO: 2085033 - DNA, 20 bp, Homo sapiens
ccctggggcctgtactgcct

SEQ ID NO: 2085034 - DNA, 17 bp, Homo sapiens
ccctgggggaagccctg

SEQ ID NO: 2085035 - DNA, 13 bp, Homo sapiens
cctcctgcctcga

SEQ ID NO: 2085036 - DNA, 23 bp, Homo sapiens
cctcctgctgcctaataaagaga

SEQ ID NO: 2085037 - DNA, 21 bp, Homo sapiens
cctcctggccggggcccctca

SEQ ID NO: 2085038 - DNA, 17 bp, Homo sapiens
cctcctgggaccatgga

SEQ ID NO: 2085039 - DNA, 14 bp, Homo sapiens
cctcctgggctaag

SEQ ID NO: 2085040 - DNA, 18 bp, Homo sapiens
cctccttataagcccagc

SEQ ID NO: 2085041 - DNA, 13 bp, Homo sapiens
cctccttcccgcc

SEQ ID NO: 2085042 - DNA, 22 bp, Homo sapiens
cctccttcccttctctccttcc

SEQ ID NO: 2085043 - DNA, 23 bp, Homo sapiens
cctccttctctgcccccagcctc

SEQ ID NO: 2085044 - DNA, 17 bp, Homo sapiens
cctcgaaccaaggcagc

SEQ ID NO: 2085045 - DNA, 12 bp, Homo sapiens
cctcgaggcacc

SEQ ID NO: 2085046 - DNA, 23 bp, Homo sapiens
cctcgaggcaccggcgctgcagg

SEQ ID NO: 2085047 - DNA, 14 bp, Homo sapiens
cctcgcagcaggtg

SEQ ID NO: 2085048 - DNA, 23 bp, Homo sapiens
cctcgcatgccagagcctggggc

SEQ ID NO: 2085049 - DNA, 13 bp, Homo sapiens
cctcgccctgggt

SEQ ID NO: 2085050 - DNA, 16 bp, Homo sapiens
cctcgcctaggcctgt

SEQ ID NO: 2085051 - DNA, 14 bp, Homo sapiens
cctcgcctgggccc

SEQ ID NO: 2085052 - DNA, 21 bp, Homo sapiens
cctcgcctgggcccaggctct

SEQ ID NO: 2085053 - DNA, 23 bp, Homo sapiens
cctcgcctgggcccaggctctgg

SEQ ID NO: 2085054 - DNA, 21 bp, Homo sapiens
cctcgccttttaggctcagga

SEQ ID NO: 2085055 - DNA, 21 bp, Homo sapiens
cctcgctgctgctactacccg

SEQ ID NO: 2085056 - DNA, 14 bp, Homo sapiens
cctcggagaagagc

SEQ ID NO: 2085057 - DNA, 13 bp, Homo sapiens
cctcggagcctca

SEQ ID NO: 2085058 - DNA, 23 bp, Homo sapiens
cctcggagcctcatccgaggcag

SEQ ID NO: 2085059 - DNA, 14 bp, Homo sapiens
cctcggtggccatg

SEQ ID NO: 2085060 - DNA, 16 bp, Homo sapiens
cctcggtggccatgct

SEQ ID NO: 2085061 - DNA, 17 bp, Homo sapiens
cctcggtggccatgctt

SEQ ID NO: 2085062 - DNA, 19 bp, Homo sapiens
cctcggtggccatgcttct

SEQ ID NO: 2085063 - DNA, 16 bp, Homo sapiens
cctcgtaccagccagg

SEQ ID NO: 2085064 - DNA, 21 bp, Homo sapiens
cctcgtccacaggggcaggcc

SEQ ID NO: 2085065 - DNA, 16 bp, Homo sapiens
cctcgtcccctgcctc

SEQ ID NO: 2085066 - DNA, 20 bp, Homo sapiens
cctcgtcctccccctgccag

SEQ ID NO: 2085067 - DNA, 21 bp, Homo sapiens
cctcgtcctccccctgccagt

SEQ ID NO: 2085068 - DNA, 15 bp, Homo sapiens
cctcgtggacacctg

SEQ ID NO: 2085069 - DNA, 16 bp, Homo sapiens
cctcgtggacacctgc

SEQ ID NO: 2085070 - DNA, 20 bp, Homo sapiens
cctcgtggacacctgccctg

SEQ ID NO: 2085071 - DNA, 21 bp, Homo sapiens
cctcgtggacacctgccctgc

SEQ ID NO: 2085072 - DNA, 22 bp, Homo sapiens
cctctaacccccagtgccacag

SEQ ID NO: 2085073 - DNA, 19 bp, Homo sapiens
cctctaagccactcttcca

SEQ ID NO: 2085074 - DNA, 20 bp, Homo sapiens
cctctacttaatgagatagt

SEQ ID NO: 2085075 - DNA, 17 bp, Homo sapiens
cctctagaacacccact

SEQ ID NO: 2085076 - DNA, 19 bp, Homo sapiens
cctctagaacacccactgg

SEQ ID NO: 2085077 - DNA, 24 bp, Homo sapiens
cctctagaacacccactggccagt

SEQ ID NO: 2085078 - DNA, 22 bp, Homo sapiens
cctctcaacagatctgtgggcc

SEQ ID NO: 2085079 - DNA, 18 bp, Homo sapiens
cctctcaatattcaataa

SEQ ID NO: 2085080 - DNA, 18 bp, Homo sapiens
cctctccaattgtaaaaa

SEQ ID NO: 2085081 - DNA, 19 bp, Homo sapiens
cctctccactgccttcgat

SEQ ID NO: 2085082 - DNA, 14 bp, Homo sapiens
cctctccatgccca

SEQ ID NO: 2085083 - DNA, 12 bp, Homo sapiens
cctctcccaggc

SEQ ID NO: 2085084 - DNA, 13 bp, Homo sapiens
cctctcccaggcc

SEQ ID NO: 2085085 - DNA, 12 bp, Homo sapiens
cctctccccaaa

SEQ ID NO: 2085086 - DNA, 15 bp, Homo sapiens
cctctccccagcaag

SEQ ID NO: 2085087 - DNA, 20 bp, Homo sapiens
cctctccccagcaagtgaga

SEQ ID NO: 2085088 - DNA, 21 bp, Homo sapiens
cctctcccgcgggcctggaca

SEQ ID NO: 2085089 - DNA, 19 bp, Homo sapiens
cctctcccggctgcctgcc

SEQ ID NO: 2085090 - DNA, 20 bp, Homo sapiens
cctctcccggctgcctgccg

SEQ ID NO: 2085091 - DNA, 12 bp, Homo sapiens
cctctcctgggg

SEQ ID NO: 2085092 - DNA, 12 bp, Homo sapiens
cctctccttgga

SEQ ID NO: 2085093 - DNA, 21 bp, Homo sapiens
cctctccttgggctcctggct

SEQ ID NO: 2085094 - DNA, 16 bp, Homo sapiens
cctctcgagcccagat

SEQ ID NO: 2085095 - DNA, 19 bp, Homo sapiens
cctctcgagttctcctatc

SEQ ID NO: 2085096 - DNA, 18 bp, Homo sapiens
cctctctaagccacagct

SEQ ID NO: 2085097 - DNA, 16 bp, Homo sapiens
cctctctcttcccagc

SEQ ID NO: 2085098 - DNA, 16 bp, Homo sapiens
cctctctgccaccacc

SEQ ID NO: 2085099 - DNA, 12 bp, Homo sapiens
cctctctgctat

SEQ ID NO: 2085100 - DNA, 14 bp, Homo sapiens
cctctctgctccag

SEQ ID NO: 2085101 - DNA, 20 bp, Homo sapiens
cctctcttatagaatattta

SEQ ID NO: 2085102 - DNA, 12 bp, Homo sapiens
cctctcttccct

SEQ ID NO: 2085103 - DNA, 20 bp, Homo sapiens
cctctcttctctattcctga

SEQ ID NO: 2085104 - DNA, 13 bp, Homo sapiens
cctctcttgcctt

SEQ ID NO: 2085105 - DNA, 15 bp, Homo sapiens
cctctgacacacagc

SEQ ID NO: 2085106 - DNA, 15 bp, Homo sapiens
cctctgacctgcagg

SEQ ID NO: 2085107 - DNA, 19 bp, Homo sapiens
cctctgacctgcaggccaa

SEQ ID NO: 2085108 - DNA, 16 bp, Homo sapiens
cctctgaggaagaagg

SEQ ID NO: 2085109 - DNA, 14 bp, Homo sapiens
cctctgaggccagc

SEQ ID NO: 2085110 - DNA, 15 bp, Homo sapiens
cctctgaggccagcc

SEQ ID NO: 2085111 - DNA, 18 bp, Homo sapiens
cctctgaggccagcctgg

SEQ ID NO: 2085112 - DNA, 20 bp, Homo sapiens
cctctgaggccagcctggcc

SEQ ID NO: 2085113 - DNA, 21 bp, Homo sapiens
cctctgaggccagcctggcct

SEQ ID NO: 2085114 - DNA, 15 bp, Homo sapiens
cctctgatacccaga

SEQ ID NO: 2085115 - DNA, 20 bp, Homo sapiens
cctctgatacccagagcatt

SEQ ID NO: 2085116 - DNA, 14 bp, Homo sapiens
cctctgatacctca

SEQ ID NO: 2085117 - DNA, 16 bp, Homo sapiens
cctctgattatcaggt

SEQ ID NO: 2085118 - DNA, 15 bp, Homo sapiens
cctctgccacctccc

SEQ ID NO: 2085119 - DNA, 17 bp, Homo sapiens
cctctgccatgcccaga

SEQ ID NO: 2085120 - DNA, 14 bp, Homo sapiens
cctctgccccaagg

SEQ ID NO: 2085121 - DNA, 15 bp, Homo sapiens
cctctgccccaaggg

SEQ ID NO: 2085122 - DNA, 19 bp, Homo sapiens
cctctgccccaaggggccc

SEQ ID NO: 2085123 - DNA, 14 bp, Homo sapiens
cctctgcccgcaga

SEQ ID NO: 2085124 - DNA, 14 bp, Homo sapiens
cctctgccctgcct

SEQ ID NO: 2085125 - DNA, 15 bp, Homo sapiens
cctctgccctgcctc

SEQ ID NO: 2085126 - DNA, 18 bp, Homo sapiens
cctctgccctgcctccct

SEQ ID NO: 2085127 - DNA, 21 bp, Homo sapiens
cctctgcctctgacacacagc

SEQ ID NO: 2085128 - DNA, 23 bp, Homo sapiens
cctctgcctctgacacacagctc

SEQ ID NO: 2085129 - DNA, 11 bp, Homo sapiens
cctctgcctga

SEQ ID NO: 2085130 - DNA, 20 bp, Homo sapiens
cctctgcctgaagtcacaca

SEQ ID NO: 2085131 - DNA, 21 bp, Homo sapiens
cctctgcctgaagtcacacag

SEQ ID NO: 2085132 - DNA, 21 bp, Homo sapiens
cctctgcgtcccccagccctc

SEQ ID NO: 2085133 - DNA, 22 bp, Homo sapiens
cctctgcgtcccccagccctca

SEQ ID NO: 2085134 - DNA, 14 bp, Homo sapiens
cctctgctctgagg

SEQ ID NO: 2085135 - DNA, 20 bp, Homo sapiens
cctctgcttgcatcacttgg

SEQ ID NO: 2085136 - DNA, 18 bp, Homo sapiens
cctctggatccctggagg

SEQ ID NO: 2085137 - DNA, 14 bp, Homo sapiens
cctctggcccagcc

SEQ ID NO: 2085138 - DNA, 20 bp, Homo sapiens
cctctggcccagcctaccct

SEQ ID NO: 2085139 - DNA, 17 bp, Homo sapiens
cctctggccctgccttc

SEQ ID NO: 2085140 - DNA, 18 bp, Homo sapiens
cctctggccctgccttct

SEQ ID NO: 2085141 - DNA, 22 bp, Homo sapiens
cctctgggcagctgtcatggaa

SEQ ID NO: 2085142 - DNA, 19 bp, Homo sapiens
cctctgggccaagactcct

SEQ ID NO: 2085143 - DNA, 20 bp, Homo sapiens
cctctgtcatcactccctgg

SEQ ID NO: 2085144 - DNA, 21 bp, Homo sapiens
cctctgtcatcactccctgga

SEQ ID NO: 2085145 - DNA, 21 bp, Homo sapiens
cctctgtccagggccctgagc

SEQ ID NO: 2085146 - DNA, 13 bp, Homo sapiens
cctctgtccctct

SEQ ID NO: 2085147 - DNA, 15 bp, Homo sapiens
cctctgtctcgagcg

SEQ ID NO: 2085148 - DNA, 18 bp, Homo sapiens
ccgaagaggaagcaagaa

SEQ ID NO: 2085149 - DNA, 17 bp, Homo sapiens
ccgaagcccaggctgaa

SEQ ID NO: 2085150 - DNA, 20 bp, Homo sapiens
ccgaagcccaggctgaagag

SEQ ID NO: 2085151 - DNA, 18 bp, Homo sapiens
ccgaagcccagtttccct

SEQ ID NO: 2085152 - DNA, 21 bp, Homo sapiens
ccgaagctaacagggaaggca

SEQ ID NO: 2085153 - DNA, 17 bp, Homo sapiens
ccgaatagctgggacta

SEQ ID NO: 2085154 - DNA, 18 bp, Homo sapiens
ccgacactgctgcaccag

SEQ ID NO: 2085155 - DNA, 12 bp, Homo sapiens
ccgacagagaga

SEQ ID NO: 2085156 - DNA, 12 bp, Homo sapiens
ccgacagcccag

SEQ ID NO: 2085157 - DNA, 13 bp, Homo sapiens
ccgacagcctggc

SEQ ID NO: 2085158 - DNA, 18 bp, Homo sapiens
ccgaccagacaccttgac

SEQ ID NO: 2085159 - DNA, 14 bp, Homo sapiens
ccgacctcagcctt

SEQ ID NO: 2085160 - DNA, 15 bp, Homo sapiens
ccgacctcagccttc

SEQ ID NO: 2085161 - DNA, 22 bp, Homo sapiens
ccgacctcgtcctccccctgcc

SEQ ID NO: 2085162 - DNA, 11 bp, Homo sapiens
ccgactcaggg

SEQ ID NO: 2085163 - DNA, 10 bp, Homo sapiens
ccgactccag

SEQ ID NO: 2085164 - DNA, 15 bp, Homo sapiens
ccgactccagccagc

SEQ ID NO: 2085165 - DNA, 23 bp, Homo sapiens
ccgactgcacagcggcccctgca

SEQ ID NO: 2085166 - DNA, 13 bp, Homo sapiens
ccgacttttctaa

SEQ ID NO: 2085167 - DNA, 18 bp, Homo sapiens
ccgagacggctggacctg

SEQ ID NO: 2085168 - DNA, 13 bp, Homo sapiens
ccgagagaggcgc

SEQ ID NO: 2085169 - DNA, 11 bp, Homo sapiens
ccgagattgca

SEQ ID NO: 2085170 - DNA, 18 bp, Homo sapiens
cctaataaacatccttca

SEQ ID NO: 2085171 - DNA, 15 bp, Homo sapiens
cctaataaagagact

SEQ ID NO: 2085172 - DNA, 15 bp, Homo sapiens
cctaataagtccaca

SEQ ID NO: 2085173 - DNA, 17 bp, Homo sapiens
cctaatcaggctgaggt

SEQ ID NO: 2085174 - DNA, 14 bp, Homo sapiens
cctaatctcatacc

SEQ ID NO: 2085175 - DNA, 19 bp, Homo sapiens
cctaatctcatacctctga

SEQ ID NO: 2085176 - DNA, 20 bp, Homo sapiens
cctaattcaattcaaagctg

SEQ ID NO: 2085177 - DNA, 21 bp, Homo sapiens
cctaattcctggcatgacact

SEQ ID NO: 2085178 - DNA, 20 bp, Homo sapiens
cctacacccttggacttgag

SEQ ID NO: 2085179 - DNA, 21 bp, Homo sapiens
cctacagataatttattttgt

SEQ ID NO: 2085180 - DNA, 21 bp, Homo sapiens
cctacatcttcagctcccata

SEQ ID NO: 2085181 - DNA, 19 bp, Homo sapiens
cctacatgaaacagaaaca

SEQ ID NO: 2085182 - DNA, 15 bp, Homo sapiens
cctacattccctggc

SEQ ID NO: 2085183 - DNA, 14 bp, Homo sapiens
cctaccacagtgtc

SEQ ID NO: 2085184 - DNA, 15 bp, Homo sapiens
cctaccacagtgtct

SEQ ID NO: 2085185 - DNA, 13 bp, Homo sapiens
cctaccacccctt

SEQ ID NO: 2085186 - DNA, 21 bp, Homo sapiens
cctaccaccttccctctttct

SEQ ID NO: 2085187 - DNA, 15 bp, Homo sapiens
cctacccaaccactc

SEQ ID NO: 2085188 - DNA, 13 bp, Homo sapiens
cctacccaccctc

SEQ ID NO: 2085189 - DNA, 13 bp, Homo sapiens
cctacccactctt

SEQ ID NO: 2085190 - DNA, 14 bp, Homo sapiens
cctacccactcttt

SEQ ID NO: 2085191 - DNA, 13 bp, Homo sapiens
cctaccccaccac

SEQ ID NO: 2085192 - DNA, 13 bp, Homo sapiens
cctaccccacctc

SEQ ID NO: 2085193 - DNA, 13 bp, Homo sapiens
cctaccctcactc

SEQ ID NO: 2085194 - DNA, 16 bp, Homo sapiens
cctaccgagtctcttc

SEQ ID NO: 2085195 - DNA, 14 bp, Homo sapiens
cctacctcagccta

SEQ ID NO: 2085196 - DNA, 15 bp, Homo sapiens
cctacctgctgctgc

SEQ ID NO: 2085197 - DNA, 14 bp, Homo sapiens
cctacctgtgcctg

SEQ ID NO: 2085198 - DNA, 15 bp, Homo sapiens
cctacctgtgcctga

SEQ ID NO: 2085199 - DNA, 21 bp, Homo sapiens
cctacgtcaaacatgaagtgt

SEQ ID NO: 2085200 - DNA, 16 bp, Homo sapiens
cctactactcaattgt

SEQ ID NO: 2085201 - DNA, 20 bp, Homo sapiens
cctactagttttccttgaaa

SEQ ID NO: 2085202 - DNA, 23 bp, Homo sapiens
cctactcacacaggcatttcctg

SEQ ID NO: 2085203 - DNA, 15 bp, Homo sapiens
cctactcccctgggc

SEQ ID NO: 2085204 - DNA, 18 bp, Homo sapiens
cctacttcattttcagag

SEQ ID NO: 2085205 - DNA, 15 bp, Homo sapiens
cctacttcctgtgac

SEQ ID NO: 2085206 - DNA, 14 bp, Homo sapiens
cctacttgtgactg

SEQ ID NO: 2085207 - DNA, 19 bp, Homo sapiens
cctacttgtgactgaaggg

SEQ ID NO: 2085208 - DNA, 15 bp, Homo sapiens
cctactttagccact

SEQ ID NO: 2085209 - DNA, 20 bp, Homo sapiens
cctactttatgtatggagct

SEQ ID NO: 2085210 - DNA, 23 bp, Homo sapiens
cctagaaccaagcttcagagcct

SEQ ID NO: 2085211 - DNA, 15 bp, Homo sapiens
cctagaactgtgcct

SEQ ID NO: 2085212 - DNA, 15 bp, Homo sapiens
cctagacctgggcca

SEQ ID NO: 2085213 - DNA, 13 bp, Homo sapiens
cctagagaggctg

SEQ ID NO: 2085214 - DNA, 16 bp, Homo sapiens
cctagagctcctgtcc

SEQ ID NO: 2085215 - DNA, 17 bp, Homo sapiens
cctagagctcctgtccc

SEQ ID NO: 2085216 - DNA, 20 bp, Homo sapiens
cctagagctcctgtccctac

SEQ ID NO: 2085217 - DNA, 20 bp, Homo sapiens
cctagaggtgggcagctggg

SEQ ID NO: 2085218 - DNA, 19 bp, Homo sapiens
cctagatccacacacagag

SEQ ID NO: 2085219 - DNA, 20 bp, Homo sapiens
cctagatccacacacagagg

SEQ ID NO: 2085220 - DNA, 12 bp, Homo sapiens
cctagcagtgaa

SEQ ID NO: 2085221 - DNA, 11 bp, Homo sapiens
cctagccacct

SEQ ID NO: 2085222 - DNA, 23 bp, Homo sapiens
cctagccacctcccaccccactc

SEQ ID NO: 2085223 - DNA, 13 bp, Homo sapiens
cctagcccacttg

SEQ ID NO: 2085224 - DNA, 14 bp, Homo sapiens
cctagccgacctca

SEQ ID NO: 2085225 - DNA, 19 bp, Homo sapiens
cctagccgacctcagcctt

SEQ ID NO: 2085226 - DNA, 19 bp, Homo sapiens
cctagccttagaagtcaca

SEQ ID NO: 2085227 - DNA, 22 bp, Homo sapiens
cctagccttagaagtcacacag

SEQ ID NO: 2085228 - DNA, 21 bp, Homo sapiens
cctagctccaccctcaccagg

SEQ ID NO: 2085229 - DNA, 15 bp, Homo sapiens
cctaggaaagcagtg

SEQ ID NO: 2085230 - DNA, 13 bp, Homo sapiens
cctaggacctcag

SEQ ID NO: 2085231 - DNA, 16 bp, Homo sapiens
cctaggacctcaggcg

SEQ ID NO: 2085232 - DNA, 13 bp, Homo sapiens
cctaggaggcctt

SEQ ID NO: 2085233 - DNA, 18 bp, Homo sapiens
cctaggaggccttctcgc

SEQ ID NO: 2085234 - DNA, 17 bp, Homo sapiens
cctaggattcctccccc

SEQ ID NO: 2085235 - DNA, 23 bp, Homo sapiens
cctaggccaaatgcacaagctca

SEQ ID NO: 2085236 - DNA, 14 bp, Homo sapiens
cctaggccccagag

SEQ ID NO: 2085237 - DNA, 18 bp, Homo sapiens
cctaggctccaccccatc

SEQ ID NO: 2085238 - DNA, 22 bp, Homo sapiens
cctagggccttttgtggattga

SEQ ID NO: 2085239 - DNA, 12 bp, Homo sapiens
cctaggtgctgg

SEQ ID NO: 2085240 - DNA, 16 bp, Homo sapiens
cctagtactctctgct

SEQ ID NO: 2085241 - DNA, 18 bp, Homo sapiens
cctagtgctattctgtgt

SEQ ID NO: 2085242 - DNA, 23 bp, Homo sapiens
cctagtgcttccacttctatgca

SEQ ID NO: 2085243 - DNA, 17 bp, Homo sapiens
cctagtggcttcctccg

SEQ ID NO: 2085244 - DNA, 19 bp, Homo sapiens
cctagtggcttcctccgtc

SEQ ID NO: 2085245 - DNA, 17 bp, Homo sapiens
cctagtttgacctcaca

SEQ ID NO: 2085246 - DNA, 22 bp, Homo sapiens
cctataaggagagttcaagcct

SEQ ID NO: 2085247 - DNA, 22 bp, Homo sapiens
cctataccatatgtctgcttct

SEQ ID NO: 2085248 - DNA, 23 bp, Homo sapiens
cctataccatatgtctgcttctg

SEQ ID NO: 2085249 - DNA, 15 bp, Homo sapiens
cctatagagaggggg

SEQ ID NO: 2085250 - DNA, 12 bp, Homo sapiens
cctatccaccca

SEQ ID NO: 2085251 - DNA, 13 bp, Homo sapiens
cctatccatcctg

SEQ ID NO: 2085252 - DNA, 16 bp, Homo sapiens
cctatccttggagagc

SEQ ID NO: 2085253 - DNA, 16 bp, Homo sapiens
cctatgacttgggcac

SEQ ID NO: 2085254 - DNA, 20 bp, Homo sapiens
cctatgcacatatggactct

SEQ ID NO: 2085255 - DNA, 21 bp, Homo sapiens
cctatggaaaagggtcttctt

SEQ ID NO: 2085256 - DNA, 13 bp, Homo sapiens
cctatggagagcc

SEQ ID NO: 2085257 - DNA, 22 bp, Homo sapiens
cctatggagagccctgggaccg

SEQ ID NO: 2085258 - DNA, 11 bp, Homo sapiens
cctatggatgt

SEQ ID NO: 2085259 - DNA, 15 bp, Homo sapiens
cctatggctgcctgc

SEQ ID NO: 2085260 - DNA, 23 bp, Homo sapiens
cctatgtactctacgccaaagtg

SEQ ID NO: 2085261 - DNA, 20 bp, Homo sapiens
cctatgtcctaaggacacac

SEQ ID NO: 2085262 - DNA, 24 bp, Homo sapiens
cctatgtcctaaggacacactaat

SEQ ID NO: 2085263 - DNA, 16 bp, Homo sapiens
cctattaacctagaga

SEQ ID NO: 2085264 - DNA, 14 bp, Homo sapiens
cctatttatgaaaa

SEQ ID NO: 2085265 - DNA, 15 bp, Homo sapiens
cctatttattcattc

SEQ ID NO: 2085266 - DNA, 12 bp, Homo sapiens
cctatttattgg

SEQ ID NO: 2085267 - DNA, 14 bp, Homo sapiens
cctatttattgggg

SEQ ID NO: 2085268 - DNA, 17 bp, Homo sapiens
cctcaaaaaaagccttt

SEQ ID NO: 2085269 - DNA, 16 bp, Homo sapiens
cctcaaaagcaccctt

SEQ ID NO: 2085270 - DNA, 14 bp, Homo sapiens
cctcaaaccctgtg

SEQ ID NO: 2085271 - DNA, 21 bp, Homo sapiens
cctcaaagcaagcattcagaa

SEQ ID NO: 2085272 - DNA, 22 bp, Homo sapiens
cctcaaataaaaagtgcttttg

SEQ ID NO: 2085273 - DNA, 21 bp, Homo sapiens
cctggccggcccaggcctcca

SEQ ID NO: 2085274 - DNA, 19 bp, Homo sapiens
cctggcctcacgcccagcc

SEQ ID NO: 2085275 - DNA, 13 bp, Homo sapiens
cctggcctcctgc

SEQ ID NO: 2085276 - DNA, 17 bp, Homo sapiens
cctggcctcctgcctct

SEQ ID NO: 2085277 - DNA, 18 bp, Homo sapiens
cctggcctcctgcctcta

SEQ ID NO: 2085278 - DNA, 13 bp, Homo sapiens
cctggcctccttt

SEQ ID NO: 2085279 - DNA, 12 bp, Homo sapiens
cctggcctgagc

SEQ ID NO: 2085280 - DNA, 14 bp, Homo sapiens
cctggcctgagctg

SEQ ID NO: 2085281 - DNA, 15 bp, Homo sapiens
cctggcctgagctgg

SEQ ID NO: 2085282 - DNA, 14 bp, Homo sapiens
cctggcctgctggg

SEQ ID NO: 2085283 - DNA, 13 bp, Homo sapiens
cctggcctggcac

SEQ ID NO: 2085284 - DNA, 12 bp, Homo sapiens
cctggcctggct

SEQ ID NO: 2085285 - DNA, 11 bp, Homo sapiens
cctggccttca

SEQ ID NO: 2085286 - DNA, 22 bp, Homo sapiens
cctggccttgtcaggacccagg

SEQ ID NO: 2085287 - DNA, 13 bp, Homo sapiens
cctggcggggcag

SEQ ID NO: 2085288 - DNA, 19 bp, Homo sapiens
cctggcggggcaggaggcc

SEQ ID NO: 2085289 - DNA, 20 bp, Homo sapiens
cctggcggggcaggaggcct

SEQ ID NO: 2085290 - DNA, 23 bp, Homo sapiens
cctggcggggcaggaggcctggc

SEQ ID NO: 2085291 - DNA, 23 bp, Homo sapiens
cctggctcccacaggcccttcct

SEQ ID NO: 2085292 - DNA, 21 bp, Homo sapiens
cctggctccccacgagtcacc

SEQ ID NO: 2085293 - DNA, 23 bp, Homo sapiens
cctggctccccacgagtcacctg

SEQ ID NO: 2085294 - DNA, 22 bp, Homo sapiens
cctggctgaccccaaagagcct

SEQ ID NO: 2085295 - DNA, 12 bp, Homo sapiens
cctggctgccag

SEQ ID NO: 2085296 - DNA, 15 bp, Homo sapiens
cctggctgccaggcg

SEQ ID NO: 2085297 - DNA, 17 bp, Homo sapiens
cctggctgctctcatgc

SEQ ID NO: 2085298 - DNA, 13 bp, Homo sapiens
cctggctggctga

SEQ ID NO: 2085299 - DNA, 12 bp, Homo sapiens
cctggctgtgga

SEQ ID NO: 2085300 - DNA, 13 bp, Homo sapiens
cctggctgtggag

SEQ ID NO: 2085301 - DNA, 14 bp, Homo sapiens
cctggctgtggagg

SEQ ID NO: 2085302 - DNA, 18 bp, Homo sapiens
cctggctgtggaggcctg

SEQ ID NO: 2085303 - DNA, 19 bp, Homo sapiens
cctggctgtggaggcctga

SEQ ID NO: 2085304 - DNA, 22 bp, Homo sapiens
cctggctgtggaggcctgatgc

SEQ ID NO: 2085305 - DNA, 20 bp, Homo sapiens
cctggcttcccatccccagc

SEQ ID NO: 2085306 - DNA, 17 bp, Homo sapiens
cctggcttctggagccc

SEQ ID NO: 2085307 - DNA, 22 bp, Homo sapiens
cctggcttctggagcccttggg

SEQ ID NO: 2085308 - DNA, 14 bp, Homo sapiens
cctggcttgctcca

SEQ ID NO: 2085309 - DNA, 15 bp, Homo sapiens
cctggcttgctccag

SEQ ID NO: 2085310 - DNA, 17 bp, Homo sapiens
cctggcttgctccaggg

SEQ ID NO: 2085311 - DNA, 20 bp, Homo sapiens
cctggcttgctccagggtct

SEQ ID NO: 2085312 - DNA, 16 bp, Homo sapiens
cctggcttgcttgccg

SEQ ID NO: 2085313 - DNA, 20 bp, Homo sapiens
cctggctttcccttccagtt

SEQ ID NO: 2085314 - DNA, 22 bp, Homo sapiens
cctggcttttcactgctggctg

SEQ ID NO: 2085315 - DNA, 23 bp, Homo sapiens
cctggcttttcactgctggctgc

SEQ ID NO: 2085316 - DNA, 21 bp, Homo sapiens
cctgggaaaggacccacccat

SEQ ID NO: 2085317 - DNA, 15 bp, Homo sapiens
cctgggaaccatgaa

SEQ ID NO: 2085318 - DNA, 14 bp, Homo sapiens
cctgggaccagggc

SEQ ID NO: 2085319 - DNA, 15 bp, Homo sapiens
cctgggacccagcta

SEQ ID NO: 2085320 - DNA, 16 bp, Homo sapiens
cctgggacccagctac

SEQ ID NO: 2085321 - DNA, 15 bp, Homo sapiens
cctgggactcccagt

SEQ ID NO: 2085322 - DNA, 12 bp, Homo sapiens
cctgggagagaa

SEQ ID NO: 2085323 - DNA, 16 bp, Homo sapiens
cctgggaggcggagag

SEQ ID NO: 2085324 - DNA, 16 bp, Homo sapiens
cctgggagtgagctgg

SEQ ID NO: 2085325 - DNA, 16 bp, Homo sapiens
cctgggattcaggaaa

SEQ ID NO: 2085326 - DNA, 18 bp, Homo sapiens
cctgggcacccacctcca

SEQ ID NO: 2085327 - DNA, 20 bp, Homo sapiens
cctgggcacccacctccacc

SEQ ID NO: 2085328 - DNA, 21 bp, Homo sapiens
cctgggcacccacctccaccc

SEQ ID NO: 2085329 - DNA, 18 bp, Homo sapiens
cctgggcatcttctggct

SEQ ID NO: 2085330 - DNA, 20 bp, Homo sapiens
cctgggcatcttctggcttg

SEQ ID NO: 2085331 - DNA, 19 bp, Homo sapiens
cctgggccaaaagggcagc

SEQ ID NO: 2085332 - DNA, 12 bp, Homo sapiens
cctgggcccagg

SEQ ID NO: 2085333 - DNA, 15 bp, Homo sapiens
cctgggcccaggctc

SEQ ID NO: 2085334 - DNA, 18 bp, Homo sapiens
cctgggcccaggctctgg

SEQ ID NO: 2085335 - DNA, 18 bp, Homo sapiens
cctgggcccgctttgcct

SEQ ID NO: 2085336 - DNA, 21 bp, Homo sapiens
cctgggcccgctttgcctgct

SEQ ID NO: 2085337 - DNA, 16 bp, Homo sapiens
cctgggccctggggcc

SEQ ID NO: 2085338 - DNA, 17 bp, Homo sapiens
cctgggccctggggcct

SEQ ID NO: 2085339 - DNA, 18 bp, Homo sapiens
cctgggccctggggcctg

SEQ ID NO: 2085340 - DNA, 21 bp, Homo sapiens
cctgggccctggggcctgtac

SEQ ID NO: 2085341 - DNA, 22 bp, Homo sapiens
cctgggccctggggcctgtact

SEQ ID NO: 2085342 - DNA, 20 bp, Homo sapiens
cctgggcctatggagagccc

SEQ ID NO: 2085343 - DNA, 21 bp, Homo sapiens
cctgggcctatggagagccct

SEQ ID NO: 2085344 - DNA, 22 bp, Homo sapiens
cctgggcctcagttcaacctgg

SEQ ID NO: 2085345 - DNA, 23 bp, Homo sapiens
cctgggcctgcttttccaggatc

SEQ ID NO: 2085346 - DNA, 22 bp, Homo sapiens
cctgggcctgtgcagcagccca

SEQ ID NO: 2085347 - DNA, 15 bp, Homo sapiens
cctgggcctttcctg

SEQ ID NO: 2085348 - DNA, 20 bp, Homo sapiens
cctgggcctttcctgtgcca

SEQ ID NO: 2085349 - DNA, 14 bp, Homo sapiens
cctgggctctgccc

SEQ ID NO: 2085350 - DNA, 12 bp, Homo sapiens
cctggggccccg

SEQ ID NO: 2085351 - DNA, 18 bp, Homo sapiens
cctggggccccgctggga

SEQ ID NO: 2085352 - DNA, 18 bp, Homo sapiens
cctggggcctgtactgcc

SEQ ID NO: 2085353 - DNA, 22 bp, Homo sapiens
cctggggcctgtactgcctgct

SEQ ID NO: 2085354 - DNA, 22 bp, Homo sapiens
cctggggctcctttctccagcc

SEQ ID NO: 2085355 - DNA, 20 bp, Homo sapiens
cctggggctctaacgcctga

SEQ ID NO: 2085356 - DNA, 22 bp, Homo sapiens
cctgggggatgtgcacggcagc

SEQ ID NO: 2085357 - DNA, 23 bp, Homo sapiens
cctgggggatgtgcacggcagct

SEQ ID NO: 2085358 - DNA, 13 bp, Homo sapiens
cctgggggccagc

SEQ ID NO: 2085359 - DNA, 23 bp, Homo sapiens
cctgggggcctggctggctgagg

SEQ ID NO: 2085360 - DNA, 22 bp, Homo sapiens
cctgggggtggcaggcacacag

SEQ ID NO: 2085361 - DNA, 18 bp, Homo sapiens
cctggggtctctgctgca

SEQ ID NO: 2085362 - DNA, 18 bp, Homo sapiens
cctgggtctaaggggttg

SEQ ID NO: 2085363 - DNA, 17 bp, Homo sapiens
cctgggtggctactctg

SEQ ID NO: 2085364 - DNA, 13 bp, Homo sapiens
cctgggttttcta

SEQ ID NO: 2085365 - DNA, 20 bp, Homo sapiens
cctgggttttctaactgtaa

SEQ ID NO: 2085366 - DNA, 17 bp, Homo sapiens
cctggtaagcagaggct

SEQ ID NO: 2085367 - DNA, 14 bp, Homo sapiens
cctggtacagcagg

SEQ ID NO: 2085368 - DNA, 16 bp, Homo sapiens
cctggtacagcagggt

SEQ ID NO: 2085369 - DNA, 18 bp, Homo sapiens
cctggtagaattgggaag

SEQ ID NO: 2085370 - DNA, 23 bp, Homo sapiens
cctggtcacaggactctgcctcc

SEQ ID NO: 2085371 - DNA, 14 bp, Homo sapiens
cctggtcctgaggg

SEQ ID NO: 2085372 - DNA, 15 bp, Homo sapiens
cctggtccttccagg

SEQ ID NO: 2085373 - DNA, 16 bp, Homo sapiens
cctggtctgccctggg

SEQ ID NO: 2085374 - DNA, 19 bp, Homo sapiens
cctggtgaggcccagcctg

SEQ ID NO: 2085375 - DNA, 17 bp, Homo sapiens
cctggtgcactggcccc

SEQ ID NO: 2085376 - DNA, 20 bp, Homo sapiens
cctttagcgcccagttgggt

SEQ ID NO: 2085377 - DNA, 17 bp, Homo sapiens
cctttaggcagcctgcc

SEQ ID NO: 2085378 - DNA, 18 bp, Homo sapiens
cctttaggcagcctgccg

SEQ ID NO: 2085379 - DNA, 16 bp, Homo sapiens
cctttaggtctggttg

SEQ ID NO: 2085380 - DNA, 13 bp, Homo sapiens
cctttatctctgt

SEQ ID NO: 2085381 - DNA, 14 bp, Homo sapiens
cctttattgcagtt

SEQ ID NO: 2085382 - DNA, 16 bp, Homo sapiens
cctttcaaatttcaca

SEQ ID NO: 2085383 - DNA, 22 bp, Homo sapiens
cctttcacaaaattttattcct

SEQ ID NO: 2085384 - DNA, 12 bp, Homo sapiens
cctttcagggaa

SEQ ID NO: 2085385 - DNA, 15 bp, Homo sapiens
cctttccacctgctt

SEQ ID NO: 2085386 - DNA, 15 bp, Homo sapiens
cctttccccagtgtg

SEQ ID NO: 2085387 - DNA, 21 bp, Homo sapiens
cctttccctcaccccctccca

SEQ ID NO: 2085388 - DNA, 12 bp, Homo sapiens
cctttcctcccc

SEQ ID NO: 2085389 - DNA, 12 bp, Homo sapiens
cctttcctctga

SEQ ID NO: 2085390 - DNA, 19 bp, Homo sapiens
cctttcctgtgccaacctg

SEQ ID NO: 2085391 - DNA, 22 bp, Homo sapiens
cctttctagtcctattctattg

SEQ ID NO: 2085392 - DNA, 14 bp, Homo sapiens
cctttctagttgaa

SEQ ID NO: 2085393 - DNA, 13 bp, Homo sapiens
cctttctccagcc

SEQ ID NO: 2085394 - DNA, 20 bp, Homo sapiens
cctttctctatcccaagcca

SEQ ID NO: 2085395 - DNA, 11 bp, Homo sapiens
cctttctctga

SEQ ID NO: 2085396 - DNA, 13 bp, Homo sapiens
cctttctgggagg

SEQ ID NO: 2085397 - DNA, 11 bp, Homo sapiens
cctttctgtgt

SEQ ID NO: 2085398 - DNA, 15 bp, Homo sapiens
cctttgagaaagaaa

SEQ ID NO: 2085399 - DNA, 14 bp, Homo sapiens
cctttgataaatgt

SEQ ID NO: 2085400 - DNA, 20 bp, Homo sapiens
cctttgcaggcccagcagac

SEQ ID NO: 2085401 - DNA, 23 bp, Homo sapiens
cgaggtcaacagagaaggcagga

SEQ ID NO: 2085402 - DNA, 22 bp, Homo sapiens
cgaggtggatcacagaggcttc

SEQ ID NO: 2085403 - DNA, 23 bp, Homo sapiens
cgaggtggatcacagaggcttct

SEQ ID NO: 2085404 - DNA, 20 bp, Homo sapiens
cgaggtgtcaccctgcagag

SEQ ID NO: 2085405 - DNA, 21 bp, Homo sapiens
cgaggtgtcaccctgcagagc

SEQ ID NO: 2085406 - DNA, 15 bp, Homo sapiens
cgagtagctgggact

SEQ ID NO: 2085407 - DNA, 16 bp, Homo sapiens
cgagtagctgggacta

SEQ ID NO: 2085408 - DNA, 20 bp, Homo sapiens
cgagtcaatcccctcattca

SEQ ID NO: 2085409 - DNA, 16 bp, Homo sapiens
cgagtcacctgcaagc

SEQ ID NO: 2085410 - DNA, 20 bp, Homo sapiens
cgagtcacctgcaagcccca

SEQ ID NO: 2085411 - DNA, 21 bp, Homo sapiens
cgagtctcttctccactggat

SEQ ID NO: 2085412 - DNA, 11 bp, Homo sapiens
cgagtgccagg

SEQ ID NO: 2085413 - DNA, 18 bp, Homo sapiens
cgatacaccgggcctgga

SEQ ID NO: 2085414 - DNA, 17 bp, Homo sapiens
cgatcaagtccagagcc

SEQ ID NO: 2085415 - DNA, 15 bp, Homo sapiens
cgatctgtactgtaa

SEQ ID NO: 2085416 - DNA, 23 bp, Homo sapiens
cgatgaatgtgttgatttgagaa

SEQ ID NO: 2085417 - DNA, 21 bp, Homo sapiens
cgatgaatttggagactctgt

SEQ ID NO: 2085418 - DNA, 22 bp, Homo sapiens
cgatgccgtgtgtctcgtctcc

SEQ ID NO: 2085419 - DNA, 16 bp, Homo sapiens
cgatgtggccctggcc

SEQ ID NO: 2085420 - DNA, 14 bp, Homo sapiens
cgattaatttatgg

SEQ ID NO: 2085421 - DNA, 11 bp, Homo sapiens
cgattagactg

SEQ ID NO: 2085422 - DNA, 17 bp, Homo sapiens
cgattccctctcccagg

SEQ ID NO: 2085423 - DNA, 16 bp, Homo sapiens
cgcaacaacaaggacc

SEQ ID NO: 2085424 - DNA, 18 bp, Homo sapiens
cgcaacaacaaggaccct

SEQ ID NO: 2085425 - DNA, 18 bp, Homo sapiens
cgcaacccttgctgctgc

SEQ ID NO: 2085426 - DNA, 19 bp, Homo sapiens
cgcaaggccctgtcccagc

SEQ ID NO: 2085427 - DNA, 16 bp, Homo sapiens
cgcaagggcatcaggc

SEQ ID NO: 2085428 - DNA, 21 bp, Homo sapiens
cgcaagggcatcaggcactgg

SEQ ID NO: 2085429 - DNA, 14 bp, Homo sapiens
cgcaagggcctgat

SEQ ID NO: 2085430 - DNA, 15 bp, Homo sapiens
cgcaagtctgcagcc

SEQ ID NO: 2085431 - DNA, 15 bp, Homo sapiens
cgcaagttcagggaa

SEQ ID NO: 2085432 - DNA, 19 bp, Homo sapiens
cgcaagttcagggaagcag

SEQ ID NO: 2085433 - DNA, 21 bp, Homo sapiens
cgcaattgtgggatgtcctct

SEQ ID NO: 2085434 - DNA, 21 bp, Homo sapiens
cgcacaaggctgaccaagaga

SEQ ID NO: 2085435 - DNA, 19 bp, Homo sapiens
cgcacatgccaatgcacgc

SEQ ID NO: 2085436 - DNA, 13 bp, Homo sapiens
cgcacatgttatc

SEQ ID NO: 2085437 - DNA, 13 bp, Homo sapiens
cgcaccagctgct

SEQ ID NO: 2085438 - DNA, 19 bp, Homo sapiens
cgcaccagctgctctgccc

SEQ ID NO: 2085439 - DNA, 17 bp, Homo sapiens
cgcaccccccaagctgt

SEQ ID NO: 2085440 - DNA, 21 bp, Homo sapiens
cgcacgcaacccttgctgctg

SEQ ID NO: 2085441 - DNA, 13 bp, Homo sapiens
cgcagaaggaagg

SEQ ID NO: 2085442 - DNA, 14 bp, Homo sapiens
cgcagaggcggaaa

SEQ ID NO: 2085443 - DNA, 18 bp, Homo sapiens
cgcagaggcggaaacctt

SEQ ID NO: 2085444 - DNA, 20 bp, Homo sapiens
cgcagaggcggaaaccttgc

SEQ ID NO: 2085445 - DNA, 21 bp, Homo sapiens
cgcagaggcggaaaccttgca

SEQ ID NO: 2085446 - DNA, 16 bp, Homo sapiens
cgcagcaccctgcaga

SEQ ID NO: 2085447 - DNA, 20 bp, Homo sapiens
cgcagcagctgggacccctc

SEQ ID NO: 2085448 - DNA, 20 bp, Homo sapiens
cgcagcaggtgcaagagaca

SEQ ID NO: 2085449 - DNA, 12 bp, Homo sapiens
cgcagccaccct

SEQ ID NO: 2085450 - DNA, 16 bp, Homo sapiens
cgcagccaccctgagg

SEQ ID NO: 2085451 - DNA, 17 bp, Homo sapiens
cgcagcccgtgaagcag

SEQ ID NO: 2085452 - DNA, 19 bp, Homo sapiens
cgcagcccgtgaagcagtg

SEQ ID NO: 2085453 - DNA, 21 bp, Homo sapiens
cgcagcccgtgaagcagtgcc

SEQ ID NO: 2085454 - DNA, 22 bp, Homo sapiens
cgcagcccgtgaagcagtgcct

SEQ ID NO: 2085455 - DNA, 23 bp, Homo sapiens
cgcagcccgtgaagcagtgcctc

SEQ ID NO: 2085456 - DNA, 10 bp, Homo sapiens
cgcagccctg

SEQ ID NO: 2085457 - DNA, 13 bp, Homo sapiens
cgcagccctgctt

SEQ ID NO: 2085458 - DNA, 15 bp, Homo sapiens
cgcagccctgctttg

SEQ ID NO: 2085459 - DNA, 19 bp, Homo sapiens
cgcagccctgggggccagc

SEQ ID NO: 2085460 - DNA, 21 bp, Homo sapiens
cgcagccgccgggcaggcctg

SEQ ID NO: 2085461 - DNA, 19 bp, Homo sapiens
cgcagcctggcggggcagg

SEQ ID NO: 2085462 - DNA, 21 bp, Homo sapiens
cgcagcctggcggggcaggag

SEQ ID NO: 2085463 - DNA, 22 bp, Homo sapiens
cgcagcctggcggggcaggagg

SEQ ID NO: 2085464 - DNA, 17 bp, Homo sapiens
cgcaggaactcccagca

SEQ ID NO: 2085465 - DNA, 18 bp, Homo sapiens
cgcaggaactcccagcaa

SEQ ID NO: 2085466 - DNA, 17 bp, Homo sapiens
cgcaggatccgctgcca

SEQ ID NO: 2085467 - DNA, 18 bp, Homo sapiens
cgcaggatccgctgccac

SEQ ID NO: 2085468 - DNA, 19 bp, Homo sapiens
cgcaggatccgctgccacc

SEQ ID NO: 2085469 - DNA, 17 bp, Homo sapiens
cgcagggaggatgccac

SEQ ID NO: 2085470 - DNA, 15 bp, Homo sapiens
cgcagtccccagccc

SEQ ID NO: 2085471 - DNA, 22 bp, Homo sapiens
cgcagtctggcctgggcgacag

SEQ ID NO: 2085472 - DNA, 21 bp, Homo sapiens
cgcatcttctccatctggcag

SEQ ID NO: 2085473 - DNA, 15 bp, Homo sapiens
cgcatgccagagcct

SEQ ID NO: 2085474 - DNA, 16 bp, Homo sapiens
cgcatgtaatcccagc

SEQ ID NO: 2085475 - DNA, 12 bp, Homo sapiens
cgcattccctga

SEQ ID NO: 2085476 - DNA, 13 bp, Homo sapiens
cgcattccctgag

SEQ ID NO: 2085477 - DNA, 16 bp, Homo sapiens
cgcattttctctagct

SEQ ID NO: 2085478 - DNA, 16 bp, Homo sapiens
cgccacggccaccctc

SEQ ID NO: 2085479 - DNA, 16 bp, Homo sapiens
cgccacggggaggggg

SEQ ID NO: 2085480 - DNA, 12 bp, Homo sapiens
cgccactcattt

SEQ ID NO: 2085481 - DNA, 20 bp, Homo sapiens
cgccactgcactccggcctg

SEQ ID NO: 2085482 - DNA, 18 bp, Homo sapiens
cgccagaggacaaggaag

SEQ ID NO: 2085483 - DNA, 21 bp, Homo sapiens
cgccagaggacaaggaagtgg

SEQ ID NO: 2085484 - DNA, 16 bp, Homo sapiens
cgccagcctcagtgcc

SEQ ID NO: 2085485 - DNA, 19 bp, Homo sapiens
cgccaggaggtcctcctct

SEQ ID NO: 2085486 - DNA, 16 bp, Homo sapiens
cgccagtttcaccatt

SEQ ID NO: 2085487 - DNA, 21 bp, Homo sapiens
cgccatcaccccctaccccag

SEQ ID NO: 2085488 - DNA, 14 bp, Homo sapiens
cgccatcagcccaa

SEQ ID NO: 2085489 - DNA, 13 bp, Homo sapiens
cgccatccttcac

SEQ ID NO: 2085490 - DNA, 15 bp, Homo sapiens
cgcccaaggctgcag

SEQ ID NO: 2085491 - DNA, 16 bp, Homo sapiens
cgcccaaggggacttg

SEQ ID NO: 2085492 - DNA, 15 bp, Homo sapiens
cgcccacaaactgat

SEQ ID NO: 2085493 - DNA, 19 bp, Homo sapiens
cgcccagcctcctcccacc

SEQ ID NO: 2085494 - DNA, 18 bp, Homo sapiens
cgcccagctgaggctggg

SEQ ID NO: 2085495 - DNA, 20 bp, Homo sapiens
cgcccagctgcacctgccag

SEQ ID NO: 2085496 - DNA, 21 bp, Homo sapiens
cgcccagtctggaatgcagtg

SEQ ID NO: 2085497 - DNA, 17 bp, Homo sapiens
cgcccattcgtctgtcc

SEQ ID NO: 2085498 - DNA, 21 bp, Homo sapiens
cgccccaacccgtggaggctg

SEQ ID NO: 2085499 - DNA, 22 bp, Homo sapiens
cgccccaacccgtggaggctgc

SEQ ID NO: 2085500 - DNA, 14 bp, Homo sapiens
cgccccacccaggg

SEQ ID NO: 2085501 - DNA, 21 bp, Homo sapiens
cgccccagatcaccagcccgg

SEQ ID NO: 2085502 - DNA, 14 bp, Homo sapiens
cgccccaggccctc

SEQ ID NO: 2085503 - DNA, 20 bp, Homo sapiens
cgcccctcgctgctgctact

SEQ ID NO: 2085504 - DNA, 17 bp, Homo sapiens
cgcccgactagcaggca

SEQ ID NO: 2085505 - DNA, 21 bp, Homo sapiens
cgcccgactagcaggcatgcc

SEQ ID NO: 2085506 - DNA, 21 bp, Homo sapiens
cgccctctgcgtcccccagcc

SEQ ID NO: 2085507 - DNA, 19 bp, Homo sapiens
cgccctgggctgtctgtca

SEQ ID NO: 2085508 - DNA, 22 bp, Homo sapiens
cgccctgggctgtctgtcacca

SEQ ID NO: 2085509 - DNA, 14 bp, Homo sapiens
cgcccttcccacag

SEQ ID NO: 2085510 - DNA, 13 bp, Homo sapiens
cgccgggcaggcc

SEQ ID NO: 2085511 - DNA, 14 bp, Homo sapiens
cgccgggcaggcct

SEQ ID NO: 2085512 - DNA, 13 bp, Homo sapiens
cgcctaggcctgt

SEQ ID NO: 2085513 - DNA, 13 bp, Homo sapiens
cgcctccaggagc

SEQ ID NO: 2085514 - DNA, 15 bp, Homo sapiens
cgcctccctccaccc

SEQ ID NO: 2085515 - DNA, 18 bp, Homo sapiens
cgcctccctccaccccag

SEQ ID NO: 2085516 - DNA, 20 bp, Homo sapiens
cgcctccctccaccccagga

SEQ ID NO: 2085517 - DNA, 13 bp, Homo sapiens
cctttgcctcttg

SEQ ID NO: 2085518 - DNA, 12 bp, Homo sapiens
cctttggaaaaa

SEQ ID NO: 2085519 - DNA, 13 bp, Homo sapiens
cctttggaaaaat

SEQ ID NO: 2085520 - DNA, 14 bp, Homo sapiens
cctttggaaaaatc

SEQ ID NO: 2085521 - DNA, 17 bp, Homo sapiens
cctttggaagaaacagg

SEQ ID NO: 2085522 - DNA, 16 bp, Homo sapiens
cctttggatgaccaga

SEQ ID NO: 2085523 - DNA, 15 bp, Homo sapiens
cctttggccattcca

SEQ ID NO: 2085524 - DNA, 20 bp, Homo sapiens
cctttgtttttatgaagaaa

SEQ ID NO: 2085525 - DNA, 11 bp, Homo sapiens
ccttttatagc

SEQ ID NO: 2085526 - DNA, 16 bp, Homo sapiens
ccttttattctgtacc

SEQ ID NO: 2085527 - DNA, 16 bp, Homo sapiens
ccttttctctcccata

SEQ ID NO: 2085528 - DNA, 13 bp, Homo sapiens
ccttttctgacca

SEQ ID NO: 2085529 - DNA, 17 bp, Homo sapiens
ccttttgatggggagaa

SEQ ID NO: 2085530 - DNA, 17 bp, Homo sapiens
ccttttgcataagatta

SEQ ID NO: 2085531 - DNA, 16 bp, Homo sapiens
ccttttgcctggctgt

SEQ ID NO: 2085532 - DNA, 15 bp, Homo sapiens
ccttttgctgctgct

SEQ ID NO: 2085533 - DNA, 18 bp, Homo sapiens
ccttttgcttgaaaccaa

SEQ ID NO: 2085534 - DNA, 19 bp, Homo sapiens
ccttttgtaccatggtgtg

SEQ ID NO: 2085535 - DNA, 12 bp, Homo sapiens
ccttttgtattt

SEQ ID NO: 2085536 - DNA, 17 bp, Homo sapiens
ccttttgtccccagggc

SEQ ID NO: 2085537 - DNA, 21 bp, Homo sapiens
ccttttgtccccagggcccct

SEQ ID NO: 2085538 - DNA, 14 bp, Homo sapiens
cctttttgactttt

SEQ ID NO: 2085539 - DNA, 13 bp, Homo sapiens
ccttttttaaaag

SEQ ID NO: 2085540 - DNA, 22 bp, Homo sapiens
ccttttttatttttttaagctg

SEQ ID NO: 2085541 - DNA, 18 bp, Homo sapiens
cgaaaacgttgacccctt

SEQ ID NO: 2085542 - DNA, 19 bp, Homo sapiens
cgaaaacgttgaccccttt

SEQ ID NO: 2085543 - DNA, 22 bp, Homo sapiens
cgaaacaggctactctcctcgg

SEQ ID NO: 2085544 - DNA, 20 bp, Homo sapiens
cgaaacctgtccataaagta

SEQ ID NO: 2085545 - DNA, 16 bp, Homo sapiens
cgaaactgtatgatta

SEQ ID NO: 2085546 - DNA, 22 bp, Homo sapiens
cgaaaggatgtaaacagtgcct

SEQ ID NO: 2085547 - DNA, 23 bp, Homo sapiens
cgaaaggatgtaaacagtgcctg

SEQ ID NO: 2085548 - DNA, 19 bp, Homo sapiens
cgaaagggacttggaagct

SEQ ID NO: 2085549 - DNA, 12 bp, Homo sapiens
cgaaagtttctt

SEQ ID NO: 2085550 - DNA, 15 bp, Homo sapiens
cgaaccaaggcagcc

SEQ ID NO: 2085551 - DNA, 20 bp, Homo sapiens
cgaaccaaggcagcctccag

SEQ ID NO: 2085552 - DNA, 14 bp, Homo sapiens
cgaacccacctgct

SEQ ID NO: 2085553 - DNA, 21 bp, Homo sapiens
cgaacccctcccctcccccct

SEQ ID NO: 2085554 - DNA, 14 bp, Homo sapiens
cgaactagaagaaa

SEQ ID NO: 2085555 - DNA, 15 bp, Homo sapiens
cgaactccttgattt

SEQ ID NO: 2085556 - DNA, 18 bp, Homo sapiens
cgaagaccttctgaagat

SEQ ID NO: 2085557 - DNA, 22 bp, Homo sapiens
cgaagaccttctgaagatctca

SEQ ID NO: 2085558 - DNA, 21 bp, Homo sapiens
cgaagagggaatggatgggga

SEQ ID NO: 2085559 - DNA, 20 bp, Homo sapiens
cgaagccatctttctttgga

SEQ ID NO: 2085560 - DNA, 10 bp, Homo sapiens
cgaagcccag

SEQ ID NO: 2085561 - DNA, 17 bp, Homo sapiens
cgaagcccaggctgaag

SEQ ID NO: 2085562 - DNA, 11 bp, Homo sapiens
cgaagcccagt

SEQ ID NO: 2085563 - DNA, 16 bp, Homo sapiens
cgaagcccttccagtg

SEQ ID NO: 2085564 - DNA, 19 bp, Homo sapiens
cgaagcccttccagtggta

SEQ ID NO: 2085565 - DNA, 22 bp, Homo sapiens
cgaagctaacagggaaggcagg

SEQ ID NO: 2085566 - DNA, 23 bp, Homo sapiens
cgaagctgtgaactcagagcccc

SEQ ID NO: 2085567 - DNA, 21 bp, Homo sapiens
cgaaggggccccggggctggc

SEQ ID NO: 2085568 - DNA, 14 bp, Homo sapiens
cgaatagctgggac

SEQ ID NO: 2085569 - DNA, 15 bp, Homo sapiens
cgaatagctgggact

SEQ ID NO: 2085570 - DNA, 14 bp, Homo sapiens
cgaatcagactcat

SEQ ID NO: 2085571 - DNA, 24 bp, Homo sapiens
cgaatgcctgtcagtttcatggag

SEQ ID NO: 2085572 - DNA, 16 bp, Homo sapiens
cgaattttattttaca

SEQ ID NO: 2085573 - DNA, 19 bp, Homo sapiens
cgacaaagcatcattgtaa

SEQ ID NO: 2085574 - DNA, 23 bp, Homo sapiens
cgacaaagcatcattgtaaatta

SEQ ID NO: 2085575 - DNA, 15 bp, Homo sapiens
cgacactgctgcacc

SEQ ID NO: 2085576 - DNA, 20 bp, Homo sapiens
cgacactgctgcaccagagt

SEQ ID NO: 2085577 - DNA, 12 bp, Homo sapiens
cgacagcccagc

SEQ ID NO: 2085578 - DNA, 14 bp, Homo sapiens
cgacagcccagcct

SEQ ID NO: 2085579 - DNA, 17 bp, Homo sapiens
cgacagcccagcctagc

SEQ ID NO: 2085580 - DNA, 16 bp, Homo sapiens
cgacaggagtattttt

SEQ ID NO: 2085581 - DNA, 15 bp, Homo sapiens
cgacagttctgaact

SEQ ID NO: 2085582 - DNA, 14 bp, Homo sapiens
cgacatactcattt

SEQ ID NO: 2085583 - DNA, 12 bp, Homo sapiens
cgaccacctgcc

SEQ ID NO: 2085584 - DNA, 21 bp, Homo sapiens
cgaccacttttcagttcagtg

SEQ ID NO: 2085585 - DNA, 13 bp, Homo sapiens
cgacctcagcctt

SEQ ID NO: 2085586 - DNA, 22 bp, Homo sapiens
cgacctcgtcctccccctgcca

SEQ ID NO: 2085587 - DNA, 17 bp, Homo sapiens
cgacgccccgaacctca

SEQ ID NO: 2085588 - DNA, 13 bp, Homo sapiens
cgacggcggcggc

SEQ ID NO: 2085589 - DNA, 19 bp, Homo sapiens
cgacggtttcaaaccagga

SEQ ID NO: 2085590 - DNA, 17 bp, Homo sapiens
cgactagcaggcatgcc

SEQ ID NO: 2085591 - DNA, 11 bp, Homo sapiens
cgactcaggga

SEQ ID NO: 2085592 - DNA, 11 bp, Homo sapiens
cgactccagcc

SEQ ID NO: 2085593 - DNA, 16 bp, Homo sapiens
cgactccagccagcgc

SEQ ID NO: 2085594 - DNA, 20 bp, Homo sapiens
cgactccagccagcgcctcc

SEQ ID NO: 2085595 - DNA, 12 bp, Homo sapiens
cgactgaagaag

SEQ ID NO: 2085596 - DNA, 16 bp, Homo sapiens
cgactgtgaaagtatg

SEQ ID NO: 2085597 - DNA, 17 bp, Homo sapiens
cgactttatacagaact

SEQ ID NO: 2085598 - DNA, 13 bp, Homo sapiens
cgagaacaacagt

SEQ ID NO: 2085599 - DNA, 19 bp, Homo sapiens
cgagaactcgaagcccttc

SEQ ID NO: 2085600 - DNA, 20 bp, Homo sapiens
cgagaactcgaagcccttcc

SEQ ID NO: 2085601 - DNA, 21 bp, Homo sapiens
cgagaactcgaagcccttcca

SEQ ID NO: 2085602 - DNA, 14 bp, Homo sapiens
cgagacacttgcct

SEQ ID NO: 2085603 - DNA, 18 bp, Homo sapiens
cgagaccatcctggcccc

SEQ ID NO: 2085604 - DNA, 19 bp, Homo sapiens
cgagacccttgcattagaa

SEQ ID NO: 2085605 - DNA, 15 bp, Homo sapiens
cgagacggctggacc

SEQ ID NO: 2085606 - DNA, 12 bp, Homo sapiens
cgagagaggcgc

SEQ ID NO: 2085607 - DNA, 13 bp, Homo sapiens
cgagagcctgctc

SEQ ID NO: 2085608 - DNA, 19 bp, Homo sapiens
cgagagcctgctcccccac

SEQ ID NO: 2085609 - DNA, 20 bp, Homo sapiens
cgagagcctgctcccccacc

SEQ ID NO: 2085610 - DNA, 13 bp, Homo sapiens
cgagaggtccctg

SEQ ID NO: 2085611 - DNA, 15 bp, Homo sapiens
cgagaggtccctgct

SEQ ID NO: 2085612 - DNA, 18 bp, Homo sapiens
cgagatcacgccactgca

SEQ ID NO: 2085613 - DNA, 20 bp, Homo sapiens
cgagatcacgccactgcact

SEQ ID NO: 2085614 - DNA, 14 bp, Homo sapiens
cgagcactggccag

SEQ ID NO: 2085615 - DNA, 15 bp, Homo sapiens
cgagcactggccaga

SEQ ID NO: 2085616 - DNA, 17 bp, Homo sapiens
cgagcactggccagaga

SEQ ID NO: 2085617 - DNA, 15 bp, Homo sapiens
cgagcagctgagcag

SEQ ID NO: 2085618 - DNA, 19 bp, Homo sapiens
cgagcagctgagcagggcc

SEQ ID NO: 2085619 - DNA, 15 bp, Homo sapiens
cgagcatcctggcca

SEQ ID NO: 2085620 - DNA, 12 bp, Homo sapiens
cgagcccagatg

SEQ ID NO: 2085621 - DNA, 15 bp, Homo sapiens
cgagccctggtggca

SEQ ID NO: 2085622 - DNA, 16 bp, Homo sapiens
cgagccctggtggcag

SEQ ID NO: 2085623 - DNA, 15 bp, Homo sapiens
cgagcctaatgaaag

SEQ ID NO: 2085624 - DNA, 14 bp, Homo sapiens
cgagcgccctgcag

SEQ ID NO: 2085625 - DNA, 19 bp, Homo sapiens
cgagcgctatcttcacata

SEQ ID NO: 2085626 - DNA, 18 bp, Homo sapiens
cgagcgctttctggaaaa

SEQ ID NO: 2085627 - DNA, 23 bp, Homo sapiens
cgagcgctttctggaaaagagga

SEQ ID NO: 2085628 - DNA, 22 bp, Homo sapiens
cgagctactctcttgccagcat

SEQ ID NO: 2085629 - DNA, 13 bp, Homo sapiens
cgaggacagggag

SEQ ID NO: 2085630 - DNA, 17 bp, Homo sapiens
cgaggagcttccagtgc

SEQ ID NO: 2085631 - DNA, 15 bp, Homo sapiens
cgaggcaccggcgct

SEQ ID NO: 2085632 - DNA, 19 bp, Homo sapiens
cgaggcaccggcgctgcag

SEQ ID NO: 2085633 - DNA, 22 bp, Homo sapiens
cgaggcaccggcgctgcaggta

SEQ ID NO: 2085634 - DNA, 21 bp, Homo sapiens
cgaggtcaacagagaaggcag

SEQ ID NO: 2085635 - DNA, 15 bp, Homo sapiens
cgcttcacccctgca

SEQ ID NO: 2085636 - DNA, 13 bp, Homo sapiens
cgcttccagacca

SEQ ID NO: 2085637 - DNA, 21 bp, Homo sapiens
cgcttccagaccacctgccag

SEQ ID NO: 2085638 - DNA, 13 bp, Homo sapiens
cgcttccccacag

SEQ ID NO: 2085639 - DNA, 15 bp, Homo sapiens
cgcttccccacagaa

SEQ ID NO: 2085640 - DNA, 17 bp, Homo sapiens
cgcttgcttctgcagca

SEQ ID NO: 2085641 - DNA, 21 bp, Homo sapiens
cgcttgcttctgcagcaactc

SEQ ID NO: 2085642 - DNA, 17 bp, Homo sapiens
cggaaaccttgcagcat

SEQ ID NO: 2085643 - DNA, 12 bp, Homo sapiens
cggaaatgaagg

SEQ ID NO: 2085644 - DNA, 21 bp, Homo sapiens
cggaagaagagatcaggaaga

SEQ ID NO: 2085645 - DNA, 22 bp, Homo sapiens
cggaagaagagatcaggaagag

SEQ ID NO: 2085646 - DNA, 14 bp, Homo sapiens
cggaagcagtgcct

SEQ ID NO: 2085647 - DNA, 22 bp, Homo sapiens
cggaagcagtgccttccataat

SEQ ID NO: 2085648 - DNA, 23 bp, Homo sapiens
cggaagcagtgccttccataatt

SEQ ID NO: 2085649 - DNA, 14 bp, Homo sapiens
cggaatagttggct

SEQ ID NO: 2085650 - DNA, 16 bp, Homo sapiens
cggaatagttggctag

SEQ ID NO: 2085651 - DNA, 17 bp, Homo sapiens
cggaatagttggctagg

SEQ ID NO: 2085652 - DNA, 19 bp, Homo sapiens
cggacagaatgatgccaaa

SEQ ID NO: 2085653 - DNA, 20 bp, Homo sapiens
cggacagccacggccaggcc

SEQ ID NO: 2085654 - DNA, 16 bp, Homo sapiens
cggacagtgcccatgc

SEQ ID NO: 2085655 - DNA, 22 bp, Homo sapiens
cggaccaagatgggcacatgag

SEQ ID NO: 2085656 - DNA, 13 bp, Homo sapiens
cggaccgcgtaga

SEQ ID NO: 2085657 - DNA, 20 bp, Homo sapiens
cggacgtcctgctggcacct

SEQ ID NO: 2085658 - DNA, 19 bp, Homo sapiens
cggacgttggttctgcact

SEQ ID NO: 2085659 - DNA, 23 bp, Homo sapiens
cggagaagagctgttcacagcca

SEQ ID NO: 2085660 - DNA, 14 bp, Homo sapiens
cggagaccctgagt

SEQ ID NO: 2085661 - DNA, 14 bp, Homo sapiens
cggagagggctgcg

SEQ ID NO: 2085662 - DNA, 14 bp, Homo sapiens
cggagcacagccct

SEQ ID NO: 2085663 - DNA, 15 bp, Homo sapiens
cggagcacagccctg

SEQ ID NO: 2085664 - DNA, 18 bp, Homo sapiens
cggagcacagccctggga

SEQ ID NO: 2085665 - DNA, 14 bp, Homo sapiens
cggagccccaggcc

SEQ ID NO: 2085666 - DNA, 22 bp, Homo sapiens
cggagccccaggcctctgtgtc

SEQ ID NO: 2085667 - DNA, 22 bp, Homo sapiens
cggagcctcatccgaggcaggg

SEQ ID NO: 2085668 - DNA, 17 bp, Homo sapiens
cggaggagaccagctca

SEQ ID NO: 2085669 - DNA, 18 bp, Homo sapiens
cggaggagaccagctcag

SEQ ID NO: 2085670 - DNA, 22 bp, Homo sapiens
cggaggagctccgctaagacct

SEQ ID NO: 2085671 - DNA, 16 bp, Homo sapiens
cggaggcggctccagg

SEQ ID NO: 2085672 - DNA, 19 bp, Homo sapiens
cggaggctgggcccctggg

SEQ ID NO: 2085673 - DNA, 20 bp, Homo sapiens
cctccagggaatccgcctgc

SEQ ID NO: 2085674 - DNA, 12 bp, Homo sapiens
cctccagggcca

SEQ ID NO: 2085675 - DNA, 18 bp, Homo sapiens
cctccagggccacgtgcc

SEQ ID NO: 2085676 - DNA, 19 bp, Homo sapiens
cctccagggccacgtgcca

SEQ ID NO: 2085677 - DNA, 20 bp, Homo sapiens
cctccagggccacgtgccag

SEQ ID NO: 2085678 - DNA, 21 bp, Homo sapiens
cctccagggccacgtgccagg

SEQ ID NO: 2085679 - DNA, 22 bp, Homo sapiens
cctccagggccacgtgccaggc

SEQ ID NO: 2085680 - DNA, 18 bp, Homo sapiens
cctccatcccgcccttcc

SEQ ID NO: 2085681 - DNA, 14 bp, Homo sapiens
cctccatgctgcct

SEQ ID NO: 2085682 - DNA, 15 bp, Homo sapiens
cctccatgctgcctc

SEQ ID NO: 2085683 - DNA, 13 bp, Homo sapiens
cctccatgggcta

SEQ ID NO: 2085684 - DNA, 18 bp, Homo sapiens
cctccatggtggaagggg

SEQ ID NO: 2085685 - DNA, 17 bp, Homo sapiens
cctccatttcaactcca

SEQ ID NO: 2085686 - DNA, 19 bp, Homo sapiens
cctccatttcaactccaga

SEQ ID NO: 2085687 - DNA, 20 bp, Homo sapiens
cctccatttcaactccagaa

SEQ ID NO: 2085688 - DNA, 24 bp, Homo sapiens
cctccatttctggcttctagtctg

SEQ ID NO: 2085689 - DNA, 16 bp, Homo sapiens
cctcccaaagtgctgg

SEQ ID NO: 2085690 - DNA, 16 bp, Homo sapiens
cctcccaacctcaatg

SEQ ID NO: 2085691 - DNA, 16 bp, Homo sapiens
cctcccaataaagctg

SEQ ID NO: 2085692 - DNA, 17 bp, Homo sapiens
cctcccaataaagctgg

SEQ ID NO: 2085693 - DNA, 17 bp, Homo sapiens
cctcccacactccccca

SEQ ID NO: 2085694 - DNA, 12 bp, Homo sapiens
cctcccacccca

SEQ ID NO: 2085695 - DNA, 13 bp, Homo sapiens
cctcccaccccac

SEQ ID NO: 2085696 - DNA, 17 bp, Homo sapiens
cctcccaccccactcca

SEQ ID NO: 2085697 - DNA, 13 bp, Homo sapiens
cctcccaccccca

SEQ ID NO: 2085698 - DNA, 16 bp, Homo sapiens
cctcccacccccagcc

SEQ ID NO: 2085699 - DNA, 12 bp, Homo sapiens
cctcccagatcc

SEQ ID NO: 2085700 - DNA, 16 bp, Homo sapiens
cctcccagccccaggg

SEQ ID NO: 2085701 - DNA, 12 bp, Homo sapiens
cctcccagccct

SEQ ID NO: 2085702 - DNA, 13 bp, Homo sapiens
cctcccagcccta

SEQ ID NO: 2085703 - DNA, 19 bp, Homo sapiens
cctcccagccctatggatg

SEQ ID NO: 2085704 - DNA, 12 bp, Homo sapiens
cctcccagcctg

SEQ ID NO: 2085705 - DNA, 22 bp, Homo sapiens
cctcccagttctacaagcatat

SEQ ID NO: 2085706 - DNA, 17 bp, Homo sapiens
cctcccatcccctggac

SEQ ID NO: 2085707 - DNA, 23 bp, Homo sapiens
cctccccacagtcctcacagcct

SEQ ID NO: 2085708 - DNA, 14 bp, Homo sapiens
cctccccaccttcc

SEQ ID NO: 2085709 - DNA, 19 bp, Homo sapiens
cctccccaccttccccaga

SEQ ID NO: 2085710 - DNA, 12 bp, Homo sapiens
cctccccagggg

SEQ ID NO: 2085711 - DNA, 23 bp, Homo sapiens
cctccccagtctacgttctccag

SEQ ID NO: 2085712 - DNA, 20 bp, Homo sapiens
cctccccattagagtcagcc

SEQ ID NO: 2085713 - DNA, 22 bp, Homo sapiens
cctccccattcacagagccttt

SEQ ID NO: 2085714 - DNA, 15 bp, Homo sapiens
cctcccccagagcca

SEQ ID NO: 2085715 - DNA, 13 bp, Homo sapiens
cctccccccactg

SEQ ID NO: 2085716 - DNA, 14 bp, Homo sapiens
cctccccccactgc

SEQ ID NO: 2085717 - DNA, 15 bp, Homo sapiens
cctccccccactgca

SEQ ID NO: 2085718 - DNA, 17 bp, Homo sapiens
cctccccccactgcagg

SEQ ID NO: 2085719 - DNA, 20 bp, Homo sapiens
cctccccccactgcaggccc

SEQ ID NO: 2085720 - DNA, 16 bp, Homo sapiens
cctccccccagcccct

SEQ ID NO: 2085721 - DNA, 14 bp, Homo sapiens
cctccccctgccag

SEQ ID NO: 2085722 - DNA, 15 bp, Homo sapiens
cctccccctgccagt

SEQ ID NO: 2085723 - DNA, 14 bp, Homo sapiens
cctccccctgctgc

SEQ ID NO: 2085724 - DNA, 15 bp, Homo sapiens
cctccccgcaccccc

SEQ ID NO: 2085725 - DNA, 21 bp, Homo sapiens
cctccccgcagtgggaagtga

SEQ ID NO: 2085726 - DNA, 13 bp, Homo sapiens
cctcccctatcca

SEQ ID NO: 2085727 - DNA, 15 bp, Homo sapiens
cctcccctatccacc

SEQ ID NO: 2085728 - DNA, 22 bp, Homo sapiens
cctcccctatccacccagccca

SEQ ID NO: 2085729 - DNA, 14 bp, Homo sapiens
cctcccctgcccta

SEQ ID NO: 2085730 - DNA, 18 bp, Homo sapiens
cctccccttcctgcaccc

SEQ ID NO: 2085731 - DNA, 17 bp, Homo sapiens
cctcccgagtagctggg

SEQ ID NO: 2085732 - DNA, 18 bp, Homo sapiens
cctcccgagtagctggga

SEQ ID NO: 2085733 - DNA, 20 bp, Homo sapiens
cctcccgagtagctgggact

SEQ ID NO: 2085734 - DNA, 13 bp, Homo sapiens
cctccctacctga

SEQ ID NO: 2085735 - DNA, 15 bp, Homo sapiens
cctccctactcccct

SEQ ID NO: 2085736 - DNA, 19 bp, Homo sapiens
cctccctccaccccaggac

SEQ ID NO: 2085737 - DNA, 14 bp, Homo sapiens
cctccctctccata

SEQ ID NO: 2085738 - DNA, 19 bp, Homo sapiens
cctccctctgacctgcagg

SEQ ID NO: 2085739 - DNA, 13 bp, Homo sapiens
cctccctctgccc

SEQ ID NO: 2085740 - DNA, 18 bp, Homo sapiens
cctccctcttccttcccc

SEQ ID NO: 2085741 - DNA, 20 bp, Homo sapiens
cctccctcttccttccccca

SEQ ID NO: 2085742 - DNA, 20 bp, Homo sapiens
cctccctgaaccatccctga

SEQ ID NO: 2085743 - DNA, 21 bp, Homo sapiens
cctccctgactccctgtgggg

SEQ ID NO: 2085744 - DNA, 18 bp, Homo sapiens
cctccctgcccctccctt

SEQ ID NO: 2085745 - DNA, 22 bp, Homo sapiens
cctccctgcccctcccttcaac

SEQ ID NO: 2085746 - DNA, 24 bp, Homo sapiens
cctccctgcccctcccttcaacca

SEQ ID NO: 2085747 - DNA, 14 bp, Homo sapiens
cctccctgccctgt

SEQ ID NO: 2085748 - DNA, 12 bp, Homo sapiens
cctccctgctac

SEQ ID NO: 2085749 - DNA, 12 bp, Homo sapiens
cctccctggcct

SEQ ID NO: 2085750 - DNA, 13 bp, Homo sapiens
cctccctggcctc

SEQ ID NO: 2085751 - DNA, 24 bp, Homo sapiens
cctccctggcctcacgcccagcct

SEQ ID NO: 2085752 - DNA, 16 bp, Homo sapiens
cctccctgtcctcctc

SEQ ID NO: 2085753 - DNA, 12 bp, Homo sapiens
cctccgccccag

SEQ ID NO: 2085754 - DNA, 16 bp, Homo sapiens
cctccgccccagacac

SEQ ID NO: 2085755 - DNA, 13 bp, Homo sapiens
cctccgcctcttg

SEQ ID NO: 2085756 - DNA, 19 bp, Homo sapiens
cctccgccttcactccggt

SEQ ID NO: 2085757 - DNA, 14 bp, Homo sapiens
cctccgtcaggaga

SEQ ID NO: 2085758 - DNA, 15 bp, Homo sapiens
cctccgtccacccag

SEQ ID NO: 2085759 - DNA, 16 bp, Homo sapiens
cctccgtccacccagg

SEQ ID NO: 2085760 - DNA, 17 bp, Homo sapiens
cctccgtccacccaggc

SEQ ID NO: 2085761 - DNA, 19 bp, Homo sapiens
cctccgtccacccaggctg

SEQ ID NO: 2085762 - DNA, 18 bp, Homo sapiens
cctccgtccaggagcctg

SEQ ID NO: 2085763 - DNA, 16 bp, Homo sapiens
cctccgtctgcaatgt

SEQ ID NO: 2085764 - DNA, 22 bp, Homo sapiens
cctccgtttatgggccttgctt

SEQ ID NO: 2085765 - DNA, 15 bp, Homo sapiens
cctcctaagcagctg

SEQ ID NO: 2085766 - DNA, 21 bp, Homo sapiens
cctcctaagcagctgggacta

SEQ ID NO: 2085767 - DNA, 21 bp, Homo sapiens
cctcctacagcactccacctt

SEQ ID NO: 2085768 - DNA, 18 bp, Homo sapiens
cctcctagaggtgggcag

SEQ ID NO: 2085769 - DNA, 23 bp, Homo sapiens
cctcctatccttggagagcagct

SEQ ID NO: 2085770 - DNA, 13 bp, Homo sapiens
cctcctcaccccc

SEQ ID NO: 2085771 - DNA, 15 bp, Homo sapiens
cctcctcaccccgtc

SEQ ID NO: 2085772 - DNA, 17 bp, Homo sapiens
cctcctccccttcctgc

SEQ ID NO: 2085773 - DNA, 12 bp, Homo sapiens
cctcctcctgac

SEQ ID NO: 2085774 - DNA, 12 bp, Homo sapiens
cctcctctgcca

SEQ ID NO: 2085775 - DNA, 13 bp, Homo sapiens
cctcctctgccac

SEQ ID NO: 2085776 - DNA, 15 bp, Homo sapiens
cctcctctgccacct

SEQ ID NO: 2085777 - DNA, 18 bp, Homo sapiens
cctcctctgccacctccc

SEQ ID NO: 2085778 - DNA, 20 bp, Homo sapiens
cctcctctgccacctcccct

SEQ ID NO: 2085779 - DNA, 17 bp, Homo sapiens
cctcctctggcccagcc

SEQ ID NO: 2085780 - DNA, 19 bp, Homo sapiens
cctcctctggcccagccta

SEQ ID NO: 2085781 - DNA, 18 bp, Homo sapiens
cctcctctgtccagggcc

SEQ ID NO: 2085782 - DNA, 16 bp, Homo sapiens
cgtggctgtggcacag

SEQ ID NO: 2085783 - DNA, 18 bp, Homo sapiens
cgtggcttcccgctcagc

SEQ ID NO: 2085784 - DNA, 21 bp, Homo sapiens
cgtggcttcccgctcagccct

SEQ ID NO: 2085785 - DNA, 15 bp, Homo sapiens
cgtggtagaagccag

SEQ ID NO: 2085786 - DNA, 17 bp, Homo sapiens
cgtggtctccttgcact

SEQ ID NO: 2085787 - DNA, 12 bp, Homo sapiens
cgtggtctttga

SEQ ID NO: 2085788 - DNA, 15 bp, Homo sapiens
cgtggtctttgaata

SEQ ID NO: 2085789 - DNA, 21 bp, Homo sapiens
cgtggtctttgaataaagtct

SEQ ID NO: 2085790 - DNA, 22 bp, Homo sapiens
cgtggtctttgaataaagtctg

SEQ ID NO: 2085791 - DNA, 23 bp, Homo sapiens
cgtggtctttgaataaagtctga

SEQ ID NO: 2085792 - DNA, 13 bp, Homo sapiens
cgtggttccaaga

SEQ ID NO: 2085793 - DNA, 21 bp, Homo sapiens
cgtgtagtggaagagcagcct

SEQ ID NO: 2085794 - DNA, 16 bp, Homo sapiens
cgtgtcatgagagaat

SEQ ID NO: 2085795 - DNA, 12 bp, Homo sapiens
cgtgtccagcac

SEQ ID NO: 2085796 - DNA, 14 bp, Homo sapiens
cgtgtccagcacag

SEQ ID NO: 2085797 - DNA, 15 bp, Homo sapiens
cgtgtccctctcgga

SEQ ID NO: 2085798 - DNA, 12 bp, Homo sapiens
cgtgtcctgcct

SEQ ID NO: 2085799 - DNA, 13 bp, Homo sapiens
cgtgtctctccca

SEQ ID NO: 2085800 - DNA, 14 bp, Homo sapiens
cgtgtgcagactgt

SEQ ID NO: 2085801 - DNA, 17 bp, Homo sapiens
cgtgtgcagactgtggc

SEQ ID NO: 2085802 - DNA, 18 bp, Homo sapiens
cgtgtgcagactgtggct

SEQ ID NO: 2085803 - DNA, 19 bp, Homo sapiens
cgtgttagtgtgtgtgcat

SEQ ID NO: 2085804 - DNA, 20 bp, Homo sapiens
cgtgttagtgtgtgtgcatg

SEQ ID NO: 2085805 - DNA, 22 bp, Homo sapiens
cgtgttagtgtgtgtgcatgtg

SEQ ID NO: 2085806 - DNA, 19 bp, Homo sapiens
cgtgtttacaaaaggcagc

SEQ ID NO: 2085807 - DNA, 14 bp, Homo sapiens
cgttatatattgta

SEQ ID NO: 2085808 - DNA, 15 bp, Homo sapiens
cgttatatattgtat

SEQ ID NO: 2085809 - DNA, 19 bp, Homo sapiens
cgttcaacttttcctttga

SEQ ID NO: 2085810 - DNA, 13 bp, Homo sapiens
cgttccctgtcag

SEQ ID NO: 2085811 - DNA, 18 bp, Homo sapiens
cgttccctgtcagaggct

SEQ ID NO: 2085812 - DNA, 15 bp, Homo sapiens
cgttctgctgcccct

SEQ ID NO: 2085813 - DNA, 19 bp, Homo sapiens
cgttctgctgcccctgcag

SEQ ID NO: 2085814 - DNA, 18 bp, Homo sapiens
cgttctgctggcctggat

SEQ ID NO: 2085815 - DNA, 15 bp, Homo sapiens
cgttgacccctttcc

SEQ ID NO: 2085816 - DNA, 23 bp, Homo sapiens
cgttggaatcacctggagggctt

SEQ ID NO: 2085817 - DNA, 11 bp, Homo sapiens
cgttgtgaggg

SEQ ID NO: 2085818 - DNA, 19 bp, Homo sapiens
cgtttagtttctagaggcc

SEQ ID NO: 2085819 - DNA, 15 bp, Homo sapiens
cgtttggcatttctc

SEQ ID NO: 2085820 - DNA, 17 bp, Homo sapiens
cgttttcatcctggcct

SEQ ID NO: 2085821 - DNA, 22 bp, Homo sapiens
cgtttttgtgctgtgggcagca

SEQ ID NO: 2085822 - DNA, 17 bp, Homo sapiens
ctaaaaaacagaggcca

SEQ ID NO: 2085823 - DNA, 20 bp, Homo sapiens
ctaaaaacatttactgacca

SEQ ID NO: 2085824 - DNA, 14 bp, Homo sapiens
ctaaaaataaaatg

SEQ ID NO: 2085825 - DNA, 18 bp, Homo sapiens
ctaaaaataaaatgatgt

SEQ ID NO: 2085826 - DNA, 15 bp, Homo sapiens
ctaaaacctgagcta

SEQ ID NO: 2085827 - DNA, 22 bp, Homo sapiens
ctaaaactatggttcccaataa

SEQ ID NO: 2085828 - DNA, 13 bp, Homo sapiens
ctaaaagaaactt

SEQ ID NO: 2085829 - DNA, 10 bp, Homo sapiens
ctaaaagaat

SEQ ID NO: 2085830 - DNA, 14 bp, Homo sapiens
ctaaaagtaaacat

SEQ ID NO: 2085831 - DNA, 13 bp, Homo sapiens
ctaaaataaaaac

SEQ ID NO: 2085832 - DNA, 16 bp, Homo sapiens
ctaaaataaaaaccag

SEQ ID NO: 2085833 - DNA, 18 bp, Homo sapiens
ctaaaataaaaaccagaa

SEQ ID NO: 2085834 - DNA, 23 bp, Homo sapiens
ctaaaatatttattttttttaag

SEQ ID NO: 2085835 - DNA, 24 bp, Homo sapiens
ctaaaatttttctagaagatatca

SEQ ID NO: 2085836 - DNA, 18 bp, Homo sapiens
ctaaacagactatttaac

SEQ ID NO: 2085837 - DNA, 13 bp, Homo sapiens
ctaaacagatata

SEQ ID NO: 2085838 - DNA, 17 bp, Homo sapiens
ctaaacattttgttatt

SEQ ID NO: 2085839 - DNA, 15 bp, Homo sapiens
ctaaacccaaataaa

SEQ ID NO: 2085840 - DNA, 17 bp, Homo sapiens
ctaaacccaaataaatg

SEQ ID NO: 2085841 - DNA, 21 bp, Homo sapiens
ctaaacgactccgagaacaac

SEQ ID NO: 2085842 - DNA, 13 bp, Homo sapiens
ctaaagaaaaaca

SEQ ID NO: 2085843 - DNA, 14 bp, Homo sapiens
ctaaagcagtgttt

SEQ ID NO: 2085844 - DNA, 21 bp, Homo sapiens
ctaaagctctgaacaaaagct

SEQ ID NO: 2085845 - DNA, 18 bp, Homo sapiens
ctaaagctggtttaatgt

SEQ ID NO: 2085846 - DNA, 20 bp, Homo sapiens
ctaaagtatgtaaagtatgt

SEQ ID NO: 2085847 - DNA, 18 bp, Homo sapiens
ctaaagtgcctaccccag

SEQ ID NO: 2085848 - DNA, 23 bp, Homo sapiens
ctaaataaagcttgcaacaaaat

SEQ ID NO: 2085849 - DNA, 16 bp, Homo sapiens
ctacccactctttgct

SEQ ID NO: 2085850 - DNA, 23 bp, Homo sapiens
ctacccactctttgctacaataa

SEQ ID NO: 2085851 - DNA, 14 bp, Homo sapiens
ctacccacttctaa

SEQ ID NO: 2085852 - DNA, 21 bp, Homo sapiens
ctacccagagattgcttctca

SEQ ID NO: 2085853 - DNA, 18 bp, Homo sapiens
ctacccagagccttctcc

SEQ ID NO: 2085854 - DNA, 18 bp, Homo sapiens
ctacccagcgagccctgg

SEQ ID NO: 2085855 - DNA, 19 bp, Homo sapiens
ctacccagcgagccctggt

SEQ ID NO: 2085856 - DNA, 14 bp, Homo sapiens
ctaccccaccacga

SEQ ID NO: 2085857 - DNA, 16 bp, Homo sapiens
ctaccccccaaaaaaa

SEQ ID NO: 2085858 - DNA, 21 bp, Homo sapiens
ctaccccccctcctgctgcct

SEQ ID NO: 2085859 - DNA, 20 bp, Homo sapiens
ctacccgagcccagctacat

SEQ ID NO: 2085860 - DNA, 17 bp, Homo sapiens
ctacccgcatcttctgt

SEQ ID NO: 2085861 - DNA, 16 bp, Homo sapiens
ctacccggcccagaga

SEQ ID NO: 2085862 - DNA, 18 bp, Homo sapiens
ctacccttgtaccccatc

SEQ ID NO: 2085863 - DNA, 22 bp, Homo sapiens
ctacccttgttagttattttag

SEQ ID NO: 2085864 - DNA, 17 bp, Homo sapiens
ctaccgagtctcttctc

SEQ ID NO: 2085865 - DNA, 23 bp, Homo sapiens
ctaccgagtctcttctccactgg

SEQ ID NO: 2085866 - DNA, 13 bp, Homo sapiens
ctacctctttgtc

SEQ ID NO: 2085867 - DNA, 12 bp, Homo sapiens
ctacctgccctc

SEQ ID NO: 2085868 - DNA, 14 bp, Homo sapiens
ctacctgccctctc

SEQ ID NO: 2085869 - DNA, 21 bp, Homo sapiens
ctacctgccctctctcagtta

SEQ ID NO: 2085870 - DNA, 13 bp, Homo sapiens
ctacctgtgcctg

SEQ ID NO: 2085871 - DNA, 11 bp, Homo sapiens
ctacctgtgtg

SEQ ID NO: 2085872 - DNA, 19 bp, Homo sapiens
ctacctgtgttcattctta

SEQ ID NO: 2085873 - DNA, 20 bp, Homo sapiens
ctacctttttttctctccta

SEQ ID NO: 2085874 - DNA, 22 bp, Homo sapiens
ctacgccaaagtgcagcccttc

SEQ ID NO: 2085875 - DNA, 14 bp, Homo sapiens
ctacgctctccttt

SEQ ID NO: 2085876 - DNA, 21 bp, Homo sapiens
ctacgctctcctttctttcta

SEQ ID NO: 2085877 - DNA, 16 bp, Homo sapiens
ctacgtataaatatga

SEQ ID NO: 2085878 - DNA, 19 bp, Homo sapiens
ctacgtataaatatgaaat

SEQ ID NO: 2085879 - DNA, 21 bp, Homo sapiens
ctacgtataaatatgaaatga

SEQ ID NO: 2085880 - DNA, 16 bp, Homo sapiens
ctacgttctccagccc

SEQ ID NO: 2085881 - DNA, 18 bp, Homo sapiens
ctactaaagtgcctaccc

SEQ ID NO: 2085882 - DNA, 16 bp, Homo sapiens
ctactacccgagccca

SEQ ID NO: 2085883 - DNA, 19 bp, Homo sapiens
ctactacccgagcccagct

SEQ ID NO: 2085884 - DNA, 22 bp, Homo sapiens
ctactagttttccttgaaaaaa

SEQ ID NO: 2085885 - DNA, 12 bp, Homo sapiens
ctactattctgt

SEQ ID NO: 2085886 - DNA, 16 bp, Homo sapiens
ctactcaagaggctga

SEQ ID NO: 2085887 - DNA, 23 bp, Homo sapiens
ctactcacacaggcatttcctgg

SEQ ID NO: 2085888 - DNA, 16 bp, Homo sapiens
ctactcagaagcctga

SEQ ID NO: 2085889 - DNA, 17 bp, Homo sapiens
ctactcagaagcctgag

SEQ ID NO: 2085890 - DNA, 19 bp, Homo sapiens
ctactcagaagcctgaggc

SEQ ID NO: 2085891 - DNA, 16 bp, Homo sapiens
ctactcagcagccctc

SEQ ID NO: 2085892 - DNA, 18 bp, Homo sapiens
ctactcagcagccctcct

SEQ ID NO: 2085893 - DNA, 21 bp, Homo sapiens
ctactcagcagccctcctcac

SEQ ID NO: 2085894 - DNA, 22 bp, Homo sapiens
ctactcagcagccctcctcacc

SEQ ID NO: 2085895 - DNA, 21 bp, Homo sapiens
ctactcatacttaagcaaaag

SEQ ID NO: 2085896 - DNA, 14 bp, Homo sapiens
ctactcattgtctc

SEQ ID NO: 2085897 - DNA, 19 bp, Homo sapiens
ctactcattgtctcagtgc

SEQ ID NO: 2085898 - DNA, 17 bp, Homo sapiens
ctactcctacctcagcc

SEQ ID NO: 2085899 - DNA, 14 bp, Homo sapiens
ctactcctgtgctc

SEQ ID NO: 2085900 - DNA, 17 bp, Homo sapiens
ctactctcctcggcccc

SEQ ID NO: 2085901 - DNA, 15 bp, Homo sapiens
ctactctcttgccag

SEQ ID NO: 2085902 - DNA, 13 bp, Homo sapiens
ctactctgtccag

SEQ ID NO: 2085903 - DNA, 19 bp, Homo sapiens
ctactctgtccaggccact

SEQ ID NO: 2085904 - DNA, 20 bp, Homo sapiens
ctactctgtccaggccactg

SEQ ID NO: 2085905 - DNA, 18 bp, Homo sapiens
ctactctgtgccagagcc

SEQ ID NO: 2085906 - DNA, 19 bp, Homo sapiens
ctactctgtgccagagcct

SEQ ID NO: 2085907 - DNA, 22 bp, Homo sapiens
ctactgactgatgacaaaccca

SEQ ID NO: 2085908 - DNA, 16 bp, Homo sapiens
ctactgctgcaaagtg

SEQ ID NO: 2085909 - DNA, 15 bp, Homo sapiens
ctactggcattaatt

SEQ ID NO: 2085910 - DNA, 19 bp, Homo sapiens
ctactggcattaattatta

SEQ ID NO: 2085911 - DNA, 19 bp, Homo sapiens
ctactgggaaattacttat

SEQ ID NO: 2085912 - DNA, 14 bp, Homo sapiens
ctactgggaaggct

SEQ ID NO: 2085913 - DNA, 17 bp, Homo sapiens
ctactggtcttgtggaa

SEQ ID NO: 2085914 - DNA, 14 bp, Homo sapiens
ctactgtaaatgta

SEQ ID NO: 2085915 - DNA, 15 bp, Homo sapiens
ctactgtaattaagt

SEQ ID NO: 2085916 - DNA, 18 bp, Homo sapiens
ctactgtaattaagtgca

SEQ ID NO: 2085917 - DNA, 19 bp, Homo sapiens
ctactgtcctacccaccct

SEQ ID NO: 2085918 - DNA, 18 bp, Homo sapiens
ctactgtggaaaaatatt

SEQ ID NO: 2085919 - DNA, 20 bp, Homo sapiens
ctactgtggaaaaatattta

SEQ ID NO: 2085920 - DNA, 22 bp, Homo sapiens
ctacttacatgcattactgcat

SEQ ID NO: 2085921 - DNA, 23 bp, Homo sapiens
ctacttcattttcagagtgacac

SEQ ID NO: 2085922 - DNA, 17 bp, Homo sapiens
ctacttcttggaaaaaa

SEQ ID NO: 2085923 - DNA, 22 bp, Homo sapiens
ctacttcttttgctcttagctg

SEQ ID NO: 2085924 - DNA, 14 bp, Homo sapiens
ctacttctttttct

SEQ ID NO: 2085925 - DNA, 12 bp, Homo sapiens
ctacttgggagg

SEQ ID NO: 2085926 - DNA, 17 bp, Homo sapiens
ctacttgtgactgaagg

SEQ ID NO: 2085927 - DNA, 19 bp, Homo sapiens
ctacttgttacctttccca

SEQ ID NO: 2085928 - DNA, 18 bp, Homo sapiens
ctactttgtctaaaaata

SEQ ID NO: 2085929 - DNA, 13 bp, Homo sapiens
ctacttttcagaa

SEQ ID NO: 2085930 - DNA, 22 bp, Homo sapiens
ctacttttgtaccagtgtgaat

SEQ ID NO: 2085931 - DNA, 13 bp, Homo sapiens
ctagaaatatgat

SEQ ID NO: 2085932 - DNA, 15 bp, Homo sapiens
ctagaacacccactg

SEQ ID NO: 2085933 - DNA, 16 bp, Homo sapiens
ctagaacacccactgg

SEQ ID NO: 2085934 - DNA, 17 bp, Homo sapiens
ctagaacacccactggc

SEQ ID NO: 2085935 - DNA, 18 bp, Homo sapiens
ctagaacacccactggcc

SEQ ID NO: 2085936 - DNA, 19 bp, Homo sapiens
ctagaacacccactggcca

SEQ ID NO: 2085937 - DNA, 21 bp, Homo sapiens
ctagaacacccactggccagt

SEQ ID NO: 2085938 - DNA, 15 bp, Homo sapiens
ctagaacatgcacat

SEQ ID NO: 2085939 - DNA, 17 bp, Homo sapiens
ctagaaccaagcttcag

SEQ ID NO: 2085940 - DNA, 23 bp, Homo sapiens
ctagaaccaagcttcagagccta

SEQ ID NO: 2085941 - DNA, 17 bp, Homo sapiens
ctagaacctagaagggc

SEQ ID NO: 2085942 - DNA, 17 bp, Homo sapiens
ctagaacttcaaaatgt

SEQ ID NO: 2085943 - DNA, 21 bp, Homo sapiens
ctagaagcggtttccaggcca

SEQ ID NO: 2085944 - DNA, 19 bp, Homo sapiens
ctagaaggccacatgtcac

SEQ ID NO: 2085945 - DNA, 20 bp, Homo sapiens
ctagaagtgggccaggacag

SEQ ID NO: 2085946 - DNA, 22 bp, Homo sapiens
ctagaatagccatgtactataa

SEQ ID NO: 2085947 - DNA, 18 bp, Homo sapiens
ctagaatggtagcactac

SEQ ID NO: 2085948 - DNA, 12 bp, Homo sapiens
ctagaatttatt

SEQ ID NO: 2085949 - DNA, 13 bp, Homo sapiens
ctagaatttattc

SEQ ID NO: 2085950 - DNA, 19 bp, Homo sapiens
ctagacctgggccaaaagg

SEQ ID NO: 2085951 - DNA, 21 bp, Homo sapiens
ctagactaattaaaatctgga

SEQ ID NO: 2085952 - DNA, 20 bp, Homo sapiens
ctagactaggaggttccggt

SEQ ID NO: 2085953 - DNA, 14 bp, Homo sapiens
ctagactggagtga

SEQ ID NO: 2085954 - DNA, 12 bp, Homo sapiens
ctagactttctg

SEQ ID NO: 2085955 - DNA, 14 bp, Homo sapiens
ctagactttctgtt

SEQ ID NO: 2085956 - DNA, 15 bp, Homo sapiens
ctagagaagaggctg

SEQ ID NO: 2085957 - DNA, 17 bp, Homo sapiens
ctagagagcagaaataa

SEQ ID NO: 2085958 - DNA, 20 bp, Homo sapiens
ctagagaggctggcaaggag

SEQ ID NO: 2085959 - DNA, 16 bp, Homo sapiens
ctagagcaacccctgt

SEQ ID NO: 2085960 - DNA, 21 bp, Homo sapiens
ctagagcaacccctgtaccca

SEQ ID NO: 2085961 - DNA, 22 bp, Homo sapiens
ctagagcaacccctgtacccag

SEQ ID NO: 2085962 - DNA, 23 bp, Homo sapiens
ctagagcaacccctgtacccagc

SEQ ID NO: 2085963 - DNA, 22 bp, Homo sapiens
ctagagctcctgtccctaccca

SEQ ID NO: 2085964 - DNA, 22 bp, Homo sapiens
ctagagctttctttcacaaaaa

SEQ ID NO: 2085965 - DNA, 14 bp, Homo sapiens
ctagaggcagggag

SEQ ID NO: 2085966 - DNA, 15 bp, Homo sapiens
ctagaggcagggagg

SEQ ID NO: 2085967 - DNA, 12 bp, Homo sapiens
ctagaggcctca

SEQ ID NO: 2085968 - DNA, 23 bp, Homo sapiens
ctagaggcttccttcatttcctc

SEQ ID NO: 2085969 - DNA, 15 bp, Homo sapiens
ctagaggtgagaaat

SEQ ID NO: 2085970 - DNA, 17 bp, Homo sapiens
ctagaggtgagaaattt

SEQ ID NO: 2085971 - DNA, 15 bp, Homo sapiens
ctagaggtgggcagc

SEQ ID NO: 2085972 - DNA, 20 bp, Homo sapiens
ctagaggtgggcagctgggc

SEQ ID NO: 2085973 - DNA, 19 bp, Homo sapiens
ctagatcaaggagcccaga

SEQ ID NO: 2085974 - DNA, 21 bp, Homo sapiens
ctagatctcctgtaattttgt

SEQ ID NO: 2085975 - DNA, 21 bp, Homo sapiens
ctagcagagtgaggatgtgtt

SEQ ID NO: 2085976 - DNA, 14 bp, Homo sapiens
ctagcagctgcagt

SEQ ID NO: 2085977 - DNA, 15 bp, Homo sapiens
ctagcaggcacagga

SEQ ID NO: 2085978 - DNA, 16 bp, Homo sapiens
ctagcaggcacaggac

SEQ ID NO: 2085979 - DNA, 15 bp, Homo sapiens
ctagcattttcttga

SEQ ID NO: 2085980 - DNA, 18 bp, Homo sapiens
ctagcattttcttgaacc

SEQ ID NO: 2085981 - DNA, 23 bp, Homo sapiens
ctagccaaggctagttcctttca

SEQ ID NO: 2085982 - DNA, 19 bp, Homo sapiens
ctagccacctcccacccca

SEQ ID NO: 2085983 - DNA, 14 bp, Homo sapiens
ctagccaggagtct

SEQ ID NO: 2085984 - DNA, 17 bp, Homo sapiens
ctagccaggagtctgtg

SEQ ID NO: 2085985 - DNA, 19 bp, Homo sapiens
ctagccaggagtctgtgct

SEQ ID NO: 2085986 - DNA, 20 bp, Homo sapiens
ctagccaggagtctgtgctc

SEQ ID NO: 2085987 - DNA, 21 bp, Homo sapiens
ctagccaggagtctgtgctct

SEQ ID NO: 2085988 - DNA, 17 bp, Homo sapiens
ctagcccagtgcttctc

SEQ ID NO: 2085989 - DNA, 18 bp, Homo sapiens
ctagccctctcacattta

SEQ ID NO: 2085990 - DNA, 13 bp, Homo sapiens
ctagccgacctca

SEQ ID NO: 2085991 - DNA, 16 bp, Homo sapiens
ctagccgacctcagcc

SEQ ID NO: 2085992 - DNA, 17 bp, Homo sapiens
ctagccgacctcagcct

SEQ ID NO: 2085993 - DNA, 18 bp, Homo sapiens
ctagccggccactttgga

SEQ ID NO: 2085994 - DNA, 16 bp, Homo sapiens
ctagccgggccatgct

SEQ ID NO: 2085995 - DNA, 22 bp, Homo sapiens
ctagccttaatcaggtcctcag

SEQ ID NO: 2085996 - DNA, 19 bp, Homo sapiens
ctagccttgaggagtgtga

SEQ ID NO: 2085997 - DNA, 16 bp, Homo sapiens
ctagcgctctcttcca

SEQ ID NO: 2085998 - DNA, 16 bp, Homo sapiens
ctagcgctgccgcacc

SEQ ID NO: 2085999 - DNA, 22 bp, Homo sapiens
ctagcgctgccgcaccccagag

SEQ ID NO: 2086000 - DNA, 14 bp, Homo sapiens
ctagctagaaatat

SEQ ID NO: 2086001 - DNA, 15 bp, Homo sapiens
ctagctagaaatatg

SEQ ID NO: 2086002 - DNA, 16 bp, Homo sapiens
ctagctagaaatatga

SEQ ID NO: 2086003 - DNA, 20 bp, Homo sapiens
ctagctccaccctcaccagg

SEQ ID NO: 2086004 - DNA, 18 bp, Homo sapiens
ctagctgatcagaatttt

SEQ ID NO: 2086005 - DNA, 14 bp, Homo sapiens
ctagctggcaggac

SEQ ID NO: 2086006 - DNA, 15 bp, Homo sapiens
ctagctggcaggaca

SEQ ID NO: 2086007 - DNA, 22 bp, Homo sapiens
ctagctggcaggacacatcccg

SEQ ID NO: 2086008 - DNA, 20 bp, Homo sapiens
ctagctgggcaaacccttct

SEQ ID NO: 2086009 - DNA, 21 bp, Homo sapiens
ctagctgggcaaacccttctc

SEQ ID NO: 2086010 - DNA, 21 bp, Homo sapiens
ctagcttcatgcctcagtttc

SEQ ID NO: 2086011 - DNA, 23 bp, Homo sapiens
ctagcttcatgcctcagtttccc

SEQ ID NO: 2086012 - DNA, 14 bp, Homo sapiens
ctaggaaagcagtg

SEQ ID NO: 2086013 - DNA, 22 bp, Homo sapiens
ctaggacctcaggcggggagga

SEQ ID NO: 2086014 - DNA, 12 bp, Homo sapiens
ctaggactgagg

SEQ ID NO: 2086015 - DNA, 13 bp, Homo sapiens
ctaggactgagga

SEQ ID NO: 2086016 - DNA, 13 bp, Homo sapiens
ctaggagaagcag

SEQ ID NO: 2086017 - DNA, 20 bp, Homo sapiens
ctaggagaagcagcctccta

SEQ ID NO: 2086018 - DNA, 20 bp, Homo sapiens
ctaggagaccaaggcgggag

SEQ ID NO: 2086019 - DNA, 20 bp, Homo sapiens
ctaggagcaaagcctgttca

SEQ ID NO: 2086020 - DNA, 18 bp, Homo sapiens
ctaggaggccttctcgca

SEQ ID NO: 2086021 - DNA, 13 bp, Homo sapiens
ctaggaggttccg

SEQ ID NO: 2086022 - DNA, 22 bp, Homo sapiens
ctaggagttgagtacagtgagg

SEQ ID NO: 2086023 - DNA, 22 bp, Homo sapiens
ctaggatgtgcattctccagcc

SEQ ID NO: 2086024 - DNA, 17 bp, Homo sapiens
ctaggattcctccccca

SEQ ID NO: 2086025 - DNA, 22 bp, Homo sapiens
ctaggattcctcccccagagcc

SEQ ID NO: 2086026 - DNA, 15 bp, Homo sapiens
ctaggcatcccaggg

SEQ ID NO: 2086027 - DNA, 19 bp, Homo sapiens
ctaggccaaatgcacaagc

SEQ ID NO: 2086028 - DNA, 17 bp, Homo sapiens
ctaggccactcctccaa

SEQ ID NO: 2086029 - DNA, 19 bp, Homo sapiens
ctaggccactcctccaaag

SEQ ID NO: 2086030 - DNA, 19 bp, Homo sapiens
ctaggccatttgtatttgt

SEQ ID NO: 2086031 - DNA, 14 bp, Homo sapiens
ctaggccccagagc

SEQ ID NO: 2086032 - DNA, 12 bp, Homo sapiens
ctaggccgggcg

SEQ ID NO: 2086033 - DNA, 18 bp, Homo sapiens
ctaggcctggccagatgc

SEQ ID NO: 2086034 - DNA, 13 bp, Homo sapiens
ctaggctgttttc

SEQ ID NO: 2086035 - DNA, 16 bp, Homo sapiens
ctaggctgttttctcc

SEQ ID NO: 2086036 - DNA, 23 bp, Homo sapiens
ctaggcttcagcatatttatagc

SEQ ID NO: 2086037 - DNA, 15 bp, Homo sapiens
ctagggagagaccct

SEQ ID NO: 2086038 - DNA, 11 bp, Homo sapiens
ctagggctgga

SEQ ID NO: 2086039 - DNA, 17 bp, Homo sapiens
ctagggtcctggccctc

SEQ ID NO: 2086040 - DNA, 16 bp, Homo sapiens
ctaggtcctggcttct

SEQ ID NO: 2086041 - DNA, 13 bp, Homo sapiens
ctaggtgctggat

SEQ ID NO: 2086042 - DNA, 14 bp, Homo sapiens
ctaggtgctggatg

SEQ ID NO: 2086043 - DNA, 21 bp, Homo sapiens
ctagtaatgggccaattaaaa

SEQ ID NO: 2086044 - DNA, 16 bp, Homo sapiens
ctagtactctctgctc

SEQ ID NO: 2086045 - DNA, 21 bp, Homo sapiens
ctagtatattagtttgattta

SEQ ID NO: 2086046 - DNA, 13 bp, Homo sapiens
ctagtcataacct

SEQ ID NO: 2086047 - DNA, 14 bp, Homo sapiens
ctagtccagtgacc

SEQ ID NO: 2086048 - DNA, 18 bp, Homo sapiens
ctagtcctattctattgc

SEQ ID NO: 2086049 - DNA, 21 bp, Homo sapiens
ctagtctcctttgcactgagg

SEQ ID NO: 2086050 - DNA, 23 bp, Homo sapiens
ctagtctcctttgcactgagggc

SEQ ID NO: 2086051 - DNA, 19 bp, Homo sapiens
ctagtctggtgttctgagt

SEQ ID NO: 2086052 - DNA, 21 bp, Homo sapiens
ctagtctggtgttctgagtac

SEQ ID NO: 2086053 - DNA, 23 bp, Homo sapiens
ctagtcttgctttgctgtctggt

SEQ ID NO: 2086054 - DNA, 18 bp, Homo sapiens
ctagtgaaagaggcagct

SEQ ID NO: 2086055 - DNA, 18 bp, Homo sapiens
ctagtgacttcctggtga

SEQ ID NO: 2086056 - DNA, 15 bp, Homo sapiens
ctagtggcttcaaaa

SEQ ID NO: 2086057 - DNA, 18 bp, Homo sapiens
ctagtggggtctccctct

SEQ ID NO: 2086058 - DNA, 23 bp, Homo sapiens
ctagtggggtctccctctcctgc

SEQ ID NO: 2086059 - DNA, 16 bp, Homo sapiens
ctagtgtaacactgca

SEQ ID NO: 2086060 - DNA, 21 bp, Homo sapiens
ctagtgtaacactgcaagaag

SEQ ID NO: 2086061 - DNA, 14 bp, Homo sapiens
ctagtgttgcttgg

SEQ ID NO: 2086062 - DNA, 16 bp, Homo sapiens
ctagtttcagtaaata

SEQ ID NO: 2086063 - DNA, 18 bp, Homo sapiens
ctagtttctttctgttat

SEQ ID NO: 2086064 - DNA, 15 bp, Homo sapiens
ctagttttcagcctt

SEQ ID NO: 2086065 - DNA, 19 bp, Homo sapiens
ctagttttcagccttggga

SEQ ID NO: 2086066 - DNA, 20 bp, Homo sapiens
ctagttttccttgaaaaaaa

SEQ ID NO: 2086067 - DNA, 17 bp, Homo sapiens
ctagttttctcctccca

SEQ ID NO: 2086068 - DNA, 18 bp, Homo sapiens
ctagttttctcctcccag

SEQ ID NO: 2086069 - DNA, 20 bp, Homo sapiens
ctagttttctcctcccagga

SEQ ID NO: 2086070 - DNA, 16 bp, Homo sapiens
ctagttttttttgtaa

SEQ ID NO: 2086071 - DNA, 18 bp, Homo sapiens
ctagttttttttgtaaac

SEQ ID NO: 2086072 - DNA, 19 bp, Homo sapiens
ctagttttttttgtaaact

SEQ ID NO: 2086073 - DNA, 21 bp, Homo sapiens
  misc_feature (4)..(4): n is a, c, g or t
  misc_feature (11)..(11): n is a, c, g or t
ctanccccccnacccccagtg

SEQ ID NO: 2086074 - DNA, 20 bp, Homo sapiens
ctataaaatgcccatttcga

SEQ ID NO: 2086075 - DNA, 19 bp, Homo sapiens
ctataaactactgtaatta

SEQ ID NO: 2086076 - DNA, 16 bp, Homo sapiens
ctataaccagacacat

SEQ ID NO: 2086077 - DNA, 20 bp, Homo sapiens
ctataattccctatctttta

SEQ ID NO: 2086078 - DNA, 22 bp, Homo sapiens
ctataattccctatcttttagt

SEQ ID NO: 2086079 - DNA, 20 bp, Homo sapiens
ctataccatatgtctgcttc

SEQ ID NO: 2086080 - DNA, 22 bp, Homo sapiens
ctataccatatgtctgcttctg

SEQ ID NO: 2086081 - DNA, 15 bp, Homo sapiens
ctcctcccatggcct

SEQ ID NO: 2086082 - DNA, 13 bp, Homo sapiens
ctcctcccattcc

SEQ ID NO: 2086083 - DNA, 15 bp, Homo sapiens
ctcctccttcccctg

SEQ ID NO: 2086084 - DNA, 13 bp, Homo sapiens
ctcctctaagcca

SEQ ID NO: 2086085 - DNA, 13 bp, Homo sapiens
ctcctctccaggc

SEQ ID NO: 2086086 - DNA, 13 bp, Homo sapiens
ctcctctccccag

SEQ ID NO: 2086087 - DNA, 22 bp, Homo sapiens
ctcctctccccagcaagtgaga

SEQ ID NO: 2086088 - DNA, 12 bp, Homo sapiens
ctcctctctgcc

SEQ ID NO: 2086089 - DNA, 12 bp, Homo sapiens
ctcctctgccac

SEQ ID NO: 2086090 - DNA, 16 bp, Homo sapiens
ctcctctgccacctcc

SEQ ID NO: 2086091 - DNA, 17 bp, Homo sapiens
ctcctctgccacctccc

SEQ ID NO: 2086092 - DNA, 13 bp, Homo sapiens
ctcctctgctgct

SEQ ID NO: 2086093 - DNA, 15 bp, Homo sapiens
ctcctctgctgctcc

SEQ ID NO: 2086094 - DNA, 22 bp, Homo sapiens
ctcctctgcttgcatcacttgg

SEQ ID NO: 2086095 - DNA, 23 bp, Homo sapiens
ctcctctgcttgcatcacttggg

SEQ ID NO: 2086096 - DNA, 17 bp, Homo sapiens
ctcctctggcccagcct

SEQ ID NO: 2086097 - DNA, 19 bp, Homo sapiens
ctcctctgtctctgctctt

SEQ ID NO: 2086098 - DNA, 19 bp, Homo sapiens
ctcctcttaaaaaataaaa

SEQ ID NO: 2086099 - DNA, 21 bp, Homo sapiens
ctcctcttaaaaaataaaaac

SEQ ID NO: 2086100 - DNA, 20 bp, Homo sapiens
ctcctcttaccgtagcctcc

SEQ ID NO: 2086101 - DNA, 18 bp, Homo sapiens
ctcctcttcaactgacca

SEQ ID NO: 2086102 - DNA, 16 bp, Homo sapiens
ctcctgaagcctctgc

SEQ ID NO: 2086103 - DNA, 23 bp, Homo sapiens
ctcctgacccagtccccgtgccc

SEQ ID NO: 2086104 - DNA, 19 bp, Homo sapiens
ctcctgactccagtgagct

SEQ ID NO: 2086105 - DNA, 17 bp, Homo sapiens
ctcctgagaaggcgagg

SEQ ID NO: 2086106 - DNA, 20 bp, Homo sapiens
ctcctgagaggtgctgcagg

SEQ ID NO: 2086107 - DNA, 15 bp, Homo sapiens
ctcctgatggccaag

SEQ ID NO: 2086108 - DNA, 11 bp, Homo sapiens
ctcctgccact

SEQ ID NO: 2086109 - DNA, 14 bp, Homo sapiens
ctcctgccactgac

SEQ ID NO: 2086110 - DNA, 13 bp, Homo sapiens
ctcctgcccagga

SEQ ID NO: 2086111 - DNA, 23 bp, Homo sapiens
ctcctgcctacattccctggcct

SEQ ID NO: 2086112 - DNA, 16 bp, Homo sapiens
ctcctgcctcagcctc

SEQ ID NO: 2086113 - DNA, 20 bp, Homo sapiens
ctcctgcctcgaactggctg

SEQ ID NO: 2086114 - DNA, 12 bp, Homo sapiens
ctcctgcctcta

SEQ ID NO: 2086115 - DNA, 11 bp, Homo sapiens
ctcctgcctgt

SEQ ID NO: 2086116 - DNA, 19 bp, Homo sapiens
ctcctgcctgtagcagtga

SEQ ID NO: 2086117 - DNA, 12 bp, Homo sapiens
ctcctgcctgtg

SEQ ID NO: 2086118 - DNA, 15 bp, Homo sapiens
ctcctgcctgtgttt

SEQ ID NO: 2086119 - DNA, 12 bp, Homo sapiens
ctcctgctgaaa

SEQ ID NO: 2086120 - DNA, 21 bp, Homo sapiens
ctcctgctgcctaataaagag

SEQ ID NO: 2086121 - DNA, 20 bp, Homo sapiens
ctcctggaaaggctcagtct

SEQ ID NO: 2086122 - DNA, 16 bp, Homo sapiens
ctcctggaaccaatcc

SEQ ID NO: 2086123 - DNA, 17 bp, Homo sapiens
ctcctggaagctgtgtc

SEQ ID NO: 2086124 - DNA, 17 bp, Homo sapiens
ctcctggagcatcccag

SEQ ID NO: 2086125 - DNA, 14 bp, Homo sapiens
ctcctggctgccag

SEQ ID NO: 2086126 - DNA, 21 bp, Homo sapiens
ctcctgggaccatggacacat

SEQ ID NO: 2086127 - DNA, 15 bp, Homo sapiens
ctcctgggagagaag

SEQ ID NO: 2086128 - DNA, 14 bp, Homo sapiens
ctcctgggggtggc

SEQ ID NO: 2086129 - DNA, 18 bp, Homo sapiens
ctcctgggggtggcaggc

SEQ ID NO: 2086130 - DNA, 20 bp, Homo sapiens
ctcctgggggtggcaggcac

SEQ ID NO: 2086131 - DNA, 24 bp, Homo sapiens
ctcctgggggtggcaggcacacag

SEQ ID NO: 2086132 - DNA, 21 bp, Homo sapiens
ctcctggtctgtgctgccctg

SEQ ID NO: 2086133 - DNA, 23 bp, Homo sapiens
ctcctggtcttgagatgtcttct

SEQ ID NO: 2086134 - DNA, 18 bp, Homo sapiens
ctcctggttcaagcgatt

SEQ ID NO: 2086135 - DNA, 22 bp, Homo sapiens
ctcctggttcaagcgattctca

SEQ ID NO: 2086136 - DNA, 18 bp, Homo sapiens
ctcctgtaattttgtagt

SEQ ID NO: 2086137 - DNA, 14 bp, Homo sapiens
ctcctgtccaacct

SEQ ID NO: 2086138 - DNA, 16 bp, Homo sapiens
ctcctgtccagcaggt

SEQ ID NO: 2086139 - DNA, 13 bp, Homo sapiens
ctcctgtccctac

SEQ ID NO: 2086140 - DNA, 18 bp, Homo sapiens
ctcctgtccctacccact

SEQ ID NO: 2086141 - DNA, 14 bp, Homo sapiens
ctcctgtctgtcct

SEQ ID NO: 2086142 - DNA, 19 bp, Homo sapiens
ctcctgtctgtcctggagg

SEQ ID NO: 2086143 - DNA, 11 bp, Homo sapiens
ctcctgtgcta

SEQ ID NO: 2086144 - DNA, 13 bp, Homo sapiens
ctcctgtgggagc

SEQ ID NO: 2086145 - DNA, 16 bp, Homo sapiens
ctcctgtgggagcctc

SEQ ID NO: 2086146 - DNA, 23 bp, Homo sapiens
ctcctgtgtcttgcaatggcagc

SEQ ID NO: 2086147 - DNA, 24 bp, Homo sapiens
ctcctgtgtgtgcgcctacaggag

SEQ ID NO: 2086148 - DNA, 16 bp, Homo sapiens
ctccttactctgagcc

SEQ ID NO: 2086149 - DNA, 22 bp, Homo sapiens
ctccttactctgagcccaggcc

SEQ ID NO: 2086150 - DNA, 17 bp, Homo sapiens
ctccttataagcccagc

SEQ ID NO: 2086151 - DNA, 12 bp, Homo sapiens
ctccttatgttt

SEQ ID NO: 2086152 - DNA, 23 bp, Homo sapiens
ctccttcccctacacctccctcc

SEQ ID NO: 2086153 - DNA, 22 bp, Homo sapiens
ctccttcccctgtggtcttgga

SEQ ID NO: 2086154 - DNA, 23 bp, Homo sapiens
ctccttccctctttccccacctc

SEQ ID NO: 2086155 - DNA, 18 bp, Homo sapiens
ctccttcccttctctcct

SEQ ID NO: 2086156 - DNA, 23 bp, Homo sapiens
ctccttcccttctctccttccct

SEQ ID NO: 2086157 - DNA, 22 bp, Homo sapiens
ctccttcctcagtcctggaagc

SEQ ID NO: 2086158 - DNA, 13 bp, Homo sapiens
ctccttcctgccc

SEQ ID NO: 2086159 - DNA, 15 bp, Homo sapiens
ctccttcctgcccca

SEQ ID NO: 2086160 - DNA, 19 bp, Homo sapiens
ctccttccttacccaaact

SEQ ID NO: 2086161 - DNA, 19 bp, Homo sapiens
ctccttcgtgtctctccca

SEQ ID NO: 2086162 - DNA, 13 bp, Homo sapiens
ctccttcttccct

SEQ ID NO: 2086163 - DNA, 17 bp, Homo sapiens
ctccttgctctgcaggc

SEQ ID NO: 2086164 - DNA, 17 bp, Homo sapiens
ctccttgtggtttatgt

SEQ ID NO: 2086165 - DNA, 16 bp, Homo sapiens
ctcctttacctaccac

SEQ ID NO: 2086166 - DNA, 19 bp, Homo sapiens
ctcctttattgctcctgta

SEQ ID NO: 2086167 - DNA, 13 bp, Homo sapiens
ctcctttcacaac

SEQ ID NO: 2086168 - DNA, 16 bp, Homo sapiens
ctcctttcacaacctt

SEQ ID NO: 2086169 - DNA, 13 bp, Homo sapiens
ctcctttcctctg

SEQ ID NO: 2086170 - DNA, 14 bp, Homo sapiens
ctcctttctccagc

SEQ ID NO: 2086171 - DNA, 18 bp, Homo sapiens
ctcctttctccagccagc

SEQ ID NO: 2086172 - DNA, 13 bp, Homo sapiens
ctcctttctctat

SEQ ID NO: 2086173 - DNA, 23 bp, Homo sapiens
ctcctttgcctaggaggccttct

SEQ ID NO: 2086174 - DNA, 12 bp, Homo sapiens
ctctcccctccc

SEQ ID NO: 2086175 - DNA, 22 bp, Homo sapiens
ctctcccctccctcttccttcc

SEQ ID NO: 2086176 - DNA, 15 bp, Homo sapiens
ctctcccctctgccc

SEQ ID NO: 2086177 - DNA, 17 bp, Homo sapiens
ctctcccctctgccctg

SEQ ID NO: 2086178 - DNA, 15 bp, Homo sapiens
ctctcccctgccctg

SEQ ID NO: 2086179 - DNA, 16 bp, Homo sapiens
ctctcccgcaccaggc

SEQ ID NO: 2086180 - DNA, 16 bp, Homo sapiens
ctctcccggctgcctg

SEQ ID NO: 2086181 - DNA, 12 bp, Homo sapiens
ctctccctctgg

SEQ ID NO: 2086182 - DNA, 18 bp, Homo sapiens
ctctccctctggccctgc

SEQ ID NO: 2086183 - DNA, 21 bp, Homo sapiens
ctctccctctggccctgcctt

SEQ ID NO: 2086184 - DNA, 16 bp, Homo sapiens
ctctccgaccagacac

SEQ ID NO: 2086185 - DNA, 21 bp, Homo sapiens
ctctcctaccccacctcatgc

SEQ ID NO: 2086186 - DNA, 15 bp, Homo sapiens
ctctcctcagactgc

SEQ ID NO: 2086187 - DNA, 18 bp, Homo sapiens
ctctcctcagactgctca

SEQ ID NO: 2086188 - DNA, 20 bp, Homo sapiens
ctctcctcggccccctccat

SEQ ID NO: 2086189 - DNA, 14 bp, Homo sapiens
ctctcctcttgcca

SEQ ID NO: 2086190 - DNA, 15 bp, Homo sapiens
ctctcctcttgccac

SEQ ID NO: 2086191 - DNA, 13 bp, Homo sapiens
ctctcctgagagg

SEQ ID NO: 2086192 - DNA, 19 bp, Homo sapiens
ctctcctgcctacatccca

SEQ ID NO: 2086193 - DNA, 13 bp, Homo sapiens
ctctcctgctgca

SEQ ID NO: 2086194 - DNA, 16 bp, Homo sapiens
ctctcctggcttccca

SEQ ID NO: 2086195 - DNA, 17 bp, Homo sapiens
ctctcctggcttcccat

SEQ ID NO: 2086196 - DNA, 20 bp, Homo sapiens
ctctcctgggggtggcaggc

SEQ ID NO: 2086197 - DNA, 13 bp, Homo sapiens
ctctccttccctc

SEQ ID NO: 2086198 - DNA, 14 bp, Homo sapiens
ctctccttccctct

SEQ ID NO: 2086199 - DNA, 21 bp, Homo sapiens
ctctccttcgtgtctctccca

SEQ ID NO: 2086200 - DNA, 17 bp, Homo sapiens
ctctccttgggctcctg

SEQ ID NO: 2086201 - DNA, 20 bp, Homo sapiens
ctctccttgggctcctggct

SEQ ID NO: 2086202 - DNA, 23 bp, Homo sapiens
ctctcgagttctcctatcttctc

SEQ ID NO: 2086203 - DNA, 15 bp, Homo sapiens
ctctcggggcccttg

SEQ ID NO: 2086204 - DNA, 21 bp, Homo sapiens
ctctcggggcccttggggcct

SEQ ID NO: 2086205 - DNA, 20 bp, Homo sapiens
ctctcggggcgacccctcag

SEQ ID NO: 2086206 - DNA, 21 bp, Homo sapiens
ctctcggggcgacccctcagt

SEQ ID NO: 2086207 - DNA, 22 bp, Homo sapiens
ctctcggggcgacccctcagtg

SEQ ID NO: 2086208 - DNA, 19 bp, Homo sapiens
ctctcgggttcaagcaatt

SEQ ID NO: 2086209 - DNA, 18 bp, Homo sapiens
ctctctaaaaataaaatg

SEQ ID NO: 2086210 - DNA, 21 bp, Homo sapiens
ctctctaaaaataaaatgatg

SEQ ID NO: 2086211 - DNA, 21 bp, Homo sapiens
ctctctaagccacagcttctt

SEQ ID NO: 2086212 - DNA, 16 bp, Homo sapiens
ctctctaagtttagaa

SEQ ID NO: 2086213 - DNA, 22 bp, Homo sapiens
ctctctatatatacatgtatag

SEQ ID NO: 2086214 - DNA, 19 bp, Homo sapiens
ctctctcctgtccaaccta

SEQ ID NO: 2086215 - DNA, 15 bp, Homo sapiens
ctctctctatatata

SEQ ID NO: 2086216 - DNA, 13 bp, Homo sapiens
ctctctctccctt

SEQ ID NO: 2086217 - DNA, 13 bp, Homo sapiens
ctctctgagactg

SEQ ID NO: 2086218 - DNA, 15 bp, Homo sapiens
ctctctgagactgct

SEQ ID NO: 2086219 - DNA, 11 bp, Homo sapiens
ctctctgaggg

SEQ ID NO: 2086220 - DNA, 18 bp, Homo sapiens
ctctctgcagccagccca

SEQ ID NO: 2086221 - DNA, 12 bp, Homo sapiens
ctctctgctcca

SEQ ID NO: 2086222 - DNA, 16 bp, Homo sapiens
ctctctgctccagaga

SEQ ID NO: 2086223 - DNA, 14 bp, Homo sapiens
ctctctgctctagc

SEQ ID NO: 2086224 - DNA, 20 bp, Homo sapiens
ctctcttaggagcagagctc

SEQ ID NO: 2086225 - DNA, 18 bp, Homo sapiens
ctctcttatagaatattt

SEQ ID NO: 2086226 - DNA, 22 bp, Homo sapiens
ctctcttcagcccctagtgcta

SEQ ID NO: 2086227 - DNA, 13 bp, Homo sapiens
ctctcttcaggag

SEQ ID NO: 2086228 - DNA, 23 bp, Homo sapiens
ctctcttctctattcctgaccct

SEQ ID NO: 2086229 - DNA, 14 bp, Homo sapiens
ctctcttgccagca

SEQ ID NO: 2086230 - DNA, 14 bp, Homo sapiens
ctctgaaatttccc

SEQ ID NO: 2086231 - DNA, 17 bp, Homo sapiens
ctctgaacaaacactga

SEQ ID NO: 2086232 - DNA, 11 bp, Homo sapiens
ctctgaagcat

SEQ ID NO: 2086233 - DNA, 18 bp, Homo sapiens
ctctgacaagggctgacc

SEQ ID NO: 2086234 - DNA, 15 bp, Homo sapiens
ctctgacacacagct

SEQ ID NO: 2086235 - DNA, 16 bp, Homo sapiens
ctctgacacacagctc

SEQ ID NO: 2086236 - DNA, 17 bp, Homo sapiens
ctctgacacacagctct

SEQ ID NO: 2086237 - DNA, 18 bp, Homo sapiens
ctctgacacacagctctg

SEQ ID NO: 2086238 - DNA, 14 bp, Homo sapiens
ctctgacctgcagg

SEQ ID NO: 2086239 - DNA, 19 bp, Homo sapiens
ctctgagaattccaaggag

SEQ ID NO: 2086240 - DNA, 21 bp, Homo sapiens
ctctgagaattccaaggagtt

SEQ ID NO: 2086241 - DNA, 16 bp, Homo sapiens
ctctgagactgctaag

SEQ ID NO: 2086242 - DNA, 14 bp, Homo sapiens
ctctgagaggccct

SEQ ID NO: 2086243 - DNA, 18 bp, Homo sapiens
ctctgagaggccctggat

SEQ ID NO: 2086244 - DNA, 16 bp, Homo sapiens
ctctgagcaaatgtgg

SEQ ID NO: 2086245 - DNA, 14 bp, Homo sapiens
ctctgaggacacta

SEQ ID NO: 2086246 - DNA, 14 bp, Homo sapiens
ctctgaggccagcc

SEQ ID NO: 2086247 - DNA, 15 bp, Homo sapiens
ctctgaggccagcct

SEQ ID NO: 2086248 - DNA, 17 bp, Homo sapiens
ctctgaggccagcctgg

SEQ ID NO: 2086249 - DNA, 20 bp, Homo sapiens
ctctgaggccagcctggcct

SEQ ID NO: 2086250 - DNA, 19 bp, Homo sapiens
ctctgaggcgccccaaccc

SEQ ID NO: 2086251 - DNA, 22 bp, Homo sapiens
ctctgaggcgccccaacccgtg

SEQ ID NO: 2086252 - DNA, 18 bp, Homo sapiens
ctctgaggcttccagaga

SEQ ID NO: 2086253 - DNA, 22 bp, Homo sapiens
ctctgagggagaggctgtggtg

SEQ ID NO: 2086254 - DNA, 21 bp, Homo sapiens
ctctgatatgggactgagcct

SEQ ID NO: 2086255 - DNA, 19 bp, Homo sapiens
ctctgattttcaaagcttt

SEQ ID NO: 2086256 - DNA, 22 bp, Homo sapiens
ctctgattttcaaagctttttc

SEQ ID NO: 2086257 - DNA, 13 bp, Homo sapiens
ctctgcacatgtc

SEQ ID NO: 2086258 - DNA, 13 bp, Homo sapiens
ctctgcactccat

SEQ ID NO: 2086259 - DNA, 16 bp, Homo sapiens
ctctgcactccatggc

SEQ ID NO: 2086260 - DNA, 19 bp, Homo sapiens
ctctgcactccatggccac

SEQ ID NO: 2086261 - DNA, 14 bp, Homo sapiens
ctctgcagccagcc

SEQ ID NO: 2086262 - DNA, 16 bp, Homo sapiens
ctctgcagccagccca

SEQ ID NO: 2086263 - DNA, 15 bp, Homo sapiens
ctctgcatctcattg

SEQ ID NO: 2086264 - DNA, 17 bp, Homo sapiens
ctctgcatctcattgta

SEQ ID NO: 2086265 - DNA, 18 bp, Homo sapiens
ctctgccatgcccagaga

SEQ ID NO: 2086266 - DNA, 12 bp, Homo sapiens
ctctgccccaag

SEQ ID NO: 2086267 - DNA, 16 bp, Homo sapiens
ctctgccccaagcagc

SEQ ID NO: 2086268 - DNA, 20 bp, Homo sapiens
ctctgccccaagcagccagc

SEQ ID NO: 2086269 - DNA, 24 bp, Homo sapiens
ctctgccccaagcagccagccagt

SEQ ID NO: 2086270 - DNA, 16 bp, Homo sapiens
ctctgccccaagcccc

SEQ ID NO: 2086271 - DNA, 15 bp, Homo sapiens
ctctgccccaagggg

SEQ ID NO: 2086272 - DNA, 18 bp, Homo sapiens
ctctgccccagaggcctc

SEQ ID NO: 2086273 - DNA, 18 bp, Homo sapiens
ctctgccccagctctggc

SEQ ID NO: 2086274 - DNA, 19 bp, Homo sapiens
ctctgccccagctctggct

SEQ ID NO: 2086275 - DNA, 16 bp, Homo sapiens
ctctgccccttctgtt

SEQ ID NO: 2086276 - DNA, 12 bp, Homo sapiens
ctgagactccag

SEQ ID NO: 2086277 - DNA, 21 bp, Homo sapiens
ctgagactctcttaggagcag

SEQ ID NO: 2086278 - DNA, 14 bp, Homo sapiens
ctggctcttctctc

SEQ ID NO: 2086279 - DNA, 12 bp, Homo sapiens
ctggctgaaaat

SEQ ID NO: 2086280 - DNA, 17 bp, Homo sapiens
ctggctgaaaatcacta

SEQ ID NO: 2086281 - DNA, 19 bp, Homo sapiens
ctggctgaccccaaagagc

SEQ ID NO: 2086282 - DNA, 13 bp, Homo sapiens
ctggctgagggca

SEQ ID NO: 2086283 - DNA, 13 bp, Homo sapiens
ctggctgagggga

SEQ ID NO: 2086284 - DNA, 21 bp, Homo sapiens
ctggctgagtggaatgcaggg

SEQ ID NO: 2086285 - DNA, 23 bp, Homo sapiens
ctggctgagtggaatgcagggaa

SEQ ID NO: 2086286 - DNA, 24 bp, Homo sapiens
ctggctgagtggaatgcagggaag

SEQ ID NO: 2086287 - DNA, 14 bp, Homo sapiens
ctggctgcaagggc

SEQ ID NO: 2086288 - DNA, 19 bp, Homo sapiens
ctggctgcaagggccagag

SEQ ID NO: 2086289 - DNA, 22 bp, Homo sapiens
ctggctgcaagggccagagttc

SEQ ID NO: 2086290 - DNA, 12 bp, Homo sapiens
ctggctgccagg

SEQ ID NO: 2086291 - DNA, 16 bp, Homo sapiens
ctggctgccaggcgtt

SEQ ID NO: 2086292 - DNA, 17 bp, Homo sapiens
ctggctgccaggcgttg

SEQ ID NO: 2086293 - DNA, 13 bp, Homo sapiens
ctggctgctgaca

SEQ ID NO: 2086294 - DNA, 15 bp, Homo sapiens
ctggctgctgacagg

SEQ ID NO: 2086295 - DNA, 11 bp, Homo sapiens
ctggctggctg

SEQ ID NO: 2086296 - DNA, 16 bp, Homo sapiens
ctggctggctgagggc

SEQ ID NO: 2086297 - DNA, 15 bp, Homo sapiens
ctggctggggcagag

SEQ ID NO: 2086298 - DNA, 16 bp, Homo sapiens
ctggctggggcagagg

SEQ ID NO: 2086299 - DNA, 17 bp, Homo sapiens
ctggctggggcagaggg

SEQ ID NO: 2086300 - DNA, 18 bp, Homo sapiens
ctggctggggcagagggg

SEQ ID NO: 2086301 - DNA, 23 bp, Homo sapiens
ctggctggggcagaggggcagcc

SEQ ID NO: 2086302 - DNA, 19 bp, Homo sapiens
ctggctgttggctgggggc

SEQ ID NO: 2086303 - DNA, 20 bp, Homo sapiens
ctggctgtttgatagcagaa

SEQ ID NO: 2086304 - DNA, 22 bp, Homo sapiens
ctggcttattcccaactgctct

SEQ ID NO: 2086305 - DNA, 17 bp, Homo sapiens
ctggcttctagatctgg

SEQ ID NO: 2086306 - DNA, 23 bp, Homo sapiens
ctggcttctctgtgcccctgtaa

SEQ ID NO: 2086307 - DNA, 14 bp, Homo sapiens
ctggcttctggagc

SEQ ID NO: 2086308 - DNA, 13 bp, Homo sapiens
ctggcttctgtgc

SEQ ID NO: 2086309 - DNA, 14 bp, Homo sapiens
ctggcttctgtgca

SEQ ID NO: 2086310 - DNA, 18 bp, Homo sapiens
ctggcttctgttgcgcca

SEQ ID NO: 2086311 - DNA, 13 bp, Homo sapiens
ctggcttgctcca

SEQ ID NO: 2086312 - DNA, 14 bp, Homo sapiens
ctggcttgcttgcc

SEQ ID NO: 2086313 - DNA, 20 bp, Homo sapiens
ctggcttgcttgccgagcct

SEQ ID NO: 2086314 - DNA, 19 bp, Homo sapiens
ctggcttgtaactccacca

SEQ ID NO: 2086315 - DNA, 15 bp, Homo sapiens
ctggctttctccgac

SEQ ID NO: 2086316 - DNA, 16 bp, Homo sapiens
ctggctttgccaagct

SEQ ID NO: 2086317 - DNA, 14 bp, Homo sapiens
ctggctttgtctct

SEQ ID NO: 2086318 - DNA, 16 bp, Homo sapiens
ctggctttgtctctag

SEQ ID NO: 2086319 - DNA, 16 bp, Homo sapiens
ctggcttttcactgct

SEQ ID NO: 2086320 - DNA, 17 bp, Homo sapiens
ctggcttttcactgctg

SEQ ID NO: 2086321 - DNA, 15 bp, Homo sapiens
ctggcttttcgcttg

SEQ ID NO: 2086322 - DNA, 22 bp, Homo sapiens
ctggcttttcgcttgcttctgc

SEQ ID NO: 2086323 - DNA, 17 bp, Homo sapiens
ctgggaaaacagaggaa

SEQ ID NO: 2086324 - DNA, 19 bp, Homo sapiens
ctgggaaaacagaggaatc

SEQ ID NO: 2086325 - DNA, 17 bp, Homo sapiens
ctgggaaacagggagcc

SEQ ID NO: 2086326 - DNA, 14 bp, Homo sapiens
ctgggaaaggaaaa

SEQ ID NO: 2086327 - DNA, 15 bp, Homo sapiens
ctgggaaaggaaaac

SEQ ID NO: 2086328 - DNA, 24 bp, Homo sapiens
ctgggaaaggaaaaccagggatag

SEQ ID NO: 2086329 - DNA, 20 bp, Homo sapiens
ctgggaaaggacccacccat

SEQ ID NO: 2086330 - DNA, 21 bp, Homo sapiens
ctgggaaaggggttgtcaaga

SEQ ID NO: 2086331 - DNA, 22 bp, Homo sapiens
ctgggaaatttctacttatcct

SEQ ID NO: 2086332 - DNA, 18 bp, Homo sapiens
ctgggaaccatgaagctg

SEQ ID NO: 2086333 - DNA, 19 bp, Homo sapiens
ctgggaaccccgcagcccg

SEQ ID NO: 2086334 - DNA, 13 bp, Homo sapiens
ctgggaaggagga

SEQ ID NO: 2086335 - DNA, 15 bp, Homo sapiens
ctgggaaggggtgcc

SEQ ID NO: 2086336 - DNA, 22 bp, Homo sapiens
ctgggaaggggtgccctctgga

SEQ ID NO: 2086337 - DNA, 13 bp, Homo sapiens
ctgggacccagct

SEQ ID NO: 2086338 - DNA, 12 bp, Homo sapiens
ctgggacccctc

SEQ ID NO: 2086339 - DNA, 14 bp, Homo sapiens
ctgggaccctttcc

SEQ ID NO: 2086340 - DNA, 15 bp, Homo sapiens
ctgggaccctttcct

SEQ ID NO: 2086341 - DNA, 19 bp, Homo sapiens
ctgggaccctttccttcct

SEQ ID NO: 2086342 - DNA, 16 bp, Homo sapiens
ctgggaccgctacacc

SEQ ID NO: 2086343 - DNA, 17 bp, Homo sapiens
ctgggaccgctacacca

SEQ ID NO: 2086344 - DNA, 24 bp, Homo sapiens
ctgggaccgctacaccactctggc

SEQ ID NO: 2086345 - DNA, 15 bp, Homo sapiens
ctgggacctgtgttc

SEQ ID NO: 2086346 - DNA, 13 bp, Homo sapiens
ctgggactacagg

SEQ ID NO: 2086347 - DNA, 16 bp, Homo sapiens
ctgggactacaggcac

SEQ ID NO: 2086348 - DNA, 17 bp, Homo sapiens
ctgggactacaggcacc

SEQ ID NO: 2086349 - DNA, 21 bp, Homo sapiens
ctgggactacaggcacccacc

SEQ ID NO: 2086350 - DNA, 13 bp, Homo sapiens
ctgtgggagcctc

SEQ ID NO: 2086351 - DNA, 14 bp, Homo sapiens
ctgtgggagcctcg

SEQ ID NO: 2086352 - DNA, 21 bp, Homo sapiens
ctgtgggagcctcgcaacccg

SEQ ID NO: 2086353 - DNA, 19 bp, Homo sapiens
ctgtgggcagcaccctccc

SEQ ID NO: 2086354 - DNA, 13 bp, Homo sapiens
ctgtgggccagga

SEQ ID NO: 2086355 - DNA, 16 bp, Homo sapiens
ctgtgggcttggcctt

SEQ ID NO: 2086356 - DNA, 17 bp, Homo sapiens
ctgtgggcttggccttg

SEQ ID NO: 2086357 - DNA, 15 bp, Homo sapiens
ctgtggggccccaga

SEQ ID NO: 2086358 - DNA, 13 bp, Homo sapiens
ctgtggggcctga

SEQ ID NO: 2086359 - DNA, 22 bp, Homo sapiens
ctgtgggggaggtccctgccag

SEQ ID NO: 2086360 - DNA, 19 bp, Homo sapiens
ctgtgggggcggctgtggg

SEQ ID NO: 2086361 - DNA, 22 bp, Homo sapiens
ctgtggtcttcaaattgtcttt

SEQ ID NO: 2086362 - DNA, 17 bp, Homo sapiens
ctgtggtgacaggccca

SEQ ID NO: 2086363 - DNA, 16 bp, Homo sapiens
ctgtggtggctgtctc

SEQ ID NO: 2086364 - DNA, 18 bp, Homo sapiens
ctgtggtggctgtctctg

SEQ ID NO: 2086365 - DNA, 18 bp, Homo sapiens
ctgtggtggggagaggca

SEQ ID NO: 2086366 - DNA, 15 bp, Homo sapiens
ctgtgtaacctccac

SEQ ID NO: 2086367 - DNA, 14 bp, Homo sapiens
ctgtgtacccactc

SEQ ID NO: 2086368 - DNA, 16 bp, Homo sapiens
ctgtgtagctctgtcc

SEQ ID NO: 2086369 - DNA, 19 bp, Homo sapiens
ctgtgtagctctgtccact

SEQ ID NO: 2086370 - DNA, 15 bp, Homo sapiens
ctgtgtagctgtgac

SEQ ID NO: 2086371 - DNA, 17 bp, Homo sapiens
ctgtgtagctgtgacct

SEQ ID NO: 2086372 - DNA, 20 bp, Homo sapiens
ctgtgtagctgtgacctgct

SEQ ID NO: 2086373 - DNA, 22 bp, Homo sapiens
ctgtgtagctgtgacctgctga

SEQ ID NO: 2086374 - DNA, 17 bp, Homo sapiens
ctgtgtccagcagctgc

SEQ ID NO: 2086375 - DNA, 20 bp, Homo sapiens
ctgtgtcttgcaatggcagc

SEQ ID NO: 2086376 - DNA, 13 bp, Homo sapiens
ctgtgtgaaaatg

SEQ ID NO: 2086377 - DNA, 23 bp, Homo sapiens
ctgtgtgacagaatcttgtattt

SEQ ID NO: 2086378 - DNA, 19 bp, Homo sapiens
ctgtgtgatgaactttctc

SEQ ID NO: 2086379 - DNA, 15 bp, Homo sapiens
ctgtgtgcagtgaag

SEQ ID NO: 2086380 - DNA, 14 bp, Homo sapiens
ctgtgtgccttcgc

SEQ ID NO: 2086381 - DNA, 18 bp, Homo sapiens
ctgtgtgctcctccttgg

SEQ ID NO: 2086382 - DNA, 21 bp, Homo sapiens
ctgtgtggggaggcagctcca

SEQ ID NO: 2086383 - DNA, 17 bp, Homo sapiens
ctgtgtgggtctgggga

SEQ ID NO: 2086384 - DNA, 18 bp, Homo sapiens
ctgtgtgtctgatgtttg

SEQ ID NO: 2086385 - DNA, 16 bp, Homo sapiens
ctgtgtgtgtccccct

SEQ ID NO: 2086386 - DNA, 14 bp, Homo sapiens
ctgtgttcacactg

SEQ ID NO: 2086387 - DNA, 23 bp, Homo sapiens
ctgtgttcattcttaccgagaaa

SEQ ID NO: 2086388 - DNA, 18 bp, Homo sapiens
ctgtgttgcgtgtcgtgg

SEQ ID NO: 2086389 - DNA, 17 bp, Homo sapiens
ctgtgttggccaggctg

SEQ ID NO: 2086390 - DNA, 13 bp, Homo sapiens
ctgtgtttcttgc

SEQ ID NO: 2086391 - DNA, 15 bp, Homo sapiens
ctgtgtttcttgcct

SEQ ID NO: 2086392 - DNA, 18 bp, Homo sapiens
ctgtgtttcttgcctcat

SEQ ID NO: 2086393 - DNA, 19 bp, Homo sapiens
ctgttaaaagatgaaaata

SEQ ID NO: 2086394 - DNA, 23 bp, Homo sapiens
ctgttaaaagatgaaaatatttg

SEQ ID NO: 2086395 - DNA, 20 bp, Homo sapiens
ctgttaacgtcatctcaggg

SEQ ID NO: 2086396 - DNA, 14 bp, Homo sapiens
ctgttactgaaatg

SEQ ID NO: 2086397 - DNA, 19 bp, Homo sapiens
ctgttacttacctaaacag

SEQ ID NO: 2086398 - DNA, 18 bp, Homo sapiens
ctgttacttgaaatacca

SEQ ID NO: 2086399 - DNA, 21 bp, Homo sapiens
ctgttacttgaaataccagtg

SEQ ID NO: 2086400 - DNA, 14 bp, Homo sapiens
ctgttactttttag

SEQ ID NO: 2086401 - DNA, 20 bp, Homo sapiens
ctgttactttttagtctttt

SEQ ID NO: 2086402 - DNA, 19 bp, Homo sapiens
ctgttatcaaaactttctt

SEQ ID NO: 2086403 - DNA, 16 bp, Homo sapiens
ctgttattgaaaatat

SEQ ID NO: 2086404 - DNA, 20 bp, Homo sapiens
ctgttattgaaaatatattt

SEQ ID NO: 2086405 - DNA, 19 bp, Homo sapiens
ctgttattttttatttcca

SEQ ID NO: 2086406 - DNA, 22 bp, Homo sapiens
ctgttcaatgtttttaaaaatc

SEQ ID NO: 2086407 - DNA, 12 bp, Homo sapiens
ctgttcacccac

SEQ ID NO: 2086408 - DNA, 19 bp, Homo sapiens
ctgttcaccttatgtatta

SEQ ID NO: 2086409 - DNA, 15 bp, Homo sapiens
ctgttcactctactt

SEQ ID NO: 2086410 - DNA, 13 bp, Homo sapiens
ctgttcagctcca

SEQ ID NO: 2086411 - DNA, 18 bp, Homo sapiens
ctgttcagctccagctca

SEQ ID NO: 2086412 - DNA, 19 bp, Homo sapiens
ctgttcagctccagctcac

SEQ ID NO: 2086413 - DNA, 16 bp, Homo sapiens
ctgttccacttctcta

SEQ ID NO: 2086414 - DNA, 23 bp, Homo sapiens
ctgttccagcccaggcagagatc

SEQ ID NO: 2086415 - DNA, 18 bp, Homo sapiens
ctgttctatcccacccaa

SEQ ID NO: 2086416 - DNA, 14 bp, Homo sapiens
ctgttctggcctca

SEQ ID NO: 2086417 - DNA, 14 bp, Homo sapiens
ctgttctgtgtggg

SEQ ID NO: 2086418 - DNA, 22 bp, Homo sapiens
ctgttctgtgtgggtctgggga

SEQ ID NO: 2086419 - DNA, 16 bp, Homo sapiens
ctgttgagttggacac

SEQ ID NO: 2086420 - DNA, 17 bp, Homo sapiens
ctgttgatcccacttca

SEQ ID NO: 2086421 - DNA, 19 bp, Homo sapiens
ctgttgatcccacttcact

SEQ ID NO: 2086422 - DNA, 22 bp, Homo sapiens
ctgttgatcccacttcactgtg

SEQ ID NO: 2086423 - DNA, 23 bp, Homo sapiens
ctgttgatcccacttcactgtga

SEQ ID NO: 2086424 - DNA, 15 bp, Homo sapiens
ctgttgattgcagga

SEQ ID NO: 2086425 - DNA, 18 bp, Homo sapiens
ctgttgccatagccccat

SEQ ID NO: 2086426 - DNA, 12 bp, Homo sapiens
ctgttgcccagg

SEQ ID NO: 2086427 - DNA, 14 bp, Homo sapiens
ctgttgcccaggct

SEQ ID NO: 2086428 - DNA, 15 bp, Homo sapiens
ctgttgcccaggctg

SEQ ID NO: 2086429 - DNA, 15 bp, Homo sapiens
ctgttgcgccactga

SEQ ID NO: 2086430 - DNA, 15 bp, Homo sapiens
ctgttgctgaagtca

SEQ ID NO: 2086431 - DNA, 15 bp, Homo sapiens
ctgttggacagctgc

SEQ ID NO: 2086432 - DNA, 18 bp, Homo sapiens
ctgttggacccgctctgg

SEQ ID NO: 2086433 - DNA, 19 bp, Homo sapiens
ctgttggacccgctctgga

SEQ ID NO: 2086434 - DNA, 20 bp, Homo sapiens
ctgttggacccgctctggac

SEQ ID NO: 2086435 - DNA, 14 bp, Homo sapiens
ctgttggcctcgcc

SEQ ID NO: 2086436 - DNA, 19 bp, Homo sapiens
ctgttggcctcgcctgggc

SEQ ID NO: 2086437 - DNA, 21 bp, Homo sapiens
ctgttggcctcgcctgggccc

SEQ ID NO: 2086438 - DNA, 17 bp, Homo sapiens
ctgttgtaaagagtgga

SEQ ID NO: 2086439 - DNA, 23 bp, Homo sapiens
ctgttgtaaatgaccaagaaaaa

SEQ ID NO: 2086440 - DNA, 12 bp, Homo sapiens
ctgttgtacaag

SEQ ID NO: 2086441 - DNA, 14 bp, Homo sapiens
ctgttgtacaagct

SEQ ID NO: 2086442 - DNA, 21 bp, Homo sapiens
ctgttgtacgtaaagcttaaa

SEQ ID NO: 2086443 - DNA, 15 bp, Homo sapiens
ctgttgtagaataat

SEQ ID NO: 2086444 - DNA, 21 bp, Homo sapiens
ctgttgttccttcacatttaa

SEQ ID NO: 2086445 - DNA, 22 bp, Homo sapiens
ctgttgttgttaatgaaaatgt

SEQ ID NO: 2086446 - DNA, 23 bp, Homo sapiens
ctgttgttgttaatgaaaatgtc

SEQ ID NO: 2086447 - DNA, 18 bp, Homo sapiens
ctgtttaaaaaaagtata

SEQ ID NO: 2086448 - DNA, 19 bp, Homo sapiens
ctgtttaaaaaaagtatat

SEQ ID NO: 2086449 - DNA, 22 bp, Homo sapiens
ctgtttaaaaaaagtatatatt

SEQ ID NO: 2086450 - DNA, 16 bp, Homo sapiens
ctgtttaatatttaaa

SEQ ID NO: 2086451 - DNA, 21 bp, Homo sapiens
ctgtttaatatttaaacagca

SEQ ID NO: 2086452 - DNA, 17 bp, Homo sapiens
ctgtttagtagcagtga

SEQ ID NO: 2086453 - DNA, 20 bp, Homo sapiens
ctgtttataaaaacaaaaac

SEQ ID NO: 2086454 - DNA, 24 bp, Homo sapiens
ctgtttatattggtataattattt

SEQ ID NO: 2086455 - DNA, 16 bp, Homo sapiens
ctgtttatggtatttt

SEQ ID NO: 2086456 - DNA, 19 bp, Homo sapiens
ctgtttcaatgacctgtat

SEQ ID NO: 2086457 - DNA, 13 bp, Homo sapiens
ctgtttccatggg

SEQ ID NO: 2086458 - DNA, 22 bp, Homo sapiens
cttgaccatcgtccttcctctc

SEQ ID NO: 2086459 - DNA, 16 bp, Homo sapiens
cttgacccatctcccc

SEQ ID NO: 2086460 - DNA, 20 bp, Homo sapiens
cttgactaaaaaaaaaagaa

SEQ ID NO: 2086461 - DNA, 18 bp, Homo sapiens
cttgactatcacatacaa

SEQ ID NO: 2086462 - DNA, 19 bp, Homo sapiens
cttgactatcacatacaat

SEQ ID NO: 2086463 - DNA, 16 bp, Homo sapiens
cttgacttcacagcag

SEQ ID NO: 2086464 - DNA, 13 bp, Homo sapiens
cttgagaaacctt

SEQ ID NO: 2086465 - DNA, 15 bp, Homo sapiens
cttgagacctcagcc

SEQ ID NO: 2086466 - DNA, 12 bp, Homo sapiens
cttgagcctgtc

SEQ ID NO: 2086467 - DNA, 14 bp, Homo sapiens
cttgagctccccaa

SEQ ID NO: 2086468 - DNA, 21 bp, Homo sapiens
cttgagcttggcagctgaact

SEQ ID NO: 2086469 - DNA, 18 bp, Homo sapiens
cttgaggacacatgtcca

SEQ ID NO: 2086470 - DNA, 14 bp, Homo sapiens
cttgaggagtgtga

SEQ ID NO: 2086471 - DNA, 14 bp, Homo sapiens
cttgaggccaggag

SEQ ID NO: 2086472 - DNA, 17 bp, Homo sapiens
cttgagggttgggctgg

SEQ ID NO: 2086473 - DNA, 19 bp, Homo sapiens
cttgagggttgggctggtg

SEQ ID NO: 2086474 - DNA, 19 bp, Homo sapiens
cttgagtagatctgcttct

SEQ ID NO: 2086475 - DNA, 22 bp, Homo sapiens
cttgatactaaaagttcttctc

SEQ ID NO: 2086476 - DNA, 23 bp, Homo sapiens
cttgatactaaaagttcttctcc

SEQ ID NO: 2086477 - DNA, 20 bp, Homo sapiens
cttgatctgtatatacaata

SEQ ID NO: 2086478 - DNA, 13 bp, Homo sapiens
cttgatgaagccc

SEQ ID NO: 2086479 - DNA, 15 bp, Homo sapiens
cttgatgaagcctgt

SEQ ID NO: 2086480 - DNA, 16 bp, Homo sapiens
cttgatgaagcctgtg

SEQ ID NO: 2086481 - DNA, 21 bp, Homo sapiens
cttgatgaagcctgtgccacc

SEQ ID NO: 2086482 - DNA, 22 bp, Homo sapiens
cttgatgaagcctgtgccacct

SEQ ID NO: 2086483 - DNA, 14 bp, Homo sapiens
cttgatgttgctta

SEQ ID NO: 2086484 - DNA, 23 bp, Homo sapiens
cttgatgttgcttagtcacttat

SEQ ID NO: 2086485 - DNA, 20 bp, Homo sapiens
cttgattttagccttctctg

SEQ ID NO: 2086486 - DNA, 16 bp, Homo sapiens
cttgcaatggcagcct

SEQ ID NO: 2086487 - DNA, 17 bp, Homo sapiens
cttgcaatggcagcctt

SEQ ID NO: 2086488 - DNA, 14 bp, Homo sapiens
cttgcacccctcac

SEQ ID NO: 2086489 - DNA, 12 bp, Homo sapiens
cttgcacctgca

SEQ ID NO: 2086490 - DNA, 18 bp, Homo sapiens
cttgcagactctacagag

SEQ ID NO: 2086491 - DNA, 21 bp, Homo sapiens
cttgcagagttcatggaatgt

SEQ ID NO: 2086492 - DNA, 23 bp, Homo sapiens
cttgcaggaaggactatgaaaag

SEQ ID NO: 2086493 - DNA, 16 bp, Homo sapiens
cttgcagtcatcagaa

SEQ ID NO: 2086494 - DNA, 16 bp, Homo sapiens
cttgcattcccagtgg

SEQ ID NO: 2086495 - DNA, 18 bp, Homo sapiens
cttgcattgaatatatta

SEQ ID NO: 2086496 - DNA, 20 bp, Homo sapiens
cttgccaagctttcttctac

SEQ ID NO: 2086497 - DNA, 23 bp, Homo sapiens
cttgccaatgaggtctgaaatgg

SEQ ID NO: 2086498 - DNA, 23 bp, Homo sapiens
cttgccaccaccagatgagaagt

SEQ ID NO: 2086499 - DNA, 14 bp, Homo sapiens
cttgccactgcctc

SEQ ID NO: 2086500 - DNA, 15 bp, Homo sapiens
cttgccactgcctct

SEQ ID NO: 2086501 - DNA, 16 bp, Homo sapiens
cttgccagacatgtgg

SEQ ID NO: 2086502 - DNA, 16 bp, Homo sapiens
cttgccaggctccctt

SEQ ID NO: 2086503 - DNA, 14 bp, Homo sapiens
cttgcccccatccc

SEQ ID NO: 2086504 - DNA, 16 bp, Homo sapiens
cttgcccccatccctc

SEQ ID NO: 2086505 - DNA, 23 bp, Homo sapiens
cttgccccctcatctcactgccc

SEQ ID NO: 2086506 - DNA, 15 bp, Homo sapiens
cttgccccttgggcc

SEQ ID NO: 2086507 - DNA, 16 bp, Homo sapiens
cttgccccttgggcct

SEQ ID NO: 2086508 - DNA, 18 bp, Homo sapiens
cttgccccttgggcctcc

SEQ ID NO: 2086509 - DNA, 16 bp, Homo sapiens
cttgcccgccagcctc

SEQ ID NO: 2086510 - DNA, 23 bp, Homo sapiens
cttgcccgccagcctcagtgcca

SEQ ID NO: 2086511 - DNA, 13 bp, Homo sapiens
cttgccctgacct

SEQ ID NO: 2086512 - DNA, 17 bp, Homo sapiens
cttgccctgacctccca

SEQ ID NO: 2086513 - DNA, 19 bp, Homo sapiens
cttgccctgacctcccagc

SEQ ID NO: 2086514 - DNA, 14 bp, Homo sapiens
cttgccctgttaaa

SEQ ID NO: 2086515 - DNA, 13 bp, Homo sapiens
cttgccgagagag

SEQ ID NO: 2086516 - DNA, 14 bp, Homo sapiens
cttgccgagcctaa

SEQ ID NO: 2086517 - DNA, 18 bp, Homo sapiens
cttgcctgaatccatcag

SEQ ID NO: 2086518 - DNA, 15 bp, Homo sapiens
cttgcctgcttttct

SEQ ID NO: 2086519 - DNA, 14 bp, Homo sapiens
cttgcctttccacc

SEQ ID NO: 2086520 - DNA, 22 bp, Homo sapiens
cttgcctttccacctgctttct

SEQ ID NO: 2086521 - DNA, 17 bp, Homo sapiens
cttgcctttcttatttg

SEQ ID NO: 2086522 - DNA, 18 bp, Homo sapiens
cttgccttttaaaagaaa

SEQ ID NO: 2086523 - DNA, 20 bp, Homo sapiens
cttgcggaatcactctgtcc

SEQ ID NO: 2086524 - DNA, 13 bp, Homo sapiens
cttgcgtcctgca

SEQ ID NO: 2086525 - DNA, 15 bp, Homo sapiens
cttgctattggaatg

SEQ ID NO: 2086526 - DNA, 18 bp, Homo sapiens
cttgctcagtgcctcctg

SEQ ID NO: 2086527 - DNA, 22 bp, Homo sapiens
cttgctcagtgcctcctggccg

SEQ ID NO: 2086528 - DNA, 12 bp, Homo sapiens
cttgctccaggg

SEQ ID NO: 2086529 - DNA, 14 bp, Homo sapiens
cttgctccagggtc

SEQ ID NO: 2086530 - DNA, 13 bp, Homo sapiens
cttgctctgctga

SEQ ID NO: 2086531 - DNA, 16 bp, Homo sapiens
cttgctctgctgacag

SEQ ID NO: 2086532 - DNA, 18 bp, Homo sapiens
cttgctgaatttcaggca

SEQ ID NO: 2086533 - DNA, 18 bp, Homo sapiens
cttgctgtaactcagaca

SEQ ID NO: 2086534 - DNA, 16 bp, Homo sapiens
cttgctgtatatgcag

SEQ ID NO: 2086535 - DNA, 15 bp, Homo sapiens
cttgctgtcctaggc

SEQ ID NO: 2086536 - DNA, 17 bp, Homo sapiens
cttgctgtcctaggcca

SEQ ID NO: 2086537 - DNA, 16 bp, Homo sapiens
cttgcttctgcagcaa

SEQ ID NO: 2086538 - DNA, 20 bp, Homo sapiens
cttgcttctgcagcaactcc

SEQ ID NO: 2086539 - DNA, 13 bp, Homo sapiens
cttgctttgctgt

SEQ ID NO: 2086540 - DNA, 18 bp, Homo sapiens
cttggaaaaagaaagaaa

SEQ ID NO: 2086541 - DNA, 22 bp, Homo sapiens
cttggaaaaatccagaaagaaa

SEQ ID NO: 2086542 - DNA, 23 bp, Homo sapiens
cttggaaagcatcacctcaggcc

SEQ ID NO: 2086543 - DNA, 24 bp, Homo sapiens
cttggaaagctgatgatgtctctt

SEQ ID NO: 2086544 - DNA, 20 bp, Homo sapiens
cttggaagctccgctttcta

SEQ ID NO: 2086545 - DNA, 22 bp, Homo sapiens
cttggaagtcgtttcaggacat

SEQ ID NO: 2086546 - DNA, 15 bp, Homo sapiens
cttggacagtctgag

SEQ ID NO: 2086547 - DNA, 17 bp, Homo sapiens
cttggacagtctgagct

SEQ ID NO: 2086548 - DNA, 13 bp, Homo sapiens
cttggacagttag

SEQ ID NO: 2086549 - DNA, 22 bp, Homo sapiens
ggtcaggcggggtgctgtggtg

SEQ ID NO: 2086550 - DNA, 16 bp, Homo sapiens
ggtcatagcagtgctt

SEQ ID NO: 2086551 - DNA, 22 bp, Homo sapiens
ggtcatcgattcaaactgctcc

SEQ ID NO: 2086552 - DNA, 23 bp, Homo sapiens
ggtcatcgattcaaactgctcca

SEQ ID NO: 2086553 - DNA, 22 bp, Homo sapiens
ggtcatgcttttgccactttgg

SEQ ID NO: 2086554 - DNA, 14 bp, Homo sapiens
ggtcatgtgtgcat

SEQ ID NO: 2086555 - DNA, 22 bp, Homo sapiens
ggtccacccaggagccccgagg

SEQ ID NO: 2086556 - DNA, 16 bp, Homo sapiens
ggtccactcagggctg

SEQ ID NO: 2086557 - DNA, 14 bp, Homo sapiens
ggtccagctcttgg

SEQ ID NO: 2086558 - DNA, 20 bp, Homo sapiens
ggtccagctcttggcccctg

SEQ ID NO: 2086559 - DNA, 17 bp, Homo sapiens
ggtccagcttgctcttc

SEQ ID NO: 2086560 - DNA, 14 bp, Homo sapiens
ggtccaggaaggca

SEQ ID NO: 2086561 - DNA, 16 bp, Homo sapiens
ggtccaggaaggcagc

SEQ ID NO: 2086562 - DNA, 17 bp, Homo sapiens
ggtccaggaaggcagct

SEQ ID NO: 2086563 - DNA, 20 bp, Homo sapiens
ggtccaggaaggcagctgct

SEQ ID NO: 2086564 - DNA, 21 bp, Homo sapiens
ggtccagggttgatcacactc

SEQ ID NO: 2086565 - DNA, 23 bp, Homo sapiens
ggtcccacatccctgggcctgct

SEQ ID NO: 2086566 - DNA, 22 bp, Homo sapiens
ggtcccacgaatttgctgggga

SEQ ID NO: 2086567 - DNA, 18 bp, Homo sapiens
ggtccccatcatcccagc

SEQ ID NO: 2086568 - DNA, 21 bp, Homo sapiens
ggtccccatcatcccagctgc

SEQ ID NO: 2086569 - DNA, 23 bp, Homo sapiens
ggtccctgataacaacctggaga

SEQ ID NO: 2086570 - DNA, 18 bp, Homo sapiens
ggtccgattaatttatgg

SEQ ID NO: 2086571 - DNA, 22 bp, Homo sapiens
ggtccgattaatttatggtttc

SEQ ID NO: 2086572 - DNA, 15 bp, Homo sapiens
ggtccgcaccagctg

SEQ ID NO: 2086573 - DNA, 21 bp, Homo sapiens
ggtccgcaccagctgctctgc

SEQ ID NO: 2086574 - DNA, 22 bp, Homo sapiens
ggtccgcaccagctgctctgcc

SEQ ID NO: 2086575 - DNA, 23 bp, Homo sapiens
ggtccgcaccagctgctctgccc

SEQ ID NO: 2086576 - DNA, 21 bp, Homo sapiens
ggtcctagcccagtgcttctc

SEQ ID NO: 2086577 - DNA, 15 bp, Homo sapiens
ggtcctgagcactgc

SEQ ID NO: 2086578 - DNA, 22 bp, Homo sapiens
ggtcctgagcactgccaggagg

SEQ ID NO: 2086579 - DNA, 14 bp, Homo sapiens
ggtcctggccctct

SEQ ID NO: 2086580 - DNA, 15 bp, Homo sapiens
ggtcctggggctctg

SEQ ID NO: 2086581 - DNA, 12 bp, Homo sapiens
ggtcctgtcacc

SEQ ID NO: 2086582 - DNA, 15 bp, Homo sapiens
ggtcctgtcaccctg

SEQ ID NO: 2086583 - DNA, 20 bp, Homo sapiens
ggtcctgttaacgtcatctc

SEQ ID NO: 2086584 - DNA, 22 bp, Homo sapiens
ggtcctgttaacgtcatctcag

SEQ ID NO: 2086585 - DNA, 15 bp, Homo sapiens
ggtccttccaggccc

SEQ ID NO: 2086586 - DNA, 21 bp, Homo sapiens
ggtcctttaggcagcctgccg

SEQ ID NO: 2086587 - DNA, 20 bp, Homo sapiens
ggtcgaccccaaagcccctt

SEQ ID NO: 2086588 - DNA, 21 bp, Homo sapiens
ggtcgccacacccggctcccc

SEQ ID NO: 2086589 - DNA, 15 bp, Homo sapiens
ggtcgccctaccctc

SEQ ID NO: 2086590 - DNA, 17 bp, Homo sapiens
ggtcgtgaactcctgag

SEQ ID NO: 2086591 - DNA, 14 bp, Homo sapiens
ggtcgtggagagct

SEQ ID NO: 2086592 - DNA, 15 bp, Homo sapiens
ggtctaaaaataaac

SEQ ID NO: 2086593 - DNA, 23 bp, Homo sapiens
ggtctcactatgttgcccaggct

SEQ ID NO: 2086594 - DNA, 23 bp, Homo sapiens
ggtctcactcctgagtggggcca

SEQ ID NO: 2086595 - DNA, 16 bp, Homo sapiens
ggtctcactctgtcgc

SEQ ID NO: 2086596 - DNA, 22 bp, Homo sapiens
ggtctcactctgtcgcccagtc

SEQ ID NO: 2086597 - DNA, 11 bp, Homo sapiens
ggtctcagctt

SEQ ID NO: 2086598 - DNA, 14 bp, Homo sapiens
ggtctcagcttcat

SEQ ID NO: 2086599 - DNA, 15 bp, Homo sapiens
ggtctcagcttcatt

SEQ ID NO: 2086600 - DNA, 16 bp, Homo sapiens
ggtctcagcttcattt

SEQ ID NO: 2086601 - DNA, 17 bp, Homo sapiens
ggtctcagcttcatttc

SEQ ID NO: 2086602 - DNA, 16 bp, Homo sapiens
ggtctcccacgtggga

SEQ ID NO: 2086603 - DNA, 19 bp, Homo sapiens
ggtctccctccagctggaa

SEQ ID NO: 2086604 - DNA, 14 bp, Homo sapiens
ggtctccctctcct

SEQ ID NO: 2086605 - DNA, 15 bp, Homo sapiens
ggtctccctctcctg

SEQ ID NO: 2086606 - DNA, 20 bp, Homo sapiens
ggtctcctctgattatcagg

SEQ ID NO: 2086607 - DNA, 20 bp, Homo sapiens
ggtctccttactctgagccc

SEQ ID NO: 2086608 - DNA, 16 bp, Homo sapiens
ggtctcgaactcctga

SEQ ID NO: 2086609 - DNA, 12 bp, Homo sapiens
ggtctgaaatgg

SEQ ID NO: 2086610 - DNA, 15 bp, Homo sapiens
ggtctgacccactgc

SEQ ID NO: 2086611 - DNA, 22 bp, Homo sapiens
ggtctgagcaccccctcattcc

SEQ ID NO: 2086612 - DNA, 12 bp, Homo sapiens
ggtctgccacca

SEQ ID NO: 2086613 - DNA, 15 bp, Homo sapiens
ggtctggctgtccct

SEQ ID NO: 2086614 - DNA, 18 bp, Homo sapiens
ggtctgtatatacatttc

SEQ ID NO: 2086615 - DNA, 14 bp, Homo sapiens
ggtctgtcccacca

SEQ ID NO: 2086616 - DNA, 15 bp, Homo sapiens
ggtctgtgctgtgcc

SEQ ID NO: 2086617 - DNA, 16 bp, Homo sapiens
ggtcttcttggcagct

SEQ ID NO: 2086618 - DNA, 21 bp, Homo sapiens
ggtcttcttgtgtcctgatga

SEQ ID NO: 2086619 - DNA, 22 bp, Homo sapiens
ggtcttgaactcctggcctcaa

SEQ ID NO: 2086620 - DNA, 16 bp, Homo sapiens
ggtcttgggctactgg

SEQ ID NO: 2086621 - DNA, 18 bp, Homo sapiens
ggtcttgggctactggca

SEQ ID NO: 2086622 - DNA, 13 bp, Homo sapiens
ggtctttgaataa

SEQ ID NO: 2086623 - DNA, 15 bp, Homo sapiens
ggtctttttaaacca

SEQ ID NO: 2086624 - DNA, 21 bp, Homo sapiens
ggtgaaaacagcccaggtcct

SEQ ID NO: 2086625 - DNA, 18 bp, Homo sapiens
ggtgaaaccctgtctcta

SEQ ID NO: 2086626 - DNA, 12 bp, Homo sapiens
ggtgaaattatg

SEQ ID NO: 2086627 - DNA, 21 bp, Homo sapiens
ggtgacagagtgagactctgt

SEQ ID NO: 2086628 - DNA, 13 bp, Homo sapiens
ggtgacatcccag

SEQ ID NO: 2086629 - DNA, 13 bp, Homo sapiens
ggtgaccccaggg

SEQ ID NO: 2086630 - DNA, 15 bp, Homo sapiens
ggtgaccccagggca

SEQ ID NO: 2086631 - DNA, 20 bp, Homo sapiens
ggtgaccccagggcacagga

SEQ ID NO: 2086632 - DNA, 20 bp, Homo sapiens
ggtgacccggcaccccctgc

SEQ ID NO: 2086633 - DNA, 23 bp, Homo sapiens
ggtgacccggcaccccctgcagc

SEQ ID NO: 2086634 - DNA, 21 bp, Homo sapiens
ggtgacggtcctttaggcagc

SEQ ID NO: 2086635 - DNA, 16 bp, Homo sapiens
ggtgactgaacgaggg

SEQ ID NO: 2086636 - DNA, 23 bp, Homo sapiens
ggtgactgcgatcttcagagcag

SEQ ID NO: 2086637 - DNA, 13 bp, Homo sapiens
ggtgactgtccca

SEQ ID NO: 2086638 - DNA, 16 bp, Homo sapiens
ggtgactgtcccaccg

SEQ ID NO: 2086639 - DNA, 23 bp, Homo sapiens
ggtgactgtcccaccgggagcct

SEQ ID NO: 2086640 - DNA, 21 bp, Homo sapiens
ggtgacttcaggtggagagca

SEQ ID NO: 2086641 - DNA, 15 bp, Homo sapiens
ggtgagaaatttaaa

SEQ ID NO: 2086642 - DNA, 12 bp, Homo sapiens
ggtgagagctgc

SEQ ID NO: 2086643 - DNA, 11 bp, Homo sapiens
ggtgagctggg

SEQ ID NO: 2086644 - DNA, 14 bp, Homo sapiens
ggtgaggcccagcc

SEQ ID NO: 2086645 - DNA, 13 bp, Homo sapiens
ggtgagggatgtg

SEQ ID NO: 2086646 - DNA, 15 bp, Homo sapiens
ggtgataagtggaaa

SEQ ID NO: 2086647 - DNA, 23 bp, Homo sapiens
ggtgatcagaaggctggggccag

SEQ ID NO: 2086648 - DNA, 13 bp, Homo sapiens
ggtgatgagggca

SEQ ID NO: 2086649 - DNA, 17 bp, Homo sapiens
ggtgatgagggcagcag

SEQ ID NO: 2086650 - DNA, 21 bp, Homo sapiens
ggtgattccttcaattcaaaa

SEQ ID NO: 2086651 - DNA, 12 bp, Homo sapiens
ggtgcaaatcct

SEQ ID NO: 2086652 - DNA, 13 bp, Homo sapiens
ggtgcaagagaca

SEQ ID NO: 2086653 - DNA, 14 bp, Homo sapiens
ggtgcaagagacag

SEQ ID NO: 2086654 - DNA, 14 bp, Homo sapiens
ggtgcacaggaggg

SEQ ID NO: 2086655 - DNA, 20 bp, Homo sapiens
ggtgcacccactcaccaggg

SEQ ID NO: 2086656 - DNA, 17 bp, Homo sapiens
ggtgcactggccccacc

SEQ ID NO: 2086657 - DNA, 18 bp, Homo sapiens
ggtgcagaggtgagcaga

SEQ ID NO: 2086658 - DNA, 20 bp, Homo sapiens
ggtgcagttgacagcaggtg

SEQ ID NO: 2086659 - DNA, 17 bp, Homo sapiens
ggtgcatggcttgggga

SEQ ID NO: 2086660 - DNA, 23 bp, Homo sapiens
ggtgcatggcttggggagcagag

SEQ ID NO: 2086661 - DNA, 23 bp, Homo sapiens
ggtgccacttcttaaaggcctgg

SEQ ID NO: 2086662 - DNA, 18 bp, Homo sapiens
ggtgccaggctgtaagca

SEQ ID NO: 2086663 - DNA, 20 bp, Homo sapiens
gtaatcccagcactttggga

SEQ ID NO: 2086664 - DNA, 13 bp, Homo sapiens
gtaatcccagcta

SEQ ID NO: 2086665 - DNA, 18 bp, Homo sapiens
gtaatcccagctactcag

SEQ ID NO: 2086666 - DNA, 14 bp, Homo sapiens
gtaatgagggactg

SEQ ID NO: 2086667 - DNA, 12 bp, Homo sapiens
gtaatgcacaat

SEQ ID NO: 2086668 - DNA, 13 bp, Homo sapiens
gtaatgcacaatt

SEQ ID NO: 2086669 - DNA, 21 bp, Homo sapiens
gtaatgcacaatttagaaaac

SEQ ID NO: 2086670 - DNA, 20 bp, Homo sapiens
gtaatgccacacattgtgct

SEQ ID NO: 2086671 - DNA, 16 bp, Homo sapiens
gtaatgcttcaatcag

SEQ ID NO: 2086672 - DNA, 16 bp, Homo sapiens
gtaatggaactgaccc

SEQ ID NO: 2086673 - DNA, 20 bp, Homo sapiens
gtaatgggccaattaaaata

SEQ ID NO: 2086674 - DNA, 15 bp, Homo sapiens
gtaatgggcctgccc

SEQ ID NO: 2086675 - DNA, 13 bp, Homo sapiens
gtaatgtatctta

SEQ ID NO: 2086676 - DNA, 18 bp, Homo sapiens
gtaatgtatttatatgtt

SEQ ID NO: 2086677 - DNA, 20 bp, Homo sapiens
gtaatgtcaccaccttccca

SEQ ID NO: 2086678 - DNA, 14 bp, Homo sapiens
gtaatgtttttgaa

SEQ ID NO: 2086679 - DNA, 19 bp, Homo sapiens
gtaattaaaagaattttcc

SEQ ID NO: 2086680 - DNA, 22 bp, Homo sapiens
gtaattaagtgcaatttcccct

SEQ ID NO: 2086681 - DNA, 21 bp, Homo sapiens
gtaattatcgggaacagtgtt

SEQ ID NO: 2086682 - DNA, 22 bp, Homo sapiens
gtaattatcgggaacagtgttt

SEQ ID NO: 2086683 - DNA, 22 bp, Homo sapiens
gtaattctaaatgaatgtttac

SEQ ID NO: 2086684 - DNA, 17 bp, Homo sapiens
gtaattgcatttctgct

SEQ ID NO: 2086685 - DNA, 12 bp, Homo sapiens
gtaattgcttac

SEQ ID NO: 2086686 - DNA, 22 bp, Homo sapiens
gtaattgcttacatttttacaa

SEQ ID NO: 2086687 - DNA, 18 bp, Homo sapiens
gtaatttagaaatcattt

SEQ ID NO: 2086688 - DNA, 16 bp, Homo sapiens
gtacaaaagtaccata

SEQ ID NO: 2086689 - DNA, 12 bp, Homo sapiens
gtacaaaataaa

SEQ ID NO: 2086690 - DNA, 16 bp, Homo sapiens
gtacaaagatatgcta

SEQ ID NO: 2086691 - DNA, 15 bp, Homo sapiens
gtacaaagtagagaa

SEQ ID NO: 2086692 - DNA, 21 bp, Homo sapiens
gtacaagttttgtataaataa

SEQ ID NO: 2086693 - DNA, 19 bp, Homo sapiens
gtacaatacataactagtt

SEQ ID NO: 2086694 - DNA, 14 bp, Homo sapiens
gtacaatctcaaat

SEQ ID NO: 2086695 - DNA, 17 bp, Homo sapiens
gtacacgtgtcctgtag

SEQ ID NO: 2086696 - DNA, 14 bp, Homo sapiens
gtacagaattttta

SEQ ID NO: 2086697 - DNA, 15 bp, Homo sapiens
gtacagaatttttaa

SEQ ID NO: 2086698 - DNA, 23 bp, Homo sapiens
gtacagaatttttaatgactttt

SEQ ID NO: 2086699 - DNA, 14 bp, Homo sapiens
gtacagcagggtct

SEQ ID NO: 2086700 - DNA, 15 bp, Homo sapiens
gtacagcagggtctt

SEQ ID NO: 2086701 - DNA, 21 bp, Homo sapiens
gtacagtagcttaaataaatt

SEQ ID NO: 2086702 - DNA, 20 bp, Homo sapiens
gtacagttatacatacctct

SEQ ID NO: 2086703 - DNA, 17 bp, Homo sapiens
gtacagttatcagggat

SEQ ID NO: 2086704 - DNA, 21 bp, Homo sapiens
gtacatatggaaatcctgtta

SEQ ID NO: 2086705 - DNA, 13 bp, Homo sapiens
gtacatgtgaggc

SEQ ID NO: 2086706 - DNA, 17 bp, Homo sapiens
gtacattcaatgtttat

SEQ ID NO: 2086707 - DNA, 13 bp, Homo sapiens
gtacattcctgat

SEQ ID NO: 2086708 - DNA, 20 bp, Homo sapiens
gtacattggtctttctacat

SEQ ID NO: 2086709 - DNA, 18 bp, Homo sapiens
gtacatttccctgtgctg

SEQ ID NO: 2086710 - DNA, 13 bp, Homo sapiens
gtacatttctgaa

SEQ ID NO: 2086711 - DNA, 17 bp, Homo sapiens
gtacatttctgaaatga

SEQ ID NO: 2086712 - DNA, 19 bp, Homo sapiens
gtaccaaatccacaagcca

SEQ ID NO: 2086713 - DNA, 22 bp, Homo sapiens
gtaccaagccccttggccctct

SEQ ID NO: 2086714 - DNA, 12 bp, Homo sapiens
gtaccagccagg

SEQ ID NO: 2086715 - DNA, 17 bp, Homo sapiens
gtaccagctcactccct

SEQ ID NO: 2086716 - DNA, 21 bp, Homo sapiens
gtaccatgctggcggcgcaga

SEQ ID NO: 2086717 - DNA, 17 bp, Homo sapiens
gtaccatgttaaagagg

SEQ ID NO: 2086718 - DNA, 21 bp, Homo sapiens
gtacccactcctcactgcccc

SEQ ID NO: 2086719 - DNA, 12 bp, Homo sapiens
gtacccactgct

SEQ ID NO: 2086720 - DNA, 12 bp, Homo sapiens
gtaccccatccc

SEQ ID NO: 2086721 - DNA, 14 bp, Homo sapiens
gtaccccatccctt

SEQ ID NO: 2086722 - DNA, 20 bp, Homo sapiens
gtaccccatcccttcctccc

SEQ ID NO: 2086723 - DNA, 18 bp, Homo sapiens
gtaccctatagagagggg

SEQ ID NO: 2086724 - DNA, 17 bp, Homo sapiens
gtacctatggctgcctg

SEQ ID NO: 2086725 - DNA, 11 bp, Homo sapiens
gtacctcagtt

SEQ ID NO: 2086726 - DNA, 14 bp, Homo sapiens
gtacctcagtttct

SEQ ID NO: 2086727 - DNA, 18 bp, Homo sapiens
gtacctgggaaaggaccc

SEQ ID NO: 2086728 - DNA, 19 bp, Homo sapiens
gtacctgggaaaggaccca

SEQ ID NO: 2086729 - DNA, 22 bp, Homo sapiens
gtacctgggaaaggacccaccc

SEQ ID NO: 2086730 - DNA, 14 bp, Homo sapiens
gtaccttgaacact

SEQ ID NO: 2086731 - DNA, 23 bp, Homo sapiens
gtaccttgaacactgggggaggg

SEQ ID NO: 2086732 - DNA, 23 bp, Homo sapiens
gtacgaacccctcccctcccccc

SEQ ID NO: 2086733 - DNA, 15 bp, Homo sapiens
gtacgtatcatttct

SEQ ID NO: 2086734 - DNA, 17 bp, Homo sapiens
gtacgtctgacaggcaa

SEQ ID NO: 2086735 - DNA, 15 bp, Homo sapiens
gtacgttatatattg

SEQ ID NO: 2086736 - DNA, 18 bp, Homo sapiens
gtacgttatatattgtat

SEQ ID NO: 2086737 - DNA, 14 bp, Homo sapiens
gtacgtttttgcat

SEQ ID NO: 2086738 - DNA, 12 bp, Homo sapiens
gtactacaattt

SEQ ID NO: 2086739 - DNA, 21 bp, Homo sapiens
gtactcagtatagcattgaac

SEQ ID NO: 2086740 - DNA, 14 bp, Homo sapiens
gtactcctcccagg

SEQ ID NO: 2086741 - DNA, 14 bp, Homo sapiens
gtactgataaaata

SEQ ID NO: 2086742 - DNA, 11 bp, Homo sapiens
gtactgcctgc

SEQ ID NO: 2086743 - DNA, 17 bp, Homo sapiens
gtactgctttcaactta

SEQ ID NO: 2086744 - DNA, 21 bp, Homo sapiens
gtactgtaattttgtttgtaa

SEQ ID NO: 2086745 - DNA, 16 bp, Homo sapiens
gtactgtatgcagttt

SEQ ID NO: 2086746 - DNA, 17 bp, Homo sapiens
gtacttaaatgaaagca

SEQ ID NO: 2086747 - DNA, 16 bp, Homo sapiens
gtacttacccggagaa

SEQ ID NO: 2086748 - DNA, 14 bp, Homo sapiens
gtacttcagtcttg

SEQ ID NO: 2086749 - DNA, 16 bp, Homo sapiens
gtacttcagtcttgga

SEQ ID NO: 2086750 - DNA, 18 bp, Homo sapiens
gtacttcctcctgatggc

SEQ ID NO: 2086751 - DNA, 12 bp, Homo sapiens
gtacttcctgtg

SEQ ID NO: 2086752 - DNA, 20 bp, Homo sapiens
gtacttctccaccctgctct

SEQ ID NO: 2086753 - DNA, 21 bp, Homo sapiens
gtacttgtggacacagctctt

SEQ ID NO: 2086754 - DNA, 11 bp, Homo sapiens
gtagaaatctg

SEQ ID NO: 2086755 - DNA, 22 bp, Homo sapiens
gtagaacaagcaacataaaaca

SEQ ID NO: 2086756 - DNA, 22 bp, Homo sapiens
gtagaacacaaggtcatttgct

SEQ ID NO: 2086757 - DNA, 19 bp, Homo sapiens
gtagaacgtaaccacggaa

SEQ ID NO: 2086758 - DNA, 17 bp, Homo sapiens
gtagaataaagaaaaac

SEQ ID NO: 2086759 - DNA, 15 bp, Homo sapiens
gtagaataaatgaag

SEQ ID NO: 2086760 - DNA, 19 bp, Homo sapiens
gtagaataaatgaagaaag

SEQ ID NO: 2086761 - DNA, 19 bp, Homo sapiens
gtagaattatatctaattt

SEQ ID NO: 2086762 - DNA, 18 bp, Homo sapiens
gtagaattgggaagctgg

SEQ ID NO: 2086763 - DNA, 18 bp, Homo sapiens
gtagacacgctcttctat

SEQ ID NO: 2086764 - DNA, 17 bp, Homo sapiens
gtagactatatacatgt

SEQ ID NO: 2086765 - DNA, 14 bp, Homo sapiens
gtagactcctgctt

SEQ ID NO: 2086766 - DNA, 11 bp, Homo sapiens
gtagagacagg

SEQ ID NO: 2086767 - DNA, 12 bp, Homo sapiens
gtagagacaggg

SEQ ID NO: 2086768 - DNA, 13 bp, Homo sapiens
gtagagacagggt

SEQ ID NO: 2086769 - DNA, 12 bp, Homo sapiens
gtagagatgtgt

SEQ ID NO: 2086770 - DNA, 10 bp, Homo sapiens
gtagagccag

SEQ ID NO: 2086771 - DNA, 18 bp, Homo sapiens
gtagagccagggtctcac

SEQ ID NO: 2086772 - DNA, 20 bp, Homo sapiens
gtagagtttgaaggaggtga

SEQ ID NO: 2086773 - DNA, 17 bp, Homo sapiens
gtagatcgcttgagccc

SEQ ID NO: 2086774 - DNA, 17 bp, Homo sapiens
gtagatggtacgatgca

SEQ ID NO: 2086775 - DNA, 17 bp, Homo sapiens
gtagattgtgtaaattc

SEQ ID NO: 2086776 - DNA, 16 bp, Homo sapiens
gtagcaaccttcattt

SEQ ID NO: 2086777 - DNA, 20 bp, Homo sapiens
gtagcaagttctagagaaga

SEQ ID NO: 2086778 - DNA, 18 bp, Homo sapiens
gtagcagataaagacagc

SEQ ID NO: 2086779 - DNA, 19 bp, Homo sapiens
gtatcgctgccttgccatg

SEQ ID NO: 2086780 - DNA, 20 bp, Homo sapiens
gtatctcggacctttcagct

SEQ ID NO: 2086781 - DNA, 15 bp, Homo sapiens
gtatctctctgccta

SEQ ID NO: 2086782 - DNA, 18 bp, Homo sapiens
gtatctgaagacctacca

SEQ ID NO: 2086783 - DNA, 13 bp, Homo sapiens
gtatcttatttat

SEQ ID NO: 2086784 - DNA, 16 bp, Homo sapiens
gtatcttatttatata

SEQ ID NO: 2086785 - DNA, 22 bp, Homo sapiens
gtatgaaagatggctgtgcctc

SEQ ID NO: 2086786 - DNA, 19 bp, Homo sapiens
gtatgaataaagacaccta

SEQ ID NO: 2086787 - DNA, 13 bp, Homo sapiens
gtatgaatgatgt

SEQ ID NO: 2086788 - DNA, 19 bp, Homo sapiens
gtatgactctcctctcctg

SEQ ID NO: 2086789 - DNA, 12 bp, Homo sapiens
gtatgagctgag

SEQ ID NO: 2086790 - DNA, 20 bp, Homo sapiens
gtatgatcacggctcactgc

SEQ ID NO: 2086791 - DNA, 22 bp, Homo sapiens
gtatgatcacggctcactgcag

SEQ ID NO: 2086792 - DNA, 19 bp, Homo sapiens
gtatgatttttacaataat

SEQ ID NO: 2086793 - DNA, 17 bp, Homo sapiens
gtatgcaagaagaatat

SEQ ID NO: 2086794 - DNA, 15 bp, Homo sapiens
gtatgcagggagctg

SEQ ID NO: 2086795 - DNA, 18 bp, Homo sapiens
gtatgctgttttaataat

SEQ ID NO: 2086796 - DNA, 13 bp, Homo sapiens
gtatggaaataaa

SEQ ID NO: 2086797 - DNA, 14 bp, Homo sapiens
gtatggaagggagg

SEQ ID NO: 2086798 - DNA, 22 bp, Homo sapiens
gtatggaagggaggggtcctga

SEQ ID NO: 2086799 - DNA, 15 bp, Homo sapiens
gtatggcctgtgtca

SEQ ID NO: 2086800 - DNA, 16 bp, Homo sapiens
gtatggtggctgggtt

SEQ ID NO: 2086801 - DNA, 19 bp, Homo sapiens
gtatgtagcccggccaggg

SEQ ID NO: 2086802 - DNA, 9 bp, Homo sapiens
gtatgtata

SEQ ID NO: 2086803 - DNA, 14 bp, Homo sapiens
gtatgtatacacac

SEQ ID NO: 2086804 - DNA, 17 bp, Homo sapiens
gtatgtatacacacata

SEQ ID NO: 2086805 - DNA, 17 bp, Homo sapiens
gtatgtggccatattta

SEQ ID NO: 2086806 - DNA, 11 bp, Homo sapiens
gtatgtgtggg

SEQ ID NO: 2086807 - DNA, 16 bp, Homo sapiens
gtatgtgtgtgtatgc

SEQ ID NO: 2086808 - DNA, 22 bp, Homo sapiens
gtatgttaaagcatcagagatg

SEQ ID NO: 2086809 - DNA, 18 bp, Homo sapiens
gtatgttaagctctttat

SEQ ID NO: 2086810 - DNA, 17 bp, Homo sapiens
gtattaaacttgtcaga

SEQ ID NO: 2086811 - DNA, 12 bp, Homo sapiens
gtattaaatatt

SEQ ID NO: 2086812 - DNA, 18 bp, Homo sapiens
gtattaagccaaacatga

SEQ ID NO: 2086813 - DNA, 15 bp, Homo sapiens
gtattaatactaaaa

SEQ ID NO: 2086814 - DNA, 19 bp, Homo sapiens
gtattaatatgctacagta

SEQ ID NO: 2086815 - DNA, 15 bp, Homo sapiens
gtattaattatctga

SEQ ID NO: 2086816 - DNA, 22 bp, Homo sapiens
gtattacactgtatttgtatct

SEQ ID NO: 2086817 - DNA, 14 bp, Homo sapiens
gtattaccattact

SEQ ID NO: 2086818 - DNA, 15 bp, Homo sapiens
gtattacttctgcta

SEQ ID NO: 2086819 - DNA, 23 bp, Homo sapiens
gtattagcacctctttttgaaca

SEQ ID NO: 2086820 - DNA, 16 bp, Homo sapiens
gtattatcacatcaag

SEQ ID NO: 2086821 - DNA, 21 bp, Homo sapiens
gtattatcacatcaagcatgc

SEQ ID NO: 2086822 - DNA, 22 bp, Homo sapiens
gtattatcacatcaagcatgca

SEQ ID NO: 2086823 - DNA, 10 bp, Homo sapiens
gtattcagat

SEQ ID NO: 2086824 - DNA, 16 bp, Homo sapiens
gtattccatgggatgt

SEQ ID NO: 2086825 - DNA, 19 bp, Homo sapiens
gtattcccttttatttcca

SEQ ID NO: 2086826 - DNA, 23 bp, Homo sapiens
gtattccttttgtgtacagtgtg

SEQ ID NO: 2086827 - DNA, 17 bp, Homo sapiens
gtattgtaaacatgtgt

SEQ ID NO: 2086828 - DNA, 15 bp, Homo sapiens
gtattgtaatgaata

SEQ ID NO: 2086829 - DNA, 21 bp, Homo sapiens
gtattgtccatatcagacctc

SEQ ID NO: 2086830 - DNA, 13 bp, Homo sapiens
gtatttatatatt

SEQ ID NO: 2086831 - DNA, 17 bp, Homo sapiens
gtatttatatatttata

SEQ ID NO: 2086832 - DNA, 15 bp, Homo sapiens
gtatttatatttgga

SEQ ID NO: 2086833 - DNA, 15 bp, Homo sapiens
gtattttaaaagcca

SEQ ID NO: 2086834 - DNA, 15 bp, Homo sapiens
gtattttcgtgcatt

SEQ ID NO: 2086835 - DNA, 18 bp, Homo sapiens
gtattttcgtgcatttgt

SEQ ID NO: 2086836 - DNA, 19 bp, Homo sapiens
gtattttcgtgcatttgtg

SEQ ID NO: 2086837 - DNA, 19 bp, Homo sapiens
gtattttcttcccatttgt

SEQ ID NO: 2086838 - DNA, 21 bp, Homo sapiens
gtattttcttcccatttgtaa

SEQ ID NO: 2086839 - DNA, 23 bp, Homo sapiens
gtattttcttcccatttgtaatg

SEQ ID NO: 2086840 - DNA, 15 bp, Homo sapiens
gtatttttactatta

SEQ ID NO: 2086841 - DNA, 18 bp, Homo sapiens
gtatttttagagattaat

SEQ ID NO: 2086842 - DNA, 20 bp, Homo sapiens
gtatttttcaggtaggccct

SEQ ID NO: 2086843 - DNA, 15 bp, Homo sapiens
gtcaaaacagattgt

SEQ ID NO: 2086844 - DNA, 16 bp, Homo sapiens
gtcaaacatgaagtgt

SEQ ID NO: 2086845 - DNA, 16 bp, Homo sapiens
gtcaaaccataaactt

SEQ ID NO: 2086846 - DNA, 21 bp, Homo sapiens
gtcaaaccgcactcacccatg

SEQ ID NO: 2086847 - DNA, 21 bp, Homo sapiens
gtcaacaagtatgaataaaga

SEQ ID NO: 2086848 - DNA, 22 bp, Homo sapiens
gtcaacagagaaggcaggaatg

SEQ ID NO: 2086849 - DNA, 14 bp, Homo sapiens
gtcaacatcttctc

SEQ ID NO: 2086850 - DNA, 16 bp, Homo sapiens
gtcaacatcttctctc

SEQ ID NO: 2086851 - DNA, 17 bp, Homo sapiens
gtcaactggagcaagaa

SEQ ID NO: 2086852 - DNA, 14 bp, Homo sapiens
gtcaactggctggc

SEQ ID NO: 2086853 - DNA, 19 bp, Homo sapiens
gtcaactggctggccagtc

SEQ ID NO: 2086854 - DNA, 13 bp, Homo sapiens
gtcaagtcaacca

SEQ ID NO: 2086855 - DNA, 17 bp, Homo sapiens
gtcaatattaaatacag

SEQ ID NO: 2086856 - DNA, 20 bp, Homo sapiens
gtcaatattaaatacagaca

SEQ ID NO: 2086857 - DNA, 17 bp, Homo sapiens
gtcaatcccaaaagtca

SEQ ID NO: 2086858 - DNA, 17 bp, Homo sapiens
gtcaatcccctcattca

SEQ ID NO: 2086859 - DNA, 22 bp, Homo sapiens
gtcaatcccctcattcaggaaa

SEQ ID NO: 2086860 - DNA, 17 bp, Homo sapiens
gtcacaagagcccagca

SEQ ID NO: 2086861 - DNA, 12 bp, Homo sapiens
gtcacagctctg

SEQ ID NO: 2086862 - DNA, 15 bp, Homo sapiens
gtcacagctgcagct

SEQ ID NO: 2086863 - DNA, 17 bp, Homo sapiens
gtcacagctgcagctgg

SEQ ID NO: 2086864 - DNA, 18 bp, Homo sapiens
gtcacagctgcagctggg

SEQ ID NO: 2086865 - DNA, 19 bp, Homo sapiens
gtcacagctgcagctgggc

SEQ ID NO: 2086866 - DNA, 22 bp, Homo sapiens
gtcacagttcttggtgactgtc

SEQ ID NO: 2086867 - DNA, 21 bp, Homo sapiens
gtcacatatacaaaagcaaga

SEQ ID NO: 2086868 - DNA, 18 bp, Homo sapiens
gtcacatatgtctgtatc

SEQ ID NO: 2086869 - DNA, 15 bp, Homo sapiens
gtcacatcacaggac

SEQ ID NO: 2086870 - DNA, 18 bp, Homo sapiens
gtcacatgctttgtttcc

SEQ ID NO: 2086871 - DNA, 23 bp, Homo sapiens
gtcacatggcctatgcacatatg

SEQ ID NO: 2086872 - DNA, 16 bp, Homo sapiens
gtcacattcaggaaga

SEQ ID NO: 2086873 - DNA, 15 bp, Homo sapiens
gtcaccaagcccagt

SEQ ID NO: 2086874 - DNA, 17 bp, Homo sapiens
gtcaccaagctcacagt

SEQ ID NO: 2086875 - DNA, 19 bp, Homo sapiens
gtcaccaatgtacccaccg

SEQ ID NO: 2086876 - DNA, 14 bp, Homo sapiens
gtcaccaccttccc

SEQ ID NO: 2086877 - DNA, 17 bp, Homo sapiens
gtcaccaccttcccagc

SEQ ID NO: 2086878 - DNA, 18 bp, Homo sapiens
gtcaccagctatctgtca

SEQ ID NO: 2086879 - DNA, 21 bp, Homo sapiens
gtcacccaggctctggagcca

SEQ ID NO: 2086880 - DNA, 23 bp, Homo sapiens
gtcacccaggctctggagccaga

SEQ ID NO: 2086881 - DNA, 12 bp, Homo sapiens
gtcaccctggcc

SEQ ID NO: 2086882 - DNA, 20 bp, Homo sapiens
gtcaccgtggaccttcctgc

SEQ ID NO: 2086883 - DNA, 13 bp, Homo sapiens
gtcacctcctcca

SEQ ID NO: 2086884 - DNA, 20 bp, Homo sapiens
gtcacctgaagactcattct

SEQ ID NO: 2086885 - DNA, 14 bp, Homo sapiens
gtcacctgcaagcc

SEQ ID NO: 2086886 - DNA, 22 bp, Homo sapiens
gtcacgaggtccagacccactc

SEQ ID NO: 2086887 - DNA, 13 bp, Homo sapiens
gtcacgtcttgaa

SEQ ID NO: 2086888 - DNA, 23 bp, Homo sapiens
gtcactagcagctgcagtcaaca

SEQ ID NO: 2086889 - DNA, 19 bp, Homo sapiens
gtcactatgctatttctgg

SEQ ID NO: 2086890 - DNA, 22 bp, Homo sapiens
gtcactatgctatttctggcct

SEQ ID NO: 2086891 - DNA, 12 bp, Homo sapiens
gtcactcccaga

SEQ ID NO: 2086892 - DNA, 20 bp, Homo sapiens
gtcactgcacagtgcatctc

SEQ ID NO: 2086893 - DNA, 23 bp, Homo sapiens
gtcactgctacaccttagcagct

SEQ ID NO: 2086894 - DNA, 15 bp, Homo sapiens
gtcccacatccctgg

SEQ ID NO: 2086895 - DNA, 20 bp, Homo sapiens
gtcccacatccctgggcctg

SEQ ID NO: 2086896 - DNA, 21 bp, Homo sapiens
gtcccaccaactctgcactcc

SEQ ID NO: 2086897 - DNA, 12 bp, Homo sapiens
gtcccacctctt

SEQ ID NO: 2086898 - DNA, 22 bp, Homo sapiens
gtcccacctcttctcttcctgt

SEQ ID NO: 2086899 - DNA, 14 bp, Homo sapiens
gtcccaccttggct

SEQ ID NO: 2086900 - DNA, 16 bp, Homo sapiens
gtcccaccttggctgc

SEQ ID NO: 2086901 - DNA, 21 bp, Homo sapiens
gtcccaccttggctgcaggga

SEQ ID NO: 2086902 - DNA, 23 bp, Homo sapiens
gtcccaccttggctgcagggagt

SEQ ID NO: 2086903 - DNA, 20 bp, Homo sapiens
gtcccagaaccacactgttg

SEQ ID NO: 2086904 - DNA, 12 bp, Homo sapiens
gtcccagagcag

SEQ ID NO: 2086905 - DNA, 21 bp, Homo sapiens
gtcccagagcttattggccac

SEQ ID NO: 2086906 - DNA, 19 bp, Homo sapiens
gtcccagaggttatctgcc

SEQ ID NO: 2086907 - DNA, 12 bp, Homo sapiens
gtcccaggcaga

SEQ ID NO: 2086908 - DNA, 20 bp, Homo sapiens
gtcccatctgctcctcccat

SEQ ID NO: 2086909 - DNA, 15 bp, Homo sapiens
gtcccatttccttgg

SEQ ID NO: 2086910 - DNA, 15 bp, Homo sapiens
gtccccacctgggac

SEQ ID NO: 2086911 - DNA, 12 bp, Homo sapiens
gtccccagggcc

SEQ ID NO: 2086912 - DNA, 17 bp, Homo sapiens
gtccccatcatcccagc

SEQ ID NO: 2086913 - DNA, 19 bp, Homo sapiens
gtccccatggcaccctgct

SEQ ID NO: 2086914 - DNA, 12 bp, Homo sapiens
gtcccccagccc

SEQ ID NO: 2086915 - DNA, 18 bp, Homo sapiens
gtcccccagccctcaggc

SEQ ID NO: 2086916 - DNA, 19 bp, Homo sapiens
gtccccgggagcacacgaa

SEQ ID NO: 2086917 - DNA, 16 bp, Homo sapiens
gtcccctcactctgtc

SEQ ID NO: 2086918 - DNA, 14 bp, Homo sapiens
gtcccctccgtagg

SEQ ID NO: 2086919 - DNA, 15 bp, Homo sapiens
gtcccctctcccctc

SEQ ID NO: 2086920 - DNA, 22 bp, Homo sapiens
gtcccctctcccctcatggaga

SEQ ID NO: 2086921 - DNA, 21 bp, Homo sapiens
gtcccctctgtcatcactccc

SEQ ID NO: 2086922 - DNA, 22 bp, Homo sapiens
gtcccctctgtcatcactccct

SEQ ID NO: 2086923 - DNA, 20 bp, Homo sapiens
gtcccctgctactcctgtgc

SEQ ID NO: 2086924 - DNA, 23 bp, Homo sapiens
gtcccctgctactcctgtgctct

SEQ ID NO: 2086925 - DNA, 13 bp, Homo sapiens
gtcccctgtccca

SEQ ID NO: 2086926 - DNA, 15 bp, Homo sapiens
gtcccctgtcccacc

SEQ ID NO: 2086927 - DNA, 20 bp, Homo sapiens
gtcccctgtcccaccaactc

SEQ ID NO: 2086928 - DNA, 17 bp, Homo sapiens
gtccctaaagaaaaaaa

SEQ ID NO: 2086929 - DNA, 14 bp, Homo sapiens
gtccctacccactc

SEQ ID NO: 2086930 - DNA, 22 bp, Homo sapiens
gtccctaccgagtctcttctcc

SEQ ID NO: 2086931 - DNA, 23 bp, Homo sapiens
gtccctcaaatgacccaaagacc

SEQ ID NO: 2086932 - DNA, 23 bp, Homo sapiens
gtccctctttgcctgtgtgagca

SEQ ID NO: 2086933 - DNA, 21 bp, Homo sapiens
gtccctgcacttgcagactct

SEQ ID NO: 2086934 - DNA, 14 bp, Homo sapiens
gtccctgctcctcc

SEQ ID NO: 2086935 - DNA, 17 bp, Homo sapiens
gtccctgcttacctgac

SEQ ID NO: 2086936 - DNA, 18 bp, Homo sapiens
gtccctgcttacctgacg

SEQ ID NO: 2086937 - DNA, 20 bp, Homo sapiens
gtccctgggggaagccctgg

SEQ ID NO: 2086938 - DNA, 21 bp, Homo sapiens
gtccctgggggaagccctgga

SEQ ID NO: 2086939 - DNA, 23 bp, Homo sapiens
gtccctgggggaagccctggatt

SEQ ID NO: 2086940 - DNA, 13 bp, Homo sapiens
gtccctggtccct

SEQ ID NO: 2086941 - DNA, 18 bp, Homo sapiens
gtccctgttctcagctcc

SEQ ID NO: 2086942 - DNA, 22 bp, Homo sapiens
gtcccttcttccctaatcagct

SEQ ID NO: 2086943 - DNA, 14 bp, Homo sapiens
gtcccttgagacct

SEQ ID NO: 2086944 - DNA, 20 bp, Homo sapiens
gtcccttgagacctcagcca

SEQ ID NO: 2086945 - DNA, 21 bp, Homo sapiens
gtcccttgagacctcagccat

SEQ ID NO: 2086946 - DNA, 22 bp, Homo sapiens
gtcccttgagacctcagccatg

SEQ ID NO: 2086947 - DNA, 21 bp, Homo sapiens
gtcccttggaaagttcagcca

SEQ ID NO: 2086948 - DNA, 22 bp, Homo sapiens
gtcccttggaaagttcagccag

SEQ ID NO: 2086949 - DNA, 15 bp, Homo sapiens
gtccgatctttgact

SEQ ID NO: 2086950 - DNA, 14 bp, Homo sapiens
gtccgattaattta

SEQ ID NO: 2086951 - DNA, 17 bp, Homo sapiens
gtccgattaatttatgg

SEQ ID NO: 2086952 - DNA, 19 bp, Homo sapiens
gtccgcaagttcagggaag

SEQ ID NO: 2086953 - DNA, 20 bp, Homo sapiens
gtccgcaagttcagggaagc

SEQ ID NO: 2086954 - DNA, 16 bp, Homo sapiens
gtccgcaccagctgct

SEQ ID NO: 2086955 - DNA, 17 bp, Homo sapiens
gtccgcaccagctgctc

SEQ ID NO: 2086956 - DNA, 18 bp, Homo sapiens
gtccgcaccagctgctct

SEQ ID NO: 2086957 - DNA, 22 bp, Homo sapiens
gtccgcaccagctgctctgccc

SEQ ID NO: 2086958 - DNA, 17 bp, Homo sapiens
gtccgccaaacactcca

SEQ ID NO: 2086959 - DNA, 14 bp, Homo sapiens
gtccgccttaatct

SEQ ID NO: 2086960 - DNA, 13 bp, Homo sapiens
gtccgttccagga

SEQ ID NO: 2086961 - DNA, 16 bp, Homo sapiens
gtcctaactggtatag

SEQ ID NO: 2086962 - DNA, 15 bp, Homo sapiens
gtcctagagctcctg

SEQ ID NO: 2086963 - DNA, 20 bp, Homo sapiens
gtcctagagctcctgtccct

SEQ ID NO: 2086964 - DNA, 18 bp, Homo sapiens
gtcctagccactcaggag

SEQ ID NO: 2086965 - DNA, 13 bp, Homo sapiens
gtcctagcccagt

SEQ ID NO: 2086966 - DNA, 18 bp, Homo sapiens
gtcctatccaaaggaatc

SEQ ID NO: 2086967 - DNA, 20 bp, Homo sapiens
gtcctcagagaatttctacc

SEQ ID NO: 2086968 - DNA, 23 bp, Homo sapiens
gtcctccaacaataaagagctca

SEQ ID NO: 2086969 - DNA, 20 bp, Homo sapiens
gtcctccatttcaactccag

SEQ ID NO: 2086970 - DNA, 20 bp, Homo sapiens
gtcctccccctgccagtgcc

SEQ ID NO: 2086971 - DNA, 22 bp, Homo sapiens
gtcctccccctgccagtgcctt

SEQ ID NO: 2086972 - DNA, 16 bp, Homo sapiens
gtcctcccctatttta

SEQ ID NO: 2086973 - DNA, 18 bp, Homo sapiens
gtcctcccctattttaag

SEQ ID NO: 2086974 - DNA, 15 bp, Homo sapiens
gtcctcctctctcta

SEQ ID NO: 2086975 - DNA, 13 bp, Homo sapiens
gtcctctcgagcc

SEQ ID NO: 2086976 - DNA, 16 bp, Homo sapiens
gtcctgacgccctgcg

SEQ ID NO: 2086977 - DNA, 17 bp, Homo sapiens
gtcctgagcactgccag

SEQ ID NO: 2086978 - DNA, 18 bp, Homo sapiens
gtcctgagcactgccagg

SEQ ID NO: 2086979 - DNA, 19 bp, Homo sapiens
gtcctgagcactgccagga

SEQ ID NO: 2086980 - DNA, 23 bp, Homo sapiens
gtcctgagcactgccaggaggga

SEQ ID NO: 2086981 - DNA, 17 bp, Homo sapiens
gtcctgcaatctccagg

SEQ ID NO: 2086982 - DNA, 20 bp, Homo sapiens
gtcctgcaatctccagggct

SEQ ID NO: 2086983 - DNA, 16 bp, Homo sapiens
gtcctgcagaggacca

SEQ ID NO: 2086984 - DNA, 22 bp, Homo sapiens
gtcctgcatttctcagtcggtg

SEQ ID NO: 2086985 - DNA, 14 bp, Homo sapiens
gtcctgccagctgc

SEQ ID NO: 2086986 - DNA, 17 bp, Homo sapiens
gtcctgccagctgcctt

SEQ ID NO: 2086987 - DNA, 21 bp, Homo sapiens
gtcctgccagctgccttcctc

SEQ ID NO: 2086988 - DNA, 15 bp, Homo sapiens
gtcctgcccaatgcc

SEQ ID NO: 2086989 - DNA, 16 bp, Homo sapiens
gtcctgcccaatgcct

SEQ ID NO: 2086990 - DNA, 23 bp, Homo sapiens
gtcctgcccatgtgtcccctcac

SEQ ID NO: 2086991 - DNA, 22 bp, Homo sapiens
gtcctgcccccgacagcccagc

SEQ ID NO: 2086992 - DNA, 12 bp, Homo sapiens
gtcctgcctctc

SEQ ID NO: 2086993 - DNA, 15 bp, Homo sapiens
gtcctgctggcacct

SEQ ID NO: 2086994 - DNA, 13 bp, Homo sapiens
gtcctggaatgaa

SEQ ID NO: 2086995 - DNA, 12 bp, Homo sapiens
gtcctggcttct

SEQ ID NO: 2086996 - DNA, 22 bp, Homo sapiens
gtcctggggcctcggagcctca

SEQ ID NO: 2086997 - DNA, 15 bp, Homo sapiens
gtcctggggctctgt

SEQ ID NO: 2086998 - DNA, 17 bp, Homo sapiens
gtcctggtggggcagct

SEQ ID NO: 2086999 - DNA, 20 bp, Homo sapiens
gtcctggtggggcagctcct

SEQ ID NO: 2087000 - DNA, 22 bp, Homo sapiens
gtcctggtggggcagctcctct

SEQ ID NO: 2087001 - DNA, 20 bp, Homo sapiens
gtcctgtcaccctggcccca

SEQ ID NO: 2087002 - DNA, 22 bp, Homo sapiens
gtcctgtcaccctggccccaac

SEQ ID NO: 2087003 - DNA, 15 bp, Homo sapiens
gtcctgtcccagagg

SEQ ID NO: 2087004 - DNA, 21 bp, Homo sapiens
gtcctgttaacgtcatctcag

SEQ ID NO: 2087005 - DNA, 18 bp, Homo sapiens
gtccttactcctgtggga

SEQ ID NO: 2087006 - DNA, 14 bp, Homo sapiens
gtccttccaggccc

SEQ ID NO: 2087007 - DNA, 18 bp, Homo sapiens
gtccttgcacccctcact

SEQ ID NO: 2087008 - DNA, 19 bp, Homo sapiens
gtccttgcacccctcactc

SEQ ID NO: 2087009 - DNA, 14 bp, Homo sapiens
gtccttgcacctgc

SEQ ID NO: 2087010 - DNA, 17 bp, Homo sapiens
gtccttgcacctgcatc

SEQ ID NO: 2087011 - DNA, 17 bp, Homo sapiens
gtccttggaagtttcat

SEQ ID NO: 2087012 - DNA, 20 bp, Homo sapiens
gtccttggcaggctgatttc

SEQ ID NO: 2087013 - DNA, 14 bp, Homo sapiens
gtccttggtgtgac

SEQ ID NO: 2087014 - DNA, 22 bp, Homo sapiens
gtccttggtgtgaccctctgaa

SEQ ID NO: 2087015 - DNA, 15 bp, Homo sapiens
gtcctttaggcagcc

SEQ ID NO: 2087016 - DNA, 18 bp, Homo sapiens
gtcctttaggcagcctgc

SEQ ID NO: 2087017 - DNA, 15 bp, Homo sapiens
gtcctttgagaaaga

SEQ ID NO: 2087018 - DNA, 22 bp, Homo sapiens
gtccttttgtaccatggtgtga

SEQ ID NO: 2087019 - DNA, 16 bp, Homo sapiens
gtcgactttgagctgg

SEQ ID NO: 2087020 - DNA, 17 bp, Homo sapiens
gtcgcaggatccgctgc

SEQ ID NO: 2087021 - DNA, 22 bp, Homo sapiens
gtcgccacacccggctccccct

SEQ ID NO: 2087022 - DNA, 23 bp, Homo sapiens
gtcgccacacccggctccccctg

SEQ ID NO: 2087023 - DNA, 13 bp, Homo sapiens
gtcgccaggctag

SEQ ID NO: 2087024 - DNA, 12 bp, Homo sapiens
gtcgcccaggag

SEQ ID NO: 2087025 - DNA, 13 bp, Homo sapiens
gtcgcccaggaga

SEQ ID NO: 2087026 - DNA, 23 bp, Homo sapiens
gtcgcccagtctggaatgcagtg

SEQ ID NO: 2087027 - DNA, 13 bp, Homo sapiens
gtcgccccaggcc

SEQ ID NO: 2087028 - DNA, 15 bp, Homo sapiens
gtcgccccaggccct

SEQ ID NO: 2087029 - DNA, 22 bp, Homo sapiens
gtcgcgcgcagcgcgtgcacag

SEQ ID NO: 2087030 - DNA, 18 bp, Homo sapiens
gtcgctctgctggcctgg

SEQ ID NO: 2087031 - DNA, 19 bp, Homo sapiens
gtcgctgggctgtgggtgc

SEQ ID NO: 2087032 - DNA, 17 bp, Homo sapiens
gtcggcacgtcccatgt

SEQ ID NO: 2087033 - DNA, 22 bp, Homo sapiens
gtcggcacgtcccatgtgcatg

SEQ ID NO: 2087034 - DNA, 23 bp, Homo sapiens
gtcgggttttattgtttaaaatc

SEQ ID NO: 2087035 - DNA, 24 bp, Homo sapiens
gtcgtggagagctaggagcaaagc

SEQ ID NO: 2087036 - DNA, 15 bp, Homo sapiens
gtctaaagtttacag

SEQ ID NO: 2087037 - DNA, 17 bp, Homo sapiens
gtctaaagtttacagta

SEQ ID NO: 2087038 - DNA, 18 bp, Homo sapiens
gtctacgttctccagccc

SEQ ID NO: 2087039 - DNA, 13 bp, Homo sapiens
gtctaggagctgg

SEQ ID NO: 2087040 - DNA, 14 bp, Homo sapiens
gtctagggagagac

SEQ ID NO: 2087041 - DNA, 21 bp, Homo sapiens
gtctagtgaagatgttgtcat

SEQ ID NO: 2087042 - DNA, 21 bp, Homo sapiens
gtctatgtaggcccctggtct

SEQ ID NO: 2087043 - DNA, 10 bp, Homo sapiens
gtctatttaa

SEQ ID NO: 2087044 - DNA, 13 bp, Homo sapiens
gtctcaaacaagg

SEQ ID NO: 2087045 - DNA, 22 bp, Homo sapiens
gtctcaaactcttgacctcagg

SEQ ID NO: 2087046 - DNA, 15 bp, Homo sapiens
gtctcaagactgaaa

SEQ ID NO: 2087047 - DNA, 20 bp, Homo sapiens
gtctcaagagggcactggtg

SEQ ID NO: 2087048 - DNA, 22 bp, Homo sapiens
gtctcaagagggcactggtggc

SEQ ID NO: 2087049 - DNA, 19 bp, Homo sapiens
gtctcactatgttgcccag

SEQ ID NO: 2087050 - DNA, 20 bp, Homo sapiens
gtctcactatgttgcccagg

SEQ ID NO: 2087051 - DNA, 23 bp, Homo sapiens
gtctcactatgttgcccaggcag

SEQ ID NO: 2087052 - DNA, 17 bp, Homo sapiens
gtctcactcctgagtgg

SEQ ID NO: 2087053 - DNA, 13 bp, Homo sapiens
gtctcactgttgc

SEQ ID NO: 2087054 - DNA, 16 bp, Homo sapiens
gtctcactgttgccca

SEQ ID NO: 2087055 - DNA, 22 bp, Homo sapiens
gtctcacttgtgcagtgttgac

SEQ ID NO: 2087056 - DNA, 16 bp, Homo sapiens
gtctcagcccgggaca

SEQ ID NO: 2087057 - DNA, 14 bp, Homo sapiens
gtctcagcctcctc

SEQ ID NO: 2087058 - DNA, 15 bp, Homo sapiens
gtctcaggtccctgc

SEQ ID NO: 2087059 - DNA, 16 bp, Homo sapiens
gtctcaggtccctgca

SEQ ID NO: 2087060 - DNA, 20 bp, Homo sapiens
gtctcagtccagatgccttc

SEQ ID NO: 2087061 - DNA, 23 bp, Homo sapiens
gtctcagtccagatgccttcctg

SEQ ID NO: 2087062 - DNA, 11 bp, Homo sapiens
gtctcattctg

SEQ ID NO: 2087063 - DNA, 23 bp, Homo sapiens
gtctccactaaatgagctcctgc

SEQ ID NO: 2087064 - DNA, 15 bp, Homo sapiens
gtctccactgaggat

SEQ ID NO: 2087065 - DNA, 19 bp, Homo sapiens
gtctccactgaggatgtga

SEQ ID NO: 2087066 - DNA, 14 bp, Homo sapiens
gtctccataatgcc

SEQ ID NO: 2087067 - DNA, 16 bp, Homo sapiens
gtctccctaaaataaa

SEQ ID NO: 2087068 - DNA, 18 bp, Homo sapiens
gtctccctaaaataaaaa

SEQ ID NO: 2087069 - DNA, 23 bp, Homo sapiens
gtctccctaaaataaaaaccaga

SEQ ID NO: 2087070 - DNA, 16 bp, Homo sapiens
gtctccctctcctgcc

SEQ ID NO: 2087071 - DNA, 17 bp, Homo sapiens
gtctccctctcctgcct

SEQ ID NO: 2087072 - DNA, 16 bp, Homo sapiens
gtctccctggagtgca

SEQ ID NO: 2087073 - DNA, 19 bp, Homo sapiens
gtctcctctgattatcagg

SEQ ID NO: 2087074 - DNA, 12 bp, Homo sapiens
gtctcctgacat

SEQ ID NO: 2087075 - DNA, 17 bp, Homo sapiens
gtctccttactctgagc

SEQ ID NO: 2087076 - DNA, 22 bp, Homo sapiens
gtctccttactctgagcccagg

SEQ ID NO: 2087077 - DNA, 15 bp, Homo sapiens
gtctcctttgcactg

SEQ ID NO: 2087078 - DNA, 13 bp, Homo sapiens
gtctcgagcgccc

SEQ ID NO: 2087079 - DNA, 20 bp, Homo sapiens
gtctcgagcgccctgcagac

SEQ ID NO: 2087080 - DNA, 23 bp, Homo sapiens
gtctcgagcgccctgcagaccct

SEQ ID NO: 2087081 - DNA, 14 bp, Homo sapiens
gtctctagccactt

SEQ ID NO: 2087082 - DNA, 12 bp, Homo sapiens
gtctctcattct

SEQ ID NO: 2087083 - DNA, 18 bp, Homo sapiens
gtctctcattctctttct

SEQ ID NO: 2087084 - DNA, 19 bp, Homo sapiens
gtctctccactgctctcag

SEQ ID NO: 2087085 - DNA, 20 bp, Homo sapiens
gtctctccactgctctcagc

SEQ ID NO: 2087086 - DNA, 20 bp, Homo sapiens
gtctctcccaccccggcctc

SEQ ID NO: 2087087 - DNA, 19 bp, Homo sapiens
gtctctctctctctacaaa

SEQ ID NO: 2087088 - DNA, 12 bp, Homo sapiens
gtctctgagaac

SEQ ID NO: 2087089 - DNA, 19 bp, Homo sapiens
gtctctgctcttgcctgca

SEQ ID NO: 2087090 - DNA, 21 bp, Homo sapiens
gtctctggaacccaggacctc

SEQ ID NO: 2087091 - DNA, 20 bp, Homo sapiens
gtctctgtataatctattta

SEQ ID NO: 2087092 - DNA, 18 bp, Homo sapiens
gtctctgtccctcactgc

SEQ ID NO: 2087093 - DNA, 22 bp, Homo sapiens
gtctctgtccctcactgccttc

SEQ ID NO: 2087094 - DNA, 21 bp, Homo sapiens
gtctcttccagtttgctttgc

SEQ ID NO: 2087095 - DNA, 14 bp, Homo sapiens
gtctcttgtagaag

SEQ ID NO: 2087096 - DNA, 18 bp, Homo sapiens
gtctctttaatgtcacag

SEQ ID NO: 2087097 - DNA, 15 bp, Homo sapiens
gtctgaaagacagaa

SEQ ID NO: 2087098 - DNA, 20 bp, Homo sapiens
gtctgaaggaatagccagag

SEQ ID NO: 2087099 - DNA, 21 bp, Homo sapiens
gtctgaaggaatagccagaga

SEQ ID NO: 2087100 - DNA, 15 bp, Homo sapiens
gtctgacaggcaatg

SEQ ID NO: 2087101 - DNA, 21 bp, Homo sapiens
gtctgacaggcaatgctggct

SEQ ID NO: 2087102 - DNA, 14 bp, Homo sapiens
gtctgacccactgc

SEQ ID NO: 2087103 - DNA, 16 bp, Homo sapiens
gtctgactccagagtc

SEQ ID NO: 2087104 - DNA, 17 bp, Homo sapiens
gtctgactccagagtct

SEQ ID NO: 2087105 - DNA, 22 bp, Homo sapiens
gtctgactccagagtctgagcc

SEQ ID NO: 2087106 - DNA, 18 bp, Homo sapiens
gtctgaggaatccagacc

SEQ ID NO: 2087107 - DNA, 15 bp, Homo sapiens
gtctgaggccccagg

SEQ ID NO: 2087108 - DNA, 18 bp, Homo sapiens
gtctgaggtcctgagcac

SEQ ID NO: 2087109 - DNA, 19 bp, Homo sapiens
gtctgaggtcctgagcact

SEQ ID NO: 2087110 - DNA, 21 bp, Homo sapiens
gtctgaggtcctgagcactgc

SEQ ID NO: 2087111 - DNA, 22 bp, Homo sapiens
gtctgagtcctgtctctgcctg

SEQ ID NO: 2087112 - DNA, 19 bp, Homo sapiens
gtctgattcccaagctctg

SEQ ID NO: 2087113 - DNA, 20 bp, Homo sapiens
gtctgattggctcacccaag

SEQ ID NO: 2087114 - DNA, 22 bp, Homo sapiens
gtctgcattgttattgtggaag

SEQ ID NO: 2087115 - DNA, 18 bp, Homo sapiens
gtctgccagccagcagcc

SEQ ID NO: 2087116 - DNA, 11 bp, Homo sapiens
gtctgccaggc

SEQ ID NO: 2087117 - DNA, 14 bp, Homo sapiens
gtctgccccaccct

SEQ ID NO: 2087118 - DNA, 23 bp, Homo sapiens
gtctgcccccgtcttctctccat

SEQ ID NO: 2087119 - DNA, 21 bp, Homo sapiens
gtctgctcaggaattgaagat

SEQ ID NO: 2087120 - DNA, 11 bp, Homo sapiens
gtctgcttctg

SEQ ID NO: 2087121 - DNA, 19 bp, Homo sapiens
gtctgcttctgtccaggac

SEQ ID NO: 2087122 - DNA, 21 bp, Homo sapiens
gtgaccctctgaatggtccag

SEQ ID NO: 2087123 - DNA, 18 bp, Homo sapiens
gtgacccttcagggccag

SEQ ID NO: 2087124 - DNA, 15 bp, Homo sapiens
gtgacctctgcctga

SEQ ID NO: 2087125 - DNA, 14 bp, Homo sapiens
gtgacgattattta

SEQ ID NO: 2087126 - DNA, 24 bp, Homo sapiens
gtgacggtcctttaggcagcctgc

SEQ ID NO: 2087127 - DNA, 20 bp, Homo sapiens
gtgactattttttaataaaa

SEQ ID NO: 2087128 - DNA, 20 bp, Homo sapiens
gtgactcggtgtaaaaccat

SEQ ID NO: 2087129 - DNA, 14 bp, Homo sapiens
gtgactctacctgc

SEQ ID NO: 2087130 - DNA, 12 bp, Homo sapiens
gtgactgaaggg

SEQ ID NO: 2087131 - DNA, 19 bp, Homo sapiens
gtgactgaaggggcacacc

SEQ ID NO: 2087132 - DNA, 22 bp, Homo sapiens
gtgactgaaggggcacaccact

SEQ ID NO: 2087133 - DNA, 17 bp, Homo sapiens
gtgactgaatttgggcc

SEQ ID NO: 2087134 - DNA, 22 bp, Homo sapiens
gtgactgaatttgggcctcttg

SEQ ID NO: 2087135 - DNA, 16 bp, Homo sapiens
gtgactgccaaggtgt

SEQ ID NO: 2087136 - DNA, 21 bp, Homo sapiens
gtgactgccccaactcctgga

SEQ ID NO: 2087137 - DNA, 12 bp, Homo sapiens
gtgactggcacc

SEQ ID NO: 2087138 - DNA, 12 bp, Homo sapiens
gtgactggcagg

SEQ ID NO: 2087139 - DNA, 13 bp, Homo sapiens
gtgactggcaggt

SEQ ID NO: 2087140 - DNA, 24 bp, Homo sapiens
gtgactggcaggtgcagatgggct

SEQ ID NO: 2087141 - DNA, 21 bp, Homo sapiens
gtgactgtcaagtacaagcaa

SEQ ID NO: 2087142 - DNA, 21 bp, Homo sapiens
gtgactgtcccaccgggagcc

SEQ ID NO: 2087143 - DNA, 16 bp, Homo sapiens
gtgacttcagctctgt

SEQ ID NO: 2087144 - DNA, 21 bp, Homo sapiens
gtgacttcctcgcctctccca

SEQ ID NO: 2087145 - DNA, 22 bp, Homo sapiens
gtgagaatcgacctcactgtca

SEQ ID NO: 2087146 - DNA, 21 bp, Homo sapiens
gtgagacacagagtggagccc

SEQ ID NO: 2087147 - DNA, 20 bp, Homo sapiens
gtgagaccacctctcaatat

SEQ ID NO: 2087148 - DNA, 16 bp, Homo sapiens
gtgagaccctgtctct

SEQ ID NO: 2087149 - DNA, 14 bp, Homo sapiens
gtgagactgacacc

SEQ ID NO: 2087150 - DNA, 22 bp, Homo sapiens
gtgagactgacacctcactgag

SEQ ID NO: 2087151 - DNA, 16 bp, Homo sapiens
gtgagagaatctgcct

SEQ ID NO: 2087152 - DNA, 13 bp, Homo sapiens
gtgagagtgagct

SEQ ID NO: 2087153 - DNA, 15 bp, Homo sapiens
gtgagcatctctgtg

SEQ ID NO: 2087154 - DNA, 15 bp, Homo sapiens
gtgagccaaagagaa

SEQ ID NO: 2087155 - DNA, 16 bp, Homo sapiens
gtgagccacagaccac

SEQ ID NO: 2087156 - DNA, 21 bp, Homo sapiens
gtgagccacagaccacctgct

SEQ ID NO: 2087157 - DNA, 20 bp, Homo sapiens
gtgagccaggtaatgaggga

SEQ ID NO: 2087158 - DNA, 14 bp, Homo sapiens
gtgagcccctggtc

SEQ ID NO: 2087159 - DNA, 18 bp, Homo sapiens
gtgagccgcatcttctcc

SEQ ID NO: 2087160 - DNA, 14 bp, Homo sapiens
gtgaggaaatggca

SEQ ID NO: 2087161 - DNA, 20 bp, Homo sapiens
gtgaggccgggcgcagtggc

SEQ ID NO: 2087162 - DNA, 11 bp, Homo sapiens
gtgaggcctgg

SEQ ID NO: 2087163 - DNA, 16 bp, Homo sapiens
gtgaggcctggccagg

SEQ ID NO: 2087164 - DNA, 18 bp, Homo sapiens
gtgaggtgctgatgagtg

SEQ ID NO: 2087165 - DNA, 12 bp, Homo sapiens
gtgagtggcagc

SEQ ID NO: 2087166 - DNA, 17 bp, Homo sapiens
gtgagtggcagccatgc

SEQ ID NO: 2087167 - DNA, 11 bp, Homo sapiens
gtgataagtgg

SEQ ID NO: 2087168 - DNA, 15 bp, Homo sapiens
gtgataagtggaaaa

SEQ ID NO: 2087169 - DNA, 19 bp, Homo sapiens
gtgataagtggaaaaaaga

SEQ ID NO: 2087170 - DNA, 20 bp, Homo sapiens
gtgatacatgtactccagag

SEQ ID NO: 2087171 - DNA, 18 bp, Homo sapiens
gtgatagctaacatttta

SEQ ID NO: 2087172 - DNA, 14 bp, Homo sapiens
gtgatatcacctct

SEQ ID NO: 2087173 - DNA, 21 bp, Homo sapiens
gtgatatcacctctcttcagc

SEQ ID NO: 2087174 - DNA, 16 bp, Homo sapiens
gtgatatcctgaaaaa

SEQ ID NO: 2087175 - DNA, 17 bp, Homo sapiens
gtgatcaactgttcagg

SEQ ID NO: 2087176 - DNA, 23 bp, Homo sapiens
gtgatcagaaggctggggccagt

SEQ ID NO: 2087177 - DNA, 19 bp, Homo sapiens
gtgatcagtatgctgtttt

SEQ ID NO: 2087178 - DNA, 20 bp, Homo sapiens
gtgatcagtatgctgtttta

SEQ ID NO: 2087179 - DNA, 17 bp, Homo sapiens
gtgatccacccacctca

SEQ ID NO: 2087180 - DNA, 21 bp, Homo sapiens
gtgatccctagctgtgacctc

SEQ ID NO: 2087181 - DNA, 22 bp, Homo sapiens
gtgatccctagctgtgacctct

SEQ ID NO: 2087182 - DNA, 18 bp, Homo sapiens
gtgatcctcccacctcag

SEQ ID NO: 2087183 - DNA, 20 bp, Homo sapiens
gtgatcctcccacctcagcc

SEQ ID NO: 2087184 - DNA, 14 bp, Homo sapiens
gtgatccttttatg

SEQ ID NO: 2087185 - DNA, 13 bp, Homo sapiens
gtgatctccatat

SEQ ID NO: 2087186 - DNA, 15 bp, Homo sapiens
gtgatctgctggcct

SEQ ID NO: 2087187 - DNA, 19 bp, Homo sapiens
gtgatctgtcccctctccc

SEQ ID NO: 2087188 - DNA, 16 bp, Homo sapiens
gtgatgagggcagcag

SEQ ID NO: 2087189 - DNA, 17 bp, Homo sapiens
gtgatgagggcagcagc

SEQ ID NO: 2087190 - DNA, 20 bp, Homo sapiens
gtgatgagggcagcagccag

SEQ ID NO: 2087191 - DNA, 21 bp, Homo sapiens
gtgatgagggcagcagccagc

SEQ ID NO: 2087192 - DNA, 21 bp, Homo sapiens
gtgatgctggtaccactggaa

SEQ ID NO: 2087193 - DNA, 14 bp, Homo sapiens
gtgatggagtgtgc

SEQ ID NO: 2087194 - DNA, 21 bp, Homo sapiens
gtgatggcgcgggaggcacca

SEQ ID NO: 2087195 - DNA, 17 bp, Homo sapiens
gtgatgggaaagcattg

SEQ ID NO: 2087196 - DNA, 15 bp, Homo sapiens
gtgatggggtgggca

SEQ ID NO: 2087197 - DNA, 16 bp, Homo sapiens
gtgatggggtgggcag

SEQ ID NO: 2087198 - DNA, 18 bp, Homo sapiens
gtgatggggtgggcaggg

SEQ ID NO: 2087199 - DNA, 20 bp, Homo sapiens
gtgatggggtgggcagggct

SEQ ID NO: 2087200 - DNA, 21 bp, Homo sapiens
gtgatgtcttcaataaattaa

SEQ ID NO: 2087201 - DNA, 23 bp, Homo sapiens
gtgatgttgtttgggagagtgca

SEQ ID NO: 2087202 - DNA, 16 bp, Homo sapiens
gtgatgtttttatgat

SEQ ID NO: 2087203 - DNA, 15 bp, Homo sapiens
gtgattaacttgctt

SEQ ID NO: 2087204 - DNA, 15 bp, Homo sapiens
gtgattcctgcattt

SEQ ID NO: 2087205 - DNA, 22 bp, Homo sapiens
gtgattccttttgatggggaga

SEQ ID NO: 2087206 - DNA, 23 bp, Homo sapiens
gtgattccttttgatggggagaa

SEQ ID NO: 2087207 - DNA, 20 bp, Homo sapiens
gtgattctcctgcctcagcc

SEQ ID NO: 2087208 - DNA, 22 bp, Homo sapiens
gtgattctcctgcctcagcctc

SEQ ID NO: 2087209 - DNA, 18 bp, Homo sapiens
gtgatttacgctcattgt

SEQ ID NO: 2087210 - DNA, 19 bp, Homo sapiens
gtgatttcagagagggcag

SEQ ID NO: 2087211 - DNA, 23 bp, Homo sapiens
gtgatttggaagagaggcacctg

SEQ ID NO: 2087212 - DNA, 21 bp, Homo sapiens
gtgattttgtacagaattttt

SEQ ID NO: 2087213 - DNA, 14 bp, Homo sapiens
gtgatttttttgtc

SEQ ID NO: 2087214 - DNA, 15 bp, Homo sapiens
gtgcaaagtgccctc

SEQ ID NO: 2087215 - DNA, 20 bp, Homo sapiens
gtgcaaattttgcatttagt

SEQ ID NO: 2087216 - DNA, 20 bp, Homo sapiens
gtgcaacaagagcaaaatga

SEQ ID NO: 2087217 - DNA, 15 bp, Homo sapiens
gtgcaagagacagag

SEQ ID NO: 2087218 - DNA, 21 bp, Homo sapiens
gtgcaagagacagagccccca

SEQ ID NO: 2087219 - DNA, 20 bp, Homo sapiens
gtgcaagagactctggcctc

SEQ ID NO: 2087220 - DNA, 22 bp, Homo sapiens
gtgcaagagactctggcctcca

SEQ ID NO: 2087221 - DNA, 15 bp, Homo sapiens
gtgcaaggggctcag

SEQ ID NO: 2087222 - DNA, 21 bp, Homo sapiens
gtgcaaggggctcagcaaggt

SEQ ID NO: 2087223 - DNA, 17 bp, Homo sapiens
gtgcaagttgtactgta

SEQ ID NO: 2087224 - DNA, 17 bp, Homo sapiens
gtgcaatgagccagatg

SEQ ID NO: 2087225 - DNA, 17 bp, Homo sapiens
gtgcaatgtaaatattt

SEQ ID NO: 2087226 - DNA, 20 bp, Homo sapiens
gtgcaatgtaaatattttaa

SEQ ID NO: 2087227 - DNA, 13 bp, Homo sapiens
gtgcacacttgta

SEQ ID NO: 2087228 - DNA, 21 bp, Homo sapiens
gtgcacagcgcgggcggaggc

SEQ ID NO: 2087229 - DNA, 15 bp, Homo sapiens
gtgcacatgtgtctg

SEQ ID NO: 2087230 - DNA, 16 bp, Homo sapiens
gtgcacatgtgtctgt

SEQ ID NO: 2087231 - DNA, 18 bp, Homo sapiens
gtgcaccaccatgccagg

SEQ ID NO: 2087232 - DNA, 19 bp, Homo sapiens
gtgcaccaccatgccaggc

SEQ ID NO: 2087233 - DNA, 18 bp, Homo sapiens
gtgcacccactcaccagg

SEQ ID NO: 2087234 - DNA, 19 bp, Homo sapiens
gtgcacccactcaccaggg

SEQ ID NO: 2087235 - DNA, 22 bp, Homo sapiens
gtgcacccactcaccagggtcc

SEQ ID NO: 2087236 - DNA, 22 bp, Homo sapiens
gtgctgcgagatcgctggcaga

SEQ ID NO: 2087237 - DNA, 21 bp, Homo sapiens
gtgctgggattacaagcgtga

SEQ ID NO: 2087238 - DNA, 20 bp, Homo sapiens
gtgctgggattacaggtgtg

SEQ ID NO: 2087239 - DNA, 18 bp, Homo sapiens
gtgctgtgcctgctagag

SEQ ID NO: 2087240 - DNA, 20 bp, Homo sapiens
gtgctgtgcctgctagagca

SEQ ID NO: 2087241 - DNA, 17 bp, Homo sapiens
gtgctgtggccagggtg

SEQ ID NO: 2087242 - DNA, 18 bp, Homo sapiens
gtgctgtggccagggtga

SEQ ID NO: 2087243 - DNA, 23 bp, Homo sapiens
gtgctgtggccagggtgagagct

SEQ ID NO: 2087244 - DNA, 18 bp, Homo sapiens
gtgctgtgggcagcaccc

SEQ ID NO: 2087245 - DNA, 18 bp, Homo sapiens
gtgcttacagtgactgtc

SEQ ID NO: 2087246 - DNA, 13 bp, Homo sapiens
gtgcttcagcctg

SEQ ID NO: 2087247 - DNA, 15 bp, Homo sapiens
gtgcttcagcctgag

SEQ ID NO: 2087248 - DNA, 20 bp, Homo sapiens
gtgcttccctaggctgagct

SEQ ID NO: 2087249 - DNA, 19 bp, Homo sapiens
gtgcttctccaacactgaa

SEQ ID NO: 2087250 - DNA, 21 bp, Homo sapiens
gtgcttgggtggtgggtgctg

SEQ ID NO: 2087251 - DNA, 15 bp, Homo sapiens
gtgcttgtcatctgc

SEQ ID NO: 2087252 - DNA, 15 bp, Homo sapiens
gtggaaaaaagagaa

SEQ ID NO: 2087253 - DNA, 18 bp, Homo sapiens
gtggaagccctccttcca

SEQ ID NO: 2087254 - DNA, 18 bp, Homo sapiens
gtggaaggcagggacaga

SEQ ID NO: 2087255 - DNA, 20 bp, Homo sapiens
gtggaagggggtgtgcgtgc

SEQ ID NO: 2087256 - DNA, 18 bp, Homo sapiens
gtggaatgcagggaagag

SEQ ID NO: 2087257 - DNA, 23 bp, Homo sapiens
gtggacacagctcttctccaggc

SEQ ID NO: 2087258 - DNA, 24 bp, Homo sapiens
gtggacacagctcttctccaggct

SEQ ID NO: 2087259 - DNA, 21 bp, Homo sapiens
gtggacaccaggagtccctgg

SEQ ID NO: 2087260 - DNA, 22 bp, Homo sapiens
gtggacaccaggagtccctggt

SEQ ID NO: 2087261 - DNA, 11 bp, Homo sapiens
gtggacacctg

SEQ ID NO: 2087262 - DNA, 12 bp, Homo sapiens
gtggacacctgc

SEQ ID NO: 2087263 - DNA, 14 bp, Homo sapiens
gtggacacctgccc

SEQ ID NO: 2087264 - DNA, 19 bp, Homo sapiens
gtggacacctgccctgccc

SEQ ID NO: 2087265 - DNA, 14 bp, Homo sapiens
gtggacagtcctgg

SEQ ID NO: 2087266 - DNA, 16 bp, Homo sapiens
gtggacagtcctggga

SEQ ID NO: 2087267 - DNA, 16 bp, Homo sapiens
gtggacatcatgaagc

SEQ ID NO: 2087268 - DNA, 15 bp, Homo sapiens
gtggaccttcctgcc

SEQ ID NO: 2087269 - DNA, 23 bp, Homo sapiens
gtggagaaataaaaatacctctt

SEQ ID NO: 2087270 - DNA, 15 bp, Homo sapiens
gtggagagtgagaat

SEQ ID NO: 2087271 - DNA, 19 bp, Homo sapiens
gtggaggaaggtgctgagc

SEQ ID NO: 2087272 - DNA, 20 bp, Homo sapiens
gtggaggaaggtgctgagct

SEQ ID NO: 2087273 - DNA, 20 bp, Homo sapiens
gtggaggagctcaggacact

SEQ ID NO: 2087274 - DNA, 13 bp, Homo sapiens
gtggaggcctgat

SEQ ID NO: 2087275 - DNA, 12 bp, Homo sapiens
gtggaggctgct

SEQ ID NO: 2087276 - DNA, 19 bp, Homo sapiens
gtggagggtcgccacaccc

SEQ ID NO: 2087277 - DNA, 17 bp, Homo sapiens
gtggaggttgcagtgag

SEQ ID NO: 2087278 - DNA, 22 bp, Homo sapiens
gtggaggttgcagtgagctgag

SEQ ID NO: 2087279 - DNA, 14 bp, Homo sapiens
gtggatagctgcct

SEQ ID NO: 2087280 - DNA, 13 bp, Homo sapiens
gtggatcacagag

SEQ ID NO: 2087281 - DNA, 16 bp, Homo sapiens
gtggatcacagaggct

SEQ ID NO: 2087282 - DNA, 13 bp, Homo sapiens
gtggatcacctga

SEQ ID NO: 2087283 - DNA, 16 bp, Homo sapiens
gtggatgcctggtggc

SEQ ID NO: 2087284 - DNA, 18 bp, Homo sapiens
gtggatgcctggtggcag

SEQ ID NO: 2087285 - DNA, 21 bp, Homo sapiens
gtggatgcctggtggcagctg

SEQ ID NO: 2087286 - DNA, 17 bp, Homo sapiens
gtggatgctccagggca

SEQ ID NO: 2087287 - DNA, 18 bp, Homo sapiens
gtggatgctccagggcag

SEQ ID NO: 2087288 - DNA, 17 bp, Homo sapiens
gtggatggatggacaga

SEQ ID NO: 2087289 - DNA, 20 bp, Homo sapiens
gtggattagctagaatgcac

SEQ ID NO: 2087290 - DNA, 13 bp, Homo sapiens
gtggattgagggt

SEQ ID NO: 2087291 - DNA, 14 bp, Homo sapiens
gtggcaaagtgctg

SEQ ID NO: 2087292 - DNA, 15 bp, Homo sapiens
gtggcaaagtgctgt

SEQ ID NO: 2087293 - DNA, 16 bp, Homo sapiens
gtggcaaagtgctgta

SEQ ID NO: 2087294 - DNA, 13 bp, Homo sapiens
gtggcaaatataa

SEQ ID NO: 2087295 - DNA, 20 bp, Homo sapiens
gtggcaccagatgcaacctc

SEQ ID NO: 2087296 - DNA, 13 bp, Homo sapiens
gtggcacctcctg

SEQ ID NO: 2087297 - DNA, 19 bp, Homo sapiens
gtggcacggagagaaggcc

SEQ ID NO: 2087298 - DNA, 19 bp, Homo sapiens
gtggcagaaaagaggagac

SEQ ID NO: 2087299 - DNA, 18 bp, Homo sapiens
gtggcagaccgggggcca

SEQ ID NO: 2087300 - DNA, 16 bp, Homo sapiens
gtggcagccatgcctc

SEQ ID NO: 2087301 - DNA, 17 bp, Homo sapiens
gtggcagccatgcctca

SEQ ID NO: 2087302 - DNA, 20 bp, Homo sapiens
gtggcagccatgcctcatgc

SEQ ID NO: 2087303 - DNA, 12 bp, Homo sapiens
gtggcagccctg

SEQ ID NO: 2087304 - DNA, 13 bp, Homo sapiens
gtggcagccctgt

SEQ ID NO: 2087305 - DNA, 14 bp, Homo sapiens
gtggcagccctgta

SEQ ID NO: 2087306 - DNA, 14 bp, Homo sapiens
gtggcagctgcggt

SEQ ID NO: 2087307 - DNA, 22 bp, Homo sapiens
gtggcagctgcggtccacccag

SEQ ID NO: 2087308 - DNA, 23 bp, Homo sapiens
gtggcagctgcggtccacccagg

SEQ ID NO: 2087309 - DNA, 12 bp, Homo sapiens
gtggcagctgct

SEQ ID NO: 2087310 - DNA, 15 bp, Homo sapiens
gtggcaggaccagga

SEQ ID NO: 2087311 - DNA, 20 bp, Homo sapiens
gtggcaggcacacagcagcc

SEQ ID NO: 2087312 - DNA, 21 bp, Homo sapiens
gtggcaggcacacagcagccc

SEQ ID NO: 2087313 - DNA, 17 bp, Homo sapiens
gtggcaggcctaggacc

SEQ ID NO: 2087314 - DNA, 22 bp, Homo sapiens
gtggcatgttcatcgtataaca

SEQ ID NO: 2087315 - DNA, 22 bp, Homo sapiens
gtggccaatccaggtgggagag

SEQ ID NO: 2087316 - DNA, 21 bp, Homo sapiens
gtggccactccagacccctgg

SEQ ID NO: 2087317 - DNA, 16 bp, Homo sapiens
gtggccactttaagag

SEQ ID NO: 2087318 - DNA, 12 bp, Homo sapiens
gtggccagagct

SEQ ID NO: 2087319 - DNA, 15 bp, Homo sapiens
gtggccagagctgga

SEQ ID NO: 2087320 - DNA, 19 bp, Homo sapiens
gtggccagagctggaaggc

SEQ ID NO: 2087321 - DNA, 16 bp, Homo sapiens
gtggccatcagggtgg

SEQ ID NO: 2087322 - DNA, 15 bp, Homo sapiens
gtggccatccctggg

SEQ ID NO: 2087323 - DNA, 19 bp, Homo sapiens
gtggccatgcttcttgccc

SEQ ID NO: 2087324 - DNA, 17 bp, Homo sapiens
gtggccccctgtgccag

SEQ ID NO: 2087325 - DNA, 18 bp, Homo sapiens
gtggccccctgtgccagc

SEQ ID NO: 2087326 - DNA, 21 bp, Homo sapiens
gtggccccctgtgccagctca

SEQ ID NO: 2087327 - DNA, 18 bp, Homo sapiens
gtggcccctcacctgggc

SEQ ID NO: 2087328 - DNA, 21 bp, Homo sapiens
gtggcccctcacctgggcctt

SEQ ID NO: 2087329 - DNA, 18 bp, Homo sapiens
gtggcccgacagcctggc

SEQ ID NO: 2087330 - DNA, 17 bp, Homo sapiens
gtggccctgccctctcc

SEQ ID NO: 2087331 - DNA, 21 bp, Homo sapiens
gtggccctgccctctccttcc

SEQ ID NO: 2087332 - DNA, 13 bp, Homo sapiens
gtggcccttcctg

SEQ ID NO: 2087333 - DNA, 15 bp, Homo sapiens
gtggcccttcctgga

SEQ ID NO: 2087334 - DNA, 17 bp, Homo sapiens
gtggcccttcctggaca

SEQ ID NO: 2087335 - DNA, 18 bp, Homo sapiens
gtggcccttcctggacag

SEQ ID NO: 2087336 - DNA, 22 bp, Homo sapiens
gtggccgcaagcgcagggagga

SEQ ID NO: 2087337 - DNA, 14 bp, Homo sapiens
gtggccggggaagc

SEQ ID NO: 2087338 - DNA, 22 bp, Homo sapiens
gtggcctcacttccctgggaac

SEQ ID NO: 2087339 - DNA, 15 bp, Homo sapiens
gtggcctcagccctc

SEQ ID NO: 2087340 - DNA, 12 bp, Homo sapiens
gtggcctgggca

SEQ ID NO: 2087341 - DNA, 14 bp, Homo sapiens
gtggcctgggcaag

SEQ ID NO: 2087342 - DNA, 20 bp, Homo sapiens
gtggcctgtgtccagcagct

SEQ ID NO: 2087343 - DNA, 21 bp, Homo sapiens
gtggccttccccttttgcctg

SEQ ID NO: 2087344 - DNA, 12 bp, Homo sapiens
gtggccttgccc

SEQ ID NO: 2087345 - DNA, 20 bp, Homo sapiens
gtggccttgttctgtcacca

SEQ ID NO: 2087346 - DNA, 13 bp, Homo sapiens
gtggcggtgcctg

SEQ ID NO: 2087347 - DNA, 18 bp, Homo sapiens
gtggctactctgtgccag

SEQ ID NO: 2087348 - DNA, 22 bp, Homo sapiens
gtggctcacgcctataatccca

SEQ ID NO: 2087349 - DNA, 14 bp, Homo sapiens
gtggctgacccagt

SEQ ID NO: 2087350 - DNA, 15 bp, Homo sapiens
gtggctgacccagtc

SEQ ID NO: 2087351 - DNA, 17 bp, Homo sapiens
gttaggaggctgcatgc

SEQ ID NO: 2087352 - DNA, 22 bp, Homo sapiens
gttaggaggctgcatgctctgg

SEQ ID NO: 2087353 - DNA, 23 bp, Homo sapiens
gttaggaggctgcatgctctgga

SEQ ID NO: 2087354 - DNA, 11 bp, Homo sapiens
gttagggaggg

SEQ ID NO: 2087355 - DNA, 13 bp, Homo sapiens
gttagggaggggt

SEQ ID NO: 2087356 - DNA, 16 bp, Homo sapiens
gttagtatctaacatg

SEQ ID NO: 2087357 - DNA, 22 bp, Homo sapiens
gttagtcatttgctgagcatgt

SEQ ID NO: 2087358 - DNA, 19 bp, Homo sapiens
gttagtgtgtgtgcatgtg

SEQ ID NO: 2087359 - DNA, 23 bp, Homo sapiens
gttagtgtgtgtgcatgtgtgtg

SEQ ID NO: 2087360 - DNA, 18 bp, Homo sapiens
gttagtgtgttgtctgtg

SEQ ID NO: 2087361 - DNA, 19 bp, Homo sapiens
gttagtgtgttgtctgtgc

SEQ ID NO: 2087362 - DNA, 20 bp, Homo sapiens
gttagtgtgttgtctgtgca

SEQ ID NO: 2087363 - DNA, 14 bp, Homo sapiens
gttagtttttactt

SEQ ID NO: 2087364 - DNA, 18 bp, Homo sapiens
gttataaatcaatgtcac

SEQ ID NO: 2087365 - DNA, 16 bp, Homo sapiens
gttataagaaacagag

SEQ ID NO: 2087366 - DNA, 19 bp, Homo sapiens
gttatactgtcggtttttt

SEQ ID NO: 2087367 - DNA, 19 bp, Homo sapiens
gttatagtatatctggaca

SEQ ID NO: 2087368 - DNA, 17 bp, Homo sapiens
gttatatattttttgta

SEQ ID NO: 2087369 - DNA, 19 bp, Homo sapiens
gttatattgaatatatcag

SEQ ID NO: 2087370 - DNA, 16 bp, Homo sapiens
gttatcagttaacatt

SEQ ID NO: 2087371 - DNA, 21 bp, Homo sapiens
gttatctaagttaatttaaag

SEQ ID NO: 2087372 - DNA, 17 bp, Homo sapiens
gttatgaaaacagatgc

SEQ ID NO: 2087373 - DNA, 19 bp, Homo sapiens
gttatgtatatagatgtgc

SEQ ID NO: 2087374 - DNA, 13 bp, Homo sapiens
gttattctcttca

SEQ ID NO: 2087375 - DNA, 15 bp, Homo sapiens
gttattgaaaatata

SEQ ID NO: 2087376 - DNA, 21 bp, Homo sapiens
gttattgggcaagtgattgaa

SEQ ID NO: 2087377 - DNA, 19 bp, Homo sapiens
gttatttatagtcatttat

SEQ ID NO: 2087378 - DNA, 13 bp, Homo sapiens
gttatttgtacag

SEQ ID NO: 2087379 - DNA, 14 bp, Homo sapiens
gttatttgtacagt

SEQ ID NO: 2087380 - DNA, 20 bp, Homo sapiens
gttatttgtacagttcagtt

SEQ ID NO: 2087381 - DNA, 18 bp, Homo sapiens
gttattttaggagacagt

SEQ ID NO: 2087382 - DNA, 17 bp, Homo sapiens
gttattttcagtatttt

SEQ ID NO: 2087383 - DNA, 23 bp, Homo sapiens
gttattttctttgaaattgttta

SEQ ID NO: 2087384 - DNA, 20 bp, Homo sapiens
gttatttttgtccctgctcc

SEQ ID NO: 2087385 - DNA, 21 bp, Homo sapiens
gttattttttaattattattt

SEQ ID NO: 2087386 - DNA, 14 bp, Homo sapiens
gttcaagcctgtgg

SEQ ID NO: 2087387 - DNA, 16 bp, Homo sapiens
gttcaagcctgtggga

SEQ ID NO: 2087388 - DNA, 20 bp, Homo sapiens
gttcaagcgattcttctgct

SEQ ID NO: 2087389 - DNA, 18 bp, Homo sapiens
gttcaaggaccacatgtg

SEQ ID NO: 2087390 - DNA, 20 bp, Homo sapiens
gttcaatgcaaagtaaaaaa

SEQ ID NO: 2087391 - DNA, 15 bp, Homo sapiens
gttcaattccctgaa

SEQ ID NO: 2087392 - DNA, 18 bp, Homo sapiens
gttcacaacataaggaga

SEQ ID NO: 2087393 - DNA, 17 bp, Homo sapiens
gttcaccttatgtatta

SEQ ID NO: 2087394 - DNA, 21 bp, Homo sapiens
gttcaccttatgtattatttt

SEQ ID NO: 2087395 - DNA, 16 bp, Homo sapiens
gttcacgcaacttgaa

SEQ ID NO: 2087396 - DNA, 19 bp, Homo sapiens
gttcactgcaacctccgcc

SEQ ID NO: 2087397 - DNA, 16 bp, Homo sapiens
gttcagagactcaggg

SEQ ID NO: 2087398 - DNA, 21 bp, Homo sapiens
gttcagcccctcctctgccac

SEQ ID NO: 2087399 - DNA, 13 bp, Homo sapiens
gttcagctccagc

SEQ ID NO: 2087400 - DNA, 14 bp, Homo sapiens
gttcagggaagcag

SEQ ID NO: 2087401 - DNA, 17 bp, Homo sapiens
gttcagggaagcaggca

SEQ ID NO: 2087402 - DNA, 19 bp, Homo sapiens
gttcagggaagcaggcaga

SEQ ID NO: 2087403 - DNA, 21 bp, Homo sapiens
gttcagggttggcccctgccc

SEQ ID NO: 2087404 - DNA, 22 bp, Homo sapiens
gttcagggttggcccctgcccg

SEQ ID NO: 2087405 - DNA, 17 bp, Homo sapiens
gttcaggtaacaggcag

SEQ ID NO: 2087406 - DNA, 16 bp, Homo sapiens
gttcagtgccttggag

SEQ ID NO: 2087407 - DNA, 20 bp, Homo sapiens
gttcagttcctctttgcatg

SEQ ID NO: 2087408 - DNA, 20 bp, Homo sapiens
gttcatagggtctcttcagg

SEQ ID NO: 2087409 - DNA, 22 bp, Homo sapiens
gttcatagggtctcttcaggtt

SEQ ID NO: 2087410 - DNA, 17 bp, Homo sapiens
gttcatccaaggaacct

SEQ ID NO: 2087411 - DNA, 23 bp, Homo sapiens
gttcatccaaggaacctaattga

SEQ ID NO: 2087412 - DNA, 14 bp, Homo sapiens
gttcatgagtggat

SEQ ID NO: 2087413 - DNA, 15 bp, Homo sapiens
gttcatgagtggatg

SEQ ID NO: 2087414 - DNA, 16 bp, Homo sapiens
gttcatgagtggatgg

SEQ ID NO: 2087415 - DNA, 18 bp, Homo sapiens
gttcattaaattttctat

SEQ ID NO: 2087416 - DNA, 19 bp, Homo sapiens
gttcattccccggccctcc

SEQ ID NO: 2087417 - DNA, 13 bp, Homo sapiens
gttcatttcctca

SEQ ID NO: 2087418 - DNA, 15 bp, Homo sapiens
gttccaaatgaatgt

SEQ ID NO: 2087419 - DNA, 21 bp, Homo sapiens
gttccaagaaagatccaccct

SEQ ID NO: 2087420 - DNA, 14 bp, Homo sapiens
gttccacttctcta

SEQ ID NO: 2087421 - DNA, 15 bp, Homo sapiens
gttccacttctctag

SEQ ID NO: 2087422 - DNA, 13 bp, Homo sapiens
gttccatgttaaa

SEQ ID NO: 2087423 - DNA, 21 bp, Homo sapiens
gttcccaagagcatcatgcct

SEQ ID NO: 2087424 - DNA, 19 bp, Homo sapiens
gttccccatctgggtcctt

SEQ ID NO: 2087425 - DNA, 14 bp, Homo sapiens
gttcccccagacag

SEQ ID NO: 2087426 - DNA, 23 bp, Homo sapiens
gttcccggagcacagccctggga

SEQ ID NO: 2087427 - DNA, 17 bp, Homo sapiens
gttccctgaaaacccag

SEQ ID NO: 2087428 - DNA, 21 bp, Homo sapiens
gttccctgaacatctgtgtgt

SEQ ID NO: 2087429 - DNA, 13 bp, Homo sapiens
gttccctgcaccc

SEQ ID NO: 2087430 - DNA, 15 bp, Homo sapiens
gttccctgcaccctg

SEQ ID NO: 2087431 - DNA, 16 bp, Homo sapiens
gttccctgtcagaggc

SEQ ID NO: 2087432 - DNA, 17 bp, Homo sapiens
gttccctgtcagaggct

SEQ ID NO: 2087433 - DNA, 16 bp, Homo sapiens
gttccctgtcttgtcc

SEQ ID NO: 2087434 - DNA, 15 bp, Homo sapiens
gttcccttgaccatt

SEQ ID NO: 2087435 - DNA, 18 bp, Homo sapiens
gttccgtcccaaacagag

SEQ ID NO: 2087436 - DNA, 13 bp, Homo sapiens
gttcctctttgca

SEQ ID NO: 2087437 - DNA, 14 bp, Homo sapiens
gttcctctttgcat

SEQ ID NO: 2087438 - DNA, 15 bp, Homo sapiens
gttcctgcactccag

SEQ ID NO: 2087439 - DNA, 19 bp, Homo sapiens
gttcctggctttgacatga

SEQ ID NO: 2087440 - DNA, 23 bp, Homo sapiens
gttccttgatctgtatatacaat

SEQ ID NO: 2087441 - DNA, 21 bp, Homo sapiens
gttcctttttcaacttggaaa

SEQ ID NO: 2087442 - DNA, 18 bp, Homo sapiens
gttcgagaccagcctggc

SEQ ID NO: 2087443 - DNA, 16 bp, Homo sapiens
gttcgcagccaccctg

SEQ ID NO: 2087444 - DNA, 19 bp, Homo sapiens
gttcgcagccaccctgagg

SEQ ID NO: 2087445 - DNA, 20 bp, Homo sapiens
gttcgcagccaccctgagga

SEQ ID NO: 2087446 - DNA, 14 bp, Homo sapiens
gttctaatattttt

SEQ ID NO: 2087447 - DNA, 19 bp, Homo sapiens
gttctacaagcatatttga

SEQ ID NO: 2087448 - DNA, 23 bp, Homo sapiens
gttctagagaagaggctggtgct

SEQ ID NO: 2087449 - DNA, 14 bp, Homo sapiens
gttctagtctcctt

SEQ ID NO: 2087450 - DNA, 19 bp, Homo sapiens
gttctatataaggaggaaa

SEQ ID NO: 2087451 - DNA, 20 bp, Homo sapiens
gttctatataaggaggaaaa

SEQ ID NO: 2087452 - DNA, 21 bp, Homo sapiens
gttctatcccacccaacagct

SEQ ID NO: 2087453 - DNA, 17 bp, Homo sapiens
gttctcaatgcttttct

SEQ ID NO: 2087454 - DNA, 16 bp, Homo sapiens
gttctcaatgtgaaaa

SEQ ID NO: 2087455 - DNA, 17 bp, Homo sapiens
gttctcagatcttgaca

SEQ ID NO: 2087456 - DNA, 22 bp, Homo sapiens
gttctcagctccgtcatctgcg

SEQ ID NO: 2087457 - DNA, 16 bp, Homo sapiens
gttctccagcccacac

SEQ ID NO: 2087458 - DNA, 21 bp, Homo sapiens
gttctccagcccacacccctc

SEQ ID NO: 2087459 - DNA, 22 bp, Homo sapiens
gttctccagcccacacccctcc

SEQ ID NO: 2087460 - DNA, 19 bp, Homo sapiens
gttctccgggtgtggcctc

SEQ ID NO: 2087461 - DNA, 15 bp, Homo sapiens
gttctgcactgaaaa

SEQ ID NO: 2087462 - DNA, 14 bp, Homo sapiens
gttctgcgttacaa

SEQ ID NO: 2087463 - DNA, 15 bp, Homo sapiens
gttctgctcctctcc

SEQ ID NO: 2087464 - DNA, 15 bp, Homo sapiens
gttctgctgcccctg

SEQ ID NO: 2087465 - DNA, 10 bp, Homo sapiens
gtttaaaatc

SEQ ID NO: 2087466 - DNA, 17 bp, Homo sapiens
gtttaaataaagtatca

SEQ ID NO: 2087467 - DNA, 14 bp, Homo sapiens
gtttaaattgtaaa

SEQ ID NO: 2087468 - DNA, 17 bp, Homo sapiens
gtttaagccaaaacaat

SEQ ID NO: 2087469 - DNA, 12 bp, Homo sapiens
gtttaagtgttg

SEQ ID NO: 2087470 - DNA, 15 bp, Homo sapiens
gtttaatatttaaac

SEQ ID NO: 2087471 - DNA, 15 bp, Homo sapiens
gtttacaaaaggcag

SEQ ID NO: 2087472 - DNA, 22 bp, Homo sapiens
gtttacaaaaggcagccctttg

SEQ ID NO: 2087473 - DNA, 15 bp, Homo sapiens
gtttacagtaaataa

SEQ ID NO: 2087474 - DNA, 22 bp, Homo sapiens
gtttacatgaacacagctgctg

SEQ ID NO: 2087475 - DNA, 16 bp, Homo sapiens
gtttactaaagagaca

SEQ ID NO: 2087476 - DNA, 14 bp, Homo sapiens
gtttacttcatgag

SEQ ID NO: 2087477 - DNA, 17 bp, Homo sapiens
gtttacttttcagggca

SEQ ID NO: 2087478 - DNA, 18 bp, Homo sapiens
gtttagaagagcctgact

SEQ ID NO: 2087479 - DNA, 15 bp, Homo sapiens
gtttagattccagga

SEQ ID NO: 2087480 - DNA, 12 bp, Homo sapiens
gtttagcctgga

SEQ ID NO: 2087481 - DNA, 19 bp, Homo sapiens
gtttagtttctagaggcct

SEQ ID NO: 2087482 - DNA, 16 bp, Homo sapiens
gtttatataaggcagt

SEQ ID NO: 2087483 - DNA, 15 bp, Homo sapiens
gtttatgtctaaaga

SEQ ID NO: 2087484 - DNA, 14 bp, Homo sapiens
gtttattggaagtg

SEQ ID NO: 2087485 - DNA, 22 bp, Homo sapiens
gtttatttaacttttagtaaag

SEQ ID NO: 2087486 - DNA, 14 bp, Homo sapiens
gtttatttattcac

SEQ ID NO: 2087487 - DNA, 17 bp, Homo sapiens
gtttatttattctgcat

SEQ ID NO: 2087488 - DNA, 12 bp, Homo sapiens
gtttatttccaa

SEQ ID NO: 2087489 - DNA, 17 bp, Homo sapiens
gtttatttttcatattg

SEQ ID NO: 2087490 - DNA, 18 bp, Homo sapiens
gtttatttttcatattgt

SEQ ID NO: 2087491 - DNA, 18 bp, Homo sapiens
gtttattttttctacaca

SEQ ID NO: 2087492 - DNA, 13 bp, Homo sapiens
gtttcaatgtgat

SEQ ID NO: 2087493 - DNA, 19 bp, Homo sapiens
gtttcaatgtgattctaat

SEQ ID NO: 2087494 - DNA, 22 bp, Homo sapiens
gtttcaattccacctgcaatca

SEQ ID NO: 2087495 - DNA, 13 bp, Homo sapiens
gtttcactatgat

SEQ ID NO: 2087496 - DNA, 20 bp, Homo sapiens
gtttcactatgattttctat

SEQ ID NO: 2087497 - DNA, 15 bp, Homo sapiens
gtttcagaagcccca

SEQ ID NO: 2087498 - DNA, 19 bp, Homo sapiens
gtttcatgttttgtgacta

SEQ ID NO: 2087499 - DNA, 15 bp, Homo sapiens
gtttcattctcctgc

SEQ ID NO: 2087500 - DNA, 16 bp, Homo sapiens
gtttcattctcctgcc

SEQ ID NO: 2087501 - DNA, 19 bp, Homo sapiens
gtttcattctcctgcctgt

SEQ ID NO: 2087502 - DNA, 21 bp, Homo sapiens
gtttccaaagggcagtaaagt

SEQ ID NO: 2087503 - DNA, 16 bp, Homo sapiens
gtttccagaaaatata

SEQ ID NO: 2087504 - DNA, 20 bp, Homo sapiens
gtttccagaaaatataaatg

SEQ ID NO: 2087505 - DNA, 14 bp, Homo sapiens
gtttccaggaagag

SEQ ID NO: 2087506 - DNA, 22 bp, Homo sapiens
gtttccatttctcaatcagtgc

SEQ ID NO: 2087507 - DNA, 23 bp, Homo sapiens
gtttccctcaaatgcgcgtgtgc

SEQ ID NO: 2087508 - DNA, 17 bp, Homo sapiens
gtttcctcatctgcaga

SEQ ID NO: 2087509 - DNA, 14 bp, Homo sapiens
gtttccttcagtgc

SEQ ID NO: 2087510 - DNA, 13 bp, Homo sapiens
gtttctaaaacta

SEQ ID NO: 2087511 - DNA, 20 bp, Homo sapiens
gtttctagaggcctcagttt

SEQ ID NO: 2087512 - DNA, 16 bp, Homo sapiens
gtttctcagaatccaa

SEQ ID NO: 2087513 - DNA, 15 bp, Homo sapiens
gtttctccccctggg

SEQ ID NO: 2087514 - DNA, 20 bp, Homo sapiens
gtttctcctttattgctcct

SEQ ID NO: 2087515 - DNA, 14 bp, Homo sapiens
gtttctgagaaaag

SEQ ID NO: 2087516 - DNA, 14 bp, Homo sapiens
gtttctgcagtagt

SEQ ID NO: 2087517 - DNA, 22 bp, Homo sapiens
gtttctgcagtagtctctgtgc

SEQ ID NO: 2087518 - DNA, 22 bp, Homo sapiens
gtttcttaaataagaaactttt

SEQ ID NO: 2087519 - DNA, 22 bp, Homo sapiens
gtttcttgcctcatttttttcc

SEQ ID NO: 2087520 - DNA, 18 bp, Homo sapiens
gtttgaaagtgaataaac

SEQ ID NO: 2087521 - DNA, 17 bp, Homo sapiens
gtttgaatataaacact

SEQ ID NO: 2087522 - DNA, 19 bp, Homo sapiens
gtttgaatataaacactat

SEQ ID NO: 2087523 - DNA, 15 bp, Homo sapiens
gtttgacattgtatg

SEQ ID NO: 2087524 - DNA, 13 bp, Homo sapiens
gtttgagctcaga

SEQ ID NO: 2087525 - DNA, 15 bp, Homo sapiens
gtttgagctcagacc

SEQ ID NO: 2087526 - DNA, 16 bp, Homo sapiens
gtttgagctcagaccc

SEQ ID NO: 2087527 - DNA, 16 bp, Homo sapiens
gtttgaggctgcagcg

SEQ ID NO: 2087528 - DNA, 15 bp, Homo sapiens
gtttgatttcattaa

SEQ ID NO: 2087529 - DNA, 13 bp, Homo sapiens
gtttgcaaggaag

SEQ ID NO: 2087530 - DNA, 21 bp, Homo sapiens
gtttgcagaaaagcacctgcc

SEQ ID NO: 2087531 - DNA, 16 bp, Homo sapiens
gtttgccctgcctgca

SEQ ID NO: 2087532 - DNA, 18 bp, Homo sapiens
gtttgccttctactttta

SEQ ID NO: 2087533 - DNA, 20 bp, Homo sapiens
gtttggatgggagtgagaca

SEQ ID NO: 2087534 - DNA, 17 bp, Homo sapiens
gtttggcaatagtttgc

SEQ ID NO: 2087535 - DNA, 19 bp, Homo sapiens
gtttggcaatagtttgcat

SEQ ID NO: 2087536 - DNA, 12 bp, Homo sapiens
gtttgggagagt

SEQ ID NO: 2087537 - DNA, 21 bp, Homo sapiens
gtttgggcagaagggagaagg

SEQ ID NO: 2087538 - DNA, 23 bp, Homo sapiens
gtttggggcaggagtagctgagc

SEQ ID NO: 2087539 - DNA, 16 bp, Homo sapiens
gtttggtccagcctgg

SEQ ID NO: 2087540 - DNA, 19 bp, Homo sapiens
gtttggtgtaggtaaatct

SEQ ID NO: 2087541 - DNA, 14 bp, Homo sapiens
gtttggttgtaaat

SEQ ID NO: 2087542 - DNA, 13 bp, Homo sapiens
gtttgtatattgt

SEQ ID NO: 2087543 - DNA, 18 bp, Homo sapiens
gtttgtcatatattcatg

SEQ ID NO: 2087544 - DNA, 17 bp, Homo sapiens
gtttgtcccccggggca

SEQ ID NO: 2087545 - DNA, 18 bp, Homo sapiens
gtttgtctgtcttcatag

SEQ ID NO: 2087546 - DNA, 23 bp, Homo sapiens
gtttgtgcctttttatttttgtt

SEQ ID NO: 2087547 - DNA, 16 bp, Homo sapiens
gtttgtttttcaaagc

SEQ ID NO: 2087548 - DNA, 15 bp, Homo sapiens
gttttaacagaacca

SEQ ID NO: 2087549 - DNA, 17 bp, Homo sapiens
gttttaagattgtaatt

SEQ ID NO: 2087550 - DNA, 21 bp, Homo sapiens
gttttaagattgtaattcaga

SEQ ID NO: 2087551 - DNA, 17 bp, Homo sapiens
gttttaaggacattaaa

SEQ ID NO: 2087552 - DNA, 23 bp, Homo sapiens
gttttacaataaaatcttgaaaa

SEQ ID NO: 2087553 - DNA, 13 bp, Homo sapiens
gttttagaaaaca

SEQ ID NO: 2087554 - DNA, 23 bp, Homo sapiens
gttttatactgtacttaataaat

SEQ ID NO: 2087555 - DNA, 19 bp, Homo sapiens
gttttatatttttatagac

SEQ ID NO: 2087556 - DNA, 11 bp, Homo sapiens
gttttatcagt

SEQ ID NO: 2087557 - DNA, 17 bp, Homo sapiens
gttttatggcatgattt

SEQ ID NO: 2087558 - DNA, 22 bp, Homo sapiens
gttttattgtccttcagagctc

SEQ ID NO: 2087559 - DNA, 21 bp, Homo sapiens
gttttcatggtgaaaatgtac

SEQ ID NO: 2087560 - DNA, 15 bp, Homo sapiens
gttttctaactgtaa

SEQ ID NO: 2087561 - DNA, 17 bp, Homo sapiens
gttttctaactgtaaat

SEQ ID NO: 2087562 - DNA, 19 bp, Homo sapiens
gttttctaactgtaaatca

SEQ ID NO: 2087563 - DNA, 23 bp, Homo sapiens
gttttctaactgtaaatcacttg

SEQ ID NO: 2087564 - DNA, 17 bp, Homo sapiens
gttttctcagaacagct

SEQ ID NO: 2087565 - DNA, 15 bp, Homo sapiens
gttttctgagaaaga

SEQ ID NO: 2087566 - DNA, 17 bp, Homo sapiens
gttttctgagaaagact

SEQ ID NO: 2087567 - DNA, 15 bp, Homo sapiens
gttttctgctgttta

SEQ ID NO: 2087568 - DNA, 15 bp, Homo sapiens
gttttcttcccatca

SEQ ID NO: 2087569 - DNA, 14 bp, Homo sapiens
gttttctttgaatg

SEQ ID NO: 2087570 - DNA, 16 bp, Homo sapiens
gttttgatatgagtat

SEQ ID NO: 2087571 - DNA, 21 bp, Homo sapiens
gttttgatgaaattcttgaag

SEQ ID NO: 2087572 - DNA, 19 bp, Homo sapiens
gttttgatttgtactgaaa

SEQ ID NO: 2087573 - DNA, 19 bp, Homo sapiens
gttttgcacgtcttgctat

SEQ ID NO: 2087574 - DNA, 14 bp, Homo sapiens
gttttgcactgaca

SEQ ID NO: 2087575 - DNA, 16 bp, Homo sapiens
gttttgccatgttggc

SEQ ID NO: 2087576 - DNA, 17 bp, Homo sapiens
gttttgctacataatta

SEQ ID NO: 2087577 - DNA, 22 bp, Homo sapiens
gttttgtataaataataaagaa

SEQ ID NO: 2087578 - DNA, 21 bp, Homo sapiens
gttttgtcccatttccttgga

SEQ ID NO: 2087579 - DNA, 21 bp, Homo sapiens
gtttttaacaactaatcaaga

SEQ ID NO: 2087580 - DNA, 14 bp, Homo sapiens
taaaatttatattg

SEQ ID NO: 2087581 - DNA, 17 bp, Homo sapiens
taaaatttatattgtaa

SEQ ID NO: 2087582 - DNA, 16 bp, Homo sapiens
taaaatttgtttagaa

SEQ ID NO: 2087583 - DNA, 13 bp, Homo sapiens
taaaattttcaaa

SEQ ID NO: 2087584 - DNA, 22 bp, Homo sapiens
taaacaaaaacacattgagttt

SEQ ID NO: 2087585 - DNA, 12 bp, Homo sapiens
taaacaaatgta

SEQ ID NO: 2087586 - DNA, 12 bp, Homo sapiens
taaacacagtgc

SEQ ID NO: 2087587 - DNA, 23 bp, Homo sapiens
taaacacccatgaatcaaagaca

SEQ ID NO: 2087588 - DNA, 14 bp, Homo sapiens
taaacactgtaatc

SEQ ID NO: 2087589 - DNA, 16 bp, Homo sapiens
taaacactgtaatctt

SEQ ID NO: 2087590 - DNA, 23 bp, Homo sapiens
taaacagactatttaacttgagg

SEQ ID NO: 2087591 - DNA, 11 bp, Homo sapiens
taaacagcatt

SEQ ID NO: 2087592 - DNA, 12 bp, Homo sapiens
taaacagcattt

SEQ ID NO: 2087593 - DNA, 20 bp, Homo sapiens
taaacataattcttgtatat

SEQ ID NO: 2087594 - DNA, 16 bp, Homo sapiens
taaacatgagaataaa

SEQ ID NO: 2087595 - DNA, 17 bp, Homo sapiens
taaacattaaatgtctt

SEQ ID NO: 2087596 - DNA, 21 bp, Homo sapiens
taaacattaaatgtcttatat

SEQ ID NO: 2087597 - DNA, 20 bp, Homo sapiens
taaaccaaaggacattatgt

SEQ ID NO: 2087598 - DNA, 16 bp, Homo sapiens
taaaccagcagaaaag

SEQ ID NO: 2087599 - DNA, 22 bp, Homo sapiens
taaaccagcagaaaagtgctta

SEQ ID NO: 2087600 - DNA, 18 bp, Homo sapiens
taaaccagtttagatttc

SEQ ID NO: 2087601 - DNA, 19 bp, Homo sapiens
taaaccagtttagatttca

SEQ ID NO: 2087602 - DNA, 17 bp, Homo sapiens
taaacccccgctccaga

SEQ ID NO: 2087603 - DNA, 22 bp, Homo sapiens
taaacccccgctccagatctgc

SEQ ID NO: 2087604 - DNA, 17 bp, Homo sapiens
taaacctggagatgatg

SEQ ID NO: 2087605 - DNA, 14 bp, Homo sapiens
taaacgaagataaa

SEQ ID NO: 2087606 - DNA, 22 bp, Homo sapiens
taaacgtgatgatcagctgttt

SEQ ID NO: 2087607 - DNA, 14 bp, Homo sapiens
taaactactgtaat

SEQ ID NO: 2087608 - DNA, 16 bp, Homo sapiens
taaactactgtaatta

SEQ ID NO: 2087609 - DNA, 22 bp, Homo sapiens
taaactagtaatgggccaatta

SEQ ID NO: 2087610 - DNA, 12 bp, Homo sapiens
taaactagtttc

SEQ ID NO: 2087611 - DNA, 13 bp, Homo sapiens
taaactagtttcc

SEQ ID NO: 2087612 - DNA, 14 bp, Homo sapiens
taaactagtttcca

SEQ ID NO: 2087613 - DNA, 15 bp, Homo sapiens
taaactagtttccag

SEQ ID NO: 2087614 - DNA, 17 bp, Homo sapiens
taaactataagcaagaa

SEQ ID NO: 2087615 - DNA, 21 bp, Homo sapiens
taaactatcttggtgaatttt

SEQ ID NO: 2087616 - DNA, 22 bp, Homo sapiens
taaactatcttggtgaattttt

SEQ ID NO: 2087617 - DNA, 15 bp, Homo sapiens
taaactatttgtctt

SEQ ID NO: 2087618 - DNA, 15 bp, Homo sapiens
taaactcaaaactta

SEQ ID NO: 2087619 - DNA, 23 bp, Homo sapiens
taaactcaaaatatttgtacata

SEQ ID NO: 2087620 - DNA, 14 bp, Homo sapiens
taaactctaaacat

SEQ ID NO: 2087621 - DNA, 13 bp, Homo sapiens
taaactgtgtgca

SEQ ID NO: 2087622 - DNA, 15 bp, Homo sapiens
taaacttagaataaa

SEQ ID NO: 2087623 - DNA, 16 bp, Homo sapiens
taaacttcagcaccat

SEQ ID NO: 2087624 - DNA, 13 bp, Homo sapiens
taaacttcatctt

SEQ ID NO: 2087625 - DNA, 13 bp, Homo sapiens
taaacttgtgtat

SEQ ID NO: 2087626 - DNA, 16 bp, Homo sapiens
taaactttgtgccttt

SEQ ID NO: 2087627 - DNA, 17 bp, Homo sapiens
taaactttgtgcctttg

SEQ ID NO: 2087628 - DNA, 14 bp, Homo sapiens
taaagaaaaacaaa

SEQ ID NO: 2087629 - DNA, 15 bp, Homo sapiens
taaagaaaaacaaac

SEQ ID NO: 2087630 - DNA, 17 bp, Homo sapiens
taaagaactccttattt

SEQ ID NO: 2087631 - DNA, 20 bp, Homo sapiens
taaagaatatttacaataaa

SEQ ID NO: 2087632 - DNA, 15 bp, Homo sapiens
taaagactgagaccc

SEQ ID NO: 2087633 - DNA, 20 bp, Homo sapiens
taaagacttaagattaaatt

SEQ ID NO: 2087634 - DNA, 15 bp, Homo sapiens
taaagacttcatgtt

SEQ ID NO: 2087635 - DNA, 19 bp, Homo sapiens
taaagaggcgtcttgtatt

SEQ ID NO: 2087636 - DNA, 20 bp, Homo sapiens
taaagagtatttacaataaa

SEQ ID NO: 2087637 - DNA, 12 bp, Homo sapiens
taaagagttctt

SEQ ID NO: 2087638 - DNA, 21 bp, Homo sapiens
taaagatgatctactcagaaa

SEQ ID NO: 2087639 - DNA, 21 bp, Homo sapiens
taaagattttttaataattta

SEQ ID NO: 2087640 - DNA, 22 bp, Homo sapiens
taaagattttttaataatttag

SEQ ID NO: 2087641 - DNA, 17 bp, Homo sapiens
taaagcaacattttatt

SEQ ID NO: 2087642 - DNA, 13 bp, Homo sapiens
taaagcagtggac

SEQ ID NO: 2087643 - DNA, 19 bp, Homo sapiens
taaagcagtggacaccagg

SEQ ID NO: 2087644 - DNA, 13 bp, Homo sapiens
taaagcagtgttt

SEQ ID NO: 2087645 - DNA, 16 bp, Homo sapiens
taaagcagtgttttca

SEQ ID NO: 2087646 - DNA, 22 bp, Homo sapiens
taaagcccataaggccagaaac

SEQ ID NO: 2087647 - DNA, 17 bp, Homo sapiens
taaagcctatttttcaa

SEQ ID NO: 2087648 - DNA, 21 bp, Homo sapiens
taaagcctgctttttaagtgt

SEQ ID NO: 2087649 - DNA, 13 bp, Homo sapiens
taaagctactgaa

SEQ ID NO: 2087650 - DNA, 21 bp, Homo sapiens
taaagctactgaatttattgc

SEQ ID NO: 2087651 - DNA, 18 bp, Homo sapiens
taaagctgcctgtagtta

SEQ ID NO: 2087652 - DNA, 16 bp, Homo sapiens
taaagctggacaagaa

SEQ ID NO: 2087653 - DNA, 18 bp, Homo sapiens
taaagctggacaagaagc

SEQ ID NO: 2087654 - DNA, 19 bp, Homo sapiens
taaagctggacaagaagct

SEQ ID NO: 2087655 - DNA, 21 bp, Homo sapiens
taaagctggacaagaagctgc

SEQ ID NO: 2087656 - DNA, 23 bp, Homo sapiens
taaagctggacaagaagctgcta

SEQ ID NO: 2087657 - DNA, 16 bp, Homo sapiens
taaaggaagtcaccaa

SEQ ID NO: 2087658 - DNA, 22 bp, Homo sapiens
taaaggagaaggcatgaaattg

SEQ ID NO: 2087659 - DNA, 16 bp, Homo sapiens
taaaggagttaagagt

SEQ ID NO: 2087660 - DNA, 20 bp, Homo sapiens
taaaggagttaagagtagca

SEQ ID NO: 2087661 - DNA, 21 bp, Homo sapiens
taaaggattgatcactttgtt

SEQ ID NO: 2087662 - DNA, 19 bp, Homo sapiens
taaaggcaccatctaatag

SEQ ID NO: 2087663 - DNA, 23 bp, Homo sapiens
taaaggcctggaaccagggagga

SEQ ID NO: 2087664 - DNA, 22 bp, Homo sapiens
taaaggcctttaataagtcatt

SEQ ID NO: 2087665 - DNA, 22 bp, Homo sapiens
taaaggcttttggcagcaaagt

SEQ ID NO: 2087666 - DNA, 18 bp, Homo sapiens
taaaggtagagatgtgtg

SEQ ID NO: 2087667 - DNA, 22 bp, Homo sapiens
taaaggtatttagaatatatta

SEQ ID NO: 2087668 - DNA, 21 bp, Homo sapiens
taaaggtggtatgtgtgtgta

SEQ ID NO: 2087669 - DNA, 15 bp, Homo sapiens
taaagtaattttgtg

SEQ ID NO: 2087670 - DNA, 22 bp, Homo sapiens
taaagtacctgtagtgagaaac

SEQ ID NO: 2087671 - DNA, 14 bp, Homo sapiens
taaagtatcatgca

SEQ ID NO: 2087672 - DNA, 21 bp, Homo sapiens
taaagtatgtaaagtatgtaa

SEQ ID NO: 2087673 - DNA, 22 bp, Homo sapiens
taaagtatgtaaagtatgtaaa

SEQ ID NO: 2087674 - DNA, 19 bp, Homo sapiens
taaagtcaggacctggctt

SEQ ID NO: 2087675 - DNA, 15 bp, Homo sapiens
taaagtgaccaggct

SEQ ID NO: 2087676 - DNA, 16 bp, Homo sapiens
taaagtgtaaatcctt

SEQ ID NO: 2087677 - DNA, 12 bp, Homo sapiens
taaagtgtaata

SEQ ID NO: 2087678 - DNA, 16 bp, Homo sapiens
taaagtgtaataatat

SEQ ID NO: 2087679 - DNA, 23 bp, Homo sapiens
taaagtgtctattagttttcttt

SEQ ID NO: 2087680 - DNA, 15 bp, Homo sapiens
taaagttcaacatgt

SEQ ID NO: 2087681 - DNA, 18 bp, Homo sapiens
taaagttcaacatgttat

SEQ ID NO: 2087682 - DNA, 13 bp, Homo sapiens
taaagtttaaaaa

SEQ ID NO: 2087683 - DNA, 15 bp, Homo sapiens
taaagtttatttcat

SEQ ID NO: 2087684 - DNA, 13 bp, Homo sapiens
taaataaaagaaa

SEQ ID NO: 2087685 - DNA, 14 bp, Homo sapiens
taaataaaagcagc

SEQ ID NO: 2087686 - DNA, 20 bp, Homo sapiens
taaataaaagcagcatctgc

SEQ ID NO: 2087687 - DNA, 13 bp, Homo sapiens
taaataaaccctt

SEQ ID NO: 2087688 - DNA, 14 bp, Homo sapiens
taaataaagtatca

SEQ ID NO: 2087689 - DNA, 14 bp, Homo sapiens
taaataaatagatt

SEQ ID NO: 2087690 - DNA, 15 bp, Homo sapiens
taaataaatagattt

SEQ ID NO: 2087691 - DNA, 14 bp, Homo sapiens
taaataaatatttt

SEQ ID NO: 2087692 - DNA, 11 bp, Homo sapiens
taaataaatgc

SEQ ID NO: 2087693 - DNA, 13 bp, Homo sapiens
taaataaattcaa

SEQ ID NO: 2087694 - DNA, 17 bp, Homo sapiens
taaataaattcaaacca

SEQ ID NO: 2087695 - DNA, 13 bp, Homo sapiens
taacagtcattta

SEQ ID NO: 2087696 - DNA, 14 bp, Homo sapiens
taacagtcatttaa

SEQ ID NO: 2087697 - DNA, 18 bp, Homo sapiens
taacagtcatttaaaaaa

SEQ ID NO: 2087698 - DNA, 21 bp, Homo sapiens
taacagtcctaactggtatag

SEQ ID NO: 2087699 - DNA, 21 bp, Homo sapiens
taacataaaatctgtgaatta

SEQ ID NO: 2087700 - DNA, 19 bp, Homo sapiens
taacataatttgtacatat

SEQ ID NO: 2087701 - DNA, 19 bp, Homo sapiens
taacataggttttgattta

SEQ ID NO: 2087702 - DNA, 23 bp, Homo sapiens
taacatataatgttgttatttaa

SEQ ID NO: 2087703 - DNA, 14 bp, Homo sapiens
taacatatttacta

SEQ ID NO: 2087704 - DNA, 17 bp, Homo sapiens
taacatcatgcattcac

SEQ ID NO: 2087705 - DNA, 13 bp, Homo sapiens
taacatccagaag

SEQ ID NO: 2087706 - DNA, 23 bp, Homo sapiens
taacatcctttctattgaaaaat

SEQ ID NO: 2087707 - DNA, 23 bp, Homo sapiens
taacatgaaaaacacggcagctg

SEQ ID NO: 2087708 - DNA, 15 bp, Homo sapiens
taacatgtatcccaa

SEQ ID NO: 2087709 - DNA, 17 bp, Homo sapiens
taacattaacatctatt

SEQ ID NO: 2087710 - DNA, 16 bp, Homo sapiens
taacattaattctact

SEQ ID NO: 2087711 - DNA, 18 bp, Homo sapiens
taacattaattctactaa

SEQ ID NO: 2087712 - DNA, 12 bp, Homo sapiens
taacattattta

SEQ ID NO: 2087713 - DNA, 22 bp, Homo sapiens
taacattctgtaaaatgtctgt

SEQ ID NO: 2087714 - DNA, 18 bp, Homo sapiens
taaccacaaccaggaaga

SEQ ID NO: 2087715 - DNA, 15 bp, Homo sapiens
taaccacggaaaaga

SEQ ID NO: 2087716 - DNA, 20 bp, Homo sapiens
taaccacttaaaaaatgtcc

SEQ ID NO: 2087717 - DNA, 16 bp, Homo sapiens
taaccagtacttctaa

SEQ ID NO: 2087718 - DNA, 21 bp, Homo sapiens
taaccagtacttctaagagca

SEQ ID NO: 2087719 - DNA, 17 bp, Homo sapiens
taaccatggtgcttgtt

SEQ ID NO: 2087720 - DNA, 20 bp, Homo sapiens
taaccattacatgtttaaat

SEQ ID NO: 2087721 - DNA, 19 bp, Homo sapiens
taacccatttttgagccaa

SEQ ID NO: 2087722 - DNA, 21 bp, Homo sapiens
taaccccaggcatcccatccc

SEQ ID NO: 2087723 - DNA, 22 bp, Homo sapiens
taacccccagcccacagagcct

SEQ ID NO: 2087724 - DNA, 19 bp, Homo sapiens
taacccccagtgccacaga

SEQ ID NO: 2087725 - DNA, 21 bp, Homo sapiens
taacccccagtgccacagaga

SEQ ID NO: 2087726 - DNA, 14 bp, Homo sapiens
taaccctctcttcc

SEQ ID NO: 2087727 - DNA, 17 bp, Homo sapiens
taaccgtttttcaagaa

SEQ ID NO: 2087728 - DNA, 16 bp, Homo sapiens
taacctactagacaat

SEQ ID NO: 2087729 - DNA, 13 bp, Homo sapiens
taacctggcttat

SEQ ID NO: 2087730 - DNA, 13 bp, Homo sapiens
taaccttagagct

SEQ ID NO: 2087731 - DNA, 14 bp, Homo sapiens
taacgcctgagccc

SEQ ID NO: 2087732 - DNA, 16 bp, Homo sapiens
taacgggcatgtatta

SEQ ID NO: 2087733 - DNA, 14 bp, Homo sapiens
taactaaattaaca

SEQ ID NO: 2087734 - DNA, 16 bp, Homo sapiens
taactaaattaacatt

SEQ ID NO: 2087735 - DNA, 21 bp, Homo sapiens
taactaaggtcccataataaa

SEQ ID NO: 2087736 - DNA, 17 bp, Homo sapiens
taactaatgctaagaaa

SEQ ID NO: 2087737 - DNA, 15 bp, Homo sapiens
taactaatttaaacc

SEQ ID NO: 2087738 - DNA, 18 bp, Homo sapiens
taactaatttaaaccagc

SEQ ID NO: 2087739 - DNA, 20 bp, Homo sapiens
taactaatttaaaccagcag

SEQ ID NO: 2087740 - DNA, 23 bp, Homo sapiens
taactaatttaaaccagcagaaa

SEQ ID NO: 2087741 - DNA, 17 bp, Homo sapiens
taactagatctcctgta

SEQ ID NO: 2087742 - DNA, 17 bp, Homo sapiens
taactagtcctttacta

SEQ ID NO: 2087743 - DNA, 13 bp, Homo sapiens
taactatgtgatg

SEQ ID NO: 2087744 - DNA, 15 bp, Homo sapiens
taactcatcataaaa

SEQ ID NO: 2087745 - DNA, 14 bp, Homo sapiens
taactcatctgtca

SEQ ID NO: 2087746 - DNA, 14 bp, Homo sapiens
taactcatgggtac

SEQ ID NO: 2087747 - DNA, 22 bp, Homo sapiens
taactccaccaacccatcagaa

SEQ ID NO: 2087748 - DNA, 18 bp, Homo sapiens
taactctcgggacctcgt

SEQ ID NO: 2087749 - DNA, 10 bp, Homo sapiens
taactctggc

SEQ ID NO: 2087750 - DNA, 20 bp, Homo sapiens
taactgaaaattatttaaac

SEQ ID NO: 2087751 - DNA, 14 bp, Homo sapiens
taactgaagagaca

SEQ ID NO: 2087752 - DNA, 14 bp, Homo sapiens
taactgaaggagaa

SEQ ID NO: 2087753 - DNA, 14 bp, Homo sapiens
taactgagaatttt

SEQ ID NO: 2087754 - DNA, 13 bp, Homo sapiens
taactgctgagcc

SEQ ID NO: 2087755 - DNA, 17 bp, Homo sapiens
taactgctgagccactc

SEQ ID NO: 2087756 - DNA, 19 bp, Homo sapiens
taactgggtaatgaaacaa

SEQ ID NO: 2087757 - DNA, 11 bp, Homo sapiens
taactgtaaat

SEQ ID NO: 2087758 - DNA, 13 bp, Homo sapiens
taactgtaaatca

SEQ ID NO: 2087759 - DNA, 14 bp, Homo sapiens
taactgtaaatcac

SEQ ID NO: 2087760 - DNA, 17 bp, Homo sapiens
taactgtaaatcacttg

SEQ ID NO: 2087761 - DNA, 16 bp, Homo sapiens
taactgtatgtgtctt

SEQ ID NO: 2087762 - DNA, 17 bp, Homo sapiens
taactgtgtgaagaaat

SEQ ID NO: 2087763 - DNA, 16 bp, Homo sapiens
taacttaaaatatttt

SEQ ID NO: 2087764 - DNA, 17 bp, Homo sapiens
taacttaaatagtattt

SEQ ID NO: 2087765 - DNA, 24 bp, Homo sapiens
taacttagaaggatggcatctcca

SEQ ID NO: 2087766 - DNA, 17 bp, Homo sapiens
taacttcaaatatagag

SEQ ID NO: 2087767 - DNA, 15 bp, Homo sapiens
taacttcagagaagt

SEQ ID NO: 2087768 - DNA, 18 bp, Homo sapiens
taacttcagagaagtcag

SEQ ID NO: 2087769 - DNA, 22 bp, Homo sapiens
taacttgagggtaataaactta

SEQ ID NO: 2087770 - DNA, 19 bp, Homo sapiens
taacttgcttagtatggtt

SEQ ID NO: 2087771 - DNA, 14 bp, Homo sapiens
taactttagaaata

SEQ ID NO: 2087772 - DNA, 23 bp, Homo sapiens
taagaaacacagggttttgtatt

SEQ ID NO: 2087773 - DNA, 17 bp, Homo sapiens
taagaagacatgacaat

SEQ ID NO: 2087774 - DNA, 14 bp, Homo sapiens
taagaaggaaaaat

SEQ ID NO: 2087775 - DNA, 21 bp, Homo sapiens
taagaatctagcaagaattga

SEQ ID NO: 2087776 - DNA, 14 bp, Homo sapiens
taagaatggaagaa

SEQ ID NO: 2087777 - DNA, 19 bp, Homo sapiens
taagacaagaatatgttca

SEQ ID NO: 2087778 - DNA, 19 bp, Homo sapiens
taagaccataacagccaac

SEQ ID NO: 2087779 - DNA, 21 bp, Homo sapiens
taagaccgtgtcccaaggagc

SEQ ID NO: 2087780 - DNA, 14 bp, Homo sapiens
taagacgtgaatgt

SEQ ID NO: 2087781 - DNA, 15 bp, Homo sapiens
taagagaaacaggcc

SEQ ID NO: 2087782 - DNA, 18 bp, Homo sapiens
taagagaaagaaaatgaa

SEQ ID NO: 2087783 - DNA, 12 bp, Homo sapiens
taagagagaaat

SEQ ID NO: 2087784 - DNA, 16 bp, Homo sapiens
taagagctagcgctgc

SEQ ID NO: 2087785 - DNA, 18 bp, Homo sapiens
taagagctagcgctgccg

SEQ ID NO: 2087786 - DNA, 15 bp, Homo sapiens
taagaggcagcgtga

SEQ ID NO: 2087787 - DNA, 15 bp, Homo sapiens
taagaggcagggtct

SEQ ID NO: 2087788 - DNA, 18 bp, Homo sapiens
taagaggcgacttcctct

SEQ ID NO: 2087789 - DNA, 16 bp, Homo sapiens
taagatacactcctgc

SEQ ID NO: 2087790 - DNA, 21 bp, Homo sapiens
taagatacactcctgctgtgc

SEQ ID NO: 2087791 - DNA, 17 bp, Homo sapiens
taagatgagatttgcca

SEQ ID NO: 2087792 - DNA, 19 bp, Homo sapiens
taagatgagatttgccagc

SEQ ID NO: 2087793 - DNA, 18 bp, Homo sapiens
taagatgggcagctagtt

SEQ ID NO: 2087794 - DNA, 20 bp, Homo sapiens
taagattaaattatatctga

SEQ ID NO: 2087795 - DNA, 22 bp, Homo sapiens
taagattaaattatatctgagg

SEQ ID NO: 2087796 - DNA, 14 bp, Homo sapiens
taagattccagaga

SEQ ID NO: 2087797 - DNA, 21 bp, Homo sapiens
taagattccagagagtggctc

SEQ ID NO: 2087798 - DNA, 14 bp, Homo sapiens
taagattgtaattc

SEQ ID NO: 2087799 - DNA, 18 bp, Homo sapiens
taagcaaatttcaaaaga

SEQ ID NO: 2087800 - DNA, 18 bp, Homo sapiens
taagcaacttgcttctaa

SEQ ID NO: 2087801 - DNA, 12 bp, Homo sapiens
taagcagtccct

SEQ ID NO: 2087802 - DNA, 21 bp, Homo sapiens
taagcatcttgtcaagaaata

SEQ ID NO: 2087803 - DNA, 16 bp, Homo sapiens
taagcattctgagctg

SEQ ID NO: 2087804 - DNA, 22 bp, Homo sapiens
taagcattgaatggctatgttt

SEQ ID NO: 2087805 - DNA, 16 bp, Homo sapiens
taagccacaagaaatt

SEQ ID NO: 2087806 - DNA, 22 bp, Homo sapiens
taagccacaagaaatttgattt

SEQ ID NO: 2087807 - DNA, 12 bp, Homo sapiens
taagccacagct

SEQ ID NO: 2087808 - DNA, 14 bp, Homo sapiens
taagccagagcctg

SEQ ID NO: 2087809 - DNA, 19 bp, Homo sapiens
taagccctcgaaccaaggc

SEQ ID NO: 2087810 - DNA, 12 bp, Homo sapiens
taatcagcctct

SEQ ID NO: 2087811 - DNA, 13 bp, Homo sapiens
taatcagcctctt

SEQ ID NO: 2087812 - DNA, 14 bp, Homo sapiens
taatcagcctctta

SEQ ID NO: 2087813 - DNA, 19 bp, Homo sapiens
taatcagggaggtcatttt

SEQ ID NO: 2087814 - DNA, 19 bp, Homo sapiens
taatcaggtcctcagagaa

SEQ ID NO: 2087815 - DNA, 18 bp, Homo sapiens
taatcaggttgttaatgt

SEQ ID NO: 2087816 - DNA, 19 bp, Homo sapiens
taatcccagcactttggga

SEQ ID NO: 2087817 - DNA, 15 bp, Homo sapiens
taatcgaaatgaatt

SEQ ID NO: 2087818 - DNA, 18 bp, Homo sapiens
taatcgagtctacctctt

SEQ ID NO: 2087819 - DNA, 15 bp, Homo sapiens
taatcggcccacagc

SEQ ID NO: 2087820 - DNA, 15 bp, Homo sapiens
taatcgttatgtgtg

SEQ ID NO: 2087821 - DNA, 16 bp, Homo sapiens
taatcgttatgtgtgt

SEQ ID NO: 2087822 - DNA, 18 bp, Homo sapiens
taatcgttatgtgtgtat

SEQ ID NO: 2087823 - DNA, 22 bp, Homo sapiens
taatctagaacacaggcaaaat

SEQ ID NO: 2087824 - DNA, 17 bp, Homo sapiens
taatctcatacctctga

SEQ ID NO: 2087825 - DNA, 20 bp, Homo sapiens
taatctcatacctctgacca

SEQ ID NO: 2087826 - DNA, 13 bp, Homo sapiens
taatctccacagt

SEQ ID NO: 2087827 - DNA, 21 bp, Homo sapiens
taatctgcaaagaatgagaag

SEQ ID NO: 2087828 - DNA, 18 bp, Homo sapiens
taatctggactcctctgt

SEQ ID NO: 2087829 - DNA, 19 bp, Homo sapiens
taatctggactcctctgtc

SEQ ID NO: 2087830 - DNA, 17 bp, Homo sapiens
taatctgtagggctgga

SEQ ID NO: 2087831 - DNA, 20 bp, Homo sapiens
taatctgtagggctggacct

SEQ ID NO: 2087832 - DNA, 19 bp, Homo sapiens
taatcttaattttgtattt

SEQ ID NO: 2087833 - DNA, 16 bp, Homo sapiens
taatgaaaaggaagtt

SEQ ID NO: 2087834 - DNA, 14 bp, Homo sapiens
taatgaaaatgtca

SEQ ID NO: 2087835 - DNA, 15 bp, Homo sapiens
taatgaaaatgtcag

SEQ ID NO: 2087836 - DNA, 19 bp, Homo sapiens
taatgaaagggaaagtcag

SEQ ID NO: 2087837 - DNA, 16 bp, Homo sapiens
taatgaaattgagaag

SEQ ID NO: 2087838 - DNA, 19 bp, Homo sapiens
taatgaacagcagaaagac

SEQ ID NO: 2087839 - DNA, 22 bp, Homo sapiens
taatgaagggaaaggatatttt

SEQ ID NO: 2087840 - DNA, 15 bp, Homo sapiens
taatgagaacattta

SEQ ID NO: 2087841 - DNA, 15 bp, Homo sapiens
taatgagggactgga

SEQ ID NO: 2087842 - DNA, 13 bp, Homo sapiens
taatgcaaattaa

SEQ ID NO: 2087843 - DNA, 11 bp, Homo sapiens
taatgcacaat

SEQ ID NO: 2087844 - DNA, 13 bp, Homo sapiens
taatgcacaattt

SEQ ID NO: 2087845 - DNA, 15 bp, Homo sapiens
taatgcacaatttag

SEQ ID NO: 2087846 - DNA, 12 bp, Homo sapiens
taatgccttcca

SEQ ID NO: 2087847 - DNA, 17 bp, Homo sapiens
taatgcttcaagtgttg

SEQ ID NO: 2087848 - DNA, 18 bp, Homo sapiens
taatgctttcctccctgg

SEQ ID NO: 2087849 - DNA, 16 bp, Homo sapiens
taatggaaagcagcag

SEQ ID NO: 2087850 - DNA, 12 bp, Homo sapiens
taatggagaaga

SEQ ID NO: 2087851 - DNA, 22 bp, Homo sapiens
taatggctgataattttaaatt

SEQ ID NO: 2087852 - DNA, 19 bp, Homo sapiens
taatgggccaattaaaata

SEQ ID NO: 2087853 - DNA, 14 bp, Homo sapiens
taatgggcctgccc

SEQ ID NO: 2087854 - DNA, 21 bp, Homo sapiens
taatggtctaaaaataaacca

SEQ ID NO: 2087855 - DNA, 16 bp, Homo sapiens
taatggtgccttcatt

SEQ ID NO: 2087856 - DNA, 19 bp, Homo sapiens
taatggtgttactaaagtc

SEQ ID NO: 2087857 - DNA, 15 bp, Homo sapiens
taatggtttactgct

SEQ ID NO: 2087858 - DNA, 19 bp, Homo sapiens
taatgtaagggtctgttgt

SEQ ID NO: 2087859 - DNA, 16 bp, Homo sapiens
taatgtacaagttttg

SEQ ID NO: 2087860 - DNA, 18 bp, Homo sapiens
taatgtacaagttttgta

SEQ ID NO: 2087861 - DNA, 19 bp, Homo sapiens
taatgtacaagttttgtat

SEQ ID NO: 2087862 - DNA, 15 bp, Homo sapiens
taatgtacagagtgg

SEQ ID NO: 2087863 - DNA, 17 bp, Homo sapiens
taatgtatttatatgtt

SEQ ID NO: 2087864 - DNA, 17 bp, Homo sapiens
taatgtcacaggcaggt

SEQ ID NO: 2087865 - DNA, 15 bp, Homo sapiens
taatgtcaccacctt

SEQ ID NO: 2087866 - DNA, 17 bp, Homo sapiens
taatgtcttcatttcat

SEQ ID NO: 2087867 - DNA, 19 bp, Homo sapiens
taatgtcttcatttcattg

SEQ ID NO: 2087868 - DNA, 18 bp, Homo sapiens
taatgtggatttcctatt

SEQ ID NO: 2087869 - DNA, 12 bp, Homo sapiens
taatgtgtgtat

SEQ ID NO: 2087870 - DNA, 14 bp, Homo sapiens
taatgtgtgtatgt

SEQ ID NO: 2087871 - DNA, 13 bp, Homo sapiens
taatgttctctgg

SEQ ID NO: 2087872 - DNA, 20 bp, Homo sapiens
taatgttctgaataatttct

SEQ ID NO: 2087873 - DNA, 18 bp, Homo sapiens
taatgttgttatttaaag

SEQ ID NO: 2087874 - DNA, 16 bp, Homo sapiens
taatgtttgatttagt

SEQ ID NO: 2087875 - DNA, 12 bp, Homo sapiens
taatgtttgcta

SEQ ID NO: 2087876 - DNA, 12 bp, Homo sapiens
taatgttttgta

SEQ ID NO: 2087877 - DNA, 15 bp, Homo sapiens
taatgttttgtacaa

SEQ ID NO: 2087878 - DNA, 18 bp, Homo sapiens
taattaaaatctggaaat

SEQ ID NO: 2087879 - DNA, 21 bp, Homo sapiens
taattaaataaaaatctgtgg

SEQ ID NO: 2087880 - DNA, 22 bp, Homo sapiens
taattaaataaatcattaatac

SEQ ID NO: 2087881 - DNA, 13 bp, Homo sapiens
taattaagtgcaa

SEQ ID NO: 2087882 - DNA, 16 bp, Homo sapiens
taattaatatgttcat

SEQ ID NO: 2087883 - DNA, 19 bp, Homo sapiens
taattaatcgaaatgaatt

SEQ ID NO: 2087884 - DNA, 21 bp, Homo sapiens
taattaggatctatgcaattt

SEQ ID NO: 2087885 - DNA, 20 bp, Homo sapiens
taattagggcatcctgcccc

SEQ ID NO: 2087886 - DNA, 17 bp, Homo sapiens
taattaggggttgctaa

SEQ ID NO: 2087887 - DNA, 18 bp, Homo sapiens
taattaggggttgctaag

SEQ ID NO: 2087888 - DNA, 17 bp, Homo sapiens
taattatcggaagcagt

SEQ ID NO: 2087889 - DNA, 21 bp, Homo sapiens
taattatcggaagcagtgcct

SEQ ID NO: 2087890 - DNA, 18 bp, Homo sapiens
taattatcgggaacagtg

SEQ ID NO: 2087891 - DNA, 20 bp, Homo sapiens
taattatcgggaacagtgtt

SEQ ID NO: 2087892 - DNA, 23 bp, Homo sapiens
taattatcgggaacagtgtttcc

SEQ ID NO: 2087893 - DNA, 21 bp, Homo sapiens
taattatgacagttatactgt

SEQ ID NO: 2087894 - DNA, 12 bp, Homo sapiens
taattattattt

SEQ ID NO: 2087895 - DNA, 14 bp, Homo sapiens
taattattatttat

SEQ ID NO: 2087896 - DNA, 17 bp, Homo sapiens
taattattatttatata

SEQ ID NO: 2087897 - DNA, 16 bp, Homo sapiens
taattcaattcaaagc

SEQ ID NO: 2087898 - DNA, 15 bp, Homo sapiens
taattcagaaaacat

SEQ ID NO: 2087899 - DNA, 18 bp, Homo sapiens
taattcagcactgatttc

SEQ ID NO: 2087900 - DNA, 19 bp, Homo sapiens
taattcagcactgatttca

SEQ ID NO: 2087901 - DNA, 22 bp, Homo sapiens
taattcagcactgatttcacaa

SEQ ID NO: 2087902 - DNA, 12 bp, Homo sapiens
taattcataatt

SEQ ID NO: 2087903 - DNA, 18 bp, Homo sapiens
taattcataattagaaca

SEQ ID NO: 2087904 - DNA, 16 bp, Homo sapiens
taattcattaaatttc

SEQ ID NO: 2087905 - DNA, 19 bp, Homo sapiens
taattccaatatgatgact

SEQ ID NO: 2087906 - DNA, 18 bp, Homo sapiens
taattcccattttgcaaa

SEQ ID NO: 2087907 - DNA, 15 bp, Homo sapiens
taattccctatcttt

SEQ ID NO: 2087908 - DNA, 22 bp, Homo sapiens
taattcctctcactaaacttta

SEQ ID NO: 2087909 - DNA, 21 bp, Homo sapiens
taattcggaagggaaaacagt

SEQ ID NO: 2087910 - DNA, 15 bp, Homo sapiens
taattctatgagata

SEQ ID NO: 2087911 - DNA, 20 bp, Homo sapiens
taattctcatgtgatccttt

SEQ ID NO: 2087912 - DNA, 13 bp, Homo sapiens
taattctgcttct

SEQ ID NO: 2087913 - DNA, 16 bp, Homo sapiens
taattcttgtatatta

SEQ ID NO: 2087914 - DNA, 20 bp, Homo sapiens
taattcttgttgttctgtag

SEQ ID NO: 2087915 - DNA, 18 bp, Homo sapiens
taattgagaaacatgaat

SEQ ID NO: 2087916 - DNA, 19 bp, Homo sapiens
taattgatcaaattcattt

SEQ ID NO: 2087917 - DNA, 20 bp, Homo sapiens
taattgatttgacccactca

SEQ ID NO: 2087918 - DNA, 20 bp, Homo sapiens
taattgcatttaaaaatata

SEQ ID NO: 2087919 - DNA, 18 bp, Homo sapiens
taattgcttaaaagacat

SEQ ID NO: 2087920 - DNA, 15 bp, Homo sapiens
taattgcttacattt

SEQ ID NO: 2087921 - DNA, 16 bp, Homo sapiens
taattgcttacatttt

SEQ ID NO: 2087922 - DNA, 12 bp, Homo sapiens
taattgggattt

SEQ ID NO: 2087923 - DNA, 23 bp, Homo sapiens
taattgtgaataaaaattgatga

SEQ ID NO: 2087924 - DNA, 13 bp, Homo sapiens
taattgtgtacaa

SEQ ID NO: 2087925 - DNA, 15 bp, Homo sapiens
tacccctgcctgggt

SEQ ID NO: 2087926 - DNA, 20 bp, Homo sapiens
tacccttcacctttggtgca

SEQ ID NO: 2087927 - DNA, 16 bp, Homo sapiens
tacccttgtaccccat

SEQ ID NO: 2087928 - DNA, 18 bp, Homo sapiens
tacccttgtaccccatcc

SEQ ID NO: 2087929 - DNA, 14 bp, Homo sapiens
taccgagaaaagga

SEQ ID NO: 2087930 - DNA, 19 bp, Homo sapiens
taccgaggagctaaacatg

SEQ ID NO: 2087931 - DNA, 22 bp, Homo sapiens
taccgagtctcttctccactgg

SEQ ID NO: 2087932 - DNA, 19 bp, Homo sapiens
taccgcgtctaccctggga

SEQ ID NO: 2087933 - DNA, 14 bp, Homo sapiens
tacctaaacagata

SEQ ID NO: 2087934 - DNA, 15 bp, Homo sapiens
tacctaacattattt

SEQ ID NO: 2087935 - DNA, 16 bp, Homo sapiens
tacctaccacagtgtc

SEQ ID NO: 2087936 - DNA, 17 bp, Homo sapiens
tacctaccacagtgtct

SEQ ID NO: 2087937 - DNA, 20 bp, Homo sapiens
tacctaggatgcatgacaat

SEQ ID NO: 2087938 - DNA, 14 bp, Homo sapiens
tacctataatgtgt

SEQ ID NO: 2087939 - DNA, 19 bp, Homo sapiens
tacctataatgtgtgtatg

SEQ ID NO: 2087940 - DNA, 16 bp, Homo sapiens
tacctatcatcttaag

SEQ ID NO: 2087941 - DNA, 18 bp, Homo sapiens
tacctatggctgcctgca

SEQ ID NO: 2087942 - DNA, 17 bp, Homo sapiens
tacctcaacctatggta

SEQ ID NO: 2087943 - DNA, 15 bp, Homo sapiens
tacctcactggggtc

SEQ ID NO: 2087944 - DNA, 12 bp, Homo sapiens
tacctcagccta

SEQ ID NO: 2087945 - DNA, 14 bp, Homo sapiens
tacctcgaggctct

SEQ ID NO: 2087946 - DNA, 21 bp, Homo sapiens
tacctctcttatagaatattt

SEQ ID NO: 2087947 - DNA, 23 bp, Homo sapiens
tacctctcttatagaatatttat

SEQ ID NO: 2087948 - DNA, 17 bp, Homo sapiens
tacctctgatacctcaa

SEQ ID NO: 2087949 - DNA, 14 bp, Homo sapiens
tacctctgtgtgct

SEQ ID NO: 2087950 - DNA, 19 bp, Homo sapiens
tacctctttgtcagtctgg

SEQ ID NO: 2087951 - DNA, 15 bp, Homo sapiens
tacctgagcattcag

SEQ ID NO: 2087952 - DNA, 12 bp, Homo sapiens
tacctgccctct

SEQ ID NO: 2087953 - DNA, 14 bp, Homo sapiens
tacctgccctctct

SEQ ID NO: 2087954 - DNA, 16 bp, Homo sapiens
tacctgccctctctca

SEQ ID NO: 2087955 - DNA, 22 bp, Homo sapiens
tacctgggaaaggacccaccca

SEQ ID NO: 2087956 - DNA, 16 bp, Homo sapiens
tacctgggatatgaca

SEQ ID NO: 2087957 - DNA, 20 bp, Homo sapiens
tacctgtagtgagaaactga

SEQ ID NO: 2087958 - DNA, 12 bp, Homo sapiens
tacctgtgcctg

SEQ ID NO: 2087959 - DNA, 16 bp, Homo sapiens
tacctgtgtggacagg

SEQ ID NO: 2087960 - DNA, 21 bp, Homo sapiens
taccttagattagctctggac

SEQ ID NO: 2087961 - DNA, 20 bp, Homo sapiens
taccttcaataaagtatcta

SEQ ID NO: 2087962 - DNA, 15 bp, Homo sapiens
taccttctggttgct

SEQ ID NO: 2087963 - DNA, 15 bp, Homo sapiens
taccttgaccatcgt

SEQ ID NO: 2087964 - DNA, 20 bp, Homo sapiens
taccttgcagccatgaccag

SEQ ID NO: 2087965 - DNA, 16 bp, Homo sapiens
tacctttacataattg

SEQ ID NO: 2087966 - DNA, 14 bp, Homo sapiens
tacctttatggttt

SEQ ID NO: 2087967 - DNA, 16 bp, Homo sapiens
tacctttatggtttct

SEQ ID NO: 2087968 - DNA, 18 bp, Homo sapiens
tacctttattaatgaact

SEQ ID NO: 2087969 - DNA, 16 bp, Homo sapiens
tacctttcccatgctg

SEQ ID NO: 2087970 - DNA, 19 bp, Homo sapiens
tacctttcccatgctgaat

SEQ ID NO: 2087971 - DNA, 15 bp, Homo sapiens
tacgctctcctttct

SEQ ID NO: 2087972 - DNA, 19 bp, Homo sapiens
tacggagggaggacatcat

SEQ ID NO: 2087973 - DNA, 20 bp, Homo sapiens
tacggagggaggacatcata

SEQ ID NO: 2087974 - DNA, 16 bp, Homo sapiens
tacggttgtctagagg

SEQ ID NO: 2087975 - DNA, 14 bp, Homo sapiens
tacgtctgacaggc

SEQ ID NO: 2087976 - DNA, 16 bp, Homo sapiens
tacgtgttaggaggct

SEQ ID NO: 2087977 - DNA, 14 bp, Homo sapiens
tactaaagagacat

SEQ ID NO: 2087978 - DNA, 18 bp, Homo sapiens
tactaaagatatcagagc

SEQ ID NO: 2087979 - DNA, 22 bp, Homo sapiens
tactaaagatatcagagctctt

SEQ ID NO: 2087980 - DNA, 16 bp, Homo sapiens
tactaaagcagtgttt

SEQ ID NO: 2087981 - DNA, 20 bp, Homo sapiens
tactaaattgtatacatttt

SEQ ID NO: 2087982 - DNA, 14 bp, Homo sapiens
tactaattgagaaa

SEQ ID NO: 2087983 - DNA, 21 bp, Homo sapiens
tactacagttgttttttgaaa

SEQ ID NO: 2087984 - DNA, 15 bp, Homo sapiens
tactactattctgtt

SEQ ID NO: 2087985 - DNA, 22 bp, Homo sapiens
tactactattctgttaaaatca

SEQ ID NO: 2087986 - DNA, 20 bp, Homo sapiens
tactactgctgcaaagtgca

SEQ ID NO: 2087987 - DNA, 12 bp, Homo sapiens
tactactgtaaa

SEQ ID NO: 2087988 - DNA, 13 bp, Homo sapiens
tactactgtaaat

SEQ ID NO: 2087989 - DNA, 15 bp, Homo sapiens
tactactgtaaatgt

SEQ ID NO: 2087990 - DNA, 22 bp, Homo sapiens
tactactgtggaaaaatattta

SEQ ID NO: 2087991 - DNA, 22 bp, Homo sapiens
tactacttgttacctttcccat

SEQ ID NO: 2087992 - DNA, 23 bp, Homo sapiens
tactagaaagctctgcatgtgtg

SEQ ID NO: 2087993 - DNA, 15 bp, Homo sapiens
tactagaatttgtat

SEQ ID NO: 2087994 - DNA, 19 bp, Homo sapiens
tactagatgtctttaggca

SEQ ID NO: 2087995 - DNA, 18 bp, Homo sapiens
tactagttgatgaaggag

SEQ ID NO: 2087996 - DNA, 13 bp, Homo sapiens
tactatacaacaa

SEQ ID NO: 2087997 - DNA, 16 bp, Homo sapiens
tactatacaacaatgt

SEQ ID NO: 2087998 - DNA, 14 bp, Homo sapiens
tactatatttatgg

SEQ ID NO: 2087999 - DNA, 21 bp, Homo sapiens
tactatggaaagcagccatat

SEQ ID NO: 2088000 - DNA, 15 bp, Homo sapiens
tactattgtttaaaa

SEQ ID NO: 2088001 - DNA, 12 bp, Homo sapiens
tactatttcaca

SEQ ID NO: 2088002 - DNA, 13 bp, Homo sapiens
tactatttcacaa

SEQ ID NO: 2088003 - DNA, 19 bp, Homo sapiens
tactcaagaggctgaggca

SEQ ID NO: 2088004 - DNA, 13 bp, Homo sapiens
tactcacacaggc

SEQ ID NO: 2088005 - DNA, 21 bp, Homo sapiens
tactcacagtctctttaatct

SEQ ID NO: 2088006 - DNA, 18 bp, Homo sapiens
tactcacctctctctaag

SEQ ID NO: 2088007 - DNA, 19 bp, Homo sapiens
tactcagaagcctgaggct

SEQ ID NO: 2088008 - DNA, 12 bp, Homo sapiens
tactcagagcag

SEQ ID NO: 2088009 - DNA, 14 bp, Homo sapiens
tactcagagcagag

SEQ ID NO: 2088010 - DNA, 16 bp, Homo sapiens
tactcagcagcagaga

SEQ ID NO: 2088011 - DNA, 19 bp, Homo sapiens
tactcagcagccctcctca

SEQ ID NO: 2088012 - DNA, 12 bp, Homo sapiens
tactcagccctg

SEQ ID NO: 2088013 - DNA, 13 bp, Homo sapiens
tactcagccctgg

SEQ ID NO: 2088014 - DNA, 14 bp, Homo sapiens
tactcagccctggg

SEQ ID NO: 2088015 - DNA, 15 bp, Homo sapiens
tactcaggaggctga

SEQ ID NO: 2088016 - DNA, 22 bp, Homo sapiens
tactcaggaggctgaggcagaa

SEQ ID NO: 2088017 - DNA, 22 bp, Homo sapiens
tactcataagttggaccagagg

SEQ ID NO: 2088018 - DNA, 19 bp, Homo sapiens
tactcatatatatctatct

SEQ ID NO: 2088019 - DNA, 21 bp, Homo sapiens
tactcatatatatctatctta

SEQ ID NO: 2088020 - DNA, 23 bp, Homo sapiens
tactcatatatatctatcttata

SEQ ID NO: 2088021 - DNA, 20 bp, Homo sapiens
tactcattcatttattcatt

SEQ ID NO: 2088022 - DNA, 22 bp, Homo sapiens
tactcatttctaaaagaatatt

SEQ ID NO: 2088023 - DNA, 19 bp, Homo sapiens
tactccagtggtgaagaaa

SEQ ID NO: 2088024 - DNA, 13 bp, Homo sapiens
tactcccaggcac

SEQ ID NO: 2088025 - DNA, 14 bp, Homo sapiens
tactcccctgggca

SEQ ID NO: 2088026 - DNA, 15 bp, Homo sapiens
tactcccttcctggc

SEQ ID NO: 2088027 - DNA, 17 bp, Homo sapiens
tactcccttcctggcct

SEQ ID NO: 2088028 - DNA, 14 bp, Homo sapiens
tactcctgcaaaat

SEQ ID NO: 2088029 - DNA, 16 bp, Homo sapiens
tactcctgtgctctgg

SEQ ID NO: 2088030 - DNA, 17 bp, Homo sapiens
tactcctgtgctctgga

SEQ ID NO: 2088031 - DNA, 18 bp, Homo sapiens
tactcctgtgggagcctc

SEQ ID NO: 2088032 - DNA, 22 bp, Homo sapiens
tactcgggaggctgaggcagga

SEQ ID NO: 2088033 - DNA, 17 bp, Homo sapiens
tactctacgccaaagtg

SEQ ID NO: 2088034 - DNA, 22 bp, Homo sapiens
tactctagcctgggccagagaa

SEQ ID NO: 2088035 - DNA, 19 bp, Homo sapiens
tactctcctcggccccctc

SEQ ID NO: 2088036 - DNA, 18 bp, Homo sapiens
tactctgagcccaggccg

SEQ ID NO: 2088037 - DNA, 23 bp, Homo sapiens
tactctgcggtggtgccagaggt

SEQ ID NO: 2088038 - DNA, 14 bp, Homo sapiens
tactctgtccaggc

SEQ ID NO: 2088039 - DNA, 15 bp, Homo sapiens
tactctgtgccagag

SEQ ID NO: 2088040 - DNA, 14 bp, Homo sapiens
tagccagtgacttt

SEQ ID NO: 2088041 - DNA, 14 bp, Homo sapiens
tagccatggctcag

SEQ ID NO: 2088042 - DNA, 16 bp, Homo sapiens
tagccatggctcaggc

SEQ ID NO: 2088043 - DNA, 16 bp, Homo sapiens
tagcccagcactgtga

SEQ ID NO: 2088044 - DNA, 19 bp, Homo sapiens
tagcccagcactgtgaaga

SEQ ID NO: 2088045 - DNA, 18 bp, Homo sapiens
tagcccgaggaccgggct

SEQ ID NO: 2088046 - DNA, 12 bp, Homo sapiens
tagccctcagtc

SEQ ID NO: 2088047 - DNA, 18 bp, Homo sapiens
tagccctgcggagccggc

SEQ ID NO: 2088048 - DNA, 14 bp, Homo sapiens
tagccctttctgtg

SEQ ID NO: 2088049 - DNA, 14 bp, Homo sapiens
tagccgacctcagc

SEQ ID NO: 2088050 - DNA, 20 bp, Homo sapiens
tagcctccgtttatgggcct

SEQ ID NO: 2088051 - DNA, 21 bp, Homo sapiens
tagcctccgtttatgggcctt

SEQ ID NO: 2088052 - DNA, 16 bp, Homo sapiens
tagccttaaatttttg

SEQ ID NO: 2088053 - DNA, 18 bp, Homo sapiens
tagccttgctcaggtgca

SEQ ID NO: 2088054 - DNA, 16 bp, Homo sapiens
tagccttgtgccctgc

SEQ ID NO: 2088055 - DNA, 18 bp, Homo sapiens
tagcgagctgctctgcta

SEQ ID NO: 2088056 - DNA, 21 bp, Homo sapiens
tagcgctgccgcaccccagag

SEQ ID NO: 2088057 - DNA, 20 bp, Homo sapiens
tagcgctggctcaggaagaa

SEQ ID NO: 2088058 - DNA, 23 bp, Homo sapiens
tagctaccttctctacccatctc

SEQ ID NO: 2088059 - DNA, 19 bp, Homo sapiens
tagctagaagtgggccagg

SEQ ID NO: 2088060 - DNA, 16 bp, Homo sapiens
tagctagaatgcacac

SEQ ID NO: 2088061 - DNA, 14 bp, Homo sapiens
tagctatcatttct

SEQ ID NO: 2088062 - DNA, 15 bp, Homo sapiens
tagctattactgtct

SEQ ID NO: 2088063 - DNA, 22 bp, Homo sapiens
tagctattgcatgtaaaatgca

SEQ ID NO: 2088064 - DNA, 21 bp, Homo sapiens
tagctatttgtttacatgcag

SEQ ID NO: 2088065 - DNA, 11 bp, Homo sapiens
tagctcagttt

SEQ ID NO: 2088066 - DNA, 22 bp, Homo sapiens
tagctccaccctcaccaggatg

SEQ ID NO: 2088067 - DNA, 16 bp, Homo sapiens
tagctcctctgctgct

SEQ ID NO: 2088068 - DNA, 14 bp, Homo sapiens
tagctctgatcagc

SEQ ID NO: 2088069 - DNA, 14 bp, Homo sapiens
tagctctgcctccc

SEQ ID NO: 2088070 - DNA, 17 bp, Homo sapiens
tagctctgcctccctct

SEQ ID NO: 2088071 - DNA, 14 bp, Homo sapiens
tagctctgttcttt

SEQ ID NO: 2088072 - DNA, 17 bp, Homo sapiens
tagctcttctatttaaa

SEQ ID NO: 2088073 - DNA, 17 bp, Homo sapiens
tagctgaacaatgaatg

SEQ ID NO: 2088074 - DNA, 23 bp, Homo sapiens
tagctgacatctcctctatcaca

SEQ ID NO: 2088075 - DNA, 23 bp, Homo sapiens
tagctgacccagccccttgagaa

SEQ ID NO: 2088076 - DNA, 14 bp, Homo sapiens
tagctgagaggaag

SEQ ID NO: 2088077 - DNA, 16 bp, Homo sapiens
tagctgagaggaagat

SEQ ID NO: 2088078 - DNA, 11 bp, Homo sapiens
tagctgagtgt

SEQ ID NO: 2088079 - DNA, 11 bp, Homo sapiens
tagctgcagaa

SEQ ID NO: 2088080 - DNA, 22 bp, Homo sapiens
tagctgctttaaatctatctat

SEQ ID NO: 2088081 - DNA, 11 bp, Homo sapiens
tagctggcagg

SEQ ID NO: 2088082 - DNA, 12 bp, Homo sapiens
tagctgggacta

SEQ ID NO: 2088083 - DNA, 19 bp, Homo sapiens
tagctgggactacaggcac

SEQ ID NO: 2088084 - DNA, 21 bp, Homo sapiens
tagctgtctgctcagacagaa

SEQ ID NO: 2088085 - DNA, 19 bp, Homo sapiens
tagctgtgacctgctgagc

SEQ ID NO: 2088086 - DNA, 20 bp, Homo sapiens
tagctgtgacctgctgagct

SEQ ID NO: 2088087 - DNA, 18 bp, Homo sapiens
tagctgtggtgaggtggg

SEQ ID NO: 2088088 - DNA, 13 bp, Homo sapiens
tagctgttgagct

SEQ ID NO: 2088089 - DNA, 16 bp, Homo sapiens
tagctgttgagctgtt

SEQ ID NO: 2088090 - DNA, 17 bp, Homo sapiens
tagctgttgagctgttt

SEQ ID NO: 2088091 - DNA, 17 bp, Homo sapiens
tagcttagacctcagcc

SEQ ID NO: 2088092 - DNA, 23 bp, Homo sapiens
tagcttagacctcagcctgtgct

SEQ ID NO: 2088093 - DNA, 17 bp, Homo sapiens
tagcttcatgcctcagt

SEQ ID NO: 2088094 - DNA, 17 bp, Homo sapiens
tagcttgtatagtgtaa

SEQ ID NO: 2088095 - DNA, 18 bp, Homo sapiens
tagctttattttttaagt

SEQ ID NO: 2088096 - DNA, 22 bp, Homo sapiens
tagctttattttttaagtattt

SEQ ID NO: 2088097 - DNA, 15 bp, Homo sapiens
tagctttgctctttg

SEQ ID NO: 2088098 - DNA, 11 bp, Homo sapiens
taggaaagcac

SEQ ID NO: 2088099 - DNA, 21 bp, Homo sapiens
taggaaagcaccgcagcatgt

SEQ ID NO: 2088100 - DNA, 20 bp, Homo sapiens
taggaaataaaacctttcaa

SEQ ID NO: 2088101 - DNA, 18 bp, Homo sapiens
taggaacagagtatatat

SEQ ID NO: 2088102 - DNA, 13 bp, Homo sapiens
taggaagaaaaat

SEQ ID NO: 2088103 - DNA, 14 bp, Homo sapiens
taggaagagaaacc

SEQ ID NO: 2088104 - DNA, 15 bp, Homo sapiens
taggaagagaaacca

SEQ ID NO: 2088105 - DNA, 19 bp, Homo sapiens
taggaagagaaaccaggga

SEQ ID NO: 2088106 - DNA, 13 bp, Homo sapiens
taggaagcatatg

SEQ ID NO: 2088107 - DNA, 14 bp, Homo sapiens
taggaagtgaccga

SEQ ID NO: 2088108 - DNA, 21 bp, Homo sapiens
taggaattcccagcccaaagc

SEQ ID NO: 2088109 - DNA, 14 bp, Homo sapiens
taggacctcaggcg

SEQ ID NO: 2088110 - DNA, 18 bp, Homo sapiens
taggactctgaggctctt

SEQ ID NO: 2088111 - DNA, 18 bp, Homo sapiens
taggactgacatttctat

SEQ ID NO: 2088112 - DNA, 15 bp, Homo sapiens
taggagctcacagtc

SEQ ID NO: 2088113 - DNA, 20 bp, Homo sapiens
taggaggaccagagctactg

SEQ ID NO: 2088114 - DNA, 16 bp, Homo sapiens
taggatctatgcaatt

SEQ ID NO: 2088115 - DNA, 23 bp, Homo sapiens
taggatctatgcaatttttaaac

SEQ ID NO: 2088116 - DNA, 19 bp, Homo sapiens
taggatgtttttcatgaaa

SEQ ID NO: 2088117 - DNA, 16 bp, Homo sapiens
taggatttatttaaaa

SEQ ID NO: 2088118 - DNA, 16 bp, Homo sapiens
taggcagagcctttgg

SEQ ID NO: 2088119 - DNA, 19 bp, Homo sapiens
taggcagcctctctgctat

SEQ ID NO: 2088120 - DNA, 15 bp, Homo sapiens
taggcagggatttga

SEQ ID NO: 2088121 - DNA, 17 bp, Homo sapiens
taggcagggatttgagg

SEQ ID NO: 2088122 - DNA, 16 bp, Homo sapiens
taggcatcccagggga

SEQ ID NO: 2088123 - DNA, 15 bp, Homo sapiens
taggccactcctcca

SEQ ID NO: 2088124 - DNA, 15 bp, Homo sapiens
taggccatttgtatt

SEQ ID NO: 2088125 - DNA, 20 bp, Homo sapiens
taggccctggatgtgcccac

SEQ ID NO: 2088126 - DNA, 23 bp, Homo sapiens
taggcccttgtcctgccagctgc

SEQ ID NO: 2088127 - DNA, 14 bp, Homo sapiens
taggcgagtgccag

SEQ ID NO: 2088128 - DNA, 15 bp, Homo sapiens
taggcggtcatgtgt

SEQ ID NO: 2088129 - DNA, 17 bp, Homo sapiens
taggcggtcatgtgtgc

SEQ ID NO: 2088130 - DNA, 21 bp, Homo sapiens
taggctgccccgggtccccag

SEQ ID NO: 2088131 - DNA, 22 bp, Homo sapiens
taggctgccccgggtccccagc

SEQ ID NO: 2088132 - DNA, 14 bp, Homo sapiens
tagggacttaaaaa

SEQ ID NO: 2088133 - DNA, 14 bp, Homo sapiens
tagggagagaagat

SEQ ID NO: 2088134 - DNA, 11 bp, Homo sapiens
tagggccaggc

SEQ ID NO: 2088135 - DNA, 23 bp, Homo sapiens
tagggctggactctggcacccag

SEQ ID NO: 2088136 - DNA, 18 bp, Homo sapiens
taggggccgagggaaatg

SEQ ID NO: 2088137 - DNA, 23 bp, Homo sapiens
taggggtaatatattgctgctgg

SEQ ID NO: 2088138 - DNA, 17 bp, Homo sapiens
taggggtcaggctccat

SEQ ID NO: 2088139 - DNA, 18 bp, Homo sapiens
tagggtaaggtgccttct

SEQ ID NO: 2088140 - DNA, 15 bp, Homo sapiens
tagggtatgatcctt

SEQ ID NO: 2088141 - DNA, 17 bp, Homo sapiens
tagggtcctggccctct

SEQ ID NO: 2088142 - DNA, 15 bp, Homo sapiens
tagggtctcttcagg

SEQ ID NO: 2088143 - DNA, 15 bp, Homo sapiens
taggtcaatgaaata

SEQ ID NO: 2088144 - DNA, 16 bp, Homo sapiens
taggtcaatgaaatat

SEQ ID NO: 2088145 - DNA, 15 bp, Homo sapiens
taggtcattactaac

SEQ ID NO: 2088146 - DNA, 12 bp, Homo sapiens
taggtctggttg

SEQ ID NO: 2088147 - DNA, 18 bp, Homo sapiens
taggtgctacaaaaacac

SEQ ID NO: 2088148 - DNA, 20 bp, Homo sapiens
taggtgctacaaaaacacag

SEQ ID NO: 2088149 - DNA, 22 bp, Homo sapiens
taggtgctacaaaaacacagca

SEQ ID NO: 2088150 - DNA, 12 bp, Homo sapiens
taggttataaga

SEQ ID NO: 2088151 - DNA, 14 bp, Homo sapiens
taggttcaattccc

SEQ ID NO: 2088152 - DNA, 20 bp, Homo sapiens
taggttgccaataatacact

SEQ ID NO: 2088153 - DNA, 15 bp, Homo sapiens
taggtttttttgtat

SEQ ID NO: 2088154 - DNA, 19 bp, Homo sapiens
taggtttttttgtatagta

SEQ ID NO: 2088155 - DNA, 12 bp, Homo sapiens
tatatatgtgta

SEQ ID NO: 2088156 - DNA, 16 bp, Homo sapiens
tatatatgtgtatata

SEQ ID NO: 2088157 - DNA, 20 bp, Homo sapiens
tatatatgtgtatatataca

SEQ ID NO: 2088158 - DNA, 23 bp, Homo sapiens
tatatatgtgtatatatacatac

SEQ ID NO: 2088159 - DNA, 13 bp, Homo sapiens
tatatatgtgtgt

SEQ ID NO: 2088160 - DNA, 22 bp, Homo sapiens
tatatattggtaacatcctttc

SEQ ID NO: 2088161 - DNA, 22 bp, Homo sapiens
tatatatttttggttgtcaata

SEQ ID NO: 2088162 - DNA, 18 bp, Homo sapiens
tatatcagaaaagggaag

SEQ ID NO: 2088163 - DNA, 16 bp, Homo sapiens
tatatcagaatctgtg

SEQ ID NO: 2088164 - DNA, 19 bp, Homo sapiens
tatatcagaatctgtgtga

SEQ ID NO: 2088165 - DNA, 14 bp, Homo sapiens
tatatcagttataa

SEQ ID NO: 2088166 - DNA, 22 bp, Homo sapiens
tatatcagttataattattcca

SEQ ID NO: 2088167 - DNA, 17 bp, Homo sapiens
tatatcatgaaacactt

SEQ ID NO: 2088168 - DNA, 18 bp, Homo sapiens
tatatctaatttatacaa

SEQ ID NO: 2088169 - DNA, 14 bp, Homo sapiens
tatatctatagtag

SEQ ID NO: 2088170 - DNA, 19 bp, Homo sapiens
tatatctatagtagtcaat

SEQ ID NO: 2088171 - DNA, 14 bp, Homo sapiens
tatatctatctatt

SEQ ID NO: 2088172 - DNA, 19 bp, Homo sapiens
tatatctatctatttgagg

SEQ ID NO: 2088173 - DNA, 16 bp, Homo sapiens
tatatctgaaaactgg

SEQ ID NO: 2088174 - DNA, 16 bp, Homo sapiens
tatatctgcttcagtg

SEQ ID NO: 2088175 - DNA, 16 bp, Homo sapiens
tatatcttatgttaaa

SEQ ID NO: 2088176 - DNA, 17 bp, Homo sapiens
tatatgatctaatacaa

SEQ ID NO: 2088177 - DNA, 19 bp, Homo sapiens
tatatgatctaatacaaag

SEQ ID NO: 2088178 - DNA, 15 bp, Homo sapiens
tatatgatttatagt

SEQ ID NO: 2088179 - DNA, 16 bp, Homo sapiens
tatatgatttatagtt

SEQ ID NO: 2088180 - DNA, 21 bp, Homo sapiens
tatatgatttatagtttgtac

SEQ ID NO: 2088181 - DNA, 22 bp, Homo sapiens
tatatgcatttaattctgaaat

SEQ ID NO: 2088182 - DNA, 18 bp, Homo sapiens
tatatgccttaagccaat

SEQ ID NO: 2088183 - DNA, 17 bp, Homo sapiens
tatatgccttatgtaat

SEQ ID NO: 2088184 - DNA, 11 bp, Homo sapiens
tatatgtacag

SEQ ID NO: 2088185 - DNA, 12 bp, Homo sapiens
tatatgtacagt

SEQ ID NO: 2088186 - DNA, 13 bp, Homo sapiens
tatatgtacagtt

SEQ ID NO: 2088187 - DNA, 14 bp, Homo sapiens
tatatgtacagtta

SEQ ID NO: 2088188 - DNA, 13 bp, Homo sapiens
tatatgtatatat

SEQ ID NO: 2088189 - DNA, 21 bp, Homo sapiens
tatatgtatatatatatagta

SEQ ID NO: 2088190 - DNA, 14 bp, Homo sapiens
tatatgtatatgta

SEQ ID NO: 2088191 - DNA, 20 bp, Homo sapiens
tatatgtatttaaaaaaatc

SEQ ID NO: 2088192 - DNA, 16 bp, Homo sapiens
tatatgtatttattgt

SEQ ID NO: 2088193 - DNA, 14 bp, Homo sapiens
tatatgtcagacat

SEQ ID NO: 2088194 - DNA, 14 bp, Homo sapiens
tatatgtctgtgtg

SEQ ID NO: 2088195 - DNA, 23 bp, Homo sapiens
tatatgtgtaattttttaaatga

SEQ ID NO: 2088196 - DNA, 17 bp, Homo sapiens
tatatgtgtatatatac

SEQ ID NO: 2088197 - DNA, 19 bp, Homo sapiens
tatatgtgtgtttaaataa

SEQ ID NO: 2088198 - DNA, 22 bp, Homo sapiens
tatatgtgtgtttaaataaagt

SEQ ID NO: 2088199 - DNA, 13 bp, Homo sapiens
tatattaaagtgt

SEQ ID NO: 2088200 - DNA, 22 bp, Homo sapiens
tatattacactacacactgtgt

SEQ ID NO: 2088201 - DNA, 21 bp, Homo sapiens
tatattacctcaaattcctaa

SEQ ID NO: 2088202 - DNA, 16 bp, Homo sapiens
tatattagcatttagt

SEQ ID NO: 2088203 - DNA, 23 bp, Homo sapiens
tatattagcatttagtccaatgt

SEQ ID NO: 2088204 - DNA, 23 bp, Homo sapiens
tatattataataatgttctctgg

SEQ ID NO: 2088205 - DNA, 16 bp, Homo sapiens
tatattatggtgtaat

SEQ ID NO: 2088206 - DNA, 18 bp, Homo sapiens
tatattatggtgtaatgc

SEQ ID NO: 2088207 - DNA, 24 bp, Homo sapiens
tatattatggtgtaatgcacaatt

SEQ ID NO: 2088208 - DNA, 17 bp, Homo sapiens
tatattcagagatgtac

SEQ ID NO: 2088209 - DNA, 21 bp, Homo sapiens
tatattcagagatgtaccatg

SEQ ID NO: 2088210 - DNA, 16 bp, Homo sapiens
tatattcatgtaataa

SEQ ID NO: 2088211 - DNA, 18 bp, Homo sapiens
tatattcatgtaataaat

SEQ ID NO: 2088212 - DNA, 20 bp, Homo sapiens
tatattcatgtaataaatct

SEQ ID NO: 2088213 - DNA, 19 bp, Homo sapiens
tatattccatatattagca

SEQ ID NO: 2088214 - DNA, 22 bp, Homo sapiens
tatattccgggtgccattccca

SEQ ID NO: 2088215 - DNA, 13 bp, Homo sapiens
tatattctggaaa

SEQ ID NO: 2088216 - DNA, 14 bp, Homo sapiens
tatattctggaaaa

SEQ ID NO: 2088217 - DNA, 15 bp, Homo sapiens
tatattgtatattct

SEQ ID NO: 2088218 - DNA, 16 bp, Homo sapiens
tatattgtatattctg

SEQ ID NO: 2088219 - DNA, 18 bp, Homo sapiens
tatattgtatattctgga

SEQ ID NO: 2088220 - DNA, 21 bp, Homo sapiens
tatatttaaaggggagatact

SEQ ID NO: 2088221 - DNA, 20 bp, Homo sapiens
tatatttaatttttacatga

SEQ ID NO: 2088222 - DNA, 18 bp, Homo sapiens
tatatttactaaaagaat

SEQ ID NO: 2088223 - DNA, 21 bp, Homo sapiens
tatatttagattgttaaaata

SEQ ID NO: 2088224 - DNA, 16 bp, Homo sapiens
tatatttagttatagt

SEQ ID NO: 2088225 - DNA, 18 bp, Homo sapiens
tatatttagttatagttt

SEQ ID NO: 2088226 - DNA, 12 bp, Homo sapiens
tatatttataac

SEQ ID NO: 2088227 - DNA, 14 bp, Homo sapiens
tatatttataactc

SEQ ID NO: 2088228 - DNA, 15 bp, Homo sapiens
tatatttataactca

SEQ ID NO: 2088229 - DNA, 24 bp, Homo sapiens
tatatttataactcatcataaaat

SEQ ID NO: 2088230 - DNA, 19 bp, Homo sapiens
tatatttatgaatgtgcat

SEQ ID NO: 2088231 - DNA, 11 bp, Homo sapiens
tatatttggaa

SEQ ID NO: 2088232 - DNA, 14 bp, Homo sapiens
tatatttggaaaga

SEQ ID NO: 2088233 - DNA, 17 bp, Homo sapiens
tatatttgtgtatgtgt

SEQ ID NO: 2088234 - DNA, 15 bp, Homo sapiens
tatattttatgattt

SEQ ID NO: 2088235 - DNA, 24 bp, Homo sapiens
tatattttcatgacttttccatgt

SEQ ID NO: 2088236 - DNA, 22 bp, Homo sapiens
tatattttccctctcttgcctt

SEQ ID NO: 2088237 - DNA, 13 bp, Homo sapiens
tatatttttatat

SEQ ID NO: 2088238 - DNA, 21 bp, Homo sapiens
tatatttttgatggtaagact

SEQ ID NO: 2088239 - DNA, 18 bp, Homo sapiens
tatatttttggttgtcaa

SEQ ID NO: 2088240 - DNA, 18 bp, Homo sapiens
tatcaaaacatatcaatt

SEQ ID NO: 2088241 - DNA, 19 bp, Homo sapiens
tatcaaaacatatcaattc

SEQ ID NO: 2088242 - DNA, 12 bp, Homo sapiens
tatcaaaagaca

SEQ ID NO: 2088243 - DNA, 16 bp, Homo sapiens
tatcaaactgaagcca

SEQ ID NO: 2088244 - DNA, 21 bp, Homo sapiens
tatcaacatctttttcctccc

SEQ ID NO: 2088245 - DNA, 21 bp, Homo sapiens
tatcaaccccagacactggtt

SEQ ID NO: 2088246 - DNA, 19 bp, Homo sapiens
tatcaacctaagcaacaga

SEQ ID NO: 2088247 - DNA, 23 bp, Homo sapiens
tatcaagccagtacgtgctaaca

SEQ ID NO: 2088248 - DNA, 13 bp, Homo sapiens
tatcaatagtcaa

SEQ ID NO: 2088249 - DNA, 20 bp, Homo sapiens
tatcaatagtcaagaaaaat

SEQ ID NO: 2088250 - DNA, 11 bp, Homo sapiens
tatcaattcaa

SEQ ID NO: 2088251 - DNA, 12 bp, Homo sapiens
tatcacatacaa

SEQ ID NO: 2088252 - DNA, 15 bp, Homo sapiens
tatcacatacaattt

SEQ ID NO: 2088253 - DNA, 17 bp, Homo sapiens
tatcacatacaatttgc

SEQ ID NO: 2088254 - DNA, 19 bp, Homo sapiens
tatcactggcaatatttgt

SEQ ID NO: 2088255 - DNA, 14 bp, Homo sapiens
tatcacttatatat

SEQ ID NO: 2088256 - DNA, 15 bp, Homo sapiens
tatcagaaaagtaga

SEQ ID NO: 2088257 - DNA, 17 bp, Homo sapiens
tatcagaaaagtagaat

SEQ ID NO: 2088258 - DNA, 14 bp, Homo sapiens
tatcagaagaccac

SEQ ID NO: 2088259 - DNA, 15 bp, Homo sapiens
tatcagagctcttaa

SEQ ID NO: 2088260 - DNA, 21 bp, Homo sapiens
tatcagagttgcttttctaat

SEQ ID NO: 2088261 - DNA, 22 bp, Homo sapiens
tatcagagttgcttttctaatc

SEQ ID NO: 2088262 - DNA, 14 bp, Homo sapiens
tatcaggcacaggc

SEQ ID NO: 2088263 - DNA, 20 bp, Homo sapiens
tatcaggtgctgccatccag

SEQ ID NO: 2088264 - DNA, 16 bp, Homo sapiens
tatcagtgacagagtt

SEQ ID NO: 2088265 - DNA, 17 bp, Homo sapiens
tatcagtgacagagttc

SEQ ID NO: 2088266 - DNA, 22 bp, Homo sapiens
tatcagtgacagagttcactat

SEQ ID NO: 2088267 - DNA, 16 bp, Homo sapiens
tatcagtgcttaatgt

SEQ ID NO: 2088268 - DNA, 18 bp, Homo sapiens
tatcagttactcagccct

SEQ ID NO: 2088269 - DNA, 19 bp, Homo sapiens
tatcagttactcagccctg

SEQ ID NO: 2088270 - DNA, 14 bp, Homo sapiens
tcatggtgaaaatg

SEQ ID NO: 2088271 - DNA, 19 bp, Homo sapiens
tcatggtgaaaatgtactg

SEQ ID NO: 2088272 - DNA, 21 bp, Homo sapiens
tcatgtaaacctaagcacgta

SEQ ID NO: 2088273 - DNA, 23 bp, Homo sapiens
tcatgtaaattttgtatgaaaaa

SEQ ID NO: 2088274 - DNA, 18 bp, Homo sapiens
tcatgtaccatcaataaa

SEQ ID NO: 2088275 - DNA, 14 bp, Homo sapiens
tcatgtacttcctg

SEQ ID NO: 2088276 - DNA, 21 bp, Homo sapiens
tcatgtatgttcagaagaaat

SEQ ID NO: 2088277 - DNA, 16 bp, Homo sapiens
tcatgtcaggcctgtg

SEQ ID NO: 2088278 - DNA, 13 bp, Homo sapiens
tcatgtgtgcatg

SEQ ID NO: 2088279 - DNA, 13 bp, Homo sapiens
tcatgttcctcaa

SEQ ID NO: 2088280 - DNA, 17 bp, Homo sapiens
tcatgttgaagccactg

SEQ ID NO: 2088281 - DNA, 17 bp, Homo sapiens
tcatgttggccaggctg

SEQ ID NO: 2088282 - DNA, 13 bp, Homo sapiens
tcatgttggtcaa

SEQ ID NO: 2088283 - DNA, 20 bp, Homo sapiens
tcatgttgttcccacacaca

SEQ ID NO: 2088284 - DNA, 16 bp, Homo sapiens
tcatgttttgtgacta

SEQ ID NO: 2088285 - DNA, 17 bp, Homo sapiens
tcattaccaagttactt

SEQ ID NO: 2088286 - DNA, 23 bp, Homo sapiens
tcattataaacgtgatgatcagc

SEQ ID NO: 2088287 - DNA, 16 bp, Homo sapiens
tcattatttgcagaga

SEQ ID NO: 2088288 - DNA, 22 bp, Homo sapiens
tcattcaaaacaaccatcctgc

SEQ ID NO: 2088289 - DNA, 18 bp, Homo sapiens
tcattcaagcctgtgaat

SEQ ID NO: 2088290 - DNA, 17 bp, Homo sapiens
tcattcaatatctgaca

SEQ ID NO: 2088291 - DNA, 20 bp, Homo sapiens
tcattcagtgagacacagag

SEQ ID NO: 2088292 - DNA, 21 bp, Homo sapiens
tcattccaacttcccagttca

SEQ ID NO: 2088293 - DNA, 15 bp, Homo sapiens
tcattcccagagtca

SEQ ID NO: 2088294 - DNA, 16 bp, Homo sapiens
tcattccccggccctc

SEQ ID NO: 2088295 - DNA, 12 bp, Homo sapiens
tcattcccctcg

SEQ ID NO: 2088296 - DNA, 22 bp, Homo sapiens
tcattcctgaaagaaacagtta

SEQ ID NO: 2088297 - DNA, 17 bp, Homo sapiens
tcattcgcctgtgggaa

SEQ ID NO: 2088298 - DNA, 21 bp, Homo sapiens
tcattcgcctgtgggaagaga

SEQ ID NO: 2088299 - DNA, 15 bp, Homo sapiens
tcattctcctgcctg

SEQ ID NO: 2088300 - DNA, 17 bp, Homo sapiens
tcattcttgaaagctgt

SEQ ID NO: 2088301 - DNA, 21 bp, Homo sapiens
tcattctttcccctcagagct

SEQ ID NO: 2088302 - DNA, 18 bp, Homo sapiens
tcattgactgaactgcac

SEQ ID NO: 2088303 - DNA, 13 bp, Homo sapiens
tcattgatatgaa

SEQ ID NO: 2088304 - DNA, 18 bp, Homo sapiens
tcattgatatgaaaaata

SEQ ID NO: 2088305 - DNA, 12 bp, Homo sapiens
tcattgtaaatt

SEQ ID NO: 2088306 - DNA, 12 bp, Homo sapiens
tcattgtagaaa

SEQ ID NO: 2088307 - DNA, 22 bp, Homo sapiens
tcattgtatatatgtgtgttta

SEQ ID NO: 2088308 - DNA, 15 bp, Homo sapiens
tcattgtatgatgtg

SEQ ID NO: 2088309 - DNA, 17 bp, Homo sapiens
tcattgtatgatgtgtt

SEQ ID NO: 2088310 - DNA, 22 bp, Homo sapiens
tcattgtccatgcctacagata

SEQ ID NO: 2088311 - DNA, 23 bp, Homo sapiens
tcattgtccatgcctacagataa

SEQ ID NO: 2088312 - DNA, 11 bp, Homo sapiens
tcattgtctca

SEQ ID NO: 2088313 - DNA, 16 bp, Homo sapiens
tcattgtctcagtgct

SEQ ID NO: 2088314 - DNA, 18 bp, Homo sapiens
tcattgtctcagtgctgg

SEQ ID NO: 2088315 - DNA, 18 bp, Homo sapiens
tcattgtggctatctgca

SEQ ID NO: 2088316 - DNA, 21 bp, Homo sapiens
tcattgttacaggtgtactat

SEQ ID NO: 2088317 - DNA, 22 bp, Homo sapiens
tcattgttacaggtgtactatg

SEQ ID NO: 2088318 - DNA, 24 bp, Homo sapiens
tcattgttttacttttgtcttcct

SEQ ID NO: 2088319 - DNA, 23 bp, Homo sapiens
tcatttaaaaaaaaaatttgttt

SEQ ID NO: 2088320 - DNA, 14 bp, Homo sapiens
tcatttaagggaaa

SEQ ID NO: 2088321 - DNA, 16 bp, Homo sapiens
tcatttaagggaaaaa

SEQ ID NO: 2088322 - DNA, 22 bp, Homo sapiens
tcatttaatcctcccttcctcc

SEQ ID NO: 2088323 - DNA, 14 bp, Homo sapiens
tcatttagttagaa

SEQ ID NO: 2088324 - DNA, 21 bp, Homo sapiens
tcatttataaaaccatcaaaa

SEQ ID NO: 2088325 - DNA, 14 bp, Homo sapiens
tcatttatgaaaag

SEQ ID NO: 2088326 - DNA, 14 bp, Homo sapiens
tcatttcacattaa

SEQ ID NO: 2088327 - DNA, 19 bp, Homo sapiens
tcatttcacattaatggtc

SEQ ID NO: 2088328 - DNA, 15 bp, Homo sapiens
tcatttcatctcatt

SEQ ID NO: 2088329 - DNA, 16 bp, Homo sapiens
tcatttcatctcattt

SEQ ID NO: 2088330 - DNA, 15 bp, Homo sapiens
tcatttcatttccta

SEQ ID NO: 2088331 - DNA, 13 bp, Homo sapiens
tcatttcctcaaa

SEQ ID NO: 2088332 - DNA, 13 bp, Homo sapiens
tcatttcctgtgt

SEQ ID NO: 2088333 - DNA, 13 bp, Homo sapiens
tcatttctaaaag

SEQ ID NO: 2088334 - DNA, 16 bp, Homo sapiens
tcatttgcaagctgag

SEQ ID NO: 2088335 - DNA, 13 bp, Homo sapiens
tcatttggtgctg

SEQ ID NO: 2088336 - DNA, 14 bp, Homo sapiens
tcatttgtcacaca

SEQ ID NO: 2088337 - DNA, 17 bp, Homo sapiens
tcattttaaaatctgat

SEQ ID NO: 2088338 - DNA, 21 bp, Homo sapiens
tcattttaaaatctgatttaa

SEQ ID NO: 2088339 - DNA, 22 bp, Homo sapiens
tcattttaacatctgagaaaag

SEQ ID NO: 2088340 - DNA, 19 bp, Homo sapiens
tcattttaagaagacatga

SEQ ID NO: 2088341 - DNA, 14 bp, Homo sapiens
tcattttaattatt

SEQ ID NO: 2088342 - DNA, 21 bp, Homo sapiens
tcattttaggcctcctctctg

SEQ ID NO: 2088343 - DNA, 16 bp, Homo sapiens
tcattttagtgactgt

SEQ ID NO: 2088344 - DNA, 12 bp, Homo sapiens
tcattttcagag

SEQ ID NO: 2088345 - DNA, 15 bp, Homo sapiens
tcattttcagagtga

SEQ ID NO: 2088346 - DNA, 22 bp, Homo sapiens
tcattttgagtctcaggccctg

SEQ ID NO: 2088347 - DNA, 13 bp, Homo sapiens
tcattttgcacgt

SEQ ID NO: 2088348 - DNA, 17 bp, Homo sapiens
tcattttgtaacaaatg

SEQ ID NO: 2088349 - DNA, 18 bp, Homo sapiens
tcatttttttaacacata

SEQ ID NO: 2088350 - DNA, 19 bp, Homo sapiens
tcattttttttttttgagg

SEQ ID NO: 2088351 - DNA, 18 bp, Homo sapiens
tccaaaattacttctctc

SEQ ID NO: 2088352 - DNA, 15 bp, Homo sapiens
tccaaactcctgcct

SEQ ID NO: 2088353 - DNA, 20 bp, Homo sapiens
tccaaagggcagtaaagttt

SEQ ID NO: 2088354 - DNA, 17 bp, Homo sapiens
tccaaaggggctgctgg

SEQ ID NO: 2088355 - DNA, 19 bp, Homo sapiens
tccaaaggggctgctgggg

SEQ ID NO: 2088356 - DNA, 22 bp, Homo sapiens
tccaaatattattcaagtgcct

SEQ ID NO: 2088357 - DNA, 20 bp, Homo sapiens
tccaaatgaatgttgtctgt

SEQ ID NO: 2088358 - DNA, 22 bp, Homo sapiens
tccaaatgaggatatcatcttt

SEQ ID NO: 2088359 - DNA, 19 bp, Homo sapiens
tccaaatgattttcatcaa

SEQ ID NO: 2088360 - DNA, 18 bp, Homo sapiens
tccaacaataaagagctc

SEQ ID NO: 2088361 - DNA, 15 bp, Homo sapiens
tccaacagacagggc

SEQ ID NO: 2088362 - DNA, 18 bp, Homo sapiens
tccaacagacagggccta

SEQ ID NO: 2088363 - DNA, 12 bp, Homo sapiens
tccaacagcttg

SEQ ID NO: 2088364 - DNA, 21 bp, Homo sapiens
tccaacagcttgaccagacct

SEQ ID NO: 2088365 - DNA, 15 bp, Homo sapiens
tccaacccatgatga

SEQ ID NO: 2088366 - DNA, 19 bp, Homo sapiens
tccaaccccagctggcctc

SEQ ID NO: 2088367 - DNA, 20 bp, Homo sapiens
tccaaccccagctggcctct

SEQ ID NO: 2088368 - DNA, 17 bp, Homo sapiens
tccaaccccccacctgc

SEQ ID NO: 2088369 - DNA, 21 bp, Homo sapiens
tccaacctaacccctttcctg

SEQ ID NO: 2088370 - DNA, 21 bp, Homo sapiens
tccaactggattataaataaa

SEQ ID NO: 2088371 - DNA, 15 bp, Homo sapiens
tccaacttcatttga

SEQ ID NO: 2088372 - DNA, 17 bp, Homo sapiens
tccaagaaagatccacc

SEQ ID NO: 2088373 - DNA, 12 bp, Homo sapiens
tccaagagaatt

SEQ ID NO: 2088374 - DNA, 20 bp, Homo sapiens
tccaagattcaaagagacta

SEQ ID NO: 2088375 - DNA, 11 bp, Homo sapiens
tccaagcaaag

SEQ ID NO: 2088376 - DNA, 21 bp, Homo sapiens
tccaagcgaggtcaacagaga

SEQ ID NO: 2088377 - DNA, 16 bp, Homo sapiens
tccaagctggtcccac

SEQ ID NO: 2088378 - DNA, 20 bp, Homo sapiens
tccaagctggtcccactcag

SEQ ID NO: 2088379 - DNA, 21 bp, Homo sapiens
tccaagctggtcccactcagt

SEQ ID NO: 2088380 - DNA, 17 bp, Homo sapiens
tccaagcttcaagtgat

SEQ ID NO: 2088381 - DNA, 20 bp, Homo sapiens
tccaaggaacctaattgaaa

SEQ ID NO: 2088382 - DNA, 22 bp, Homo sapiens
tccaaggaacctaattgaaatt

SEQ ID NO: 2088383 - DNA, 20 bp, Homo sapiens
tccaaggagaaacagagaca

SEQ ID NO: 2088384 - DNA, 20 bp, Homo sapiens
tccagatgccttcctgtctt

SEQ ID NO: 2088385 - DNA, 21 bp, Homo sapiens
tccagatgccttcctgtcttt

SEQ ID NO: 2088386 - DNA, 23 bp, Homo sapiens
tccagcacagaaggaatctgtgc

SEQ ID NO: 2088387 - DNA, 23 bp, Homo sapiens
tccagcaggtagtgggtgaatgt

SEQ ID NO: 2088388 - DNA, 16 bp, Homo sapiens
tccagcatccagcctg

SEQ ID NO: 2088389 - DNA, 13 bp, Homo sapiens
tccagcatttgcc

SEQ ID NO: 2088390 - DNA, 23 bp, Homo sapiens
tccagccagcaatgatgtccaga

SEQ ID NO: 2088391 - DNA, 11 bp, Homo sapiens
tccagccagcg

SEQ ID NO: 2088392 - DNA, 12 bp, Homo sapiens
tccagccagcgc

SEQ ID NO: 2088393 - DNA, 19 bp, Homo sapiens
tccagccagcgcctccctc

SEQ ID NO: 2088394 - DNA, 14 bp, Homo sapiens
tccagccagctcct

SEQ ID NO: 2088395 - DNA, 20 bp, Homo sapiens
tccagccatcaagagactga

SEQ ID NO: 2088396 - DNA, 24 bp, Homo sapiens
tccagccatcaagagactgagtca

SEQ ID NO: 2088397 - DNA, 19 bp, Homo sapiens
tccagcctctcccggctgc

SEQ ID NO: 2088398 - DNA, 22 bp, Homo sapiens
tccagcctctcccggctgcctg

SEQ ID NO: 2088399 - DNA, 13 bp, Homo sapiens
tccagcctgggca

SEQ ID NO: 2088400 - DNA, 12 bp, Homo sapiens
tccagcctgggt

SEQ ID NO: 2088401 - DNA, 19 bp, Homo sapiens
tccagccttctctctctgg

SEQ ID NO: 2088402 - DNA, 15 bp, Homo sapiens
tccagctcaccagcc

SEQ ID NO: 2088403 - DNA, 23 bp, Homo sapiens
tccagctcaccagccccagtgcc

SEQ ID NO: 2088404 - DNA, 13 bp, Homo sapiens
tccagctccagtt

SEQ ID NO: 2088405 - DNA, 14 bp, Homo sapiens
tccagctcttggcc

SEQ ID NO: 2088406 - DNA, 17 bp, Homo sapiens
tccagcttgctcttcag

SEQ ID NO: 2088407 - DNA, 17 bp, Homo sapiens
tccaggaaggcagctgc

SEQ ID NO: 2088408 - DNA, 21 bp, Homo sapiens
tccaggaaggcagctgctctt

SEQ ID NO: 2088409 - DNA, 19 bp, Homo sapiens
tccaggaaggtagcccagc

SEQ ID NO: 2088410 - DNA, 16 bp, Homo sapiens
tccaggaataggcatt

SEQ ID NO: 2088411 - DNA, 21 bp, Homo sapiens
tccaggagcacacggccctgc

SEQ ID NO: 2088412 - DNA, 14 bp, Homo sapiens
tccaggagcccaga

SEQ ID NO: 2088413 - DNA, 18 bp, Homo sapiens
tccaggagcctgtgcctc

SEQ ID NO: 2088414 - DNA, 23 bp, Homo sapiens
tccaggcacccttctttcctctt

SEQ ID NO: 2088415 - DNA, 17 bp, Homo sapiens
tccaggcacgtcccgga

SEQ ID NO: 2088416 - DNA, 16 bp, Homo sapiens
tccaggcatgctggcc

SEQ ID NO: 2088417 - DNA, 17 bp, Homo sapiens
tccaggccactgtggcc

SEQ ID NO: 2088418 - DNA, 16 bp, Homo sapiens
tccaggcccctgagga

SEQ ID NO: 2088419 - DNA, 10 bp, Homo sapiens
tccaggctcc

SEQ ID NO: 2088420 - DNA, 12 bp, Homo sapiens
tccaggctcctt

SEQ ID NO: 2088421 - DNA, 22 bp, Homo sapiens
tccaggctcctttagcgcccag

SEQ ID NO: 2088422 - DNA, 21 bp, Homo sapiens
tccaggctgtatcccatgagc

SEQ ID NO: 2088423 - DNA, 22 bp, Homo sapiens
tccagggcatccgcagcccagg

SEQ ID NO: 2088424 - DNA, 17 bp, Homo sapiens
tccagggccacgtgcca

SEQ ID NO: 2088425 - DNA, 22 bp, Homo sapiens
tccagggccacgtgccaggccc

SEQ ID NO: 2088426 - DNA, 14 bp, Homo sapiens
tccagggctgcccc

SEQ ID NO: 2088427 - DNA, 18 bp, Homo sapiens
tccagggttgatcacact

SEQ ID NO: 2088428 - DNA, 16 bp, Homo sapiens
tccaggtatctccagg

SEQ ID NO: 2088429 - DNA, 17 bp, Homo sapiens
tccaggtatctccagga

SEQ ID NO: 2088430 - DNA, 18 bp, Homo sapiens
tccaggtatctccaggat

SEQ ID NO: 2088431 - DNA, 15 bp, Homo sapiens
tccaggtcctggtgg

SEQ ID NO: 2088432 - DNA, 22 bp, Homo sapiens
tccaggtcctggtggggcagct

SEQ ID NO: 2088433 - DNA, 22 bp, Homo sapiens
tccagtaggtaatgattatgtg

SEQ ID NO: 2088434 - DNA, 22 bp, Homo sapiens
tccagtatggaagaatggggtg

SEQ ID NO: 2088435 - DNA, 19 bp, Homo sapiens
tccagtattcttgtcaaaa

SEQ ID NO: 2088436 - DNA, 16 bp, Homo sapiens
tccagtctcctgacat

SEQ ID NO: 2088437 - DNA, 17 bp, Homo sapiens
tccagtctcctgacatt

SEQ ID NO: 2088438 - DNA, 12 bp, Homo sapiens
tccagtgagccg

SEQ ID NO: 2088439 - DNA, 22 bp, Homo sapiens
tccagtgatgtgctggagctgg

SEQ ID NO: 2088440 - DNA, 15 bp, Homo sapiens
tccagtgcatgttgc

SEQ ID NO: 2088441 - DNA, 16 bp, Homo sapiens
tccagtggtaccagct

SEQ ID NO: 2088442 - DNA, 17 bp, Homo sapiens
tccagtggtaccagctc

SEQ ID NO: 2088443 - DNA, 19 bp, Homo sapiens
tccagtggtaccagctcac

SEQ ID NO: 2088444 - DNA, 12 bp, Homo sapiens
tccagtggtgaa

SEQ ID NO: 2088445 - DNA, 19 bp, Homo sapiens
tccagtggtgaagaaaact

SEQ ID NO: 2088446 - DNA, 15 bp, Homo sapiens
tccagtggttgctgt

SEQ ID NO: 2088447 - DNA, 16 bp, Homo sapiens
tccagtgtgcacccct

SEQ ID NO: 2088448 - DNA, 19 bp, Homo sapiens
tccagtgtgcacccctccc

SEQ ID NO: 2088449 - DNA, 21 bp, Homo sapiens
tccagtgtgcacccctcccca

SEQ ID NO: 2088450 - DNA, 23 bp, Homo sapiens
tccagtgtgcacccctccccatt

SEQ ID NO: 2088451 - DNA, 18 bp, Homo sapiens
tccagtgttggctgtgtg

SEQ ID NO: 2088452 - DNA, 19 bp, Homo sapiens
tccagtgttggctgtgtga

SEQ ID NO: 2088453 - DNA, 14 bp, Homo sapiens
tccagtttgttctc

SEQ ID NO: 2088454 - DNA, 17 bp, Homo sapiens
tccagtttgttctccgg

SEQ ID NO: 2088455 - DNA, 15 bp, Homo sapiens
tccataaagcaagct

SEQ ID NO: 2088456 - DNA, 21 bp, Homo sapiens
tccataaagtaattttgtgaa

SEQ ID NO: 2088457 - DNA, 16 bp, Homo sapiens
tccataatcaatctat

SEQ ID NO: 2088458 - DNA, 21 bp, Homo sapiens
tccataatctggactcctctg

SEQ ID NO: 2088459 - DNA, 22 bp, Homo sapiens
tccataatctggactcctctgt

SEQ ID NO: 2088460 - DNA, 15 bp, Homo sapiens
tccataatgccactg

SEQ ID NO: 2088461 - DNA, 12 bp, Homo sapiens
tccataatgtat

SEQ ID NO: 2088462 - DNA, 17 bp, Homo sapiens
tccatacacatccccag

SEQ ID NO: 2088463 - DNA, 15 bp, Homo sapiens
tccataggaatcatg

SEQ ID NO: 2088464 - DNA, 17 bp, Homo sapiens
tccataggaatcatgtt

SEQ ID NO: 2088465 - DNA, 15 bp, Homo sapiens
tccatatcagacctc

SEQ ID NO: 2088466 - DNA, 23 bp, Homo sapiens
tccatatcagacctctgatccct

SEQ ID NO: 2088467 - DNA, 14 bp, Homo sapiens
tccatcagctccct

SEQ ID NO: 2088468 - DNA, 14 bp, Homo sapiens
tccatcaggccact

SEQ ID NO: 2088469 - DNA, 14 bp, Homo sapiens
tccatccccaaact

SEQ ID NO: 2088470 - DNA, 15 bp, Homo sapiens
tccatctggcagggt

SEQ ID NO: 2088471 - DNA, 20 bp, Homo sapiens
tccatctgggctaccccacc

SEQ ID NO: 2088472 - DNA, 19 bp, Homo sapiens
tccatctgtggaaatgaca

SEQ ID NO: 2088473 - DNA, 21 bp, Homo sapiens
tccatgaagaccacatccaca

SEQ ID NO: 2088474 - DNA, 23 bp, Homo sapiens
tccatgaagaccacatccacaca

SEQ ID NO: 2088475 - DNA, 19 bp, Homo sapiens
tccatgcagactcctcaga

SEQ ID NO: 2088476 - DNA, 21 bp, Homo sapiens
tccatgcagactcctcagatc

SEQ ID NO: 2088477 - DNA, 17 bp, Homo sapiens
tccatgcctacagataa

SEQ ID NO: 2088478 - DNA, 13 bp, Homo sapiens
tccatgcctgagg

SEQ ID NO: 2088479 - DNA, 14 bp, Homo sapiens
tccatgcctgaggg

SEQ ID NO: 2088480 - DNA, 14 bp, Homo sapiens
tccatgctgcctcc

SEQ ID NO: 2088481 - DNA, 15 bp, Homo sapiens
tccatgctgcctcca

SEQ ID NO: 2088482 - DNA, 21 bp, Homo sapiens
tccatggacaatataaactga

SEQ ID NO: 2088483 - DNA, 20 bp, Homo sapiens
tccatggaggaggtgtccca

SEQ ID NO: 2088484 - DNA, 22 bp, Homo sapiens
tccatggaggaggtgtcccaag

SEQ ID NO: 2088485 - DNA, 13 bp, Homo sapiens
tccatggcaccag

SEQ ID NO: 2088486 - DNA, 15 bp, Homo sapiens
tccatggcaccagcc

SEQ ID NO: 2088487 - DNA, 12 bp, Homo sapiens
tccatggccacc

SEQ ID NO: 2088488 - DNA, 14 bp, Homo sapiens
tccatggtggaagg

SEQ ID NO: 2088489 - DNA, 15 bp, Homo sapiens
tccatgtagcaggac

SEQ ID NO: 2088490 - DNA, 21 bp, Homo sapiens
tccatgtattcacacacccct

SEQ ID NO: 2088491 - DNA, 17 bp, Homo sapiens
tccatgtcctatgtgtg

SEQ ID NO: 2088492 - DNA, 16 bp, Homo sapiens
tccatgtcgcctctgc

SEQ ID NO: 2088493 - DNA, 17 bp, Homo sapiens
tccatgtcgcctctgca

SEQ ID NO: 2088494 - DNA, 11 bp, Homo sapiens
tccatgtggcc

SEQ ID NO: 2088495 - DNA, 22 bp, Homo sapiens
tccatgtggccccaggtgccac

SEQ ID NO: 2088496 - DNA, 20 bp, Homo sapiens
tccatgtgggctagttgggc

SEQ ID NO: 2088497 - DNA, 18 bp, Homo sapiens
tccatgttagtttttact

SEQ ID NO: 2088498 - DNA, 17 bp, Homo sapiens
tcctgcaattctacagt

SEQ ID NO: 2088499 - DNA, 12 bp, Homo sapiens
tcctgcactcca

SEQ ID NO: 2088500 - DNA, 14 bp, Homo sapiens
tcctgcactccaga

SEQ ID NO: 2088501 - DNA, 15 bp, Homo sapiens
tcctgcactccagaa

SEQ ID NO: 2088502 - DNA, 12 bp, Homo sapiens
tcctgcagcctc

SEQ ID NO: 2088503 - DNA, 16 bp, Homo sapiens
tcctgcatttgtgaaa

SEQ ID NO: 2088504 - DNA, 12 bp, Homo sapiens
tcctgccactga

SEQ ID NO: 2088505 - DNA, 13 bp, Homo sapiens
tcctgccactgac

SEQ ID NO: 2088506 - DNA, 11 bp, Homo sapiens
tcctgccagct

SEQ ID NO: 2088507 - DNA, 16 bp, Homo sapiens
tcctgcccaggagagc

SEQ ID NO: 2088508 - DNA, 23 bp, Homo sapiens
tcctgcccaggagagccagccct

SEQ ID NO: 2088509 - DNA, 21 bp, Homo sapiens
tcctgccccaactccttccag

SEQ ID NO: 2088510 - DNA, 15 bp, Homo sapiens
tcctgcccccagcca

SEQ ID NO: 2088511 - DNA, 22 bp, Homo sapiens
tcctgcccccgacagcccagcc

SEQ ID NO: 2088512 - DNA, 12 bp, Homo sapiens
tcctgccctgtt

SEQ ID NO: 2088513 - DNA, 17 bp, Homo sapiens
tcctgcctcagcctccc

SEQ ID NO: 2088514 - DNA, 15 bp, Homo sapiens
tcctgcctctactgg

SEQ ID NO: 2088515 - DNA, 17 bp, Homo sapiens
tcctgcctctactggga

SEQ ID NO: 2088516 - DNA, 11 bp, Homo sapiens
tcctgcctctc

SEQ ID NO: 2088517 - DNA, 12 bp, Homo sapiens
tcctgcctctct

SEQ ID NO: 2088518 - DNA, 15 bp, Homo sapiens
tcctgcctctctgct

SEQ ID NO: 2088519 - DNA, 20 bp, Homo sapiens
tcctgcctctctgctccaga

SEQ ID NO: 2088520 - DNA, 11 bp, Homo sapiens
tcctgccttga

SEQ ID NO: 2088521 - DNA, 21 bp, Homo sapiens
tcctgccttgatgaagcctgt

SEQ ID NO: 2088522 - DNA, 23 bp, Homo sapiens
tcctgccttgatgaagcctgtgc

SEQ ID NO: 2088523 - DNA, 14 bp, Homo sapiens
tcctgcgggtttta

SEQ ID NO: 2088524 - DNA, 16 bp, Homo sapiens
tcctgcgggttttaat

SEQ ID NO: 2088525 - DNA, 21 bp, Homo sapiens
tcctgctgaaacacctcccag

SEQ ID NO: 2088526 - DNA, 20 bp, Homo sapiens
tcctgctgcctaataaagag

SEQ ID NO: 2088527 - DNA, 15 bp, Homo sapiens
tcctgctggcacctc

SEQ ID NO: 2088528 - DNA, 18 bp, Homo sapiens
tcctgctggcacctcaga

SEQ ID NO: 2088529 - DNA, 13 bp, Homo sapiens
tcctgctgtggcc

SEQ ID NO: 2088530 - DNA, 14 bp, Homo sapiens
tcctgctgtggcct

SEQ ID NO: 2088531 - DNA, 15 bp, Homo sapiens
tcctgctgtggcctc

SEQ ID NO: 2088532 - DNA, 17 bp, Homo sapiens
tcctgctgtggcctcac

SEQ ID NO: 2088533 - DNA, 19 bp, Homo sapiens
tcctgcttaaacttgaccc

SEQ ID NO: 2088534 - DNA, 23 bp, Homo sapiens
tcctgcttcctaggccccagagc

SEQ ID NO: 2088535 - DNA, 18 bp, Homo sapiens
tcctgcttttgaggacag

SEQ ID NO: 2088536 - DNA, 22 bp, Homo sapiens
tcctggaaaggctcagtctcag

SEQ ID NO: 2088537 - DNA, 17 bp, Homo sapiens
tcctggaatgaagcatg

SEQ ID NO: 2088538 - DNA, 19 bp, Homo sapiens
tcctggaatgaagcatgta

SEQ ID NO: 2088539 - DNA, 13 bp, Homo sapiens
tcctggacagctg

SEQ ID NO: 2088540 - DNA, 14 bp, Homo sapiens
tcctggacagctgt

SEQ ID NO: 2088541 - DNA, 18 bp, Homo sapiens
tcctggacagctgtgcct

SEQ ID NO: 2088542 - DNA, 22 bp, Homo sapiens
tcctggacctgagtcggcccca

SEQ ID NO: 2088543 - DNA, 14 bp, Homo sapiens
tcctggagcatccc

SEQ ID NO: 2088544 - DNA, 19 bp, Homo sapiens
tcctggagcatcccaggcg

SEQ ID NO: 2088545 - DNA, 18 bp, Homo sapiens
tcctggaggatgaccagg

SEQ ID NO: 2088546 - DNA, 18 bp, Homo sapiens
tcctggagggggcaagcc

SEQ ID NO: 2088547 - DNA, 19 bp, Homo sapiens
tcctggagggggcaagcct

SEQ ID NO: 2088548 - DNA, 20 bp, Homo sapiens
tcctggaggtgggagacaag

SEQ ID NO: 2088549 - DNA, 16 bp, Homo sapiens
tcctggcacccggccc

SEQ ID NO: 2088550 - DNA, 19 bp, Homo sapiens
tcctggcacccggcccctg

SEQ ID NO: 2088551 - DNA, 22 bp, Homo sapiens
tcctggcacccggcccctgctg

SEQ ID NO: 2088552 - DNA, 18 bp, Homo sapiens
tcctggccagacgctgcc

SEQ ID NO: 2088553 - DNA, 19 bp, Homo sapiens
tcctggccccagcccccac

SEQ ID NO: 2088554 - DNA, 12 bp, Homo sapiens
tcctggcccctc

SEQ ID NO: 2088555 - DNA, 22 bp, Homo sapiens
tcctggcccctccagaccctgc

SEQ ID NO: 2088556 - DNA, 19 bp, Homo sapiens
tcctggcctcactggctgg

SEQ ID NO: 2088557 - DNA, 20 bp, Homo sapiens
tcctggcctcactggctggg

SEQ ID NO: 2088558 - DNA, 13 bp, Homo sapiens
tcctggctgccag

SEQ ID NO: 2088559 - DNA, 14 bp, Homo sapiens
tcctggctgccagg

SEQ ID NO: 2088560 - DNA, 15 bp, Homo sapiens
tcctggctgccaggc

SEQ ID NO: 2088561 - DNA, 18 bp, Homo sapiens
tcctggctgctctcatgc

SEQ ID NO: 2088562 - DNA, 11 bp, Homo sapiens
tcctggcttct

SEQ ID NO: 2088563 - DNA, 17 bp, Homo sapiens
tcctgggagaacctcag

SEQ ID NO: 2088564 - DNA, 21 bp, Homo sapiens
tcctgggagagaaggagatca

SEQ ID NO: 2088565 - DNA, 12 bp, Homo sapiens
tcctgggagtga

SEQ ID NO: 2088566 - DNA, 15 bp, Homo sapiens
tcctgggcagcttga

SEQ ID NO: 2088567 - DNA, 15 bp, Homo sapiens
tcctgggcctgtccc

SEQ ID NO: 2088568 - DNA, 16 bp, Homo sapiens
tcctgggggtggcagg

SEQ ID NO: 2088569 - DNA, 21 bp, Homo sapiens
tcctgggggttctttcttcct

SEQ ID NO: 2088570 - DNA, 22 bp, Homo sapiens
tcctgggggttctttcttcctc

SEQ ID NO: 2088571 - DNA, 13 bp, Homo sapiens
tcctgggtggcta

SEQ ID NO: 2088572 - DNA, 23 bp, Homo sapiens
tcctgggtggctactctgtgcca

SEQ ID NO: 2088573 - DNA, 14 bp, Homo sapiens
tcctggtctgaaaa

SEQ ID NO: 2088574 - DNA, 16 bp, Homo sapiens
tcctggtctgctcagg

SEQ ID NO: 2088575 - DNA, 20 bp, Homo sapiens
tcctggtctgtgctgccctg

SEQ ID NO: 2088576 - DNA, 17 bp, Homo sapiens
tcctggtcttgagatgt

SEQ ID NO: 2088577 - DNA, 17 bp, Homo sapiens
tcctggtgaggcccagc

SEQ ID NO: 2088578 - DNA, 13 bp, Homo sapiens
tcctggtggggca

SEQ ID NO: 2088579 - DNA, 17 bp, Homo sapiens
tcctggtggggcagctc

SEQ ID NO: 2088580 - DNA, 21 bp, Homo sapiens
tcctggtggggcagctcctct

SEQ ID NO: 2088581 - DNA, 20 bp, Homo sapiens
tcctgtaacacaagccacag

SEQ ID NO: 2088582 - DNA, 21 bp, Homo sapiens
tcctgtaacacaagccacaga

SEQ ID NO: 2088583 - DNA, 23 bp, Homo sapiens
tcctgtaacacaagccacagaag

SEQ ID NO: 2088584 - DNA, 15 bp, Homo sapiens
tcctgtaattttgta

SEQ ID NO: 2088585 - DNA, 19 bp, Homo sapiens
tcctgtagcatcttctgga

SEQ ID NO: 2088586 - DNA, 17 bp, Homo sapiens
tcctgtatttgttccca

SEQ ID NO: 2088587 - DNA, 13 bp, Homo sapiens
tcctgtcaccctg

SEQ ID NO: 2088588 - DNA, 19 bp, Homo sapiens
tcctgtcaccctggcccca

SEQ ID NO: 2088589 - DNA, 16 bp, Homo sapiens
tcctgtcatcccctac

SEQ ID NO: 2088590 - DNA, 20 bp, Homo sapiens
tcctgtccaacctaacccct

SEQ ID NO: 2088591 - DNA, 12 bp, Homo sapiens
tcctgtccactc

SEQ ID NO: 2088592 - DNA, 14 bp, Homo sapiens
tcctgtcccagagg

SEQ ID NO: 2088593 - DNA, 13 bp, Homo sapiens
tcctgtccctacc

SEQ ID NO: 2088594 - DNA, 15 bp, Homo sapiens
tcctgtccctaccca

SEQ ID NO: 2088595 - DNA, 17 bp, Homo sapiens
tcctgtccctacccact

SEQ ID NO: 2088596 - DNA, 13 bp, Homo sapiens
tcctgtctgccag

SEQ ID NO: 2088597 - DNA, 14 bp, Homo sapiens
tcctgtctgccagc

SEQ ID NO: 2088598 - DNA, 22 bp, Homo sapiens
tcctgtctgccagccagcagcc

SEQ ID NO: 2088599 - DNA, 17 bp, Homo sapiens
tcctgtctttaaggaaa

SEQ ID NO: 2088600 - DNA, 18 bp, Homo sapiens
tcctgtctttaaggaaaa

SEQ ID NO: 2088601 - DNA, 19 bp, Homo sapiens
tcctgtgaccccaccttga

SEQ ID NO: 2088602 - DNA, 21 bp, Homo sapiens
tcctgtgaccccaccttgacg

SEQ ID NO: 2088603 - DNA, 22 bp, Homo sapiens
tcctgtgccaacctgatgcccc

SEQ ID NO: 2088604 - DNA, 17 bp, Homo sapiens
tcctgtgcccacatccc

SEQ ID NO: 2088605 - DNA, 16 bp, Homo sapiens
tcctgtgggagcctcg

SEQ ID NO: 2088606 - DNA, 18 bp, Homo sapiens
tcctgtgggccaggagct

SEQ ID NO: 2088607 - DNA, 21 bp, Homo sapiens
tcctgtgggccaggagctcag

SEQ ID NO: 2088608 - DNA, 22 bp, Homo sapiens
tcctgtgggccaggagctcagc

SEQ ID NO: 2088609 - DNA, 18 bp, Homo sapiens
tcctgtgtggggaggcag

SEQ ID NO: 2088610 - DNA, 19 bp, Homo sapiens
tcctgtgtggggaggcagc

SEQ ID NO: 2088611 - DNA, 22 bp, Homo sapiens
tcctgttaacgtcatctcaggg

SEQ ID NO: 2088612 - DNA, 23 bp, Homo sapiens
tcctgttagctgttatttctatt

SEQ ID NO: 2088613 - DNA, 20 bp, Homo sapiens
tctatttaaaaaataaaaaa

SEQ ID NO: 2088614 - DNA, 14 bp, Homo sapiens
tctatttattaagt

SEQ ID NO: 2088615 - DNA, 13 bp, Homo sapiens
tctatttctctct

SEQ ID NO: 2088616 - DNA, 13 bp, Homo sapiens
tctatttctgaga

SEQ ID NO: 2088617 - DNA, 17 bp, Homo sapiens
tctattttgtaaactca

SEQ ID NO: 2088618 - DNA, 16 bp, Homo sapiens
tctatttttcttctaa

SEQ ID NO: 2088619 - DNA, 14 bp, Homo sapiens
tctatttttgtaga

SEQ ID NO: 2088620 - DNA, 22 bp, Homo sapiens
tctcaaaaaaagggcaataaat

SEQ ID NO: 2088621 - DNA, 13 bp, Homo sapiens
tctcaaaaaataa

SEQ ID NO: 2088622 - DNA, 18 bp, Homo sapiens
tctcaaaataagttgaaa

SEQ ID NO: 2088623 - DNA, 19 bp, Homo sapiens
tctcaaatgctaaatgcaa

SEQ ID NO: 2088624 - DNA, 19 bp, Homo sapiens
tctcaacaaagcacagtgt

SEQ ID NO: 2088625 - DNA, 21 bp, Homo sapiens
tctcaacaaagcacagtgtta

SEQ ID NO: 2088626 - DNA, 14 bp, Homo sapiens
tctcaatatgctta

SEQ ID NO: 2088627 - DNA, 18 bp, Homo sapiens
tctcaatattcaataaag

SEQ ID NO: 2088628 - DNA, 15 bp, Homo sapiens
tctcaatgcttttct

SEQ ID NO: 2088629 - DNA, 13 bp, Homo sapiens
tctcaatgtgaaa

SEQ ID NO: 2088630 - DNA, 19 bp, Homo sapiens
tctcaattgtatagttata

SEQ ID NO: 2088631 - DNA, 14 bp, Homo sapiens
tctcacaattgtaa

SEQ ID NO: 2088632 - DNA, 22 bp, Homo sapiens
tctcactatgttgcccaggcag

SEQ ID NO: 2088633 - DNA, 23 bp, Homo sapiens
tctcactatgttgcccaggcagg

SEQ ID NO: 2088634 - DNA, 17 bp, Homo sapiens
tctcactccaccaccca

SEQ ID NO: 2088635 - DNA, 18 bp, Homo sapiens
tctcactccaccacccaa

SEQ ID NO: 2088636 - DNA, 13 bp, Homo sapiens
tctcactcctacc

SEQ ID NO: 2088637 - DNA, 16 bp, Homo sapiens
tctcactgcccagttt

SEQ ID NO: 2088638 - DNA, 13 bp, Homo sapiens
tctcacttatacc

SEQ ID NO: 2088639 - DNA, 18 bp, Homo sapiens
tctcacttataccaaagg

SEQ ID NO: 2088640 - DNA, 16 bp, Homo sapiens
tctcagaatccaaaga

SEQ ID NO: 2088641 - DNA, 17 bp, Homo sapiens
tctcagaatccaaagat

SEQ ID NO: 2088642 - DNA, 15 bp, Homo sapiens
tctcagacttgttgt

SEQ ID NO: 2088643 - DNA, 17 bp, Homo sapiens
tctcagatcttgacagt

SEQ ID NO: 2088644 - DNA, 15 bp, Homo sapiens
tctcagccaacgagt

SEQ ID NO: 2088645 - DNA, 20 bp, Homo sapiens
tctcagccccgggcctgcct

SEQ ID NO: 2088646 - DNA, 21 bp, Homo sapiens
tctcagccgcttctgactgct

SEQ ID NO: 2088647 - DNA, 15 bp, Homo sapiens
tctcagcctcctcag

SEQ ID NO: 2088648 - DNA, 12 bp, Homo sapiens
tctcaggaaatc

SEQ ID NO: 2088649 - DNA, 21 bp, Homo sapiens
tctcaggaaatcaaatatgca

SEQ ID NO: 2088650 - DNA, 19 bp, Homo sapiens
tctcaggacacaggcctgt

SEQ ID NO: 2088651 - DNA, 14 bp, Homo sapiens
tctcaggagcacag

SEQ ID NO: 2088652 - DNA, 15 bp, Homo sapiens
tctcaggagcacagg

SEQ ID NO: 2088653 - DNA, 19 bp, Homo sapiens
tctcaggagcacaggcagc

SEQ ID NO: 2088654 - DNA, 20 bp, Homo sapiens
tctcaggagcacaggcagct

SEQ ID NO: 2088655 - DNA, 18 bp, Homo sapiens
tctcaggagcttgcaaga

SEQ ID NO: 2088656 - DNA, 22 bp, Homo sapiens
tctcaggggccagtgagggctg

SEQ ID NO: 2088657 - DNA, 20 bp, Homo sapiens
tctcagggggtcagcagagt

SEQ ID NO: 2088658 - DNA, 16 bp, Homo sapiens
tctcagggtccagacc

SEQ ID NO: 2088659 - DNA, 14 bp, Homo sapiens
tctcaggtcactcc

SEQ ID NO: 2088660 - DNA, 21 bp, Homo sapiens
tctcaggtcactccagtgtta

SEQ ID NO: 2088661 - DNA, 15 bp, Homo sapiens
tctcagtcagtaatt

SEQ ID NO: 2088662 - DNA, 16 bp, Homo sapiens
tctcagtttgtataga

SEQ ID NO: 2088663 - DNA, 21 bp, Homo sapiens
tctcatactcccccacagttt

SEQ ID NO: 2088664 - DNA, 15 bp, Homo sapiens
tctcatcagtgtcct

SEQ ID NO: 2088665 - DNA, 16 bp, Homo sapiens
tctcatcatattgtat

SEQ ID NO: 2088666 - DNA, 13 bp, Homo sapiens
tctcatctactca

SEQ ID NO: 2088667 - DNA, 19 bp, Homo sapiens
tctcatctcagtgaagaat

SEQ ID NO: 2088668 - DNA, 14 bp, Homo sapiens
tctcatgcctgcct

SEQ ID NO: 2088669 - DNA, 14 bp, Homo sapiens
tctcatgtgatcct

SEQ ID NO: 2088670 - DNA, 15 bp, Homo sapiens
tctcatgtgatcctt

SEQ ID NO: 2088671 - DNA, 19 bp, Homo sapiens
tctcatgtgatccttttat

SEQ ID NO: 2088672 - DNA, 22 bp, Homo sapiens
tctcatgttgaagccactgcct

SEQ ID NO: 2088673 - DNA, 21 bp, Homo sapiens
tctcattcaggtgttctcttc

SEQ ID NO: 2088674 - DNA, 16 bp, Homo sapiens
tctcatttaagggaaa

SEQ ID NO: 2088675 - DNA, 21 bp, Homo sapiens
tctcatttttccgtaaaaatg

SEQ ID NO: 2088676 - DNA, 18 bp, Homo sapiens
tctccaaaggccctacca

SEQ ID NO: 2088677 - DNA, 15 bp, Homo sapiens
tctccaaaggggctg

SEQ ID NO: 2088678 - DNA, 19 bp, Homo sapiens
tctccaaaggggctgctgg

SEQ ID NO: 2088679 - DNA, 24 bp, Homo sapiens
tctccaaatattattcaagtgcct

SEQ ID NO: 2088680 - DNA, 18 bp, Homo sapiens
tctccaaatgattttcat

SEQ ID NO: 2088681 - DNA, 14 bp, Homo sapiens
tctccaattgtaaa

SEQ ID NO: 2088682 - DNA, 16 bp, Homo sapiens
tctccaattgtaaaaa

SEQ ID NO: 2088683 - DNA, 16 bp, Homo sapiens
tctccaccctgagcct

SEQ ID NO: 2088684 - DNA, 21 bp, Homo sapiens
tctccaccctgagcctgacct

SEQ ID NO: 2088685 - DNA, 12 bp, Homo sapiens
tctccaccctgc

SEQ ID NO: 2088686 - DNA, 17 bp, Homo sapiens
tctccaccctgctctcc

SEQ ID NO: 2088687 - DNA, 18 bp, Homo sapiens
tctccactgaggatgtga

SEQ ID NO: 2088688 - DNA, 16 bp, Homo sapiens
tctccactgctctcag

SEQ ID NO: 2088689 - DNA, 17 bp, Homo sapiens
tctccagaggccaagga

SEQ ID NO: 2088690 - DNA, 14 bp, Homo sapiens
tctccagcccacac

SEQ ID NO: 2088691 - DNA, 15 bp, Homo sapiens
tctccagcccacacc

SEQ ID NO: 2088692 - DNA, 18 bp, Homo sapiens
tctccagcccacacccct

SEQ ID NO: 2088693 - DNA, 20 bp, Homo sapiens
tctccaggaaggtagcccag

SEQ ID NO: 2088694 - DNA, 21 bp, Homo sapiens
tctccaggaaggtagcccagc

SEQ ID NO: 2088695 - DNA, 17 bp, Homo sapiens
tctccaggcacccttct

SEQ ID NO: 2088696 - DNA, 16 bp, Homo sapiens
tctccagggctgcccc

SEQ ID NO: 2088697 - DNA, 19 bp, Homo sapiens
tctccagtatccactttgc

SEQ ID NO: 2088698 - DNA, 17 bp, Homo sapiens
tctccagtggttgctgt

SEQ ID NO: 2088699 - DNA, 15 bp, Homo sapiens
tctccagttttcagt

SEQ ID NO: 2088700 - DNA, 16 bp, Homo sapiens
tctccatatctccttc

SEQ ID NO: 2088701 - DNA, 23 bp, Homo sapiens
tctccatgtagaataaatgaaga

SEQ ID NO: 2088702 - DNA, 18 bp, Homo sapiens
tctccattctagatgctt

SEQ ID NO: 2088703 - DNA, 19 bp, Homo sapiens
tctccatttcacacaggtc

SEQ ID NO: 2088704 - DNA, 21 bp, Homo sapiens
tctcccacccagccctgcccc

SEQ ID NO: 2088705 - DNA, 14 bp, Homo sapiens
tctcccacgtggga

SEQ ID NO: 2088706 - DNA, 14 bp, Homo sapiens
tctcccaggcccca

SEQ ID NO: 2088707 - DNA, 20 bp, Homo sapiens
tctcccaggccccatgacct

SEQ ID NO: 2088708 - DNA, 21 bp, Homo sapiens
tctcccaggccccatgacctc

SEQ ID NO: 2088709 - DNA, 23 bp, Homo sapiens
tctcccaggccccatgacctcca

SEQ ID NO: 2088710 - DNA, 21 bp, Homo sapiens
tctcccaggtggattttgtgg

SEQ ID NO: 2088711 - DNA, 15 bp, Homo sapiens
tctcccagtcattta

SEQ ID NO: 2088712 - DNA, 18 bp, Homo sapiens
tctcccataccatcactg

SEQ ID NO: 2088713 - DNA, 16 bp, Homo sapiens
tctcccccgacactgc

SEQ ID NO: 2088714 - DNA, 18 bp, Homo sapiens
tctcccccgacactgctg

SEQ ID NO: 2088715 - DNA, 21 bp, Homo sapiens
tctcccccgacactgctgcac

SEQ ID NO: 2088716 - DNA, 17 bp, Homo sapiens
tctcccctccctcttcc

SEQ ID NO: 2088717 - DNA, 13 bp, Homo sapiens
tctcccctctgcc

SEQ ID NO: 2088718 - DNA, 17 bp, Homo sapiens
tctcccctgccctgctg

SEQ ID NO: 2088719 - DNA, 15 bp, Homo sapiens
tctcccgcgggcctg

SEQ ID NO: 2088720 - DNA, 16 bp, Homo sapiens
tctcccggctgcctgc

SEQ ID NO: 2088721 - DNA, 17 bp, Homo sapiens
tctcccggctgcctgcc

SEQ ID NO: 2088722 - DNA, 22 bp, Homo sapiens
tctccctaaaataaaaaccaga

SEQ ID NO: 2088723 - DNA, 12 bp, Homo sapiens
tctccctcaccc

SEQ ID NO: 2088724 - DNA, 21 bp, Homo sapiens
tctccctccagggaatccgcc

SEQ ID NO: 2088725 - DNA, 14 bp, Homo sapiens
tctccctctcctgc

SEQ ID NO: 2088726 - DNA, 16 bp, Homo sapiens
tctccctctggccctg

SEQ ID NO: 2088727 - DNA, 24 bp, Homo sapiens
tctccctgacatttctaacatatg

SEQ ID NO: 2088728 - DNA, 14 bp, Homo sapiens
tctggagctgctgt

SEQ ID NO: 2088729 - DNA, 21 bp, Homo sapiens
tctggaggacacacagtctca

SEQ ID NO: 2088730 - DNA, 21 bp, Homo sapiens
tctggagtctcacttgtctca

SEQ ID NO: 2088731 - DNA, 19 bp, Homo sapiens
tctggatggcaccagaggc

SEQ ID NO: 2088732 - DNA, 14 bp, Homo sapiens
tctggattccagag

SEQ ID NO: 2088733 - DNA, 12 bp, Homo sapiens
tctggcagccac

SEQ ID NO: 2088734 - DNA, 23 bp, Homo sapiens
tctggcagccacacttctcagga

SEQ ID NO: 2088735 - DNA, 12 bp, Homo sapiens
tctggccaccct

SEQ ID NO: 2088736 - DNA, 15 bp, Homo sapiens
tctggccaccctggc

SEQ ID NO: 2088737 - DNA, 17 bp, Homo sapiens
tctggccaccctggccc

SEQ ID NO: 2088738 - DNA, 18 bp, Homo sapiens
tctggccaccctggcccg

SEQ ID NO: 2088739 - DNA, 15 bp, Homo sapiens
tctggccaggagctg

SEQ ID NO: 2088740 - DNA, 19 bp, Homo sapiens
tctggccaggagctggagg

SEQ ID NO: 2088741 - DNA, 13 bp, Homo sapiens
tctggccccaggc

SEQ ID NO: 2088742 - DNA, 18 bp, Homo sapiens
tctggccctttctggacc

SEQ ID NO: 2088743 - DNA, 20 bp, Homo sapiens
tctggcctcagaccaactct

SEQ ID NO: 2088744 - DNA, 13 bp, Homo sapiens
tctggcctcagca

SEQ ID NO: 2088745 - DNA, 11 bp, Homo sapiens
tctggcctcca

SEQ ID NO: 2088746 - DNA, 14 bp, Homo sapiens
tctggccttttcct

SEQ ID NO: 2088747 - DNA, 15 bp, Homo sapiens
tctggcgcaagagaa

SEQ ID NO: 2088748 - DNA, 19 bp, Homo sapiens
tctggcggcttcctgtcca

SEQ ID NO: 2088749 - DNA, 21 bp, Homo sapiens
tctggcggcttcctgtccact

SEQ ID NO: 2088750 - DNA, 13 bp, Homo sapiens
tctggctcctcct

SEQ ID NO: 2088751 - DNA, 15 bp, Homo sapiens
tctggcttccaggta

SEQ ID NO: 2088752 - DNA, 24 bp, Homo sapiens
tctggcttccaggtatctccagga

SEQ ID NO: 2088753 - DNA, 19 bp, Homo sapiens
tctgggaccctttccttcc

SEQ ID NO: 2088754 - DNA, 16 bp, Homo sapiens
tctgggacctcagttt

SEQ ID NO: 2088755 - DNA, 13 bp, Homo sapiens
tctgggaggcaga

SEQ ID NO: 2088756 - DNA, 18 bp, Homo sapiens
tctgggaggtcttggccg

SEQ ID NO: 2088757 - DNA, 20 bp, Homo sapiens
tctgggagtgttctgtttcc

SEQ ID NO: 2088758 - DNA, 15 bp, Homo sapiens
tctgggagttccctg

SEQ ID NO: 2088759 - DNA, 12 bp, Homo sapiens
tctgggcagctg

SEQ ID NO: 2088760 - DNA, 19 bp, Homo sapiens
tctgggccaagttcctcta

SEQ ID NO: 2088761 - DNA, 14 bp, Homo sapiens
tctgggcccccact

SEQ ID NO: 2088762 - DNA, 15 bp, Homo sapiens
tctgggcccccactt

SEQ ID NO: 2088763 - DNA, 18 bp, Homo sapiens
tctgggctaccccaccca

SEQ ID NO: 2088764 - DNA, 14 bp, Homo sapiens
tctgggctcagggc

SEQ ID NO: 2088765 - DNA, 17 bp, Homo sapiens
tctgggctgctacccag

SEQ ID NO: 2088766 - DNA, 21 bp, Homo sapiens
tctgggcttggggcttcctaa

SEQ ID NO: 2088767 - DNA, 13 bp, Homo sapiens
tctggggaggaag

SEQ ID NO: 2088768 - DNA, 21 bp, Homo sapiens
tctggggaggaagggccagga

SEQ ID NO: 2088769 - DNA, 19 bp, Homo sapiens
tctggggccctgggcctca

SEQ ID NO: 2088770 - DNA, 16 bp, Homo sapiens
tctggggttcagcccc

SEQ ID NO: 2088771 - DNA, 19 bp, Homo sapiens
tctggggttcagcccctcc

SEQ ID NO: 2088772 - DNA, 16 bp, Homo sapiens
tctgggtccctcggag

SEQ ID NO: 2088773 - DNA, 17 bp, Homo sapiens
tctgggtccctcggagc

SEQ ID NO: 2088774 - DNA, 13 bp, Homo sapiens
tctgggtggcctc

SEQ ID NO: 2088775 - DNA, 19 bp, Homo sapiens
tctgggtggctcctgccac

SEQ ID NO: 2088776 - DNA, 14 bp, Homo sapiens
tctgggttcactgc

SEQ ID NO: 2088777 - DNA, 22 bp, Homo sapiens
tctggtatgaacttgaggacac

SEQ ID NO: 2088778 - DNA, 18 bp, Homo sapiens
tctggtcaggcccactgc

SEQ ID NO: 2088779 - DNA, 21 bp, Homo sapiens
tctggtgtagctcctctgctg

SEQ ID NO: 2088780 - DNA, 13 bp, Homo sapiens
tctggttgcttca

SEQ ID NO: 2088781 - DNA, 21 bp, Homo sapiens
tctggttgttgcaccatctgc

SEQ ID NO: 2088782 - DNA, 17 bp, Homo sapiens
tctggtttagtgttctg

SEQ ID NO: 2088783 - DNA, 13 bp, Homo sapiens
tctggttttaaca

SEQ ID NO: 2088784 - DNA, 15 bp, Homo sapiens
tctgtaaactcaaaa

SEQ ID NO: 2088785 - DNA, 16 bp, Homo sapiens
tctgtaaggaactgga

SEQ ID NO: 2088786 - DNA, 18 bp, Homo sapiens
tctgtaattctattgtgc

SEQ ID NO: 2088787 - DNA, 18 bp, Homo sapiens
tctgtaccttgcagccat

SEQ ID NO: 2088788 - DNA, 12 bp, Homo sapiens
tctgtactgtaa

SEQ ID NO: 2088789 - DNA, 14 bp, Homo sapiens
tctgtactgtaatt

SEQ ID NO: 2088790 - DNA, 18 bp, Homo sapiens
tctgtagaaagaatgtgt

SEQ ID NO: 2088791 - DNA, 15 bp, Homo sapiens
tctgtagggctggac

SEQ ID NO: 2088792 - DNA, 16 bp, Homo sapiens
tctgtagggctggacc

SEQ ID NO: 2088793 - DNA, 21 bp, Homo sapiens
tctgtataaacattaaatgtc

SEQ ID NO: 2088794 - DNA, 14 bp, Homo sapiens
tctgtatatacatt

SEQ ID NO: 2088795 - DNA, 21 bp, Homo sapiens
tctgtatatgttgtaataaaa

SEQ ID NO: 2088796 - DNA, 14 bp, Homo sapiens
tctgtattttcatt

SEQ ID NO: 2088797 - DNA, 16 bp, Homo sapiens
tctgtattttcattta

SEQ ID NO: 2088798 - DNA, 20 bp, Homo sapiens
tctgtattttcatttaacta

SEQ ID NO: 2088799 - DNA, 20 bp, Homo sapiens
tctgtcaccagctatctgtc

SEQ ID NO: 2088800 - DNA, 17 bp, Homo sapiens
tctgtcacccaggctgg

SEQ ID NO: 2088801 - DNA, 14 bp, Homo sapiens
tctgtcacgtgaaa

SEQ ID NO: 2088802 - DNA, 16 bp, Homo sapiens
tctgtcacgtgaaata

SEQ ID NO: 2088803 - DNA, 13 bp, Homo sapiens
tctgtcagccagc

SEQ ID NO: 2088804 - DNA, 17 bp, Homo sapiens
tctgtcagccagccgcc

SEQ ID NO: 2088805 - DNA, 22 bp, Homo sapiens
tctgtcagccagccgccctggg

SEQ ID NO: 2088806 - DNA, 15 bp, Homo sapiens
tctgtcatcactccc

SEQ ID NO: 2088807 - DNA, 18 bp, Homo sapiens
tctgtcatcactccctgg

SEQ ID NO: 2088808 - DNA, 13 bp, Homo sapiens
tctgtcatctctc

SEQ ID NO: 2088809 - DNA, 22 bp, Homo sapiens
tctgtcatctctctggggccct

SEQ ID NO: 2088810 - DNA, 23 bp, Homo sapiens
tctgtcatctctctggggccctg

SEQ ID NO: 2088811 - DNA, 23 bp, Homo sapiens
tctgtcatttgagcagggctcag

SEQ ID NO: 2088812 - DNA, 23 bp, Homo sapiens
tctgtccaggacatgatactgat

SEQ ID NO: 2088813 - DNA, 12 bp, Homo sapiens
tctgtccaggcc

SEQ ID NO: 2088814 - DNA, 13 bp, Homo sapiens
tctgtccaggcca

SEQ ID NO: 2088815 - DNA, 20 bp, Homo sapiens
tctgtccagggccctgagct

SEQ ID NO: 2088816 - DNA, 14 bp, Homo sapiens
tctgtcccctctcc

SEQ ID NO: 2088817 - DNA, 16 bp, Homo sapiens
tctgtccctcactgcc

SEQ ID NO: 2088818 - DNA, 17 bp, Homo sapiens
tctgtccctcactgcct

SEQ ID NO: 2088819 - DNA, 14 bp, Homo sapiens
tctgtcctactctg

SEQ ID NO: 2088820 - DNA, 20 bp, Homo sapiens
tctgtcctactctgtgtcag

SEQ ID NO: 2088821 - DNA, 14 bp, Homo sapiens
tctgtcgcccagtc

SEQ ID NO: 2088822 - DNA, 22 bp, Homo sapiens
tctgtctcgagcgccctgcaga

SEQ ID NO: 2088823 - DNA, 12 bp, Homo sapiens
tctgtctctctt

SEQ ID NO: 2088824 - DNA, 11 bp, Homo sapiens
tctgtctctgc

SEQ ID NO: 2088825 - DNA, 18 bp, Homo sapiens
tctgtctggctgtacgtc

SEQ ID NO: 2088826 - DNA, 15 bp, Homo sapiens
tctgtctgtcccaaa

SEQ ID NO: 2088827 - DNA, 21 bp, Homo sapiens
tctgtcttgccagccagaagc

SEQ ID NO: 2088828 - DNA, 15 bp, Homo sapiens
tctgtctttgtggga

SEQ ID NO: 2088829 - DNA, 18 bp, Homo sapiens
tctgtgaattgagctgca

SEQ ID NO: 2088830 - DNA, 18 bp, Homo sapiens
tctgtgactcgcttagct

SEQ ID NO: 2088831 - DNA, 17 bp, Homo sapiens
tctgtgcactagcctgt

SEQ ID NO: 2088832 - DNA, 21 bp, Homo sapiens
tctgtgcactagcctgtgatt

SEQ ID NO: 2088833 - DNA, 16 bp, Homo sapiens
tctgtgccagagcctg

SEQ ID NO: 2088834 - DNA, 20 bp, Homo sapiens
tctgtgccagagcctggggc

SEQ ID NO: 2088835 - DNA, 22 bp, Homo sapiens
tctgtgctcttttggtggggag

SEQ ID NO: 2088836 - DNA, 23 bp, Homo sapiens
tctgtgctgccctgctctgggga

SEQ ID NO: 2088837 - DNA, 19 bp, Homo sapiens
tctgtgctgtgcctgctag

SEQ ID NO: 2088838 - DNA, 20 bp, Homo sapiens
tctgtgctgtgcctgctaga

SEQ ID NO: 2088839 - DNA, 23 bp, Homo sapiens
tctgtgctgtgcctgctagagca

SEQ ID NO: 2088840 - DNA, 22 bp, Homo sapiens
tctgtggagagtgagaataatt

SEQ ID NO: 2088841 - DNA, 12 bp, Homo sapiens
tctgtggcctgt

SEQ ID NO: 2088842 - DNA, 22 bp, Homo sapiens
tctgtggcctgtgtccagcagc

SEQ ID NO: 2088843 - DNA, 15 bp, Homo sapiens
tcttctgtacgtctg

SEQ ID NO: 2088844 - DNA, 22 bp, Homo sapiens
tcttctgtacgtctgacaggca

SEQ ID NO: 2088845 - DNA, 23 bp, Homo sapiens
tcttctgtacgtctgacaggcaa

SEQ ID NO: 2088846 - DNA, 13 bp, Homo sapiens
tcttctgttctca

SEQ ID NO: 2088847 - DNA, 14 bp, Homo sapiens
tcttctgttctcaa

SEQ ID NO: 2088848 - DNA, 19 bp, Homo sapiens
tcttctgttgtagaataat

SEQ ID NO: 2088849 - DNA, 18 bp, Homo sapiens
tcttcttaagacttttgg

SEQ ID NO: 2088850 - DNA, 20 bp, Homo sapiens
tcttcttgagcagaccgtga

SEQ ID NO: 2088851 - DNA, 14 bp, Homo sapiens
tcttcttggcagct

SEQ ID NO: 2088852 - DNA, 21 bp, Homo sapiens
tcttcttttaaaccattttct

SEQ ID NO: 2088853 - DNA, 16 bp, Homo sapiens
tcttctttttttgtga

SEQ ID NO: 2088854 - DNA, 16 bp, Homo sapiens
tcttgaaaagaatcta

SEQ ID NO: 2088855 - DNA, 16 bp, Homo sapiens
tcttgaaacagcctgg

SEQ ID NO: 2088856 - DNA, 14 bp, Homo sapiens
tcttgaaagctgtg

SEQ ID NO: 2088857 - DNA, 15 bp, Homo sapiens
tcttgaactcctggc

SEQ ID NO: 2088858 - DNA, 11 bp, Homo sapiens
tcttgaagaat

SEQ ID NO: 2088859 - DNA, 13 bp, Homo sapiens
tcttgaagaatat

SEQ ID NO: 2088860 - DNA, 15 bp, Homo sapiens
tcttgaattcctggg

SEQ ID NO: 2088861 - DNA, 18 bp, Homo sapiens
tcttgaatttctaaaaaa

SEQ ID NO: 2088862 - DNA, 21 bp, Homo sapiens
tcttgacacggtgaaatccag

SEQ ID NO: 2088863 - DNA, 19 bp, Homo sapiens
tcttgacagtatatttgaa

SEQ ID NO: 2088864 - DNA, 16 bp, Homo sapiens
tcttgagatgtcttct

SEQ ID NO: 2088865 - DNA, 18 bp, Homo sapiens
tcttgagtactagaattt

SEQ ID NO: 2088866 - DNA, 22 bp, Homo sapiens
tcttgatgtcatgtacttcctg

SEQ ID NO: 2088867 - DNA, 13 bp, Homo sapiens
tcttgcaatggca

SEQ ID NO: 2088868 - DNA, 17 bp, Homo sapiens
tcttgcaatggcagcct

SEQ ID NO: 2088869 - DNA, 13 bp, Homo sapiens
tcttgcaggctga

SEQ ID NO: 2088870 - DNA, 14 bp, Homo sapiens
tcttgccagccaga

SEQ ID NO: 2088871 - DNA, 23 bp, Homo sapiens
tcttgccccctcatctcactgcc

SEQ ID NO: 2088872 - DNA, 13 bp, Homo sapiens
tcttgcctctctc

SEQ ID NO: 2088873 - DNA, 11 bp, Homo sapiens
tcttgcctgaa

SEQ ID NO: 2088874 - DNA, 13 bp, Homo sapiens
tcttgcctgaggc

SEQ ID NO: 2088875 - DNA, 22 bp, Homo sapiens
tcttgcctgaggctcaagaggc

SEQ ID NO: 2088876 - DNA, 23 bp, Homo sapiens
tcttgcctgaggctcaagaggcc

SEQ ID NO: 2088877 - DNA, 13 bp, Homo sapiens
tcttgcctgccag

SEQ ID NO: 2088878 - DNA, 19 bp, Homo sapiens
tcttgcctttccacctgct

SEQ ID NO: 2088879 - DNA, 22 bp, Homo sapiens
tcttgcctttccacctgctttc

SEQ ID NO: 2088880 - DNA, 11 bp, Homo sapiens
tcttgctctgc

SEQ ID NO: 2088881 - DNA, 13 bp, Homo sapiens
tcttgctctgctg

SEQ ID NO: 2088882 - DNA, 19 bp, Homo sapiens
tcttgctggattaatgttt

SEQ ID NO: 2088883 - DNA, 15 bp, Homo sapiens
tcttgcttgtacata

SEQ ID NO: 2088884 - DNA, 12 bp, Homo sapiens
tcttggaaaaaa

SEQ ID NO: 2088885 - DNA, 15 bp, Homo sapiens
tcttggaaaaaaatt

SEQ ID NO: 2088886 - DNA, 16 bp, Homo sapiens
tcttggacactgtaca

SEQ ID NO: 2088887 - DNA, 21 bp, Homo sapiens
tcttggacctctgctctgagg

SEQ ID NO: 2088888 - DNA, 23 bp, Homo sapiens
tcttggacctctgctctgaggct

SEQ ID NO: 2088889 - DNA, 14 bp, Homo sapiens
tcttggagaacttt

SEQ ID NO: 2088890 - DNA, 17 bp, Homo sapiens
tcttggagaactttcca

SEQ ID NO: 2088891 - DNA, 23 bp, Homo sapiens
tcttggcagcttaacattgactt

SEQ ID NO: 2088892 - DNA, 23 bp, Homo sapiens
tcttggcagtattccatgggatg

SEQ ID NO: 2088893 - DNA, 19 bp, Homo sapiens
tcttggcattttcctcgcc

SEQ ID NO: 2088894 - DNA, 13 bp, Homo sapiens
tcttggcccctgt

SEQ ID NO: 2088895 - DNA, 18 bp, Homo sapiens
tcttggcccctgtgtgag

SEQ ID NO: 2088896 - DNA, 16 bp, Homo sapiens
tcttggccgactcagg

SEQ ID NO: 2088897 - DNA, 17 bp, Homo sapiens
tcttggccgactcaggg

SEQ ID NO: 2088898 - DNA, 18 bp, Homo sapiens
tcttggccgactcaggga

SEQ ID NO: 2088899 - DNA, 22 bp, Homo sapiens
tcttggccgactcagggaccta

SEQ ID NO: 2088900 - DNA, 13 bp, Homo sapiens
tcttggcctgcct

SEQ ID NO: 2088901 - DNA, 18 bp, Homo sapiens
tcttggcctgcctcccag

SEQ ID NO: 2088902 - DNA, 16 bp, Homo sapiens
tcttggcttctgggac

SEQ ID NO: 2088903 - DNA, 22 bp, Homo sapiens
tcttgggctactggcagctcct

SEQ ID NO: 2088904 - DNA, 13 bp, Homo sapiens
tcttggggctcgc

SEQ ID NO: 2088905 - DNA, 16 bp, Homo sapiens
tcttggggctcgcccc

SEQ ID NO: 2088906 - DNA, 20 bp, Homo sapiens
tcttggggctcgccccaccc

SEQ ID NO: 2088907 - DNA, 16 bp, Homo sapiens
tcttggggtcccaggg

SEQ ID NO: 2088908 - DNA, 14 bp, Homo sapiens
tcttggtcctgtca

SEQ ID NO: 2088909 - DNA, 16 bp, Homo sapiens
tcttggtgactgtccc

SEQ ID NO: 2088910 - DNA, 19 bp, Homo sapiens
tcttggtgatggagtgtgc

SEQ ID NO: 2088911 - DNA, 17 bp, Homo sapiens
tcttggtttggggagaa

SEQ ID NO: 2088912 - DNA, 18 bp, Homo sapiens
tcttggtttggggagaaa

SEQ ID NO: 2088913 - DNA, 13 bp, Homo sapiens
tcttgtattttct

SEQ ID NO: 2088914 - DNA, 18 bp, Homo sapiens
tcttgtattttcttccca

SEQ ID NO: 2088915 - DNA, 20 bp, Homo sapiens
tcttgtattttcttcccatt

SEQ ID NO: 2088916 - DNA, 11 bp, Homo sapiens
tcttgtcagaa

SEQ ID NO: 2088917 - DNA, 17 bp, Homo sapiens
tcttgtcatataaacct

SEQ ID NO: 2088918 - DNA, 14 bp, Homo sapiens
tcttgtccacagtc

SEQ ID NO: 2088919 - DNA, 20 bp, Homo sapiens
tcttgtccacagtctcccat

SEQ ID NO: 2088920 - DNA, 13 bp, Homo sapiens
tcttgtgcatgtt

SEQ ID NO: 2088921 - DNA, 15 bp, Homo sapiens
tcttgtgcatgttta

SEQ ID NO: 2088922 - DNA, 17 bp, Homo sapiens
tctttaaaatacacact

SEQ ID NO: 2088923 - DNA, 15 bp, Homo sapiens
tctttaaatcaaaag

SEQ ID NO: 2088924 - DNA, 14 bp, Homo sapiens
tctttaacctcatc

SEQ ID NO: 2088925 - DNA, 23 bp, Homo sapiens
tctttaatcattttgcctctttt

SEQ ID NO: 2088926 - DNA, 14 bp, Homo sapiens
tctttaatcccagt

SEQ ID NO: 2088927 - DNA, 16 bp, Homo sapiens
tctttaatcccagttt

SEQ ID NO: 2088928 - DNA, 15 bp, Homo sapiens
tctttaatgtcacag

SEQ ID NO: 2088929 - DNA, 17 bp, Homo sapiens
tctttaatgttgtccag

SEQ ID NO: 2088930 - DNA, 13 bp, Homo sapiens
tctttacaataaa

SEQ ID NO: 2088931 - DNA, 20 bp, Homo sapiens
tctttaggtgcctcctgtct

SEQ ID NO: 2088932 - DNA, 21 bp, Homo sapiens
tctttaggtgcctcctgtctt

SEQ ID NO: 2088933 - DNA, 18 bp, Homo sapiens
tctttatttctagcagag

SEQ ID NO: 2088934 - DNA, 20 bp, Homo sapiens
tctttcaagtgaatctaaaa

SEQ ID NO: 2088935 - DNA, 12 bp, Homo sapiens
tctttcagcatt

SEQ ID NO: 2088936 - DNA, 15 bp, Homo sapiens
tctttccccacctct

SEQ ID NO: 2088937 - DNA, 19 bp, Homo sapiens
tctttccccacctcttcct

SEQ ID NO: 2088938 - DNA, 18 bp, Homo sapiens
tctttccttgtctctcat

SEQ ID NO: 2088939 - DNA, 23 bp, Homo sapiens
tctttcggactgaggccttctca

SEQ ID NO: 2088940 - DNA, 21 bp, Homo sapiens
tctttctaactccagtgaagt

SEQ ID NO: 2088941 - DNA, 15 bp, Homo sapiens
tctttctattccaaa

SEQ ID NO: 2088942 - DNA, 13 bp, Homo sapiens
tctttctcttccc

SEQ ID NO: 2088943 - DNA, 13 bp, Homo sapiens
tctttctgttatt

SEQ ID NO: 2088944 - DNA, 19 bp, Homo sapiens
tctttcttattttgtaata

SEQ ID NO: 2088945 - DNA, 21 bp, Homo sapiens
tctttcttattttgtaataaa

SEQ ID NO: 2088946 - DNA, 22 bp, Homo sapiens
tctttcttattttgtaataaac

SEQ ID NO: 2088947 - DNA, 23 bp, Homo sapiens
tctttcttattttgtaataaact

SEQ ID NO: 2088948 - DNA, 14 bp, Homo sapiens
tctttcttcctctg

SEQ ID NO: 2088949 - DNA, 15 bp, Homo sapiens
tctttcttcctctgc

SEQ ID NO: 2088950 - DNA, 16 bp, Homo sapiens
tctttcttcctctgct

SEQ ID NO: 2088951 - DNA, 17 bp, Homo sapiens
tctttcttcctctgctg

SEQ ID NO: 2088952 - DNA, 13 bp, Homo sapiens
tctttctttttct

SEQ ID NO: 2088953 - DNA, 18 bp, Homo sapiens
tctttctttttctggaaa

SEQ ID NO: 2088954 - DNA, 19 bp, Homo sapiens
tctttctttttctggaaat

SEQ ID NO: 2088955 - DNA, 20 bp, Homo sapiens
tctttctttttctgtctctc

SEQ ID NO: 2088956 - DNA, 14 bp, Homo sapiens
tctttgaaaagaaa

SEQ ID NO: 2088957 - DNA, 12 bp, Homo sapiens
tctttgaataaa

SEQ ID NO: 2088958 - DNA, 16 bp, Homo sapiens
tgacacacagctctgt

SEQ ID NO: 2088959 - DNA, 18 bp, Homo sapiens
tgacacacagctctgtcc

SEQ ID NO: 2088960 - DNA, 23 bp, Homo sapiens
tgacacacgtatttatatttgga

SEQ ID NO: 2088961 - DNA, 12 bp, Homo sapiens
tgacacaggcca

SEQ ID NO: 2088962 - DNA, 14 bp, Homo sapiens
tgacacaggccagc

SEQ ID NO: 2088963 - DNA, 16 bp, Homo sapiens
tgacacaggccagccc

SEQ ID NO: 2088964 - DNA, 18 bp, Homo sapiens
tgacacaggccagcccca

SEQ ID NO: 2088965 - DNA, 22 bp, Homo sapiens
tgacacataatttgaatggtgc

SEQ ID NO: 2088966 - DNA, 13 bp, Homo sapiens
tgacacctaccat

SEQ ID NO: 2088967 - DNA, 17 bp, Homo sapiens
tgacacctaccatgctg

SEQ ID NO: 2088968 - DNA, 19 bp, Homo sapiens
tgacactctagtgacttcc

SEQ ID NO: 2088969 - DNA, 14 bp, Homo sapiens
tgacagaaatgcaa

SEQ ID NO: 2088970 - DNA, 13 bp, Homo sapiens
tgacagaacactg

SEQ ID NO: 2088971 - DNA, 15 bp, Homo sapiens
tgacagaacactgtc

SEQ ID NO: 2088972 - DNA, 16 bp, Homo sapiens
tgacagaacactgtct

SEQ ID NO: 2088973 - DNA, 18 bp, Homo sapiens
tgacagaatcttgtattt

SEQ ID NO: 2088974 - DNA, 23 bp, Homo sapiens
tgacagacacaggcccggctcca

SEQ ID NO: 2088975 - DNA, 19 bp, Homo sapiens
tgacagagacccagatctc

SEQ ID NO: 2088976 - DNA, 14 bp, Homo sapiens
tgacagaggcagcc

SEQ ID NO: 2088977 - DNA, 23 bp, Homo sapiens
tgacagaggcagccccattctgc

SEQ ID NO: 2088978 - DNA, 19 bp, Homo sapiens
tgacagatacatagatgga

SEQ ID NO: 2088979 - DNA, 19 bp, Homo sapiens
tgacagatgttgaatgccc

SEQ ID NO: 2088980 - DNA, 14 bp, Homo sapiens
tgacagccagagcc

SEQ ID NO: 2088981 - DNA, 20 bp, Homo sapiens
tgacagctaggatgtgcatt

SEQ ID NO: 2088982 - DNA, 22 bp, Homo sapiens
tgacagctaggatgtgcattct

SEQ ID NO: 2088983 - DNA, 14 bp, Homo sapiens
tgacagctgtccct

SEQ ID NO: 2088984 - DNA, 17 bp, Homo sapiens
tgacagctgtccctgtc

SEQ ID NO: 2088985 - DNA, 17 bp, Homo sapiens
tgacaggaaagccctcc

SEQ ID NO: 2088986 - DNA, 18 bp, Homo sapiens
tgacaggaaagccctccc

SEQ ID NO: 2088987 - DNA, 15 bp, Homo sapiens
tgacaggatgtggca

SEQ ID NO: 2088988 - DNA, 20 bp, Homo sapiens
tgacaggatgtggcactgct

SEQ ID NO: 2088989 - DNA, 21 bp, Homo sapiens
tgacaggatgtggcactgctt

SEQ ID NO: 2088990 - DNA, 17 bp, Homo sapiens
tgacaggcaatgctggc

SEQ ID NO: 2088991 - DNA, 15 bp, Homo sapiens
tgacaggcccagtgg

SEQ ID NO: 2088992 - DNA, 20 bp, Homo sapiens
tgacaggcccagtggaacag

SEQ ID NO: 2088993 - DNA, 21 bp, Homo sapiens
tgacagggcacaccgggcact

SEQ ID NO: 2088994 - DNA, 22 bp, Homo sapiens
tgacagggcacaccgggcactc

SEQ ID NO: 2088995 - DNA, 19 bp, Homo sapiens
tgacaggttcccagcagct

SEQ ID NO: 2088996 - DNA, 20 bp, Homo sapiens
tgacaggttcccagcagctg

SEQ ID NO: 2088997 - DNA, 16 bp, Homo sapiens
tgacagtggaactaca

SEQ ID NO: 2088998 - DNA, 15 bp, Homo sapiens
tgacataataaagac

SEQ ID NO: 2088999 - DNA, 20 bp, Homo sapiens
tgacatcacttgtacaaaat

SEQ ID NO: 2089000 - DNA, 12 bp, Homo sapiens
tgacatcccagg

SEQ ID NO: 2089001 - DNA, 13 bp, Homo sapiens
tgacatcccagga

SEQ ID NO: 2089002 - DNA, 20 bp, Homo sapiens
tgacatcccaggaggggcct

SEQ ID NO: 2089003 - DNA, 12 bp, Homo sapiens
tgacatctcctc

SEQ ID NO: 2089004 - DNA, 19 bp, Homo sapiens
tgacatctcctctatcaca

SEQ ID NO: 2089005 - DNA, 13 bp, Homo sapiens
tgacatctctttg

SEQ ID NO: 2089006 - DNA, 21 bp, Homo sapiens
tgacatgcactgacccttcca

SEQ ID NO: 2089007 - DNA, 12 bp, Homo sapiens
tgacatgccacc

SEQ ID NO: 2089008 - DNA, 15 bp, Homo sapiens
tgacatgccaccctc

SEQ ID NO: 2089009 - DNA, 17 bp, Homo sapiens
tgacatgccaccctctc

SEQ ID NO: 2089010 - DNA, 20 bp, Homo sapiens
tgacatgccaccctctccat

SEQ ID NO: 2089011 - DNA, 19 bp, Homo sapiens
tgacatgccatccattctg

SEQ ID NO: 2089012 - DNA, 20 bp, Homo sapiens
tgacatgccatccattctgc

SEQ ID NO: 2089013 - DNA, 20 bp, Homo sapiens
tgacatgtaatgaatggtca

SEQ ID NO: 2089014 - DNA, 16 bp, Homo sapiens
tgacatgtccctacac

SEQ ID NO: 2089015 - DNA, 21 bp, Homo sapiens
tgacattaagacacacctctg

SEQ ID NO: 2089016 - DNA, 15 bp, Homo sapiens
tgacattcaaggcat

SEQ ID NO: 2089017 - DNA, 14 bp, Homo sapiens
tgacattcattttc

SEQ ID NO: 2089018 - DNA, 17 bp, Homo sapiens
tgacattccttgtcacc

SEQ ID NO: 2089019 - DNA, 18 bp, Homo sapiens
tgacattccttgtcacca

SEQ ID NO: 2089020 - DNA, 22 bp, Homo sapiens
tgacatttccttctttgtctta

SEQ ID NO: 2089021 - DNA, 12 bp, Homo sapiens
tgacatttctaa

SEQ ID NO: 2089022 - DNA, 22 bp, Homo sapiens
tgacatttctaacatatgtatt

SEQ ID NO: 2089023 - DNA, 16 bp, Homo sapiens
tgaccaaaagttacat

SEQ ID NO: 2089024 - DNA, 20 bp, Homo sapiens
tgaccaacatggagaaaccc

SEQ ID NO: 2089025 - DNA, 16 bp, Homo sapiens
tgaccaagaaaaagaa

SEQ ID NO: 2089026 - DNA, 16 bp, Homo sapiens
tgaccaagttataaat

SEQ ID NO: 2089027 - DNA, 18 bp, Homo sapiens
tgaccaatactactgtaa

SEQ ID NO: 2089028 - DNA, 23 bp, Homo sapiens
tgaccaatactactgtaaatgta

SEQ ID NO: 2089029 - DNA, 14 bp, Homo sapiens
tgaccaatctctgt

SEQ ID NO: 2089030 - DNA, 16 bp, Homo sapiens
tgaccaatctctgtga

SEQ ID NO: 2089031 - DNA, 20 bp, Homo sapiens
tgaccacggacgtttccatc

SEQ ID NO: 2089032 - DNA, 19 bp, Homo sapiens
tgaccacgggcctcagttt

SEQ ID NO: 2089033 - DNA, 23 bp, Homo sapiens
tgaccacgggcctcagtttcccc

SEQ ID NO: 2089034 - DNA, 14 bp, Homo sapiens
tgaccagacctaga

SEQ ID NO: 2089035 - DNA, 12 bp, Homo sapiens
tgaccaggacta

SEQ ID NO: 2089036 - DNA, 16 bp, Homo sapiens
tgaccagttctggcca

SEQ ID NO: 2089037 - DNA, 18 bp, Homo sapiens
tgaccagttctggccagg

SEQ ID NO: 2089038 - DNA, 15 bp, Homo sapiens
tgaccatcctgtcct

SEQ ID NO: 2089039 - DNA, 18 bp, Homo sapiens
tgaccatctgtttgagaa

SEQ ID NO: 2089040 - DNA, 18 bp, Homo sapiens
tgacccaatgctcctgga

SEQ ID NO: 2089041 - DNA, 13 bp, Homo sapiens
tgacccacagcct

SEQ ID NO: 2089042 - DNA, 15 bp, Homo sapiens
tgacccacagcctct

SEQ ID NO: 2089043 - DNA, 19 bp, Homo sapiens
tgacccactcacacttgga

SEQ ID NO: 2089044 - DNA, 13 bp, Homo sapiens
tgacccactgctt

SEQ ID NO: 2089045 - DNA, 22 bp, Homo sapiens
tgacccagagtggagtctgagt

SEQ ID NO: 2089046 - DNA, 18 bp, Homo sapiens
tgacccagccccttgaga

SEQ ID NO: 2089047 - DNA, 20 bp, Homo sapiens
tgacccagtccctgggggaa

SEQ ID NO: 2089048 - DNA, 16 bp, Homo sapiens
tgacccatgttccctt

SEQ ID NO: 2089049 - DNA, 11 bp, Homo sapiens
tgaccccaggg

SEQ ID NO: 2089050 - DNA, 19 bp, Homo sapiens
tgaccccagggcacaggag

SEQ ID NO: 2089051 - DNA, 21 bp, Homo sapiens
tgaccccagggcacaggagct

SEQ ID NO: 2089052 - DNA, 22 bp, Homo sapiens
tgaccccagggcacaggagcta

SEQ ID NO: 2089053 - DNA, 12 bp, Homo sapiens
tgacccctttcc

SEQ ID NO: 2089054 - DNA, 19 bp, Homo sapiens
tgacccctttcccccaccc

SEQ ID NO: 2089055 - DNA, 18 bp, Homo sapiens
tgacccggcaccccctgc

SEQ ID NO: 2089056 - DNA, 19 bp, Homo sapiens
tgacccggcaccccctgca

SEQ ID NO: 2089057 - DNA, 22 bp, Homo sapiens
tgaccctgcgaaggggccctgg

SEQ ID NO: 2089058 - DNA, 15 bp, Homo sapiens
tgacccttcagggcc

SEQ ID NO: 2089059 - DNA, 16 bp, Homo sapiens
tgacccttcagggcca

SEQ ID NO: 2089060 - DNA, 17 bp, Homo sapiens
tgacccttcagggccag

SEQ ID NO: 2089061 - DNA, 21 bp, Homo sapiens
tgacccttccagacatacgaa

SEQ ID NO: 2089062 - DNA, 23 bp, Homo sapiens
tgacccttcccaatcagcactga

SEQ ID NO: 2089063 - DNA, 13 bp, Homo sapiens
tgaccggcacctg

SEQ ID NO: 2089064 - DNA, 18 bp, Homo sapiens
tgaccgttttcatcctgg

SEQ ID NO: 2089065 - DNA, 18 bp, Homo sapiens
tgacctcacagtgaccct

SEQ ID NO: 2089066 - DNA, 19 bp, Homo sapiens
tgacctcaccggcatgctg

SEQ ID NO: 2089067 - DNA, 13 bp, Homo sapiens
tgacctcagcaaa

SEQ ID NO: 2089068 - DNA, 17 bp, Homo sapiens
tgacctcagcaaatcct

SEQ ID NO: 2089069 - DNA, 13 bp, Homo sapiens
tgacctcagctgc

SEQ ID NO: 2089070 - DNA, 14 bp, Homo sapiens
tgacctcagctgca

SEQ ID NO: 2089071 - DNA, 20 bp, Homo sapiens
tgacctcaggtgatccaccc

SEQ ID NO: 2089072 - DNA, 18 bp, Homo sapiens
tgacctccagctttcctg

SEQ ID NO: 2089073 - DNA, 16 bp, Homo sapiens
tgataaacattaaaca

SEQ ID NO: 2089074 - DNA, 22 bp, Homo sapiens
tgataaacattaaacactgtaa

SEQ ID NO: 2089075 - DNA, 16 bp, Homo sapiens
tgataaactaaaagca

SEQ ID NO: 2089076 - DNA, 18 bp, Homo sapiens
tgataaagattttttaat

SEQ ID NO: 2089077 - DNA, 19 bp, Homo sapiens
tgataaattccactggact

SEQ ID NO: 2089078 - DNA, 17 bp, Homo sapiens
tgataacaacctggaga

SEQ ID NO: 2089079 - DNA, 17 bp, Homo sapiens
tgataacaagcaaggat

SEQ ID NO: 2089080 - DNA, 20 bp, Homo sapiens
tgataaggatcagaacagca

SEQ ID NO: 2089081 - DNA, 18 bp, Homo sapiens
tgataagtggaaaaaaga

SEQ ID NO: 2089082 - DNA, 16 bp, Homo sapiens
tgataatgaacagaac

SEQ ID NO: 2089083 - DNA, 15 bp, Homo sapiens
tgatacgtacagcca

SEQ ID NO: 2089084 - DNA, 14 bp, Homo sapiens
tgatactaagcatt

SEQ ID NO: 2089085 - DNA, 16 bp, Homo sapiens
tgatactaagcattga

SEQ ID NO: 2089086 - DNA, 13 bp, Homo sapiens
tgatactattcag

SEQ ID NO: 2089087 - DNA, 19 bp, Homo sapiens
tgatactattcagaggagc

SEQ ID NO: 2089088 - DNA, 19 bp, Homo sapiens
tgatactgatgccatgtaa

SEQ ID NO: 2089089 - DNA, 16 bp, Homo sapiens
tgatactgcaataaat

SEQ ID NO: 2089090 - DNA, 20 bp, Homo sapiens
tgatactgggtacaagagcc

SEQ ID NO: 2089091 - DNA, 16 bp, Homo sapiens
tgatacttcaggtgct

SEQ ID NO: 2089092 - DNA, 17 bp, Homo sapiens
tgatacttcaggtgctt

SEQ ID NO: 2089093 - DNA, 20 bp, Homo sapiens
tgatacttcaggtgcttttg

SEQ ID NO: 2089094 - DNA, 15 bp, Homo sapiens
tgatacttttgacaa

SEQ ID NO: 2089095 - DNA, 11 bp, Homo sapiens
tgatagcttta

SEQ ID NO: 2089096 - DNA, 13 bp, Homo sapiens
tgataggaaaaga

SEQ ID NO: 2089097 - DNA, 14 bp, Homo sapiens
tgatatatgtattt

SEQ ID NO: 2089098 - DNA, 22 bp, Homo sapiens
tgatatatgtatttattgtcat

SEQ ID NO: 2089099 - DNA, 16 bp, Homo sapiens
tgatatcacctctctt

SEQ ID NO: 2089100 - DNA, 21 bp, Homo sapiens
tgatatccagtaagcacatgt

SEQ ID NO: 2089101 - DNA, 16 bp, Homo sapiens
tgatatgagtatacaa

SEQ ID NO: 2089102 - DNA, 17 bp, Homo sapiens
tgatatgagtatacaat

SEQ ID NO: 2089103 - DNA, 15 bp, Homo sapiens
tgatatgtaaacata

SEQ ID NO: 2089104 - DNA, 23 bp, Homo sapiens
tgatattaaaggagttaagagta

SEQ ID NO: 2089105 - DNA, 22 bp, Homo sapiens
tgatattttcaacgcagccctg

SEQ ID NO: 2089106 - DNA, 16 bp, Homo sapiens
tgatcaaaaataaact

SEQ ID NO: 2089107 - DNA, 17 bp, Homo sapiens
tgatcaaaaataaacta

SEQ ID NO: 2089108 - DNA, 17 bp, Homo sapiens
tgatcaaattcattttt

SEQ ID NO: 2089109 - DNA, 12 bp, Homo sapiens
tgatcacagtga

SEQ ID NO: 2089110 - DNA, 14 bp, Homo sapiens
tgatcacggctcac

SEQ ID NO: 2089111 - DNA, 13 bp, Homo sapiens
tgatcagaaggct

SEQ ID NO: 2089112 - DNA, 15 bp, Homo sapiens
tgatcagaaggctgg

SEQ ID NO: 2089113 - DNA, 18 bp, Homo sapiens
tgatcagctgtttgtcat

SEQ ID NO: 2089114 - DNA, 20 bp, Homo sapiens
tgatcataggtatttcaaaa

SEQ ID NO: 2089115 - DNA, 24 bp, Homo sapiens
tgatcatccactgtgccatgtgcc

SEQ ID NO: 2089116 - DNA, 19 bp, Homo sapiens
tgatcatggtcagctcaca

SEQ ID NO: 2089117 - DNA, 13 bp, Homo sapiens
tgatccaagctgg

SEQ ID NO: 2089118 - DNA, 14 bp, Homo sapiens
tgatccaagctggt

SEQ ID NO: 2089119 - DNA, 17 bp, Homo sapiens
tgatccaagctggtccc

SEQ ID NO: 2089120 - DNA, 18 bp, Homo sapiens
tgatccacccacctcagc

SEQ ID NO: 2089121 - DNA, 21 bp, Homo sapiens
tgatccacccacctcagcctc

SEQ ID NO: 2089122 - DNA, 19 bp, Homo sapiens
tgatcccacttcactgtga

SEQ ID NO: 2089123 - DNA, 23 bp, Homo sapiens
tgatccctttcccatgatccaga

SEQ ID NO: 2089124 - DNA, 17 bp, Homo sapiens
tgatcctccaacttcat

SEQ ID NO: 2089125 - DNA, 21 bp, Homo sapiens
tgatcctcccacctcagcctc

SEQ ID NO: 2089126 - DNA, 21 bp, Homo sapiens
tgatccttgttttaagattgt

SEQ ID NO: 2089127 - DNA, 20 bp, Homo sapiens
tgatcgggataacaaaatca

SEQ ID NO: 2089128 - DNA, 15 bp, Homo sapiens
tgatcgtgctaaatt

SEQ ID NO: 2089129 - DNA, 22 bp, Homo sapiens
tgatcgtgctaaattttcagta

SEQ ID NO: 2089130 - DNA, 21 bp, Homo sapiens
tgatctatagatgacctagaa

SEQ ID NO: 2089131 - DNA, 14 bp, Homo sapiens
tgatctcaggagct

SEQ ID NO: 2089132 - DNA, 13 bp, Homo sapiens
tgatctccctgcc

SEQ ID NO: 2089133 - DNA, 17 bp, Homo sapiens
tgatctccctgccgcct

SEQ ID NO: 2089134 - DNA, 13 bp, Homo sapiens
tgatctgtatata

SEQ ID NO: 2089135 - DNA, 19 bp, Homo sapiens
tgatctgtatatacaataa

SEQ ID NO: 2089136 - DNA, 19 bp, Homo sapiens
tgatctgtcccctctcccc

SEQ ID NO: 2089137 - DNA, 18 bp, Homo sapiens
tgatcttgagatttcttt

SEQ ID NO: 2089138 - DNA, 14 bp, Homo sapiens
tgatctttaaaata

SEQ ID NO: 2089139 - DNA, 15 bp, Homo sapiens
tgatgaaaataataa

SEQ ID NO: 2089140 - DNA, 16 bp, Homo sapiens
tgatgaaaataataaa

SEQ ID NO: 2089141 - DNA, 20 bp, Homo sapiens
tgatgaaactcctgattttg

SEQ ID NO: 2089142 - DNA, 17 bp, Homo sapiens
tgatgaaattcttgaag

SEQ ID NO: 2089143 - DNA, 14 bp, Homo sapiens
tgatgaactttctc

SEQ ID NO: 2089144 - DNA, 23 bp, Homo sapiens
tgatgaactttctcttcatactt

SEQ ID NO: 2089145 - DNA, 14 bp, Homo sapiens
tgatgaagagagag

SEQ ID NO: 2089146 - DNA, 13 bp, Homo sapiens
tgatgaagcccgt

SEQ ID NO: 2089147 - DNA, 16 bp, Homo sapiens
tgatgaagcccgtgtc

SEQ ID NO: 2089148 - DNA, 20 bp, Homo sapiens
tgatgaagcccgtgtcctgc

SEQ ID NO: 2089149 - DNA, 21 bp, Homo sapiens
tgatgaagcctgtgccacctg

SEQ ID NO: 2089150 - DNA, 13 bp, Homo sapiens
tgatgacataata

SEQ ID NO: 2089151 - DNA, 18 bp, Homo sapiens
tgatgaccaatctctgtg

SEQ ID NO: 2089152 - DNA, 17 bp, Homo sapiens
tgatgagggcagcagcc

SEQ ID NO: 2089153 - DNA, 18 bp, Homo sapiens
tgatgagtaacttaacca

SEQ ID NO: 2089154 - DNA, 17 bp, Homo sapiens
tgatgatctttaaaata

SEQ ID NO: 2089155 - DNA, 23 bp, Homo sapiens
tgatgatctttgcagacaggcaa

SEQ ID NO: 2089156 - DNA, 16 bp, Homo sapiens
tgatgatgatgatgat

SEQ ID NO: 2089157 - DNA, 21 bp, Homo sapiens
tgatgatgtctcttgtagaag

SEQ ID NO: 2089158 - DNA, 20 bp, Homo sapiens
tgatgattaaacacctgaca

SEQ ID NO: 2089159 - DNA, 22 bp, Homo sapiens
tgatgcatcagaaagggagggc

SEQ ID NO: 2089160 - DNA, 20 bp, Homo sapiens
tgatgccacttcccagaggc

SEQ ID NO: 2089161 - DNA, 21 bp, Homo sapiens
tgatgcgaaaacttgaatctg

SEQ ID NO: 2089162 - DNA, 19 bp, Homo sapiens
tgatggaccgggtgggcct

SEQ ID NO: 2089163 - DNA, 13 bp, Homo sapiens
tgatggagaagga

SEQ ID NO: 2089164 - DNA, 17 bp, Homo sapiens
tgatggcaattttgtaa

SEQ ID NO: 2089165 - DNA, 14 bp, Homo sapiens
tgatggccaagggg

SEQ ID NO: 2089166 - DNA, 22 bp, Homo sapiens
tgatggcgattccctctcaccc

SEQ ID NO: 2089167 - DNA, 18 bp, Homo sapiens
tgatggcgcgggaggcac

SEQ ID NO: 2089168 - DNA, 21 bp, Homo sapiens
tgatggcgcgggaggcaccag

SEQ ID NO: 2089169 - DNA, 19 bp, Homo sapiens
tgatgggagagtagatggt

SEQ ID NO: 2089170 - DNA, 14 bp, Homo sapiens
tgatggggagaaag

SEQ ID NO: 2089171 - DNA, 19 bp, Homo sapiens
tgatggggtgggcagggct

SEQ ID NO: 2089172 - DNA, 13 bp, Homo sapiens
tgatggtgagctg

SEQ ID NO: 2089173 - DNA, 14 bp, Homo sapiens
tgatggtgagctgg

SEQ ID NO: 2089174 - DNA, 17 bp, Homo sapiens
tgatgtcagccttgcat

SEQ ID NO: 2089175 - DNA, 15 bp, Homo sapiens
tgatgtcatgtactt

SEQ ID NO: 2089176 - DNA, 13 bp, Homo sapiens
tgatgtccagaag

SEQ ID NO: 2089177 - DNA, 15 bp, Homo sapiens
tgatgtccagaagaa

SEQ ID NO: 2089178 - DNA, 16 bp, Homo sapiens
tgatgtctcttgtaga

SEQ ID NO: 2089179 - DNA, 15 bp, Homo sapiens
tgatgtcttcaataa

SEQ ID NO: 2089180 - DNA, 12 bp, Homo sapiens
tgatgtgctgga

SEQ ID NO: 2089181 - DNA, 23 bp, Homo sapiens
tgatgttaactattattaataaa

SEQ ID NO: 2089182 - DNA, 15 bp, Homo sapiens
tgatgttgagctgag

SEQ ID NO: 2089183 - DNA, 13 bp, Homo sapiens
tgatgtttccaga

SEQ ID NO: 2089184 - DNA, 14 bp, Homo sapiens
tgatgtttccagaa

SEQ ID NO: 2089185 - DNA, 18 bp, Homo sapiens
tgatgtttccagaaaata

SEQ ID NO: 2089186 - DNA, 15 bp, Homo sapiens
tgatgttttgttcaa

SEQ ID NO: 2089187 - DNA, 12 bp, Homo sapiens
tgattaaacacc

SEQ ID NO: 2089188 - DNA, 15 bp, Homo sapiens
tgccacacttcaggc

SEQ ID NO: 2089189 - DNA, 14 bp, Homo sapiens
tgccacagccccac

SEQ ID NO: 2089190 - DNA, 16 bp, Homo sapiens
tgccacagccccacag

SEQ ID NO: 2089191 - DNA, 13 bp, Homo sapiens
tgccaccaataaa

SEQ ID NO: 2089192 - DNA, 15 bp, Homo sapiens
tgccaccaataaaaa

SEQ ID NO: 2089193 - DNA, 16 bp, Homo sapiens
tgccaccaataaaaat

SEQ ID NO: 2089194 - DNA, 21 bp, Homo sapiens
tgccaccaccagatgagaagt

SEQ ID NO: 2089195 - DNA, 15 bp, Homo sapiens
tgccaccacgtctgc

SEQ ID NO: 2089196 - DNA, 18 bp, Homo sapiens
tgccaccacgtctgccag

SEQ ID NO: 2089197 - DNA, 23 bp, Homo sapiens
tgccaccacgtctgccaggccca

SEQ ID NO: 2089198 - DNA, 15 bp, Homo sapiens
tgccaccatcctgct

SEQ ID NO: 2089199 - DNA, 19 bp, Homo sapiens
tgccaccatcctgctgctg

SEQ ID NO: 2089200 - DNA, 21 bp, Homo sapiens
tgccaccgccagaggacaagg

SEQ ID NO: 2089201 - DNA, 17 bp, Homo sapiens
tgccaccggggaaccca

SEQ ID NO: 2089202 - DNA, 13 bp, Homo sapiens
tgccacctgcaag

SEQ ID NO: 2089203 - DNA, 10 bp, Homo sapiens
tgccacctgt

SEQ ID NO: 2089204 - DNA, 12 bp, Homo sapiens
tgccacctgtct

SEQ ID NO: 2089205 - DNA, 13 bp, Homo sapiens
tgccacctgtctg

SEQ ID NO: 2089206 - DNA, 23 bp, Homo sapiens
tgccacctgttaaaatgtacact

SEQ ID NO: 2089207 - DNA, 18 bp, Homo sapiens
tgccactaacctgtagaa

SEQ ID NO: 2089208 - DNA, 13 bp, Homo sapiens
tgccactccctga

SEQ ID NO: 2089209 - DNA, 14 bp, Homo sapiens
tgccactccctgag

SEQ ID NO: 2089210 - DNA, 12 bp, Homo sapiens
tgccactgccag

SEQ ID NO: 2089211 - DNA, 16 bp, Homo sapiens
tgccactgccaggcac

SEQ ID NO: 2089212 - DNA, 17 bp, Homo sapiens
tgccactgccaggcacc

SEQ ID NO: 2089213 - DNA, 18 bp, Homo sapiens
tgccactgccaggcacct

SEQ ID NO: 2089214 - DNA, 20 bp, Homo sapiens
tgccactgccaggcacctgg

SEQ ID NO: 2089215 - DNA, 23 bp, Homo sapiens
tgccactgccaggcacctggcct

SEQ ID NO: 2089216 - DNA, 17 bp, Homo sapiens
tgccactgcctcttcct

SEQ ID NO: 2089217 - DNA, 22 bp, Homo sapiens
tgccacttcttaaaggcctgga

SEQ ID NO: 2089218 - DNA, 17 bp, Homo sapiens
tgccactttcgggaggg

SEQ ID NO: 2089219 - DNA, 16 bp, Homo sapiens
tgccactttggcttct

SEQ ID NO: 2089220 - DNA, 19 bp, Homo sapiens
tgccactttggcttctcct

SEQ ID NO: 2089221 - DNA, 20 bp, Homo sapiens
tgccactttggcttctcctg

SEQ ID NO: 2089222 - DNA, 22 bp, Homo sapiens
tgccactttggcttctcctgtg

SEQ ID NO: 2089223 - DNA, 19 bp, Homo sapiens
tgccagaacagtttgtaca

SEQ ID NO: 2089224 - DNA, 13 bp, Homo sapiens
tgccagacatgtg

SEQ ID NO: 2089225 - DNA, 21 bp, Homo sapiens
tgccagagacggaagcctttt

SEQ ID NO: 2089226 - DNA, 22 bp, Homo sapiens
tgccagagacggaagccttttt

SEQ ID NO: 2089227 - DNA, 19 bp, Homo sapiens
tgccagagcccaagtgcca

SEQ ID NO: 2089228 - DNA, 20 bp, Homo sapiens
tgccagagcccaagtgccat

SEQ ID NO: 2089229 - DNA, 11 bp, Homo sapiens
tgccagagcct

SEQ ID NO: 2089230 - DNA, 16 bp, Homo sapiens
tgccagagcctggggc

SEQ ID NO: 2089231 - DNA, 20 bp, Homo sapiens
tgccagagctttgttttata

SEQ ID NO: 2089232 - DNA, 21 bp, Homo sapiens
tgccagatgcctttatggctg

SEQ ID NO: 2089233 - DNA, 18 bp, Homo sapiens
tgccagcacaggggcccc

SEQ ID NO: 2089234 - DNA, 21 bp, Homo sapiens
tgccagcagctgtttctggaa

SEQ ID NO: 2089235 - DNA, 11 bp, Homo sapiens
tgccagccaca

SEQ ID NO: 2089236 - DNA, 12 bp, Homo sapiens
tgccagccagaa

SEQ ID NO: 2089237 - DNA, 22 bp, Homo sapiens
tgccagccagaagcctctgcct

SEQ ID NO: 2089238 - DNA, 16 bp, Homo sapiens
tgccagccagcagcca

SEQ ID NO: 2089239 - DNA, 11 bp, Homo sapiens
tgccagccatc

SEQ ID NO: 2089240 - DNA, 17 bp, Homo sapiens
tgccagccatcacaagg

SEQ ID NO: 2089241 - DNA, 21 bp, Homo sapiens
tgccagccgtgatgctcaggc

SEQ ID NO: 2089242 - DNA, 21 bp, Homo sapiens
tgccagcctggcttctggagc

SEQ ID NO: 2089243 - DNA, 16 bp, Homo sapiens
tgccagctcaggtgac

SEQ ID NO: 2089244 - DNA, 22 bp, Homo sapiens
tgccagctgccttcctcatccc

SEQ ID NO: 2089245 - DNA, 13 bp, Homo sapiens
tgccaggacacct

SEQ ID NO: 2089246 - DNA, 19 bp, Homo sapiens
tgccaggacacctgcccca

SEQ ID NO: 2089247 - DNA, 17 bp, Homo sapiens
tgccaggacagctggct

SEQ ID NO: 2089248 - DNA, 21 bp, Homo sapiens
tgccaggactccccaggccag

SEQ ID NO: 2089249 - DNA, 21 bp, Homo sapiens
tgccaggagggacaaaggagc

SEQ ID NO: 2089250 - DNA, 22 bp, Homo sapiens
tgccaggagggacaaaggagcc

SEQ ID NO: 2089251 - DNA, 24 bp, Homo sapiens
tgccaggagggacaaaggagcctg

SEQ ID NO: 2089252 - DNA, 13 bp, Homo sapiens
tgccaggcacctg

SEQ ID NO: 2089253 - DNA, 23 bp, Homo sapiens
tgccaggcacctggcctgctggg

SEQ ID NO: 2089254 - DNA, 23 bp, Homo sapiens
tgccaggcccatctcaggtgcca

SEQ ID NO: 2089255 - DNA, 18 bp, Homo sapiens
tgccaggcgttggtgcca

SEQ ID NO: 2089256 - DNA, 19 bp, Homo sapiens
tgccaggcgttggtgccac

SEQ ID NO: 2089257 - DNA, 21 bp, Homo sapiens
tgccaggcgttggtgccactt

SEQ ID NO: 2089258 - DNA, 19 bp, Homo sapiens
tgccaggctccctttctct

SEQ ID NO: 2089259 - DNA, 21 bp, Homo sapiens
tgccaggctgtaagcattctg

SEQ ID NO: 2089260 - DNA, 11 bp, Homo sapiens
tgccagggctc

SEQ ID NO: 2089261 - DNA, 19 bp, Homo sapiens
tgccagggctcgggcgctg

SEQ ID NO: 2089262 - DNA, 18 bp, Homo sapiens
tgccaggtttttggtctg

SEQ ID NO: 2089263 - DNA, 24 bp, Homo sapiens
tgccaggtttttggtctgacccac

SEQ ID NO: 2089264 - DNA, 14 bp, Homo sapiens
tgccagtgaagact

SEQ ID NO: 2089265 - DNA, 17 bp, Homo sapiens
tgccagtgaagacttct

SEQ ID NO: 2089266 - DNA, 11 bp, Homo sapiens
tgccagtgcct

SEQ ID NO: 2089267 - DNA, 13 bp, Homo sapiens
tgccagtgcctta

SEQ ID NO: 2089268 - DNA, 15 bp, Homo sapiens
tgccagtgccttacc

SEQ ID NO: 2089269 - DNA, 22 bp, Homo sapiens
tgccagtgccttacctcctgcc

SEQ ID NO: 2089270 - DNA, 17 bp, Homo sapiens
tgccagttatggctata

SEQ ID NO: 2089271 - DNA, 22 bp, Homo sapiens
tgccagttgaaaatggattttt

SEQ ID NO: 2089272 - DNA, 23 bp, Homo sapiens
tgccagttgaaaatggattttta

SEQ ID NO: 2089273 - DNA, 21 bp, Homo sapiens
tgccatagagtttaacacaag

SEQ ID NO: 2089274 - DNA, 14 bp, Homo sapiens
tgccatagccccat

SEQ ID NO: 2089275 - DNA, 17 bp, Homo sapiens
tgccatattctgttggc

SEQ ID NO: 2089276 - DNA, 12 bp, Homo sapiens
tgccatctgttt

SEQ ID NO: 2089277 - DNA, 13 bp, Homo sapiens
tgccatgaggcct

SEQ ID NO: 2089278 - DNA, 15 bp, Homo sapiens
tgccatgaggccttt

SEQ ID NO: 2089279 - DNA, 14 bp, Homo sapiens
tgccatgccactgc

SEQ ID NO: 2089280 - DNA, 18 bp, Homo sapiens
tgccatgccactgccagg

SEQ ID NO: 2089281 - DNA, 20 bp, Homo sapiens
tgccatgccactgccaggca

SEQ ID NO: 2089282 - DNA, 21 bp, Homo sapiens
tgccatgccactgccaggcac

SEQ ID NO: 2089283 - DNA, 18 bp, Homo sapiens
tgccatggacagaagaag

SEQ ID NO: 2089284 - DNA, 20 bp, Homo sapiens
tgccatggacagaagaaggc

SEQ ID NO: 2089285 - DNA, 17 bp, Homo sapiens
tgccatggcgtgtccct

SEQ ID NO: 2089286 - DNA, 17 bp, Homo sapiens
tgccatgtcaaacaaat

SEQ ID NO: 2089287 - DNA, 18 bp, Homo sapiens
tgccatgtcaaacaaata

SEQ ID NO: 2089288 - DNA, 17 bp, Homo sapiens
tgccatgtggagtggac

SEQ ID NO: 2089289 - DNA, 15 bp, Homo sapiens
tgccatgttggccag

SEQ ID NO: 2089290 - DNA, 21 bp, Homo sapiens
tgccatgttggccaggctggt

SEQ ID NO: 2089291 - DNA, 13 bp, Homo sapiens
tgccattactctg

SEQ ID NO: 2089292 - DNA, 18 bp, Homo sapiens
tgccattcatagagagcc

SEQ ID NO: 2089293 - DNA, 17 bp, Homo sapiens
tgccatttcctgtctgg

SEQ ID NO: 2089294 - DNA, 19 bp, Homo sapiens
tgccatttgcaccctccgc

SEQ ID NO: 2089295 - DNA, 23 bp, Homo sapiens
tgccatttgtactgaccccatca

SEQ ID NO: 2089296 - DNA, 18 bp, Homo sapiens
tgcccaacctgctctcct

SEQ ID NO: 2089297 - DNA, 24 bp, Homo sapiens
tgcccaacctgctctcctcttgcc

SEQ ID NO: 2089298 - DNA, 23 bp, Homo sapiens
tgcccaagaatagatgctgactg

SEQ ID NO: 2089299 - DNA, 23 bp, Homo sapiens
tgcccacatcccaggcttcaccc

SEQ ID NO: 2089300 - DNA, 17 bp, Homo sapiens
tgcccaccaacatccca

SEQ ID NO: 2089301 - DNA, 23 bp, Homo sapiens
tgcccaccaacatcccattgccc

SEQ ID NO: 2089302 - DNA, 14 bp, Homo sapiens
tgctcatcacccag

SEQ ID NO: 2089303 - DNA, 15 bp, Homo sapiens
tgctcatcacccagt

SEQ ID NO: 2089304 - DNA, 21 bp, Homo sapiens
tgctcatcacccagtcctggc

SEQ ID NO: 2089305 - DNA, 19 bp, Homo sapiens
tgctccagggtcttgggct

SEQ ID NO: 2089306 - DNA, 23 bp, Homo sapiens
tgctccagggtcttgggctactg

SEQ ID NO: 2089307 - DNA, 14 bp, Homo sapiens
tgctcccagcagcc

SEQ ID NO: 2089308 - DNA, 21 bp, Homo sapiens
tgctcccagcagccctaagga

SEQ ID NO: 2089309 - DNA, 16 bp, Homo sapiens
tgctcccatctcctga

SEQ ID NO: 2089310 - DNA, 18 bp, Homo sapiens
tgctccccagccctggct

SEQ ID NO: 2089311 - DNA, 23 bp, Homo sapiens
tgctcctaaacccccgctccaga

SEQ ID NO: 2089312 - DNA, 18 bp, Homo sapiens
tgctcctagtttgacctc

SEQ ID NO: 2089313 - DNA, 12 bp, Homo sapiens
tgctcctccagg

SEQ ID NO: 2089314 - DNA, 21 bp, Homo sapiens
tgctcctccagggccacgtgc

SEQ ID NO: 2089315 - DNA, 12 bp, Homo sapiens
tgctcctctcca

SEQ ID NO: 2089316 - DNA, 14 bp, Homo sapiens
tgctcctctccagg

SEQ ID NO: 2089317 - DNA, 16 bp, Homo sapiens
tgctcctctccaggca

SEQ ID NO: 2089318 - DNA, 21 bp, Homo sapiens
tgctcctgtacgaacccctcc

SEQ ID NO: 2089319 - DNA, 23 bp, Homo sapiens
tgctcgattattccctgtacaat

SEQ ID NO: 2089320 - DNA, 16 bp, Homo sapiens
tgctcgcagcctggcg

SEQ ID NO: 2089321 - DNA, 17 bp, Homo sapiens
tgctcgcttctcctcca

SEQ ID NO: 2089322 - DNA, 17 bp, Homo sapiens
tgctcggggtgcacagg

SEQ ID NO: 2089323 - DNA, 18 bp, Homo sapiens
tgctcggggtgcacagga

SEQ ID NO: 2089324 - DNA, 21 bp, Homo sapiens
tgctcggggtgcacaggaggg

SEQ ID NO: 2089325 - DNA, 12 bp, Homo sapiens
tgctctattgta

SEQ ID NO: 2089326 - DNA, 13 bp, Homo sapiens
tgctctcccctgc

SEQ ID NO: 2089327 - DNA, 17 bp, Homo sapiens
tgctctcccctgccctg

SEQ ID NO: 2089328 - DNA, 20 bp, Homo sapiens
tgctctcccctgccctgctg

SEQ ID NO: 2089329 - DNA, 22 bp, Homo sapiens
tgctctcctaccccacctcatg

SEQ ID NO: 2089330 - DNA, 12 bp, Homo sapiens
tgctctcctctt

SEQ ID NO: 2089331 - DNA, 14 bp, Homo sapiens
tgctctcctcttgc

SEQ ID NO: 2089332 - DNA, 22 bp, Homo sapiens
tgctctcctcttgccactgcct

SEQ ID NO: 2089333 - DNA, 13 bp, Homo sapiens
tgctctcttcagg

SEQ ID NO: 2089334 - DNA, 16 bp, Homo sapiens
tgctctgaggcttcca

SEQ ID NO: 2089335 - DNA, 16 bp, Homo sapiens
tgctctgctgacagac

SEQ ID NO: 2089336 - DNA, 22 bp, Homo sapiens
tgctctgctgacagacacaggc

SEQ ID NO: 2089337 - DNA, 19 bp, Homo sapiens
tgctctggaaaatgtgacc

SEQ ID NO: 2089338 - DNA, 23 bp, Homo sapiens
tgctctggaaaatgtgacccaga

SEQ ID NO: 2089339 - DNA, 13 bp, Homo sapiens
tgctctggaagcc

SEQ ID NO: 2089340 - DNA, 15 bp, Homo sapiens
tgctctggaggctgc

SEQ ID NO: 2089341 - DNA, 21 bp, Homo sapiens
tgctctggcggcttcctgtcc

SEQ ID NO: 2089342 - DNA, 15 bp, Homo sapiens
tgctcttagctgtct

SEQ ID NO: 2089343 - DNA, 13 bp, Homo sapiens
tgctcttctctta

SEQ ID NO: 2089344 - DNA, 15 bp, Homo sapiens
tgctcttctgttctc

SEQ ID NO: 2089345 - DNA, 15 bp, Homo sapiens
tgctcttctttctga

SEQ ID NO: 2089346 - DNA, 16 bp, Homo sapiens
tgctcttctttctgag

SEQ ID NO: 2089347 - DNA, 14 bp, Homo sapiens
tgctcttgcctgca

SEQ ID NO: 2089348 - DNA, 12 bp, Homo sapiens
tgctcttggaaa

SEQ ID NO: 2089349 - DNA, 18 bp, Homo sapiens
tgctcttggaaagctgat

SEQ ID NO: 2089350 - DNA, 23 bp, Homo sapiens
tgctgaaacacacaggccatttc

SEQ ID NO: 2089351 - DNA, 15 bp, Homo sapiens
tgctgaaacacctcc

SEQ ID NO: 2089352 - DNA, 20 bp, Homo sapiens
tgctgaaacacctcccaggg

SEQ ID NO: 2089353 - DNA, 13 bp, Homo sapiens
tgctgaagggacc

SEQ ID NO: 2089354 - DNA, 13 bp, Homo sapiens
tgctgaattattt

SEQ ID NO: 2089355 - DNA, 22 bp, Homo sapiens
tgctgaattattttgttgtgat

SEQ ID NO: 2089356 - DNA, 22 bp, Homo sapiens
tgctgacagacacaggcccggc

SEQ ID NO: 2089357 - DNA, 21 bp, Homo sapiens
tgctgactaactataagcatg

SEQ ID NO: 2089358 - DNA, 19 bp, Homo sapiens
tgctgagaacctggccttc

SEQ ID NO: 2089359 - DNA, 15 bp, Homo sapiens
tgctgagagacccaa

SEQ ID NO: 2089360 - DNA, 17 bp, Homo sapiens
tgctgagagacccaagg

SEQ ID NO: 2089361 - DNA, 13 bp, Homo sapiens
tgctgagctctga

SEQ ID NO: 2089362 - DNA, 21 bp, Homo sapiens
tgctgagcttagccttgtgcc

SEQ ID NO: 2089363 - DNA, 17 bp, Homo sapiens
tgctgaggactccctcc

SEQ ID NO: 2089364 - DNA, 17 bp, Homo sapiens
tgctgatcaatgaaatg

SEQ ID NO: 2089365 - DNA, 18 bp, Homo sapiens
tgctgattcaagaaacag

SEQ ID NO: 2089366 - DNA, 21 bp, Homo sapiens
tgctgattcaagaaacagaag

SEQ ID NO: 2089367 - DNA, 17 bp, Homo sapiens
tgctgcaaagtgcaaat

SEQ ID NO: 2089368 - DNA, 18 bp, Homo sapiens
tgctgcaaagtgcaaata

SEQ ID NO: 2089369 - DNA, 20 bp, Homo sapiens
tgctgcaaagtgcaaatact

SEQ ID NO: 2089370 - DNA, 14 bp, Homo sapiens
tgctgcaccagagt

SEQ ID NO: 2089371 - DNA, 13 bp, Homo sapiens
tgctgcagccagg

SEQ ID NO: 2089372 - DNA, 23 bp, Homo sapiens
tgctgcagccaggaggagaggaa

SEQ ID NO: 2089373 - DNA, 19 bp, Homo sapiens
tgctgcatttgtgtcatct

SEQ ID NO: 2089374 - DNA, 11 bp, Homo sapiens
tgctgccatcc

SEQ ID NO: 2089375 - DNA, 12 bp, Homo sapiens
tgctgccatcca

SEQ ID NO: 2089376 - DNA, 14 bp, Homo sapiens
tgctgccatccagg

SEQ ID NO: 2089377 - DNA, 21 bp, Homo sapiens
tgctgccatccaggttcagct

SEQ ID NO: 2089378 - DNA, 12 bp, Homo sapiens
tgctgccatgcc

SEQ ID NO: 2089379 - DNA, 20 bp, Homo sapiens
tgctgccatgccactgccag

SEQ ID NO: 2089380 - DNA, 21 bp, Homo sapiens
tgctgccccgttccctgtcag

SEQ ID NO: 2089381 - DNA, 13 bp, Homo sapiens
tgctgcccctgca

SEQ ID NO: 2089382 - DNA, 14 bp, Homo sapiens
tgctgcccctgcag

SEQ ID NO: 2089383 - DNA, 15 bp, Homo sapiens
tgctgcccctgcagt

SEQ ID NO: 2089384 - DNA, 17 bp, Homo sapiens
tgctgcccgtcttcagc

SEQ ID NO: 2089385 - DNA, 20 bp, Homo sapiens
tgctgcccgtcttcagccta

SEQ ID NO: 2089386 - DNA, 11 bp, Homo sapiens
tgctgccctgc

SEQ ID NO: 2089387 - DNA, 17 bp, Homo sapiens
tgctgccgcctcccagc

SEQ ID NO: 2089388 - DNA, 20 bp, Homo sapiens
tgctgcgtcagaccagtact

SEQ ID NO: 2089389 - DNA, 13 bp, Homo sapiens
tgctgctactacc

SEQ ID NO: 2089390 - DNA, 13 bp, Homo sapiens
tgctgctctctga

SEQ ID NO: 2089391 - DNA, 22 bp, Homo sapiens
tgctgctgacctgatcacctct

SEQ ID NO: 2089392 - DNA, 15 bp, Homo sapiens
tgctgctgagaacct

SEQ ID NO: 2089393 - DNA, 16 bp, Homo sapiens
tgctgctgagaacctg

SEQ ID NO: 2089394 - DNA, 17 bp, Homo sapiens
tgctgctgagaacctgg

SEQ ID NO: 2089395 - DNA, 15 bp, Homo sapiens
tgctgctgctgctgc

SEQ ID NO: 2089396 - DNA, 19 bp, Homo sapiens
tgctgctgtaactgctgag

SEQ ID NO: 2089397 - DNA, 21 bp, Homo sapiens
tgctgctgtaactgctgagcc

SEQ ID NO: 2089398 - DNA, 24 bp, Homo sapiens
tgctgctgtaactgctgagccact

SEQ ID NO: 2089399 - DNA, 17 bp, Homo sapiens
tgctgctttttggcaca

SEQ ID NO: 2089400 - DNA, 16 bp, Homo sapiens
tgctggaaaccacact

SEQ ID NO: 2089401 - DNA, 20 bp, Homo sapiens
tgctggacggcattcctgct

SEQ ID NO: 2089402 - DNA, 20 bp, Homo sapiens
tgctggacggggactgggga

SEQ ID NO: 2089403 - DNA, 21 bp, Homo sapiens
tgctggacggggactggggat

SEQ ID NO: 2089404 - DNA, 17 bp, Homo sapiens
tgctggactgaggacca

SEQ ID NO: 2089405 - DNA, 12 bp, Homo sapiens
tgctggccagca

SEQ ID NO: 2089406 - DNA, 13 bp, Homo sapiens
tgctggccagcac

SEQ ID NO: 2089407 - DNA, 20 bp, Homo sapiens
tgctggccagcaccctctcc

SEQ ID NO: 2089408 - DNA, 22 bp, Homo sapiens
tgctggccagcaccctctcctg

SEQ ID NO: 2089409 - DNA, 21 bp, Homo sapiens
tgctggcctcccaataaagct

SEQ ID NO: 2089410 - DNA, 22 bp, Homo sapiens
tgctggcctcccaataaagctg

SEQ ID NO: 2089411 - DNA, 23 bp, Homo sapiens
tgctggcctcccaataaagctgg

SEQ ID NO: 2089412 - DNA, 14 bp, Homo sapiens
tgctggcctggatc

SEQ ID NO: 2089413 - DNA, 15 bp, Homo sapiens
tgctggcctggatct

SEQ ID NO: 2089414 - DNA, 13 bp, Homo sapiens
tgctggcctggcc

SEQ ID NO: 2089415 - DNA, 13 bp, Homo sapiens
tgctggcctgtgg

SEQ ID NO: 2089416 - DNA, 20 bp, Homo sapiens
tgctggcctgtggcaggcct

SEQ ID NO: 2089417 - DNA, 12 bp, Homo sapiens
tggcactgcttg

SEQ ID NO: 2089418 - DNA, 13 bp, Homo sapiens
tggcagaaaagag

SEQ ID NO: 2089419 - DNA, 23 bp, Homo sapiens
tggcagaaaagaggagaccctgg

SEQ ID NO: 2089420 - DNA, 18 bp, Homo sapiens
tggcagaccgggggccag

SEQ ID NO: 2089421 - DNA, 17 bp, Homo sapiens
tggcagagaaggcctct

SEQ ID NO: 2089422 - DNA, 18 bp, Homo sapiens
tggcagagaaggcctctt

SEQ ID NO: 2089423 - DNA, 16 bp, Homo sapiens
tggcagagaaggcttc

SEQ ID NO: 2089424 - DNA, 17 bp, Homo sapiens
tggcagagaaggcttcc

SEQ ID NO: 2089425 - DNA, 19 bp, Homo sapiens
tggcagagaaggcttcctc

SEQ ID NO: 2089426 - DNA, 21 bp, Homo sapiens
tggcagagcccccaaggactc

SEQ ID NO: 2089427 - DNA, 21 bp, Homo sapiens
tggcagataatcagcctctta

SEQ ID NO: 2089428 - DNA, 18 bp, Homo sapiens
tggcagccacacttctca

SEQ ID NO: 2089429 - DNA, 21 bp, Homo sapiens
tggcagccacacttctcagga

SEQ ID NO: 2089430 - DNA, 15 bp, Homo sapiens
tggcagccaccccct

SEQ ID NO: 2089431 - DNA, 16 bp, Homo sapiens
tggcagccaccccctc

SEQ ID NO: 2089432 - DNA, 14 bp, Homo sapiens
tggcagccatgcct

SEQ ID NO: 2089433 - DNA, 18 bp, Homo sapiens
tggcagccatgcctcatg

SEQ ID NO: 2089434 - DNA, 21 bp, Homo sapiens
tggcagccatgcctcatgcca

SEQ ID NO: 2089435 - DNA, 12 bp, Homo sapiens
tggcagccctgt

SEQ ID NO: 2089436 - DNA, 17 bp, Homo sapiens
tggcagccctgtaggga

SEQ ID NO: 2089437 - DNA, 13 bp, Homo sapiens
tggcagccttggc

SEQ ID NO: 2089438 - DNA, 17 bp, Homo sapiens
tggcagccttggcaaac

SEQ ID NO: 2089439 - DNA, 20 bp, Homo sapiens
tggcagctagactggagtga

SEQ ID NO: 2089440 - DNA, 14 bp, Homo sapiens
tggcagctcctctc

SEQ ID NO: 2089441 - DNA, 23 bp, Homo sapiens
tggcagctcctctccttgggctc

SEQ ID NO: 2089442 - DNA, 21 bp, Homo sapiens
tggcagctgcggtccacccag

SEQ ID NO: 2089443 - DNA, 22 bp, Homo sapiens
tggcagctgcggtccacccagg

SEQ ID NO: 2089444 - DNA, 23 bp, Homo sapiens
tggcagctgcggtccacccagga

SEQ ID NO: 2089445 - DNA, 20 bp, Homo sapiens
tggcaggaagtctctcccga

SEQ ID NO: 2089446 - DNA, 11 bp, Homo sapiens
tggcaggacca

SEQ ID NO: 2089447 - DNA, 16 bp, Homo sapiens
tggcaggaccaggact

SEQ ID NO: 2089448 - DNA, 17 bp, Homo sapiens
tggcaggaccaggacta

SEQ ID NO: 2089449 - DNA, 21 bp, Homo sapiens
tggcaggcacacagcagcccc

SEQ ID NO: 2089450 - DNA, 22 bp, Homo sapiens
tggcaggcacacagcagccccc

SEQ ID NO: 2089451 - DNA, 14 bp, Homo sapiens
tggcagtccagcca

SEQ ID NO: 2089452 - DNA, 15 bp, Homo sapiens
tggcagtccagccag

SEQ ID NO: 2089453 - DNA, 20 bp, Homo sapiens
tggcagtccagccagctcct

SEQ ID NO: 2089454 - DNA, 13 bp, Homo sapiens
tggcagtgggagc

SEQ ID NO: 2089455 - DNA, 21 bp, Homo sapiens
tggcatatttatattgtatat

SEQ ID NO: 2089456 - DNA, 15 bp, Homo sapiens
tggcatcacagggca

SEQ ID NO: 2089457 - DNA, 18 bp, Homo sapiens
tggcatcacagggcagag

SEQ ID NO: 2089458 - DNA, 16 bp, Homo sapiens
tggcatcgtagaagag

SEQ ID NO: 2089459 - DNA, 23 bp, Homo sapiens
tggcatcgtagaagagatgtggc

SEQ ID NO: 2089460 - DNA, 18 bp, Homo sapiens
tggcatgatttatatatg

SEQ ID NO: 2089461 - DNA, 21 bp, Homo sapiens
tggcatgatttatatatggca

SEQ ID NO: 2089462 - DNA, 18 bp, Homo sapiens
tggcatgcttaaatattg

SEQ ID NO: 2089463 - DNA, 16 bp, Homo sapiens
tggcatggatttctgt

SEQ ID NO: 2089464 - DNA, 20 bp, Homo sapiens
tggcatgtcagagccaggct

SEQ ID NO: 2089465 - DNA, 21 bp, Homo sapiens
tggcatgtcagagccaggctc

SEQ ID NO: 2089466 - DNA, 19 bp, Homo sapiens
tggcattacagctggagaa

SEQ ID NO: 2089467 - DNA, 14 bp, Homo sapiens
tggccaagagcatc

SEQ ID NO: 2089468 - DNA, 16 bp, Homo sapiens
tggccaccccgtgcca

SEQ ID NO: 2089469 - DNA, 11 bp, Homo sapiens
tggccaccctg

SEQ ID NO: 2089470 - DNA, 22 bp, Homo sapiens
tggccactttaagagagaaatc

SEQ ID NO: 2089471 - DNA, 21 bp, Homo sapiens
tggccagacacaggtgcctca

SEQ ID NO: 2089472 - DNA, 20 bp, Homo sapiens
tggccagagagggcccagct

SEQ ID NO: 2089473 - DNA, 13 bp, Homo sapiens
tggccagagctgg

SEQ ID NO: 2089474 - DNA, 14 bp, Homo sapiens
tggccagagctgga

SEQ ID NO: 2089475 - DNA, 23 bp, Homo sapiens
tggccagagctggaaggcagggc

SEQ ID NO: 2089476 - DNA, 15 bp, Homo sapiens
tggccagagctggga

SEQ ID NO: 2089477 - DNA, 17 bp, Homo sapiens
tggccagagctgggagg

SEQ ID NO: 2089478 - DNA, 15 bp, Homo sapiens
tggccagatgcacca

SEQ ID NO: 2089479 - DNA, 13 bp, Homo sapiens
tggccaggctggt

SEQ ID NO: 2089480 - DNA, 15 bp, Homo sapiens
tggccaggctggtct

SEQ ID NO: 2089481 - DNA, 17 bp, Homo sapiens
tggccaggctggtctca

SEQ ID NO: 2089482 - DNA, 13 bp, Homo sapiens
tggccagggtgag

SEQ ID NO: 2089483 - DNA, 19 bp, Homo sapiens
tggccagggtgagagctgc

SEQ ID NO: 2089484 - DNA, 16 bp, Homo sapiens
tggccagtcctagagc

SEQ ID NO: 2089485 - DNA, 18 bp, Homo sapiens
tggccagtcctagagctc

SEQ ID NO: 2089486 - DNA, 20 bp, Homo sapiens
tggccagtcctagagctcct

SEQ ID NO: 2089487 - DNA, 23 bp, Homo sapiens
tggccagtgtgacaaggattgct

SEQ ID NO: 2089488 - DNA, 13 bp, Homo sapiens
tggccatccctgg

SEQ ID NO: 2089489 - DNA, 21 bp, Homo sapiens
tggccatccctgggcccctcc

SEQ ID NO: 2089490 - DNA, 23 bp, Homo sapiens
tggccatccctgggcccctccac

SEQ ID NO: 2089491 - DNA, 14 bp, Homo sapiens
tggccatgcttctt

SEQ ID NO: 2089492 - DNA, 16 bp, Homo sapiens
tggccatgcttcttgc

SEQ ID NO: 2089493 - DNA, 17 bp, Homo sapiens
tggccatgcttcttgcc

SEQ ID NO: 2089494 - DNA, 21 bp, Homo sapiens
tggccatgtcgcctgccccca

SEQ ID NO: 2089495 - DNA, 17 bp, Homo sapiens
tggccattttcttgcct

SEQ ID NO: 2089496 - DNA, 18 bp, Homo sapiens
tggccattttcttgcctg

SEQ ID NO: 2089497 - DNA, 23 bp, Homo sapiens
tggccattttcttgcctgaggct

SEQ ID NO: 2089498 - DNA, 14 bp, Homo sapiens
tggcccaaatccag

SEQ ID NO: 2089499 - DNA, 19 bp, Homo sapiens
tggcccaatgcctataaaa

SEQ ID NO: 2089500 - DNA, 18 bp, Homo sapiens
tggcccagagctggaaca

SEQ ID NO: 2089501 - DNA, 20 bp, Homo sapiens
tggcccagggtaggggaggg

SEQ ID NO: 2089502 - DNA, 20 bp, Homo sapiens
tggcccatagaaacatgaca

SEQ ID NO: 2089503 - DNA, 23 bp, Homo sapiens
tggcccatagaaacatgacactg

SEQ ID NO: 2089504 - DNA, 24 bp, Homo sapiens
tggcccatagaaacatgacactga

SEQ ID NO: 2089505 - DNA, 14 bp, Homo sapiens
tggccccagccccc

SEQ ID NO: 2089506 - DNA, 14 bp, Homo sapiens
tggccccaggtgcc

SEQ ID NO: 2089507 - DNA, 15 bp, Homo sapiens
tggccccaggtgcca

SEQ ID NO: 2089508 - DNA, 22 bp, Homo sapiens
tggccccaggtgccaccaataa

SEQ ID NO: 2089509 - DNA, 23 bp, Homo sapiens
tggccccaggtgccaccaataaa

SEQ ID NO: 2089510 - DNA, 12 bp, Homo sapiens
tggcccccctcc

SEQ ID NO: 2089511 - DNA, 16 bp, Homo sapiens
tggccccctgtgccag

SEQ ID NO: 2089512 - DNA, 19 bp, Homo sapiens
tggccccgggctctggcca

SEQ ID NO: 2089513 - DNA, 12 bp, Homo sapiens
tggcccctcacc

SEQ ID NO: 2089514 - DNA, 18 bp, Homo sapiens
tggcccctcacctgggcc

SEQ ID NO: 2089515 - DNA, 21 bp, Homo sapiens
tggcccctccagaccctgcct

SEQ ID NO: 2089516 - DNA, 14 bp, Homo sapiens
tggcccctgcccgg

SEQ ID NO: 2089517 - DNA, 14 bp, Homo sapiens
tggcccctgtgtga

SEQ ID NO: 2089518 - DNA, 14 bp, Homo sapiens
tggcccgacagcct

SEQ ID NO: 2089519 - DNA, 15 bp, Homo sapiens
tggcccgacagcctg

SEQ ID NO: 2089520 - DNA, 19 bp, Homo sapiens
tggcccgacagcctggcac

SEQ ID NO: 2089521 - DNA, 16 bp, Homo sapiens
tggccctgccttcttc

SEQ ID NO: 2089522 - DNA, 14 bp, Homo sapiens
tggccctggcctgc

SEQ ID NO: 2089523 - DNA, 15 bp, Homo sapiens
tggccctggcctgct

SEQ ID NO: 2089524 - DNA, 19 bp, Homo sapiens
tggccctggggtcccacga

SEQ ID NO: 2089525 - DNA, 17 bp, Homo sapiens
tggcccttcctggacag

SEQ ID NO: 2089526 - DNA, 21 bp, Homo sapiens
tggcccttcctggacagctgt

SEQ ID NO: 2089527 - DNA, 17 bp, Homo sapiens
tggccgactcagggacc

SEQ ID NO: 2089528 - DNA, 17 bp, Homo sapiens
tggccgcaagcgcaggg

SEQ ID NO: 2089529 - DNA, 18 bp, Homo sapiens
tggccgcaagcgcaggga

SEQ ID NO: 2089530 - DNA, 22 bp, Homo sapiens
tggccgcaagcgcagggaggat

SEQ ID NO: 2089531 - DNA, 12 bp, Homo sapiens
tgtaaattttag

SEQ ID NO: 2089532 - DNA, 17 bp, Homo sapiens
tgtaacaagccacccca

SEQ ID NO: 2089533 - DNA, 20 bp, Homo sapiens
tgtaacacaagccacagaag

SEQ ID NO: 2089534 - DNA, 20 bp, Homo sapiens
tgtaacacagctgagagact

SEQ ID NO: 2089535 - DNA, 17 bp, Homo sapiens
tgtaacactgcaagaag

SEQ ID NO: 2089536 - DNA, 20 bp, Homo sapiens
tgtaacaggtctcctcttaa

SEQ ID NO: 2089537 - DNA, 15 bp, Homo sapiens
tgtaacatagattta

SEQ ID NO: 2089538 - DNA, 13 bp, Homo sapiens
tgtaacttcaaat

SEQ ID NO: 2089539 - DNA, 15 bp, Homo sapiens
tgtaacttttgtaag

SEQ ID NO: 2089540 - DNA, 15 bp, Homo sapiens
tgtaagaaaatttga

SEQ ID NO: 2089541 - DNA, 13 bp, Homo sapiens
tgtaagagaattc

SEQ ID NO: 2089542 - DNA, 16 bp, Homo sapiens
tgtaagcaacttgctt

SEQ ID NO: 2089543 - DNA, 17 bp, Homo sapiens
tgtaagcaacttgcttc

SEQ ID NO: 2089544 - DNA, 21 bp, Homo sapiens
tgtaagcaacttgcttctaaa

SEQ ID NO: 2089545 - DNA, 22 bp, Homo sapiens
tgtaagcattctgagctgggct

SEQ ID NO: 2089546 - DNA, 21 bp, Homo sapiens
tgtaaggaactggaacacaca

SEQ ID NO: 2089547 - DNA, 13 bp, Homo sapiens
tgtaagggaaact

SEQ ID NO: 2089548 - DNA, 21 bp, Homo sapiens
tgtaagggtctgttgtaaatg

SEQ ID NO: 2089549 - DNA, 23 bp, Homo sapiens
tgtaaggtcttcttgtgtcctga

SEQ ID NO: 2089550 - DNA, 20 bp, Homo sapiens
tgtaataaaaatttgtttaa

SEQ ID NO: 2089551 - DNA, 13 bp, Homo sapiens
tgtaataaaaggt

SEQ ID NO: 2089552 - DNA, 12 bp, Homo sapiens
tgtaataaactc

SEQ ID NO: 2089553 - DNA, 17 bp, Homo sapiens
tgtaataaactctctag

SEQ ID NO: 2089554 - DNA, 23 bp, Homo sapiens
tgtaataagaaagtataaagtca

SEQ ID NO: 2089555 - DNA, 16 bp, Homo sapiens
tgtaatagaaaactga

SEQ ID NO: 2089556 - DNA, 17 bp, Homo sapiens
tgtaatcatataataaa

SEQ ID NO: 2089557 - DNA, 23 bp, Homo sapiens
tgtaatcccagctactcaggagg

SEQ ID NO: 2089558 - DNA, 19 bp, Homo sapiens
tgtaatcctgtatattatg

SEQ ID NO: 2089559 - DNA, 22 bp, Homo sapiens
tgtaatcctgtatattatggtg

SEQ ID NO: 2089560 - DNA, 16 bp, Homo sapiens
tgtaatcgttatgtgt

SEQ ID NO: 2089561 - DNA, 13 bp, Homo sapiens
tgtaatgatcata

SEQ ID NO: 2089562 - DNA, 13 bp, Homo sapiens
tgtaatgcacaat

SEQ ID NO: 2089563 - DNA, 14 bp, Homo sapiens
tgtaatgcacaatt

SEQ ID NO: 2089564 - DNA, 15 bp, Homo sapiens
tgtaatgcacaattt

SEQ ID NO: 2089565 - DNA, 16 bp, Homo sapiens
tgtaatgcacaattta

SEQ ID NO: 2089566 - DNA, 22 bp, Homo sapiens
tgtaatgcacaatttagaaaac

SEQ ID NO: 2089567 - DNA, 14 bp, Homo sapiens
tgtaatgtatctta

SEQ ID NO: 2089568 - DNA, 17 bp, Homo sapiens
tgtaatgtatcttattt

SEQ ID NO: 2089569 - DNA, 14 bp, Homo sapiens
tgtaattaagtgca

SEQ ID NO: 2089570 - DNA, 13 bp, Homo sapiens
tgtaattcagaaa

SEQ ID NO: 2089571 - DNA, 14 bp, Homo sapiens
tgtaattctaaatg

SEQ ID NO: 2089572 - DNA, 15 bp, Homo sapiens
tgtaattgaataaag

SEQ ID NO: 2089573 - DNA, 18 bp, Homo sapiens
tgtaattgcttacatttt

SEQ ID NO: 2089574 - DNA, 21 bp, Homo sapiens
tgtaattttttaaatgaaaat

SEQ ID NO: 2089575 - DNA, 15 bp, Homo sapiens
tgtacaaaaacaaaa

SEQ ID NO: 2089576 - DNA, 13 bp, Homo sapiens
tgtacaaaataaa

SEQ ID NO: 2089577 - DNA, 22 bp, Homo sapiens
tgtacaaaataaacaaataaca

SEQ ID NO: 2089578 - DNA, 17 bp, Homo sapiens
tgtacaaagtagagaag

SEQ ID NO: 2089579 - DNA, 18 bp, Homo sapiens
tgtacaaagtagagaagt

SEQ ID NO: 2089580 - DNA, 19 bp, Homo sapiens
tgtacaaagtagagaagta

SEQ ID NO: 2089581 - DNA, 23 bp, Homo sapiens
tgtacaagttttgtataaataat

SEQ ID NO: 2089582 - DNA, 21 bp, Homo sapiens
tgtacaatacataactagttt

SEQ ID NO: 2089583 - DNA, 14 bp, Homo sapiens
tgtacaatatttaa

SEQ ID NO: 2089584 - DNA, 15 bp, Homo sapiens
tgtacaatatttaaa

SEQ ID NO: 2089585 - DNA, 23 bp, Homo sapiens
tgtacaattgaacttaaataaat

SEQ ID NO: 2089586 - DNA, 17 bp, Homo sapiens
tgtacacgtgtcctgta

SEQ ID NO: 2089587 - DNA, 21 bp, Homo sapiens
tgtacagaattctgctacctc

SEQ ID NO: 2089588 - DNA, 13 bp, Homo sapiens
tgtacagaatttt

SEQ ID NO: 2089589 - DNA, 18 bp, Homo sapiens
tgtacagacgtatgctta

SEQ ID NO: 2089590 - DNA, 13 bp, Homo sapiens
tgtacagcatgca

SEQ ID NO: 2089591 - DNA, 16 bp, Homo sapiens
tgtacagtggagaaat

SEQ ID NO: 2089592 - DNA, 19 bp, Homo sapiens
tgtacagtgtgtaaagtgt

SEQ ID NO: 2089593 - DNA, 14 bp, Homo sapiens
tgtacagttataca

SEQ ID NO: 2089594 - DNA, 17 bp, Homo sapiens
tgtacagttatctaagt

SEQ ID NO: 2089595 - DNA, 21 bp, Homo sapiens
tgtacagttatctaagttaat

SEQ ID NO: 2089596 - DNA, 22 bp, Homo sapiens
tgtacatatggaaatcctgtta

SEQ ID NO: 2089597 - DNA, 19 bp, Homo sapiens
tgtacatatgtaaaataaa

SEQ ID NO: 2089598 - DNA, 14 bp, Homo sapiens
tgtacatgcattca

SEQ ID NO: 2089599 - DNA, 20 bp, Homo sapiens
tgtacatgtgtagcctgtgc

SEQ ID NO: 2089600 - DNA, 14 bp, Homo sapiens
tgtacattaattac

SEQ ID NO: 2089601 - DNA, 15 bp, Homo sapiens
tgtacattctaaaat

SEQ ID NO: 2089602 - DNA, 18 bp, Homo sapiens
tgtacattggtctttcta

SEQ ID NO: 2089603 - DNA, 17 bp, Homo sapiens
tgtaccaggtcattctt

SEQ ID NO: 2089604 - DNA, 15 bp, Homo sapiens
tgtaccagtgtactg

SEQ ID NO: 2089605 - DNA, 13 bp, Homo sapiens
tgtaccagtgtga

SEQ ID NO: 2089606 - DNA, 14 bp, Homo sapiens
tgtaccagtgtgaa

SEQ ID NO: 2089607 - DNA, 12 bp, Homo sapiens
tgtaccatcaat

SEQ ID NO: 2089608 - DNA, 17 bp, Homo sapiens
tgtaccatgttaaagag

SEQ ID NO: 2089609 - DNA, 16 bp, Homo sapiens
tgtacccactcctcac

SEQ ID NO: 2089610 - DNA, 21 bp, Homo sapiens
tgtacccactcctcactgccc

SEQ ID NO: 2089611 - DNA, 20 bp, Homo sapiens
tgtaccgcgtctaccctggg

SEQ ID NO: 2089612 - DNA, 22 bp, Homo sapiens
tgtaccgcgtctaccctgggat

SEQ ID NO: 2089613 - DNA, 15 bp, Homo sapiens
tgtacgaacccctcc

SEQ ID NO: 2089614 - DNA, 16 bp, Homo sapiens
tgtacgtctgacaggc

SEQ ID NO: 2089615 - DNA, 17 bp, Homo sapiens
tgtacgtctgacaggca

SEQ ID NO: 2089616 - DNA, 12 bp, Homo sapiens
tgtactatgtta

SEQ ID NO: 2089617 - DNA, 12 bp, Homo sapiens
tgtactgaaaaa

SEQ ID NO: 2089618 - DNA, 20 bp, Homo sapiens
tgtactgagccttgtaattc

SEQ ID NO: 2089619 - DNA, 15 bp, Homo sapiens
tgtactgtaattttg

SEQ ID NO: 2089620 - DNA, 22 bp, Homo sapiens
tgtactgtaattttgtttgtaa

SEQ ID NO: 2089621 - DNA, 13 bp, Homo sapiens
tgtactgtatgca

SEQ ID NO: 2089622 - DNA, 20 bp, Homo sapiens
tgtacttaataaattcagat

SEQ ID NO: 2089623 - DNA, 20 bp, Homo sapiens
tgtacttattttccaataaa

SEQ ID NO: 2089624 - DNA, 21 bp, Homo sapiens
tgtacttattttccaataaaa

SEQ ID NO: 2089625 - DNA, 14 bp, Homo sapiens
tgtacttcaagtta

SEQ ID NO: 2089626 - DNA, 19 bp, Homo sapiens
tgtacttcctgtgtactct

SEQ ID NO: 2089627 - DNA, 15 bp, Homo sapiens
tgtagaaatctgtaa

SEQ ID NO: 2089628 - DNA, 15 bp, Homo sapiens
tgtagaataaatgaa

SEQ ID NO: 2089629 - DNA, 18 bp, Homo sapiens
tgtagaatgatttcatgc

SEQ ID NO: 2089630 - DNA, 16 bp, Homo sapiens
tgtagactatatacat

SEQ ID NO: 2089631 - DNA, 19 bp, Homo sapiens
tgtagactatatacatgtg

SEQ ID NO: 2089632 - DNA, 22 bp, Homo sapiens
tgtagactatatacatgtgtgt

SEQ ID NO: 2089633 - DNA, 18 bp, Homo sapiens
tgtagacttactttccta

SEQ ID NO: 2089634 - DNA, 14 bp, Homo sapiens
tgtagagcttctgg

SEQ ID NO: 2089635 - DNA, 17 bp, Homo sapiens
tgtagcatttcttgatg

SEQ ID NO: 2089636 - DNA, 12 bp, Homo sapiens
tgtagccagccg

SEQ ID NO: 2089637 - DNA, 15 bp, Homo sapiens
tgtagccagccgggg

SEQ ID NO: 2089638 - DNA, 19 bp, Homo sapiens
tgtagccatggctcaggca

SEQ ID NO: 2089639 - DNA, 14 bp, Homo sapiens
tgtagcctgtgcat

SEQ ID NO: 2089640 - DNA, 20 bp, Homo sapiens
tgtagcctgtgcatgtatgt

SEQ ID NO: 2089641 - DNA, 22 bp, Homo sapiens
tgtagcctgtgcatgtatgtct

SEQ ID NO: 2089642 - DNA, 17 bp, Homo sapiens
tgtagctcctctgctgc

SEQ ID NO: 2089643 - DNA, 14 bp, Homo sapiens
tgtagctctgtcca

SEQ ID NO: 2089644 - DNA, 21 bp, Homo sapiens
tgtagctgatgaaactcctga

SEQ ID NO: 2089645 - DNA, 13 bp, Homo sapiens
tgtagctgtgacc

SEQ ID NO: 2089646 - DNA, 13 bp, Homo sapiens
tgtttaaagttca

SEQ ID NO: 2089647 - DNA, 12 bp, Homo sapiens
tgtttaaataaa

SEQ ID NO: 2089648 - DNA, 14 bp, Homo sapiens
tgtttaaataaagt

SEQ ID NO: 2089649 - DNA, 14 bp, Homo sapiens
tgtttaatatttaa

SEQ ID NO: 2089650 - DNA, 18 bp, Homo sapiens
tgtttacactctttgtaa

SEQ ID NO: 2089651 - DNA, 12 bp, Homo sapiens
tgtttacatatc

SEQ ID NO: 2089652 - DNA, 15 bp, Homo sapiens
tgtttagattccagg

SEQ ID NO: 2089653 - DNA, 15 bp, Homo sapiens
tgtttatataatttt

SEQ ID NO: 2089654 - DNA, 18 bp, Homo sapiens
tgtttatatttaattttt

SEQ ID NO: 2089655 - DNA, 21 bp, Homo sapiens
tgtttatgcaaggaaggaaag

SEQ ID NO: 2089656 - DNA, 12 bp, Homo sapiens
tgtttatttttc

SEQ ID NO: 2089657 - DNA, 14 bp, Homo sapiens
tgtttatttttcat

SEQ ID NO: 2089658 - DNA, 16 bp, Homo sapiens
tgtttatttttcatat

SEQ ID NO: 2089659 - DNA, 18 bp, Homo sapiens
tgtttatttttcatattg

SEQ ID NO: 2089660 - DNA, 14 bp, Homo sapiens
tgtttccagaaaat

SEQ ID NO: 2089661 - DNA, 15 bp, Homo sapiens
tgtttccagaaaata

SEQ ID NO: 2089662 - DNA, 21 bp, Homo sapiens
tgtttccagtacacctttcag

SEQ ID NO: 2089663 - DNA, 20 bp, Homo sapiens
tgtttcccgctccaagagaa

SEQ ID NO: 2089664 - DNA, 11 bp, Homo sapiens
tgtttcctgag

SEQ ID NO: 2089665 - DNA, 12 bp, Homo sapiens
tgtttccttcag

SEQ ID NO: 2089666 - DNA, 15 bp, Homo sapiens
tgtttccttcagtgc

SEQ ID NO: 2089667 - DNA, 15 bp, Homo sapiens
tgtttctaaaactat

SEQ ID NO: 2089668 - DNA, 16 bp, Homo sapiens
tgtttctccccctggg

SEQ ID NO: 2089669 - DNA, 17 bp, Homo sapiens
tgtttctccttctgaaa

SEQ ID NO: 2089670 - DNA, 18 bp, Homo sapiens
tgtttcttgttcatccaa

SEQ ID NO: 2089671 - DNA, 19 bp, Homo sapiens
tgtttggggatgagaaagg

SEQ ID NO: 2089672 - DNA, 15 bp, Homo sapiens
tgtttggggcaggag

SEQ ID NO: 2089673 - DNA, 23 bp, Homo sapiens
tgtttggggcaggagtagctgag

SEQ ID NO: 2089674 - DNA, 15 bp, Homo sapiens
tgtttgtaaattaat

SEQ ID NO: 2089675 - DNA, 13 bp, Homo sapiens
tgtttgtaagatt

SEQ ID NO: 2089676 - DNA, 18 bp, Homo sapiens
tgtttgtagccaatacat

SEQ ID NO: 2089677 - DNA, 15 bp, Homo sapiens
tgtttgtctggattg

SEQ ID NO: 2089678 - DNA, 14 bp, Homo sapiens
tgtttgtgtgagag

SEQ ID NO: 2089679 - DNA, 17 bp, Homo sapiens
tgtttgtttcctttgtt

SEQ ID NO: 2089680 - DNA, 12 bp, Homo sapiens
tgttttaaatta

SEQ ID NO: 2089681 - DNA, 21 bp, Homo sapiens
tgttttaaccagtacttctaa

SEQ ID NO: 2089682 - DNA, 22 bp, Homo sapiens
tgttttaagaggcagggtctca

SEQ ID NO: 2089683 - DNA, 17 bp, Homo sapiens
tgttttacaaatttttc

SEQ ID NO: 2089684 - DNA, 23 bp, Homo sapiens
tgttttattttttattgttttca

SEQ ID NO: 2089685 - DNA, 12 bp, Homo sapiens
tgttttcaaatg

SEQ ID NO: 2089686 - DNA, 20 bp, Homo sapiens
tgttttcatggtgaaaatgt

SEQ ID NO: 2089687 - DNA, 11 bp, Homo sapiens
tgttttccaca

SEQ ID NO: 2089688 - DNA, 15 bp, Homo sapiens
tgttttccactgtgc

SEQ ID NO: 2089689 - DNA, 23 bp, Homo sapiens
tgttttcccgagcaaagtctaaa

SEQ ID NO: 2089690 - DNA, 12 bp, Homo sapiens
tgttttctgaat

SEQ ID NO: 2089691 - DNA, 17 bp, Homo sapiens
tgttttctgaataacat

SEQ ID NO: 2089692 - DNA, 11 bp, Homo sapiens
tgttttctgat

SEQ ID NO: 2089693 - DNA, 17 bp, Homo sapiens
tgttttctgatgacata

SEQ ID NO: 2089694 - DNA, 22 bp, Homo sapiens
tgttttgcacgtcttgctattt

SEQ ID NO: 2089695 - DNA, 13 bp, Homo sapiens
tgttttgcactga

SEQ ID NO: 2089696 - DNA, 15 bp, Homo sapiens
tgttttgtatatgat

SEQ ID NO: 2089697 - DNA, 17 bp, Homo sapiens
tgtttttaaaaatcata

SEQ ID NO: 2089698 - DNA, 15 bp, Homo sapiens
tgtttttaagctgtt

SEQ ID NO: 2089699 - DNA, 13 bp, Homo sapiens
tgtttttcatgaa

SEQ ID NO: 2089700 - DNA, 16 bp, Homo sapiens
tgttttttgaaaacat

SEQ ID NO: 2089701 - DNA, 18 bp, Homo sapiens
tgttttttttttccactt

SEQ ID NO: 2089702 - DNA, 22 bp, Homo sapiens
ttaaaaaaagtatatattctac

SEQ ID NO: 2089703 - DNA, 18 bp, Homo sapiens
ttaaaaaaatcaaaacaa

SEQ ID NO: 2089704 - DNA, 10 bp, Homo sapiens
ttaaaaaagc

SEQ ID NO: 2089705 - DNA, 21 bp, Homo sapiens
ttaaaaaagcttaaaactttg

SEQ ID NO: 2089706 - DNA, 23 bp, Homo sapiens
ttaaaaaataaaaaaatacagta

SEQ ID NO: 2089707 - DNA, 17 bp, Homo sapiens
ttaaaaaataaatataa

SEQ ID NO: 2089708 - DNA, 13 bp, Homo sapiens
ttaaaaaatacac

SEQ ID NO: 2089709 - DNA, 12 bp, Homo sapiens
ttaaaaaatgaa

SEQ ID NO: 2089710 - DNA, 16 bp, Homo sapiens
ttaaaaaatgtccatg

SEQ ID NO: 2089711 - DNA, 23 bp, Homo sapiens
ttaaaaaggaaagaaaactaaca

SEQ ID NO: 2089712 - DNA, 16 bp, Homo sapiens
ttaaaaagtactcttt

SEQ ID NO: 2089713 - DNA, 19 bp, Homo sapiens
ttaaaaataaagctactga

SEQ ID NO: 2089714 - DNA, 23 bp, Homo sapiens
ttaaaacaaggcttaaaagagta

SEQ ID NO: 2089715 - DNA, 14 bp, Homo sapiens
ttaaaacatgcacg

SEQ ID NO: 2089716 - DNA, 13 bp, Homo sapiens
ttaaaaccatgca

SEQ ID NO: 2089717 - DNA, 23 bp, Homo sapiens
ttaaaaccatgcagcttcatcaa

SEQ ID NO: 2089718 - DNA, 22 bp, Homo sapiens
ttaaaactatccaattaaaatt

SEQ ID NO: 2089719 - DNA, 15 bp, Homo sapiens
ttaaaactttgaagt

SEQ ID NO: 2089720 - DNA, 9 bp, Homo sapiens
ttaaaagaa

SEQ ID NO: 2089721 - DNA, 14 bp, Homo sapiens
ttaaaagaagactg

SEQ ID NO: 2089722 - DNA, 14 bp, Homo sapiens
ttaaaagacatttt

SEQ ID NO: 2089723 - DNA, 12 bp, Homo sapiens
ttaaaagagtag

SEQ ID NO: 2089724 - DNA, 14 bp, Homo sapiens
ttaaaagtaaatgt

SEQ ID NO: 2089725 - DNA, 23 bp, Homo sapiens
ttaaaagtgttgattacataatc

SEQ ID NO: 2089726 - DNA, 21 bp, Homo sapiens
ttaaaagttgggaaaagtgtt

SEQ ID NO: 2089727 - DNA, 16 bp, Homo sapiens
ttaaaagtttcaatgt

SEQ ID NO: 2089728 - DNA, 12 bp, Homo sapiens
ttaaaataatat

SEQ ID NO: 2089729 - DNA, 19 bp, Homo sapiens
ttaaaatacacactcaaat

SEQ ID NO: 2089730 - DNA, 21 bp, Homo sapiens
ttaaaatagcaaaagaagaag

SEQ ID NO: 2089731 - DNA, 22 bp, Homo sapiens
ttaaaatagcaacactctatat

SEQ ID NO: 2089732 - DNA, 13 bp, Homo sapiens
ttaaaatatatat

SEQ ID NO: 2089733 - DNA, 12 bp, Homo sapiens
ttaaaatatttt

SEQ ID NO: 2089734 - DNA, 15 bp, Homo sapiens
ttaaaatctggaaat

SEQ ID NO: 2089735 - DNA, 17 bp, Homo sapiens
ttaaaatctggaaatct

SEQ ID NO: 2089736 - DNA, 16 bp, Homo sapiens
ttaaaatgattgtaaa

SEQ ID NO: 2089737 - DNA, 20 bp, Homo sapiens
ttaaacaaaatagaagctgt

SEQ ID NO: 2089738 - DNA, 22 bp, Homo sapiens
ttaaacaaatgtatgattacat

SEQ ID NO: 2089739 - DNA, 14 bp, Homo sapiens
ttaaacacctgaca

SEQ ID NO: 2089740 - DNA, 16 bp, Homo sapiens
ttaaacacctgacaca

SEQ ID NO: 2089741 - DNA, 16 bp, Homo sapiens
ttaaacactgtaatct

SEQ ID NO: 2089742 - DNA, 17 bp, Homo sapiens
ttaaacactgtaatctt

SEQ ID NO: 2089743 - DNA, 19 bp, Homo sapiens
ttaaaccagcagaaaagtg

SEQ ID NO: 2089744 - DNA, 20 bp, Homo sapiens
ttaaaccagcagaaaagtgc

SEQ ID NO: 2089745 - DNA, 18 bp, Homo sapiens
ttaaacctctcttctacc

SEQ ID NO: 2089746 - DNA, 14 bp, Homo sapiens
ttaaaccttttttg

SEQ ID NO: 2089747 - DNA, 16 bp, Homo sapiens
ttaaacgagataatgt

SEQ ID NO: 2089748 - DNA, 18 bp, Homo sapiens
ttaaactgttctgtgtgg

SEQ ID NO: 2089749 - DNA, 16 bp, Homo sapiens
ttaaacttgtcagaat

SEQ ID NO: 2089750 - DNA, 18 bp, Homo sapiens
ttaaagacttaagattaa

SEQ ID NO: 2089751 - DNA, 19 bp, Homo sapiens
ttaaagacttaagattaaa

SEQ ID NO: 2089752 - DNA, 23 bp, Homo sapiens
ttaaagagcatggaaaaatactg

SEQ ID NO: 2089753 - DNA, 19 bp, Homo sapiens
ttaaagaggcgtcttgtat

SEQ ID NO: 2089754 - DNA, 22 bp, Homo sapiens
ttaaagaggcgtcttgtatttt

SEQ ID NO: 2089755 - DNA, 23 bp, Homo sapiens
ttaaagaggcgtcttgtattttc

SEQ ID NO: 2089756 - DNA, 21 bp, Homo sapiens
ttaaagcgtagacatatattt

SEQ ID NO: 2089757 - DNA, 14 bp, Homo sapiens
ttaaagctgcctgt

SEQ ID NO: 2089758 - DNA, 17 bp, Homo sapiens
ttaaagctgcctgtagt

SEQ ID NO: 2089759 - DNA, 18 bp, Homo sapiens
ttaaagctgcctgtagtt

SEQ ID NO: 2089760 - DNA, 22 bp, Homo sapiens
ttaaaggaaaagtcaacatctt

SEQ ID NO: 2089761 - DNA, 15 bp, Homo sapiens
ttaaaggctgtggta

SEQ ID NO: 2089762 - DNA, 12 bp, Homo sapiens
ttatctgcctgg

SEQ ID NO: 2089763 - DNA, 16 bp, Homo sapiens
ttatctgcctggcctg

SEQ ID NO: 2089764 - DNA, 21 bp, Homo sapiens
ttatctgcctggcctggctcc

SEQ ID NO: 2089765 - DNA, 15 bp, Homo sapiens
ttatcttacttttgg

SEQ ID NO: 2089766 - DNA, 16 bp, Homo sapiens
ttatcttggactgaca

SEQ ID NO: 2089767 - DNA, 16 bp, Homo sapiens
ttatctttacttttaa

SEQ ID NO: 2089768 - DNA, 11 bp, Homo sapiens
ttatgaaatgg

SEQ ID NO: 2089769 - DNA, 16 bp, Homo sapiens
ttatgaatgtgcattt

SEQ ID NO: 2089770 - DNA, 19 bp, Homo sapiens
ttatgaatgtgcatttctt

SEQ ID NO: 2089771 - DNA, 23 bp, Homo sapiens
ttatgacatcacttgtacaaaat

SEQ ID NO: 2089772 - DNA, 21 bp, Homo sapiens
ttatgagatgatgaaaataat

SEQ ID NO: 2089773 - DNA, 17 bp, Homo sapiens
ttatgcaaggaaggaaa

SEQ ID NO: 2089774 - DNA, 22 bp, Homo sapiens
ttatgcttaaaatatgtatgtc

SEQ ID NO: 2089775 - DNA, 16 bp, Homo sapiens
ttatggaaatatagtt

SEQ ID NO: 2089776 - DNA, 22 bp, Homo sapiens
ttatggatcccaattcatttca

SEQ ID NO: 2089777 - DNA, 18 bp, Homo sapiens
ttatggcaagtgatatca

SEQ ID NO: 2089778 - DNA, 18 bp, Homo sapiens
ttatggctataggtgcta

SEQ ID NO: 2089779 - DNA, 15 bp, Homo sapiens
ttatgggtcctgcaa

SEQ ID NO: 2089780 - DNA, 22 bp, Homo sapiens
ttatggtattttcgtgcatttg

SEQ ID NO: 2089781 - DNA, 22 bp, Homo sapiens
ttatggtcaatcccaaaagtca

SEQ ID NO: 2089782 - DNA, 13 bp, Homo sapiens
ttatggtgaaatt

SEQ ID NO: 2089783 - DNA, 17 bp, Homo sapiens
ttatggtgtgttcctaa

SEQ ID NO: 2089784 - DNA, 13 bp, Homo sapiens
ttatggtttctgc

SEQ ID NO: 2089785 - DNA, 16 bp, Homo sapiens
ttatgtatatagatgt

SEQ ID NO: 2089786 - DNA, 13 bp, Homo sapiens
ttatgtctaaaga

SEQ ID NO: 2089787 - DNA, 19 bp, Homo sapiens
ttatgtctcaaaataagtt

SEQ ID NO: 2089788 - DNA, 17 bp, Homo sapiens
ttatgtgacaacctttg

SEQ ID NO: 2089789 - DNA, 19 bp, Homo sapiens
ttatgtgacaacctttgtg

SEQ ID NO: 2089790 - DNA, 17 bp, Homo sapiens
ttatgtgtgcatgtgtg

SEQ ID NO: 2089791 - DNA, 12 bp, Homo sapiens
ttatgtgtgtat

SEQ ID NO: 2089792 - DNA, 12 bp, Homo sapiens
ttattaaataaa

SEQ ID NO: 2089793 - DNA, 19 bp, Homo sapiens
ttattaacaaattatgtta

SEQ ID NO: 2089794 - DNA, 16 bp, Homo sapiens
ttattaataccaaata

SEQ ID NO: 2089795 - DNA, 15 bp, Homo sapiens
ttattaatgaactgt

SEQ ID NO: 2089796 - DNA, 16 bp, Homo sapiens
ttattacatttataca

SEQ ID NO: 2089797 - DNA, 18 bp, Homo sapiens
ttattacatttatacatc

SEQ ID NO: 2089798 - DNA, 15 bp, Homo sapiens
ttattacctctgata

SEQ ID NO: 2089799 - DNA, 12 bp, Homo sapiens
ttattagctgta

SEQ ID NO: 2089800 - DNA, 14 bp, Homo sapiens
ttattatcctgcat

SEQ ID NO: 2089801 - DNA, 19 bp, Homo sapiens
ttattcaattctgtataga

SEQ ID NO: 2089802 - DNA, 15 bp, Homo sapiens
ttattcactgtaagt

SEQ ID NO: 2089803 - DNA, 15 bp, Homo sapiens
ttattcagcttcatt

SEQ ID NO: 2089804 - DNA, 12 bp, Homo sapiens
ttattcattcag

SEQ ID NO: 2089805 - DNA, 18 bp, Homo sapiens
ttattcatttaaaatgat

SEQ ID NO: 2089806 - DNA, 20 bp, Homo sapiens
ttattcatttaaaatgatta

SEQ ID NO: 2089807 - DNA, 18 bp, Homo sapiens
ttattccccatcttccaa

SEQ ID NO: 2089808 - DNA, 20 bp, Homo sapiens
ttattccccattcttcctag

SEQ ID NO: 2089809 - DNA, 22 bp, Homo sapiens
ttattcctatatagtttattga

SEQ ID NO: 2089810 - DNA, 17 bp, Homo sapiens
ttattcctgataataat

SEQ ID NO: 2089811 - DNA, 17 bp, Homo sapiens
ttattctcactccacca

SEQ ID NO: 2089812 - DNA, 16 bp, Homo sapiens
ttattctttttaaagt

SEQ ID NO: 2089813 - DNA, 19 bp, Homo sapiens
ttattgaagatttaccata

SEQ ID NO: 2089814 - DNA, 14 bp, Homo sapiens
ttattgacaataat

SEQ ID NO: 2089815 - DNA, 15 bp, Homo sapiens
ttattgcccacgctg

SEQ ID NO: 2089816 - DNA, 14 bp, Homo sapiens
ttattgcttaatcc

SEQ ID NO: 2089817 - DNA, 23 bp, Homo sapiens
ttattgcttgatacttttgacaa

SEQ ID NO: 2089818 - DNA, 14 bp, Homo sapiens
ttattggaccagaa

SEQ ID NO: 2089819 - DNA, 20 bp, Homo sapiens
ttattggcctgctaatagct

SEQ ID NO: 2089820 - DNA, 20 bp, Homo sapiens
ttattgggcaagtgattgaa

SEQ ID NO: 2089821 - DNA, 12 bp, Homo sapiens
ttattgtacctc

SEQ ID NO: 2089822 - DNA, 15 bp, Homo sapiens
ttattgtacctctct

SEQ ID NO: 2089823 - DNA, 17 bp, Homo sapiens
ttattgtacctctctta

SEQ ID NO: 2089824 - DNA, 14 bp, Homo sapiens
ttattgtataaact

SEQ ID NO: 2089825 - DNA, 21 bp, Homo sapiens
ttattgtataaactatcagtt

SEQ ID NO: 2089826 - DNA, 21 bp, Homo sapiens
ttatttaaaatagcaaaagaa

SEQ ID NO: 2089827 - DNA, 13 bp, Homo sapiens
ttatttaaatgtt

SEQ ID NO: 2089828 - DNA, 15 bp, Homo sapiens
ttatttaagaataaa

SEQ ID NO: 2089829 - DNA, 20 bp, Homo sapiens
ttatttaagaataaagtctt

SEQ ID NO: 2089830 - DNA, 14 bp, Homo sapiens
ttatttaataacaa

SEQ ID NO: 2089831 - DNA, 12 bp, Homo sapiens
ttatttaatgtt

SEQ ID NO: 2089832 - DNA, 13 bp, Homo sapiens
ttatttaatgttt

SEQ ID NO: 2089833 - DNA, 14 bp, Homo sapiens
ttatttaattaaaa

SEQ ID NO: 2089834 - DNA, 14 bp, Homo sapiens
ttatttacttgaaa

SEQ ID NO: 2089835 - DNA, 20 bp, Homo sapiens
ttatttagttgaaaaatcta

SEQ ID NO: 2089836 - DNA, 14 bp, Homo sapiens
ttatttatagtcat

SEQ ID NO: 2089837 - DNA, 14 bp, Homo sapiens
ttatttatatatga

SEQ ID NO: 2089838 - DNA, 18 bp, Homo sapiens
ttatttatcagtgacaga

SEQ ID NO: 2089839 - DNA, 14 bp, Homo sapiens
ttatttatttaata

SEQ ID NO: 2089840 - DNA, 13 bp, Homo sapiens
ttatttatttctg

SEQ ID NO: 2089841 - DNA, 22 bp, Homo sapiens
ttatttcaaccgcttgccatat

SEQ ID NO: 2089842 - DNA, 14 bp, Homo sapiens
ttatttcatccagt

SEQ ID NO: 2089843 - DNA, 14 bp, Homo sapiens
ttatttctgtaaaa

SEQ ID NO: 2089844 - DNA, 13 bp, Homo sapiens
ttatttctttgtg

SEQ ID NO: 2089845 - DNA, 16 bp, Homo sapiens
ttatttgtaatagatg

SEQ ID NO: 2089846 - DNA, 14 bp, Homo sapiens
ttatttgtacagtt

SEQ ID NO: 2089847 - DNA, 15 bp, Homo sapiens
ttatttgtacagttc

SEQ ID NO: 2089848 - DNA, 13 bp, Homo sapiens
ttatttgtgtaat

SEQ ID NO: 2089849 - DNA, 18 bp, Homo sapiens
ttatttgttattttcagt

SEQ ID NO: 2089850 - DNA, 19 bp, Homo sapiens
ttatttgttgagagtgtga

SEQ ID NO: 2089851 - DNA, 20 bp, Homo sapiens
ttatttgtttatatttaatt

SEQ ID NO: 2089852 - DNA, 17 bp, Homo sapiens
ttattttaaacaaaata

SEQ ID NO: 2089853 - DNA, 18 bp, Homo sapiens
ttattttaggagacagtc

SEQ ID NO: 2089854 - DNA, 18 bp, Homo sapiens
ttattttcaagaaactga

SEQ ID NO: 2089855 - DNA, 14 bp, Homo sapiens
ttattttcacctgt

SEQ ID NO: 2089856 - DNA, 12 bp, Homo sapiens
ttattttcactg

SEQ ID NO: 2089857 - DNA, 12 bp, Homo sapiens
ttattttcatta

SEQ ID NO: 2089858 - DNA, 14 bp, Homo sapiens
ttattttcattaca

SEQ ID NO: 2089859 - DNA, 13 bp, Homo sapiens
ttattttccaata

SEQ ID NO: 2089860 - DNA, 14 bp, Homo sapiens
ttattttgcactgt

SEQ ID NO: 2089861 - DNA, 14 bp, Homo sapiens
ttattttgtaataa

SEQ ID NO: 2089862 - DNA, 16 bp, Homo sapiens
ttattttgtaataaac

SEQ ID NO: 2089863 - DNA, 22 bp, Homo sapiens
ttattttgtattacatctaatg

SEQ ID NO: 2089864 - DNA, 20 bp, Homo sapiens
ttattttgttgtgattttgt

SEQ ID NO: 2089865 - DNA, 20 bp, Homo sapiens
ttattttgtttaagtggctt

SEQ ID NO: 2089866 - DNA, 23 bp, Homo sapiens
ttatttttgacagtgttgaaaat

SEQ ID NO: 2089867 - DNA, 15 bp, Homo sapiens
ttatttttgtccctg

SEQ ID NO: 2089868 - DNA, 19 bp, Homo sapiens
ttatttttgtccctgctcc

SEQ ID NO: 2089869 - DNA, 23 bp, Homo sapiens
ttatttttgtccctgctcctccc

SEQ ID NO: 2089870 - DNA, 23 bp, Homo sapiens
ttatttttgtttcttccaaagca

SEQ ID NO: 2089871 - DNA, 18 bp, Homo sapiens
ttattttttctacacagt

SEQ ID NO: 2089872 - DNA, 20 bp, Homo sapiens
ttatttttttaagctgtaaa

SEQ ID NO: 2089873 - DNA, 17 bp, Homo sapiens
ttcaaaaaaacactagt

SEQ ID NO: 2089874 - DNA, 21 bp, Homo sapiens
ttcaaaaagtctacgctctcc

SEQ ID NO: 2089875 - DNA, 13 bp, Homo sapiens
ttcaaaaagtgtt

SEQ ID NO: 2089876 - DNA, 21 bp, Homo sapiens
ttcaaaagaatcagaaacagg

SEQ ID NO: 2089877 - DNA, 14 bp, Homo sapiens
ttcaaaagacatgt

SEQ ID NO: 2089878 - DNA, 13 bp, Homo sapiens
ttcgctgccagga

SEQ ID NO: 2089879 - DNA, 20 bp, Homo sapiens
ttcgctgccaggacacctgc

SEQ ID NO: 2089880 - DNA, 21 bp, Homo sapiens
ttcgctgccaggacacctgcc

SEQ ID NO: 2089881 - DNA, 19 bp, Homo sapiens
ttcgctgctagagaagggg

SEQ ID NO: 2089882 - DNA, 15 bp, Homo sapiens
ttcgctgctctagct

SEQ ID NO: 2089883 - DNA, 18 bp, Homo sapiens
ttcgcttgcttctgcagc

SEQ ID NO: 2089884 - DNA, 20 bp, Homo sapiens
ttcggacagtttatttgttg

SEQ ID NO: 2089885 - DNA, 15 bp, Homo sapiens
ttcggatttgacaaa

SEQ ID NO: 2089886 - DNA, 17 bp, Homo sapiens
ttcggggaactcctgga

SEQ ID NO: 2089887 - DNA, 13 bp, Homo sapiens
ttcggggctggga

SEQ ID NO: 2089888 - DNA, 13 bp, Homo sapiens
ttctaaaaaacag

SEQ ID NO: 2089889 - DNA, 14 bp, Homo sapiens
ttctaaaagaatat

SEQ ID NO: 2089890 - DNA, 19 bp, Homo sapiens
ttctaaaatataatcaacc

SEQ ID NO: 2089891 - DNA, 21 bp, Homo sapiens
ttctaaaggtagatcatcttg

SEQ ID NO: 2089892 - DNA, 16 bp, Homo sapiens
ttctaacatatgtatt

SEQ ID NO: 2089893 - DNA, 17 bp, Homo sapiens
ttctaacatatgtatta

SEQ ID NO: 2089894 - DNA, 15 bp, Homo sapiens
ttctaactgtaaatc

SEQ ID NO: 2089895 - DNA, 19 bp, Homo sapiens
ttctaactgtaaatcactt

SEQ ID NO: 2089896 - DNA, 17 bp, Homo sapiens
ttctaagtaaaaccaca

SEQ ID NO: 2089897 - DNA, 20 bp, Homo sapiens
ttctaagtaaaaccacagca

SEQ ID NO: 2089898 - DNA, 21 bp, Homo sapiens
ttctaagtaaaaccacagcag

SEQ ID NO: 2089899 - DNA, 22 bp, Homo sapiens
ttctaatatatttttatattta

SEQ ID NO: 2089900 - DNA, 23 bp, Homo sapiens
ttctaatcttgttaaattgctta

SEQ ID NO: 2089901 - DNA, 14 bp, Homo sapiens
ttctaatgtcttca

SEQ ID NO: 2089902 - DNA, 15 bp, Homo sapiens
ttctacaaccagagc

SEQ ID NO: 2089903 - DNA, 18 bp, Homo sapiens
ttctacaagcatatttga

SEQ ID NO: 2089904 - DNA, 21 bp, Homo sapiens
ttctacaagcatatttgagaa

SEQ ID NO: 2089905 - DNA, 22 bp, Homo sapiens
ttctacacagtaaaaacttgta

SEQ ID NO: 2089906 - DNA, 19 bp, Homo sapiens
ttctacacagtgggaactc

SEQ ID NO: 2089907 - DNA, 18 bp, Homo sapiens
ttctacacatatatgtat

SEQ ID NO: 2089908 - DNA, 15 bp, Homo sapiens
ttctaccatttcaga

SEQ ID NO: 2089909 - DNA, 18 bp, Homo sapiens
ttctacccagagccttct

SEQ ID NO: 2089910 - DNA, 12 bp, Homo sapiens
ttctacccagcg

SEQ ID NO: 2089911 - DNA, 19 bp, Homo sapiens
ttctacccagcgagccctg

SEQ ID NO: 2089912 - DNA, 21 bp, Homo sapiens
ttctacctttttttctctcct

SEQ ID NO: 2089913 - DNA, 13 bp, Homo sapiens
ttctactgtgact

SEQ ID NO: 2089914 - DNA, 19 bp, Homo sapiens
ttctactttgatatgactg

SEQ ID NO: 2089915 - DNA, 15 bp, Homo sapiens
ttctagaggcctcag

SEQ ID NO: 2089916 - DNA, 14 bp, Homo sapiens
ttctagcaactgtt

SEQ ID NO: 2089917 - DNA, 17 bp, Homo sapiens
ttctagctagaaatatg

SEQ ID NO: 2089918 - DNA, 22 bp, Homo sapiens
ttctagctagaaatatgatttt

SEQ ID NO: 2089919 - DNA, 12 bp, Homo sapiens
ttctagctgttg

SEQ ID NO: 2089920 - DNA, 14 bp, Homo sapiens
ttctagctttcaaa

SEQ ID NO: 2089921 - DNA, 17 bp, Homo sapiens
ttctaggtcctggcttc

SEQ ID NO: 2089922 - DNA, 22 bp, Homo sapiens
ttctagtctcctttgcactgag

SEQ ID NO: 2089923 - DNA, 16 bp, Homo sapiens
ttctagtctggtgttc

SEQ ID NO: 2089924 - DNA, 19 bp, Homo sapiens
ttctagtctggtgttctga

SEQ ID NO: 2089925 - DNA, 21 bp, Homo sapiens
ttctagtctggtgttctgagt

SEQ ID NO: 2089926 - DNA, 17 bp, Homo sapiens
ttctagtgatttcctgt

SEQ ID NO: 2089927 - DNA, 18 bp, Homo sapiens
ttctagtgtaacactgca

SEQ ID NO: 2089928 - DNA, 23 bp, Homo sapiens
ttctagttagctgctttaaatct

SEQ ID NO: 2089929 - DNA, 23 bp, Homo sapiens
ttctatagcagattgtgtaacaa

SEQ ID NO: 2089930 - DNA, 14 bp, Homo sapiens
ttctatagccaaaa

SEQ ID NO: 2089931 - DNA, 23 bp, Homo sapiens
ttctatagccaaaaatagctaaa

SEQ ID NO: 2089932 - DNA, 19 bp, Homo sapiens
ttctatagctcttctattt

SEQ ID NO: 2089933 - DNA, 20 bp, Homo sapiens
ttctatagctcttctattta

SEQ ID NO: 2089934 - DNA, 18 bp, Homo sapiens
ttctatataaggaggaaa

SEQ ID NO: 2089935 - DNA, 22 bp, Homo sapiens
ttctatataaggaggaaaacgg

SEQ ID NO: 2089936 - DNA, 14 bp, Homo sapiens
ttctatcacatatt

SEQ ID NO: 2089937 - DNA, 17 bp, Homo sapiens
ttctatcacatatttga

SEQ ID NO: 2089938 - DNA, 22 bp, Homo sapiens
ttctatcactggcaatatttgt

SEQ ID NO: 2089939 - DNA, 23 bp, Homo sapiens
ttctatcctacaacaagagttta

SEQ ID NO: 2089940 - DNA, 20 bp, Homo sapiens
ttctatcttgaatttcatgc

SEQ ID NO: 2089941 - DNA, 22 bp, Homo sapiens
ttctatgaagtctttgttgcac

SEQ ID NO: 2089942 - DNA, 17 bp, Homo sapiens
ttctattctctcctcag

SEQ ID NO: 2089943 - DNA, 15 bp, Homo sapiens
ttctatttttgtaga

SEQ ID NO: 2089944 - DNA, 16 bp, Homo sapiens
ttctcaaagaatctca

SEQ ID NO: 2089945 - DNA, 21 bp, Homo sapiens
ttctcaacaaagcacagtgtt

SEQ ID NO: 2089946 - DNA, 14 bp, Homo sapiens
ttctcaacctacca

SEQ ID NO: 2089947 - DNA, 15 bp, Homo sapiens
ttctcaacctaccac

SEQ ID NO: 2089948 - DNA, 15 bp, Homo sapiens
ttctcaatcagtgca

SEQ ID NO: 2089949 - DNA, 23 bp, Homo sapiens
ttctcaattattggcctgctaat

SEQ ID NO: 2089950 - DNA, 14 bp, Homo sapiens
ttctcactccacca

SEQ ID NO: 2089951 - DNA, 16 bp, Homo sapiens
ttctcactccaccacc

SEQ ID NO: 2089952 - DNA, 18 bp, Homo sapiens
ttctcactcctacctggt

SEQ ID NO: 2089953 - DNA, 13 bp, Homo sapiens
ttctcagaacagc

SEQ ID NO: 2089954 - DNA, 17 bp, Homo sapiens
ttctcagaacagctgaa

SEQ ID NO: 2089955 - DNA, 20 bp, Homo sapiens
ttctcagaatccaaagatca

SEQ ID NO: 2089956 - DNA, 16 bp, Homo sapiens
ttctcaggacacaggc

SEQ ID NO: 2089957 - DNA, 19 bp, Homo sapiens
ttctcaggacacaggcctg

SEQ ID NO: 2089958 - DNA, 17 bp, Homo sapiens
ttctcagggggtcagca

SEQ ID NO: 2089959 - DNA, 24 bp, Homo sapiens
ttctcataggaaaagtacatttaa

SEQ ID NO: 2089960 - DNA, 16 bp, Homo sapiens
ttctcatcatattgta

SEQ ID NO: 2089961 - DNA, 20 bp, Homo sapiens
ttctcatcatattgtatgta

SEQ ID NO: 2089962 - DNA, 20 bp, Homo sapiens
ttctcatgatttacagagaa

SEQ ID NO: 2089963 - DNA, 14 bp, Homo sapiens
ttctcatgtctcag

SEQ ID NO: 2089964 - DNA, 16 bp, Homo sapiens
ttctccaagagctaca

SEQ ID NO: 2089965 - DNA, 11 bp, Homo sapiens
ttctccaggct

SEQ ID NO: 2089966 - DNA, 18 bp, Homo sapiens
ttctccatctggcagggt

SEQ ID NO: 2089967 - DNA, 17 bp, Homo sapiens
ttctccccctgggctct

SEQ ID NO: 2089968 - DNA, 18 bp, Homo sapiens
ttctccccctgggctctg

SEQ ID NO: 2089969 - DNA, 13 bp, Homo sapiens
ttctccctcaccc

SEQ ID NO: 2089970 - DNA, 23 bp, Homo sapiens
ttctccgactgctagggagtggt

SEQ ID NO: 2089971 - DNA, 17 bp, Homo sapiens
ttctccggggtctgtgc

SEQ ID NO: 2089972 - DNA, 17 bp, Homo sapiens
ttctccgggtgtggcct

SEQ ID NO: 2089973 - DNA, 21 bp, Homo sapiens
ttctcctgggcccgctttgcc

SEQ ID NO: 2089974 - DNA, 16 bp, Homo sapiens
ttctcctgtcagagat

SEQ ID NO: 2089975 - DNA, 14 bp, Homo sapiens
ttctcctgtttaca

SEQ ID NO: 2089976 - DNA, 16 bp, Homo sapiens
ttctcctttattgctc

SEQ ID NO: 2089977 - DNA, 13 bp, Homo sapiens
ttctcgggaaatt

SEQ ID NO: 2089978 - DNA, 20 bp, Homo sapiens
ttctctaaaatagccactta

SEQ ID NO: 2089979 - DNA, 20 bp, Homo sapiens
ttctctacagacttctccag

SEQ ID NO: 2089980 - DNA, 21 bp, Homo sapiens
ttctctagctgatcagaattt

SEQ ID NO: 2089981 - DNA, 16 bp, Homo sapiens
ttctctctcctgtcca

SEQ ID NO: 2089982 - DNA, 12 bp, Homo sapiens
ttctctggctcc

SEQ ID NO: 2089983 - DNA, 15 bp, Homo sapiens
ttctctggctccaga

SEQ ID NO: 2089984 - DNA, 16 bp, Homo sapiens
ttctctggctccagaa

SEQ ID NO: 2089985 - DNA, 23 bp, Homo sapiens
ttctctgggtaggtgttgaaaat

SEQ ID NO: 2089986 - DNA, 12 bp, Homo sapiens
ttctctgtgaac

SEQ ID NO: 2089987 - DNA, 18 bp, Homo sapiens
ttctctgtgcccctgtaa

SEQ ID NO: 2089988 - DNA, 22 bp, Homo sapiens
ttctcttacgctctctgtctgg

SEQ ID NO: 2089989 - DNA, 18 bp, Homo sapiens
ttctcttcactcccaata

SEQ ID NO: 2089990 - DNA, 21 bp, Homo sapiens
ttctctttcttattttgtaat

SEQ ID NO: 2089991 - DNA, 14 bp, Homo sapiens
ttctgaactcaagc

SEQ ID NO: 2089992 - DNA, 19 bp, Homo sapiens
ttggaagagaggcacctgc

SEQ ID NO: 2089993 - DNA, 17 bp, Homo sapiens
ttggaagctctgaagtc

SEQ ID NO: 2089994 - DNA, 20 bp, Homo sapiens
ttggaagtcgtttcaggaca

SEQ ID NO: 2089995 - DNA, 20 bp, Homo sapiens
ttggaagtgtgtggaaggca

SEQ ID NO: 2089996 - DNA, 21 bp, Homo sapiens
ttggaagtgttcaagaaataa

SEQ ID NO: 2089997 - DNA, 16 bp, Homo sapiens
ttggaataataatttt

SEQ ID NO: 2089998 - DNA, 21 bp, Homo sapiens
ttggaatgactataaacatta

SEQ ID NO: 2089999 - DNA, 13 bp, Homo sapiens
ttggacaaaatgg

SEQ ID NO: 2090000 - DNA, 17 bp, Homo sapiens
ttggacacactgtaaac

SEQ ID NO: 2090001 - DNA, 16 bp, Homo sapiens
ttggacagctgcttgt

SEQ ID NO: 2090002 - DNA, 15 bp, Homo sapiens
ttggacccgctctgg

SEQ ID NO: 2090003 - DNA, 18 bp, Homo sapiens
ttggagaaaatgaagaaa

SEQ ID NO: 2090004 - DNA, 15 bp, Homo sapiens
ttggagactctgtgg

SEQ ID NO: 2090005 - DNA, 13 bp, Homo sapiens
ttggagagcagct

SEQ ID NO: 2090006 - DNA, 14 bp, Homo sapiens
ttggagagcagctg

SEQ ID NO: 2090007 - DNA, 19 bp, Homo sapiens
ttggagagggacgaagaaa

SEQ ID NO: 2090008 - DNA, 13 bp, Homo sapiens
ttggagagtaaaa

SEQ ID NO: 2090009 - DNA, 12 bp, Homo sapiens
ttggagccactc

SEQ ID NO: 2090010 - DNA, 20 bp, Homo sapiens
ttggagccactcctgtcccg

SEQ ID NO: 2090011 - DNA, 16 bp, Homo sapiens
ttggaggcctttagat

SEQ ID NO: 2090012 - DNA, 22 bp, Homo sapiens
ttggataatgctgttgcctcat

SEQ ID NO: 2090013 - DNA, 19 bp, Homo sapiens
ttggatatgtaaaacattt

SEQ ID NO: 2090014 - DNA, 20 bp, Homo sapiens
ttggatgggagtgagacaga

SEQ ID NO: 2090015 - DNA, 14 bp, Homo sapiens
ttggatgtggagct

SEQ ID NO: 2090016 - DNA, 16 bp, Homo sapiens
ttggcaatagtttgca

SEQ ID NO: 2090017 - DNA, 23 bp, Homo sapiens
ttggcacagaaacacaatatttt

SEQ ID NO: 2090018 - DNA, 14 bp, Homo sapiens
ttggcagagaggac

SEQ ID NO: 2090019 - DNA, 14 bp, Homo sapiens
ttggcagtgtgtca

SEQ ID NO: 2090020 - DNA, 24 bp, Homo sapiens
ttggccaaagccaaagctaggcct

SEQ ID NO: 2090021 - DNA, 15 bp, Homo sapiens
ttggccaaagtgtta

SEQ ID NO: 2090022 - DNA, 23 bp, Homo sapiens
ttggccaatgcacctaaagaaaa

SEQ ID NO: 2090023 - DNA, 13 bp, Homo sapiens
ttggcccaatgcc

SEQ ID NO: 2090024 - DNA, 19 bp, Homo sapiens
ttggccgccatccgggacg

SEQ ID NO: 2090025 - DNA, 22 bp, Homo sapiens
ttggccgggtgcggtggctcac

SEQ ID NO: 2090026 - DNA, 13 bp, Homo sapiens
ttggcctcgcctg

SEQ ID NO: 2090027 - DNA, 21 bp, Homo sapiens
ttggcctcgcctgggcccagg

SEQ ID NO: 2090028 - DNA, 24 bp, Homo sapiens
ttggcctggtggccatgtcgcctg

SEQ ID NO: 2090029 - DNA, 23 bp, Homo sapiens
ttggcgatgaggtaattctccct

SEQ ID NO: 2090030 - DNA, 14 bp, Homo sapiens
ttggctcaatcctc

SEQ ID NO: 2090031 - DNA, 14 bp, Homo sapiens
ttggctctttcaga

SEQ ID NO: 2090032 - DNA, 13 bp, Homo sapiens
ttggctgcaggga

SEQ ID NO: 2090033 - DNA, 20 bp, Homo sapiens
ttggctgcgctaacccccag

SEQ ID NO: 2090034 - DNA, 23 bp, Homo sapiens
ttggctggatgaaattttctaga

SEQ ID NO: 2090035 - DNA, 21 bp, Homo sapiens
ttggctgggggcctcagtgcc

SEQ ID NO: 2090036 - DNA, 18 bp, Homo sapiens
ttggctgggtgttttcaa

SEQ ID NO: 2090037 - DNA, 16 bp, Homo sapiens
ttggcttcctccgtcc

SEQ ID NO: 2090038 - DNA, 15 bp, Homo sapiens
ttggcttctcctgtg

SEQ ID NO: 2090039 - DNA, 16 bp, Homo sapiens
ttggcttctcctgtga

SEQ ID NO: 2090040 - DNA, 17 bp, Homo sapiens
ttggcttctcctgtgac

SEQ ID NO: 2090041 - DNA, 19 bp, Homo sapiens
ttggcttctcctgtgaccc

SEQ ID NO: 2090042 - DNA, 18 bp, Homo sapiens
ttgggaatggatcctgga

SEQ ID NO: 2090043 - DNA, 11 bp, Homo sapiens
ttgggagcact

SEQ ID NO: 2090044 - DNA, 15 bp, Homo sapiens
ttgggagcactggag

SEQ ID NO: 2090045 - DNA, 19 bp, Homo sapiens
ttgggagcttgggaatgga

SEQ ID NO: 2090046 - DNA, 18 bp, Homo sapiens
ttgggagggacagggctt

SEQ ID NO: 2090047 - DNA, 23 bp, Homo sapiens
ttgggagggatgagagtggctta

SEQ ID NO: 2090048 - DNA, 22 bp, Homo sapiens
ttgggaggttttattctgactt

SEQ ID NO: 2090049 - DNA, 17 bp, Homo sapiens
ttgggatttatatctat

SEQ ID NO: 2090050 - DNA, 17 bp, Homo sapiens
ttgggcacccccagcct

SEQ ID NO: 2090051 - DNA, 21 bp, Homo sapiens
ttgggcacccccagcctgggc

SEQ ID NO: 2090052 - DNA, 23 bp, Homo sapiens
ttgggcacccccagcctgggcct

SEQ ID NO: 2090053 - DNA, 15 bp, Homo sapiens
ttgggccctgcacag

SEQ ID NO: 2090054 - DNA, 12 bp, Homo sapiens
ttgggcctcccc

SEQ ID NO: 2090055 - DNA, 20 bp, Homo sapiens
ttgggctactggcagctcct

SEQ ID NO: 2090056 - DNA, 19 bp, Homo sapiens
ttgggctcctggctgccag

SEQ ID NO: 2090057 - DNA, 22 bp, Homo sapiens
ttgggctgacacctaccatgct

SEQ ID NO: 2090058 - DNA, 23 bp, Homo sapiens
ttgggctgacacctaccatgctg

SEQ ID NO: 2090059 - DNA, 13 bp, Homo sapiens
ttggggaccagag

SEQ ID NO: 2090060 - DNA, 22 bp, Homo sapiens
ttggggcaggagtagctgagct

SEQ ID NO: 2090061 - DNA, 12 bp, Homo sapiens
ttggggcctggc

SEQ ID NO: 2090062 - DNA, 15 bp, Homo sapiens
ttggggcctggcttg

SEQ ID NO: 2090063 - DNA, 21 bp, Homo sapiens
ttgggtgtaacaggtctcctc

SEQ ID NO: 2090064 - DNA, 22 bp, Homo sapiens
ttgggttcaagcgattcttctg

SEQ ID NO: 2090065 - DNA, 18 bp, Homo sapiens
ttggtaggcttatcaaaa

SEQ ID NO: 2090066 - DNA, 16 bp, Homo sapiens
ttggtatcaagaaagt

SEQ ID NO: 2090067 - DNA, 17 bp, Homo sapiens
ttggtatcaagaaagtc

SEQ ID NO: 2090068 - DNA, 13 bp, Homo sapiens
ttggtccctgggg

SEQ ID NO: 2090069 - DNA, 15 bp, Homo sapiens
ttggtccctggtccc

SEQ ID NO: 2090070 - DNA, 23 bp, Homo sapiens
ttggtcctgtcaccctggcccca

SEQ ID NO: 2090071 - DNA, 18 bp, Homo sapiens
ttggtctctatttcattt

SEQ ID NO: 2090072 - DNA, 20 bp, Homo sapiens
ttggtctgacccactgcttt

SEQ ID NO: 2090073 - DNA, 15 bp, Homo sapiens
ttggtcttatttatt

SEQ ID NO: 2090074 - DNA, 19 bp, Homo sapiens
ttggtcttatttattattg

SEQ ID NO: 2090075 - DNA, 15 bp, Homo sapiens
ttggtgataagtgga

SEQ ID NO: 2090076 - DNA, 17 bp, Homo sapiens
ttggtgataagtggaaa

SEQ ID NO: 2090077 - DNA, 20 bp, Homo sapiens
ttggtgcagaggtttcttga

SEQ ID NO: 2090078 - DNA, 12 bp, Homo sapiens
ttggtgcctggc

SEQ ID NO: 2090079 - DNA, 13 bp, Homo sapiens
ttggtggctgagc

SEQ ID NO: 2090080 - DNA, 13 bp, Homo sapiens
ttggtgggctggc

SEQ ID NO: 2090081 - DNA, 17 bp, Homo sapiens
ttggtgggctggcccag

SEQ ID NO: 2090082 - DNA, 20 bp, Homo sapiens
ttggtgtaaagccaacaccc

SEQ ID NO: 2090083 - DNA, 18 bp, Homo sapiens
ttggtgtaggtaaatcta

SEQ ID NO: 2090084 - DNA, 21 bp, Homo sapiens
ttggtgtggctgtattcagat

SEQ ID NO: 2090085 - DNA, 13 bp, Homo sapiens
ttggtgttgacat

SEQ ID NO: 2090086 - DNA, 13 bp, Homo sapiens
ttggttagctgga

SEQ ID NO: 2090087 - DNA, 14 bp, Homo sapiens
ttggttcccttgtg

SEQ ID NO: 2090088 - DNA, 15 bp, Homo sapiens
ttggttctaatagaa

SEQ ID NO: 2090089 - DNA, 16 bp, Homo sapiens
ttggttctctccagga

SEQ ID NO: 2090090 - DNA, 12 bp, Homo sapiens
ttggttgtcaat

SEQ ID NO: 2090091 - DNA, 13 bp, Homo sapiens
ttggtttaagcag

SEQ ID NO: 2090092 - DNA, 19 bp, Homo sapiens
ttggtttggacacagtgtt

SEQ ID NO: 2090093 - DNA, 21 bp, Homo sapiens
ttggttttgctacataattat

SEQ ID NO: 2090094 - DNA, 20 bp, Homo sapiens
ttgtaaaacctgtcaatgat

SEQ ID NO: 2090095 - DNA, 14 bp, Homo sapiens
ttgtaaaactacac

SEQ ID NO: 2090096 - DNA, 21 bp, Homo sapiens
ttgtaaaagaacagtaaacat

SEQ ID NO: 2090097 - DNA, 23 bp, Homo sapiens
ttgtaaaagaacagtaaacattg

SEQ ID NO: 2090098 - DNA, 16 bp, Homo sapiens
ttgtaaacagaaggag

SEQ ID NO: 2090099 - DNA, 15 bp, Homo sapiens
ttgtaaaggtcagag

SEQ ID NO: 2090100 - DNA, 20 bp, Homo sapiens
ttgtaaaggtcagagtcaaa

SEQ ID NO: 2090101 - DNA, 14 bp, Homo sapiens
ttgtaaataaaagt

SEQ ID NO: 2090102 - DNA, 21 bp, Homo sapiens
ttgtaaataaaagtatttaat

SEQ ID NO: 2090103 - DNA, 15 bp, Homo sapiens
ttgtaaataaataga

SEQ ID NO: 2090104 - DNA, 17 bp, Homo sapiens
ttgtaaataaatagatt

SEQ ID NO: 2090105 - DNA, 20 bp, Homo sapiens
ttgtaaataagtgaaaataa

SEQ ID NO: 2090106 - DNA, 11 bp, Homo sapiens
ttgtaaataca

SEQ ID NO: 2090107 - DNA, 24 bp, Homo sapiens
tttattagctgtaaatacatgtgt

SEQ ID NO: 2090108 - DNA, 14 bp, Homo sapiens
tttattattgaaga

SEQ ID NO: 2090109 - DNA, 17 bp, Homo sapiens
tttattattttcacctg

SEQ ID NO: 2090110 - DNA, 17 bp, Homo sapiens
tttattcaagttattgt

SEQ ID NO: 2090111 - DNA, 22 bp, Homo sapiens
tttattcagcttcatttgtgtc

SEQ ID NO: 2090112 - DNA, 16 bp, Homo sapiens
tttattcattagctgt

SEQ ID NO: 2090113 - DNA, 13 bp, Homo sapiens
tttattctgtttt

SEQ ID NO: 2090114 - DNA, 16 bp, Homo sapiens
tttattctttttaaag

SEQ ID NO: 2090115 - DNA, 12 bp, Homo sapiens
tttattgacaat

SEQ ID NO: 2090116 - DNA, 22 bp, Homo sapiens
tttatttaaaaaactaaaaact

SEQ ID NO: 2090117 - DNA, 22 bp, Homo sapiens
tttatttaaactgttctgtgtg

SEQ ID NO: 2090118 - DNA, 22 bp, Homo sapiens
tttatttccaaaataaaatgaa

SEQ ID NO: 2090119 - DNA, 17 bp, Homo sapiens
tttatttttcatattgt

SEQ ID NO: 2090120 - DNA, 13 bp, Homo sapiens
tttatttttgaac

SEQ ID NO: 2090121 - DNA, 14 bp, Homo sapiens
tttattttttaagt

SEQ ID NO: 2090122 - DNA, 15 bp, Homo sapiens
tttattttttaatca

SEQ ID NO: 2090123 - DNA, 17 bp, Homo sapiens
tttcaaaaattacacta

SEQ ID NO: 2090124 - DNA, 21 bp, Homo sapiens
tttcaaaaattgtgtttagat

SEQ ID NO: 2090125 - DNA, 12 bp, Homo sapiens
tttcaaaagaca

SEQ ID NO: 2090126 - DNA, 13 bp, Homo sapiens
tttcaaaagtgga

SEQ ID NO: 2090127 - DNA, 13 bp, Homo sapiens
tttcaaatatcac

SEQ ID NO: 2090128 - DNA, 23 bp, Homo sapiens
tttcaaatggactcatggcttag

SEQ ID NO: 2090129 - DNA, 12 bp, Homo sapiens
tttcaaccagca

SEQ ID NO: 2090130 - DNA, 14 bp, Homo sapiens
tttcaaccagcatt

SEQ ID NO: 2090131 - DNA, 15 bp, Homo sapiens
tttcaaccagcattt

SEQ ID NO: 2090132 - DNA, 19 bp, Homo sapiens
tttcaaccagcattttact

SEQ ID NO: 2090133 - DNA, 18 bp, Homo sapiens
tttcaaccgcttgccata

SEQ ID NO: 2090134 - DNA, 20 bp, Homo sapiens
tttcaacgcagccctgcttt

SEQ ID NO: 2090135 - DNA, 21 bp, Homo sapiens
tttcaacgcagccctgctttg

SEQ ID NO: 2090136 - DNA, 14 bp, Homo sapiens
tttcaactccagaa

SEQ ID NO: 2090137 - DNA, 21 bp, Homo sapiens
tttcaagaaaaaataaatgga

SEQ ID NO: 2090138 - DNA, 14 bp, Homo sapiens
tttcaagaaaactg

SEQ ID NO: 2090139 - DNA, 17 bp, Homo sapiens
tttcaagaaaactggaa

SEQ ID NO: 2090140 - DNA, 19 bp, Homo sapiens
tttcaagaaactgaggaat

SEQ ID NO: 2090141 - DNA, 14 bp, Homo sapiens
tttcaagagaagaa

SEQ ID NO: 2090142 - DNA, 15 bp, Homo sapiens
tttcaagagaagaaa

SEQ ID NO: 2090143 - DNA, 20 bp, Homo sapiens
tttcaagagaagaaaaaatt

SEQ ID NO: 2090144 - DNA, 12 bp, Homo sapiens
tttcaatgattg

SEQ ID NO: 2090145 - DNA, 21 bp, Homo sapiens
tttcaatgattgtttaattgt

SEQ ID NO: 2090146 - DNA, 20 bp, Homo sapiens
tttcaatgtgattctaatgt

SEQ ID NO: 2090147 - DNA, 22 bp, Homo sapiens
tttcaatgtgattctaatgtct

SEQ ID NO: 2090148 - DNA, 17 bp, Homo sapiens
tttcaattatttcaatg

SEQ ID NO: 2090149 - DNA, 15 bp, Homo sapiens
tttcaattctcaaaa

SEQ ID NO: 2090150 - DNA, 14 bp, Homo sapiens
tttcaatttccaag

SEQ ID NO: 2090151 - DNA, 19 bp, Homo sapiens
tttcaatttccaagagctg

SEQ ID NO: 2090152 - DNA, 16 bp, Homo sapiens
tttcacaaccttctgt

SEQ ID NO: 2090153 - DNA, 22 bp, Homo sapiens
tttcacaaccttctgtggctca

SEQ ID NO: 2090154 - DNA, 16 bp, Homo sapiens
tttcacacaggtcctg

SEQ ID NO: 2090155 - DNA, 11 bp, Homo sapiens
tttcaccattt

SEQ ID NO: 2090156 - DNA, 22 bp, Homo sapiens
tttcacctggaagcatttgttt

SEQ ID NO: 2090157 - DNA, 16 bp, Homo sapiens
tttcaccttgggtttg

SEQ ID NO: 2090158 - DNA, 18 bp, Homo sapiens
tttcacgggaactctcca

SEQ ID NO: 2090159 - DNA, 17 bp, Homo sapiens
tttcactatgattttct

SEQ ID NO: 2090160 - DNA, 18 bp, Homo sapiens
tttcactgctggctgcct

SEQ ID NO: 2090161 - DNA, 17 bp, Homo sapiens
tttcactggagttacat

SEQ ID NO: 2090162 - DNA, 18 bp, Homo sapiens
tttcactggagttacatt

SEQ ID NO: 2090163 - DNA, 19 bp, Homo sapiens
tttcactggagttacatta

SEQ ID NO: 2090164 - DNA, 23 bp, Homo sapiens
tttcagaaataaaatgaaatgtc

SEQ ID NO: 2090165 - DNA, 23 bp, Homo sapiens
tttcagaattgaaggagaaaatg

SEQ ID NO: 2090166 - DNA, 13 bp, Homo sapiens
tttcagagccagt

SEQ ID NO: 2090167 - DNA, 19 bp, Homo sapiens
tttcagagccagtgaagga

SEQ ID NO: 2090168 - DNA, 15 bp, Homo sapiens
tttcagatatatatc

SEQ ID NO: 2090169 - DNA, 15 bp, Homo sapiens
tttcagcattcagtc

SEQ ID NO: 2090170 - DNA, 12 bp, Homo sapiens
tttcagctctct

SEQ ID NO: 2090171 - DNA, 16 bp, Homo sapiens
tttcagctctctgtat

SEQ ID NO: 2090172 - DNA, 14 bp, Homo sapiens
tttcagctgtgaac

SEQ ID NO: 2090173 - DNA, 16 bp, Homo sapiens
tttcaggacatggggc

SEQ ID NO: 2090174 - DNA, 23 bp, Homo sapiens
tttcaggagggtccccagctggt

SEQ ID NO: 2090175 - DNA, 16 bp, Homo sapiens
tttcaggatactctgt

SEQ ID NO: 2090176 - DNA, 20 bp, Homo sapiens
tttcaggatactctgtcaga

SEQ ID NO: 2090177 - DNA, 21 bp, Homo sapiens
tttcaggggtcgtcaccacct

SEQ ID NO: 2090178 - DNA, 18 bp, Homo sapiens
tttcaggtgtttagttgc

SEQ ID NO: 2090179 - DNA, 18 bp, Homo sapiens
tttcagtccccacagata

SEQ ID NO: 2090180 - DNA, 17 bp, Homo sapiens
tttcagtgaaagcatca

SEQ ID NO: 2090181 - DNA, 19 bp, Homo sapiens
tttcataaggcctgccctc

SEQ ID NO: 2090182 - DNA, 18 bp, Homo sapiens
tttcatacaaaactgttc

SEQ ID NO: 2090183 - DNA, 12 bp, Homo sapiens
tttcatattgtg

SEQ ID NO: 2090184 - DNA, 15 bp, Homo sapiens
tttcatattgtgcca

SEQ ID NO: 2090185 - DNA, 14 bp, Homo sapiens
tttcatcaatttaa

SEQ ID NO: 2090186 - DNA, 13 bp, Homo sapiens
tttcatcattttt

SEQ ID NO: 2090187 - DNA, 23 bp, Homo sapiens
tttcatccctatgggattcagtg

SEQ ID NO: 2090188 - DNA, 15 bp, Homo sapiens
tttcatcctggcctc

SEQ ID NO: 2090189 - DNA, 21 bp, Homo sapiens
tttcatctcatttaagggaaa

SEQ ID NO: 2090190 - DNA, 23 bp, Homo sapiens
tttcatctcatttaagggaaaaa

SEQ ID NO: 2090191 - DNA, 16 bp, Homo sapiens
tttcatgaacacagcc

SEQ ID NO: 2090192 - DNA, 19 bp, Homo sapiens
tttcatgataatgaacaga

SEQ ID NO: 2090193 - DNA, 22 bp, Homo sapiens
tttcatgataatgaacagaaca

SEQ ID NO: 2090194 - DNA, 16 bp, Homo sapiens
tttcatgctatctctg

SEQ ID NO: 2090195 - DNA, 19 bp, Homo sapiens
tttcatgctatctctgtgt

SEQ ID NO: 2090196 - DNA, 12 bp, Homo sapiens
tttcatggaagt

SEQ ID NO: 2090197 - DNA, 21 bp, Homo sapiens
tttcatggtgaaaatgtactg

SEQ ID NO: 2090198 - DNA, 22 bp, Homo sapiens
tttcatggtgaaaatgtactga

SEQ ID NO: 2090199 - DNA, 13 bp, Homo sapiens
tttcattaaagca

SEQ ID NO: 2090200 - DNA, 21 bp, Homo sapiens
tttcattaatacagggcattt

SEQ ID NO: 2090201 - DNA, 21 bp, Homo sapiens
tttcattgatatgaaaaatat

SEQ ID NO: 2090202 - DNA, 22 bp, Homo sapiens
tttcattgatatgaaaaatatg

SEQ ID NO: 2090203 - DNA, 16 bp, Homo sapiens
tttcattgtatgatgt

SEQ ID NO: 2090204 - DNA, 18 bp, Homo sapiens
tttcattgtatgatgtgt

SEQ ID NO: 2090205 - DNA, 14 bp, Homo sapiens
tttcatttcaactg

SEQ ID NO: 2090206 - DNA, 13 bp, Homo sapiens
tttccaagagctg

SEQ ID NO: 2090207 - DNA, 14 bp, Homo sapiens
tttccaagagctga

SEQ ID NO: 2090208 - DNA, 18 bp, Homo sapiens
tttccaagtaatataatg

SEQ ID NO: 2090209 - DNA, 22 bp, Homo sapiens
tttccacaagattcccagagac

SEQ ID NO: 2090210 - DNA, 12 bp, Homo sapiens
tttccacaccat

SEQ ID NO: 2090211 - DNA, 14 bp, Homo sapiens
tttccacaccatca

SEQ ID NO: 2090212 - DNA, 20 bp, Homo sapiens
tttccaccatcaaatgctgt

SEQ ID NO: 2090213 - DNA, 19 bp, Homo sapiens
tttccacgatgaaaaactt

SEQ ID NO: 2090214 - DNA, 13 bp, Homo sapiens
tttccagaaaata

SEQ ID NO: 2090215 - DNA, 24 bp, Homo sapiens
tttccagaaaatataaatgcatga

SEQ ID NO: 2090216 - DNA, 18 bp, Homo sapiens
tttccaggatcctgcagg

SEQ ID NO: 2090217 - DNA, 23 bp, Homo sapiens
tttccagggcatccgcagcccag

SEQ ID NO: 2090218 - DNA, 15 bp, Homo sapiens
tttccagttctgaca

SEQ ID NO: 2090219 - DNA, 19 bp, Homo sapiens
tttcccaccaccttggact

SEQ ID NO: 2090220 - DNA, 22 bp, Homo sapiens
tttcccaccaccttggactcct

SEQ ID NO: 2090221 - DNA, 12 bp, Homo sapiens
tttcccataatt

SEQ ID NO: 2090222 - DNA, 21 bp, Homo sapiens
ttttatgtgctctcatcagaa

SEQ ID NO: 2090223 - DNA, 12 bp, Homo sapiens
ttttattaaagc

SEQ ID NO: 2090224 - DNA, 14 bp, Homo sapiens
ttttattctgtttt

SEQ ID NO: 2090225 - DNA, 12 bp, Homo sapiens
ttttattgtttt

SEQ ID NO: 2090226 - DNA, 19 bp, Homo sapiens
ttttatttagttgaaaaat

SEQ ID NO: 2090227 - DNA, 20 bp, Homo sapiens
ttttatttccacataaaggt

SEQ ID NO: 2090228 - DNA, 13 bp, Homo sapiens
ttttatttctcgg

SEQ ID NO: 2090229 - DNA, 13 bp, Homo sapiens
ttttatttttcta

SEQ ID NO: 2090230 - DNA, 15 bp, Homo sapiens
ttttcaaatgtcagc

SEQ ID NO: 2090231 - DNA, 14 bp, Homo sapiens
ttttcaaccagcat

SEQ ID NO: 2090232 - DNA, 20 bp, Homo sapiens
ttttcaaccagcattttact

SEQ ID NO: 2090233 - DNA, 22 bp, Homo sapiens
ttttcaaccagcattttactac

SEQ ID NO: 2090234 - DNA, 18 bp, Homo sapiens
ttttcaagaaaactggaa

SEQ ID NO: 2090235 - DNA, 15 bp, Homo sapiens
ttttcaagaaactga

SEQ ID NO: 2090236 - DNA, 20 bp, Homo sapiens
ttttcaagagaagaaaaaat

SEQ ID NO: 2090237 - DNA, 22 bp, Homo sapiens
ttttcaagagaagaaaaaatta

SEQ ID NO: 2090238 - DNA, 14 bp, Homo sapiens
ttttcaatatttat

SEQ ID NO: 2090239 - DNA, 18 bp, Homo sapiens
ttttcaattttgcatgct

SEQ ID NO: 2090240 - DNA, 23 bp, Homo sapiens
ttttcacctggaagcatttgttt

SEQ ID NO: 2090241 - DNA, 18 bp, Homo sapiens
ttttcacttgcttaaaaa

SEQ ID NO: 2090242 - DNA, 17 bp, Homo sapiens
ttttcactttagctatg

SEQ ID NO: 2090243 - DNA, 16 bp, Homo sapiens
ttttcagcaactcaga

SEQ ID NO: 2090244 - DNA, 20 bp, Homo sapiens
ttttcagctattagcaactg

SEQ ID NO: 2090245 - DNA, 22 bp, Homo sapiens
ttttcaggtaggcccttgtcct

SEQ ID NO: 2090246 - DNA, 16 bp, Homo sapiens
ttttcagtattttgga

SEQ ID NO: 2090247 - DNA, 23 bp, Homo sapiens
ttttcagtattttggagaaatta

SEQ ID NO: 2090248 - DNA, 14 bp, Homo sapiens
ttttcataaactga

SEQ ID NO: 2090249 - DNA, 18 bp, Homo sapiens
ttttcataaactgagcct

SEQ ID NO: 2090250 - DNA, 23 bp, Homo sapiens
ttttcataacttgctgaatttca

SEQ ID NO: 2090251 - DNA, 21 bp, Homo sapiens
ttttcatagattgagaagttt

SEQ ID NO: 2090252 - DNA, 14 bp, Homo sapiens
ttttcatattgtgc

SEQ ID NO: 2090253 - DNA, 19 bp, Homo sapiens
ttttcatattgtgccaata

SEQ ID NO: 2090254 - DNA, 15 bp, Homo sapiens
ttttcatcctggcct

SEQ ID NO: 2090255 - DNA, 16 bp, Homo sapiens
ttttcatcctggcctc

SEQ ID NO: 2090256 - DNA, 13 bp, Homo sapiens
ttttcatggaagt

SEQ ID NO: 2090257 - DNA, 19 bp, Homo sapiens
ttttcatggaagtggcagt

SEQ ID NO: 2090258 - DNA, 21 bp, Homo sapiens
ttttcatggtgaaaatgtact

SEQ ID NO: 2090259 - DNA, 17 bp, Homo sapiens
ttttcattgatatgaaa

SEQ ID NO: 2090260 - DNA, 13 bp, Homo sapiens
ttttccaataaaa

SEQ ID NO: 2090261 - DNA, 18 bp, Homo sapiens
ttttccactcctatggaa

SEQ ID NO: 2090262 - DNA, 14 bp, Homo sapiens
ttttccatgtatct

SEQ ID NO: 2090263 - DNA, 19 bp, Homo sapiens
ttttccccggtcccttgag

SEQ ID NO: 2090264 - DNA, 14 bp, Homo sapiens
ttttcctaaatgca

SEQ ID NO: 2090265 - DNA, 21 bp, Homo sapiens
ttttcctccagacagatacag

SEQ ID NO: 2090266 - DNA, 13 bp, Homo sapiens
ttttcctccctca

SEQ ID NO: 2090267 - DNA, 22 bp, Homo sapiens
ttttcctgaatattaatcccag

SEQ ID NO: 2090268 - DNA, 16 bp, Homo sapiens
ttttccttcaaagttt

SEQ ID NO: 2090269 - DNA, 16 bp, Homo sapiens
ttttcctttgtcatca

SEQ ID NO: 2090270 - DNA, 14 bp, Homo sapiens
ttttcgtgcatttg

SEQ ID NO: 2090271 - DNA, 17 bp, Homo sapiens
ttttcgtgcatttgtga

SEQ ID NO: 2090272 - DNA, 12 bp, Homo sapiens
ttttctaactgt

SEQ ID NO: 2090273 - DNA, 14 bp, Homo sapiens
ttttctaactgtaa

SEQ ID NO: 2090274 - DNA, 23 bp, Homo sapiens
ttttctacctttttttctctcct

SEQ ID NO: 2090275 - DNA, 22 bp, Homo sapiens
ttttctatagctcttctattta

SEQ ID NO: 2090276 - DNA, 18 bp, Homo sapiens
ttttctcagaacagctga

SEQ ID NO: 2090277 - DNA, 13 bp, Homo sapiens
ttttctcctccca

SEQ ID NO: 2090278 - DNA, 14 bp, Homo sapiens
ttttctcctcccag

SEQ ID NO: 2090279 - DNA, 14 bp, Homo sapiens
ttttctctcccata

SEQ ID NO: 2090280 - DNA, 15 bp, Homo sapiens
ttttctgagaaagac

SEQ ID NO: 2090281 - DNA, 18 bp, Homo sapiens
ttttctgagaaagactat

SEQ ID NO: 2090282 - DNA, 11 bp, Homo sapiens
ttttctggaaa

SEQ ID NO: 2090283 - DNA, 21 bp, Homo sapiens
ttttctggaatacatgaaata

SEQ ID NO: 2090284 - DNA, 18 bp, Homo sapiens
ttttctggaatgtaatca

SEQ ID NO: 2090285 - DNA, 14 bp, Homo sapiens
ttttcttctaaaat

SEQ ID NO: 2090286 - DNA, 14 bp, Homo sapiens
ttttctttgaaatt

SEQ ID NO: 2090287 - DNA, 12 bp, Homo sapiens
ttttctttgtgt

SEQ ID NO: 2090288 - DNA, 16 bp, Homo sapiens
ttttgaaactagaagt

SEQ ID NO: 2090289 - DNA, 18 bp, Homo sapiens
ttttgaagaagggaaatt

SEQ ID NO: 2090290 - DNA, 22 bp, Homo sapiens
ttttgaagaagggaaattcaca

SEQ ID NO: 2090291 - DNA, 20 bp, Homo sapiens
ttttgaagcctgctaaatga

SEQ ID NO: 2090292 - DNA, 19 bp, Homo sapiens
ttttgaagtagtttgtata

SEQ ID NO: 2090293 - DNA, 16 bp, Homo sapiens
ttttgaatccatgctt

SEQ ID NO: 2090294 - DNA, 19 bp, Homo sapiens
ttttgacagtgttgaaaat

SEQ ID NO: 2090295 - DNA, 15 bp, Homo sapiens
ttttgacataaagtt

SEQ ID NO: 2090296 - DNA, 17 bp, Homo sapiens
ttttgacttaaagcaga

SEQ ID NO: 2090297 - DNA, 15 bp, Homo sapiens
ttttgatagctttat

SEQ ID NO: 2090298 - DNA, 17 bp, Homo sapiens
ttttgatccaagctggt

SEQ ID NO: 2090299 - DNA, 18 bp, Homo sapiens
ttttgatttatatgtgta

SEQ ID NO: 2090300 - DNA, 15 bp, Homo sapiens
ttttgatttatgcat

SEQ ID NO: 2090301 - DNA, 13 bp, Homo sapiens
ttttgcaaaattt

SEQ ID NO: 2090302 - DNA, 16 bp, Homo sapiens
ttttgcacgtcttgct

SEQ ID NO: 2090303 - DNA, 14 bp, Homo sapiens
ttttgcattattca

SEQ ID NO: 2090304 - DNA, 13 bp, Homo sapiens
ttttgcatttatg

SEQ ID NO: 2090305 - DNA, 13 bp, Homo sapiens
ttttgcctggctg

SEQ ID NO: 2090306 - DNA, 14 bp, Homo sapiens
ttttgcctggctgt

SEQ ID NO: 2090307 - DNA, 11 bp, Homo sapiens
ttttgctgctg

SEQ ID NO: 2090308 - DNA, 16 bp, Homo sapiens
ttttgctgctgctgct

SEQ ID NO: 2090309 - DNA, 19 bp, Homo sapiens
ttttgctggtgtctgagct

SEQ ID NO: 2090310 - DNA, 11 bp, Homo sapiens
ttttgctgtct

SEQ ID NO: 2090311 - DNA, 15 bp, Homo sapiens
ttttgctgtctttct

SEQ ID NO: 2090312 - DNA, 18 bp, Homo sapiens
ttttgcttaaaattttac

SEQ ID NO: 2090313 - DNA, 13 bp, Homo sapiens
ttttgctttgttt

SEQ ID NO: 2090314 - DNA, 17 bp, Homo sapiens
ttttggtattacactgt

SEQ ID NO: 2090315 - DNA, 21 bp, Homo sapiens
ttttgtaaactgtatcaaatc

SEQ ID NO: 2090316 - DNA, 15 bp, Homo sapiens
ttttgtaacaaatga

SEQ ID NO: 2090317 - DNA, 11 bp, Homo sapiens
ttttgtaactt

SEQ ID NO: 2090318 - DNA, 15 bp, Homo sapiens
ttttgtaataaaagg

SEQ ID NO: 2090319 - DNA, 17 bp, Homo sapiens
ttttgtacaattactaa

SEQ ID NO: 2090320 - DNA, 12 bp, Homo sapiens
ttttgtacagaa

SEQ ID NO: 2090321 - DNA, 14 bp, Homo sapiens
ttttgtacagaatt

SEQ ID NO: 2090322 - DNA, 15 bp, Homo sapiens
ttttgtacagaattt

SEQ ID NO: 2090323 - DNA, 20 bp, Homo sapiens
ttttgtacgttatatattgt

SEQ ID NO: 2090324 - DNA, 19 bp, Homo sapiens
ttttgtagagccagggtct

SEQ ID NO: 2090325 - DNA, 18 bp, Homo sapiens
ttttgtatagtaaagtga

SEQ ID NO: 2090326 - DNA, 13 bp, Homo sapiens
ttttgtatatatc

SEQ ID NO: 2090327 - DNA, 13 bp, Homo sapiens
ttttgtatatgat

SEQ ID NO: 2090328 - DNA, 18 bp, Homo sapiens
ttttgtatattgtaggaa

SEQ ID NO: 2090329 - DNA, 18 bp, Homo sapiens
ttttgtatttaaaacctt

SEQ ID NO: 2090330 - DNA, 14 bp, Homo sapiens
ttttgtatttttga

SEQ ID NO: 2090331 - DNA, 18 bp, Homo sapiens
ttttgtcgagtttacttc

SEQ ID NO: 2090332 - DNA, 14 bp, Homo sapiens
ttttgtcttcctca

SEQ ID NO: 2090333 - DNA, 21 bp, Homo sapiens
ttttgtgatgtcccaacttgt

SEQ ID NO: 2090334 - DNA, 19 bp, Homo sapiens
ttttgtgatttagaactgt

SEQ ID NO: 2090335 - DNA, 11 bp, Homo sapiens
ttttgtggatt

SEQ ID NO: 2090336 - DNA, 18 bp, Homo sapiens
ttttgtggattgacagta

SEQ ID NO: 2090337 - DNA, 15 bp, Homo sapiens
ttttgttgattaaaa

SEQ ID NO: 2090338 - DNA, 15 bp, Homo sapiens
aaaaataaagctact

SEQ ID NO: 2090339 - DNA, 16 bp, Homo sapiens
aaaaataaagctactg

SEQ ID NO: 2090340 - DNA, 11 bp, Homo sapiens
aaaaataaata

SEQ ID NO: 2090341 - DNA, 22 bp, Homo sapiens
aaaaataaatataattgggatt

SEQ ID NO: 2090342 - DNA, 12 bp, Homo sapiens
aaaaataaatgg

SEQ ID NO: 2090343 - DNA, 16 bp, Homo sapiens
aaaaatacagtaaagt

SEQ ID NO: 2090344 - DNA, 11 bp, Homo sapiens
aaaaatatata

SEQ ID NO: 2090345 - DNA, 18 bp, Homo sapiens
aaaaatatatatctatct

SEQ ID NO: 2090346 - DNA, 20 bp, Homo sapiens
aaaaatatggaacttctaat

SEQ ID NO: 2090347 - DNA, 12 bp, Homo sapiens
aaaaatctagtt

SEQ ID NO: 2090348 - DNA, 13 bp, Homo sapiens
aaaaatctagttt

SEQ ID NO: 2090349 - DNA, 12 bp, Homo sapiens
aaaaatctgttt

SEQ ID NO: 2090350 - DNA, 14 bp, Homo sapiens
aaaaatgatctaaa

SEQ ID NO: 2090351 - DNA, 14 bp, Homo sapiens
aaaaattaaagccc

SEQ ID NO: 2090352 - DNA, 19 bp, Homo sapiens
aaaaattagtgaagttctt

SEQ ID NO: 2090353 - DNA, 13 bp, Homo sapiens
aaaaattgcacaa

SEQ ID NO: 2090354 - DNA, 12 bp, Homo sapiens
aaaacaaaacaa

SEQ ID NO: 2090355 - DNA, 15 bp, Homo sapiens
aaaacaaaaccagct

SEQ ID NO: 2090356 - DNA, 13 bp, Homo sapiens
aaaacaagaaaga

SEQ ID NO: 2090357 - DNA, 15 bp, Homo sapiens
aaaacaagaatgaaa

SEQ ID NO: 2090358 - DNA, 16 bp, Homo sapiens
aaaacaatcacactca

SEQ ID NO: 2090359 - DNA, 13 bp, Homo sapiens
aaaacaatgaaga

SEQ ID NO: 2090360 - DNA, 17 bp, Homo sapiens
aaaacaatgaaggaaaa

SEQ ID NO: 2090361 - DNA, 18 bp, Homo sapiens
aaaacacattgagtttaa

SEQ ID NO: 2090362 - DNA, 14 bp, Homo sapiens
aaaacactagtttt

SEQ ID NO: 2090363 - DNA, 18 bp, Homo sapiens
aaaacagcctcacagaag

SEQ ID NO: 2090364 - DNA, 18 bp, Homo sapiens
aaaacaggtggagaaatt

SEQ ID NO: 2090365 - DNA, 17 bp, Homo sapiens
aaaacataaaatataca

SEQ ID NO: 2090366 - DNA, 14 bp, Homo sapiens
aaaacataatataa

SEQ ID NO: 2090367 - DNA, 22 bp, Homo sapiens
aaaacatatcaattcaacacat

SEQ ID NO: 2090368 - DNA, 11 bp, Homo sapiens
aaaacatgaaa

SEQ ID NO: 2090369 - DNA, 19 bp, Homo sapiens
aaaacatgagaaatgtgaa

SEQ ID NO: 2090370 - DNA, 14 bp, Homo sapiens
aaaacatggtagaa

SEQ ID NO: 2090371 - DNA, 14 bp, Homo sapiens
aaaacattcatcca

SEQ ID NO: 2090372 - DNA, 15 bp, Homo sapiens
aaaacatttcaaagc

SEQ ID NO: 2090373 - DNA, 11 bp, Homo sapiens
aaaacatttgt

SEQ ID NO: 2090374 - DNA, 16 bp, Homo sapiens
aaaaccactagaactc

SEQ ID NO: 2090375 - DNA, 20 bp, Homo sapiens
aaaaccactgaacatttgct

SEQ ID NO: 2090376 - DNA, 22 bp, Homo sapiens
aaaaccagctgctactcataag

SEQ ID NO: 2090377 - DNA, 20 bp, Homo sapiens
aaaaccatgcagcttcatca

SEQ ID NO: 2090378 - DNA, 13 bp, Homo sapiens
aaaacccagagag

SEQ ID NO: 2090379 - DNA, 15 bp, Homo sapiens
aaaacccagagagga

SEQ ID NO: 2090380 - DNA, 19 bp, Homo sapiens
aaaacccagcatgtacaaa

SEQ ID NO: 2090381 - DNA, 18 bp, Homo sapiens
aaaaccctgctttttgac

SEQ ID NO: 2090382 - DNA, 18 bp, Homo sapiens
aaaaccttgatttaaaat

SEQ ID NO: 2090383 - DNA, 13 bp, Homo sapiens
aaaacgcctcttt

SEQ ID NO: 2090384 - DNA, 21 bp, Homo sapiens
aaaacgtgggtatttcctgct

SEQ ID NO: 2090385 - DNA, 19 bp, Homo sapiens
aaaacgttgacccctttcc

SEQ ID NO: 2090386 - DNA, 13 bp, Homo sapiens
aaaactaaaaact

SEQ ID NO: 2090387 - DNA, 19 bp, Homo sapiens
aaaactaaatctctaatat

SEQ ID NO: 2090388 - DNA, 17 bp, Homo sapiens
aaaactatggttcccaa

SEQ ID NO: 2090389 - DNA, 18 bp, Homo sapiens
aaaactgatcaaaaataa

SEQ ID NO: 2090390 - DNA, 19 bp, Homo sapiens
aaaactgatcaaaaataaa

SEQ ID NO: 2090391 - DNA, 22 bp, Homo sapiens
aaaactgatcaaaaataaacta

SEQ ID NO: 2090392 - DNA, 23 bp, Homo sapiens
aaaactgatcaaaaataaactag

SEQ ID NO: 2090393 - DNA, 20 bp, Homo sapiens
aaaactggaaatctggattt

SEQ ID NO: 2090394 - DNA, 17 bp, Homo sapiens
aaaacttaacatattta

SEQ ID NO: 2090395 - DNA, 19 bp, Homo sapiens
aaaacttaacatatttact

SEQ ID NO: 2090396 - DNA, 18 bp, Homo sapiens
aaaagaaaaaaaaagcat

SEQ ID NO: 2090397 - DNA, 11 bp, Homo sapiens
aaaagaaaacc

SEQ ID NO: 2090398 - DNA, 20 bp, Homo sapiens
aaaagaaaaccattttagtt

SEQ ID NO: 2090399 - DNA, 18 bp, Homo sapiens
aaaagaaaccgtaatttt

SEQ ID NO: 2090400 - DNA, 12 bp, Homo sapiens
aaaagaaatgaa

SEQ ID NO: 2090401 - DNA, 16 bp, Homo sapiens
aaaagaacagtaaaca

SEQ ID NO: 2090402 - DNA, 13 bp, Homo sapiens
aaaagaatatttt

SEQ ID NO: 2090403 - DNA, 21 bp, Homo sapiens
aaaagacagtggatcatgaaa

SEQ ID NO: 2090404 - DNA, 22 bp, Homo sapiens
aaaagactattaagagcaataa

SEQ ID NO: 2090405 - DNA, 19 bp, Homo sapiens
aaaagagagaaaacttatt

SEQ ID NO: 2090406 - DNA, 21 bp, Homo sapiens
aaaagagagaaaacttatttg

SEQ ID NO: 2090407 - DNA, 20 bp, Homo sapiens
aaaagaggatgatttcagaa

SEQ ID NO: 2090408 - DNA, 13 bp, Homo sapiens
aaaagataaagat

SEQ ID NO: 2090409 - DNA, 18 bp, Homo sapiens
aaaagataaagatgatct

SEQ ID NO: 2090410 - DNA, 15 bp, Homo sapiens
aaaagattatatatc

SEQ ID NO: 2090411 - DNA, 20 bp, Homo sapiens
aaaagattatatatcataaa

SEQ ID NO: 2090412 - DNA, 12 bp, Homo sapiens
aaaagattctgt

SEQ ID NO: 2090413 - DNA, 13 bp, Homo sapiens
aaaagatttgttt

SEQ ID NO: 2090414 - DNA, 14 bp, Homo sapiens
aaaagcaaatgaga

SEQ ID NO: 2090415 - DNA, 14 bp, Homo sapiens
aaaagcaagactgt

SEQ ID NO: 2090416 - DNA, 10 bp, Homo sapiens
aaaagcactt

SEQ ID NO: 2090417 - DNA, 16 bp, Homo sapiens
aaaagcatgactattt

SEQ ID NO: 2090418 - DNA, 16 bp, Homo sapiens
aaaagcccagtgacct

SEQ ID NO: 2090419 - DNA, 20 bp, Homo sapiens
aaaagctacagttttgtgaa

SEQ ID NO: 2090420 - DNA, 21 bp, Homo sapiens
aaaagctgcttgactatcaca

SEQ ID NO: 2090421 - DNA, 21 bp, Homo sapiens
aaaagctttgaaccctgggac

SEQ ID NO: 2090422 - DNA, 18 bp, Homo sapiens
aaaaggagagaagaaagt

SEQ ID NO: 2090423 - DNA, 14 bp, Homo sapiens
aaaaggctagttta

SEQ ID NO: 2090424 - DNA, 15 bp, Homo sapiens
aaaaggtattaaatt

SEQ ID NO: 2090425 - DNA, 14 bp, Homo sapiens
aaaaggtttatgaa

SEQ ID NO: 2090426 - DNA, 23 bp, Homo sapiens
aaaaggtttatgaaaaagaagaa

SEQ ID NO: 2090427 - DNA, 17 bp, Homo sapiens
aaaagtacatttaatac

SEQ ID NO: 2090428 - DNA, 21 bp, Homo sapiens
aaaagtacatttaatacagca

SEQ ID NO: 2090429 - DNA, 15 bp, Homo sapiens
aaaagtagaattata

SEQ ID NO: 2090430 - DNA, 15 bp, Homo sapiens
aaaagtgaacttgat

SEQ ID NO: 2090431 - DNA, 14 bp, Homo sapiens
aaaagtgcaaagtt

SEQ ID NO: 2090432 - DNA, 13 bp, Homo sapiens
aaaagtgcaatgc

SEQ ID NO: 2090433 - DNA, 19 bp, Homo sapiens
aaaagtgttgattacataa

SEQ ID NO: 2090434 - DNA, 21 bp, Homo sapiens
aaaagtgtttatttttcatat

SEQ ID NO: 2090435 - DNA, 16 bp, Homo sapiens
aaaagttcgaaagaaa

SEQ ID NO: 2090436 - DNA, 14 bp, Homo sapiens
aaaagttgcagtct

SEQ ID NO: 2090437 - DNA, 17 bp, Homo sapiens
aaaagttgcagtctcag

SEQ ID NO: 2090438 - DNA, 18 bp, Homo sapiens
aaaagttgcagtctcaga

SEQ ID NO: 2090439 - DNA, 16 bp, Homo sapiens
aaaagtttgccagaag

SEQ ID NO: 2090440 - DNA, 20 bp, Homo sapiens
aaaataaaaaaatacagtaa

SEQ ID NO: 2090441 - DNA, 17 bp, Homo sapiens
aaaataaaaacataaaa

SEQ ID NO: 2090442 - DNA, 17 bp, Homo sapiens
aaaataaaaaccagaat

SEQ ID NO: 2090443 - DNA, 20 bp, Homo sapiens
aaaataaaaaccagaatcat

SEQ ID NO: 2090444 - DNA, 16 bp, Homo sapiens
aaaataaaattatggt

SEQ ID NO: 2090445 - DNA, 10 bp, Homo sapiens
aaaataaagc

SEQ ID NO: 2090446 - DNA, 22 bp, Homo sapiens
aaaataaagcctatttttcaaa

SEQ ID NO: 2090447 - DNA, 13 bp, Homo sapiens
aaaataaagttgg

SEQ ID NO: 2090448 - DNA, 12 bp, Homo sapiens
aaaataaattga

SEQ ID NO: 2090449 - DNA, 14 bp, Homo sapiens
aaaataacatttga

SEQ ID NO: 2090450 - DNA, 14 bp, Homo sapiens
aaaataagctttat

SEQ ID NO: 2090451 - DNA, 23 bp, Homo sapiens
aaaataataggatataaaacaca

SEQ ID NO: 2090452 - DNA, 12 bp, Homo sapiens
aaaataatttaa

SEQ ID NO: 2090453 - DNA, 20 bp, Homo sapiens
aaaataattttaaacaaagg

SEQ ID NO: 2090454 - DNA, 12 bp, Homo sapiens
aaaggagcctgt

SEQ ID NO: 2090455 - DNA, 20 bp, Homo sapiens
aaaggatgtaaacagtgcct

SEQ ID NO: 2090456 - DNA, 21 bp, Homo sapiens
aaaggatgtaaacagtgcctg

SEQ ID NO: 2090457 - DNA, 19 bp, Homo sapiens
aaaggattaagatacactc

SEQ ID NO: 2090458 - DNA, 11 bp, Homo sapiens
aaaggcctggg

SEQ ID NO: 2090459 - DNA, 13 bp, Homo sapiens
aaaggcctggggt

SEQ ID NO: 2090460 - DNA, 20 bp, Homo sapiens
aaaggctctgaaagccagct

SEQ ID NO: 2090461 - DNA, 22 bp, Homo sapiens
aaaggctggctgaaaatcacta

SEQ ID NO: 2090462 - DNA, 13 bp, Homo sapiens
aaaggctgtggta

SEQ ID NO: 2090463 - DNA, 15 bp, Homo sapiens
aaagggaaactggct

SEQ ID NO: 2090464 - DNA, 22 bp, Homo sapiens
aaagggacttggaagctccgct

SEQ ID NO: 2090465 - DNA, 15 bp, Homo sapiens
aaagggcagccaggg

SEQ ID NO: 2090466 - DNA, 23 bp, Homo sapiens
aaagggcccacagtgacttttgc

SEQ ID NO: 2090467 - DNA, 19 bp, Homo sapiens
aaaggggctgctggggcat

SEQ ID NO: 2090468 - DNA, 21 bp, Homo sapiens
aaagggtagcctacaaatgtt

SEQ ID NO: 2090469 - DNA, 14 bp, Homo sapiens
aaaggtataatttt

SEQ ID NO: 2090470 - DNA, 17 bp, Homo sapiens
aaaggtcattgtggcta

SEQ ID NO: 2090471 - DNA, 17 bp, Homo sapiens
aaaggtggtatgtgtgt

SEQ ID NO: 2090472 - DNA, 19 bp, Homo sapiens
aaaggtggtatgtgtgtgt

SEQ ID NO: 2090473 - DNA, 14 bp, Homo sapiens
aaaggtgtgtcaaa

SEQ ID NO: 2090474 - DNA, 12 bp, Homo sapiens
aaaggttaacag

SEQ ID NO: 2090475 - DNA, 15 bp, Homo sapiens
aaaggttcttcatcc

SEQ ID NO: 2090476 - DNA, 16 bp, Homo sapiens
aaaggtttatgaaaaa

SEQ ID NO: 2090477 - DNA, 15 bp, Homo sapiens
aaaggtttcatgtag

SEQ ID NO: 2090478 - DNA, 19 bp, Homo sapiens
aaagtaacaaggtgtcttt

SEQ ID NO: 2090479 - DNA, 19 bp, Homo sapiens
aaagtaagtaccactcagg

SEQ ID NO: 2090480 - DNA, 13 bp, Homo sapiens
aaagtacatttaa

SEQ ID NO: 2090481 - DNA, 15 bp, Homo sapiens
aaagtacatttaata

SEQ ID NO: 2090482 - DNA, 23 bp, Homo sapiens
aaagtactctttaagagtgaaat

SEQ ID NO: 2090483 - DNA, 23 bp, Homo sapiens
aaagtacttctccaccctgctct

SEQ ID NO: 2090484 - DNA, 19 bp, Homo sapiens
aaagtagaattatatctaa

SEQ ID NO: 2090485 - DNA, 20 bp, Homo sapiens
aaagtagaattatatctaat

SEQ ID NO: 2090486 - DNA, 13 bp, Homo sapiens
aaagtagagaagt

SEQ ID NO: 2090487 - DNA, 15 bp, Homo sapiens
aaagtagagaagtat

SEQ ID NO: 2090488 - DNA, 17 bp, Homo sapiens
aaagtatatatagaatc

SEQ ID NO: 2090489 - DNA, 18 bp, Homo sapiens
aaagtatatatagaatct

SEQ ID NO: 2090490 - DNA, 15 bp, Homo sapiens
aaagtatattttcct

SEQ ID NO: 2090491 - DNA, 12 bp, Homo sapiens
aaagtatcatgc

SEQ ID NO: 2090492 - DNA, 20 bp, Homo sapiens
aaagtatgtaaagtatgtaa

SEQ ID NO: 2090493 - DNA, 14 bp, Homo sapiens
aaagtatgtgatat

SEQ ID NO: 2090494 - DNA, 21 bp, Homo sapiens
aaagtatttttttaagttaga

SEQ ID NO: 2090495 - DNA, 16 bp, Homo sapiens
aaagtctaaagtttac

SEQ ID NO: 2090496 - DNA, 19 bp, Homo sapiens
aaagtctaaagtttacagt

SEQ ID NO: 2090497 - DNA, 17 bp, Homo sapiens
aaagtctgtgtccaatt

SEQ ID NO: 2090498 - DNA, 22 bp, Homo sapiens
aaagtctgtgtgatgaactttc

SEQ ID NO: 2090499 - DNA, 14 bp, Homo sapiens
aaagtgaataaact

SEQ ID NO: 2090500 - DNA, 18 bp, Homo sapiens
aaagtgaataaacttcag

SEQ ID NO: 2090501 - DNA, 18 bp, Homo sapiens
aaagtgacagagacccag

SEQ ID NO: 2090502 - DNA, 22 bp, Homo sapiens
aaagtgacagagacccagatct

SEQ ID NO: 2090503 - DNA, 22 bp, Homo sapiens
aaagtgaggaagcctaaataaa

SEQ ID NO: 2090504 - DNA, 15 bp, Homo sapiens
aaagtgataatttct

SEQ ID NO: 2090505 - DNA, 23 bp, Homo sapiens
aaagtgatcagtatgctgtttta

SEQ ID NO: 2090506 - DNA, 14 bp, Homo sapiens
aaagtgatctgtcc

SEQ ID NO: 2090507 - DNA, 23 bp, Homo sapiens
aaagtgatctgtcccctctcccc

SEQ ID NO: 2090508 - DNA, 18 bp, Homo sapiens
aaagtgcaaagtgccctc

SEQ ID NO: 2090509 - DNA, 15 bp, Homo sapiens
aaagtgcaatgcgtg

SEQ ID NO: 2090510 - DNA, 14 bp, Homo sapiens
aaagtgcagccctt

SEQ ID NO: 2090511 - DNA, 17 bp, Homo sapiens
aaagtgcagcccttcct

SEQ ID NO: 2090512 - DNA, 19 bp, Homo sapiens
aaagtgcagcccttcctcc

SEQ ID NO: 2090513 - DNA, 21 bp, Homo sapiens
aaagtgcagcccttcctcctg

SEQ ID NO: 2090514 - DNA, 20 bp, Homo sapiens
aaagtgccatttcctgtctg

SEQ ID NO: 2090515 - DNA, 19 bp, Homo sapiens
aaagtgcttagaaagttat

SEQ ID NO: 2090516 - DNA, 18 bp, Homo sapiens
aaagtggattttcctgaa

SEQ ID NO: 2090517 - DNA, 17 bp, Homo sapiens
aaagtggccatgccacc

SEQ ID NO: 2090518 - DNA, 19 bp, Homo sapiens
aaagtggctaattcaattt

SEQ ID NO: 2090519 - DNA, 20 bp, Homo sapiens
aaagtgtaaatcctttttct

SEQ ID NO: 2090520 - DNA, 14 bp, Homo sapiens
aaagtgtgagcagt

SEQ ID NO: 2090521 - DNA, 22 bp, Homo sapiens
aaagtgtgagcagtgagttaca

SEQ ID NO: 2090522 - DNA, 17 bp, Homo sapiens
aaagtgtttatttttca

SEQ ID NO: 2090523 - DNA, 20 bp, Homo sapiens
aaagtgtttatttttcatat

SEQ ID NO: 2090524 - DNA, 21 bp, Homo sapiens
aaagtgtttatttttcatatt

SEQ ID NO: 2090525 - DNA, 16 bp, Homo sapiens
aaagttacaaattcaa

SEQ ID NO: 2090526 - DNA, 22 bp, Homo sapiens
aaagttattgtgttgccttagc

SEQ ID NO: 2090527 - DNA, 22 bp, Homo sapiens
aaagttcatagggtctcttcag

SEQ ID NO: 2090528 - DNA, 21 bp, Homo sapiens
aaagttccctacttcctgtga

SEQ ID NO: 2090529 - DNA, 18 bp, Homo sapiens
aaagttgataaagatttt

SEQ ID NO: 2090530 - DNA, 23 bp, Homo sapiens
aaagttgataaagattttttaat

SEQ ID NO: 2090531 - DNA, 12 bp, Homo sapiens
aaagttgctttg

SEQ ID NO: 2090532 - DNA, 19 bp, Homo sapiens
aaagttgggaaaagtgtta

SEQ ID NO: 2090533 - DNA, 16 bp, Homo sapiens
aaagttggtgacagat

SEQ ID NO: 2090534 - DNA, 14 bp, Homo sapiens
aaagtttaaaaaat

SEQ ID NO: 2090535 - DNA, 13 bp, Homo sapiens
aaagtttcaatgt

SEQ ID NO: 2090536 - DNA, 18 bp, Homo sapiens
aaagtttcttggtctcag

SEQ ID NO: 2090537 - DNA, 21 bp, Homo sapiens
aaagttttgatgaaattcttg

SEQ ID NO: 2090538 - DNA, 22 bp, Homo sapiens
aaataaaaaccagaatcataat

SEQ ID NO: 2090539 - DNA, 14 bp, Homo sapiens
aaataaaaataaat

SEQ ID NO: 2090540 - DNA, 16 bp, Homo sapiens
aaataaaaatattctc

SEQ ID NO: 2090541 - DNA, 14 bp, Homo sapiens
aaataaaaccagct

SEQ ID NO: 2090542 - DNA, 17 bp, Homo sapiens
aaataaaacctttcaaa

SEQ ID NO: 2090543 - DNA, 16 bp, Homo sapiens
aaataaaatgaaaaat

SEQ ID NO: 2090544 - DNA, 13 bp, Homo sapiens
aaataaaatgatg

SEQ ID NO: 2090545 - DNA, 18 bp, Homo sapiens
aaataaacctggagatga

SEQ ID NO: 2090546 - DNA, 14 bp, Homo sapiens
aaataaactctaaa

SEQ ID NO: 2090547 - DNA, 11 bp, Homo sapiens
aaataaagcct

SEQ ID NO: 2090548 - DNA, 18 bp, Homo sapiens
aaataaagctactgaatt

SEQ ID NO: 2090549 - DNA, 20 bp, Homo sapiens
aaataaagcttgcaacaaaa

SEQ ID NO: 2090550 - DNA, 19 bp, Homo sapiens
aaataaagtatcatgcatt

SEQ ID NO: 2090551 - DNA, 19 bp, Homo sapiens
aaataaagttggtcttttg

SEQ ID NO: 2090552 - DNA, 16 bp, Homo sapiens
aaataaattgaaatat

SEQ ID NO: 2090553 - DNA, 13 bp, Homo sapiens
aaataaattgttt

SEQ ID NO: 2090554 - DNA, 15 bp, Homo sapiens
aaataaattttgaat

SEQ ID NO: 2090555 - DNA, 14 bp, Homo sapiens
aaataaattttgtt

SEQ ID NO: 2090556 - DNA, 14 bp, Homo sapiens
aaataacaatgtgc

SEQ ID NO: 2090557 - DNA, 12 bp, Homo sapiens
aaataacatttg

SEQ ID NO: 2090558 - DNA, 14 bp, Homo sapiens
aaataagaaacttt

SEQ ID NO: 2090559 - DNA, 15 bp, Homo sapiens
aaataagaaactttt

SEQ ID NO: 2090560 - DNA, 12 bp, Homo sapiens
aaataagagaga

SEQ ID NO: 2090561 - DNA, 20 bp, Homo sapiens
aaataaggggcacctgggaa

SEQ ID NO: 2090562 - DNA, 13 bp, Homo sapiens
aaataagtttttg

SEQ ID NO: 2090563 - DNA, 15 bp, Homo sapiens
aaataatcggcccac

SEQ ID NO: 2090564 - DNA, 12 bp, Homo sapiens
aaataatgattt

SEQ ID NO: 2090565 - DNA, 14 bp, Homo sapiens
aaataatttaacta

SEQ ID NO: 2090566 - DNA, 18 bp, Homo sapiens
aaataatttaactaattt

SEQ ID NO: 2090567 - DNA, 19 bp, Homo sapiens
aaataatttaactaattta

SEQ ID NO: 2090568 - DNA, 20 bp, Homo sapiens
aaataattttaaacaaaggt

SEQ ID NO: 2090569 - DNA, 16 bp, Homo sapiens
aaatgaggacatgttt

SEQ ID NO: 2090570 - DNA, 12 bp, Homo sapiens
aaatgaggagag

SEQ ID NO: 2090571 - DNA, 17 bp, Homo sapiens
aaatgaggtcagagcct

SEQ ID NO: 2090572 - DNA, 19 bp, Homo sapiens
aaatgaggtcagagcctgc

SEQ ID NO: 2090573 - DNA, 17 bp, Homo sapiens
aaatgatgtatgatttg

SEQ ID NO: 2090574 - DNA, 15 bp, Homo sapiens
aaatgattgtaaaat

SEQ ID NO: 2090575 - DNA, 15 bp, Homo sapiens
aaatgcaaaaatctc

SEQ ID NO: 2090576 - DNA, 16 bp, Homo sapiens
aaatgcaaaaatctct

SEQ ID NO: 2090577 - DNA, 21 bp, Homo sapiens
aaatgcaaacactgtgtattt

SEQ ID NO: 2090578 - DNA, 15 bp, Homo sapiens
aaatgcaatatgtat

SEQ ID NO: 2090579 - DNA, 18 bp, Homo sapiens
aaatgcagtccagaataa

SEQ ID NO: 2090580 - DNA, 12 bp, Homo sapiens
aaatgcagtgaa

SEQ ID NO: 2090581 - DNA, 15 bp, Homo sapiens
aaatgcataaatgca

SEQ ID NO: 2090582 - DNA, 16 bp, Homo sapiens
aaatgcatccattcct

SEQ ID NO: 2090583 - DNA, 22 bp, Homo sapiens
aaatgcatccattcctcaggga

SEQ ID NO: 2090584 - DNA, 19 bp, Homo sapiens
aaatgcatgattttataca

SEQ ID NO: 2090585 - DNA, 20 bp, Homo sapiens
aaatgcatgattttatacat

SEQ ID NO: 2090586 - DNA, 16 bp, Homo sapiens
aaatgccttttcccaa

SEQ ID NO: 2090587 - DNA, 21 bp, Homo sapiens
aaatgccttttcccaaaatgt

SEQ ID NO: 2090588 - DNA, 21 bp, Homo sapiens
aaatgctattgttgtgggctt

SEQ ID NO: 2090589 - DNA, 13 bp, Homo sapiens
aaatgctgaatga

SEQ ID NO: 2090590 - DNA, 22 bp, Homo sapiens
aaatgctgggggtaggtggcta

SEQ ID NO: 2090591 - DNA, 20 bp, Homo sapiens
aaatgctgttggtgagaatc

SEQ ID NO: 2090592 - DNA, 15 bp, Homo sapiens
aaatgcttaaaacaa

SEQ ID NO: 2090593 - DNA, 18 bp, Homo sapiens
aaatgctttatgcaaacc

SEQ ID NO: 2090594 - DNA, 15 bp, Homo sapiens
aaatggagaagctct

SEQ ID NO: 2090595 - DNA, 16 bp, Homo sapiens
aaatggagaagctctg

SEQ ID NO: 2090596 - DNA, 19 bp, Homo sapiens
aaatggagcttgtacatat

SEQ ID NO: 2090597 - DNA, 11 bp, Homo sapiens
aaatggagggt

SEQ ID NO: 2090598 - DNA, 14 bp, Homo sapiens
aaatggagggtggg

SEQ ID NO: 2090599 - DNA, 22 bp, Homo sapiens
aaatggaggtccttctgctgga

SEQ ID NO: 2090600 - DNA, 17 bp, Homo sapiens
aaatggctggtttttag

SEQ ID NO: 2090601 - DNA, 22 bp, Homo sapiens
aaatggcttcagaattaaaact

SEQ ID NO: 2090602 - DNA, 17 bp, Homo sapiens
aaatggtcgcccaggag

SEQ ID NO: 2090603 - DNA, 19 bp, Homo sapiens
aaatggtggtttgtcatat

SEQ ID NO: 2090604 - DNA, 21 bp, Homo sapiens
aaatggttgtctgggtcaata

SEQ ID NO: 2090605 - DNA, 20 bp, Homo sapiens
aaatgtaccttcagaataag

SEQ ID NO: 2090606 - DNA, 15 bp, Homo sapiens
aaatgtactgagatt

SEQ ID NO: 2090607 - DNA, 16 bp, Homo sapiens
aaatgtaggtatgaat

SEQ ID NO: 2090608 - DNA, 22 bp, Homo sapiens
aaatgtagtatggcctgtgtca

SEQ ID NO: 2090609 - DNA, 14 bp, Homo sapiens
aaatgtatatacac

SEQ ID NO: 2090610 - DNA, 16 bp, Homo sapiens
aaatgtatatacacat

SEQ ID NO: 2090611 - DNA, 18 bp, Homo sapiens
aaatgtatatacacatat

SEQ ID NO: 2090612 - DNA, 17 bp, Homo sapiens
aaatgtatatatgtata

SEQ ID NO: 2090613 - DNA, 23 bp, Homo sapiens
aaatgtatcctgataaacattaa

SEQ ID NO: 2090614 - DNA, 17 bp, Homo sapiens
aaatgtatcttattcac

SEQ ID NO: 2090615 - DNA, 20 bp, Homo sapiens
aaatgtcacacttgtttctt

SEQ ID NO: 2090616 - DNA, 17 bp, Homo sapiens
aaatgtcatcaaatatt

SEQ ID NO: 2090617 - DNA, 22 bp, Homo sapiens
aaatgtcctgtggtgacaggcc

SEQ ID NO: 2090618 - DNA, 15 bp, Homo sapiens
aaatgtgcttttaaa

SEQ ID NO: 2090619 - DNA, 11 bp, Homo sapiens
aaatgtgtatt

SEQ ID NO: 2090620 - DNA, 15 bp, Homo sapiens
aaatgttcaaactgt

SEQ ID NO: 2090621 - DNA, 15 bp, Homo sapiens
aaatgttcagaaggt

SEQ ID NO: 2090622 - DNA, 13 bp, Homo sapiens
aaatgttctatat

SEQ ID NO: 2090623 - DNA, 22 bp, Homo sapiens
aaatgttctatatgcatttaat

SEQ ID NO: 2090624 - DNA, 18 bp, Homo sapiens
aaatgttgaaatcttaaa

SEQ ID NO: 2090625 - DNA, 19 bp, Homo sapiens
aaatgttgaaatcttaaaa

SEQ ID NO: 2090626 - DNA, 18 bp, Homo sapiens
aaatgttggaattttcaa

SEQ ID NO: 2090627 - DNA, 18 bp, Homo sapiens
aaatgtttcactatgatt

SEQ ID NO: 2090628 - DNA, 19 bp, Homo sapiens
aaatgtttcactatgattt

SEQ ID NO: 2090629 - DNA, 15 bp, Homo sapiens
aaatgtttctgcagt

SEQ ID NO: 2090630 - DNA, 18 bp, Homo sapiens
aaatgtttttattaacaa

SEQ ID NO: 2090631 - DNA, 18 bp, Homo sapiens
aaattaacagtcctaact

SEQ ID NO: 2090632 - DNA, 15 bp, Homo sapiens
aaattaagactttaa

SEQ ID NO: 2090633 - DNA, 22 bp, Homo sapiens
aaattaagactttaaaagatga

SEQ ID NO: 2090634 - DNA, 22 bp, Homo sapiens
aaattacacccaaagaggtatt

SEQ ID NO: 2090635 - DNA, 14 bp, Homo sapiens
aaattactctttct

SEQ ID NO: 2090636 - DNA, 20 bp, Homo sapiens
aaattagaaagcaacttatc

SEQ ID NO: 2090637 - DNA, 18 bp, Homo sapiens
aaattaggatttcatgat

SEQ ID NO: 2090638 - DNA, 15 bp, Homo sapiens
aaattagtaattgta

SEQ ID NO: 2090639 - DNA, 22 bp, Homo sapiens
aaattataacttaaaatatttt

SEQ ID NO: 2090640 - DNA, 16 bp, Homo sapiens
aaattatactgtagct

SEQ ID NO: 2090641 - DNA, 20 bp, Homo sapiens
aaattatgagatgatgaaaa

SEQ ID NO: 2090642 - DNA, 16 bp, Homo sapiens
aaattatggtgaaatt

SEQ ID NO: 2090643 - DNA, 15 bp, Homo sapiens
aaattatttcataca

SEQ ID NO: 2090644 - DNA, 13 bp, Homo sapiens
aaattatttgtgt

SEQ ID NO: 2090645 - DNA, 22 bp, Homo sapiens
aaattatttgtgtaatagaaaa

SEQ ID NO: 2090646 - DNA, 23 bp, Homo sapiens
aaattatttgtgtaatagaaaac

SEQ ID NO: 2090647 - DNA, 17 bp, Homo sapiens
aaattattttaatattt

SEQ ID NO: 2090648 - DNA, 22 bp, Homo sapiens
aaattattttaatattttgtat

SEQ ID NO: 2090649 - DNA, 19 bp, Homo sapiens
aaattatttttaagaaatc

SEQ ID NO: 2090650 - DNA, 21 bp, Homo sapiens
aaattcaaaaagtgtttattt

SEQ ID NO: 2090651 - DNA, 13 bp, Homo sapiens
aaattcaaaccat

SEQ ID NO: 2090652 - DNA, 19 bp, Homo sapiens
aaattcaaaccatttaatt

SEQ ID NO: 2090653 - DNA, 21 bp, Homo sapiens
aaattcaaaccatttaattca

SEQ ID NO: 2090654 - DNA, 14 bp, Homo sapiens
aaattcatttcaca

SEQ ID NO: 2090655 - DNA, 19 bp, Homo sapiens
aaattccaaacttctaaat

SEQ ID NO: 2090656 - DNA, 14 bp, Homo sapiens
aaattcctgtagca

SEQ ID NO: 2090657 - DNA, 12 bp, Homo sapiens
aaattcctgttg

SEQ ID NO: 2090658 - DNA, 18 bp, Homo sapiens
aaattcttgaagttcatg

SEQ ID NO: 2090659 - DNA, 17 bp, Homo sapiens
aaattctttatttctgt

SEQ ID NO: 2090660 - DNA, 15 bp, Homo sapiens
aaattctttttcaaa

SEQ ID NO: 2090661 - DNA, 12 bp, Homo sapiens
aaattgaagaga

SEQ ID NO: 2090662 - DNA, 21 bp, Homo sapiens
aaattgaagagagatatatct

SEQ ID NO: 2090663 - DNA, 14 bp, Homo sapiens
aaattgaatgcaaa

SEQ ID NO: 2090664 - DNA, 15 bp, Homo sapiens
aaattgaatgcaaac

SEQ ID NO: 2090665 - DNA, 13 bp, Homo sapiens
aaattgacttctt

SEQ ID NO: 2090666 - DNA, 12 bp, Homo sapiens
aaattgcacaat

SEQ ID NO: 2090667 - DNA, 13 bp, Homo sapiens
aaattgcacaatt

SEQ ID NO: 2090668 - DNA, 13 bp, Homo sapiens
aaattgcttttgt

SEQ ID NO: 2090669 - DNA, 23 bp, Homo sapiens
aaattgcttttgttgtgactttt

SEQ ID NO: 2090670 - DNA, 18 bp, Homo sapiens
aaattggtacttgtttca

SEQ ID NO: 2090671 - DNA, 22 bp, Homo sapiens
aaattggtgataagtggaaaaa

SEQ ID NO: 2090672 - DNA, 23 bp, Homo sapiens
aaattgtcgtttttttcttgtgc

SEQ ID NO: 2090673 - DNA, 21 bp, Homo sapiens
aaattgtcttttgtcatgtgg

SEQ ID NO: 2090674 - DNA, 19 bp, Homo sapiens
aaattgtgtttagatttta

SEQ ID NO: 2090675 - DNA, 20 bp, Homo sapiens
aaattgttcatgttaccaaa

SEQ ID NO: 2090676 - DNA, 14 bp, Homo sapiens
aaattgttcctgat

SEQ ID NO: 2090677 - DNA, 19 bp, Homo sapiens
aaattgtttggcttcctcc

SEQ ID NO: 2090678 - DNA, 16 bp, Homo sapiens
aaatttaaaaataaag

SEQ ID NO: 2090679 - DNA, 20 bp, Homo sapiens
aaatttaaaaataaagctac

SEQ ID NO: 2090680 - DNA, 21 bp, Homo sapiens
aaatttaataaaaacttcaga

SEQ ID NO: 2090681 - DNA, 16 bp, Homo sapiens
aaatttatattgtaaa

SEQ ID NO: 2090682 - DNA, 12 bp, Homo sapiens
aaatttcaaaag

SEQ ID NO: 2090683 - DNA, 16 bp, Homo sapiens
aaatttcaaaagacat

SEQ ID NO: 2090684 - DNA, 15 bp, Homo sapiens
aacttaaatcactga

SEQ ID NO: 2090685 - DNA, 23 bp, Homo sapiens
aacttacattgtgaaacttctgt

SEQ ID NO: 2090686 - DNA, 17 bp, Homo sapiens
aacttagaataaaattg

SEQ ID NO: 2090687 - DNA, 19 bp, Homo sapiens
aacttagaataaaattgta

SEQ ID NO: 2090688 - DNA, 16 bp, Homo sapiens
aacttagcatgtgttg

SEQ ID NO: 2090689 - DNA, 22 bp, Homo sapiens
aacttagtgcggacaagtttta

SEQ ID NO: 2090690 - DNA, 13 bp, Homo sapiens
aacttatttgagt

SEQ ID NO: 2090691 - DNA, 19 bp, Homo sapiens
aacttatttgagtgattat

SEQ ID NO: 2090692 - DNA, 22 bp, Homo sapiens
aacttcaagtgcatgctctctg

SEQ ID NO: 2090693 - DNA, 15 bp, Homo sapiens
aacttcagacacaaa

SEQ ID NO: 2090694 - DNA, 14 bp, Homo sapiens
aacttcagagaagt

SEQ ID NO: 2090695 - DNA, 20 bp, Homo sapiens
aacttcatatatgaggactt

SEQ ID NO: 2090696 - DNA, 12 bp, Homo sapiens
aacttcatttga

SEQ ID NO: 2090697 - DNA, 23 bp, Homo sapiens
aacttccttggactcattttaaa

SEQ ID NO: 2090698 - DNA, 18 bp, Homo sapiens
aacttcctttgagaattg

SEQ ID NO: 2090699 - DNA, 20 bp, Homo sapiens
aacttcgaaagcatcattat

SEQ ID NO: 2090700 - DNA, 21 bp, Homo sapiens
aacttgaactgattcacatct

SEQ ID NO: 2090701 - DNA, 16 bp, Homo sapiens
aacttgaatctgttac

SEQ ID NO: 2090702 - DNA, 16 bp, Homo sapiens
aacttgagggtaataa

SEQ ID NO: 2090703 - DNA, 20 bp, Homo sapiens
aacttgatatatttcattct

SEQ ID NO: 2090704 - DNA, 14 bp, Homo sapiens
aacttgattttaaa

SEQ ID NO: 2090705 - DNA, 16 bp, Homo sapiens
aacttggaaaaagaaa

SEQ ID NO: 2090706 - DNA, 19 bp, Homo sapiens
aacttggaaaaagaaagaa

SEQ ID NO: 2090707 - DNA, 16 bp, Homo sapiens
aacttggttttgctac

SEQ ID NO: 2090708 - DNA, 14 bp, Homo sapiens
aacttgtatattcc

SEQ ID NO: 2090709 - DNA, 21 bp, Homo sapiens
aacttgtgtactgataaaata

SEQ ID NO: 2090710 - DNA, 13 bp, Homo sapiens
aacttgtgttcta

SEQ ID NO: 2090711 - DNA, 15 bp, Homo sapiens
aacttgtgttctatt

SEQ ID NO: 2090712 - DNA, 20 bp, Homo sapiens
aactttacccaaaaactaaa

SEQ ID NO: 2090713 - DNA, 16 bp, Homo sapiens
aactttagaaataaga

SEQ ID NO: 2090714 - DNA, 15 bp, Homo sapiens
aactttctgtaaact

SEQ ID NO: 2090715 - DNA, 15 bp, Homo sapiens
aagaaaaaaaaagca

SEQ ID NO: 2090716 - DNA, 17 bp, Homo sapiens
aagaaaaaaaagaaagc

SEQ ID NO: 2090717 - DNA, 14 bp, Homo sapiens
aagaaaaaaatata

SEQ ID NO: 2090718 - DNA, 21 bp, Homo sapiens
aagaaaaaaatatattttatg

SEQ ID NO: 2090719 - DNA, 12 bp, Homo sapiens
aagaaaaaatac

SEQ ID NO: 2090720 - DNA, 23 bp, Homo sapiens
aagaaaaataccatgtctctaag

SEQ ID NO: 2090721 - DNA, 12 bp, Homo sapiens
aagaaaaccatt

SEQ ID NO: 2090722 - DNA, 14 bp, Homo sapiens
aagaaaactaacaa

SEQ ID NO: 2090723 - DNA, 14 bp, Homo sapiens
aagaaaactggaaa

SEQ ID NO: 2090724 - DNA, 15 bp, Homo sapiens
aagaaaagataaaga

SEQ ID NO: 2090725 - DNA, 22 bp, Homo sapiens
aagaaaagcagacgcagcagct

SEQ ID NO: 2090726 - DNA, 19 bp, Homo sapiens
aagaaaattagtaattgta

SEQ ID NO: 2090727 - DNA, 11 bp, Homo sapiens
aagaaacagaa

SEQ ID NO: 2090728 - DNA, 18 bp, Homo sapiens
aagaaacaggggatcaaa

SEQ ID NO: 2090729 - DNA, 19 bp, Homo sapiens
aagaaacaggggatcaaag

SEQ ID NO: 2090730 - DNA, 20 bp, Homo sapiens
aagaaaccacaggttccata

SEQ ID NO: 2090731 - DNA, 16 bp, Homo sapiens
aagaaactgaggaatt

SEQ ID NO: 2090732 - DNA, 21 bp, Homo sapiens
aagaaactgaggaattttctt

SEQ ID NO: 2090733 - DNA, 14 bp, Homo sapiens
aagaaactttttta

SEQ ID NO: 2090734 - DNA, 14 bp, Homo sapiens
aagaaagaaacact

SEQ ID NO: 2090735 - DNA, 14 bp, Homo sapiens
aagaaagaacggaa

SEQ ID NO: 2090736 - DNA, 15 bp, Homo sapiens
aagaaagggcaagaa

SEQ ID NO: 2090737 - DNA, 15 bp, Homo sapiens
aagaaataagttttt

SEQ ID NO: 2090738 - DNA, 13 bp, Homo sapiens
aagaaatgtaagg

SEQ ID NO: 2090739 - DNA, 21 bp, Homo sapiens
aagaacaaagagaaaaaatac

SEQ ID NO: 2090740 - DNA, 14 bp, Homo sapiens
aagaacggaagaag

SEQ ID NO: 2090741 - DNA, 23 bp, Homo sapiens
aagaactgccccatctcctccca

SEQ ID NO: 2090742 - DNA, 12 bp, Homo sapiens
aagaagaatata

SEQ ID NO: 2090743 - DNA, 10 bp, Homo sapiens
aagaagagac

SEQ ID NO: 2090744 - DNA, 14 bp, Homo sapiens
aagaagagacagga

SEQ ID NO: 2090745 - DNA, 16 bp, Homo sapiens
aagaagagtttgcaaa

SEQ ID NO: 2090746 - DNA, 21 bp, Homo sapiens
aagaagcaacctcagtaattt

SEQ ID NO: 2090747 - DNA, 22 bp, Homo sapiens
aagaagcattttgtaagttgaa

SEQ ID NO: 2090748 - DNA, 15 bp, Homo sapiens
aagaagccctgctgg

SEQ ID NO: 2090749 - DNA, 11 bp, Homo sapiens
aagaaggaagt

SEQ ID NO: 2090750 - DNA, 21 bp, Homo sapiens
aagaaggcacaggtgtaaata

SEQ ID NO: 2090751 - DNA, 14 bp, Homo sapiens
aagaagggaaattc

SEQ ID NO: 2090752 - DNA, 15 bp, Homo sapiens
aagaagggaaattca

SEQ ID NO: 2090753 - DNA, 14 bp, Homo sapiens
aagaagtaaatttg

SEQ ID NO: 2090754 - DNA, 14 bp, Homo sapiens
aagaagtccccagg

SEQ ID NO: 2090755 - DNA, 17 bp, Homo sapiens
aagaagtccccaggtca

SEQ ID NO: 2090756 - DNA, 20 bp, Homo sapiens
aagaataaaaattgacttct

SEQ ID NO: 2090757 - DNA, 16 bp, Homo sapiens
aagaataaatgaatct

SEQ ID NO: 2090758 - DNA, 13 bp, Homo sapiens
aagaatacagaaa

SEQ ID NO: 2090759 - DNA, 17 bp, Homo sapiens
aagaatacagaaaatgc

SEQ ID NO: 2090760 - DNA, 16 bp, Homo sapiens
aagaatacttctcatt

SEQ ID NO: 2090761 - DNA, 19 bp, Homo sapiens
aagaataggtcattttcta

SEQ ID NO: 2090762 - DNA, 13 bp, Homo sapiens
aagaatataaata

SEQ ID NO: 2090763 - DNA, 21 bp, Homo sapiens
aagaatattcagagaatatca

SEQ ID NO: 2090764 - DNA, 22 bp, Homo sapiens
aagaatattcagagaatatcaa

SEQ ID NO: 2090765 - DNA, 13 bp, Homo sapiens
aagaatattcagg

SEQ ID NO: 2090766 - DNA, 16 bp, Homo sapiens
aagaatcatagtgcca

SEQ ID NO: 2090767 - DNA, 23 bp, Homo sapiens
aagaatgcagattcctgggcctg

SEQ ID NO: 2090768 - DNA, 22 bp, Homo sapiens
aagaatgctggttttcctaaat

SEQ ID NO: 2090769 - DNA, 16 bp, Homo sapiens
aagaatggagcagtac

SEQ ID NO: 2090770 - DNA, 14 bp, Homo sapiens
aagaattatttttg

SEQ ID NO: 2090771 - DNA, 22 bp, Homo sapiens
aagaatttcttggtaagaagcc

SEQ ID NO: 2090772 - DNA, 20 bp, Homo sapiens
aagaattttcagaccccagc

SEQ ID NO: 2090773 - DNA, 22 bp, Homo sapiens
aagaattttcagaccccagcgg

SEQ ID NO: 2090774 - DNA, 22 bp, Homo sapiens
aagacaaaccactgtacatata

SEQ ID NO: 2090775 - DNA, 22 bp, Homo sapiens
aagacacacctctggatccctg

SEQ ID NO: 2090776 - DNA, 18 bp, Homo sapiens
aagacagaatgtcaccag

SEQ ID NO: 2090777 - DNA, 21 bp, Homo sapiens
aagacagcactacagatatca

SEQ ID NO: 2090778 - DNA, 14 bp, Homo sapiens
aagacagctgacag

SEQ ID NO: 2090779 - DNA, 19 bp, Homo sapiens
aagacatgcactatgagga

SEQ ID NO: 2090780 - DNA, 18 bp, Homo sapiens
aagacatgttgtaaatta

SEQ ID NO: 2090781 - DNA, 13 bp, Homo sapiens
aagacatttttat

SEQ ID NO: 2090782 - DNA, 20 bp, Homo sapiens
aagaccagcctggccaacat

SEQ ID NO: 2090783 - DNA, 12 bp, Homo sapiens
aagaccagggct

SEQ ID NO: 2090784 - DNA, 17 bp, Homo sapiens
aagacccagtgtaaaga

SEQ ID NO: 2090785 - DNA, 13 bp, Homo sapiens
aagaccccatctc

SEQ ID NO: 2090786 - DNA, 13 bp, Homo sapiens
aagaccctgagac

SEQ ID NO: 2090787 - DNA, 14 bp, Homo sapiens
aagaccctgagact

SEQ ID NO: 2090788 - DNA, 15 bp, Homo sapiens
aagaccgtgtcccaa

SEQ ID NO: 2090789 - DNA, 19 bp, Homo sapiens
aagacctaaatgacctcag

SEQ ID NO: 2090790 - DNA, 22 bp, Homo sapiens
aagacctaccagggacaagcag

SEQ ID NO: 2090791 - DNA, 14 bp, Homo sapiens
aagaccttctgaag

SEQ ID NO: 2090792 - DNA, 15 bp, Homo sapiens
aagaccttctgaaga

SEQ ID NO: 2090793 - DNA, 12 bp, Homo sapiens
aagacgtttttg

SEQ ID NO: 2090794 - DNA, 22 bp, Homo sapiens
aagacgtttttgtgctgtgggc

SEQ ID NO: 2090795 - DNA, 20 bp, Homo sapiens
aagactatccaacttaacat

SEQ ID NO: 2090796 - DNA, 17 bp, Homo sapiens
aagactattaagagcaa

SEQ ID NO: 2090797 - DNA, 14 bp, Homo sapiens
aagactcagtgttc

SEQ ID NO: 2090798 - DNA, 14 bp, Homo sapiens
aagactccaaagaa

SEQ ID NO: 2090799 - DNA, 11 bp, Homo sapiens
aagcaaaggtg

SEQ ID NO: 2090800 - DNA, 17 bp, Homo sapiens
aagcaaagttgggtgta

SEQ ID NO: 2090801 - DNA, 17 bp, Homo sapiens
aagcaaatcgaatgaaa

SEQ ID NO: 2090802 - DNA, 22 bp, Homo sapiens
aagcaaatttcaaaagacatgt

SEQ ID NO: 2090803 - DNA, 21 bp, Homo sapiens
aagcaacacaagacacctttt

SEQ ID NO: 2090804 - DNA, 19 bp, Homo sapiens
aagcaacataaaacaatga

SEQ ID NO: 2090805 - DNA, 18 bp, Homo sapiens
aagcaacctcagtaattt

SEQ ID NO: 2090806 - DNA, 22 bp, Homo sapiens
aagcaacttgcttctaaatgcc

SEQ ID NO: 2090807 - DNA, 19 bp, Homo sapiens
aagcaagaaagccgtactg

SEQ ID NO: 2090808 - DNA, 19 bp, Homo sapiens
aagcaagacgtcctggaat

SEQ ID NO: 2090809 - DNA, 21 bp, Homo sapiens
aagcaagacgtcctggaatga

SEQ ID NO: 2090810 - DNA, 19 bp, Homo sapiens
aagcaagcattcagaagaa

SEQ ID NO: 2090811 - DNA, 13 bp, Homo sapiens
aagcaagcttaat

SEQ ID NO: 2090812 - DNA, 16 bp, Homo sapiens
aagcaagggctccagc

SEQ ID NO: 2090813 - DNA, 17 bp, Homo sapiens
aagcaagggctccagca

SEQ ID NO: 2090814 - DNA, 23 bp, Homo sapiens
aagcaataattaggatctatgca

SEQ ID NO: 2090815 - DNA, 14 bp, Homo sapiens
aagcaatatttccc

SEQ ID NO: 2090816 - DNA, 17 bp, Homo sapiens
aagcaattgccctgtaa

SEQ ID NO: 2090817 - DNA, 16 bp, Homo sapiens
aagcacagacattaaa

SEQ ID NO: 2090818 - DNA, 18 bp, Homo sapiens
aagcacagtgttaaatga

SEQ ID NO: 2090819 - DNA, 20 bp, Homo sapiens
aagcacagtgttaaatgaaa

SEQ ID NO: 2090820 - DNA, 16 bp, Homo sapiens
aagcacatattgagca

SEQ ID NO: 2090821 - DNA, 21 bp, Homo sapiens
aagcaccagcttctccaggct

SEQ ID NO: 2090822 - DNA, 12 bp, Homo sapiens
aagcacccttga

SEQ ID NO: 2090823 - DNA, 17 bp, Homo sapiens
aagcaccgcagcatgtg

SEQ ID NO: 2090824 - DNA, 13 bp, Homo sapiens
aagcacctcctgc

SEQ ID NO: 2090825 - DNA, 14 bp, Homo sapiens
aagcacctcctgcc

SEQ ID NO: 2090826 - DNA, 13 bp, Homo sapiens
aagcacctgccga

SEQ ID NO: 2090827 - DNA, 19 bp, Homo sapiens
aagcactgacttctaagta

SEQ ID NO: 2090828 - DNA, 21 bp, Homo sapiens
aagcacttgttccttctgctt

SEQ ID NO: 2090829 - DNA, 13 bp, Homo sapiens
aagcactttacag

SEQ ID NO: 2090830 - DNA, 11 bp, Homo sapiens
aagcacttttt

SEQ ID NO: 2090831 - DNA, 13 bp, Homo sapiens
aagcagagcttcc

SEQ ID NO: 2090832 - DNA, 21 bp, Homo sapiens
aagcagaggctttggggtcct

SEQ ID NO: 2090833 - DNA, 10 bp, Homo sapiens
aagcagccag

SEQ ID NO: 2090834 - DNA, 17 bp, Homo sapiens
aagcagccagccagtct

SEQ ID NO: 2090835 - DNA, 16 bp, Homo sapiens
aagcaggcagagcggg

SEQ ID NO: 2090836 - DNA, 17 bp, Homo sapiens
aagcagggacacccccc

SEQ ID NO: 2090837 - DNA, 22 bp, Homo sapiens
aagcaggttgaggggctcctgg

SEQ ID NO: 2090838 - DNA, 20 bp, Homo sapiens
aagcagtcctcttattccta

SEQ ID NO: 2090839 - DNA, 14 bp, Homo sapiens
aagcagtgcctcga

SEQ ID NO: 2090840 - DNA, 21 bp, Homo sapiens
aagcagtgcctcgaggcaccg

SEQ ID NO: 2090841 - DNA, 22 bp, Homo sapiens
aagcagtgtgtccttggggcac

SEQ ID NO: 2090842 - DNA, 14 bp, Homo sapiens
aagcagtgttttca

SEQ ID NO: 2090843 - DNA, 22 bp, Homo sapiens
aagcataaatgcaaacacacaa

SEQ ID NO: 2090844 - DNA, 18 bp, Homo sapiens
aagcatatgcctacttgt

SEQ ID NO: 2090845 - DNA, 18 bp, Homo sapiens
aagcatcacctcaggcca

SEQ ID NO: 2090846 - DNA, 23 bp, Homo sapiens
aagcatcacctcaggccaggtgc

SEQ ID NO: 2090847 - DNA, 13 bp, Homo sapiens
aagcatcagaaag

SEQ ID NO: 2090848 - DNA, 14 bp, Homo sapiens
aagcatcattgtaa

SEQ ID NO: 2090849 - DNA, 19 bp, Homo sapiens
aagcatgcaataatgtgca

SEQ ID NO: 2090850 - DNA, 17 bp, Homo sapiens
aagcatggtcccacatc

SEQ ID NO: 2090851 - DNA, 22 bp, Homo sapiens
aagcatggtcccacatccctgg

SEQ ID NO: 2090852 - DNA, 16 bp, Homo sapiens
aagcatgtaggagaat

SEQ ID NO: 2090853 - DNA, 13 bp, Homo sapiens
aagcatgtggcat

SEQ ID NO: 2090854 - DNA, 15 bp, Homo sapiens
aagcatgtgtttgca

SEQ ID NO: 2090855 - DNA, 15 bp, Homo sapiens
aagcatgtttcatgt

SEQ ID NO: 2090856 - DNA, 15 bp, Homo sapiens
aagcattcagaagaa

SEQ ID NO: 2090857 - DNA, 12 bp, Homo sapiens
aagcattcttag

SEQ ID NO: 2090858 - DNA, 14 bp, Homo sapiens
aagcattgagatct

SEQ ID NO: 2090859 - DNA, 13 bp, Homo sapiens
aagcattgtaaat

SEQ ID NO: 2090860 - DNA, 18 bp, Homo sapiens
aagcattgtaaatgtgct

SEQ ID NO: 2090861 - DNA, 19 bp, Homo sapiens
aagcattgtaaatgtgctt

SEQ ID NO: 2090862 - DNA, 16 bp, Homo sapiens
aagcatttactttgtg

SEQ ID NO: 2090863 - DNA, 18 bp, Homo sapiens
aagcattttactgtctgt

SEQ ID NO: 2090864 - DNA, 13 bp, Homo sapiens
aagcattttgtaa

SEQ ID NO: 2090865 - DNA, 15 bp, Homo sapiens
aagccaaactctgcc

SEQ ID NO: 2090866 - DNA, 15 bp, Homo sapiens
aagccaaatttatat

SEQ ID NO: 2090867 - DNA, 17 bp, Homo sapiens
aagccaacagtcaaaac

SEQ ID NO: 2090868 - DNA, 16 bp, Homo sapiens
aagccaacgacaaagc

SEQ ID NO: 2090869 - DNA, 15 bp, Homo sapiens
aagccacaagaaatt

SEQ ID NO: 2090870 - DNA, 11 bp, Homo sapiens
aagccacagaa

SEQ ID NO: 2090871 - DNA, 19 bp, Homo sapiens
aagccacaggagccccacc

SEQ ID NO: 2090872 - DNA, 23 bp, Homo sapiens
aagccaccttccagtgagctctg

SEQ ID NO: 2090873 - DNA, 16 bp, Homo sapiens
aagccacgctgtcctc

SEQ ID NO: 2090874 - DNA, 13 bp, Homo sapiens
aagccactgaagc

SEQ ID NO: 2090875 - DNA, 23 bp, Homo sapiens
aagccagattttttaaaatttat

SEQ ID NO: 2090876 - DNA, 21 bp, Homo sapiens
aagccagctgccgaccagagc

SEQ ID NO: 2090877 - DNA, 23 bp, Homo sapiens
aagccagctgccgaccagagccc

SEQ ID NO: 2090878 - DNA, 18 bp, Homo sapiens
aagccaggagcaaatgtt

SEQ ID NO: 2090879 - DNA, 21 bp, Homo sapiens
aagccaggagcaaatgtttct

SEQ ID NO: 2090880 - DNA, 18 bp, Homo sapiens
aagccaggctgagtgagc

SEQ ID NO: 2090881 - DNA, 13 bp, Homo sapiens
aagccagtggcag

SEQ ID NO: 2090882 - DNA, 21 bp, Homo sapiens
aagccatggtgacacacagca

SEQ ID NO: 2090883 - DNA, 23 bp, Homo sapiens
aagccattcacttccccaatctt

SEQ ID NO: 2090884 - DNA, 18 bp, Homo sapiens
aagcccagtgacctgacc

SEQ ID NO: 2090885 - DNA, 17 bp, Homo sapiens
aagcccagtttcccttc

SEQ ID NO: 2090886 - DNA, 21 bp, Homo sapiens
aagcccatggagcagggatgt

SEQ ID NO: 2090887 - DNA, 13 bp, Homo sapiens
aagccccagggcc

SEQ ID NO: 2090888 - DNA, 14 bp, Homo sapiens
aagccccagggcct

SEQ ID NO: 2090889 - DNA, 15 bp, Homo sapiens
aagccccagggcctg

SEQ ID NO: 2090890 - DNA, 17 bp, Homo sapiens
aagccccagggcctggg

SEQ ID NO: 2090891 - DNA, 20 bp, Homo sapiens
aagcccccacttctctccag

SEQ ID NO: 2090892 - DNA, 19 bp, Homo sapiens
aagccccccacctttctcg

SEQ ID NO: 2090893 - DNA, 22 bp, Homo sapiens
aagccccccacctttctcgctg

SEQ ID NO: 2090894 - DNA, 19 bp, Homo sapiens
aagcccctcagcccttgcc

SEQ ID NO: 2090895 - DNA, 18 bp, Homo sapiens
aagccccttgtcctctcc

SEQ ID NO: 2090896 - DNA, 13 bp, Homo sapiens
aagccctccttcc

SEQ ID NO: 2090897 - DNA, 15 bp, Homo sapiens
aagccctccttccac

SEQ ID NO: 2090898 - DNA, 21 bp, Homo sapiens
aagccctcgaaccaaggcagc

SEQ ID NO: 2090899 - DNA, 14 bp, Homo sapiens
aagccgggaacaga

SEQ ID NO: 2090900 - DNA, 22 bp, Homo sapiens
aagccggttgcagagaatctgt

SEQ ID NO: 2090901 - DNA, 22 bp, Homo sapiens
aagcctcactattacttgaact

SEQ ID NO: 2090902 - DNA, 20 bp, Homo sapiens
aagcctccatttagttcttt

SEQ ID NO: 2090903 - DNA, 13 bp, Homo sapiens
aagcctccctcct

SEQ ID NO: 2090904 - DNA, 17 bp, Homo sapiens
aagcctctgccctgcct

SEQ ID NO: 2090905 - DNA, 11 bp, Homo sapiens
aagcctctgct

SEQ ID NO: 2090906 - DNA, 14 bp, Homo sapiens
aagcctctgctgcc

SEQ ID NO: 2090907 - DNA, 14 bp, Homo sapiens
aagcctctggtgga

SEQ ID NO: 2090908 - DNA, 21 bp, Homo sapiens
aagcctgcctaggaattccca

SEQ ID NO: 2090909 - DNA, 19 bp, Homo sapiens
aagcctgctaaatgaagag

SEQ ID NO: 2090910 - DNA, 17 bp, Homo sapiens
aagcctggactctaagc

SEQ ID NO: 2090911 - DNA, 15 bp, Homo sapiens
aagcctgggggcctg

SEQ ID NO: 2090912 - DNA, 18 bp, Homo sapiens
aagcctgggggcctggct

SEQ ID NO: 2090913 - DNA, 19 bp, Homo sapiens
aagcctgggggcctggctg

SEQ ID NO: 2090914 - DNA, 16 bp, Homo sapiens
aagtagaattatatct

SEQ ID NO: 2090915 - DNA, 22 bp, Homo sapiens
aagtagaattatatctaattta

SEQ ID NO: 2090916 - DNA, 16 bp, Homo sapiens
aagtagagaacagtca

SEQ ID NO: 2090917 - DNA, 14 bp, Homo sapiens
aagtagagaagtat

SEQ ID NO: 2090918 - DNA, 17 bp, Homo sapiens
aagtagatagaaagcaa

SEQ ID NO: 2090919 - DNA, 15 bp, Homo sapiens
aagtaggaaaaataa

SEQ ID NO: 2090920 - DNA, 22 bp, Homo sapiens
aagtaggactttcctaaatgtt

SEQ ID NO: 2090921 - DNA, 14 bp, Homo sapiens
aagtagtagtgtct

SEQ ID NO: 2090922 - DNA, 21 bp, Homo sapiens
aagtatatagtatatttatac

SEQ ID NO: 2090923 - DNA, 11 bp, Homo sapiens
aagtatcatgc

SEQ ID NO: 2090924 - DNA, 13 bp, Homo sapiens
aagtatccaatta

SEQ ID NO: 2090925 - DNA, 21 bp, Homo sapiens
aagtatccaattatgtgacaa

SEQ ID NO: 2090926 - DNA, 13 bp, Homo sapiens
aagtatgtaaaca

SEQ ID NO: 2090927 - DNA, 12 bp, Homo sapiens
aagtatgtaaag

SEQ ID NO: 2090928 - DNA, 22 bp, Homo sapiens
aagtatgtaaagtatgtaaaca

SEQ ID NO: 2090929 - DNA, 17 bp, Homo sapiens
aagtatgtgatatctga

SEQ ID NO: 2090930 - DNA, 20 bp, Homo sapiens
aagtattaggggtaatatat

SEQ ID NO: 2090931 - DNA, 11 bp, Homo sapiens
aagtatttagg

SEQ ID NO: 2090932 - DNA, 16 bp, Homo sapiens
aagtatttaggttttt

SEQ ID NO: 2090933 - DNA, 12 bp, Homo sapiens
aagtatttatat

SEQ ID NO: 2090934 - DNA, 17 bp, Homo sapiens
aagtatttatatattta

SEQ ID NO: 2090935 - DNA, 19 bp, Homo sapiens
aagtatttgttaatttaga

SEQ ID NO: 2090936 - DNA, 20 bp, Homo sapiens
aagtattttatctgtgttgt

SEQ ID NO: 2090937 - DNA, 23 bp, Homo sapiens
aagtatttttttaagttagagaa

SEQ ID NO: 2090938 - DNA, 16 bp, Homo sapiens
aagtcaaaaggtgcct

SEQ ID NO: 2090939 - DNA, 22 bp, Homo sapiens
aagtcaaagtaaaacttgctgc

SEQ ID NO: 2090940 - DNA, 20 bp, Homo sapiens
aagtcaacaaccatgccagg

SEQ ID NO: 2090941 - DNA, 16 bp, Homo sapiens
aagtcaacactcttct

SEQ ID NO: 2090942 - DNA, 17 bp, Homo sapiens
aagtcaacactcttctt

SEQ ID NO: 2090943 - DNA, 19 bp, Homo sapiens
aagtcaacactcttcttga

SEQ ID NO: 2090944 - DNA, 16 bp, Homo sapiens
aagtcacacagacaca

SEQ ID NO: 2090945 - DNA, 18 bp, Homo sapiens
aagtcacacagacacaca

SEQ ID NO: 2090946 - DNA, 13 bp, Homo sapiens
aagtcacacagtg

SEQ ID NO: 2090947 - DNA, 16 bp, Homo sapiens
aagtcacagctgcagc

SEQ ID NO: 2090948 - DNA, 23 bp, Homo sapiens
aagtcacagctgcagctgggccc

SEQ ID NO: 2090949 - DNA, 20 bp, Homo sapiens
aagtcaccactccattccca

SEQ ID NO: 2090950 - DNA, 14 bp, Homo sapiens
aagtcaccggagct

SEQ ID NO: 2090951 - DNA, 12 bp, Homo sapiens
aagtcactgcac

SEQ ID NO: 2090952 - DNA, 14 bp, Homo sapiens
aagtcactgcacag

SEQ ID NO: 2090953 - DNA, 16 bp, Homo sapiens
aagtcagactgctggg

SEQ ID NO: 2090954 - DNA, 20 bp, Homo sapiens
aagtcagctttcagagccag

SEQ ID NO: 2090955 - DNA, 21 bp, Homo sapiens
aagtcaggcccttattttcaa

SEQ ID NO: 2090956 - DNA, 12 bp, Homo sapiens
aagtcatccaca

SEQ ID NO: 2090957 - DNA, 23 bp, Homo sapiens
aagtcatcttagctttccacagg

SEQ ID NO: 2090958 - DNA, 15 bp, Homo sapiens
aagtcatgaagccca

SEQ ID NO: 2090959 - DNA, 17 bp, Homo sapiens
aagtcatgaagcccaag

SEQ ID NO: 2090960 - DNA, 23 bp, Homo sapiens
aagtcatgaagcccaagtgaaat

SEQ ID NO: 2090961 - DNA, 20 bp, Homo sapiens
aagtcattgtcgctcagcaa

SEQ ID NO: 2090962 - DNA, 19 bp, Homo sapiens
aagtccaacctgcctgtgc

SEQ ID NO: 2090963 - DNA, 12 bp, Homo sapiens
aagtccagagcc

SEQ ID NO: 2090964 - DNA, 13 bp, Homo sapiens
aagtccaggtcct

SEQ ID NO: 2090965 - DNA, 17 bp, Homo sapiens
aagtccaggtcctggtg

SEQ ID NO: 2090966 - DNA, 21 bp, Homo sapiens
aagtccctgttctcagctccg

SEQ ID NO: 2090967 - DNA, 18 bp, Homo sapiens
aagtcctatcgactttat

SEQ ID NO: 2090968 - DNA, 19 bp, Homo sapiens
aagtcgtccttactcctgt

SEQ ID NO: 2090969 - DNA, 18 bp, Homo sapiens
aagtcgtttcaggacatg

SEQ ID NO: 2090970 - DNA, 19 bp, Homo sapiens
aagtcgtttcaggacatgg

SEQ ID NO: 2090971 - DNA, 11 bp, Homo sapiens
aagtctaaagt

SEQ ID NO: 2090972 - DNA, 13 bp, Homo sapiens
aagtctaaagttt

SEQ ID NO: 2090973 - DNA, 14 bp, Homo sapiens
aagtctaaagttta

SEQ ID NO: 2090974 - DNA, 21 bp, Homo sapiens
aagtctattttaaagacgctc

SEQ ID NO: 2090975 - DNA, 19 bp, Homo sapiens
aagtctccaagaatacaga

SEQ ID NO: 2090976 - DNA, 14 bp, Homo sapiens
aagtctctgactct

SEQ ID NO: 2090977 - DNA, 22 bp, Homo sapiens
aagtctctgactcttgcctttc

SEQ ID NO: 2090978 - DNA, 14 bp, Homo sapiens
aagtctctgctgct

SEQ ID NO: 2090979 - DNA, 13 bp, Homo sapiens
aagtctgagtggg

SEQ ID NO: 2090980 - DNA, 20 bp, Homo sapiens
aagtctgggatgtagaactt

SEQ ID NO: 2090981 - DNA, 17 bp, Homo sapiens
aagtcttaaaataactt

SEQ ID NO: 2090982 - DNA, 18 bp, Homo sapiens
aagtcttacttaaaaaaa

SEQ ID NO: 2090983 - DNA, 16 bp, Homo sapiens
aagtcttgtcagaatt

SEQ ID NO: 2090984 - DNA, 18 bp, Homo sapiens
aagtgaaggagaaaggag

SEQ ID NO: 2090985 - DNA, 14 bp, Homo sapiens
aagtgaataaactt

SEQ ID NO: 2090986 - DNA, 16 bp, Homo sapiens
aagtgaataaacttca

SEQ ID NO: 2090987 - DNA, 14 bp, Homo sapiens
aagtgaatccttaa

SEQ ID NO: 2090988 - DNA, 18 bp, Homo sapiens
aagtgaatgctcaagttt

SEQ ID NO: 2090989 - DNA, 15 bp, Homo sapiens
aagtgaatttgcctg

SEQ ID NO: 2090990 - DNA, 17 bp, Homo sapiens
aagtgaatttgcctgta

SEQ ID NO: 2090991 - DNA, 13 bp, Homo sapiens
aagtgactaccag

SEQ ID NO: 2090992 - DNA, 22 bp, Homo sapiens
aagtgagaagctgggcatgaac

SEQ ID NO: 2090993 - DNA, 21 bp, Homo sapiens
aagtgagggctgggcagctga

SEQ ID NO: 2090994 - DNA, 14 bp, Homo sapiens
aagtgatatatgta

SEQ ID NO: 2090995 - DNA, 21 bp, Homo sapiens
aagtgatatatgtatttattg

SEQ ID NO: 2090996 - DNA, 18 bp, Homo sapiens
aagtgatatcataaaagt

SEQ ID NO: 2090997 - DNA, 13 bp, Homo sapiens
aagtgatcctccc

SEQ ID NO: 2090998 - DNA, 19 bp, Homo sapiens
aagtgatctgtcccctctc

SEQ ID NO: 2090999 - DNA, 16 bp, Homo sapiens
aagtgatgatggatga

SEQ ID NO: 2091000 - DNA, 15 bp, Homo sapiens
aagtgattctcctgc

SEQ ID NO: 2091001 - DNA, 17 bp, Homo sapiens
aagtgattctcctgcct

SEQ ID NO: 2091002 - DNA, 12 bp, Homo sapiens
aagtgcaaagtt

SEQ ID NO: 2091003 - DNA, 17 bp, Homo sapiens
aagtgcacacagaaata

SEQ ID NO: 2091004 - DNA, 22 bp, Homo sapiens
aagtgcacacagaaatatatat

SEQ ID NO: 2091005 - DNA, 23 bp, Homo sapiens
aagtgcacacagaaatatatata

SEQ ID NO: 2091006 - DNA, 12 bp, Homo sapiens
aagtgccatccc

SEQ ID NO: 2091007 - DNA, 13 bp, Homo sapiens
aagtgccatccca

SEQ ID NO: 2091008 - DNA, 15 bp, Homo sapiens
aagtgccatcccaca

SEQ ID NO: 2091009 - DNA, 19 bp, Homo sapiens
aagtgccatttcctgtctg

SEQ ID NO: 2091010 - DNA, 20 bp, Homo sapiens
aagtgccatttcctgtctgg

SEQ ID NO: 2091011 - DNA, 14 bp, Homo sapiens
aagtgctccccaca

SEQ ID NO: 2091012 - DNA, 22 bp, Homo sapiens
aagtgctgggattacaggtgtg

SEQ ID NO: 2091013 - DNA, 23 bp, Homo sapiens
aagtgctgtttgagggattttat

SEQ ID NO: 2091014 - DNA, 14 bp, Homo sapiens
aagtgcttagaaag

SEQ ID NO: 2091015 - DNA, 10 bp, Homo sapiens
aagtggaaaa

SEQ ID NO: 2091016 - DNA, 19 bp, Homo sapiens
aagtggaccaggacaggac

SEQ ID NO: 2091017 - DNA, 14 bp, Homo sapiens
aagtggatggaagt

SEQ ID NO: 2091018 - DNA, 16 bp, Homo sapiens
aagtggatggaagtgt

SEQ ID NO: 2091019 - DNA, 12 bp, Homo sapiens
aagtggctgctg

SEQ ID NO: 2091020 - DNA, 16 bp, Homo sapiens
aagtgggccaggacag

SEQ ID NO: 2091021 - DNA, 17 bp, Homo sapiens
aagtgggggccgctggc

SEQ ID NO: 2091022 - DNA, 18 bp, Homo sapiens
aagtgggggccgctggcc

SEQ ID NO: 2091023 - DNA, 22 bp, Homo sapiens
aagtgggttcactagagctggg

SEQ ID NO: 2091024 - DNA, 15 bp, Homo sapiens
aagtgtaaaatagaa

SEQ ID NO: 2091025 - DNA, 16 bp, Homo sapiens
aagtgtaataatatga

SEQ ID NO: 2091026 - DNA, 23 bp, Homo sapiens
aagtgtatttttgtttaatcaaa

SEQ ID NO: 2091027 - DNA, 22 bp, Homo sapiens
aagtgtcatatgtaggtgtctg

SEQ ID NO: 2091028 - DNA, 24 bp, Homo sapiens
aagtgtcatatgtaggtgtctgca

SEQ ID NO: 2091029 - DNA, 20 bp, Homo sapiens
aataaatttattttcttgga

SEQ ID NO: 2091030 - DNA, 18 bp, Homo sapiens
aataaatttggttctaat

SEQ ID NO: 2091031 - DNA, 16 bp, Homo sapiens
aataaattttgtttca

SEQ ID NO: 2091032 - DNA, 19 bp, Homo sapiens
aataacaatgtgctctcgg

SEQ ID NO: 2091033 - DNA, 21 bp, Homo sapiens
aataaccacttaaaaaatgtc

SEQ ID NO: 2091034 - DNA, 15 bp, Homo sapiens
aataacttcagagaa

SEQ ID NO: 2091035 - DNA, 16 bp, Homo sapiens
aataacttcagagaag

SEQ ID NO: 2091036 - DNA, 11 bp, Homo sapiens
aataagaaagt

SEQ ID NO: 2091037 - DNA, 15 bp, Homo sapiens
aataagaagcaaata

SEQ ID NO: 2091038 - DNA, 14 bp, Homo sapiens
aataagaatgattt

SEQ ID NO: 2091039 - DNA, 14 bp, Homo sapiens
aataagagaaagaa

SEQ ID NO: 2091040 - DNA, 23 bp, Homo sapiens
aataagataatgatgagtaactt

SEQ ID NO: 2091041 - DNA, 19 bp, Homo sapiens
aataaggggcacctgggaa

SEQ ID NO: 2091042 - DNA, 14 bp, Homo sapiens
aataagtattcttc

SEQ ID NO: 2091043 - DNA, 14 bp, Homo sapiens
aataagtgaaaata

SEQ ID NO: 2091044 - DNA, 12 bp, Homo sapiens
aataagtgctgt

SEQ ID NO: 2091045 - DNA, 16 bp, Homo sapiens
aataagtgctgtttga

SEQ ID NO: 2091046 - DNA, 18 bp, Homo sapiens
aataagtgctgtttgaga

SEQ ID NO: 2091047 - DNA, 17 bp, Homo sapiens
aataagtggttatttct

SEQ ID NO: 2091048 - DNA, 20 bp, Homo sapiens
aataagtttttgtttcacag

SEQ ID NO: 2091049 - DNA, 16 bp, Homo sapiens
aataatagccatcctt

SEQ ID NO: 2091050 - DNA, 14 bp, Homo sapiens
aataatctttgggt

SEQ ID NO: 2091051 - DNA, 11 bp, Homo sapiens
aataatgattt

SEQ ID NO: 2091052 - DNA, 20 bp, Homo sapiens
aataatgtgcaaattttgca

SEQ ID NO: 2091053 - DNA, 22 bp, Homo sapiens
aataattaggttaacattgttg

SEQ ID NO: 2091054 - DNA, 20 bp, Homo sapiens
aataattatgagtttgctta

SEQ ID NO: 2091055 - DNA, 21 bp, Homo sapiens
aataattgatcaaattcattt

SEQ ID NO: 2091056 - DNA, 16 bp, Homo sapiens
aataatttaactaatt

SEQ ID NO: 2091057 - DNA, 18 bp, Homo sapiens
aataatttaactaattta

SEQ ID NO: 2091058 - DNA, 22 bp, Homo sapiens
aataatttaactaatttaaacc

SEQ ID NO: 2091059 - DNA, 12 bp, Homo sapiens
aataatttagac

SEQ ID NO: 2091060 - DNA, 12 bp, Homo sapiens
aataatttcatc

SEQ ID NO: 2091061 - DNA, 17 bp, Homo sapiens
aataatttgttgtactt

SEQ ID NO: 2091062 - DNA, 18 bp, Homo sapiens
aataatttgttgtacttt

SEQ ID NO: 2091063 - DNA, 12 bp, Homo sapiens
aataattttcct

SEQ ID NO: 2091064 - DNA, 21 bp, Homo sapiens
aatacaaaaaattagccgggc

SEQ ID NO: 2091065 - DNA, 20 bp, Homo sapiens
aatacaaaaattagccgggc

SEQ ID NO: 2091066 - DNA, 12 bp, Homo sapiens
aatacaaaataa

SEQ ID NO: 2091067 - DNA, 20 bp, Homo sapiens
aatacaaaataaaattatgg

SEQ ID NO: 2091068 - DNA, 20 bp, Homo sapiens
aatacaaacatatttgttaa

SEQ ID NO: 2091069 - DNA, 22 bp, Homo sapiens
aatacaacatgtagctgagttt

SEQ ID NO: 2091070 - DNA, 14 bp, Homo sapiens
aatacacactcaaa

SEQ ID NO: 2091071 - DNA, 20 bp, Homo sapiens
aatacaccacctcactcctg

SEQ ID NO: 2091072 - DNA, 17 bp, Homo sapiens
aatacaccacgaatttg

SEQ ID NO: 2091073 - DNA, 19 bp, Homo sapiens
aatacagaaattagccggg

SEQ ID NO: 2091074 - DNA, 16 bp, Homo sapiens
aatacagggcatgcat

SEQ ID NO: 2091075 - DNA, 23 bp, Homo sapiens
aatacagggcatgcattttgcag

SEQ ID NO: 2091076 - DNA, 13 bp, Homo sapiens
aatacagtaaagt

SEQ ID NO: 2091077 - DNA, 14 bp, Homo sapiens
aatacagtaaagtt

SEQ ID NO: 2091078 - DNA, 19 bp, Homo sapiens
aatacagtaaagtttaaaa

SEQ ID NO: 2091079 - DNA, 20 bp, Homo sapiens
aatacagtaaagtttaaaaa

SEQ ID NO: 2091080 - DNA, 23 bp, Homo sapiens
aatacatgctaagagaagtagaa

SEQ ID NO: 2091081 - DNA, 20 bp, Homo sapiens
aatacatgtgtggatgtgta

SEQ ID NO: 2091082 - DNA, 16 bp, Homo sapiens
aataccaaatatttta

SEQ ID NO: 2091083 - DNA, 16 bp, Homo sapiens
aataccaagtatttat

SEQ ID NO: 2091084 - DNA, 19 bp, Homo sapiens
aataccactggttaaaata

SEQ ID NO: 2091085 - DNA, 17 bp, Homo sapiens
aatacccccagagacct

SEQ ID NO: 2091086 - DNA, 15 bp, Homo sapiens
aatacctctgtgtgc

SEQ ID NO: 2091087 - DNA, 16 bp, Homo sapiens
aatacctctgtgtgct

SEQ ID NO: 2091088 - DNA, 16 bp, Homo sapiens
aatacgcactacatgt

SEQ ID NO: 2091089 - DNA, 14 bp, Homo sapiens
aatactaaaatatg

SEQ ID NO: 2091090 - DNA, 16 bp, Homo sapiens
aatactaaagtgtcta

SEQ ID NO: 2091091 - DNA, 13 bp, Homo sapiens
aatactaaatggt

SEQ ID NO: 2091092 - DNA, 16 bp, Homo sapiens
aatactacacatccaa

SEQ ID NO: 2091093 - DNA, 18 bp, Homo sapiens
aatactactgtaaatgta

SEQ ID NO: 2091094 - DNA, 23 bp, Homo sapiens
aatactccaagcttcaagtgata

SEQ ID NO: 2091095 - DNA, 22 bp, Homo sapiens
aatactgccggtcacccaggct

SEQ ID NO: 2091096 - DNA, 13 bp, Homo sapiens
aatactgtacata

SEQ ID NO: 2091097 - DNA, 22 bp, Homo sapiens
aatactgtacatagatgtatca

SEQ ID NO: 2091098 - DNA, 18 bp, Homo sapiens
aatacttaacattgattt

SEQ ID NO: 2091099 - DNA, 11 bp, Homo sapiens
aatacttcatg

SEQ ID NO: 2091100 - DNA, 20 bp, Homo sapiens
aatacttcatttggtgctgg

SEQ ID NO: 2091101 - DNA, 22 bp, Homo sapiens
aatacttctcattttttaaaaa

SEQ ID NO: 2091102 - DNA, 23 bp, Homo sapiens
aatacttctgagaccttgtttca

SEQ ID NO: 2091103 - DNA, 11 bp, Homo sapiens
aatacttgagc

SEQ ID NO: 2091104 - DNA, 19 bp, Homo sapiens
aatacttgagctgtatata

SEQ ID NO: 2091105 - DNA, 16 bp, Homo sapiens
aatactttttcttaaa

SEQ ID NO: 2091106 - DNA, 13 bp, Homo sapiens
aatagaaaactga

SEQ ID NO: 2091107 - DNA, 21 bp, Homo sapiens
aatagaaactcaccatgtaaa

SEQ ID NO: 2091108 - DNA, 23 bp, Homo sapiens
aatagacaactcttccatttatt

SEQ ID NO: 2091109 - DNA, 20 bp, Homo sapiens
aatagacacatcaaatgccc

SEQ ID NO: 2091110 - DNA, 15 bp, Homo sapiens
aatagactaaatgaa

SEQ ID NO: 2091111 - DNA, 21 bp, Homo sapiens
aatagagtatggttgattccc

SEQ ID NO: 2091112 - DNA, 20 bp, Homo sapiens
aatagatcctaggtgctgga

SEQ ID NO: 2091113 - DNA, 11 bp, Homo sapiens
aatagatgttt

SEQ ID NO: 2091114 - DNA, 15 bp, Homo sapiens
aatagattatagttg

SEQ ID NO: 2091115 - DNA, 19 bp, Homo sapiens
aatagcaaaagaagaagtt

SEQ ID NO: 2091116 - DNA, 15 bp, Homo sapiens
aatagcatctgctct

SEQ ID NO: 2091117 - DNA, 20 bp, Homo sapiens
aatagccacttaccttcaat

SEQ ID NO: 2091118 - DNA, 22 bp, Homo sapiens
aatagccacttaccttcaataa

SEQ ID NO: 2091119 - DNA, 21 bp, Homo sapiens
aatagctaaatacctcaatca

SEQ ID NO: 2091120 - DNA, 13 bp, Homo sapiens
aatagctattgca

SEQ ID NO: 2091121 - DNA, 14 bp, Homo sapiens
aatagctattgcat

SEQ ID NO: 2091122 - DNA, 19 bp, Homo sapiens
aatagctattgcatgtaaa

SEQ ID NO: 2091123 - DNA, 23 bp, Homo sapiens
aatagctattgcatgtaaaatgc

SEQ ID NO: 2091124 - DNA, 13 bp, Homo sapiens
aatagctgggact

SEQ ID NO: 2091125 - DNA, 14 bp, Homo sapiens
aatagcttgtatag

SEQ ID NO: 2091126 - DNA, 17 bp, Homo sapiens
aatagtcaagaaaaatt

SEQ ID NO: 2091127 - DNA, 14 bp, Homo sapiens
aatagtccaatatt

SEQ ID NO: 2091128 - DNA, 15 bp, Homo sapiens
aatagtccaatattt

SEQ ID NO: 2091129 - DNA, 22 bp, Homo sapiens
aatagtgtgtcaagattgcaaa

SEQ ID NO: 2091130 - DNA, 13 bp, Homo sapiens
aatagttggctag

SEQ ID NO: 2091131 - DNA, 18 bp, Homo sapiens
aatagttgtccatatttt

SEQ ID NO: 2091132 - DNA, 21 bp, Homo sapiens
aatagttgtccatattttcac

SEQ ID NO: 2091133 - DNA, 20 bp, Homo sapiens
aatagtttctgattcactat

SEQ ID NO: 2091134 - DNA, 13 bp, Homo sapiens
aatataaaatagt

SEQ ID NO: 2091135 - DNA, 14 bp, Homo sapiens
aatataaacactat

SEQ ID NO: 2091136 - DNA, 17 bp, Homo sapiens
aatataaacttgtgtat

SEQ ID NO: 2091137 - DNA, 21 bp, Homo sapiens
aatataaagatggctgacttt

SEQ ID NO: 2091138 - DNA, 14 bp, Homo sapiens
aatataaatgcatg

SEQ ID NO: 2091139 - DNA, 16 bp, Homo sapiens
aatataaatgcatgat

SEQ ID NO: 2091140 - DNA, 18 bp, Homo sapiens
aatataaattaagacttt

SEQ ID NO: 2091141 - DNA, 21 bp, Homo sapiens
aatataaccattacatgttta

SEQ ID NO: 2091142 - DNA, 15 bp, Homo sapiens
aatataattgtttta

SEQ ID NO: 2091143 - DNA, 17 bp, Homo sapiens
aatatactatatttatg

SEQ ID NO: 2091144 - DNA, 15 bp, Homo sapiens
aatgtgaccaggggt

SEQ ID NO: 2091145 - DNA, 17 bp, Homo sapiens
aatgtgaccaggggtga

SEQ ID NO: 2091146 - DNA, 18 bp, Homo sapiens
aatgtgatcaactgttca

SEQ ID NO: 2091147 - DNA, 20 bp, Homo sapiens
aatgtgatcaactgttcagg

SEQ ID NO: 2091148 - DNA, 22 bp, Homo sapiens
aatgtgattctaatgtcttcat

SEQ ID NO: 2091149 - DNA, 14 bp, Homo sapiens
aatgtgcaaatttt

SEQ ID NO: 2091150 - DNA, 18 bp, Homo sapiens
aatgtgcaaattttgcat

SEQ ID NO: 2091151 - DNA, 19 bp, Homo sapiens
aatgtgcaagttgtactgt

SEQ ID NO: 2091152 - DNA, 19 bp, Homo sapiens
aatgtggatagctgccttt

SEQ ID NO: 2091153 - DNA, 20 bp, Homo sapiens
aatgtggcctaaaaatgcaa

SEQ ID NO: 2091154 - DNA, 12 bp, Homo sapiens
aatgtgtaaatg

SEQ ID NO: 2091155 - DNA, 21 bp, Homo sapiens
aatgtgtggtgctaactgtat

SEQ ID NO: 2091156 - DNA, 18 bp, Homo sapiens
aatgtgtgtatgtgtatt

SEQ ID NO: 2091157 - DNA, 18 bp, Homo sapiens
aatgtgtgtctgaagact

SEQ ID NO: 2091158 - DNA, 17 bp, Homo sapiens
aatgtgttgatttgaga

SEQ ID NO: 2091159 - DNA, 18 bp, Homo sapiens
aatgttaaaatattgatt

SEQ ID NO: 2091160 - DNA, 19 bp, Homo sapiens
aatgttaagacttgacagt

SEQ ID NO: 2091161 - DNA, 16 bp, Homo sapiens
aatgttacattattat

SEQ ID NO: 2091162 - DNA, 17 bp, Homo sapiens
aatgttagcctcaattt

SEQ ID NO: 2091163 - DNA, 22 bp, Homo sapiens
aatgttatgttgtgttctaata

SEQ ID NO: 2091164 - DNA, 22 bp, Homo sapiens
aatgttatttgttattttcagt

SEQ ID NO: 2091165 - DNA, 21 bp, Homo sapiens
aatgttattttttaattatta

SEQ ID NO: 2091166 - DNA, 17 bp, Homo sapiens
aatgttcatcaattccc

SEQ ID NO: 2091167 - DNA, 15 bp, Homo sapiens
aatgttccctgcacc

SEQ ID NO: 2091168 - DNA, 20 bp, Homo sapiens
aatgttccctgcaccctgga

SEQ ID NO: 2091169 - DNA, 15 bp, Homo sapiens
aatgttctatatgca

SEQ ID NO: 2091170 - DNA, 23 bp, Homo sapiens
aatgttcttggttcccattgtga

SEQ ID NO: 2091171 - DNA, 15 bp, Homo sapiens
aatgttctttaatgt

SEQ ID NO: 2091172 - DNA, 13 bp, Homo sapiens
aatgttgaaatct

SEQ ID NO: 2091173 - DNA, 14 bp, Homo sapiens
aatgttgaaatctt

SEQ ID NO: 2091174 - DNA, 13 bp, Homo sapiens
aatgttggaattt

SEQ ID NO: 2091175 - DNA, 20 bp, Homo sapiens
aatgttgggatttatatcta

SEQ ID NO: 2091176 - DNA, 14 bp, Homo sapiens
aatgtttaaatata

SEQ ID NO: 2091177 - DNA, 20 bp, Homo sapiens
aatgtttacactctttgtaa

SEQ ID NO: 2091178 - DNA, 22 bp, Homo sapiens
aatgtttatgcaaggaaggaaa

SEQ ID NO: 2091179 - DNA, 16 bp, Homo sapiens
aatgtttattccttga

SEQ ID NO: 2091180 - DNA, 20 bp, Homo sapiens
aatgtttcactatgattttc

SEQ ID NO: 2091181 - DNA, 23 bp, Homo sapiens
aatgtttcactatgattttctat

SEQ ID NO: 2091182 - DNA, 16 bp, Homo sapiens
aatgtttgatttagta

SEQ ID NO: 2091183 - DNA, 18 bp, Homo sapiens
aatgtttgcctctgcctc

SEQ ID NO: 2091184 - DNA, 19 bp, Homo sapiens
aatgtttgcctctgcctct

SEQ ID NO: 2091185 - DNA, 18 bp, Homo sapiens
aatgtttgggcagaaggg

SEQ ID NO: 2091186 - DNA, 22 bp, Homo sapiens
aattaaaaaaatatatattgta

SEQ ID NO: 2091187 - DNA, 17 bp, Homo sapiens
aattaaaaaatttccag

SEQ ID NO: 2091188 - DNA, 21 bp, Homo sapiens
aattaaaaaccactgaacatt

SEQ ID NO: 2091189 - DNA, 13 bp, Homo sapiens
aattaaaatatat

SEQ ID NO: 2091190 - DNA, 11 bp, Homo sapiens
aattaaatgta

SEQ ID NO: 2091191 - DNA, 20 bp, Homo sapiens
aattaacattgggaaatctt

SEQ ID NO: 2091192 - DNA, 16 bp, Homo sapiens
aattaactatgtgatg

SEQ ID NO: 2091193 - DNA, 19 bp, Homo sapiens
aattaactatgtgatgtta

SEQ ID NO: 2091194 - DNA, 18 bp, Homo sapiens
aattaagtaaaccaaaaa

SEQ ID NO: 2091195 - DNA, 18 bp, Homo sapiens
aattaagtgcaatttccc

SEQ ID NO: 2091196 - DNA, 14 bp, Homo sapiens
aattacactacaag

SEQ ID NO: 2091197 - DNA, 17 bp, Homo sapiens
aattacactacaagttt

SEQ ID NO: 2091198 - DNA, 21 bp, Homo sapiens
aattaccttgagccagtaatt

SEQ ID NO: 2091199 - DNA, 14 bp, Homo sapiens
aattacttctctct

SEQ ID NO: 2091200 - DNA, 21 bp, Homo sapiens
aattaggaggctcaacaataa

SEQ ID NO: 2091201 - DNA, 18 bp, Homo sapiens
aattaggatctatgcaat

SEQ ID NO: 2091202 - DNA, 20 bp, Homo sapiens
aattaggatctatgcaattt

SEQ ID NO: 2091203 - DNA, 14 bp, Homo sapiens
aattagtaataaaa

SEQ ID NO: 2091204 - DNA, 18 bp, Homo sapiens
aattagtatttatttaat

SEQ ID NO: 2091205 - DNA, 16 bp, Homo sapiens
aattagtgagatttgt

SEQ ID NO: 2091206 - DNA, 17 bp, Homo sapiens
aattagtgagatttgta

SEQ ID NO: 2091207 - DNA, 13 bp, Homo sapiens
aattataagaaga

SEQ ID NO: 2091208 - DNA, 21 bp, Homo sapiens
aattatataggttgtgcaaat

SEQ ID NO: 2091209 - DNA, 17 bp, Homo sapiens
aattatatctaatttat

SEQ ID NO: 2091210 - DNA, 15 bp, Homo sapiens
aattatccagagttt

SEQ ID NO: 2091211 - DNA, 13 bp, Homo sapiens
aattatccaggaa

SEQ ID NO: 2091212 - DNA, 15 bp, Homo sapiens
aattatcggaagcag

SEQ ID NO: 2091213 - DNA, 19 bp, Homo sapiens
aattatcgggaacagtgtt

SEQ ID NO: 2091214 - DNA, 23 bp, Homo sapiens
aattatcgggaacagtgtttccc

SEQ ID NO: 2091215 - DNA, 13 bp, Homo sapiens
aattatgacagtt

SEQ ID NO: 2091216 - DNA, 13 bp, Homo sapiens
aattatgagatga

SEQ ID NO: 2091217 - DNA, 22 bp, Homo sapiens
aattatgagatgatgaaaataa

SEQ ID NO: 2091218 - DNA, 14 bp, Homo sapiens
aattatgcactggc

SEQ ID NO: 2091219 - DNA, 18 bp, Homo sapiens
aattatggaaatatagtt

SEQ ID NO: 2091220 - DNA, 16 bp, Homo sapiens
aattatgtatgtttac

SEQ ID NO: 2091221 - DNA, 21 bp, Homo sapiens
aattatgtgacaacctttgtg

SEQ ID NO: 2091222 - DNA, 23 bp, Homo sapiens
aattatgtgacaacctttgtgta

SEQ ID NO: 2091223 - DNA, 20 bp, Homo sapiens
aattattatgtctcaaaata

SEQ ID NO: 2091224 - DNA, 21 bp, Homo sapiens
aattattattcttcataacaa

SEQ ID NO: 2091225 - DNA, 12 bp, Homo sapiens
aattattctaat

SEQ ID NO: 2091226 - DNA, 18 bp, Homo sapiens
aattattctaattttata

SEQ ID NO: 2091227 - DNA, 12 bp, Homo sapiens
aattattgtata

SEQ ID NO: 2091228 - DNA, 20 bp, Homo sapiens
aattatttatttatggagga

SEQ ID NO: 2091229 - DNA, 11 bp, Homo sapiens
aattatttcaa

SEQ ID NO: 2091230 - DNA, 12 bp, Homo sapiens
aattatttcaat

SEQ ID NO: 2091231 - DNA, 23 bp, Homo sapiens
aattatttcatacaaaactgttc

SEQ ID NO: 2091232 - DNA, 15 bp, Homo sapiens
aattatttgtgtaat

SEQ ID NO: 2091233 - DNA, 18 bp, Homo sapiens
aattatttgtgtaataga

SEQ ID NO: 2091234 - DNA, 19 bp, Homo sapiens
aattatttgtgtaatagaa

SEQ ID NO: 2091235 - DNA, 14 bp, Homo sapiens
aattattttaaaca

SEQ ID NO: 2091236 - DNA, 18 bp, Homo sapiens
aattattttaaacaaaat

SEQ ID NO: 2091237 - DNA, 22 bp, Homo sapiens
aattattttctttttgtaatta

SEQ ID NO: 2091238 - DNA, 14 bp, Homo sapiens
aattatttttgtgt

SEQ ID NO: 2091239 - DNA, 19 bp, Homo sapiens
aattatttttgtgtttcta

SEQ ID NO: 2091240 - DNA, 15 bp, Homo sapiens
aattcaaaaagtgtt

SEQ ID NO: 2091241 - DNA, 12 bp, Homo sapiens
aattcaaaagct

SEQ ID NO: 2091242 - DNA, 21 bp, Homo sapiens
aattcaaaccatttaattcat

SEQ ID NO: 2091243 - DNA, 15 bp, Homo sapiens
aattcaacacattac

SEQ ID NO: 2091244 - DNA, 17 bp, Homo sapiens
aattcaacacattactt

SEQ ID NO: 2091245 - DNA, 18 bp, Homo sapiens
aattcaacctgtgtctta

SEQ ID NO: 2091246 - DNA, 15 bp, Homo sapiens
aattcaattcaaagc

SEQ ID NO: 2091247 - DNA, 12 bp, Homo sapiens
aattcagcaccc

SEQ ID NO: 2091248 - DNA, 14 bp, Homo sapiens
aattcagcaccctg

SEQ ID NO: 2091249 - DNA, 18 bp, Homo sapiens
aattcagcaccctgggtg

SEQ ID NO: 2091250 - DNA, 15 bp, Homo sapiens
aattcagcactgatt

SEQ ID NO: 2091251 - DNA, 13 bp, Homo sapiens
aattcaggactgg

SEQ ID NO: 2091252 - DNA, 20 bp, Homo sapiens
aattcaggactggctcaccc

SEQ ID NO: 2091253 - DNA, 14 bp, Homo sapiens
aattcataattaga

SEQ ID NO: 2091254 - DNA, 15 bp, Homo sapiens
aattcataattagaa

SEQ ID NO: 2091255 - DNA, 17 bp, Homo sapiens
aattcataattagaaca

SEQ ID NO: 2091256 - DNA, 18 bp, Homo sapiens
aattcatgtacagcatgc

SEQ ID NO: 2091257 - DNA, 22 bp, Homo sapiens
aattcattaaatttctggattt

SEQ ID NO: 2091258 - DNA, 19 bp, Homo sapiens
aattcatttcactttaaag

SEQ ID NO: 2091259 - DNA, 13 bp, Homo sapiens
acaattgtaaagt

SEQ ID NO: 2091260 - DNA, 13 bp, Homo sapiens
acaatttaaagca

SEQ ID NO: 2091261 - DNA, 14 bp, Homo sapiens
acaatttagaaaac

SEQ ID NO: 2091262 - DNA, 12 bp, Homo sapiens
acaatttatatt

SEQ ID NO: 2091263 - DNA, 17 bp, Homo sapiens
acaatttcctttatatt

SEQ ID NO: 2091264 - DNA, 17 bp, Homo sapiens
acaatttgagcaattca

SEQ ID NO: 2091265 - DNA, 19 bp, Homo sapiens
acaatttgagcaattcatt

SEQ ID NO: 2091266 - DNA, 22 bp, Homo sapiens
acaattttcaggtttcttaaaa

SEQ ID NO: 2091267 - DNA, 15 bp, Homo sapiens
acacaaaatgtcaca

SEQ ID NO: 2091268 - DNA, 15 bp, Homo sapiens
acacaaacacctcct

SEQ ID NO: 2091269 - DNA, 13 bp, Homo sapiens
acacaacacacac

SEQ ID NO: 2091270 - DNA, 13 bp, Homo sapiens
acacaagccacag

SEQ ID NO: 2091271 - DNA, 19 bp, Homo sapiens
acacaagccacagaagcca

SEQ ID NO: 2091272 - DNA, 16 bp, Homo sapiens
acacaaggctgggcac

SEQ ID NO: 2091273 - DNA, 22 bp, Homo sapiens
acacaatctttccttgtctctc

SEQ ID NO: 2091274 - DNA, 18 bp, Homo sapiens
acacaattgatacttcag

SEQ ID NO: 2091275 - DNA, 20 bp, Homo sapiens
acacaattgatacttcaggt

SEQ ID NO: 2091276 - DNA, 23 bp, Homo sapiens
acacaattgatacttcaggtgct

SEQ ID NO: 2091277 - DNA, 10 bp, Homo sapiens
acacacacac

SEQ ID NO: 2091278 - DNA, 13 bp, Homo sapiens
acacacacacaca

SEQ ID NO: 2091279 - DNA, 13 bp, Homo sapiens
acacacacacata

SEQ ID NO: 2091280 - DNA, 14 bp, Homo sapiens
acacacagatgcac

SEQ ID NO: 2091281 - DNA, 13 bp, Homo sapiens
acacacagcactc

SEQ ID NO: 2091282 - DNA, 11 bp, Homo sapiens
acacacagctc

SEQ ID NO: 2091283 - DNA, 13 bp, Homo sapiens
acacacagctcct

SEQ ID NO: 2091284 - DNA, 13 bp, Homo sapiens
acacacatataca

SEQ ID NO: 2091285 - DNA, 14 bp, Homo sapiens
acacacatatacat

SEQ ID NO: 2091286 - DNA, 18 bp, Homo sapiens
acacacatatacatatat

SEQ ID NO: 2091287 - DNA, 20 bp, Homo sapiens
acacaccagagcccaccttg

SEQ ID NO: 2091288 - DNA, 12 bp, Homo sapiens
acacacccccca

SEQ ID NO: 2091289 - DNA, 11 bp, Homo sapiens
acacacccctc

SEQ ID NO: 2091290 - DNA, 14 bp, Homo sapiens
acacacgcaggaac

SEQ ID NO: 2091291 - DNA, 16 bp, Homo sapiens
acacacgcaggaactc

SEQ ID NO: 2091292 - DNA, 23 bp, Homo sapiens
acacacgtatttatatttggaaa

SEQ ID NO: 2091293 - DNA, 20 bp, Homo sapiens
acacactcaaatcaagaaac

SEQ ID NO: 2091294 - DNA, 13 bp, Homo sapiens
acacactcagcag

SEQ ID NO: 2091295 - DNA, 18 bp, Homo sapiens
acacactgtaaacccctg

SEQ ID NO: 2091296 - DNA, 21 bp, Homo sapiens
acacactgtaaacccctgggt

SEQ ID NO: 2091297 - DNA, 18 bp, Homo sapiens
acacagactacagccaga

SEQ ID NO: 2091298 - DNA, 23 bp, Homo sapiens
acacagactgcgatttgtcccag

SEQ ID NO: 2091299 - DNA, 17 bp, Homo sapiens
acacagaggaagagcag

SEQ ID NO: 2091300 - DNA, 20 bp, Homo sapiens
acacagaggttttaaacagt

SEQ ID NO: 2091301 - DNA, 21 bp, Homo sapiens
acacagaggttttaaacagtc

SEQ ID NO: 2091302 - DNA, 19 bp, Homo sapiens
acacagatatacacatgga

SEQ ID NO: 2091303 - DNA, 15 bp, Homo sapiens
acacagatatgcaca

SEQ ID NO: 2091304 - DNA, 22 bp, Homo sapiens
acacagcctgggaccagggcat

SEQ ID NO: 2091305 - DNA, 18 bp, Homo sapiens
acacagcgtccctagcag

SEQ ID NO: 2091306 - DNA, 12 bp, Homo sapiens
acacagctctgt

SEQ ID NO: 2091307 - DNA, 16 bp, Homo sapiens
acacaggcaactgagg

SEQ ID NO: 2091308 - DNA, 20 bp, Homo sapiens
acacaggcaactgaggcaga

SEQ ID NO: 2091309 - DNA, 21 bp, Homo sapiens
acacaggcaactgaggcagac

SEQ ID NO: 2091310 - DNA, 16 bp, Homo sapiens
acacaggcatttcctg

SEQ ID NO: 2091311 - DNA, 20 bp, Homo sapiens
acacaggcatttcctgggtg

SEQ ID NO: 2091312 - DNA, 14 bp, Homo sapiens
acacaggccagccc

SEQ ID NO: 2091313 - DNA, 18 bp, Homo sapiens
acacaggcccggctccag

SEQ ID NO: 2091314 - DNA, 23 bp, Homo sapiens
acacaggcccggctccaggctcc

SEQ ID NO: 2091315 - DNA, 24 bp, Homo sapiens
acacaggcccggctccaggctcct

SEQ ID NO: 2091316 - DNA, 22 bp, Homo sapiens
acacaggcctgtgtagctgtga

SEQ ID NO: 2091317 - DNA, 19 bp, Homo sapiens
acacagggctctttgatgg

SEQ ID NO: 2091318 - DNA, 15 bp, Homo sapiens
acacagggttttgta

SEQ ID NO: 2091319 - DNA, 20 bp, Homo sapiens
acacaggtacagcaacagga

SEQ ID NO: 2091320 - DNA, 23 bp, Homo sapiens
acacaggtcctgaaagtctgtgt

SEQ ID NO: 2091321 - DNA, 20 bp, Homo sapiens
acacagtgggaactctgaca

SEQ ID NO: 2091322 - DNA, 22 bp, Homo sapiens
acacagtgttccagctgcctgg

SEQ ID NO: 2091323 - DNA, 23 bp, Homo sapiens
acacagtgttccagctgcctggg

SEQ ID NO: 2091324 - DNA, 15 bp, Homo sapiens
acacagttgctgtca

SEQ ID NO: 2091325 - DNA, 13 bp, Homo sapiens
acacataatttga

SEQ ID NO: 2091326 - DNA, 19 bp, Homo sapiens
acacatactcatttttcat

SEQ ID NO: 2091327 - DNA, 22 bp, Homo sapiens
acacatactcatttttcatgat

SEQ ID NO: 2091328 - DNA, 21 bp, Homo sapiens
acacatatacctataatgtgt

SEQ ID NO: 2091329 - DNA, 14 bp, Homo sapiens
acacatcaaatgcc

SEQ ID NO: 2091330 - DNA, 15 bp, Homo sapiens
acacatcaaatgccc

SEQ ID NO: 2091331 - DNA, 20 bp, Homo sapiens
acacatccccagccagaagt

SEQ ID NO: 2091332 - DNA, 17 bp, Homo sapiens
acacatcccggcctctt

SEQ ID NO: 2091333 - DNA, 20 bp, Homo sapiens
acacatcccggcctcttcca

SEQ ID NO: 2091334 - DNA, 17 bp, Homo sapiens
acacatccctaatgtgt

SEQ ID NO: 2091335 - DNA, 16 bp, Homo sapiens
acacatcgcactgtgg

SEQ ID NO: 2091336 - DNA, 22 bp, Homo sapiens
acacatgaaccatccttcccat

SEQ ID NO: 2091337 - DNA, 15 bp, Homo sapiens
acacattacttgcac

SEQ ID NO: 2091338 - DNA, 17 bp, Homo sapiens
acacattacttgcacaa

SEQ ID NO: 2091339 - DNA, 18 bp, Homo sapiens
acacattacttgcacaag

SEQ ID NO: 2091340 - DNA, 19 bp, Homo sapiens
acacattatgttagagagg

SEQ ID NO: 2091341 - DNA, 14 bp, Homo sapiens
acacattgtgcttg

SEQ ID NO: 2091342 - DNA, 23 bp, Homo sapiens
acaccaccaaatgacaagtcaca

SEQ ID NO: 2091343 - DNA, 17 bp, Homo sapiens
acaccactctggcagcc

SEQ ID NO: 2091344 - DNA, 13 bp, Homo sapiens
acaccactgccct

SEQ ID NO: 2091345 - DNA, 14 bp, Homo sapiens
acaccactgccctg

SEQ ID NO: 2091346 - DNA, 17 bp, Homo sapiens
acaccactgccctgcct

SEQ ID NO: 2091347 - DNA, 13 bp, Homo sapiens
acaccagagccca

SEQ ID NO: 2091348 - DNA, 23 bp, Homo sapiens
acaccagagcccaccttggctca

SEQ ID NO: 2091349 - DNA, 23 bp, Homo sapiens
acaccagccatcatgtgcctgga

SEQ ID NO: 2091350 - DNA, 17 bp, Homo sapiens
acaccaggagtccctgg

SEQ ID NO: 2091351 - DNA, 17 bp, Homo sapiens
acaccataggtagaatg

SEQ ID NO: 2091352 - DNA, 20 bp, Homo sapiens
acacccaaagcatggactaa

SEQ ID NO: 2091353 - DNA, 12 bp, Homo sapiens
acacccactggc

SEQ ID NO: 2091354 - DNA, 13 bp, Homo sapiens
acacccactggcc

SEQ ID NO: 2091355 - DNA, 14 bp, Homo sapiens
acacccactggcca

SEQ ID NO: 2091356 - DNA, 19 bp, Homo sapiens
acacccagcccacttctgc

SEQ ID NO: 2091357 - DNA, 21 bp, Homo sapiens
acacccatgtaaatgtccaaa

SEQ ID NO: 2091358 - DNA, 20 bp, Homo sapiens
acacccctccaaagccccac

SEQ ID NO: 2091359 - DNA, 16 bp, Homo sapiens
acacccctcccctgcc

SEQ ID NO: 2091360 - DNA, 23 bp, Homo sapiens
acacccctcccctgccctagagc

SEQ ID NO: 2091361 - DNA, 18 bp, Homo sapiens
acaccccttatccaggac

SEQ ID NO: 2091362 - DNA, 17 bp, Homo sapiens
acacccggctccccctg

SEQ ID NO: 2091363 - DNA, 13 bp, Homo sapiens
acacccttttaac

SEQ ID NO: 2091364 - DNA, 18 bp, Homo sapiens
acacctaccaaaaaataa

SEQ ID NO: 2091365 - DNA, 11 bp, Homo sapiens
acacctcccag

SEQ ID NO: 2091366 - DNA, 23 bp, Homo sapiens
acacctcccaggggctccacctg

SEQ ID NO: 2091367 - DNA, 16 bp, Homo sapiens
acacctccctgaacca

SEQ ID NO: 2091368 - DNA, 17 bp, Homo sapiens
acacctccttgctttgc

SEQ ID NO: 2091369 - DNA, 14 bp, Homo sapiens
acacctgcacctcc

SEQ ID NO: 2091370 - DNA, 18 bp, Homo sapiens
acacctgcacctcccccc

SEQ ID NO: 2091371 - DNA, 15 bp, Homo sapiens
acacctgccccagcg

SEQ ID NO: 2091372 - DNA, 19 bp, Homo sapiens
acacctgccccagcgcggc

SEQ ID NO: 2091373 - DNA, 12 bp, Homo sapiens
acacctgccctg

SEQ ID NO: 2091374 - DNA, 19 bp, Homo sapiens
acaggcaatgctggctgtt

SEQ ID NO: 2091375 - DNA, 23 bp, Homo sapiens
acaggcaatgctggctgttggct

SEQ ID NO: 2091376 - DNA, 22 bp, Homo sapiens
acaggcagcgatggtctcagaa

SEQ ID NO: 2091377 - DNA, 20 bp, Homo sapiens
acaggcatttcctgggtggc

SEQ ID NO: 2091378 - DNA, 19 bp, Homo sapiens
acaggccagccccatcttg

SEQ ID NO: 2091379 - DNA, 13 bp, Homo sapiens
acaggcccagtgg

SEQ ID NO: 2091380 - DNA, 19 bp, Homo sapiens
acaggccccccgcagcacc

SEQ ID NO: 2091381 - DNA, 17 bp, Homo sapiens
acaggcccggctccagg

SEQ ID NO: 2091382 - DNA, 20 bp, Homo sapiens
acaggcccggctccaggctc

SEQ ID NO: 2091383 - DNA, 21 bp, Homo sapiens
acaggcccggctccaggctcc

SEQ ID NO: 2091384 - DNA, 15 bp, Homo sapiens
acaggcccttcctct

SEQ ID NO: 2091385 - DNA, 22 bp, Homo sapiens
acaggcccttggggttccccca

SEQ ID NO: 2091386 - DNA, 20 bp, Homo sapiens
acaggctgttctgcactgaa

SEQ ID NO: 2091387 - DNA, 12 bp, Homo sapiens
acagggaaggca

SEQ ID NO: 2091388 - DNA, 17 bp, Homo sapiens
acagggagcccctagga

SEQ ID NO: 2091389 - DNA, 18 bp, Homo sapiens
acagggagcccctaggaa

SEQ ID NO: 2091390 - DNA, 12 bp, Homo sapiens
acagggcacacc

SEQ ID NO: 2091391 - DNA, 15 bp, Homo sapiens
acaggggatcaaagt

SEQ ID NO: 2091392 - DNA, 19 bp, Homo sapiens
acaggggcggggcaggaat

SEQ ID NO: 2091393 - DNA, 17 bp, Homo sapiens
acagggtagcaggtacc

SEQ ID NO: 2091394 - DNA, 22 bp, Homo sapiens
acagggtcgggggggtccccat

SEQ ID NO: 2091395 - DNA, 18 bp, Homo sapiens
acaggtaaactatcttgg

SEQ ID NO: 2091396 - DNA, 14 bp, Homo sapiens
acaggtaaccacaa

SEQ ID NO: 2091397 - DNA, 15 bp, Homo sapiens
acaggtctagacttt

SEQ ID NO: 2091398 - DNA, 18 bp, Homo sapiens
acaggtctcctcttaaaa

SEQ ID NO: 2091399 - DNA, 14 bp, Homo sapiens
acaggtgcaagcca

SEQ ID NO: 2091400 - DNA, 19 bp, Homo sapiens
acaggtggcctagcaggca

SEQ ID NO: 2091401 - DNA, 19 bp, Homo sapiens
acaggtgtgaaccaccaca

SEQ ID NO: 2091402 - DNA, 13 bp, Homo sapiens
acaggttttcagc

SEQ ID NO: 2091403 - DNA, 22 bp, Homo sapiens
acagtaaaaacttgtactatgt

SEQ ID NO: 2091404 - DNA, 17 bp, Homo sapiens
acagtaaagtttaaaaa

SEQ ID NO: 2091405 - DNA, 17 bp, Homo sapiens
acagtaaataaattgtt

SEQ ID NO: 2091406 - DNA, 16 bp, Homo sapiens
acagtactatgtaaat

SEQ ID NO: 2091407 - DNA, 19 bp, Homo sapiens
acagtagccaagttatatt

SEQ ID NO: 2091408 - DNA, 18 bp, Homo sapiens
acagtagcttaaataaat

SEQ ID NO: 2091409 - DNA, 22 bp, Homo sapiens
acagtagcttaaataaattcaa

SEQ ID NO: 2091410 - DNA, 14 bp, Homo sapiens
acagtcattcacat

SEQ ID NO: 2091411 - DNA, 14 bp, Homo sapiens
acagtcatttaaaa

SEQ ID NO: 2091412 - DNA, 18 bp, Homo sapiens
acagtcctaactggtata

SEQ ID NO: 2091413 - DNA, 22 bp, Homo sapiens
acagtcctcacagcctctccct

SEQ ID NO: 2091414 - DNA, 21 bp, Homo sapiens
acagtcctgggagaacctcag

SEQ ID NO: 2091415 - DNA, 23 bp, Homo sapiens
acagtcctgggagaacctcaggc

SEQ ID NO: 2091416 - DNA, 15 bp, Homo sapiens
acagtctaaagctgg

SEQ ID NO: 2091417 - DNA, 16 bp, Homo sapiens
acagtctcagtccaga

SEQ ID NO: 2091418 - DNA, 12 bp, Homo sapiens
acagtctctggg

SEQ ID NO: 2091419 - DNA, 20 bp, Homo sapiens
acagtctctttaatcttcag

SEQ ID NO: 2091420 - DNA, 22 bp, Homo sapiens
acagtgacaaattgtaactaca

SEQ ID NO: 2091421 - DNA, 20 bp, Homo sapiens
acagtgactgtcgtgtttac

SEQ ID NO: 2091422 - DNA, 20 bp, Homo sapiens
acagtgactttacaggaggt

SEQ ID NO: 2091423 - DNA, 12 bp, Homo sapiens
acagtgagccaa

SEQ ID NO: 2091424 - DNA, 17 bp, Homo sapiens
acagtgagcctgaattt

SEQ ID NO: 2091425 - DNA, 21 bp, Homo sapiens
acagtgagcctgaattttgtt

SEQ ID NO: 2091426 - DNA, 14 bp, Homo sapiens
acagtgaggagggt

SEQ ID NO: 2091427 - DNA, 22 bp, Homo sapiens
acagtgagtcgaggacagggag

SEQ ID NO: 2091428 - DNA, 15 bp, Homo sapiens
acagtgcatctcagc

SEQ ID NO: 2091429 - DNA, 18 bp, Homo sapiens
acagtgcatctcagccca

SEQ ID NO: 2091430 - DNA, 19 bp, Homo sapiens
acagtgctctaggctgccc

SEQ ID NO: 2091431 - DNA, 12 bp, Homo sapiens
acagtgctgctt

SEQ ID NO: 2091432 - DNA, 16 bp, Homo sapiens
acagtggaactacatt

SEQ ID NO: 2091433 - DNA, 13 bp, Homo sapiens
acagtggagtgag

SEQ ID NO: 2091434 - DNA, 16 bp, Homo sapiens
acagtgggaactctga

SEQ ID NO: 2091435 - DNA, 19 bp, Homo sapiens
acagtgggaactctgacaa

SEQ ID NO: 2091436 - DNA, 21 bp, Homo sapiens
acagtgggaactctgacaagg

SEQ ID NO: 2091437 - DNA, 17 bp, Homo sapiens
acagtgggaactggagg

SEQ ID NO: 2091438 - DNA, 14 bp, Homo sapiens
acagtgggtggcac

SEQ ID NO: 2091439 - DNA, 17 bp, Homo sapiens
acagtgggtggcacctc

SEQ ID NO: 2091440 - DNA, 21 bp, Homo sapiens
acagtgggtggcacctcctga

SEQ ID NO: 2091441 - DNA, 11 bp, Homo sapiens
acagtgtgtgt

SEQ ID NO: 2091442 - DNA, 21 bp, Homo sapiens
acagtgttccagctgcctggg

SEQ ID NO: 2091443 - DNA, 19 bp, Homo sapiens
acagtgtttcgacagctga

SEQ ID NO: 2091444 - DNA, 23 bp, Homo sapiens
acagttatctaagttaatttaaa

SEQ ID NO: 2091445 - DNA, 18 bp, Homo sapiens
acagttatttatagtcat

SEQ ID NO: 2091446 - DNA, 17 bp, Homo sapiens
acagttcaaagaagtca

SEQ ID NO: 2091447 - DNA, 12 bp, Homo sapiens
acagttcaagaa

SEQ ID NO: 2091448 - DNA, 22 bp, Homo sapiens
acagttcttggtgactgtccca

SEQ ID NO: 2091449 - DNA, 14 bp, Homo sapiens
acagttggcagaga

SEQ ID NO: 2091450 - DNA, 19 bp, Homo sapiens
acagttgtctattctgagc

SEQ ID NO: 2091451 - DNA, 15 bp, Homo sapiens
acagtttatttgttg

SEQ ID NO: 2091452 - DNA, 16 bp, Homo sapiens
acagttttaagagttg

SEQ ID NO: 2091453 - DNA, 16 bp, Homo sapiens
acagttttctgagaaa

SEQ ID NO: 2091454 - DNA, 17 bp, Homo sapiens
acagttttctgagaaag

SEQ ID NO: 2091455 - DNA, 23 bp, Homo sapiens
acagttttgtcagtctttcttag

SEQ ID NO: 2091456 - DNA, 15 bp, Homo sapiens
acataaagcaaatag

SEQ ID NO: 2091457 - DNA, 18 bp, Homo sapiens
acataaagcaaatagaca

SEQ ID NO: 2091458 - DNA, 13 bp, Homo sapiens
acataacaagaaa

SEQ ID NO: 2091459 - DNA, 22 bp, Homo sapiens
acataacttgatatagaaagct

SEQ ID NO: 2091460 - DNA, 19 bp, Homo sapiens
acataagaccgtgtcccaa

SEQ ID NO: 2091461 - DNA, 15 bp, Homo sapiens
acataagccattatt

SEQ ID NO: 2091462 - DNA, 18 bp, Homo sapiens
acataagccattattcac

SEQ ID NO: 2091463 - DNA, 18 bp, Homo sapiens
acataatataagaatcat

SEQ ID NO: 2091464 - DNA, 23 bp, Homo sapiens
acataattatccaggaagggaat

SEQ ID NO: 2091465 - DNA, 17 bp, Homo sapiens
acatacaacacaaagag

SEQ ID NO: 2091466 - DNA, 13 bp, Homo sapiens
acatacaatttgc

SEQ ID NO: 2091467 - DNA, 16 bp, Homo sapiens
acatacacatacatac

SEQ ID NO: 2091468 - DNA, 20 bp, Homo sapiens
acatacacttgtataaatgt

SEQ ID NO: 2091469 - DNA, 13 bp, Homo sapiens
acatacatacaca

SEQ ID NO: 2091470 - DNA, 15 bp, Homo sapiens
acatacatacataca

SEQ ID NO: 2091471 - DNA, 17 bp, Homo sapiens
acatacatacatatata

SEQ ID NO: 2091472 - DNA, 13 bp, Homo sapiens
acatacatatata

SEQ ID NO: 2091473 - DNA, 14 bp, Homo sapiens
acatacatatatat

SEQ ID NO: 2091474 - DNA, 24 bp, Homo sapiens
acatacgtgttaggaggctgcatg

SEQ ID NO: 2091475 - DNA, 13 bp, Homo sapiens
acatactcatttg

SEQ ID NO: 2091476 - DNA, 17 bp, Homo sapiens
acatactcatttttcat

SEQ ID NO: 2091477 - DNA, 21 bp, Homo sapiens
acatagaaattgcctgacgaa

SEQ ID NO: 2091478 - DNA, 18 bp, Homo sapiens
acatagatgtatcattaa

SEQ ID NO: 2091479 - DNA, 19 bp, Homo sapiens
acatagatgtatcattaat

SEQ ID NO: 2091480 - DNA, 18 bp, Homo sapiens
acatagattaatggcact

SEQ ID NO: 2091481 - DNA, 22 bp, Homo sapiens
acatagctacccaaaagagaaa

SEQ ID NO: 2091482 - DNA, 18 bp, Homo sapiens
acataggcaaattggaaa

SEQ ID NO: 2091483 - DNA, 12 bp, Homo sapiens
acatagtcacaa

SEQ ID NO: 2091484 - DNA, 14 bp, Homo sapiens
acatagtcacaaaa

SEQ ID NO: 2091485 - DNA, 17 bp, Homo sapiens
acatagttctccagttg

SEQ ID NO: 2091486 - DNA, 12 bp, Homo sapiens
acatataaaagt

SEQ ID NO: 2091487 - DNA, 14 bp, Homo sapiens
acatataaaagtta

SEQ ID NO: 2091488 - DNA, 13 bp, Homo sapiens
acatatacatata

SEQ ID NO: 2091489 - DNA, 15 bp, Homo sapiens
accattccccatggg

SEQ ID NO: 2091490 - DNA, 17 bp, Homo sapiens
accattgacctcagctg

SEQ ID NO: 2091491 - DNA, 18 bp, Homo sapiens
accattgacctcagctgc

SEQ ID NO: 2091492 - DNA, 24 bp, Homo sapiens
accattgacctcagctgcacattc

SEQ ID NO: 2091493 - DNA, 22 bp, Homo sapiens
accattgtcttccaaccccagc

SEQ ID NO: 2091494 - DNA, 17 bp, Homo sapiens
accatttaattcataat

SEQ ID NO: 2091495 - DNA, 14 bp, Homo sapiens
accatttcaaatgg

SEQ ID NO: 2091496 - DNA, 20 bp, Homo sapiens
accatttgtattaccattac

SEQ ID NO: 2091497 - DNA, 20 bp, Homo sapiens
accattttagttcctttatt

SEQ ID NO: 2091498 - DNA, 22 bp, Homo sapiens
accattttagttcctttattta

SEQ ID NO: 2091499 - DNA, 21 bp, Homo sapiens
accattttggggtacccactg

SEQ ID NO: 2091500 - DNA, 14 bp, Homo sapiens
acccaaaagagaaa

SEQ ID NO: 2091501 - DNA, 16 bp, Homo sapiens
acccaaaagagaaaaa

SEQ ID NO: 2091502 - DNA, 23 bp, Homo sapiens
acccaaaagtcaaaaggtgcctg

SEQ ID NO: 2091503 - DNA, 14 bp, Homo sapiens
acccaaagcatgga

SEQ ID NO: 2091504 - DNA, 16 bp, Homo sapiens
acccaaagcatggact

SEQ ID NO: 2091505 - DNA, 16 bp, Homo sapiens
acccaagaggtgggga

SEQ ID NO: 2091506 - DNA, 20 bp, Homo sapiens
acccaagtatacaataaagt

SEQ ID NO: 2091507 - DNA, 16 bp, Homo sapiens
acccaagtccaagcat

SEQ ID NO: 2091508 - DNA, 16 bp, Homo sapiens
acccaatgctcctgga

SEQ ID NO: 2091509 - DNA, 17 bp, Homo sapiens
acccaattcaggactgg

SEQ ID NO: 2091510 - DNA, 13 bp, Homo sapiens
acccacacatgtt

SEQ ID NO: 2091511 - DNA, 23 bp, Homo sapiens
acccacacatgtttacagaactg

SEQ ID NO: 2091512 - DNA, 13 bp, Homo sapiens
acccacagggcta

SEQ ID NO: 2091513 - DNA, 15 bp, Homo sapiens
acccacatgtgacac

SEQ ID NO: 2091514 - DNA, 12 bp, Homo sapiens
acccaccagcct

SEQ ID NO: 2091515 - DNA, 15 bp, Homo sapiens
acccaccagcctaag

SEQ ID NO: 2091516 - DNA, 21 bp, Homo sapiens
acccaccagcctaagaagctc

SEQ ID NO: 2091517 - DNA, 20 bp, Homo sapiens
acccacccatcttcctgctg

SEQ ID NO: 2091518 - DNA, 23 bp, Homo sapiens
acccacccatcttcctgctgctg

SEQ ID NO: 2091519 - DNA, 21 bp, Homo sapiens
acccaccccctctttgtgtac

SEQ ID NO: 2091520 - DNA, 14 bp, Homo sapiens
acccaccgggccac

SEQ ID NO: 2091521 - DNA, 16 bp, Homo sapiens
acccaccgggccactc

SEQ ID NO: 2091522 - DNA, 18 bp, Homo sapiens
acccaccgggccactcct

SEQ ID NO: 2091523 - DNA, 19 bp, Homo sapiens
acccaccgggccactcctt

SEQ ID NO: 2091524 - DNA, 15 bp, Homo sapiens
acccacctcagcctc

SEQ ID NO: 2091525 - DNA, 14 bp, Homo sapiens
acccacctccaccc

SEQ ID NO: 2091526 - DNA, 20 bp, Homo sapiens
acccactctcctctgcctca

SEQ ID NO: 2091527 - DNA, 17 bp, Homo sapiens
acccactctttgctaca

SEQ ID NO: 2091528 - DNA, 11 bp, Homo sapiens
acccactgctc

SEQ ID NO: 2091529 - DNA, 20 bp, Homo sapiens
acccactgcttttggtctgt

SEQ ID NO: 2091530 - DNA, 14 bp, Homo sapiens
acccactggccagt

SEQ ID NO: 2091531 - DNA, 18 bp, Homo sapiens
acccactgtccgcctctg

SEQ ID NO: 2091532 - DNA, 18 bp, Homo sapiens
acccactgtgcttacagt

SEQ ID NO: 2091533 - DNA, 19 bp, Homo sapiens
acccagaaattccttccca

SEQ ID NO: 2091534 - DNA, 22 bp, Homo sapiens
acccagaaattccttcccactc

SEQ ID NO: 2091535 - DNA, 17 bp, Homo sapiens
acccagagaggaatcag

SEQ ID NO: 2091536 - DNA, 15 bp, Homo sapiens
acccagagccttctc

SEQ ID NO: 2091537 - DNA, 14 bp, Homo sapiens
acccagaggaggca

SEQ ID NO: 2091538 - DNA, 15 bp, Homo sapiens
acccagcaacacaga

SEQ ID NO: 2091539 - DNA, 17 bp, Homo sapiens
acccagcaacagaaaaa

SEQ ID NO: 2091540 - DNA, 13 bp, Homo sapiens
acccagcatgtac

SEQ ID NO: 2091541 - DNA, 11 bp, Homo sapiens
acccagcccat

SEQ ID NO: 2091542 - DNA, 22 bp, Homo sapiens
acccagcccattctctctcctg

SEQ ID NO: 2091543 - DNA, 23 bp, Homo sapiens
acccagcccattctctctcctgt

SEQ ID NO: 2091544 - DNA, 20 bp, Homo sapiens
acccagccccttgagaaacc

SEQ ID NO: 2091545 - DNA, 19 bp, Homo sapiens
acccagccctgcccctcac

SEQ ID NO: 2091546 - DNA, 13 bp, Homo sapiens
acccagccctggg

SEQ ID NO: 2091547 - DNA, 19 bp, Homo sapiens
acccagcgagccctggtgg

SEQ ID NO: 2091548 - DNA, 24 bp, Homo sapiens
acccagcgagccctggtggcagtg

SEQ ID NO: 2091549 - DNA, 19 bp, Homo sapiens
acccagctactctgtccag

SEQ ID NO: 2091550 - DNA, 17 bp, Homo sapiens
acccaggacaagcatgg

SEQ ID NO: 2091551 - DNA, 19 bp, Homo sapiens
acccaggagccccgaggcc

SEQ ID NO: 2091552 - DNA, 16 bp, Homo sapiens
acccaggagtttgtgt

SEQ ID NO: 2091553 - DNA, 19 bp, Homo sapiens
acccaggagtttgtgtgtc

SEQ ID NO: 2091554 - DNA, 20 bp, Homo sapiens
acccaggagtttgtgtgtct

SEQ ID NO: 2091555 - DNA, 14 bp, Homo sapiens
acccaggccctcca

SEQ ID NO: 2091556 - DNA, 20 bp, Homo sapiens
acccaggccctccatgggct

SEQ ID NO: 2091557 - DNA, 22 bp, Homo sapiens
acccaggccctccatgggctag

SEQ ID NO: 2091558 - DNA, 13 bp, Homo sapiens
acccaggctccat

SEQ ID NO: 2091559 - DNA, 15 bp, Homo sapiens
acccaggctccatgg

SEQ ID NO: 2091560 - DNA, 16 bp, Homo sapiens
acccaggctccatggg

SEQ ID NO: 2091561 - DNA, 13 bp, Homo sapiens
acccaggctgcac

SEQ ID NO: 2091562 - DNA, 17 bp, Homo sapiens
acccaggctgcactgca

SEQ ID NO: 2091563 - DNA, 20 bp, Homo sapiens
acccaggctggagtggagtg

SEQ ID NO: 2091564 - DNA, 19 bp, Homo sapiens
acccagggctccctcctgg

SEQ ID NO: 2091565 - DNA, 18 bp, Homo sapiens
  misc_feature (7)..(7): n is a, c, g or t
acccagnagggcgtcgct

SEQ ID NO: 2091566 - DNA, 17 bp, Homo sapiens
acccagtaactcatctg

SEQ ID NO: 2091567 - DNA, 12 bp, Homo sapiens
acccagtcctgg

SEQ ID NO: 2091568 - DNA, 13 bp, Homo sapiens
acccagtcctggc

SEQ ID NO: 2091569 - DNA, 15 bp, Homo sapiens
acccagtgtaaagaa

SEQ ID NO: 2091570 - DNA, 20 bp, Homo sapiens
acccagtgtaaagaataaat

SEQ ID NO: 2091571 - DNA, 17 bp, Homo sapiens
acccatagatcttctga

SEQ ID NO: 2091572 - DNA, 22 bp, Homo sapiens
acccatagatcttctgaaatga

SEQ ID NO: 2091573 - DNA, 16 bp, Homo sapiens
acccatagcttccatg

SEQ ID NO: 2091574 - DNA, 16 bp, Homo sapiens
acccatatatcttatg

SEQ ID NO: 2091575 - DNA, 18 bp, Homo sapiens
acccatcagaaggagaag

SEQ ID NO: 2091576 - DNA, 15 bp, Homo sapiens
acccatcttccccgg

SEQ ID NO: 2091577 - DNA, 19 bp, Homo sapiens
acccatcttcctgctgctg

SEQ ID NO: 2091578 - DNA, 20 bp, Homo sapiens
acccatcttcctgctgctgt

SEQ ID NO: 2091579 - DNA, 17 bp, Homo sapiens
acccatgaatcaaagac

SEQ ID NO: 2091580 - DNA, 13 bp, Homo sapiens
acccatgaggcaa

SEQ ID NO: 2091581 - DNA, 20 bp, Homo sapiens
acccatgaggcaatgtcagg

SEQ ID NO: 2091582 - DNA, 20 bp, Homo sapiens
acccatgatgagctcctctt

SEQ ID NO: 2091583 - DNA, 20 bp, Homo sapiens
acccattcccccatgtggct

SEQ ID NO: 2091584 - DNA, 17 bp, Homo sapiens
acccattcctatttctt

SEQ ID NO: 2091585 - DNA, 14 bp, Homo sapiens
acccattttcacat

SEQ ID NO: 2091586 - DNA, 20 bp, Homo sapiens
acccattttgagtgactcga

SEQ ID NO: 2091587 - DNA, 16 bp, Homo sapiens
acccatttttgagcca

SEQ ID NO: 2091588 - DNA, 17 bp, Homo sapiens
acccatttttgagccaa

SEQ ID NO: 2091589 - DNA, 22 bp, Homo sapiens
acccatttttgagccaagcttc

SEQ ID NO: 2091590 - DNA, 19 bp, Homo sapiens
accccaaagagcctggaga

SEQ ID NO: 2091591 - DNA, 17 bp, Homo sapiens
accccaacgcacaggaa

SEQ ID NO: 2091592 - DNA, 12 bp, Homo sapiens
accccaagcagc

SEQ ID NO: 2091593 - DNA, 21 bp, Homo sapiens
accccaagggacaaccccatc

SEQ ID NO: 2091594 - DNA, 19 bp, Homo sapiens
accccacattggacttcct

SEQ ID NO: 2091595 - DNA, 22 bp, Homo sapiens
accccaccacgatgtggccctg

SEQ ID NO: 2091596 - DNA, 22 bp, Homo sapiens
accccacctcatgcctggcccc

SEQ ID NO: 2091597 - DNA, 17 bp, Homo sapiens
accccacgttctatata

SEQ ID NO: 2091598 - DNA, 13 bp, Homo sapiens
accccactccagc

SEQ ID NO: 2091599 - DNA, 17 bp, Homo sapiens
accccactccagccctg

SEQ ID NO: 2091600 - DNA, 18 bp, Homo sapiens
accccactccagccctgt

SEQ ID NO: 2091601 - DNA, 18 bp, Homo sapiens
accccagctagggctgga

SEQ ID NO: 2091602 - DNA, 14 bp, Homo sapiens
accccagctcccta

SEQ ID NO: 2091603 - DNA, 19 bp, Homo sapiens
acctggtactgcacatttt

SEQ ID NO: 2091604 - DNA, 11 bp, Homo sapiens
acctgtaatca

SEQ ID NO: 2091605 - DNA, 15 bp, Homo sapiens
acctgtaatcccagc

SEQ ID NO: 2091606 - DNA, 19 bp, Homo sapiens
acctgtaatcccagcactt

SEQ ID NO: 2091607 - DNA, 20 bp, Homo sapiens
acctgtaatcccagctactt

SEQ ID NO: 2091608 - DNA, 19 bp, Homo sapiens
acctgtagtcccagctact

SEQ ID NO: 2091609 - DNA, 15 bp, Homo sapiens
acctgtctccctggg

SEQ ID NO: 2091610 - DNA, 17 bp, Homo sapiens
acctgtctgtcgctggg

SEQ ID NO: 2091611 - DNA, 14 bp, Homo sapiens
acctgtctgtctgt

SEQ ID NO: 2091612 - DNA, 20 bp, Homo sapiens
acctgtctgtctgtctgtcc

SEQ ID NO: 2091613 - DNA, 13 bp, Homo sapiens
acctgtgcacccc

SEQ ID NO: 2091614 - DNA, 19 bp, Homo sapiens
acctgtgtggacaggacta

SEQ ID NO: 2091615 - DNA, 18 bp, Homo sapiens
acctgtgtttcttgcctc

SEQ ID NO: 2091616 - DNA, 16 bp, Homo sapiens
acctgttcaggagctg

SEQ ID NO: 2091617 - DNA, 18 bp, Homo sapiens
acctgttcaggagctgaa

SEQ ID NO: 2091618 - DNA, 21 bp, Homo sapiens
acctgtttatataattttgca

SEQ ID NO: 2091619 - DNA, 20 bp, Homo sapiens
acctgtttttaagctgtttc

SEQ ID NO: 2091620 - DNA, 12 bp, Homo sapiens
accttacattcc

SEQ ID NO: 2091621 - DNA, 16 bp, Homo sapiens
accttaccaactttct

SEQ ID NO: 2091622 - DNA, 17 bp, Homo sapiens
accttaccaactttctg

SEQ ID NO: 2091623 - DNA, 20 bp, Homo sapiens
accttaccaactttctgtaa

SEQ ID NO: 2091624 - DNA, 19 bp, Homo sapiens
accttagattagctctgga

SEQ ID NO: 2091625 - DNA, 17 bp, Homo sapiens
accttagcagctcttcc

SEQ ID NO: 2091626 - DNA, 12 bp, Homo sapiens
accttatgtatt

SEQ ID NO: 2091627 - DNA, 13 bp, Homo sapiens
accttatgtatta

SEQ ID NO: 2091628 - DNA, 15 bp, Homo sapiens
accttatgtattatt

SEQ ID NO: 2091629 - DNA, 18 bp, Homo sapiens
accttattgtacctctct

SEQ ID NO: 2091630 - DNA, 20 bp, Homo sapiens
accttattgtacctctctta

SEQ ID NO: 2091631 - DNA, 14 bp, Homo sapiens
accttcaataaagt

SEQ ID NO: 2091632 - DNA, 17 bp, Homo sapiens
accttcaataaagtatc

SEQ ID NO: 2091633 - DNA, 19 bp, Homo sapiens
accttcaataaagtatcta

SEQ ID NO: 2091634 - DNA, 16 bp, Homo sapiens
accttcaattcctggg

SEQ ID NO: 2091635 - DNA, 17 bp, Homo sapiens
accttcaattcctgggc

SEQ ID NO: 2091636 - DNA, 19 bp, Homo sapiens
accttcccagctctccctc

SEQ ID NO: 2091637 - DNA, 17 bp, Homo sapiens
accttcccatgccctgg

SEQ ID NO: 2091638 - DNA, 9 bp, Homo sapiens
accttcccc

SEQ ID NO: 2091639 - DNA, 13 bp, Homo sapiens
accttccctccaa

SEQ ID NO: 2091640 - DNA, 17 bp, Homo sapiens
accttccttaagccagg

SEQ ID NO: 2091641 - DNA, 21 bp, Homo sapiens
accttctcaaaagattgtttt

SEQ ID NO: 2091642 - DNA, 19 bp, Homo sapiens
accttctctacccatctcc

SEQ ID NO: 2091643 - DNA, 17 bp, Homo sapiens
accttctgaagatctca

SEQ ID NO: 2091644 - DNA, 15 bp, Homo sapiens
accttctgtggctca

SEQ ID NO: 2091645 - DNA, 21 bp, Homo sapiens
accttcttcgctgctagagaa

SEQ ID NO: 2091646 - DNA, 18 bp, Homo sapiens
accttcttggcttctggg

SEQ ID NO: 2091647 - DNA, 23 bp, Homo sapiens
accttcttggcttctgggacctg

SEQ ID NO: 2091648 - DNA, 18 bp, Homo sapiens
accttgaacactggggga

SEQ ID NO: 2091649 - DNA, 14 bp, Homo sapiens
accttgacagggca

SEQ ID NO: 2091650 - DNA, 21 bp, Homo sapiens
accttgccaagctttcttcta

SEQ ID NO: 2091651 - DNA, 18 bp, Homo sapiens
accttgctcttctttctg

SEQ ID NO: 2091652 - DNA, 17 bp, Homo sapiens
accttggactcctccca

SEQ ID NO: 2091653 - DNA, 12 bp, Homo sapiens
accttggctcaa

SEQ ID NO: 2091654 - DNA, 18 bp, Homo sapiens
accttggtaaattgtaaa

SEQ ID NO: 2091655 - DNA, 22 bp, Homo sapiens
accttgtcatgtaccatcaata

SEQ ID NO: 2091656 - DNA, 13 bp, Homo sapiens
accttgtgtctgt

SEQ ID NO: 2091657 - DNA, 17 bp, Homo sapiens
acctttaagtcctctct

SEQ ID NO: 2091658 - DNA, 15 bp, Homo sapiens
acctttatggtttct

SEQ ID NO: 2091659 - DNA, 22 bp, Homo sapiens
acctttattaatgaactgtgac

SEQ ID NO: 2091660 - DNA, 14 bp, Homo sapiens
acctttattgtgat

SEQ ID NO: 2091661 - DNA, 16 bp, Homo sapiens
acctttattgtgatct

SEQ ID NO: 2091662 - DNA, 16 bp, Homo sapiens
acctttcagctgtgaa

SEQ ID NO: 2091663 - DNA, 18 bp, Homo sapiens
acctttcccatgctgaat

SEQ ID NO: 2091664 - DNA, 15 bp, Homo sapiens
acctttccccagaca

SEQ ID NO: 2091665 - DNA, 18 bp, Homo sapiens
acctttccctcaccccct

SEQ ID NO: 2091666 - DNA, 19 bp, Homo sapiens
acctttccgctgtcgcccc

SEQ ID NO: 2091667 - DNA, 14 bp, Homo sapiens
acctttggaaaaat

SEQ ID NO: 2091668 - DNA, 12 bp, Homo sapiens
acctttggtgca

SEQ ID NO: 2091669 - DNA, 17 bp, Homo sapiens
acctttggtgcagaggt

SEQ ID NO: 2091670 - DNA, 14 bp, Homo sapiens
accttttataccag

SEQ ID NO: 2091671 - DNA, 17 bp, Homo sapiens
accttttgtatttaaaa

SEQ ID NO: 2091672 - DNA, 19 bp, Homo sapiens
acctttttttctctcctaa

SEQ ID NO: 2091673 - DNA, 23 bp, Homo sapiens
acgaaatgttattttttaattat

SEQ ID NO: 2091674 - DNA, 13 bp, Homo sapiens
acgaacaggggcc

SEQ ID NO: 2091675 - DNA, 22 bp, Homo sapiens
acgaatttggtgtggctgtatt

SEQ ID NO: 2091676 - DNA, 12 bp, Homo sapiens
acgacactgaag

SEQ ID NO: 2091677 - DNA, 18 bp, Homo sapiens
acgactgaagaaggacat

SEQ ID NO: 2091678 - DNA, 19 bp, Homo sapiens
acgagaccctacaggagag

SEQ ID NO: 2091679 - DNA, 14 bp, Homo sapiens
acgagcactggcca

SEQ ID NO: 2091680 - DNA, 15 bp, Homo sapiens
acgagcactggccag

SEQ ID NO: 2091681 - DNA, 19 bp, Homo sapiens
acgagcactggccagagag

SEQ ID NO: 2091682 - DNA, 14 bp, Homo sapiens
acgagtcacctgca

SEQ ID NO: 2091683 - DNA, 11 bp, Homo sapiens
acgatcttggc

SEQ ID NO: 2091684 - DNA, 14 bp, Homo sapiens
acgatgaaaaactt

SEQ ID NO: 2091685 - DNA, 15 bp, Homo sapiens
acgatgtcaaggact

SEQ ID NO: 2091686 - DNA, 16 bp, Homo sapiens
acgatgtggccctggc

SEQ ID NO: 2091687 - DNA, 22 bp, Homo sapiens
acgatgtggccctggcctgctg

SEQ ID NO: 2091688 - DNA, 16 bp, Homo sapiens
acgattatttatttct

SEQ ID NO: 2091689 - DNA, 14 bp, Homo sapiens
acgattttgcacaa

SEQ ID NO: 2091690 - DNA, 17 bp, Homo sapiens
acgcaagggagaagaaa

SEQ ID NO: 2091691 - DNA, 21 bp, Homo sapiens
acgcaattgtgggatgtcctc

SEQ ID NO: 2091692 - DNA, 15 bp, Homo sapiens
acgcacacatcagtg

SEQ ID NO: 2091693 - DNA, 14 bp, Homo sapiens
acgcacacatggac

SEQ ID NO: 2091694 - DNA, 17 bp, Homo sapiens
acgcacagccaaggact

SEQ ID NO: 2091695 - DNA, 18 bp, Homo sapiens
acgcacatagagatatgc

SEQ ID NO: 2091696 - DNA, 22 bp, Homo sapiens
acgcaccaccatgccaggctaa

SEQ ID NO: 2091697 - DNA, 11 bp, Homo sapiens
acgcagcagct

SEQ ID NO: 2091698 - DNA, 23 bp, Homo sapiens
acgcagcagctgggacccctccc

SEQ ID NO: 2091699 - DNA, 23 bp, Homo sapiens
acgcagccctgggggccagctgg

SEQ ID NO: 2091700 - DNA, 14 bp, Homo sapiens
acgcatcctgcagt

SEQ ID NO: 2091701 - DNA, 17 bp, Homo sapiens
acgccaaagtgcagccc

SEQ ID NO: 2091702 - DNA, 18 bp, Homo sapiens
acgccaaagtgcagccct

SEQ ID NO: 2091703 - DNA, 19 bp, Homo sapiens
acgccaaagtgcagccctt

SEQ ID NO: 2091704 - DNA, 15 bp, Homo sapiens
acgccactcatttca

SEQ ID NO: 2091705 - DNA, 21 bp, Homo sapiens
acgccactcatttcatctcat

SEQ ID NO: 2091706 - DNA, 18 bp, Homo sapiens
acgccactgcactatagc

SEQ ID NO: 2091707 - DNA, 22 bp, Homo sapiens
acgccactgcactccagcctgg

SEQ ID NO: 2091708 - DNA, 23 bp, Homo sapiens
acgccactgcactccagcctggg

SEQ ID NO: 2091709 - DNA, 15 bp, Homo sapiens
acgcccagcctcctc

SEQ ID NO: 2091710 - DNA, 18 bp, Homo sapiens
acgcccctccctcctctg

SEQ ID NO: 2091711 - DNA, 13 bp, Homo sapiens
acgccgtggagca

SEQ ID NO: 2091712 - DNA, 16 bp, Homo sapiens
acgcctataatcccag

SEQ ID NO: 2091713 - DNA, 18 bp, Homo sapiens
acgcctataatcccagca

SEQ ID NO: 2091714 - DNA, 18 bp, Homo sapiens
acgcctatgatcccagca

SEQ ID NO: 2091715 - DNA, 12 bp, Homo sapiens
acgcctcctggc

SEQ ID NO: 2091716 - DNA, 16 bp, Homo sapiens
acgcctcctggccaga

SEQ ID NO: 2091717 - DNA, 19 bp, Homo sapiens
acgcctcttttccctctct

SEQ ID NO: 2091718 - DNA, 20 bp, Homo sapiens
actcagtctagtgaagatgt

SEQ ID NO: 2091719 - DNA, 22 bp, Homo sapiens
actcagttaaaatgtctgtttc

SEQ ID NO: 2091720 - DNA, 15 bp, Homo sapiens
actcagtttgtcaga

SEQ ID NO: 2091721 - DNA, 9 bp, Homo sapiens
actcatcat

SEQ ID NO: 2091722 - DNA, 13 bp, Homo sapiens
actcatcataaaa

SEQ ID NO: 2091723 - DNA, 17 bp, Homo sapiens
actcatcataaaataaa

SEQ ID NO: 2091724 - DNA, 14 bp, Homo sapiens
actcatctgttatc

SEQ ID NO: 2091725 - DNA, 15 bp, Homo sapiens
actcatctgttatcc

SEQ ID NO: 2091726 - DNA, 16 bp, Homo sapiens
actcatgtacattggt

SEQ ID NO: 2091727 - DNA, 20 bp, Homo sapiens
actcatgttgttcccacaca

SEQ ID NO: 2091728 - DNA, 21 bp, Homo sapiens
actcatgttgttcccacacac

SEQ ID NO: 2091729 - DNA, 15 bp, Homo sapiens
actcattagactgga

SEQ ID NO: 2091730 - DNA, 13 bp, Homo sapiens
actcattccttca

SEQ ID NO: 2091731 - DNA, 15 bp, Homo sapiens
actcatttcatctca

SEQ ID NO: 2091732 - DNA, 14 bp, Homo sapiens
actcatttctaaaa

SEQ ID NO: 2091733 - DNA, 18 bp, Homo sapiens
actcatttctaaaagaat

SEQ ID NO: 2091734 - DNA, 19 bp, Homo sapiens
actcatttctaaaagaata

SEQ ID NO: 2091735 - DNA, 23 bp, Homo sapiens
actcatttttcatgataatgaac

SEQ ID NO: 2091736 - DNA, 14 bp, Homo sapiens
actccaaagaaatg

SEQ ID NO: 2091737 - DNA, 23 bp, Homo sapiens
actccaagcttcaagtgatatat

SEQ ID NO: 2091738 - DNA, 13 bp, Homo sapiens
actccacagcgga

SEQ ID NO: 2091739 - DNA, 20 bp, Homo sapiens
actccaccaacccatcagaa

SEQ ID NO: 2091740 - DNA, 23 bp, Homo sapiens
actccactctccttcgtgtctct

SEQ ID NO: 2091741 - DNA, 23 bp, Homo sapiens
actccagaatctgctgttgccat

SEQ ID NO: 2091742 - DNA, 13 bp, Homo sapiens
actccagacccct

SEQ ID NO: 2091743 - DNA, 21 bp, Homo sapiens
actccagacccctggcttttc

SEQ ID NO: 2091744 - DNA, 14 bp, Homo sapiens
actccagagtctga

SEQ ID NO: 2091745 - DNA, 11 bp, Homo sapiens
actccagccag

SEQ ID NO: 2091746 - DNA, 12 bp, Homo sapiens
actccagccagc

SEQ ID NO: 2091747 - DNA, 16 bp, Homo sapiens
actccagccagcgcct

SEQ ID NO: 2091748 - DNA, 20 bp, Homo sapiens
actccagccagcgcctccct

SEQ ID NO: 2091749 - DNA, 21 bp, Homo sapiens
actccagccagcgcctccctc

SEQ ID NO: 2091750 - DNA, 23 bp, Homo sapiens
actccagccagcgcctccctcca

SEQ ID NO: 2091751 - DNA, 14 bp, Homo sapiens
actccagccctgtc

SEQ ID NO: 2091752 - DNA, 22 bp, Homo sapiens
actccagccctgtcccctgaaa

SEQ ID NO: 2091753 - DNA, 19 bp, Homo sapiens
actccagcctgagcaacag

SEQ ID NO: 2091754 - DNA, 16 bp, Homo sapiens
actccagcgcctgccc

SEQ ID NO: 2091755 - DNA, 22 bp, Homo sapiens
actccagcgcctgccctccctg

SEQ ID NO: 2091756 - DNA, 12 bp, Homo sapiens
actccagctccc

SEQ ID NO: 2091757 - DNA, 17 bp, Homo sapiens
actccaggaaaactgtt

SEQ ID NO: 2091758 - DNA, 16 bp, Homo sapiens
actccagtctcctgac

SEQ ID NO: 2091759 - DNA, 20 bp, Homo sapiens
actccagtgatgttcttcaa

SEQ ID NO: 2091760 - DNA, 18 bp, Homo sapiens
actccagtggtgaagaaa

SEQ ID NO: 2091761 - DNA, 16 bp, Homo sapiens
actccatacataactt

SEQ ID NO: 2091762 - DNA, 18 bp, Homo sapiens
actccatatttatttaaa

SEQ ID NO: 2091763 - DNA, 14 bp, Homo sapiens
actccatggccacc

SEQ ID NO: 2091764 - DNA, 12 bp, Homo sapiens
actccattccca

SEQ ID NO: 2091765 - DNA, 14 bp, Homo sapiens
actccattcccaac

SEQ ID NO: 2091766 - DNA, 19 bp, Homo sapiens
actcccaaagctcagactt

SEQ ID NO: 2091767 - DNA, 17 bp, Homo sapiens
actcccagaccacctcc

SEQ ID NO: 2091768 - DNA, 12 bp, Homo sapiens
actcccagggac

SEQ ID NO: 2091769 - DNA, 16 bp, Homo sapiens
actccctaagaaaccc

SEQ ID NO: 2091770 - DNA, 16 bp, Homo sapiens
actccctccatgtggc

SEQ ID NO: 2091771 - DNA, 15 bp, Homo sapiens
actccctcccctgcc

SEQ ID NO: 2091772 - DNA, 20 bp, Homo sapiens
actccctgaacctcagtttc

SEQ ID NO: 2091773 - DNA, 22 bp, Homo sapiens
actccctgaacctcagtttcct

SEQ ID NO: 2091774 - DNA, 12 bp, Homo sapiens
actccctgagct

SEQ ID NO: 2091775 - DNA, 23 bp, Homo sapiens
actccctgggaaaggggttgtca

SEQ ID NO: 2091776 - DNA, 16 bp, Homo sapiens
actcccttcctggcct

SEQ ID NO: 2091777 - DNA, 18 bp, Homo sapiens
actcccttcctggcctca

SEQ ID NO: 2091778 - DNA, 20 bp, Homo sapiens
actcccttcctggcctcact

SEQ ID NO: 2091779 - DNA, 19 bp, Homo sapiens
actccgaaacaagtagaaa

SEQ ID NO: 2091780 - DNA, 16 bp, Homo sapiens
actccgagaacaacag

SEQ ID NO: 2091781 - DNA, 23 bp, Homo sapiens
actccggcctgatgacagagcga

SEQ ID NO: 2091782 - DNA, 15 bp, Homo sapiens
actcctacctcagcc

SEQ ID NO: 2091783 - DNA, 14 bp, Homo sapiens
actcctacctggta

SEQ ID NO: 2091784 - DNA, 18 bp, Homo sapiens
actcctcagatctgaaca

SEQ ID NO: 2091785 - DNA, 12 bp, Homo sapiens
actcctcccagg

SEQ ID NO: 2091786 - DNA, 18 bp, Homo sapiens
actcctcggtactcccat

SEQ ID NO: 2091787 - DNA, 21 bp, Homo sapiens
actcctctaagccactcttcc

SEQ ID NO: 2091788 - DNA, 15 bp, Homo sapiens
actcctctgtctctg

SEQ ID NO: 2091789 - DNA, 17 bp, Homo sapiens
actcctgagtggggcca

SEQ ID NO: 2091790 - DNA, 15 bp, Homo sapiens
actcctgattttgta

SEQ ID NO: 2091791 - DNA, 21 bp, Homo sapiens
actcctgattttgtagttaat

SEQ ID NO: 2091792 - DNA, 18 bp, Homo sapiens
actcctgccagttgaaaa

SEQ ID NO: 2091793 - DNA, 23 bp, Homo sapiens
actcctgccagttgaaaatggat

SEQ ID NO: 2091794 - DNA, 16 bp, Homo sapiens
actcctggaagctgtg

SEQ ID NO: 2091795 - DNA, 13 bp, Homo sapiens
actcctggcctca

SEQ ID NO: 2091796 - DNA, 14 bp, Homo sapiens
actcctgtgctctg

SEQ ID NO: 2091797 - DNA, 20 bp, Homo sapiens
actcctgtgctctggaggct

SEQ ID NO: 2091798 - DNA, 15 bp, Homo sapiens
actcctgtgggagcc

SEQ ID NO: 2091799 - DNA, 18 bp, Homo sapiens
actccttattttgtatta

SEQ ID NO: 2091800 - DNA, 22 bp, Homo sapiens
actccttcaacaattctaaaat

SEQ ID NO: 2091801 - DNA, 13 bp, Homo sapiens
actccttcctgcc

SEQ ID NO: 2091802 - DNA, 14 bp, Homo sapiens
actccttcctgccc

SEQ ID NO: 2091803 - DNA, 19 bp, Homo sapiens
actccttgtggtttatgtc

SEQ ID NO: 2091804 - DNA, 22 bp, Homo sapiens
actcctttctctatcccaagcc

SEQ ID NO: 2091805 - DNA, 19 bp, Homo sapiens
actcctttgcattccatga

SEQ ID NO: 2091806 - DNA, 22 bp, Homo sapiens
actcctttgcattccatgattt

SEQ ID NO: 2091807 - DNA, 17 bp, Homo sapiens
actcgaagcccttccag

SEQ ID NO: 2091808 - DNA, 16 bp, Homo sapiens
actcgagaccatcctg

SEQ ID NO: 2091809 - DNA, 15 bp, Homo sapiens
actcgatgaatgtgt

SEQ ID NO: 2091810 - DNA, 21 bp, Homo sapiens
actcggcctcccaaagtgctg

SEQ ID NO: 2091811 - DNA, 20 bp, Homo sapiens
actcgggaggctgagacagg

SEQ ID NO: 2091812 - DNA, 22 bp, Homo sapiens
actcggtcaaaatattttttaa

SEQ ID NO: 2091813 - DNA, 13 bp, Homo sapiens
actcggtgtaaaa

SEQ ID NO: 2091814 - DNA, 13 bp, Homo sapiens
actctaaatattt

SEQ ID NO: 2091815 - DNA, 20 bp, Homo sapiens
actctaagtctccaagaata

SEQ ID NO: 2091816 - DNA, 20 bp, Homo sapiens
actctaattcccattttgca

SEQ ID NO: 2091817 - DNA, 22 bp, Homo sapiens
actctaattcccattttgcaaa

SEQ ID NO: 2091818 - DNA, 15 bp, Homo sapiens
actctacagaggcca

SEQ ID NO: 2091819 - DNA, 17 bp, Homo sapiens
actctacccatattaca

SEQ ID NO: 2091820 - DNA, 15 bp, Homo sapiens
actctacgccaaagt

SEQ ID NO: 2091821 - DNA, 16 bp, Homo sapiens
actctacgccaaagtg

SEQ ID NO: 2091822 - DNA, 21 bp, Homo sapiens
actctacttagcatgtcccta

SEQ ID NO: 2091823 - DNA, 22 bp, Homo sapiens
actctagcctggcaacagagca

SEQ ID NO: 2091824 - DNA, 21 bp, Homo sapiens
actctaggggtcaggctccat

SEQ ID NO: 2091825 - DNA, 18 bp, Homo sapiens
actctagtgacttcctgg

SEQ ID NO: 2091826 - DNA, 22 bp, Homo sapiens
actctagtgacttcctggtgag

SEQ ID NO: 2091827 - DNA, 23 bp, Homo sapiens
actctagtgacttcctggtgagg

SEQ ID NO: 2091828 - DNA, 19 bp, Homo sapiens
actctatagttattgtttt

SEQ ID NO: 2091829 - DNA, 19 bp, Homo sapiens
actctatgccccaaatata

SEQ ID NO: 2091830 - DNA, 21 bp, Homo sapiens
actctatgccccaaatatagc

SEQ ID NO: 2091831 - DNA, 15 bp, Homo sapiens
actctcaggaggcgc

SEQ ID NO: 2091832 - DNA, 12 bp, Homo sapiens
actgggaaggct

SEQ ID NO: 2091833 - DNA, 18 bp, Homo sapiens
actgggcaatgatggcaa

SEQ ID NO: 2091834 - DNA, 21 bp, Homo sapiens
actggggagttataaaaatac

SEQ ID NO: 2091835 - DNA, 14 bp, Homo sapiens
actggggcttgcaa

SEQ ID NO: 2091836 - DNA, 21 bp, Homo sapiens
actggggcttgcaagaggagg

SEQ ID NO: 2091837 - DNA, 22 bp, Homo sapiens
actggggcttgcaagaggaggt

SEQ ID NO: 2091838 - DNA, 18 bp, Homo sapiens
actggggtcctggggcct

SEQ ID NO: 2091839 - DNA, 19 bp, Homo sapiens
actgggtacttgtggacac

SEQ ID NO: 2091840 - DNA, 16 bp, Homo sapiens
actgggtctcactcct

SEQ ID NO: 2091841 - DNA, 19 bp, Homo sapiens
actggtccactcagggctg

SEQ ID NO: 2091842 - DNA, 12 bp, Homo sapiens
actggtgactgc

SEQ ID NO: 2091843 - DNA, 12 bp, Homo sapiens
actggtggcccg

SEQ ID NO: 2091844 - DNA, 21 bp, Homo sapiens
actggtggcccgacagcctgg

SEQ ID NO: 2091845 - DNA, 18 bp, Homo sapiens
actggtttcagttgacaa

SEQ ID NO: 2091846 - DNA, 14 bp, Homo sapiens
actggtttctcaga

SEQ ID NO: 2091847 - DNA, 17 bp, Homo sapiens
actgtaaatacaaaata

SEQ ID NO: 2091848 - DNA, 19 bp, Homo sapiens
actgtaaatatccacagac

SEQ ID NO: 2091849 - DNA, 20 bp, Homo sapiens
actgtaaatatccacagact

SEQ ID NO: 2091850 - DNA, 14 bp, Homo sapiens
actgtaaatcactt

SEQ ID NO: 2091851 - DNA, 14 bp, Homo sapiens
actgtaatcttaaa

SEQ ID NO: 2091852 - DNA, 15 bp, Homo sapiens
actgtaatcttaaaa

SEQ ID NO: 2091853 - DNA, 19 bp, Homo sapiens
actgtaattaagtgcaatt

SEQ ID NO: 2091854 - DNA, 21 bp, Homo sapiens
actgtaattttgtttgtaatc

SEQ ID NO: 2091855 - DNA, 14 bp, Homo sapiens
actgtactcctccc

SEQ ID NO: 2091856 - DNA, 15 bp, Homo sapiens
actgtactcctccca

SEQ ID NO: 2091857 - DNA, 19 bp, Homo sapiens
actgtagaatgatttcatg

SEQ ID NO: 2091858 - DNA, 22 bp, Homo sapiens
actgtagcctcgccgtctgtga

SEQ ID NO: 2091859 - DNA, 22 bp, Homo sapiens
actgtatcaaatctgtatatgt

SEQ ID NO: 2091860 - DNA, 13 bp, Homo sapiens
actgtatttgtat

SEQ ID NO: 2091861 - DNA, 23 bp, Homo sapiens
actgtcaagtcatgatggagact

SEQ ID NO: 2091862 - DNA, 15 bp, Homo sapiens
actgtcactgttcct

SEQ ID NO: 2091863 - DNA, 14 bp, Homo sapiens
actgtcagagctgt

SEQ ID NO: 2091864 - DNA, 21 bp, Homo sapiens
actgtcagagctgttggcctc

SEQ ID NO: 2091865 - DNA, 22 bp, Homo sapiens
actgtcagagctgttggcctcg

SEQ ID NO: 2091866 - DNA, 13 bp, Homo sapiens
actgtcatagaaa

SEQ ID NO: 2091867 - DNA, 17 bp, Homo sapiens
actgtcatctagcccct

SEQ ID NO: 2091868 - DNA, 14 bp, Homo sapiens
actgtccctcaaat

SEQ ID NO: 2091869 - DNA, 17 bp, Homo sapiens
actgtcgctgcttcgtg

SEQ ID NO: 2091870 - DNA, 19 bp, Homo sapiens
actgtcgtgtttacaaaag

SEQ ID NO: 2091871 - DNA, 19 bp, Homo sapiens
actgtctcaactactcagc

SEQ ID NO: 2091872 - DNA, 13 bp, Homo sapiens
actgtctggtttt

SEQ ID NO: 2091873 - DNA, 21 bp, Homo sapiens
actgtcttgcctgccagggcc

SEQ ID NO: 2091874 - DNA, 20 bp, Homo sapiens
actgtgaaagtatgtgatat

SEQ ID NO: 2091875 - DNA, 17 bp, Homo sapiens
actgtgaagacccagca

SEQ ID NO: 2091876 - DNA, 18 bp, Homo sapiens
actgtgatggggtgggca

SEQ ID NO: 2091877 - DNA, 18 bp, Homo sapiens
actgtgcactgacatgtt

SEQ ID NO: 2091878 - DNA, 16 bp, Homo sapiens
actgtgccatgtgcca

SEQ ID NO: 2091879 - DNA, 15 bp, Homo sapiens
actgtgccctgcctt

SEQ ID NO: 2091880 - DNA, 16 bp, Homo sapiens
actgtgccctgccttc

SEQ ID NO: 2091881 - DNA, 17 bp, Homo sapiens
actgtggaaaaatattt

SEQ ID NO: 2091882 - DNA, 16 bp, Homo sapiens
actgtggccagagctg

SEQ ID NO: 2091883 - DNA, 17 bp, Homo sapiens
actgtggcgttctgctg

SEQ ID NO: 2091884 - DNA, 12 bp, Homo sapiens
actgtgtgaaga

SEQ ID NO: 2091885 - DNA, 18 bp, Homo sapiens
actgtgtgaagaaatgga

SEQ ID NO: 2091886 - DNA, 23 bp, Homo sapiens
actgttctgtgtgggtctgggga

SEQ ID NO: 2091887 - DNA, 14 bp, Homo sapiens
actgttgaaaatta

SEQ ID NO: 2091888 - DNA, 18 bp, Homo sapiens
actgttgagttggacaca

SEQ ID NO: 2091889 - DNA, 17 bp, Homo sapiens
actgttgcccaggctgg

SEQ ID NO: 2091890 - DNA, 22 bp, Homo sapiens
actgtttgccttctacttttaa

SEQ ID NO: 2091891 - DNA, 20 bp, Homo sapiens
actgtttggctgacatgact

SEQ ID NO: 2091892 - DNA, 17 bp, Homo sapiens
acttaaaaaaatgacag

SEQ ID NO: 2091893 - DNA, 22 bp, Homo sapiens
acttaaaaaaatgacagatgtt

SEQ ID NO: 2091894 - DNA, 16 bp, Homo sapiens
acttaaaaaatgtcca

SEQ ID NO: 2091895 - DNA, 15 bp, Homo sapiens
acttaaagcttgttt

SEQ ID NO: 2091896 - DNA, 17 bp, Homo sapiens
acttaaaggctgtggta

SEQ ID NO: 2091897 - DNA, 20 bp, Homo sapiens
acttaaatagcatctgctct

SEQ ID NO: 2091898 - DNA, 13 bp, Homo sapiens
acttaaatgaaag

SEQ ID NO: 2091899 - DNA, 20 bp, Homo sapiens
acttaaattttaagcttgaa

SEQ ID NO: 2091900 - DNA, 15 bp, Homo sapiens
acttaacggctccag

SEQ ID NO: 2091901 - DNA, 17 bp, Homo sapiens
acttaacggctccagga

SEQ ID NO: 2091902 - DNA, 17 bp, Homo sapiens
acttaactgtgtgaaga

SEQ ID NO: 2091903 - DNA, 12 bp, Homo sapiens
acttaagagaaa

SEQ ID NO: 2091904 - DNA, 13 bp, Homo sapiens
acttaagagaaat

SEQ ID NO: 2091905 - DNA, 14 bp, Homo sapiens
acttaagagaaatg

SEQ ID NO: 2091906 - DNA, 17 bp, Homo sapiens
acttaagagaaatggca

SEQ ID NO: 2091907 - DNA, 13 bp, Homo sapiens
acttaagcaaaag

SEQ ID NO: 2091908 - DNA, 13 bp, Homo sapiens
acttaataaattc

SEQ ID NO: 2091909 - DNA, 16 bp, Homo sapiens
acttacacttggagcc

SEQ ID NO: 2091910 - DNA, 14 bp, Homo sapiens
acttacatgattca

SEQ ID NO: 2091911 - DNA, 18 bp, Homo sapiens
acttaccaggcaccaaaa

SEQ ID NO: 2091912 - DNA, 19 bp, Homo sapiens
acttacctaaacagatata

SEQ ID NO: 2091913 - DNA, 11 bp, Homo sapiens
acttacctgca

SEQ ID NO: 2091914 - DNA, 15 bp, Homo sapiens
acttactgtttctta

SEQ ID NO: 2091915 - DNA, 17 bp, Homo sapiens
acttagaataaaattgt

SEQ ID NO: 2091916 - DNA, 13 bp, Homo sapiens
acttagcccaaga

SEQ ID NO: 2091917 - DNA, 23 bp, Homo sapiens
acttagccgtccatggcaccagc

SEQ ID NO: 2091918 - DNA, 21 bp, Homo sapiens
acttagcttgaaggatctgtt

SEQ ID NO: 2091919 - DNA, 20 bp, Homo sapiens
acttagtgcggacaagtttt

SEQ ID NO: 2091920 - DNA, 14 bp, Homo sapiens
acttataccaaagg

SEQ ID NO: 2091921 - DNA, 16 bp, Homo sapiens
acttataccaaaggga

SEQ ID NO: 2091922 - DNA, 17 bp, Homo sapiens
acttatatcatcagcat

SEQ ID NO: 2091923 - DNA, 18 bp, Homo sapiens
acttatctagaaagaaaa

SEQ ID NO: 2091924 - DNA, 21 bp, Homo sapiens
acttatctagaaagaaaagac

SEQ ID NO: 2091925 - DNA, 19 bp, Homo sapiens
acttatgctagtttattgg

SEQ ID NO: 2091926 - DNA, 16 bp, Homo sapiens
acttatttttgacagt

SEQ ID NO: 2091927 - DNA, 22 bp, Homo sapiens
acttatttttgacagtgttgaa

SEQ ID NO: 2091928 - DNA, 23 bp, Homo sapiens
acttcaaaaatgttaaaccctta

SEQ ID NO: 2091929 - DNA, 19 bp, Homo sapiens
acttcaagcatggctattt

SEQ ID NO: 2091930 - DNA, 15 bp, Homo sapiens
acttcaatgaacaaa

SEQ ID NO: 2091931 - DNA, 13 bp, Homo sapiens
acttcacaaaatg

SEQ ID NO: 2091932 - DNA, 13 bp, Homo sapiens
acttcacactgca

SEQ ID NO: 2091933 - DNA, 16 bp, Homo sapiens
acttcactaccaaatg

SEQ ID NO: 2091934 - DNA, 17 bp, Homo sapiens
acttcactttaattctc

SEQ ID NO: 2091935 - DNA, 19 bp, Homo sapiens
acttcagaacatgctggat

SEQ ID NO: 2091936 - DNA, 15 bp, Homo sapiens
acttcagagaagtca

SEQ ID NO: 2091937 - DNA, 16 bp, Homo sapiens
acttcaggctcttctc

SEQ ID NO: 2091938 - DNA, 12 bp, Homo sapiens
acttcaggtgct

SEQ ID NO: 2091939 - DNA, 17 bp, Homo sapiens
acttcaggtgcttttga

SEQ ID NO: 2091940 - DNA, 20 bp, Homo sapiens
acttcaggttgttctgtata

SEQ ID NO: 2091941 - DNA, 16 bp, Homo sapiens
acttcagtcctggtct

SEQ ID NO: 2091942 - DNA, 18 bp, Homo sapiens
acttcatatatgaggact

SEQ ID NO: 2091943 - DNA, 22 bp, Homo sapiens
acttcatggcctttgataaatg

SEQ ID NO: 2091944 - DNA, 21 bp, Homo sapiens
acttcattcttgaaagctgtg

SEQ ID NO: 2091945 - DNA, 14 bp, Homo sapiens
acttcattttcaga

SEQ ID NO: 2091946 - DNA, 21 bp, Homo sapiens
acttccacagaatacaagcca

SEQ ID NO: 2091947 - DNA, 15 bp, Homo sapiens
agaacacccactggc

SEQ ID NO: 2091948 - DNA, 19 bp, Homo sapiens
agaacagccgctcctgtct

SEQ ID NO: 2091949 - DNA, 20 bp, Homo sapiens
agaacagccgctcctgtctg

SEQ ID NO: 2091950 - DNA, 22 bp, Homo sapiens
agaacagccgctcctgtctgcc

SEQ ID NO: 2091951 - DNA, 23 bp, Homo sapiens
agaacagccgctcctgtctgcca

SEQ ID NO: 2091952 - DNA, 13 bp, Homo sapiens
agaacagtaaaca

SEQ ID NO: 2091953 - DNA, 18 bp, Homo sapiens
agaacatctgtcctgtga

SEQ ID NO: 2091954 - DNA, 13 bp, Homo sapiens
agaacatgcacat

SEQ ID NO: 2091955 - DNA, 18 bp, Homo sapiens
agaacatggcctaagggc

SEQ ID NO: 2091956 - DNA, 20 bp, Homo sapiens
agaaccaaaagttttcctga

SEQ ID NO: 2091957 - DNA, 18 bp, Homo sapiens
agaaccaagcttcagagc

SEQ ID NO: 2091958 - DNA, 19 bp, Homo sapiens
agaacccctacatgaaaca

SEQ ID NO: 2091959 - DNA, 14 bp, Homo sapiens
agaacctaattcaa

SEQ ID NO: 2091960 - DNA, 19 bp, Homo sapiens
agaacctcaggcttccttg

SEQ ID NO: 2091961 - DNA, 21 bp, Homo sapiens
agaacctcaggcttccttggc

SEQ ID NO: 2091962 - DNA, 15 bp, Homo sapiens
agaacctggaagggc

SEQ ID NO: 2091963 - DNA, 16 bp, Homo sapiens
agaacctggaagggct

SEQ ID NO: 2091964 - DNA, 17 bp, Homo sapiens
agaacctggagggctgg

SEQ ID NO: 2091965 - DNA, 12 bp, Homo sapiens
agaacctggcct

SEQ ID NO: 2091966 - DNA, 13 bp, Homo sapiens
agaacctggcctt

SEQ ID NO: 2091967 - DNA, 14 bp, Homo sapiens
agaacctggccttc

SEQ ID NO: 2091968 - DNA, 12 bp, Homo sapiens
agaacggaagaa

SEQ ID NO: 2091969 - DNA, 23 bp, Homo sapiens
agaacgtattttaaaagccacat

SEQ ID NO: 2091970 - DNA, 17 bp, Homo sapiens
agaactagaacctggag

SEQ ID NO: 2091971 - DNA, 18 bp, Homo sapiens
agaactcgaagcccttcc

SEQ ID NO: 2091972 - DNA, 22 bp, Homo sapiens
agaactcgaagcccttccagtg

SEQ ID NO: 2091973 - DNA, 23 bp, Homo sapiens
agaactctccatcttattttcat

SEQ ID NO: 2091974 - DNA, 14 bp, Homo sapiens
agaactctgggctg

SEQ ID NO: 2091975 - DNA, 20 bp, Homo sapiens
agaactctgggctgctaccc

SEQ ID NO: 2091976 - DNA, 19 bp, Homo sapiens
agaactgaattaagttatt

SEQ ID NO: 2091977 - DNA, 22 bp, Homo sapiens
agaactgaggtcactgggttct

SEQ ID NO: 2091978 - DNA, 14 bp, Homo sapiens
agaactgccccatc

SEQ ID NO: 2091979 - DNA, 21 bp, Homo sapiens
agaactgctaaatactgtaca

SEQ ID NO: 2091980 - DNA, 22 bp, Homo sapiens
agaactttgtacagtggagaaa

SEQ ID NO: 2091981 - DNA, 23 bp, Homo sapiens
agaagaaaaagttgcagtctcag

SEQ ID NO: 2091982 - DNA, 13 bp, Homo sapiens
agaagaaacaagg

SEQ ID NO: 2091983 - DNA, 18 bp, Homo sapiens
agaagaaagaacggaaga

SEQ ID NO: 2091984 - DNA, 14 bp, Homo sapiens
agaagaaatgaata

SEQ ID NO: 2091985 - DNA, 18 bp, Homo sapiens
agaagaaattctgtcata

SEQ ID NO: 2091986 - DNA, 15 bp, Homo sapiens
agaagaagctgagga

SEQ ID NO: 2091987 - DNA, 14 bp, Homo sapiens
agaagaaggcagca

SEQ ID NO: 2091988 - DNA, 20 bp, Homo sapiens
agaagaatacaaacatattt

SEQ ID NO: 2091989 - DNA, 19 bp, Homo sapiens
agaagaattgaacccagga

SEQ ID NO: 2091990 - DNA, 22 bp, Homo sapiens
agaagaattttcagaccccagc

SEQ ID NO: 2091991 - DNA, 12 bp, Homo sapiens
agaagacactgc

SEQ ID NO: 2091992 - DNA, 14 bp, Homo sapiens
agaagacatggaga

SEQ ID NO: 2091993 - DNA, 21 bp, Homo sapiens
agaagacgggatttgaagctg

SEQ ID NO: 2091994 - DNA, 15 bp, Homo sapiens
agaagagagaaatag

SEQ ID NO: 2091995 - DNA, 20 bp, Homo sapiens
agaagagatgggcttgtttt

SEQ ID NO: 2091996 - DNA, 22 bp, Homo sapiens
agaagagatgtggcaaagtgct

SEQ ID NO: 2091997 - DNA, 14 bp, Homo sapiens
agaagagcctgact

SEQ ID NO: 2091998 - DNA, 20 bp, Homo sapiens
agaagaggaaattaaagtct

SEQ ID NO: 2091999 - DNA, 14 bp, Homo sapiens
agaagagtcaggaa

SEQ ID NO: 2092000 - DNA, 17 bp, Homo sapiens
agaagagtcaggaaggg

SEQ ID NO: 2092001 - DNA, 13 bp, Homo sapiens
agaagatagcagg

SEQ ID NO: 2092002 - DNA, 14 bp, Homo sapiens
agaagatgccctcc

SEQ ID NO: 2092003 - DNA, 21 bp, Homo sapiens
agaagcaacctcagtaattta

SEQ ID NO: 2092004 - DNA, 13 bp, Homo sapiens
agaagcaggaagg

SEQ ID NO: 2092005 - DNA, 14 bp, Homo sapiens
agaagcagtgagcc

SEQ ID NO: 2092006 - DNA, 23 bp, Homo sapiens
agaagcatcaccatgcatggtgg

SEQ ID NO: 2092007 - DNA, 15 bp, Homo sapiens
agaagccaaattttt

SEQ ID NO: 2092008 - DNA, 16 bp, Homo sapiens
agaagccaaatttttt

SEQ ID NO: 2092009 - DNA, 18 bp, Homo sapiens
agaagccacgctgtcctc

SEQ ID NO: 2092010 - DNA, 18 bp, Homo sapiens
agaagcccaatattataa

SEQ ID NO: 2092011 - DNA, 14 bp, Homo sapiens
agaagcccatggag

SEQ ID NO: 2092012 - DNA, 19 bp, Homo sapiens
agaagccctgctgggccca

SEQ ID NO: 2092013 - DNA, 22 bp, Homo sapiens
agaagccgggaacagacaacag

SEQ ID NO: 2092014 - DNA, 12 bp, Homo sapiens
agaagcctgagg

SEQ ID NO: 2092015 - DNA, 14 bp, Homo sapiens
agaagcctgaggct

SEQ ID NO: 2092016 - DNA, 11 bp, Homo sapiens
agaagcctggg

SEQ ID NO: 2092017 - DNA, 12 bp, Homo sapiens
agaagcctgggg

SEQ ID NO: 2092018 - DNA, 18 bp, Homo sapiens
agaagcctgggggcctgg

SEQ ID NO: 2092019 - DNA, 19 bp, Homo sapiens
agaagcctgggggcctggc

SEQ ID NO: 2092020 - DNA, 20 bp, Homo sapiens
agaagcctgggggcctggct

SEQ ID NO: 2092021 - DNA, 16 bp, Homo sapiens
agaagcctgttttgtt

SEQ ID NO: 2092022 - DNA, 13 bp, Homo sapiens
agaagctgtagta

SEQ ID NO: 2092023 - DNA, 17 bp, Homo sapiens
agaagcttcagaagttt

SEQ ID NO: 2092024 - DNA, 19 bp, Homo sapiens
agaagcttcatgccaggtt

SEQ ID NO: 2092025 - DNA, 21 bp, Homo sapiens
agaaggaaaattttagcgtgc

SEQ ID NO: 2092026 - DNA, 14 bp, Homo sapiens
agaaggaaatagcc

SEQ ID NO: 2092027 - DNA, 17 bp, Homo sapiens
agaaggaaggcagggag

SEQ ID NO: 2092028 - DNA, 21 bp, Homo sapiens
agaaggaaggcagggaggagg

SEQ ID NO: 2092029 - DNA, 13 bp, Homo sapiens
agaaggaagggca

SEQ ID NO: 2092030 - DNA, 17 bp, Homo sapiens
agaaggaagtgaagagg

SEQ ID NO: 2092031 - DNA, 18 bp, Homo sapiens
agaaggacatgtgctatt

SEQ ID NO: 2092032 - DNA, 14 bp, Homo sapiens
agaaggagatcagg

SEQ ID NO: 2092033 - DNA, 16 bp, Homo sapiens
agaaggagcaagagaa

SEQ ID NO: 2092034 - DNA, 15 bp, Homo sapiens
agaaggagggcagag

SEQ ID NO: 2092035 - DNA, 14 bp, Homo sapiens
agaaggatgaatga

SEQ ID NO: 2092036 - DNA, 19 bp, Homo sapiens
agaaggcaaaaatagtttg

SEQ ID NO: 2092037 - DNA, 19 bp, Homo sapiens
agaaggcacaggtgtaaat

SEQ ID NO: 2092038 - DNA, 22 bp, Homo sapiens
agaaggcacaggtgtaaatata

SEQ ID NO: 2092039 - DNA, 13 bp, Homo sapiens
agaaggccaagaa

SEQ ID NO: 2092040 - DNA, 15 bp, Homo sapiens
agaaggccgctgccc

SEQ ID NO: 2092041 - DNA, 19 bp, Homo sapiens
agaaggcctcttgtgctca

SEQ ID NO: 2092042 - DNA, 22 bp, Homo sapiens
agaaggcctcttgtgctcacgc

SEQ ID NO: 2092043 - DNA, 17 bp, Homo sapiens
agaaggcgaggagagtg

SEQ ID NO: 2092044 - DNA, 15 bp, Homo sapiens
agaaggctggggcca

SEQ ID NO: 2092045 - DNA, 21 bp, Homo sapiens
agaaggcttcctccagcggct

SEQ ID NO: 2092046 - DNA, 13 bp, Homo sapiens
agaagggagaagg

SEQ ID NO: 2092047 - DNA, 20 bp, Homo sapiens
agaagggagttgctcactca

SEQ ID NO: 2092048 - DNA, 12 bp, Homo sapiens
agaagggccagc

SEQ ID NO: 2092049 - DNA, 13 bp, Homo sapiens
agaagggccagcc

SEQ ID NO: 2092050 - DNA, 21 bp, Homo sapiens
agaagggctagaacctggagg

SEQ ID NO: 2092051 - DNA, 18 bp, Homo sapiens
agaaggggaagatactga

SEQ ID NO: 2092052 - DNA, 16 bp, Homo sapiens
agaagggttatatttt

SEQ ID NO: 2092053 - DNA, 20 bp, Homo sapiens
agaagggttttccaccctgg

SEQ ID NO: 2092054 - DNA, 19 bp, Homo sapiens
agaagtaaagtttatttca

SEQ ID NO: 2092055 - DNA, 20 bp, Homo sapiens
agaagtaaagtttatttcat

SEQ ID NO: 2092056 - DNA, 19 bp, Homo sapiens
agaagtaaatttgtccaat

SEQ ID NO: 2092057 - DNA, 17 bp, Homo sapiens
agaagtacgtttttgca

SEQ ID NO: 2092058 - DNA, 21 bp, Homo sapiens
agaagtactgcccttttgtgt

SEQ ID NO: 2092059 - DNA, 21 bp, Homo sapiens
agaagtatccaattatgtgac

SEQ ID NO: 2092060 - DNA, 14 bp, Homo sapiens
agaagtcaaagtaa

SEQ ID NO: 2092061 - DNA, 17 bp, Homo sapiens
agaagtcagttggagaa

SEQ ID NO: 2092062 - DNA, 15 bp, Homo sapiens
agagagggcagaggg

SEQ ID NO: 2092063 - DNA, 15 bp, Homo sapiens
agagagggcccagct

SEQ ID NO: 2092064 - DNA, 22 bp, Homo sapiens
agagaggggaataatagaagaa

SEQ ID NO: 2092065 - DNA, 19 bp, Homo sapiens
agagaggggacatttccct

SEQ ID NO: 2092066 - DNA, 12 bp, Homo sapiens
agagagggggct

SEQ ID NO: 2092067 - DNA, 21 bp, Homo sapiens
agagagggtggtgacctctgc

SEQ ID NO: 2092068 - DNA, 23 bp, Homo sapiens
agagagggtggtgacctctgcct

SEQ ID NO: 2092069 - DNA, 16 bp, Homo sapiens
agagaggtagcgagct

SEQ ID NO: 2092070 - DNA, 21 bp, Homo sapiens
agagaggttctggggaggaag

SEQ ID NO: 2092071 - DNA, 24 bp, Homo sapiens
agagaggttctggggaggaagggc

SEQ ID NO: 2092072 - DNA, 19 bp, Homo sapiens
agagagtattaaatattta

SEQ ID NO: 2092073 - DNA, 15 bp, Homo sapiens
agagagtcctctgga

SEQ ID NO: 2092074 - DNA, 16 bp, Homo sapiens
agagagtcttccaggt

SEQ ID NO: 2092075 - DNA, 14 bp, Homo sapiens
agagagtggctcct

SEQ ID NO: 2092076 - DNA, 16 bp, Homo sapiens
agagagtggctcctcc

SEQ ID NO: 2092077 - DNA, 15 bp, Homo sapiens
agagagttgaaccta

SEQ ID NO: 2092078 - DNA, 21 bp, Homo sapiens
agagatacattccctatcaaa

SEQ ID NO: 2092079 - DNA, 16 bp, Homo sapiens
agagatatatctgaaa

SEQ ID NO: 2092080 - DNA, 15 bp, Homo sapiens
agagatcaggaagag

SEQ ID NO: 2092081 - DNA, 17 bp, Homo sapiens
agagatctagaaagtgg

SEQ ID NO: 2092082 - DNA, 19 bp, Homo sapiens
agagatgaagagtgagagg

SEQ ID NO: 2092083 - DNA, 14 bp, Homo sapiens
agagatgactgaaa

SEQ ID NO: 2092084 - DNA, 22 bp, Homo sapiens
agagatgattcggatttgacaa

SEQ ID NO: 2092085 - DNA, 16 bp, Homo sapiens
agagatgcctccaccg

SEQ ID NO: 2092086 - DNA, 21 bp, Homo sapiens
agagatgcctccaccgctgcc

SEQ ID NO: 2092087 - DNA, 20 bp, Homo sapiens
agagatgtaccatgttaaag

SEQ ID NO: 2092088 - DNA, 17 bp, Homo sapiens
agagatgtagcagaata

SEQ ID NO: 2092089 - DNA, 22 bp, Homo sapiens
agagatgtttttaaaagtttca

SEQ ID NO: 2092090 - DNA, 13 bp, Homo sapiens
agagattaatttg

SEQ ID NO: 2092091 - DNA, 17 bp, Homo sapiens
agagattaatttgtgta

SEQ ID NO: 2092092 - DNA, 19 bp, Homo sapiens
agagattaatttgtgtaga

SEQ ID NO: 2092093 - DNA, 15 bp, Homo sapiens
agagattaattttaa

SEQ ID NO: 2092094 - DNA, 22 bp, Homo sapiens
agagattttgtcgggacagaga

SEQ ID NO: 2092095 - DNA, 13 bp, Homo sapiens
agagcaacccctg

SEQ ID NO: 2092096 - DNA, 14 bp, Homo sapiens
agagcaagactctg

SEQ ID NO: 2092097 - DNA, 14 bp, Homo sapiens
agagcaagtctgga

SEQ ID NO: 2092098 - DNA, 14 bp, Homo sapiens
agagcacactgtag

SEQ ID NO: 2092099 - DNA, 18 bp, Homo sapiens
agagcacctagtccagtg

SEQ ID NO: 2092100 - DNA, 21 bp, Homo sapiens
agagcactaggttcaattccc

SEQ ID NO: 2092101 - DNA, 13 bp, Homo sapiens
agagcagaaataa

SEQ ID NO: 2092102 - DNA, 13 bp, Homo sapiens
agagcagagagca

SEQ ID NO: 2092103 - DNA, 18 bp, Homo sapiens
agagcagagcaaatgagg

SEQ ID NO: 2092104 - DNA, 18 bp, Homo sapiens
agagcagctggctctcca

SEQ ID NO: 2092105 - DNA, 12 bp, Homo sapiens
agagcaggcaca

SEQ ID NO: 2092106 - DNA, 20 bp, Homo sapiens
agagcaggctcagactctgg

SEQ ID NO: 2092107 - DNA, 23 bp, Homo sapiens
agagcatcatgcctctgaggcca

SEQ ID NO: 2092108 - DNA, 16 bp, Homo sapiens
agagccagccctccct

SEQ ID NO: 2092109 - DNA, 21 bp, Homo sapiens
agagccagccctccctgtcct

SEQ ID NO: 2092110 - DNA, 15 bp, Homo sapiens
agagccagcctggga

SEQ ID NO: 2092111 - DNA, 12 bp, Homo sapiens
agagccagctct

SEQ ID NO: 2092112 - DNA, 14 bp, Homo sapiens
agagccagctctct

SEQ ID NO: 2092113 - DNA, 15 bp, Homo sapiens
agagccatgggcctg

SEQ ID NO: 2092114 - DNA, 23 bp, Homo sapiens
agagccatgggcctgggcctgct

SEQ ID NO: 2092115 - DNA, 15 bp, Homo sapiens
agagccatgtaccag

SEQ ID NO: 2092116 - DNA, 15 bp, Homo sapiens
agagcccaagtgcca

SEQ ID NO: 2092117 - DNA, 13 bp, Homo sapiens
agagcccaccttg

SEQ ID NO: 2092118 - DNA, 19 bp, Homo sapiens
agagcccaccttggctcaa

SEQ ID NO: 2092119 - DNA, 14 bp, Homo sapiens
agagccccacacgg

SEQ ID NO: 2092120 - DNA, 13 bp, Homo sapiens
agagcccccaagc

SEQ ID NO: 2092121 - DNA, 17 bp, Homo sapiens
agagcccccaagcctct

SEQ ID NO: 2092122 - DNA, 18 bp, Homo sapiens
agagcccccaagcctctg

SEQ ID NO: 2092123 - DNA, 14 bp, Homo sapiens
agagccccccacaa

SEQ ID NO: 2092124 - DNA, 18 bp, Homo sapiens
agagccctgagctcaggc

SEQ ID NO: 2092125 - DNA, 20 bp, Homo sapiens
agagccctgagctcaggctg

SEQ ID NO: 2092126 - DNA, 16 bp, Homo sapiens
agagccctgctgtggg

SEQ ID NO: 2092127 - DNA, 19 bp, Homo sapiens
agagccctgggtgacttca

SEQ ID NO: 2092128 - DNA, 18 bp, Homo sapiens
agagcctaagaaaatcat

SEQ ID NO: 2092129 - DNA, 17 bp, Homo sapiens
agagcctagccacctcc

SEQ ID NO: 2092130 - DNA, 22 bp, Homo sapiens
agagcctagccacctcccaccc

SEQ ID NO: 2092131 - DNA, 16 bp, Homo sapiens
agagcctgaatttgta

SEQ ID NO: 2092132 - DNA, 14 bp, Homo sapiens
agagcctgcctcag

SEQ ID NO: 2092133 - DNA, 13 bp, Homo sapiens
agagcctgctccc

SEQ ID NO: 2092134 - DNA, 13 bp, Homo sapiens
agagcctggagaa

SEQ ID NO: 2092135 - DNA, 17 bp, Homo sapiens
agagcctggagaagctg

SEQ ID NO: 2092136 - DNA, 16 bp, Homo sapiens
agagcctggggctcta

SEQ ID NO: 2092137 - DNA, 13 bp, Homo sapiens
agagcctgtcttt

SEQ ID NO: 2092138 - DNA, 22 bp, Homo sapiens
agagcctgtctttcagcattca

SEQ ID NO: 2092139 - DNA, 21 bp, Homo sapiens
agagccttctcctgcctacat

SEQ ID NO: 2092140 - DNA, 20 bp, Homo sapiens
agagccttggtgtccacctg

SEQ ID NO: 2092141 - DNA, 21 bp, Homo sapiens
agagccttggtgtccacctgg

SEQ ID NO: 2092142 - DNA, 22 bp, Homo sapiens
agagccttggtgtccacctggc

SEQ ID NO: 2092143 - DNA, 20 bp, Homo sapiens
agagcgggcctcttccctca

SEQ ID NO: 2092144 - DNA, 18 bp, Homo sapiens
agagcggggaggtgcctg

SEQ ID NO: 2092145 - DNA, 11 bp, Homo sapiens
agagctacata

SEQ ID NO: 2092146 - DNA, 16 bp, Homo sapiens
agagctacataattta

SEQ ID NO: 2092147 - DNA, 18 bp, Homo sapiens
agagctagaacctggaga

SEQ ID NO: 2092148 - DNA, 22 bp, Homo sapiens
agagctagaacctggagggcta

SEQ ID NO: 2092149 - DNA, 18 bp, Homo sapiens
agagctaggagcaaagcc

SEQ ID NO: 2092150 - DNA, 15 bp, Homo sapiens
agagctatgttccct

SEQ ID NO: 2092151 - DNA, 17 bp, Homo sapiens
agagctatgttccctcc

SEQ ID NO: 2092152 - DNA, 18 bp, Homo sapiens
agagctcctgtccctacc

SEQ ID NO: 2092153 - DNA, 22 bp, Homo sapiens
agagctcttcaagctgtcccct

SEQ ID NO: 2092154 - DNA, 21 bp, Homo sapiens
agagctcttcggtttctgagc

SEQ ID NO: 2092155 - DNA, 11 bp, Homo sapiens
agagctgaggc

SEQ ID NO: 2092156 - DNA, 19 bp, Homo sapiens
agagctgatggagaaggaa

SEQ ID NO: 2092157 - DNA, 20 bp, Homo sapiens
agagctgatggagaaggaag

SEQ ID NO: 2092158 - DNA, 21 bp, Homo sapiens
agagctgatgtgagtgtgtgt

SEQ ID NO: 2092159 - DNA, 15 bp, Homo sapiens
agagctgctctggaa

SEQ ID NO: 2092160 - DNA, 23 bp, Homo sapiens
agagctgctctggaaaatgtgac

SEQ ID NO: 2092161 - DNA, 20 bp, Homo sapiens
agagctggaaggcagggcag

SEQ ID NO: 2092162 - DNA, 15 bp, Homo sapiens
agagctggcaaaggt

SEQ ID NO: 2092163 - DNA, 20 bp, Homo sapiens
agagctgggaaacagggagc

SEQ ID NO: 2092164 - DNA, 12 bp, Homo sapiens
agagctgggagg

SEQ ID NO: 2092165 - DNA, 15 bp, Homo sapiens
agagcttagcctgga

SEQ ID NO: 2092166 - DNA, 16 bp, Homo sapiens
agagcttattggccac

SEQ ID NO: 2092167 - DNA, 17 bp, Homo sapiens
agagcttattggccact

SEQ ID NO: 2092168 - DNA, 14 bp, Homo sapiens
agagcttcccagga

SEQ ID NO: 2092169 - DNA, 15 bp, Homo sapiens
agagcttcccaggat

SEQ ID NO: 2092170 - DNA, 20 bp, Homo sapiens
agagcttggtggctgagctt

SEQ ID NO: 2092171 - DNA, 22 bp, Homo sapiens
agagctttctgtccttttggca

SEQ ID NO: 2092172 - DNA, 22 bp, Homo sapiens
agaggaaaaacgatcgctgtga

SEQ ID NO: 2092173 - DNA, 19 bp, Homo sapiens
agaggaagagagagaccct

SEQ ID NO: 2092174 - DNA, 22 bp, Homo sapiens
agaggaagatgaagagaagctg

SEQ ID NO: 2092175 - DNA, 14 bp, Homo sapiens
agaggaataagaat

SEQ ID NO: 2092176 - DNA, 14 bp, Homo sapiens
agaggaccacagtg

SEQ ID NO: 2092177 - DNA, 23 bp, Homo sapiens
agcacaatgtctcacatgggaca

SEQ ID NO: 2092178 - DNA, 14 bp, Homo sapiens
agcacaccccaagg

SEQ ID NO: 2092179 - DNA, 16 bp, Homo sapiens
agcacaccccaaggga

SEQ ID NO: 2092180 - DNA, 18 bp, Homo sapiens
agcacaccccaagggaca

SEQ ID NO: 2092181 - DNA, 16 bp, Homo sapiens
agcacacggccctgcc

SEQ ID NO: 2092182 - DNA, 19 bp, Homo sapiens
agcacacggccctgcccca

SEQ ID NO: 2092183 - DNA, 23 bp, Homo sapiens
agcacacggccctgccccatcct

SEQ ID NO: 2092184 - DNA, 24 bp, Homo sapiens
agcacacggccctgccccatcctg

SEQ ID NO: 2092185 - DNA, 14 bp, Homo sapiens
agcacagccctggg

SEQ ID NO: 2092186 - DNA, 15 bp, Homo sapiens
agcacagccctggga

SEQ ID NO: 2092187 - DNA, 16 bp, Homo sapiens
agcacagccctgggag

SEQ ID NO: 2092188 - DNA, 15 bp, Homo sapiens
agcacaggcagctgg

SEQ ID NO: 2092189 - DNA, 16 bp, Homo sapiens
agcacaggggccccag

SEQ ID NO: 2092190 - DNA, 22 bp, Homo sapiens
agcacagtgttaaatgaaattg

SEQ ID NO: 2092191 - DNA, 19 bp, Homo sapiens
agcacattcttaaaggaaa

SEQ ID NO: 2092192 - DNA, 14 bp, Homo sapiens
agcacatttctcct

SEQ ID NO: 2092193 - DNA, 18 bp, Homo sapiens
agcacatttctcctgttt

SEQ ID NO: 2092194 - DNA, 18 bp, Homo sapiens
agcaccagcttctccagg

SEQ ID NO: 2092195 - DNA, 21 bp, Homo sapiens
agcaccagcttctccaggctc

SEQ ID NO: 2092196 - DNA, 14 bp, Homo sapiens
agcaccccctcatt

SEQ ID NO: 2092197 - DNA, 16 bp, Homo sapiens
agcaccccctcattcc

SEQ ID NO: 2092198 - DNA, 13 bp, Homo sapiens
agcacccctgtct

SEQ ID NO: 2092199 - DNA, 18 bp, Homo sapiens
agcacccgttcaccttct

SEQ ID NO: 2092200 - DNA, 18 bp, Homo sapiens
agcaccctcccccgcagc

SEQ ID NO: 2092201 - DNA, 14 bp, Homo sapiens
agcaccctctcctg

SEQ ID NO: 2092202 - DNA, 16 bp, Homo sapiens
agcaccctctcctggg

SEQ ID NO: 2092203 - DNA, 19 bp, Homo sapiens
agcaccctctcctgggggt

SEQ ID NO: 2092204 - DNA, 17 bp, Homo sapiens
agcaccctgggtgccat

SEQ ID NO: 2092205 - DNA, 15 bp, Homo sapiens
agcacctacttacat

SEQ ID NO: 2092206 - DNA, 13 bp, Homo sapiens
agcacctgaaccc

SEQ ID NO: 2092207 - DNA, 15 bp, Homo sapiens
agcacctgaacccca

SEQ ID NO: 2092208 - DNA, 13 bp, Homo sapiens
agcacctgcagat

SEQ ID NO: 2092209 - DNA, 20 bp, Homo sapiens
agcacctgccgacctcgtcc

SEQ ID NO: 2092210 - DNA, 21 bp, Homo sapiens
agcacctgccgacctcgtcct

SEQ ID NO: 2092211 - DNA, 13 bp, Homo sapiens
agcaccttaatat

SEQ ID NO: 2092212 - DNA, 14 bp, Homo sapiens
agcactaaagcagt

SEQ ID NO: 2092213 - DNA, 16 bp, Homo sapiens
agcactaaagcagtgg

SEQ ID NO: 2092214 - DNA, 20 bp, Homo sapiens
agcactaaagcagtggacac

SEQ ID NO: 2092215 - DNA, 16 bp, Homo sapiens
agcactaacgtaaata

SEQ ID NO: 2092216 - DNA, 17 bp, Homo sapiens
agcactaaggccgtgtc

SEQ ID NO: 2092217 - DNA, 23 bp, Homo sapiens
agcactaggttcaattccctgaa

SEQ ID NO: 2092218 - DNA, 20 bp, Homo sapiens
agcactcaaccaacctcccc

SEQ ID NO: 2092219 - DNA, 17 bp, Homo sapiens
agcactcagaaaagaaa

SEQ ID NO: 2092220 - DNA, 20 bp, Homo sapiens
agcactcagtctagtgaaga

SEQ ID NO: 2092221 - DNA, 16 bp, Homo sapiens
agcactcgagaccatc

SEQ ID NO: 2092222 - DNA, 18 bp, Homo sapiens
agcactcgagaccatcct

SEQ ID NO: 2092223 - DNA, 19 bp, Homo sapiens
agcactcgagaccatcctg

SEQ ID NO: 2092224 - DNA, 20 bp, Homo sapiens
agcactcgagaccatcctgg

SEQ ID NO: 2092225 - DNA, 15 bp, Homo sapiens
agcactctctaaatc

SEQ ID NO: 2092226 - DNA, 23 bp, Homo sapiens
agcactctctaaatcttccttgt

SEQ ID NO: 2092227 - DNA, 10 bp, Homo sapiens
agcactgaaa

SEQ ID NO: 2092228 - DNA, 11 bp, Homo sapiens
agcactgaaaa

SEQ ID NO: 2092229 - DNA, 13 bp, Homo sapiens
agcactgatttca

SEQ ID NO: 2092230 - DNA, 15 bp, Homo sapiens
agcactgcagatagc

SEQ ID NO: 2092231 - DNA, 20 bp, Homo sapiens
agcactggagtgcagggagg

SEQ ID NO: 2092232 - DNA, 14 bp, Homo sapiens
agcactggccagag

SEQ ID NO: 2092233 - DNA, 17 bp, Homo sapiens
agcacttctttcctctc

SEQ ID NO: 2092234 - DNA, 22 bp, Homo sapiens
agcacttgcgtcctgcagagga

SEQ ID NO: 2092235 - DNA, 13 bp, Homo sapiens
agcacttgctgta

SEQ ID NO: 2092236 - DNA, 18 bp, Homo sapiens
agcacttgttccttctgc

SEQ ID NO: 2092237 - DNA, 19 bp, Homo sapiens
agcactttaaccctctctt

SEQ ID NO: 2092238 - DNA, 12 bp, Homo sapiens
agcactttggga

SEQ ID NO: 2092239 - DNA, 21 bp, Homo sapiens
agcactttgggaggccaaggt

SEQ ID NO: 2092240 - DNA, 16 bp, Homo sapiens
agcactttgggaggct

SEQ ID NO: 2092241 - DNA, 22 bp, Homo sapiens
agcactttgggaggctgaggcg

SEQ ID NO: 2092242 - DNA, 12 bp, Homo sapiens
agcagaaaagtg

SEQ ID NO: 2092243 - DNA, 15 bp, Homo sapiens
agcagaaaagtgctt

SEQ ID NO: 2092244 - DNA, 20 bp, Homo sapiens
agcagaaaagtgcttagaaa

SEQ ID NO: 2092245 - DNA, 21 bp, Homo sapiens
agcagaagaaaaagttgcagt

SEQ ID NO: 2092246 - DNA, 14 bp, Homo sapiens
agcagaagagggag

SEQ ID NO: 2092247 - DNA, 16 bp, Homo sapiens
agcagaatgaagacct

SEQ ID NO: 2092248 - DNA, 21 bp, Homo sapiens
agcagacagtgttttctggga

SEQ ID NO: 2092249 - DNA, 23 bp, Homo sapiens
agcagacgcagcagctgggaccc

SEQ ID NO: 2092250 - DNA, 22 bp, Homo sapiens
agcagagaatgaaagggcccag

SEQ ID NO: 2092251 - DNA, 15 bp, Homo sapiens
agcagagcaggggca

SEQ ID NO: 2092252 - DNA, 19 bp, Homo sapiens
agcagagctgatggagaag

SEQ ID NO: 2092253 - DNA, 22 bp, Homo sapiens
agcagagctgatggagaaggaa

SEQ ID NO: 2092254 - DNA, 23 bp, Homo sapiens
agcagagctgatggagaaggaag

SEQ ID NO: 2092255 - DNA, 22 bp, Homo sapiens
agcagaggagtccagggcggga

SEQ ID NO: 2092256 - DNA, 13 bp, Homo sapiens
agcagaggcagcg

SEQ ID NO: 2092257 - DNA, 18 bp, Homo sapiens
agcagagggactttgtat

SEQ ID NO: 2092258 - DNA, 23 bp, Homo sapiens
agcagaggtggccagagctggga

SEQ ID NO: 2092259 - DNA, 14 bp, Homo sapiens
agcagataaagaca

SEQ ID NO: 2092260 - DNA, 15 bp, Homo sapiens
agcagataaagacag

SEQ ID NO: 2092261 - DNA, 15 bp, Homo sapiens
agcagatggaaagaa

SEQ ID NO: 2092262 - DNA, 18 bp, Homo sapiens
agcagatggtcctccatt

SEQ ID NO: 2092263 - DNA, 20 bp, Homo sapiens
agcagcacatggtgttgtat

SEQ ID NO: 2092264 - DNA, 20 bp, Homo sapiens
agcagcacgattttgcacaa

SEQ ID NO: 2092265 - DNA, 18 bp, Homo sapiens
agcagcagagagccctgg

SEQ ID NO: 2092266 - DNA, 22 bp, Homo sapiens
agcagcagagagccctgggtga

SEQ ID NO: 2092267 - DNA, 22 bp, Homo sapiens
agcagcagctaggactgaggag

SEQ ID NO: 2092268 - DNA, 18 bp, Homo sapiens
agcagcatctgctaataa

SEQ ID NO: 2092269 - DNA, 19 bp, Homo sapiens
agcagcattcagcacaccc

SEQ ID NO: 2092270 - DNA, 11 bp, Homo sapiens
agcagccagcc

SEQ ID NO: 2092271 - DNA, 12 bp, Homo sapiens
agcagccagcca

SEQ ID NO: 2092272 - DNA, 12 bp, Homo sapiens
agcagccagccc

SEQ ID NO: 2092273 - DNA, 22 bp, Homo sapiens
agcagccagccctgcctggagg

SEQ ID NO: 2092274 - DNA, 13 bp, Homo sapiens
agcagccagctct

SEQ ID NO: 2092275 - DNA, 12 bp, Homo sapiens
agcagcccaaat

SEQ ID NO: 2092276 - DNA, 12 bp, Homo sapiens
agcagcccagct

SEQ ID NO: 2092277 - DNA, 13 bp, Homo sapiens
agcagcccagctt

SEQ ID NO: 2092278 - DNA, 17 bp, Homo sapiens
agcagcccatggcctct

SEQ ID NO: 2092279 - DNA, 14 bp, Homo sapiens
agcagcctttctgt

SEQ ID NO: 2092280 - DNA, 23 bp, Homo sapiens
agcagcggtaccccagggcctac

SEQ ID NO: 2092281 - DNA, 14 bp, Homo sapiens
agcagctaggactg

SEQ ID NO: 2092282 - DNA, 12 bp, Homo sapiens
agcagctcaggc

SEQ ID NO: 2092283 - DNA, 21 bp, Homo sapiens
agcagctcaggcacacttctt

SEQ ID NO: 2092284 - DNA, 15 bp, Homo sapiens
agcagctcccctggg

SEQ ID NO: 2092285 - DNA, 18 bp, Homo sapiens
agcagctgaacagccaaa

SEQ ID NO: 2092286 - DNA, 11 bp, Homo sapiens
agcagctgagc

SEQ ID NO: 2092287 - DNA, 19 bp, Homo sapiens
agcagctgagcagggccgg

SEQ ID NO: 2092288 - DNA, 21 bp, Homo sapiens
agcagctgcgggtctgaagga

SEQ ID NO: 2092289 - DNA, 12 bp, Homo sapiens
agcagctgggcc

SEQ ID NO: 2092290 - DNA, 19 bp, Homo sapiens
agcagctgggccggccagc

SEQ ID NO: 2092291 - DNA, 18 bp, Homo sapiens
agcaggaacagagactct

SEQ ID NO: 2092292 - DNA, 19 bp, Homo sapiens
agccggccccccctctttt

SEQ ID NO: 2092293 - DNA, 21 bp, Homo sapiens
agccggcgtggcaaatataaa

SEQ ID NO: 2092294 - DNA, 19 bp, Homo sapiens
agccgggcacccccaacct

SEQ ID NO: 2092295 - DNA, 22 bp, Homo sapiens
agccgggcgtggtggcgggcac

SEQ ID NO: 2092296 - DNA, 12 bp, Homo sapiens
agccggtgcctg

SEQ ID NO: 2092297 - DNA, 13 bp, Homo sapiens
agccggtgcctgg

SEQ ID NO: 2092298 - DNA, 14 bp, Homo sapiens
agccgtactgtcta

SEQ ID NO: 2092299 - DNA, 20 bp, Homo sapiens
agccgtcagccaaatgtaat

SEQ ID NO: 2092300 - DNA, 14 bp, Homo sapiens
agccgtccatggca

SEQ ID NO: 2092301 - DNA, 22 bp, Homo sapiens
agccgtccatggcaccagcccc

SEQ ID NO: 2092302 - DNA, 20 bp, Homo sapiens
agccgtctgactccagagtc

SEQ ID NO: 2092303 - DNA, 23 bp, Homo sapiens
agccgtgcctttctctggctcca

SEQ ID NO: 2092304 - DNA, 14 bp, Homo sapiens
agccgtggcttccc

SEQ ID NO: 2092305 - DNA, 23 bp, Homo sapiens
agccgtggcttcccgctcagccc

SEQ ID NO: 2092306 - DNA, 21 bp, Homo sapiens
agccgttttcatgagctgagt

SEQ ID NO: 2092307 - DNA, 14 bp, Homo sapiens
agcctaccccctga

SEQ ID NO: 2092308 - DNA, 21 bp, Homo sapiens
agcctacccttgtaccccatc

SEQ ID NO: 2092309 - DNA, 15 bp, Homo sapiens
agcctagaccctcct

SEQ ID NO: 2092310 - DNA, 13 bp, Homo sapiens
agcctagccacct

SEQ ID NO: 2092311 - DNA, 18 bp, Homo sapiens
agcctagccgacctcagc

SEQ ID NO: 2092312 - DNA, 19 bp, Homo sapiens
agcctagccgacctcagcc

SEQ ID NO: 2092313 - DNA, 21 bp, Homo sapiens
agcctagccgacctcagcctt

SEQ ID NO: 2092314 - DNA, 22 bp, Homo sapiens
agcctagctaccttctctaccc

SEQ ID NO: 2092315 - DNA, 15 bp, Homo sapiens
agcctcaacctcctg

SEQ ID NO: 2092316 - DNA, 15 bp, Homo sapiens
agcctcaatttctga

SEQ ID NO: 2092317 - DNA, 16 bp, Homo sapiens
agcctcacttgaatgt

SEQ ID NO: 2092318 - DNA, 15 bp, Homo sapiens
agcctcagcatcctg

SEQ ID NO: 2092319 - DNA, 20 bp, Homo sapiens
agcctcagcatcctggcacc

SEQ ID NO: 2092320 - DNA, 23 bp, Homo sapiens
agcctcagcatcctggcacccgg

SEQ ID NO: 2092321 - DNA, 13 bp, Homo sapiens
agcctcagctcag

SEQ ID NO: 2092322 - DNA, 17 bp, Homo sapiens
agcctcagctcagcctc

SEQ ID NO: 2092323 - DNA, 15 bp, Homo sapiens
agcctcagtgccact

SEQ ID NO: 2092324 - DNA, 14 bp, Homo sapiens
agcctcatatttaa

SEQ ID NO: 2092325 - DNA, 20 bp, Homo sapiens
agcctcatccgaggcagggt

SEQ ID NO: 2092326 - DNA, 13 bp, Homo sapiens
agcctccagagcc

SEQ ID NO: 2092327 - DNA, 18 bp, Homo sapiens
agcctccagagccagcct

SEQ ID NO: 2092328 - DNA, 19 bp, Homo sapiens
agcctccagagccagcctg

SEQ ID NO: 2092329 - DNA, 20 bp, Homo sapiens
agcctccagagccagcctgg

SEQ ID NO: 2092330 - DNA, 22 bp, Homo sapiens
agcctccagagccagcctggga

SEQ ID NO: 2092331 - DNA, 20 bp, Homo sapiens
agcctccatgctgcctccag

SEQ ID NO: 2092332 - DNA, 17 bp, Homo sapiens
agcctccatttagttct

SEQ ID NO: 2092333 - DNA, 16 bp, Homo sapiens
agcctcccaaagtgct

SEQ ID NO: 2092334 - DNA, 21 bp, Homo sapiens
agcctccccccgctggggagc

SEQ ID NO: 2092335 - DNA, 14 bp, Homo sapiens
agcctccccctcag

SEQ ID NO: 2092336 - DNA, 17 bp, Homo sapiens
agcctccccctgctgct

SEQ ID NO: 2092337 - DNA, 18 bp, Homo sapiens
agcctcccgaatagctgg

SEQ ID NO: 2092338 - DNA, 22 bp, Homo sapiens
agcctcccgagtagctgggact

SEQ ID NO: 2092339 - DNA, 13 bp, Homo sapiens
agcctccctcctc

SEQ ID NO: 2092340 - DNA, 21 bp, Homo sapiens
agcctccctcctcgtcccctg

SEQ ID NO: 2092341 - DNA, 14 bp, Homo sapiens
agcctccctctgac

SEQ ID NO: 2092342 - DNA, 15 bp, Homo sapiens
agcctccgtcaggag

SEQ ID NO: 2092343 - DNA, 19 bp, Homo sapiens
agcctccgtttatgggcct

SEQ ID NO: 2092344 - DNA, 21 bp, Homo sapiens
agcctccgtttatgggccttg

SEQ ID NO: 2092345 - DNA, 14 bp, Homo sapiens
agcctcctcccacc

SEQ ID NO: 2092346 - DNA, 22 bp, Homo sapiens
agcctcctcccaccaccctccc

SEQ ID NO: 2092347 - DNA, 12 bp, Homo sapiens
agcctcctctgc

SEQ ID NO: 2092348 - DNA, 22 bp, Homo sapiens
agcctcctctgcttgcatcact

SEQ ID NO: 2092349 - DNA, 22 bp, Homo sapiens
agcctcctgacctgaggctcct

SEQ ID NO: 2092350 - DNA, 15 bp, Homo sapiens
agcctcctgggcagt

SEQ ID NO: 2092351 - DNA, 18 bp, Homo sapiens
agcctcgcaacccgtgcc

SEQ ID NO: 2092352 - DNA, 19 bp, Homo sapiens
agcctcgcaacccgtgcca

SEQ ID NO: 2092353 - DNA, 20 bp, Homo sapiens
agcctcgccgtctgtgaatt

SEQ ID NO: 2092354 - DNA, 18 bp, Homo sapiens
agcctcggtggccatgct

SEQ ID NO: 2092355 - DNA, 22 bp, Homo sapiens
agcctcggtggccatgcttctt

SEQ ID NO: 2092356 - DNA, 23 bp, Homo sapiens
agcctctccaggcaccatctccc

SEQ ID NO: 2092357 - DNA, 16 bp, Homo sapiens
agcctctcccggctgc

SEQ ID NO: 2092358 - DNA, 20 bp, Homo sapiens
agcctctcccggctgcctgc

SEQ ID NO: 2092359 - DNA, 22 bp, Homo sapiens
agcctctcccggctgcctgccg

SEQ ID NO: 2092360 - DNA, 13 bp, Homo sapiens
agcctctgcccca

SEQ ID NO: 2092361 - DNA, 19 bp, Homo sapiens
agcctctgccccaaggggc

SEQ ID NO: 2092362 - DNA, 17 bp, Homo sapiens
agcctctgccctgcctc

SEQ ID NO: 2092363 - DNA, 16 bp, Homo sapiens
agcctctgcctcccta

SEQ ID NO: 2092364 - DNA, 12 bp, Homo sapiens
agcctctgctgc

SEQ ID NO: 2092365 - DNA, 14 bp, Homo sapiens
agcctctgctgcca

SEQ ID NO: 2092366 - DNA, 20 bp, Homo sapiens
agcctcttaaagctgcctgt

SEQ ID NO: 2092367 - DNA, 22 bp, Homo sapiens
agcctcttagtgattgtgtctg

SEQ ID NO: 2092368 - DNA, 11 bp, Homo sapiens
agcctgactgt

SEQ ID NO: 2092369 - DNA, 17 bp, Homo sapiens
agcctgaggctgagact

SEQ ID NO: 2092370 - DNA, 15 bp, Homo sapiens
agcctgagtctcctg

SEQ ID NO: 2092371 - DNA, 18 bp, Homo sapiens
agcctgagtctcctgtgc

SEQ ID NO: 2092372 - DNA, 19 bp, Homo sapiens
agcctgccctcagcacaga

SEQ ID NO: 2092373 - DNA, 17 bp, Homo sapiens
agcctgccgagcaaccg

SEQ ID NO: 2092374 - DNA, 23 bp, Homo sapiens
agcctgccgccgtctctgtcccg

SEQ ID NO: 2092375 - DNA, 14 bp, Homo sapiens
agcctgctccccca

SEQ ID NO: 2092376 - DNA, 21 bp, Homo sapiens
agcctgctcccccaccccctc

SEQ ID NO: 2092377 - DNA, 14 bp, Homo sapiens
agcctgctttttaa

SEQ ID NO: 2092378 - DNA, 22 bp, Homo sapiens
agcctggactctaagctggagc

SEQ ID NO: 2092379 - DNA, 11 bp, Homo sapiens
agcctggagaa

SEQ ID NO: 2092380 - DNA, 19 bp, Homo sapiens
agcctggcacaggactgat

SEQ ID NO: 2092381 - DNA, 16 bp, Homo sapiens
agcctggcccatagaa

SEQ ID NO: 2092382 - DNA, 11 bp, Homo sapiens
agcctggcctc

SEQ ID NO: 2092383 - DNA, 17 bp, Homo sapiens
agcctggcctcctgcct

SEQ ID NO: 2092384 - DNA, 18 bp, Homo sapiens
agcctggcctcctgcctc

SEQ ID NO: 2092385 - DNA, 20 bp, Homo sapiens
agcctggcctcctgcctcta

SEQ ID NO: 2092386 - DNA, 17 bp, Homo sapiens
agcctggcggggcagga

SEQ ID NO: 2092387 - DNA, 18 bp, Homo sapiens
agcctggcttctggagcc

SEQ ID NO: 2092388 - DNA, 16 bp, Homo sapiens
agcctgggaccagggc

SEQ ID NO: 2092389 - DNA, 15 bp, Homo sapiens
agcctgggcaacaga

SEQ ID NO: 2092390 - DNA, 17 bp, Homo sapiens
agcctgggcaacagagc

SEQ ID NO: 2092391 - DNA, 17 bp, Homo sapiens
agcctgggcagcatagc

SEQ ID NO: 2092392 - DNA, 13 bp, Homo sapiens
agcctgggccaga

SEQ ID NO: 2092393 - DNA, 21 bp, Homo sapiens
agcctgggcctatggagagcc

SEQ ID NO: 2092394 - DNA, 24 bp, Homo sapiens
agcctgggcctatggagagccctg

SEQ ID NO: 2092395 - DNA, 17 bp, Homo sapiens
agcctgggggcctggct

SEQ ID NO: 2092396 - DNA, 19 bp, Homo sapiens
agcctgggggcctggctgg

SEQ ID NO: 2092397 - DNA, 20 bp, Homo sapiens
agcctgggggcctggctggc

SEQ ID NO: 2092398 - DNA, 23 bp, Homo sapiens
agcctgggtgagaatcctgcctc

SEQ ID NO: 2092399 - DNA, 18 bp, Homo sapiens
agcctggtgggcctcctc

SEQ ID NO: 2092400 - DNA, 21 bp, Homo sapiens
agcctggtttagcctggatgt

SEQ ID NO: 2092401 - DNA, 19 bp, Homo sapiens
agcctgtatagacagcact

SEQ ID NO: 2092402 - DNA, 21 bp, Homo sapiens
agcctgtcctggtacagcagg

SEQ ID NO: 2092403 - DNA, 17 bp, Homo sapiens
agcctgtgaacccagga

SEQ ID NO: 2092404 - DNA, 23 bp, Homo sapiens
agcctgtgaataaaaaccctgta

SEQ ID NO: 2092405 - DNA, 11 bp, Homo sapiens
agcctgtgcca

SEQ ID NO: 2092406 - DNA, 16 bp, Homo sapiens
aggaagggacacacac

SEQ ID NO: 2092407 - DNA, 12 bp, Homo sapiens
aggaagggcaaa

SEQ ID NO: 2092408 - DNA, 12 bp, Homo sapiens
aggaagggccag

SEQ ID NO: 2092409 - DNA, 18 bp, Homo sapiens
aggaagggccaggagaga

SEQ ID NO: 2092410 - DNA, 20 bp, Homo sapiens
aggaagggccaggagagaga

SEQ ID NO: 2092411 - DNA, 22 bp, Homo sapiens
aggaagggtgggaagcttgctg

SEQ ID NO: 2092412 - DNA, 12 bp, Homo sapiens
aggaaggtagcc

SEQ ID NO: 2092413 - DNA, 15 bp, Homo sapiens
aggaaggtgctgagc

SEQ ID NO: 2092414 - DNA, 16 bp, Homo sapiens
aggaaggtgctgagct

SEQ ID NO: 2092415 - DNA, 17 bp, Homo sapiens
aggaagtctaggagctg

SEQ ID NO: 2092416 - DNA, 18 bp, Homo sapiens
aggaagtctaggagctgg

SEQ ID NO: 2092417 - DNA, 19 bp, Homo sapiens
aggaagtgggggccgctgg

SEQ ID NO: 2092418 - DNA, 22 bp, Homo sapiens
aggaagtgggggccgctggccc

SEQ ID NO: 2092419 - DNA, 14 bp, Homo sapiens
aggaataaggcctt

SEQ ID NO: 2092420 - DNA, 16 bp, Homo sapiens
aggaatcatgatctga

SEQ ID NO: 2092421 - DNA, 21 bp, Homo sapiens
aggaatcatgtcaggcctgtg

SEQ ID NO: 2092422 - DNA, 16 bp, Homo sapiens
aggaatcatgttggat

SEQ ID NO: 2092423 - DNA, 16 bp, Homo sapiens
aggaatctacctgtgg

SEQ ID NO: 2092424 - DNA, 18 bp, Homo sapiens
aggaatctacctgtggtg

SEQ ID NO: 2092425 - DNA, 23 bp, Homo sapiens
aggaatgaaatcctgcttcagtg

SEQ ID NO: 2092426 - DNA, 21 bp, Homo sapiens
aggaatgaccacgggcctcag

SEQ ID NO: 2092427 - DNA, 24 bp, Homo sapiens
aggaatgcctcctccctgggcaga

SEQ ID NO: 2092428 - DNA, 22 bp, Homo sapiens
aggaattcccagcccaaagctg

SEQ ID NO: 2092429 - DNA, 22 bp, Homo sapiens
aggaatttctcctactttacac

SEQ ID NO: 2092430 - DNA, 16 bp, Homo sapiens
aggaattttctttgtg

SEQ ID NO: 2092431 - DNA, 14 bp, Homo sapiens
aggacaacctgccc

SEQ ID NO: 2092432 - DNA, 19 bp, Homo sapiens
aggacaaggaagtgggggc

SEQ ID NO: 2092433 - DNA, 19 bp, Homo sapiens
aggacaatgccttgggaga

SEQ ID NO: 2092434 - DNA, 20 bp, Homo sapiens
aggacacacagtctcagtcc

SEQ ID NO: 2092435 - DNA, 22 bp, Homo sapiens
aggacacacagtctcagtccag

SEQ ID NO: 2092436 - DNA, 23 bp, Homo sapiens
aggacacactaatcgaactatga

SEQ ID NO: 2092437 - DNA, 11 bp, Homo sapiens
aggacacaggc

SEQ ID NO: 2092438 - DNA, 13 bp, Homo sapiens
aggacacaggcct

SEQ ID NO: 2092439 - DNA, 19 bp, Homo sapiens
aggacacatcccggcctct

SEQ ID NO: 2092440 - DNA, 20 bp, Homo sapiens
aggacacatcccggcctctt

SEQ ID NO: 2092441 - DNA, 12 bp, Homo sapiens
aggacacatgtc

SEQ ID NO: 2092442 - DNA, 14 bp, Homo sapiens
aggacacctgcccc

SEQ ID NO: 2092443 - DNA, 17 bp, Homo sapiens
aggacacctggccgcct

SEQ ID NO: 2092444 - DNA, 23 bp, Homo sapiens
aggacacctggccgcctccagga

SEQ ID NO: 2092445 - DNA, 19 bp, Homo sapiens
aggacagagctggctgtct

SEQ ID NO: 2092446 - DNA, 16 bp, Homo sapiens
aggacagccgcctgga

SEQ ID NO: 2092447 - DNA, 22 bp, Homo sapiens
aggacagcctgtggcggtgcct

SEQ ID NO: 2092448 - DNA, 12 bp, Homo sapiens
aggacagctggc

SEQ ID NO: 2092449 - DNA, 14 bp, Homo sapiens
aggacagctggctg

SEQ ID NO: 2092450 - DNA, 16 bp, Homo sapiens
aggacagctggctgct

SEQ ID NO: 2092451 - DNA, 12 bp, Homo sapiens
aggacaggcccg

SEQ ID NO: 2092452 - DNA, 21 bp, Homo sapiens
aggacagtgcttcagcctgag

SEQ ID NO: 2092453 - DNA, 20 bp, Homo sapiens
aggacagttgggctatgtgt

SEQ ID NO: 2092454 - DNA, 12 bp, Homo sapiens
aggacatcataa

SEQ ID NO: 2092455 - DNA, 18 bp, Homo sapiens
aggacatggagagagact

SEQ ID NO: 2092456 - DNA, 22 bp, Homo sapiens
aggacatgtgctattgaactga

SEQ ID NO: 2092457 - DNA, 15 bp, Homo sapiens
aggacatgtttttgt

SEQ ID NO: 2092458 - DNA, 16 bp, Homo sapiens
aggacattatgtgtgc

SEQ ID NO: 2092459 - DNA, 17 bp, Homo sapiens
aggaccaactggcttct

SEQ ID NO: 2092460 - DNA, 22 bp, Homo sapiens
aggaccacagtgggtggcacct

SEQ ID NO: 2092461 - DNA, 12 bp, Homo sapiens
aggaccaggact

SEQ ID NO: 2092462 - DNA, 17 bp, Homo sapiens
aggaccagtcccagagc

SEQ ID NO: 2092463 - DNA, 14 bp, Homo sapiens
aggacccaggccct

SEQ ID NO: 2092464 - DNA, 21 bp, Homo sapiens
aggacccggaggggcctggca

SEQ ID NO: 2092465 - DNA, 16 bp, Homo sapiens
aggaccctggctcttc

SEQ ID NO: 2092466 - DNA, 19 bp, Homo sapiens
aggaccctggctcttctct

SEQ ID NO: 2092467 - DNA, 20 bp, Homo sapiens
aggaccctgttttccacacc

SEQ ID NO: 2092468 - DNA, 19 bp, Homo sapiens
aggacctcatatcttcctc

SEQ ID NO: 2092469 - DNA, 23 bp, Homo sapiens
aggacctcatatcttcctcatca

SEQ ID NO: 2092470 - DNA, 17 bp, Homo sapiens
aggacctccggggagag

SEQ ID NO: 2092471 - DNA, 19 bp, Homo sapiens
aggacctgagcctgccgag

SEQ ID NO: 2092472 - DNA, 20 bp, Homo sapiens
aggacctggcttggctttaa

SEQ ID NO: 2092473 - DNA, 23 bp, Homo sapiens
aggacgagggatgggatttcatg

SEQ ID NO: 2092474 - DNA, 16 bp, Homo sapiens
aggacgccactcattt

SEQ ID NO: 2092475 - DNA, 21 bp, Homo sapiens
aggacgtcatcggaggctggg

SEQ ID NO: 2092476 - DNA, 18 bp, Homo sapiens
aggactaacactcagaag

SEQ ID NO: 2092477 - DNA, 20 bp, Homo sapiens
aggactaacactcagaagcc

SEQ ID NO: 2092478 - DNA, 21 bp, Homo sapiens
aggactaacactcagaagcct

SEQ ID NO: 2092479 - DNA, 20 bp, Homo sapiens
aggactaacataaaatctgt

SEQ ID NO: 2092480 - DNA, 17 bp, Homo sapiens
aggactaatgcatgtgg

SEQ ID NO: 2092481 - DNA, 20 bp, Homo sapiens
aggactacgttaagggaagg

SEQ ID NO: 2092482 - DNA, 18 bp, Homo sapiens
aggactagaacctggagg

SEQ ID NO: 2092483 - DNA, 22 bp, Homo sapiens
aggactagaacctggagggctg

SEQ ID NO: 2092484 - DNA, 19 bp, Homo sapiens
aggactatagcccaggtcc

SEQ ID NO: 2092485 - DNA, 16 bp, Homo sapiens
aggactatgggtacat

SEQ ID NO: 2092486 - DNA, 12 bp, Homo sapiens
aggactcaccct

SEQ ID NO: 2092487 - DNA, 17 bp, Homo sapiens
aggactccccaggccag

SEQ ID NO: 2092488 - DNA, 18 bp, Homo sapiens
aggactccccaggccagg

SEQ ID NO: 2092489 - DNA, 13 bp, Homo sapiens
aggactctgaggc

SEQ ID NO: 2092490 - DNA, 20 bp, Homo sapiens
aggactctgccccttctgtt

SEQ ID NO: 2092491 - DNA, 17 bp, Homo sapiens
aggactgaattgtcccc

SEQ ID NO: 2092492 - DNA, 15 bp, Homo sapiens
aggactgagactggc

SEQ ID NO: 2092493 - DNA, 16 bp, Homo sapiens
aggactggagaccgct

SEQ ID NO: 2092494 - DNA, 12 bp, Homo sapiens
aggactggctca

SEQ ID NO: 2092495 - DNA, 23 bp, Homo sapiens
aggacttggtctgatttcaggat

SEQ ID NO: 2092496 - DNA, 16 bp, Homo sapiens
aggacttgtgtctctg

SEQ ID NO: 2092497 - DNA, 13 bp, Homo sapiens
aggactttccagt

SEQ ID NO: 2092498 - DNA, 23 bp, Homo sapiens
aggacttttctttgtggcttcct

SEQ ID NO: 2092499 - DNA, 13 bp, Homo sapiens
aggagaaaaacaa

SEQ ID NO: 2092500 - DNA, 14 bp, Homo sapiens
aggagaaaatgcat

SEQ ID NO: 2092501 - DNA, 14 bp, Homo sapiens
aggagaaacagaga

SEQ ID NO: 2092502 - DNA, 14 bp, Homo sapiens
aggagaaataaact

SEQ ID NO: 2092503 - DNA, 12 bp, Homo sapiens
aggagaaatgca

SEQ ID NO: 2092504 - DNA, 18 bp, Homo sapiens
aggagaatcaataaaaat

SEQ ID NO: 2092505 - DNA, 22 bp, Homo sapiens
aggagacactgtgctataaatc

SEQ ID NO: 2092506 - DNA, 17 bp, Homo sapiens
aggagaccaaggcggga

SEQ ID NO: 2092507 - DNA, 15 bp, Homo sapiens
aggagaccctggaat

SEQ ID NO: 2092508 - DNA, 15 bp, Homo sapiens
aggagactcacctct

SEQ ID NO: 2092509 - DNA, 17 bp, Homo sapiens
aggagactcacctctgc

SEQ ID NO: 2092510 - DNA, 16 bp, Homo sapiens
aggagagactgaaagc

SEQ ID NO: 2092511 - DNA, 23 bp, Homo sapiens
aggagagactgaaagcagcagct

SEQ ID NO: 2092512 - DNA, 14 bp, Homo sapiens
aggagagagttgaa

SEQ ID NO: 2092513 - DNA, 21 bp, Homo sapiens
aggagagataccttgaaaaag

SEQ ID NO: 2092514 - DNA, 16 bp, Homo sapiens
aggagagcccttcatt

SEQ ID NO: 2092515 - DNA, 23 bp, Homo sapiens
aggagaggaaaaacgatcgctgt

SEQ ID NO: 2092516 - DNA, 13 bp, Homo sapiens
aggagaggggcag

SEQ ID NO: 2092517 - DNA, 22 bp, Homo sapiens
aggagagttcaagcctgtggga

SEQ ID NO: 2092518 - DNA, 12 bp, Homo sapiens
aggagatataaa

SEQ ID NO: 2092519 - DNA, 19 bp, Homo sapiens
aggagatataaaatctaga

SEQ ID NO: 2092520 - DNA, 14 bp, Homo sapiens
aggccaagagcaga

SEQ ID NO: 2092521 - DNA, 17 bp, Homo sapiens
aggccaagctgaagtga

SEQ ID NO: 2092522 - DNA, 14 bp, Homo sapiens
aggccaaggcaggt

SEQ ID NO: 2092523 - DNA, 18 bp, Homo sapiens
aggccaagtcaggccctt

SEQ ID NO: 2092524 - DNA, 22 bp, Homo sapiens
aggccacaccatctcctttcag

SEQ ID NO: 2092525 - DNA, 18 bp, Homo sapiens
aggccaccgggacagacc

SEQ ID NO: 2092526 - DNA, 18 bp, Homo sapiens
aggccactgtggccagag

SEQ ID NO: 2092527 - DNA, 21 bp, Homo sapiens
aggccagccccatcttggtcc

SEQ ID NO: 2092528 - DNA, 13 bp, Homo sapiens
aggccagcctggc

SEQ ID NO: 2092529 - DNA, 21 bp, Homo sapiens
aggccaggagtttgagaccag

SEQ ID NO: 2092530 - DNA, 14 bp, Homo sapiens
aggccaggtgcagt

SEQ ID NO: 2092531 - DNA, 14 bp, Homo sapiens
aggccagtgccagg

SEQ ID NO: 2092532 - DNA, 15 bp, Homo sapiens
aggccagtgccagga

SEQ ID NO: 2092533 - DNA, 20 bp, Homo sapiens
aggccagtgccaggacagct

SEQ ID NO: 2092534 - DNA, 21 bp, Homo sapiens
aggccagtgccaggacagctg

SEQ ID NO: 2092535 - DNA, 22 bp, Homo sapiens
aggccagtgccaggacagctgg

SEQ ID NO: 2092536 - DNA, 16 bp, Homo sapiens
aggccatgggcctcct

SEQ ID NO: 2092537 - DNA, 17 bp, Homo sapiens
aggccatgggcctcctg

SEQ ID NO: 2092538 - DNA, 15 bp, Homo sapiens
aggccatttgtattt

SEQ ID NO: 2092539 - DNA, 20 bp, Homo sapiens
aggcccaagagatgaagagt

SEQ ID NO: 2092540 - DNA, 23 bp, Homo sapiens
aggcccagccgcaggaaggcaga

SEQ ID NO: 2092541 - DNA, 14 bp, Homo sapiens
aggcccagcctgtc

SEQ ID NO: 2092542 - DNA, 19 bp, Homo sapiens
aggcccagcctgtcctggt

SEQ ID NO: 2092543 - DNA, 20 bp, Homo sapiens
aggcccagctatggccccag

SEQ ID NO: 2092544 - DNA, 19 bp, Homo sapiens
aggcccatctcaggtgcca

SEQ ID NO: 2092545 - DNA, 20 bp, Homo sapiens
aggcccatctcaggtgccac

SEQ ID NO: 2092546 - DNA, 12 bp, Homo sapiens
aggccccagagc

SEQ ID NO: 2092547 - DNA, 17 bp, Homo sapiens
aggccccatgacctcca

SEQ ID NO: 2092548 - DNA, 19 bp, Homo sapiens
aggcccccacctggctcac

SEQ ID NO: 2092549 - DNA, 16 bp, Homo sapiens
aggcccccgctggctc

SEQ ID NO: 2092550 - DNA, 15 bp, Homo sapiens
aggccccgcttgtcc

SEQ ID NO: 2092551 - DNA, 13 bp, Homo sapiens
aggcccctgagga

SEQ ID NO: 2092552 - DNA, 12 bp, Homo sapiens
aggcccctgcca

SEQ ID NO: 2092553 - DNA, 13 bp, Homo sapiens
aggcccctgccac

SEQ ID NO: 2092554 - DNA, 15 bp, Homo sapiens
aggcccctgccaccc

SEQ ID NO: 2092555 - DNA, 14 bp, Homo sapiens
aggcccgagcagct

SEQ ID NO: 2092556 - DNA, 22 bp, Homo sapiens
aggcccgagcagctgagcaggg

SEQ ID NO: 2092557 - DNA, 18 bp, Homo sapiens
aggcccggctccaggctc

SEQ ID NO: 2092558 - DNA, 21 bp, Homo sapiens
aggcccggctccaggctcctt

SEQ ID NO: 2092559 - DNA, 13 bp, Homo sapiens
aggcccggggctg

SEQ ID NO: 2092560 - DNA, 14 bp, Homo sapiens
aggcccggggctgg

SEQ ID NO: 2092561 - DNA, 21 bp, Homo sapiens
aggccctaccagagggaacac

SEQ ID NO: 2092562 - DNA, 16 bp, Homo sapiens
aggccctccatgggct

SEQ ID NO: 2092563 - DNA, 17 bp, Homo sapiens
aggccctccatgggcta

SEQ ID NO: 2092564 - DNA, 23 bp, Homo sapiens
aggccctccctgactccctgtgg

SEQ ID NO: 2092565 - DNA, 16 bp, Homo sapiens
aggccctgccttcagc

SEQ ID NO: 2092566 - DNA, 18 bp, Homo sapiens
aggccctggatcagcgtg

SEQ ID NO: 2092567 - DNA, 21 bp, Homo sapiens
aggccctggatgtgcccacag

SEQ ID NO: 2092568 - DNA, 19 bp, Homo sapiens
aggccctggtgtcaggcag

SEQ ID NO: 2092569 - DNA, 14 bp, Homo sapiens
aggccctgtcccag

SEQ ID NO: 2092570 - DNA, 15 bp, Homo sapiens
aggccctgtcccagc

SEQ ID NO: 2092571 - DNA, 22 bp, Homo sapiens
aggcccttattttcaagaaact

SEQ ID NO: 2092572 - DNA, 13 bp, Homo sapiens
aggcccttcctct

SEQ ID NO: 2092573 - DNA, 19 bp, Homo sapiens
aggcccttcctctccactg

SEQ ID NO: 2092574 - DNA, 17 bp, Homo sapiens
aggcccttgtcctgcca

SEQ ID NO: 2092575 - DNA, 18 bp, Homo sapiens
aggcccttgtcctgccag

SEQ ID NO: 2092576 - DNA, 20 bp, Homo sapiens
aggcccttgtcctgccagct

SEQ ID NO: 2092577 - DNA, 22 bp, Homo sapiens
aggcccttgtcctgccagctgc

SEQ ID NO: 2092578 - DNA, 17 bp, Homo sapiens
aggccgggcttgggccc

SEQ ID NO: 2092579 - DNA, 13 bp, Homo sapiens
aggccgttcccct

SEQ ID NO: 2092580 - DNA, 23 bp, Homo sapiens
aggccgttccccttggcttcctc

SEQ ID NO: 2092581 - DNA, 19 bp, Homo sapiens
aggcctaatctcatacctc

SEQ ID NO: 2092582 - DNA, 22 bp, Homo sapiens
aggcctaatctcatacctctga

SEQ ID NO: 2092583 - DNA, 17 bp, Homo sapiens
aggcctaggacctcagg

SEQ ID NO: 2092584 - DNA, 16 bp, Homo sapiens
aggcctataaccccag

SEQ ID NO: 2092585 - DNA, 14 bp, Homo sapiens
aggcctatcaacct

SEQ ID NO: 2092586 - DNA, 12 bp, Homo sapiens
aggcctcagttc

SEQ ID NO: 2092587 - DNA, 21 bp, Homo sapiens
aggcctcagtttctccatcag

SEQ ID NO: 2092588 - DNA, 16 bp, Homo sapiens
aggcctcatccctcgg

SEQ ID NO: 2092589 - DNA, 14 bp, Homo sapiens
aggcctcatctcct

SEQ ID NO: 2092590 - DNA, 20 bp, Homo sapiens
aggcctccacgggggcggca

SEQ ID NO: 2092591 - DNA, 11 bp, Homo sapiens
aggcctccagc

SEQ ID NO: 2092592 - DNA, 15 bp, Homo sapiens
aggcctccagcctct

SEQ ID NO: 2092593 - DNA, 18 bp, Homo sapiens
aggcctccagcctctccc

SEQ ID NO: 2092594 - DNA, 21 bp, Homo sapiens
aggcctccagcctctcccggc

SEQ ID NO: 2092595 - DNA, 21 bp, Homo sapiens
aggcctcgtaccagccaggat

SEQ ID NO: 2092596 - DNA, 16 bp, Homo sapiens
aggcctctgtgtcctt

SEQ ID NO: 2092597 - DNA, 21 bp, Homo sapiens
aggcctcttggacctctgctc

SEQ ID NO: 2092598 - DNA, 13 bp, Homo sapiens
aggcctgcctgtt

SEQ ID NO: 2092599 - DNA, 18 bp, Homo sapiens
aggcctgctcagggactg

SEQ ID NO: 2092600 - DNA, 17 bp, Homo sapiens
aggcctggaaccaggga

SEQ ID NO: 2092601 - DNA, 15 bp, Homo sapiens
aggcctggccaggca

SEQ ID NO: 2092602 - DNA, 12 bp, Homo sapiens
aggcctggcctt

SEQ ID NO: 2092603 - DNA, 22 bp, Homo sapiens
aggcctggccttgtcaggaccc

SEQ ID NO: 2092604 - DNA, 16 bp, Homo sapiens
aggcctgggacccagc

SEQ ID NO: 2092605 - DNA, 17 bp, Homo sapiens
aggcctgggacccagct

SEQ ID NO: 2092606 - DNA, 19 bp, Homo sapiens
aggcctgggacccagctac

SEQ ID NO: 2092607 - DNA, 20 bp, Homo sapiens
aggcctgggacccagctact

SEQ ID NO: 2092608 - DNA, 17 bp, Homo sapiens
aggcctgggggcaggga

SEQ ID NO: 2092609 - DNA, 22 bp, Homo sapiens
aggcctgtgtagctgtgacctg

SEQ ID NO: 2092610 - DNA, 23 bp, Homo sapiens
aggcctgtgtagctgtgacctgc

SEQ ID NO: 2092611 - DNA, 23 bp, Homo sapiens
aggcctgtgtgtgaaaggaagct

SEQ ID NO: 2092612 - DNA, 21 bp, Homo sapiens
aggcctttagatattattcat

SEQ ID NO: 2092613 - DNA, 19 bp, Homo sapiens
aggcgcagcccgaagccca

SEQ ID NO: 2092614 - DNA, 20 bp, Homo sapiens
aggcgcagcccgaagcccag

SEQ ID NO: 2092615 - DNA, 19 bp, Homo sapiens
aggcgcgtctgccccaccc

SEQ ID NO: 2092616 - DNA, 15 bp, Homo sapiens
aggcggaaaccttgc

SEQ ID NO: 2092617 - DNA, 17 bp, Homo sapiens
aggcggaaaccttgcag

SEQ ID NO: 2092618 - DNA, 18 bp, Homo sapiens
aggcggaaaccttgcagc

SEQ ID NO: 2092619 - DNA, 19 bp, Homo sapiens
aggcggcacattggcagtg

SEQ ID NO: 2092620 - DNA, 14 bp, Homo sapiens
aggcgggaaggagg

SEQ ID NO: 2092621 - DNA, 15 bp, Homo sapiens
aggcggtcatgtgtg

SEQ ID NO: 2092622 - DNA, 20 bp, Homo sapiens
aggcggtcatgtgtgcatgt

SEQ ID NO: 2092623 - DNA, 13 bp, Homo sapiens
aggcgtcttgtat

SEQ ID NO: 2092624 - DNA, 16 bp, Homo sapiens
aggcgtcttgtatttt

SEQ ID NO: 2092625 - DNA, 19 bp, Homo sapiens
aggcgttcttcgaggtgga

SEQ ID NO: 2092626 - DNA, 21 bp, Homo sapiens
aggctaagatgagatttgcca

SEQ ID NO: 2092627 - DNA, 23 bp, Homo sapiens
aggctaagatgagatttgccagc

SEQ ID NO: 2092628 - DNA, 12 bp, Homo sapiens
aggctaattttt

SEQ ID NO: 2092629 - DNA, 17 bp, Homo sapiens
aggctagtttattttgt

SEQ ID NO: 2092630 - DNA, 13 bp, Homo sapiens
aggctatttaaaa

SEQ ID NO: 2092631 - DNA, 18 bp, Homo sapiens
aggctatttgttcagaga

SEQ ID NO: 2092632 - DNA, 15 bp, Homo sapiens
aggctcaacaataaa

SEQ ID NO: 2092633 - DNA, 14 bp, Homo sapiens
aggctcaagaggcc

SEQ ID NO: 2092634 - DNA, 20 bp, Homo sapiens
aggctcaagaggcccaggga

SEQ ID NO: 2092635 - DNA, 13 bp, Homo sapiens
aggtaacaggcag

SEQ ID NO: 2092636 - DNA, 17 bp, Homo sapiens
aggtaatgagggactgg

SEQ ID NO: 2092637 - DNA, 16 bp, Homo sapiens
aggtaattctccctaa

SEQ ID NO: 2092638 - DNA, 22 bp, Homo sapiens
aggtactatctgtgaagttaca

SEQ ID NO: 2092639 - DNA, 13 bp, Homo sapiens
aggtacttcctcc

SEQ ID NO: 2092640 - DNA, 19 bp, Homo sapiens
aggtacttcctcctgatgg

SEQ ID NO: 2092641 - DNA, 20 bp, Homo sapiens
aggtacttcctcctgatggc

SEQ ID NO: 2092642 - DNA, 14 bp, Homo sapiens
aggtagagatgtgt

SEQ ID NO: 2092643 - DNA, 16 bp, Homo sapiens
aggtagcccagcactg

SEQ ID NO: 2092644 - DNA, 17 bp, Homo sapiens
aggtagcccagcactgt

SEQ ID NO: 2092645 - DNA, 15 bp, Homo sapiens
aggtagcgagctgct

SEQ ID NO: 2092646 - DNA, 18 bp, Homo sapiens
aggtagctcccagcactc

SEQ ID NO: 2092647 - DNA, 19 bp, Homo sapiens
aggtagcttacctgacaca

SEQ ID NO: 2092648 - DNA, 13 bp, Homo sapiens
aggtaggcccttg

SEQ ID NO: 2092649 - DNA, 17 bp, Homo sapiens
aggtaggcccttgtcct

SEQ ID NO: 2092650 - DNA, 18 bp, Homo sapiens
aggtaggcccttgtcctg

SEQ ID NO: 2092651 - DNA, 19 bp, Homo sapiens
aggtaggcccttgtcctgc

SEQ ID NO: 2092652 - DNA, 21 bp, Homo sapiens
aggtagtgggtgaatgtgtga

SEQ ID NO: 2092653 - DNA, 11 bp, Homo sapiens
aggtataattt

SEQ ID NO: 2092654 - DNA, 16 bp, Homo sapiens
aggtatcaggcacagg

SEQ ID NO: 2092655 - DNA, 15 bp, Homo sapiens
aggtatctccaggat

SEQ ID NO: 2092656 - DNA, 14 bp, Homo sapiens
aggtatttcaaaac

SEQ ID NO: 2092657 - DNA, 17 bp, Homo sapiens
aggtattttaactgtgt

SEQ ID NO: 2092658 - DNA, 17 bp, Homo sapiens
aggtcaacagagaaggc

SEQ ID NO: 2092659 - DNA, 19 bp, Homo sapiens
aggtcaacagagaaggcag

SEQ ID NO: 2092660 - DNA, 21 bp, Homo sapiens
aggtcaacagagaaggcagga

SEQ ID NO: 2092661 - DNA, 15 bp, Homo sapiens
aggtcaatgaaatat

SEQ ID NO: 2092662 - DNA, 19 bp, Homo sapiens
aggtcacattcaggaagat

SEQ ID NO: 2092663 - DNA, 12 bp, Homo sapiens
aggtcagagatg

SEQ ID NO: 2092664 - DNA, 12 bp, Homo sapiens
aggtcagagcct

SEQ ID NO: 2092665 - DNA, 13 bp, Homo sapiens
aggtcagagcctg

SEQ ID NO: 2092666 - DNA, 17 bp, Homo sapiens
aggtcagagcctgcagt

SEQ ID NO: 2092667 - DNA, 20 bp, Homo sapiens
aggtcaggagttcctaacca

SEQ ID NO: 2092668 - DNA, 14 bp, Homo sapiens
aggtcattttctat

SEQ ID NO: 2092669 - DNA, 15 bp, Homo sapiens
aggtccaagggccat

SEQ ID NO: 2092670 - DNA, 18 bp, Homo sapiens
aggtccaagggccatact

SEQ ID NO: 2092671 - DNA, 15 bp, Homo sapiens
aggtccctgccagtg

SEQ ID NO: 2092672 - DNA, 15 bp, Homo sapiens
aggtccggaggggtt

SEQ ID NO: 2092673 - DNA, 17 bp, Homo sapiens
aggtcctcctctctcta

SEQ ID NO: 2092674 - DNA, 21 bp, Homo sapiens
aggtcctgaaagtctgtgtcc

SEQ ID NO: 2092675 - DNA, 17 bp, Homo sapiens
aggtcctgagcactgcc

SEQ ID NO: 2092676 - DNA, 20 bp, Homo sapiens
aggtcctgagcactgccagg

SEQ ID NO: 2092677 - DNA, 20 bp, Homo sapiens
aggtcctgcccatgtgtccc

SEQ ID NO: 2092678 - DNA, 14 bp, Homo sapiens
aggtcctggcttct

SEQ ID NO: 2092679 - DNA, 20 bp, Homo sapiens
aggtcctggtggggcagctc

SEQ ID NO: 2092680 - DNA, 16 bp, Homo sapiens
aggtctcagcccggga

SEQ ID NO: 2092681 - DNA, 13 bp, Homo sapiens
aggtctccctgga

SEQ ID NO: 2092682 - DNA, 12 bp, Homo sapiens
aggtctcctctt

SEQ ID NO: 2092683 - DNA, 14 bp, Homo sapiens
aggtctcctcttaa

SEQ ID NO: 2092684 - DNA, 15 bp, Homo sapiens
aggtctcctcttaaa

SEQ ID NO: 2092685 - DNA, 23 bp, Homo sapiens
aggtctccttactctgagcccag

SEQ ID NO: 2092686 - DNA, 24 bp, Homo sapiens
aggtctccttactctgagcccagg

SEQ ID NO: 2092687 - DNA, 13 bp, Homo sapiens
aggtctgaaatgg

SEQ ID NO: 2092688 - DNA, 15 bp, Homo sapiens
aggtctgaaatggag

SEQ ID NO: 2092689 - DNA, 12 bp, Homo sapiens
aggtctgagccc

SEQ ID NO: 2092690 - DNA, 14 bp, Homo sapiens
aggtctgagccctg

SEQ ID NO: 2092691 - DNA, 21 bp, Homo sapiens
aggtctgggagtgttctgttt

SEQ ID NO: 2092692 - DNA, 16 bp, Homo sapiens
aggtcttcagccatca

SEQ ID NO: 2092693 - DNA, 16 bp, Homo sapiens
aggtcttgaactcctg

SEQ ID NO: 2092694 - DNA, 17 bp, Homo sapiens
aggtcttgaactcctgg

SEQ ID NO: 2092695 - DNA, 21 bp, Homo sapiens
aggtcttgaactcctggcctc

SEQ ID NO: 2092696 - DNA, 21 bp, Homo sapiens
aggtcttggccgactcaggga

SEQ ID NO: 2092697 - DNA, 22 bp, Homo sapiens
aggtcttgggaggctttcaatt

SEQ ID NO: 2092698 - DNA, 23 bp, Homo sapiens
aggtgaacaccactttgtctctg

SEQ ID NO: 2092699 - DNA, 15 bp, Homo sapiens
aggtgaagtccctgt

SEQ ID NO: 2092700 - DNA, 15 bp, Homo sapiens
aggtgacagagtgag

SEQ ID NO: 2092701 - DNA, 22 bp, Homo sapiens
aggtgacagagtgagactctgt

SEQ ID NO: 2092702 - DNA, 21 bp, Homo sapiens
aggtgacccaatgctcctgga

SEQ ID NO: 2092703 - DNA, 13 bp, Homo sapiens
aggtgaccccagg

SEQ ID NO: 2092704 - DNA, 19 bp, Homo sapiens
aggtgaccccagggcacag

SEQ ID NO: 2092705 - DNA, 21 bp, Homo sapiens
aggtgaccccagggcacagga

SEQ ID NO: 2092706 - DNA, 13 bp, Homo sapiens
aggtgagaaattt

SEQ ID NO: 2092707 - DNA, 16 bp, Homo sapiens
aggtgagaccacctct

SEQ ID NO: 2092708 - DNA, 23 bp, Homo sapiens
aggtgatccacccacctcagcct

SEQ ID NO: 2092709 - DNA, 16 bp, Homo sapiens
aggtgcaagagacaga

SEQ ID NO: 2092710 - DNA, 23 bp, Homo sapiens
aggtgcaagagacagagccccca

SEQ ID NO: 2092711 - DNA, 17 bp, Homo sapiens
aggtgcagatgggctgt

SEQ ID NO: 2092712 - DNA, 12 bp, Homo sapiens
aggtgcaggtgc

SEQ ID NO: 2092713 - DNA, 15 bp, Homo sapiens
aggtgccactccctg

SEQ ID NO: 2092714 - DNA, 16 bp, Homo sapiens
aggtgccactccctga

SEQ ID NO: 2092715 - DNA, 19 bp, Homo sapiens
aggtgccactccctgagct

SEQ ID NO: 2092716 - DNA, 13 bp, Homo sapiens
aggtgccaggctg

SEQ ID NO: 2092717 - DNA, 12 bp, Homo sapiens
aggtgcccagga

SEQ ID NO: 2092718 - DNA, 14 bp, Homo sapiens
aggtgcccaggaga

SEQ ID NO: 2092719 - DNA, 17 bp, Homo sapiens
aggtgcctcctgtctta

SEQ ID NO: 2092720 - DNA, 15 bp, Homo sapiens
aggtgcctgagctgg

SEQ ID NO: 2092721 - DNA, 18 bp, Homo sapiens
aggtgcctgtgaggcagg

SEQ ID NO: 2092722 - DNA, 19 bp, Homo sapiens
aggtgcctgtgaggcaggg

SEQ ID NO: 2092723 - DNA, 22 bp, Homo sapiens
aggtgcctgtgaggcaggggcg

SEQ ID NO: 2092724 - DNA, 22 bp, Homo sapiens
aggtgccttcttattctcactc

SEQ ID NO: 2092725 - DNA, 23 bp, Homo sapiens
aggtgccttcttattctcactcc

SEQ ID NO: 2092726 - DNA, 16 bp, Homo sapiens
aggtgcggccaccacc

SEQ ID NO: 2092727 - DNA, 18 bp, Homo sapiens
aggtgctacaaaaacaca

SEQ ID NO: 2092728 - DNA, 18 bp, Homo sapiens
aggtgctgagcttagcct

SEQ ID NO: 2092729 - DNA, 11 bp, Homo sapiens
aggtggaagcc

SEQ ID NO: 2092730 - DNA, 13 bp, Homo sapiens
aggtggaagccct

SEQ ID NO: 2092731 - DNA, 20 bp, Homo sapiens
aggtggaagccctccttcca

SEQ ID NO: 2092732 - DNA, 17 bp, Homo sapiens
aggtggagagcactaga

SEQ ID NO: 2092733 - DNA, 18 bp, Homo sapiens
aggtggagagcactagaa

SEQ ID NO: 2092734 - DNA, 14 bp, Homo sapiens
aggtggagtctcat

SEQ ID NO: 2092735 - DNA, 16 bp, Homo sapiens
aggtggatcacagagg

SEQ ID NO: 2092736 - DNA, 14 bp, Homo sapiens
aggtggcagccctg

SEQ ID NO: 2092737 - DNA, 15 bp, Homo sapiens
aggtggcagccctgt

SEQ ID NO: 2092738 - DNA, 17 bp, Homo sapiens
aggtggcaggaccagga

SEQ ID NO: 2092739 - DNA, 12 bp, Homo sapiens
aggtgggcagca

SEQ ID NO: 2092740 - DNA, 15 bp, Homo sapiens
aggtgggcagcagct

SEQ ID NO: 2092741 - DNA, 18 bp, Homo sapiens
aggtgggcagctgggccc

SEQ ID NO: 2092742 - DNA, 15 bp, Homo sapiens
aggtgggctgagccc

SEQ ID NO: 2092743 - DNA, 16 bp, Homo sapiens
aggtgggctgagccct

SEQ ID NO: 2092744 - DNA, 20 bp, Homo sapiens
aggtgggctgagccctggca

SEQ ID NO: 2092745 - DNA, 13 bp, Homo sapiens
aggtggggcagct

SEQ ID NO: 2092746 - DNA, 23 bp, Homo sapiens
aggtggggcagcttgagggttgg

SEQ ID NO: 2092747 - DNA, 13 bp, Homo sapiens
aggtgggtccagg

SEQ ID NO: 2092748 - DNA, 18 bp, Homo sapiens
aggtgggtccaggaaggc

SEQ ID NO: 2092749 - DNA, 13 bp, Homo sapiens
aggtggtggagga

SEQ ID NO: 2092750 - DNA, 14 bp, Homo sapiens
aggtggtggaggag

SEQ ID NO: 2092751 - DNA, 19 bp, Homo sapiens
agtgactgtcgtgtttaca

SEQ ID NO: 2092752 - DNA, 13 bp, Homo sapiens
agtgacttcctgg

SEQ ID NO: 2092753 - DNA, 16 bp, Homo sapiens
agtgactttttctgag

SEQ ID NO: 2092754 - DNA, 22 bp, Homo sapiens
agtgagaaaaagctcctgtcct

SEQ ID NO: 2092755 - DNA, 16 bp, Homo sapiens
agtgagactctgtctc

SEQ ID NO: 2092756 - DNA, 22 bp, Homo sapiens
agtgagactctgtctcaaaaaa

SEQ ID NO: 2092757 - DNA, 14 bp, Homo sapiens
agtgagagggcatg

SEQ ID NO: 2092758 - DNA, 19 bp, Homo sapiens
agtgagatttgtatttata

SEQ ID NO: 2092759 - DNA, 22 bp, Homo sapiens
agtgagcactaaggtgtgctct

SEQ ID NO: 2092760 - DNA, 13 bp, Homo sapiens
agtgagcagtaga

SEQ ID NO: 2092761 - DNA, 20 bp, Homo sapiens
agtgagccgcatcttctcca

SEQ ID NO: 2092762 - DNA, 12 bp, Homo sapiens
agtgagctggtt

SEQ ID NO: 2092763 - DNA, 23 bp, Homo sapiens
agtgagctggtttttagcggaga

SEQ ID NO: 2092764 - DNA, 17 bp, Homo sapiens
agtgagctgtaggtgtg

SEQ ID NO: 2092765 - DNA, 16 bp, Homo sapiens
agtgaggcttccaggc

SEQ ID NO: 2092766 - DNA, 18 bp, Homo sapiens
agtgaggcttccaggctc

SEQ ID NO: 2092767 - DNA, 12 bp, Homo sapiens
agtgagggctgg

SEQ ID NO: 2092768 - DNA, 15 bp, Homo sapiens
agtgagggctgggca

SEQ ID NO: 2092769 - DNA, 15 bp, Homo sapiens
agtgagtcgaggaca

SEQ ID NO: 2092770 - DNA, 16 bp, Homo sapiens
agtgagtctcttcaga

SEQ ID NO: 2092771 - DNA, 16 bp, Homo sapiens
agtgagtgtggcttag

SEQ ID NO: 2092772 - DNA, 19 bp, Homo sapiens
agtgagttgttgccctggg

SEQ ID NO: 2092773 - DNA, 17 bp, Homo sapiens
agtgatacaacttcaag

SEQ ID NO: 2092774 - DNA, 23 bp, Homo sapiens
agtgatacaacttcaagtgcatg

SEQ ID NO: 2092775 - DNA, 17 bp, Homo sapiens
agtgatatcataaaagt

SEQ ID NO: 2092776 - DNA, 15 bp, Homo sapiens
agtgatcctcccacc

SEQ ID NO: 2092777 - DNA, 20 bp, Homo sapiens
agtgatcctcccacctcagc

SEQ ID NO: 2092778 - DNA, 22 bp, Homo sapiens
agtgatcctcccacctcagcct

SEQ ID NO: 2092779 - DNA, 23 bp, Homo sapiens
agtgatcctcccacctcagcctc

SEQ ID NO: 2092780 - DNA, 20 bp, Homo sapiens
agtgatggcgcgggaggcac

SEQ ID NO: 2092781 - DNA, 19 bp, Homo sapiens
agtgatgtcactagggcag

SEQ ID NO: 2092782 - DNA, 15 bp, Homo sapiens
agtgattctcctgcc

SEQ ID NO: 2092783 - DNA, 20 bp, Homo sapiens
agtgattctcctgcctcagc

SEQ ID NO: 2092784 - DNA, 15 bp, Homo sapiens
agtgattgacacaca

SEQ ID NO: 2092785 - DNA, 17 bp, Homo sapiens
agtgattgtcttaatat

SEQ ID NO: 2092786 - DNA, 18 bp, Homo sapiens
agtgcaaagtgccctcat

SEQ ID NO: 2092787 - DNA, 19 bp, Homo sapiens
agtgcaaatactccaagct

SEQ ID NO: 2092788 - DNA, 18 bp, Homo sapiens
agtgcacttgctggaaga

SEQ ID NO: 2092789 - DNA, 22 bp, Homo sapiens
agtgcagtggtgcgatcttggc

SEQ ID NO: 2092790 - DNA, 15 bp, Homo sapiens
agtgcatctcagccc

SEQ ID NO: 2092791 - DNA, 17 bp, Homo sapiens
agtgcatgctctctgca

SEQ ID NO: 2092792 - DNA, 15 bp, Homo sapiens
agtgcattttcccag

SEQ ID NO: 2092793 - DNA, 12 bp, Homo sapiens
agtgccacagag

SEQ ID NO: 2092794 - DNA, 13 bp, Homo sapiens
agtgccacagaga

SEQ ID NO: 2092795 - DNA, 14 bp, Homo sapiens
agtgccacagagaa

SEQ ID NO: 2092796 - DNA, 21 bp, Homo sapiens
agtgccacttgacattccttg

SEQ ID NO: 2092797 - DNA, 14 bp, Homo sapiens
agtgccaggacagc

SEQ ID NO: 2092798 - DNA, 15 bp, Homo sapiens
agtgccaggacagct

SEQ ID NO: 2092799 - DNA, 21 bp, Homo sapiens
agtgccaggacagctggctgc

SEQ ID NO: 2092800 - DNA, 23 bp, Homo sapiens
agtgccaggacagctggctgctg

SEQ ID NO: 2092801 - DNA, 16 bp, Homo sapiens
agtgccatcccacatt

SEQ ID NO: 2092802 - DNA, 17 bp, Homo sapiens
agtgcccgccctgcccc

SEQ ID NO: 2092803 - DNA, 16 bp, Homo sapiens
agtgccctccacagcc

SEQ ID NO: 2092804 - DNA, 23 bp, Homo sapiens
agtgcccttaaaataatgattta

SEQ ID NO: 2092805 - DNA, 14 bp, Homo sapiens
agtgcctcctggcc

SEQ ID NO: 2092806 - DNA, 19 bp, Homo sapiens
agtgcctcctgggaccatg

SEQ ID NO: 2092807 - DNA, 13 bp, Homo sapiens
agtgcctcgaggc

SEQ ID NO: 2092808 - DNA, 14 bp, Homo sapiens
agtgcctcgaggca

SEQ ID NO: 2092809 - DNA, 17 bp, Homo sapiens
agtgcctcgaggcaccg

SEQ ID NO: 2092810 - DNA, 18 bp, Homo sapiens
agtgccttacctcctgcc

SEQ ID NO: 2092811 - DNA, 22 bp, Homo sapiens
agtgccttacctcctgcccagg

SEQ ID NO: 2092812 - DNA, 13 bp, Homo sapiens
agtgccttccata

SEQ ID NO: 2092813 - DNA, 16 bp, Homo sapiens
agtgccttccataatt

SEQ ID NO: 2092814 - DNA, 21 bp, Homo sapiens
agtgccttggagcagaaagcc

SEQ ID NO: 2092815 - DNA, 22 bp, Homo sapiens
agtgcgctcattttaggcctcc

SEQ ID NO: 2092816 - DNA, 23 bp, Homo sapiens
agtgcgctcattttaggcctcct

SEQ ID NO: 2092817 - DNA, 19 bp, Homo sapiens
agtgcgctcttggtccctg

SEQ ID NO: 2092818 - DNA, 13 bp, Homo sapiens
agtgctatatata

SEQ ID NO: 2092819 - DNA, 14 bp, Homo sapiens
agtgctatatatat

SEQ ID NO: 2092820 - DNA, 15 bp, Homo sapiens
agtgctatatatata

SEQ ID NO: 2092821 - DNA, 14 bp, Homo sapiens
agtgctccccacac

SEQ ID NO: 2092822 - DNA, 17 bp, Homo sapiens
agtgctctaggctgccc

SEQ ID NO: 2092823 - DNA, 18 bp, Homo sapiens
agtgctctaggctgcccc

SEQ ID NO: 2092824 - DNA, 18 bp, Homo sapiens
agtgctgagaaggacacc

SEQ ID NO: 2092825 - DNA, 12 bp, Homo sapiens
agtgctgccctg

SEQ ID NO: 2092826 - DNA, 22 bp, Homo sapiens
agtgctgccctgcgaagtggct

SEQ ID NO: 2092827 - DNA, 20 bp, Homo sapiens
agtgctgggattacaggtgt

SEQ ID NO: 2092828 - DNA, 15 bp, Homo sapiens
agtgctgttctggag

SEQ ID NO: 2092829 - DNA, 20 bp, Homo sapiens
agtgctgttctggagctgct

SEQ ID NO: 2092830 - DNA, 12 bp, Homo sapiens
agtgcttagaaa

SEQ ID NO: 2092831 - DNA, 13 bp, Homo sapiens
agtgcttagaaag

SEQ ID NO: 2092832 - DNA, 19 bp, Homo sapiens
agtgcttcagcctgaggct

SEQ ID NO: 2092833 - DNA, 19 bp, Homo sapiens
agtgcttctccaacactga

SEQ ID NO: 2092834 - DNA, 19 bp, Homo sapiens
agtgcttgagtttggggaa

SEQ ID NO: 2092835 - DNA, 22 bp, Homo sapiens
agtgcttgccaccaccagatga

SEQ ID NO: 2092836 - DNA, 14 bp, Homo sapiens
agtggaaaaaagag

SEQ ID NO: 2092837 - DNA, 20 bp, Homo sapiens
agtggaaaaaagagaaaaac

SEQ ID NO: 2092838 - DNA, 14 bp, Homo sapiens
agtggaaattcagg

SEQ ID NO: 2092839 - DNA, 21 bp, Homo sapiens
agtggaacagtcacccttctg

SEQ ID NO: 2092840 - DNA, 23 bp, Homo sapiens
agtggaacagtcacccttctggg

SEQ ID NO: 2092841 - DNA, 15 bp, Homo sapiens
agtggaagagcagcc

SEQ ID NO: 2092842 - DNA, 19 bp, Homo sapiens
agtggaagagcagcctgat

SEQ ID NO: 2092843 - DNA, 20 bp, Homo sapiens
agtggaatgcagggaagagg

SEQ ID NO: 2092844 - DNA, 13 bp, Homo sapiens
agtggacaggagt

SEQ ID NO: 2092845 - DNA, 20 bp, Homo sapiens
agtggacattcaaaaacctg

SEQ ID NO: 2092846 - DNA, 15 bp, Homo sapiens
agtggaccaggacag

SEQ ID NO: 2092847 - DNA, 18 bp, Homo sapiens
agtggagaaatatttata

SEQ ID NO: 2092848 - DNA, 22 bp, Homo sapiens
agtggagcaaatgcttaaaaca

SEQ ID NO: 2092849 - DNA, 13 bp, Homo sapiens
agtggagccctca

SEQ ID NO: 2092850 - DNA, 12 bp, Homo sapiens
agtggagggggt

SEQ ID NO: 2092851 - DNA, 17 bp, Homo sapiens
agtggagggggtgtctg

SEQ ID NO: 2092852 - DNA, 15 bp, Homo sapiens
agtggagtgagatct

SEQ ID NO: 2092853 - DNA, 14 bp, Homo sapiens
agtggatctccaag

SEQ ID NO: 2092854 - DNA, 17 bp, Homo sapiens
agtggatgcattcctga

SEQ ID NO: 2092855 - DNA, 18 bp, Homo sapiens
agtggatgcattcctgag

SEQ ID NO: 2092856 - DNA, 21 bp, Homo sapiens
agtggatggaggagaaataaa

SEQ ID NO: 2092857 - DNA, 19 bp, Homo sapiens
agtggatggatggacagaa

SEQ ID NO: 2092858 - DNA, 23 bp, Homo sapiens
agtggatggatggacagaatgat

SEQ ID NO: 2092859 - DNA, 12 bp, Homo sapiens
agtggcagccat

SEQ ID NO: 2092860 - DNA, 13 bp, Homo sapiens
agtggcagctgct

SEQ ID NO: 2092861 - DNA, 21 bp, Homo sapiens
agtggcagctgtcccctctcc

SEQ ID NO: 2092862 - DNA, 18 bp, Homo sapiens
agtggcccctcacctggg

SEQ ID NO: 2092863 - DNA, 20 bp, Homo sapiens
agtggccgcaagcgcaggga

SEQ ID NO: 2092864 - DNA, 21 bp, Homo sapiens
agtggccgcaagcgcagggag

SEQ ID NO: 2092865 - DNA, 22 bp, Homo sapiens
agtggccgcaagcgcagggagg

SEQ ID NO: 2092866 - DNA, 15 bp, Homo sapiens
ataattttaaacaaa

SEQ ID NO: 2092867 - DNA, 14 bp, Homo sapiens
ataattttaaattc

SEQ ID NO: 2092868 - DNA, 21 bp, Homo sapiens
ataattttcaagagaagaaaa

SEQ ID NO: 2092869 - DNA, 23 bp, Homo sapiens
ataattttcaagagaagaaaaaa

SEQ ID NO: 2092870 - DNA, 17 bp, Homo sapiens
ataattttgcagcagaa

SEQ ID NO: 2092871 - DNA, 18 bp, Homo sapiens
ataatttttaaagtatat

SEQ ID NO: 2092872 - DNA, 15 bp, Homo sapiens
ataattttttattca

SEQ ID NO: 2092873 - DNA, 17 bp, Homo sapiens
ataattttttattcaag

SEQ ID NO: 2092874 - DNA, 23 bp, Homo sapiens
ataatttttttattactgatttt

SEQ ID NO: 2092875 - DNA, 20 bp, Homo sapiens
ataatttttttcaatattta

SEQ ID NO: 2092876 - DNA, 22 bp, Homo sapiens
ataatttttttcaatatttatt

SEQ ID NO: 2092877 - DNA, 23 bp, Homo sapiens
atacaaaaatgagctaggcatgg

SEQ ID NO: 2092878 - DNA, 18 bp, Homo sapiens
atacaaaataaaattatg

SEQ ID NO: 2092879 - DNA, 12 bp, Homo sapiens
atacaaaataat

SEQ ID NO: 2092880 - DNA, 13 bp, Homo sapiens
atacaaaataatt

SEQ ID NO: 2092881 - DNA, 14 bp, Homo sapiens
atacaaaataattt

SEQ ID NO: 2092882 - DNA, 16 bp, Homo sapiens
atacaaaataatttaa

SEQ ID NO: 2092883 - DNA, 19 bp, Homo sapiens
atacaaaataatttaacta

SEQ ID NO: 2092884 - DNA, 19 bp, Homo sapiens
atacaaacatatttgttaa

SEQ ID NO: 2092885 - DNA, 16 bp, Homo sapiens
atacaacaagaacaac

SEQ ID NO: 2092886 - DNA, 15 bp, Homo sapiens
atacaacacaaagag

SEQ ID NO: 2092887 - DNA, 16 bp, Homo sapiens
atacaacctgagcctt

SEQ ID NO: 2092888 - DNA, 23 bp, Homo sapiens
atacaacctgagccttttcttat

SEQ ID NO: 2092889 - DNA, 16 bp, Homo sapiens
atacaactagagatat

SEQ ID NO: 2092890 - DNA, 14 bp, Homo sapiens
atacaataacataa

SEQ ID NO: 2092891 - DNA, 20 bp, Homo sapiens
atacaatatataaaaatata

SEQ ID NO: 2092892 - DNA, 16 bp, Homo sapiens
atacaatgacaagtat

SEQ ID NO: 2092893 - DNA, 13 bp, Homo sapiens
atacacaacattt

SEQ ID NO: 2092894 - DNA, 15 bp, Homo sapiens
atacacaagtaaaca

SEQ ID NO: 2092895 - DNA, 13 bp, Homo sapiens
atacacacatata

SEQ ID NO: 2092896 - DNA, 16 bp, Homo sapiens
atacacacatatacat

SEQ ID NO: 2092897 - DNA, 21 bp, Homo sapiens
atacacacatatacatatata

SEQ ID NO: 2092898 - DNA, 13 bp, Homo sapiens
atacacatacata

SEQ ID NO: 2092899 - DNA, 16 bp, Homo sapiens
atacacatacatacat

SEQ ID NO: 2092900 - DNA, 14 bp, Homo sapiens
atacacatatacct

SEQ ID NO: 2092901 - DNA, 20 bp, Homo sapiens
atacaccacctcactcctgt

SEQ ID NO: 2092902 - DNA, 14 bp, Homo sapiens
atacaccgggcctg

SEQ ID NO: 2092903 - DNA, 20 bp, Homo sapiens
atacactcaaacaatcatga

SEQ ID NO: 2092904 - DNA, 12 bp, Homo sapiens
atacactcctgc

SEQ ID NO: 2092905 - DNA, 13 bp, Homo sapiens
atacactcctgct

SEQ ID NO: 2092906 - DNA, 14 bp, Homo sapiens
atacactcctgctg

SEQ ID NO: 2092907 - DNA, 13 bp, Homo sapiens
atacactctctag

SEQ ID NO: 2092908 - DNA, 21 bp, Homo sapiens
atacactgaagttaacagaga

SEQ ID NO: 2092909 - DNA, 14 bp, Homo sapiens
atacagacactaag

SEQ ID NO: 2092910 - DNA, 16 bp, Homo sapiens
atacagaggtaactat

SEQ ID NO: 2092911 - DNA, 23 bp, Homo sapiens
atacagccccaaaccagggtgca

SEQ ID NO: 2092912 - DNA, 19 bp, Homo sapiens
atacaggaaaagctgctga

SEQ ID NO: 2092913 - DNA, 22 bp, Homo sapiens
atacaggaaaagctgctgacag

SEQ ID NO: 2092914 - DNA, 23 bp, Homo sapiens
atacaggaaaagctgctgacagt

SEQ ID NO: 2092915 - DNA, 13 bp, Homo sapiens
atacagtaaagtt

SEQ ID NO: 2092916 - DNA, 17 bp, Homo sapiens
atacagtaaagtttaaa

SEQ ID NO: 2092917 - DNA, 21 bp, Homo sapiens
atacagtaaagtttaaaaaat

SEQ ID NO: 2092918 - DNA, 12 bp, Homo sapiens
atacagtgcatc

SEQ ID NO: 2092919 - DNA, 23 bp, Homo sapiens
atacagtgttattttctttgaaa

SEQ ID NO: 2092920 - DNA, 17 bp, Homo sapiens
atacatacacatacata

SEQ ID NO: 2092921 - DNA, 18 bp, Homo sapiens
atacatacatacatacat

SEQ ID NO: 2092922 - DNA, 17 bp, Homo sapiens
atacatacatacatata

SEQ ID NO: 2092923 - DNA, 18 bp, Homo sapiens
atacatacatacatatat

SEQ ID NO: 2092924 - DNA, 19 bp, Homo sapiens
atacatacatacatatata

SEQ ID NO: 2092925 - DNA, 13 bp, Homo sapiens
atacatacatata

SEQ ID NO: 2092926 - DNA, 17 bp, Homo sapiens
atacatacctctctcta

SEQ ID NO: 2092927 - DNA, 16 bp, Homo sapiens
atacatagtcacaaaa

SEQ ID NO: 2092928 - DNA, 16 bp, Homo sapiens
atacatatatatatac

SEQ ID NO: 2092929 - DNA, 20 bp, Homo sapiens
atacatatatatatacacat

SEQ ID NO: 2092930 - DNA, 22 bp, Homo sapiens
atacatatatatatacacatac

SEQ ID NO: 2092931 - DNA, 23 bp, Homo sapiens
atacatatatatatacacataca

SEQ ID NO: 2092932 - DNA, 14 bp, Homo sapiens
atacatatatatct

SEQ ID NO: 2092933 - DNA, 14 bp, Homo sapiens
atacatatcagaaa

SEQ ID NO: 2092934 - DNA, 22 bp, Homo sapiens
atacatatgtagactatataca

SEQ ID NO: 2092935 - DNA, 16 bp, Homo sapiens
atacatattataaata

SEQ ID NO: 2092936 - DNA, 23 bp, Homo sapiens
atacatattataaataaatgcca

SEQ ID NO: 2092937 - DNA, 12 bp, Homo sapiens
atacatgtatag

SEQ ID NO: 2092938 - DNA, 15 bp, Homo sapiens
atacatgtatagtga

SEQ ID NO: 2092939 - DNA, 14 bp, Homo sapiens
atacatgtgtgtat

SEQ ID NO: 2092940 - DNA, 17 bp, Homo sapiens
atacatgtgtgtatata

SEQ ID NO: 2092941 - DNA, 23 bp, Homo sapiens
atacatgtgtgtatatatgtgta

SEQ ID NO: 2092942 - DNA, 21 bp, Homo sapiens
atacatgttcatcgtatttcc

SEQ ID NO: 2092943 - DNA, 15 bp, Homo sapiens
atacattaaggagca

SEQ ID NO: 2092944 - DNA, 17 bp, Homo sapiens
atacattccctatcaaa

SEQ ID NO: 2092945 - DNA, 20 bp, Homo sapiens
atacatttataatgtttgct

SEQ ID NO: 2092946 - DNA, 21 bp, Homo sapiens
atacatttataatgtttgcta

SEQ ID NO: 2092947 - DNA, 14 bp, Homo sapiens
atacatttcatctg

SEQ ID NO: 2092948 - DNA, 18 bp, Homo sapiens
atacattttgttatagaa

SEQ ID NO: 2092949 - DNA, 16 bp, Homo sapiens
ataccaaatattttag

SEQ ID NO: 2092950 - DNA, 14 bp, Homo sapiens
ataccaagtattta

SEQ ID NO: 2092951 - DNA, 16 bp, Homo sapiens
ataccaggttgaaaga

SEQ ID NO: 2092952 - DNA, 19 bp, Homo sapiens
ataccatatgtctgcttct

SEQ ID NO: 2092953 - DNA, 21 bp, Homo sapiens
ataccatatgtctgcttctgt

SEQ ID NO: 2092954 - DNA, 12 bp, Homo sapiens
ataccatcactg

SEQ ID NO: 2092955 - DNA, 15 bp, Homo sapiens
ataccatgtctctaa

SEQ ID NO: 2092956 - DNA, 13 bp, Homo sapiens
atacccccagaga

SEQ ID NO: 2092957 - DNA, 15 bp, Homo sapiens
atacccccagagacc

SEQ ID NO: 2092958 - DNA, 17 bp, Homo sapiens
atacccccagagacctt

SEQ ID NO: 2092959 - DNA, 14 bp, Homo sapiens
atacccctgcctgg

SEQ ID NO: 2092960 - DNA, 20 bp, Homo sapiens
atacccttctttaaatcaaa

SEQ ID NO: 2092961 - DNA, 19 bp, Homo sapiens
atacctataatgtgtgtat

SEQ ID NO: 2092962 - DNA, 14 bp, Homo sapiens
atacctctctctat

SEQ ID NO: 2092963 - DNA, 18 bp, Homo sapiens
atacctctctctatatat

SEQ ID NO: 2092964 - DNA, 13 bp, Homo sapiens
atacctctgacca

SEQ ID NO: 2092965 - DNA, 14 bp, Homo sapiens
atacctctgaccaa

SEQ ID NO: 2092966 - DNA, 13 bp, Homo sapiens
atacctctgtgtg

SEQ ID NO: 2092967 - DNA, 19 bp, Homo sapiens
atacctgtgtttcttgcct

SEQ ID NO: 2092968 - DNA, 14 bp, Homo sapiens
atacgaaacacaaa

SEQ ID NO: 2092969 - DNA, 17 bp, Homo sapiens
atacgcactacatgtgg

SEQ ID NO: 2092970 - DNA, 14 bp, Homo sapiens
atacggttgcttca

SEQ ID NO: 2092971 - DNA, 21 bp, Homo sapiens
atacgtgttaggaggctgcat

SEQ ID NO: 2092972 - DNA, 12 bp, Homo sapiens
atactaaaatat

SEQ ID NO: 2092973 - DNA, 14 bp, Homo sapiens
atactaaaatatgt

SEQ ID NO: 2092974 - DNA, 18 bp, Homo sapiens
atactaaagtgtctatta

SEQ ID NO: 2092975 - DNA, 17 bp, Homo sapiens
atactaagcattgaatg

SEQ ID NO: 2092976 - DNA, 15 bp, Homo sapiens
atactatacaacaat

SEQ ID NO: 2092977 - DNA, 16 bp, Homo sapiens
atactatacaacaatg

SEQ ID NO: 2092978 - DNA, 16 bp, Homo sapiens
atactcatttctaaaa

SEQ ID NO: 2092979 - DNA, 20 bp, Homo sapiens
atactcatttctaaaagaat

SEQ ID NO: 2092980 - DNA, 22 bp, Homo sapiens
atactcatttctaaaagaatat

SEQ ID NO: 2092981 - DNA, 22 bp, Homo sapiens
atatttataactcatcataaaa

SEQ ID NO: 2092982 - DNA, 12 bp, Homo sapiens
atatttatattg

SEQ ID NO: 2092983 - DNA, 13 bp, Homo sapiens
atatttatgctta

SEQ ID NO: 2092984 - DNA, 18 bp, Homo sapiens
atatttatgcttaaaata

SEQ ID NO: 2092985 - DNA, 21 bp, Homo sapiens
atatttatgcttaaaatatgt

SEQ ID NO: 2092986 - DNA, 23 bp, Homo sapiens
atatttatgcttaaaatatgtat

SEQ ID NO: 2092987 - DNA, 19 bp, Homo sapiens
atatttatggggggagaac

SEQ ID NO: 2092988 - DNA, 19 bp, Homo sapiens
atatttatgtctatttaag

SEQ ID NO: 2092989 - DNA, 23 bp, Homo sapiens
atatttattattttcacctgttt

SEQ ID NO: 2092990 - DNA, 22 bp, Homo sapiens
atatttattgtttatttatcag

SEQ ID NO: 2092991 - DNA, 15 bp, Homo sapiens
atatttcaaaataaa

SEQ ID NO: 2092992 - DNA, 17 bp, Homo sapiens
atatttcaaatgaacac

SEQ ID NO: 2092993 - DNA, 12 bp, Homo sapiens
atatttgaaatt

SEQ ID NO: 2092994 - DNA, 16 bp, Homo sapiens
atatttgaaattttat

SEQ ID NO: 2092995 - DNA, 23 bp, Homo sapiens
atatttgattgtaaaaacaaaaa

SEQ ID NO: 2092996 - DNA, 14 bp, Homo sapiens
atatttgcttattt

SEQ ID NO: 2092997 - DNA, 13 bp, Homo sapiens
atatttgtacata

SEQ ID NO: 2092998 - DNA, 12 bp, Homo sapiens
atatttgtagaa

SEQ ID NO: 2092999 - DNA, 17 bp, Homo sapiens
atatttgtgtatgtgta

SEQ ID NO: 2093000 - DNA, 15 bp, Homo sapiens
atattttaaagaatt

SEQ ID NO: 2093001 - DNA, 22 bp, Homo sapiens
atattttatatgaaatgtttca

SEQ ID NO: 2093002 - DNA, 23 bp, Homo sapiens
atattttcatgacttttccatgt

SEQ ID NO: 2093003 - DNA, 18 bp, Homo sapiens
atattttcattaaaagct

SEQ ID NO: 2093004 - DNA, 16 bp, Homo sapiens
atattttccatgaaaa

SEQ ID NO: 2093005 - DNA, 13 bp, Homo sapiens
atattttccctct

SEQ ID NO: 2093006 - DNA, 14 bp, Homo sapiens
atattttgtatata

SEQ ID NO: 2093007 - DNA, 19 bp, Homo sapiens
atatttttatagacaaata

SEQ ID NO: 2093008 - DNA, 12 bp, Homo sapiens
atatttttcaac

SEQ ID NO: 2093009 - DNA, 18 bp, Homo sapiens
atatttttcaaccagcat

SEQ ID NO: 2093010 - DNA, 24 bp, Homo sapiens
atatttttcaaccagcattttact

SEQ ID NO: 2093011 - DNA, 18 bp, Homo sapiens
atattttttcagaaatat

SEQ ID NO: 2093012 - DNA, 17 bp, Homo sapiens
atcaaaaataaactagt

SEQ ID NO: 2093013 - DNA, 18 bp, Homo sapiens
atcaaaacatatcaattc

SEQ ID NO: 2093014 - DNA, 20 bp, Homo sapiens
atcaaaacatatcaattcaa

SEQ ID NO: 2093015 - DNA, 12 bp, Homo sapiens
atcaaaagacag

SEQ ID NO: 2093016 - DNA, 16 bp, Homo sapiens
atcaaaataaattgaa

SEQ ID NO: 2093017 - DNA, 11 bp, Homo sapiens
atcaaaatctt

SEQ ID NO: 2093018 - DNA, 15 bp, Homo sapiens
atcaaagcaagggct

SEQ ID NO: 2093019 - DNA, 15 bp, Homo sapiens
atcaaagtaaaaaat

SEQ ID NO: 2093020 - DNA, 15 bp, Homo sapiens
atcaaatatgcaaag

SEQ ID NO: 2093021 - DNA, 22 bp, Homo sapiens
atcaaatctgtatatgttgtaa

SEQ ID NO: 2093022 - DNA, 22 bp, Homo sapiens
atcaaatgctgtagaatgcttg

SEQ ID NO: 2093023 - DNA, 20 bp, Homo sapiens
atcaaatttcacgtcgtctt

SEQ ID NO: 2093024 - DNA, 18 bp, Homo sapiens
atcaacaagagttgtctt

SEQ ID NO: 2093025 - DNA, 18 bp, Homo sapiens
atcaaccccagacactgg

SEQ ID NO: 2093026 - DNA, 19 bp, Homo sapiens
atcaaccccttcgctcctg

SEQ ID NO: 2093027 - DNA, 15 bp, Homo sapiens
atcaactccagctcc

SEQ ID NO: 2093028 - DNA, 12 bp, Homo sapiens
atcaagaaagtc

SEQ ID NO: 2093029 - DNA, 16 bp, Homo sapiens
atcaagctagaaggcc

SEQ ID NO: 2093030 - DNA, 20 bp, Homo sapiens
atcaagctagaaggccacat

SEQ ID NO: 2093031 - DNA, 18 bp, Homo sapiens
atcaagctgtacatttgg

SEQ ID NO: 2093032 - DNA, 15 bp, Homo sapiens
atcaaggaatcctga

SEQ ID NO: 2093033 - DNA, 15 bp, Homo sapiens
atcaaggagcccaga

SEQ ID NO: 2093034 - DNA, 16 bp, Homo sapiens
atcaaggagcccagaa

SEQ ID NO: 2093035 - DNA, 13 bp, Homo sapiens
atcaagtccagag

SEQ ID NO: 2093036 - DNA, 22 bp, Homo sapiens
atcaatagactgtacttatttt

SEQ ID NO: 2093037 - DNA, 19 bp, Homo sapiens
atcaatcatctgtgtgaaa

SEQ ID NO: 2093038 - DNA, 18 bp, Homo sapiens
atcaatgaagatttttaa

SEQ ID NO: 2093039 - DNA, 15 bp, Homo sapiens
atcaatggaaacagg

SEQ ID NO: 2093040 - DNA, 19 bp, Homo sapiens
atcaatgtttcttctaggt

SEQ ID NO: 2093041 - DNA, 14 bp, Homo sapiens
atcaattaaatgta

SEQ ID NO: 2093042 - DNA, 16 bp, Homo sapiens
atcaatttcccagaag

SEQ ID NO: 2093043 - DNA, 20 bp, Homo sapiens
atcaatttgtaattgcttac

SEQ ID NO: 2093044 - DNA, 22 bp, Homo sapiens
atcaatttttatacatatcaga

SEQ ID NO: 2093045 - DNA, 23 bp, Homo sapiens
atcaatttttatacatatcagaa

SEQ ID NO: 2093046 - DNA, 13 bp, Homo sapiens
atcacaagcaata

SEQ ID NO: 2093047 - DNA, 20 bp, Homo sapiens
atcacaagcaataattagga

SEQ ID NO: 2093048 - DNA, 13 bp, Homo sapiens
atcacaaggggaa

SEQ ID NO: 2093049 - DNA, 13 bp, Homo sapiens
atcacacctctgg

SEQ ID NO: 2093050 - DNA, 20 bp, Homo sapiens
atcacagatgggtattaaac

SEQ ID NO: 2093051 - DNA, 19 bp, Homo sapiens
atcacagcagaatgaagac

SEQ ID NO: 2093052 - DNA, 15 bp, Homo sapiens
atcacagggcagagc

SEQ ID NO: 2093053 - DNA, 19 bp, Homo sapiens
atcacagggcagagccggg

SEQ ID NO: 2093054 - DNA, 12 bp, Homo sapiens
atcacagggccc

SEQ ID NO: 2093055 - DNA, 21 bp, Homo sapiens
atcacagggccccagaaggca

SEQ ID NO: 2093056 - DNA, 12 bp, Homo sapiens
atcacaggggcg

SEQ ID NO: 2093057 - DNA, 15 bp, Homo sapiens
atcacaggggcgggg

SEQ ID NO: 2093058 - DNA, 20 bp, Homo sapiens
atcacagtggcgagaggaga

SEQ ID NO: 2093059 - DNA, 12 bp, Homo sapiens
atcacatacaat

SEQ ID NO: 2093060 - DNA, 18 bp, Homo sapiens
atcacatacaatttgcac

SEQ ID NO: 2093061 - DNA, 21 bp, Homo sapiens
atcacatacaatttgcactgt

SEQ ID NO: 2093062 - DNA, 15 bp, Homo sapiens
atcaccagcccggcc

SEQ ID NO: 2093063 - DNA, 12 bp, Homo sapiens
atcacccagtcc

SEQ ID NO: 2093064 - DNA, 20 bp, Homo sapiens
atcaccgacgcgtctcctgt

SEQ ID NO: 2093065 - DNA, 20 bp, Homo sapiens
atcaccgagagtagccgaga

SEQ ID NO: 2093066 - DNA, 14 bp, Homo sapiens
atcacctcaggcca

SEQ ID NO: 2093067 - DNA, 20 bp, Homo sapiens
atcacctctgtaatttttca

SEQ ID NO: 2093068 - DNA, 18 bp, Homo sapiens
atcacctttttgactttt

SEQ ID NO: 2093069 - DNA, 17 bp, Homo sapiens
atcacgccactgcacta

SEQ ID NO: 2093070 - DNA, 19 bp, Homo sapiens
atcacggctcactgcagcc

SEQ ID NO: 2093071 - DNA, 15 bp, Homo sapiens
atcactataaccatc

SEQ ID NO: 2093072 - DNA, 15 bp, Homo sapiens
atcactatctttctg

SEQ ID NO: 2093073 - DNA, 14 bp, Homo sapiens
atcactccctggat

SEQ ID NO: 2093074 - DNA, 13 bp, Homo sapiens
atcactctgtcct

SEQ ID NO: 2093075 - DNA, 15 bp, Homo sapiens
atcactgattgggtg

SEQ ID NO: 2093076 - DNA, 16 bp, Homo sapiens
atcactggagcccagg

SEQ ID NO: 2093077 - DNA, 13 bp, Homo sapiens
atcactggatgaa

SEQ ID NO: 2093078 - DNA, 18 bp, Homo sapiens
atcactgtagtctaagac

SEQ ID NO: 2093079 - DNA, 13 bp, Homo sapiens
atcactgtatttt

SEQ ID NO: 2093080 - DNA, 14 bp, Homo sapiens
atcacttaatgaac

SEQ ID NO: 2093081 - DNA, 13 bp, Homo sapiens
atcacttgaaccc

SEQ ID NO: 2093082 - DNA, 23 bp, Homo sapiens
atcacttggggtcaccaccctcc

SEQ ID NO: 2093083 - DNA, 12 bp, Homo sapiens
atcacttgtaaa

SEQ ID NO: 2093084 - DNA, 18 bp, Homo sapiens
atcacttgtaaataaata

SEQ ID NO: 2093085 - DNA, 15 bp, Homo sapiens
atcacttttcagtga

SEQ ID NO: 2093086 - DNA, 16 bp, Homo sapiens
atcagaaaagtagaat

SEQ ID NO: 2093087 - DNA, 20 bp, Homo sapiens
atcagaaagggagggctctg

SEQ ID NO: 2093088 - DNA, 23 bp, Homo sapiens
atcagaaagggagggctctgagg

SEQ ID NO: 2093089 - DNA, 21 bp, Homo sapiens
atcagaaatgtcatcaaatat

SEQ ID NO: 2093090 - DNA, 13 bp, Homo sapiens
atcagaaggctgg

SEQ ID NO: 2093091 - DNA, 19 bp, Homo sapiens
atcagaaggctggggccag

SEQ ID NO: 2093092 - DNA, 14 bp, Homo sapiens
atcagaccctaccc

SEQ ID NO: 2093093 - DNA, 16 bp, Homo sapiens
atcagaccctacccca

SEQ ID NO: 2093094 - DNA, 15 bp, Homo sapiens
atcagacctctgatc

SEQ ID NO: 2093095 - DNA, 18 bp, Homo sapiens
atcagacctctgatccct

SEQ ID NO: 2093096 - DNA, 21 bp, Homo sapiens
atgaacagaacatagacagaa

SEQ ID NO: 2093097 - DNA, 13 bp, Homo sapiens
atgaaccacatct

SEQ ID NO: 2093098 - DNA, 14 bp, Homo sapiens
atgaactcaacttt

SEQ ID NO: 2093099 - DNA, 16 bp, Homo sapiens
atgaactcttaatcaa

SEQ ID NO: 2093100 - DNA, 17 bp, Homo sapiens
atgaacttgaggacaca

SEQ ID NO: 2093101 - DNA, 17 bp, Homo sapiens
atgaactttctcttcat

SEQ ID NO: 2093102 - DNA, 17 bp, Homo sapiens
atgaagaaaaaatacat

SEQ ID NO: 2093103 - DNA, 21 bp, Homo sapiens
atgaagaaaaaggctggctga

SEQ ID NO: 2093104 - DNA, 14 bp, Homo sapiens
atgaagaaagggag

SEQ ID NO: 2093105 - DNA, 13 bp, Homo sapiens
atgaagacctaaa

SEQ ID NO: 2093106 - DNA, 18 bp, Homo sapiens
atgaagacctaaatgacc

SEQ ID NO: 2093107 - DNA, 19 bp, Homo sapiens
atgaagacctaaatgacct

SEQ ID NO: 2093108 - DNA, 21 bp, Homo sapiens
atgaagacctaaatgacctca

SEQ ID NO: 2093109 - DNA, 22 bp, Homo sapiens
atgaagacctaaatgacctcag

SEQ ID NO: 2093110 - DNA, 14 bp, Homo sapiens
atgaagagaagctg

SEQ ID NO: 2093111 - DNA, 22 bp, Homo sapiens
atgaagattctcctgtgctaga

SEQ ID NO: 2093112 - DNA, 12 bp, Homo sapiens
atgaagcatgta

SEQ ID NO: 2093113 - DNA, 13 bp, Homo sapiens
atgaagcatgtag

SEQ ID NO: 2093114 - DNA, 12 bp, Homo sapiens
atgaagcccaag

SEQ ID NO: 2093115 - DNA, 17 bp, Homo sapiens
atgaagcccaagtgaaa

SEQ ID NO: 2093116 - DNA, 18 bp, Homo sapiens
atgaagcctgtgccacct

SEQ ID NO: 2093117 - DNA, 20 bp, Homo sapiens
atgaagcctgtgccacctgc

SEQ ID NO: 2093118 - DNA, 15 bp, Homo sapiens
atgaagctctggcca

SEQ ID NO: 2093119 - DNA, 19 bp, Homo sapiens
atgaagctggaagcactgc

SEQ ID NO: 2093120 - DNA, 21 bp, Homo sapiens
atgaagctggaagcactgctg

SEQ ID NO: 2093121 - DNA, 22 bp, Homo sapiens
atgaagctggaagcactgctgt

SEQ ID NO: 2093122 - DNA, 23 bp, Homo sapiens
atgaagctggaagcactgctgtg

SEQ ID NO: 2093123 - DNA, 17 bp, Homo sapiens
atgaagggaaaggatat

SEQ ID NO: 2093124 - DNA, 15 bp, Homo sapiens
atgaagggcccgaga

SEQ ID NO: 2093125 - DNA, 22 bp, Homo sapiens
atgaaggttaggatttaacagt

SEQ ID NO: 2093126 - DNA, 19 bp, Homo sapiens
atgaaggtttctgaaaatt

SEQ ID NO: 2093127 - DNA, 18 bp, Homo sapiens
atgaagtcgttgtgaggg

SEQ ID NO: 2093128 - DNA, 19 bp, Homo sapiens
atgaagtgtgtttccttca

SEQ ID NO: 2093129 - DNA, 18 bp, Homo sapiens
atgaagtgttagatagaa

SEQ ID NO: 2093130 - DNA, 18 bp, Homo sapiens
atgaagtttgaacttcat

SEQ ID NO: 2093131 - DNA, 20 bp, Homo sapiens
atgaatagatgtgatcactg

SEQ ID NO: 2093132 - DNA, 13 bp, Homo sapiens
atgaatatctgct

SEQ ID NO: 2093133 - DNA, 19 bp, Homo sapiens
atgaatatttcaaaataaa

SEQ ID NO: 2093134 - DNA, 18 bp, Homo sapiens
atgaatcccacccacatg

SEQ ID NO: 2093135 - DNA, 15 bp, Homo sapiens
atgaatgcacactag

SEQ ID NO: 2093136 - DNA, 13 bp, Homo sapiens
atgaattaaattt

SEQ ID NO: 2093137 - DNA, 20 bp, Homo sapiens
atgaattctctctaaaaata

SEQ ID NO: 2093138 - DNA, 17 bp, Homo sapiens
atgaattcttatgctta

SEQ ID NO: 2093139 - DNA, 22 bp, Homo sapiens
atgacaaacccaggagtttgtg

SEQ ID NO: 2093140 - DNA, 19 bp, Homo sapiens
atgacaacagaagcttcag

SEQ ID NO: 2093141 - DNA, 21 bp, Homo sapiens
atgacaaggggagggccagga

SEQ ID NO: 2093142 - DNA, 17 bp, Homo sapiens
atgacacatttggcagt

SEQ ID NO: 2093143 - DNA, 15 bp, Homo sapiens
atgacacggtaggcc

SEQ ID NO: 2093144 - DNA, 18 bp, Homo sapiens
atgacacggtaggccaag

SEQ ID NO: 2093145 - DNA, 19 bp, Homo sapiens
atgacacggtaggccaagc

SEQ ID NO: 2093146 - DNA, 12 bp, Homo sapiens
atgacactgacc

SEQ ID NO: 2093147 - DNA, 16 bp, Homo sapiens
atgacactgttcagga

SEQ ID NO: 2093148 - DNA, 13 bp, Homo sapiens
atgacagccagag

SEQ ID NO: 2093149 - DNA, 15 bp, Homo sapiens
atgacagccagagcc

SEQ ID NO: 2093150 - DNA, 22 bp, Homo sapiens
atgacagtccgtcaaaacagat

SEQ ID NO: 2093151 - DNA, 22 bp, Homo sapiens
atgacagttatactgtcggttt

SEQ ID NO: 2093152 - DNA, 14 bp, Homo sapiens
atgacatcacttgt

SEQ ID NO: 2093153 - DNA, 15 bp, Homo sapiens
atgacatgcactgac

SEQ ID NO: 2093154 - DNA, 17 bp, Homo sapiens
atgacatgcactgaccc

SEQ ID NO: 2093155 - DNA, 23 bp, Homo sapiens
atgacatgcactgacccttccag

SEQ ID NO: 2093156 - DNA, 16 bp, Homo sapiens
atgacatgccaccctc

SEQ ID NO: 2093157 - DNA, 23 bp, Homo sapiens
atgacatgttatatattttttgt

SEQ ID NO: 2093158 - DNA, 14 bp, Homo sapiens
atgacatttttgat

SEQ ID NO: 2093159 - DNA, 17 bp, Homo sapiens
atgaccaatctctgtga

SEQ ID NO: 2093160 - DNA, 19 bp, Homo sapiens
atgaccacgggcctcagtt

SEQ ID NO: 2093161 - DNA, 20 bp, Homo sapiens
atgaccacgggcctcagttt

SEQ ID NO: 2093162 - DNA, 19 bp, Homo sapiens
atgaccagaaacagggaca

SEQ ID NO: 2093163 - DNA, 14 bp, Homo sapiens
atgaccatcctgtc

SEQ ID NO: 2093164 - DNA, 23 bp, Homo sapiens
atgaccctgcgaaggggccctgg

SEQ ID NO: 2093165 - DNA, 22 bp, Homo sapiens
atgacctactagttttccttga

SEQ ID NO: 2093166 - DNA, 22 bp, Homo sapiens
atgacctcagcaaatcctcttc

SEQ ID NO: 2093167 - DNA, 12 bp, Homo sapiens
atgacctccagc

SEQ ID NO: 2093168 - DNA, 13 bp, Homo sapiens
atgacctccagct

SEQ ID NO: 2093169 - DNA, 23 bp, Homo sapiens
atgactaaaaatattataactta

SEQ ID NO: 2093170 - DNA, 19 bp, Homo sapiens
atgactagaggcagggagg

SEQ ID NO: 2093171 - DNA, 15 bp, Homo sapiens
atgactataaacatt

SEQ ID NO: 2093172 - DNA, 23 bp, Homo sapiens
atgactataaacattaaaagaag

SEQ ID NO: 2093173 - DNA, 22 bp, Homo sapiens
atgactcccttaaaatagaaat

SEQ ID NO: 2093174 - DNA, 14 bp, Homo sapiens
atgactcctttctc

SEQ ID NO: 2093175 - DNA, 17 bp, Homo sapiens
atgactgtgattttcag

SEQ ID NO: 2093176 - DNA, 22 bp, Homo sapiens
atgacttgggcacccccagcct

SEQ ID NO: 2093177 - DNA, 23 bp, Homo sapiens
atgacttgggcacccccagcctg

SEQ ID NO: 2093178 - DNA, 20 bp, Homo sapiens
atgacttttctggaagacat

SEQ ID NO: 2093179 - DNA, 17 bp, Homo sapiens
atgactttttttctgat

SEQ ID NO: 2093180 - DNA, 11 bp, Homo sapiens
atgagaaatgt

SEQ ID NO: 2093181 - DNA, 12 bp, Homo sapiens
atgagaaatgtg

SEQ ID NO: 2093182 - DNA, 21 bp, Homo sapiens
atgagaacaagtcacagctgc

SEQ ID NO: 2093183 - DNA, 15 bp, Homo sapiens
atgagaagagggcct

SEQ ID NO: 2093184 - DNA, 11 bp, Homo sapiens
atgagaagtta

SEQ ID NO: 2093185 - DNA, 21 bp, Homo sapiens
atgagaagttaagcagccttt

SEQ ID NO: 2093186 - DNA, 21 bp, Homo sapiens
atgagacccattcctatttct

SEQ ID NO: 2093187 - DNA, 18 bp, Homo sapiens
atgagagaatcacacaag

SEQ ID NO: 2093188 - DNA, 16 bp, Homo sapiens
atgagattccctctcc

SEQ ID NO: 2093189 - DNA, 21 bp, Homo sapiens
atgagattccctctcctcccc

SEQ ID NO: 2093190 - DNA, 22 bp, Homo sapiens
atgagattgttttatcatgaca

SEQ ID NO: 2093191 - DNA, 16 bp, Homo sapiens
atgagatttgccagca

SEQ ID NO: 2093192 - DNA, 14 bp, Homo sapiens
atgagcagtcacac

SEQ ID NO: 2093193 - DNA, 20 bp, Homo sapiens
atgagccgctgtgagcccct

SEQ ID NO: 2093194 - DNA, 15 bp, Homo sapiens
atgagcctcagcatc

SEQ ID NO: 2093195 - DNA, 17 bp, Homo sapiens
atgagcctcagcatcct

SEQ ID NO: 2093196 - DNA, 18 bp, Homo sapiens
atgagcctcagcatcctg

SEQ ID NO: 2093197 - DNA, 19 bp, Homo sapiens
atgagcctcagcatcctgg

SEQ ID NO: 2093198 - DNA, 21 bp, Homo sapiens
atgagcctcagcatcctggca

SEQ ID NO: 2093199 - DNA, 23 bp, Homo sapiens
atgagcctgtaatcctcagctga

SEQ ID NO: 2093200 - DNA, 14 bp, Homo sapiens
atgagctcctcttc

SEQ ID NO: 2093201 - DNA, 12 bp, Homo sapiens
atgagctcctgc

SEQ ID NO: 2093202 - DNA, 20 bp, Homo sapiens
atgagctctgaacaaacact

SEQ ID NO: 2093203 - DNA, 15 bp, Homo sapiens
atgagctgtatctgt

SEQ ID NO: 2093204 - DNA, 19 bp, Homo sapiens
atgaggaacctcaaactgg

SEQ ID NO: 2093205 - DNA, 22 bp, Homo sapiens
atgaggaacctcaaactgggta

SEQ ID NO: 2093206 - DNA, 17 bp, Homo sapiens
atgaggagagaaggaca

SEQ ID NO: 2093207 - DNA, 18 bp, Homo sapiens
atgaggaggattgcttct

SEQ ID NO: 2093208 - DNA, 21 bp, Homo sapiens
atgaggcaatgtcaggaacag

SEQ ID NO: 2093209 - DNA, 13 bp, Homo sapiens
atgagggactgga

SEQ ID NO: 2093210 - DNA, 21 bp, Homo sapiens
atgcttaaaatatgtatgtct

SEQ ID NO: 2093211 - DNA, 23 bp, Homo sapiens
atgcttaaaatatgtatgtctaa

SEQ ID NO: 2093212 - DNA, 19 bp, Homo sapiens
atgcttcaagtgttgctct

SEQ ID NO: 2093213 - DNA, 14 bp, Homo sapiens
atgcttcagttgta

SEQ ID NO: 2093214 - DNA, 14 bp, Homo sapiens
atgcttctgttgta

SEQ ID NO: 2093215 - DNA, 15 bp, Homo sapiens
atgcttcttccttac

SEQ ID NO: 2093216 - DNA, 12 bp, Homo sapiens
atgcttcttgcc

SEQ ID NO: 2093217 - DNA, 19 bp, Homo sapiens
atgcttcttgccccttggg

SEQ ID NO: 2093218 - DNA, 16 bp, Homo sapiens
atgctttatgtttaaa

SEQ ID NO: 2093219 - DNA, 15 bp, Homo sapiens
atgctttccaaaacc

SEQ ID NO: 2093220 - DNA, 18 bp, Homo sapiens
atgctttcctccctggca

SEQ ID NO: 2093221 - DNA, 19 bp, Homo sapiens
atgctttcctccctggcat

SEQ ID NO: 2093222 - DNA, 22 bp, Homo sapiens
atgctttctgaagctttaccag

SEQ ID NO: 2093223 - DNA, 21 bp, Homo sapiens
atgctttgaagtacaattgtg

SEQ ID NO: 2093224 - DNA, 19 bp, Homo sapiens
atgctttgggaggccaagg

SEQ ID NO: 2093225 - DNA, 20 bp, Homo sapiens
atgctttgggaggccaaggc

SEQ ID NO: 2093226 - DNA, 16 bp, Homo sapiens
atgctttttgaatgtt

SEQ ID NO: 2093227 - DNA, 15 bp, Homo sapiens
atggaaacagggcag

SEQ ID NO: 2093228 - DNA, 23 bp, Homo sapiens
atggaaacctgaaaaaaagttta

SEQ ID NO: 2093229 - DNA, 16 bp, Homo sapiens
atggaaatatgttcta

SEQ ID NO: 2093230 - DNA, 15 bp, Homo sapiens
atggaaatcctgtta

SEQ ID NO: 2093231 - DNA, 13 bp, Homo sapiens
atggaaccttccc

SEQ ID NO: 2093232 - DNA, 17 bp, Homo sapiens
atggaaccttccctcca

SEQ ID NO: 2093233 - DNA, 23 bp, Homo sapiens
atggaactcagctgtctgtggct

SEQ ID NO: 2093234 - DNA, 18 bp, Homo sapiens
atggaacttctaatatat

SEQ ID NO: 2093235 - DNA, 15 bp, Homo sapiens
atggaagagaaatct

SEQ ID NO: 2093236 - DNA, 15 bp, Homo sapiens
atggaataaaccatt

SEQ ID NO: 2093237 - DNA, 14 bp, Homo sapiens
atggaatagaaaag

SEQ ID NO: 2093238 - DNA, 23 bp, Homo sapiens
atggaatagaaaagatgagaggc

SEQ ID NO: 2093239 - DNA, 15 bp, Homo sapiens
atggaatttgtaagt

SEQ ID NO: 2093240 - DNA, 16 bp, Homo sapiens
atggacaatataaact

SEQ ID NO: 2093241 - DNA, 21 bp, Homo sapiens
atggacaccccttatccagga

SEQ ID NO: 2093242 - DNA, 22 bp, Homo sapiens
atggacaccccttatccaggac

SEQ ID NO: 2093243 - DNA, 19 bp, Homo sapiens
atggacccctcccttgctc

SEQ ID NO: 2093244 - DNA, 14 bp, Homo sapiens
atggaccctcgcag

SEQ ID NO: 2093245 - DNA, 16 bp, Homo sapiens
atggaccctcgcagca

SEQ ID NO: 2093246 - DNA, 23 bp, Homo sapiens
atggaccctcgcagcaggtgcaa

SEQ ID NO: 2093247 - DNA, 21 bp, Homo sapiens
atggactaaccccaacgcaca

SEQ ID NO: 2093248 - DNA, 21 bp, Homo sapiens
atggactcatggcttagaaat

SEQ ID NO: 2093249 - DNA, 15 bp, Homo sapiens
atggactctgcacat

SEQ ID NO: 2093250 - DNA, 16 bp, Homo sapiens
atggacttttgggggt

SEQ ID NO: 2093251 - DNA, 20 bp, Homo sapiens
atggagaaacatcctaagtg

SEQ ID NO: 2093252 - DNA, 12 bp, Homo sapiens
atggagaaggaa

SEQ ID NO: 2093253 - DNA, 14 bp, Homo sapiens
atggagaaggaagg

SEQ ID NO: 2093254 - DNA, 14 bp, Homo sapiens
atggagactcctgc

SEQ ID NO: 2093255 - DNA, 18 bp, Homo sapiens
atggagactcctgccctg

SEQ ID NO: 2093256 - DNA, 20 bp, Homo sapiens
atggagactcctgccctgtt

SEQ ID NO: 2093257 - DNA, 14 bp, Homo sapiens
atggagagagactc

SEQ ID NO: 2093258 - DNA, 14 bp, Homo sapiens
atggagagagggga

SEQ ID NO: 2093259 - DNA, 13 bp, Homo sapiens
atggagagccctg

SEQ ID NO: 2093260 - DNA, 18 bp, Homo sapiens
atggagaggcggcctcgt

SEQ ID NO: 2093261 - DNA, 17 bp, Homo sapiens
atggagagggggtacaa

SEQ ID NO: 2093262 - DNA, 18 bp, Homo sapiens
atggagattctgattcag

SEQ ID NO: 2093263 - DNA, 19 bp, Homo sapiens
atggagcagtacatgggaa

SEQ ID NO: 2093264 - DNA, 22 bp, Homo sapiens
atggagcctggcacaggactga

SEQ ID NO: 2093265 - DNA, 14 bp, Homo sapiens
atggagcttgtaca

SEQ ID NO: 2093266 - DNA, 17 bp, Homo sapiens
atggagcttgtacatat

SEQ ID NO: 2093267 - DNA, 12 bp, Homo sapiens
atggaggagaaa

SEQ ID NO: 2093268 - DNA, 13 bp, Homo sapiens
atggaggagaaga

SEQ ID NO: 2093269 - DNA, 18 bp, Homo sapiens
atggaggcaggctccccc

SEQ ID NO: 2093270 - DNA, 19 bp, Homo sapiens
atggaggcaggctccccct

SEQ ID NO: 2093271 - DNA, 22 bp, Homo sapiens
atggaggcctcacacccagagg

SEQ ID NO: 2093272 - DNA, 16 bp, Homo sapiens
atggagggaataatac

SEQ ID NO: 2093273 - DNA, 12 bp, Homo sapiens
atggagggcaga

SEQ ID NO: 2093274 - DNA, 22 bp, Homo sapiens
atggagggcagagtgggctgcc

SEQ ID NO: 2093275 - DNA, 16 bp, Homo sapiens
atggagtgagcagtag

SEQ ID NO: 2093276 - DNA, 18 bp, Homo sapiens
atggataacctatatgat

SEQ ID NO: 2093277 - DNA, 13 bp, Homo sapiens
atggatgctgggg

SEQ ID NO: 2093278 - DNA, 15 bp, Homo sapiens
atggatgctggggag

SEQ ID NO: 2093279 - DNA, 20 bp, Homo sapiens
atggatggaaatatgttcta

SEQ ID NO: 2093280 - DNA, 13 bp, Homo sapiens
atggatggacaga

SEQ ID NO: 2093281 - DNA, 14 bp, Homo sapiens
atggatggacagaa

SEQ ID NO: 2093282 - DNA, 13 bp, Homo sapiens
atggatggggaga

SEQ ID NO: 2093283 - DNA, 14 bp, Homo sapiens
atggattatttatg

SEQ ID NO: 2093284 - DNA, 14 bp, Homo sapiens
atggattctaaaat

SEQ ID NO: 2093285 - DNA, 15 bp, Homo sapiens
atggattctaaaatg

SEQ ID NO: 2093286 - DNA, 20 bp, Homo sapiens
atggatttctgtcttctcta

SEQ ID NO: 2093287 - DNA, 15 bp, Homo sapiens
atggatttgaagcaa

SEQ ID NO: 2093288 - DNA, 13 bp, Homo sapiens
atggatttttaaa

SEQ ID NO: 2093289 - DNA, 22 bp, Homo sapiens
atggatttttaaattatactgt

SEQ ID NO: 2093290 - DNA, 24 bp, Homo sapiens
atggcaaagcggttgcttctggct

SEQ ID NO: 2093291 - DNA, 23 bp, Homo sapiens
atggcaagggggtgtcatctgag

SEQ ID NO: 2093292 - DNA, 21 bp, Homo sapiens
atggcaagtgatatcacctct

SEQ ID NO: 2093293 - DNA, 15 bp, Homo sapiens
atggcaattttgtaa

SEQ ID NO: 2093294 - DNA, 23 bp, Homo sapiens
atggcacagcccaaagaaggaaa

SEQ ID NO: 2093295 - DNA, 22 bp, Homo sapiens
atggcaccaacgggaccccctg

SEQ ID NO: 2093296 - DNA, 14 bp, Homo sapiens
atggcaccagaggc

SEQ ID NO: 2093297 - DNA, 17 bp, Homo sapiens
atggcaccagccccctg

SEQ ID NO: 2093298 - DNA, 18 bp, Homo sapiens
atggcaccagccccctgg

SEQ ID NO: 2093299 - DNA, 14 bp, Homo sapiens
atggcagatgtagg

SEQ ID NO: 2093300 - DNA, 19 bp, Homo sapiens
atggcagctagactggagt

SEQ ID NO: 2093301 - DNA, 20 bp, Homo sapiens
atggcagtccagccagctcc

SEQ ID NO: 2093302 - DNA, 24 bp, Homo sapiens
atggcatatttatattgtatattc

SEQ ID NO: 2093303 - DNA, 13 bp, Homo sapiens
atggccaagagca

SEQ ID NO: 2093304 - DNA, 20 bp, Homo sapiens
atggccaccccgtgccaccc

SEQ ID NO: 2093305 - DNA, 21 bp, Homo sapiens
atggccaccccgtgccacccg

SEQ ID NO: 2093306 - DNA, 13 bp, Homo sapiens
atggccccagggt

SEQ ID NO: 2093307 - DNA, 17 bp, Homo sapiens
atggccccagggttgaa

SEQ ID NO: 2093308 - DNA, 19 bp, Homo sapiens
atggccctagaactgtgcc

SEQ ID NO: 2093309 - DNA, 12 bp, Homo sapiens
atggccttccct

SEQ ID NO: 2093310 - DNA, 19 bp, Homo sapiens
atggcgcgggaggcaccag

SEQ ID NO: 2093311 - DNA, 17 bp, Homo sapiens
atggcgtaatgggcctg

SEQ ID NO: 2093312 - DNA, 12 bp, Homo sapiens
atggctcaggca

SEQ ID NO: 2093313 - DNA, 16 bp, Homo sapiens
atggctcaggcaagcc

SEQ ID NO: 2093314 - DNA, 18 bp, Homo sapiens
atggctgtaaactataaa

SEQ ID NO: 2093315 - DNA, 13 bp, Homo sapiens
atggctgtatttt

SEQ ID NO: 2093316 - DNA, 18 bp, Homo sapiens
atggctgtgcctctgcct

SEQ ID NO: 2093317 - DNA, 20 bp, Homo sapiens
atggctgtgcctctgcctgt

SEQ ID NO: 2093318 - DNA, 24 bp, Homo sapiens
atggcttagttaagtcatccacag

SEQ ID NO: 2093319 - DNA, 16 bp, Homo sapiens
atggcttataaatgtg

SEQ ID NO: 2093320 - DNA, 18 bp, Homo sapiens
atggcttggggagcagag

SEQ ID NO: 2093321 - DNA, 14 bp, Homo sapiens
atgggaaagcattg

SEQ ID NO: 2093322 - DNA, 23 bp, Homo sapiens
atgggaaaggaggcatgcctctg

SEQ ID NO: 2093323 - DNA, 15 bp, Homo sapiens
atgggaagatggtag

SEQ ID NO: 2093324 - DNA, 23 bp, Homo sapiens
atgggaattctttacaataaaca

SEQ ID NO: 2093325 - DNA, 12 bp, Homo sapiens
atgttttgtaca

SEQ ID NO: 2093326 - DNA, 13 bp, Homo sapiens
atgttttgttcaa

SEQ ID NO: 2093327 - DNA, 23 bp, Homo sapiens
atgtttttaaaagtttcaatgtg

SEQ ID NO: 2093328 - DNA, 13 bp, Homo sapiens
atgtttttaatgt

SEQ ID NO: 2093329 - DNA, 19 bp, Homo sapiens
atgtttttaatgtatagta

SEQ ID NO: 2093330 - DNA, 17 bp, Homo sapiens
atgtttttgtgtatttg

SEQ ID NO: 2093331 - DNA, 21 bp, Homo sapiens
atgtttttgttttctttgaat

SEQ ID NO: 2093332 - DNA, 23 bp, Homo sapiens
attaaaaaaaagaagagccttgt

SEQ ID NO: 2093333 - DNA, 13 bp, Homo sapiens
attaaaaaccact

SEQ ID NO: 2093334 - DNA, 15 bp, Homo sapiens
attaaaaagttaatc

SEQ ID NO: 2093335 - DNA, 14 bp, Homo sapiens
attaaaagaatttt

SEQ ID NO: 2093336 - DNA, 23 bp, Homo sapiens
attaaaatatatataaatatata

SEQ ID NO: 2093337 - DNA, 16 bp, Homo sapiens
attaaaattaaggtct

SEQ ID NO: 2093338 - DNA, 14 bp, Homo sapiens
attaaaattagtga

SEQ ID NO: 2093339 - DNA, 12 bp, Homo sapiens
attaaaggaagg

SEQ ID NO: 2093340 - DNA, 13 bp, Homo sapiens
attaaaggaagga

SEQ ID NO: 2093341 - DNA, 19 bp, Homo sapiens
attaaaggcttttggcagc

SEQ ID NO: 2093342 - DNA, 13 bp, Homo sapiens
attaaagtgccat

SEQ ID NO: 2093343 - DNA, 16 bp, Homo sapiens
attaaataaatatttt

SEQ ID NO: 2093344 - DNA, 21 bp, Homo sapiens
attaaataacagtgtgtgacc

SEQ ID NO: 2093345 - DNA, 12 bp, Homo sapiens
attaaatacaga

SEQ ID NO: 2093346 - DNA, 17 bp, Homo sapiens
attaaatacagacacta

SEQ ID NO: 2093347 - DNA, 20 bp, Homo sapiens
attaaatacagacactaagt

SEQ ID NO: 2093348 - DNA, 20 bp, Homo sapiens
attaaatatgttagcaaaga

SEQ ID NO: 2093349 - DNA, 14 bp, Homo sapiens
attaaatgtcttat

SEQ ID NO: 2093350 - DNA, 24 bp, Homo sapiens
attaaattatatctgaggcactga

SEQ ID NO: 2093351 - DNA, 20 bp, Homo sapiens
attaaattttctatgcttat

SEQ ID NO: 2093352 - DNA, 18 bp, Homo sapiens
attaacaaaagattctgt

SEQ ID NO: 2093353 - DNA, 22 bp, Homo sapiens
attaacatcatcaggcttggaa

SEQ ID NO: 2093354 - DNA, 16 bp, Homo sapiens
attaacgggcatgtat

SEQ ID NO: 2093355 - DNA, 17 bp, Homo sapiens
attaacgggcatgtatt

SEQ ID NO: 2093356 - DNA, 19 bp, Homo sapiens
attaactgggtaatgaaac

SEQ ID NO: 2093357 - DNA, 19 bp, Homo sapiens
attaacttttttagaatga

SEQ ID NO: 2093358 - DNA, 13 bp, Homo sapiens
attaagactttaa

SEQ ID NO: 2093359 - DNA, 15 bp, Homo sapiens
attaagagatacatt

SEQ ID NO: 2093360 - DNA, 19 bp, Homo sapiens
attaagagatacattccct

SEQ ID NO: 2093361 - DNA, 18 bp, Homo sapiens
attaagatacactcctgc

SEQ ID NO: 2093362 - DNA, 19 bp, Homo sapiens
attaagggaaaggaaaaga

SEQ ID NO: 2093363 - DNA, 23 bp, Homo sapiens
attaaggtctgggagtgttctgt

SEQ ID NO: 2093364 - DNA, 17 bp, Homo sapiens
attaagttattgatttt

SEQ ID NO: 2093365 - DNA, 20 bp, Homo sapiens
attaagttctcaatgtgaaa

SEQ ID NO: 2093366 - DNA, 22 bp, Homo sapiens
attaataaaaaatggaaagaat

SEQ ID NO: 2093367 - DNA, 19 bp, Homo sapiens
attaatagcttttattgta

SEQ ID NO: 2093368 - DNA, 20 bp, Homo sapiens
attaatatggggatgcagca

SEQ ID NO: 2093369 - DNA, 16 bp, Homo sapiens
attaatattcattgta

SEQ ID NO: 2093370 - DNA, 17 bp, Homo sapiens
attaatattcattgtat

SEQ ID NO: 2093371 - DNA, 16 bp, Homo sapiens
attaatattgtgctta

SEQ ID NO: 2093372 - DNA, 23 bp, Homo sapiens
attaatcaatcatctgtgtgaaa

SEQ ID NO: 2093373 - DNA, 16 bp, Homo sapiens
attaatcaccaaagta

SEQ ID NO: 2093374 - DNA, 16 bp, Homo sapiens
attaatcgtgtcttca

SEQ ID NO: 2093375 - DNA, 14 bp, Homo sapiens
attaatggcactga

SEQ ID NO: 2093376 - DNA, 12 bp, Homo sapiens
attaatgtgttg

SEQ ID NO: 2093377 - DNA, 18 bp, Homo sapiens
attaatgttaattcagca

SEQ ID NO: 2093378 - DNA, 16 bp, Homo sapiens
attaatgttttgtaca

SEQ ID NO: 2093379 - DNA, 20 bp, Homo sapiens
attaattagattttcttgca

SEQ ID NO: 2093380 - DNA, 14 bp, Homo sapiens
attaattatctgat

SEQ ID NO: 2093381 - DNA, 19 bp, Homo sapiens
attaattcaccttccagtg

SEQ ID NO: 2093382 - DNA, 11 bp, Homo sapiens
attaattcatt

SEQ ID NO: 2093383 - DNA, 15 bp, Homo sapiens
attaatttatggttt

SEQ ID NO: 2093384 - DNA, 22 bp, Homo sapiens
attacaagcgtgagccactgca

SEQ ID NO: 2093385 - DNA, 20 bp, Homo sapiens
attacactgtatttgtatct

SEQ ID NO: 2093386 - DNA, 15 bp, Homo sapiens
attacagaggaagtt

SEQ ID NO: 2093387 - DNA, 21 bp, Homo sapiens
attacaggccttttgactctt

SEQ ID NO: 2093388 - DNA, 17 bp, Homo sapiens
attacataatcaaagct

SEQ ID NO: 2093389 - DNA, 19 bp, Homo sapiens
attacataatcaaagctac

SEQ ID NO: 2093390 - DNA, 20 bp, Homo sapiens
attacatgtttaaattgtaa

SEQ ID NO: 2093391 - DNA, 22 bp, Homo sapiens
attacatgtttaaattgtaaat

SEQ ID NO: 2093392 - DNA, 14 bp, Homo sapiens
attacatttataca

SEQ ID NO: 2093393 - DNA, 18 bp, Homo sapiens
attacatttccaaatgaa

SEQ ID NO: 2093394 - DNA, 22 bp, Homo sapiens
attacatttccaaatgaatgac

SEQ ID NO: 2093395 - DNA, 19 bp, Homo sapiens
attaccaaaaaagtatttt

SEQ ID NO: 2093396 - DNA, 13 bp, Homo sapiens
attacctctgata

SEQ ID NO: 2093397 - DNA, 21 bp, Homo sapiens
attaccttagattagctctgg

SEQ ID NO: 2093398 - DNA, 14 bp, Homo sapiens
attacgtgagccag

SEQ ID NO: 2093399 - DNA, 18 bp, Homo sapiens
attactaaagacagaaaa

SEQ ID NO: 2093400 - DNA, 21 bp, Homo sapiens
attactacaaaatttgaaatt

SEQ ID NO: 2093401 - DNA, 13 bp, Homo sapiens
attactctttctc

SEQ ID NO: 2093402 - DNA, 16 bp, Homo sapiens
attactgcctttggaa

SEQ ID NO: 2093403 - DNA, 23 bp, Homo sapiens
attactgcctttggaagaaacag

SEQ ID NO: 2093404 - DNA, 13 bp, Homo sapiens
attacttcagggc

SEQ ID NO: 2093405 - DNA, 15 bp, Homo sapiens
attacttcagggctg

SEQ ID NO: 2093406 - DNA, 16 bp, Homo sapiens
attacttgaactttcc

SEQ ID NO: 2093407 - DNA, 14 bp, Homo sapiens
attacttgcacaag

SEQ ID NO: 2093408 - DNA, 18 bp, Homo sapiens
attacttgcacaagcttg

SEQ ID NO: 2093409 - DNA, 21 bp, Homo sapiens
attactttaaaataaaaaagt

SEQ ID NO: 2093410 - DNA, 16 bp, Homo sapiens
attagaaatagacagt

SEQ ID NO: 2093411 - DNA, 22 bp, Homo sapiens
attagaaatagacagtatattt

SEQ ID NO: 2093412 - DNA, 18 bp, Homo sapiens
attagaagtgttaactta

SEQ ID NO: 2093413 - DNA, 19 bp, Homo sapiens
attagactggacagcttgt

SEQ ID NO: 2093414 - DNA, 18 bp, Homo sapiens
attagcaaagaagcttca

SEQ ID NO: 2093415 - DNA, 15 bp, Homo sapiens
attagcacctctttt

SEQ ID NO: 2093416 - DNA, 22 bp, Homo sapiens
attagctgtgatttttgttgat

SEQ ID NO: 2093417 - DNA, 20 bp, Homo sapiens
attaggatctatgcaatttt

SEQ ID NO: 2093418 - DNA, 23 bp, Homo sapiens
attaggatctatgcaatttttaa

SEQ ID NO: 2093419 - DNA, 16 bp, Homo sapiens
attaggatttcatgat

SEQ ID NO: 2093420 - DNA, 19 bp, Homo sapiens
attaggatttgccccttcc

SEQ ID NO: 2093421 - DNA, 22 bp, Homo sapiens
attaggggttgctaagaagcga

SEQ ID NO: 2093422 - DNA, 18 bp, Homo sapiens
attaggttaacattgttg

SEQ ID NO: 2093423 - DNA, 21 bp, Homo sapiens
attaggttttgtacaattgaa

SEQ ID NO: 2093424 - DNA, 16 bp, Homo sapiens
attagtaattgtaagt

SEQ ID NO: 2093425 - DNA, 19 bp, Homo sapiens
attagtacacagcaccaga

SEQ ID NO: 2093426 - DNA, 21 bp, Homo sapiens
attagtacagtagcttaaata

SEQ ID NO: 2093427 - DNA, 14 bp, Homo sapiens
attagtatcctgtt

SEQ ID NO: 2093428 - DNA, 13 bp, Homo sapiens
attagtattcagg

SEQ ID NO: 2093429 - DNA, 17 bp, Homo sapiens
attagtattcaggcact

SEQ ID NO: 2093430 - DNA, 18 bp, Homo sapiens
attagtattcaggcactg

SEQ ID NO: 2093431 - DNA, 20 bp, Homo sapiens
attagtattcaggcactgag

SEQ ID NO: 2093432 - DNA, 16 bp, Homo sapiens
attagtccaaatgtga

SEQ ID NO: 2093433 - DNA, 13 bp, Homo sapiens
attataaaaccat

SEQ ID NO: 2093434 - DNA, 15 bp, Homo sapiens
attataaaattattt

SEQ ID NO: 2093435 - DNA, 15 bp, Homo sapiens
attataaataaatgc

SEQ ID NO: 2093436 - DNA, 18 bp, Homo sapiens
attataaataaatgccaa

SEQ ID NO: 2093437 - DNA, 19 bp, Homo sapiens
attataaataaatgccaac

SEQ ID NO: 2093438 - DNA, 18 bp, Homo sapiens
attataaatccaaagtaa

SEQ ID NO: 2093439 - DNA, 22 bp, Homo sapiens
attgtatagagatatgcagaag

SEQ ID NO: 2093440 - DNA, 13 bp, Homo sapiens
attgtatatatgt

SEQ ID NO: 2093441 - DNA, 18 bp, Homo sapiens
attgtatattctggaaaa

SEQ ID NO: 2093442 - DNA, 13 bp, Homo sapiens
attgtatgatgtg

SEQ ID NO: 2093443 - DNA, 14 bp, Homo sapiens
attgtatgatgtgt

SEQ ID NO: 2093444 - DNA, 15 bp, Homo sapiens
attgtatgatgtgtt

SEQ ID NO: 2093445 - DNA, 14 bp, Homo sapiens
attgtatgtaagta

SEQ ID NO: 2093446 - DNA, 22 bp, Homo sapiens
attgtattttatatgagagaat

SEQ ID NO: 2093447 - DNA, 17 bp, Homo sapiens
attgtcattactgcctt

SEQ ID NO: 2093448 - DNA, 20 bp, Homo sapiens
attgtcattactgcctttgg

SEQ ID NO: 2093449 - DNA, 12 bp, Homo sapiens
attgtccatatc

SEQ ID NO: 2093450 - DNA, 11 bp, Homo sapiens
attgtccatgt

SEQ ID NO: 2093451 - DNA, 16 bp, Homo sapiens
attgtccctgtttcaa

SEQ ID NO: 2093452 - DNA, 21 bp, Homo sapiens
attgtcctcccctattttaag

SEQ ID NO: 2093453 - DNA, 16 bp, Homo sapiens
attgtctatatggaat

SEQ ID NO: 2093454 - DNA, 16 bp, Homo sapiens
attgtcttaatattgt

SEQ ID NO: 2093455 - DNA, 16 bp, Homo sapiens
attgtcttccaacccc

SEQ ID NO: 2093456 - DNA, 21 bp, Homo sapiens
attgtcttccaaccccagctg

SEQ ID NO: 2093457 - DNA, 15 bp, Homo sapiens
attgtgaccaagtta

SEQ ID NO: 2093458 - DNA, 13 bp, Homo sapiens
attgtgatgtttt

SEQ ID NO: 2093459 - DNA, 15 bp, Homo sapiens
attgtgcaaatggaa

SEQ ID NO: 2093460 - DNA, 19 bp, Homo sapiens
attgtgccaatatgtattg

SEQ ID NO: 2093461 - DNA, 18 bp, Homo sapiens
attgtgccatgtcaaaca

SEQ ID NO: 2093462 - DNA, 21 bp, Homo sapiens
attgtgccatgtcaaacaaat

SEQ ID NO: 2093463 - DNA, 15 bp, Homo sapiens
attgtgcctatgata

SEQ ID NO: 2093464 - DNA, 13 bp, Homo sapiens
attgtgcttaaat

SEQ ID NO: 2093465 - DNA, 18 bp, Homo sapiens
attgtgggtaacgtgaga

SEQ ID NO: 2093466 - DNA, 22 bp, Homo sapiens
attgtgtacaaagtagagaagt

SEQ ID NO: 2093467 - DNA, 19 bp, Homo sapiens
attgtgtattatgttgttc

SEQ ID NO: 2093468 - DNA, 17 bp, Homo sapiens
attgtgtcagactgttt

SEQ ID NO: 2093469 - DNA, 17 bp, Homo sapiens
attgtgtcatattaaac

SEQ ID NO: 2093470 - DNA, 18 bp, Homo sapiens
attgtgttgccttagcac

SEQ ID NO: 2093471 - DNA, 13 bp, Homo sapiens
attgttaaaacct

SEQ ID NO: 2093472 - DNA, 15 bp, Homo sapiens
attgttacagaagct

SEQ ID NO: 2093473 - DNA, 16 bp, Homo sapiens
attgttaccatgaaga

SEQ ID NO: 2093474 - DNA, 16 bp, Homo sapiens
attgttcatgttacca

SEQ ID NO: 2093475 - DNA, 21 bp, Homo sapiens
attgttccttacctttacata

SEQ ID NO: 2093476 - DNA, 12 bp, Homo sapiens
attgttgcatta

SEQ ID NO: 2093477 - DNA, 14 bp, Homo sapiens
attgttgctccctg

SEQ ID NO: 2093478 - DNA, 16 bp, Homo sapiens
attgtttaaaaacagg

SEQ ID NO: 2093479 - DNA, 21 bp, Homo sapiens
attgtttaaaaacaggaaaaa

SEQ ID NO: 2093480 - DNA, 15 bp, Homo sapiens
attgtttaaaatcat

SEQ ID NO: 2093481 - DNA, 19 bp, Homo sapiens
attgtttaaaatcatttct

SEQ ID NO: 2093482 - DNA, 20 bp, Homo sapiens
attgtttgtctgtcttcata

SEQ ID NO: 2093483 - DNA, 20 bp, Homo sapiens
attgttttatggtgtgttcc

SEQ ID NO: 2093484 - DNA, 16 bp, Homo sapiens
attgttttatgttcta

SEQ ID NO: 2093485 - DNA, 22 bp, Homo sapiens
atttaaaaaactaaaaactaga

SEQ ID NO: 2093486 - DNA, 11 bp, Homo sapiens
atttaaaaaat

SEQ ID NO: 2093487 - DNA, 17 bp, Homo sapiens
atttaaaaaataaaaaa

SEQ ID NO: 2093488 - DNA, 17 bp, Homo sapiens
atttaaaaaataaatat

SEQ ID NO: 2093489 - DNA, 18 bp, Homo sapiens
atttaaaaaataaatata

SEQ ID NO: 2093490 - DNA, 14 bp, Homo sapiens
atttaaaaataaag

SEQ ID NO: 2093491 - DNA, 13 bp, Homo sapiens
atttaaaatagca

SEQ ID NO: 2093492 - DNA, 20 bp, Homo sapiens
atttaaaatagcaaaagaag

SEQ ID NO: 2093493 - DNA, 23 bp, Homo sapiens
atttaaaatagcaaaagaagaag

SEQ ID NO: 2093494 - DNA, 14 bp, Homo sapiens
atttaaacagcagt

SEQ ID NO: 2093495 - DNA, 15 bp, Homo sapiens
atttaaacagcagtg

SEQ ID NO: 2093496 - DNA, 13 bp, Homo sapiens
atttaaaccagca

SEQ ID NO: 2093497 - DNA, 16 bp, Homo sapiens
atttaaaccagcagaa

SEQ ID NO: 2093498 - DNA, 21 bp, Homo sapiens
atttaaaccagcagaaaagtg

SEQ ID NO: 2093499 - DNA, 19 bp, Homo sapiens
atttaaatgttgaaatctt

SEQ ID NO: 2093500 - DNA, 13 bp, Homo sapiens
atttaacaagatc

SEQ ID NO: 2093501 - DNA, 15 bp, Homo sapiens
atttaacactaaaaa

SEQ ID NO: 2093502 - DNA, 15 bp, Homo sapiens
atttaacagtcattt

SEQ ID NO: 2093503 - DNA, 17 bp, Homo sapiens
atttaacagtcatttaa

SEQ ID NO: 2093504 - DNA, 22 bp, Homo sapiens
atttaacatgcaacccgaaggt

SEQ ID NO: 2093505 - DNA, 18 bp, Homo sapiens
atttaacttgagggtaat

SEQ ID NO: 2093506 - DNA, 20 bp, Homo sapiens
atttaacttgagggtaataa

SEQ ID NO: 2093507 - DNA, 21 bp, Homo sapiens
atttaacttgagggtaataaa

SEQ ID NO: 2093508 - DNA, 21 bp, Homo sapiens
atttaacttttagtaaagtca

SEQ ID NO: 2093509 - DNA, 23 bp, Homo sapiens
atttaacttttagtaaagtcaag

SEQ ID NO: 2093510 - DNA, 13 bp, Homo sapiens
atttaagcatttt

SEQ ID NO: 2093511 - DNA, 19 bp, Homo sapiens
atttaagcctcatatttaa

SEQ ID NO: 2093512 - DNA, 15 bp, Homo sapiens
atttaagggaaaaat

SEQ ID NO: 2093513 - DNA, 14 bp, Homo sapiens
atttaagtatatag

SEQ ID NO: 2093514 - DNA, 21 bp, Homo sapiens
atttaagtatatagtatattt

SEQ ID NO: 2093515 - DNA, 21 bp, Homo sapiens
atttaagtttgttgctgtcaa

SEQ ID NO: 2093516 - DNA, 15 bp, Homo sapiens
atttaatacctttgg

SEQ ID NO: 2093517 - DNA, 18 bp, Homo sapiens
atttaatagcaaagaatt

SEQ ID NO: 2093518 - DNA, 13 bp, Homo sapiens
atttaatatctga

SEQ ID NO: 2093519 - DNA, 13 bp, Homo sapiens
atttaattaaaaa

SEQ ID NO: 2093520 - DNA, 15 bp, Homo sapiens
atttaattcataatt

SEQ ID NO: 2093521 - DNA, 14 bp, Homo sapiens
atttaattcttatt

SEQ ID NO: 2093522 - DNA, 18 bp, Homo sapiens
atttaatttttacatgac

SEQ ID NO: 2093523 - DNA, 16 bp, Homo sapiens
atttacatatgaaatt

SEQ ID NO: 2093524 - DNA, 18 bp, Homo sapiens
atttacatgaattgcatt

SEQ ID NO: 2093525 - DNA, 21 bp, Homo sapiens
atttaccacagcagctgaaca

SEQ ID NO: 2093526 - DNA, 18 bp, Homo sapiens
atttaccagggatgtaga

SEQ ID NO: 2093527 - DNA, 13 bp, Homo sapiens
atttactaaaaga

SEQ ID NO: 2093528 - DNA, 21 bp, Homo sapiens
atttactaagccacaagaaat

SEQ ID NO: 2093529 - DNA, 22 bp, Homo sapiens
atttactcattcatttattcat

SEQ ID NO: 2093530 - DNA, 19 bp, Homo sapiens
atttacttaatgggtacaa

SEQ ID NO: 2093531 - DNA, 14 bp, Homo sapiens
atttacttgtagaa

SEQ ID NO: 2093532 - DNA, 19 bp, Homo sapiens
atttacttgtagaaatctg

SEQ ID NO: 2093533 - DNA, 14 bp, Homo sapiens
atttagaaaacttt

SEQ ID NO: 2093534 - DNA, 22 bp, Homo sapiens
atttagagatgaattaaattta

SEQ ID NO: 2093535 - DNA, 23 bp, Homo sapiens
atttaggtttttgtttgtttcct

SEQ ID NO: 2093536 - DNA, 16 bp, Homo sapiens
atttagttatagtttc

SEQ ID NO: 2093537 - DNA, 12 bp, Homo sapiens
atttagttcttt

SEQ ID NO: 2093538 - DNA, 17 bp, Homo sapiens
atttagttctttgttat

SEQ ID NO: 2093539 - DNA, 19 bp, Homo sapiens
atttagttttatggcatga

SEQ ID NO: 2093540 - DNA, 19 bp, Homo sapiens
atttataaaattagaaagc

SEQ ID NO: 2093541 - DNA, 18 bp, Homo sapiens
atttataaactagatctc

SEQ ID NO: 2093542 - DNA, 19 bp, Homo sapiens
atttataaactagatctcc

SEQ ID NO: 2093543 - DNA, 22 bp, Homo sapiens
atttataaatatatttaagata

SEQ ID NO: 2093544 - DNA, 14 bp, Homo sapiens
atttataactcatc

SEQ ID NO: 2093545 - DNA, 17 bp, Homo sapiens
atttataactcatcata

SEQ ID NO: 2093546 - DNA, 15 bp, Homo sapiens
atttatacaaaataa

SEQ ID NO: 2093547 - DNA, 12 bp, Homo sapiens
atttatagtttg

SEQ ID NO: 2093548 - DNA, 17 bp, Homo sapiens
atttatatatatatgta

SEQ ID NO: 2093549 - DNA, 18 bp, Homo sapiens
atttatatatcagttata

SEQ ID NO: 2093550 - DNA, 16 bp, Homo sapiens
atttatatatgaagta

SEQ ID NO: 2093551 - DNA, 16 bp, Homo sapiens
atttatatatggcata

SEQ ID NO: 2093552 - DNA, 15 bp, Homo sapiens
atttatatatgtatt

SEQ ID NO: 2093553 - DNA, 15 bp, Homo sapiens
atttatatatttata

SEQ ID NO: 2093554 - DNA, 14 bp, Homo sapiens
caaaaaccagcagg

SEQ ID NO: 2093555 - DNA, 18 bp, Homo sapiens
caaaaagacagtgtgtgt

SEQ ID NO: 2093556 - DNA, 22 bp, Homo sapiens
caaaaagctcttacactacatt

SEQ ID NO: 2093557 - DNA, 18 bp, Homo sapiens
caaaaaggaccaactggc

SEQ ID NO: 2093558 - DNA, 22 bp, Homo sapiens
caaaaaggctagtttattttgt

SEQ ID NO: 2093559 - DNA, 17 bp, Homo sapiens
caaaaagtgtttatttt

SEQ ID NO: 2093560 - DNA, 12 bp, Homo sapiens
caaaaataaact

SEQ ID NO: 2093561 - DNA, 13 bp, Homo sapiens
caaaaataaacta

SEQ ID NO: 2093562 - DNA, 19 bp, Homo sapiens
caaaaatgaaagcatgtct

SEQ ID NO: 2093563 - DNA, 19 bp, Homo sapiens
caaaaatggtggtttgtca

SEQ ID NO: 2093564 - DNA, 20 bp, Homo sapiens
caaaaatggtggtttgtcat

SEQ ID NO: 2093565 - DNA, 21 bp, Homo sapiens
caaaaatggtggtttgtcata

SEQ ID NO: 2093566 - DNA, 17 bp, Homo sapiens
caaaaattacactacaa

SEQ ID NO: 2093567 - DNA, 14 bp, Homo sapiens
caaaacaaaacaac

SEQ ID NO: 2093568 - DNA, 17 bp, Homo sapiens
caaaacaaaacaacaac

SEQ ID NO: 2093569 - DNA, 18 bp, Homo sapiens
caaaacaaaacaacaaca

SEQ ID NO: 2093570 - DNA, 14 bp, Homo sapiens
caaaacaagaaaga

SEQ ID NO: 2093571 - DNA, 17 bp, Homo sapiens
caaaacaagaaagaaac

SEQ ID NO: 2093572 - DNA, 19 bp, Homo sapiens
caaaacaagaaagaaacgt

SEQ ID NO: 2093573 - DNA, 15 bp, Homo sapiens
caaaacatatcaatt

SEQ ID NO: 2093574 - DNA, 18 bp, Homo sapiens
caaaacatatcaattcaa

SEQ ID NO: 2093575 - DNA, 13 bp, Homo sapiens
caaaaccagctgc

SEQ ID NO: 2093576 - DNA, 14 bp, Homo sapiens
caaaaccagctgct

SEQ ID NO: 2093577 - DNA, 18 bp, Homo sapiens
caaaacctgatgttaaaa

SEQ ID NO: 2093578 - DNA, 16 bp, Homo sapiens
caaaacttcctgtttg

SEQ ID NO: 2093579 - DNA, 21 bp, Homo sapiens
caaaagaaaaaaaaaagcacc

SEQ ID NO: 2093580 - DNA, 20 bp, Homo sapiens
caaaagaagaagtttcatca

SEQ ID NO: 2093581 - DNA, 21 bp, Homo sapiens
caaaagacatgttgtaaatta

SEQ ID NO: 2093582 - DNA, 16 bp, Homo sapiens
caaaagcaagactgtt

SEQ ID NO: 2093583 - DNA, 14 bp, Homo sapiens
caaaagcacccttg

SEQ ID NO: 2093584 - DNA, 15 bp, Homo sapiens
caaaagccaaaaggt

SEQ ID NO: 2093585 - DNA, 11 bp, Homo sapiens
caaaagcctgg

SEQ ID NO: 2093586 - DNA, 15 bp, Homo sapiens
caaaagctgcttgac

SEQ ID NO: 2093587 - DNA, 22 bp, Homo sapiens
caaaagctgcttgactatcaca

SEQ ID NO: 2093588 - DNA, 12 bp, Homo sapiens
caaaagggcagc

SEQ ID NO: 2093589 - DNA, 18 bp, Homo sapiens
caaaagggcagccagggg

SEQ ID NO: 2093590 - DNA, 19 bp, Homo sapiens
caaaagggcagccaggggc

SEQ ID NO: 2093591 - DNA, 15 bp, Homo sapiens
caaaaggtgcctgtg

SEQ ID NO: 2093592 - DNA, 17 bp, Homo sapiens
caaaagtgatctgtccc

SEQ ID NO: 2093593 - DNA, 19 bp, Homo sapiens
caaaagttacatgtttgca

SEQ ID NO: 2093594 - DNA, 14 bp, Homo sapiens
caaaagtttctctt

SEQ ID NO: 2093595 - DNA, 15 bp, Homo sapiens
caaaagttttcctga

SEQ ID NO: 2093596 - DNA, 17 bp, Homo sapiens
caaaagttttcctgaga

SEQ ID NO: 2093597 - DNA, 18 bp, Homo sapiens
caaaataaaattatggtg

SEQ ID NO: 2093598 - DNA, 14 bp, Homo sapiens
caaaataaatgttg

SEQ ID NO: 2093599 - DNA, 18 bp, Homo sapiens
caaaataaattgaaatat

SEQ ID NO: 2093600 - DNA, 20 bp, Homo sapiens
caaaataaggggcacctggg

SEQ ID NO: 2093601 - DNA, 11 bp, Homo sapiens
caaaataattt

SEQ ID NO: 2093602 - DNA, 16 bp, Homo sapiens
caaaataatttaacta

SEQ ID NO: 2093603 - DNA, 19 bp, Homo sapiens
caaaataatttaactaatt

SEQ ID NO: 2093604 - DNA, 13 bp, Homo sapiens
caaaatagagaat

SEQ ID NO: 2093605 - DNA, 23 bp, Homo sapiens
caaaatatataatggtttactgc

SEQ ID NO: 2093606 - DNA, 21 bp, Homo sapiens
caaaatcacaagcaataatta

SEQ ID NO: 2093607 - DNA, 20 bp, Homo sapiens
caaaatccttgcttatgaca

SEQ ID NO: 2093608 - DNA, 18 bp, Homo sapiens
caaaatcgattggcttta

SEQ ID NO: 2093609 - DNA, 17 bp, Homo sapiens
caaaatgacaaggggag

SEQ ID NO: 2093610 - DNA, 11 bp, Homo sapiens
caaaatgcaag

SEQ ID NO: 2093611 - DNA, 20 bp, Homo sapiens
caaaattataagaagaggaa

SEQ ID NO: 2093612 - DNA, 21 bp, Homo sapiens
caaaatttcaaaagtgatctg

SEQ ID NO: 2093613 - DNA, 18 bp, Homo sapiens
caaaatttccagtacctt

SEQ ID NO: 2093614 - DNA, 19 bp, Homo sapiens
caaaatttccagtaccttt

SEQ ID NO: 2093615 - DNA, 21 bp, Homo sapiens
caaaatttctttttttaaatt

SEQ ID NO: 2093616 - DNA, 23 bp, Homo sapiens
caaaattttatagctcagtttat

SEQ ID NO: 2093617 - DNA, 14 bp, Homo sapiens
caaacaagcacaga

SEQ ID NO: 2093618 - DNA, 17 bp, Homo sapiens
caaacacactgtaaata

SEQ ID NO: 2093619 - DNA, 18 bp, Homo sapiens
caaacaccaacataaaaa

SEQ ID NO: 2093620 - DNA, 19 bp, Homo sapiens
caaacactgaatcatgtta

SEQ ID NO: 2093621 - DNA, 15 bp, Homo sapiens
caaacactgtgtatt

SEQ ID NO: 2093622 - DNA, 12 bp, Homo sapiens
caaacatgaagt

SEQ ID NO: 2093623 - DNA, 16 bp, Homo sapiens
caaacatgagtgaata

SEQ ID NO: 2093624 - DNA, 22 bp, Homo sapiens
caaacatgtggcaacctgttct

SEQ ID NO: 2093625 - DNA, 18 bp, Homo sapiens
caaacatgtggttaatgc

SEQ ID NO: 2093626 - DNA, 15 bp, Homo sapiens
caaaccacaactgac

SEQ ID NO: 2093627 - DNA, 16 bp, Homo sapiens
caaaccactgtacata

SEQ ID NO: 2093628 - DNA, 17 bp, Homo sapiens
caaaccactgtacatat

SEQ ID NO: 2093629 - DNA, 18 bp, Homo sapiens
caaaccactgtacatata

SEQ ID NO: 2093630 - DNA, 12 bp, Homo sapiens
caaaccagggtg

SEQ ID NO: 2093631 - DNA, 13 bp, Homo sapiens
caaaccagggtgc

SEQ ID NO: 2093632 - DNA, 14 bp, Homo sapiens
caaaccatttcaaa

SEQ ID NO: 2093633 - DNA, 16 bp, Homo sapiens
caaaccatttcaaatg

SEQ ID NO: 2093634 - DNA, 13 bp, Homo sapiens
caaacccatgagg

SEQ ID NO: 2093635 - DNA, 17 bp, Homo sapiens
caaactacagaataatg

SEQ ID NO: 2093636 - DNA, 16 bp, Homo sapiens
caaactacatgtaatc

SEQ ID NO: 2093637 - DNA, 16 bp, Homo sapiens
caaactattgggaggg

SEQ ID NO: 2093638 - DNA, 15 bp, Homo sapiens
caaactcaaggtcaa

SEQ ID NO: 2093639 - DNA, 19 bp, Homo sapiens
caaactcactgctcaagaa

SEQ ID NO: 2093640 - DNA, 15 bp, Homo sapiens
caaactcctgcctgt

SEQ ID NO: 2093641 - DNA, 17 bp, Homo sapiens
caaactcttgacctcag

SEQ ID NO: 2093642 - DNA, 20 bp, Homo sapiens
caaactcttgacctcaggtg

SEQ ID NO: 2093643 - DNA, 21 bp, Homo sapiens
caaactcttgacctcaggtga

SEQ ID NO: 2093644 - DNA, 15 bp, Homo sapiens
caaactgaagccaga

SEQ ID NO: 2093645 - DNA, 23 bp, Homo sapiens
caaactgagtaaattggaaacat

SEQ ID NO: 2093646 - DNA, 21 bp, Homo sapiens
caaactgcacacacagctcct

SEQ ID NO: 2093647 - DNA, 13 bp, Homo sapiens
caaactgctccaa

SEQ ID NO: 2093648 - DNA, 17 bp, Homo sapiens
caaactggggcctccct

SEQ ID NO: 2093649 - DNA, 14 bp, Homo sapiens
caaactgtgccctg

SEQ ID NO: 2093650 - DNA, 20 bp, Homo sapiens
caaactgtgccctgccttca

SEQ ID NO: 2093651 - DNA, 21 bp, Homo sapiens
caaactgtgccctgccttcag

SEQ ID NO: 2093652 - DNA, 16 bp, Homo sapiens
caaacttctaaatgtt

SEQ ID NO: 2093653 - DNA, 14 bp, Homo sapiens
caaactttaaattc

SEQ ID NO: 2093654 - DNA, 23 bp, Homo sapiens
caaagaaatccccccttcagaac

SEQ ID NO: 2093655 - DNA, 14 bp, Homo sapiens
caaagaaatgtaag

SEQ ID NO: 2093656 - DNA, 16 bp, Homo sapiens
caaagaacaagaaatt

SEQ ID NO: 2093657 - DNA, 19 bp, Homo sapiens
caaagaacggcatgtgaat

SEQ ID NO: 2093658 - DNA, 21 bp, Homo sapiens
caaagaacggcatgtgaattc

SEQ ID NO: 2093659 - DNA, 20 bp, Homo sapiens
caaagaactgccccatctcc

SEQ ID NO: 2093660 - DNA, 14 bp, Homo sapiens
caaagaagcttcat

SEQ ID NO: 2093661 - DNA, 13 bp, Homo sapiens
caaagaagtcatg

SEQ ID NO: 2093662 - DNA, 22 bp, Homo sapiens
caaagaattcctgaagccagat

SEQ ID NO: 2093663 - DNA, 15 bp, Homo sapiens
caaagagaataaaga

SEQ ID NO: 2093664 - DNA, 19 bp, Homo sapiens
caaagaggcctttaaccat

SEQ ID NO: 2093665 - DNA, 13 bp, Homo sapiens
caaagaggtattt

SEQ ID NO: 2093666 - DNA, 22 bp, Homo sapiens
caaagagtgggctgcatctggg

SEQ ID NO: 2093667 - DNA, 20 bp, Homo sapiens
caaagatatgctaagcagta

SEQ ID NO: 2093668 - DNA, 14 bp, Homo sapiens
caaagcaaaagaag

SEQ ID NO: 2093669 - DNA, 20 bp, Homo sapiens
caagccatggtgacacacag

SEQ ID NO: 2093670 - DNA, 21 bp, Homo sapiens
caagccattttttgaggagag

SEQ ID NO: 2093671 - DNA, 15 bp, Homo sapiens
caagcccaggctgga

SEQ ID NO: 2093672 - DNA, 14 bp, Homo sapiens
caagccccagggcc

SEQ ID NO: 2093673 - DNA, 16 bp, Homo sapiens
caagccccagggcctg

SEQ ID NO: 2093674 - DNA, 18 bp, Homo sapiens
caagccccagggcctggg

SEQ ID NO: 2093675 - DNA, 19 bp, Homo sapiens
caagccccagggcctgggg

SEQ ID NO: 2093676 - DNA, 15 bp, Homo sapiens
caagccctggcaaca

SEQ ID NO: 2093677 - DNA, 12 bp, Homo sapiens
caagcctctgcc

SEQ ID NO: 2093678 - DNA, 20 bp, Homo sapiens
caagcctctgccccaagggg

SEQ ID NO: 2093679 - DNA, 17 bp, Homo sapiens
caagcctggtctcctcc

SEQ ID NO: 2093680 - DNA, 19 bp, Homo sapiens
caagcctggtctcctccca

SEQ ID NO: 2093681 - DNA, 13 bp, Homo sapiens
caagcctgtggga

SEQ ID NO: 2093682 - DNA, 14 bp, Homo sapiens
caagcctgtgggag

SEQ ID NO: 2093683 - DNA, 17 bp, Homo sapiens
caagccttactcacctc

SEQ ID NO: 2093684 - DNA, 17 bp, Homo sapiens
caagcgaggtcaacaga

SEQ ID NO: 2093685 - DNA, 20 bp, Homo sapiens
caagcgaggtcaacagagaa

SEQ ID NO: 2093686 - DNA, 18 bp, Homo sapiens
caagcgattctcatgtct

SEQ ID NO: 2093687 - DNA, 18 bp, Homo sapiens
caagcgattcttctgctt

SEQ ID NO: 2093688 - DNA, 22 bp, Homo sapiens
caagcgattcttctgcttcagc

SEQ ID NO: 2093689 - DNA, 16 bp, Homo sapiens
caagcgcagggaggat

SEQ ID NO: 2093690 - DNA, 20 bp, Homo sapiens
caagcgcagggaggatgcca

SEQ ID NO: 2093691 - DNA, 21 bp, Homo sapiens
caagcgcagggaggatgccac

SEQ ID NO: 2093692 - DNA, 17 bp, Homo sapiens
caagcgtgagccactgc

SEQ ID NO: 2093693 - DNA, 18 bp, Homo sapiens
caagctagaaggccacat

SEQ ID NO: 2093694 - DNA, 15 bp, Homo sapiens
caagctagccagagg

SEQ ID NO: 2093695 - DNA, 14 bp, Homo sapiens
caagctctgctcct

SEQ ID NO: 2093696 - DNA, 13 bp, Homo sapiens
caagctcttcctt

SEQ ID NO: 2093697 - DNA, 18 bp, Homo sapiens
caagctgaagtgaaggag

SEQ ID NO: 2093698 - DNA, 21 bp, Homo sapiens
caagctgaagtgaaggagaaa

SEQ ID NO: 2093699 - DNA, 18 bp, Homo sapiens
caagctgaggtgcccagg

SEQ ID NO: 2093700 - DNA, 13 bp, Homo sapiens
caagctggaagca

SEQ ID NO: 2093701 - DNA, 14 bp, Homo sapiens
caagctggaagcac

SEQ ID NO: 2093702 - DNA, 18 bp, Homo sapiens
caagctggaagcacatgt

SEQ ID NO: 2093703 - DNA, 21 bp, Homo sapiens
caagctggtcccactcagtcc

SEQ ID NO: 2093704 - DNA, 22 bp, Homo sapiens
caagctggtcccactcagtcca

SEQ ID NO: 2093705 - DNA, 17 bp, Homo sapiens
caagcttcaagtgatat

SEQ ID NO: 2093706 - DNA, 19 bp, Homo sapiens
caagcttcaagtgatatat

SEQ ID NO: 2093707 - DNA, 14 bp, Homo sapiens
caagcttcagagcc

SEQ ID NO: 2093708 - DNA, 15 bp, Homo sapiens
caagcttcagagcct

SEQ ID NO: 2093709 - DNA, 16 bp, Homo sapiens
caagcttcagagccta

SEQ ID NO: 2093710 - DNA, 18 bp, Homo sapiens
caagcttcagagcctagc

SEQ ID NO: 2093711 - DNA, 20 bp, Homo sapiens
caagcttcagagcctagcca

SEQ ID NO: 2093712 - DNA, 22 bp, Homo sapiens
caagcttcagagcctagccacc

SEQ ID NO: 2093713 - DNA, 19 bp, Homo sapiens
caagcttgtatatacatat

SEQ ID NO: 2093714 - DNA, 22 bp, Homo sapiens
caagcttgtatatacatattat

SEQ ID NO: 2093715 - DNA, 19 bp, Homo sapiens
caagctttcttctacaacc

SEQ ID NO: 2093716 - DNA, 21 bp, Homo sapiens
caagctttcttctacaaccag

SEQ ID NO: 2093717 - DNA, 22 bp, Homo sapiens
caagctttcttctacaaccaga

SEQ ID NO: 2093718 - DNA, 23 bp, Homo sapiens
caagctttcttctacaaccagag

SEQ ID NO: 2093719 - DNA, 17 bp, Homo sapiens
caaggaaagccccagca

SEQ ID NO: 2093720 - DNA, 17 bp, Homo sapiens
caaggaacaagagaaaa

SEQ ID NO: 2093721 - DNA, 17 bp, Homo sapiens
caaggaacctaattgaa

SEQ ID NO: 2093722 - DNA, 23 bp, Homo sapiens
caaggaacctaattgaaatttaa

SEQ ID NO: 2093723 - DNA, 23 bp, Homo sapiens
caaggaaggaaagaaagaaggaa

SEQ ID NO: 2093724 - DNA, 19 bp, Homo sapiens
caaggaagggtgggaagct

SEQ ID NO: 2093725 - DNA, 17 bp, Homo sapiens
caaggacaacctgcccc

SEQ ID NO: 2093726 - DNA, 23 bp, Homo sapiens
caaggacaacctgcccctcccca

SEQ ID NO: 2093727 - DNA, 19 bp, Homo sapiens
caaggaccctgttttccac

SEQ ID NO: 2093728 - DNA, 12 bp, Homo sapiens
caaggactctgg

SEQ ID NO: 2093729 - DNA, 15 bp, Homo sapiens
caaggactgcaggga

SEQ ID NO: 2093730 - DNA, 14 bp, Homo sapiens
caaggactttccag

SEQ ID NO: 2093731 - DNA, 18 bp, Homo sapiens
caaggactttccagtgag

SEQ ID NO: 2093732 - DNA, 14 bp, Homo sapiens
caaggaggaaaaac

SEQ ID NO: 2093733 - DNA, 15 bp, Homo sapiens
caaggattgctactg

SEQ ID NO: 2093734 - DNA, 15 bp, Homo sapiens
caaggcagcaaggcc

SEQ ID NO: 2093735 - DNA, 19 bp, Homo sapiens
caaggcagcaaggcccgag

SEQ ID NO: 2093736 - DNA, 12 bp, Homo sapiens
caaggcagcctc

SEQ ID NO: 2093737 - DNA, 13 bp, Homo sapiens
caaggcagcctcc

SEQ ID NO: 2093738 - DNA, 20 bp, Homo sapiens
caaggcagcctccagagcca

SEQ ID NO: 2093739 - DNA, 13 bp, Homo sapiens
caaggcccagcta

SEQ ID NO: 2093740 - DNA, 19 bp, Homo sapiens
caaggcccgagcagctgag

SEQ ID NO: 2093741 - DNA, 20 bp, Homo sapiens
caaggcccgagcagctgagc

SEQ ID NO: 2093742 - DNA, 20 bp, Homo sapiens
caaggccctctatttctctc

SEQ ID NO: 2093743 - DNA, 11 bp, Homo sapiens
caaggccctgt

SEQ ID NO: 2093744 - DNA, 12 bp, Homo sapiens
caaggccctgtc

SEQ ID NO: 2093745 - DNA, 14 bp, Homo sapiens
caaggccctgtccc

SEQ ID NO: 2093746 - DNA, 19 bp, Homo sapiens
caaggccctgtcccagcag

SEQ ID NO: 2093747 - DNA, 22 bp, Homo sapiens
caaggctcttctccttggagga

SEQ ID NO: 2093748 - DNA, 23 bp, Homo sapiens
caaggctcttctccttggaggac

SEQ ID NO: 2093749 - DNA, 21 bp, Homo sapiens
caaggctgaccaagagagaaa

SEQ ID NO: 2093750 - DNA, 23 bp, Homo sapiens
caaggctgaccaagagagaaaga

SEQ ID NO: 2093751 - DNA, 16 bp, Homo sapiens
caaggcttaaaagagt

SEQ ID NO: 2093752 - DNA, 20 bp, Homo sapiens
caagggaagaaacactctta

SEQ ID NO: 2093753 - DNA, 19 bp, Homo sapiens
caagggacaaccccatcat

SEQ ID NO: 2093754 - DNA, 15 bp, Homo sapiens
caagggagaagaaat

SEQ ID NO: 2093755 - DNA, 16 bp, Homo sapiens
caagggcatcaggcac

SEQ ID NO: 2093756 - DNA, 14 bp, Homo sapiens
caagggctccagca

SEQ ID NO: 2093757 - DNA, 21 bp, Homo sapiens
caaggggaatgtttgcctctg

SEQ ID NO: 2093758 - DNA, 17 bp, Homo sapiens
caaggggagggccagga

SEQ ID NO: 2093759 - DNA, 19 bp, Homo sapiens
caagggtatgggaagccat

SEQ ID NO: 2093760 - DNA, 13 bp, Homo sapiens
caagggtccagaa

SEQ ID NO: 2093761 - DNA, 21 bp, Homo sapiens
caaggtctccttactctgagc

SEQ ID NO: 2093762 - DNA, 14 bp, Homo sapiens
caaggtctgctttt

SEQ ID NO: 2093763 - DNA, 14 bp, Homo sapiens
caaggtctttggtt

SEQ ID NO: 2093764 - DNA, 19 bp, Homo sapiens
caaggtggccaaattattt

SEQ ID NO: 2093765 - DNA, 17 bp, Homo sapiens
caaggtgggctgagccc

SEQ ID NO: 2093766 - DNA, 19 bp, Homo sapiens
caaggtgggctgagccctg

SEQ ID NO: 2093767 - DNA, 23 bp, Homo sapiens
caaggtgggctgagccctggcag

SEQ ID NO: 2093768 - DNA, 21 bp, Homo sapiens
caaggtgggtggatcacctga

SEQ ID NO: 2093769 - DNA, 15 bp, Homo sapiens
caaggttccctctga

SEQ ID NO: 2093770 - DNA, 16 bp, Homo sapiens
caaggttccctctgag

SEQ ID NO: 2093771 - DNA, 18 bp, Homo sapiens
caaggttccctctgagaa

SEQ ID NO: 2093772 - DNA, 17 bp, Homo sapiens
caaggttttggagtcag

SEQ ID NO: 2093773 - DNA, 17 bp, Homo sapiens
caagtataaagtcagga

SEQ ID NO: 2093774 - DNA, 21 bp, Homo sapiens
caagtatgaataaagacacct

SEQ ID NO: 2093775 - DNA, 16 bp, Homo sapiens
caagtcacagctgcag

SEQ ID NO: 2093776 - DNA, 12 bp, Homo sapiens
caagtcatttta

SEQ ID NO: 2093777 - DNA, 13 bp, Homo sapiens
caagtccagagcc

SEQ ID NO: 2093778 - DNA, 14 bp, Homo sapiens
caagtccagagccg

SEQ ID NO: 2093779 - DNA, 13 bp, Homo sapiens
caagtccaggtcc

SEQ ID NO: 2093780 - DNA, 17 bp, Homo sapiens
caagtccaggtcctggt

SEQ ID NO: 2093781 - DNA, 24 bp, Homo sapiens
caagtccaggtcctggtggggcag

SEQ ID NO: 2093782 - DNA, 18 bp, Homo sapiens
caagtccctgactctctg

SEQ ID NO: 2093783 - DNA, 18 bp, Homo sapiens
cacaactgacacaggaaa

SEQ ID NO: 2093784 - DNA, 22 bp, Homo sapiens
cacaagattcccagagacagga

SEQ ID NO: 2093785 - DNA, 17 bp, Homo sapiens
cacaagcacaaagctca

SEQ ID NO: 2093786 - DNA, 12 bp, Homo sapiens
cacaagccacag

SEQ ID NO: 2093787 - DNA, 13 bp, Homo sapiens
cacaagctggaag

SEQ ID NO: 2093788 - DNA, 14 bp, Homo sapiens
cacaagctggaagc

SEQ ID NO: 2093789 - DNA, 16 bp, Homo sapiens
cacaagcttgtatata

SEQ ID NO: 2093790 - DNA, 20 bp, Homo sapiens
cacaagcttgtatatacata

SEQ ID NO: 2093791 - DNA, 21 bp, Homo sapiens
cacaagcttgtatatacatat

SEQ ID NO: 2093792 - DNA, 15 bp, Homo sapiens
cacaaggcagcaagg

SEQ ID NO: 2093793 - DNA, 14 bp, Homo sapiens
cacaaggctgacca

SEQ ID NO: 2093794 - DNA, 21 bp, Homo sapiens
cacaaggctgaccaagagaga

SEQ ID NO: 2093795 - DNA, 24 bp, Homo sapiens
cacaaggctgggcacctctagtgc

SEQ ID NO: 2093796 - DNA, 17 bp, Homo sapiens
cacaaggtgcaaatcaa

SEQ ID NO: 2093797 - DNA, 11 bp, Homo sapiens
cacaatatttt

SEQ ID NO: 2093798 - DNA, 21 bp, Homo sapiens
cacaatctttccttgtctctc

SEQ ID NO: 2093799 - DNA, 20 bp, Homo sapiens
cacaatgatgattaaacacc

SEQ ID NO: 2093800 - DNA, 14 bp, Homo sapiens
cacaattaattgtc

SEQ ID NO: 2093801 - DNA, 19 bp, Homo sapiens
cacaattgatacttcaggt

SEQ ID NO: 2093802 - DNA, 13 bp, Homo sapiens
cacaatttagaaa

SEQ ID NO: 2093803 - DNA, 22 bp, Homo sapiens
cacaatttagaaaacattcatc

SEQ ID NO: 2093804 - DNA, 16 bp, Homo sapiens
cacaatttgagcaatt

SEQ ID NO: 2093805 - DNA, 19 bp, Homo sapiens
cacaatttgagcaattcat

SEQ ID NO: 2093806 - DNA, 16 bp, Homo sapiens
cacacaaaatgtcaca

SEQ ID NO: 2093807 - DNA, 20 bp, Homo sapiens
cacacaaaatgtcacacttg

SEQ ID NO: 2093808 - DNA, 15 bp, Homo sapiens
cacacaaacacctcc

SEQ ID NO: 2093809 - DNA, 16 bp, Homo sapiens
cacacaaacacctcct

SEQ ID NO: 2093810 - DNA, 18 bp, Homo sapiens
cacacaaacacctcctag

SEQ ID NO: 2093811 - DNA, 20 bp, Homo sapiens
cacacaaacacctcctagca

SEQ ID NO: 2093812 - DNA, 18 bp, Homo sapiens
cacacaaaggtataattt

SEQ ID NO: 2093813 - DNA, 13 bp, Homo sapiens
cacacaaggctgg

SEQ ID NO: 2093814 - DNA, 14 bp, Homo sapiens
cacacaaggctggg

SEQ ID NO: 2093815 - DNA, 23 bp, Homo sapiens
cacacaatgctattgaaattact

SEQ ID NO: 2093816 - DNA, 14 bp, Homo sapiens
cacacacacacata

SEQ ID NO: 2093817 - DNA, 17 bp, Homo sapiens
cacacacagatgcacac

SEQ ID NO: 2093818 - DNA, 14 bp, Homo sapiens
cacacacagctcct

SEQ ID NO: 2093819 - DNA, 13 bp, Homo sapiens
cacacacaggcaa

SEQ ID NO: 2093820 - DNA, 21 bp, Homo sapiens
cacacacaggcaactgaggca

SEQ ID NO: 2093821 - DNA, 13 bp, Homo sapiens
cacacacatagat

SEQ ID NO: 2093822 - DNA, 14 bp, Homo sapiens
cacacagaaatata

SEQ ID NO: 2093823 - DNA, 22 bp, Homo sapiens
cacacagaaatatatatacata

SEQ ID NO: 2093824 - DNA, 19 bp, Homo sapiens
cacacagagcctgcctcag

SEQ ID NO: 2093825 - DNA, 19 bp, Homo sapiens
cacacagatgcacacacag

SEQ ID NO: 2093826 - DNA, 12 bp, Homo sapiens
cacacagcactc

SEQ ID NO: 2093827 - DNA, 20 bp, Homo sapiens
cacacagcagccccccagca

SEQ ID NO: 2093828 - DNA, 12 bp, Homo sapiens
cacacagctctg

SEQ ID NO: 2093829 - DNA, 13 bp, Homo sapiens
cacacagctctgt

SEQ ID NO: 2093830 - DNA, 14 bp, Homo sapiens
cacacagctctgtc

SEQ ID NO: 2093831 - DNA, 17 bp, Homo sapiens
cacacagctctgtcctg

SEQ ID NO: 2093832 - DNA, 19 bp, Homo sapiens
cacacaggcaactgaggca

SEQ ID NO: 2093833 - DNA, 19 bp, Homo sapiens
cacacaggcatttcctggg

SEQ ID NO: 2093834 - DNA, 21 bp, Homo sapiens
cacacaggcatttcctgggtg

SEQ ID NO: 2093835 - DNA, 18 bp, Homo sapiens
cacacaggtacagcaaca

SEQ ID NO: 2093836 - DNA, 21 bp, Homo sapiens
cacacagtattaagtgacagt

SEQ ID NO: 2093837 - DNA, 18 bp, Homo sapiens
cacacagtctcagtccag

SEQ ID NO: 2093838 - DNA, 20 bp, Homo sapiens
cacacagtctcagtccagat

SEQ ID NO: 2093839 - DNA, 21 bp, Homo sapiens
cacacagtgagtcgaggacag

SEQ ID NO: 2093840 - DNA, 23 bp, Homo sapiens
cacacatagattaatggcactga

SEQ ID NO: 2093841 - DNA, 14 bp, Homo sapiens
cacacatatacata

SEQ ID NO: 2093842 - DNA, 15 bp, Homo sapiens
cacacatatacatat

SEQ ID NO: 2093843 - DNA, 15 bp, Homo sapiens
cacacatcagtgcac

SEQ ID NO: 2093844 - DNA, 20 bp, Homo sapiens
cacacattgtgcttggcccc

SEQ ID NO: 2093845 - DNA, 18 bp, Homo sapiens
cacaccactgccctgcct

SEQ ID NO: 2093846 - DNA, 15 bp, Homo sapiens
cacaccagagcccac

SEQ ID NO: 2093847 - DNA, 21 bp, Homo sapiens
cacaccagagcccaccttggc

SEQ ID NO: 2093848 - DNA, 14 bp, Homo sapiens
cacaccatcaccct

SEQ ID NO: 2093849 - DNA, 20 bp, Homo sapiens
cacaccatcttaaatgacag

SEQ ID NO: 2093850 - DNA, 12 bp, Homo sapiens
cacacccagagg

SEQ ID NO: 2093851 - DNA, 12 bp, Homo sapiens
cacaccccaagg

SEQ ID NO: 2093852 - DNA, 18 bp, Homo sapiens
cacaccccatctctcttc

SEQ ID NO: 2093853 - DNA, 20 bp, Homo sapiens
cacacccggctccccctgct

SEQ ID NO: 2093854 - DNA, 17 bp, Homo sapiens
cacaccgggcactcaga

SEQ ID NO: 2093855 - DNA, 15 bp, Homo sapiens
cacaccgtgagcaga

SEQ ID NO: 2093856 - DNA, 21 bp, Homo sapiens
cacacctctggatccctggag

SEQ ID NO: 2093857 - DNA, 22 bp, Homo sapiens
cacacctctggatccctggagg

SEQ ID NO: 2093858 - DNA, 12 bp, Homo sapiens
cacacctctggg

SEQ ID NO: 2093859 - DNA, 17 bp, Homo sapiens
cacacctgagccagcct

SEQ ID NO: 2093860 - DNA, 22 bp, Homo sapiens
cacacctgtaatcccagcactt

SEQ ID NO: 2093861 - DNA, 12 bp, Homo sapiens
cacaccttaggt

SEQ ID NO: 2093862 - DNA, 14 bp, Homo sapiens
cacacgcaggaact

SEQ ID NO: 2093863 - DNA, 19 bp, Homo sapiens
cacacgcaggaactcccag

SEQ ID NO: 2093864 - DNA, 18 bp, Homo sapiens
cacacggaggcatctgca

SEQ ID NO: 2093865 - DNA, 14 bp, Homo sapiens
cacacggccctgcc

SEQ ID NO: 2093866 - DNA, 13 bp, Homo sapiens
cacacgtgctcgc

SEQ ID NO: 2093867 - DNA, 18 bp, Homo sapiens
cacacgtgctcgcagcct

SEQ ID NO: 2093868 - DNA, 19 bp, Homo sapiens
cacacgtgctcgcagcctg

SEQ ID NO: 2093869 - DNA, 17 bp, Homo sapiens
cacactagcctctccag

SEQ ID NO: 2093870 - DNA, 19 bp, Homo sapiens
cacactagcctctccagga

SEQ ID NO: 2093871 - DNA, 18 bp, Homo sapiens
cacactattaccatgaga

SEQ ID NO: 2093872 - DNA, 19 bp, Homo sapiens
cacactattaccatgagaa

SEQ ID NO: 2093873 - DNA, 20 bp, Homo sapiens
cacactattaccatgagaag

SEQ ID NO: 2093874 - DNA, 19 bp, Homo sapiens
cacactcaaatcaagaaac

SEQ ID NO: 2093875 - DNA, 17 bp, Homo sapiens
cacactgagctgggcac

SEQ ID NO: 2093876 - DNA, 20 bp, Homo sapiens
cacactgcaagagccttggt

SEQ ID NO: 2093877 - DNA, 22 bp, Homo sapiens
cacactggcacgtttgtgagaa

SEQ ID NO: 2093878 - DNA, 11 bp, Homo sapiens
cacactgtaaa

SEQ ID NO: 2093879 - DNA, 16 bp, Homo sapiens
cacactgtaaacccct

SEQ ID NO: 2093880 - DNA, 14 bp, Homo sapiens
cacactgtaaatat

SEQ ID NO: 2093881 - DNA, 15 bp, Homo sapiens
cacactgttactcca

SEQ ID NO: 2093882 - DNA, 16 bp, Homo sapiens
cacactgttactccac

SEQ ID NO: 2093883 - DNA, 14 bp, Homo sapiens
cacacttcaggctc

SEQ ID NO: 2093884 - DNA, 18 bp, Homo sapiens
cacacttcaggctcttct

SEQ ID NO: 2093885 - DNA, 22 bp, Homo sapiens
cacacttcaggctcttctcctt

SEQ ID NO: 2093886 - DNA, 14 bp, Homo sapiens
cacacttctcagga

SEQ ID NO: 2093887 - DNA, 22 bp, Homo sapiens
cacacttcttgaaacagcctgg

SEQ ID NO: 2093888 - DNA, 18 bp, Homo sapiens
cacagaaacacaatattt

SEQ ID NO: 2093889 - DNA, 15 bp, Homo sapiens
cacagaaatatatat

SEQ ID NO: 2093890 - DNA, 19 bp, Homo sapiens
cacagaaatatatatacat

SEQ ID NO: 2093891 - DNA, 20 bp, Homo sapiens
cacagaaatatatatacata

SEQ ID NO: 2093892 - DNA, 23 bp, Homo sapiens
cacagaacactgggtagtagcta

SEQ ID NO: 2093893 - DNA, 16 bp, Homo sapiens
cacagaagccaggagc

SEQ ID NO: 2093894 - DNA, 19 bp, Homo sapiens
cacagaaggaatctgtgca

SEQ ID NO: 2093895 - DNA, 17 bp, Homo sapiens
cacagacagatcccatc

SEQ ID NO: 2093896 - DNA, 20 bp, Homo sapiens
cacagacagatcccatccat

SEQ ID NO: 2093897 - DNA, 20 bp, Homo sapiens
cacagaccacctgcttctga

SEQ ID NO: 2093898 - DNA, 16 bp, Homo sapiens
cactggccagagaggg

SEQ ID NO: 2093899 - DNA, 17 bp, Homo sapiens
cactggccagagagggc

SEQ ID NO: 2093900 - DNA, 18 bp, Homo sapiens
cactggccagagagggcc

SEQ ID NO: 2093901 - DNA, 19 bp, Homo sapiens
cactggccagagagggccc

SEQ ID NO: 2093902 - DNA, 20 bp, Homo sapiens
cactggccagagagggccca

SEQ ID NO: 2093903 - DNA, 21 bp, Homo sapiens
cactggccagagagggcccag

SEQ ID NO: 2093904 - DNA, 12 bp, Homo sapiens
cactggccagtc

SEQ ID NO: 2093905 - DNA, 14 bp, Homo sapiens
cactggccagtcct

SEQ ID NO: 2093906 - DNA, 13 bp, Homo sapiens
cactggccccacc

SEQ ID NO: 2093907 - DNA, 14 bp, Homo sapiens
cactggccccaccc

SEQ ID NO: 2093908 - DNA, 22 bp, Homo sapiens
cactggctggggcagaggggca

SEQ ID NO: 2093909 - DNA, 23 bp, Homo sapiens
cactggctggggcagaggggcag

SEQ ID NO: 2093910 - DNA, 23 bp, Homo sapiens
cactgggatgagccgctgtgagc

SEQ ID NO: 2093911 - DNA, 14 bp, Homo sapiens
cactgggggagggg

SEQ ID NO: 2093912 - DNA, 15 bp, Homo sapiens
cactgggggagggga

SEQ ID NO: 2093913 - DNA, 18 bp, Homo sapiens
cactgggggaggggacat

SEQ ID NO: 2093914 - DNA, 15 bp, Homo sapiens
cactggggtcctggg

SEQ ID NO: 2093915 - DNA, 18 bp, Homo sapiens
cactgggtctcactcctg

SEQ ID NO: 2093916 - DNA, 22 bp, Homo sapiens
cactggtggcccgacagcctgg

SEQ ID NO: 2093917 - DNA, 20 bp, Homo sapiens
cactggttaaaataaagcct

SEQ ID NO: 2093918 - DNA, 15 bp, Homo sapiens
cactggtttctcaga

SEQ ID NO: 2093919 - DNA, 17 bp, Homo sapiens
cactgtaaaatgaaatt

SEQ ID NO: 2093920 - DNA, 18 bp, Homo sapiens
cactgtaaaatgaaatta

SEQ ID NO: 2093921 - DNA, 22 bp, Homo sapiens
cactgtaagtttattttttcta

SEQ ID NO: 2093922 - DNA, 16 bp, Homo sapiens
cactgtaatcttaaaa

SEQ ID NO: 2093923 - DNA, 21 bp, Homo sapiens
cactgtattttcattttaatt

SEQ ID NO: 2093924 - DNA, 14 bp, Homo sapiens
cactgtcaagatga

SEQ ID NO: 2093925 - DNA, 12 bp, Homo sapiens
cactgtccgcct

SEQ ID NO: 2093926 - DNA, 18 bp, Homo sapiens
cactgtccgcctctgccc

SEQ ID NO: 2093927 - DNA, 20 bp, Homo sapiens
cactgtgaagacccagcagg

SEQ ID NO: 2093928 - DNA, 23 bp, Homo sapiens
cactgtgaagacccagcaggaag

SEQ ID NO: 2093929 - DNA, 17 bp, Homo sapiens
cactgtgaggggaaggc

SEQ ID NO: 2093930 - DNA, 18 bp, Homo sapiens
cactgtgcgttttagagt

SEQ ID NO: 2093931 - DNA, 20 bp, Homo sapiens
cactgtgcgttttagagtat

SEQ ID NO: 2093932 - DNA, 14 bp, Homo sapiens
cactgtgctataaa

SEQ ID NO: 2093933 - DNA, 16 bp, Homo sapiens
cactgtgctattacaa

SEQ ID NO: 2093934 - DNA, 16 bp, Homo sapiens
cactgtgcttacagtg

SEQ ID NO: 2093935 - DNA, 19 bp, Homo sapiens
cactgtgcttacagtgact

SEQ ID NO: 2093936 - DNA, 15 bp, Homo sapiens
cactgtggccagagc

SEQ ID NO: 2093937 - DNA, 23 bp, Homo sapiens
cactgtggccagagctggaaggc

SEQ ID NO: 2093938 - DNA, 19 bp, Homo sapiens
cactgtggcgttctgctgc

SEQ ID NO: 2093939 - DNA, 20 bp, Homo sapiens
cactgtggcgttctgctgcc

SEQ ID NO: 2093940 - DNA, 22 bp, Homo sapiens
cactgtgttggccaggctggtc

SEQ ID NO: 2093941 - DNA, 18 bp, Homo sapiens
cactgttactccacagcg

SEQ ID NO: 2093942 - DNA, 16 bp, Homo sapiens
cactgttgaaaattat

SEQ ID NO: 2093943 - DNA, 21 bp, Homo sapiens
cactgttgaaaattattttaa

SEQ ID NO: 2093944 - DNA, 15 bp, Homo sapiens
cactgttgcccaggc

SEQ ID NO: 2093945 - DNA, 15 bp, Homo sapiens
cacttaccttcaata

SEQ ID NO: 2093946 - DNA, 17 bp, Homo sapiens
cacttaccttcaataaa

SEQ ID NO: 2093947 - DNA, 19 bp, Homo sapiens
cacttagaaattgcatttc

SEQ ID NO: 2093948 - DNA, 20 bp, Homo sapiens
cacttagaaattgcatttcc

SEQ ID NO: 2093949 - DNA, 24 bp, Homo sapiens
cacttagaaattgcatttcctgac

SEQ ID NO: 2093950 - DNA, 15 bp, Homo sapiens
cacttagcccaagag

SEQ ID NO: 2093951 - DNA, 11 bp, Homo sapiens
cacttatatat

SEQ ID NO: 2093952 - DNA, 22 bp, Homo sapiens
cacttattatgaggctattaaa

SEQ ID NO: 2093953 - DNA, 14 bp, Homo sapiens
cacttatttcataa

SEQ ID NO: 2093954 - DNA, 21 bp, Homo sapiens
cacttcaagtgaccaccagga

SEQ ID NO: 2093955 - DNA, 19 bp, Homo sapiens
cacttcagagtagagggct

SEQ ID NO: 2093956 - DNA, 13 bp, Homo sapiens
cacttcagcccag

SEQ ID NO: 2093957 - DNA, 14 bp, Homo sapiens
cacttcaggctctt

SEQ ID NO: 2093958 - DNA, 15 bp, Homo sapiens
cacttcaggctcttc

SEQ ID NO: 2093959 - DNA, 16 bp, Homo sapiens
cacttcaggctcttct

SEQ ID NO: 2093960 - DNA, 17 bp, Homo sapiens
cacttctaaatagcaat

SEQ ID NO: 2093961 - DNA, 18 bp, Homo sapiens
cacttctaaatgaagtgc

SEQ ID NO: 2093962 - DNA, 19 bp, Homo sapiens
cacttctcaggacacaggc

SEQ ID NO: 2093963 - DNA, 21 bp, Homo sapiens
cacttctcaggacacaggcct

SEQ ID NO: 2093964 - DNA, 22 bp, Homo sapiens
cacttctcaggacacaggcctg

SEQ ID NO: 2093965 - DNA, 23 bp, Homo sapiens
cacttctcatcatattgtatgta

SEQ ID NO: 2093966 - DNA, 12 bp, Homo sapiens
cacttctctaga

SEQ ID NO: 2093967 - DNA, 13 bp, Homo sapiens
cacttctctccag

SEQ ID NO: 2093968 - DNA, 22 bp, Homo sapiens
cacttctctccaggctgtttct

SEQ ID NO: 2093969 - DNA, 23 bp, Homo sapiens
cacttcttcttggtcttatttat

SEQ ID NO: 2093970 - DNA, 15 bp, Homo sapiens
cacttcttgaaacag

SEQ ID NO: 2093971 - DNA, 18 bp, Homo sapiens
cacttcttgaaacagcct

SEQ ID NO: 2093972 - DNA, 17 bp, Homo sapiens
cacttctttgcagagcc

SEQ ID NO: 2093973 - DNA, 19 bp, Homo sapiens
cacttctttgcagagcctt

SEQ ID NO: 2093974 - DNA, 15 bp, Homo sapiens
cacttgacattcctt

SEQ ID NO: 2093975 - DNA, 13 bp, Homo sapiens
cacttgcagactc

SEQ ID NO: 2093976 - DNA, 19 bp, Homo sapiens
cacttgcagactctacaga

SEQ ID NO: 2093977 - DNA, 15 bp, Homo sapiens
cacttgcgtcctgca

SEQ ID NO: 2093978 - DNA, 19 bp, Homo sapiens
cacttgcgtcctgcagagg

SEQ ID NO: 2093979 - DNA, 12 bp, Homo sapiens
cacttggagccc

SEQ ID NO: 2093980 - DNA, 20 bp, Homo sapiens
cacttggggcaccttgctcc

SEQ ID NO: 2093981 - DNA, 22 bp, Homo sapiens
cacttggggcaccttgctcctc

SEQ ID NO: 2093982 - DNA, 12 bp, Homo sapiens
cacttgtataaa

SEQ ID NO: 2093983 - DNA, 19 bp, Homo sapiens
cacttgtataaatgtatat

SEQ ID NO: 2093984 - DNA, 15 bp, Homo sapiens
cacttgttccttctg

SEQ ID NO: 2093985 - DNA, 22 bp, Homo sapiens
cacttgttccttctgcttctcc

SEQ ID NO: 2093986 - DNA, 13 bp, Homo sapiens
cacttgtttcttg

SEQ ID NO: 2093987 - DNA, 18 bp, Homo sapiens
cactttaaccctctcttc

SEQ ID NO: 2093988 - DNA, 20 bp, Homo sapiens
cactttaaccctctcttccc

SEQ ID NO: 2093989 - DNA, 22 bp, Homo sapiens
cactttaattctcatgtgatcc

SEQ ID NO: 2093990 - DNA, 19 bp, Homo sapiens
cactttcagtgaaagcatc

SEQ ID NO: 2093991 - DNA, 17 bp, Homo sapiens
cactttcctacaaaatg

SEQ ID NO: 2093992 - DNA, 18 bp, Homo sapiens
cactttggagctttagct

SEQ ID NO: 2093993 - DNA, 19 bp, Homo sapiens
cactttggcttctcctgtg

SEQ ID NO: 2093994 - DNA, 20 bp, Homo sapiens
cactttggcttctcctgtga

SEQ ID NO: 2093995 - DNA, 21 bp, Homo sapiens
cactttggcttctcctgtgac

SEQ ID NO: 2093996 - DNA, 15 bp, Homo sapiens
cactttgttaaaaat

SEQ ID NO: 2093997 - DNA, 17 bp, Homo sapiens
cacttttaatgaacaaa

SEQ ID NO: 2093998 - DNA, 19 bp, Homo sapiens
cacttttctttattgctgt

SEQ ID NO: 2093999 - DNA, 19 bp, Homo sapiens
cagaaaaaaaaaaagaaac

SEQ ID NO: 2094000 - DNA, 14 bp, Homo sapiens
cagaaaaaaataaa

SEQ ID NO: 2094001 - DNA, 23 bp, Homo sapiens
cagaaaacaaatcttcaaggtgt

SEQ ID NO: 2094002 - DNA, 17 bp, Homo sapiens
cagaaaagaaaaccatt

SEQ ID NO: 2094003 - DNA, 14 bp, Homo sapiens
cagaaaagcacctg

SEQ ID NO: 2094004 - DNA, 14 bp, Homo sapiens
cagaaaagtagaat

SEQ ID NO: 2094005 - DNA, 20 bp, Homo sapiens
cagaaaagtagaattatatc

SEQ ID NO: 2094006 - DNA, 13 bp, Homo sapiens
cagaaaagtgctt

SEQ ID NO: 2094007 - DNA, 22 bp, Homo sapiens
cagaaaagtgcttagaaagtta

SEQ ID NO: 2094008 - DNA, 20 bp, Homo sapiens
cagaaacaaaaacactaaaa

SEQ ID NO: 2094009 - DNA, 22 bp, Homo sapiens
cagaaacaggtgcatctgggga

SEQ ID NO: 2094010 - DNA, 22 bp, Homo sapiens
cagaaaccaagtctacttcact

SEQ ID NO: 2094011 - DNA, 15 bp, Homo sapiens
cagaaaccagttatg

SEQ ID NO: 2094012 - DNA, 19 bp, Homo sapiens
cagagtgagactctgtctc

SEQ ID NO: 2094013 - DNA, 23 bp, Homo sapiens
cagagtgaggatgtgttttgcac

SEQ ID NO: 2094014 - DNA, 16 bp, Homo sapiens
cagagtggagccctca

SEQ ID NO: 2094015 - DNA, 17 bp, Homo sapiens
cagagtggagccctcag

SEQ ID NO: 2094016 - DNA, 18 bp, Homo sapiens
cagagtggagccctcagt

SEQ ID NO: 2094017 - DNA, 13 bp, Homo sapiens
cagagtggagtct

SEQ ID NO: 2094018 - DNA, 18 bp, Homo sapiens
cagagtgggctgcctggg

SEQ ID NO: 2094019 - DNA, 20 bp, Homo sapiens
cagagtgggctgcctgggga

SEQ ID NO: 2094020 - DNA, 19 bp, Homo sapiens
cagagtgtgggaagggaga

SEQ ID NO: 2094021 - DNA, 16 bp, Homo sapiens
cagagttattgaatct

SEQ ID NO: 2094022 - DNA, 21 bp, Homo sapiens
cagagttattgaatcttaatt

SEQ ID NO: 2094023 - DNA, 20 bp, Homo sapiens
cagagttcactataaatggt

SEQ ID NO: 2094024 - DNA, 22 bp, Homo sapiens
cagagttgggatgcggggcaga

SEQ ID NO: 2094025 - DNA, 14 bp, Homo sapiens
cagataaagacagc

SEQ ID NO: 2094026 - DNA, 22 bp, Homo sapiens
cagataaagacagctgacagat

SEQ ID NO: 2094027 - DNA, 19 bp, Homo sapiens
cagataactgaaaattatt

SEQ ID NO: 2094028 - DNA, 19 bp, Homo sapiens
cagataatcagcctcttaa

SEQ ID NO: 2094029 - DNA, 18 bp, Homo sapiens
cagataatttattttgta

SEQ ID NO: 2094030 - DNA, 21 bp, Homo sapiens
cagataatttattttgtattt

SEQ ID NO: 2094031 - DNA, 22 bp, Homo sapiens
cagatacaggaaaagctgctga

SEQ ID NO: 2094032 - DNA, 23 bp, Homo sapiens
cagatacaggaaaagctgctgac

SEQ ID NO: 2094033 - DNA, 16 bp, Homo sapiens
cagatacatagatgga

SEQ ID NO: 2094034 - DNA, 21 bp, Homo sapiens
cagataccatactcatttcta

SEQ ID NO: 2094035 - DNA, 16 bp, Homo sapiens
cagatagacagtgctg

SEQ ID NO: 2094036 - DNA, 18 bp, Homo sapiens
cagatagacagtgctgcc

SEQ ID NO: 2094037 - DNA, 19 bp, Homo sapiens
cagatagacagtgctgccc

SEQ ID NO: 2094038 - DNA, 21 bp, Homo sapiens
cagatagacagtgctgccctg

SEQ ID NO: 2094039 - DNA, 24 bp, Homo sapiens
cagatagacagtgctgccctgcga

SEQ ID NO: 2094040 - DNA, 22 bp, Homo sapiens
cagatataaatggctggttttt

SEQ ID NO: 2094041 - DNA, 23 bp, Homo sapiens
cagatataaatggctggttttta

SEQ ID NO: 2094042 - DNA, 18 bp, Homo sapiens
cagatatacacatggatg

SEQ ID NO: 2094043 - DNA, 20 bp, Homo sapiens
cagatatatatcatattggt

SEQ ID NO: 2094044 - DNA, 13 bp, Homo sapiens
cagatatattttt

SEQ ID NO: 2094045 - DNA, 15 bp, Homo sapiens
cagatatatttttca

SEQ ID NO: 2094046 - DNA, 16 bp, Homo sapiens
cagatatatttttcac

SEQ ID NO: 2094047 - DNA, 18 bp, Homo sapiens
cagatatatttttcacag

SEQ ID NO: 2094048 - DNA, 15 bp, Homo sapiens
cagatattttttcag

SEQ ID NO: 2094049 - DNA, 15 bp, Homo sapiens
cagatcatctgggga

SEQ ID NO: 2094050 - DNA, 18 bp, Homo sapiens
cagatcatgtaaggaagg

SEQ ID NO: 2094051 - DNA, 18 bp, Homo sapiens
cagatcctactcttcctt

SEQ ID NO: 2094052 - DNA, 16 bp, Homo sapiens
cagatcgtattaatta

SEQ ID NO: 2094053 - DNA, 17 bp, Homo sapiens
cagatcgtattaattat

SEQ ID NO: 2094054 - DNA, 18 bp, Homo sapiens
cagatcgtattaattatc

SEQ ID NO: 2094055 - DNA, 21 bp, Homo sapiens
cagatcgtattaattatctga

SEQ ID NO: 2094056 - DNA, 13 bp, Homo sapiens
cagatctgcctgg

SEQ ID NO: 2094057 - DNA, 17 bp, Homo sapiens
cagatctgcctgggcct

SEQ ID NO: 2094058 - DNA, 22 bp, Homo sapiens
cagatctgcctgggcctgtgca

SEQ ID NO: 2094059 - DNA, 14 bp, Homo sapiens
cagatgagaagtta

SEQ ID NO: 2094060 - DNA, 21 bp, Homo sapiens
cagatgagaagttaagcagcc

SEQ ID NO: 2094061 - DNA, 17 bp, Homo sapiens
cagatgagattccctct

SEQ ID NO: 2094062 - DNA, 22 bp, Homo sapiens
cagatgagattccctctcctcc

SEQ ID NO: 2094063 - DNA, 12 bp, Homo sapiens
cagatgagctgt

SEQ ID NO: 2094064 - DNA, 16 bp, Homo sapiens
cagatgcaacctcact

SEQ ID NO: 2094065 - DNA, 14 bp, Homo sapiens
cagatgcaccagcc

SEQ ID NO: 2094066 - DNA, 17 bp, Homo sapiens
cagatgcaccagccctt

SEQ ID NO: 2094067 - DNA, 22 bp, Homo sapiens
cagatgcaccagcccttagcag

SEQ ID NO: 2094068 - DNA, 16 bp, Homo sapiens
cagatgcaccccaaca

SEQ ID NO: 2094069 - DNA, 15 bp, Homo sapiens
cagatgcccccgtga

SEQ ID NO: 2094070 - DNA, 12 bp, Homo sapiens
cagatgctgggg

SEQ ID NO: 2094071 - DNA, 15 bp, Homo sapiens
cagatggaggtgcca

SEQ ID NO: 2094072 - DNA, 16 bp, Homo sapiens
cagatggcatgtgttt

SEQ ID NO: 2094073 - DNA, 18 bp, Homo sapiens
cagatgtaggagggactg

SEQ ID NO: 2094074 - DNA, 20 bp, Homo sapiens
cagatgtggagtctgtgtct

SEQ ID NO: 2094075 - DNA, 20 bp, Homo sapiens
cagatgtgggctttgatttc

SEQ ID NO: 2094076 - DNA, 17 bp, Homo sapiens
cagattacttcagggct

SEQ ID NO: 2094077 - DNA, 18 bp, Homo sapiens
cagattacttcagggctg

SEQ ID NO: 2094078 - DNA, 17 bp, Homo sapiens
cagattcccagagcaaa

SEQ ID NO: 2094079 - DNA, 14 bp, Homo sapiens
cagattcctgggcc

SEQ ID NO: 2094080 - DNA, 15 bp, Homo sapiens
cagattcctgggcct

SEQ ID NO: 2094081 - DNA, 17 bp, Homo sapiens
cagattcctgggcctgt

SEQ ID NO: 2094082 - DNA, 18 bp, Homo sapiens
cagattcctgggcctgtc

SEQ ID NO: 2094083 - DNA, 12 bp, Homo sapiens
cagattctgatt

SEQ ID NO: 2094084 - DNA, 18 bp, Homo sapiens
cagattgcaacaggctgg

SEQ ID NO: 2094085 - DNA, 19 bp, Homo sapiens
cagattgcaacaggctggg

SEQ ID NO: 2094086 - DNA, 21 bp, Homo sapiens
cagattgcaacaggctgggct

SEQ ID NO: 2094087 - DNA, 20 bp, Homo sapiens
cagatttgctaatttatcct

SEQ ID NO: 2094088 - DNA, 14 bp, Homo sapiens
cagatttgtgttat

SEQ ID NO: 2094089 - DNA, 15 bp, Homo sapiens
cagcaaaaatataaa

SEQ ID NO: 2094090 - DNA, 19 bp, Homo sapiens
cagcaaagagtgggctgca

SEQ ID NO: 2094091 - DNA, 13 bp, Homo sapiens
cagcaacagaaaa

SEQ ID NO: 2094092 - DNA, 17 bp, Homo sapiens
cagcaacagaaaaatgg

SEQ ID NO: 2094093 - DNA, 23 bp, Homo sapiens
cagcaacaggaatctcagagaca

SEQ ID NO: 2094094 - DNA, 23 bp, Homo sapiens
cagcaacgcaggcccccaggtgc

SEQ ID NO: 2094095 - DNA, 13 bp, Homo sapiens
cagcaactcccac

SEQ ID NO: 2094096 - DNA, 15 bp, Homo sapiens
cagcaactcccacga

SEQ ID NO: 2094097 - DNA, 16 bp, Homo sapiens
cagcaagagcacaaga

SEQ ID NO: 2094098 - DNA, 17 bp, Homo sapiens
cagcaagagcacaagag

SEQ ID NO: 2094099 - DNA, 12 bp, Homo sapiens
cagcaagccggc

SEQ ID NO: 2094100 - DNA, 16 bp, Homo sapiens
cagcaaggcccgagca

SEQ ID NO: 2094101 - DNA, 14 bp, Homo sapiens
cagcaagtgagagc

SEQ ID NO: 2094102 - DNA, 16 bp, Homo sapiens
cagcaagtgagagctg

SEQ ID NO: 2094103 - DNA, 17 bp, Homo sapiens
cagcaagtgagagctgg

SEQ ID NO: 2094104 - DNA, 17 bp, Homo sapiens
cagcaagtttcaccttg

SEQ ID NO: 2094105 - DNA, 18 bp, Homo sapiens
cagcaatgatgtccagaa

SEQ ID NO: 2094106 - DNA, 14 bp, Homo sapiens
cagcacaccccaag

SEQ ID NO: 2094107 - DNA, 23 bp, Homo sapiens
cagcacagaaggaatctgtgcag

SEQ ID NO: 2094108 - DNA, 13 bp, Homo sapiens
cagcacaggggcc

SEQ ID NO: 2094109 - DNA, 12 bp, Homo sapiens
cagcacccaggc

SEQ ID NO: 2094110 - DNA, 15 bp, Homo sapiens
cagcacccaggctcc

SEQ ID NO: 2094111 - DNA, 18 bp, Homo sapiens
cagcaccctcccccgcag

SEQ ID NO: 2094112 - DNA, 16 bp, Homo sapiens
cagcaccctctcctgg

SEQ ID NO: 2094113 - DNA, 23 bp, Homo sapiens
cagcaccctctcctgggggtggc

SEQ ID NO: 2094114 - DNA, 14 bp, Homo sapiens
cagcactaaagcag

SEQ ID NO: 2094115 - DNA, 20 bp, Homo sapiens
cagcactaaagcagtggaca

SEQ ID NO: 2094116 - DNA, 16 bp, Homo sapiens
cagcactaaggccgtg

SEQ ID NO: 2094117 - DNA, 22 bp, Homo sapiens
cagcactcaaccaacctccccg

SEQ ID NO: 2094118 - DNA, 23 bp, Homo sapiens
cagcactcagaaaagaaaaccat

SEQ ID NO: 2094119 - DNA, 14 bp, Homo sapiens
cagcactcctctgt

SEQ ID NO: 2094120 - DNA, 20 bp, Homo sapiens
cagcactcctctgtctctgc

SEQ ID NO: 2094121 - DNA, 11 bp, Homo sapiens
cagcactgtga

SEQ ID NO: 2094122 - DNA, 23 bp, Homo sapiens
cagcactttaaccctctcttccc

SEQ ID NO: 2094123 - DNA, 14 bp, Homo sapiens
cagcactttgggag

SEQ ID NO: 2094124 - DNA, 16 bp, Homo sapiens
cagcagaaaagtgctt

SEQ ID NO: 2094125 - DNA, 22 bp, Homo sapiens
cagcagaaaagtgcttagaaag

SEQ ID NO: 2094126 - DNA, 20 bp, Homo sapiens
cagctccccaggactcaccc

SEQ ID NO: 2094127 - DNA, 21 bp, Homo sapiens
cagctccccaggactcaccct

SEQ ID NO: 2094128 - DNA, 18 bp, Homo sapiens
cagctccctaggagacca

SEQ ID NO: 2094129 - DNA, 19 bp, Homo sapiens
cagctccctaggagaccaa

SEQ ID NO: 2094130 - DNA, 17 bp, Homo sapiens
cagctccgcctctgtcc

SEQ ID NO: 2094131 - DNA, 13 bp, Homo sapiens
cagctcctctcct

SEQ ID NO: 2094132 - DNA, 18 bp, Homo sapiens
cagctcctctccttgggc

SEQ ID NO: 2094133 - DNA, 22 bp, Homo sapiens
cagctcctctccttgggctcct

SEQ ID NO: 2094134 - DNA, 16 bp, Homo sapiens
cagctccttctgtcct

SEQ ID NO: 2094135 - DNA, 23 bp, Homo sapiens
cagctccttctgtcctactctgt

SEQ ID NO: 2094136 - DNA, 19 bp, Homo sapiens
cagctccttttgtccccag

SEQ ID NO: 2094137 - DNA, 21 bp, Homo sapiens
cagctccttttgtccccaggg

SEQ ID NO: 2094138 - DNA, 23 bp, Homo sapiens
cagctccttttgtccccagggcc

SEQ ID NO: 2094139 - DNA, 20 bp, Homo sapiens
cagctctagttttcagcctt

SEQ ID NO: 2094140 - DNA, 19 bp, Homo sapiens
cagctctccctctggccct

SEQ ID NO: 2094141 - DNA, 20 bp, Homo sapiens
cagctctccctctggccctg

SEQ ID NO: 2094142 - DNA, 15 bp, Homo sapiens
cagctctctctaccc

SEQ ID NO: 2094143 - DNA, 23 bp, Homo sapiens
cagctctctctacccggcccaga

SEQ ID NO: 2094144 - DNA, 16 bp, Homo sapiens
cagctctctgtataaa

SEQ ID NO: 2094145 - DNA, 18 bp, Homo sapiens
cagctctctgtataaaca

SEQ ID NO: 2094146 - DNA, 21 bp, Homo sapiens
cagctctgacattctgattcg

SEQ ID NO: 2094147 - DNA, 12 bp, Homo sapiens
cagctctggctt

SEQ ID NO: 2094148 - DNA, 14 bp, Homo sapiens
cagctctggcttcc

SEQ ID NO: 2094149 - DNA, 13 bp, Homo sapiens
cagctctgtcctg

SEQ ID NO: 2094150 - DNA, 23 bp, Homo sapiens
cagctctgtcctgggagtgagct

SEQ ID NO: 2094151 - DNA, 14 bp, Homo sapiens
cagctctgtggcct

SEQ ID NO: 2094152 - DNA, 22 bp, Homo sapiens
cagctctgtggcctgtgtccag

SEQ ID NO: 2094153 - DNA, 24 bp, Homo sapiens
cagctctgtggcctgtgtccagca

SEQ ID NO: 2094154 - DNA, 21 bp, Homo sapiens
cagctcttcactcagccacac

SEQ ID NO: 2094155 - DNA, 20 bp, Homo sapiens
cagctcttcccctttcctgg

SEQ ID NO: 2094156 - DNA, 16 bp, Homo sapiens
cagctcttctccaggc

SEQ ID NO: 2094157 - DNA, 18 bp, Homo sapiens
cagctcttctccaggctg

SEQ ID NO: 2094158 - DNA, 23 bp, Homo sapiens
cagctcttctccaggctgtatcc

SEQ ID NO: 2094159 - DNA, 15 bp, Homo sapiens
cagctcttggcattt

SEQ ID NO: 2094160 - DNA, 15 bp, Homo sapiens
cagctcttggcccct

SEQ ID NO: 2094161 - DNA, 16 bp, Homo sapiens
cagctcttggcccctg

SEQ ID NO: 2094162 - DNA, 20 bp, Homo sapiens
cagctcttggcccctgtgtg

SEQ ID NO: 2094163 - DNA, 20 bp, Homo sapiens
cagctgacacataatttgaa

SEQ ID NO: 2094164 - DNA, 21 bp, Homo sapiens
cagctgagagacttttaatca

SEQ ID NO: 2094165 - DNA, 13 bp, Homo sapiens
cagctgagcaggg

SEQ ID NO: 2094166 - DNA, 16 bp, Homo sapiens
cagctgcacctgccag

SEQ ID NO: 2094167 - DNA, 18 bp, Homo sapiens
cagctgcacctgccagcc

SEQ ID NO: 2094168 - DNA, 19 bp, Homo sapiens
cagctgcagatgccacacc

SEQ ID NO: 2094169 - DNA, 17 bp, Homo sapiens
cagctgcagctgggccc

SEQ ID NO: 2094170 - DNA, 18 bp, Homo sapiens
cagctgcagctgggcccc

SEQ ID NO: 2094171 - DNA, 22 bp, Homo sapiens
cagctgcagtcaacagttcaaa

SEQ ID NO: 2094172 - DNA, 17 bp, Homo sapiens
cagctgcatctactcag

SEQ ID NO: 2094173 - DNA, 13 bp, Homo sapiens
cagctgccaagca

SEQ ID NO: 2094174 - DNA, 18 bp, Homo sapiens
cagctgccgaccagagcc

SEQ ID NO: 2094175 - DNA, 11 bp, Homo sapiens
cagctgcctgg

SEQ ID NO: 2094176 - DNA, 13 bp, Homo sapiens
cagctgccttcct

SEQ ID NO: 2094177 - DNA, 18 bp, Homo sapiens
cagctgccttcctcatcc

SEQ ID NO: 2094178 - DNA, 12 bp, Homo sapiens
cagctgctctgc

SEQ ID NO: 2094179 - DNA, 15 bp, Homo sapiens
cagctgctctgcccc

SEQ ID NO: 2094180 - DNA, 16 bp, Homo sapiens
cagctgctctgcccct

SEQ ID NO: 2094181 - DNA, 20 bp, Homo sapiens
cagctgctgaaacaacaaat

SEQ ID NO: 2094182 - DNA, 13 bp, Homo sapiens
cagctgctgaaga

SEQ ID NO: 2094183 - DNA, 17 bp, Homo sapiens
cagctgctgaagaggca

SEQ ID NO: 2094184 - DNA, 10 bp, Homo sapiens
cagctgcttg

SEQ ID NO: 2094185 - DNA, 22 bp, Homo sapiens
cagctgcttttgtctatgggac

SEQ ID NO: 2094186 - DNA, 20 bp, Homo sapiens
cagctggaattgctgctctc

SEQ ID NO: 2094187 - DNA, 10 bp, Homo sapiens
cagctggcct

SEQ ID NO: 2094188 - DNA, 20 bp, Homo sapiens
cagctggctctccaccttgt

SEQ ID NO: 2094189 - DNA, 13 bp, Homo sapiens
cagctggctgctg

SEQ ID NO: 2094190 - DNA, 15 bp, Homo sapiens
cagctggctgctgac

SEQ ID NO: 2094191 - DNA, 18 bp, Homo sapiens
cagctggctgctgacagg

SEQ ID NO: 2094192 - DNA, 21 bp, Homo sapiens
cagctggctgctgacaggatg

SEQ ID NO: 2094193 - DNA, 22 bp, Homo sapiens
cagctggctgctgacaggatgt

SEQ ID NO: 2094194 - DNA, 12 bp, Homo sapiens
cagctgggcccc

SEQ ID NO: 2094195 - DNA, 13 bp, Homo sapiens
cagctgggcccca

SEQ ID NO: 2094196 - DNA, 18 bp, Homo sapiens
cagctgggccccatgctc

SEQ ID NO: 2094197 - DNA, 19 bp, Homo sapiens
cagctgggccccatgctct

SEQ ID NO: 2094198 - DNA, 22 bp, Homo sapiens
cagctgggccccatgctctgcc

SEQ ID NO: 2094199 - DNA, 18 bp, Homo sapiens
cagctgggccggccagcc

SEQ ID NO: 2094200 - DNA, 17 bp, Homo sapiens
cagctggtccagggcct

SEQ ID NO: 2094201 - DNA, 14 bp, Homo sapiens
cagctggtgctgca

SEQ ID NO: 2094202 - DNA, 20 bp, Homo sapiens
cagctggtgctgcaaggaag

SEQ ID NO: 2094203 - DNA, 20 bp, Homo sapiens
cagctggtgggaagcgtctg

SEQ ID NO: 2094204 - DNA, 21 bp, Homo sapiens
cagctgtcatggaaaagccca

SEQ ID NO: 2094205 - DNA, 18 bp, Homo sapiens
cagctgtcccctctccct

SEQ ID NO: 2094206 - DNA, 16 bp, Homo sapiens
cagctgtccctgtcac

SEQ ID NO: 2094207 - DNA, 16 bp, Homo sapiens
cagctgtctgtggctt

SEQ ID NO: 2094208 - DNA, 20 bp, Homo sapiens
cagctgtgaacatggactct

SEQ ID NO: 2094209 - DNA, 11 bp, Homo sapiens
cagctgtgcct

SEQ ID NO: 2094210 - DNA, 13 bp, Homo sapiens
cagctgtgcctcg

SEQ ID NO: 2094211 - DNA, 14 bp, Homo sapiens
cagctgtttaagat

SEQ ID NO: 2094212 - DNA, 15 bp, Homo sapiens
cagctgtttctggaa

SEQ ID NO: 2094213 - DNA, 22 bp, Homo sapiens
cagcttatgggatccttgtctt

SEQ ID NO: 2094214 - DNA, 19 bp, Homo sapiens
cagcttatggggtatttta

SEQ ID NO: 2094215 - DNA, 23 bp, Homo sapiens
cagcttatggggtattttaagca

SEQ ID NO: 2094216 - DNA, 12 bp, Homo sapiens
cagcttcagttg

SEQ ID NO: 2094217 - DNA, 15 bp, Homo sapiens
cagcttcatcaattt

SEQ ID NO: 2094218 - DNA, 18 bp, Homo sapiens
cagcttcatcaattttta

SEQ ID NO: 2094219 - DNA, 22 bp, Homo sapiens
cagcttcatcaatttttataca

SEQ ID NO: 2094220 - DNA, 15 bp, Homo sapiens
cagcttcattatgca

SEQ ID NO: 2094221 - DNA, 16 bp, Homo sapiens
cagcttcatttccgtg

SEQ ID NO: 2094222 - DNA, 17 bp, Homo sapiens
cagcttcatttccgtga

SEQ ID NO: 2094223 - DNA, 19 bp, Homo sapiens
cagcttcatttccgtgaag

SEQ ID NO: 2094224 - DNA, 20 bp, Homo sapiens
cagcttcatttcctgtgtct

SEQ ID NO: 2094225 - DNA, 13 bp, Homo sapiens
cagcttcatttgt

SEQ ID NO: 2094226 - DNA, 15 bp, Homo sapiens
cagcttcctggtgta

SEQ ID NO: 2094227 - DNA, 13 bp, Homo sapiens
cagcttcctgtgg

SEQ ID NO: 2094228 - DNA, 12 bp, Homo sapiens
cagcttctccag

SEQ ID NO: 2094229 - DNA, 15 bp, Homo sapiens
cagcttctccaggct

SEQ ID NO: 2094230 - DNA, 13 bp, Homo sapiens
cagcttgaccaga

SEQ ID NO: 2094231 - DNA, 18 bp, Homo sapiens
cagcttgaccagacctag

SEQ ID NO: 2094232 - DNA, 16 bp, Homo sapiens
cagcttgagcctgtca

SEQ ID NO: 2094233 - DNA, 20 bp, Homo sapiens
cagcttgagggttgggctgg

SEQ ID NO: 2094234 - DNA, 23 bp, Homo sapiens
cagcttgctcttcagtgggagaa

SEQ ID NO: 2094235 - DNA, 19 bp, Homo sapiens
cagcttgtaaatagctcag

SEQ ID NO: 2094236 - DNA, 15 bp, Homo sapiens
cagcttgtagccagc

SEQ ID NO: 2094237 - DNA, 19 bp, Homo sapiens
cagctttacatgcaattta

SEQ ID NO: 2094238 - DNA, 13 bp, Homo sapiens
cagctttcagagc

SEQ ID NO: 2094239 - DNA, 19 bp, Homo sapiens
cagctttcagagccagtga

SEQ ID NO: 2094240 - DNA, 22 bp, Homo sapiens
cagctttgctaccaaagcacct

SEQ ID NO: 2094241 - DNA, 18 bp, Homo sapiens
cagggcatattaaaggct

SEQ ID NO: 2094242 - DNA, 19 bp, Homo sapiens
cagggcatattaaaggctt

SEQ ID NO: 2094243 - DNA, 19 bp, Homo sapiens
cagggcatgcattttgcag

SEQ ID NO: 2094244 - DNA, 15 bp, Homo sapiens
cagggccacgtgcca

SEQ ID NO: 2094245 - DNA, 16 bp, Homo sapiens
cagggccacgtgccag

SEQ ID NO: 2094246 - DNA, 17 bp, Homo sapiens
cagggccacgtgccagg

SEQ ID NO: 2094247 - DNA, 21 bp, Homo sapiens
cagggccacgtgccaggcccg

SEQ ID NO: 2094248 - DNA, 20 bp, Homo sapiens
cagggccagaaggagggcag

SEQ ID NO: 2094249 - DNA, 21 bp, Homo sapiens
cagggccagaaggagggcaga

SEQ ID NO: 2094250 - DNA, 22 bp, Homo sapiens
cagggccagaaggagggcagag

SEQ ID NO: 2094251 - DNA, 21 bp, Homo sapiens
cagggcccaaagcccagctct

SEQ ID NO: 2094252 - DNA, 14 bp, Homo sapiens
cagggcccaggtga

SEQ ID NO: 2094253 - DNA, 17 bp, Homo sapiens
cagggccccagaaggca

SEQ ID NO: 2094254 - DNA, 16 bp, Homo sapiens
cagggccccagcacta

SEQ ID NO: 2094255 - DNA, 16 bp, Homo sapiens
cagggcccccacaggc

SEQ ID NO: 2094256 - DNA, 17 bp, Homo sapiens
cagggcccccacaggcc

SEQ ID NO: 2094257 - DNA, 15 bp, Homo sapiens
cagggccctgagctc

SEQ ID NO: 2094258 - DNA, 21 bp, Homo sapiens
cagggccctgagctcggtgga

SEQ ID NO: 2094259 - DNA, 18 bp, Homo sapiens
cagggccctgcagagggg

SEQ ID NO: 2094260 - DNA, 12 bp, Homo sapiens
cagggcctgggg

SEQ ID NO: 2094261 - DNA, 14 bp, Homo sapiens
cagggcctggtgtg

SEQ ID NO: 2094262 - DNA, 16 bp, Homo sapiens
cagggccttgcccaga

SEQ ID NO: 2094263 - DNA, 17 bp, Homo sapiens
cagggccttgcccagag

SEQ ID NO: 2094264 - DNA, 19 bp, Homo sapiens
cagggccttgcccagagat

SEQ ID NO: 2094265 - DNA, 23 bp, Homo sapiens
cagggcgataaaactaaatatat

SEQ ID NO: 2094266 - DNA, 15 bp, Homo sapiens
cagggctaccctccc

SEQ ID NO: 2094267 - DNA, 19 bp, Homo sapiens
cagggctcagcctggtggg

SEQ ID NO: 2094268 - DNA, 12 bp, Homo sapiens
cagggctcagcg

SEQ ID NO: 2094269 - DNA, 23 bp, Homo sapiens
cagggctcagcggggacagctcc

SEQ ID NO: 2094270 - DNA, 15 bp, Homo sapiens
cagggctccacagag

SEQ ID NO: 2094271 - DNA, 12 bp, Homo sapiens
cagggctccctc

SEQ ID NO: 2094272 - DNA, 14 bp, Homo sapiens
cagggctccctcct

SEQ ID NO: 2094273 - DNA, 16 bp, Homo sapiens
cagggctccctcctgg

SEQ ID NO: 2094274 - DNA, 20 bp, Homo sapiens
cagggctcgggcgctgtggc

SEQ ID NO: 2094275 - DNA, 22 bp, Homo sapiens
cagggctcgggcgctgtggctc

SEQ ID NO: 2094276 - DNA, 16 bp, Homo sapiens
cagggctctcctggct

SEQ ID NO: 2094277 - DNA, 13 bp, Homo sapiens
cagggctctgccc

SEQ ID NO: 2094278 - DNA, 19 bp, Homo sapiens
cagggctctgccccagagg

SEQ ID NO: 2094279 - DNA, 20 bp, Homo sapiens
cagggctctgccccagaggc

SEQ ID NO: 2094280 - DNA, 12 bp, Homo sapiens
cagggctgcccc

SEQ ID NO: 2094281 - DNA, 19 bp, Homo sapiens
cagggctggaaaagtcaca

SEQ ID NO: 2094282 - DNA, 23 bp, Homo sapiens
cagggctggaaaagtcacacaga

SEQ ID NO: 2094283 - DNA, 22 bp, Homo sapiens
cagggctggagtgcgctcttgg

SEQ ID NO: 2094284 - DNA, 14 bp, Homo sapiens
cagggcttggggag

SEQ ID NO: 2094285 - DNA, 16 bp, Homo sapiens
caggggaaaatgaagg

SEQ ID NO: 2094286 - DNA, 13 bp, Homo sapiens
caggggatcaaag

SEQ ID NO: 2094287 - DNA, 12 bp, Homo sapiens
caggggcaggcc

SEQ ID NO: 2094288 - DNA, 14 bp, Homo sapiens
caggggcaggcctg

SEQ ID NO: 2094289 - DNA, 12 bp, Homo sapiens
caggggccccag

SEQ ID NO: 2094290 - DNA, 21 bp, Homo sapiens
caggggccccagatctgcctg

SEQ ID NO: 2094291 - DNA, 22 bp, Homo sapiens
caggggccccagatctgcctgg

SEQ ID NO: 2094292 - DNA, 23 bp, Homo sapiens
caggggccccagatctgcctggg

SEQ ID NO: 2094293 - DNA, 13 bp, Homo sapiens
caggggcggggca

SEQ ID NO: 2094294 - DNA, 15 bp, Homo sapiens
caggggctccacctg

SEQ ID NO: 2094295 - DNA, 13 bp, Homo sapiens
caggggctgctca

SEQ ID NO: 2094296 - DNA, 15 bp, Homo sapiens
caggggctgctcatc

SEQ ID NO: 2094297 - DNA, 16 bp, Homo sapiens
caggggctgctcatca

SEQ ID NO: 2094298 - DNA, 21 bp, Homo sapiens
caggggctgctcatcacccag

SEQ ID NO: 2094299 - DNA, 21 bp, Homo sapiens
cagggggcctttaaagactta

SEQ ID NO: 2094300 - DNA, 22 bp, Homo sapiens
cagggggcctttaaagacttaa

SEQ ID NO: 2094301 - DNA, 22 bp, Homo sapiens
caggggtatatttagaccctgt

SEQ ID NO: 2094302 - DNA, 17 bp, Homo sapiens
caggggtctccctggag

SEQ ID NO: 2094303 - DNA, 16 bp, Homo sapiens
caggggtgcctgtggg

SEQ ID NO: 2094304 - DNA, 13 bp, Homo sapiens
caggggtggagaa

SEQ ID NO: 2094305 - DNA, 15 bp, Homo sapiens
caggggtgggagagc

SEQ ID NO: 2094306 - DNA, 23 bp, Homo sapiens
cagggtagataacctgtacttca

SEQ ID NO: 2094307 - DNA, 13 bp, Homo sapiens
cagggtagcaggt

SEQ ID NO: 2094308 - DNA, 14 bp, Homo sapiens
cagggtccagaccc

SEQ ID NO: 2094309 - DNA, 15 bp, Homo sapiens
cagggtccgcaccag

SEQ ID NO: 2094310 - DNA, 16 bp, Homo sapiens
cagggtccgcaccagc

SEQ ID NO: 2094311 - DNA, 20 bp, Homo sapiens
cagggtccgcaccagctgct

SEQ ID NO: 2094312 - DNA, 21 bp, Homo sapiens
cagggtccgcaccagctgctc

SEQ ID NO: 2094313 - DNA, 22 bp, Homo sapiens
cagggtccgcaccagctgctct

SEQ ID NO: 2094314 - DNA, 15 bp, Homo sapiens
cagggtctcactctg

SEQ ID NO: 2094315 - DNA, 16 bp, Homo sapiens
cagggtctcactctgt

SEQ ID NO: 2094316 - DNA, 21 bp, Homo sapiens
cagggtctcactctgtcgccc

SEQ ID NO: 2094317 - DNA, 20 bp, Homo sapiens
cagggtcttgggctactggc

SEQ ID NO: 2094318 - DNA, 23 bp, Homo sapiens
cagggtcttgggctactggcagc

SEQ ID NO: 2094319 - DNA, 14 bp, Homo sapiens
cagggtgagagctg

SEQ ID NO: 2094320 - DNA, 18 bp, Homo sapiens
cagggtgggatggaggag

SEQ ID NO: 2094321 - DNA, 15 bp, Homo sapiens
cagggtgggccactc

SEQ ID NO: 2094322 - DNA, 18 bp, Homo sapiens
cagggtgggccactctcc

SEQ ID NO: 2094323 - DNA, 20 bp, Homo sapiens
cagggtgttacaaggcactt

SEQ ID NO: 2094324 - DNA, 21 bp, Homo sapiens
cagggttgatcacactctggg

SEQ ID NO: 2094325 - DNA, 14 bp, Homo sapiens
cagggttggcccct

SEQ ID NO: 2094326 - DNA, 16 bp, Homo sapiens
cagggttggcccctgc

SEQ ID NO: 2094327 - DNA, 18 bp, Homo sapiens
caggtaaatgggcagtgc

SEQ ID NO: 2094328 - DNA, 14 bp, Homo sapiens
caggtaacaggcag

SEQ ID NO: 2094329 - DNA, 17 bp, Homo sapiens
caggtaacaggcagata

SEQ ID NO: 2094330 - DNA, 17 bp, Homo sapiens
caggtaatgagggactg

SEQ ID NO: 2094331 - DNA, 21 bp, Homo sapiens
caggtacttcctcctgatggc

SEQ ID NO: 2094332 - DNA, 22 bp, Homo sapiens
caggtacttcctcctgatggcc

SEQ ID NO: 2094333 - DNA, 20 bp, Homo sapiens
caggtagatcgcttgagccc

SEQ ID NO: 2094334 - DNA, 12 bp, Homo sapiens
caggtaggccct

SEQ ID NO: 2094335 - DNA, 13 bp, Homo sapiens
caggtaggccctt

SEQ ID NO: 2094336 - DNA, 21 bp, Homo sapiens
caggtaggcccttgtcctgcc

SEQ ID NO: 2094337 - DNA, 22 bp, Homo sapiens
caggtaggcccttgtcctgcca

SEQ ID NO: 2094338 - DNA, 16 bp, Homo sapiens
caggtagtactgggaa

SEQ ID NO: 2094339 - DNA, 15 bp, Homo sapiens
caggtatcaggcaca

SEQ ID NO: 2094340 - DNA, 22 bp, Homo sapiens
caggtatcaggcacaggcagga

SEQ ID NO: 2094341 - DNA, 16 bp, Homo sapiens
caggtatctccaggat

SEQ ID NO: 2094342 - DNA, 18 bp, Homo sapiens
caggtatctccaggattg

SEQ ID NO: 2094343 - DNA, 20 bp, Homo sapiens
caggtatgaccttctaggaa

SEQ ID NO: 2094344 - DNA, 23 bp, Homo sapiens
caggtcctgaaagtctgtgtcca

SEQ ID NO: 2094345 - DNA, 12 bp, Homo sapiens
caggtcctgccc

SEQ ID NO: 2094346 - DNA, 23 bp, Homo sapiens
caggtcctgcccatgtgtcccct

SEQ ID NO: 2094347 - DNA, 13 bp, Homo sapiens
caggtcctggtgg

SEQ ID NO: 2094348 - DNA, 14 bp, Homo sapiens
caggtcctggtggg

SEQ ID NO: 2094349 - DNA, 18 bp, Homo sapiens
caggtcctggtggggcag

SEQ ID NO: 2094350 - DNA, 20 bp, Homo sapiens
caggtcctggtggggcagct

SEQ ID NO: 2094351 - DNA, 22 bp, Homo sapiens
caggtccttcctttaggtctgg

SEQ ID NO: 2094352 - DNA, 14 bp, Homo sapiens
caggtctctggcag

SEQ ID NO: 2094353 - DNA, 15 bp, Homo sapiens
caggtctctggcaga

SEQ ID NO: 2094354 - DNA, 20 bp, Homo sapiens
caggtctctggcagagaagg

SEQ ID NO: 2094355 - DNA, 24 bp, Homo sapiens
cagtgttttttcactttagctatg

SEQ ID NO: 2094356 - DNA, 12 bp, Homo sapiens
cagttaaaatgt

SEQ ID NO: 2094357 - DNA, 19 bp, Homo sapiens
cagttaactttaagactga

SEQ ID NO: 2094358 - DNA, 15 bp, Homo sapiens
cagttacaaaaatag

SEQ ID NO: 2094359 - DNA, 16 bp, Homo sapiens
cagttacttacctgca

SEQ ID NO: 2094360 - DNA, 15 bp, Homo sapiens
cagttatattcttta

SEQ ID NO: 2094361 - DNA, 16 bp, Homo sapiens
cagttatattctttaa

SEQ ID NO: 2094362 - DNA, 19 bp, Homo sapiens
cagttatattctttaaatt

SEQ ID NO: 2094363 - DNA, 13 bp, Homo sapiens
cagttatggctat

SEQ ID NO: 2094364 - DNA, 14 bp, Homo sapiens
cagttatttatagt

SEQ ID NO: 2094365 - DNA, 13 bp, Homo sapiens
cagttcaaagaag

SEQ ID NO: 2094366 - DNA, 15 bp, Homo sapiens
cagttcaaagcagga

SEQ ID NO: 2094367 - DNA, 17 bp, Homo sapiens
cagttcaaatcctcacc

SEQ ID NO: 2094368 - DNA, 17 bp, Homo sapiens
cagttcaacctggtggc

SEQ ID NO: 2094369 - DNA, 22 bp, Homo sapiens
cagttcaacctggtggcaccag

SEQ ID NO: 2094370 - DNA, 23 bp, Homo sapiens
cagttcagagttgtacactgtgt

SEQ ID NO: 2094371 - DNA, 12 bp, Homo sapiens
cagttcatctat

SEQ ID NO: 2094372 - DNA, 21 bp, Homo sapiens
cagttcatctatggcagtcca

SEQ ID NO: 2094373 - DNA, 23 bp, Homo sapiens
cagttcccggagcacagccctgg

SEQ ID NO: 2094374 - DNA, 14 bp, Homo sapiens
cagttcctcgccct

SEQ ID NO: 2094375 - DNA, 18 bp, Homo sapiens
cagttcctcgccctgggt

SEQ ID NO: 2094376 - DNA, 15 bp, Homo sapiens
cagttcctctttgca

SEQ ID NO: 2094377 - DNA, 23 bp, Homo sapiens
cagttcctctttgcatggaattt

SEQ ID NO: 2094378 - DNA, 15 bp, Homo sapiens
cagttcctttcaatg

SEQ ID NO: 2094379 - DNA, 15 bp, Homo sapiens
cagttcgcagccacc

SEQ ID NO: 2094380 - DNA, 16 bp, Homo sapiens
cagttcgcagccaccc

SEQ ID NO: 2094381 - DNA, 20 bp, Homo sapiens
cagttctacaagcatatttg

SEQ ID NO: 2094382 - DNA, 16 bp, Homo sapiens
cagttctgaactggaa

SEQ ID NO: 2094383 - DNA, 19 bp, Homo sapiens
cagttctgctcctctccag

SEQ ID NO: 2094384 - DNA, 20 bp, Homo sapiens
cagttctgctcctctccagg

SEQ ID NO: 2094385 - DNA, 14 bp, Homo sapiens
cagttgaaaagact

SEQ ID NO: 2094386 - DNA, 18 bp, Homo sapiens
cagttgaaaagactccaa

SEQ ID NO: 2094387 - DNA, 21 bp, Homo sapiens
cagttgaatgacaacagaagc

SEQ ID NO: 2094388 - DNA, 20 bp, Homo sapiens
cagttgagtcgtcatcactt

SEQ ID NO: 2094389 - DNA, 16 bp, Homo sapiens
cagttgcaataaaata

SEQ ID NO: 2094390 - DNA, 19 bp, Homo sapiens
cagttgcaataaaatagta

SEQ ID NO: 2094391 - DNA, 21 bp, Homo sapiens
cagttggcagagaaggcctct

SEQ ID NO: 2094392 - DNA, 14 bp, Homo sapiens
cagttgggagcact

SEQ ID NO: 2094393 - DNA, 16 bp, Homo sapiens
cagttgggagcactgg

SEQ ID NO: 2094394 - DNA, 23 bp, Homo sapiens
cagttgtctattctgagccttga

SEQ ID NO: 2094395 - DNA, 14 bp, Homo sapiens
cagttgttatttag

SEQ ID NO: 2094396 - DNA, 12 bp, Homo sapiens
cagtttaaagca

SEQ ID NO: 2094397 - DNA, 18 bp, Homo sapiens
cagtttagaacagaggga

SEQ ID NO: 2094398 - DNA, 21 bp, Homo sapiens
cagtttagaacagagggacca

SEQ ID NO: 2094399 - DNA, 18 bp, Homo sapiens
cagtttcccttctatgca

SEQ ID NO: 2094400 - DNA, 20 bp, Homo sapiens
cagtttctcctttattgctc

SEQ ID NO: 2094401 - DNA, 21 bp, Homo sapiens
cagtttgcagaaaagcacctg

SEQ ID NO: 2094402 - DNA, 22 bp, Homo sapiens
cagtttgcagaaaagcacctgc

SEQ ID NO: 2094403 - DNA, 21 bp, Homo sapiens
cagtttgcttagttctcactg

SEQ ID NO: 2094404 - DNA, 13 bp, Homo sapiens
cagtttgtcagac

SEQ ID NO: 2094405 - DNA, 16 bp, Homo sapiens
cagtttgttctccggg

SEQ ID NO: 2094406 - DNA, 20 bp, Homo sapiens
cagtttttcggtgggacagc

SEQ ID NO: 2094407 - DNA, 16 bp, Homo sapiens
cagttttttatgctaa

SEQ ID NO: 2094408 - DNA, 21 bp, Homo sapiens
cagtttttttatggcattttt

SEQ ID NO: 2094409 - DNA, 17 bp, Homo sapiens
cataaaatatacaaaca

SEQ ID NO: 2094410 - DNA, 20 bp, Homo sapiens
cataaaatatacaaacatgt

SEQ ID NO: 2094411 - DNA, 17 bp, Homo sapiens
cataaaatctgtgaatt

SEQ ID NO: 2094412 - DNA, 19 bp, Homo sapiens
cataaaatgggtgatatgc

SEQ ID NO: 2094413 - DNA, 13 bp, Homo sapiens
cataaacagcatt

SEQ ID NO: 2094414 - DNA, 19 bp, Homo sapiens
cataaaccaatgagctgta

SEQ ID NO: 2094415 - DNA, 23 bp, Homo sapiens
cataaaccaatgagctgtatctg

SEQ ID NO: 2094416 - DNA, 16 bp, Homo sapiens
cataaacttcatggtc

SEQ ID NO: 2094417 - DNA, 20 bp, Homo sapiens
cataaagcaaatagacacag

SEQ ID NO: 2094418 - DNA, 22 bp, Homo sapiens
cataaaggtggtatgtgtgtgt

SEQ ID NO: 2094419 - DNA, 19 bp, Homo sapiens
cataaagtgccagtttgct

SEQ ID NO: 2094420 - DNA, 20 bp, Homo sapiens
cataacagattttttttgga

SEQ ID NO: 2094421 - DNA, 22 bp, Homo sapiens
cataaccatgtgaaaaggcaaa

SEQ ID NO: 2094422 - DNA, 20 bp, Homo sapiens
cataaccattcccattggtt

SEQ ID NO: 2094423 - DNA, 20 bp, Homo sapiens
cataaccccaggcatcccat

SEQ ID NO: 2094424 - DNA, 19 bp, Homo sapiens
cataactagtttaattaac

SEQ ID NO: 2094425 - DNA, 19 bp, Homo sapiens
cataacttgctgaatttca

SEQ ID NO: 2094426 - DNA, 12 bp, Homo sapiens
cataagaatgaa

SEQ ID NO: 2094427 - DNA, 20 bp, Homo sapiens
cataagaccataacagccaa

SEQ ID NO: 2094428 - DNA, 12 bp, Homo sapiens
cataagattaaa

SEQ ID NO: 2094429 - DNA, 22 bp, Homo sapiens
cataaggaatgtagctggtttc

SEQ ID NO: 2094430 - DNA, 14 bp, Homo sapiens
cataaggagaatgt

SEQ ID NO: 2094431 - DNA, 19 bp, Homo sapiens
cataaggagaatgtatctc

SEQ ID NO: 2094432 - DNA, 22 bp, Homo sapiens
cataaggccagaaactcctttt

SEQ ID NO: 2094433 - DNA, 12 bp, Homo sapiens
cataaggcctgc

SEQ ID NO: 2094434 - DNA, 16 bp, Homo sapiens
cataaggcctgccctc

SEQ ID NO: 2094435 - DNA, 21 bp, Homo sapiens
cataaggcctgccctcccatg

SEQ ID NO: 2094436 - DNA, 12 bp, Homo sapiens
cataagtttctg

SEQ ID NO: 2094437 - DNA, 13 bp, Homo sapiens
cataatataagaa

SEQ ID NO: 2094438 - DNA, 19 bp, Homo sapiens
cataatatcttgaagaata

SEQ ID NO: 2094439 - DNA, 20 bp, Homo sapiens
cataatatcttgaagaatat

SEQ ID NO: 2094440 - DNA, 21 bp, Homo sapiens
cataatatcttgaagaatatt

SEQ ID NO: 2094441 - DNA, 21 bp, Homo sapiens
cataatctggactcctctgtc

SEQ ID NO: 2094442 - DNA, 23 bp, Homo sapiens
cataatctggactcctctgtcca

SEQ ID NO: 2094443 - DNA, 22 bp, Homo sapiens
cataatgaatgctattgaaaag

SEQ ID NO: 2094444 - DNA, 13 bp, Homo sapiens
cataatgccactg

SEQ ID NO: 2094445 - DNA, 20 bp, Homo sapiens
cataatgctcccatctcctg

SEQ ID NO: 2094446 - DNA, 21 bp, Homo sapiens
cataatgctcccatctcctga

SEQ ID NO: 2094447 - DNA, 22 bp, Homo sapiens
cataatgctcccatctcctgat

SEQ ID NO: 2094448 - DNA, 15 bp, Homo sapiens
cataatgtataaaga

SEQ ID NO: 2094449 - DNA, 15 bp, Homo sapiens
cataattagaacaat

SEQ ID NO: 2094450 - DNA, 19 bp, Homo sapiens
cataattatgacagttata

SEQ ID NO: 2094451 - DNA, 17 bp, Homo sapiens
cataattcttgtatatt

SEQ ID NO: 2094452 - DNA, 14 bp, Homo sapiens
cataattttcttca

SEQ ID NO: 2094453 - DNA, 15 bp, Homo sapiens
catacaacacaaaga

SEQ ID NO: 2094454 - DNA, 16 bp, Homo sapiens
catacaacacaaagag

SEQ ID NO: 2094455 - DNA, 17 bp, Homo sapiens
catacaacacaaagaga

SEQ ID NO: 2094456 - DNA, 15 bp, Homo sapiens
catacaatttgcact

SEQ ID NO: 2094457 - DNA, 24 bp, Homo sapiens
catacacatccccagccagaagtt

SEQ ID NO: 2094458 - DNA, 19 bp, Homo sapiens
catacacttgtataaatgt

SEQ ID NO: 2094459 - DNA, 20 bp, Homo sapiens
catacacttgtataaatgta

SEQ ID NO: 2094460 - DNA, 18 bp, Homo sapiens
catacatacacatacata

SEQ ID NO: 2094461 - DNA, 17 bp, Homo sapiens
catacatacatacatac

SEQ ID NO: 2094462 - DNA, 17 bp, Homo sapiens
catacattaaggagcag

SEQ ID NO: 2094463 - DNA, 17 bp, Homo sapiens
catacatttataatgtt

SEQ ID NO: 2094464 - DNA, 12 bp, Homo sapiens
cataccatcact

SEQ ID NO: 2094465 - DNA, 23 bp, Homo sapiens
catacccctgcctgggttttcta

SEQ ID NO: 2094466 - DNA, 18 bp, Homo sapiens
cataccctttatctctgt

SEQ ID NO: 2094467 - DNA, 19 bp, Homo sapiens
cataccgctggggaacaga

SEQ ID NO: 2094468 - DNA, 18 bp, Homo sapiens
catacctgctggtgcaga

SEQ ID NO: 2094469 - DNA, 16 bp, Homo sapiens
catgcacagctgcttg

SEQ ID NO: 2094470 - DNA, 19 bp, Homo sapiens
catgcacagctgcttgtcc

SEQ ID NO: 2094471 - DNA, 19 bp, Homo sapiens
catgcactgacccttccag

SEQ ID NO: 2094472 - DNA, 22 bp, Homo sapiens
catgcactgacccttccagaca

SEQ ID NO: 2094473 - DNA, 12 bp, Homo sapiens
catgcagctctg

SEQ ID NO: 2094474 - DNA, 13 bp, Homo sapiens
catgcagcttcat

SEQ ID NO: 2094475 - DNA, 20 bp, Homo sapiens
catgcagcttcatcaatttt

SEQ ID NO: 2094476 - DNA, 22 bp, Homo sapiens
catgcagcttcatcaattttta

SEQ ID NO: 2094477 - DNA, 15 bp, Homo sapiens
catgcattactgcat

SEQ ID NO: 2094478 - DNA, 14 bp, Homo sapiens
catgcattcataca

SEQ ID NO: 2094479 - DNA, 14 bp, Homo sapiens
catgcattttgcag

SEQ ID NO: 2094480 - DNA, 19 bp, Homo sapiens
catgcattttgcagcagtg

SEQ ID NO: 2094481 - DNA, 20 bp, Homo sapiens
catgcattttgcagcagtga

SEQ ID NO: 2094482 - DNA, 14 bp, Homo sapiens
catgccaccctctc

SEQ ID NO: 2094483 - DNA, 13 bp, Homo sapiens
catgccactgcca

SEQ ID NO: 2094484 - DNA, 15 bp, Homo sapiens
catgccactgccagg

SEQ ID NO: 2094485 - DNA, 17 bp, Homo sapiens
catgccactgccaggca

SEQ ID NO: 2094486 - DNA, 21 bp, Homo sapiens
catgccactgccaggcacctg

SEQ ID NO: 2094487 - DNA, 18 bp, Homo sapiens
catgccatctccaccctg

SEQ ID NO: 2094488 - DNA, 16 bp, Homo sapiens
catgccatctgttttc

SEQ ID NO: 2094489 - DNA, 12 bp, Homo sapiens
catgcccaacct

SEQ ID NO: 2094490 - DNA, 11 bp, Homo sapiens
catgcccagag

SEQ ID NO: 2094491 - DNA, 12 bp, Homo sapiens
catgcccagaga

SEQ ID NO: 2094492 - DNA, 22 bp, Homo sapiens
catgcccagtcgatatctcact

SEQ ID NO: 2094493 - DNA, 16 bp, Homo sapiens
catgcctacagataat

SEQ ID NO: 2094494 - DNA, 16 bp, Homo sapiens
catgcctcaagaacac

SEQ ID NO: 2094495 - DNA, 14 bp, Homo sapiens
catgcctcatgcca

SEQ ID NO: 2094496 - DNA, 16 bp, Homo sapiens
catgcctcatgccaca

SEQ ID NO: 2094497 - DNA, 17 bp, Homo sapiens
catgcctcatgccacac

SEQ ID NO: 2094498 - DNA, 21 bp, Homo sapiens
catgcctctgaggccagcctg

SEQ ID NO: 2094499 - DNA, 22 bp, Homo sapiens
catgcctctgaggccagcctgg

SEQ ID NO: 2094500 - DNA, 22 bp, Homo sapiens
catgcctctgatatgggactga

SEQ ID NO: 2094501 - DNA, 11 bp, Homo sapiens
catgcctgagg

SEQ ID NO: 2094502 - DNA, 20 bp, Homo sapiens
catgcctgagggtggagact

SEQ ID NO: 2094503 - DNA, 15 bp, Homo sapiens
catgcctgattttaa

SEQ ID NO: 2094504 - DNA, 18 bp, Homo sapiens
catgcctggcccccctcc

SEQ ID NO: 2094505 - DNA, 21 bp, Homo sapiens
catgcctggcccccctccagg

SEQ ID NO: 2094506 - DNA, 22 bp, Homo sapiens
catgcctggcccccctccaggc

SEQ ID NO: 2094507 - DNA, 13 bp, Homo sapiens
catgcgcacaagg

SEQ ID NO: 2094508 - DNA, 17 bp, Homo sapiens
catgcgtatatgtgcgt

SEQ ID NO: 2094509 - DNA, 13 bp, Homo sapiens
catgctaagagaa

SEQ ID NO: 2094510 - DNA, 16 bp, Homo sapiens
catgctatctctgtgt

SEQ ID NO: 2094511 - DNA, 16 bp, Homo sapiens
catgctcaaccactgt

SEQ ID NO: 2094512 - DNA, 19 bp, Homo sapiens
catgctcaaccactgtggc

SEQ ID NO: 2094513 - DNA, 20 bp, Homo sapiens
catgctcagccctgactggt

SEQ ID NO: 2094514 - DNA, 17 bp, Homo sapiens
catgctcagcccttcct

SEQ ID NO: 2094515 - DNA, 11 bp, Homo sapiens
catgctctgga

SEQ ID NO: 2094516 - DNA, 19 bp, Homo sapiens
catgctctggaagcctgga

SEQ ID NO: 2094517 - DNA, 21 bp, Homo sapiens
catgctctggaagcctggact

SEQ ID NO: 2094518 - DNA, 19 bp, Homo sapiens
catgctgaagggaccttga

SEQ ID NO: 2094519 - DNA, 12 bp, Homo sapiens
catgctgcctcc

SEQ ID NO: 2094520 - DNA, 14 bp, Homo sapiens
catgctggcctgtg

SEQ ID NO: 2094521 - DNA, 16 bp, Homo sapiens
catgctggcctgtggc

SEQ ID NO: 2094522 - DNA, 18 bp, Homo sapiens
catgctggcggcgcagag

SEQ ID NO: 2094523 - DNA, 22 bp, Homo sapiens
catgctggcggcgcagagggaa

SEQ ID NO: 2094524 - DNA, 20 bp, Homo sapiens
catgctggggcaagtccctg

SEQ ID NO: 2094525 - DNA, 22 bp, Homo sapiens
catgctgtgctctttgaagaga

SEQ ID NO: 2094526 - DNA, 16 bp, Homo sapiens
catgcttcttccttac

SEQ ID NO: 2094527 - DNA, 13 bp, Homo sapiens
catgcttcttgcc

SEQ ID NO: 2094528 - DNA, 19 bp, Homo sapiens
catgctttaaagtgtaata

SEQ ID NO: 2094529 - DNA, 12 bp, Homo sapiens
catgctttccca

SEQ ID NO: 2094530 - DNA, 20 bp, Homo sapiens
catgctttcctaaagtctct

SEQ ID NO: 2094531 - DNA, 15 bp, Homo sapiens
catggaaaagcccag

SEQ ID NO: 2094532 - DNA, 21 bp, Homo sapiens
catggaaaatgtcctgtggtg

SEQ ID NO: 2094533 - DNA, 17 bp, Homo sapiens
catggaaacctgaaaaa

SEQ ID NO: 2094534 - DNA, 23 bp, Homo sapiens
catggaatgtaactatatcatcc

SEQ ID NO: 2094535 - DNA, 16 bp, Homo sapiens
catggaatttgtaagt

SEQ ID NO: 2094536 - DNA, 23 bp, Homo sapiens
catggacaccccttatccaggac

SEQ ID NO: 2094537 - DNA, 16 bp, Homo sapiens
catggagaaaccctgt

SEQ ID NO: 2094538 - DNA, 21 bp, Homo sapiens
catggagactcctgccctgtt

SEQ ID NO: 2094539 - DNA, 16 bp, Homo sapiens
catggagagagactca

SEQ ID NO: 2094540 - DNA, 23 bp, Homo sapiens
catggagagagactcaaagagac

SEQ ID NO: 2094541 - DNA, 13 bp, Homo sapiens
catggagctgagg

SEQ ID NO: 2094542 - DNA, 16 bp, Homo sapiens
catggaggcaggctcc

SEQ ID NO: 2094543 - DNA, 20 bp, Homo sapiens
catggatgcacgcacatgcc

SEQ ID NO: 2094544 - DNA, 21 bp, Homo sapiens
catggatttctgtcttctcta

SEQ ID NO: 2094545 - DNA, 16 bp, Homo sapiens
catggatttgatgaaa

SEQ ID NO: 2094546 - DNA, 12 bp, Homo sapiens
catggcaccagc

SEQ ID NO: 2094547 - DNA, 17 bp, Homo sapiens
catggcaccagccccct

SEQ ID NO: 2094548 - DNA, 20 bp, Homo sapiens
catggcaccagccccctgga

SEQ ID NO: 2094549 - DNA, 19 bp, Homo sapiens
catggcagatgtaggaggg

SEQ ID NO: 2094550 - DNA, 20 bp, Homo sapiens
catggcagatgtaggaggga

SEQ ID NO: 2094551 - DNA, 21 bp, Homo sapiens
catggcagatgtaggagggac

SEQ ID NO: 2094552 - DNA, 20 bp, Homo sapiens
catggccaaatcgcagtgat

SEQ ID NO: 2094553 - DNA, 14 bp, Homo sapiens
catggccaggtggc

SEQ ID NO: 2094554 - DNA, 14 bp, Homo sapiens
catggccctggggt

SEQ ID NO: 2094555 - DNA, 21 bp, Homo sapiens
catggcctattatattaaaat

SEQ ID NO: 2094556 - DNA, 20 bp, Homo sapiens
catggcgtaatgggcctgcc

SEQ ID NO: 2094557 - DNA, 14 bp, Homo sapiens
catggctaactggc

SEQ ID NO: 2094558 - DNA, 16 bp, Homo sapiens
catggctaactggcga

SEQ ID NO: 2094559 - DNA, 21 bp, Homo sapiens
catggctatcctagagaggct

SEQ ID NO: 2094560 - DNA, 14 bp, Homo sapiens
catggctattttat

SEQ ID NO: 2094561 - DNA, 13 bp, Homo sapiens
catggctcaggca

SEQ ID NO: 2094562 - DNA, 16 bp, Homo sapiens
catggctcaggcaagc

SEQ ID NO: 2094563 - DNA, 20 bp, Homo sapiens
catggctcaggcaagcccct

SEQ ID NO: 2094564 - DNA, 17 bp, Homo sapiens
catggcttaatgtttat

SEQ ID NO: 2094565 - DNA, 18 bp, Homo sapiens
catggcttggggagcaga

SEQ ID NO: 2094566 - DNA, 13 bp, Homo sapiens
catgggaaaggag

SEQ ID NO: 2094567 - DNA, 23 bp, Homo sapiens
catgggaatgtgcctcggcctcc

SEQ ID NO: 2094568 - DNA, 18 bp, Homo sapiens
catgggcctcctgtgtgt

SEQ ID NO: 2094569 - DNA, 14 bp, Homo sapiens
catgggcctgctgc

SEQ ID NO: 2094570 - DNA, 15 bp, Homo sapiens
catgggcctgctgcg

SEQ ID NO: 2094571 - DNA, 22 bp, Homo sapiens
catgggcctgctgcgtcagacc

SEQ ID NO: 2094572 - DNA, 13 bp, Homo sapiens
catgggcctgggc

SEQ ID NO: 2094573 - DNA, 15 bp, Homo sapiens
catgggcctgggcct

SEQ ID NO: 2094574 - DNA, 16 bp, Homo sapiens
catgggcctgggcctg

SEQ ID NO: 2094575 - DNA, 18 bp, Homo sapiens
catgggcctgggcctgct

SEQ ID NO: 2094576 - DNA, 23 bp, Homo sapiens
catgggcttggacttcctggggc

SEQ ID NO: 2094577 - DNA, 24 bp, Homo sapiens
catggggaagtgctccccacacgt

SEQ ID NO: 2094578 - DNA, 22 bp, Homo sapiens
catgggtacccagactctaaat

SEQ ID NO: 2094579 - DNA, 18 bp, Homo sapiens
catgggtgtcagctttgc

SEQ ID NO: 2094580 - DNA, 18 bp, Homo sapiens
catgggtgtgcccttggg

SEQ ID NO: 2094581 - DNA, 17 bp, Homo sapiens
catggtcccacatccct

SEQ ID NO: 2094582 - DNA, 19 bp, Homo sapiens
catggtcccacatccctgg

SEQ ID NO: 2094583 - DNA, 23 bp, Homo sapiens
catggtcccacatccctgggcct

SEQ ID NO: 2094584 - DNA, 22 bp, Homo sapiens
ccaaagtgcagcccttcctcct

SEQ ID NO: 2094585 - DNA, 14 bp, Homo sapiens
ccaaagtgctggga

SEQ ID NO: 2094586 - DNA, 13 bp, Homo sapiens
ccaaataaatgtg

SEQ ID NO: 2094587 - DNA, 19 bp, Homo sapiens
ccaaataaatgtgtaaatg

SEQ ID NO: 2094588 - DNA, 23 bp, Homo sapiens
ccaaatattattcaagtgcctct

SEQ ID NO: 2094589 - DNA, 16 bp, Homo sapiens
ccaaatcatagtggct

SEQ ID NO: 2094590 - DNA, 19 bp, Homo sapiens
ccaaatgatgccacttccc

SEQ ID NO: 2094591 - DNA, 18 bp, Homo sapiens
ccaaatgcacaagctcag

SEQ ID NO: 2094592 - DNA, 19 bp, Homo sapiens
ccaaatggctctgtgaaat

SEQ ID NO: 2094593 - DNA, 22 bp, Homo sapiens
ccaaatgtaattgaataaagtt

SEQ ID NO: 2094594 - DNA, 21 bp, Homo sapiens
ccaaatgtgatcaactgttca

SEQ ID NO: 2094595 - DNA, 12 bp, Homo sapiens
ccaaattatttg

SEQ ID NO: 2094596 - DNA, 14 bp, Homo sapiens
ccaaattatttgtg

SEQ ID NO: 2094597 - DNA, 17 bp, Homo sapiens
ccaaattatttgtgtaa

SEQ ID NO: 2094598 - DNA, 18 bp, Homo sapiens
ccaaattatttgtgtaat

SEQ ID NO: 2094599 - DNA, 19 bp, Homo sapiens
ccaaattgcttctaggagt

SEQ ID NO: 2094600 - DNA, 16 bp, Homo sapiens
ccaacaataaagagct

SEQ ID NO: 2094601 - DNA, 16 bp, Homo sapiens
ccaacaatggggtggg

SEQ ID NO: 2094602 - DNA, 18 bp, Homo sapiens
ccaacaatggggtgggcc

SEQ ID NO: 2094603 - DNA, 22 bp, Homo sapiens
ccaacacaatctttccttgtct

SEQ ID NO: 2094604 - DNA, 20 bp, Homo sapiens
ccaacaccctgtctaaaaaa

SEQ ID NO: 2094605 - DNA, 23 bp, Homo sapiens
ccaacaccttcttggcttctggg

SEQ ID NO: 2094606 - DNA, 19 bp, Homo sapiens
ccaacagcttgaccagacc

SEQ ID NO: 2094607 - DNA, 20 bp, Homo sapiens
ccaacagcttgaccagacct

SEQ ID NO: 2094608 - DNA, 14 bp, Homo sapiens
ccaacaggtggcag

SEQ ID NO: 2094609 - DNA, 18 bp, Homo sapiens
ccaacaggtggcaggacc

SEQ ID NO: 2094610 - DNA, 19 bp, Homo sapiens
ccaacagtcaaaacagaga

SEQ ID NO: 2094611 - DNA, 20 bp, Homo sapiens
ccaacagtgagtctgtcagc

SEQ ID NO: 2094612 - DNA, 20 bp, Homo sapiens
ccaacatacccttctttaaa

SEQ ID NO: 2094613 - DNA, 21 bp, Homo sapiens
ccaacatcccattgccctggt

SEQ ID NO: 2094614 - DNA, 21 bp, Homo sapiens
ccaaccaagagcacattctta

SEQ ID NO: 2094615 - DNA, 14 bp, Homo sapiens
ccaaccacaaacca

SEQ ID NO: 2094616 - DNA, 14 bp, Homo sapiens
ccaaccagcttgtc

SEQ ID NO: 2094617 - DNA, 12 bp, Homo sapiens
ccaacccatcag

SEQ ID NO: 2094618 - DNA, 19 bp, Homo sapiens
ccaaccccagctggcctct

SEQ ID NO: 2094619 - DNA, 12 bp, Homo sapiens
ccaaccccaggg

SEQ ID NO: 2094620 - DNA, 18 bp, Homo sapiens
ccaaccccccacctgcca

SEQ ID NO: 2094621 - DNA, 22 bp, Homo sapiens
ccaaccccgcggtgctctggcg

SEQ ID NO: 2094622 - DNA, 15 bp, Homo sapiens
ccaacccgtggaggc

SEQ ID NO: 2094623 - DNA, 17 bp, Homo sapiens
ccaacccgtggaggctg

SEQ ID NO: 2094624 - DNA, 21 bp, Homo sapiens
ccaacccgtggaggctgctcg

SEQ ID NO: 2094625 - DNA, 16 bp, Homo sapiens
ccaacctcaatgccct

SEQ ID NO: 2094626 - DNA, 18 bp, Homo sapiens
ccaacctcaatgccctgc

SEQ ID NO: 2094627 - DNA, 19 bp, Homo sapiens
ccaacctcaatgccctgcc

SEQ ID NO: 2094628 - DNA, 20 bp, Homo sapiens
ccaacctcaatgccctgcca

SEQ ID NO: 2094629 - DNA, 12 bp, Homo sapiens
ccaacctgacca

SEQ ID NO: 2094630 - DNA, 13 bp, Homo sapiens
ccaacctgaccaa

SEQ ID NO: 2094631 - DNA, 18 bp, Homo sapiens
ccaacctgatgccccttc

SEQ ID NO: 2094632 - DNA, 13 bp, Homo sapiens
ccaacctggacaa

SEQ ID NO: 2094633 - DNA, 20 bp, Homo sapiens
ccaacctttccctcaccccc

SEQ ID NO: 2094634 - DNA, 13 bp, Homo sapiens
ccaacgcacagga

SEQ ID NO: 2094635 - DNA, 19 bp, Homo sapiens
ccaacgttaaaagacagtg

SEQ ID NO: 2094636 - DNA, 17 bp, Homo sapiens
ccaactattaaagtgcc

SEQ ID NO: 2094637 - DNA, 14 bp, Homo sapiens
ccaactcacctgag

SEQ ID NO: 2094638 - DNA, 13 bp, Homo sapiens
ccaactcctcctt

SEQ ID NO: 2094639 - DNA, 14 bp, Homo sapiens
ccaactcctccttg

SEQ ID NO: 2094640 - DNA, 15 bp, Homo sapiens
ccaactcctccttgc

SEQ ID NO: 2094641 - DNA, 13 bp, Homo sapiens
ccaactctgcact

SEQ ID NO: 2094642 - DNA, 15 bp, Homo sapiens
ccaactctgcactcc

SEQ ID NO: 2094643 - DNA, 13 bp, Homo sapiens
ccaactggtcact

SEQ ID NO: 2094644 - DNA, 18 bp, Homo sapiens
ccaactgtgttcattaga

SEQ ID NO: 2094645 - DNA, 11 bp, Homo sapiens
ccaacttgtaa

SEQ ID NO: 2094646 - DNA, 11 bp, Homo sapiens
ccaagaaaaag

SEQ ID NO: 2094647 - DNA, 13 bp, Homo sapiens
ccaagaagggcta

SEQ ID NO: 2094648 - DNA, 22 bp, Homo sapiens
ccaagaagggctagaacctgga

SEQ ID NO: 2094649 - DNA, 19 bp, Homo sapiens
ccaagaatagatgctgact

SEQ ID NO: 2094650 - DNA, 18 bp, Homo sapiens
ccaagacttggcaacaga

SEQ ID NO: 2094651 - DNA, 22 bp, Homo sapiens
ccaagacttggcaacagaagca

SEQ ID NO: 2094652 - DNA, 21 bp, Homo sapiens
ccaagagagacattgcctcca

SEQ ID NO: 2094653 - DNA, 20 bp, Homo sapiens
ccaagagcacattcttaaag

SEQ ID NO: 2094654 - DNA, 19 bp, Homo sapiens
ccaagagcagaggcagcga

SEQ ID NO: 2094655 - DNA, 21 bp, Homo sapiens
ccaagagcatcatgcctctga

SEQ ID NO: 2094656 - DNA, 22 bp, Homo sapiens
ccaagagcatcatgcctctgag

SEQ ID NO: 2094657 - DNA, 23 bp, Homo sapiens
ccaagagcatcatgcctctgagg

SEQ ID NO: 2094658 - DNA, 15 bp, Homo sapiens
ccaagaggtctgagc

SEQ ID NO: 2094659 - DNA, 16 bp, Homo sapiens
ccaagaggtctgagcc

SEQ ID NO: 2094660 - DNA, 18 bp, Homo sapiens
ccaagatacttaagtgct

SEQ ID NO: 2094661 - DNA, 17 bp, Homo sapiens
ccaagatgggcacatga

SEQ ID NO: 2094662 - DNA, 19 bp, Homo sapiens
ccaagatgggcacatgagg

SEQ ID NO: 2094663 - DNA, 19 bp, Homo sapiens
ccaagattcaaagagacta

SEQ ID NO: 2094664 - DNA, 21 bp, Homo sapiens
ccaagcactcgagaccatcct

SEQ ID NO: 2094665 - DNA, 22 bp, Homo sapiens
ccaagcactcgagaccatcctg

SEQ ID NO: 2094666 - DNA, 11 bp, Homo sapiens
ccaagcagcca

SEQ ID NO: 2094667 - DNA, 12 bp, Homo sapiens
ccaagcagccag

SEQ ID NO: 2094668 - DNA, 13 bp, Homo sapiens
ccaagcagccagc

SEQ ID NO: 2094669 - DNA, 14 bp, Homo sapiens
ccaagcagccagcc

SEQ ID NO: 2094670 - DNA, 21 bp, Homo sapiens
ccaagcccttttacagctctt

SEQ ID NO: 2094671 - DNA, 13 bp, Homo sapiens
ccaagcctctgcc

SEQ ID NO: 2094672 - DNA, 14 bp, Homo sapiens
ccaagcctctgccc

SEQ ID NO: 2094673 - DNA, 19 bp, Homo sapiens
ccaagcctctgccccaagg

SEQ ID NO: 2094674 - DNA, 21 bp, Homo sapiens
ccaagcctctgccccaagggg

SEQ ID NO: 2094675 - DNA, 13 bp, Homo sapiens
ccaagcctgacca

SEQ ID NO: 2094676 - DNA, 22 bp, Homo sapiens
ccaagctcacagttcctcgccc

SEQ ID NO: 2094677 - DNA, 14 bp, Homo sapiens
ccaagctccatctc

SEQ ID NO: 2094678 - DNA, 18 bp, Homo sapiens
ccaagctctagtgggaag

SEQ ID NO: 2094679 - DNA, 14 bp, Homo sapiens
ccaagctctgctcc

SEQ ID NO: 2094680 - DNA, 15 bp, Homo sapiens
ccaagctgaggtgcc

SEQ ID NO: 2094681 - DNA, 12 bp, Homo sapiens
ccaagctggcag

SEQ ID NO: 2094682 - DNA, 17 bp, Homo sapiens
ccaagcttcaaccctca

SEQ ID NO: 2094683 - DNA, 18 bp, Homo sapiens
ccaagcttcaaccctcag

SEQ ID NO: 2094684 - DNA, 20 bp, Homo sapiens
ccaagcttcagagcctagcc

SEQ ID NO: 2094685 - DNA, 21 bp, Homo sapiens
ccaagcttcagagcctagcca

SEQ ID NO: 2094686 - DNA, 15 bp, Homo sapiens
ccaagctttcttcta

SEQ ID NO: 2094687 - DNA, 22 bp, Homo sapiens
ccaagctttgaatacccccaga

SEQ ID NO: 2094688 - DNA, 14 bp, Homo sapiens
ccaaggaacaagag

SEQ ID NO: 2094689 - DNA, 14 bp, Homo sapiens
ccaaggaccaggtt

SEQ ID NO: 2094690 - DNA, 20 bp, Homo sapiens
ccaaggactttccagtgagg

SEQ ID NO: 2094691 - DNA, 21 bp, Homo sapiens
ccaaggactttccagtgagga

SEQ ID NO: 2094692 - DNA, 15 bp, Homo sapiens
ccaaggagaaacaga

SEQ ID NO: 2094693 - DNA, 21 bp, Homo sapiens
ccaaggagaaacagagacagg

SEQ ID NO: 2094694 - DNA, 23 bp, Homo sapiens
ccaaggagctgatttccaggccc

SEQ ID NO: 2094695 - DNA, 13 bp, Homo sapiens
ccaaggcagcctc

SEQ ID NO: 2094696 - DNA, 14 bp, Homo sapiens
ccaaggcagcctcc

SEQ ID NO: 2094697 - DNA, 19 bp, Homo sapiens
ccaaggcagcctccagagc

SEQ ID NO: 2094698 - DNA, 20 bp, Homo sapiens
ccaaggcagcctccagagcc

SEQ ID NO: 2094699 - DNA, 23 bp, Homo sapiens
ccagaagtaaagtttatttcatg

SEQ ID NO: 2094700 - DNA, 15 bp, Homo sapiens
ccagaatctgctgtt

SEQ ID NO: 2094701 - DNA, 18 bp, Homo sapiens
ccagaatctgctgttgcc

SEQ ID NO: 2094702 - DNA, 21 bp, Homo sapiens
ccagaatcttcgtcctgcccc

SEQ ID NO: 2094703 - DNA, 16 bp, Homo sapiens
ccagacacagatacat

SEQ ID NO: 2094704 - DNA, 21 bp, Homo sapiens
ccagacaccttgacagggcac

SEQ ID NO: 2094705 - DNA, 11 bp, Homo sapiens
ccagacactgg

SEQ ID NO: 2094706 - DNA, 12 bp, Homo sapiens
ccagaccacctg

SEQ ID NO: 2094707 - DNA, 13 bp, Homo sapiens
ccagaccacctgc

SEQ ID NO: 2094708 - DNA, 17 bp, Homo sapiens
ccagaccacctgccagc

SEQ ID NO: 2094709 - DNA, 19 bp, Homo sapiens
ccagaccacctgccagcca

SEQ ID NO: 2094710 - DNA, 20 bp, Homo sapiens
ccagaccacctgccagccat

SEQ ID NO: 2094711 - DNA, 15 bp, Homo sapiens
ccagaccattgtctt

SEQ ID NO: 2094712 - DNA, 17 bp, Homo sapiens
ccagacccctggctttt

SEQ ID NO: 2094713 - DNA, 24 bp, Homo sapiens
ccagacccctggcttttcactgct

SEQ ID NO: 2094714 - DNA, 12 bp, Homo sapiens
ccagaccctgcc

SEQ ID NO: 2094715 - DNA, 17 bp, Homo sapiens
ccagaccctgcctgagc

SEQ ID NO: 2094716 - DNA, 18 bp, Homo sapiens
ccagaccctgcctgagcc

SEQ ID NO: 2094717 - DNA, 13 bp, Homo sapiens
ccagacctagacc

SEQ ID NO: 2094718 - DNA, 17 bp, Homo sapiens
ccagacctagacctggg

SEQ ID NO: 2094719 - DNA, 18 bp, Homo sapiens
ccagacgctgccgctgcc

SEQ ID NO: 2094720 - DNA, 17 bp, Homo sapiens
ccagactcctttcctct

SEQ ID NO: 2094721 - DNA, 21 bp, Homo sapiens
ccagactcgttcttctgggaa

SEQ ID NO: 2094722 - DNA, 12 bp, Homo sapiens
ccagactgtgga

SEQ ID NO: 2094723 - DNA, 16 bp, Homo sapiens
ccagagaagctcattt

SEQ ID NO: 2094724 - DNA, 16 bp, Homo sapiens
ccagagaccccttcct

SEQ ID NO: 2094725 - DNA, 17 bp, Homo sapiens
ccagagaccccttcctt

SEQ ID NO: 2094726 - DNA, 21 bp, Homo sapiens
ccagagaccccttcctttcct

SEQ ID NO: 2094727 - DNA, 22 bp, Homo sapiens
ccagagaccccttcctttcctc

SEQ ID NO: 2094728 - DNA, 21 bp, Homo sapiens
ccagagacctgaggcagatga

SEQ ID NO: 2094729 - DNA, 15 bp, Homo sapiens
ccagagaccttttct

SEQ ID NO: 2094730 - DNA, 15 bp, Homo sapiens
ccagagaggagcacc

SEQ ID NO: 2094731 - DNA, 19 bp, Homo sapiens
ccagagaggagcacctgaa

SEQ ID NO: 2094732 - DNA, 16 bp, Homo sapiens
ccagagagggcccagc

SEQ ID NO: 2094733 - DNA, 19 bp, Homo sapiens
ccagagagggcccagctgt

SEQ ID NO: 2094734 - DNA, 21 bp, Homo sapiens
ccagagagggcccagctgtag

SEQ ID NO: 2094735 - DNA, 19 bp, Homo sapiens
ccagagaggggacatttcc

SEQ ID NO: 2094736 - DNA, 13 bp, Homo sapiens
ccagagagggtgg

SEQ ID NO: 2094737 - DNA, 14 bp, Homo sapiens
ccagagagtcctct

SEQ ID NO: 2094738 - DNA, 14 bp, Homo sapiens
ccagagagtggctc

SEQ ID NO: 2094739 - DNA, 18 bp, Homo sapiens
ccagagagtggctcctcc

SEQ ID NO: 2094740 - DNA, 13 bp, Homo sapiens
ccagagcaaaata

SEQ ID NO: 2094741 - DNA, 23 bp, Homo sapiens
ccagagcacaagttccagctggt

SEQ ID NO: 2094742 - DNA, 21 bp, Homo sapiens
ccagagcattacgtgagccag

SEQ ID NO: 2094743 - DNA, 22 bp, Homo sapiens
ccagagcattacgtgagccagg

SEQ ID NO: 2094744 - DNA, 16 bp, Homo sapiens
ccagagcccaagtgcc

SEQ ID NO: 2094745 - DNA, 23 bp, Homo sapiens
ccagagcccaagtgccatcccac

SEQ ID NO: 2094746 - DNA, 22 bp, Homo sapiens
ccagagcccaccttggctcaag

SEQ ID NO: 2094747 - DNA, 16 bp, Homo sapiens
ccagagcccatgctca

SEQ ID NO: 2094748 - DNA, 17 bp, Homo sapiens
ccagagcccatgctcaa

SEQ ID NO: 2094749 - DNA, 14 bp, Homo sapiens
ccagagcctggggc

SEQ ID NO: 2094750 - DNA, 16 bp, Homo sapiens
ccagagcctggggctc

SEQ ID NO: 2094751 - DNA, 13 bp, Homo sapiens
ccagagccttctc

SEQ ID NO: 2094752 - DNA, 19 bp, Homo sapiens
ccagagctggaaggcaggg

SEQ ID NO: 2094753 - DNA, 20 bp, Homo sapiens
ccagagctggaaggcagggc

SEQ ID NO: 2094754 - DNA, 22 bp, Homo sapiens
ccagagctggaaggcagggcag

SEQ ID NO: 2094755 - DNA, 21 bp, Homo sapiens
ccagagctgggaggcatggcc

SEQ ID NO: 2094756 - DNA, 17 bp, Homo sapiens
ccagagcttattggcca

SEQ ID NO: 2094757 - DNA, 22 bp, Homo sapiens
ccagagcttattggccactggg

SEQ ID NO: 2094758 - DNA, 12 bp, Homo sapiens
ccagaggaagcc

SEQ ID NO: 2094759 - DNA, 15 bp, Homo sapiens
ccagaggacaaggaa

SEQ ID NO: 2094760 - DNA, 19 bp, Homo sapiens
ccagaggacaaggaagtgg

SEQ ID NO: 2094761 - DNA, 16 bp, Homo sapiens
ccagaggcagagcctg

SEQ ID NO: 2094762 - DNA, 21 bp, Homo sapiens
ccagagggagtgacagaggca

SEQ ID NO: 2094763 - DNA, 21 bp, Homo sapiens
ccagagggccaagagagacat

SEQ ID NO: 2094764 - DNA, 15 bp, Homo sapiens
ccagagggcccaggc

SEQ ID NO: 2094765 - DNA, 23 bp, Homo sapiens
ccagaggggtgggttcctcttcc

SEQ ID NO: 2094766 - DNA, 20 bp, Homo sapiens
ccagagggtagggcagcaga

SEQ ID NO: 2094767 - DNA, 22 bp, Homo sapiens
ccagaggtgacccaatgctcct

SEQ ID NO: 2094768 - DNA, 18 bp, Homo sapiens
ccagaggttatctgcctg

SEQ ID NO: 2094769 - DNA, 14 bp, Homo sapiens
ccagagtctgagcc

SEQ ID NO: 2094770 - DNA, 15 bp, Homo sapiens
ccagagtctgagccc

SEQ ID NO: 2094771 - DNA, 22 bp, Homo sapiens
ccagagtgaaagggctatggca

SEQ ID NO: 2094772 - DNA, 20 bp, Homo sapiens
ccagagtggagtctgagtct

SEQ ID NO: 2094773 - DNA, 22 bp, Homo sapiens
ccagagttccacaaatctatat

SEQ ID NO: 2094774 - DNA, 21 bp, Homo sapiens
ccagatattgcactaggtcaa

SEQ ID NO: 2094775 - DNA, 18 bp, Homo sapiens
ccagatcctctgctgact

SEQ ID NO: 2094776 - DNA, 18 bp, Homo sapiens
ccagatcgatcctggatt

SEQ ID NO: 2094777 - DNA, 15 bp, Homo sapiens
ccagatctgcctggg

SEQ ID NO: 2094778 - DNA, 18 bp, Homo sapiens
ccagatctgcctgggcct

SEQ ID NO: 2094779 - DNA, 17 bp, Homo sapiens
ccagatgcaccagccct

SEQ ID NO: 2094780 - DNA, 19 bp, Homo sapiens
ccagattcttccactggct

SEQ ID NO: 2094781 - DNA, 16 bp, Homo sapiens
ccagattgcaacaggc

SEQ ID NO: 2094782 - DNA, 22 bp, Homo sapiens
ccagattgcaacaggctgggct

SEQ ID NO: 2094783 - DNA, 23 bp, Homo sapiens
ccagattgcaacaggctgggctt

SEQ ID NO: 2094784 - DNA, 21 bp, Homo sapiens
ccagatttgctaatttatcct

SEQ ID NO: 2094785 - DNA, 21 bp, Homo sapiens
ccagcaaagagtgggctgcat

SEQ ID NO: 2094786 - DNA, 21 bp, Homo sapiens
ccagcaacacaagctggaagc

SEQ ID NO: 2094787 - DNA, 15 bp, Homo sapiens
ccagcaacacagagc

SEQ ID NO: 2094788 - DNA, 18 bp, Homo sapiens
ccagcaagagcacaagag

SEQ ID NO: 2094789 - DNA, 20 bp, Homo sapiens
ccagcaagtgagagctgggt

SEQ ID NO: 2094790 - DNA, 22 bp, Homo sapiens
ccagcaagtgagagctgggtgt

SEQ ID NO: 2094791 - DNA, 17 bp, Homo sapiens
ccagcaatgatgtccag

SEQ ID NO: 2094792 - DNA, 14 bp, Homo sapiens
ccagcacaggggcc

SEQ ID NO: 2094793 - DNA, 24 bp, Homo sapiens
ccagcacaggggccccagatctgc

SEQ ID NO: 2094794 - DNA, 20 bp, Homo sapiens
ccagcaccctctcctggggg

SEQ ID NO: 2094795 - DNA, 19 bp, Homo sapiens
ccagcactcctctgtctct

SEQ ID NO: 2094796 - DNA, 20 bp, Homo sapiens
ccagcactgtgaagacccag

SEQ ID NO: 2094797 - DNA, 17 bp, Homo sapiens
ccagcactttgggaggc

SEQ ID NO: 2094798 - DNA, 19 bp, Homo sapiens
ccagcactttgggaggcca

SEQ ID NO: 2094799 - DNA, 20 bp, Homo sapiens
ccagcactttgggaggctga

SEQ ID NO: 2094800 - DNA, 21 bp, Homo sapiens
ccagcactttgggaggctgag

SEQ ID NO: 2094801 - DNA, 12 bp, Homo sapiens
ccagcagaaaag

SEQ ID NO: 2094802 - DNA, 13 bp, Homo sapiens
ccagcagaaaagt

SEQ ID NO: 2094803 - DNA, 19 bp, Homo sapiens
ccagcagaagagggaggct

SEQ ID NO: 2094804 - DNA, 16 bp, Homo sapiens
ccagcagccagctctc

SEQ ID NO: 2094805 - DNA, 20 bp, Homo sapiens
ccagcagccagctctcagcc

SEQ ID NO: 2094806 - DNA, 23 bp, Homo sapiens
ccagcagctgcgggtctgaagga

SEQ ID NO: 2094807 - DNA, 14 bp, Homo sapiens
ccagcagctgggcc

SEQ ID NO: 2094808 - DNA, 13 bp, Homo sapiens
ccagcaggtgtgg

SEQ ID NO: 2094809 - DNA, 22 bp, Homo sapiens
ccagcagttgaatgacaacaga

SEQ ID NO: 2094810 - DNA, 15 bp, Homo sapiens
ccagcagtttgggag

SEQ ID NO: 2094811 - DNA, 13 bp, Homo sapiens
ccagcatccagcc

SEQ ID NO: 2094812 - DNA, 16 bp, Homo sapiens
ccagcatccagcctgt

SEQ ID NO: 2094813 - DNA, 21 bp, Homo sapiens
ccagctcttggcccctgtgtg

SEQ ID NO: 2094814 - DNA, 15 bp, Homo sapiens
ccagctgaggctggg

SEQ ID NO: 2094815 - DNA, 18 bp, Homo sapiens
ccagctgcacctgccagc

SEQ ID NO: 2094816 - DNA, 19 bp, Homo sapiens
ccagctgcaggaatcaaaa

SEQ ID NO: 2094817 - DNA, 13 bp, Homo sapiens
ccagctgcctggg

SEQ ID NO: 2094818 - DNA, 16 bp, Homo sapiens
ccagctgcctgggagg

SEQ ID NO: 2094819 - DNA, 12 bp, Homo sapiens
ccagctgctctg

SEQ ID NO: 2094820 - DNA, 13 bp, Homo sapiens
ccagctgctctgc

SEQ ID NO: 2094821 - DNA, 15 bp, Homo sapiens
ccagctggaattgct

SEQ ID NO: 2094822 - DNA, 20 bp, Homo sapiens
ccagctggcctctagaacac

SEQ ID NO: 2094823 - DNA, 14 bp, Homo sapiens
ccagctggtgctgc

SEQ ID NO: 2094824 - DNA, 17 bp, Homo sapiens
ccagctggtgctgcaag

SEQ ID NO: 2094825 - DNA, 16 bp, Homo sapiens
ccagctgtagccatgg

SEQ ID NO: 2094826 - DNA, 18 bp, Homo sapiens
ccagctgtagccatggct

SEQ ID NO: 2094827 - DNA, 22 bp, Homo sapiens
ccagctgtagccatggctcagg

SEQ ID NO: 2094828 - DNA, 23 bp, Homo sapiens
ccagctgtagccatggctcaggc

SEQ ID NO: 2094829 - DNA, 19 bp, Homo sapiens
ccagctgtgttcacactgt

SEQ ID NO: 2094830 - DNA, 23 bp, Homo sapiens
ccagcttcattatgcagctgagg

SEQ ID NO: 2094831 - DNA, 14 bp, Homo sapiens
ccagcttcctggtg

SEQ ID NO: 2094832 - DNA, 16 bp, Homo sapiens
ccagcttctccaggct

SEQ ID NO: 2094833 - DNA, 16 bp, Homo sapiens
ccagcttgctcttcag

SEQ ID NO: 2094834 - DNA, 23 bp, Homo sapiens
ccagcttgctcttcagtgggaga

SEQ ID NO: 2094835 - DNA, 16 bp, Homo sapiens
ccagcttgttatttat

SEQ ID NO: 2094836 - DNA, 20 bp, Homo sapiens
ccagctttatctgtcacaca

SEQ ID NO: 2094837 - DNA, 20 bp, Homo sapiens
ccagctttgctaccaaagca

SEQ ID NO: 2094838 - DNA, 16 bp, Homo sapiens
ccaggaaggcagctgc

SEQ ID NO: 2094839 - DNA, 14 bp, Homo sapiens
ccaggaatctgcca

SEQ ID NO: 2094840 - DNA, 23 bp, Homo sapiens
ccaggacaagcatggtcccacat

SEQ ID NO: 2094841 - DNA, 12 bp, Homo sapiens
ccaggacacctg

SEQ ID NO: 2094842 - DNA, 14 bp, Homo sapiens
ccaggacacctgcc

SEQ ID NO: 2094843 - DNA, 14 bp, Homo sapiens
ccaggacaggacca

SEQ ID NO: 2094844 - DNA, 15 bp, Homo sapiens
ccaggacaggcccgg

SEQ ID NO: 2094845 - DNA, 22 bp, Homo sapiens
ccaggacgccactcatttcatc

SEQ ID NO: 2094846 - DNA, 16 bp, Homo sapiens
ccaggactcaccctca

SEQ ID NO: 2094847 - DNA, 17 bp, Homo sapiens
ccaggactccccaggcc

SEQ ID NO: 2094848 - DNA, 14 bp, Homo sapiens
ccaggactctgccc

SEQ ID NO: 2094849 - DNA, 16 bp, Homo sapiens
ccaggagagccagccc

SEQ ID NO: 2094850 - DNA, 18 bp, Homo sapiens
ccaggagagccagccctc

SEQ ID NO: 2094851 - DNA, 20 bp, Homo sapiens
ccaggagagccagccctccc

SEQ ID NO: 2094852 - DNA, 15 bp, Homo sapiens
ccaggagcaaatgtt

SEQ ID NO: 2094853 - DNA, 19 bp, Homo sapiens
ccaggagcacacggccctg

SEQ ID NO: 2094854 - DNA, 20 bp, Homo sapiens
ccaggagcacacggccctgc

SEQ ID NO: 2094855 - DNA, 14 bp, Homo sapiens
ccaggagcccagag

SEQ ID NO: 2094856 - DNA, 15 bp, Homo sapiens
ccaggagccccgagg

SEQ ID NO: 2094857 - DNA, 19 bp, Homo sapiens
ccaggagccccgaggcctt

SEQ ID NO: 2094858 - DNA, 18 bp, Homo sapiens
ccaggagcctaccccctg

SEQ ID NO: 2094859 - DNA, 16 bp, Homo sapiens
ccaggagcctgtgcct

SEQ ID NO: 2094860 - DNA, 14 bp, Homo sapiens
ccaggagctcagcc

SEQ ID NO: 2094861 - DNA, 19 bp, Homo sapiens
ccaggagctgagtcacctc

SEQ ID NO: 2094862 - DNA, 22 bp, Homo sapiens
ccaggagctgagtcacctcctc

SEQ ID NO: 2094863 - DNA, 12 bp, Homo sapiens
ccaggagctgga

SEQ ID NO: 2094864 - DNA, 21 bp, Homo sapiens
ccaggagggacaaaggagcct

SEQ ID NO: 2094865 - DNA, 23 bp, Homo sapiens
ccaggagggacaaaggagcctgt

SEQ ID NO: 2094866 - DNA, 13 bp, Homo sapiens
ccaggaggggcct

SEQ ID NO: 2094867 - DNA, 18 bp, Homo sapiens
ccaggaggggcctctgaa

SEQ ID NO: 2094868 - DNA, 20 bp, Homo sapiens
ccaggaggggcctctgaaat

SEQ ID NO: 2094869 - DNA, 17 bp, Homo sapiens
ccaggaggtcctcctct

SEQ ID NO: 2094870 - DNA, 20 bp, Homo sapiens
ccaggaggttggtgactgaa

SEQ ID NO: 2094871 - DNA, 16 bp, Homo sapiens
ccaggagttgacgcat

SEQ ID NO: 2094872 - DNA, 21 bp, Homo sapiens
ccaggagtttgagacaagccc

SEQ ID NO: 2094873 - DNA, 23 bp, Homo sapiens
ccaggagtttgagacaagccctg

SEQ ID NO: 2094874 - DNA, 18 bp, Homo sapiens
ccaggagtttgtgtgtct

SEQ ID NO: 2094875 - DNA, 22 bp, Homo sapiens
ccaggatcccagagcttcccag

SEQ ID NO: 2094876 - DNA, 15 bp, Homo sapiens
ccaggatcctgcagg

SEQ ID NO: 2094877 - DNA, 22 bp, Homo sapiens
ccaggatgacacctccatttct

SEQ ID NO: 2094878 - DNA, 18 bp, Homo sapiens
ccaggattcctctctcag

SEQ ID NO: 2094879 - DNA, 23 bp, Homo sapiens
ccaggattttaacaaaagcaaga

SEQ ID NO: 2094880 - DNA, 15 bp, Homo sapiens
ccaggattttgtgtt

SEQ ID NO: 2094881 - DNA, 15 bp, Homo sapiens
ccaggcaccatctcc

SEQ ID NO: 2094882 - DNA, 18 bp, Homo sapiens
ccaggcaccccctggaga

SEQ ID NO: 2094883 - DNA, 13 bp, Homo sapiens
ccaggcacccttc

SEQ ID NO: 2094884 - DNA, 21 bp, Homo sapiens
ccaggcacccttctttcctct

SEQ ID NO: 2094885 - DNA, 14 bp, Homo sapiens
ccaggcacctggcc

SEQ ID NO: 2094886 - DNA, 15 bp, Homo sapiens
ccaggcacctggcct

SEQ ID NO: 2094887 - DNA, 18 bp, Homo sapiens
ccaggcacctggcctgct

SEQ ID NO: 2094888 - DNA, 16 bp, Homo sapiens
ccaggcacgtcccgga

SEQ ID NO: 2094889 - DNA, 15 bp, Homo sapiens
ccaggcactgtctta

SEQ ID NO: 2094890 - DNA, 13 bp, Homo sapiens
ccaggcagagaca

SEQ ID NO: 2094891 - DNA, 17 bp, Homo sapiens
ccaggcaggccctgcct

SEQ ID NO: 2094892 - DNA, 19 bp, Homo sapiens
ccaggcaggggtgggagag

SEQ ID NO: 2094893 - DNA, 23 bp, Homo sapiens
ccaggcaggtcttgaactcctgg

SEQ ID NO: 2094894 - DNA, 17 bp, Homo sapiens
ccaggcaggtgcctgga

SEQ ID NO: 2094895 - DNA, 12 bp, Homo sapiens
ccaggcatgctg

SEQ ID NO: 2094896 - DNA, 15 bp, Homo sapiens
ccaggcatggcgagg

SEQ ID NO: 2094897 - DNA, 19 bp, Homo sapiens
ccaggcatggcgaggctga

SEQ ID NO: 2094898 - DNA, 15 bp, Homo sapiens
ccaggccactgtggc

SEQ ID NO: 2094899 - DNA, 18 bp, Homo sapiens
ccaggccactgtggccag

SEQ ID NO: 2094900 - DNA, 20 bp, Homo sapiens
ccaggccactgtggccagag

SEQ ID NO: 2094901 - DNA, 23 bp, Homo sapiens
ccaggccactgtggccagagctg

SEQ ID NO: 2094902 - DNA, 12 bp, Homo sapiens
ccaggccagagg

SEQ ID NO: 2094903 - DNA, 12 bp, Homo sapiens
ccaggccaggcc

SEQ ID NO: 2094904 - DNA, 18 bp, Homo sapiens
ccaggccaggccaccagg

SEQ ID NO: 2094905 - DNA, 13 bp, Homo sapiens
ccaggcccatctc

SEQ ID NO: 2094906 - DNA, 16 bp, Homo sapiens
ccaggcccatctcagg

SEQ ID NO: 2094907 - DNA, 19 bp, Homo sapiens
ccaggcccatctcaggtgc

SEQ ID NO: 2094908 - DNA, 15 bp, Homo sapiens
ccaggccccatgacc

SEQ ID NO: 2094909 - DNA, 21 bp, Homo sapiens
ccaggccccatgacctccagc

SEQ ID NO: 2094910 - DNA, 15 bp, Homo sapiens
ccaggcccccgctgg

SEQ ID NO: 2094911 - DNA, 14 bp, Homo sapiens
ccaggcccctgagg

SEQ ID NO: 2094912 - DNA, 23 bp, Homo sapiens
ccaggcccctgaggactggagac

SEQ ID NO: 2094913 - DNA, 21 bp, Homo sapiens
ccaggcccctgccaccctggg

SEQ ID NO: 2094914 - DNA, 15 bp, Homo sapiens
ccaggcccggggctg

SEQ ID NO: 2094915 - DNA, 21 bp, Homo sapiens
ccaggcccggggctggcggct

SEQ ID NO: 2094916 - DNA, 20 bp, Homo sapiens
ccaggccctccatgggctag

SEQ ID NO: 2094917 - DNA, 14 bp, Homo sapiens
ccaggccgcctgcc

SEQ ID NO: 2094918 - DNA, 19 bp, Homo sapiens
ccaggccgcctgccatacc

SEQ ID NO: 2094919 - DNA, 20 bp, Homo sapiens
ccaggccgcctgccataccg

SEQ ID NO: 2094920 - DNA, 14 bp, Homo sapiens
ccaggcctccagcc

SEQ ID NO: 2094921 - DNA, 15 bp, Homo sapiens
ccaggcctccagcct

SEQ ID NO: 2094922 - DNA, 19 bp, Homo sapiens
ccaggcctccagcctctcc

SEQ ID NO: 2094923 - DNA, 12 bp, Homo sapiens
ccaggcctgcct

SEQ ID NO: 2094924 - DNA, 18 bp, Homo sapiens
ccaggcgccccttccccc

SEQ ID NO: 2094925 - DNA, 23 bp, Homo sapiens
ccaggcgggcggcacgccaacag

SEQ ID NO: 2094926 - DNA, 19 bp, Homo sapiens
ccaggcgttggtgccactt

SEQ ID NO: 2094927 - DNA, 14 bp, Homo sapiens
ccaggctccatggg

SEQ ID NO: 2094928 - DNA, 20 bp, Homo sapiens
ccatgatcgagccactgcac

SEQ ID NO: 2094929 - DNA, 15 bp, Homo sapiens
ccatgatctgtattt

SEQ ID NO: 2094930 - DNA, 22 bp, Homo sapiens
ccatgatgccgctcttctgtca

SEQ ID NO: 2094931 - DNA, 19 bp, Homo sapiens
ccatgatggtgctgacctc

SEQ ID NO: 2094932 - DNA, 12 bp, Homo sapiens
ccatgccactgc

SEQ ID NO: 2094933 - DNA, 14 bp, Homo sapiens
ccatgccactgcca

SEQ ID NO: 2094934 - DNA, 18 bp, Homo sapiens
ccatgccactgccaggca

SEQ ID NO: 2094935 - DNA, 19 bp, Homo sapiens
ccatgccactgccaggcac

SEQ ID NO: 2094936 - DNA, 13 bp, Homo sapiens
ccatgcccagaga

SEQ ID NO: 2094937 - DNA, 13 bp, Homo sapiens
ccatgcctcatgc

SEQ ID NO: 2094938 - DNA, 13 bp, Homo sapiens
ccatgcctgaggg

SEQ ID NO: 2094939 - DNA, 19 bp, Homo sapiens
ccatgcctgcaaccttgca

SEQ ID NO: 2094940 - DNA, 15 bp, Homo sapiens
ccatgctctgcccca

SEQ ID NO: 2094941 - DNA, 17 bp, Homo sapiens
ccatgctctgccccaag

SEQ ID NO: 2094942 - DNA, 13 bp, Homo sapiens
ccatgctgaaggg

SEQ ID NO: 2094943 - DNA, 20 bp, Homo sapiens
ccatgctggcggcgcagagg

SEQ ID NO: 2094944 - DNA, 12 bp, Homo sapiens
ccatgcttcttg

SEQ ID NO: 2094945 - DNA, 20 bp, Homo sapiens
ccatgcttcttgccccttgg

SEQ ID NO: 2094946 - DNA, 21 bp, Homo sapiens
ccatgcttcttgccccttggg

SEQ ID NO: 2094947 - DNA, 21 bp, Homo sapiens
ccatggacaatataaactgaa

SEQ ID NO: 2094948 - DNA, 13 bp, Homo sapiens
ccatggacacatt

SEQ ID NO: 2094949 - DNA, 21 bp, Homo sapiens
ccatggaggaggtgtcccaag

SEQ ID NO: 2094950 - DNA, 22 bp, Homo sapiens
ccatggaggaggtgtcccaagc

SEQ ID NO: 2094951 - DNA, 14 bp, Homo sapiens
ccatggaggcaggc

SEQ ID NO: 2094952 - DNA, 16 bp, Homo sapiens
ccatggcaccagcccc

SEQ ID NO: 2094953 - DNA, 21 bp, Homo sapiens
ccatggcaccagccccctgga

SEQ ID NO: 2094954 - DNA, 18 bp, Homo sapiens
ccatggcagcatggagag

SEQ ID NO: 2094955 - DNA, 12 bp, Homo sapiens
ccatggccaccc

SEQ ID NO: 2094956 - DNA, 21 bp, Homo sapiens
ccatggcgtgtccctctcgga

SEQ ID NO: 2094957 - DNA, 16 bp, Homo sapiens
ccatggctcaggcaag

SEQ ID NO: 2094958 - DNA, 22 bp, Homo sapiens
ccatgggatgttaagcaaagga

SEQ ID NO: 2094959 - DNA, 17 bp, Homo sapiens
ccatgggcctcctgtgt

SEQ ID NO: 2094960 - DNA, 16 bp, Homo sapiens
ccatgggcctgctgcg

SEQ ID NO: 2094961 - DNA, 21 bp, Homo sapiens
ccatgggcctgctgcgtcaga

SEQ ID NO: 2094962 - DNA, 16 bp, Homo sapiens
ccatgggcctgggcct

SEQ ID NO: 2094963 - DNA, 20 bp, Homo sapiens
ccatgggcctgggcctgctt

SEQ ID NO: 2094964 - DNA, 19 bp, Homo sapiens
ccatggggaagtgctcccc

SEQ ID NO: 2094965 - DNA, 19 bp, Homo sapiens
ccatgggggtgctgcagcc

SEQ ID NO: 2094966 - DNA, 14 bp, Homo sapiens
ccatggtgcttgtt

SEQ ID NO: 2094967 - DNA, 15 bp, Homo sapiens
ccatgtaacaaccag

SEQ ID NO: 2094968 - DNA, 19 bp, Homo sapiens
ccatgtaacaaccagagat

SEQ ID NO: 2094969 - DNA, 16 bp, Homo sapiens
ccatgtaccagtgtac

SEQ ID NO: 2094970 - DNA, 19 bp, Homo sapiens
ccatgtaccagtgtactgc

SEQ ID NO: 2094971 - DNA, 19 bp, Homo sapiens
ccatgtagaataaatgaag

SEQ ID NO: 2094972 - DNA, 18 bp, Homo sapiens
ccatgtagttttaacaga

SEQ ID NO: 2094973 - DNA, 20 bp, Homo sapiens
ccatgtagttttaacagaac

SEQ ID NO: 2094974 - DNA, 16 bp, Homo sapiens
ccatgtattcacacac

SEQ ID NO: 2094975 - DNA, 16 bp, Homo sapiens
ccatgtatttatctct

SEQ ID NO: 2094976 - DNA, 16 bp, Homo sapiens
ccatgtcaaacaaata

SEQ ID NO: 2094977 - DNA, 15 bp, Homo sapiens
ccatgtccaatggag

SEQ ID NO: 2094978 - DNA, 16 bp, Homo sapiens
ccatgtcctatgtgtg

SEQ ID NO: 2094979 - DNA, 12 bp, Homo sapiens
ccatgtcgcctc

SEQ ID NO: 2094980 - DNA, 15 bp, Homo sapiens
ccatgtcgcctctgc

SEQ ID NO: 2094981 - DNA, 13 bp, Homo sapiens
ccatgtggagtgg

SEQ ID NO: 2094982 - DNA, 15 bp, Homo sapiens
ccatgtggccccagg

SEQ ID NO: 2094983 - DNA, 19 bp, Homo sapiens
ccatgtggccccaggtgcc

SEQ ID NO: 2094984 - DNA, 22 bp, Homo sapiens
ccatgtggccccaggtgccacc

SEQ ID NO: 2094985 - DNA, 14 bp, Homo sapiens
ccatgtggctgaag

SEQ ID NO: 2094986 - DNA, 13 bp, Homo sapiens
ccatgtgtcccct

SEQ ID NO: 2094987 - DNA, 17 bp, Homo sapiens
ccatgtgtcccctcact

SEQ ID NO: 2094988 - DNA, 20 bp, Homo sapiens
ccatgttggccaggatggtc

SEQ ID NO: 2094989 - DNA, 18 bp, Homo sapiens
ccatgttggccaggctgg

SEQ ID NO: 2094990 - DNA, 19 bp, Homo sapiens
ccatgttggccaggctggt

SEQ ID NO: 2094991 - DNA, 21 bp, Homo sapiens
ccatgttggccaggctggtct

SEQ ID NO: 2094992 - DNA, 16 bp, Homo sapiens
ccatgtttgagctcag

SEQ ID NO: 2094993 - DNA, 21 bp, Homo sapiens
ccatgtttgagctcagacccc

SEQ ID NO: 2094994 - DNA, 15 bp, Homo sapiens
ccatgtttgtaaaac

SEQ ID NO: 2094995 - DNA, 20 bp, Homo sapiens
ccattaaatccgcaaacagc

SEQ ID NO: 2094996 - DNA, 18 bp, Homo sapiens
ccattactaaagacagaa

SEQ ID NO: 2094997 - DNA, 16 bp, Homo sapiens
ccattagagtcagcct

SEQ ID NO: 2094998 - DNA, 15 bp, Homo sapiens
ccattaggcatgcct

SEQ ID NO: 2094999 - DNA, 15 bp, Homo sapiens
ccattagtatcctgt

SEQ ID NO: 2095000 - DNA, 15 bp, Homo sapiens
ccattcacagagcct

SEQ ID NO: 2095001 - DNA, 18 bp, Homo sapiens
ccattcatgccaaagcaa

SEQ ID NO: 2095002 - DNA, 21 bp, Homo sapiens
ccattccaagtcaacactctt

SEQ ID NO: 2095003 - DNA, 16 bp, Homo sapiens
ccattcctcagggaca

SEQ ID NO: 2095004 - DNA, 17 bp, Homo sapiens
ccattcgtctgtcccag

SEQ ID NO: 2095005 - DNA, 20 bp, Homo sapiens
ccattctcatatgtagccct

SEQ ID NO: 2095006 - DNA, 14 bp, Homo sapiens
ccattctctctcct

SEQ ID NO: 2095007 - DNA, 16 bp, Homo sapiens
ccattctctctcctgt

SEQ ID NO: 2095008 - DNA, 17 bp, Homo sapiens
ccattctgaccatttca

SEQ ID NO: 2095009 - DNA, 20 bp, Homo sapiens
ccattctgcctccattctga

SEQ ID NO: 2095010 - DNA, 19 bp, Homo sapiens
ccattcttcctagttttct

SEQ ID NO: 2095011 - DNA, 20 bp, Homo sapiens
ccattcttcctagttttctc

SEQ ID NO: 2095012 - DNA, 13 bp, Homo sapiens
ccattgacctcag

SEQ ID NO: 2095013 - DNA, 22 bp, Homo sapiens
ccattgacctcagctgcacatt

SEQ ID NO: 2095014 - DNA, 21 bp, Homo sapiens
ccattgacttgcacatctctg

SEQ ID NO: 2095015 - DNA, 22 bp, Homo sapiens
ccattggctgcgctaaccccca

SEQ ID NO: 2095016 - DNA, 17 bp, Homo sapiens
ccattggtttttgtagt

SEQ ID NO: 2095017 - DNA, 14 bp, Homo sapiens
ccattgtcttccaa

SEQ ID NO: 2095018 - DNA, 16 bp, Homo sapiens
ccattgtcttccaacc

SEQ ID NO: 2095019 - DNA, 22 bp, Homo sapiens
ccattgtcttccaaccccagct

SEQ ID NO: 2095020 - DNA, 19 bp, Homo sapiens
ccattgttccttaccttta

SEQ ID NO: 2095021 - DNA, 22 bp, Homo sapiens
ccatttaaagcttattaaaact

SEQ ID NO: 2095022 - DNA, 16 bp, Homo sapiens
ccatttaggtttctga

SEQ ID NO: 2095023 - DNA, 13 bp, Homo sapiens
ccatttcaaatgg

SEQ ID NO: 2095024 - DNA, 14 bp, Homo sapiens
ccatttcaactcca

SEQ ID NO: 2095025 - DNA, 21 bp, Homo sapiens
ccatttcatctatttctgaga

SEQ ID NO: 2095026 - DNA, 12 bp, Homo sapiens
ccatttccttgg

SEQ ID NO: 2095027 - DNA, 12 bp, Homo sapiens
ccatttctattt

SEQ ID NO: 2095028 - DNA, 14 bp, Homo sapiens
ccatttctatttat

SEQ ID NO: 2095029 - DNA, 23 bp, Homo sapiens
ccatttctcaatcagtgcagtga

SEQ ID NO: 2095030 - DNA, 21 bp, Homo sapiens
ccatttgcacaggttttcagc

SEQ ID NO: 2095031 - DNA, 14 bp, Homo sapiens
ccatttgtaatgta

SEQ ID NO: 2095032 - DNA, 17 bp, Homo sapiens
ccatttgtaatgtatct

SEQ ID NO: 2095033 - DNA, 20 bp, Homo sapiens
ccatttgtattaccattact

SEQ ID NO: 2095034 - DNA, 17 bp, Homo sapiens
ccatttgtatttgtatt

SEQ ID NO: 2095035 - DNA, 12 bp, Homo sapiens
ccattttcgctt

SEQ ID NO: 2095036 - DNA, 16 bp, Homo sapiens
ccattttcttgcctga

SEQ ID NO: 2095037 - DNA, 19 bp, Homo sapiens
ccattttcttgcctgaggc

SEQ ID NO: 2095038 - DNA, 14 bp, Homo sapiens
ccattttgcaaaat

SEQ ID NO: 2095039 - DNA, 22 bp, Homo sapiens
ccattttggggtacccactgct

SEQ ID NO: 2095040 - DNA, 22 bp, Homo sapiens
ccatttttactaaagcagtgtt

SEQ ID NO: 2095041 - DNA, 22 bp, Homo sapiens
cccaaaaatgttcccttgacca

SEQ ID NO: 2095042 - DNA, 16 bp, Homo sapiens
cccaaaacctcatgac

SEQ ID NO: 2095043 - DNA, 14 bp, Homo sapiens
cccatccatcagct

SEQ ID NO: 2095044 - DNA, 15 bp, Homo sapiens
cccatccatcagctc

SEQ ID NO: 2095045 - DNA, 16 bp, Homo sapiens
cccatccatcagctcc

SEQ ID NO: 2095046 - DNA, 18 bp, Homo sapiens
cccatccatcagctccct

SEQ ID NO: 2095047 - DNA, 18 bp, Homo sapiens
cccatccccagcgattcc

SEQ ID NO: 2095048 - DNA, 19 bp, Homo sapiens
cccatcccccactgccaca

SEQ ID NO: 2095049 - DNA, 12 bp, Homo sapiens
cccatccccttt

SEQ ID NO: 2095050 - DNA, 14 bp, Homo sapiens
cccatcctgggcct

SEQ ID NO: 2095051 - DNA, 20 bp, Homo sapiens
cccatcctgggccttacctc

SEQ ID NO: 2095052 - DNA, 16 bp, Homo sapiens
cccatctaagctgcag

SEQ ID NO: 2095053 - DNA, 18 bp, Homo sapiens
cccatctaagctgcagct

SEQ ID NO: 2095054 - DNA, 22 bp, Homo sapiens
cccatctaagctgcagcttcct

SEQ ID NO: 2095055 - DNA, 21 bp, Homo sapiens
cccatctatgtcccttgctgt

SEQ ID NO: 2095056 - DNA, 18 bp, Homo sapiens
cccatctcaggtgccact

SEQ ID NO: 2095057 - DNA, 19 bp, Homo sapiens
cccatctcaggtgccactc

SEQ ID NO: 2095058 - DNA, 15 bp, Homo sapiens
cccatctccccaggc

SEQ ID NO: 2095059 - DNA, 13 bp, Homo sapiens
cccatctcctccc

SEQ ID NO: 2095060 - DNA, 15 bp, Homo sapiens
cccatctcctcccat

SEQ ID NO: 2095061 - DNA, 19 bp, Homo sapiens
cccatctgaaccactttgc

SEQ ID NO: 2095062 - DNA, 12 bp, Homo sapiens
cccatctgctcc

SEQ ID NO: 2095063 - DNA, 17 bp, Homo sapiens
cccatctgctcctccca

SEQ ID NO: 2095064 - DNA, 18 bp, Homo sapiens
cccatcttcctgctgctg

SEQ ID NO: 2095065 - DNA, 16 bp, Homo sapiens
cccatgaatcaaagac

SEQ ID NO: 2095066 - DNA, 15 bp, Homo sapiens
cccatgagcctcagc

SEQ ID NO: 2095067 - DNA, 14 bp, Homo sapiens
cccatgatccagaa

SEQ ID NO: 2095068 - DNA, 21 bp, Homo sapiens
cccatgatgccgctcttctgt

SEQ ID NO: 2095069 - DNA, 14 bp, Homo sapiens
cccatgctctgccc

SEQ ID NO: 2095070 - DNA, 16 bp, Homo sapiens
cccatgctctgcccca

SEQ ID NO: 2095071 - DNA, 21 bp, Homo sapiens
cccatgctgaattattttgtt

SEQ ID NO: 2095072 - DNA, 21 bp, Homo sapiens
cccatgggcttggacttcctg

SEQ ID NO: 2095073 - DNA, 14 bp, Homo sapiens
cccatgtcacctca

SEQ ID NO: 2095074 - DNA, 15 bp, Homo sapiens
cccatgtcacctcag

SEQ ID NO: 2095075 - DNA, 16 bp, Homo sapiens
cccatgtctctcagaa

SEQ ID NO: 2095076 - DNA, 17 bp, Homo sapiens
cccatgtgacttttatc

SEQ ID NO: 2095077 - DNA, 15 bp, Homo sapiens
cccatgtggctgaag

SEQ ID NO: 2095078 - DNA, 17 bp, Homo sapiens
cccatgtggctgaagac

SEQ ID NO: 2095079 - DNA, 16 bp, Homo sapiens
cccatgttgcatgcct

SEQ ID NO: 2095080 - DNA, 20 bp, Homo sapiens
cccatgttgcatgcctatgt

SEQ ID NO: 2095081 - DNA, 16 bp, Homo sapiens
cccattcacagagcct

SEQ ID NO: 2095082 - DNA, 18 bp, Homo sapiens
cccattcacagagccttt

SEQ ID NO: 2095083 - DNA, 21 bp, Homo sapiens
cccattcccccatgtggctga

SEQ ID NO: 2095084 - DNA, 15 bp, Homo sapiens
cccattccccttaag

SEQ ID NO: 2095085 - DNA, 17 bp, Homo sapiens
cccattcgtctgtccca

SEQ ID NO: 2095086 - DNA, 18 bp, Homo sapiens
cccattctctctcctgtc

SEQ ID NO: 2095087 - DNA, 21 bp, Homo sapiens
cccattctgcctccattctga

SEQ ID NO: 2095088 - DNA, 13 bp, Homo sapiens
cccattctgcctg

SEQ ID NO: 2095089 - DNA, 14 bp, Homo sapiens
cccattctgcctgc

SEQ ID NO: 2095090 - DNA, 16 bp, Homo sapiens
cccattgacttgcaca

SEQ ID NO: 2095091 - DNA, 14 bp, Homo sapiens
cccattgccctggt

SEQ ID NO: 2095092 - DNA, 11 bp, Homo sapiens
cccatttcctt

SEQ ID NO: 2095093 - DNA, 19 bp, Homo sapiens
cccatttctatttatttac

SEQ ID NO: 2095094 - DNA, 17 bp, Homo sapiens
ccccaaaagtacttacc

SEQ ID NO: 2095095 - DNA, 22 bp, Homo sapiens
ccccaaactgtgccctgccttc

SEQ ID NO: 2095096 - DNA, 22 bp, Homo sapiens
ccccaaagagcctggagaagct

SEQ ID NO: 2095097 - DNA, 14 bp, Homo sapiens
ccccaaaggcatcc

SEQ ID NO: 2095098 - DNA, 22 bp, Homo sapiens
ccccaacatctccctcccacat

SEQ ID NO: 2095099 - DNA, 21 bp, Homo sapiens
ccccaaccccgcggtgctctg

SEQ ID NO: 2095100 - DNA, 21 bp, Homo sapiens
ccccaacctttccctcacccc

SEQ ID NO: 2095101 - DNA, 21 bp, Homo sapiens
ccccaactattaaagtgccat

SEQ ID NO: 2095102 - DNA, 14 bp, Homo sapiens
ccccaactcctgga

SEQ ID NO: 2095103 - DNA, 16 bp, Homo sapiens
ccccaactccttccag

SEQ ID NO: 2095104 - DNA, 17 bp, Homo sapiens
ccccaactccttccagc

SEQ ID NO: 2095105 - DNA, 14 bp, Homo sapiens
ccccaagcagccag

SEQ ID NO: 2095106 - DNA, 14 bp, Homo sapiens
ccccaagcctctgc

SEQ ID NO: 2095107 - DNA, 16 bp, Homo sapiens
ccccacagcacccagg

SEQ ID NO: 2095108 - DNA, 15 bp, Homo sapiens
ccccaccacactgaa

SEQ ID NO: 2095109 - DNA, 12 bp, Homo sapiens
ccccaccaccta

SEQ ID NO: 2095110 - DNA, 17 bp, Homo sapiens
ccccaccacttctttta

SEQ ID NO: 2095111 - DNA, 17 bp, Homo sapiens
ccccaccccctccccag

SEQ ID NO: 2095112 - DNA, 17 bp, Homo sapiens
ccccacccccttcagtg

SEQ ID NO: 2095113 - DNA, 21 bp, Homo sapiens
ccccacccccttcagtgccca

SEQ ID NO: 2095114 - DNA, 18 bp, Homo sapiens
ccccacctcatgcctggc

SEQ ID NO: 2095115 - DNA, 20 bp, Homo sapiens
ccccacgagtcacctgcaag

SEQ ID NO: 2095116 - DNA, 15 bp, Homo sapiens
ccccactccagccct

SEQ ID NO: 2095117 - DNA, 16 bp, Homo sapiens
ccccactccagccctg

SEQ ID NO: 2095118 - DNA, 17 bp, Homo sapiens
ccccactccagccctgt

SEQ ID NO: 2095119 - DNA, 14 bp, Homo sapiens
ccccactccccacc

SEQ ID NO: 2095120 - DNA, 21 bp, Homo sapiens
ccccactctaggggtcaggct

SEQ ID NO: 2095121 - DNA, 20 bp, Homo sapiens
ccccactctcattccccagg

SEQ ID NO: 2095122 - DNA, 16 bp, Homo sapiens
ccccactctgctctga

SEQ ID NO: 2095123 - DNA, 19 bp, Homo sapiens
ccccactctgctctgatgc

SEQ ID NO: 2095124 - DNA, 18 bp, Homo sapiens
ccccactgcaggccccgc

SEQ ID NO: 2095125 - DNA, 20 bp, Homo sapiens
ccccacttctctactctgga

SEQ ID NO: 2095126 - DNA, 21 bp, Homo sapiens
ccccactttcctacaaaatgg

SEQ ID NO: 2095127 - DNA, 16 bp, Homo sapiens
ccccagaaggcaggga

SEQ ID NO: 2095128 - DNA, 18 bp, Homo sapiens
ccccagacttctctttct

SEQ ID NO: 2095129 - DNA, 20 bp, Homo sapiens
ccccagacttctctttctta

SEQ ID NO: 2095130 - DNA, 11 bp, Homo sapiens
ccccagagacc

SEQ ID NO: 2095131 - DNA, 20 bp, Homo sapiens
ccccagagaccttttctctc

SEQ ID NO: 2095132 - DNA, 18 bp, Homo sapiens
ccccagatcaccagcccg

SEQ ID NO: 2095133 - DNA, 15 bp, Homo sapiens
ccccagatctgcctg

SEQ ID NO: 2095134 - DNA, 22 bp, Homo sapiens
ccccagattgcaacaggctggg

SEQ ID NO: 2095135 - DNA, 17 bp, Homo sapiens
ccccagcaagtgagagc

SEQ ID NO: 2095136 - DNA, 11 bp, Homo sapiens
ccccagcacta

SEQ ID NO: 2095137 - DNA, 22 bp, Homo sapiens
ccccagcactaaggccgtgtct

SEQ ID NO: 2095138 - DNA, 16 bp, Homo sapiens
ccccagcactcctctg

SEQ ID NO: 2095139 - DNA, 13 bp, Homo sapiens
ccccagcccacag

SEQ ID NO: 2095140 - DNA, 19 bp, Homo sapiens
ccccagcccctcctcccct

SEQ ID NO: 2095141 - DNA, 14 bp, Homo sapiens
ccccagccctcagg

SEQ ID NO: 2095142 - DNA, 18 bp, Homo sapiens
ccccagccctcaggccag

SEQ ID NO: 2095143 - DNA, 16 bp, Homo sapiens
ccccagccctggctct

SEQ ID NO: 2095144 - DNA, 11 bp, Homo sapiens
ccccagcctgg

SEQ ID NO: 2095145 - DNA, 13 bp, Homo sapiens
ccccagcctgggc

SEQ ID NO: 2095146 - DNA, 15 bp, Homo sapiens
ccccagcctgggcct

SEQ ID NO: 2095147 - DNA, 19 bp, Homo sapiens
ccccagctccccaggactc

SEQ ID NO: 2095148 - DNA, 17 bp, Homo sapiens
ccccagctggtccaggg

SEQ ID NO: 2095149 - DNA, 23 bp, Homo sapiens
ccccagctgtcatcaattaaagg

SEQ ID NO: 2095150 - DNA, 23 bp, Homo sapiens
ccccaggacgccactcatttcat

SEQ ID NO: 2095151 - DNA, 15 bp, Homo sapiens
ccccaggcatcccat

SEQ ID NO: 2095152 - DNA, 13 bp, Homo sapiens
ccccaggccaggc

SEQ ID NO: 2095153 - DNA, 16 bp, Homo sapiens
ccccaggccctccctg

SEQ ID NO: 2095154 - DNA, 14 bp, Homo sapiens
ccccaggcctccag

SEQ ID NO: 2095155 - DNA, 15 bp, Homo sapiens
ccccaggcctccagc

SEQ ID NO: 2095156 - DNA, 18 bp, Homo sapiens
ccccaggcctccagcctc

SEQ ID NO: 2095157 - DNA, 15 bp, Homo sapiens
ccccaggcctctgtg

SEQ ID NO: 2095158 - DNA, 23 bp, Homo sapiens
ccctctggatcctgctgtggcct

SEQ ID NO: 2095159 - DNA, 19 bp, Homo sapiens
ccctcttgacccatctccc

SEQ ID NO: 2095160 - DNA, 16 bp, Homo sapiens
ccctctttccccacct

SEQ ID NO: 2095161 - DNA, 18 bp, Homo sapiens
ccctctttccccacctct

SEQ ID NO: 2095162 - DNA, 12 bp, Homo sapiens
ccctctttctac

SEQ ID NO: 2095163 - DNA, 17 bp, Homo sapiens
ccctcttttggccttgt

SEQ ID NO: 2095164 - DNA, 18 bp, Homo sapiens
ccctgaagatttcagagg

SEQ ID NO: 2095165 - DNA, 21 bp, Homo sapiens
ccctgaagatttcagaggctg

SEQ ID NO: 2095166 - DNA, 16 bp, Homo sapiens
ccctgacccctgcacc

SEQ ID NO: 2095167 - DNA, 18 bp, Homo sapiens
ccctgacctcccagccct

SEQ ID NO: 2095168 - DNA, 22 bp, Homo sapiens
ccctgacctcccagccctatgg

SEQ ID NO: 2095169 - DNA, 16 bp, Homo sapiens
ccctgactccctgtgg

SEQ ID NO: 2095170 - DNA, 13 bp, Homo sapiens
ccctgactctctg

SEQ ID NO: 2095171 - DNA, 17 bp, Homo sapiens
ccctgactctctgtgac

SEQ ID NO: 2095172 - DNA, 13 bp, Homo sapiens
ccctgagactcca

SEQ ID NO: 2095173 - DNA, 16 bp, Homo sapiens
ccctgagactccagaa

SEQ ID NO: 2095174 - DNA, 14 bp, Homo sapiens
ccctgagctcaggc

SEQ ID NO: 2095175 - DNA, 16 bp, Homo sapiens
ccctgagctcaggctg

SEQ ID NO: 2095176 - DNA, 20 bp, Homo sapiens
ccctgagctcaggctgagcc

SEQ ID NO: 2095177 - DNA, 14 bp, Homo sapiens
ccctgaggactgga

SEQ ID NO: 2095178 - DNA, 22 bp, Homo sapiens
ccctgaggagtctgaggtcctg

SEQ ID NO: 2095179 - DNA, 20 bp, Homo sapiens
ccctgagtggatctccaagg

SEQ ID NO: 2095180 - DNA, 21 bp, Homo sapiens
ccctgagtggatctccaagga

SEQ ID NO: 2095181 - DNA, 22 bp, Homo sapiens
ccctgagtggatctccaaggac

SEQ ID NO: 2095182 - DNA, 18 bp, Homo sapiens
ccctgataacaacctgga

SEQ ID NO: 2095183 - DNA, 23 bp, Homo sapiens
ccctgcacaaagcccttccatgt

SEQ ID NO: 2095184 - DNA, 22 bp, Homo sapiens
ccctgcacttgcagactctaca

SEQ ID NO: 2095185 - DNA, 14 bp, Homo sapiens
ccctgcagaccctg

SEQ ID NO: 2095186 - DNA, 16 bp, Homo sapiens
ccctgcagaccctgcc

SEQ ID NO: 2095187 - DNA, 13 bp, Homo sapiens
ccctgcagagcta

SEQ ID NO: 2095188 - DNA, 19 bp, Homo sapiens
ccctgcagcttgtagccag

SEQ ID NO: 2095189 - DNA, 21 bp, Homo sapiens
ccctgcagcttgtagccagcc

SEQ ID NO: 2095190 - DNA, 20 bp, Homo sapiens
ccctgcagttggcagaaagg

SEQ ID NO: 2095191 - DNA, 19 bp, Homo sapiens
ccctgcatccaatctgctc

SEQ ID NO: 2095192 - DNA, 12 bp, Homo sapiens
ccctgcatcccc

SEQ ID NO: 2095193 - DNA, 18 bp, Homo sapiens
ccctgccacactcagtcc

SEQ ID NO: 2095194 - DNA, 14 bp, Homo sapiens
ccctgccaccctgg

SEQ ID NO: 2095195 - DNA, 15 bp, Homo sapiens
ccctgccaccctggg

SEQ ID NO: 2095196 - DNA, 16 bp, Homo sapiens
ccctgccacctgtctg

SEQ ID NO: 2095197 - DNA, 21 bp, Homo sapiens
ccctgccaggaggctgcggcc

SEQ ID NO: 2095198 - DNA, 12 bp, Homo sapiens
ccctgccagggc

SEQ ID NO: 2095199 - DNA, 14 bp, Homo sapiens
ccctgccagggctc

SEQ ID NO: 2095200 - DNA, 15 bp, Homo sapiens
ccctgccagggctcg

SEQ ID NO: 2095201 - DNA, 12 bp, Homo sapiens
ccctgccagtgt

SEQ ID NO: 2095202 - DNA, 20 bp, Homo sapiens
ccctgccccaacccccaccg

SEQ ID NO: 2095203 - DNA, 15 bp, Homo sapiens
ccctgccccatcctg

SEQ ID NO: 2095204 - DNA, 17 bp, Homo sapiens
ccctgccccatcctggg

SEQ ID NO: 2095205 - DNA, 14 bp, Homo sapiens
ccctgcccccaaag

SEQ ID NO: 2095206 - DNA, 15 bp, Homo sapiens
ccctgcccccatctc

SEQ ID NO: 2095207 - DNA, 16 bp, Homo sapiens
ccctgcccccatctcc

SEQ ID NO: 2095208 - DNA, 23 bp, Homo sapiens
ccctgcccccatctccccaggcc

SEQ ID NO: 2095209 - DNA, 16 bp, Homo sapiens
ccctgcccctgcccca

SEQ ID NO: 2095210 - DNA, 14 bp, Homo sapiens
ccctgcccggctgc

SEQ ID NO: 2095211 - DNA, 11 bp, Homo sapiens
ccctgccctgc

SEQ ID NO: 2095212 - DNA, 18 bp, Homo sapiens
ccctgccctgccacctgt

SEQ ID NO: 2095213 - DNA, 13 bp, Homo sapiens
ccctgccgcctca

SEQ ID NO: 2095214 - DNA, 13 bp, Homo sapiens
ccctgcctggagg

SEQ ID NO: 2095215 - DNA, 16 bp, Homo sapiens
ccctgcctggaggacc

SEQ ID NO: 2095216 - DNA, 21 bp, Homo sapiens
ccctgcctggaggacctgagc

SEQ ID NO: 2095217 - DNA, 21 bp, Homo sapiens
ccctgcctgggttttctaact

SEQ ID NO: 2095218 - DNA, 17 bp, Homo sapiens
ccctgcgaaggggccct

SEQ ID NO: 2095219 - DNA, 21 bp, Homo sapiens
ccctgcgtcctgacgccctgc

SEQ ID NO: 2095220 - DNA, 17 bp, Homo sapiens
ccctgcgttggagccac

SEQ ID NO: 2095221 - DNA, 19 bp, Homo sapiens
ccctgcgttggagccactc

SEQ ID NO: 2095222 - DNA, 20 bp, Homo sapiens
ccctgcgttggagccactcc

SEQ ID NO: 2095223 - DNA, 21 bp, Homo sapiens
ccctgctaccaaggcccagct

SEQ ID NO: 2095224 - DNA, 13 bp, Homo sapiens
ccctgctctgggg

SEQ ID NO: 2095225 - DNA, 22 bp, Homo sapiens
ccctgctgccgcctcccagcct

SEQ ID NO: 2095226 - DNA, 20 bp, Homo sapiens
ccctgctggttcagggttgg

SEQ ID NO: 2095227 - DNA, 12 bp, Homo sapiens
ccctgcttctca

SEQ ID NO: 2095228 - DNA, 13 bp, Homo sapiens
ccctgcttggtca

SEQ ID NO: 2095229 - DNA, 23 bp, Homo sapiens
ccctgctttgggctgccctggtg

SEQ ID NO: 2095230 - DNA, 18 bp, Homo sapiens
ccctggaactgtctctca

SEQ ID NO: 2095231 - DNA, 19 bp, Homo sapiens
ccctggaattcagcaccct

SEQ ID NO: 2095232 - DNA, 20 bp, Homo sapiens
ccctggaattcagcaccctg

SEQ ID NO: 2095233 - DNA, 21 bp, Homo sapiens
ccctggaccaccagccccagc

SEQ ID NO: 2095234 - DNA, 18 bp, Homo sapiens
ccctggagcggctctcct

SEQ ID NO: 2095235 - DNA, 21 bp, Homo sapiens
ccctggagcggctctcctgag

SEQ ID NO: 2095236 - DNA, 23 bp, Homo sapiens
ccctggagtcccctgggcctgga

SEQ ID NO: 2095237 - DNA, 16 bp, Homo sapiens
ccctggatcagcgtgg

SEQ ID NO: 2095238 - DNA, 20 bp, Homo sapiens
ccctggatcagcgtggcctt

SEQ ID NO: 2095239 - DNA, 21 bp, Homo sapiens
ccctggatcagcgtggccttg

SEQ ID NO: 2095240 - DNA, 21 bp, Homo sapiens
ccctggatgtcccctgtccca

SEQ ID NO: 2095241 - DNA, 20 bp, Homo sapiens
ccctggatgtgtggggcatg

SEQ ID NO: 2095242 - DNA, 22 bp, Homo sapiens
ccctggcaggatgaccctgcga

SEQ ID NO: 2095243 - DNA, 13 bp, Homo sapiens
ccctggccctgcc

SEQ ID NO: 2095244 - DNA, 20 bp, Homo sapiens
ccctggcctcacgcccagcc

SEQ ID NO: 2095245 - DNA, 11 bp, Homo sapiens
ccctggcctga

SEQ ID NO: 2095246 - DNA, 13 bp, Homo sapiens
ccctggcctgctg

SEQ ID NO: 2095247 - DNA, 14 bp, Homo sapiens
ccctggcctgctgg

SEQ ID NO: 2095248 - DNA, 22 bp, Homo sapiens
ccctggcctttgaggcaaaggc

SEQ ID NO: 2095249 - DNA, 17 bp, Homo sapiens
ccctggctcccacaggc

SEQ ID NO: 2095250 - DNA, 19 bp, Homo sapiens
ccctggctcccacaggccc

SEQ ID NO: 2095251 - DNA, 10 bp, Homo sapiens
ccctggctga

SEQ ID NO: 2095252 - DNA, 22 bp, Homo sapiens
ccctggcttttcactgctggct

SEQ ID NO: 2095253 - DNA, 13 bp, Homo sapiens
ccctgggaaaggg

SEQ ID NO: 2095254 - DNA, 17 bp, Homo sapiens
ccctgggattcaggaaa

SEQ ID NO: 2095255 - DNA, 14 bp, Homo sapiens
ccctgggccccacc

SEQ ID NO: 2095256 - DNA, 16 bp, Homo sapiens
ccctgggccccaccac

SEQ ID NO: 2095257 - DNA, 14 bp, Homo sapiens
ccctgggcccctcc

SEQ ID NO: 2095258 - DNA, 15 bp, Homo sapiens
ccctgggcccctcca

SEQ ID NO: 2095259 - DNA, 14 bp, Homo sapiens
ccctgggcctcagt

SEQ ID NO: 2095260 - DNA, 16 bp, Homo sapiens
ccctgggcctgctgct

SEQ ID NO: 2095261 - DNA, 17 bp, Homo sapiens
ccctgggcctgctgctg

SEQ ID NO: 2095262 - DNA, 19 bp, Homo sapiens
ccctgggcctgctgctgag

SEQ ID NO: 2095263 - DNA, 13 bp, Homo sapiens
ccctgggctctgc

SEQ ID NO: 2095264 - DNA, 19 bp, Homo sapiens
ccctggggatatgcaaccc

SEQ ID NO: 2095265 - DNA, 21 bp, Homo sapiens
ccctggggcctgtactgcctg

SEQ ID NO: 2095266 - DNA, 22 bp, Homo sapiens
ccctggggcctgtactgcctgc

SEQ ID NO: 2095267 - DNA, 15 bp, Homo sapiens
ccctggggcttctcc

SEQ ID NO: 2095268 - DNA, 13 bp, Homo sapiens
ccctgggggccag

SEQ ID NO: 2095269 - DNA, 15 bp, Homo sapiens
ccctgggggccagct

SEQ ID NO: 2095270 - DNA, 17 bp, Homo sapiens
ccctgggggccagctgg

SEQ ID NO: 2095271 - DNA, 18 bp, Homo sapiens
ccctggggtatgagctgc

SEQ ID NO: 2095272 - DNA, 15 bp, Homo sapiens
ccctgggtaactgtc

SEQ ID NO: 2095273 - DNA, 16 bp, Homo sapiens
cctaccaatgcatgca

SEQ ID NO: 2095274 - DNA, 13 bp, Homo sapiens
cctaccacagtgt

SEQ ID NO: 2095275 - DNA, 14 bp, Homo sapiens
cctaccaccttccc

SEQ ID NO: 2095276 - DNA, 15 bp, Homo sapiens
cctaccaccttccct

SEQ ID NO: 2095277 - DNA, 12 bp, Homo sapiens
cctacccactct

SEQ ID NO: 2095278 - DNA, 19 bp, Homo sapiens
cctaccgagtctcttctcc

SEQ ID NO: 2095279 - DNA, 20 bp, Homo sapiens
cctaccgagtctcttctcca

SEQ ID NO: 2095280 - DNA, 16 bp, Homo sapiens
cctacctcagcctaga

SEQ ID NO: 2095281 - DNA, 23 bp, Homo sapiens
cctactagttttccttgaaaaaa

SEQ ID NO: 2095282 - DNA, 16 bp, Homo sapiens
cctactcccctgatcc

SEQ ID NO: 2095283 - DNA, 17 bp, Homo sapiens
cctactcccctgatccc

SEQ ID NO: 2095284 - DNA, 13 bp, Homo sapiens
cctactgactgat

SEQ ID NO: 2095285 - DNA, 16 bp, Homo sapiens
cctacttcttttgctc

SEQ ID NO: 2095286 - DNA, 18 bp, Homo sapiens
cctacttgtgactgaagg

SEQ ID NO: 2095287 - DNA, 18 bp, Homo sapiens
cctagaaccaagcttcag

SEQ ID NO: 2095288 - DNA, 16 bp, Homo sapiens
cctagaccctcctcct

SEQ ID NO: 2095289 - DNA, 12 bp, Homo sapiens
cctagacctggg

SEQ ID NO: 2095290 - DNA, 13 bp, Homo sapiens
cctagacctgggc

SEQ ID NO: 2095291 - DNA, 19 bp, Homo sapiens
cctagagagcagaaataaa

SEQ ID NO: 2095292 - DNA, 14 bp, Homo sapiens
cctagagctcctgt

SEQ ID NO: 2095293 - DNA, 22 bp, Homo sapiens
cctagaggtgggcagctgggcc

SEQ ID NO: 2095294 - DNA, 17 bp, Homo sapiens
cctagatccacacacag

SEQ ID NO: 2095295 - DNA, 18 bp, Homo sapiens
cctagcaagacctgttgg

SEQ ID NO: 2095296 - DNA, 18 bp, Homo sapiens
cctagcaggcacaggaca

SEQ ID NO: 2095297 - DNA, 14 bp, Homo sapiens
cctagccacctccc

SEQ ID NO: 2095298 - DNA, 15 bp, Homo sapiens
cctagccacctccca

SEQ ID NO: 2095299 - DNA, 18 bp, Homo sapiens
cctagccacctcccaccc

SEQ ID NO: 2095300 - DNA, 13 bp, Homo sapiens
cctagcccagtgc

SEQ ID NO: 2095301 - DNA, 15 bp, Homo sapiens
cctagcccagtgctt

SEQ ID NO: 2095302 - DNA, 20 bp, Homo sapiens
cctagcccagtgcttctcca

SEQ ID NO: 2095303 - DNA, 18 bp, Homo sapiens
cctagccgacctcagcct

SEQ ID NO: 2095304 - DNA, 22 bp, Homo sapiens
cctagctccaccctcaccagga

SEQ ID NO: 2095305 - DNA, 22 bp, Homo sapiens
cctagctgggcaaacccttctc

SEQ ID NO: 2095306 - DNA, 21 bp, Homo sapiens
cctagctgtgacctctcccct

SEQ ID NO: 2095307 - DNA, 16 bp, Homo sapiens
cctaggaattcccagc

SEQ ID NO: 2095308 - DNA, 14 bp, Homo sapiens
cctaggacctcagg

SEQ ID NO: 2095309 - DNA, 19 bp, Homo sapiens
cctaggacttgagcctcca

SEQ ID NO: 2095310 - DNA, 12 bp, Homo sapiens
cctaggagacca

SEQ ID NO: 2095311 - DNA, 13 bp, Homo sapiens
cctaggagttgag

SEQ ID NO: 2095312 - DNA, 20 bp, Homo sapiens
cctaggccaaatgcacaagc

SEQ ID NO: 2095313 - DNA, 23 bp, Homo sapiens
cctaggccacaccatctcctttc

SEQ ID NO: 2095314 - DNA, 14 bp, Homo sapiens
cctaggccactcct

SEQ ID NO: 2095315 - DNA, 16 bp, Homo sapiens
cctaggccactcctcc

SEQ ID NO: 2095316 - DNA, 15 bp, Homo sapiens
cctaggccccagagc

SEQ ID NO: 2095317 - DNA, 16 bp, Homo sapiens
cctaggccccagagca

SEQ ID NO: 2095318 - DNA, 17 bp, Homo sapiens
cctaggctccaccccat

SEQ ID NO: 2095319 - DNA, 11 bp, Homo sapiens
cctagggagcc

SEQ ID NO: 2095320 - DNA, 15 bp, Homo sapiens
cctaggtgacagagt

SEQ ID NO: 2095321 - DNA, 15 bp, Homo sapiens
cctagtactctctgc

SEQ ID NO: 2095322 - DNA, 21 bp, Homo sapiens
cctagtactctctgctctagc

SEQ ID NO: 2095323 - DNA, 16 bp, Homo sapiens
cctagtccagtgacct

SEQ ID NO: 2095324 - DNA, 15 bp, Homo sapiens
cctagtgcttccact

SEQ ID NO: 2095325 - DNA, 15 bp, Homo sapiens
cctagtggcttcctc

SEQ ID NO: 2095326 - DNA, 19 bp, Homo sapiens
cctagtggggtctccctct

SEQ ID NO: 2095327 - DNA, 21 bp, Homo sapiens
cctagtggggtctccctctcc

SEQ ID NO: 2095328 - DNA, 17 bp, Homo sapiens
cctagttcctgtggcca

SEQ ID NO: 2095329 - DNA, 15 bp, Homo sapiens
cctagttttctcctc

SEQ ID NO: 2095330 - DNA, 16 bp, Homo sapiens
cctataaaatgcccat

SEQ ID NO: 2095331 - DNA, 23 bp, Homo sapiens
cctataaggagagttcaagcctg

SEQ ID NO: 2095332 - DNA, 15 bp, Homo sapiens
cctataatgtgtgta

SEQ ID NO: 2095333 - DNA, 16 bp, Homo sapiens
cctataatgtgtgtat

SEQ ID NO: 2095334 - DNA, 17 bp, Homo sapiens
cctataatgtgtgtatg

SEQ ID NO: 2095335 - DNA, 21 bp, Homo sapiens
cctataatgtgtgtatgtgta

SEQ ID NO: 2095336 - DNA, 13 bp, Homo sapiens
cctatagagaggg

SEQ ID NO: 2095337 - DNA, 14 bp, Homo sapiens
cctatagtcccagc

SEQ ID NO: 2095338 - DNA, 16 bp, Homo sapiens
cctatatagtttattg

SEQ ID NO: 2095339 - DNA, 11 bp, Homo sapiens
cctatcaaaac

SEQ ID NO: 2095340 - DNA, 20 bp, Homo sapiens
cctatcaaaacatatcaatt

SEQ ID NO: 2095341 - DNA, 20 bp, Homo sapiens
cctatcaacctaagcaacag

SEQ ID NO: 2095342 - DNA, 17 bp, Homo sapiens
cctatcagaagtttctc

SEQ ID NO: 2095343 - DNA, 14 bp, Homo sapiens
cctatccacccagc

SEQ ID NO: 2095344 - DNA, 17 bp, Homo sapiens
cctatccacccagccca

SEQ ID NO: 2095345 - DNA, 18 bp, Homo sapiens
cctatccacccagcccat

SEQ ID NO: 2095346 - DNA, 19 bp, Homo sapiens
cctatctgtgattccccca

SEQ ID NO: 2095347 - DNA, 18 bp, Homo sapiens
cctatcttttagttttag

SEQ ID NO: 2095348 - DNA, 17 bp, Homo sapiens
cctatgataaattcaca

SEQ ID NO: 2095349 - DNA, 21 bp, Homo sapiens
cctatgcacatatggactctg

SEQ ID NO: 2095350 - DNA, 19 bp, Homo sapiens
cctatggagagccctggga

SEQ ID NO: 2095351 - DNA, 21 bp, Homo sapiens
cctatggagagccctgggacc

SEQ ID NO: 2095352 - DNA, 22 bp, Homo sapiens
cctatggtataatggttgactg

SEQ ID NO: 2095353 - DNA, 14 bp, Homo sapiens
cctatgtcctaagg

SEQ ID NO: 2095354 - DNA, 19 bp, Homo sapiens
cctatgtcctaaggacaca

SEQ ID NO: 2095355 - DNA, 11 bp, Homo sapiens
cctattctcac

SEQ ID NO: 2095356 - DNA, 13 bp, Homo sapiens
cctatttattggg

SEQ ID NO: 2095357 - DNA, 17 bp, Homo sapiens
cctattttcttttccat

SEQ ID NO: 2095358 - DNA, 21 bp, Homo sapiens
cctcaaatacatacctactga

SEQ ID NO: 2095359 - DNA, 14 bp, Homo sapiens
cctcaaatgtcaga

SEQ ID NO: 2095360 - DNA, 18 bp, Homo sapiens
cctcaaatgtcagagcta

SEQ ID NO: 2095361 - DNA, 15 bp, Homo sapiens
cctcaacctcctggg

SEQ ID NO: 2095362 - DNA, 20 bp, Homo sapiens
cctcaagtgattctcctgcc

SEQ ID NO: 2095363 - DNA, 14 bp, Homo sapiens
cctcaatgccctgc

SEQ ID NO: 2095364 - DNA, 19 bp, Homo sapiens
cctcaatgccctgccatta

SEQ ID NO: 2095365 - DNA, 14 bp, Homo sapiens
cctcaatgtgacca

SEQ ID NO: 2095366 - DNA, 16 bp, Homo sapiens
cctcaatttctgaaca

SEQ ID NO: 2095367 - DNA, 13 bp, Homo sapiens
cctcacagcctct

SEQ ID NO: 2095368 - DNA, 15 bp, Homo sapiens
cctcacagcctctcc

SEQ ID NO: 2095369 - DNA, 17 bp, Homo sapiens
cctcacagcctctccct

SEQ ID NO: 2095370 - DNA, 12 bp, Homo sapiens
cctcacaggagc

SEQ ID NO: 2095371 - DNA, 15 bp, Homo sapiens
cctcacaggagcaga

SEQ ID NO: 2095372 - DNA, 14 bp, Homo sapiens
cctcaccaataact

SEQ ID NO: 2095373 - DNA, 17 bp, Homo sapiens
cctcaccaataacttca

SEQ ID NO: 2095374 - DNA, 17 bp, Homo sapiens
cctcacccccaggtgtt

SEQ ID NO: 2095375 - DNA, 21 bp, Homo sapiens
cctcacccccaggtgttgcca

SEQ ID NO: 2095376 - DNA, 13 bp, Homo sapiens
cctcaccggcatg

SEQ ID NO: 2095377 - DNA, 18 bp, Homo sapiens
cctcaccggcatgctggc

SEQ ID NO: 2095378 - DNA, 20 bp, Homo sapiens
cctcaccggcatgctggcct

SEQ ID NO: 2095379 - DNA, 17 bp, Homo sapiens
cctcacctgcctgccct

SEQ ID NO: 2095380 - DNA, 22 bp, Homo sapiens
cctcacctgggcctttcctgtg

SEQ ID NO: 2095381 - DNA, 23 bp, Homo sapiens
cctcacgcccagcctcctcccac

SEQ ID NO: 2095382 - DNA, 14 bp, Homo sapiens
cctcacgctctgga

SEQ ID NO: 2095383 - DNA, 20 bp, Homo sapiens
cctcactatgacactgagca

SEQ ID NO: 2095384 - DNA, 21 bp, Homo sapiens
cctcactatggtatgctggcc

SEQ ID NO: 2095385 - DNA, 17 bp, Homo sapiens
cctcactattcaagtat

SEQ ID NO: 2095386 - DNA, 17 bp, Homo sapiens
cctcactctggcctcag

SEQ ID NO: 2095387 - DNA, 17 bp, Homo sapiens
cctcactgaatgcctca

SEQ ID NO: 2095388 - DNA, 15 bp, Homo sapiens
cctcactgccccacc

SEQ ID NO: 2095389 - DNA, 15 bp, Homo sapiens
cctgaaggttcctga

SEQ ID NO: 2095390 - DNA, 19 bp, Homo sapiens
cctgaagtcacacagtgag

SEQ ID NO: 2095391 - DNA, 21 bp, Homo sapiens
cctgaatacccttttctgacc

SEQ ID NO: 2095392 - DNA, 20 bp, Homo sapiens
cctgaatataacaaccttta

SEQ ID NO: 2095393 - DNA, 15 bp, Homo sapiens
cctgaatccatcagg

SEQ ID NO: 2095394 - DNA, 21 bp, Homo sapiens
cctgaatccatcaggacttgg

SEQ ID NO: 2095395 - DNA, 21 bp, Homo sapiens
cctgaatggttccatgcctga

SEQ ID NO: 2095396 - DNA, 23 bp, Homo sapiens
cctgaatgtattgaacttggaaa

SEQ ID NO: 2095397 - DNA, 19 bp, Homo sapiens
cctgaatttattattgttc

SEQ ID NO: 2095398 - DNA, 19 bp, Homo sapiens
cctgacaagcactgctagg

SEQ ID NO: 2095399 - DNA, 13 bp, Homo sapiens
cctgacaatggca

SEQ ID NO: 2095400 - DNA, 21 bp, Homo sapiens
cctgacagatgtcagccgagc

SEQ ID NO: 2095401 - DNA, 19 bp, Homo sapiens
cctgacaggttcccagcag

SEQ ID NO: 2095402 - DNA, 20 bp, Homo sapiens
cctgacaggttcccagcagc

SEQ ID NO: 2095403 - DNA, 13 bp, Homo sapiens
cctgaccggcacc

SEQ ID NO: 2095404 - DNA, 19 bp, Homo sapiens
cctgaccggcacctgcgag

SEQ ID NO: 2095405 - DNA, 13 bp, Homo sapiens
cctgacctcccag

SEQ ID NO: 2095406 - DNA, 17 bp, Homo sapiens
cctgacctcccagccct

SEQ ID NO: 2095407 - DNA, 16 bp, Homo sapiens
cctgacctccctctaa

SEQ ID NO: 2095408 - DNA, 14 bp, Homo sapiens
cctgacctgaggct

SEQ ID NO: 2095409 - DNA, 13 bp, Homo sapiens
cctgacgccctgc

SEQ ID NO: 2095410 - DNA, 18 bp, Homo sapiens
cctgacgccctgcgttgg

SEQ ID NO: 2095411 - DNA, 22 bp, Homo sapiens
cctgacgccctgcgttggagcc

SEQ ID NO: 2095412 - DNA, 15 bp, Homo sapiens
cctgactccctgtgg

SEQ ID NO: 2095413 - DNA, 16 bp, Homo sapiens
cctgactccctgtggg

SEQ ID NO: 2095414 - DNA, 15 bp, Homo sapiens
cctgactctctgtga

SEQ ID NO: 2095415 - DNA, 15 bp, Homo sapiens
cctgactgacacagg

SEQ ID NO: 2095416 - DNA, 21 bp, Homo sapiens
cctgactgacacaggccagcc

SEQ ID NO: 2095417 - DNA, 22 bp, Homo sapiens
cctgactgacacaggccagccc

SEQ ID NO: 2095418 - DNA, 11 bp, Homo sapiens
cctgactgtgt

SEQ ID NO: 2095419 - DNA, 14 bp, Homo sapiens
cctgactgtgttca

SEQ ID NO: 2095420 - DNA, 19 bp, Homo sapiens
cctgacttggggagatgga

SEQ ID NO: 2095421 - DNA, 18 bp, Homo sapiens
cctgagaaacccaccagc

SEQ ID NO: 2095422 - DNA, 22 bp, Homo sapiens
cctgagaaacccaccagcctaa

SEQ ID NO: 2095423 - DNA, 22 bp, Homo sapiens
cctgagaagtgtctaaaaacac

SEQ ID NO: 2095424 - DNA, 21 bp, Homo sapiens
cctgagaccagttgggagcac

SEQ ID NO: 2095425 - DNA, 14 bp, Homo sapiens
cctgagactccaga

SEQ ID NO: 2095426 - DNA, 17 bp, Homo sapiens
cctgagatcagagtcct

SEQ ID NO: 2095427 - DNA, 21 bp, Homo sapiens
cctgagcaacagagtgagacc

SEQ ID NO: 2095428 - DNA, 14 bp, Homo sapiens
cctgagcccaggga

SEQ ID NO: 2095429 - DNA, 19 bp, Homo sapiens
cctgagcccagggaggccg

SEQ ID NO: 2095430 - DNA, 16 bp, Homo sapiens
cctgagcctgccgagc

SEQ ID NO: 2095431 - DNA, 18 bp, Homo sapiens
cctgagctagaagctgga

SEQ ID NO: 2095432 - DNA, 13 bp, Homo sapiens
cctgagctcaggc

SEQ ID NO: 2095433 - DNA, 14 bp, Homo sapiens
cctgagctcaggct

SEQ ID NO: 2095434 - DNA, 21 bp, Homo sapiens
cctgagctcaggctgagccca

SEQ ID NO: 2095435 - DNA, 22 bp, Homo sapiens
cctgagctcaggctgagcccag

SEQ ID NO: 2095436 - DNA, 15 bp, Homo sapiens
cctgagctcggtgga

SEQ ID NO: 2095437 - DNA, 21 bp, Homo sapiens
cctgagctcggtggacccagg

SEQ ID NO: 2095438 - DNA, 15 bp, Homo sapiens
cctgagctggggcca

SEQ ID NO: 2095439 - DNA, 17 bp, Homo sapiens
cctgaggagtctgaggt

SEQ ID NO: 2095440 - DNA, 19 bp, Homo sapiens
cctgaggagtctgaggtcc

SEQ ID NO: 2095441 - DNA, 21 bp, Homo sapiens
cctgaggagtctgaggtcctg

SEQ ID NO: 2095442 - DNA, 21 bp, Homo sapiens
cctgaggcctctggaaagcaa

SEQ ID NO: 2095443 - DNA, 15 bp, Homo sapiens
cctgaggctcaagag

SEQ ID NO: 2095444 - DNA, 18 bp, Homo sapiens
cctgaggctcaagaggcc

SEQ ID NO: 2095445 - DNA, 20 bp, Homo sapiens
cctgaggctcaagaggccca

SEQ ID NO: 2095446 - DNA, 21 bp, Homo sapiens
cctgaggctcaagaggcccag

SEQ ID NO: 2095447 - DNA, 22 bp, Homo sapiens
cctgaggctcaagaggcccagg

SEQ ID NO: 2095448 - DNA, 18 bp, Homo sapiens
cctgaggctcctgtgcta

SEQ ID NO: 2095449 - DNA, 13 bp, Homo sapiens
cctgagtcaccag

SEQ ID NO: 2095450 - DNA, 14 bp, Homo sapiens
cctgagtcaccagg

SEQ ID NO: 2095451 - DNA, 15 bp, Homo sapiens
cctgagtcacccatg

SEQ ID NO: 2095452 - DNA, 18 bp, Homo sapiens
cctgagtcacccatgaag

SEQ ID NO: 2095453 - DNA, 15 bp, Homo sapiens
cctgagtcggcccca

SEQ ID NO: 2095454 - DNA, 18 bp, Homo sapiens
cctgagtcggccccacat

SEQ ID NO: 2095455 - DNA, 19 bp, Homo sapiens
cctgagtcggccccacatg

SEQ ID NO: 2095456 - DNA, 14 bp, Homo sapiens
cctgagtctcctgt

SEQ ID NO: 2095457 - DNA, 15 bp, Homo sapiens
cctgagtctcctgtg

SEQ ID NO: 2095458 - DNA, 16 bp, Homo sapiens
cctgagtctcctgtgc

SEQ ID NO: 2095459 - DNA, 12 bp, Homo sapiens
cctgagtcttgg

SEQ ID NO: 2095460 - DNA, 17 bp, Homo sapiens
cctgagtcttggcctgc

SEQ ID NO: 2095461 - DNA, 18 bp, Homo sapiens
cctgagtcttggcctgcc

SEQ ID NO: 2095462 - DNA, 19 bp, Homo sapiens
cctgagtcttggcctgcct

SEQ ID NO: 2095463 - DNA, 13 bp, Homo sapiens
cctgagtggatct

SEQ ID NO: 2095464 - DNA, 23 bp, Homo sapiens
cctgagtggatctccaaggacca

SEQ ID NO: 2095465 - DNA, 20 bp, Homo sapiens
cctgagtgtgggcttctgaa

SEQ ID NO: 2095466 - DNA, 19 bp, Homo sapiens
cctgataacaagcaaggat

SEQ ID NO: 2095467 - DNA, 15 bp, Homo sapiens
cctgatactgggtac

SEQ ID NO: 2095468 - DNA, 22 bp, Homo sapiens
cctgatactgggtacaagagcc

SEQ ID NO: 2095469 - DNA, 24 bp, Homo sapiens
cctgatcacctctggctttgtctc

SEQ ID NO: 2095470 - DNA, 15 bp, Homo sapiens
cctgatcatggtcag

SEQ ID NO: 2095471 - DNA, 19 bp, Homo sapiens
cctgatcatggtcagctca

SEQ ID NO: 2095472 - DNA, 20 bp, Homo sapiens
cctgatcttggctcactgca

SEQ ID NO: 2095473 - DNA, 13 bp, Homo sapiens
cctgatgctgccc

SEQ ID NO: 2095474 - DNA, 14 bp, Homo sapiens
cctgatgctgcccc

SEQ ID NO: 2095475 - DNA, 16 bp, Homo sapiens
cctgatgctgccccgt

SEQ ID NO: 2095476 - DNA, 12 bp, Homo sapiens
cctgatggccaa

SEQ ID NO: 2095477 - DNA, 16 bp, Homo sapiens
cctgatggccaagagc

SEQ ID NO: 2095478 - DNA, 19 bp, Homo sapiens
cctgatggccaagagcatc

SEQ ID NO: 2095479 - DNA, 18 bp, Homo sapiens
cctgatttagatatgcaa

SEQ ID NO: 2095480 - DNA, 16 bp, Homo sapiens
cctgatttctctgaac

SEQ ID NO: 2095481 - DNA, 17 bp, Homo sapiens
cctgatttctctgaaca

SEQ ID NO: 2095482 - DNA, 14 bp, Homo sapiens
cctgcaaaatttta

SEQ ID NO: 2095483 - DNA, 14 bp, Homo sapiens
cctgcaaactcact

SEQ ID NO: 2095484 - DNA, 22 bp, Homo sapiens
cctgcaaactcactgctcaaga

SEQ ID NO: 2095485 - DNA, 22 bp, Homo sapiens
cctgcaagccccagggcctggg

SEQ ID NO: 2095486 - DNA, 17 bp, Homo sapiens
cctgcaatctccagggc

SEQ ID NO: 2095487 - DNA, 20 bp, Homo sapiens
cctgcaatctccagggctgc

SEQ ID NO: 2095488 - DNA, 23 bp, Homo sapiens
cctgcacaaagcccttccatgtc

SEQ ID NO: 2095489 - DNA, 22 bp, Homo sapiens
cctgcaccagcccttccctgct

SEQ ID NO: 2095490 - DNA, 13 bp, Homo sapiens
cctgcaccctgga

SEQ ID NO: 2095491 - DNA, 14 bp, Homo sapiens
cctgcacctccccc

SEQ ID NO: 2095492 - DNA, 17 bp, Homo sapiens
cctgcacctccccccac

SEQ ID NO: 2095493 - DNA, 18 bp, Homo sapiens
cctgcacctccccccact

SEQ ID NO: 2095494 - DNA, 21 bp, Homo sapiens
cctgcacctccccccactgca

SEQ ID NO: 2095495 - DNA, 22 bp, Homo sapiens
cctgcacctccccccactgcag

SEQ ID NO: 2095496 - DNA, 14 bp, Homo sapiens
cctgcacctgtgca

SEQ ID NO: 2095497 - DNA, 21 bp, Homo sapiens
cctgcactaatttgatgttta

SEQ ID NO: 2095498 - DNA, 18 bp, Homo sapiens
cctgcacttgcagactct

SEQ ID NO: 2095499 - DNA, 15 bp, Homo sapiens
cctgcagaccctgcc

SEQ ID NO: 2095500 - DNA, 17 bp, Homo sapiens
cctgcagaccctgccct

SEQ ID NO: 2095501 - DNA, 18 bp, Homo sapiens
cctgcagaccctgccctt

SEQ ID NO: 2095502 - DNA, 11 bp, Homo sapiens
cctgcagagag

SEQ ID NO: 2095503 - DNA, 17 bp, Homo sapiens
cctgcgtctgtttttaa

SEQ ID NO: 2095504 - DNA, 21 bp, Homo sapiens
cctgcgttggagccactcctg

SEQ ID NO: 2095505 - DNA, 21 bp, Homo sapiens
cctgctaattccccagattgc

SEQ ID NO: 2095506 - DNA, 16 bp, Homo sapiens
cctgctacacaaaagc

SEQ ID NO: 2095507 - DNA, 15 bp, Homo sapiens
cctgctactcctgtg

SEQ ID NO: 2095508 - DNA, 16 bp, Homo sapiens
cctgctactcctgtgc

SEQ ID NO: 2095509 - DNA, 13 bp, Homo sapiens
cctgctagagcaa

SEQ ID NO: 2095510 - DNA, 12 bp, Homo sapiens
cctgctcccagc

SEQ ID NO: 2095511 - DNA, 13 bp, Homo sapiens
cctgctcccagca

SEQ ID NO: 2095512 - DNA, 14 bp, Homo sapiens
cctgctcccagcag

SEQ ID NO: 2095513 - DNA, 12 bp, Homo sapiens
cctgctcctccc

SEQ ID NO: 2095514 - DNA, 18 bp, Homo sapiens
cctgctcctcccaaccca

SEQ ID NO: 2095515 - DNA, 15 bp, Homo sapiens
cctgctctcttcagg

SEQ ID NO: 2095516 - DNA, 23 bp, Homo sapiens
cctgctctcttcaggaggccctg

SEQ ID NO: 2095517 - DNA, 20 bp, Homo sapiens
cctgctgaaacacctcccag

SEQ ID NO: 2095518 - DNA, 21 bp, Homo sapiens
cctgctgaaacacctcccagg

SEQ ID NO: 2095519 - DNA, 21 bp, Homo sapiens
cctgctgagagacccaaggag

SEQ ID NO: 2095520 - DNA, 19 bp, Homo sapiens
cctgctgagctctgagagg

SEQ ID NO: 2095521 - DNA, 22 bp, Homo sapiens
cctgctgcctaataaagagact

SEQ ID NO: 2095522 - DNA, 23 bp, Homo sapiens
cctgctgcgtcagaccagtactg

SEQ ID NO: 2095523 - DNA, 14 bp, Homo sapiens
cctgctgctcatcc

SEQ ID NO: 2095524 - DNA, 15 bp, Homo sapiens
cctgctgctgacctg

SEQ ID NO: 2095525 - DNA, 20 bp, Homo sapiens
cctgctgctgagaacctggc

SEQ ID NO: 2095526 - DNA, 23 bp, Homo sapiens
cctgctgctgagaacctggcctt

SEQ ID NO: 2095527 - DNA, 21 bp, Homo sapiens
cctgctgctgtaactgctgag

SEQ ID NO: 2095528 - DNA, 13 bp, Homo sapiens
cctgctggcacct

SEQ ID NO: 2095529 - DNA, 20 bp, Homo sapiens
cctgctgggaaccccgcagc

SEQ ID NO: 2095530 - DNA, 22 bp, Homo sapiens
cctgctgggaaccccgcagccc

SEQ ID NO: 2095531 - DNA, 23 bp, Homo sapiens
cctgctgggaaccccgcagcccg

SEQ ID NO: 2095532 - DNA, 16 bp, Homo sapiens
cctgctgggctctcca

SEQ ID NO: 2095533 - DNA, 20 bp, Homo sapiens
cctgctgggctctccacctc

SEQ ID NO: 2095534 - DNA, 14 bp, Homo sapiens
cctgctgtggcctc

SEQ ID NO: 2095535 - DNA, 18 bp, Homo sapiens
cctgcttaaacttgaccc

SEQ ID NO: 2095536 - DNA, 21 bp, Homo sapiens
cctgcttgaaggaacagtgct

SEQ ID NO: 2095537 - DNA, 23 bp, Homo sapiens
cctgcttggggggtgatgagggc

SEQ ID NO: 2095538 - DNA, 18 bp, Homo sapiens
cctgctttgggctgccct

SEQ ID NO: 2095539 - DNA, 21 bp, Homo sapiens
cctgctttgggctgccctggt

SEQ ID NO: 2095540 - DNA, 23 bp, Homo sapiens
cctgctttgggctgccctggtgc

SEQ ID NO: 2095541 - DNA, 16 bp, Homo sapiens
cctgcttttccaggat

SEQ ID NO: 2095542 - DNA, 19 bp, Homo sapiens
cctgcttttccaggatcct

SEQ ID NO: 2095543 - DNA, 21 bp, Homo sapiens
cctggaaaggctcagtctcag

SEQ ID NO: 2095544 - DNA, 23 bp, Homo sapiens
cctggaaaggctcagtctcagga

SEQ ID NO: 2095545 - DNA, 22 bp, Homo sapiens
cctggaaatatcagttactcag

SEQ ID NO: 2095546 - DNA, 13 bp, Homo sapiens
cctggaaccaatc

SEQ ID NO: 2095547 - DNA, 14 bp, Homo sapiens
cctggaaccaatcc

SEQ ID NO: 2095548 - DNA, 14 bp, Homo sapiens
cctggaaccaggga

SEQ ID NO: 2095549 - DNA, 18 bp, Homo sapiens
cctggaactgtctctcat

SEQ ID NO: 2095550 - DNA, 20 bp, Homo sapiens
cctggaactgtctctcatga

SEQ ID NO: 2095551 - DNA, 17 bp, Homo sapiens
cctggaagctgtgtcct

SEQ ID NO: 2095552 - DNA, 18 bp, Homo sapiens
cctggaagctgtgtcctt

SEQ ID NO: 2095553 - DNA, 23 bp, Homo sapiens
cctggaagctgtgtccttgcacc

SEQ ID NO: 2095554 - DNA, 13 bp, Homo sapiens
cctggaagggcta

SEQ ID NO: 2095555 - DNA, 24 bp, Homo sapiens
cctggaagggctagaacctgtaga

SEQ ID NO: 2095556 - DNA, 12 bp, Homo sapiens
cctggaatgaag

SEQ ID NO: 2095557 - DNA, 17 bp, Homo sapiens
cctggaattcagcaccc

SEQ ID NO: 2095558 - DNA, 22 bp, Homo sapiens
cctggaattcagcaccctgggt

SEQ ID NO: 2095559 - DNA, 15 bp, Homo sapiens
cctggacagctgtgc

SEQ ID NO: 2095560 - DNA, 22 bp, Homo sapiens
cctggacagctgtgcctcgctc

SEQ ID NO: 2095561 - DNA, 21 bp, Homo sapiens
cctggacatttgccttgctgg

SEQ ID NO: 2095562 - DNA, 23 bp, Homo sapiens
cctggaccaccagccccagcaag

SEQ ID NO: 2095563 - DNA, 13 bp, Homo sapiens
cctggagaactag

SEQ ID NO: 2095564 - DNA, 23 bp, Homo sapiens
cctggagaactagaacctggagg

SEQ ID NO: 2095565 - DNA, 21 bp, Homo sapiens
cctggagagccagaacctgga

SEQ ID NO: 2095566 - DNA, 22 bp, Homo sapiens
cctggagagccagaacctggag

SEQ ID NO: 2095567 - DNA, 13 bp, Homo sapiens
cctggagagctag

SEQ ID NO: 2095568 - DNA, 14 bp, Homo sapiens
cctggagagctaga

SEQ ID NO: 2095569 - DNA, 21 bp, Homo sapiens
cctggagagctagaacctaga

SEQ ID NO: 2095570 - DNA, 15 bp, Homo sapiens
cctggagaggggcct

SEQ ID NO: 2095571 - DNA, 14 bp, Homo sapiens
cctggaggacctga

SEQ ID NO: 2095572 - DNA, 16 bp, Homo sapiens
cctggaggacctgagc

SEQ ID NO: 2095573 - DNA, 19 bp, Homo sapiens
cctggaggacctgagcctg

SEQ ID NO: 2095574 - DNA, 21 bp, Homo sapiens
cctggagggaatgaacctgga

SEQ ID NO: 2095575 - DNA, 19 bp, Homo sapiens
cctggagggctagaaccta

SEQ ID NO: 2095576 - DNA, 21 bp, Homo sapiens
cctggagggctagaacctgga

SEQ ID NO: 2095577 - DNA, 20 bp, Homo sapiens
cctggaggggctagaaccta

SEQ ID NO: 2095578 - DNA, 18 bp, Homo sapiens
cctggagtcccctgggcc

SEQ ID NO: 2095579 - DNA, 16 bp, Homo sapiens
cctggatcagcgtggc

SEQ ID NO: 2095580 - DNA, 18 bp, Homo sapiens
cctggatcagcgtggcct

SEQ ID NO: 2095581 - DNA, 20 bp, Homo sapiens
cctggatcagcgtggccttg

SEQ ID NO: 2095582 - DNA, 21 bp, Homo sapiens
cctggatccatcaggccactt

SEQ ID NO: 2095583 - DNA, 19 bp, Homo sapiens
cctggatctccccactcta

SEQ ID NO: 2095584 - DNA, 16 bp, Homo sapiens
cctggatgggcattgg

SEQ ID NO: 2095585 - DNA, 17 bp, Homo sapiens
cctggatgggcattggg

SEQ ID NO: 2095586 - DNA, 21 bp, Homo sapiens
cctggatgtcatattggcagt

SEQ ID NO: 2095587 - DNA, 21 bp, Homo sapiens
cctggatgtcccctgtcccac

SEQ ID NO: 2095588 - DNA, 16 bp, Homo sapiens
cctggatgtgcccaca

SEQ ID NO: 2095589 - DNA, 18 bp, Homo sapiens
cctggatgtgcccacagg

SEQ ID NO: 2095590 - DNA, 17 bp, Homo sapiens
cctggatgtgtggggca

SEQ ID NO: 2095591 - DNA, 18 bp, Homo sapiens
cctggatgtgtggggcat

SEQ ID NO: 2095592 - DNA, 14 bp, Homo sapiens
cctggcacaggact

SEQ ID NO: 2095593 - DNA, 15 bp, Homo sapiens
cctggcacaggactg

SEQ ID NO: 2095594 - DNA, 18 bp, Homo sapiens
cctggcacccggcccctg

SEQ ID NO: 2095595 - DNA, 12 bp, Homo sapiens
cctggcagccgt

SEQ ID NO: 2095596 - DNA, 18 bp, Homo sapiens
cctggcagccgtgccttc

SEQ ID NO: 2095597 - DNA, 20 bp, Homo sapiens
cctggcaggttagaacctag

SEQ ID NO: 2095598 - DNA, 15 bp, Homo sapiens
cctggccagatgcac

SEQ ID NO: 2095599 - DNA, 23 bp, Homo sapiens
cctggccagatgcaccagccctt

SEQ ID NO: 2095600 - DNA, 23 bp, Homo sapiens
cctggcccatagaaacatgacac

SEQ ID NO: 2095601 - DNA, 15 bp, Homo sapiens
cctggccccatgtct

SEQ ID NO: 2095602 - DNA, 19 bp, Homo sapiens
cctggcccccctccaggca

SEQ ID NO: 2095603 - DNA, 20 bp, Homo sapiens
cctggcccccctccaggcat

SEQ ID NO: 2095604 - DNA, 23 bp, Homo sapiens
cctggcccccctccaggcatgct

SEQ ID NO: 2095605 - DNA, 21 bp, Homo sapiens
cctggccccgggctctggcca

SEQ ID NO: 2095606 - DNA, 13 bp, Homo sapiens
cctggccctgcct

SEQ ID NO: 2095607 - DNA, 17 bp, Homo sapiens
cctggccgcctccagga

SEQ ID NO: 2095608 - DNA, 19 bp, Homo sapiens
cctggccgcctccaggagc

SEQ ID NO: 2095609 - DNA, 20 bp, Homo sapiens
cctggccgcctccaggagcc

SEQ ID NO: 2095610 - DNA, 20 bp, Homo sapiens
cctggccggcccaggcctcc

SEQ ID NO: 2095611 - DNA, 20 bp, Homo sapiens
cctggcctcacgcccagcct

SEQ ID NO: 2095612 - DNA, 23 bp, Homo sapiens
cctggcctcacgcccagcctcct

SEQ ID NO: 2095613 - DNA, 14 bp, Homo sapiens
cctggcctcctgcc

SEQ ID NO: 2095614 - DNA, 15 bp, Homo sapiens
cctggcctcctgcct

SEQ ID NO: 2095615 - DNA, 18 bp, Homo sapiens
cctggcctgagctggggc

SEQ ID NO: 2095616 - DNA, 16 bp, Homo sapiens
ccttgccctgacctcc

SEQ ID NO: 2095617 - DNA, 18 bp, Homo sapiens
ccttgcccttgccctgac

SEQ ID NO: 2095618 - DNA, 19 bp, Homo sapiens
ccttgccttttaaaagaaa

SEQ ID NO: 2095619 - DNA, 17 bp, Homo sapiens
ccttgcgaccatgtgta

SEQ ID NO: 2095620 - DNA, 15 bp, Homo sapiens
ccttgctcagtgcct

SEQ ID NO: 2095621 - DNA, 18 bp, Homo sapiens
ccttgctcagtgcctcct

SEQ ID NO: 2095622 - DNA, 18 bp, Homo sapiens
ccttgctcgctgtaaaat

SEQ ID NO: 2095623 - DNA, 20 bp, Homo sapiens
ccttgctctcccctgccctg

SEQ ID NO: 2095624 - DNA, 16 bp, Homo sapiens
ccttgctgctgcccgc

SEQ ID NO: 2095625 - DNA, 22 bp, Homo sapiens
ccttgctggacggggactgggg

SEQ ID NO: 2095626 - DNA, 18 bp, Homo sapiens
ccttgcttatgacatcac

SEQ ID NO: 2095627 - DNA, 15 bp, Homo sapiens
ccttgctttgggctt

SEQ ID NO: 2095628 - DNA, 18 bp, Homo sapiens
ccttgctttgggctttgc

SEQ ID NO: 2095629 - DNA, 19 bp, Homo sapiens
ccttggaaatactttatct

SEQ ID NO: 2095630 - DNA, 15 bp, Homo sapiens
ccttggaagtttcat

SEQ ID NO: 2095631 - DNA, 18 bp, Homo sapiens
ccttggacaacttttctc

SEQ ID NO: 2095632 - DNA, 16 bp, Homo sapiens
ccttggagagacacag

SEQ ID NO: 2095633 - DNA, 17 bp, Homo sapiens
ccttggagagacacagc

SEQ ID NO: 2095634 - DNA, 21 bp, Homo sapiens
ccttggagagcagctggctct

SEQ ID NO: 2095635 - DNA, 22 bp, Homo sapiens
ccttggagcagaaagccagggt

SEQ ID NO: 2095636 - DNA, 12 bp, Homo sapiens
ccttggaggaca

SEQ ID NO: 2095637 - DNA, 19 bp, Homo sapiens
ccttggcatcacagggcag

SEQ ID NO: 2095638 - DNA, 19 bp, Homo sapiens
ccttggccgtgaggacacg

SEQ ID NO: 2095639 - DNA, 21 bp, Homo sapiens
ccttggcgggcagcccagcct

SEQ ID NO: 2095640 - DNA, 22 bp, Homo sapiens
ccttggcgggcagcccagcctc

SEQ ID NO: 2095641 - DNA, 16 bp, Homo sapiens
ccttggctgcagggag

SEQ ID NO: 2095642 - DNA, 24 bp, Homo sapiens
ccttgggcatccacccagtgctgc

SEQ ID NO: 2095643 - DNA, 13 bp, Homo sapiens
ccttgggcctccc

SEQ ID NO: 2095644 - DNA, 22 bp, Homo sapiens
ccttgggcctccccccagcccc

SEQ ID NO: 2095645 - DNA, 12 bp, Homo sapiens
ccttgggctcct

SEQ ID NO: 2095646 - DNA, 16 bp, Homo sapiens
ccttgggctcctggct

SEQ ID NO: 2095647 - DNA, 18 bp, Homo sapiens
ccttgggctcctggctgc

SEQ ID NO: 2095648 - DNA, 19 bp, Homo sapiens
ccttgggctcctggctgcc

SEQ ID NO: 2095649 - DNA, 22 bp, Homo sapiens
ccttgggctcctggctgccagg

SEQ ID NO: 2095650 - DNA, 23 bp, Homo sapiens
ccttgggctcctggctgccaggc

SEQ ID NO: 2095651 - DNA, 14 bp, Homo sapiens
ccttggggcctggc

SEQ ID NO: 2095652 - DNA, 16 bp, Homo sapiens
ccttggggcctggctt

SEQ ID NO: 2095653 - DNA, 20 bp, Homo sapiens
ccttggggttcccccagaca

SEQ ID NO: 2095654 - DNA, 20 bp, Homo sapiens
ccttggtgtccacctggccc

SEQ ID NO: 2095655 - DNA, 14 bp, Homo sapiens
ccttgtaccccatc

SEQ ID NO: 2095656 - DNA, 15 bp, Homo sapiens
ccttgtaccccatcc

SEQ ID NO: 2095657 - DNA, 14 bp, Homo sapiens
ccttgtcaggaccc

SEQ ID NO: 2095658 - DNA, 17 bp, Homo sapiens
ccttgtcaggacccagg

SEQ ID NO: 2095659 - DNA, 19 bp, Homo sapiens
ccttgtcaggacccaggcc

SEQ ID NO: 2095660 - DNA, 21 bp, Homo sapiens
ccttgtcaggacccaggccgc

SEQ ID NO: 2095661 - DNA, 14 bp, Homo sapiens
ccttgtcctctccc

SEQ ID NO: 2095662 - DNA, 17 bp, Homo sapiens
ccttgtcctgccagctg

SEQ ID NO: 2095663 - DNA, 19 bp, Homo sapiens
ccttgtctttactgacaag

SEQ ID NO: 2095664 - DNA, 17 bp, Homo sapiens
ccttgtgccctgccccc

SEQ ID NO: 2095665 - DNA, 12 bp, Homo sapiens
ccttgtgcttgg

SEQ ID NO: 2095666 - DNA, 16 bp, Homo sapiens
ccttgtgtttctgtgg

SEQ ID NO: 2095667 - DNA, 22 bp, Homo sapiens
ccttgtttcaatctttgctgta
